United States Patent 11,492,591 (UNIVERSAL DONOR STEM CELLS AND RELATED METHODS) - sequence listing, part 11

SEQ ID NO: 333682 - DNA, 20 bp, Artificial
  CRISPR gRNA sequence
tgactgtggattgaaccaaa

SEQ ID NO: 333683 - DNA, 20 bp, Artificial
  CRISPR gRNA sequence
gactgtggattgaaccaaaa

SEQ ID NO: 333684 - DNA, 20 bp, Artificial
  CRISPR gRNA sequence
actgtggattgaaccaaaaa

SEQ ID NO: 333685 - DNA, 20 bp, Artificial
  CRISPR gRNA sequence
tggattgaaccaaaaatctt

SEQ ID NO: 333686 - DNA, 20 bp, Artificial
  CRISPR gRNA sequence
aaccaaaaatctttcatgca

SEQ ID NO: 333687 - DNA, 20 bp, Artificial
  CRISPR gRNA sequence
tcatgcacccaggaagctgt

SEQ ID NO: 333688 - DNA, 20 bp, Artificial
  CRISPR gRNA sequence
catgcacccaggaagctgtg

SEQ ID NO: 333689 - DNA, 20 bp, Artificial
  CRISPR gRNA sequence
atgcacccaggaagctgtgt

SEQ ID NO: 333690 - DNA, 20 bp, Artificial
  CRISPR gRNA sequence
tgtgacctcgggcaaataat

SEQ ID NO: 333691 - DNA, 20 bp, Artificial
  CRISPR gRNA sequence
gggcaaataatttaatctgt

SEQ ID NO: 333692 - DNA, 20 bp, Artificial
  CRISPR gRNA sequence
aatctgtctgggccttcagt

SEQ ID NO: 333693 - DNA, 20 bp, Artificial
  CRISPR gRNA sequence
atctgtctgggccttcagtt

SEQ ID NO: 333694 - DNA, 20 bp, Artificial
  CRISPR gRNA sequence
tctgggccttcagttgtctg

SEQ ID NO: 333695 - DNA, 20 bp, Artificial
  CRISPR gRNA sequence
ggccttcagttgtctgtatg

SEQ ID NO: 333696 - DNA, 20 bp, Artificial
  CRISPR gRNA sequence
cagttgtctgtatgtacaca

SEQ ID NO: 333697 - DNA, 20 bp, Artificial
  CRISPR gRNA sequence
agttgtctgtatgtacacaa

SEQ ID NO: 333698 - DNA, 20 bp, Artificial
  CRISPR gRNA sequence
tctgtatgtacacaaaagag

SEQ ID NO: 333699 - DNA, 20 bp, Artificial
  CRISPR gRNA sequence
tatgtacacaaaagaggtca

SEQ ID NO: 333700 - DNA, 20 bp, Artificial
  CRISPR gRNA sequence
actgtgtatgatgctgagaa

SEQ ID NO: 333701 - DNA, 20 bp, Artificial
  CRISPR gRNA sequence
tgtatgatgctgagaagagg

SEQ ID NO: 333702 - DNA, 20 bp, Artificial
  CRISPR gRNA sequence
agaagaggttgaatcatgtt

SEQ ID NO: 333703 - DNA, 20 bp, Artificial
  CRISPR gRNA sequence
aatcatgttacaggaaacaa

SEQ ID NO: 333704 - DNA, 20 bp, Artificial
  CRISPR gRNA sequence
caggaaacaaaaagtgtaaa

SEQ ID NO: 333705 - DNA, 20 bp, Artificial
  CRISPR gRNA sequence
agggtatttataggatgcct

SEQ ID NO: 333706 - DNA, 20 bp, Artificial
  CRISPR gRNA sequence
ataggatgcctgaaacatga

SEQ ID NO: 333707 - DNA, 20 bp, Artificial
  CRISPR gRNA sequence
taggatgcctgaaacatgaa

SEQ ID NO: 333708 - DNA, 20 bp, Artificial
  CRISPR gRNA sequence
aaacatgaagtgttgatgaa

SEQ ID NO: 333709 - DNA, 20 bp, Artificial
  CRISPR gRNA sequence
atgaaatttattagcaatgg

SEQ ID NO: 333710 - DNA, 20 bp, Artificial
  CRISPR gRNA sequence
attagcaatggaaatggtat

SEQ ID NO: 333711 - DNA, 20 bp, Artificial
  CRISPR gRNA sequence
ttagcaatggaaatggtatg

SEQ ID NO: 333712 - DNA, 20 bp, Artificial
  CRISPR gRNA sequence
gcaatggaaatggtatgtta

SEQ ID NO: 333713 - DNA, 20 bp, Artificial
  CRISPR gRNA sequence
ggaagcatgaggagcatatc

SEQ ID NO: 333714 - DNA, 20 bp, Artificial
  CRISPR gRNA sequence
tggagaagattttatattaa

SEQ ID NO: 333715 - DNA, 20 bp, Artificial
  CRISPR gRNA sequence
ggagaagattttatattaaa

SEQ ID NO: 333716 - DNA, 20 bp, Artificial
  CRISPR gRNA sequence
gagaagattttatattaaag

SEQ ID NO: 333717 - DNA, 20 bp, Artificial
  CRISPR gRNA sequence
tatattaaaggtggtatggg

SEQ ID NO: 333718 - DNA, 20 bp, Artificial
  CRISPR gRNA sequence
atattaaaggtggtatggga

SEQ ID NO: 333719 - DNA, 20 bp, Artificial
  CRISPR gRNA sequence
tattaaaggtggtatgggaa

SEQ ID NO: 333720 - DNA, 20 bp, Artificial
  CRISPR gRNA sequence
aaggtggtatgggaagaaaa

SEQ ID NO: 333721 - DNA, 20 bp, Artificial
  CRISPR gRNA sequence
gtaaggggaacactgacaat

SEQ ID NO: 333722 - DNA, 20 bp, Artificial
  CRISPR gRNA sequence
acaatttttaactactggta

SEQ ID NO: 333723 - DNA, 20 bp, Artificial
  CRISPR gRNA sequence
ttaactactggtatggcaac

SEQ ID NO: 333724 - DNA, 20 bp, Artificial
  CRISPR gRNA sequence
taactactggtatggcaaca

SEQ ID NO: 333725 - DNA, 20 bp, Artificial
  CRISPR gRNA sequence
aactactggtatggcaacag

SEQ ID NO: 333726 - DNA, 20 bp, Artificial
  CRISPR gRNA sequence
actactggtatggcaacaga

SEQ ID NO: 333727 - DNA, 20 bp, Artificial
  CRISPR gRNA sequence
ctggtatggcaacagaattg

SEQ ID NO: 333728 - DNA, 20 bp, Artificial
  CRISPR gRNA sequence
gtatggcaacagaattgacc

SEQ ID NO: 333729 - DNA, 20 bp, Artificial
  CRISPR gRNA sequence
accaaatagatttgacacct

SEQ ID NO: 333730 - DNA, 20 bp, Artificial
  CRISPR gRNA sequence
gacaccttaccaatcagagc

SEQ ID NO: 333731 - DNA, 20 bp, Artificial
  CRISPR gRNA sequence
acaccttaccaatcagagca

SEQ ID NO: 333732 - DNA, 20 bp, Artificial
  CRISPR gRNA sequence
accaatcagagcagacacta

SEQ ID NO: 333733 - DNA, 20 bp, Artificial
  CRISPR gRNA sequence
ccaatcagagcagacactat

SEQ ID NO: 333734 - DNA, 20 bp, Artificial
  CRISPR gRNA sequence
tctataaaagtggtgctatc

SEQ ID NO: 333735 - DNA, 20 bp, Artificial
  CRISPR gRNA sequence
taaaagtggtgctatctatc

SEQ ID NO: 333736 - DNA, 20 bp, Artificial
  CRISPR gRNA sequence
tctatcataccagcattcca

SEQ ID NO: 333737 - DNA, 20 bp, Artificial
  CRISPR gRNA sequence
tcataccagcattccaggct

SEQ ID NO: 333738 - DNA, 20 bp, Artificial
  CRISPR gRNA sequence
caggctgagtattagacttg

SEQ ID NO: 333739 - DNA, 20 bp, Artificial
  CRISPR gRNA sequence
agtattagacttggagataa

SEQ ID NO: 333740 - DNA, 20 bp, Artificial
  CRISPR gRNA sequence
gacttggagataagaacatc

SEQ ID NO: 333741 - DNA, 20 bp, Artificial
  CRISPR gRNA sequence
ggagataagaacatccaaga

SEQ ID NO: 333742 - DNA, 20 bp, Artificial
  CRISPR gRNA sequence
gagataagaacatccaagaa

SEQ ID NO: 333743 - DNA, 20 bp, Artificial
  CRISPR gRNA sequence
gatgcttttgcagttataag

SEQ ID NO: 333744 - DNA, 20 bp, Artificial
  CRISPR gRNA sequence
ttgcagttataagaaactaa

SEQ ID NO: 333745 - DNA, 20 bp, Artificial
  CRISPR gRNA sequence
tgcagttataagaaactaac

SEQ ID NO: 333746 - DNA, 20 bp, Artificial
  CRISPR gRNA sequence
gcagttataagaaactaacg

SEQ ID NO: 333747 - DNA, 20 bp, Artificial
  CRISPR gRNA sequence
cagttataagaaactaacgt

SEQ ID NO: 333748 - DNA, 20 bp, Artificial
  CRISPR gRNA sequence
taagaaactaacgtattcag

SEQ ID NO: 333749 - DNA, 20 bp, Artificial
  CRISPR gRNA sequence
acgtattcagatcttcctta

SEQ ID NO: 333750 - DNA, 20 bp, Artificial
  CRISPR gRNA sequence
agatcttccttaaattgtct

SEQ ID NO: 333751 - DNA, 20 bp, Artificial
  CRISPR gRNA sequence
ccttaaattgtctatccatt

SEQ ID NO: 333752 - DNA, 20 bp, Artificial
  CRISPR gRNA sequence
cttaaattgtctatccatta

SEQ ID NO: 333753 - DNA, 20 bp, Artificial
  CRISPR gRNA sequence
aaattgtctatccattaaat

SEQ ID NO: 333754 - DNA, 20 bp, Artificial
  CRISPR gRNA sequence
aattgtctatccattaaatg

SEQ ID NO: 333755 - DNA, 20 bp, Artificial
  CRISPR gRNA sequence
tctatccattaaatgcttta

SEQ ID NO: 333756 - DNA, 20 bp, Artificial
  CRISPR gRNA sequence
tccattaaatgctttagtca

SEQ ID NO: 333757 - DNA, 20 bp, Artificial
  CRISPR gRNA sequence
aatgctttagtcatggttat

SEQ ID NO: 333758 - DNA, 20 bp, Artificial
  CRISPR gRNA sequence
tagtcatggttataaggggc

SEQ ID NO: 333759 - DNA, 20 bp, Artificial
  CRISPR gRNA sequence
agtcatggttataaggggca

SEQ ID NO: 333760 - DNA, 20 bp, Artificial
  CRISPR gRNA sequence
gtcatggttataaggggcag

SEQ ID NO: 333761 - DNA, 20 bp, Artificial
  CRISPR gRNA sequence
taaggggcagtctcctttaa

SEQ ID NO: 333762 - DNA, 20 bp, Artificial
  CRISPR gRNA sequence
ctttaatactattttcaaat

SEQ ID NO: 333763 - DNA, 20 bp, Artificial
  CRISPR gRNA sequence
taatactattttcaaatgtt

SEQ ID NO: 333764 - DNA, 20 bp, Artificial
  CRISPR gRNA sequence
aatactattttcaaatgtta

SEQ ID NO: 333765 - DNA, 20 bp, Artificial
  CRISPR gRNA sequence
atactattttcaaatgttac

SEQ ID NO: 333766 - DNA, 20 bp, Artificial
  CRISPR gRNA sequence
ttttcaaatgttaccaaagg

SEQ ID NO: 333767 - DNA, 20 bp, Artificial
  CRISPR gRNA sequence
tcaaatgttaccaaaggcta

SEQ ID NO: 333768 - DNA, 20 bp, Artificial
  CRISPR gRNA sequence
caaatgttaccaaaggctaa

SEQ ID NO: 333769 - DNA, 20 bp, Artificial
  CRISPR gRNA sequence
aaatgttaccaaaggctaag

SEQ ID NO: 333770 - DNA, 20 bp, Artificial
  CRISPR gRNA sequence
ccaaaggctaagaagaattt

SEQ ID NO: 333771 - DNA, 20 bp, Artificial
  CRISPR gRNA sequence
agaagaatttgtaatttgtc

SEQ ID NO: 333772 - DNA, 20 bp, Artificial
  CRISPR gRNA sequence
gtaatttgtcatttgagcat

SEQ ID NO: 333773 - DNA, 20 bp, Artificial
  CRISPR gRNA sequence
taatttgtcatttgagcatt

SEQ ID NO: 333774 - DNA, 20 bp, Artificial
  CRISPR gRNA sequence
gtcatttgagcattgtctta

SEQ ID NO: 333775 - DNA, 20 bp, Artificial
  CRISPR gRNA sequence
tcatttgagcattgtcttag

SEQ ID NO: 333776 - DNA, 20 bp, Artificial
  CRISPR gRNA sequence
gagcattgtcttagtccatt

SEQ ID NO: 333777 - DNA, 20 bp, Artificial
  CRISPR gRNA sequence
agcattgtcttagtccattt

SEQ ID NO: 333778 - DNA, 20 bp, Artificial
  CRISPR gRNA sequence
tcttagtccattttctgttg

SEQ ID NO: 333779 - DNA, 20 bp, Artificial
  CRISPR gRNA sequence
agtccattttctgttgctat

SEQ ID NO: 333780 - DNA, 20 bp, Artificial
  CRISPR gRNA sequence
gtccattttctgttgctatc

SEQ ID NO: 333781 - DNA, 20 bp, Artificial
  CRISPR gRNA sequence
tctgttgctatcactgaata

SEQ ID NO: 333782 - DNA, 20 bp, Artificial
  CRISPR gRNA sequence
ctgttgctatcactgaatac

SEQ ID NO: 333783 - DNA, 20 bp, Artificial
  CRISPR gRNA sequence
tgttgctatcactgaatacc

SEQ ID NO: 333784 - DNA, 20 bp, Artificial
  CRISPR gRNA sequence
ttgctatcactgaataccgg

SEQ ID NO: 333785 - DNA, 20 bp, Artificial
  CRISPR gRNA sequence
ctatcactgaataccggaga

SEQ ID NO: 333786 - DNA, 20 bp, Artificial
  CRISPR gRNA sequence
tcactgaataccggagactg

SEQ ID NO: 333787 - DNA, 20 bp, Artificial
  CRISPR gRNA sequence
aataccggagactgggtaat

SEQ ID NO: 333788 - DNA, 20 bp, Artificial
  CRISPR gRNA sequence
ggtaatttataaagaaaaga

SEQ ID NO: 333789 - DNA, 20 bp, Artificial
  CRISPR gRNA sequence
ataaagaaaagaaatgtatt

SEQ ID NO: 333790 - DNA, 20 bp, Artificial
  CRISPR gRNA sequence
taaagaaaagaaatgtattt

SEQ ID NO: 333791 - DNA, 20 bp, Artificial
  CRISPR gRNA sequence
cttacagttctggaggctgg

SEQ ID NO: 333792 - DNA, 20 bp, Artificial
  CRISPR gRNA sequence
ttacagttctggaggctggg

SEQ ID NO: 333793 - DNA, 20 bp, Artificial
  CRISPR gRNA sequence
acagttctggaggctggggc

SEQ ID NO: 333794 - DNA, 20 bp, Artificial
  CRISPR gRNA sequence
cagttctggaggctggggcc

SEQ ID NO: 333795 - DNA, 20 bp, Artificial
  CRISPR gRNA sequence
tggaggctggggcctaagtc

SEQ ID NO: 333796 - DNA, 20 bp, Artificial
  CRISPR gRNA sequence
gaggctggggcctaagtcta

SEQ ID NO: 333797 - DNA, 20 bp, Artificial
  CRISPR gRNA sequence
gggcctaagtctaggggtct

SEQ ID NO: 333798 - DNA, 20 bp, Artificial
  CRISPR gRNA sequence
agtctaggggtctaggggcc

SEQ ID NO: 333799 - DNA, 20 bp, Artificial
  CRISPR gRNA sequence
ggggtctaggggcctaggtc

SEQ ID NO: 333800 - DNA, 20 bp, Artificial
  CRISPR gRNA sequence
ggggcctaggtctaggctga

SEQ ID NO: 333801 - DNA, 20 bp, Artificial
  CRISPR gRNA sequence
ggtctaggctgaggcctagg

SEQ ID NO: 333802 - DNA, 20 bp, Artificial
  CRISPR gRNA sequence
ggctgaggcctaggggcgaa

SEQ ID NO: 333803 - DNA, 20 bp, Artificial
  CRISPR gRNA sequence
aggcctaggggcgaaatctg

SEQ ID NO: 333804 - DNA, 20 bp, Artificial
  CRISPR gRNA sequence
ggggcgaaatctggtgaggg

SEQ ID NO: 333805 - DNA, 20 bp, Artificial
  CRISPR gRNA sequence
gtgagggccttctttctggt

SEQ ID NO: 333806 - DNA, 20 bp, Artificial
  CRISPR gRNA sequence
ctttctggtggggacactca

SEQ ID NO: 333807 - DNA, 20 bp, Artificial
  CRISPR gRNA sequence
tttctggtggggacactcat

SEQ ID NO: 333808 - DNA, 20 bp, Artificial
  CRISPR gRNA sequence
tctggtggggacactcatca

SEQ ID NO: 333809 - DNA, 20 bp, Artificial
  CRISPR gRNA sequence
ctggtggggacactcatcag

SEQ ID NO: 333810 - DNA, 20 bp, Artificial
  CRISPR gRNA sequence
tggtggggacactcatcaga

SEQ ID NO: 333811 - DNA, 20 bp, Artificial
  CRISPR gRNA sequence
gtggggacactcatcagagg

SEQ ID NO: 333812 - DNA, 20 bp, Artificial
  CRISPR gRNA sequence
atcagaggcccaaggcagta

SEQ ID NO: 333813 - DNA, 20 bp, Artificial
  CRISPR gRNA sequence
catgatgaggaggttcttga

SEQ ID NO: 333814 - DNA, 20 bp, Artificial
  CRISPR gRNA sequence
ttgagagacagccaatctgg

SEQ ID NO: 333815 - DNA, 20 bp, Artificial
  CRISPR gRNA sequence
gagagacagccaatctggct

SEQ ID NO: 333816 - DNA, 20 bp, Artificial
  CRISPR gRNA sequence
agagacagccaatctggctg

SEQ ID NO: 333817 - DNA, 20 bp, Artificial
  CRISPR gRNA sequence
gctgtttataacatactaac

SEQ ID NO: 333818 - DNA, 20 bp, Artificial
  CRISPR gRNA sequence
tttataacatactaactctc

SEQ ID NO: 333819 - DNA, 20 bp, Artificial
  CRISPR gRNA sequence
ataacatactaactctcatg

SEQ ID NO: 333820 - DNA, 20 bp, Artificial
  CRISPR gRNA sequence
taacatactaactctcatga

SEQ ID NO: 333821 - DNA, 20 bp, Artificial
  CRISPR gRNA sequence
actctcatgataattaaccc

SEQ ID NO: 333822 - DNA, 20 bp, Artificial
  CRISPR gRNA sequence
tcatgataattaacccactc

SEQ ID NO: 333823 - DNA, 20 bp, Artificial
  CRISPR gRNA sequence
atgataattaacccactcct

SEQ ID NO: 333824 - DNA, 20 bp, Artificial
  CRISPR gRNA sequence
acccactcctgtgataacct

SEQ ID NO: 333825 - DNA, 20 bp, Artificial
  CRISPR gRNA sequence
ctgtgataacctattaatct

SEQ ID NO: 333826 - DNA, 20 bp, Artificial
  CRISPR gRNA sequence
tgataacctattaatctgtt

SEQ ID NO: 333827 - DNA, 20 bp, Artificial
  CRISPR gRNA sequence
ttaatctgttaacccattaa

SEQ ID NO: 333828 - DNA, 20 bp, Artificial
  CRISPR gRNA sequence
atctgttaacccattaaccc

SEQ ID NO: 333829 - DNA, 20 bp, Artificial
  CRISPR gRNA sequence
ttaacccattaacccatgaa

SEQ ID NO: 333830 - DNA, 20 bp, Artificial
  CRISPR gRNA sequence
acccattaacccatgaattg

SEQ ID NO: 333831 - DNA, 20 bp, Artificial
  CRISPR gRNA sequence
acccatgaattggattaagc

SEQ ID NO: 333832 - DNA, 20 bp, Artificial
  CRISPR gRNA sequence
gattaagctattcatggggg

SEQ ID NO: 333833 - DNA, 20 bp, Artificial
  CRISPR gRNA sequence
agctattcatgggggttctg

SEQ ID NO: 333834 - DNA, 20 bp, Artificial
  CRISPR gRNA sequence
ttcatgggggttctgccaat

SEQ ID NO: 333835 - DNA, 20 bp, Artificial
  CRISPR gRNA sequence
atgggggttctgccaatcat

SEQ ID NO: 333836 - DNA, 20 bp, Artificial
  CRISPR gRNA sequence
tgccaatcatctcttaaagg

SEQ ID NO: 333837 - DNA, 20 bp, Artificial
  CRISPR gRNA sequence
ccaatcatctcttaaaggcc

SEQ ID NO: 333838 - DNA, 20 bp, Artificial
  CRISPR gRNA sequence
ttaaaggccccacctcccaa

SEQ ID NO: 333839 - DNA, 20 bp, Artificial
  CRISPR gRNA sequence
aaaggccccacctcccaatt

SEQ ID NO: 333840 - DNA, 20 bp, Artificial
  CRISPR gRNA sequence
aaggccccacctcccaattc

SEQ ID NO: 333841 - DNA, 20 bp, Artificial
  CRISPR gRNA sequence
ccaattctattacactgggg

SEQ ID NO: 333842 - DNA, 20 bp, Artificial
  CRISPR gRNA sequence
tattacactggggattaatt

SEQ ID NO: 333843 - DNA, 20 bp, Artificial
  CRISPR gRNA sequence
ttacactggggattaatttt

SEQ ID NO: 333844 - DNA, 20 bp, Artificial
  CRISPR gRNA sequence
cactggggattaattttcaa

SEQ ID NO: 333845 - DNA, 20 bp, Artificial
  CRISPR gRNA sequence
gggattaattttcaatatga

SEQ ID NO: 333846 - DNA, 20 bp, Artificial
  CRISPR gRNA sequence
attttcaatatgagtgtcag

SEQ ID NO: 333847 - DNA, 20 bp, Artificial
  CRISPR gRNA sequence
tcaatatgagtgtcagtcag

SEQ ID NO: 333848 - DNA, 20 bp, Artificial
  CRISPR gRNA sequence
caatatgagtgtcagtcaga

SEQ ID NO: 333849 - DNA, 20 bp, Artificial
  CRISPR gRNA sequence
aatatgagtgtcagtcagag

SEQ ID NO: 333850 - DNA, 20 bp, Artificial
  CRISPR gRNA sequence
aagctatagcaagcatatct

SEQ ID NO: 333851 - DNA, 20 bp, Artificial
  CRISPR gRNA sequence
tagcaagcatatctgttcta

SEQ ID NO: 333852 - DNA, 20 bp, Artificial
  CRISPR gRNA sequence
ttctatatctgccaaaatag

SEQ ID NO: 333853 - DNA, 20 bp, Artificial
  CRISPR gRNA sequence
tatatctgccaaaatagtta

SEQ ID NO: 333854 - DNA, 20 bp, Artificial
  CRISPR gRNA sequence
tatctgccaaaatagttatg

SEQ ID NO: 333855 - DNA, 20 bp, Artificial
  CRISPR gRNA sequence
ccaaaatagttatgaaataa

SEQ ID NO: 333856 - DNA, 20 bp, Artificial
  CRISPR gRNA sequence
tgaaataattaattaaatgc

SEQ ID NO: 333857 - DNA, 20 bp, Artificial
  CRISPR gRNA sequence
attaaatgctatagttaaaa

SEQ ID NO: 333858 - DNA, 20 bp, Artificial
  CRISPR gRNA sequence
aatgctatagttaaaaacat

SEQ ID NO: 333859 - DNA, 20 bp, Artificial
  CRISPR gRNA sequence
tagttaaaaacattcgaact

SEQ ID NO: 333860 - DNA, 20 bp, Artificial
  CRISPR gRNA sequence
aaaacattcgaactgcagac

SEQ ID NO: 333861 - DNA, 20 bp, Artificial
  CRISPR gRNA sequence
gaactgcagacttagagctg

SEQ ID NO: 333862 - DNA, 20 bp, Artificial
  CRISPR gRNA sequence
cagacttagagctgtcaagc

SEQ ID NO: 333863 - DNA, 20 bp, Artificial
  CRISPR gRNA sequence
agagctgtcaagcggttttc

SEQ ID NO: 333864 - DNA, 20 bp, Artificial
  CRISPR gRNA sequence
gagctgtcaagcggttttcc

SEQ ID NO: 333865 - DNA, 20 bp, Artificial
  CRISPR gRNA sequence
tcaagcggttttccagatgg

SEQ ID NO: 333866 - DNA, 20 bp, Artificial
  CRISPR gRNA sequence
tccagatggaaagtttaaac

SEQ ID NO: 333867 - DNA, 20 bp, Artificial
  CRISPR gRNA sequence
ccagatggaaagtttaaaca

SEQ ID NO: 333868 - DNA, 20 bp, Artificial
  CRISPR gRNA sequence
cagatggaaagtttaaacac

SEQ ID NO: 333869 - DNA, 20 bp, Artificial
  CRISPR gRNA sequence
aaacactggatatgtggaaa

SEQ ID NO: 333870 - DNA, 20 bp, Artificial
  CRISPR gRNA sequence
aacactggatatgtggaaac

SEQ ID NO: 333871 - DNA, 20 bp, Artificial
  CRISPR gRNA sequence
gatatgtggaaacctaagtc

SEQ ID NO: 333872 - DNA, 20 bp, Artificial
  CRISPR gRNA sequence
agtcagccttctgatcacta

SEQ ID NO: 333873 - DNA, 20 bp, Artificial
  CRISPR gRNA sequence
ctgatcactacatttcataa

SEQ ID NO: 333874 - DNA, 20 bp, Artificial
  CRISPR gRNA sequence
tgatcactacatttcataat

SEQ ID NO: 333875 - DNA, 20 bp, Artificial
  CRISPR gRNA sequence
atcactacatttcataataa

SEQ ID NO: 333876 - DNA, 20 bp, Artificial
  CRISPR gRNA sequence
catttcataataaataggcg

SEQ ID NO: 333877 - DNA, 20 bp, Artificial
  CRISPR gRNA sequence
cataataaataggcgatcca

SEQ ID NO: 333878 - DNA, 20 bp, Artificial
  CRISPR gRNA sequence
ataataaataggcgatccag

SEQ ID NO: 333879 - DNA, 20 bp, Artificial
  CRISPR gRNA sequence
ttaagttaaagataaaaaaa

SEQ ID NO: 333880 - DNA, 20 bp, Artificial
  CRISPR gRNA sequence
taagttaaagataaaaaaat

SEQ ID NO: 333881 - DNA, 20 bp, Artificial
  CRISPR gRNA sequence
aagttaaagataaaaaaatg

SEQ ID NO: 333882 - DNA, 20 bp, Artificial
  CRISPR gRNA sequence
agttaaagataaaaaaatga

SEQ ID NO: 333883 - DNA, 20 bp, Artificial
  CRISPR gRNA sequence
aagataaaaaaatgagtaat

SEQ ID NO: 333884 - DNA, 20 bp, Artificial
  CRISPR gRNA sequence
agagcgtccaggccaggtgc

SEQ ID NO: 333885 - DNA, 20 bp, Artificial
  CRISPR gRNA sequence
acgcttataatcccagcact

SEQ ID NO: 333886 - DNA, 20 bp, Artificial
  CRISPR gRNA sequence
ataatcccagcactttggga

SEQ ID NO: 333887 - DNA, 20 bp, Artificial
  CRISPR gRNA sequence
taatcccagcactttgggag

SEQ ID NO: 333888 - DNA, 20 bp, Artificial
  CRISPR gRNA sequence
tgggaggccaaggtgggcgg

SEQ ID NO: 333889 - DNA, 20 bp, Artificial
  CRISPR gRNA sequence
gggaggccaaggtgggcgga

SEQ ID NO: 333890 - DNA, 20 bp, Artificial
  CRISPR gRNA sequence
ggaggccaaggtgggcggat

SEQ ID NO: 333891 - DNA, 20 bp, Artificial
  CRISPR gRNA sequence
gccaacacggtgaaaccctg

SEQ ID NO: 333892 - DNA, 20 bp, Artificial
  CRISPR gRNA sequence
tctctactaaaaatacaaaa

SEQ ID NO: 333893 - DNA, 20 bp, Artificial
  CRISPR gRNA sequence
tactaaaaatacaaaaatta

SEQ ID NO: 333894 - DNA, 20 bp, Artificial
  CRISPR gRNA sequence
ctaaaaatacaaaaattagc

SEQ ID NO: 333895 - DNA, 20 bp, Artificial
  CRISPR gRNA sequence
aaaatacaaaaattagctga

SEQ ID NO: 333896 - DNA, 20 bp, Artificial
  CRISPR gRNA sequence
gctgagcatggtggcatgtg

SEQ ID NO: 333897 - DNA, 20 bp, Artificial
  CRISPR gRNA sequence
agcatggtggcatgtgactg

SEQ ID NO: 333898 - DNA, 20 bp, Artificial
  CRISPR gRNA sequence
tagtcccagctacttgggaa

SEQ ID NO: 333899 - DNA, 20 bp, Artificial
  CRISPR gRNA sequence
cttgggaagctgaggcagca

SEQ ID NO: 333900 - DNA, 20 bp, Artificial
  CRISPR gRNA sequence
gggaagctgaggcagcagaa

SEQ ID NO: 333901 - DNA, 20 bp, Artificial
  CRISPR gRNA sequence
ggaagctgaggcagcagaat

SEQ ID NO: 333902 - DNA, 20 bp, Artificial
  CRISPR gRNA sequence
aggcagcagaatcgcttgaa

SEQ ID NO: 333903 - DNA, 20 bp, Artificial
  CRISPR gRNA sequence
gaacctaggaggcagaggtt

SEQ ID NO: 333904 - DNA, 20 bp, Artificial
  CRISPR gRNA sequence
aacctaggaggcagaggttg

SEQ ID NO: 333905 - DNA, 20 bp, Artificial
  CRISPR gRNA sequence
ggaggcagaggttgcagtga

SEQ ID NO: 333906 - DNA, 20 bp, Artificial
  CRISPR gRNA sequence
cagtgagctgagattgcacc

SEQ ID NO: 333907 - DNA, 20 bp, Artificial
  CRISPR gRNA sequence
agattgcaccactgcactct

SEQ ID NO: 333908 - DNA, 20 bp, Artificial
  CRISPR gRNA sequence
caccactgcactctagcctg

SEQ ID NO: 333909 - DNA, 20 bp, Artificial
  CRISPR gRNA sequence
cactctagcctgctggtgac

SEQ ID NO: 333910 - DNA, 20 bp, Artificial
  CRISPR gRNA sequence
tagcctgctggtgacagaac

SEQ ID NO: 333911 - DNA, 20 bp, Artificial
  CRISPR gRNA sequence
gcctgctggtgacagaacaa

SEQ ID NO: 333912 - DNA, 20 bp, Artificial
  CRISPR gRNA sequence
ctggtgacagaacaagactc

SEQ ID NO: 333913 - DNA, 20 bp, Artificial
  CRISPR gRNA sequence
gtgacagaacaagactccat

SEQ ID NO: 333914 - DNA, 20 bp, Artificial
  CRISPR gRNA sequence
catctcaaaaaaaaaaaaaa

SEQ ID NO: 333915 - DNA, 20 bp, Artificial
  CRISPR gRNA sequence
aaaaaaaaaaaaaagagtgt

SEQ ID NO: 333916 - DNA, 20 bp, Artificial
  CRISPR gRNA sequence
tgaaatcttcagctgatgtc

SEQ ID NO: 333917 - DNA, 20 bp, Artificial
  CRISPR gRNA sequence
aaatcttcagctgatgtcag

SEQ ID NO: 333918 - DNA, 20 bp, Artificial
  CRISPR gRNA sequence
cagctgatgtcagtggcaca

SEQ ID NO: 333919 - DNA, 20 bp, Artificial
  CRISPR gRNA sequence
agctgatgtcagtggcacac

SEQ ID NO: 333920 - DNA, 20 bp, Artificial
  CRISPR gRNA sequence
atgtcagtggcacacactct

SEQ ID NO: 333921 - DNA, 20 bp, Artificial
  CRISPR gRNA sequence
tcaacatgccattcaagaaa

SEQ ID NO: 333922 - DNA, 20 bp, Artificial
  CRISPR gRNA sequence
aacatgccattcaagaaaaa

SEQ ID NO: 333923 - DNA, 20 bp, Artificial
  CRISPR gRNA sequence
aagaaaaattgaggcacggc

SEQ ID NO: 333924 - DNA, 20 bp, Artificial
  CRISPR gRNA sequence
aggcacggcattcctggtcc

SEQ ID NO: 333925 - DNA, 20 bp, Artificial
  CRISPR gRNA sequence
ctggtcctacctaaatactt

SEQ ID NO: 333926 - DNA, 20 bp, Artificial
  CRISPR gRNA sequence
gtcctacctaaatacttttg

SEQ ID NO: 333927 - DNA, 20 bp, Artificial
  CRISPR gRNA sequence
cctaaatacttttgtgggca

SEQ ID NO: 333928 - DNA, 20 bp, Artificial
  CRISPR gRNA sequence
aatacttttgtgggcaagaa

SEQ ID NO: 333929 - DNA, 20 bp, Artificial
  CRISPR gRNA sequence
ttgtgggcaagaaagacagt

SEQ ID NO: 333930 - DNA, 20 bp, Artificial
  CRISPR gRNA sequence
tgtgggcaagaaagacagtc

SEQ ID NO: 333931 - DNA, 20 bp, Artificial
  CRISPR gRNA sequence
gtgggcaagaaagacagtct

SEQ ID NO: 333932 - DNA, 20 bp, Artificial
  CRISPR gRNA sequence
tgggcaagaaagacagtctc

SEQ ID NO: 333933 - DNA, 20 bp, Artificial
  CRISPR gRNA sequence
ctttattttaatttattctg

SEQ ID NO: 333934 - DNA, 20 bp, Artificial
  CRISPR gRNA sequence
tattttaatttattctgact

SEQ ID NO: 333935 - DNA, 20 bp, Artificial
  CRISPR gRNA sequence
attttaatttattctgactt

SEQ ID NO: 333936 - DNA, 20 bp, Artificial
  CRISPR gRNA sequence
ttttaatttattctgacttt

SEQ ID NO: 333937 - DNA, 20 bp, Artificial
  CRISPR gRNA sequence
taatttattctgactttctg

SEQ ID NO: 333938 - DNA, 20 bp, Artificial
  CRISPR gRNA sequence
aatttattctgactttctgg

SEQ ID NO: 333939 - DNA, 20 bp, Artificial
  CRISPR gRNA sequence
atttattctgactttctgga

SEQ ID NO: 333940 - DNA, 20 bp, Artificial
  CRISPR gRNA sequence
attctgactttctggaatag

SEQ ID NO: 333941 - DNA, 20 bp, Artificial
  CRISPR gRNA sequence
ttctgactttctggaatagc

SEQ ID NO: 333942 - DNA, 20 bp, Artificial
  CRISPR gRNA sequence
tgactttctggaatagccca

SEQ ID NO: 333943 - DNA, 20 bp, Artificial
  CRISPR gRNA sequence
actttctggaatagcccatt

SEQ ID NO: 333944 - DNA, 20 bp, Artificial
  CRISPR gRNA sequence
tctggaatagcccattatga

SEQ ID NO: 333945 - DNA, 20 bp, Artificial
  CRISPR gRNA sequence
ctggaatagcccattatgat

SEQ ID NO: 333946 - DNA, 20 bp, Artificial
  CRISPR gRNA sequence
tggaatagcccattatgata

SEQ ID NO: 333947 - DNA, 20 bp, Artificial
  CRISPR gRNA sequence
gaatagcccattatgatatt

SEQ ID NO: 333948 - DNA, 20 bp, Artificial
  CRISPR gRNA sequence
tgatattgagacagaaagtg

SEQ ID NO: 333949 - DNA, 20 bp, Artificial
  CRISPR gRNA sequence
agacagaaagtggttaacag

SEQ ID NO: 333950 - DNA, 20 bp, Artificial
  CRISPR gRNA sequence
acaggaacattgttttccct

SEQ ID NO: 333951 - DNA, 20 bp, Artificial
  CRISPR gRNA sequence
ttttccctttggaagactta

SEQ ID NO: 333952 - DNA, 20 bp, Artificial
  CRISPR gRNA sequence
tccctttggaagacttaccc

SEQ ID NO: 333953 - DNA, 20 bp, Artificial
  CRISPR gRNA sequence
ccctttggaagacttaccca

SEQ ID NO: 333954 - DNA, 20 bp, Artificial
  CRISPR gRNA sequence
cctttggaagacttacccaa

SEQ ID NO: 333955 - DNA, 20 bp, Artificial
  CRISPR gRNA sequence
tggaagacttacccaacagc

SEQ ID NO: 333956 - DNA, 20 bp, Artificial
  CRISPR gRNA sequence
ggaagacttacccaacagca

SEQ ID NO: 333957 - DNA, 20 bp, Artificial
  CRISPR gRNA sequence
gaagacttacccaacagcaa

SEQ ID NO: 333958 - DNA, 20 bp, Artificial
  CRISPR gRNA sequence
acccaacagcaaagaattag

SEQ ID NO: 333959 - DNA, 20 bp, Artificial
  CRISPR gRNA sequence
cccaacagcaaagaattagc

SEQ ID NO: 333960 - DNA, 20 bp, Artificial
  CRISPR gRNA sequence
gctctctcagttgtttgcag

SEQ ID NO: 333961 - DNA, 20 bp, Artificial
  CRISPR gRNA sequence
tctcagttgtttgcagtctt

SEQ ID NO: 333962 - DNA, 20 bp, Artificial
  CRISPR gRNA sequence
tcagttgtttgcagtcttat

SEQ ID NO: 333963 - DNA, 20 bp, Artificial
  CRISPR gRNA sequence
agttgtttgcagtcttatct

SEQ ID NO: 333964 - DNA, 20 bp, Artificial
  CRISPR gRNA sequence
tttgcagtcttatctggata

SEQ ID NO: 333965 - DNA, 20 bp, Artificial
  CRISPR gRNA sequence
gcagtcttatctggatatat

SEQ ID NO: 333966 - DNA, 20 bp, Artificial
  CRISPR gRNA sequence
cagtcttatctggatatatt

SEQ ID NO: 333967 - DNA, 20 bp, Artificial
  CRISPR gRNA sequence
atctggatatattctgatgc

SEQ ID NO: 333968 - DNA, 20 bp, Artificial
  CRISPR gRNA sequence
tctggatatattctgatgct

SEQ ID NO: 333969 - DNA, 20 bp, Artificial
  CRISPR gRNA sequence
gatatattctgatgctgaat

SEQ ID NO: 333970 - DNA, 20 bp, Artificial
  CRISPR gRNA sequence
tgatgctgaatccagagaaa

SEQ ID NO: 333971 - DNA, 20 bp, Artificial
  CRISPR gRNA sequence
atgctgaatccagagaaagc

SEQ ID NO: 333972 - DNA, 20 bp, Artificial
  CRISPR gRNA sequence
aatccagagaaagcaggtgt

SEQ ID NO: 333973 - DNA, 20 bp, Artificial
  CRISPR gRNA sequence
gaaataacattaagatgttt

SEQ ID NO: 333974 - DNA, 20 bp, Artificial
  CRISPR gRNA sequence
agatgtttttgtttcacttc

SEQ ID NO: 333975 - DNA, 20 bp, Artificial
  CRISPR gRNA sequence
ttgtttcacttcttcatttc

SEQ ID NO: 333976 - DNA, 20 bp, Artificial
  CRISPR gRNA sequence
tgtttcacttcttcatttca

SEQ ID NO: 333977 - DNA, 20 bp, Artificial
  CRISPR gRNA sequence
gtttcacttcttcatttcac

SEQ ID NO: 333978 - DNA, 20 bp, Artificial
  CRISPR gRNA sequence
tttcacttcttcatttcacg

SEQ ID NO: 333979 - DNA, 20 bp, Artificial
  CRISPR gRNA sequence
cacttcttcatttcacggat

SEQ ID NO: 333980 - DNA, 20 bp, Artificial
  CRISPR gRNA sequence
acttcttcatttcacggatg

SEQ ID NO: 333981 - DNA, 20 bp, Artificial
  CRISPR gRNA sequence
cttcatttcacggatgagga

SEQ ID NO: 333982 - DNA, 20 bp, Artificial
  CRISPR gRNA sequence
ttcatttcacggatgaggag

SEQ ID NO: 333983 - DNA, 20 bp, Artificial
  CRISPR gRNA sequence
catttcacggatgaggaggc

SEQ ID NO: 333984 - DNA, 20 bp, Artificial
  CRISPR gRNA sequence
atttcacggatgaggaggct

SEQ ID NO: 333985 - DNA, 20 bp, Artificial
  CRISPR gRNA sequence
cacggatgaggaggctgaat

SEQ ID NO: 333986 - DNA, 20 bp, Artificial
  CRISPR gRNA sequence
acggatgaggaggctgaatt

SEQ ID NO: 333987 - DNA, 20 bp, Artificial
  CRISPR gRNA sequence
aattccacaggggtacccta

SEQ ID NO: 333988 - DNA, 20 bp, Artificial
  CRISPR gRNA sequence
cacaggggtaccctagccac

SEQ ID NO: 333989 - DNA, 20 bp, Artificial
  CRISPR gRNA sequence
gccacagagccttgctagtg

SEQ ID NO: 333990 - DNA, 20 bp, Artificial
  CRISPR gRNA sequence
gctagtggcagagccagaat

SEQ ID NO: 333991 - DNA, 20 bp, Artificial
  CRISPR gRNA sequence
ctagtggcagagccagaatt

SEQ ID NO: 333992 - DNA, 20 bp, Artificial
  CRISPR gRNA sequence
gtggcagagccagaatttgc

SEQ ID NO: 333993 - DNA, 20 bp, Artificial
  CRISPR gRNA sequence
gcctctggtttccttgggat

SEQ ID NO: 333994 - DNA, 20 bp, Artificial
  CRISPR gRNA sequence
cctctggtttccttgggatc

SEQ ID NO: 333995 - DNA, 20 bp, Artificial
  CRISPR gRNA sequence
tggtttccttgggatccact

SEQ ID NO: 333996 - DNA, 20 bp, Artificial
  CRISPR gRNA sequence
gtttccttgggatccactgc

SEQ ID NO: 333997 - DNA, 20 bp, Artificial
  CRISPR gRNA sequence
ccttgggatccactgcaatg

SEQ ID NO: 333998 - DNA, 20 bp, Artificial
  CRISPR gRNA sequence
cttgggatccactgcaatgc

SEQ ID NO: 333999 - DNA, 20 bp, Artificial
  CRISPR gRNA sequence
gggatccactgcaatgcact

SEQ ID NO: 334000 - DNA, 20 bp, Artificial
  CRISPR gRNA sequence
ggatccactgcaatgcactt

SEQ ID NO: 334001 - DNA, 20 bp, Artificial
  CRISPR gRNA sequence
caatgcacttccaccacact

SEQ ID NO: 334002 - DNA, 20 bp, Artificial
  CRISPR gRNA sequence
ccaccacactgcaccgccaa

SEQ ID NO: 334003 - DNA, 20 bp, Artificial
  CRISPR gRNA sequence
caccacactgcaccgccaac

SEQ ID NO: 334004 - DNA, 20 bp, Artificial
  CRISPR gRNA sequence
caccgccaaccattcatgtc

SEQ ID NO: 334005 - DNA, 20 bp, Artificial
  CRISPR gRNA sequence
atgtcctcttgtgtttgcca

SEQ ID NO: 334006 - DNA, 20 bp, Artificial
  CRISPR gRNA sequence
ttgtgtttgccacagtgcgg

SEQ ID NO: 334007 - DNA, 20 bp, Artificial
  CRISPR gRNA sequence
gtgtttgccacagtgcgggc

SEQ ID NO: 334008 - DNA, 20 bp, Artificial
  CRISPR gRNA sequence
tgtttgccacagtgcgggca

SEQ ID NO: 334009 - DNA, 20 bp, Artificial
  CRISPR gRNA sequence
gccacagtgcgggcacaatg

SEQ ID NO: 334010 - DNA, 20 bp, Artificial
  CRISPR gRNA sequence
ccacagtgcgggcacaatgg

SEQ ID NO: 334011 - DNA, 20 bp, Artificial
  CRISPR gRNA sequence
ctgagaaaatcatcttcgga

SEQ ID NO: 334012 - DNA, 20 bp, Artificial
  CRISPR gRNA sequence
agaaaatcatcttcggaagt

SEQ ID NO: 334013 - DNA, 20 bp, Artificial
  CRISPR gRNA sequence
cggaagtagaagacaatgcg

SEQ ID NO: 334014 - DNA, 20 bp, Artificial
  CRISPR gRNA sequence
ggaagtagaagacaatgcgt

SEQ ID NO: 334015 - DNA, 20 bp, Artificial
  CRISPR gRNA sequence
tgtctgtgtatacatggtga

SEQ ID NO: 334016 - DNA, 20 bp, Artificial
  CRISPR gRNA sequence
tgtatacatggtgaccacag

SEQ ID NO: 334017 - DNA, 20 bp, Artificial
  CRISPR gRNA sequence
tggctccaagatcattgtgg

SEQ ID NO: 334018 - DNA, 20 bp, Artificial
  CRISPR gRNA sequence
ggctccaagatcattgtggt

SEQ ID NO: 334019 - DNA, 20 bp, Artificial
  CRISPR gRNA sequence
gctccaagatcattgtggtt

SEQ ID NO: 334020 - DNA, 20 bp, Artificial
  CRISPR gRNA sequence
caagatcattgtggtttact

SEQ ID NO: 334021 - DNA, 20 bp, Artificial
  CRISPR gRNA sequence
tggtttacttgctgccattc

SEQ ID NO: 334022 - DNA, 20 bp, Artificial
  CRISPR gRNA sequence
acttgctgccattctaaagt

SEQ ID NO: 334023 - DNA, 20 bp, Artificial
  CRISPR gRNA sequence
cttgctgccattctaaagtc

SEQ ID NO: 334024 - DNA, 20 bp, Artificial
  CRISPR gRNA sequence
gctgccattctaaagtctct

SEQ ID NO: 334025 - DNA, 20 bp, Artificial
  CRISPR gRNA sequence
ctgccattctaaagtctctg

SEQ ID NO: 334026 - DNA, 20 bp, Artificial
  CRISPR gRNA sequence
ccattctaaagtctctggga

SEQ ID NO: 334027 - DNA, 20 bp, Artificial
  CRISPR gRNA sequence
taaagtctctgggaaatttt

SEQ ID NO: 334028 - DNA, 20 bp, Artificial
  CRISPR gRNA sequence
aagtctctgggaaatttttt

SEQ ID NO: 334029 - DNA, 20 bp, Artificial
  CRISPR gRNA sequence
tgggaaattttttgtgaaca

SEQ ID NO: 334030 - DNA, 20 bp, Artificial
  CRISPR gRNA sequence
ggaaattttttgtgaacatt

SEQ ID NO: 334031 - DNA, 20 bp, Artificial
  CRISPR gRNA sequence
tttgtgaacatttctaaagg

SEQ ID NO: 334032 - DNA, 20 bp, Artificial
  CRISPR gRNA sequence
ttgtgaacatttctaaagga

SEQ ID NO: 334033 - DNA, 20 bp, Artificial
  CRISPR gRNA sequence
tgtgaacatttctaaaggaa

SEQ ID NO: 334034 - DNA, 20 bp, Artificial
  CRISPR gRNA sequence
gtgaacatttctaaaggaac

SEQ ID NO: 334035 - DNA, 20 bp, Artificial
  CRISPR gRNA sequence
tgaacatttctaaaggaact

SEQ ID NO: 334036 - DNA, 20 bp, Artificial
  CRISPR gRNA sequence
ctaaaggaactgagaacccg

SEQ ID NO: 334037 - DNA, 20 bp, Artificial
  CRISPR gRNA sequence
taaaggaactgagaacccgt

SEQ ID NO: 334038 - DNA, 20 bp, Artificial
  CRISPR gRNA sequence
aaggaactgagaacccgtcc

SEQ ID NO: 334039 - DNA, 20 bp, Artificial
  CRISPR gRNA sequence
agaacccgtccactgatttt

SEQ ID NO: 334040 - DNA, 20 bp, Artificial
  CRISPR gRNA sequence
attttatcttctgcagcaga

SEQ ID NO: 334041 - DNA, 20 bp, Artificial
  CRISPR gRNA sequence
tatcttctgcagcagacggt

SEQ ID NO: 334042 - DNA, 20 bp, Artificial
  CRISPR gRNA sequence
atcttctgcagcagacggta

SEQ ID NO: 334043 - DNA, 20 bp, Artificial
  CRISPR gRNA sequence
tcttctgcagcagacggtag

SEQ ID NO: 334044 - DNA, 20 bp, Artificial
  CRISPR gRNA sequence
ctgcagcagacggtagagac

SEQ ID NO: 334045 - DNA, 20 bp, Artificial
  CRISPR gRNA sequence
tgcagcagacggtagagaca

SEQ ID NO: 334046 - DNA, 20 bp, Artificial
  CRISPR gRNA sequence
cagcagacggtagagacata

SEQ ID NO: 334047 - DNA, 20 bp, Artificial
  CRISPR gRNA sequence
tactgtcagacaaataaagc

SEQ ID NO: 334048 - DNA, 20 bp, Artificial
  CRISPR gRNA sequence
actgtcagacaaataaagcc

SEQ ID NO: 334049 - DNA, 20 bp, Artificial
  CRISPR gRNA sequence
ctgtcagacaaataaagccc

SEQ ID NO: 334050 - DNA, 20 bp, Artificial
  CRISPR gRNA sequence
tcagacaaataaagccccaa

SEQ ID NO: 334051 - DNA, 20 bp, Artificial
  CRISPR gRNA sequence
cgttttaatctaatgtagac

SEQ ID NO: 334052 - DNA, 20 bp, Artificial
  CRISPR gRNA sequence
taatctaatgtagactgcac

SEQ ID NO: 334053 - DNA, 20 bp, Artificial
  CRISPR gRNA sequence
aatctaatgtagactgcacc

SEQ ID NO: 334054 - DNA, 20 bp, Artificial
  CRISPR gRNA sequence
atctaatgtagactgcacct

SEQ ID NO: 334055 - DNA, 20 bp, Artificial
  CRISPR gRNA sequence
atgtagactgcacctgttct

SEQ ID NO: 334056 - DNA, 20 bp, Artificial
  CRISPR gRNA sequence
cacctgttctcatgccaaca

SEQ ID NO: 334057 - DNA, 20 bp, Artificial
  CRISPR gRNA sequence
ttctcatgccaacagttttt

SEQ ID NO: 334058 - DNA, 20 bp, Artificial
  CRISPR gRNA sequence
tcatgccaacagtttttttt

SEQ ID NO: 334059 - DNA, 20 bp, Artificial
  CRISPR gRNA sequence
atgccaacagtttttttttc

SEQ ID NO: 334060 - DNA, 20 bp, Artificial
  CRISPR gRNA sequence
ttttttctttgcctctggat

SEQ ID NO: 334061 - DNA, 20 bp, Artificial
  CRISPR gRNA sequence
tttttctttgcctctggata

SEQ ID NO: 334062 - DNA, 20 bp, Artificial
  CRISPR gRNA sequence
ttttctttgcctctggataa

SEQ ID NO: 334063 - DNA, 20 bp, Artificial
  CRISPR gRNA sequence
tttctttgcctctggataat

SEQ ID NO: 334064 - DNA, 20 bp, Artificial
  CRISPR gRNA sequence
ttctttgcctctggataata

SEQ ID NO: 334065 - DNA, 20 bp, Artificial
  CRISPR gRNA sequence
tctttgcctctggataatat

SEQ ID NO: 334066 - DNA, 20 bp, Artificial
  CRISPR gRNA sequence
ctttgcctctggataatatt

SEQ ID NO: 334067 - DNA, 20 bp, Artificial
  CRISPR gRNA sequence
tttgcctctggataatattg

SEQ ID NO: 334068 - DNA, 20 bp, Artificial
  CRISPR gRNA sequence
tgcctctggataatattgtt

SEQ ID NO: 334069 - DNA, 20 bp, Artificial
  CRISPR gRNA sequence
gcctctggataatattgttc

SEQ ID NO: 334070 - DNA, 20 bp, Artificial
  CRISPR gRNA sequence
cctctggataatattgttcc

SEQ ID NO: 334071 - DNA, 20 bp, Artificial
  CRISPR gRNA sequence
tggataatattgttccttcc

SEQ ID NO: 334072 - DNA, 20 bp, Artificial
  CRISPR gRNA sequence
gataatattgttccttccag

SEQ ID NO: 334073 - DNA, 20 bp, Artificial
  CRISPR gRNA sequence
ttccttccagtttttaaaac

SEQ ID NO: 334074 - DNA, 20 bp, Artificial
  CRISPR gRNA sequence
cttccagtttttaaaacgaa

SEQ ID NO: 334075 - DNA, 20 bp, Artificial
  CRISPR gRNA sequence
ccagtttttaaaacgaagca

SEQ ID NO: 334076 - DNA, 20 bp, Artificial
  CRISPR gRNA sequence
cagtttttaaaacgaagcaa

SEQ ID NO: 334077 - DNA, 20 bp, Artificial
  CRISPR gRNA sequence
ttaaaacgaagcaagtatta

SEQ ID NO: 334078 - DNA, 20 bp, Artificial
  CRISPR gRNA sequence
taaaacgaagcaagtattat

SEQ ID NO: 334079 - DNA, 20 bp, Artificial
  CRISPR gRNA sequence
aaaacgaagcaagtattatt

SEQ ID NO: 334080 - DNA, 20 bp, Artificial
  CRISPR gRNA sequence
aaacgaagcaagtattattt

SEQ ID NO: 334081 - DNA, 20 bp, Artificial
  CRISPR gRNA sequence
ttttccttctgtatgctttt

SEQ ID NO: 334082 - DNA, 20 bp, Artificial
  CRISPR gRNA sequence
tccttctgtatgcttttaaa

SEQ ID NO: 334083 - DNA, 20 bp, Artificial
  CRISPR gRNA sequence
ccttctgtatgcttttaaac

SEQ ID NO: 334084 - DNA, 20 bp, Artificial
  CRISPR gRNA sequence
cttctgtatgcttttaaaca

SEQ ID NO: 334085 - DNA, 20 bp, Artificial
  CRISPR gRNA sequence
ctgtatgcttttaaacatac

SEQ ID NO: 334086 - DNA, 20 bp, Artificial
  CRISPR gRNA sequence
tgtatgcttttaaacatact

SEQ ID NO: 334087 - DNA, 20 bp, Artificial
  CRISPR gRNA sequence
tatgcttttaaacatacttg

SEQ ID NO: 334088 - DNA, 20 bp, Artificial
  CRISPR gRNA sequence
ttaaacatacttgttattat

SEQ ID NO: 334089 - DNA, 20 bp, Artificial
  CRISPR gRNA sequence
taaacatacttgttattata

SEQ ID NO: 334090 - DNA, 20 bp, Artificial
  CRISPR gRNA sequence
aaacatacttgttattataa

SEQ ID NO: 334091 - DNA, 20 bp, Artificial
  CRISPR gRNA sequence
aacatacttgttattataaa

SEQ ID NO: 334092 - DNA, 20 bp, Artificial
  CRISPR gRNA sequence
gttattataaaacaaaacat

SEQ ID NO: 334093 - DNA, 20 bp, Artificial
  CRISPR gRNA sequence
ttattataaaacaaaacata

SEQ ID NO: 334094 - DNA, 20 bp, Artificial
  CRISPR gRNA sequence
ttataaaacaaaacatacat

SEQ ID NO: 334095 - DNA, 20 bp, Artificial
  CRISPR gRNA sequence
taaaacaaaacatacatata

SEQ ID NO: 334096 - DNA, 20 bp, Artificial
  CRISPR gRNA sequence
aatgaataatgctaaagcat

SEQ ID NO: 334097 - DNA, 20 bp, Artificial
  CRISPR gRNA sequence
atgaataatgctaaagcata

SEQ ID NO: 334098 - DNA, 20 bp, Artificial
  CRISPR gRNA sequence
aagcatactatcttaccctc

SEQ ID NO: 334099 - DNA, 20 bp, Artificial
  CRISPR gRNA sequence
tcttaccctcataatcacca

SEQ ID NO: 334100 - DNA, 20 bp, Artificial
  CRISPR gRNA sequence
accctcataatcaccacagg

SEQ ID NO: 334101 - DNA, 20 bp, Artificial
  CRISPR gRNA sequence
ccctcataatcaccacaggt

SEQ ID NO: 334102 - DNA, 20 bp, Artificial
  CRISPR gRNA sequence
ataatcaccacaggtcaaga

SEQ ID NO: 334103 - DNA, 20 bp, Artificial
  CRISPR gRNA sequence
tcagcacccctatttccttc

SEQ ID NO: 334104 - DNA, 20 bp, Artificial
  CRISPR gRNA sequence
tttccttctgattccaactc

SEQ ID NO: 334105 - DNA, 20 bp, Artificial
  CRISPR gRNA sequence
ccttctgattccaactcttt

SEQ ID NO: 334106 - DNA, 20 bp, Artificial
  CRISPR gRNA sequence
cttctgattccaactctttc

SEQ ID NO: 334107 - DNA, 20 bp, Artificial
  CRISPR gRNA sequence
ctgattccaactctttctcc

SEQ ID NO: 334108 - DNA, 20 bp, Artificial
  CRISPR gRNA sequence
tgattccaactctttctccc

SEQ ID NO: 334109 - DNA, 20 bp, Artificial
  CRISPR gRNA sequence
attccaactctttctccctc

SEQ ID NO: 334110 - DNA, 20 bp, Artificial
  CRISPR gRNA sequence
caactctttctccctcttta

SEQ ID NO: 334111 - DNA, 20 bp, Artificial
  CRISPR gRNA sequence
tttctccctctttagacaaa

SEQ ID NO: 334112 - DNA, 20 bp, Artificial
  CRISPR gRNA sequence
tctccctctttagacaaaac

SEQ ID NO: 334113 - DNA, 20 bp, Artificial
  CRISPR gRNA sequence
ctccctctttagacaaaacc

SEQ ID NO: 334114 - DNA, 20 bp, Artificial
  CRISPR gRNA sequence
tccctctttagacaaaacca

SEQ ID NO: 334115 - DNA, 20 bp, Artificial
  CRISPR gRNA sequence
cctctttagacaaaaccatt

SEQ ID NO: 334116 - DNA, 20 bp, Artificial
  CRISPR gRNA sequence
tttagacaaaaccattaggc

SEQ ID NO: 334117 - DNA, 20 bp, Artificial
  CRISPR gRNA sequence
tagacaaaaccattaggctg

SEQ ID NO: 334118 - DNA, 20 bp, Artificial
  CRISPR gRNA sequence
agacaaaaccattaggctga

SEQ ID NO: 334119 - DNA, 20 bp, Artificial
  CRISPR gRNA sequence
gacaaaaccattaggctgaa

SEQ ID NO: 334120 - DNA, 20 bp, Artificial
  CRISPR gRNA sequence
ggctgaattttgtgatacta

SEQ ID NO: 334121 - DNA, 20 bp, Artificial
  CRISPR gRNA sequence
aattttgtgatactaattca

SEQ ID NO: 334122 - DNA, 20 bp, Artificial
  CRISPR gRNA sequence
tgtgatactaattcagatta

SEQ ID NO: 334123 - DNA, 20 bp, Artificial
  CRISPR gRNA sequence
gtgatactaattcagattat

SEQ ID NO: 334124 - DNA, 20 bp, Artificial
  CRISPR gRNA sequence
tgatactaattcagattata

SEQ ID NO: 334125 - DNA, 20 bp, Artificial
  CRISPR gRNA sequence
attcagattatattaactat

SEQ ID NO: 334126 - DNA, 20 bp, Artificial
  CRISPR gRNA sequence
agattatattaactatttct

SEQ ID NO: 334127 - DNA, 20 bp, Artificial
  CRISPR gRNA sequence
tattaactatttctattttt

SEQ ID NO: 334128 - DNA, 20 bp, Artificial
  CRISPR gRNA sequence
actatttctattttttagta

SEQ ID NO: 334129 - DNA, 20 bp, Artificial
  CRISPR gRNA sequence
tttctattttttagtaatta

SEQ ID NO: 334130 - DNA, 20 bp, Artificial
  CRISPR gRNA sequence
ctattttttagtaattatgg

SEQ ID NO: 334131 - DNA, 20 bp, Artificial
  CRISPR gRNA sequence
tattttttagtaattatgga

SEQ ID NO: 334132 - DNA, 20 bp, Artificial
  CRISPR gRNA sequence
ttttttagtaattatggaag

SEQ ID NO: 334133 - DNA, 20 bp, Artificial
  CRISPR gRNA sequence
tttagtaattatggaagaaa

SEQ ID NO: 334134 - DNA, 20 bp, Artificial
  CRISPR gRNA sequence
ttagtaattatggaagaaat

SEQ ID NO: 334135 - DNA, 20 bp, Artificial
  CRISPR gRNA sequence
tagtaattatggaagaaatc

SEQ ID NO: 334136 - DNA, 20 bp, Artificial
  CRISPR gRNA sequence
agtaattatggaagaaatca

SEQ ID NO: 334137 - DNA, 20 bp, Artificial
  CRISPR gRNA sequence
gtaattatggaagaaatcaa

SEQ ID NO: 334138 - DNA, 20 bp, Artificial
  CRISPR gRNA sequence
tggaagaaatcaaaacatgt

SEQ ID NO: 334139 - DNA, 20 bp, Artificial
  CRISPR gRNA sequence
cacttagaaaagtttcaaat

SEQ ID NO: 334140 - DNA, 20 bp, Artificial
  CRISPR gRNA sequence
acttagaaaagtttcaaatt

SEQ ID NO: 334141 - DNA, 20 bp, Artificial
  CRISPR gRNA sequence
agaaaagtttcaaattacat

SEQ ID NO: 334142 - DNA, 20 bp, Artificial
  CRISPR gRNA sequence
gaaaagtttcaaattacata

SEQ ID NO: 334143 - DNA, 20 bp, Artificial
  CRISPR gRNA sequence
caaattacatataccttcac

SEQ ID NO: 334144 - DNA, 20 bp, Artificial
  CRISPR gRNA sequence
aaattacatataccttcact

SEQ ID NO: 334145 - DNA, 20 bp, Artificial
  CRISPR gRNA sequence
catataccttcactatcttt

SEQ ID NO: 334146 - DNA, 20 bp, Artificial
  CRISPR gRNA sequence
cactatctttctagacaatg

SEQ ID NO: 334147 - DNA, 20 bp, Artificial
  CRISPR gRNA sequence
actatctttctagacaatgt

SEQ ID NO: 334148 - DNA, 20 bp, Artificial
  CRISPR gRNA sequence
tctttctagacaatgtgctc

SEQ ID NO: 334149 - DNA, 20 bp, Artificial
  CRISPR gRNA sequence
tctagacaatgtgctctata

SEQ ID NO: 334150 - DNA, 20 bp, Artificial
  CRISPR gRNA sequence
ctagacaatgtgctctatat

SEQ ID NO: 334151 - DNA, 20 bp, Artificial
  CRISPR gRNA sequence
tagacaatgtgctctatatt

SEQ ID NO: 334152 - DNA, 20 bp, Artificial
  CRISPR gRNA sequence
gacaatgtgctctatattga

SEQ ID NO: 334153 - DNA, 20 bp, Artificial
  CRISPR gRNA sequence
tatattgacagatgtttctt

SEQ ID NO: 334154 - DNA, 20 bp, Artificial
  CRISPR gRNA sequence
tattgacagatgtttctttt

SEQ ID NO: 334155 - DNA, 20 bp, Artificial
  CRISPR gRNA sequence
acagatgtttcttttagcac

SEQ ID NO: 334156 - DNA, 20 bp, Artificial
  CRISPR gRNA sequence
cttttagcacattggaggta

SEQ ID NO: 334157 - DNA, 20 bp, Artificial
  CRISPR gRNA sequence
ttttagcacattggaggtat

SEQ ID NO: 334158 - DNA, 20 bp, Artificial
  CRISPR gRNA sequence
ttagcacattggaggtatat

SEQ ID NO: 334159 - DNA, 20 bp, Artificial
  CRISPR gRNA sequence
tagcacattggaggtatatg

SEQ ID NO: 334160 - DNA, 20 bp, Artificial
  CRISPR gRNA sequence
agcacattggaggtatatgt

SEQ ID NO: 334161 - DNA, 20 bp, Artificial
  CRISPR gRNA sequence
gcacattggaggtatatgtt

SEQ ID NO: 334162 - DNA, 20 bp, Artificial
  CRISPR gRNA sequence
gaggtatatgttataattcc

SEQ ID NO: 334163 - DNA, 20 bp, Artificial
  CRISPR gRNA sequence
taattccactgtatcagggc

SEQ ID NO: 334164 - DNA, 20 bp, Artificial
  CRISPR gRNA sequence
cactgtatcagggcttttat

SEQ ID NO: 334165 - DNA, 20 bp, Artificial
  CRISPR gRNA sequence
tatcagggcttttattgttg

SEQ ID NO: 334166 - DNA, 20 bp, Artificial
  CRISPR gRNA sequence
ttattgttgatgttgaaaca

SEQ ID NO: 334167 - DNA, 20 bp, Artificial
  CRISPR gRNA sequence
tattgttgatgttgaaacag

SEQ ID NO: 334168 - DNA, 20 bp, Artificial
  CRISPR gRNA sequence
attgttgatgttgaaacagt

SEQ ID NO: 334169 - DNA, 20 bp, Artificial
  CRISPR gRNA sequence
ttgttgatgttgaaacagtc

SEQ ID NO: 334170 - DNA, 20 bp, Artificial
  CRISPR gRNA sequence
ttgatgttgaaacagtctaa

SEQ ID NO: 334171 - DNA, 20 bp, Artificial
  CRISPR gRNA sequence
atgttgaaacagtctaatag

SEQ ID NO: 334172 - DNA, 20 bp, Artificial
  CRISPR gRNA sequence
aaacagtctaatagttgctc

SEQ ID NO: 334173 - DNA, 20 bp, Artificial
  CRISPR gRNA sequence
atagttgctccttggaaggt

SEQ ID NO: 334174 - DNA, 20 bp, Artificial
  CRISPR gRNA sequence
ctccttggaaggtaatcagt

SEQ ID NO: 334175 - DNA, 20 bp, Artificial
  CRISPR gRNA sequence
cttggaaggtaatcagtctc

SEQ ID NO: 334176 - DNA, 20 bp, Artificial
  CRISPR gRNA sequence
ggaaggtaatcagtctcttt

SEQ ID NO: 334177 - DNA, 20 bp, Artificial
  CRISPR gRNA sequence
gaaggtaatcagtctctttt

SEQ ID NO: 334178 - DNA, 20 bp, Artificial
  CRISPR gRNA sequence
ttttctctggctgcttttag

SEQ ID NO: 334179 - DNA, 20 bp, Artificial
  CRISPR gRNA sequence
ttctctggctgcttttagga

SEQ ID NO: 334180 - DNA, 20 bp, Artificial
  CRISPR gRNA sequence
tctctggctgcttttaggat

SEQ ID NO: 334181 - DNA, 20 bp, Artificial
  CRISPR gRNA sequence
ctctggctgcttttaggatt

SEQ ID NO: 334182 - DNA, 20 bp, Artificial
  CRISPR gRNA sequence
tctggctgcttttaggattt

SEQ ID NO: 334183 - DNA, 20 bp, Artificial
  CRISPR gRNA sequence
tggctgcttttaggattttc

SEQ ID NO: 334184 - DNA, 20 bp, Artificial
  CRISPR gRNA sequence
gctgcttttaggattttcac

SEQ ID NO: 334185 - DNA, 20 bp, Artificial
  CRISPR gRNA sequence
cttttaggattttcactaag

SEQ ID NO: 334186 - DNA, 20 bp, Artificial
  CRISPR gRNA sequence
ttaggattttcactaagata

SEQ ID NO: 334187 - DNA, 20 bp, Artificial
  CRISPR gRNA sequence
taggattttcactaagatac

SEQ ID NO: 334188 - DNA, 20 bp, Artificial
  CRISPR gRNA sequence
aggattttcactaagataca

SEQ ID NO: 334189 - DNA, 20 bp, Artificial
  CRISPR gRNA sequence
ggattttcactaagatacat

SEQ ID NO: 334190 - DNA, 20 bp, Artificial
  CRISPR gRNA sequence
tcactaagatacatctaggt

SEQ ID NO: 334191 - DNA, 20 bp, Artificial
  CRISPR gRNA sequence
cactaagatacatctaggtg

SEQ ID NO: 334192 - DNA, 20 bp, Artificial
  CRISPR gRNA sequence
actaagatacatctaggtgt

SEQ ID NO: 334193 - DNA, 20 bp, Artificial
  CRISPR gRNA sequence
agatacatctaggtgtgcat

SEQ ID NO: 334194 - DNA, 20 bp, Artificial
  CRISPR gRNA sequence
ggtgtgcatacttttaaaaa

SEQ ID NO: 334195 - DNA, 20 bp, Artificial
  CRISPR gRNA sequence
ttaaaaaatatgcttgtgaa

SEQ ID NO: 334196 - DNA, 20 bp, Artificial
  CRISPR gRNA sequence
taaaaaatatgcttgtgaat

SEQ ID NO: 334197 - DNA, 20 bp, Artificial
  CRISPR gRNA sequence
aaaaaatatgcttgtgaatt

SEQ ID NO: 334198 - DNA, 20 bp, Artificial
  CRISPR gRNA sequence
aaaaatatgcttgtgaattg

SEQ ID NO: 334199 - DNA, 20 bp, Artificial
  CRISPR gRNA sequence
gtgaattgttgggattcttg

SEQ ID NO: 334200 - DNA, 20 bp, Artificial
  CRISPR gRNA sequence
tgaattgttgggattcttga

SEQ ID NO: 334201 - DNA, 20 bp, Artificial
  CRISPR gRNA sequence
ttgggattcttgaatctgtg

SEQ ID NO: 334202 - DNA, 20 bp, Artificial
  CRISPR gRNA sequence
ggattcttgaatctgtggag

SEQ ID NO: 334203 - DNA, 20 bp, Artificial
  CRISPR gRNA sequence
ttgaatctgtggagtgtgac

SEQ ID NO: 334204 - DNA, 20 bp, Artificial
  CRISPR gRNA sequence
gaatctgtggagtgtgactg

SEQ ID NO: 334205 - DNA, 20 bp, Artificial
  CRISPR gRNA sequence
aatctgtggagtgtgactgg

SEQ ID NO: 334206 - DNA, 20 bp, Artificial
  CRISPR gRNA sequence
tggagtgtgactgggttcta

SEQ ID NO: 334207 - DNA, 20 bp, Artificial
  CRISPR gRNA sequence
ggttctaactaatttttcca

SEQ ID NO: 334208 - DNA, 20 bp, Artificial
  CRISPR gRNA sequence
taactaatttttccaaccta

SEQ ID NO: 334209 - DNA, 20 bp, Artificial
  CRISPR gRNA sequence
actaatttttccaacctatc

SEQ ID NO: 334210 - DNA, 20 bp, Artificial
  CRISPR gRNA sequence
atttttccaacctatctgct

SEQ ID NO: 334211 - DNA, 20 bp, Artificial
  CRISPR gRNA sequence
ttccaacctatctgctggtt

SEQ ID NO: 334212 - DNA, 20 bp, Artificial
  CRISPR gRNA sequence
tccaacctatctgctggttc

SEQ ID NO: 334213 - DNA, 20 bp, Artificial
  CRISPR gRNA sequence
ccaacctatctgctggttca

SEQ ID NO: 334214 - DNA, 20 bp, Artificial
  CRISPR gRNA sequence
caacctatctgctggttcac

SEQ ID NO: 334215 - DNA, 20 bp, Artificial
  CRISPR gRNA sequence
tctgctggttcaccaatttt

SEQ ID NO: 334216 - DNA, 20 bp, Artificial
  CRISPR gRNA sequence
ctggttcaccaattttctct

SEQ ID NO: 334217 - DNA, 20 bp, Artificial
  CRISPR gRNA sequence
gttcaccaattttctcttta

SEQ ID NO: 334218 - DNA, 20 bp, Artificial
  CRISPR gRNA sequence
accaattttctctttaactc

SEQ ID NO: 334219 - DNA, 20 bp, Artificial
  CRISPR gRNA sequence
tctctttaactctgtctaat

SEQ ID NO: 334220 - DNA, 20 bp, Artificial
  CRISPR gRNA sequence
ctctttaactctgtctaata

SEQ ID NO: 334221 - DNA, 20 bp, Artificial
  CRISPR gRNA sequence
tctttaactctgtctaatat

SEQ ID NO: 334222 - DNA, 20 bp, Artificial
  CRISPR gRNA sequence
tttaactctgtctaatatat

SEQ ID NO: 334223 - DNA, 20 bp, Artificial
  CRISPR gRNA sequence
taactctgtctaatatatat

SEQ ID NO: 334224 - DNA, 20 bp, Artificial
  CRISPR gRNA sequence
aactctgtctaatatatatt

SEQ ID NO: 334225 - DNA, 20 bp, Artificial
  CRISPR gRNA sequence
actctgtctaatatatatta

SEQ ID NO: 334226 - DNA, 20 bp, Artificial
  CRISPR gRNA sequence
tgtctaatatatattaaact

SEQ ID NO: 334227 - DNA, 20 bp, Artificial
  CRISPR gRNA sequence
tctaatatatattaaactta

SEQ ID NO: 334228 - DNA, 20 bp, Artificial
  CRISPR gRNA sequence
atatatattaaacttatcta

SEQ ID NO: 334229 - DNA, 20 bp, Artificial
  CRISPR gRNA sequence
aacttatctattgagtttta

SEQ ID NO: 334230 - DNA, 20 bp, Artificial
  CRISPR gRNA sequence
atctattgagttttaaatct

SEQ ID NO: 334231 - DNA, 20 bp, Artificial
  CRISPR gRNA sequence
tctattgagttttaaatctc

SEQ ID NO: 334232 - DNA, 20 bp, Artificial
  CRISPR gRNA sequence
ttgagttttaaatctcagtg

SEQ ID NO: 334233 - DNA, 20 bp, Artificial
  CRISPR gRNA sequence
agttttaaatctcagtgcat

SEQ ID NO: 334234 - DNA, 20 bp, Artificial
  CRISPR gRNA sequence
taaatctcagtgcatttttt

SEQ ID NO: 334235 - DNA, 20 bp, Artificial
  CRISPR gRNA sequence
aaatctcagtgcattttttt

SEQ ID NO: 334236 - DNA, 20 bp, Artificial
  CRISPR gRNA sequence
aatctcagtgcatttttttg

SEQ ID NO: 334237 - DNA, 20 bp, Artificial
  CRISPR gRNA sequence
agtgcatttttttggccgat

SEQ ID NO: 334238 - DNA, 20 bp, Artificial
  CRISPR gRNA sequence
ttttggccgattcttgtagg

SEQ ID NO: 334239 - DNA, 20 bp, Artificial
  CRISPR gRNA sequence
tttggccgattcttgtaggt

SEQ ID NO: 334240 - DNA, 20 bp, Artificial
  CRISPR gRNA sequence
ttggccgattcttgtaggtt

SEQ ID NO: 334241 - DNA, 20 bp, Artificial
  CRISPR gRNA sequence
tggccgattcttgtaggttc

SEQ ID NO: 334242 - DNA, 20 bp, Artificial
  CRISPR gRNA sequence
ggccgattcttgtaggttct

SEQ ID NO: 334243 - DNA, 20 bp, Artificial
  CRISPR gRNA sequence
gccgattcttgtaggttctt

SEQ ID NO: 334244 - DNA, 20 bp, Artificial
  CRISPR gRNA sequence
ttgtaggttctttttcaaat

SEQ ID NO: 334245 - DNA, 20 bp, Artificial
  CRISPR gRNA sequence
gtaggttctttttcaaatta

SEQ ID NO: 334246 - DNA, 20 bp, Artificial
  CRISPR gRNA sequence
taggttctttttcaaattag

SEQ ID NO: 334247 - DNA, 20 bp, Artificial
  CRISPR gRNA sequence
tttttcaaattagttgactt

SEQ ID NO: 334248 - DNA, 20 bp, Artificial
  CRISPR gRNA sequence
tttcaaattagttgacttaa

SEQ ID NO: 334249 - DNA, 20 bp, Artificial
  CRISPR gRNA sequence
ttcaaattagttgacttaaa

SEQ ID NO: 334250 - DNA, 20 bp, Artificial
  CRISPR gRNA sequence
tcaaattagttgacttaaat

SEQ ID NO: 334251 - DNA, 20 bp, Artificial
  CRISPR gRNA sequence
caaattagttgacttaaatt

SEQ ID NO: 334252 - DNA, 20 bp, Artificial
  CRISPR gRNA sequence
aaattagttgacttaaattt

SEQ ID NO: 334253 - DNA, 20 bp, Artificial
  CRISPR gRNA sequence
gttgacttaaattttcctgt

SEQ ID NO: 334254 - DNA, 20 bp, Artificial
  CRISPR gRNA sequence
acttaaattttcctgtgtac

SEQ ID NO: 334255 - DNA, 20 bp, Artificial
  CRISPR gRNA sequence
aaattttcctgtgtactaca

SEQ ID NO: 334256 - DNA, 20 bp, Artificial
  CRISPR gRNA sequence
aattttcctgtgtactacag

SEQ ID NO: 334257 - DNA, 20 bp, Artificial
  CRISPR gRNA sequence
tcctgtgtactacagatatt

SEQ ID NO: 334258 - DNA, 20 bp, Artificial
  CRISPR gRNA sequence
cctgtgtactacagatatta

SEQ ID NO: 334259 - DNA, 20 bp, Artificial
  CRISPR gRNA sequence
ctgtgtactacagatattat

SEQ ID NO: 334260 - DNA, 20 bp, Artificial
  CRISPR gRNA sequence
tgtactacagatattattac

SEQ ID NO: 334261 - DNA, 20 bp, Artificial
  CRISPR gRNA sequence
cagatattattacaagtttt

SEQ ID NO: 334262 - DNA, 20 bp, Artificial
  CRISPR gRNA sequence
ttacaagtttttctcttatt

SEQ ID NO: 334263 - DNA, 20 bp, Artificial
  CRISPR gRNA sequence
caagtttttctcttatttgc

SEQ ID NO: 334264 - DNA, 20 bp, Artificial
  CRISPR gRNA sequence
ttctcttatttgcttaaaca

SEQ ID NO: 334265 - DNA, 20 bp, Artificial
  CRISPR gRNA sequence
tctcttatttgcttaaacat

SEQ ID NO: 334266 - DNA, 20 bp, Artificial
  CRISPR gRNA sequence
ctcttatttgcttaaacata

SEQ ID NO: 334267 - DNA, 20 bp, Artificial
  CRISPR gRNA sequence
tcttatttgcttaaacataa

SEQ ID NO: 334268 - DNA, 20 bp, Artificial
  CRISPR gRNA sequence
ttatttgcttaaacataata

SEQ ID NO: 334269 - DNA, 20 bp, Artificial
  CRISPR gRNA sequence
atttgcttaaacataataag

SEQ ID NO: 334270 - DNA, 20 bp, Artificial
  CRISPR gRNA sequence
tttgcttaaacataataagc

SEQ ID NO: 334271 - DNA, 20 bp, Artificial
  CRISPR gRNA sequence
gcttaaacataataagctta

SEQ ID NO: 334272 - DNA, 20 bp, Artificial
  CRISPR gRNA sequence
cttaaacataataagcttaa

SEQ ID NO: 334273 - DNA, 20 bp, Artificial
  CRISPR gRNA sequence
aaacataataagcttaatta

SEQ ID NO: 334274 - DNA, 20 bp, Artificial
  CRISPR gRNA sequence
aacataataagcttaattac

SEQ ID NO: 334275 - DNA, 20 bp, Artificial
  CRISPR gRNA sequence
aattactttattttggggac

SEQ ID NO: 334276 - DNA, 20 bp, Artificial
  CRISPR gRNA sequence
attactttattttggggacc

SEQ ID NO: 334277 - DNA, 20 bp, Artificial
  CRISPR gRNA sequence
ctttattttggggacctgat

SEQ ID NO: 334278 - DNA, 20 bp, Artificial
  CRISPR gRNA sequence
tattttggggacctgataat

SEQ ID NO: 334279 - DNA, 20 bp, Artificial
  CRISPR gRNA sequence
attttggggacctgataatt

SEQ ID NO: 334280 - DNA, 20 bp, Artificial
  CRISPR gRNA sequence
ttttggggacctgataattc

SEQ ID NO: 334281 - DNA, 20 bp, Artificial
  CRISPR gRNA sequence
tggggacctgataattcagg

SEQ ID NO: 334282 - DNA, 20 bp, Artificial
  CRISPR gRNA sequence
ggggacctgataattcaggt

SEQ ID NO: 334283 - DNA, 20 bp, Artificial
  CRISPR gRNA sequence
gggacctgataattcaggta

SEQ ID NO: 334284 - DNA, 20 bp, Artificial
  CRISPR gRNA sequence
ataattcaggtatataaatc

SEQ ID NO: 334285 - DNA, 20 bp, Artificial
  CRISPR gRNA sequence
aggtatataaatcatgagtt

SEQ ID NO: 334286 - DNA, 20 bp, Artificial
  CRISPR gRNA sequence
gtttttgtagtttgttgttt

SEQ ID NO: 334287 - DNA, 20 bp, Artificial
  CRISPR gRNA sequence
tttttgtagtttgttgtttc

SEQ ID NO: 334288 - DNA, 20 bp, Artificial
  CRISPR gRNA sequence
ttgtagtttgttgtttctgt

SEQ ID NO: 334289 - DNA, 20 bp, Artificial
  CRISPR gRNA sequence
tgtagtttgttgtttctgtt

SEQ ID NO: 334290 - DNA, 20 bp, Artificial
  CRISPR gRNA sequence
gtagtttgttgtttctgttg

SEQ ID NO: 334291 - DNA, 20 bp, Artificial
  CRISPR gRNA sequence
tagtttgttgtttctgttgt

SEQ ID NO: 334292 - DNA, 20 bp, Artificial
  CRISPR gRNA sequence
gttgtttctgttgttccctt

SEQ ID NO: 334293 - DNA, 20 bp, Artificial
  CRISPR gRNA sequence
ttgtttctgttgttcccttg

SEQ ID NO: 334294 - DNA, 20 bp, Artificial
  CRISPR gRNA sequence
tttctgttgttcccttgttt

SEQ ID NO: 334295 - DNA, 20 bp, Artificial
  CRISPR gRNA sequence
ctgttgttcccttgttttct

SEQ ID NO: 334296 - DNA, 20 bp, Artificial
  CRISPR gRNA sequence
tgttgttcccttgttttctt

SEQ ID NO: 334297 - DNA, 20 bp, Artificial
  CRISPR gRNA sequence
ttgttcccttgttttcttgt

SEQ ID NO: 334298 - DNA, 20 bp, Artificial
  CRISPR gRNA sequence
ttcccttgttttcttgtatg

SEQ ID NO: 334299 - DNA, 20 bp, Artificial
  CRISPR gRNA sequence
ccttgttttcttgtatgtct

SEQ ID NO: 334300 - DNA, 20 bp, Artificial
  CRISPR gRNA sequence
gttttcttgtatgtctcatt

SEQ ID NO: 334301 - DNA, 20 bp, Artificial
  CRISPR gRNA sequence
ttttcttgtatgtctcatta

SEQ ID NO: 334302 - DNA, 20 bp, Artificial
  CRISPR gRNA sequence
tcttgtatgtctcattattt

SEQ ID NO: 334303 - DNA, 20 bp, Artificial
  CRISPR gRNA sequence
cttgtatgtctcattatttt

SEQ ID NO: 334304 - DNA, 20 bp, Artificial
  CRISPR gRNA sequence
ttgtatgtctcattattttt

SEQ ID NO: 334305 - DNA, 20 bp, Artificial
  CRISPR gRNA sequence
gtatgtctcattatttttgt

SEQ ID NO: 334306 - DNA, 20 bp, Artificial
  CRISPR gRNA sequence
tatgtctcattatttttgtg

SEQ ID NO: 334307 - DNA, 20 bp, Artificial
  CRISPR gRNA sequence
attatttttgtgatgtgttt

SEQ ID NO: 334308 - DNA, 20 bp, Artificial
  CRISPR gRNA sequence
tttttgtgatgtgtttgcca

SEQ ID NO: 334309 - DNA, 20 bp, Artificial
  CRISPR gRNA sequence
ttgtgatgtgtttgccattg

SEQ ID NO: 334310 - DNA, 20 bp, Artificial
  CRISPR gRNA sequence
tgtgatgtgtttgccattga

SEQ ID NO: 334311 - DNA, 20 bp, Artificial
  CRISPR gRNA sequence
gtgatgtgtttgccattgaa

SEQ ID NO: 334312 - DNA, 20 bp, Artificial
  CRISPR gRNA sequence
tgatgtgtttgccattgaat

SEQ ID NO: 334313 - DNA, 20 bp, Artificial
  CRISPR gRNA sequence
gccattgaatgtgaatatta

SEQ ID NO: 334314 - DNA, 20 bp, Artificial
  CRISPR gRNA sequence
ccattgaatgtgaatattat

SEQ ID NO: 334315 - DNA, 20 bp, Artificial
  CRISPR gRNA sequence
aatgtgaatattatttgtat

SEQ ID NO: 334316 - DNA, 20 bp, Artificial
  CRISPR gRNA sequence
tttgtatgaaattttttgag

SEQ ID NO: 334317 - DNA, 20 bp, Artificial
  CRISPR gRNA sequence
gtatgaaattttttgaggcc

SEQ ID NO: 334318 - DNA, 20 bp, Artificial
  CRISPR gRNA sequence
tatgaaattttttgaggcct

SEQ ID NO: 334319 - DNA, 20 bp, Artificial
  CRISPR gRNA sequence
tttgaggcctaggatgtaaa

SEQ ID NO: 334320 - DNA, 20 bp, Artificial
  CRISPR gRNA sequence
ttgaggcctaggatgtaaac

SEQ ID NO: 334321 - DNA, 20 bp, Artificial
  CRISPR gRNA sequence
tgaggcctaggatgtaaacc

SEQ ID NO: 334322 - DNA, 20 bp, Artificial
  CRISPR gRNA sequence
gaggcctaggatgtaaacct

SEQ ID NO: 334323 - DNA, 20 bp, Artificial
  CRISPR gRNA sequence
aggcctaggatgtaaacctt

SEQ ID NO: 334324 - DNA, 20 bp, Artificial
  CRISPR gRNA sequence
ggatgtaaaccttttcttct

SEQ ID NO: 334325 - DNA, 20 bp, Artificial
  CRISPR gRNA sequence
ttcttcttgtaatagtttgc

SEQ ID NO: 334326 - DNA, 20 bp, Artificial
  CRISPR gRNA sequence
tcttcttgtaatagtttgca

SEQ ID NO: 334327 - DNA, 20 bp, Artificial
  CRISPR gRNA sequence
cttcttgtaatagtttgcat

SEQ ID NO: 334328 - DNA, 20 bp, Artificial
  CRISPR gRNA sequence
ttcttgtaatagtttgcatt

SEQ ID NO: 334329 - DNA, 20 bp, Artificial
  CRISPR gRNA sequence
cttgtaatagtttgcatttt

SEQ ID NO: 334330 - DNA, 20 bp, Artificial
  CRISPR gRNA sequence
ttgtaatagtttgcattttt

SEQ ID NO: 334331 - DNA, 20 bp, Artificial
  CRISPR gRNA sequence
gtaatagtttgcatttttac

SEQ ID NO: 334332 - DNA, 20 bp, Artificial
  CRISPR gRNA sequence
taatagtttgcatttttact

SEQ ID NO: 334333 - DNA, 20 bp, Artificial
  CRISPR gRNA sequence
gcatttttactttcaaaagc

SEQ ID NO: 334334 - DNA, 20 bp, Artificial
  CRISPR gRNA sequence
catttttactttcaaaagct

SEQ ID NO: 334335 - DNA, 20 bp, Artificial
  CRISPR gRNA sequence
ttactttcaaaagctgaagg

SEQ ID NO: 334336 - DNA, 20 bp, Artificial
  CRISPR gRNA sequence
tactttcaaaagctgaaggg

SEQ ID NO: 334337 - DNA, 20 bp, Artificial
  CRISPR gRNA sequence
actttcaaaagctgaagggt

SEQ ID NO: 334338 - DNA, 20 bp, Artificial
  CRISPR gRNA sequence
ctttcaaaagctgaagggta

SEQ ID NO: 334339 - DNA, 20 bp, Artificial
  CRISPR gRNA sequence
tcaaaagctgaagggtaata

SEQ ID NO: 334340 - DNA, 20 bp, Artificial
  CRISPR gRNA sequence
caaaagctgaagggtaataa

SEQ ID NO: 334341 - DNA, 20 bp, Artificial
  CRISPR gRNA sequence
aaaagctgaagggtaataat

SEQ ID NO: 334342 - DNA, 20 bp, Artificial
  CRISPR gRNA sequence
aagggtaataataatgcaaa

SEQ ID NO: 334343 - DNA, 20 bp, Artificial
  CRISPR gRNA sequence
cttaaagaaaattcaaggat

SEQ ID NO: 334344 - DNA, 20 bp, Artificial
  CRISPR gRNA sequence
aaagaaaattcaaggattga

SEQ ID NO: 334345 - DNA, 20 bp, Artificial
  CRISPR gRNA sequence
aagaaaattcaaggattgag

SEQ ID NO: 334346 - DNA, 20 bp, Artificial
  CRISPR gRNA sequence
aaggattgaggttttctaac

SEQ ID NO: 334347 - DNA, 20 bp, Artificial
  CRISPR gRNA sequence
aggttttctaaccattgaag

SEQ ID NO: 334348 - DNA, 20 bp, Artificial
  CRISPR gRNA sequence
tctaaccattgaagtccaga

SEQ ID NO: 334349 - DNA, 20 bp, Artificial
  CRISPR gRNA sequence
ctaaccattgaagtccagaa

SEQ ID NO: 334350 - DNA, 20 bp, Artificial
  CRISPR gRNA sequence
taaccattgaagtccagaag

SEQ ID NO: 334351 - DNA, 20 bp, Artificial
  CRISPR gRNA sequence
accattgaagtccagaagat

SEQ ID NO: 334352 - DNA, 20 bp, Artificial
  CRISPR gRNA sequence
aagtccagaagatttttctg

SEQ ID NO: 334353 - DNA, 20 bp, Artificial
  CRISPR gRNA sequence
ttctggaccatctaatctga

SEQ ID NO: 334354 - DNA, 20 bp, Artificial
  CRISPR gRNA sequence
tctggaccatctaatctgaa

SEQ ID NO: 334355 - DNA, 20 bp, Artificial
  CRISPR gRNA sequence
ctggaccatctaatctgaat

SEQ ID NO: 334356 - DNA, 20 bp, Artificial
  CRISPR gRNA sequence
tggaccatctaatctgaatg

SEQ ID NO: 334357 - DNA, 20 bp, Artificial
  CRISPR gRNA sequence
gaccatctaatctgaatgag

SEQ ID NO: 334358 - DNA, 20 bp, Artificial
  CRISPR gRNA sequence
atctgaatgaggtctggttt

SEQ ID NO: 334359 - DNA, 20 bp, Artificial
  CRISPR gRNA sequence
aatgaggtctggtttatttc

SEQ ID NO: 334360 - DNA, 20 bp, Artificial
  CRISPR gRNA sequence
gtttatttctttacctgtgc

SEQ ID NO: 334361 - DNA, 20 bp, Artificial
  CRISPR gRNA sequence
atttctttacctgtgctcca

SEQ ID NO: 334362 - DNA, 20 bp, Artificial
  CRISPR gRNA sequence
tttctttacctgtgctccaa

SEQ ID NO: 334363 - DNA, 20 bp, Artificial
  CRISPR gRNA sequence
ctttacctgtgctccaagaa

SEQ ID NO: 334364 - DNA, 20 bp, Artificial
  CRISPR gRNA sequence
tttacctgtgctccaagaat

SEQ ID NO: 334365 - DNA, 20 bp, Artificial
  CRISPR gRNA sequence
tacctgtgctccaagaatgt

SEQ ID NO: 334366 - DNA, 20 bp, Artificial
  CRISPR gRNA sequence
acctgtgctccaagaatgta

SEQ ID NO: 334367 - DNA, 20 bp, Artificial
  CRISPR gRNA sequence
cctgtgctccaagaatgtaa

SEQ ID NO: 334368 - DNA, 20 bp, Artificial
  CRISPR gRNA sequence
tgctccaagaatgtaactct

SEQ ID NO: 334369 - DNA, 20 bp, Artificial
  CRISPR gRNA sequence
caagaatgtaactctttggg

SEQ ID NO: 334370 - DNA, 20 bp, Artificial
  CRISPR gRNA sequence
tttggggtcccaatttattg

SEQ ID NO: 334371 - DNA, 20 bp, Artificial
  CRISPR gRNA sequence
tggggtcccaatttattggg

SEQ ID NO: 334372 - DNA, 20 bp, Artificial
  CRISPR gRNA sequence
ggggtcccaatttattgggg

SEQ ID NO: 334373 - DNA, 20 bp, Artificial
  CRISPR gRNA sequence
gggtcccaatttattgggga

SEQ ID NO: 334374 - DNA, 20 bp, Artificial
  CRISPR gRNA sequence
attggggagagggttttctg

SEQ ID NO: 334375 - DNA, 20 bp, Artificial
  CRISPR gRNA sequence
ttggggagagggttttctgc

SEQ ID NO: 334376 - DNA, 20 bp, Artificial
  CRISPR gRNA sequence
gggagagggttttctgctag

SEQ ID NO: 334377 - DNA, 20 bp, Artificial
  CRISPR gRNA sequence
tctgctagatcactcactct

SEQ ID NO: 334378 - DNA, 20 bp, Artificial
  CRISPR gRNA sequence
ctgctagatcactcactctg

SEQ ID NO: 334379 - DNA, 20 bp, Artificial
  CRISPR gRNA sequence
tgctagatcactcactctgc

SEQ ID NO: 334380 - DNA, 20 bp, Artificial
  CRISPR gRNA sequence
ctagatcactcactctgcag

SEQ ID NO: 334381 - DNA, 20 bp, Artificial
  CRISPR gRNA sequence
gatcactcactctgcagatt

SEQ ID NO: 334382 - DNA, 20 bp, Artificial
  CRISPR gRNA sequence
actctgcagattctgggagt

SEQ ID NO: 334383 - DNA, 20 bp, Artificial
  CRISPR gRNA sequence
tgcagattctgggagttgag

SEQ ID NO: 334384 - DNA, 20 bp, Artificial
  CRISPR gRNA sequence
cagattctgggagttgagac

SEQ ID NO: 334385 - DNA, 20 bp, Artificial
  CRISPR gRNA sequence
tgggagttgagacataaaaa

SEQ ID NO: 334386 - DNA, 20 bp, Artificial
  CRISPR gRNA sequence
ggagttgagacataaaaaca

SEQ ID NO: 334387 - DNA, 20 bp, Artificial
  CRISPR gRNA sequence
agacataaaaacaaaagttt

SEQ ID NO: 334388 - DNA, 20 bp, Artificial
  CRISPR gRNA sequence
gaatttgaaagaacagcaat

SEQ ID NO: 334389 - DNA, 20 bp, Artificial
  CRISPR gRNA sequence
aatttgaaagaacagcaatg

SEQ ID NO: 334390 - DNA, 20 bp, Artificial
  CRISPR gRNA sequence
gaaagaacagcaatgctttc

SEQ ID NO: 334391 - DNA, 20 bp, Artificial
  CRISPR gRNA sequence
aaagaacagcaatgctttcc

SEQ ID NO: 334392 - DNA, 20 bp, Artificial
  CRISPR gRNA sequence
tccgagtaaaagcagcttcc

SEQ ID NO: 334393 - DNA, 20 bp, Artificial
  CRISPR gRNA sequence
ccgagtaaaagcagcttcca

SEQ ID NO: 334394 - DNA, 20 bp, Artificial
  CRISPR gRNA sequence
cgagtaaaagcagcttccaa

SEQ ID NO: 334395 - DNA, 20 bp, Artificial
  CRISPR gRNA sequence
ccaagctttgcctgtctctc

SEQ ID NO: 334396 - DNA, 20 bp, Artificial
  CRISPR gRNA sequence
caagctttgcctgtctctcg

SEQ ID NO: 334397 - DNA, 20 bp, Artificial
  CRISPR gRNA sequence
tgcctgtctctcggggttct

SEQ ID NO: 334398 - DNA, 20 bp, Artificial
  CRISPR gRNA sequence
gcctgtctctcggggttctg

SEQ ID NO: 334399 - DNA, 20 bp, Artificial
  CRISPR gRNA sequence
cctgtctctcggggttctgg

SEQ ID NO: 334400 - DNA, 20 bp, Artificial
  CRISPR gRNA sequence
tctctcggggttctggttct

SEQ ID NO: 334401 - DNA, 20 bp, Artificial
  CRISPR gRNA sequence
tcggggttctggttctctct

SEQ ID NO: 334402 - DNA, 20 bp, Artificial
  CRISPR gRNA sequence
ggggttctggttctctcttc

SEQ ID NO: 334403 - DNA, 20 bp, Artificial
  CRISPR gRNA sequence
tggttctctcttcaaattta

SEQ ID NO: 334404 - DNA, 20 bp, Artificial
  CRISPR gRNA sequence
gttctctcttcaaatttagc

SEQ ID NO: 334405 - DNA, 20 bp, Artificial
  CRISPR gRNA sequence
tctcttcaaatttagcctgg

SEQ ID NO: 334406 - DNA, 20 bp, Artificial
  CRISPR gRNA sequence
tcttcaaatttagcctggta

SEQ ID NO: 334407 - DNA, 20 bp, Artificial
  CRISPR gRNA sequence
ttcaaatttagcctggtaat

SEQ ID NO: 334408 - DNA, 20 bp, Artificial
  CRISPR gRNA sequence
caaatttagcctggtaattt

SEQ ID NO: 334409 - DNA, 20 bp, Artificial
  CRISPR gRNA sequence
aaatttagcctggtaatttc

SEQ ID NO: 334410 - DNA, 20 bp, Artificial
  CRISPR gRNA sequence
agcctggtaatttctcctcc

SEQ ID NO: 334411 - DNA, 20 bp, Artificial
  CRISPR gRNA sequence
gcctggtaatttctcctcct

SEQ ID NO: 334412 - DNA, 20 bp, Artificial
  CRISPR gRNA sequence
gtaatttctcctcctttgtg

SEQ ID NO: 334413 - DNA, 20 bp, Artificial
  CRISPR gRNA sequence
ctcctcctttgtgtcattct

SEQ ID NO: 334414 - DNA, 20 bp, Artificial
  CRISPR gRNA sequence
tcctcctttgtgtcattctt

SEQ ID NO: 334415 - DNA, 20 bp, Artificial
  CRISPR gRNA sequence
ctcctttgtgtcattcttta

SEQ ID NO: 334416 - DNA, 20 bp, Artificial
  CRISPR gRNA sequence
ctttgtgtcattctttaatg

SEQ ID NO: 334417 - DNA, 20 bp, Artificial
  CRISPR gRNA sequence
tgtgtcattctttaatgctt

SEQ ID NO: 334418 - DNA, 20 bp, Artificial
  CRISPR gRNA sequence
gtgtcattctttaatgcttt

SEQ ID NO: 334419 - DNA, 20 bp, Artificial
  CRISPR gRNA sequence
tgtcattctttaatgctttt

SEQ ID NO: 334420 - DNA, 20 bp, Artificial
  CRISPR gRNA sequence
tttaatgcttttaataatat

SEQ ID NO: 334421 - DNA, 20 bp, Artificial
  CRISPR gRNA sequence
taatgcttttaataatattt

SEQ ID NO: 334422 - DNA, 20 bp, Artificial
  CRISPR gRNA sequence
aatgcttttaataatatttt

SEQ ID NO: 334423 - DNA, 20 bp, Artificial
  CRISPR gRNA sequence
atgcttttaataatattttt

SEQ ID NO: 334424 - DNA, 20 bp, Artificial
  CRISPR gRNA sequence
ttaataatatttttggacat

SEQ ID NO: 334425 - DNA, 20 bp, Artificial
  CRISPR gRNA sequence
taataatatttttggacatt

SEQ ID NO: 334426 - DNA, 20 bp, Artificial
  CRISPR gRNA sequence
aataatatttttggacattt

SEQ ID NO: 334427 - DNA, 20 bp, Artificial
  CRISPR gRNA sequence
ataatatttttggacatttg

SEQ ID NO: 334428 - DNA, 20 bp, Artificial
  CRISPR gRNA sequence
ttggacatttgttcaacatt

SEQ ID NO: 334429 - DNA, 20 bp, Artificial
  CRISPR gRNA sequence
tggacatttgttcaacattt

SEQ ID NO: 334430 - DNA, 20 bp, Artificial
  CRISPR gRNA sequence
ggacatttgttcaacatttt

SEQ ID NO: 334431 - DNA, 20 bp, Artificial
  CRISPR gRNA sequence
gacatttgttcaacattttt

SEQ ID NO: 334432 - DNA, 20 bp, Artificial
  CRISPR gRNA sequence
gttcaacatttttggttgtt

SEQ ID NO: 334433 - DNA, 20 bp, Artificial
  CRISPR gRNA sequence
ttcaacatttttggttgttt

SEQ ID NO: 334434 - DNA, 20 bp, Artificial
  CRISPR gRNA sequence
aacatttttggttgttttgg

SEQ ID NO: 334435 - DNA, 20 bp, Artificial
  CRISPR gRNA sequence
ttggttgttttggcgtgaga

SEQ ID NO: 334436 - DNA, 20 bp, Artificial
  CRISPR gRNA sequence
tggttgttttggcgtgagaa

SEQ ID NO: 334437 - DNA, 20 bp, Artificial
  CRISPR gRNA sequence
ggttgttttggcgtgagaat

SEQ ID NO: 334438 - DNA, 20 bp, Artificial
  CRISPR gRNA sequence
gttgttttggcgtgagaatt

SEQ ID NO: 334439 - DNA, 20 bp, Artificial
  CRISPR gRNA sequence
ttttggcgtgagaattagtt

SEQ ID NO: 334440 - DNA, 20 bp, Artificial
  CRISPR gRNA sequence
tggcgtgagaattagtttga

SEQ ID NO: 334441 - DNA, 20 bp, Artificial
  CRISPR gRNA sequence
ggcgtgagaattagtttgaa

SEQ ID NO: 334442 - DNA, 20 bp, Artificial
  CRISPR gRNA sequence
gcgtgagaattagtttgaat

SEQ ID NO: 334443 - DNA, 20 bp, Artificial
  CRISPR gRNA sequence
gtttgaataatagggactgc

SEQ ID NO: 334444 - DNA, 20 bp, Artificial
  CRISPR gRNA sequence
gaataatagggactgctata

SEQ ID NO: 334445 - DNA, 20 bp, Artificial
  CRISPR gRNA sequence
aataatagggactgctataa

SEQ ID NO: 334446 - DNA, 20 bp, Artificial
  CRISPR gRNA sequence
ctataactgaagactagaac

SEQ ID NO: 334447 - DNA, 20 bp, Artificial
  CRISPR gRNA sequence
taactgaagactagaacact

SEQ ID NO: 334448 - DNA, 20 bp, Artificial
  CRISPR gRNA sequence
aagactagaacacttgtgct

SEQ ID NO: 334449 - DNA, 20 bp, Artificial
  CRISPR gRNA sequence
gaacacttgtgcttattttc

SEQ ID NO: 334450 - DNA, 20 bp, Artificial
  CRISPR gRNA sequence
gtgcttattttcacaatcaa

SEQ ID NO: 334451 - DNA, 20 bp, Artificial
  CRISPR gRNA sequence
tgcttattttcacaatcaaa

SEQ ID NO: 334452 - DNA, 20 bp, Artificial
  CRISPR gRNA sequence
attttcacaatcaaatcacc

SEQ ID NO: 334453 - DNA, 20 bp, Artificial
  CRISPR gRNA sequence
ttttcacaatcaaatcaccc

SEQ ID NO: 334454 - DNA, 20 bp, Artificial
  CRISPR gRNA sequence
tcacaatcaaatcacccaaa

SEQ ID NO: 334455 - DNA, 20 bp, Artificial
  CRISPR gRNA sequence
cacaatcaaatcacccaaat

SEQ ID NO: 334456 - DNA, 20 bp, Artificial
  CRISPR gRNA sequence
acaatcaaatcacccaaatt

SEQ ID NO: 334457 - DNA, 20 bp, Artificial
  CRISPR gRNA sequence
aagatatatagggaaaatat

SEQ ID NO: 334458 - DNA, 20 bp, Artificial
  CRISPR gRNA sequence
aagcccagggtcattaagaa

SEQ ID NO: 334459 - DNA, 20 bp, Artificial
  CRISPR gRNA sequence
agaaaataagtaattgtgta

SEQ ID NO: 334460 - DNA, 20 bp, Artificial
  CRISPR gRNA sequence
tgtatcttaaataaaattaa

SEQ ID NO: 334461 - DNA, 20 bp, Artificial
  CRISPR gRNA sequence
aaataaaattaaggcaacta

SEQ ID NO: 334462 - DNA, 20 bp, Artificial
  CRISPR gRNA sequence
aataaaattaaggcaactag

SEQ ID NO: 334463 - DNA, 20 bp, Artificial
  CRISPR gRNA sequence
aggcaactagtgtaagtaga

SEQ ID NO: 334464 - DNA, 20 bp, Artificial
  CRISPR gRNA sequence
gtgtaagtagaggtgtgaca

SEQ ID NO: 334465 - DNA, 20 bp, Artificial
  CRISPR gRNA sequence
ctgcataatgctaatcctgt

SEQ ID NO: 334466 - DNA, 20 bp, Artificial
  CRISPR gRNA sequence
cataatgctaatcctgttac

SEQ ID NO: 334467 - DNA, 20 bp, Artificial
  CRISPR gRNA sequence
atcctgttacaaatttcaga

SEQ ID NO: 334468 - DNA, 20 bp, Artificial
  CRISPR gRNA sequence
ttacaaatttcagaaagcaa

SEQ ID NO: 334469 - DNA, 20 bp, Artificial
  CRISPR gRNA sequence
caaatttcagaaagcaaaat

SEQ ID NO: 334470 - DNA, 20 bp, Artificial
  CRISPR gRNA sequence
cagaaagcaaaatggcaata

SEQ ID NO: 334471 - DNA, 20 bp, Artificial
  CRISPR gRNA sequence
agaaagcaaaatggcaatac

SEQ ID NO: 334472 - DNA, 20 bp, Artificial
  CRISPR gRNA sequence
taacttttaaacattttgac

SEQ ID NO: 334473 - DNA, 20 bp, Artificial
  CRISPR gRNA sequence
ttaaacattttgaccaaatg

SEQ ID NO: 334474 - DNA, 20 bp, Artificial
  CRISPR gRNA sequence
taaacattttgaccaaatgt

SEQ ID NO: 334475 - DNA, 20 bp, Artificial
  CRISPR gRNA sequence
aaacattttgaccaaatgtc

SEQ ID NO: 334476 - DNA, 20 bp, Artificial
  CRISPR gRNA sequence
aacattttgaccaaatgtca

SEQ ID NO: 334477 - DNA, 20 bp, Artificial
  CRISPR gRNA sequence
tgaccaaatgtcataatatt

SEQ ID NO: 334478 - DNA, 20 bp, Artificial
  CRISPR gRNA sequence
gaccaaatgtcataatattt

SEQ ID NO: 334479 - DNA, 20 bp, Artificial
  CRISPR gRNA sequence
accaaatgtcataatattta

SEQ ID NO: 334480 - DNA, 20 bp, Artificial
  CRISPR gRNA sequence
acataaaagcaaaatgctga

SEQ ID NO: 334481 - DNA, 20 bp, Artificial
  CRISPR gRNA sequence
cataaaagcaaaatgctgaa

SEQ ID NO: 334482 - DNA, 20 bp, Artificial
  CRISPR gRNA sequence
aaaataatcccaatatccaa

SEQ ID NO: 334483 - DNA, 20 bp, Artificial
  CRISPR gRNA sequence
gtattttagttttaacaaat

SEQ ID NO: 334484 - DNA, 20 bp, Artificial
  CRISPR gRNA sequence
tagttttaacaaattatgat

SEQ ID NO: 334485 - DNA, 20 bp, Artificial
  CRISPR gRNA sequence
agttttaacaaattatgata

SEQ ID NO: 334486 - DNA, 20 bp, Artificial
  CRISPR gRNA sequence
gttttaacaaattatgatag

SEQ ID NO: 334487 - DNA, 20 bp, Artificial
  CRISPR gRNA sequence
taacaaattatgatagatta

SEQ ID NO: 334488 - DNA, 20 bp, Artificial
  CRISPR gRNA sequence
aacaaattatgatagattaa

SEQ ID NO: 334489 - DNA, 20 bp, Artificial
  CRISPR gRNA sequence
acaaattatgatagattaac

SEQ ID NO: 334490 - DNA, 20 bp, Artificial
  CRISPR gRNA sequence
tgatagattaacattttggc

SEQ ID NO: 334491 - DNA, 20 bp, Artificial
  CRISPR gRNA sequence
acattttggccaataatata

SEQ ID NO: 334492 - DNA, 20 bp, Artificial
  CRISPR gRNA sequence
tggccaataatatagtcatt

SEQ ID NO: 334493 - DNA, 20 bp, Artificial
  CRISPR gRNA sequence
ggccaataatatagtcatta

SEQ ID NO: 334494 - DNA, 20 bp, Artificial
  CRISPR gRNA sequence
gccaataatatagtcattaa

SEQ ID NO: 334495 - DNA, 20 bp, Artificial
  CRISPR gRNA sequence
aaaaggataattatgatgac

SEQ ID NO: 334496 - DNA, 20 bp, Artificial
  CRISPR gRNA sequence
tgatgactaaaaatgaaatg

SEQ ID NO: 334497 - DNA, 20 bp, Artificial
  CRISPR gRNA sequence
aaaatgaaatgtttatgaca

SEQ ID NO: 334498 - DNA, 20 bp, Artificial
  CRISPR gRNA sequence
atgacataaaataacaatag

SEQ ID NO: 334499 - DNA, 20 bp, Artificial
  CRISPR gRNA sequence
tgacataaaataacaatagc

SEQ ID NO: 334500 - DNA, 20 bp, Artificial
  CRISPR gRNA sequence
gctataaataataagtatgt

SEQ ID NO: 334501 - DNA, 20 bp, Artificial
  CRISPR gRNA sequence
ctataaataataagtatgtt

SEQ ID NO: 334502 - DNA, 20 bp, Artificial
  CRISPR gRNA sequence
taaataataagtatgttttt

SEQ ID NO: 334503 - DNA, 20 bp, Artificial
  CRISPR gRNA sequence
ttgcaagataaagagcaaaa

SEQ ID NO: 334504 - DNA, 20 bp, Artificial
  CRISPR gRNA sequence
tgcaagataaagagcaaaaa

SEQ ID NO: 334505 - DNA, 20 bp, Artificial
  CRISPR gRNA sequence
gcaagataaagagcaaaaat

SEQ ID NO: 334506 - DNA, 20 bp, Artificial
  CRISPR gRNA sequence
caagataaagagcaaaaata

SEQ ID NO: 334507 - DNA, 20 bp, Artificial
  CRISPR gRNA sequence
ctatttcactgtagaactag

SEQ ID NO: 334508 - DNA, 20 bp, Artificial
  CRISPR gRNA sequence
tatttcactgtagaactagg

SEQ ID NO: 334509 - DNA, 20 bp, Artificial
  CRISPR gRNA sequence
tttcactgtagaactaggta

SEQ ID NO: 334510 - DNA, 20 bp, Artificial
  CRISPR gRNA sequence
cactgtagaactaggtaatt

SEQ ID NO: 334511 - DNA, 20 bp, Artificial
  CRISPR gRNA sequence
actgtagaactaggtaattt

SEQ ID NO: 334512 - DNA, 20 bp, Artificial
  CRISPR gRNA sequence
tagaactaggtaattttttt

SEQ ID NO: 334513 - DNA, 20 bp, Artificial
  CRISPR gRNA sequence
ggtaatttttttccttaaaa

SEQ ID NO: 334514 - DNA, 20 bp, Artificial
  CRISPR gRNA sequence
ttttccttaaaattttttta

SEQ ID NO: 334515 - DNA, 20 bp, Artificial
  CRISPR gRNA sequence
tttccttaaaatttttttac

SEQ ID NO: 334516 - DNA, 20 bp, Artificial
  CRISPR gRNA sequence
ttccttaaaatttttttaca

SEQ ID NO: 334517 - DNA, 20 bp, Artificial
  CRISPR gRNA sequence
tccttaaaatttttttacac

SEQ ID NO: 334518 - DNA, 20 bp, Artificial
  CRISPR gRNA sequence
ccttaaaatttttttacact

SEQ ID NO: 334519 - DNA, 20 bp, Artificial
  CRISPR gRNA sequence
cttaaaatttttttacactt

SEQ ID NO: 334520 - DNA, 20 bp, Artificial
  CRISPR gRNA sequence
aaaatttttttacacttaca

SEQ ID NO: 334521 - DNA, 20 bp, Artificial
  CRISPR gRNA sequence
aaatttttttacacttacat

SEQ ID NO: 334522 - DNA, 20 bp, Artificial
  CRISPR gRNA sequence
ttttacacttacatagtttt

SEQ ID NO: 334523 - DNA, 20 bp, Artificial
  CRISPR gRNA sequence
tttacacttacatagttttc

SEQ ID NO: 334524 - DNA, 20 bp, Artificial
  CRISPR gRNA sequence
ttacacttacatagttttct

SEQ ID NO: 334525 - DNA, 20 bp, Artificial
  CRISPR gRNA sequence
tacacttacatagttttctc

SEQ ID NO: 334526 - DNA, 20 bp, Artificial
  CRISPR gRNA sequence
acacttacatagttttctca

SEQ ID NO: 334527 - DNA, 20 bp, Artificial
  CRISPR gRNA sequence
cacttacatagttttctcaa

SEQ ID NO: 334528 - DNA, 20 bp, Artificial
  CRISPR gRNA sequence
acatagttttctcaaaaaca

SEQ ID NO: 334529 - DNA, 20 bp, Artificial
  CRISPR gRNA sequence
catagttttctcaaaaacaa

SEQ ID NO: 334530 - DNA, 20 bp, Artificial
  CRISPR gRNA sequence
tctcaaaaacaaagaccaag

SEQ ID NO: 334531 - DNA, 20 bp, Artificial
  CRISPR gRNA sequence
ctcaaaaacaaagaccaaga

SEQ ID NO: 334532 - DNA, 20 bp, Artificial
  CRISPR gRNA sequence
tcaaaaacaaagaccaagat

SEQ ID NO: 334533 - DNA, 20 bp, Artificial
  CRISPR gRNA sequence
aaaaacaaagaccaagattt

SEQ ID NO: 334534 - DNA, 20 bp, Artificial
  CRISPR gRNA sequence
caaaacttaggaaaaaacca

SEQ ID NO: 334535 - DNA, 20 bp, Artificial
  CRISPR gRNA sequence
aaaacttaggaaaaaaccag

SEQ ID NO: 334536 - DNA, 20 bp, Artificial
  CRISPR gRNA sequence
aggaaaaaaccagcatacta

SEQ ID NO: 334537 - DNA, 20 bp, Artificial
  CRISPR gRNA sequence
ggaaaaaaccagcatactaa

SEQ ID NO: 334538 - DNA, 20 bp, Artificial
  CRISPR gRNA sequence
ataattttcccaaacaattt

SEQ ID NO: 334539 - DNA, 20 bp, Artificial
  CRISPR gRNA sequence
tcccaaacaatttcagcatg

SEQ ID NO: 334540 - DNA, 20 bp, Artificial
  CRISPR gRNA sequence
cccaaacaatttcagcatga

SEQ ID NO: 334541 - DNA, 20 bp, Artificial
  CRISPR gRNA sequence
ccaaacaatttcagcatgaa

SEQ ID NO: 334542 - DNA, 20 bp, Artificial
  CRISPR gRNA sequence
cagcatgaaaatttgtcata

SEQ ID NO: 334543 - DNA, 20 bp, Artificial
  CRISPR gRNA sequence
agcatgaaaatttgtcatat

SEQ ID NO: 334544 - DNA, 20 bp, Artificial
  CRISPR gRNA sequence
gtcatattaaaaaggaaaat

SEQ ID NO: 334545 - DNA, 20 bp, Artificial
  CRISPR gRNA sequence
tcatattaaaaaggaaaata

SEQ ID NO: 334546 - DNA, 20 bp, Artificial
  CRISPR gRNA sequence
aaaaggaaaataaaacaaaa

SEQ ID NO: 334547 - DNA, 20 bp, Artificial
  CRISPR gRNA sequence
gaatttatagtctaataact

SEQ ID NO: 334548 - DNA, 20 bp, Artificial
  CRISPR gRNA sequence
aatttatagtctaataactc

SEQ ID NO: 334549 - DNA, 20 bp, Artificial
  CRISPR gRNA sequence
atagtctaataactcagaat

SEQ ID NO: 334550 - DNA, 20 bp, Artificial
  CRISPR gRNA sequence
tagtctaataactcagaatc

SEQ ID NO: 334551 - DNA, 20 bp, Artificial
  CRISPR gRNA sequence
ataactcagaatctgcaacc

SEQ ID NO: 334552 - DNA, 20 bp, Artificial
  CRISPR gRNA sequence
agaatctgcaaccaccaggc

SEQ ID NO: 334553 - DNA, 20 bp, Artificial
  CRISPR gRNA sequence
caaccaccaggccaaggtga

SEQ ID NO: 334554 - DNA, 20 bp, Artificial
  CRISPR gRNA sequence
cagttttttccttctgtgat

SEQ ID NO: 334555 - DNA, 20 bp, Artificial
  CRISPR gRNA sequence
agttttttccttctgtgatt

SEQ ID NO: 334556 - DNA, 20 bp, Artificial
  CRISPR gRNA sequence
tttccttctgtgattcccat

SEQ ID NO: 334557 - DNA, 20 bp, Artificial
  CRISPR gRNA sequence
ttccttctgtgattcccatg

SEQ ID NO: 334558 - DNA, 20 bp, Artificial
  CRISPR gRNA sequence
tccttctgtgattcccatgt

SEQ ID NO: 334559 - DNA, 20 bp, Artificial
  CRISPR gRNA sequence
ccttctgtgattcccatgta

SEQ ID NO: 334560 - DNA, 20 bp, Artificial
  CRISPR gRNA sequence
cttctgtgattcccatgtag

SEQ ID NO: 334561 - DNA, 20 bp, Artificial
  CRISPR gRNA sequence
ctgtgattcccatgtagctt

SEQ ID NO: 334562 - DNA, 20 bp, Artificial
  CRISPR gRNA sequence
tgtgattcccatgtagcttg

SEQ ID NO: 334563 - DNA, 20 bp, Artificial
  CRISPR gRNA sequence
tgattcccatgtagcttgca

SEQ ID NO: 334564 - DNA, 20 bp, Artificial
  CRISPR gRNA sequence
ccatgtagcttgcaaaaaca

SEQ ID NO: 334565 - DNA, 20 bp, Artificial
  CRISPR gRNA sequence
gcaaaaacaaccttggcttc

SEQ ID NO: 334566 - DNA, 20 bp, Artificial
  CRISPR gRNA sequence
caaaaacaaccttggcttcc

SEQ ID NO: 334567 - DNA, 20 bp, Artificial
  CRISPR gRNA sequence
ggcttcctataagcataaat

SEQ ID NO: 334568 - DNA, 20 bp, Artificial
  CRISPR gRNA sequence
gcttcctataagcataaatt

SEQ ID NO: 334569 - DNA, 20 bp, Artificial
  CRISPR gRNA sequence
cctataagcataaatttatt

SEQ ID NO: 334570 - DNA, 20 bp, Artificial
  CRISPR gRNA sequence
ctataagcataaatttattt

SEQ ID NO: 334571 - DNA, 20 bp, Artificial
  CRISPR gRNA sequence
taagcataaatttatttcag

SEQ ID NO: 334572 - DNA, 20 bp, Artificial
  CRISPR gRNA sequence
atttcagaaaatgaaaaagt

SEQ ID NO: 334573 - DNA, 20 bp, Artificial
  CRISPR gRNA sequence
tttcagaaaatgaaaaagtg

SEQ ID NO: 334574 - DNA, 20 bp, Artificial
  CRISPR gRNA sequence
cagaaaatgaaaaagtgggg

SEQ ID NO: 334575 - DNA, 20 bp, Artificial
  CRISPR gRNA sequence
agaaaatgaaaaagtggggc

SEQ ID NO: 334576 - DNA, 20 bp, Artificial
  CRISPR gRNA sequence
ggcatggtggttcacgtctg

SEQ ID NO: 334577 - DNA, 20 bp, Artificial
  CRISPR gRNA sequence
acgtctgtaatcctagcact

SEQ ID NO: 334578 - DNA, 20 bp, Artificial
  CRISPR gRNA sequence
taatcctagcactttaagag

SEQ ID NO: 334579 - DNA, 20 bp, Artificial
  CRISPR gRNA sequence
gcactttaagaggctgaggc

SEQ ID NO: 334580 - DNA, 20 bp, Artificial
  CRISPR gRNA sequence
taagaggctgaggcaggagg

SEQ ID NO: 334581 - DNA, 20 bp, Artificial
  CRISPR gRNA sequence
aagaggctgaggcaggagga

SEQ ID NO: 334582 - DNA, 20 bp, Artificial
  CRISPR gRNA sequence
agaggctgaggcaggaggat

SEQ ID NO: 334583 - DNA, 20 bp, Artificial
  CRISPR gRNA sequence
aggcaggaggattgcttgag

SEQ ID NO: 334584 - DNA, 20 bp, Artificial
  CRISPR gRNA sequence
cttgaggccaggagttcaag

SEQ ID NO: 334585 - DNA, 20 bp, Artificial
  CRISPR gRNA sequence
gaggccaggagttcaagacc

SEQ ID NO: 334586 - DNA, 20 bp, Artificial
  CRISPR gRNA sequence
aggccaggagttcaagacca

SEQ ID NO: 334587 - DNA, 20 bp, Artificial
  CRISPR gRNA sequence
aagaccagcctgggcaacat

SEQ ID NO: 334588 - DNA, 20 bp, Artificial
  CRISPR gRNA sequence
ggcaacatagcaagacctgt

SEQ ID NO: 334589 - DNA, 20 bp, Artificial
  CRISPR gRNA sequence
tctctacaaaatttcttttt

SEQ ID NO: 334590 - DNA, 20 bp, Artificial
  CRISPR gRNA sequence
tacaaaatttctttttcaaa

SEQ ID NO: 334591 - DNA, 20 bp, Artificial
  CRISPR gRNA sequence
caaaatttctttttcaaagt

SEQ ID NO: 334592 - DNA, 20 bp, Artificial
  CRISPR gRNA sequence
ctttttcaaagttagccaga

SEQ ID NO: 334593 - DNA, 20 bp, Artificial
  CRISPR gRNA sequence
tttttcaaagttagccagat

SEQ ID NO: 334594 - DNA, 20 bp, Artificial
  CRISPR gRNA sequence
tttcaaagttagccagatat

SEQ ID NO: 334595 - DNA, 20 bp, Artificial
  CRISPR gRNA sequence
ttcaaagttagccagatatg

SEQ ID NO: 334596 - DNA, 20 bp, Artificial
  CRISPR gRNA sequence
tcaaagttagccagatatgg

SEQ ID NO: 334597 - DNA, 20 bp, Artificial
  CRISPR gRNA sequence
caaagttagccagatatggt

SEQ ID NO: 334598 - DNA, 20 bp, Artificial
  CRISPR gRNA sequence
aaagttagccagatatggtg

SEQ ID NO: 334599 - DNA, 20 bp, Artificial
  CRISPR gRNA sequence
gccagatatggtggtgtgtg

SEQ ID NO: 334600 - DNA, 20 bp, Artificial
  CRISPR gRNA sequence
tattcccagcttcttgggag

SEQ ID NO: 334601 - DNA, 20 bp, Artificial
  CRISPR gRNA sequence
ccagcttcttgggaggctga

SEQ ID NO: 334602 - DNA, 20 bp, Artificial
  CRISPR gRNA sequence
cttgggaggctgaggcagga

SEQ ID NO: 334603 - DNA, 20 bp, Artificial
  CRISPR gRNA sequence
ttgggaggctgaggcaggag

SEQ ID NO: 334604 - DNA, 20 bp, Artificial
  CRISPR gRNA sequence
gggaggctgaggcaggaggg

SEQ ID NO: 334605 - DNA, 20 bp, Artificial
  CRISPR gRNA sequence
ggaggctgaggcaggaggga

SEQ ID NO: 334606 - DNA, 20 bp, Artificial
  CRISPR gRNA sequence
aggcaggagggacccttgag

SEQ ID NO: 334607 - DNA, 20 bp, Artificial
  CRISPR gRNA sequence
gagtcaaggaagtggaggct

SEQ ID NO: 334608 - DNA, 20 bp, Artificial
  CRISPR gRNA sequence
agtcaaggaagtggaggcta

SEQ ID NO: 334609 - DNA, 20 bp, Artificial
  CRISPR gRNA sequence
caacgagctaggatcatgcc

SEQ ID NO: 334610 - DNA, 20 bp, Artificial
  CRISPR gRNA sequence
ggatcatgccactgcactgt

SEQ ID NO: 334611 - DNA, 20 bp, Artificial
  CRISPR gRNA sequence
cactgtagcctggggaacag

SEQ ID NO: 334612 - DNA, 20 bp, Artificial
  CRISPR gRNA sequence
tagcctggggaacagagtaa

SEQ ID NO: 334613 - DNA, 20 bp, Artificial
  CRISPR gRNA sequence
gggaacagagtaaacccttt

SEQ ID NO: 334614 - DNA, 20 bp, Artificial
  CRISPR gRNA sequence
ttctctgaaaagaaaagaaa

SEQ ID NO: 334615 - DNA, 20 bp, Artificial
  CRISPR gRNA sequence
tctctgaaaagaaaagaaaa

SEQ ID NO: 334616 - DNA, 20 bp, Artificial
  CRISPR gRNA sequence
ctctgaaaagaaaagaaaag

SEQ ID NO: 334617 - DNA, 20 bp, Artificial
  CRISPR gRNA sequence
tctgaaaagaaaagaaaaga

SEQ ID NO: 334618 - DNA, 20 bp, Artificial
  CRISPR gRNA sequence
tgaaaagaaaagaaaagaaa

SEQ ID NO: 334619 - DNA, 20 bp, Artificial
  CRISPR gRNA sequence
aaaagaaaagaaaagaaaag

SEQ ID NO: 334620 - DNA, 20 bp, Artificial
  CRISPR gRNA sequence
gggctttatctttattatca

SEQ ID NO: 334621 - DNA, 20 bp, Artificial
  CRISPR gRNA sequence
tatctttattatcaggcctt

SEQ ID NO: 334622 - DNA, 20 bp, Artificial
  CRISPR gRNA sequence
atctttattatcaggccttg

SEQ ID NO: 334623 - DNA, 20 bp, Artificial
  CRISPR gRNA sequence
tctttattatcaggccttga

SEQ ID NO: 334624 - DNA, 20 bp, Artificial
  CRISPR gRNA sequence
tattatcaggccttgattca

SEQ ID NO: 334625 - DNA, 20 bp, Artificial
  CRISPR gRNA sequence
attatcaggccttgattcag

SEQ ID NO: 334626 - DNA, 20 bp, Artificial
  CRISPR gRNA sequence
ttatcaggccttgattcagt

SEQ ID NO: 334627 - DNA, 20 bp, Artificial
  CRISPR gRNA sequence
tcaggccttgattcagttct

SEQ ID NO: 334628 - DNA, 20 bp, Artificial
  CRISPR gRNA sequence
gattcagttctcagtggatg

SEQ ID NO: 334629 - DNA, 20 bp, Artificial
  CRISPR gRNA sequence
attcagttctcagtggatga

SEQ ID NO: 334630 - DNA, 20 bp, Artificial
  CRISPR gRNA sequence
agttctcagtggatgaggtt

SEQ ID NO: 334631 - DNA, 20 bp, Artificial
  CRISPR gRNA sequence
tcagtggatgaggtttggag

SEQ ID NO: 334632 - DNA, 20 bp, Artificial
  CRISPR gRNA sequence
agtggatgaggtttggagaa

SEQ ID NO: 334633 - DNA, 20 bp, Artificial
  CRISPR gRNA sequence
ggagaaaatacatttctgtc

SEQ ID NO: 334634 - DNA, 20 bp, Artificial
  CRISPR gRNA sequence
gagaaaatacatttctgtca

SEQ ID NO: 334635 - DNA, 20 bp, Artificial
  CRISPR gRNA sequence
ctgtcatttgaaaatgatta

SEQ ID NO: 334636 - DNA, 20 bp, Artificial
  CRISPR gRNA sequence
tgtcatttgaaaatgattag

SEQ ID NO: 334637 - DNA, 20 bp, Artificial
  CRISPR gRNA sequence
tcatttgaaaatgattagtc

SEQ ID NO: 334638 - DNA, 20 bp, Artificial
  CRISPR gRNA sequence
gaaaatgattagtctgttct

SEQ ID NO: 334639 - DNA, 20 bp, Artificial
  CRISPR gRNA sequence
aaaatgattagtctgttctt

SEQ ID NO: 334640 - DNA, 20 bp, Artificial
  CRISPR gRNA sequence
gtctgttcttttactcttta

SEQ ID NO: 334641 - DNA, 20 bp, Artificial
  CRISPR gRNA sequence
ttcttttactctttagcagg

SEQ ID NO: 334642 - DNA, 20 bp, Artificial
  CRISPR gRNA sequence
ttttactctttagcaggagg

SEQ ID NO: 334643 - DNA, 20 bp, Artificial
  CRISPR gRNA sequence
ttactctttagcaggaggac

SEQ ID NO: 334644 - DNA, 20 bp, Artificial
  CRISPR gRNA sequence
tactctttagcaggaggaca

SEQ ID NO: 334645 - DNA, 20 bp, Artificial
  CRISPR gRNA sequence
actctttagcaggaggacat

SEQ ID NO: 334646 - DNA, 20 bp, Artificial
  CRISPR gRNA sequence
ctctttagcaggaggacata

SEQ ID NO: 334647 - DNA, 20 bp, Artificial
  CRISPR gRNA sequence
tttagcaggaggacataatg

SEQ ID NO: 334648 - DNA, 20 bp, Artificial
  CRISPR gRNA sequence
tagcaggaggacataatgta

SEQ ID NO: 334649 - DNA, 20 bp, Artificial
  CRISPR gRNA sequence
agcaggaggacataatgtat

SEQ ID NO: 334650 - DNA, 20 bp, Artificial
  CRISPR gRNA sequence
gcaggaggacataatgtatg

SEQ ID NO: 334651 - DNA, 20 bp, Artificial
  CRISPR gRNA sequence
tttgtatatatacacacaca

SEQ ID NO: 334652 - DNA, 20 bp, Artificial
  CRISPR gRNA sequence
gtatatatacacacacatag

SEQ ID NO: 334653 - DNA, 20 bp, Artificial
  CRISPR gRNA sequence
tatatatacacacacatagt

SEQ ID NO: 334654 - DNA, 20 bp, Artificial
  CRISPR gRNA sequence
tatatattgtaatatacata

SEQ ID NO: 334655 - DNA, 20 bp, Artificial
  CRISPR gRNA sequence
tatattgtaatatacatata

SEQ ID NO: 334656 - DNA, 20 bp, Artificial
  CRISPR gRNA sequence
taatatacatatacatataa

SEQ ID NO: 334657 - DNA, 20 bp, Artificial
  CRISPR gRNA sequence
taatatataatatgtaatat

SEQ ID NO: 334658 - DNA, 20 bp, Artificial
  CRISPR gRNA sequence
aatatataatatgtaatata

SEQ ID NO: 334659 - DNA, 20 bp, Artificial
  CRISPR gRNA sequence
atatataatatgtaatatac

SEQ ID NO: 334660 - DNA, 20 bp, Artificial
  CRISPR gRNA sequence
ttcatttttaaactacttcg

SEQ ID NO: 334661 - DNA, 20 bp, Artificial
  CRISPR gRNA sequence
atttttaaactacttcgtac

SEQ ID NO: 334662 - DNA, 20 bp, Artificial
  CRISPR gRNA sequence
ttaaactacttcgtactttt

SEQ ID NO: 334663 - DNA, 20 bp, Artificial
  CRISPR gRNA sequence
taaactacttcgtactttta

SEQ ID NO: 334664 - DNA, 20 bp, Artificial
  CRISPR gRNA sequence
aaactacttcgtacttttac

SEQ ID NO: 334665 - DNA, 20 bp, Artificial
  CRISPR gRNA sequence
aactacttcgtacttttaca

SEQ ID NO: 334666 - DNA, 20 bp, Artificial
  CRISPR gRNA sequence
cttcgtacttttacaaagtg

SEQ ID NO: 334667 - DNA, 20 bp, Artificial
  CRISPR gRNA sequence
cgtacttttacaaagtgagc

SEQ ID NO: 334668 - DNA, 20 bp, Artificial
  CRISPR gRNA sequence
gtacttttacaaagtgagca

SEQ ID NO: 334669 - DNA, 20 bp, Artificial
  CRISPR gRNA sequence
ttacaaagtgagcaatttct

SEQ ID NO: 334670 - DNA, 20 bp, Artificial
  CRISPR gRNA sequence
tacaaagtgagcaatttcta

SEQ ID NO: 334671 - DNA, 20 bp, Artificial
  CRISPR gRNA sequence
acaaagtgagcaatttctat

SEQ ID NO: 334672 - DNA, 20 bp, Artificial
  CRISPR gRNA sequence
caaagtgagcaatttctatc

SEQ ID NO: 334673 - DNA, 20 bp, Artificial
  CRISPR gRNA sequence
ctatctttccttttatctgc

SEQ ID NO: 334674 - DNA, 20 bp, Artificial
  CRISPR gRNA sequence
tatctttccttttatctgct

SEQ ID NO: 334675 - DNA, 20 bp, Artificial
  CRISPR gRNA sequence
tctttccttttatctgcttt

SEQ ID NO: 334676 - DNA, 20 bp, Artificial
  CRISPR gRNA sequence
tccttttatctgctttactg

SEQ ID NO: 334677 - DNA, 20 bp, Artificial
  CRISPR gRNA sequence
ccttttatctgctttactga

SEQ ID NO: 334678 - DNA, 20 bp, Artificial
  CRISPR gRNA sequence
cttttatctgctttactgat

SEQ ID NO: 334679 - DNA, 20 bp, Artificial
  CRISPR gRNA sequence
ttatctgctttactgatgta

SEQ ID NO: 334680 - DNA, 20 bp, Artificial
  CRISPR gRNA sequence
tatctgctttactgatgtac

SEQ ID NO: 334681 - DNA, 20 bp, Artificial
  CRISPR gRNA sequence
atctgctttactgatgtaca

SEQ ID NO: 334682 - DNA, 20 bp, Artificial
  CRISPR gRNA sequence
tctgctttactgatgtacat

SEQ ID NO: 334683 - DNA, 20 bp, Artificial
  CRISPR gRNA sequence
ctttactgatgtacatcagt

SEQ ID NO: 334684 - DNA, 20 bp, Artificial
  CRISPR gRNA sequence
tactgatgtacatcagtgat

SEQ ID NO: 334685 - DNA, 20 bp, Artificial
  CRISPR gRNA sequence
actgatgtacatcagtgatt

SEQ ID NO: 334686 - DNA, 20 bp, Artificial
  CRISPR gRNA sequence
ctgatgtacatcagtgatta

SEQ ID NO: 334687 - DNA, 20 bp, Artificial
  CRISPR gRNA sequence
atgtacatcagtgattattt

SEQ ID NO: 334688 - DNA, 20 bp, Artificial
  CRISPR gRNA sequence
tttactcatcagaagtacac

SEQ ID NO: 334689 - DNA, 20 bp, Artificial
  CRISPR gRNA sequence
actcatcagaagtacacatg

SEQ ID NO: 334690 - DNA, 20 bp, Artificial
  CRISPR gRNA sequence
ctcatcagaagtacacatgg

SEQ ID NO: 334691 - DNA, 20 bp, Artificial
  CRISPR gRNA sequence
atcagaagtacacatggttc

SEQ ID NO: 334692 - DNA, 20 bp, Artificial
  CRISPR gRNA sequence
ttgtcagagtagtttgatca

SEQ ID NO: 334693 - DNA, 20 bp, Artificial
  CRISPR gRNA sequence
gtcagagtagtttgatcaac

SEQ ID NO: 334694 - DNA, 20 bp, Artificial
  CRISPR gRNA sequence
tcagagtagtttgatcaaca

SEQ ID NO: 334695 - DNA, 20 bp, Artificial
  CRISPR gRNA sequence
gatcaacaggtagacaattc

SEQ ID NO: 334696 - DNA, 20 bp, Artificial
  CRISPR gRNA sequence
atcaacaggtagacaattcc

SEQ ID NO: 334697 - DNA, 20 bp, Artificial
  CRISPR gRNA sequence
cttctccccaagatatacct

SEQ ID NO: 334698 - DNA, 20 bp, Artificial
  CRISPR gRNA sequence
ctccccaagatatacctact

SEQ ID NO: 334699 - DNA, 20 bp, Artificial
  CRISPR gRNA sequence
tccccaagatatacctacta

SEQ ID NO: 334700 - DNA, 20 bp, Artificial
  CRISPR gRNA sequence
cccaagatatacctactaat

SEQ ID NO: 334701 - DNA, 20 bp, Artificial
  CRISPR gRNA sequence
ctaataaatgaagtttttcc

SEQ ID NO: 334702 - DNA, 20 bp, Artificial
  CRISPR gRNA sequence
ataaatgaagtttttcctaa

SEQ ID NO: 334703 - DNA, 20 bp, Artificial
  CRISPR gRNA sequence
ttcctaaacttcaacttttc

SEQ ID NO: 334704 - DNA, 20 bp, Artificial
  CRISPR gRNA sequence
tcctaaacttcaacttttcc

SEQ ID NO: 334705 - DNA, 20 bp, Artificial
  CRISPR gRNA sequence
cctaaacttcaacttttccc

SEQ ID NO: 334706 - DNA, 20 bp, Artificial
  CRISPR gRNA sequence
ctaaacttcaacttttccca

SEQ ID NO: 334707 - DNA, 20 bp, Artificial
  CRISPR gRNA sequence
aacttcaacttttcccatat

SEQ ID NO: 334708 - DNA, 20 bp, Artificial
  CRISPR gRNA sequence
caacttttcccatatctctc

SEQ ID NO: 334709 - DNA, 20 bp, Artificial
  CRISPR gRNA sequence
aacttttcccatatctctct

SEQ ID NO: 334710 - DNA, 20 bp, Artificial
  CRISPR gRNA sequence
ttcccatatctctctgttta

SEQ ID NO: 334711 - DNA, 20 bp, Artificial
  CRISPR gRNA sequence
tcccatatctctctgtttag

SEQ ID NO: 334712 - DNA, 20 bp, Artificial
  CRISPR gRNA sequence
cccatatctctctgtttagc

SEQ ID NO: 334713 - DNA, 20 bp, Artificial
  CRISPR gRNA sequence
ccatatctctctgtttagct

SEQ ID NO: 334714 - DNA, 20 bp, Artificial
  CRISPR gRNA sequence
tctgtttagctaagtgctac

SEQ ID NO: 334715 - DNA, 20 bp, Artificial
  CRISPR gRNA sequence
tgtttagctaagtgctacta

SEQ ID NO: 334716 - DNA, 20 bp, Artificial
  CRISPR gRNA sequence
tttagctaagtgctactaat

SEQ ID NO: 334717 - DNA, 20 bp, Artificial
  CRISPR gRNA sequence
agctaagtgctactaatcct

SEQ ID NO: 334718 - DNA, 20 bp, Artificial
  CRISPR gRNA sequence
gctaagtgctactaatcctt

SEQ ID NO: 334719 - DNA, 20 bp, Artificial
  CRISPR gRNA sequence
agtgctactaatcctttaat

SEQ ID NO: 334720 - DNA, 20 bp, Artificial
  CRISPR gRNA sequence
ctaatcctttaattccaatt

SEQ ID NO: 334721 - DNA, 20 bp, Artificial
  CRISPR gRNA sequence
atcctttaattccaatttta

SEQ ID NO: 334722 - DNA, 20 bp, Artificial
  CRISPR gRNA sequence
taattccaattttaaaactc

SEQ ID NO: 334723 - DNA, 20 bp, Artificial
  CRISPR gRNA sequence
aattccaattttaaaactca

SEQ ID NO: 334724 - DNA, 20 bp, Artificial
  CRISPR gRNA sequence
attccaattttaaaactcac

SEQ ID NO: 334725 - DNA, 20 bp, Artificial
  CRISPR gRNA sequence
caattttaaaactcacttcc

SEQ ID NO: 334726 - DNA, 20 bp, Artificial
  CRISPR gRNA sequence
taaaactcacttcctcaagg

SEQ ID NO: 334727 - DNA, 20 bp, Artificial
  CRISPR gRNA sequence
aaaactcacttcctcaaggc

SEQ ID NO: 334728 - DNA, 20 bp, Artificial
  CRISPR gRNA sequence
aaactcacttcctcaaggcg

SEQ ID NO: 334729 - DNA, 20 bp, Artificial
  CRISPR gRNA sequence
acttcctcaaggcggcattt

SEQ ID NO: 334730 - DNA, 20 bp, Artificial
  CRISPR gRNA sequence
cctcaaggcggcattttctg

SEQ ID NO: 334731 - DNA, 20 bp, Artificial
  CRISPR gRNA sequence
ctcaaggcggcattttctga

SEQ ID NO: 334732 - DNA, 20 bp, Artificial
  CRISPR gRNA sequence
aaggcggcattttctgattc

SEQ ID NO: 334733 - DNA, 20 bp, Artificial
  CRISPR gRNA sequence
tctgattctataatcaaaat

SEQ ID NO: 334734 - DNA, 20 bp, Artificial
  CRISPR gRNA sequence
ctgattctataatcaaaatt

SEQ ID NO: 334735 - DNA, 20 bp, Artificial
  CRISPR gRNA sequence
tgattctataatcaaaatta

SEQ ID NO: 334736 - DNA, 20 bp, Artificial
  CRISPR gRNA sequence
attctataatcaaaattata

SEQ ID NO: 334737 - DNA, 20 bp, Artificial
  CRISPR gRNA sequence
tataatcaaaattataaccc

SEQ ID NO: 334738 - DNA, 20 bp, Artificial
  CRISPR gRNA sequence
taatcaaaattataacccac

SEQ ID NO: 334739 - DNA, 20 bp, Artificial
  CRISPR gRNA sequence
taacccacctgactctacca

SEQ ID NO: 334740 - DNA, 20 bp, Artificial
  CRISPR gRNA sequence
actctaccaccttcatttaa

SEQ ID NO: 334741 - DNA, 20 bp, Artificial
  CRISPR gRNA sequence
taccaccttcatttaaatag

SEQ ID NO: 334742 - DNA, 20 bp, Artificial
  CRISPR gRNA sequence
ccaccttcatttaaatagta

SEQ ID NO: 334743 - DNA, 20 bp, Artificial
  CRISPR gRNA sequence
catttaaatagtactccatt

SEQ ID NO: 334744 - DNA, 20 bp, Artificial
  CRISPR gRNA sequence
atttaaatagtactccattc

SEQ ID NO: 334745 - DNA, 20 bp, Artificial
  CRISPR gRNA sequence
aaatagtactccattcctat

SEQ ID NO: 334746 - DNA, 20 bp, Artificial
  CRISPR gRNA sequence
aatagtactccattcctatc

SEQ ID NO: 334747 - DNA, 20 bp, Artificial
  CRISPR gRNA sequence
cattcctatcacaaattatg

SEQ ID NO: 334748 - DNA, 20 bp, Artificial
  CRISPR gRNA sequence
ctatcacaaattatgttgca

SEQ ID NO: 334749 - DNA, 20 bp, Artificial
  CRISPR gRNA sequence
tcacaaattatgttgcatta

SEQ ID NO: 334750 - DNA, 20 bp, Artificial
  CRISPR gRNA sequence
tgttgcattactacatattt

SEQ ID NO: 334751 - DNA, 20 bp, Artificial
  CRISPR gRNA sequence
cattactacatatttattcc

SEQ ID NO: 334752 - DNA, 20 bp, Artificial
  CRISPR gRNA sequence
ctacatatttattcctttac

SEQ ID NO: 334753 - DNA, 20 bp, Artificial
  CRISPR gRNA sequence
catatttattcctttaccat

SEQ ID NO: 334754 - DNA, 20 bp, Artificial
  CRISPR gRNA sequence
attcctttaccatctgcctc

SEQ ID NO: 334755 - DNA, 20 bp, Artificial
  CRISPR gRNA sequence
ttcctttaccatctgcctcc

SEQ ID NO: 334756 - DNA, 20 bp, Artificial
  CRISPR gRNA sequence
ctttaccatctgcctccaat

SEQ ID NO: 334757 - DNA, 20 bp, Artificial
  CRISPR gRNA sequence
taccatctgcctccaatatg

SEQ ID NO: 334758 - DNA, 20 bp, Artificial
  CRISPR gRNA sequence
accatctgcctccaatatga

SEQ ID NO: 334759 - DNA, 20 bp, Artificial
  CRISPR gRNA sequence
ccatctgcctccaatatgaa

SEQ ID NO: 334760 - DNA, 20 bp, Artificial
  CRISPR gRNA sequence
cctccaatatgaaagctacc

SEQ ID NO: 334761 - DNA, 20 bp, Artificial
  CRISPR gRNA sequence
caatatgaaagctaccaaag

SEQ ID NO: 334762 - DNA, 20 bp, Artificial
  CRISPR gRNA sequence
ccaaaggacagaggccatac

SEQ ID NO: 334763 - DNA, 20 bp, Artificial
  CRISPR gRNA sequence
gattcatacacactatgtaa

SEQ ID NO: 334764 - DNA, 20 bp, Artificial
  CRISPR gRNA sequence
attcatacacactatgtaaa

SEQ ID NO: 334765 - DNA, 20 bp, Artificial
  CRISPR gRNA sequence
atacacactatgtaaatata

SEQ ID NO: 334766 - DNA, 20 bp, Artificial
  CRISPR gRNA sequence
tgtaaatatattatttaata

SEQ ID NO: 334767 - DNA, 20 bp, Artificial
  CRISPR gRNA sequence
tttaatatttagtatattct

SEQ ID NO: 334768 - DNA, 20 bp, Artificial
  CRISPR gRNA sequence
aatatttagtatattctata

SEQ ID NO: 334769 - DNA, 20 bp, Artificial
  CRISPR gRNA sequence
atatttagtatattctatat

SEQ ID NO: 334770 - DNA, 20 bp, Artificial
  CRISPR gRNA sequence
agtatattctatattcacat

SEQ ID NO: 334771 - DNA, 20 bp, Artificial
  CRISPR gRNA sequence
gtatattctatattcacata

SEQ ID NO: 334772 - DNA, 20 bp, Artificial
  CRISPR gRNA sequence
tatattcacatatgacaagc

SEQ ID NO: 334773 - DNA, 20 bp, Artificial
  CRISPR gRNA sequence
tattcacatatgacaagcaa

SEQ ID NO: 334774 - DNA, 20 bp, Artificial
  CRISPR gRNA sequence
acatatgacaagcaagtttc

SEQ ID NO: 334775 - DNA, 20 bp, Artificial
  CRISPR gRNA sequence
ctggttaggatttttttttc

SEQ ID NO: 334776 - DNA, 20 bp, Artificial
  CRISPR gRNA sequence
tggttaggatttttttttct

SEQ ID NO: 334777 - DNA, 20 bp, Artificial
  CRISPR gRNA sequence
gttaggatttttttttctct

SEQ ID NO: 334778 - DNA, 20 bp, Artificial
  CRISPR gRNA sequence
ggatttttttttctctagga

SEQ ID NO: 334779 - DNA, 20 bp, Artificial
  CRISPR gRNA sequence
ttttttctctaggacatagt

SEQ ID NO: 334780 - DNA, 20 bp, Artificial
  CRISPR gRNA sequence
tttttctctaggacatagtt

SEQ ID NO: 334781 - DNA, 20 bp, Artificial
  CRISPR gRNA sequence
ttttctctaggacatagttt

SEQ ID NO: 334782 - DNA, 20 bp, Artificial
  CRISPR gRNA sequence
tttctctaggacatagtttt

SEQ ID NO: 334783 - DNA, 20 bp, Artificial
  CRISPR gRNA sequence
ttctctaggacatagtttta

SEQ ID NO: 334784 - DNA, 20 bp, Artificial
  CRISPR gRNA sequence
tctctaggacatagttttat

SEQ ID NO: 334785 - DNA, 20 bp, Artificial
  CRISPR gRNA sequence
ctctaggacatagttttatc

SEQ ID NO: 334786 - DNA, 20 bp, Artificial
  CRISPR gRNA sequence
tctaggacatagttttatct

SEQ ID NO: 334787 - DNA, 20 bp, Artificial
  CRISPR gRNA sequence
taggacatagttttatctta

SEQ ID NO: 334788 - DNA, 20 bp, Artificial
  CRISPR gRNA sequence
ggacatagttttatcttatg

SEQ ID NO: 334789 - DNA, 20 bp, Artificial
  CRISPR gRNA sequence
tatcttatgttcttccttga

SEQ ID NO: 334790 - DNA, 20 bp, Artificial
  CRISPR gRNA sequence
atcttatgttcttccttgag

SEQ ID NO: 334791 - DNA, 20 bp, Artificial
  CRISPR gRNA sequence
tcttatgttcttccttgagg

SEQ ID NO: 334792 - DNA, 20 bp, Artificial
  CRISPR gRNA sequence
atgttcttccttgaggggtg

SEQ ID NO: 334793 - DNA, 20 bp, Artificial
  CRISPR gRNA sequence
tgttcttccttgaggggtgg

SEQ ID NO: 334794 - DNA, 20 bp, Artificial
  CRISPR gRNA sequence
ttccttgaggggtggaggga

SEQ ID NO: 334795 - DNA, 20 bp, Artificial
  CRISPR gRNA sequence
ccttgaggggtggagggaga

SEQ ID NO: 334796 - DNA, 20 bp, Artificial
  CRISPR gRNA sequence
cttgaggggtggagggagaa

SEQ ID NO: 334797 - DNA, 20 bp, Artificial
  CRISPR gRNA sequence
gaggggtggagggagaatgt

SEQ ID NO: 334798 - DNA, 20 bp, Artificial
  CRISPR gRNA sequence
aggggtggagggagaatgtg

SEQ ID NO: 334799 - DNA, 20 bp, Artificial
  CRISPR gRNA sequence
tttcattttggtgcaacaga

SEQ ID NO: 334800 - DNA, 20 bp, Artificial
  CRISPR gRNA sequence
cattttggtgcaacagagat

SEQ ID NO: 334801 - DNA, 20 bp, Artificial
  CRISPR gRNA sequence
attttggtgcaacagagatg

SEQ ID NO: 334802 - DNA, 20 bp, Artificial
  CRISPR gRNA sequence
tggtgcaacagagatgactt

SEQ ID NO: 334803 - DNA, 20 bp, Artificial
  CRISPR gRNA sequence
ggtgcaacagagatgacttt

SEQ ID NO: 334804 - DNA, 20 bp, Artificial
  CRISPR gRNA sequence
gtgcaacagagatgacttta

SEQ ID NO: 334805 - DNA, 20 bp, Artificial
  CRISPR gRNA sequence
tatgcattgaataaattgct

SEQ ID NO: 334806 - DNA, 20 bp, Artificial
  CRISPR gRNA sequence
atgcattgaataaattgctt

SEQ ID NO: 334807 - DNA, 20 bp, Artificial
  CRISPR gRNA sequence
tgcattgaataaattgcttt

SEQ ID NO: 334808 - DNA, 20 bp, Artificial
  CRISPR gRNA sequence
aataaattgcttttatgtta

SEQ ID NO: 334809 - DNA, 20 bp, Artificial
  CRISPR gRNA sequence
cttttatgttaaaatataat

SEQ ID NO: 334810 - DNA, 20 bp, Artificial
  CRISPR gRNA sequence
ttatgttaaaatataattat

SEQ ID NO: 334811 - DNA, 20 bp, Artificial
  CRISPR gRNA sequence
tatgttaaaatataattatt

SEQ ID NO: 334812 - DNA, 20 bp, Artificial
  CRISPR gRNA sequence
atgttaaaatataattatta

SEQ ID NO: 334813 - DNA, 20 bp, Artificial
  CRISPR gRNA sequence
tgttaaaatataattattag

SEQ ID NO: 334814 - DNA, 20 bp, Artificial
  CRISPR gRNA sequence
aaatataattattagggcaa

SEQ ID NO: 334815 - DNA, 20 bp, Artificial
  CRISPR gRNA sequence
ttagggcaacattataaaat

SEQ ID NO: 334816 - DNA, 20 bp, Artificial
  CRISPR gRNA sequence
gggcaacattataaaatgtc

SEQ ID NO: 334817 - DNA, 20 bp, Artificial
  CRISPR gRNA sequence
taaaatgtcacttttgcttt

SEQ ID NO: 334818 - DNA, 20 bp, Artificial
  CRISPR gRNA sequence
ttgctttgttttctttcttt

SEQ ID NO: 334819 - DNA, 20 bp, Artificial
  CRISPR gRNA sequence
tgctttgttttctttctttt

SEQ ID NO: 334820 - DNA, 20 bp, Artificial
  CRISPR gRNA sequence
gctttgttttctttcttttt

SEQ ID NO: 334821 - DNA, 20 bp, Artificial
  CRISPR gRNA sequence
ctttgttttctttcttttta

SEQ ID NO: 334822 - DNA, 20 bp, Artificial
  CRISPR gRNA sequence
tgttttctttctttttatgc

SEQ ID NO: 334823 - DNA, 20 bp, Artificial
  CRISPR gRNA sequence
gttttctttctttttatgca

SEQ ID NO: 334824 - DNA, 20 bp, Artificial
  CRISPR gRNA sequence
ttttctttctttttatgcag

SEQ ID NO: 334825 - DNA, 20 bp, Artificial
  CRISPR gRNA sequence
tctttctttttatgcaggag

SEQ ID NO: 334826 - DNA, 20 bp, Artificial
  CRISPR gRNA sequence
ctttctttttatgcaggaga

SEQ ID NO: 334827 - DNA, 20 bp, Artificial
  CRISPR gRNA sequence
tttctttttatgcaggagaa

SEQ ID NO: 334828 - DNA, 20 bp, Artificial
  CRISPR gRNA sequence
tctttttatgcaggagaaat

SEQ ID NO: 334829 - DNA, 20 bp, Artificial
  CRISPR gRNA sequence
ctttttatgcaggagaaatc

SEQ ID NO: 334830 - DNA, 20 bp, Artificial
  CRISPR gRNA sequence
tttttatgcaggagaaatca

SEQ ID NO: 334831 - DNA, 20 bp, Artificial
  CRISPR gRNA sequence
tttatgcaggagaaatcaat

SEQ ID NO: 334832 - DNA, 20 bp, Artificial
  CRISPR gRNA sequence
ttatgcaggagaaatcaatg

SEQ ID NO: 334833 - DNA, 20 bp, Artificial
  CRISPR gRNA sequence
tatgcaggagaaatcaatgg

SEQ ID NO: 334834 - DNA, 20 bp, Artificial
  CRISPR gRNA sequence
atgcaggagaaatcaatggt

SEQ ID NO: 334835 - DNA, 20 bp, Artificial
  CRISPR gRNA sequence
tgcaggagaaatcaatggtt

SEQ ID NO: 334836 - DNA, 20 bp, Artificial
  CRISPR gRNA sequence
tgccaattatgagatgttta

SEQ ID NO: 334837 - DNA, 20 bp, Artificial
  CRISPR gRNA sequence
ccaattatgagatgtttata

SEQ ID NO: 334838 - DNA, 20 bp, Artificial
  CRISPR gRNA sequence
tgagatgtttatatttcaca

SEQ ID NO: 334839 - DNA, 20 bp, Artificial
  CRISPR gRNA sequence
atatttcacaacggaggtgt

SEQ ID NO: 334840 - DNA, 20 bp, Artificial
  CRISPR gRNA sequence
tatttcacaacggaggtgta

SEQ ID NO: 334841 - DNA, 20 bp, Artificial
  CRISPR gRNA sequence
cacaacggaggtgtacaaat

SEQ ID NO: 334842 - DNA, 20 bp, Artificial
  CRISPR gRNA sequence
acaacggaggtgtacaaatt

SEQ ID NO: 334843 - DNA, 20 bp, Artificial
  CRISPR gRNA sequence
tatgcaaatatcctgacatt

SEQ ID NO: 334844 - DNA, 20 bp, Artificial
  CRISPR gRNA sequence
atgcaaatatcctgacattg

SEQ ID NO: 334845 - DNA, 20 bp, Artificial
  CRISPR gRNA sequence
tgcaaatatcctgacattgt

SEQ ID NO: 334846 - DNA, 20 bp, Artificial
  CRISPR gRNA sequence
acattgtccagcaatttaaa

SEQ ID NO: 334847 - DNA, 20 bp, Artificial
  CRISPR gRNA sequence
tccagcaatttaaaatgcag

SEQ ID NO: 334848 - DNA, 20 bp, Artificial
  CRISPR gRNA sequence
aaaatgcagttgctgaaagg

SEQ ID NO: 334849 - DNA, 20 bp, Artificial
  CRISPR gRNA sequence
aaatgcagttgctgaaaggg

SEQ ID NO: 334850 - DNA, 20 bp, Artificial
  CRISPR gRNA sequence
ctgaaaggggggcaaatact

SEQ ID NO: 334851 - DNA, 20 bp, Artificial
  CRISPR gRNA sequence
aaaggggggcaaatactctg

SEQ ID NO: 334852 - DNA, 20 bp, Artificial
  CRISPR gRNA sequence
tgcgatctcactaagacaaa

SEQ ID NO: 334853 - DNA, 20 bp, Artificial
  CRISPR gRNA sequence
cgatctcactaagacaaaag

SEQ ID NO: 334854 - DNA, 20 bp, Artificial
  CRISPR gRNA sequence
actaagacaaaaggaagtgg

SEQ ID NO: 334855 - DNA, 20 bp, Artificial
  CRISPR gRNA sequence
agacaaaaggaagtggaaac

SEQ ID NO: 334856 - DNA, 20 bp, Artificial
  CRISPR gRNA sequence
agagtctgaaattctgccat

SEQ ID NO: 334857 - DNA, 20 bp, Artificial
  CRISPR gRNA sequence
aaattctgccattctcagtt

SEQ ID NO: 334858 - DNA, 20 bp, Artificial
  CRISPR gRNA sequence
tgccattctcagttatccaa

SEQ ID NO: 334859 - DNA, 20 bp, Artificial
  CRISPR gRNA sequence
ccattctcagttatccaaca

SEQ ID NO: 334860 - DNA, 20 bp, Artificial
  CRISPR gRNA sequence
tcagttatccaacaacagtg

SEQ ID NO: 334861 - DNA, 20 bp, Artificial
  CRISPR gRNA sequence
agttatccaacaacagtgtc

SEQ ID NO: 334862 - DNA, 20 bp, Artificial
  CRISPR gRNA sequence
tccaacaacagtgtctcttt

SEQ ID NO: 334863 - DNA, 20 bp, Artificial
  CRISPR gRNA sequence
tttttttctatacaacttgg

SEQ ID NO: 334864 - DNA, 20 bp, Artificial
  CRISPR gRNA sequence
tttttctatacaacttggac

SEQ ID NO: 334865 - DNA, 20 bp, Artificial
  CRISPR gRNA sequence
ttttctatacaacttggacc

SEQ ID NO: 334866 - DNA, 20 bp, Artificial
  CRISPR gRNA sequence
tttctatacaacttggacca

SEQ ID NO: 334867 - DNA, 20 bp, Artificial
  CRISPR gRNA sequence
ttctatacaacttggaccat

SEQ ID NO: 334868 - DNA, 20 bp, Artificial
  CRISPR gRNA sequence
tctatacaacttggaccatt

SEQ ID NO: 334869 - DNA, 20 bp, Artificial
  CRISPR gRNA sequence
ctatacaacttggaccattc

SEQ ID NO: 334870 - DNA, 20 bp, Artificial
  CRISPR gRNA sequence
tatacaacttggaccattct

SEQ ID NO: 334871 - DNA, 20 bp, Artificial
  CRISPR gRNA sequence
tacaacttggaccattctca

SEQ ID NO: 334872 - DNA, 20 bp, Artificial
  CRISPR gRNA sequence
ggaccattctcatgccaact

SEQ ID NO: 334873 - DNA, 20 bp, Artificial
  CRISPR gRNA sequence
gaccattctcatgccaacta

SEQ ID NO: 334874 - DNA, 20 bp, Artificial
  CRISPR gRNA sequence
tcatgccaactattacttct

SEQ ID NO: 334875 - DNA, 20 bp, Artificial
  CRISPR gRNA sequence
atgccaactattacttctgc

SEQ ID NO: 334876 - DNA, 20 bp, Artificial
  CRISPR gRNA sequence
ttacttctgcaacctatcaa

SEQ ID NO: 334877 - DNA, 20 bp, Artificial
  CRISPR gRNA sequence
cttctgcaacctatcaattt

SEQ ID NO: 334878 - DNA, 20 bp, Artificial
  CRISPR gRNA sequence
ctgcaacctatcaatttttg

SEQ ID NO: 334879 - DNA, 20 bp, Artificial
  CRISPR gRNA sequence
tgcaacctatcaatttttga

SEQ ID NO: 334880 - DNA, 20 bp, Artificial
  CRISPR gRNA sequence
caacctatcaatttttgatc

SEQ ID NO: 334881 - DNA, 20 bp, Artificial
  CRISPR gRNA sequence
tcaatttttgatcctcctcc

SEQ ID NO: 334882 - DNA, 20 bp, Artificial
  CRISPR gRNA sequence
ttgatcctcctccttttaaa

SEQ ID NO: 334883 - DNA, 20 bp, Artificial
  CRISPR gRNA sequence
tgatcctcctccttttaaag

SEQ ID NO: 334884 - DNA, 20 bp, Artificial
  CRISPR gRNA sequence
gatcctcctccttttaaagt

SEQ ID NO: 334885 - DNA, 20 bp, Artificial
  CRISPR gRNA sequence
atcctcctccttttaaagta

SEQ ID NO: 334886 - DNA, 20 bp, Artificial
  CRISPR gRNA sequence
ctccttttaaagtaactctt

SEQ ID NO: 334887 - DNA, 20 bp, Artificial
  CRISPR gRNA sequence
cttttaaagtaactcttaca

SEQ ID NO: 334888 - DNA, 20 bp, Artificial
  CRISPR gRNA sequence
ttaaagtaactcttacagga

SEQ ID NO: 334889 - DNA, 20 bp, Artificial
  CRISPR gRNA sequence
taaagtaactcttacaggag

SEQ ID NO: 334890 - DNA, 20 bp, Artificial
  CRISPR gRNA sequence
aaagtaactcttacaggagg

SEQ ID NO: 334891 - DNA, 20 bp, Artificial
  CRISPR gRNA sequence
aagtaactcttacaggagga

SEQ ID NO: 334892 - DNA, 20 bp, Artificial
  CRISPR gRNA sequence
ttacaggaggatatttgcat

SEQ ID NO: 334893 - DNA, 20 bp, Artificial
  CRISPR gRNA sequence
acaggaggatatttgcatat

SEQ ID NO: 334894 - DNA, 20 bp, Artificial
  CRISPR gRNA sequence
caggaggatatttgcatatt

SEQ ID NO: 334895 - DNA, 20 bp, Artificial
  CRISPR gRNA sequence
gcatatttatggtaagacat

SEQ ID NO: 334896 - DNA, 20 bp, Artificial
  CRISPR gRNA sequence
catatttatggtaagacatt

SEQ ID NO: 334897 - DNA, 20 bp, Artificial
  CRISPR gRNA sequence
atggtaagacattgctttca

SEQ ID NO: 334898 - DNA, 20 bp, Artificial
  CRISPR gRNA sequence
tggtaagacattgctttcat

SEQ ID NO: 334899 - DNA, 20 bp, Artificial
  CRISPR gRNA sequence
ctttcatcttccaaacttaa

SEQ ID NO: 334900 - DNA, 20 bp, Artificial
  CRISPR gRNA sequence
tcatcttccaaacttaagag

SEQ ID NO: 334901 - DNA, 20 bp, Artificial
  CRISPR gRNA sequence
catcttccaaacttaagagt

SEQ ID NO: 334902 - DNA, 20 bp, Artificial
  CRISPR gRNA sequence
atcttccaaacttaagagta

SEQ ID NO: 334903 - DNA, 20 bp, Artificial
  CRISPR gRNA sequence
ccaaacttaagagtatatat

SEQ ID NO: 334904 - DNA, 20 bp, Artificial
  CRISPR gRNA sequence
caaacttaagagtatatata

SEQ ID NO: 334905 - DNA, 20 bp, Artificial
  CRISPR gRNA sequence
aagagtatatatatgttttg

SEQ ID NO: 334906 - DNA, 20 bp, Artificial
  CRISPR gRNA sequence
agagtatatatatgttttga

SEQ ID NO: 334907 - DNA, 20 bp, Artificial
  CRISPR gRNA sequence
tgacaacttttctcactaat

SEQ ID NO: 334908 - DNA, 20 bp, Artificial
  CRISPR gRNA sequence
gacaacttttctcactaata

SEQ ID NO: 334909 - DNA, 20 bp, Artificial
  CRISPR gRNA sequence
acaacttttctcactaataa

SEQ ID NO: 334910 - DNA, 20 bp, Artificial
  CRISPR gRNA sequence
ttctcactaataaaatcaat

SEQ ID NO: 334911 - DNA, 20 bp, Artificial
  CRISPR gRNA sequence
tctcactaataaaatcaatt

SEQ ID NO: 334912 - DNA, 20 bp, Artificial
  CRISPR gRNA sequence
ctcactaataaaatcaatta

SEQ ID NO: 334913 - DNA, 20 bp, Artificial
  CRISPR gRNA sequence
tcactaataaaatcaattag

SEQ ID NO: 334914 - DNA, 20 bp, Artificial
  CRISPR gRNA sequence
actaataaaatcaattagac

SEQ ID NO: 334915 - DNA, 20 bp, Artificial
  CRISPR gRNA sequence
ataaaatcaattagacaaat

SEQ ID NO: 334916 - DNA, 20 bp, Artificial
  CRISPR gRNA sequence
gacaaataaatatcttttgt

SEQ ID NO: 334917 - DNA, 20 bp, Artificial
  CRISPR gRNA sequence
ttgtgttggagttcacttag

SEQ ID NO: 334918 - DNA, 20 bp, Artificial
  CRISPR gRNA sequence
tgtgttggagttcacttaga

SEQ ID NO: 334919 - DNA, 20 bp, Artificial
  CRISPR gRNA sequence
gtgttggagttcacttagat

SEQ ID NO: 334920 - DNA, 20 bp, Artificial
  CRISPR gRNA sequence
tgttggagttcacttagatg

SEQ ID NO: 334921 - DNA, 20 bp, Artificial
  CRISPR gRNA sequence
gagttcacttagatgcagtt

SEQ ID NO: 334922 - DNA, 20 bp, Artificial
  CRISPR gRNA sequence
acttagatgcagttgatggt

SEQ ID NO: 334923 - DNA, 20 bp, Artificial
  CRISPR gRNA sequence
agatgcagttgatggtaatc

SEQ ID NO: 334924 - DNA, 20 bp, Artificial
  CRISPR gRNA sequence
gatgcagttgatggtaatca

SEQ ID NO: 334925 - DNA, 20 bp, Artificial
  CRISPR gRNA sequence
atggtaatcatttataatga

SEQ ID NO: 334926 - DNA, 20 bp, Artificial
  CRISPR gRNA sequence
ataatgaagatatacaggtg

SEQ ID NO: 334927 - DNA, 20 bp, Artificial
  CRISPR gRNA sequence
taatgaagatatacaggtga

SEQ ID NO: 334928 - DNA, 20 bp, Artificial
  CRISPR gRNA sequence
actattaatcataattagta

SEQ ID NO: 334929 - DNA, 20 bp, Artificial
  CRISPR gRNA sequence
ctattaatcataattagtat

SEQ ID NO: 334930 - DNA, 20 bp, Artificial
  CRISPR gRNA sequence
ttaatcataattagtattat

SEQ ID NO: 334931 - DNA, 20 bp, Artificial
  CRISPR gRNA sequence
atcataattagtattattca

SEQ ID NO: 334932 - DNA, 20 bp, Artificial
  CRISPR gRNA sequence
gtattattcagcaatatgca

SEQ ID NO: 334933 - DNA, 20 bp, Artificial
  CRISPR gRNA sequence
ttcagcaatatgcaatgtaa

SEQ ID NO: 334934 - DNA, 20 bp, Artificial
  CRISPR gRNA sequence
agcaatatgcaatgtaatcc

SEQ ID NO: 334935 - DNA, 20 bp, Artificial
  CRISPR gRNA sequence
ctaagtcagaaatagatcat

SEQ ID NO: 334936 - DNA, 20 bp, Artificial
  CRISPR gRNA sequence
agtcagaaatagatcatatt

SEQ ID NO: 334937 - DNA, 20 bp, Artificial
  CRISPR gRNA sequence
ccttttaaacacatatgcta

SEQ ID NO: 334938 - DNA, 20 bp, Artificial
  CRISPR gRNA sequence
ttaaacacatatgctattaa

SEQ ID NO: 334939 - DNA, 20 bp, Artificial
  CRISPR gRNA sequence
taaacacatatgctattaaa

SEQ ID NO: 334940 - DNA, 20 bp, Artificial
  CRISPR gRNA sequence
aaacacatatgctattaaaa

SEQ ID NO: 334941 - DNA, 20 bp, Artificial
  CRISPR gRNA sequence
aacacatatgctattaaaaa

SEQ ID NO: 334942 - DNA, 20 bp, Artificial
  CRISPR gRNA sequence
ttaaaaatcaggaaaaacat

SEQ ID NO: 334943 - DNA, 20 bp, Artificial
  CRISPR gRNA sequence
aaaatcaggaaaaacattaa

SEQ ID NO: 334944 - DNA, 20 bp, Artificial
  CRISPR gRNA sequence
agacaaatacttaaacttat

SEQ ID NO: 334945 - DNA, 20 bp, Artificial
  CRISPR gRNA sequence
aaacttatggcttaataatg

SEQ ID NO: 334946 - DNA, 20 bp, Artificial
  CRISPR gRNA sequence
aacttatggcttaataatgg

SEQ ID NO: 334947 - DNA, 20 bp, Artificial
  CRISPR gRNA sequence
atggcttaataatgggtatt

SEQ ID NO: 334948 - DNA, 20 bp, Artificial
  CRISPR gRNA sequence
tggcttaataatgggtatta

SEQ ID NO: 334949 - DNA, 20 bp, Artificial
  CRISPR gRNA sequence
aataatgggtattatctcta

SEQ ID NO: 334950 - DNA, 20 bp, Artificial
  CRISPR gRNA sequence
ataatgggtattatctctat

SEQ ID NO: 334951 - DNA, 20 bp, Artificial
  CRISPR gRNA sequence
tctctattcacctaagattt

SEQ ID NO: 334952 - DNA, 20 bp, Artificial
  CRISPR gRNA sequence
tattcacctaagatttaagg

SEQ ID NO: 334953 - DNA, 20 bp, Artificial
  CRISPR gRNA sequence
ttcacctaagatttaaggtt

SEQ ID NO: 334954 - DNA, 20 bp, Artificial
  CRISPR gRNA sequence
acctaagatttaaggtttgg

SEQ ID NO: 334955 - DNA, 20 bp, Artificial
  CRISPR gRNA sequence
agatttaaggtttggttttg

SEQ ID NO: 334956 - DNA, 20 bp, Artificial
  CRISPR gRNA sequence
aaggtttggttttgcactgt

SEQ ID NO: 334957 - DNA, 20 bp, Artificial
  CRISPR gRNA sequence
aggtttggttttgcactgtg

SEQ ID NO: 334958 - DNA, 20 bp, Artificial
  CRISPR gRNA sequence
ggttttgcactgtgtttgtg

SEQ ID NO: 334959 - DNA, 20 bp, Artificial
  CRISPR gRNA sequence
gttttgcactgtgtttgtgg

SEQ ID NO: 334960 - DNA, 20 bp, Artificial
  CRISPR gRNA sequence
tgcactgtgtttgtggaatg

SEQ ID NO: 334961 - DNA, 20 bp, Artificial
  CRISPR gRNA sequence
gcactgtgtttgtggaatga

SEQ ID NO: 334962 - DNA, 20 bp, Artificial
  CRISPR gRNA sequence
cactgtgtttgtggaatgaa

SEQ ID NO: 334963 - DNA, 20 bp, Artificial
  CRISPR gRNA sequence
tgtttgtggaatgaagtatg

SEQ ID NO: 334964 - DNA, 20 bp, Artificial
  CRISPR gRNA sequence
gtggaatgaagtatgatgat

SEQ ID NO: 334965 - DNA, 20 bp, Artificial
  CRISPR gRNA sequence
tggaatgaagtatgatgatt

SEQ ID NO: 334966 - DNA, 20 bp, Artificial
  CRISPR gRNA sequence
aaaatcatagttttataaca

SEQ ID NO: 334967 - DNA, 20 bp, Artificial
  CRISPR gRNA sequence
tataacattacttttactat

SEQ ID NO: 334968 - DNA, 20 bp, Artificial
  CRISPR gRNA sequence
ataacattacttttactatt

SEQ ID NO: 334969 - DNA, 20 bp, Artificial
  CRISPR gRNA sequence
taacattacttttactatta

SEQ ID NO: 334970 - DNA, 20 bp, Artificial
  CRISPR gRNA sequence
cttttactattacctctttt

SEQ ID NO: 334971 - DNA, 20 bp, Artificial
  CRISPR gRNA sequence
ttactattacctcttttata

SEQ ID NO: 334972 - DNA, 20 bp, Artificial
  CRISPR gRNA sequence
tactattacctcttttataa

SEQ ID NO: 334973 - DNA, 20 bp, Artificial
  CRISPR gRNA sequence
actattacctcttttataaa

SEQ ID NO: 334974 - DNA, 20 bp, Artificial
  CRISPR gRNA sequence
ctattacctcttttataaaa

SEQ ID NO: 334975 - DNA, 20 bp, Artificial
  CRISPR gRNA sequence
ttacctcttttataaaaata

SEQ ID NO: 334976 - DNA, 20 bp, Artificial
  CRISPR gRNA sequence
cctcttttataaaaatatag

SEQ ID NO: 334977 - DNA, 20 bp, Artificial
  CRISPR gRNA sequence
ttttataaaaatataggcag

SEQ ID NO: 334978 - DNA, 20 bp, Artificial
  CRISPR gRNA sequence
ttataaaaatataggcagaa

SEQ ID NO: 334979 - DNA, 20 bp, Artificial
  CRISPR gRNA sequence
tataaaaatataggcagaaa

SEQ ID NO: 334980 - DNA, 20 bp, Artificial
  CRISPR gRNA sequence
ataaaaatataggcagaaaa

SEQ ID NO: 334981 - DNA, 20 bp, Artificial
  CRISPR gRNA sequence
taaaaatataggcagaaaag

SEQ ID NO: 334982 - DNA, 20 bp, Artificial
  CRISPR gRNA sequence
tctattaaccacatttgtaa

SEQ ID NO: 334983 - DNA, 20 bp, Artificial
  CRISPR gRNA sequence
ctattaaccacatttgtaaa

SEQ ID NO: 334984 - DNA, 20 bp, Artificial
  CRISPR gRNA sequence
tattaaccacatttgtaaat

SEQ ID NO: 334985 - DNA, 20 bp, Artificial
  CRISPR gRNA sequence
ttaaccacatttgtaaatac

SEQ ID NO: 334986 - DNA, 20 bp, Artificial
  CRISPR gRNA sequence
accacatttgtaaatacatt

SEQ ID NO: 334987 - DNA, 20 bp, Artificial
  CRISPR gRNA sequence
gtaaatacattatatgcata

SEQ ID NO: 334988 - DNA, 20 bp, Artificial
  CRISPR gRNA sequence
taaatacattatatgcataa

SEQ ID NO: 334989 - DNA, 20 bp, Artificial
  CRISPR gRNA sequence
tatgcataatcttttaagtt

SEQ ID NO: 334990 - DNA, 20 bp, Artificial
  CRISPR gRNA sequence
ttaagttttagttcctggat

SEQ ID NO: 334991 - DNA, 20 bp, Artificial
  CRISPR gRNA sequence
taagttttagttcctggatc

SEQ ID NO: 334992 - DNA, 20 bp, Artificial
  CRISPR gRNA sequence
aagttttagttcctggatcc

SEQ ID NO: 334993 - DNA, 20 bp, Artificial
  CRISPR gRNA sequence
agttttagttcctggatcct

SEQ ID NO: 334994 - DNA, 20 bp, Artificial
  CRISPR gRNA sequence
tagttcctggatccttgcca

SEQ ID NO: 334995 - DNA, 20 bp, Artificial
  CRISPR gRNA sequence
agttcctggatccttgccat

SEQ ID NO: 334996 - DNA, 20 bp, Artificial
  CRISPR gRNA sequence
gttcctggatccttgccata

SEQ ID NO: 334997 - DNA, 20 bp, Artificial
  CRISPR gRNA sequence
ctggatccttgccataatac

SEQ ID NO: 334998 - DNA, 20 bp, Artificial
  CRISPR gRNA sequence
gatccttgccataatactga

SEQ ID NO: 334999 - DNA, 20 bp, Artificial
  CRISPR gRNA sequence
gccataatactgagatgatg

SEQ ID NO: 335000 - DNA, 20 bp, Artificial
  CRISPR gRNA sequence
ccataatactgagatgatgt

SEQ ID NO: 335001 - DNA, 20 bp, Artificial
  CRISPR gRNA sequence
agatgatgttagtctaataa

SEQ ID NO: 335002 - DNA, 20 bp, Artificial
  CRISPR gRNA sequence
gtctaataacttgcccactt

SEQ ID NO: 335003 - DNA, 20 bp, Artificial
  CRISPR gRNA sequence
ataacttgcccacttactgg

SEQ ID NO: 335004 - DNA, 20 bp, Artificial
  CRISPR gRNA sequence
gcccacttactggatttcat

SEQ ID NO: 335005 - DNA, 20 bp, Artificial
  CRISPR gRNA sequence
cccacttactggatttcatg

SEQ ID NO: 335006 - DNA, 20 bp, Artificial
  CRISPR gRNA sequence
actggatttcatgactataa

SEQ ID NO: 335007 - DNA, 20 bp, Artificial
  CRISPR gRNA sequence
ctggatttcatgactataat

SEQ ID NO: 335008 - DNA, 20 bp, Artificial
  CRISPR gRNA sequence
gatttcatgactataataaa

SEQ ID NO: 335009 - DNA, 20 bp, Artificial
  CRISPR gRNA sequence
catgactataataaagaaaa

SEQ ID NO: 335010 - DNA, 20 bp, Artificial
  CRISPR gRNA sequence
atgactataataaagaaaag

SEQ ID NO: 335011 - DNA, 20 bp, Artificial
  CRISPR gRNA sequence
taataaagaaaagcttcatt

SEQ ID NO: 335012 - DNA, 20 bp, Artificial
  CRISPR gRNA sequence
catttgattaaatagctctt

SEQ ID NO: 335013 - DNA, 20 bp, Artificial
  CRISPR gRNA sequence
atttgattaaatagctcttt

SEQ ID NO: 335014 - DNA, 20 bp, Artificial
  CRISPR gRNA sequence
gattaaatagctcttttaaa

SEQ ID NO: 335015 - DNA, 20 bp, Artificial
  CRISPR gRNA sequence
attaaatagctcttttaaat

SEQ ID NO: 335016 - DNA, 20 bp, Artificial
  CRISPR gRNA sequence
aatagctcttttaaatttgg

SEQ ID NO: 335017 - DNA, 20 bp, Artificial
  CRISPR gRNA sequence
ttttaaatttggtaagagaa

SEQ ID NO: 335018 - DNA, 20 bp, Artificial
  CRISPR gRNA sequence
ttaaatttggtaagagaact

SEQ ID NO: 335019 - DNA, 20 bp, Artificial
  CRISPR gRNA sequence
taaatttggtaagagaactt

SEQ ID NO: 335020 - DNA, 20 bp, Artificial
  CRISPR gRNA sequence
aaatttggtaagagaacttg

SEQ ID NO: 335021 - DNA, 20 bp, Artificial
  CRISPR gRNA sequence
aatttggtaagagaacttgt

SEQ ID NO: 335022 - DNA, 20 bp, Artificial
  CRISPR gRNA sequence
ggtaagagaacttgtggttc

SEQ ID NO: 335023 - DNA, 20 bp, Artificial
  CRISPR gRNA sequence
gtaagagaacttgtggttca

SEQ ID NO: 335024 - DNA, 20 bp, Artificial
  CRISPR gRNA sequence
gtggttcagcagaatttttc

SEQ ID NO: 335025 - DNA, 20 bp, Artificial
  CRISPR gRNA sequence
tggttcagcagaatttttca

SEQ ID NO: 335026 - DNA, 20 bp, Artificial
  CRISPR gRNA sequence
agcagaatttttcattaaca

SEQ ID NO: 335027 - DNA, 20 bp, Artificial
  CRISPR gRNA sequence
ttcattaacatacctttttt

SEQ ID NO: 335028 - DNA, 20 bp, Artificial
  CRISPR gRNA sequence
tcattaacataccttttttt

SEQ ID NO: 335029 - DNA, 20 bp, Artificial
  CRISPR gRNA sequence
cattaacatacctttttttc

SEQ ID NO: 335030 - DNA, 20 bp, Artificial
  CRISPR gRNA sequence
attaacatacctttttttcc

SEQ ID NO: 335031 - DNA, 20 bp, Artificial
  CRISPR gRNA sequence
acatacctttttttccaatc

SEQ ID NO: 335032 - DNA, 20 bp, Artificial
  CRISPR gRNA sequence
tttttccaatccagaatcac

SEQ ID NO: 335033 - DNA, 20 bp, Artificial
  CRISPR gRNA sequence
ttttccaatccagaatcaca

SEQ ID NO: 335034 - DNA, 20 bp, Artificial
  CRISPR gRNA sequence
tttccaatccagaatcacaa

SEQ ID NO: 335035 - DNA, 20 bp, Artificial
  CRISPR gRNA sequence
ttccaatccagaatcacaac

SEQ ID NO: 335036 - DNA, 20 bp, Artificial
  CRISPR gRNA sequence
tccaatccagaatcacaact

SEQ ID NO: 335037 - DNA, 20 bp, Artificial
  CRISPR gRNA sequence
ccaatccagaatcacaactt

SEQ ID NO: 335038 - DNA, 20 bp, Artificial
  CRISPR gRNA sequence
caatccagaatcacaacttt

SEQ ID NO: 335039 - DNA, 20 bp, Artificial
  CRISPR gRNA sequence
tgttgccagctgaagttctg

SEQ ID NO: 335040 - DNA, 20 bp, Artificial
  CRISPR gRNA sequence
gttgccagctgaagttctgg

SEQ ID NO: 335041 - DNA, 20 bp, Artificial
  CRISPR gRNA sequence
ttgccagctgaagttctggt

SEQ ID NO: 335042 - DNA, 20 bp, Artificial
  CRISPR gRNA sequence
ccagctgaagttctggttac

SEQ ID NO: 335043 - DNA, 20 bp, Artificial
  CRISPR gRNA sequence
aagttctggttacccatagg

SEQ ID NO: 335044 - DNA, 20 bp, Artificial
  CRISPR gRNA sequence
tggttacccataggatgtgc

SEQ ID NO: 335045 - DNA, 20 bp, Artificial
  CRISPR gRNA sequence
gttacccataggatgtgcag

SEQ ID NO: 335046 - DNA, 20 bp, Artificial
  CRISPR gRNA sequence
cccataggatgtgcagcctt

SEQ ID NO: 335047 - DNA, 20 bp, Artificial
  CRISPR gRNA sequence
tgttgtagtctgcattttgg

SEQ ID NO: 335048 - DNA, 20 bp, Artificial
  CRISPR gRNA sequence
gttgtagtctgcattttggg

SEQ ID NO: 335049 - DNA, 20 bp, Artificial
  CRISPR gRNA sequence
ttgtagtctgcattttggga

SEQ ID NO: 335050 - DNA, 20 bp, Artificial
  CRISPR gRNA sequence
tagtctgcattttgggatgc

SEQ ID NO: 335051 - DNA, 20 bp, Artificial
  CRISPR gRNA sequence
cattttgggatgcatactta

SEQ ID NO: 335052 - DNA, 20 bp, Artificial
  CRISPR gRNA sequence
tgggatgcatacttatttgt

SEQ ID NO: 335053 - DNA, 20 bp, Artificial
  CRISPR gRNA sequence
gggatgcatacttatttgtt

SEQ ID NO: 335054 - DNA, 20 bp, Artificial
  CRISPR gRNA sequence
ggatgcatacttatttgttg

SEQ ID NO: 335055 - DNA, 20 bp, Artificial
  CRISPR gRNA sequence
atttgttggcttacaaaaaa

SEQ ID NO: 335056 - DNA, 20 bp, Artificial
  CRISPR gRNA sequence
tttgttggcttacaaaaaag

SEQ ID NO: 335057 - DNA, 20 bp, Artificial
  CRISPR gRNA sequence
gttggcttacaaaaaaggta

SEQ ID NO: 335058 - DNA, 20 bp, Artificial
  CRISPR gRNA sequence
ttggcttacaaaaaaggtaa

SEQ ID NO: 335059 - DNA, 20 bp, Artificial
  CRISPR gRNA sequence
gcttacaaaaaaggtaagcg

SEQ ID NO: 335060 - DNA, 20 bp, Artificial
  CRISPR gRNA sequence
acaaaaaaggtaagcgattt

SEQ ID NO: 335061 - DNA, 20 bp, Artificial
  CRISPR gRNA sequence
caaaaaaggtaagcgatttc

SEQ ID NO: 335062 - DNA, 20 bp, Artificial
  CRISPR gRNA sequence
ctatctttccttgtatctgc

SEQ ID NO: 335063 - DNA, 20 bp, Artificial
  CRISPR gRNA sequence
tatctttccttgtatctgct

SEQ ID NO: 335064 - DNA, 20 bp, Artificial
  CRISPR gRNA sequence
tctttccttgtatctgcttt

SEQ ID NO: 335065 - DNA, 20 bp, Artificial
  CRISPR gRNA sequence
tccttgtatctgctttacag

SEQ ID NO: 335066 - DNA, 20 bp, Artificial
  CRISPR gRNA sequence
ccttgtatctgctttacaga

SEQ ID NO: 335067 - DNA, 20 bp, Artificial
  CRISPR gRNA sequence
cttgtatctgctttacagat

SEQ ID NO: 335068 - DNA, 20 bp, Artificial
  CRISPR gRNA sequence
gtatctgctttacagatgca

SEQ ID NO: 335069 - DNA, 20 bp, Artificial
  CRISPR gRNA sequence
tatctgctttacagatgcac

SEQ ID NO: 335070 - DNA, 20 bp, Artificial
  CRISPR gRNA sequence
ctttacagatgcacatcagt

SEQ ID NO: 335071 - DNA, 20 bp, Artificial
  CRISPR gRNA sequence
tacagatgcacatcagtgat

SEQ ID NO: 335072 - DNA, 20 bp, Artificial
  CRISPR gRNA sequence
acagatgcacatcagtgatt

SEQ ID NO: 335073 - DNA, 20 bp, Artificial
  CRISPR gRNA sequence
cagatgcacatcagtgatta

SEQ ID NO: 335074 - DNA, 20 bp, Artificial
  CRISPR gRNA sequence
tttcctcatcaaaagtacac

SEQ ID NO: 335075 - DNA, 20 bp, Artificial
  CRISPR gRNA sequence
cctcatcaaaagtacacatg

SEQ ID NO: 335076 - DNA, 20 bp, Artificial
  CRISPR gRNA sequence
ctcatcaaaagtacacatgg

SEQ ID NO: 335077 - DNA, 20 bp, Artificial
  CRISPR gRNA sequence
atcaaaagtacacatggctc

SEQ ID NO: 335078 - DNA, 20 bp, Artificial
  CRISPR gRNA sequence
ttgtcagagtaatttgacca

SEQ ID NO: 335079 - DNA, 20 bp, Artificial
  CRISPR gRNA sequence
gtcagagtaatttgaccaac

SEQ ID NO: 335080 - DNA, 20 bp, Artificial
  CRISPR gRNA sequence
tcagagtaatttgaccaaca

SEQ ID NO: 335081 - DNA, 20 bp, Artificial
  CRISPR gRNA sequence
gaccaacagggagacaattc

SEQ ID NO: 335082 - DNA, 20 bp, Artificial
  CRISPR gRNA sequence
accaacagggagacaattcc

SEQ ID NO: 335083 - DNA, 20 bp, Artificial
  CRISPR gRNA sequence
cttccccccaagacatacct

SEQ ID NO: 335084 - DNA, 20 bp, Artificial
  CRISPR gRNA sequence
ccccccaagacatacctact

SEQ ID NO: 335085 - DNA, 20 bp, Artificial
  CRISPR gRNA sequence
cccccaagacatacctacta

SEQ ID NO: 335086 - DNA, 20 bp, Artificial
  CRISPR gRNA sequence
ctaattaaactaatcacttg

SEQ ID NO: 335087 - DNA, 20 bp, Artificial
  CRISPR gRNA sequence
attaaactaatcacttggaa

SEQ ID NO: 335088 - DNA, 20 bp, Artificial
  CRISPR gRNA sequence
aactaatcacttggaacaga

SEQ ID NO: 335089 - DNA, 20 bp, Artificial
  CRISPR gRNA sequence
atcacttggaacagaaattt

SEQ ID NO: 335090 - DNA, 20 bp, Artificial
  CRISPR gRNA sequence
ggaacagaaatttatgtatt

SEQ ID NO: 335091 - DNA, 20 bp, Artificial
  CRISPR gRNA sequence
gaacagaaatttatgtattt

SEQ ID NO: 335092 - DNA, 20 bp, Artificial
  CRISPR gRNA sequence
atgtatttgttttatagccc

SEQ ID NO: 335093 - DNA, 20 bp, Artificial
  CRISPR gRNA sequence
tgtatttgttttatagccca

SEQ ID NO: 335094 - DNA, 20 bp, Artificial
  CRISPR gRNA sequence
gttttatagcccacacattc

SEQ ID NO: 335095 - DNA, 20 bp, Artificial
  CRISPR gRNA sequence
ttttatagcccacacattcc

SEQ ID NO: 335096 - DNA, 20 bp, Artificial
  CRISPR gRNA sequence
tatagcccacacattccaaa

SEQ ID NO: 335097 - DNA, 20 bp, Artificial
  CRISPR gRNA sequence
atagcccacacattccaaag

SEQ ID NO: 335098 - DNA, 20 bp, Artificial
  CRISPR gRNA sequence
tagcccacacattccaaaga

SEQ ID NO: 335099 - DNA, 20 bp, Artificial
  CRISPR gRNA sequence
caaagaggacttgacttgat

SEQ ID NO: 335100 - DNA, 20 bp, Artificial
  CRISPR gRNA sequence
gacttgatggcttacagaga

SEQ ID NO: 335101 - DNA, 20 bp, Artificial
  CRISPR gRNA sequence
acttgatggcttacagagag

SEQ ID NO: 335102 - DNA, 20 bp, Artificial
  CRISPR gRNA sequence
gatggcttacagagagttac

SEQ ID NO: 335103 - DNA, 20 bp, Artificial
  CRISPR gRNA sequence
atggcttacagagagttaca

SEQ ID NO: 335104 - DNA, 20 bp, Artificial
  CRISPR gRNA sequence
acagagagttacattattat

SEQ ID NO: 335105 - DNA, 20 bp, Artificial
  CRISPR gRNA sequence
cagagagttacattattatt

SEQ ID NO: 335106 - DNA, 20 bp, Artificial
  CRISPR gRNA sequence
cattattattattattgttc

SEQ ID NO: 335107 - DNA, 20 bp, Artificial
  CRISPR gRNA sequence
ttattattattgttcaaact

SEQ ID NO: 335108 - DNA, 20 bp, Artificial
  CRISPR gRNA sequence
ttattattgttcaaactaga

SEQ ID NO: 335109 - DNA, 20 bp, Artificial
  CRISPR gRNA sequence
ttattgttcaaactagatga

SEQ ID NO: 335110 - DNA, 20 bp, Artificial
  CRISPR gRNA sequence
ttgttcaaactagatgagga

SEQ ID NO: 335111 - DNA, 20 bp, Artificial
  CRISPR gRNA sequence
ttcaaactagatgaggaaat

SEQ ID NO: 335112 - DNA, 20 bp, Artificial
  CRISPR gRNA sequence
aaactagatgaggaaattga

SEQ ID NO: 335113 - DNA, 20 bp, Artificial
  CRISPR gRNA sequence
gatgaggaaattgaggtcaa

SEQ ID NO: 335114 - DNA, 20 bp, Artificial
  CRISPR gRNA sequence
aggtcaagagaagactaaag

SEQ ID NO: 335115 - DNA, 20 bp, Artificial
  CRISPR gRNA sequence
aaggtcaggaggaaggttaa

SEQ ID NO: 335116 - DNA, 20 bp, Artificial
  CRISPR gRNA sequence
aaacatcaaaatagatgact

SEQ ID NO: 335117 - DNA, 20 bp, Artificial
  CRISPR gRNA sequence
tgatttttaaaaaattatta

SEQ ID NO: 335118 - DNA, 20 bp, Artificial
  CRISPR gRNA sequence
atttttaaaaaattattatg

SEQ ID NO: 335119 - DNA, 20 bp, Artificial
  CRISPR gRNA sequence
ttaaaaaattattatgcatg

SEQ ID NO: 335120 - DNA, 20 bp, Artificial
  CRISPR gRNA sequence
taaaaaattattatgcatgg

SEQ ID NO: 335121 - DNA, 20 bp, Artificial
  CRISPR gRNA sequence
aaaaaattattatgcatggg

SEQ ID NO: 335122 - DNA, 20 bp, Artificial
  CRISPR gRNA sequence
aaaaattattatgcatgggc

SEQ ID NO: 335123 - DNA, 20 bp, Artificial
  CRISPR gRNA sequence
ttatgcatgggctgcgaatt

SEQ ID NO: 335124 - DNA, 20 bp, Artificial
  CRISPR gRNA sequence
tgcatgggctgcgaatttga

SEQ ID NO: 335125 - DNA, 20 bp, Artificial
  CRISPR gRNA sequence
cgaatttgaatccaaggttc

SEQ ID NO: 335126 - DNA, 20 bp, Artificial
  CRISPR gRNA sequence
gaatccaaggttcctgagag

SEQ ID NO: 335127 - DNA, 20 bp, Artificial
  CRISPR gRNA sequence
aatccaaggttcctgagagg

SEQ ID NO: 335128 - DNA, 20 bp, Artificial
  CRISPR gRNA sequence
ctgagaggcagggcagagat

SEQ ID NO: 335129 - DNA, 20 bp, Artificial
  CRISPR gRNA sequence
agaggcagggcagagatgaa

SEQ ID NO: 335130 - DNA, 20 bp, Artificial
  CRISPR gRNA sequence
gttataagttttgcttagct

SEQ ID NO: 335131 - DNA, 20 bp, Artificial
  CRISPR gRNA sequence
taagttttgcttagctggta

SEQ ID NO: 335132 - DNA, 20 bp, Artificial
  CRISPR gRNA sequence
tgcttagctggtaagttaaa

SEQ ID NO: 335133 - DNA, 20 bp, Artificial
  CRISPR gRNA sequence
gcttagctggtaagttaaaa

SEQ ID NO: 335134 - DNA, 20 bp, Artificial
  CRISPR gRNA sequence
cttagctggtaagttaaaaa

SEQ ID NO: 335135 - DNA, 20 bp, Artificial
  CRISPR gRNA sequence
agctggtaagttaaaaacag

SEQ ID NO: 335136 - DNA, 20 bp, Artificial
  CRISPR gRNA sequence
gctggtaagttaaaaacagt

SEQ ID NO: 335137 - DNA, 20 bp, Artificial
  CRISPR gRNA sequence
gtaagttaaaaacagtcagc

SEQ ID NO: 335138 - DNA, 20 bp, Artificial
  CRISPR gRNA sequence
aaaacagtcagcaagaaagc

SEQ ID NO: 335139 - DNA, 20 bp, Artificial
  CRISPR gRNA sequence
ctaaggtgtcaattgtagct

SEQ ID NO: 335140 - DNA, 20 bp, Artificial
  CRISPR gRNA sequence
taaggtgtcaattgtagctg

SEQ ID NO: 335141 - DNA, 20 bp, Artificial
  CRISPR gRNA sequence
aggtgtcaattgtagctgag

SEQ ID NO: 335142 - DNA, 20 bp, Artificial
  CRISPR gRNA sequence
tagctgagaaggaaattgac

SEQ ID NO: 335143 - DNA, 20 bp, Artificial
  CRISPR gRNA sequence
agaaggaaattgacaacttt

SEQ ID NO: 335144 - DNA, 20 bp, Artificial
  CRISPR gRNA sequence
acaacttttttacatggtag

SEQ ID NO: 335145 - DNA, 20 bp, Artificial
  CRISPR gRNA sequence
ttttacatggtaggttatta

SEQ ID NO: 335146 - DNA, 20 bp, Artificial
  CRISPR gRNA sequence
tttacatggtaggttattag

SEQ ID NO: 335147 - DNA, 20 bp, Artificial
  CRISPR gRNA sequence
ttacatggtaggttattaga

SEQ ID NO: 335148 - DNA, 20 bp, Artificial
  CRISPR gRNA sequence
tacatggtaggttattagac

SEQ ID NO: 335149 - DNA, 20 bp, Artificial
  CRISPR gRNA sequence
acatggtaggttattagact

SEQ ID NO: 335150 - DNA, 20 bp, Artificial
  CRISPR gRNA sequence
catggtaggttattagactc

SEQ ID NO: 335151 - DNA, 20 bp, Artificial
  CRISPR gRNA sequence
ttagactccttgcttttaaa

SEQ ID NO: 335152 - DNA, 20 bp, Artificial
  CRISPR gRNA sequence
gactccttgcttttaaagaa

SEQ ID NO: 335153 - DNA, 20 bp, Artificial
  CRISPR gRNA sequence
cttgcttttaaagaaaacca

SEQ ID NO: 335154 - DNA, 20 bp, Artificial
  CRISPR gRNA sequence
gcttttaaagaaaaccactg

SEQ ID NO: 335155 - DNA, 20 bp, Artificial
  CRISPR gRNA sequence
cttttaaagaaaaccactga

SEQ ID NO: 335156 - DNA, 20 bp, Artificial
  CRISPR gRNA sequence
ttaaagaaaaccactgagga

SEQ ID NO: 335157 - DNA, 20 bp, Artificial
  CRISPR gRNA sequence
taaagaaaaccactgaggag

SEQ ID NO: 335158 - DNA, 20 bp, Artificial
  CRISPR gRNA sequence
aaagaaaaccactgaggagc

SEQ ID NO: 335159 - DNA, 20 bp, Artificial
  CRISPR gRNA sequence
aagaaaaccactgaggagct

SEQ ID NO: 335160 - DNA, 20 bp, Artificial
  CRISPR gRNA sequence
aggagctatttagaaagata

SEQ ID NO: 335161 - DNA, 20 bp, Artificial
  CRISPR gRNA sequence
tttagaaagataaacaacaa

SEQ ID NO: 335162 - DNA, 20 bp, Artificial
  CRISPR gRNA sequence
agaaagataaacaacaatga

SEQ ID NO: 335163 - DNA, 20 bp, Artificial
  CRISPR gRNA sequence
gaaagataaacaacaatgac

SEQ ID NO: 335164 - DNA, 20 bp, Artificial
  CRISPR gRNA sequence
cctgtgctgggggatattct

SEQ ID NO: 335165 - DNA, 20 bp, Artificial
  CRISPR gRNA sequence
tgctgggggatattcttttt

SEQ ID NO: 335166 - DNA, 20 bp, Artificial
  CRISPR gRNA sequence
ggggatattctttttggtct

SEQ ID NO: 335167 - DNA, 20 bp, Artificial
  CRISPR gRNA sequence
tttttggtctcttgcattac

SEQ ID NO: 335168 - DNA, 20 bp, Artificial
  CRISPR gRNA sequence
tttggtctcttgcattacag

SEQ ID NO: 335169 - DNA, 20 bp, Artificial
  CRISPR gRNA sequence
ttggtctcttgcattacagg

SEQ ID NO: 335170 - DNA, 20 bp, Artificial
  CRISPR gRNA sequence
tggtctcttgcattacaggt

SEQ ID NO: 335171 - DNA, 20 bp, Artificial
  CRISPR gRNA sequence
ggtctcttgcattacaggtt

SEQ ID NO: 335172 - DNA, 20 bp, Artificial
  CRISPR gRNA sequence
gtctcttgcattacaggttc

SEQ ID NO: 335173 - DNA, 20 bp, Artificial
  CRISPR gRNA sequence
ttgcattacaggttctcaat

SEQ ID NO: 335174 - DNA, 20 bp, Artificial
  CRISPR gRNA sequence
gcattacaggttctcaatca

SEQ ID NO: 335175 - DNA, 20 bp, Artificial
  CRISPR gRNA sequence
cattacaggttctcaatcaa

SEQ ID NO: 335176 - DNA, 20 bp, Artificial
  CRISPR gRNA sequence
caggttctcaatcaaagaac

SEQ ID NO: 335177 - DNA, 20 bp, Artificial
  CRISPR gRNA sequence
tcaatcaaagaactgacacc

SEQ ID NO: 335178 - DNA, 20 bp, Artificial
  CRISPR gRNA sequence
aatcaaagaactgacaccac

SEQ ID NO: 335179 - DNA, 20 bp, Artificial
  CRISPR gRNA sequence
acaccactctgcatattacg

SEQ ID NO: 335180 - DNA, 20 bp, Artificial
  CRISPR gRNA sequence
tgcatattacgcgagtatgc

SEQ ID NO: 335181 - DNA, 20 bp, Artificial
  CRISPR gRNA sequence
catattacgcgagtatgcta

SEQ ID NO: 335182 - DNA, 20 bp, Artificial
  CRISPR gRNA sequence
cgcgagtatgctagtactca

SEQ ID NO: 335183 - DNA, 20 bp, Artificial
  CRISPR gRNA sequence
gtactcaagtatatccacag

SEQ ID NO: 335184 - DNA, 20 bp, Artificial
  CRISPR gRNA sequence
aagtatatccacagtgtggt

SEQ ID NO: 335185 - DNA, 20 bp, Artificial
  CRISPR gRNA sequence
gccagtgtatatctgtggga

SEQ ID NO: 335186 - DNA, 20 bp, Artificial
  CRISPR gRNA sequence
tgggagagtggaatttggaa

SEQ ID NO: 335187 - DNA, 20 bp, Artificial
  CRISPR gRNA sequence
ggaaagagacataaagaagg

SEQ ID NO: 335188 - DNA, 20 bp, Artificial
  CRISPR gRNA sequence
gaaagagacataaagaagga

SEQ ID NO: 335189 - DNA, 20 bp, Artificial
  CRISPR gRNA sequence
agtctgctgggaaagaaaca

SEQ ID NO: 335190 - DNA, 20 bp, Artificial
  CRISPR gRNA sequence
ctgggaaagaaacaataaag

SEQ ID NO: 335191 - DNA, 20 bp, Artificial
  CRISPR gRNA sequence
ggaaagaaacaataaaggca

SEQ ID NO: 335192 - DNA, 20 bp, Artificial
  CRISPR gRNA sequence
agtagaaagctctttttatg

SEQ ID NO: 335193 - DNA, 20 bp, Artificial
  CRISPR gRNA sequence
tttttatgtaaagccctttt

SEQ ID NO: 335194 - DNA, 20 bp, Artificial
  CRISPR gRNA sequence
tttatgtaaagcccttttca

SEQ ID NO: 335195 - DNA, 20 bp, Artificial
  CRISPR gRNA sequence
ttatgtaaagcccttttcat

SEQ ID NO: 335196 - DNA, 20 bp, Artificial
  CRISPR gRNA sequence
tatgtaaagcccttttcata

SEQ ID NO: 335197 - DNA, 20 bp, Artificial
  CRISPR gRNA sequence
atgtaaagcccttttcatat

SEQ ID NO: 335198 - DNA, 20 bp, Artificial
  CRISPR gRNA sequence
tgtaaagcccttttcatatt

SEQ ID NO: 335199 - DNA, 20 bp, Artificial
  CRISPR gRNA sequence
ttcatattgtttttctactt

SEQ ID NO: 335200 - DNA, 20 bp, Artificial
  CRISPR gRNA sequence
tcatattgtttttctactta

SEQ ID NO: 335201 - DNA, 20 bp, Artificial
  CRISPR gRNA sequence
catattgtttttctacttag

SEQ ID NO: 335202 - DNA, 20 bp, Artificial
  CRISPR gRNA sequence
atattgtttttctacttagc

SEQ ID NO: 335203 - DNA, 20 bp, Artificial
  CRISPR gRNA sequence
tttttctacttagcctaaag

SEQ ID NO: 335204 - DNA, 20 bp, Artificial
  CRISPR gRNA sequence
ttctacttagcctaaagcca

SEQ ID NO: 335205 - DNA, 20 bp, Artificial
  CRISPR gRNA sequence
tctacttagcctaaagccag

SEQ ID NO: 335206 - DNA, 20 bp, Artificial
  CRISPR gRNA sequence
ctacttagcctaaagccagg

SEQ ID NO: 335207 - DNA, 20 bp, Artificial
  CRISPR gRNA sequence
tacttagcctaaagccagga

SEQ ID NO: 335208 - DNA, 20 bp, Artificial
  CRISPR gRNA sequence
cttagcctaaagccaggaac

SEQ ID NO: 335209 - DNA, 20 bp, Artificial
  CRISPR gRNA sequence
agcctaaagccaggaaccta

SEQ ID NO: 335210 - DNA, 20 bp, Artificial
  CRISPR gRNA sequence
gcctaaagccaggaacctaa

SEQ ID NO: 335211 - DNA, 20 bp, Artificial
  CRISPR gRNA sequence
aagccaggaacctaagtcac

SEQ ID NO: 335212 - DNA, 20 bp, Artificial
  CRISPR gRNA sequence
agtcacattatcatgttttt

SEQ ID NO: 335213 - DNA, 20 bp, Artificial
  CRISPR gRNA sequence
tcatgtttttgtcacatacc

SEQ ID NO: 335214 - DNA, 20 bp, Artificial
  CRISPR gRNA sequence
ttgtcacataccacttcaac

SEQ ID NO: 335215 - DNA, 20 bp, Artificial
  CRISPR gRNA sequence
tgtcacataccacttcaaca

SEQ ID NO: 335216 - DNA, 20 bp, Artificial
  CRISPR gRNA sequence
gtcacataccacttcaacaa

SEQ ID NO: 335217 - DNA, 20 bp, Artificial
  CRISPR gRNA sequence
tcacataccacttcaacaaa

SEQ ID NO: 335218 - DNA, 20 bp, Artificial
  CRISPR gRNA sequence
caacaaagaatagaaaacag

SEQ ID NO: 335219 - DNA, 20 bp, Artificial
  CRISPR gRNA sequence
aacaaagaatagaaaacagt

SEQ ID NO: 335220 - DNA, 20 bp, Artificial
  CRISPR gRNA sequence
ctggctttttctttcagaag

SEQ ID NO: 335221 - DNA, 20 bp, Artificial
  CRISPR gRNA sequence
tggctttttctttcagaagt

SEQ ID NO: 335222 - DNA, 20 bp, Artificial
  CRISPR gRNA sequence
gctttttctttcagaagtat

SEQ ID NO: 335223 - DNA, 20 bp, Artificial
  CRISPR gRNA sequence
tttctttcagaagtattcat

SEQ ID NO: 335224 - DNA, 20 bp, Artificial
  CRISPR gRNA sequence
ttctttcagaagtattcatc

SEQ ID NO: 335225 - DNA, 20 bp, Artificial
  CRISPR gRNA sequence
tctttcagaagtattcatcc

SEQ ID NO: 335226 - DNA, 20 bp, Artificial
  CRISPR gRNA sequence
ctttcagaagtattcatcca

SEQ ID NO: 335227 - DNA, 20 bp, Artificial
  CRISPR gRNA sequence
tttcagaagtattcatccag

SEQ ID NO: 335228 - DNA, 20 bp, Artificial
  CRISPR gRNA sequence
tcagaagtattcatccagtg

SEQ ID NO: 335229 - DNA, 20 bp, Artificial
  CRISPR gRNA sequence
cagaagtattcatccagtgt

SEQ ID NO: 335230 - DNA, 20 bp, Artificial
  CRISPR gRNA sequence
agaagtattcatccagtgtg

SEQ ID NO: 335231 - DNA, 20 bp, Artificial
  CRISPR gRNA sequence
atccagtgtgcacgacccta

SEQ ID NO: 335232 - DNA, 20 bp, Artificial
  CRISPR gRNA sequence
acggtgaatacatgttcatg

SEQ ID NO: 335233 - DNA, 20 bp, Artificial
  CRISPR gRNA sequence
atgagagcagtgaacacagc

SEQ ID NO: 335234 - DNA, 20 bp, Artificial
  CRISPR gRNA sequence
gactcacaggtatgactcca

SEQ ID NO: 335235 - DNA, 20 bp, Artificial
  CRISPR gRNA sequence
acaggtatgactccatttgg

SEQ ID NO: 335236 - DNA, 20 bp, Artificial
  CRISPR gRNA sequence
catttgggggtttgggaagg

SEQ ID NO: 335237 - DNA, 20 bp, Artificial
  CRISPR gRNA sequence
gggggtttgggaagggaaga

SEQ ID NO: 335238 - DNA, 20 bp, Artificial
  CRISPR gRNA sequence
ggggtttgggaagggaagag

SEQ ID NO: 335239 - DNA, 20 bp, Artificial
  CRISPR gRNA sequence
gggaagggaagaggtttctt

SEQ ID NO: 335240 - DNA, 20 bp, Artificial
  CRISPR gRNA sequence
ggaagggaagaggtttcttc

SEQ ID NO: 335241 - DNA, 20 bp, Artificial
  CRISPR gRNA sequence
cttcacagtaagcctggaat

SEQ ID NO: 335242 - DNA, 20 bp, Artificial
  CRISPR gRNA sequence
ttcacagtaagcctggaatg

SEQ ID NO: 335243 - DNA, 20 bp, Artificial
  CRISPR gRNA sequence
cacagtaagcctggaatgtt

SEQ ID NO: 335244 - DNA, 20 bp, Artificial
  CRISPR gRNA sequence
acagtaagcctggaatgtta

SEQ ID NO: 335245 - DNA, 20 bp, Artificial
  CRISPR gRNA sequence
gaatgttaattttttttttt

SEQ ID NO: 335246 - DNA, 20 bp, Artificial
  CRISPR gRNA sequence
atttttttttttttaatttt

SEQ ID NO: 335247 - DNA, 20 bp, Artificial
  CRISPR gRNA sequence
ttttttttttaattttaaag

SEQ ID NO: 335248 - DNA, 20 bp, Artificial
  CRISPR gRNA sequence
tttttttttaattttaaagg

SEQ ID NO: 335249 - DNA, 20 bp, Artificial
  CRISPR gRNA sequence
ttttttttaattttaaagga

SEQ ID NO: 335250 - DNA, 20 bp, Artificial
  CRISPR gRNA sequence
tttttttaattttaaaggaa

SEQ ID NO: 335251 - DNA, 20 bp, Artificial
  CRISPR gRNA sequence
ttttttaattttaaaggaaa

SEQ ID NO: 335252 - DNA, 20 bp, Artificial
  CRISPR gRNA sequence
tttttaattttaaaggaaag

SEQ ID NO: 335253 - DNA, 20 bp, Artificial
  CRISPR gRNA sequence
ttttaattttaaaggaaagg

SEQ ID NO: 335254 - DNA, 20 bp, Artificial
  CRISPR gRNA sequence
tttaattttaaaggaaagga

SEQ ID NO: 335255 - DNA, 20 bp, Artificial
  CRISPR gRNA sequence
ttaattttaaaggaaaggaa

SEQ ID NO: 335256 - DNA, 20 bp, Artificial
  CRISPR gRNA sequence
taattttaaaggaaaggaaa

SEQ ID NO: 335257 - DNA, 20 bp, Artificial
  CRISPR gRNA sequence
aattttaaaggaaaggaaaa

SEQ ID NO: 335258 - DNA, 20 bp, Artificial
  CRISPR gRNA sequence
attttaaaggaaaggaaaac

SEQ ID NO: 335259 - DNA, 20 bp, Artificial
  CRISPR gRNA sequence
taaaggaaaggaaaacatct

SEQ ID NO: 335260 - DNA, 20 bp, Artificial
  CRISPR gRNA sequence
aaaggaaaggaaaacatctc

SEQ ID NO: 335261 - DNA, 20 bp, Artificial
  CRISPR gRNA sequence
aaggaaaggaaaacatctcc

SEQ ID NO: 335262 - DNA, 20 bp, Artificial
  CRISPR gRNA sequence
caaggcctaattctagaatt

SEQ ID NO: 335263 - DNA, 20 bp, Artificial
  CRISPR gRNA sequence
attctagaattttctgtgaa

SEQ ID NO: 335264 - DNA, 20 bp, Artificial
  CRISPR gRNA sequence
tagaattttctgtgaaaatc

SEQ ID NO: 335265 - DNA, 20 bp, Artificial
  CRISPR gRNA sequence
gaattttctgtgaaaatctg

SEQ ID NO: 335266 - DNA, 20 bp, Artificial
  CRISPR gRNA sequence
tctgtgaaaatctggatttc

SEQ ID NO: 335267 - DNA, 20 bp, Artificial
  CRISPR gRNA sequence
ctgtgaaaatctggatttct

SEQ ID NO: 335268 - DNA, 20 bp, Artificial
  CRISPR gRNA sequence
tgtgaaaatctggatttctc

SEQ ID NO: 335269 - DNA, 20 bp, Artificial
  CRISPR gRNA sequence
tgaaaatctggatttctcac

SEQ ID NO: 335270 - DNA, 20 bp, Artificial
  CRISPR gRNA sequence
gatttctcacttttaactag

SEQ ID NO: 335271 - DNA, 20 bp, Artificial
  CRISPR gRNA sequence
ctcacttttaactagattta

SEQ ID NO: 335272 - DNA, 20 bp, Artificial
  CRISPR gRNA sequence
tcacttttaactagatttat

SEQ ID NO: 335273 - DNA, 20 bp, Artificial
  CRISPR gRNA sequence
acttttaactagatttatat

SEQ ID NO: 335274 - DNA, 20 bp, Artificial
  CRISPR gRNA sequence
ttaactagatttatattttc

SEQ ID NO: 335275 - DNA, 20 bp, Artificial
  CRISPR gRNA sequence
taactagatttatattttct

SEQ ID NO: 335276 - DNA, 20 bp, Artificial
  CRISPR gRNA sequence
aactagatttatattttctg

SEQ ID NO: 335277 - DNA, 20 bp, Artificial
  CRISPR gRNA sequence
actagatttatattttctgc

SEQ ID NO: 335278 - DNA, 20 bp, Artificial
  CRISPR gRNA sequence
gatttatattttctgcagta

SEQ ID NO: 335279 - DNA, 20 bp, Artificial
  CRISPR gRNA sequence
atattttctgcagtatattg

SEQ ID NO: 335280 - DNA, 20 bp, Artificial
  CRISPR gRNA sequence
tattttctgcagtatattga

SEQ ID NO: 335281 - DNA, 20 bp, Artificial
  CRISPR gRNA sequence
tctgcagtatattgaaaaca

SEQ ID NO: 335282 - DNA, 20 bp, Artificial
  CRISPR gRNA sequence
ctgcagtatattgaaaacaa

SEQ ID NO: 335283 - DNA, 20 bp, Artificial
  CRISPR gRNA sequence
tgcagtatattgaaaacaaa

SEQ ID NO: 335284 - DNA, 20 bp, Artificial
  CRISPR gRNA sequence
cagtatattgaaaacaaaca

SEQ ID NO: 335285 - DNA, 20 bp, Artificial
  CRISPR gRNA sequence
aaaacaaacaagcaataggt

SEQ ID NO: 335286 - DNA, 20 bp, Artificial
  CRISPR gRNA sequence
gtaagccactattgaaacta

SEQ ID NO: 335287 - DNA, 20 bp, Artificial
  CRISPR gRNA sequence
taagccactattgaaactaa

SEQ ID NO: 335288 - DNA, 20 bp, Artificial
  CRISPR gRNA sequence
ttgaaactaaacacacaaac

SEQ ID NO: 335289 - DNA, 20 bp, Artificial
  CRISPR gRNA sequence
aaactaaacacacaaacagc

SEQ ID NO: 335290 - DNA, 20 bp, Artificial
  CRISPR gRNA sequence
aacacacaaacagctcataa

SEQ ID NO: 335291 - DNA, 20 bp, Artificial
  CRISPR gRNA sequence
ataaaccaccatagtatcaa

SEQ ID NO: 335292 - DNA, 20 bp, Artificial
  CRISPR gRNA sequence
tcccattgatgtttcaaaag

SEQ ID NO: 335293 - DNA, 20 bp, Artificial
  CRISPR gRNA sequence
cccattgatgtttcaaaagt

SEQ ID NO: 335294 - DNA, 20 bp, Artificial
  CRISPR gRNA sequence
ccattgatgtttcaaaagtt

SEQ ID NO: 335295 - DNA, 20 bp, Artificial
  CRISPR gRNA sequence
atgtttcaaaagttgggatg

SEQ ID NO: 335296 - DNA, 20 bp, Artificial
  CRISPR gRNA sequence
caaaagttgggatgattcta

SEQ ID NO: 335297 - DNA, 20 bp, Artificial
  CRISPR gRNA sequence
aaaagttgggatgattctaa

SEQ ID NO: 335298 - DNA, 20 bp, Artificial
  CRISPR gRNA sequence
ggatgattctaagtgttttt

SEQ ID NO: 335299 - DNA, 20 bp, Artificial
  CRISPR gRNA sequence
taagtgttttttgttgaagg

SEQ ID NO: 335300 - DNA, 20 bp, Artificial
  CRISPR gRNA sequence
agtgttttttgttgaagggt

SEQ ID NO: 335301 - DNA, 20 bp, Artificial
  CRISPR gRNA sequence
tttgttgaagggttcattca

SEQ ID NO: 335302 - DNA, 20 bp, Artificial
  CRISPR gRNA sequence
ttgttgaagggttcattcag

SEQ ID NO: 335303 - DNA, 20 bp, Artificial
  CRISPR gRNA sequence
tgttgaagggttcattcagt

SEQ ID NO: 335304 - DNA, 20 bp, Artificial
  CRISPR gRNA sequence
gttgaagggttcattcagtc

SEQ ID NO: 335305 - DNA, 20 bp, Artificial
  CRISPR gRNA sequence
ttgaagggttcattcagtca

SEQ ID NO: 335306 - DNA, 20 bp, Artificial
  CRISPR gRNA sequence
aagggttcattcagtcattc

SEQ ID NO: 335307 - DNA, 20 bp, Artificial
  CRISPR gRNA sequence
attcagtcattcaatgagcg

SEQ ID NO: 335308 - DNA, 20 bp, Artificial
  CRISPR gRNA sequence
agtcattcaatgagcgttta

SEQ ID NO: 335309 - DNA, 20 bp, Artificial
  CRISPR gRNA sequence
aatgagcgtttattgagcat

SEQ ID NO: 335310 - DNA, 20 bp, Artificial
  CRISPR gRNA sequence
attgagcatcagttaagtgt

SEQ ID NO: 335311 - DNA, 20 bp, Artificial
  CRISPR gRNA sequence
ttgagcatcagttaagtgtg

SEQ ID NO: 335312 - DNA, 20 bp, Artificial
  CRISPR gRNA sequence
agcatcagttaagtgtgagt

SEQ ID NO: 335313 - DNA, 20 bp, Artificial
  CRISPR gRNA sequence
agtgtgagttactgagtgag

SEQ ID NO: 335314 - DNA, 20 bp, Artificial
  CRISPR gRNA sequence
ctgagtgaggcactctgggg

SEQ ID NO: 335315 - DNA, 20 bp, Artificial
  CRISPR gRNA sequence
agtgaggcactctggggaat

SEQ ID NO: 335316 - DNA, 20 bp, Artificial
  CRISPR gRNA sequence
tggggaatttggacagatat

SEQ ID NO: 335317 - DNA, 20 bp, Artificial
  CRISPR gRNA sequence
gggaatttggacagatatat

SEQ ID NO: 335318 - DNA, 20 bp, Artificial
  CRISPR gRNA sequence
ggacagatatatgctaattt

SEQ ID NO: 335319 - DNA, 20 bp, Artificial
  CRISPR gRNA sequence
gacagatatatgctaatttt

SEQ ID NO: 335320 - DNA, 20 bp, Artificial
  CRISPR gRNA sequence
attttggactgagattagga

SEQ ID NO: 335321 - DNA, 20 bp, Artificial
  CRISPR gRNA sequence
tggactgagattaggaagag

SEQ ID NO: 335322 - DNA, 20 bp, Artificial
  CRISPR gRNA sequence
ggactgagattaggaagaga

SEQ ID NO: 335323 - DNA, 20 bp, Artificial
  CRISPR gRNA sequence
gactgagattaggaagagag

SEQ ID NO: 335324 - DNA, 20 bp, Artificial
  CRISPR gRNA sequence
agattaggaagagagatctg

SEQ ID NO: 335325 - DNA, 20 bp, Artificial
  CRISPR gRNA sequence
ggaagagagatctgtgctgg

SEQ ID NO: 335326 - DNA, 20 bp, Artificial
  CRISPR gRNA sequence
tgctggtactgctagaggga

SEQ ID NO: 335327 - DNA, 20 bp, Artificial
  CRISPR gRNA sequence
gtactgctagagggaagaag

SEQ ID NO: 335328 - DNA, 20 bp, Artificial
  CRISPR gRNA sequence
ctagagggaagaaggagaaa

SEQ ID NO: 335329 - DNA, 20 bp, Artificial
  CRISPR gRNA sequence
gagggaagaaggagaaattg

SEQ ID NO: 335330 - DNA, 20 bp, Artificial
  CRISPR gRNA sequence
atgaagatatctggttattt

SEQ ID NO: 335331 - DNA, 20 bp, Artificial
  CRISPR gRNA sequence
gttattttgaggtaaagagt

SEQ ID NO: 335332 - DNA, 20 bp, Artificial
  CRISPR gRNA sequence
ttttgaggtaaagagtgtgc

SEQ ID NO: 335333 - DNA, 20 bp, Artificial
  CRISPR gRNA sequence
tgaggtaaagagtgtgcaag

SEQ ID NO: 335334 - DNA, 20 bp, Artificial
  CRISPR gRNA sequence
gaggtaaagagtgtgcaagt

SEQ ID NO: 335335 - DNA, 20 bp, Artificial
  CRISPR gRNA sequence
aggtaaagagtgtgcaagtt

SEQ ID NO: 335336 - DNA, 20 bp, Artificial
  CRISPR gRNA sequence
agagaacttggatggcttta

SEQ ID NO: 335337 - DNA, 20 bp, Artificial
  CRISPR gRNA sequence
gagaacttggatggctttag

SEQ ID NO: 335338 - DNA, 20 bp, Artificial
  CRISPR gRNA sequence
ggatggctttagaagtctca

SEQ ID NO: 335339 - DNA, 20 bp, Artificial
  CRISPR gRNA sequence
gatggctttagaagtctcag

SEQ ID NO: 335340 - DNA, 20 bp, Artificial
  CRISPR gRNA sequence
tagaagtctcagtaacatgg

SEQ ID NO: 335341 - DNA, 20 bp, Artificial
  CRISPR gRNA sequence
agaagtctcagtaacatgga

SEQ ID NO: 335342 - DNA, 20 bp, Artificial
  CRISPR gRNA sequence
gaagtctcagtaacatggaa

SEQ ID NO: 335343 - DNA, 20 bp, Artificial
  CRISPR gRNA sequence
agtaacatggaaatttgacc

SEQ ID NO: 335344 - DNA, 20 bp, Artificial
  CRISPR gRNA sequence
gaccttttctgttaagagtc

SEQ ID NO: 335345 - DNA, 20 bp, Artificial
  CRISPR gRNA sequence
accttttctgttaagagtca

SEQ ID NO: 335346 - DNA, 20 bp, Artificial
  CRISPR gRNA sequence
ttctgttaagagtcagaaaa

SEQ ID NO: 335347 - DNA, 20 bp, Artificial
  CRISPR gRNA sequence
tctgttaagagtcagaaaac

SEQ ID NO: 335348 - DNA, 20 bp, Artificial
  CRISPR gRNA sequence
ctgttaagagtcagaaaact

SEQ ID NO: 335349 - DNA, 20 bp, Artificial
  CRISPR gRNA sequence
tgttaagagtcagaaaactg

SEQ ID NO: 335350 - DNA, 20 bp, Artificial
  CRISPR gRNA sequence
ttaagagtcagaaaactgaa

SEQ ID NO: 335351 - DNA, 20 bp, Artificial
  CRISPR gRNA sequence
agagtcagaaaactgaaagt

SEQ ID NO: 335352 - DNA, 20 bp, Artificial
  CRISPR gRNA sequence
aaagttgccaagtttgagga

SEQ ID NO: 335353 - DNA, 20 bp, Artificial
  CRISPR gRNA sequence
ccaagtttgaggagcaccca

SEQ ID NO: 335354 - DNA, 20 bp, Artificial
  CRISPR gRNA sequence
gaggagcacccagaaagttt

SEQ ID NO: 335355 - DNA, 20 bp, Artificial
  CRISPR gRNA sequence
aggagcacccagaaagtttg

SEQ ID NO: 335356 - DNA, 20 bp, Artificial
  CRISPR gRNA sequence
gaagcttccattgtggaaaa

SEQ ID NO: 335357 - DNA, 20 bp, Artificial
  CRISPR gRNA sequence
aagcttccattgtggaaaat

SEQ ID NO: 335358 - DNA, 20 bp, Artificial
  CRISPR gRNA sequence
ccattgtggaaaattcatgt

SEQ ID NO: 335359 - DNA, 20 bp, Artificial
  CRISPR gRNA sequence
cattgtggaaaattcatgtc

SEQ ID NO: 335360 - DNA, 20 bp, Artificial
  CRISPR gRNA sequence
tggaaaattcatgtcttatg

SEQ ID NO: 335361 - DNA, 20 bp, Artificial
  CRISPR gRNA sequence
atgtcttatgcccttgaggt

SEQ ID NO: 335362 - DNA, 20 bp, Artificial
  CRISPR gRNA sequence
atgcccttgaggttcgaatg

SEQ ID NO: 335363 - DNA, 20 bp, Artificial
  CRISPR gRNA sequence
tgcccttgaggttcgaatga

SEQ ID NO: 335364 - DNA, 20 bp, Artificial
  CRISPR gRNA sequence
gaggttcgaatgatgtgcga

SEQ ID NO: 335365 - DNA, 20 bp, Artificial
  CRISPR gRNA sequence
aggttcgaatgatgtgcgat

SEQ ID NO: 335366 - DNA, 20 bp, Artificial
  CRISPR gRNA sequence
gaatgatgtgcgatgtgtaa

SEQ ID NO: 335367 - DNA, 20 bp, Artificial
  CRISPR gRNA sequence
catttttccacccctcagtg

SEQ ID NO: 335368 - DNA, 20 bp, Artificial
  CRISPR gRNA sequence
ttccacccctcagtggctac

SEQ ID NO: 335369 - DNA, 20 bp, Artificial
  CRISPR gRNA sequence
tccacccctcagtggctaca

SEQ ID NO: 335370 - DNA, 20 bp, Artificial
  CRISPR gRNA sequence
ccacccctcagtggctacag

SEQ ID NO: 335371 - DNA, 20 bp, Artificial
  CRISPR gRNA sequence
cacccctcagtggctacaga

SEQ ID NO: 335372 - DNA, 20 bp, Artificial
  CRISPR gRNA sequence
agtggctacagattatctaa

SEQ ID NO: 335373 - DNA, 20 bp, Artificial
  CRISPR gRNA sequence
cagattatctaaaggggaca

SEQ ID NO: 335374 - DNA, 20 bp, Artificial
  CRISPR gRNA sequence
tctaaaggggacacacatag

SEQ ID NO: 335375 - DNA, 20 bp, Artificial
  CRISPR gRNA sequence
aaggggacacacatagcttg

SEQ ID NO: 335376 - DNA, 20 bp, Artificial
  CRISPR gRNA sequence
gcgttgtcatggaattatag

SEQ ID NO: 335377 - DNA, 20 bp, Artificial
  CRISPR gRNA sequence
cgttgtcatggaattatagc

SEQ ID NO: 335378 - DNA, 20 bp, Artificial
  CRISPR gRNA sequence
tcatggaattatagcatggg

SEQ ID NO: 335379 - DNA, 20 bp, Artificial
  CRISPR gRNA sequence
tagcatgggatgggagctaa

SEQ ID NO: 335380 - DNA, 20 bp, Artificial
  CRISPR gRNA sequence
aaaaggatccttgagttcac

SEQ ID NO: 335381 - DNA, 20 bp, Artificial
  CRISPR gRNA sequence
gagttcacatttcatgtttt

SEQ ID NO: 335382 - DNA, 20 bp, Artificial
  CRISPR gRNA sequence
agttcacatttcatgtttta

SEQ ID NO: 335383 - DNA, 20 bp, Artificial
  CRISPR gRNA sequence
acatttcatgttttagatga

SEQ ID NO: 335384 - DNA, 20 bp, Artificial
  CRISPR gRNA sequence
catgttttagatgacagaaa

SEQ ID NO: 335385 - DNA, 20 bp, Artificial
  CRISPR gRNA sequence
atgttttagatgacagaaat

SEQ ID NO: 335386 - DNA, 20 bp, Artificial
  CRISPR gRNA sequence
tagatgacagaaattgatgc

SEQ ID NO: 335387 - DNA, 20 bp, Artificial
  CRISPR gRNA sequence
agatgacagaaattgatgct

SEQ ID NO: 335388 - DNA, 20 bp, Artificial
  CRISPR gRNA sequence
gatgacagaaattgatgctc

SEQ ID NO: 335389 - DNA, 20 bp, Artificial
  CRISPR gRNA sequence
atgctcaaagtgttcagtga

SEQ ID NO: 335390 - DNA, 20 bp, Artificial
  CRISPR gRNA sequence
aaagtgttcagtgactcttt

SEQ ID NO: 335391 - DNA, 20 bp, Artificial
  CRISPR gRNA sequence
agtgactcttttggttccct

SEQ ID NO: 335392 - DNA, 20 bp, Artificial
  CRISPR gRNA sequence
ttttggttccctagacagtt

SEQ ID NO: 335393 - DNA, 20 bp, Artificial
  CRISPR gRNA sequence
ttggttccctagacagttaa

SEQ ID NO: 335394 - DNA, 20 bp, Artificial
  CRISPR gRNA sequence
tggttccctagacagttaat

SEQ ID NO: 335395 - DNA, 20 bp, Artificial
  CRISPR gRNA sequence
ggttccctagacagttaata

SEQ ID NO: 335396 - DNA, 20 bp, Artificial
  CRISPR gRNA sequence
gttccctagacagttaatac

SEQ ID NO: 335397 - DNA, 20 bp, Artificial
  CRISPR gRNA sequence
cctagacagttaatacctag

SEQ ID NO: 335398 - DNA, 20 bp, Artificial
  CRISPR gRNA sequence
gacagttaatacctagcttt

SEQ ID NO: 335399 - DNA, 20 bp, Artificial
  CRISPR gRNA sequence
atacctagctttgacacttg

SEQ ID NO: 335400 - DNA, 20 bp, Artificial
  CRISPR gRNA sequence
gctttgacacttgcaaagag

SEQ ID NO: 335401 - DNA, 20 bp, Artificial
  CRISPR gRNA sequence
tgacacttgcaaagagctta

SEQ ID NO: 335402 - DNA, 20 bp, Artificial
  CRISPR gRNA sequence
gacacttgcaaagagcttat

SEQ ID NO: 335403 - DNA, 20 bp, Artificial
  CRISPR gRNA sequence
acacttgcaaagagcttatg

SEQ ID NO: 335404 - DNA, 20 bp, Artificial
  CRISPR gRNA sequence
gcaaagagcttatgtttcat

SEQ ID NO: 335405 - DNA, 20 bp, Artificial
  CRISPR gRNA sequence
caaagagcttatgtttcatt

SEQ ID NO: 335406 - DNA, 20 bp, Artificial
  CRISPR gRNA sequence
atgtttcattactttgctgt

SEQ ID NO: 335407 - DNA, 20 bp, Artificial
  CRISPR gRNA sequence
tgtttcattactttgctgtt

SEQ ID NO: 335408 - DNA, 20 bp, Artificial
  CRISPR gRNA sequence
cattactttgctgtttaaaa

SEQ ID NO: 335409 - DNA, 20 bp, Artificial
  CRISPR gRNA sequence
attactttgctgtttaaaaa

SEQ ID NO: 335410 - DNA, 20 bp, Artificial
  CRISPR gRNA sequence
ctttgctgtttaaaaaatat

SEQ ID NO: 335411 - DNA, 20 bp, Artificial
  CRISPR gRNA sequence
tgctgtttaaaaaatatatg

SEQ ID NO: 335412 - DNA, 20 bp, Artificial
  CRISPR gRNA sequence
gctgtttaaaaaatatatga

SEQ ID NO: 335413 - DNA, 20 bp, Artificial
  CRISPR gRNA sequence
ctgtttaaaaaatatatgat

SEQ ID NO: 335414 - DNA, 20 bp, Artificial
  CRISPR gRNA sequence
tttaaaaaatatatgatctc

SEQ ID NO: 335415 - DNA, 20 bp, Artificial
  CRISPR gRNA sequence
aaaaaatatatgatctctca

SEQ ID NO: 335416 - DNA, 20 bp, Artificial
  CRISPR gRNA sequence
aaaaatatatgatctctcaa

SEQ ID NO: 335417 - DNA, 20 bp, Artificial
  CRISPR gRNA sequence
tcaatctctttgcttaatgt

SEQ ID NO: 335418 - DNA, 20 bp, Artificial
  CRISPR gRNA sequence
aatctctttgcttaatgtgt

SEQ ID NO: 335419 - DNA, 20 bp, Artificial
  CRISPR gRNA sequence
tttgcttaatgtgttctggc

SEQ ID NO: 335420 - DNA, 20 bp, Artificial
  CRISPR gRNA sequence
tgcttaatgtgttctggctg

SEQ ID NO: 335421 - DNA, 20 bp, Artificial
  CRISPR gRNA sequence
gcttaatgtgttctggctgt

SEQ ID NO: 335422 - DNA, 20 bp, Artificial
  CRISPR gRNA sequence
cttaatgtgttctggctgtt

SEQ ID NO: 335423 - DNA, 20 bp, Artificial
  CRISPR gRNA sequence
aatgtgttctggctgtttgg

SEQ ID NO: 335424 - DNA, 20 bp, Artificial
  CRISPR gRNA sequence
atgtgttctggctgtttgga

SEQ ID NO: 335425 - DNA, 20 bp, Artificial
  CRISPR gRNA sequence
tggctgtttggatccccaca

SEQ ID NO: 335426 - DNA, 20 bp, Artificial
  CRISPR gRNA sequence
gctgtttggatccccacaag

SEQ ID NO: 335427 - DNA, 20 bp, Artificial
  CRISPR gRNA sequence
tttggatccccacaagcaga

SEQ ID NO: 335428 - DNA, 20 bp, Artificial
  CRISPR gRNA sequence
ggatccccacaagcagaacc

SEQ ID NO: 335429 - DNA, 20 bp, Artificial
  CRISPR gRNA sequence
gatccccacaagcagaacct

SEQ ID NO: 335430 - DNA, 20 bp, Artificial
  CRISPR gRNA sequence
acataaggacttgggtgcaa

SEQ ID NO: 335431 - DNA, 20 bp, Artificial
  CRISPR gRNA sequence
gggtgcaagtagtttatttg

SEQ ID NO: 335432 - DNA, 20 bp, Artificial
  CRISPR gRNA sequence
ggtgcaagtagtttatttgg

SEQ ID NO: 335433 - DNA, 20 bp, Artificial
  CRISPR gRNA sequence
atttgggaggtgatcccagg

SEQ ID NO: 335434 - DNA, 20 bp, Artificial
  CRISPR gRNA sequence
tttgggaggtgatcccagga

SEQ ID NO: 335435 - DNA, 20 bp, Artificial
  CRISPR gRNA sequence
gggaggtgatcccaggaaga

SEQ ID NO: 335436 - DNA, 20 bp, Artificial
  CRISPR gRNA sequence
ggaggtgatcccaggaagaa

SEQ ID NO: 335437 - DNA, 20 bp, Artificial
  CRISPR gRNA sequence
ttatcaaggtctcagctcca

SEQ ID NO: 335438 - DNA, 20 bp, Artificial
  CRISPR gRNA sequence
tcaaggtctcagctccaggc

SEQ ID NO: 335439 - DNA, 20 bp, Artificial
  CRISPR gRNA sequence
agctccaggccacagaggcc

SEQ ID NO: 335440 - DNA, 20 bp, Artificial
  CRISPR gRNA sequence
caggccacagaggcctgact

SEQ ID NO: 335441 - DNA, 20 bp, Artificial
  CRISPR gRNA sequence
acttcattggacctctgaga

SEQ ID NO: 335442 - DNA, 20 bp, Artificial
  CRISPR gRNA sequence
cattggacctctgagaagtg

SEQ ID NO: 335443 - DNA, 20 bp, Artificial
  CRISPR gRNA sequence
attggacctctgagaagtgt

SEQ ID NO: 335444 - DNA, 20 bp, Artificial
  CRISPR gRNA sequence
gacctctgagaagtgtacag

SEQ ID NO: 335445 - DNA, 20 bp, Artificial
  CRISPR gRNA sequence
tgagaagtgtacagatgcct

SEQ ID NO: 335446 - DNA, 20 bp, Artificial
  CRISPR gRNA sequence
agaagtgtacagatgcctcc

SEQ ID NO: 335447 - DNA, 20 bp, Artificial
  CRISPR gRNA sequence
ccagaatcattctcttgaag

SEQ ID NO: 335448 - DNA, 20 bp, Artificial
  CRISPR gRNA sequence
tcttgaaggatggcaaccac

SEQ ID NO: 335449 - DNA, 20 bp, Artificial
  CRISPR gRNA sequence
ttgaaggatggcaaccactg

SEQ ID NO: 335450 - DNA, 20 bp, Artificial
  CRISPR gRNA sequence
gaaggatggcaaccactggc

SEQ ID NO: 335451 - DNA, 20 bp, Artificial
  CRISPR gRNA sequence
aaggatggcaaccactggct

SEQ ID NO: 335452 - DNA, 20 bp, Artificial
  CRISPR gRNA sequence
gctccatcctcactgatttg

SEQ ID NO: 335453 - DNA, 20 bp, Artificial
  CRISPR gRNA sequence
catcctcactgatttggggt

SEQ ID NO: 335454 - DNA, 20 bp, Artificial
  CRISPR gRNA sequence
actgatttggggttgcctgc

SEQ ID NO: 335455 - DNA, 20 bp, Artificial
  CRISPR gRNA sequence
atttggggttgcctgcggag

SEQ ID NO: 335456 - DNA, 20 bp, Artificial
  CRISPR gRNA sequence
ggggttgcctgcggagggca

SEQ ID NO: 335457 - DNA, 20 bp, Artificial
  CRISPR gRNA sequence
gggttgcctgcggagggcat

SEQ ID NO: 335458 - DNA, 20 bp, Artificial
  CRISPR gRNA sequence
cctgcggagggcattagctt

SEQ ID NO: 335459 - DNA, 20 bp, Artificial
  CRISPR gRNA sequence
cggagggcattagctttccc

SEQ ID NO: 335460 - DNA, 20 bp, Artificial
  CRISPR gRNA sequence
gctttccctcatctctgagc

SEQ ID NO: 335461 - DNA, 20 bp, Artificial
  CRISPR gRNA sequence
tccctcatctctgagctgtg

SEQ ID NO: 335462 - DNA, 20 bp, Artificial
  CRISPR gRNA sequence
ccctcatctctgagctgtgc

SEQ ID NO: 335463 - DNA, 20 bp, Artificial
  CRISPR gRNA sequence
cctcatctctgagctgtgcc

SEQ ID NO: 335464 - DNA, 20 bp, Artificial
  CRISPR gRNA sequence
atctctgagctgtgcctcta

SEQ ID NO: 335465 - DNA, 20 bp, Artificial
  CRISPR gRNA sequence
tgagctgtgcctctacttgg

SEQ ID NO: 335466 - DNA, 20 bp, Artificial
  CRISPR gRNA sequence
agctgtgcctctacttggga

SEQ ID NO: 335467 - DNA, 20 bp, Artificial
  CRISPR gRNA sequence
tgcctctacttgggatgagc

SEQ ID NO: 335468 - DNA, 20 bp, Artificial
  CRISPR gRNA sequence
tacttgggatgagcctactt

SEQ ID NO: 335469 - DNA, 20 bp, Artificial
  CRISPR gRNA sequence
cttgggatgagcctacttgg

SEQ ID NO: 335470 - DNA, 20 bp, Artificial
  CRISPR gRNA sequence
gggatgagcctacttgggat

SEQ ID NO: 335471 - DNA, 20 bp, Artificial
  CRISPR gRNA sequence
ggatgagcctacttgggatg

SEQ ID NO: 335472 - DNA, 20 bp, Artificial
  CRISPR gRNA sequence
cttgggatgagtcttcagag

SEQ ID NO: 335473 - DNA, 20 bp, Artificial
  CRISPR gRNA sequence
gggatgagtcttcagagaaa

SEQ ID NO: 335474 - DNA, 20 bp, Artificial
  CRISPR gRNA sequence
ggatgagtcttcagagaaag

SEQ ID NO: 335475 - DNA, 20 bp, Artificial
  CRISPR gRNA sequence
cagagaaagtctggaggcag

SEQ ID NO: 335476 - DNA, 20 bp, Artificial
  CRISPR gRNA sequence
agagaaagtctggaggcaga

SEQ ID NO: 335477 - DNA, 20 bp, Artificial
  CRISPR gRNA sequence
gaggcagaaaagcagtgaaa

SEQ ID NO: 335478 - DNA, 20 bp, Artificial
  CRISPR gRNA sequence
ttgtgctagaacagtcagcc

SEQ ID NO: 335479 - DNA, 20 bp, Artificial
  CRISPR gRNA sequence
tgctagaacagtcagcccat

SEQ ID NO: 335480 - DNA, 20 bp, Artificial
  CRISPR gRNA sequence
gaacagtcagcccatgcagc

SEQ ID NO: 335481 - DNA, 20 bp, Artificial
  CRISPR gRNA sequence
tctgccccagcagcagctgc

SEQ ID NO: 335482 - DNA, 20 bp, Artificial
  CRISPR gRNA sequence
ctgccccagcagcagctgca

SEQ ID NO: 335483 - DNA, 20 bp, Artificial
  CRISPR gRNA sequence
tgccccagcagcagctgcaa

SEQ ID NO: 335484 - DNA, 20 bp, Artificial
  CRISPR gRNA sequence
ccccagcagcagctgcaatc

SEQ ID NO: 335485 - DNA, 20 bp, Artificial
  CRISPR gRNA sequence
caatcagaggtggacagttt

SEQ ID NO: 335486 - DNA, 20 bp, Artificial
  CRISPR gRNA sequence
caaagtgatgagtttagata

SEQ ID NO: 335487 - DNA, 20 bp, Artificial
  CRISPR gRNA sequence
aaagtgatgagtttagataa

SEQ ID NO: 335488 - DNA, 20 bp, Artificial
  CRISPR gRNA sequence
agataatgtctgttatagga

SEQ ID NO: 335489 - DNA, 20 bp, Artificial
  CRISPR gRNA sequence
gataatgtctgttataggag

SEQ ID NO: 335490 - DNA, 20 bp, Artificial
  CRISPR gRNA sequence
ttataggagtcgagagctaa

SEQ ID NO: 335491 - DNA, 20 bp, Artificial
  CRISPR gRNA sequence
taggagtcgagagctaaact

SEQ ID NO: 335492 - DNA, 20 bp, Artificial
  CRISPR gRNA sequence
aacttctctggaaatgggga

SEQ ID NO: 335493 - DNA, 20 bp, Artificial
  CRISPR gRNA sequence
ctctggaaatggggaactgg

SEQ ID NO: 335494 - DNA, 20 bp, Artificial
  CRISPR gRNA sequence
tctggaaatggggaactggt

SEQ ID NO: 335495 - DNA, 20 bp, Artificial
  CRISPR gRNA sequence
tggaaatggggaactggtgc

SEQ ID NO: 335496 - DNA, 20 bp, Artificial
  CRISPR gRNA sequence
gaaatggggaactggtgctg

SEQ ID NO: 335497 - DNA, 20 bp, Artificial
  CRISPR gRNA sequence
gtgctgggtgttgaagcata

SEQ ID NO: 335498 - DNA, 20 bp, Artificial
  CRISPR gRNA sequence
ggtgttgaagcataaagatg

SEQ ID NO: 335499 - DNA, 20 bp, Artificial
  CRISPR gRNA sequence
aagcataaagatgagtttgc

SEQ ID NO: 335500 - DNA, 20 bp, Artificial
  CRISPR gRNA sequence
gcatggtgtgtgtgtgagtg

SEQ ID NO: 335501 - DNA, 20 bp, Artificial
  CRISPR gRNA sequence
catggtgtgtgtgtgagtgt

SEQ ID NO: 335502 - DNA, 20 bp, Artificial
  CRISPR gRNA sequence
gtgtgtatgaaaggcaatgg

SEQ ID NO: 335503 - DNA, 20 bp, Artificial
  CRISPR gRNA sequence
tgtgtatgaaaggcaatgga

SEQ ID NO: 335504 - DNA, 20 bp, Artificial
  CRISPR gRNA sequence
cttgtagggaactggcacat

SEQ ID NO: 335505 - DNA, 20 bp, Artificial
  CRISPR gRNA sequence
ttgtagggaactggcacatg

SEQ ID NO: 335506 - DNA, 20 bp, Artificial
  CRISPR gRNA sequence
gtagggaactggcacatgga

SEQ ID NO: 335507 - DNA, 20 bp, Artificial
  CRISPR gRNA sequence
tagggaactggcacatggag

SEQ ID NO: 335508 - DNA, 20 bp, Artificial
  CRISPR gRNA sequence
gcacatggagagcatttaga

SEQ ID NO: 335509 - DNA, 20 bp, Artificial
  CRISPR gRNA sequence
agataatttatgctgaattt

SEQ ID NO: 335510 - DNA, 20 bp, Artificial
  CRISPR gRNA sequence
gataatttatgctgaatttt

SEQ ID NO: 335511 - DNA, 20 bp, Artificial
  CRISPR gRNA sequence
atgctgaatttttgttacag

SEQ ID NO: 335512 - DNA, 20 bp, Artificial
  CRISPR gRNA sequence
tgctgaatttttgttacaga

SEQ ID NO: 335513 - DNA, 20 bp, Artificial
  CRISPR gRNA sequence
aatttttgttacagatgtga

SEQ ID NO: 335514 - DNA, 20 bp, Artificial
  CRISPR gRNA sequence
ttgttacagatgtgacccta

SEQ ID NO: 335515 - DNA, 20 bp, Artificial
  CRISPR gRNA sequence
tgttacagatgtgaccctat

SEQ ID NO: 335516 - DNA, 20 bp, Artificial
  CRISPR gRNA sequence
gttacagatgtgaccctata

SEQ ID NO: 335517 - DNA, 20 bp, Artificial
  CRISPR gRNA sequence
ttacagatgtgaccctataa

SEQ ID NO: 335518 - DNA, 20 bp, Artificial
  CRISPR gRNA sequence
cagatgtgaccctataatat

SEQ ID NO: 335519 - DNA, 20 bp, Artificial
  CRISPR gRNA sequence
taatatggaactctggcacc

SEQ ID NO: 335520 - DNA, 20 bp, Artificial
  CRISPR gRNA sequence
tggcacccaggcatgaagca

SEQ ID NO: 335521 - DNA, 20 bp, Artificial
  CRISPR gRNA sequence
gcacccaggcatgaagcacg

SEQ ID NO: 335522 - DNA, 20 bp, Artificial
  CRISPR gRNA sequence
gccagttttcctcaacttga

SEQ ID NO: 335523 - DNA, 20 bp, Artificial
  CRISPR gRNA sequence
tcctcaacttgaagtgcaag

SEQ ID NO: 335524 - DNA, 20 bp, Artificial
  CRISPR gRNA sequence
cctcaacttgaagtgcaaga

SEQ ID NO: 335525 - DNA, 20 bp, Artificial
  CRISPR gRNA sequence
ctcaacttgaagtgcaagat

SEQ ID NO: 335526 - DNA, 20 bp, Artificial
  CRISPR gRNA sequence
aacttgaagtgcaagattct

SEQ ID NO: 335527 - DNA, 20 bp, Artificial
  CRISPR gRNA sequence
gaagtgcaagattctcttat

SEQ ID NO: 335528 - DNA, 20 bp, Artificial
  CRISPR gRNA sequence
aagtgcaagattctcttatt

SEQ ID NO: 335529 - DNA, 20 bp, Artificial
  CRISPR gRNA sequence
tcttatttccgggaccacgg

SEQ ID NO: 335530 - DNA, 20 bp, Artificial
  CRISPR gRNA sequence
ttatttccgggaccacggag

SEQ ID NO: 335531 - DNA, 20 bp, Artificial
  CRISPR gRNA sequence
atttccgggaccacggagag

SEQ ID NO: 335532 - DNA, 20 bp, Artificial
  CRISPR gRNA sequence
tttccgggaccacggagagt

SEQ ID NO: 335533 - DNA, 20 bp, Artificial
  CRISPR gRNA sequence
ccgggaccacggagagtctg

SEQ ID NO: 335534 - DNA, 20 bp, Artificial
  CRISPR gRNA sequence
cgggaccacggagagtctga

SEQ ID NO: 335535 - DNA, 20 bp, Artificial
  CRISPR gRNA sequence
acttaactacatacatcttc

SEQ ID NO: 335536 - DNA, 20 bp, Artificial
  CRISPR gRNA sequence
aactacatacatcttctgct

SEQ ID NO: 335537 - DNA, 20 bp, Artificial
  CRISPR gRNA sequence
actacatacatcttctgctg

SEQ ID NO: 335538 - DNA, 20 bp, Artificial
  CRISPR gRNA sequence
catacatcttctgctggtgt

SEQ ID NO: 335539 - DNA, 20 bp, Artificial
  CRISPR gRNA sequence
ctgctggtgttttgttcaat

SEQ ID NO: 335540 - DNA, 20 bp, Artificial
  CRISPR gRNA sequence
tgctggtgttttgttcaatc

SEQ ID NO: 335541 - DNA, 20 bp, Artificial
  CRISPR gRNA sequence
ctggtgttttgttcaatctg

SEQ ID NO: 335542 - DNA, 20 bp, Artificial
  CRISPR gRNA sequence
gtgttttgttcaatctggaa

SEQ ID NO: 335543 - DNA, 20 bp, Artificial
  CRISPR gRNA sequence
tgttcaatctggaagaatga

SEQ ID NO: 335544 - DNA, 20 bp, Artificial
  CRISPR gRNA sequence
gttcaatctggaagaatgac

SEQ ID NO: 335545 - DNA, 20 bp, Artificial
  CRISPR gRNA sequence
ttcaatctggaagaatgact

SEQ ID NO: 335546 - DNA, 20 bp, Artificial
  CRISPR gRNA sequence
aatctggaagaatgactgta

SEQ ID NO: 335547 - DNA, 20 bp, Artificial
  CRISPR gRNA sequence
gaagaatgactgtatcagtc

SEQ ID NO: 335548 - DNA, 20 bp, Artificial
  CRISPR gRNA sequence
tatcagtcaatggggatttt

SEQ ID NO: 335549 - DNA, 20 bp, Artificial
  CRISPR gRNA sequence
taacagactgccttggtact

SEQ ID NO: 335550 - DNA, 20 bp, Artificial
  CRISPR gRNA sequence
aacagactgccttggtactg

SEQ ID NO: 335551 - DNA, 20 bp, Artificial
  CRISPR gRNA sequence
acagactgccttggtactgc

SEQ ID NO: 335552 - DNA, 20 bp, Artificial
  CRISPR gRNA sequence
ccttggtactgccgagtcct

SEQ ID NO: 335553 - DNA, 20 bp, Artificial
  CRISPR gRNA sequence
ggtactgccgagtcctctca

SEQ ID NO: 335554 - DNA, 20 bp, Artificial
  CRISPR gRNA sequence
gtactgccgagtcctctcaa

SEQ ID NO: 335555 - DNA, 20 bp, Artificial
  CRISPR gRNA sequence
ccgagtcctctcaaaacaaa

SEQ ID NO: 335556 - DNA, 20 bp, Artificial
  CRISPR gRNA sequence
tcaaaacaaacaccctcttg

SEQ ID NO: 335557 - DNA, 20 bp, Artificial
  CRISPR gRNA sequence
aaaacaaacaccctcttgca

SEQ ID NO: 335558 - DNA, 20 bp, Artificial
  CRISPR gRNA sequence
ttgcaaccagctttggagaa

SEQ ID NO: 335559 - DNA, 20 bp, Artificial
  CRISPR gRNA sequence
gcaaccagctttggagaaag

SEQ ID NO: 335560 - DNA, 20 bp, Artificial
  CRISPR gRNA sequence
caaccagctttggagaaagc

SEQ ID NO: 335561 - DNA, 20 bp, Artificial
  CRISPR gRNA sequence
tggagaaagcccagctcctg

SEQ ID NO: 335562 - DNA, 20 bp, Artificial
  CRISPR gRNA sequence
ggagaaagcccagctcctgt

SEQ ID NO: 335563 - DNA, 20 bp, Artificial
  CRISPR gRNA sequence
gagaaagcccagctcctgtg

SEQ ID NO: 335564 - DNA, 20 bp, Artificial
  CRISPR gRNA sequence
ctgtgtgctcactgggagtg

SEQ ID NO: 335565 - DNA, 20 bp, Artificial
  CRISPR gRNA sequence
tgtgctcactgggagtggaa

SEQ ID NO: 335566 - DNA, 20 bp, Artificial
  CRISPR gRNA sequence
actgggagtggaatccctgt

SEQ ID NO: 335567 - DNA, 20 bp, Artificial
  CRISPR gRNA sequence
ggagtggaatccctgtctcc

SEQ ID NO: 335568 - DNA, 20 bp, Artificial
  CRISPR gRNA sequence
tctccacatctgctcctagc

SEQ ID NO: 335569 - DNA, 20 bp, Artificial
  CRISPR gRNA sequence
cacatctgctcctagcagtg

SEQ ID NO: 335570 - DNA, 20 bp, Artificial
  CRISPR gRNA sequence
ctcctagcagtgcatcagcc

SEQ ID NO: 335571 - DNA, 20 bp, Artificial
  CRISPR gRNA sequence
ctagcagtgcatcagccagt

SEQ ID NO: 335572 - DNA, 20 bp, Artificial
  CRISPR gRNA sequence
gcagtgcatcagccagtaaa

SEQ ID NO: 335573 - DNA, 20 bp, Artificial
  CRISPR gRNA sequence
acaagaaaaatgttttaaag

SEQ ID NO: 335574 - DNA, 20 bp, Artificial
  CRISPR gRNA sequence
caagaaaaatgttttaaaga

SEQ ID NO: 335575 - DNA, 20 bp, Artificial
  CRISPR gRNA sequence
taaagatgccaggggtactg

SEQ ID NO: 335576 - DNA, 20 bp, Artificial
  CRISPR gRNA sequence
aaagatgccaggggtactga

SEQ ID NO: 335577 - DNA, 20 bp, Artificial
  CRISPR gRNA sequence
aagatgccaggggtactgaa

SEQ ID NO: 335578 - DNA, 20 bp, Artificial
  CRISPR gRNA sequence
aatctgcaaagcaaatgagc

SEQ ID NO: 335579 - DNA, 20 bp, Artificial
  CRISPR gRNA sequence
caaagcaaatgagcagccaa

SEQ ID NO: 335580 - DNA, 20 bp, Artificial
  CRISPR gRNA sequence
tccgcatttcactatcatac

SEQ ID NO: 335581 - DNA, 20 bp, Artificial
  CRISPR gRNA sequence
cactatcatactacctcttc

SEQ ID NO: 335582 - DNA, 20 bp, Artificial
  CRISPR gRNA sequence
actatcatactacctcttct

SEQ ID NO: 335583 - DNA, 20 bp, Artificial
  CRISPR gRNA sequence
tcatactacctcttctttct

SEQ ID NO: 335584 - DNA, 20 bp, Artificial
  CRISPR gRNA sequence
cctcttctttctgtagggat

SEQ ID NO: 335585 - DNA, 20 bp, Artificial
  CRISPR gRNA sequence
ttctttctgtagggatgaga

SEQ ID NO: 335586 - DNA, 20 bp, Artificial
  CRISPR gRNA sequence
ctttctgtagggatgagaat

SEQ ID NO: 335587 - DNA, 20 bp, Artificial
  CRISPR gRNA sequence
tttctgtagggatgagaatt

SEQ ID NO: 335588 - DNA, 20 bp, Artificial
  CRISPR gRNA sequence
tctgtagggatgagaattcc

SEQ ID NO: 335589 - DNA, 20 bp, Artificial
  CRISPR gRNA sequence
ctgtagggatgagaattcct

SEQ ID NO: 335590 - DNA, 20 bp, Artificial
  CRISPR gRNA sequence
tgtagggatgagaattcctc

SEQ ID NO: 335591 - DNA, 20 bp, Artificial
  CRISPR gRNA sequence
tagggatgagaattcctctt

SEQ ID NO: 335592 - DNA, 20 bp, Artificial
  CRISPR gRNA sequence
ctcttttaatcagtcaaggg

SEQ ID NO: 335593 - DNA, 20 bp, Artificial
  CRISPR gRNA sequence
ttttaatcagtcaagggaga

SEQ ID NO: 335594 - DNA, 20 bp, Artificial
  CRISPR gRNA sequence
ttaatcagtcaagggagatg

SEQ ID NO: 335595 - DNA, 20 bp, Artificial
  CRISPR gRNA sequence
taatcagtcaagggagatgc

SEQ ID NO: 335596 - DNA, 20 bp, Artificial
  CRISPR gRNA sequence
aatcagtcaagggagatgct

SEQ ID NO: 335597 - DNA, 20 bp, Artificial
  CRISPR gRNA sequence
atcagtcaagggagatgctt

SEQ ID NO: 335598 - DNA, 20 bp, Artificial
  CRISPR gRNA sequence
caaagctggagctattttat

SEQ ID NO: 335599 - DNA, 20 bp, Artificial
  CRISPR gRNA sequence
aaagctggagctattttatt

SEQ ID NO: 335600 - DNA, 20 bp, Artificial
  CRISPR gRNA sequence
gagctattttatttctgaga

SEQ ID NO: 335601 - DNA, 20 bp, Artificial
  CRISPR gRNA sequence
ttttatttctgagatgttga

SEQ ID NO: 335602 - DNA, 20 bp, Artificial
  CRISPR gRNA sequence
tatttctgagatgttgatgt

SEQ ID NO: 335603 - DNA, 20 bp, Artificial
  CRISPR gRNA sequence
atttctgagatgttgatgtg

SEQ ID NO: 335604 - DNA, 20 bp, Artificial
  CRISPR gRNA sequence
tttctgagatgttgatgtga

SEQ ID NO: 335605 - DNA, 20 bp, Artificial
  CRISPR gRNA sequence
ctgagatgttgatgtgaact

SEQ ID NO: 335606 - DNA, 20 bp, Artificial
  CRISPR gRNA sequence
tgagatgttgatgtgaactg

SEQ ID NO: 335607 - DNA, 20 bp, Artificial
  CRISPR gRNA sequence
agatgttgatgtgaactgta

SEQ ID NO: 335608 - DNA, 20 bp, Artificial
  CRISPR gRNA sequence
atgtgaactgtacattagta

SEQ ID NO: 335609 - DNA, 20 bp, Artificial
  CRISPR gRNA sequence
tacattagtacatactcagt

SEQ ID NO: 335610 - DNA, 20 bp, Artificial
  CRISPR gRNA sequence
gtacatactcagtactctcc

SEQ ID NO: 335611 - DNA, 20 bp, Artificial
  CRISPR gRNA sequence
agtactctccttcaattgct

SEQ ID NO: 335612 - DNA, 20 bp, Artificial
  CRISPR gRNA sequence
tccttcaattgctgaacccc

SEQ ID NO: 335613 - DNA, 20 bp, Artificial
  CRISPR gRNA sequence
cttcaattgctgaaccccag

SEQ ID NO: 335614 - DNA, 20 bp, Artificial
  CRISPR gRNA sequence
caattgctgaaccccagttg

SEQ ID NO: 335615 - DNA, 20 bp, Artificial
  CRISPR gRNA sequence
aattgctgaaccccagttga

SEQ ID NO: 335616 - DNA, 20 bp, Artificial
  CRISPR gRNA sequence
ctgaaccccagttgaccatt

SEQ ID NO: 335617 - DNA, 20 bp, Artificial
  CRISPR gRNA sequence
aaccccagttgaccatttta

SEQ ID NO: 335618 - DNA, 20 bp, Artificial
  CRISPR gRNA sequence
accattttaccaagacttta

SEQ ID NO: 335619 - DNA, 20 bp, Artificial
  CRISPR gRNA sequence
taccaagactttagatgctt

SEQ ID NO: 335620 - DNA, 20 bp, Artificial
  CRISPR gRNA sequence
accaagactttagatgcttt

SEQ ID NO: 335621 - DNA, 20 bp, Artificial
  CRISPR gRNA sequence
ccaagactttagatgctttc

SEQ ID NO: 335622 - DNA, 20 bp, Artificial
  CRISPR gRNA sequence
tagatgctttcttgtgccct

SEQ ID NO: 335623 - DNA, 20 bp, Artificial
  CRISPR gRNA sequence
agatgctttcttgtgccctc

SEQ ID NO: 335624 - DNA, 20 bp, Artificial
  CRISPR gRNA sequence
gatgctttcttgtgccctca

SEQ ID NO: 335625 - DNA, 20 bp, Artificial
  CRISPR gRNA sequence
tcttgtgccctcaattttct

SEQ ID NO: 335626 - DNA, 20 bp, Artificial
  CRISPR gRNA sequence
cttgtgccctcaattttctt

SEQ ID NO: 335627 - DNA, 20 bp, Artificial
  CRISPR gRNA sequence
ttgtgccctcaattttcttt

SEQ ID NO: 335628 - DNA, 20 bp, Artificial
  CRISPR gRNA sequence
gtgccctcaattttcttttt

SEQ ID NO: 335629 - DNA, 20 bp, Artificial
  CRISPR gRNA sequence
tgccctcaattttcttttta

SEQ ID NO: 335630 - DNA, 20 bp, Artificial
  CRISPR gRNA sequence
aattttctttttaaaaatac

SEQ ID NO: 335631 - DNA, 20 bp, Artificial
  CRISPR gRNA sequence
tctttttaaaaatacttcta

SEQ ID NO: 335632 - DNA, 20 bp, Artificial
  CRISPR gRNA sequence
ctttttaaaaatacttctac

SEQ ID NO: 335633 - DNA, 20 bp, Artificial
  CRISPR gRNA sequence
tttttaaaaatacttctaca

SEQ ID NO: 335634 - DNA, 20 bp, Artificial
  CRISPR gRNA sequence
tttaaaaatacttctacatg

SEQ ID NO: 335635 - DNA, 20 bp, Artificial
  CRISPR gRNA sequence
ttaaaaatacttctacatga

SEQ ID NO: 335636 - DNA, 20 bp, Artificial
  CRISPR gRNA sequence
taaaaatacttctacatgac

SEQ ID NO: 335637 - DNA, 20 bp, Artificial
  CRISPR gRNA sequence
aaaaatacttctacatgact

SEQ ID NO: 335638 - DNA, 20 bp, Artificial
  CRISPR gRNA sequence
aaaatacttctacatgactg

SEQ ID NO: 335639 - DNA, 20 bp, Artificial
  CRISPR gRNA sequence
ctacatgactgcttgacagc

SEQ ID NO: 335640 - DNA, 20 bp, Artificial
  CRISPR gRNA sequence
tacatgactgcttgacagcc

SEQ ID NO: 335641 - DNA, 20 bp, Artificial
  CRISPR gRNA sequence
catgactgcttgacagccca

SEQ ID NO: 335642 - DNA, 20 bp, Artificial
  CRISPR gRNA sequence
cttgacagcccaacagccac

SEQ ID NO: 335643 - DNA, 20 bp, Artificial
  CRISPR gRNA sequence
gacagcccaacagccactct

SEQ ID NO: 335644 - DNA, 20 bp, Artificial
  CRISPR gRNA sequence
acagcccaacagccactctc

SEQ ID NO: 335645 - DNA, 20 bp, Artificial
  CRISPR gRNA sequence
tcaatagagagctatgtctt

SEQ ID NO: 335646 - DNA, 20 bp, Artificial
  CRISPR gRNA sequence
aatagagagctatgtcttac

SEQ ID NO: 335647 - DNA, 20 bp, Artificial
  CRISPR gRNA sequence
tgtcttacattctttcctct

SEQ ID NO: 335648 - DNA, 20 bp, Artificial
  CRISPR gRNA sequence
acattctttcctctgctgct

SEQ ID NO: 335649 - DNA, 20 bp, Artificial
  CRISPR gRNA sequence
cattctttcctctgctgctc

SEQ ID NO: 335650 - DNA, 20 bp, Artificial
  CRISPR gRNA sequence
tttcctctgctgctcaatag

SEQ ID NO: 335651 - DNA, 20 bp, Artificial
  CRISPR gRNA sequence
tcctctgctgctcaatagtt

SEQ ID NO: 335652 - DNA, 20 bp, Artificial
  CRISPR gRNA sequence
cctctgctgctcaatagttt

SEQ ID NO: 335653 - DNA, 20 bp, Artificial
  CRISPR gRNA sequence
ctctgctgctcaatagtttt

SEQ ID NO: 335654 - DNA, 20 bp, Artificial
  CRISPR gRNA sequence
tgctgctcaatagttttata

SEQ ID NO: 335655 - DNA, 20 bp, Artificial
  CRISPR gRNA sequence
ctgctcaatagttttatata

SEQ ID NO: 335656 - DNA, 20 bp, Artificial
  CRISPR gRNA sequence
ctcaatagttttatatatct

SEQ ID NO: 335657 - DNA, 20 bp, Artificial
  CRISPR gRNA sequence
aatagttttatatatctatg

SEQ ID NO: 335658 - DNA, 20 bp, Artificial
  CRISPR gRNA sequence
tatatatctatgcatacata

SEQ ID NO: 335659 - DNA, 20 bp, Artificial
  CRISPR gRNA sequence
atatatctatgcatacatat

SEQ ID NO: 335660 - DNA, 20 bp, Artificial
  CRISPR gRNA sequence
tatatctatgcatacatata

SEQ ID NO: 335661 - DNA, 20 bp, Artificial
  CRISPR gRNA sequence
tgcatacatatatacacaca

SEQ ID NO: 335662 - DNA, 20 bp, Artificial
  CRISPR gRNA sequence
ataatgaatatatttgccta

SEQ ID NO: 335663 - DNA, 20 bp, Artificial
  CRISPR gRNA sequence
gcctatattctccctacaag

SEQ ID NO: 335664 - DNA, 20 bp, Artificial
  CRISPR gRNA sequence
cctatattctccctacaaga

SEQ ID NO: 335665 - DNA, 20 bp, Artificial
  CRISPR gRNA sequence
tattctccctacaagaatat

SEQ ID NO: 335666 - DNA, 20 bp, Artificial
  CRISPR gRNA sequence
tccctacaagaatatttttg

SEQ ID NO: 335667 - DNA, 20 bp, Artificial
  CRISPR gRNA sequence
cctacaagaatatttttgct

SEQ ID NO: 335668 - DNA, 20 bp, Artificial
  CRISPR gRNA sequence
caagaatatttttgctccag

SEQ ID NO: 335669 - DNA, 20 bp, Artificial
  CRISPR gRNA sequence
ttgctccagaaagacatgtt

SEQ ID NO: 335670 - DNA, 20 bp, Artificial
  CRISPR gRNA sequence
tgctccagaaagacatgttc

SEQ ID NO: 335671 - DNA, 20 bp, Artificial
  CRISPR gRNA sequence
gctccagaaagacatgttct

SEQ ID NO: 335672 - DNA, 20 bp, Artificial
  CRISPR gRNA sequence
ctccagaaagacatgttctt

SEQ ID NO: 335673 - DNA, 20 bp, Artificial
  CRISPR gRNA sequence
cagaaagacatgttcttttc

SEQ ID NO: 335674 - DNA, 20 bp, Artificial
  CRISPR gRNA sequence
ttttctcaaattcagttaaa

SEQ ID NO: 335675 - DNA, 20 bp, Artificial
  CRISPR gRNA sequence
ttctcaaattcagttaaaat

SEQ ID NO: 335676 - DNA, 20 bp, Artificial
  CRISPR gRNA sequence
tctcaaattcagttaaaatg

SEQ ID NO: 335677 - DNA, 20 bp, Artificial
  CRISPR gRNA sequence
ctcaaattcagttaaaatgg

SEQ ID NO: 335678 - DNA, 20 bp, Artificial
  CRISPR gRNA sequence
tcaaattcagttaaaatggt

SEQ ID NO: 335679 - DNA, 20 bp, Artificial
  CRISPR gRNA sequence
aaattcagttaaaatggttt

SEQ ID NO: 335680 - DNA, 20 bp, Artificial
  CRISPR gRNA sequence
agttaaaatggtttactttg

SEQ ID NO: 335681 - DNA, 20 bp, Artificial
  CRISPR gRNA sequence
aaatggtttactttgttcaa

SEQ ID NO: 335682 - DNA, 20 bp, Artificial
  CRISPR gRNA sequence
actttgttcaagttagtggt

SEQ ID NO: 335683 - DNA, 20 bp, Artificial
  CRISPR gRNA sequence
ctttgttcaagttagtggta

SEQ ID NO: 335684 - DNA, 20 bp, Artificial
  CRISPR gRNA sequence
tgttcaagttagtggtagga

SEQ ID NO: 335685 - DNA, 20 bp, Artificial
  CRISPR gRNA sequence
gttcaagttagtggtaggaa

SEQ ID NO: 335686 - DNA, 20 bp, Artificial
  CRISPR gRNA sequence
ttcaagttagtggtaggaaa

SEQ ID NO: 335687 - DNA, 20 bp, Artificial
  CRISPR gRNA sequence
aagttagtggtaggaaacat

SEQ ID NO: 335688 - DNA, 20 bp, Artificial
  CRISPR gRNA sequence
gtggtaggaaacattgcccg

SEQ ID NO: 335689 - DNA, 20 bp, Artificial
  CRISPR gRNA sequence
cccggaattgaaagcaaatt

SEQ ID NO: 335690 - DNA, 20 bp, Artificial
  CRISPR gRNA sequence
aaagcaaatttattttatta

SEQ ID NO: 335691 - DNA, 20 bp, Artificial
  CRISPR gRNA sequence
attttattatcctattttct

SEQ ID NO: 335692 - DNA, 20 bp, Artificial
  CRISPR gRNA sequence
ttttattatcctattttcta

SEQ ID NO: 335693 - DNA, 20 bp, Artificial
  CRISPR gRNA sequence
tattatcctattttctacca

SEQ ID NO: 335694 - DNA, 20 bp, Artificial
  CRISPR gRNA sequence
attatcctattttctaccat

SEQ ID NO: 335695 - DNA, 20 bp, Artificial
  CRISPR gRNA sequence
ttatcctattttctaccatt

SEQ ID NO: 335696 - DNA, 20 bp, Artificial
  CRISPR gRNA sequence
tcctattttctaccattatc

SEQ ID NO: 335697 - DNA, 20 bp, Artificial
  CRISPR gRNA sequence
ttttctaccattatctatgt

SEQ ID NO: 335698 - DNA, 20 bp, Artificial
  CRISPR gRNA sequence
tctaccattatctatgtttt

SEQ ID NO: 335699 - DNA, 20 bp, Artificial
  CRISPR gRNA sequence
ctaccattatctatgttttc

SEQ ID NO: 335700 - DNA, 20 bp, Artificial
  CRISPR gRNA sequence
taccattatctatgttttca

SEQ ID NO: 335701 - DNA, 20 bp, Artificial
  CRISPR gRNA sequence
ccattatctatgttttcatg

SEQ ID NO: 335702 - DNA, 20 bp, Artificial
  CRISPR gRNA sequence
tctatgttttcatggtgcta

SEQ ID NO: 335703 - DNA, 20 bp, Artificial
  CRISPR gRNA sequence
tgttttcatggtgctattaa

SEQ ID NO: 335704 - DNA, 20 bp, Artificial
  CRISPR gRNA sequence
tcatggtgctattaattaca

SEQ ID NO: 335705 - DNA, 20 bp, Artificial
  CRISPR gRNA sequence
catggtgctattaattacaa

SEQ ID NO: 335706 - DNA, 20 bp, Artificial
  CRISPR gRNA sequence
atggtgctattaattacaag

SEQ ID NO: 335707 - DNA, 20 bp, Artificial
  CRISPR gRNA sequence
ttaattacaagtttagttct

SEQ ID NO: 335708 - DNA, 20 bp, Artificial
  CRISPR gRNA sequence
attacaagtttagttctttt

SEQ ID NO: 335709 - DNA, 20 bp, Artificial
  CRISPR gRNA sequence
caagtttagttctttttgta

SEQ ID NO: 335710 - DNA, 20 bp, Artificial
  CRISPR gRNA sequence
agttctttttgtagatcata

SEQ ID NO: 335711 - DNA, 20 bp, Artificial
  CRISPR gRNA sequence
gttctttttgtagatcatat

SEQ ID NO: 335712 - DNA, 20 bp, Artificial
  CRISPR gRNA sequence
tttttgtagatcatattaaa

SEQ ID NO: 335713 - DNA, 20 bp, Artificial
  CRISPR gRNA sequence
tttgtagatcatattaaaat

SEQ ID NO: 335714 - DNA, 20 bp, Artificial
  CRISPR gRNA sequence
ttgtagatcatattaaaatt

SEQ ID NO: 335715 - DNA, 20 bp, Artificial
  CRISPR gRNA sequence
tgtagatcatattaaaattg

SEQ ID NO: 335716 - DNA, 20 bp, Artificial
  CRISPR gRNA sequence
gtagatcatattaaaattgc

SEQ ID NO: 335717 - DNA, 20 bp, Artificial
  CRISPR gRNA sequence
tagatcatattaaaattgca

SEQ ID NO: 335718 - DNA, 20 bp, Artificial
  CRISPR gRNA sequence
aaattgcaaacaaaatcatc

SEQ ID NO: 335719 - DNA, 20 bp, Artificial
  CRISPR gRNA sequence
caaacaaaatcatctttaat

SEQ ID NO: 335720 - DNA, 20 bp, Artificial
  CRISPR gRNA sequence
taatgggccagcattctcat

SEQ ID NO: 335721 - DNA, 20 bp, Artificial
  CRISPR gRNA sequence
aatgggccagcattctcatg

SEQ ID NO: 335722 - DNA, 20 bp, Artificial
  CRISPR gRNA sequence
atgggccagcattctcatgg

SEQ ID NO: 335723 - DNA, 20 bp, Artificial
  CRISPR gRNA sequence
tcatggggtagagcagaata

SEQ ID NO: 335724 - DNA, 20 bp, Artificial
  CRISPR gRNA sequence
atggggtagagcagaatatt

SEQ ID NO: 335725 - DNA, 20 bp, Artificial
  CRISPR gRNA sequence
atttagcctgaaagctgcag

SEQ ID NO: 335726 - DNA, 20 bp, Artificial
  CRISPR gRNA sequence
agcctgaaagctgcagttac

SEQ ID NO: 335727 - DNA, 20 bp, Artificial
  CRISPR gRNA sequence
gcctgaaagctgcagttact

SEQ ID NO: 335728 - DNA, 20 bp, Artificial
  CRISPR gRNA sequence
aaagctgcagttactatagg

SEQ ID NO: 335729 - DNA, 20 bp, Artificial
  CRISPR gRNA sequence
cagttactataggttgctgt

SEQ ID NO: 335730 - DNA, 20 bp, Artificial
  CRISPR gRNA sequence
ctataggttgctgtcagact

SEQ ID NO: 335731 - DNA, 20 bp, Artificial
  CRISPR gRNA sequence
taggttgctgtcagactata

SEQ ID NO: 335732 - DNA, 20 bp, Artificial
  CRISPR gRNA sequence
ctgtcagactatacccatgg

SEQ ID NO: 335733 - DNA, 20 bp, Artificial
  CRISPR gRNA sequence
tcagactatacccatggtgc

SEQ ID NO: 335734 - DNA, 20 bp, Artificial
  CRISPR gRNA sequence
tacccatggtgcctctgggc

SEQ ID NO: 335735 - DNA, 20 bp, Artificial
  CRISPR gRNA sequence
tgggcttgacaggtcaaaat

SEQ ID NO: 335736 - DNA, 20 bp, Artificial
  CRISPR gRNA sequence
ggcttgacaggtcaaaatgg

SEQ ID NO: 335737 - DNA, 20 bp, Artificial
  CRISPR gRNA sequence
gacaggtcaaaatggtcccc

SEQ ID NO: 335738 - DNA, 20 bp, Artificial
  CRISPR gRNA sequence
acaggtcaaaatggtcccca

SEQ ID NO: 335739 - DNA, 20 bp, Artificial
  CRISPR gRNA sequence
gagcagccctccagacctgg

SEQ ID NO: 335740 - DNA, 20 bp, Artificial
  CRISPR gRNA sequence
cagacctgggtggaattcca

SEQ ID NO: 335741 - DNA, 20 bp, Artificial
  CRISPR gRNA sequence
ggtggaattccagggttgag

SEQ ID NO: 335742 - DNA, 20 bp, Artificial
  CRISPR gRNA sequence
cagggttgagagactcccct

SEQ ID NO: 335743 - DNA, 20 bp, Artificial
  CRISPR gRNA sequence
agagactcccctgagccaga

SEQ ID NO: 335744 - DNA, 20 bp, Artificial
  CRISPR gRNA sequence
ccctgagccagaggccacta

SEQ ID NO: 335745 - DNA, 20 bp, Artificial
  CRISPR gRNA sequence
agccagaggccactaggtat

SEQ ID NO: 335746 - DNA, 20 bp, Artificial
  CRISPR gRNA sequence
ggtattcttgctcccagagg

SEQ ID NO: 335747 - DNA, 20 bp, Artificial
  CRISPR gRNA sequence
ttgctcccagaggctgaagt

SEQ ID NO: 335748 - DNA, 20 bp, Artificial
  CRISPR gRNA sequence
gctcccagaggctgaagtca

SEQ ID NO: 335749 - DNA, 20 bp, Artificial
  CRISPR gRNA sequence
ctcccagaggctgaagtcac

SEQ ID NO: 335750 - DNA, 20 bp, Artificial
  CRISPR gRNA sequence
ccagaggctgaagtcaccct

SEQ ID NO: 335751 - DNA, 20 bp, Artificial
  CRISPR gRNA sequence
aagtcaccctgggaatcaca

SEQ ID NO: 335752 - DNA, 20 bp, Artificial
  CRISPR gRNA sequence
ggaatcacagtggtctacct

SEQ ID NO: 335753 - DNA, 20 bp, Artificial
  CRISPR gRNA sequence
cctgcattcataattccagg

SEQ ID NO: 335754 - DNA, 20 bp, Artificial
  CRISPR gRNA sequence
cattcataattccaggatct

SEQ ID NO: 335755 - DNA, 20 bp, Artificial
  CRISPR gRNA sequence
ataattccaggatctgtgaa

SEQ ID NO: 335756 - DNA, 20 bp, Artificial
  CRISPR gRNA sequence
caggatctgtgaagagcaca

SEQ ID NO: 335757 - DNA, 20 bp, Artificial
  CRISPR gRNA sequence
tgaagagcacatatgtgtca

SEQ ID NO: 335758 - DNA, 20 bp, Artificial
  CRISPR gRNA sequence
cctctcataaaaaccacaca

SEQ ID NO: 335759 - DNA, 20 bp, Artificial
  CRISPR gRNA sequence
tcataaaaaccacacagcct

SEQ ID NO: 335760 - DNA, 20 bp, Artificial
  CRISPR gRNA sequence
ataaaaaccacacagcctgg

SEQ ID NO: 335761 - DNA, 20 bp, Artificial
  CRISPR gRNA sequence
gaaattggccctggcccttc

SEQ ID NO: 335762 - DNA, 20 bp, Artificial
  CRISPR gRNA sequence
gccctggcccttcaagatag

SEQ ID NO: 335763 - DNA, 20 bp, Artificial
  CRISPR gRNA sequence
gcccttcaagatagccttct

SEQ ID NO: 335764 - DNA, 20 bp, Artificial
  CRISPR gRNA sequence
caagatagccttctttagaa

SEQ ID NO: 335765 - DNA, 20 bp, Artificial
  CRISPR gRNA sequence
aagatagccttctttagaat

SEQ ID NO: 335766 - DNA, 20 bp, Artificial
  CRISPR gRNA sequence
ctttagaatatgatttggct

SEQ ID NO: 335767 - DNA, 20 bp, Artificial
  CRISPR gRNA sequence
tttagaatatgatttggcta

SEQ ID NO: 335768 - DNA, 20 bp, Artificial
  CRISPR gRNA sequence
tagaatatgatttggctaga

SEQ ID NO: 335769 - DNA, 20 bp, Artificial
  CRISPR gRNA sequence
agaatatgatttggctagaa

SEQ ID NO: 335770 - DNA, 20 bp, Artificial
  CRISPR gRNA sequence
gaatatgatttggctagaaa

SEQ ID NO: 335771 - DNA, 20 bp, Artificial
  CRISPR gRNA sequence
ggctagaaagattcttaaat

SEQ ID NO: 335772 - DNA, 20 bp, Artificial
  CRISPR gRNA sequence
gctagaaagattcttaaata

SEQ ID NO: 335773 - DNA, 20 bp, Artificial
  CRISPR gRNA sequence
gaaagattcttaaatatgtg

SEQ ID NO: 335774 - DNA, 20 bp, Artificial
  CRISPR gRNA sequence
ttaaatatgtggaatatgat

SEQ ID NO: 335775 - DNA, 20 bp, Artificial
  CRISPR gRNA sequence
aaatatgtggaatatgatta

SEQ ID NO: 335776 - DNA, 20 bp, Artificial
  CRISPR gRNA sequence
aatatgtggaatatgattat

SEQ ID NO: 335777 - DNA, 20 bp, Artificial
  CRISPR gRNA sequence
ttcttagctggaatattttc

SEQ ID NO: 335778 - DNA, 20 bp, Artificial
  CRISPR gRNA sequence
ttagctggaatattttctct

SEQ ID NO: 335779 - DNA, 20 bp, Artificial
  CRISPR gRNA sequence
agctggaatattttctctac

SEQ ID NO: 335780 - DNA, 20 bp, Artificial
  CRISPR gRNA sequence
gctggaatattttctctact

SEQ ID NO: 335781 - DNA, 20 bp, Artificial
  CRISPR gRNA sequence
gaatattttctctacttcct

SEQ ID NO: 335782 - DNA, 20 bp, Artificial
  CRISPR gRNA sequence
tctctacttcctgtctgcat

SEQ ID NO: 335783 - DNA, 20 bp, Artificial
  CRISPR gRNA sequence
ctctacttcctgtctgcatg

SEQ ID NO: 335784 - DNA, 20 bp, Artificial
  CRISPR gRNA sequence
tctacttcctgtctgcatgc

SEQ ID NO: 335785 - DNA, 20 bp, Artificial
  CRISPR gRNA sequence
tacttcctgtctgcatgccc

SEQ ID NO: 335786 - DNA, 20 bp, Artificial
  CRISPR gRNA sequence
cttcctgtctgcatgcccaa

SEQ ID NO: 335787 - DNA, 20 bp, Artificial
  CRISPR gRNA sequence
cctgtctgcatgcccaaggc

SEQ ID NO: 335788 - DNA, 20 bp, Artificial
  CRISPR gRNA sequence
ctgtctgcatgcccaaggct

SEQ ID NO: 335789 - DNA, 20 bp, Artificial
  CRISPR gRNA sequence
tctgcatgcccaaggcttct

SEQ ID NO: 335790 - DNA, 20 bp, Artificial
  CRISPR gRNA sequence
catgcccaaggcttctgaag

SEQ ID NO: 335791 - DNA, 20 bp, Artificial
  CRISPR gRNA sequence
ctgaagcagccaatgtcgat

SEQ ID NO: 335792 - DNA, 20 bp, Artificial
  CRISPR gRNA sequence
tgaagcagccaatgtcgatg

SEQ ID NO: 335793 - DNA, 20 bp, Artificial
  CRISPR gRNA sequence
aagcagccaatgtcgatgca

SEQ ID NO: 335794 - DNA, 20 bp, Artificial
  CRISPR gRNA sequence
gtaactttaggtaaactggg

SEQ ID NO: 335795 - DNA, 20 bp, Artificial
  CRISPR gRNA sequence
taactttaggtaaactggga

SEQ ID NO: 335796 - DNA, 20 bp, Artificial
  CRISPR gRNA sequence
taggtaaactgggattatgt

SEQ ID NO: 335797 - DNA, 20 bp, Artificial
  CRISPR gRNA sequence
aggtaaactgggattatgtt

SEQ ID NO: 335798 - DNA, 20 bp, Artificial
  CRISPR gRNA sequence
ggtaaactgggattatgttg

SEQ ID NO: 335799 - DNA, 20 bp, Artificial
  CRISPR gRNA sequence
ggattatgttgtagtttaac

SEQ ID NO: 335800 - DNA, 20 bp, Artificial
  CRISPR gRNA sequence
tgttgtagtttaacattttg

SEQ ID NO: 335801 - DNA, 20 bp, Artificial
  CRISPR gRNA sequence
tagtttaacattttgtaact

SEQ ID NO: 335802 - DNA, 20 bp, Artificial
  CRISPR gRNA sequence
aacattttgtaactgtgtgc

SEQ ID NO: 335803 - DNA, 20 bp, Artificial
  CRISPR gRNA sequence
acattttgtaactgtgtgct

SEQ ID NO: 335804 - DNA, 20 bp, Artificial
  CRISPR gRNA sequence
tgtaactgtgtgcttatagt

SEQ ID NO: 335805 - DNA, 20 bp, Artificial
  CRISPR gRNA sequence
gtaactgtgtgcttatagtt

SEQ ID NO: 335806 - DNA, 20 bp, Artificial
  CRISPR gRNA sequence
taactgtgtgcttatagttt

SEQ ID NO: 335807 - DNA, 20 bp, Artificial
  CRISPR gRNA sequence
tgtgcttatagtttacaagt

SEQ ID NO: 335808 - DNA, 20 bp, Artificial
  CRISPR gRNA sequence
atagtttacaagtgagaccc

SEQ ID NO: 335809 - DNA, 20 bp, Artificial
  CRISPR gRNA sequence
tagtttacaagtgagacccg

SEQ ID NO: 335810 - DNA, 20 bp, Artificial
  CRISPR gRNA sequence
acaagtgagacccgatatgt

SEQ ID NO: 335811 - DNA, 20 bp, Artificial
  CRISPR gRNA sequence
caagtgagacccgatatgtc

SEQ ID NO: 335812 - DNA, 20 bp, Artificial
  CRISPR gRNA sequence
tgcatacttatattatctta

SEQ ID NO: 335813 - DNA, 20 bp, Artificial
  CRISPR gRNA sequence
atattatcttaagcatgtgt

SEQ ID NO: 335814 - DNA, 20 bp, Artificial
  CRISPR gRNA sequence
tattatcttaagcatgtgta

SEQ ID NO: 335815 - DNA, 20 bp, Artificial
  CRISPR gRNA sequence
tcttaagcatgtgtaatgct

SEQ ID NO: 335816 - DNA, 20 bp, Artificial
  CRISPR gRNA sequence
aagcatgtgtaatgctggat

SEQ ID NO: 335817 - DNA, 20 bp, Artificial
  CRISPR gRNA sequence
agcatgtgtaatgctggatg

SEQ ID NO: 335818 - DNA, 20 bp, Artificial
  CRISPR gRNA sequence
gatgtgtacagtacagtact

SEQ ID NO: 335819 - DNA, 20 bp, Artificial
  CRISPR gRNA sequence
aacttgtaatttgaatctag

SEQ ID NO: 335820 - DNA, 20 bp, Artificial
  CRISPR gRNA sequence
gtaatttgaatctagtatgg

SEQ ID NO: 335821 - DNA, 20 bp, Artificial
  CRISPR gRNA sequence
taatttgaatctagtatggt

SEQ ID NO: 335822 - DNA, 20 bp, Artificial
  CRISPR gRNA sequence
gaatctagtatggtgttctg

SEQ ID NO: 335823 - DNA, 20 bp, Artificial
  CRISPR gRNA sequence
aatctagtatggtgttctgt

SEQ ID NO: 335824 - DNA, 20 bp, Artificial
  CRISPR gRNA sequence
gtatggtgttctgttttcag

SEQ ID NO: 335825 - DNA, 20 bp, Artificial
  CRISPR gRNA sequence
tgttttcagctgacttggac

SEQ ID NO: 335826 - DNA, 20 bp, Artificial
  CRISPR gRNA sequence
ttttcagctgacttggacaa

SEQ ID NO: 335827 - DNA, 20 bp, Artificial
  CRISPR gRNA sequence
tcagctgacttggacaacct

SEQ ID NO: 335828 - DNA, 20 bp, Artificial
  CRISPR gRNA sequence
cagctgacttggacaacctg

SEQ ID NO: 335829 - DNA, 20 bp, Artificial
  CRISPR gRNA sequence
agctgacttggacaacctga

SEQ ID NO: 335830 - DNA, 20 bp, Artificial
  CRISPR gRNA sequence
acttggacaacctgactggc

SEQ ID NO: 335831 - DNA, 20 bp, Artificial
  CRISPR gRNA sequence
ggacaacctgactggctttg

SEQ ID NO: 335832 - DNA, 20 bp, Artificial
  CRISPR gRNA sequence
gacaacctgactggctttgc

SEQ ID NO: 335833 - DNA, 20 bp, Artificial
  CRISPR gRNA sequence
actggctttgcacaggtgtt

SEQ ID NO: 335834 - DNA, 20 bp, Artificial
  CRISPR gRNA sequence
gctttgcacaggtgttccct

SEQ ID NO: 335835 - DNA, 20 bp, Artificial
  CRISPR gRNA sequence
tgcacaggtgttccctgagt

SEQ ID NO: 335836 - DNA, 20 bp, Artificial
  CRISPR gRNA sequence
gcacaggtgttccctgagtt

SEQ ID NO: 335837 - DNA, 20 bp, Artificial
  CRISPR gRNA sequence
cacaggtgttccctgagttg

SEQ ID NO: 335838 - DNA, 20 bp, Artificial
  CRISPR gRNA sequence
cctgagttgtttgcaggttt

SEQ ID NO: 335839 - DNA, 20 bp, Artificial
  CRISPR gRNA sequence
agttgtttgcaggtttctgt

SEQ ID NO: 335840 - DNA, 20 bp, Artificial
  CRISPR gRNA sequence
tttgcaggtttctgtgtgtg

SEQ ID NO: 335841 - DNA, 20 bp, Artificial
  CRISPR gRNA sequence
gcaggtttctgtgtgtgggg

SEQ ID NO: 335842 - DNA, 20 bp, Artificial
  CRISPR gRNA sequence
caggtttctgtgtgtggggt

SEQ ID NO: 335843 - DNA, 20 bp, Artificial
  CRISPR gRNA sequence
ctgtgtgtggggtggggtat

SEQ ID NO: 335844 - DNA, 20 bp, Artificial
  CRISPR gRNA sequence
tgtgtgtggggtggggtatg

SEQ ID NO: 335845 - DNA, 20 bp, Artificial
  CRISPR gRNA sequence
tgtgtggggtggggtatggg

SEQ ID NO: 335846 - DNA, 20 bp, Artificial
  CRISPR gRNA sequence
catggtggcccacctggcct

SEQ ID NO: 335847 - DNA, 20 bp, Artificial
  CRISPR gRNA sequence
atggtggcccacctggcctg

SEQ ID NO: 335848 - DNA, 20 bp, Artificial
  CRISPR gRNA sequence
gcctggttgtccaagctgtg

SEQ ID NO: 335849 - DNA, 20 bp, Artificial
  CRISPR gRNA sequence
gttgtccaagctgtgcctcg

SEQ ID NO: 335850 - DNA, 20 bp, Artificial
  CRISPR gRNA sequence
tccaagctgtgcctcgacac

SEQ ID NO: 335851 - DNA, 20 bp, Artificial
  CRISPR gRNA sequence
tgcctcgacacatcctcatc

SEQ ID NO: 335852 - DNA, 20 bp, Artificial
  CRISPR gRNA sequence
gacacatcctcatccccagc

SEQ ID NO: 335853 - DNA, 20 bp, Artificial
  CRISPR gRNA sequence
atccccagcatgggacacct

SEQ ID NO: 335854 - DNA, 20 bp, Artificial
  CRISPR gRNA sequence
aagatgaataataattcaca

SEQ ID NO: 335855 - DNA, 20 bp, Artificial
  CRISPR gRNA sequence
acaaaatttctgtgaaatca

SEQ ID NO: 335856 - DNA, 20 bp, Artificial
  CRISPR gRNA sequence
ctgtgaaatcaaatccagtt

SEQ ID NO: 335857 - DNA, 20 bp, Artificial
  CRISPR gRNA sequence
tgtgaaatcaaatccagttt

SEQ ID NO: 335858 - DNA, 20 bp, Artificial
  CRISPR gRNA sequence
tgaaatcaaatccagtttta

SEQ ID NO: 335859 - DNA, 20 bp, Artificial
  CRISPR gRNA sequence
taagaggagccacttatcaa

SEQ ID NO: 335860 - DNA, 20 bp, Artificial
  CRISPR gRNA sequence
aagaggagccacttatcaaa

SEQ ID NO: 335861 - DNA, 20 bp, Artificial
  CRISPR gRNA sequence
agaggagccacttatcaaag

SEQ ID NO: 335862 - DNA, 20 bp, Artificial
  CRISPR gRNA sequence
atcaaagagattttaacagt

SEQ ID NO: 335863 - DNA, 20 bp, Artificial
  CRISPR gRNA sequence
tcaaagagattttaacagta

SEQ ID NO: 335864 - DNA, 20 bp, Artificial
  CRISPR gRNA sequence
taacagtagtaagaaggcaa

SEQ ID NO: 335865 - DNA, 20 bp, Artificial
  CRISPR gRNA sequence
aacagtagtaagaaggcaaa

SEQ ID NO: 335866 - DNA, 20 bp, Artificial
  CRISPR gRNA sequence
acagtagtaagaaggcaaag

SEQ ID NO: 335867 - DNA, 20 bp, Artificial
  CRISPR gRNA sequence
gatattcagcaactgaaaat

SEQ ID NO: 335868 - DNA, 20 bp, Artificial
  CRISPR gRNA sequence
atattcagcaactgaaaata

SEQ ID NO: 335869 - DNA, 20 bp, Artificial
  CRISPR gRNA sequence
agcaactgaaaatacctcac

SEQ ID NO: 335870 - DNA, 20 bp, Artificial
  CRISPR gRNA sequence
aaaatacctcactgtgtttt

SEQ ID NO: 335871 - DNA, 20 bp, Artificial
  CRISPR gRNA sequence
actgtgttttcttgggggga

SEQ ID NO: 335872 - DNA, 20 bp, Artificial
  CRISPR gRNA sequence
tgttttcttggggggagcag

SEQ ID NO: 335873 - DNA, 20 bp, Artificial
  CRISPR gRNA sequence
tcttggggggagcagggaat

SEQ ID NO: 335874 - DNA, 20 bp, Artificial
  CRISPR gRNA sequence
cttggggggagcagggaatt

SEQ ID NO: 335875 - DNA, 20 bp, Artificial
  CRISPR gRNA sequence
ttggggggagcagggaattg

SEQ ID NO: 335876 - DNA, 20 bp, Artificial
  CRISPR gRNA sequence
ggggggagcagggaattgat

SEQ ID NO: 335877 - DNA, 20 bp, Artificial
  CRISPR gRNA sequence
gggggagcagggaattgatt

SEQ ID NO: 335878 - DNA, 20 bp, Artificial
  CRISPR gRNA sequence
attaccttagctagcatgta

SEQ ID NO: 335879 - DNA, 20 bp, Artificial
  CRISPR gRNA sequence
ccttagctagcatgtacaaa

SEQ ID NO: 335880 - DNA, 20 bp, Artificial
  CRISPR gRNA sequence
agctagcatgtacaaatttg

SEQ ID NO: 335881 - DNA, 20 bp, Artificial
  CRISPR gRNA sequence
gctagcatgtacaaatttga

SEQ ID NO: 335882 - DNA, 20 bp, Artificial
  CRISPR gRNA sequence
gcatgtacaaatttgacatt

SEQ ID NO: 335883 - DNA, 20 bp, Artificial
  CRISPR gRNA sequence
gacattgtacttgaagatag

SEQ ID NO: 335884 - DNA, 20 bp, Artificial
  CRISPR gRNA sequence
acattgtacttgaagatagt

SEQ ID NO: 335885 - DNA, 20 bp, Artificial
  CRISPR gRNA sequence
tacttgaagatagttacatt

SEQ ID NO: 335886 - DNA, 20 bp, Artificial
  CRISPR gRNA sequence
gaagatagttacattgcttg

SEQ ID NO: 335887 - DNA, 20 bp, Artificial
  CRISPR gRNA sequence
aagatagttacattgcttgg

SEQ ID NO: 335888 - DNA, 20 bp, Artificial
  CRISPR gRNA sequence
ttccaagcaatgtaactatc

SEQ ID NO: 335889 - DNA, 20 bp, Artificial
  CRISPR gRNA sequence
caagcaatgtaactatcttc

SEQ ID NO: 335890 - DNA, 20 bp, Artificial
  CRISPR gRNA sequence
tcttcaagtacaatgtcaaa

SEQ ID NO: 335891 - DNA, 20 bp, Artificial
  CRISPR gRNA sequence
caagtacaatgtcaaatttg

SEQ ID NO: 335892 - DNA, 20 bp, Artificial
  CRISPR gRNA sequence
aagtacaatgtcaaatttgt

SEQ ID NO: 335893 - DNA, 20 bp, Artificial
  CRISPR gRNA sequence
gtacatgctagctaaggtaa

SEQ ID NO: 335894 - DNA, 20 bp, Artificial
  CRISPR gRNA sequence
tacatgctagctaaggtaat

SEQ ID NO: 335895 - DNA, 20 bp, Artificial
  CRISPR gRNA sequence
gctaaggtaatcaattccct

SEQ ID NO: 335896 - DNA, 20 bp, Artificial
  CRISPR gRNA sequence
aggtaatcaattccctgctc

SEQ ID NO: 335897 - DNA, 20 bp, Artificial
  CRISPR gRNA sequence
cctgctccccccaagaaaac

SEQ ID NO: 335898 - DNA, 20 bp, Artificial
  CRISPR gRNA sequence
ctccccccaagaaaacacag

SEQ ID NO: 335899 - DNA, 20 bp, Artificial
  CRISPR gRNA sequence
cccccaagaaaacacagtga

SEQ ID NO: 335900 - DNA, 20 bp, Artificial
  CRISPR gRNA sequence
tcagttgctgaatatcaaat

SEQ ID NO: 335901 - DNA, 20 bp, Artificial
  CRISPR gRNA sequence
cagttgctgaatatcaaatg

SEQ ID NO: 335902 - DNA, 20 bp, Artificial
  CRISPR gRNA sequence
agttgctgaatatcaaatgt

SEQ ID NO: 335903 - DNA, 20 bp, Artificial
  CRISPR gRNA sequence
ctgaatatcaaatgtttatt

SEQ ID NO: 335904 - DNA, 20 bp, Artificial
  CRISPR gRNA sequence
aatatcaaatgtttattctt

SEQ ID NO: 335905 - DNA, 20 bp, Artificial
  CRISPR gRNA sequence
attctttgccttcttactac

SEQ ID NO: 335906 - DNA, 20 bp, Artificial
  CRISPR gRNA sequence
ttctttgccttcttactact

SEQ ID NO: 335907 - DNA, 20 bp, Artificial
  CRISPR gRNA sequence
tttgccttcttactactgtt

SEQ ID NO: 335908 - DNA, 20 bp, Artificial
  CRISPR gRNA sequence
tgccttcttactactgttaa

SEQ ID NO: 335909 - DNA, 20 bp, Artificial
  CRISPR gRNA sequence
gccttcttactactgttaaa

SEQ ID NO: 335910 - DNA, 20 bp, Artificial
  CRISPR gRNA sequence
ccttcttactactgttaaaa

SEQ ID NO: 335911 - DNA, 20 bp, Artificial
  CRISPR gRNA sequence
cttactactgttaaaatctc

SEQ ID NO: 335912 - DNA, 20 bp, Artificial
  CRISPR gRNA sequence
ttactactgttaaaatctct

SEQ ID NO: 335913 - DNA, 20 bp, Artificial
  CRISPR gRNA sequence
actactgttaaaatctcttt

SEQ ID NO: 335914 - DNA, 20 bp, Artificial
  CRISPR gRNA sequence
ctactgttaaaatctctttg

SEQ ID NO: 335915 - DNA, 20 bp, Artificial
  CRISPR gRNA sequence
ctgttaaaatctctttgata

SEQ ID NO: 335916 - DNA, 20 bp, Artificial
  CRISPR gRNA sequence
ttaaaatctctttgataagt

SEQ ID NO: 335917 - DNA, 20 bp, Artificial
  CRISPR gRNA sequence
aaatctctttgataagtggc

SEQ ID NO: 335918 - DNA, 20 bp, Artificial
  CRISPR gRNA sequence
tttgataagtggctcctctt

SEQ ID NO: 335919 - DNA, 20 bp, Artificial
  CRISPR gRNA sequence
tgataagtggctcctcttaa

SEQ ID NO: 335920 - DNA, 20 bp, Artificial
  CRISPR gRNA sequence
gataagtggctcctcttaaa

SEQ ID NO: 335921 - DNA, 20 bp, Artificial
  CRISPR gRNA sequence
ataagtggctcctcttaaaa

SEQ ID NO: 335922 - DNA, 20 bp, Artificial
  CRISPR gRNA sequence
ctcttaaaactggatttgat

SEQ ID NO: 335923 - DNA, 20 bp, Artificial
  CRISPR gRNA sequence
ttaaaactggatttgatttc

SEQ ID NO: 335924 - DNA, 20 bp, Artificial
  CRISPR gRNA sequence
aaaactggatttgatttcac

SEQ ID NO: 335925 - DNA, 20 bp, Artificial
  CRISPR gRNA sequence
aaactggatttgatttcaca

SEQ ID NO: 335926 - DNA, 20 bp, Artificial
  CRISPR gRNA sequence
gatttgatttcacagaaatt

SEQ ID NO: 335927 - DNA, 20 bp, Artificial
  CRISPR gRNA sequence
gatttcacagaaattttgtg

SEQ ID NO: 335928 - DNA, 20 bp, Artificial
  CRISPR gRNA sequence
atttcacagaaattttgtga

SEQ ID NO: 335929 - DNA, 20 bp, Artificial
  CRISPR gRNA sequence
cacagaaattttgtgaatta

SEQ ID NO: 335930 - DNA, 20 bp, Artificial
  CRISPR gRNA sequence
acagaaattttgtgaattat

SEQ ID NO: 335931 - DNA, 20 bp, Artificial
  CRISPR gRNA sequence
tgtgaattattattcatctt

SEQ ID NO: 335932 - DNA, 20 bp, Artificial
  CRISPR gRNA sequence
gtgaattattattcatcttg

SEQ ID NO: 335933 - DNA, 20 bp, Artificial
  CRISPR gRNA sequence
tgaattattattcatcttga

SEQ ID NO: 335934 - DNA, 20 bp, Artificial
  CRISPR gRNA sequence
ttattcatcttgaggtgtcc

SEQ ID NO: 335935 - DNA, 20 bp, Artificial
  CRISPR gRNA sequence
ttcatcttgaggtgtcccat

SEQ ID NO: 335936 - DNA, 20 bp, Artificial
  CRISPR gRNA sequence
atcttgaggtgtcccatgct

SEQ ID NO: 335937 - DNA, 20 bp, Artificial
  CRISPR gRNA sequence
gaggtgtcccatgctgggga

SEQ ID NO: 335938 - DNA, 20 bp, Artificial
  CRISPR gRNA sequence
aggtgtcccatgctggggat

SEQ ID NO: 335939 - DNA, 20 bp, Artificial
  CRISPR gRNA sequence
gggatgaggatgtgtcgagg

SEQ ID NO: 335940 - DNA, 20 bp, Artificial
  CRISPR gRNA sequence
ggacaaccaggccaggtggg

SEQ ID NO: 335941 - DNA, 20 bp, Artificial
  CRISPR gRNA sequence
gacaaccaggccaggtgggc

SEQ ID NO: 335942 - DNA, 20 bp, Artificial
  CRISPR gRNA sequence
tcctccccataccccacccc

SEQ ID NO: 335943 - DNA, 20 bp, Artificial
  CRISPR gRNA sequence
ctccccataccccaccccac

SEQ ID NO: 335944 - DNA, 20 bp, Artificial
  CRISPR gRNA sequence
cccataccccaccccacaca

SEQ ID NO: 335945 - DNA, 20 bp, Artificial
  CRISPR gRNA sequence
caaacaactcagggaacacc

SEQ ID NO: 335946 - DNA, 20 bp, Artificial
  CRISPR gRNA sequence
agggaacacctgtgcaaagc

SEQ ID NO: 335947 - DNA, 20 bp, Artificial
  CRISPR gRNA sequence
tgcaaagccagtcaggttgt

SEQ ID NO: 335948 - DNA, 20 bp, Artificial
  CRISPR gRNA sequence
tccaagtcagctgaaaacag

SEQ ID NO: 335949 - DNA, 20 bp, Artificial
  CRISPR gRNA sequence
aaaacagaacaccatactag

SEQ ID NO: 335950 - DNA, 20 bp, Artificial
  CRISPR gRNA sequence
gattcaaattacaagttcag

SEQ ID NO: 335951 - DNA, 20 bp, Artificial
  CRISPR gRNA sequence
aaattacaagttcagtactg

SEQ ID NO: 335952 - DNA, 20 bp, Artificial
  CRISPR gRNA sequence
caagttcagtactgtactgt

SEQ ID NO: 335953 - DNA, 20 bp, Artificial
  CRISPR gRNA sequence
agtactgtactgtacacatc

SEQ ID NO: 335954 - DNA, 20 bp, Artificial
  CRISPR gRNA sequence
tactgtacacatccagcatt

SEQ ID NO: 335955 - DNA, 20 bp, Artificial
  CRISPR gRNA sequence
tacacatccagcattacaca

SEQ ID NO: 335956 - DNA, 20 bp, Artificial
  CRISPR gRNA sequence
cacatgcttaagataatata

SEQ ID NO: 335957 - DNA, 20 bp, Artificial
  CRISPR gRNA sequence
aagataatataagtatgcat

SEQ ID NO: 335958 - DNA, 20 bp, Artificial
  CRISPR gRNA sequence
agataatataagtatgcata

SEQ ID NO: 335959 - DNA, 20 bp, Artificial
  CRISPR gRNA sequence
acttgtaaactataagcaca

SEQ ID NO: 335960 - DNA, 20 bp, Artificial
  CRISPR gRNA sequence
gtaaactataagcacacagt

SEQ ID NO: 335961 - DNA, 20 bp, Artificial
  CRISPR gRNA sequence
taaactataagcacacagtt

SEQ ID NO: 335962 - DNA, 20 bp, Artificial
  CRISPR gRNA sequence
taagcacacagttacaaaat

SEQ ID NO: 335963 - DNA, 20 bp, Artificial
  CRISPR gRNA sequence
caaaatgttaaactacaaca

SEQ ID NO: 335964 - DNA, 20 bp, Artificial
  CRISPR gRNA sequence
aactacaacataatcccagt

SEQ ID NO: 335965 - DNA, 20 bp, Artificial
  CRISPR gRNA sequence
caacataatcccagtttacc

SEQ ID NO: 335966 - DNA, 20 bp, Artificial
  CRISPR gRNA sequence
acctaaagttacaaatgttg

SEQ ID NO: 335967 - DNA, 20 bp, Artificial
  CRISPR gRNA sequence
cctaaagttacaaatgttgt

SEQ ID NO: 335968 - DNA, 20 bp, Artificial
  CRISPR gRNA sequence
aagttacaaatgttgttgca

SEQ ID NO: 335969 - DNA, 20 bp, Artificial
  CRISPR gRNA sequence
caaatgttgttgcatcgaca

SEQ ID NO: 335970 - DNA, 20 bp, Artificial
  CRISPR gRNA sequence
ttgcatcgacattggctgct

SEQ ID NO: 335971 - DNA, 20 bp, Artificial
  CRISPR gRNA sequence
catcgacattggctgcttca

SEQ ID NO: 335972 - DNA, 20 bp, Artificial
  CRISPR gRNA sequence
gctgcttcagaagccttggg

SEQ ID NO: 335973 - DNA, 20 bp, Artificial
  CRISPR gRNA sequence
cttcagaagccttgggcatg

SEQ ID NO: 335974 - DNA, 20 bp, Artificial
  CRISPR gRNA sequence
cagaagccttgggcatgcag

SEQ ID NO: 335975 - DNA, 20 bp, Artificial
  CRISPR gRNA sequence
agaagccttgggcatgcaga

SEQ ID NO: 335976 - DNA, 20 bp, Artificial
  CRISPR gRNA sequence
gggcatgcagacaggaagta

SEQ ID NO: 335977 - DNA, 20 bp, Artificial
  CRISPR gRNA sequence
ggcatgcagacaggaagtag

SEQ ID NO: 335978 - DNA, 20 bp, Artificial
  CRISPR gRNA sequence
cagctaagaataatcatatt

SEQ ID NO: 335979 - DNA, 20 bp, Artificial
  CRISPR gRNA sequence
agaataatcatattccacat

SEQ ID NO: 335980 - DNA, 20 bp, Artificial
  CRISPR gRNA sequence
cacatatttaagaatctttc

SEQ ID NO: 335981 - DNA, 20 bp, Artificial
  CRISPR gRNA sequence
aagaatctttctagccaaat

SEQ ID NO: 335982 - DNA, 20 bp, Artificial
  CRISPR gRNA sequence
agaatctttctagccaaatc

SEQ ID NO: 335983 - DNA, 20 bp, Artificial
  CRISPR gRNA sequence
tctagccaaatcatattcta

SEQ ID NO: 335984 - DNA, 20 bp, Artificial
  CRISPR gRNA sequence
ctagccaaatcatattctaa

SEQ ID NO: 335985 - DNA, 20 bp, Artificial
  CRISPR gRNA sequence
tagccaaatcatattctaaa

SEQ ID NO: 335986 - DNA, 20 bp, Artificial
  CRISPR gRNA sequence
gccaaatcatattctaaaga

SEQ ID NO: 335987 - DNA, 20 bp, Artificial
  CRISPR gRNA sequence
taaagaaggctatcttgaag

SEQ ID NO: 335988 - DNA, 20 bp, Artificial
  CRISPR gRNA sequence
aagaaggctatcttgaaggg

SEQ ID NO: 335989 - DNA, 20 bp, Artificial
  CRISPR gRNA sequence
tcttgaagggccagggccaa

SEQ ID NO: 335990 - DNA, 20 bp, Artificial
  CRISPR gRNA sequence
gaagggccagggccaatttc

SEQ ID NO: 335991 - DNA, 20 bp, Artificial
  CRISPR gRNA sequence
aagggccagggccaatttcc

SEQ ID NO: 335992 - DNA, 20 bp, Artificial
  CRISPR gRNA sequence
ccaggctgtgtggtttttat

SEQ ID NO: 335993 - DNA, 20 bp, Artificial
  CRISPR gRNA sequence
caggctgtgtggtttttatg

SEQ ID NO: 335994 - DNA, 20 bp, Artificial
  CRISPR gRNA sequence
tgtggtttttatgagaggga

SEQ ID NO: 335995 - DNA, 20 bp, Artificial
  CRISPR gRNA sequence
ttatgagagggaattgtgcc

SEQ ID NO: 335996 - DNA, 20 bp, Artificial
  CRISPR gRNA sequence
tatgagagggaattgtgccc

SEQ ID NO: 335997 - DNA, 20 bp, Artificial
  CRISPR gRNA sequence
atgagagggaattgtgccct

SEQ ID NO: 335998 - DNA, 20 bp, Artificial
  CRISPR gRNA sequence
tgagagggaattgtgccctg

SEQ ID NO: 335999 - DNA, 20 bp, Artificial
  CRISPR gRNA sequence
tgccctgacacatatgtgct

SEQ ID NO: 336000 - DNA, 20 bp, Artificial
  CRISPR gRNA sequence
acacatatgtgctcttcaca

SEQ ID NO: 336001 - DNA, 20 bp, Artificial
  CRISPR gRNA sequence
ttcacagatcctggaattat

SEQ ID NO: 336002 - DNA, 20 bp, Artificial
  CRISPR gRNA sequence
cacagatcctggaattatga

SEQ ID NO: 336003 - DNA, 20 bp, Artificial
  CRISPR gRNA sequence
acagatcctggaattatgaa

SEQ ID NO: 336004 - DNA, 20 bp, Artificial
  CRISPR gRNA sequence
gaattatgaatgcaggtaga

SEQ ID NO: 336005 - DNA, 20 bp, Artificial
  CRISPR gRNA sequence
tgaatgcaggtagaccactg

SEQ ID NO: 336006 - DNA, 20 bp, Artificial
  CRISPR gRNA sequence
tgattcccagggtgacttca

SEQ ID NO: 336007 - DNA, 20 bp, Artificial
  CRISPR gRNA sequence
ccagggtgacttcagcctct

SEQ ID NO: 336008 - DNA, 20 bp, Artificial
  CRISPR gRNA sequence
cagcctctgggagcaagaat

SEQ ID NO: 336009 - DNA, 20 bp, Artificial
  CRISPR gRNA sequence
agcctctgggagcaagaata

SEQ ID NO: 336010 - DNA, 20 bp, Artificial
  CRISPR gRNA sequence
tgggagcaagaatacctagt

SEQ ID NO: 336011 - DNA, 20 bp, Artificial
  CRISPR gRNA sequence
ggagcaagaatacctagtgg

SEQ ID NO: 336012 - DNA, 20 bp, Artificial
  CRISPR gRNA sequence
gtggcctctggctcagggga

SEQ ID NO: 336013 - DNA, 20 bp, Artificial
  CRISPR gRNA sequence
tggctcaggggagtctctca

SEQ ID NO: 336014 - DNA, 20 bp, Artificial
  CRISPR gRNA sequence
gctcaggggagtctctcaac

SEQ ID NO: 336015 - DNA, 20 bp, Artificial
  CRISPR gRNA sequence
aggggagtctctcaaccctg

SEQ ID NO: 336016 - DNA, 20 bp, Artificial
  CRISPR gRNA sequence
tcaaccctggaattccaccc

SEQ ID NO: 336017 - DNA, 20 bp, Artificial
  CRISPR gRNA sequence
aaccctggaattccacccag

SEQ ID NO: 336018 - DNA, 20 bp, Artificial
  CRISPR gRNA sequence
gaattccacccaggtctgga

SEQ ID NO: 336019 - DNA, 20 bp, Artificial
  CRISPR gRNA sequence
cacccaggtctggagggctg

SEQ ID NO: 336020 - DNA, 20 bp, Artificial
  CRISPR gRNA sequence
gagggctgctccaggctgat

SEQ ID NO: 336021 - DNA, 20 bp, Artificial
  CRISPR gRNA sequence
ctccaggctgatggggacca

SEQ ID NO: 336022 - DNA, 20 bp, Artificial
  CRISPR gRNA sequence
caggctgatggggaccattt

SEQ ID NO: 336023 - DNA, 20 bp, Artificial
  CRISPR gRNA sequence
atggggaccattttgacctg

SEQ ID NO: 336024 - DNA, 20 bp, Artificial
  CRISPR gRNA sequence
tgacctgtcaagcccagagg

SEQ ID NO: 336025 - DNA, 20 bp, Artificial
  CRISPR gRNA sequence
gacctgtcaagcccagaggc

SEQ ID NO: 336026 - DNA, 20 bp, Artificial
  CRISPR gRNA sequence
acctgtcaagcccagaggca

SEQ ID NO: 336027 - DNA, 20 bp, Artificial
  CRISPR gRNA sequence
tcaagcccagaggcaccatg

SEQ ID NO: 336028 - DNA, 20 bp, Artificial
  CRISPR gRNA sequence
acagcaacctatagtaactg

SEQ ID NO: 336029 - DNA, 20 bp, Artificial
  CRISPR gRNA sequence
tagtaactgcagctttcagg

SEQ ID NO: 336030 - DNA, 20 bp, Artificial
  CRISPR gRNA sequence
cagctttcaggctaaatgaa

SEQ ID NO: 336031 - DNA, 20 bp, Artificial
  CRISPR gRNA sequence
tcaggctaaatgaatattct

SEQ ID NO: 336032 - DNA, 20 bp, Artificial
  CRISPR gRNA sequence
caggctaaatgaatattctg

SEQ ID NO: 336033 - DNA, 20 bp, Artificial
  CRISPR gRNA sequence
aggctaaatgaatattctgc

SEQ ID NO: 336034 - DNA, 20 bp, Artificial
  CRISPR gRNA sequence
aatgaatattctgctctacc

SEQ ID NO: 336035 - DNA, 20 bp, Artificial
  CRISPR gRNA sequence
tgctctaccccatgagaatg

SEQ ID NO: 336036 - DNA, 20 bp, Artificial
  CRISPR gRNA sequence
ctctaccccatgagaatgct

SEQ ID NO: 336037 - DNA, 20 bp, Artificial
  CRISPR gRNA sequence
taccccatgagaatgctggc

SEQ ID NO: 336038 - DNA, 20 bp, Artificial
  CRISPR gRNA sequence
ccccatgagaatgctggccc

SEQ ID NO: 336039 - DNA, 20 bp, Artificial
  CRISPR gRNA sequence
gcccattaaagatgattttg

SEQ ID NO: 336040 - DNA, 20 bp, Artificial
  CRISPR gRNA sequence
aagatgattttgtttgcaat

SEQ ID NO: 336041 - DNA, 20 bp, Artificial
  CRISPR gRNA sequence
tgtttgcaattttaatatga

SEQ ID NO: 336042 - DNA, 20 bp, Artificial
  CRISPR gRNA sequence
gtttgcaattttaatatgat

SEQ ID NO: 336043 - DNA, 20 bp, Artificial
  CRISPR gRNA sequence
tttgcaattttaatatgatc

SEQ ID NO: 336044 - DNA, 20 bp, Artificial
  CRISPR gRNA sequence
gcaattttaatatgatctac

SEQ ID NO: 336045 - DNA, 20 bp, Artificial
  CRISPR gRNA sequence
caattttaatatgatctaca

SEQ ID NO: 336046 - DNA, 20 bp, Artificial
  CRISPR gRNA sequence
taatatgatctacaaaaaga

SEQ ID NO: 336047 - DNA, 20 bp, Artificial
  CRISPR gRNA sequence
aatatgatctacaaaaagaa

SEQ ID NO: 336048 - DNA, 20 bp, Artificial
  CRISPR gRNA sequence
atatgatctacaaaaagaac

SEQ ID NO: 336049 - DNA, 20 bp, Artificial
  CRISPR gRNA sequence
caaaaagaactaaacttgta

SEQ ID NO: 336050 - DNA, 20 bp, Artificial
  CRISPR gRNA sequence
aacttgtaattaatagcacc

SEQ ID NO: 336051 - DNA, 20 bp, Artificial
  CRISPR gRNA sequence
gtaattaatagcaccatgaa

SEQ ID NO: 336052 - DNA, 20 bp, Artificial
  CRISPR gRNA sequence
taattaatagcaccatgaaa

SEQ ID NO: 336053 - DNA, 20 bp, Artificial
  CRISPR gRNA sequence
atagcaccatgaaaacatag

SEQ ID NO: 336054 - DNA, 20 bp, Artificial
  CRISPR gRNA sequence
gctttcaattccgggcaatg

SEQ ID NO: 336055 - DNA, 20 bp, Artificial
  CRISPR gRNA sequence
ctttcaattccgggcaatgt

SEQ ID NO: 336056 - DNA, 20 bp, Artificial
  CRISPR gRNA sequence
tcaattccgggcaatgtttc

SEQ ID NO: 336057 - DNA, 20 bp, Artificial
  CRISPR gRNA sequence
caattccgggcaatgtttcc

SEQ ID NO: 336058 - DNA, 20 bp, Artificial
  CRISPR gRNA sequence
aattccgggcaatgtttcct

SEQ ID NO: 336059 - DNA, 20 bp, Artificial
  CRISPR gRNA sequence
cgggcaatgtttcctaccac

SEQ ID NO: 336060 - DNA, 20 bp, Artificial
  CRISPR gRNA sequence
cctaccactaacttgaacaa

SEQ ID NO: 336061 - DNA, 20 bp, Artificial
  CRISPR gRNA sequence
ctaccactaacttgaacaaa

SEQ ID NO: 336062 - DNA, 20 bp, Artificial
  CRISPR gRNA sequence
ccactaacttgaacaaagta

SEQ ID NO: 336063 - DNA, 20 bp, Artificial
  CRISPR gRNA sequence
acttgaacaaagtaaaccat

SEQ ID NO: 336064 - DNA, 20 bp, Artificial
  CRISPR gRNA sequence
gaacaaagtaaaccatttta

SEQ ID NO: 336065 - DNA, 20 bp, Artificial
  CRISPR gRNA sequence
aacaaagtaaaccattttaa

SEQ ID NO: 336066 - DNA, 20 bp, Artificial
  CRISPR gRNA sequence
taactgaatttgagaaaaga

SEQ ID NO: 336067 - DNA, 20 bp, Artificial
  CRISPR gRNA sequence
aactgaatttgagaaaagaa

SEQ ID NO: 336068 - DNA, 20 bp, Artificial
  CRISPR gRNA sequence
actgaatttgagaaaagaac

SEQ ID NO: 336069 - DNA, 20 bp, Artificial
  CRISPR gRNA sequence
aatttgagaaaagaacatgt

SEQ ID NO: 336070 - DNA, 20 bp, Artificial
  CRISPR gRNA sequence
gagaaaagaacatgtctttc

SEQ ID NO: 336071 - DNA, 20 bp, Artificial
  CRISPR gRNA sequence
agaaaagaacatgtctttct

SEQ ID NO: 336072 - DNA, 20 bp, Artificial
  CRISPR gRNA sequence
tctggagcaaaaatattctt

SEQ ID NO: 336073 - DNA, 20 bp, Artificial
  CRISPR gRNA sequence
ctggagcaaaaatattcttg

SEQ ID NO: 336074 - DNA, 20 bp, Artificial
  CRISPR gRNA sequence
tggagcaaaaatattcttgt

SEQ ID NO: 336075 - DNA, 20 bp, Artificial
  CRISPR gRNA sequence
gagcaaaaatattcttgtag

SEQ ID NO: 336076 - DNA, 20 bp, Artificial
  CRISPR gRNA sequence
ttgtagggagaatataggca

SEQ ID NO: 336077 - DNA, 20 bp, Artificial
  CRISPR gRNA sequence
gtagggagaatataggcaaa

SEQ ID NO: 336078 - DNA, 20 bp, Artificial
  CRISPR gRNA sequence
tagggagaatataggcaaat

SEQ ID NO: 336079 - DNA, 20 bp, Artificial
  CRISPR gRNA sequence
attatgaattttatatacat

SEQ ID NO: 336080 - DNA, 20 bp, Artificial
  CRISPR gRNA sequence
tgaattttatatacatatgt

SEQ ID NO: 336081 - DNA, 20 bp, Artificial
  CRISPR gRNA sequence
tatatacatatgtgtgtata

SEQ ID NO: 336082 - DNA, 20 bp, Artificial
  CRISPR gRNA sequence
atatacatatgtgtgtatat

SEQ ID NO: 336083 - DNA, 20 bp, Artificial
  CRISPR gRNA sequence
tatacatatgtgtgtatata

SEQ ID NO: 336084 - DNA, 20 bp, Artificial
  CRISPR gRNA sequence
ttgagcagcagaggaaagaa

SEQ ID NO: 336085 - DNA, 20 bp, Artificial
  CRISPR gRNA sequence
agcagcagaggaaagaatgt

SEQ ID NO: 336086 - DNA, 20 bp, Artificial
  CRISPR gRNA sequence
tctattgagagtggctgttg

SEQ ID NO: 336087 - DNA, 20 bp, Artificial
  CRISPR gRNA sequence
tattgagagtggctgttggg

SEQ ID NO: 336088 - DNA, 20 bp, Artificial
  CRISPR gRNA sequence
ttgagagtggctgttgggct

SEQ ID NO: 336089 - DNA, 20 bp, Artificial
  CRISPR gRNA sequence
agagtggctgttgggctgtc

SEQ ID NO: 336090 - DNA, 20 bp, Artificial
  CRISPR gRNA sequence
ttgggctgtcaagcagtcat

SEQ ID NO: 336091 - DNA, 20 bp, Artificial
  CRISPR gRNA sequence
ggctgtcaagcagtcatgta

SEQ ID NO: 336092 - DNA, 20 bp, Artificial
  CRISPR gRNA sequence
tcaagcagtcatgtagaagt

SEQ ID NO: 336093 - DNA, 20 bp, Artificial
  CRISPR gRNA sequence
ttaaaaagaaaattgagggc

SEQ ID NO: 336094 - DNA, 20 bp, Artificial
  CRISPR gRNA sequence
taaaaagaaaattgagggca

SEQ ID NO: 336095 - DNA, 20 bp, Artificial
  CRISPR gRNA sequence
aaaaagaaaattgagggcac

SEQ ID NO: 336096 - DNA, 20 bp, Artificial
  CRISPR gRNA sequence
aaaagaaaattgagggcaca

SEQ ID NO: 336097 - DNA, 20 bp, Artificial
  CRISPR gRNA sequence
agggcacaagaaagcatcta

SEQ ID NO: 336098 - DNA, 20 bp, Artificial
  CRISPR gRNA sequence
aagtcttggtaaaatggtca

SEQ ID NO: 336099 - DNA, 20 bp, Artificial
  CRISPR gRNA sequence
ggtaaaatggtcaactgggg

SEQ ID NO: 336100 - DNA, 20 bp, Artificial
  CRISPR gRNA sequence
gtaaaatggtcaactggggt

SEQ ID NO: 336101 - DNA, 20 bp, Artificial
  CRISPR gRNA sequence
gggttcagcaattgaaggag

SEQ ID NO: 336102 - DNA, 20 bp, Artificial
  CRISPR gRNA sequence
agcaattgaaggagagtact

SEQ ID NO: 336103 - DNA, 20 bp, Artificial
  CRISPR gRNA sequence
aaggagagtactgagtatgt

SEQ ID NO: 336104 - DNA, 20 bp, Artificial
  CRISPR gRNA sequence
agtatgtactaatgtacagt

SEQ ID NO: 336105 - DNA, 20 bp, Artificial
  CRISPR gRNA sequence
atgtacagttcacatcaaca

SEQ ID NO: 336106 - DNA, 20 bp, Artificial
  CRISPR gRNA sequence
acatcaacatctcagaaata

SEQ ID NO: 336107 - DNA, 20 bp, Artificial
  CRISPR gRNA sequence
agaaataaaatagctccagc

SEQ ID NO: 336108 - DNA, 20 bp, Artificial
  CRISPR gRNA sequence
cagctttgaagcatctccct

SEQ ID NO: 336109 - DNA, 20 bp, Artificial
  CRISPR gRNA sequence
tgaagcatctcccttgactg

SEQ ID NO: 336110 - DNA, 20 bp, Artificial
  CRISPR gRNA sequence
gaagcatctcccttgactga

SEQ ID NO: 336111 - DNA, 20 bp, Artificial
  CRISPR gRNA sequence
aagcatctcccttgactgat

SEQ ID NO: 336112 - DNA, 20 bp, Artificial
  CRISPR gRNA sequence
ccttgactgattaaaagagg

SEQ ID NO: 336113 - DNA, 20 bp, Artificial
  CRISPR gRNA sequence
gactgattaaaagaggaatt

SEQ ID NO: 336114 - DNA, 20 bp, Artificial
  CRISPR gRNA sequence
actgattaaaagaggaattc

SEQ ID NO: 336115 - DNA, 20 bp, Artificial
  CRISPR gRNA sequence
attaaaagaggaattctcat

SEQ ID NO: 336116 - DNA, 20 bp, Artificial
  CRISPR gRNA sequence
aaagaggaattctcatccct

SEQ ID NO: 336117 - DNA, 20 bp, Artificial
  CRISPR gRNA sequence
tcatccctacagaaagaaga

SEQ ID NO: 336118 - DNA, 20 bp, Artificial
  CRISPR gRNA sequence
atccctacagaaagaagagg

SEQ ID NO: 336119 - DNA, 20 bp, Artificial
  CRISPR gRNA sequence
cagaaagaagaggtagtatg

SEQ ID NO: 336120 - DNA, 20 bp, Artificial
  CRISPR gRNA sequence
gtccttggctgctcatttgc

SEQ ID NO: 336121 - DNA, 20 bp, Artificial
  CRISPR gRNA sequence
ggctgctcatttgctttgca

SEQ ID NO: 336122 - DNA, 20 bp, Artificial
  CRISPR gRNA sequence
gctgctcatttgctttgcag

SEQ ID NO: 336123 - DNA, 20 bp, Artificial
  CRISPR gRNA sequence
ctcatttgctttgcagattc

SEQ ID NO: 336124 - DNA, 20 bp, Artificial
  CRISPR gRNA sequence
atttgctttgcagattcagt

SEQ ID NO: 336125 - DNA, 20 bp, Artificial
  CRISPR gRNA sequence
gctttgcagattcagtaccc

SEQ ID NO: 336126 - DNA, 20 bp, Artificial
  CRISPR gRNA sequence
ctttgcagattcagtacccc

SEQ ID NO: 336127 - DNA, 20 bp, Artificial
  CRISPR gRNA sequence
tgcagattcagtacccctgg

SEQ ID NO: 336128 - DNA, 20 bp, Artificial
  CRISPR gRNA sequence
gcagattcagtacccctggc

SEQ ID NO: 336129 - DNA, 20 bp, Artificial
  CRISPR gRNA sequence
cagattcagtacccctggca

SEQ ID NO: 336130 - DNA, 20 bp, Artificial
  CRISPR gRNA sequence
agtacccctggcatctttaa

SEQ ID NO: 336131 - DNA, 20 bp, Artificial
  CRISPR gRNA sequence
gcatctttaaaacatttttc

SEQ ID NO: 336132 - DNA, 20 bp, Artificial
  CRISPR gRNA sequence
taaaacatttttcttgtaaa

SEQ ID NO: 336133 - DNA, 20 bp, Artificial
  CRISPR gRNA sequence
aaaacatttttcttgtaaat

SEQ ID NO: 336134 - DNA, 20 bp, Artificial
  CRISPR gRNA sequence
aaacatttttcttgtaaatg

SEQ ID NO: 336135 - DNA, 20 bp, Artificial
  CRISPR gRNA sequence
ttcttgtaaatgtgtttgtt

SEQ ID NO: 336136 - DNA, 20 bp, Artificial
  CRISPR gRNA sequence
tcttgtaaatgtgtttgttt

SEQ ID NO: 336137 - DNA, 20 bp, Artificial
  CRISPR gRNA sequence
cttgtaaatgtgtttgtttt

SEQ ID NO: 336138 - DNA, 20 bp, Artificial
  CRISPR gRNA sequence
ttgtaaatgtgtttgtttta

SEQ ID NO: 336139 - DNA, 20 bp, Artificial
  CRISPR gRNA sequence
gtaaatgtgtttgttttact

SEQ ID NO: 336140 - DNA, 20 bp, Artificial
  CRISPR gRNA sequence
taaatgtgtttgttttactg

SEQ ID NO: 336141 - DNA, 20 bp, Artificial
  CRISPR gRNA sequence
gttttactggctgatgcact

SEQ ID NO: 336142 - DNA, 20 bp, Artificial
  CRISPR gRNA sequence
ttttactggctgatgcactg

SEQ ID NO: 336143 - DNA, 20 bp, Artificial
  CRISPR gRNA sequence
tactggctgatgcactgcta

SEQ ID NO: 336144 - DNA, 20 bp, Artificial
  CRISPR gRNA sequence
actggctgatgcactgctag

SEQ ID NO: 336145 - DNA, 20 bp, Artificial
  CRISPR gRNA sequence
ctggctgatgcactgctagg

SEQ ID NO: 336146 - DNA, 20 bp, Artificial
  CRISPR gRNA sequence
gctgatgcactgctaggagc

SEQ ID NO: 336147 - DNA, 20 bp, Artificial
  CRISPR gRNA sequence
atgcactgctaggagcagat

SEQ ID NO: 336148 - DNA, 20 bp, Artificial
  CRISPR gRNA sequence
ctaggagcagatgtggagac

SEQ ID NO: 336149 - DNA, 20 bp, Artificial
  CRISPR gRNA sequence
ggagcagatgtggagacagg

SEQ ID NO: 336150 - DNA, 20 bp, Artificial
  CRISPR gRNA sequence
cactcccagtgagcacacag

SEQ ID NO: 336151 - DNA, 20 bp, Artificial
  CRISPR gRNA sequence
ccagtgagcacacaggagct

SEQ ID NO: 336152 - DNA, 20 bp, Artificial
  CRISPR gRNA sequence
ggctttctccaaagctggtt

SEQ ID NO: 336153 - DNA, 20 bp, Artificial
  CRISPR gRNA sequence
tctccaaagctggttgcaag

SEQ ID NO: 336154 - DNA, 20 bp, Artificial
  CRISPR gRNA sequence
ctccaaagctggttgcaaga

SEQ ID NO: 336155 - DNA, 20 bp, Artificial
  CRISPR gRNA sequence
tccaaagctggttgcaagag

SEQ ID NO: 336156 - DNA, 20 bp, Artificial
  CRISPR gRNA sequence
caaagctggttgcaagaggg

SEQ ID NO: 336157 - DNA, 20 bp, Artificial
  CRISPR gRNA sequence
gttgcaagagggtgtttgtt

SEQ ID NO: 336158 - DNA, 20 bp, Artificial
  CRISPR gRNA sequence
caagagggtgtttgttttga

SEQ ID NO: 336159 - DNA, 20 bp, Artificial
  CRISPR gRNA sequence
gttttgagaggactcggcag

SEQ ID NO: 336160 - DNA, 20 bp, Artificial
  CRISPR gRNA sequence
ttttgagaggactcggcagt

SEQ ID NO: 336161 - DNA, 20 bp, Artificial
  CRISPR gRNA sequence
tgagaggactcggcagtacc

SEQ ID NO: 336162 - DNA, 20 bp, Artificial
  CRISPR gRNA sequence
gagaggactcggcagtacca

SEQ ID NO: 336163 - DNA, 20 bp, Artificial
  CRISPR gRNA sequence
agaggactcggcagtaccaa

SEQ ID NO: 336164 - DNA, 20 bp, Artificial
  CRISPR gRNA sequence
ggcagtaccaaggcagtctg

SEQ ID NO: 336165 - DNA, 20 bp, Artificial
  CRISPR gRNA sequence
ttaaaatccccattgactga

SEQ ID NO: 336166 - DNA, 20 bp, Artificial
  CRISPR gRNA sequence
aaatccccattgactgatac

SEQ ID NO: 336167 - DNA, 20 bp, Artificial
  CRISPR gRNA sequence
actgatacagtcattcttcc

SEQ ID NO: 336168 - DNA, 20 bp, Artificial
  CRISPR gRNA sequence
atacagtcattcttccagat

SEQ ID NO: 336169 - DNA, 20 bp, Artificial
  CRISPR gRNA sequence
ttccagattgaacaaaacac

SEQ ID NO: 336170 - DNA, 20 bp, Artificial
  CRISPR gRNA sequence
ccagattgaacaaaacacca

SEQ ID NO: 336171 - DNA, 20 bp, Artificial
  CRISPR gRNA sequence
cagattgaacaaaacaccag

SEQ ID NO: 336172 - DNA, 20 bp, Artificial
  CRISPR gRNA sequence
aacaaaacaccagcagaaga

SEQ ID NO: 336173 - DNA, 20 bp, Artificial
  CRISPR gRNA sequence
agtcagactctccgtggtcc

SEQ ID NO: 336174 - DNA, 20 bp, Artificial
  CRISPR gRNA sequence
tccgtggtcccggaaataag

SEQ ID NO: 336175 - DNA, 20 bp, Artificial
  CRISPR gRNA sequence
cgtggtcccggaaataagag

SEQ ID NO: 336176 - DNA, 20 bp, Artificial
  CRISPR gRNA sequence
gcacttcaagttgaggaaaa

SEQ ID NO: 336177 - DNA, 20 bp, Artificial
  CRISPR gRNA sequence
cacttcaagttgaggaaaac

SEQ ID NO: 336178 - DNA, 20 bp, Artificial
  CRISPR gRNA sequence
caagttgaggaaaactggcc

SEQ ID NO: 336179 - DNA, 20 bp, Artificial
  CRISPR gRNA sequence
aagttgaggaaaactggcca

SEQ ID NO: 336180 - DNA, 20 bp, Artificial
  CRISPR gRNA sequence
aggaaaactggccaacgtgc

SEQ ID NO: 336181 - DNA, 20 bp, Artificial
  CRISPR gRNA sequence
gccaacgtgcttcatgcctg

SEQ ID NO: 336182 - DNA, 20 bp, Artificial
  CRISPR gRNA sequence
catgcctgggtgccagagtt

SEQ ID NO: 336183 - DNA, 20 bp, Artificial
  CRISPR gRNA sequence
atgcctgggtgccagagttc

SEQ ID NO: 336184 - DNA, 20 bp, Artificial
  CRISPR gRNA sequence
ggtgccagagttccatatta

SEQ ID NO: 336185 - DNA, 20 bp, Artificial
  CRISPR gRNA sequence
catattatagggtcacatct

SEQ ID NO: 336186 - DNA, 20 bp, Artificial
  CRISPR gRNA sequence
tagggtcacatctgtaacaa

SEQ ID NO: 336187 - DNA, 20 bp, Artificial
  CRISPR gRNA sequence
taacaaaaattcagcataaa

SEQ ID NO: 336188 - DNA, 20 bp, Artificial
  CRISPR gRNA sequence
agcataaattatctaaatgc

SEQ ID NO: 336189 - DNA, 20 bp, Artificial
  CRISPR gRNA sequence
tctaaatgctctccatgtgc

SEQ ID NO: 336190 - DNA, 20 bp, Artificial
  CRISPR gRNA sequence
aatgctctccatgtgccagt

SEQ ID NO: 336191 - DNA, 20 bp, Artificial
  CRISPR gRNA sequence
tccatgtgccagttccctac

SEQ ID NO: 336192 - DNA, 20 bp, Artificial
  CRISPR gRNA sequence
catgtgccagttccctacaa

SEQ ID NO: 336193 - DNA, 20 bp, Artificial
  CRISPR gRNA sequence
cctacaagaagctttcccct

SEQ ID NO: 336194 - DNA, 20 bp, Artificial
  CRISPR gRNA sequence
caagaagctttcccctctcc

SEQ ID NO: 336195 - DNA, 20 bp, Artificial
  CRISPR gRNA sequence
tcccctctccattgcctttc

SEQ ID NO: 336196 - DNA, 20 bp, Artificial
  CRISPR gRNA sequence
cccctctccattgcctttca

SEQ ID NO: 336197 - DNA, 20 bp, Artificial
  CRISPR gRNA sequence
ccctctccattgcctttcat

SEQ ID NO: 336198 - DNA, 20 bp, Artificial
  CRISPR gRNA sequence
tccattgcctttcatacaca

SEQ ID NO: 336199 - DNA, 20 bp, Artificial
  CRISPR gRNA sequence
cattgcctttcatacacaca

SEQ ID NO: 336200 - DNA, 20 bp, Artificial
  CRISPR gRNA sequence
cctttcatacacacaaacac

SEQ ID NO: 336201 - DNA, 20 bp, Artificial
  CRISPR gRNA sequence
tcatacacacaaacacacac

SEQ ID NO: 336202 - DNA, 20 bp, Artificial
  CRISPR gRNA sequence
catacacacaaacacacacg

SEQ ID NO: 336203 - DNA, 20 bp, Artificial
  CRISPR gRNA sequence
atacacacaaacacacacgt

SEQ ID NO: 336204 - DNA, 20 bp, Artificial
  CRISPR gRNA sequence
acacacacaccatgcaaact

SEQ ID NO: 336205 - DNA, 20 bp, Artificial
  CRISPR gRNA sequence
atctttatgcttcaacaccc

SEQ ID NO: 336206 - DNA, 20 bp, Artificial
  CRISPR gRNA sequence
tatgcttcaacacccagcac

SEQ ID NO: 336207 - DNA, 20 bp, Artificial
  CRISPR gRNA sequence
atgcttcaacacccagcacc

SEQ ID NO: 336208 - DNA, 20 bp, Artificial
  CRISPR gRNA sequence
tgcttcaacacccagcacca

SEQ ID NO: 336209 - DNA, 20 bp, Artificial
  CRISPR gRNA sequence
caacacccagcaccagttcc

SEQ ID NO: 336210 - DNA, 20 bp, Artificial
  CRISPR gRNA sequence
aacacccagcaccagttccc

SEQ ID NO: 336211 - DNA, 20 bp, Artificial
  CRISPR gRNA sequence
cccatttccagagaagttta

SEQ ID NO: 336212 - DNA, 20 bp, Artificial
  CRISPR gRNA sequence
ccagagaagtttagctctcg

SEQ ID NO: 336213 - DNA, 20 bp, Artificial
  CRISPR gRNA sequence
cagagaagtttagctctcga

SEQ ID NO: 336214 - DNA, 20 bp, Artificial
  CRISPR gRNA sequence
agctctcgactcctataaca

SEQ ID NO: 336215 - DNA, 20 bp, Artificial
  CRISPR gRNA sequence
gctctcgactcctataacag

SEQ ID NO: 336216 - DNA, 20 bp, Artificial
  CRISPR gRNA sequence
tcgactcctataacagacat

SEQ ID NO: 336217 - DNA, 20 bp, Artificial
  CRISPR gRNA sequence
gactcctataacagacatta

SEQ ID NO: 336218 - DNA, 20 bp, Artificial
  CRISPR gRNA sequence
ctataacagacattatctaa

SEQ ID NO: 336219 - DNA, 20 bp, Artificial
  CRISPR gRNA sequence
taacagacattatctaaact

SEQ ID NO: 336220 - DNA, 20 bp, Artificial
  CRISPR gRNA sequence
tctaaactcatcactttgaa

SEQ ID NO: 336221 - DNA, 20 bp, Artificial
  CRISPR gRNA sequence
aactcatcactttgaaactg

SEQ ID NO: 336222 - DNA, 20 bp, Artificial
  CRISPR gRNA sequence
atcactttgaaactgtccac

SEQ ID NO: 336223 - DNA, 20 bp, Artificial
  CRISPR gRNA sequence
tgaaactgtccacctctgat

SEQ ID NO: 336224 - DNA, 20 bp, Artificial
  CRISPR gRNA sequence
gaaactgtccacctctgatt

SEQ ID NO: 336225 - DNA, 20 bp, Artificial
  CRISPR gRNA sequence
aaactgtccacctctgattg

SEQ ID NO: 336226 - DNA, 20 bp, Artificial
  CRISPR gRNA sequence
tccacctctgattgcagctg

SEQ ID NO: 336227 - DNA, 20 bp, Artificial
  CRISPR gRNA sequence
tgattgcagctgctgctggg

SEQ ID NO: 336228 - DNA, 20 bp, Artificial
  CRISPR gRNA sequence
attgcagctgctgctggggc

SEQ ID NO: 336229 - DNA, 20 bp, Artificial
  CRISPR gRNA sequence
cagctgctgctggggcagaa

SEQ ID NO: 336230 - DNA, 20 bp, Artificial
  CRISPR gRNA sequence
ctgctggggcagaaagcgct

SEQ ID NO: 336231 - DNA, 20 bp, Artificial
  CRISPR gRNA sequence
ctggggcagaaagcgctgca

SEQ ID NO: 336232 - DNA, 20 bp, Artificial
  CRISPR gRNA sequence
gggcagaaagcgctgcatgg

SEQ ID NO: 336233 - DNA, 20 bp, Artificial
  CRISPR gRNA sequence
catgggctgactgttctagc

SEQ ID NO: 336234 - DNA, 20 bp, Artificial
  CRISPR gRNA sequence
actgttctagcacaacagcc

SEQ ID NO: 336235 - DNA, 20 bp, Artificial
  CRISPR gRNA sequence
ttctagcacaacagccccac

SEQ ID NO: 336236 - DNA, 20 bp, Artificial
  CRISPR gRNA sequence
tagcacaacagccccactgc

SEQ ID NO: 336237 - DNA, 20 bp, Artificial
  CRISPR gRNA sequence
gcacaacagccccactgcat

SEQ ID NO: 336238 - DNA, 20 bp, Artificial
  CRISPR gRNA sequence
catttcactgcttttctgcc

SEQ ID NO: 336239 - DNA, 20 bp, Artificial
  CRISPR gRNA sequence
cactgcttttctgcctccag

SEQ ID NO: 336240 - DNA, 20 bp, Artificial
  CRISPR gRNA sequence
actgcttttctgcctccaga

SEQ ID NO: 336241 - DNA, 20 bp, Artificial
  CRISPR gRNA sequence
cttttctgcctccagacttt

SEQ ID NO: 336242 - DNA, 20 bp, Artificial
  CRISPR gRNA sequence
ttctgcctccagactttctc

SEQ ID NO: 336243 - DNA, 20 bp, Artificial
  CRISPR gRNA sequence
tctgcctccagactttctct

SEQ ID NO: 336244 - DNA, 20 bp, Artificial
  CRISPR gRNA sequence
ctgcctccagactttctctg

SEQ ID NO: 336245 - DNA, 20 bp, Artificial
  CRISPR gRNA sequence
tgcctccagactttctctga

SEQ ID NO: 336246 - DNA, 20 bp, Artificial
  CRISPR gRNA sequence
cctccagactttctctgaag

SEQ ID NO: 336247 - DNA, 20 bp, Artificial
  CRISPR gRNA sequence
cagactttctctgaagactc

SEQ ID NO: 336248 - DNA, 20 bp, Artificial
  CRISPR gRNA sequence
tctctgaagactcatcccaa

SEQ ID NO: 336249 - DNA, 20 bp, Artificial
  CRISPR gRNA sequence
ctctgaagactcatcccaag

SEQ ID NO: 336250 - DNA, 20 bp, Artificial
  CRISPR gRNA sequence
tctgaagactcatcccaagt

SEQ ID NO: 336251 - DNA, 20 bp, Artificial
  CRISPR gRNA sequence
tgaagactcatcccaagtag

SEQ ID NO: 336252 - DNA, 20 bp, Artificial
  CRISPR gRNA sequence
aagactcatcccaagtaggc

SEQ ID NO: 336253 - DNA, 20 bp, Artificial
  CRISPR gRNA sequence
atcccaagtaggctcatccc

SEQ ID NO: 336254 - DNA, 20 bp, Artificial
  CRISPR gRNA sequence
atcccaagtagaggcacagc

SEQ ID NO: 336255 - DNA, 20 bp, Artificial
  CRISPR gRNA sequence
agagatgagggaaagctaat

SEQ ID NO: 336256 - DNA, 20 bp, Artificial
  CRISPR gRNA sequence
atgccctccgcaggcaaccc

SEQ ID NO: 336257 - DNA, 20 bp, Artificial
  CRISPR gRNA sequence
cgcaggcaaccccaaatcag

SEQ ID NO: 336258 - DNA, 20 bp, Artificial
  CRISPR gRNA sequence
ccatccttcaagagaatgat

SEQ ID NO: 336259 - DNA, 20 bp, Artificial
  CRISPR gRNA sequence
caagagaatgattctgggag

SEQ ID NO: 336260 - DNA, 20 bp, Artificial
  CRISPR gRNA sequence
aagagaatgattctgggagg

SEQ ID NO: 336261 - DNA, 20 bp, Artificial
  CRISPR gRNA sequence
tgggaggcatctgtacactt

SEQ ID NO: 336262 - DNA, 20 bp, Artificial
  CRISPR gRNA sequence
ggaggcatctgtacacttct

SEQ ID NO: 336263 - DNA, 20 bp, Artificial
  CRISPR gRNA sequence
tacacttctcagaggtccaa

SEQ ID NO: 336264 - DNA, 20 bp, Artificial
  CRISPR gRNA sequence
ctcagaggtccaatgaagtc

SEQ ID NO: 336265 - DNA, 20 bp, Artificial
  CRISPR gRNA sequence
tcagaggtccaatgaagtca

SEQ ID NO: 336266 - DNA, 20 bp, Artificial
  CRISPR gRNA sequence
agaggtccaatgaagtcagg

SEQ ID NO: 336267 - DNA, 20 bp, Artificial
  CRISPR gRNA sequence
tgtggcctggagctgagacc

SEQ ID NO: 336268 - DNA, 20 bp, Artificial
  CRISPR gRNA sequence
tggcctggagctgagacctt

SEQ ID NO: 336269 - DNA, 20 bp, Artificial
  CRISPR gRNA sequence
gagctgagaccttgataata

SEQ ID NO: 336270 - DNA, 20 bp, Artificial
  CRISPR gRNA sequence
agaccttgataataatgcgc

SEQ ID NO: 336271 - DNA, 20 bp, Artificial
  CRISPR gRNA sequence
gataataatgcgcccttcat

SEQ ID NO: 336272 - DNA, 20 bp, Artificial
  CRISPR gRNA sequence
ataataatgcgcccttcatt

SEQ ID NO: 336273 - DNA, 20 bp, Artificial
  CRISPR gRNA sequence
catttgcttctccttgttgg

SEQ ID NO: 336274 - DNA, 20 bp, Artificial
  CRISPR gRNA sequence
atttgcttctccttgttggc

SEQ ID NO: 336275 - DNA, 20 bp, Artificial
  CRISPR gRNA sequence
gcttctccttgttggctgtc

SEQ ID NO: 336276 - DNA, 20 bp, Artificial
  CRISPR gRNA sequence
cttctccttgttggctgtct

SEQ ID NO: 336277 - DNA, 20 bp, Artificial
  CRISPR gRNA sequence
ctccttgttggctgtctcac

SEQ ID NO: 336278 - DNA, 20 bp, Artificial
  CRISPR gRNA sequence
tccttgttggctgtctcact

SEQ ID NO: 336279 - DNA, 20 bp, Artificial
  CRISPR gRNA sequence
cttgttggctgtctcactct

SEQ ID NO: 336280 - DNA, 20 bp, Artificial
  CRISPR gRNA sequence
gttggctgtctcactctccc

SEQ ID NO: 336281 - DNA, 20 bp, Artificial
  CRISPR gRNA sequence
ttggctgtctcactctccct

SEQ ID NO: 336282 - DNA, 20 bp, Artificial
  CRISPR gRNA sequence
gctgtctcactctccctgcc

SEQ ID NO: 336283 - DNA, 20 bp, Artificial
  CRISPR gRNA sequence
tctcactctccctgccccct

SEQ ID NO: 336284 - DNA, 20 bp, Artificial
  CRISPR gRNA sequence
actctccctgccccctcacc

SEQ ID NO: 336285 - DNA, 20 bp, Artificial
  CRISPR gRNA sequence
tccctgccccctcacccctt

SEQ ID NO: 336286 - DNA, 20 bp, Artificial
  CRISPR gRNA sequence
cctgccccctcaccccttct

SEQ ID NO: 336287 - DNA, 20 bp, Artificial
  CRISPR gRNA sequence
ccccctcaccccttcttcct

SEQ ID NO: 336288 - DNA, 20 bp, Artificial
  CRISPR gRNA sequence
accccttcttcctgggatca

SEQ ID NO: 336289 - DNA, 20 bp, Artificial
  CRISPR gRNA sequence
cttcctgggatcacctccca

SEQ ID NO: 336290 - DNA, 20 bp, Artificial
  CRISPR gRNA sequence
ttcctgggatcacctcccaa

SEQ ID NO: 336291 - DNA, 20 bp, Artificial
  CRISPR gRNA sequence
cctgggatcacctcccaaat

SEQ ID NO: 336292 - DNA, 20 bp, Artificial
  CRISPR gRNA sequence
ctgggatcacctcccaaata

SEQ ID NO: 336293 - DNA, 20 bp, Artificial
  CRISPR gRNA sequence
ggatcacctcccaaataaac

SEQ ID NO: 336294 - DNA, 20 bp, Artificial
  CRISPR gRNA sequence
ccaaataaactacttgcacc

SEQ ID NO: 336295 - DNA, 20 bp, Artificial
  CRISPR gRNA sequence
cttgcacccaagtccttatg

SEQ ID NO: 336296 - DNA, 20 bp, Artificial
  CRISPR gRNA sequence
gcacccaagtccttatgtca

SEQ ID NO: 336297 - DNA, 20 bp, Artificial
  CRISPR gRNA sequence
cacccaagtccttatgtcag

SEQ ID NO: 336298 - DNA, 20 bp, Artificial
  CRISPR gRNA sequence
atgtcaggttctgcttgtgg

SEQ ID NO: 336299 - DNA, 20 bp, Artificial
  CRISPR gRNA sequence
tgtcaggttctgcttgtggg

SEQ ID NO: 336300 - DNA, 20 bp, Artificial
  CRISPR gRNA sequence
tgcttgtggggatccaaaca

SEQ ID NO: 336301 - DNA, 20 bp, Artificial
  CRISPR gRNA sequence
cttgtggggatccaaacagc

SEQ ID NO: 336302 - DNA, 20 bp, Artificial
  CRISPR gRNA sequence
gtggggatccaaacagccag

SEQ ID NO: 336303 - DNA, 20 bp, Artificial
  CRISPR gRNA sequence
tggggatccaaacagccaga

SEQ ID NO: 336304 - DNA, 20 bp, Artificial
  CRISPR gRNA sequence
agcaaagagattgagagatc

SEQ ID NO: 336305 - DNA, 20 bp, Artificial
  CRISPR gRNA sequence
agagatcatatattttttaa

SEQ ID NO: 336306 - DNA, 20 bp, Artificial
  CRISPR gRNA sequence
tttaaacagcaaagtaatga

SEQ ID NO: 336307 - DNA, 20 bp, Artificial
  CRISPR gRNA sequence
ttaaacagcaaagtaatgaa

SEQ ID NO: 336308 - DNA, 20 bp, Artificial
  CRISPR gRNA sequence
taaacagcaaagtaatgaaa

SEQ ID NO: 336309 - DNA, 20 bp, Artificial
  CRISPR gRNA sequence
aaacagcaaagtaatgaaac

SEQ ID NO: 336310 - DNA, 20 bp, Artificial
  CRISPR gRNA sequence
aacagcaaagtaatgaaaca

SEQ ID NO: 336311 - DNA, 20 bp, Artificial
  CRISPR gRNA sequence
tttgcaagtgtcaaagctag

SEQ ID NO: 336312 - DNA, 20 bp, Artificial
  CRISPR gRNA sequence
tgcaagtgtcaaagctaggt

SEQ ID NO: 336313 - DNA, 20 bp, Artificial
  CRISPR gRNA sequence
gcaagtgtcaaagctaggta

SEQ ID NO: 336314 - DNA, 20 bp, Artificial
  CRISPR gRNA sequence
caagtgtcaaagctaggtat

SEQ ID NO: 336315 - DNA, 20 bp, Artificial
  CRISPR gRNA sequence
ggtattaactgtctagggaa

SEQ ID NO: 336316 - DNA, 20 bp, Artificial
  CRISPR gRNA sequence
actgtctagggaaccaaaag

SEQ ID NO: 336317 - DNA, 20 bp, Artificial
  CRISPR gRNA sequence
tctagggaaccaaaagagtc

SEQ ID NO: 336318 - DNA, 20 bp, Artificial
  CRISPR gRNA sequence
gggaaccaaaagagtcactg

SEQ ID NO: 336319 - DNA, 20 bp, Artificial
  CRISPR gRNA sequence
aacactttgagcatcaattt

SEQ ID NO: 336320 - DNA, 20 bp, Artificial
  CRISPR gRNA sequence
tgagcatcaatttctgtcat

SEQ ID NO: 336321 - DNA, 20 bp, Artificial
  CRISPR gRNA sequence
gagcatcaatttctgtcatc

SEQ ID NO: 336322 - DNA, 20 bp, Artificial
  CRISPR gRNA sequence
agcatcaatttctgtcatct

SEQ ID NO: 336323 - DNA, 20 bp, Artificial
  CRISPR gRNA sequence
ctgtcatctaaaacatgaaa

SEQ ID NO: 336324 - DNA, 20 bp, Artificial
  CRISPR gRNA sequence
tgtcatctaaaacatgaaat

SEQ ID NO: 336325 - DNA, 20 bp, Artificial
  CRISPR gRNA sequence
tcatctaaaacatgaaatgt

SEQ ID NO: 336326 - DNA, 20 bp, Artificial
  CRISPR gRNA sequence
aaacatgaaatgtgaactca

SEQ ID NO: 336327 - DNA, 20 bp, Artificial
  CRISPR gRNA sequence
aaggatcctttttagctccc

SEQ ID NO: 336328 - DNA, 20 bp, Artificial
  CRISPR gRNA sequence
tttagctcccatcccatgct

SEQ ID NO: 336329 - DNA, 20 bp, Artificial
  CRISPR gRNA sequence
ttagctcccatcccatgcta

SEQ ID NO: 336330 - DNA, 20 bp, Artificial
  CRISPR gRNA sequence
tagctcccatcccatgctat

SEQ ID NO: 336331 - DNA, 20 bp, Artificial
  CRISPR gRNA sequence
agctcccatcccatgctata

SEQ ID NO: 336332 - DNA, 20 bp, Artificial
  CRISPR gRNA sequence
gctcccatcccatgctataa

SEQ ID NO: 336333 - DNA, 20 bp, Artificial
  CRISPR gRNA sequence
ccatcccatgctataattcc

SEQ ID NO: 336334 - DNA, 20 bp, Artificial
  CRISPR gRNA sequence
taattccatgacaacgcaag

SEQ ID NO: 336335 - DNA, 20 bp, Artificial
  CRISPR gRNA sequence
catgacaacgcaagctatgt

SEQ ID NO: 336336 - DNA, 20 bp, Artificial
  CRISPR gRNA sequence
tgtgtgtcccctttagataa

SEQ ID NO: 336337 - DNA, 20 bp, Artificial
  CRISPR gRNA sequence
tagataatctgtagccactg

SEQ ID NO: 336338 - DNA, 20 bp, Artificial
  CRISPR gRNA sequence
agataatctgtagccactga

SEQ ID NO: 336339 - DNA, 20 bp, Artificial
  CRISPR gRNA sequence
gataatctgtagccactgag

SEQ ID NO: 336340 - DNA, 20 bp, Artificial
  CRISPR gRNA sequence
tagccactgaggggtggaaa

SEQ ID NO: 336341 - DNA, 20 bp, Artificial
  CRISPR gRNA sequence
aggggtggaaaaatgcagtg

SEQ ID NO: 336342 - DNA, 20 bp, Artificial
  CRISPR gRNA sequence
ctgtctcattacacatcgca

SEQ ID NO: 336343 - DNA, 20 bp, Artificial
  CRISPR gRNA sequence
tgtctcattacacatcgcac

SEQ ID NO: 336344 - DNA, 20 bp, Artificial
  CRISPR gRNA sequence
tctcattacacatcgcacat

SEQ ID NO: 336345 - DNA, 20 bp, Artificial
  CRISPR gRNA sequence
attacacatcgcacatcatt

SEQ ID NO: 336346 - DNA, 20 bp, Artificial
  CRISPR gRNA sequence
cacatcgcacatcattcgaa

SEQ ID NO: 336347 - DNA, 20 bp, Artificial
  CRISPR gRNA sequence
gaacctcaagggcataagac

SEQ ID NO: 336348 - DNA, 20 bp, Artificial
  CRISPR gRNA sequence
aagggcataagacatgaatt

SEQ ID NO: 336349 - DNA, 20 bp, Artificial
  CRISPR gRNA sequence
tccacaatggaagcttcaaa

SEQ ID NO: 336350 - DNA, 20 bp, Artificial
  CRISPR gRNA sequence
ccacaatggaagcttcaaac

SEQ ID NO: 336351 - DNA, 20 bp, Artificial
  CRISPR gRNA sequence
cacaatggaagcttcaaact

SEQ ID NO: 336352 - DNA, 20 bp, Artificial
  CRISPR gRNA sequence
caaactttctgggtgctcct

SEQ ID NO: 336353 - DNA, 20 bp, Artificial
  CRISPR gRNA sequence
aaactttctgggtgctcctc

SEQ ID NO: 336354 - DNA, 20 bp, Artificial
  CRISPR gRNA sequence
tctgggtgctcctcaaactt

SEQ ID NO: 336355 - DNA, 20 bp, Artificial
  CRISPR gRNA sequence
ctgggtgctcctcaaacttg

SEQ ID NO: 336356 - DNA, 20 bp, Artificial
  CRISPR gRNA sequence
tgggtgctcctcaaacttgg

SEQ ID NO: 336357 - DNA, 20 bp, Artificial
  CRISPR gRNA sequence
ggtgctcctcaaacttggca

SEQ ID NO: 336358 - DNA, 20 bp, Artificial
  CRISPR gRNA sequence
ctcaaacttggcaactttca

SEQ ID NO: 336359 - DNA, 20 bp, Artificial
  CRISPR gRNA sequence
aaacttggcaactttcagtt

SEQ ID NO: 336360 - DNA, 20 bp, Artificial
  CRISPR gRNA sequence
ggcaactttcagttttctga

SEQ ID NO: 336361 - DNA, 20 bp, Artificial
  CRISPR gRNA sequence
gcaactttcagttttctgac

SEQ ID NO: 336362 - DNA, 20 bp, Artificial
  CRISPR gRNA sequence
tcagttttctgactcttaac

SEQ ID NO: 336363 - DNA, 20 bp, Artificial
  CRISPR gRNA sequence
cagttttctgactcttaaca

SEQ ID NO: 336364 - DNA, 20 bp, Artificial
  CRISPR gRNA sequence
agttttctgactcttaacag

SEQ ID NO: 336365 - DNA, 20 bp, Artificial
  CRISPR gRNA sequence
tctgactcttaacagaaaag

SEQ ID NO: 336366 - DNA, 20 bp, Artificial
  CRISPR gRNA sequence
ctgactcttaacagaaaagg

SEQ ID NO: 336367 - DNA, 20 bp, Artificial
  CRISPR gRNA sequence
tgactcttaacagaaaaggt

SEQ ID NO: 336368 - DNA, 20 bp, Artificial
  CRISPR gRNA sequence
actcttaacagaaaaggtca

SEQ ID NO: 336369 - DNA, 20 bp, Artificial
  CRISPR gRNA sequence
ttaacagaaaaggtcaaatt

SEQ ID NO: 336370 - DNA, 20 bp, Artificial
  CRISPR gRNA sequence
aacagaaaaggtcaaatttc

SEQ ID NO: 336371 - DNA, 20 bp, Artificial
  CRISPR gRNA sequence
acagaaaaggtcaaatttcc

SEQ ID NO: 336372 - DNA, 20 bp, Artificial
  CRISPR gRNA sequence
ccatgttactgagacttcta

SEQ ID NO: 336373 - DNA, 20 bp, Artificial
  CRISPR gRNA sequence
catgttactgagacttctaa

SEQ ID NO: 336374 - DNA, 20 bp, Artificial
  CRISPR gRNA sequence
ctgagacttctaaagccatc

SEQ ID NO: 336375 - DNA, 20 bp, Artificial
  CRISPR gRNA sequence
agacttctaaagccatccaa

SEQ ID NO: 336376 - DNA, 20 bp, Artificial
  CRISPR gRNA sequence
ctaaagccatccaagttctc

SEQ ID NO: 336377 - DNA, 20 bp, Artificial
  CRISPR gRNA sequence
taaagccatccaagttctct

SEQ ID NO: 336378 - DNA, 20 bp, Artificial
  CRISPR gRNA sequence
aagccatccaagttctctaa

SEQ ID NO: 336379 - DNA, 20 bp, Artificial
  CRISPR gRNA sequence
tctaaacttgcacactcttt

SEQ ID NO: 336380 - DNA, 20 bp, Artificial
  CRISPR gRNA sequence
taaacttgcacactctttac

SEQ ID NO: 336381 - DNA, 20 bp, Artificial
  CRISPR gRNA sequence
aacttgcacactctttacct

SEQ ID NO: 336382 - DNA, 20 bp, Artificial
  CRISPR gRNA sequence
gcacactctttacctcaaaa

SEQ ID NO: 336383 - DNA, 20 bp, Artificial
  CRISPR gRNA sequence
cacactctttacctcaaaat

SEQ ID NO: 336384 - DNA, 20 bp, Artificial
  CRISPR gRNA sequence
tttacctcaaaataaccaga

SEQ ID NO: 336385 - DNA, 20 bp, Artificial
  CRISPR gRNA sequence
tacctcaaaataaccagata

SEQ ID NO: 336386 - DNA, 20 bp, Artificial
  CRISPR gRNA sequence
acctcaaaataaccagatat

SEQ ID NO: 336387 - DNA, 20 bp, Artificial
  CRISPR gRNA sequence
cctcaaaataaccagatatc

SEQ ID NO: 336388 - DNA, 20 bp, Artificial
  CRISPR gRNA sequence
aaaataaccagatatcttca

SEQ ID NO: 336389 - DNA, 20 bp, Artificial
  CRISPR gRNA sequence
catcaatttctccttcttcc

SEQ ID NO: 336390 - DNA, 20 bp, Artificial
  CRISPR gRNA sequence
atcaatttctccttcttccc

SEQ ID NO: 336391 - DNA, 20 bp, Artificial
  CRISPR gRNA sequence
ctccttcttccctctagcag

SEQ ID NO: 336392 - DNA, 20 bp, Artificial
  CRISPR gRNA sequence
tccttcttccctctagcagt

SEQ ID NO: 336393 - DNA, 20 bp, Artificial
  CRISPR gRNA sequence
cttcttccctctagcagtac

SEQ ID NO: 336394 - DNA, 20 bp, Artificial
  CRISPR gRNA sequence
cttccctctagcagtaccag

SEQ ID NO: 336395 - DNA, 20 bp, Artificial
  CRISPR gRNA sequence
ttccctctagcagtaccagc

SEQ ID NO: 336396 - DNA, 20 bp, Artificial
  CRISPR gRNA sequence
ccctctagcagtaccagcac

SEQ ID NO: 336397 - DNA, 20 bp, Artificial
  CRISPR gRNA sequence
cctctagcagtaccagcaca

SEQ ID NO: 336398 - DNA, 20 bp, Artificial
  CRISPR gRNA sequence
tagcagtaccagcacagatc

SEQ ID NO: 336399 - DNA, 20 bp, Artificial
  CRISPR gRNA sequence
gcagtaccagcacagatctc

SEQ ID NO: 336400 - DNA, 20 bp, Artificial
  CRISPR gRNA sequence
tcttcctaatctcagtccaa

SEQ ID NO: 336401 - DNA, 20 bp, Artificial
  CRISPR gRNA sequence
ttcctaatctcagtccaaaa

SEQ ID NO: 336402 - DNA, 20 bp, Artificial
  CRISPR gRNA sequence
cctaatctcagtccaaaatt

SEQ ID NO: 336403 - DNA, 20 bp, Artificial
  CRISPR gRNA sequence
ctaatctcagtccaaaatta

SEQ ID NO: 336404 - DNA, 20 bp, Artificial
  CRISPR gRNA sequence
atctcagtccaaaattagca

SEQ ID NO: 336405 - DNA, 20 bp, Artificial
  CRISPR gRNA sequence
agtccaaaattagcatatat

SEQ ID NO: 336406 - DNA, 20 bp, Artificial
  CRISPR gRNA sequence
gcatatatctgtccaaattc

SEQ ID NO: 336407 - DNA, 20 bp, Artificial
  CRISPR gRNA sequence
tccaaattccccagagtgcc

SEQ ID NO: 336408 - DNA, 20 bp, Artificial
  CRISPR gRNA sequence
cccagagtgcctcactcagt

SEQ ID NO: 336409 - DNA, 20 bp, Artificial
  CRISPR gRNA sequence
actcagtaactcacacttaa

SEQ ID NO: 336410 - DNA, 20 bp, Artificial
  CRISPR gRNA sequence
agtaactcacacttaactga

SEQ ID NO: 336411 - DNA, 20 bp, Artificial
  CRISPR gRNA sequence
acacttaactgatgctcaat

SEQ ID NO: 336412 - DNA, 20 bp, Artificial
  CRISPR gRNA sequence
aactgatgctcaataaacgc

SEQ ID NO: 336413 - DNA, 20 bp, Artificial
  CRISPR gRNA sequence
actgatgctcaataaacgct

SEQ ID NO: 336414 - DNA, 20 bp, Artificial
  CRISPR gRNA sequence
atgctcaataaacgctcatt

SEQ ID NO: 336415 - DNA, 20 bp, Artificial
  CRISPR gRNA sequence
aataaacgctcattgaatga

SEQ ID NO: 336416 - DNA, 20 bp, Artificial
  CRISPR gRNA sequence
attgaatgactgaatgaacc

SEQ ID NO: 336417 - DNA, 20 bp, Artificial
  CRISPR gRNA sequence
aatgactgaatgaacccttc

SEQ ID NO: 336418 - DNA, 20 bp, Artificial
  CRISPR gRNA sequence
aatgaacccttcaacaaaaa

SEQ ID NO: 336419 - DNA, 20 bp, Artificial
  CRISPR gRNA sequence
caacaaaaaacacttagaat

SEQ ID NO: 336420 - DNA, 20 bp, Artificial
  CRISPR gRNA sequence
aacaaaaaacacttagaatc

SEQ ID NO: 336421 - DNA, 20 bp, Artificial
  CRISPR gRNA sequence
agaatcatcccaacttttga

SEQ ID NO: 336422 - DNA, 20 bp, Artificial
  CRISPR gRNA sequence
gaatcatcccaacttttgaa

SEQ ID NO: 336423 - DNA, 20 bp, Artificial
  CRISPR gRNA sequence
ttgaaacatcaatgggaaaa

SEQ ID NO: 336424 - DNA, 20 bp, Artificial
  CRISPR gRNA sequence
tgaaacatcaatgggaaaat

SEQ ID NO: 336425 - DNA, 20 bp, Artificial
  CRISPR gRNA sequence
gaaacatcaatgggaaaatt

SEQ ID NO: 336426 - DNA, 20 bp, Artificial
  CRISPR gRNA sequence
aaacatcaatgggaaaattg

SEQ ID NO: 336427 - DNA, 20 bp, Artificial
  CRISPR gRNA sequence
ccttgatactatggtggttt

SEQ ID NO: 336428 - DNA, 20 bp, Artificial
  CRISPR gRNA sequence
gatactatggtggtttatga

SEQ ID NO: 336429 - DNA, 20 bp, Artificial
  CRISPR gRNA sequence
atactatggtggtttatgag

SEQ ID NO: 336430 - DNA, 20 bp, Artificial
  CRISPR gRNA sequence
tggtggtttatgagctgttt

SEQ ID NO: 336431 - DNA, 20 bp, Artificial
  CRISPR gRNA sequence
atgagctgtttgtgtgttta

SEQ ID NO: 336432 - DNA, 20 bp, Artificial
  CRISPR gRNA sequence
tgagctgtttgtgtgtttag

SEQ ID NO: 336433 - DNA, 20 bp, Artificial
  CRISPR gRNA sequence
tttgtgtgtttagtttcaat

SEQ ID NO: 336434 - DNA, 20 bp, Artificial
  CRISPR gRNA sequence
gtgtgtttagtttcaatagt

SEQ ID NO: 336435 - DNA, 20 bp, Artificial
  CRISPR gRNA sequence
tgtgtttagtttcaatagtg

SEQ ID NO: 336436 - DNA, 20 bp, Artificial
  CRISPR gRNA sequence
agtttcaatagtggcttaca

SEQ ID NO: 336437 - DNA, 20 bp, Artificial
  CRISPR gRNA sequence
gtttcaatagtggcttacaa

SEQ ID NO: 336438 - DNA, 20 bp, Artificial
  CRISPR gRNA sequence
caatagtggcttacaaacct

SEQ ID NO: 336439 - DNA, 20 bp, Artificial
  CRISPR gRNA sequence
aatagtggcttacaaaccta

SEQ ID NO: 336440 - DNA, 20 bp, Artificial
  CRISPR gRNA sequence
acaaacctattgcttgtttg

SEQ ID NO: 336441 - DNA, 20 bp, Artificial
  CRISPR gRNA sequence
caaacctattgcttgtttgt

SEQ ID NO: 336442 - DNA, 20 bp, Artificial
  CRISPR gRNA sequence
ttgcttgtttgttttcaata

SEQ ID NO: 336443 - DNA, 20 bp, Artificial
  CRISPR gRNA sequence
cttgtttgttttcaatatac

SEQ ID NO: 336444 - DNA, 20 bp, Artificial
  CRISPR gRNA sequence
gtttgttttcaatatactgc

SEQ ID NO: 336445 - DNA, 20 bp, Artificial
  CRISPR gRNA sequence
tttgttttcaatatactgca

SEQ ID NO: 336446 - DNA, 20 bp, Artificial
  CRISPR gRNA sequence
gttttcaatatactgcagaa

SEQ ID NO: 336447 - DNA, 20 bp, Artificial
  CRISPR gRNA sequence
ttttcaatatactgcagaaa

SEQ ID NO: 336448 - DNA, 20 bp, Artificial
  CRISPR gRNA sequence
tcaatatactgcagaaaata

SEQ ID NO: 336449 - DNA, 20 bp, Artificial
  CRISPR gRNA sequence
caatatactgcagaaaatat

SEQ ID NO: 336450 - DNA, 20 bp, Artificial
  CRISPR gRNA sequence
aatatactgcagaaaatata

SEQ ID NO: 336451 - DNA, 20 bp, Artificial
  CRISPR gRNA sequence
cagaaaatataaatctagtt

SEQ ID NO: 336452 - DNA, 20 bp, Artificial
  CRISPR gRNA sequence
gttaaaagtgagaaatccag

SEQ ID NO: 336453 - DNA, 20 bp, Artificial
  CRISPR gRNA sequence
aaagtgagaaatccagattt

SEQ ID NO: 336454 - DNA, 20 bp, Artificial
  CRISPR gRNA sequence
tcacagaaaattctagaatt

SEQ ID NO: 336455 - DNA, 20 bp, Artificial
  CRISPR gRNA sequence
cacagaaaattctagaatta

SEQ ID NO: 336456 - DNA, 20 bp, Artificial
  CRISPR gRNA sequence
acagaaaattctagaattag

SEQ ID NO: 336457 - DNA, 20 bp, Artificial
  CRISPR gRNA sequence
tagaattaggccttggagat

SEQ ID NO: 336458 - DNA, 20 bp, Artificial
  CRISPR gRNA sequence
gaattaggccttggagatgt

SEQ ID NO: 336459 - DNA, 20 bp, Artificial
  CRISPR gRNA sequence
ggccttggagatgttttcct

SEQ ID NO: 336460 - DNA, 20 bp, Artificial
  CRISPR gRNA sequence
ggagatgttttcctttcctt

SEQ ID NO: 336461 - DNA, 20 bp, Artificial
  CRISPR gRNA sequence
gagatgttttcctttccttt

SEQ ID NO: 336462 - DNA, 20 bp, Artificial
  CRISPR gRNA sequence
tcctttcctttaaaattaaa

SEQ ID NO: 336463 - DNA, 20 bp, Artificial
  CRISPR gRNA sequence
cctttcctttaaaattaaaa

SEQ ID NO: 336464 - DNA, 20 bp, Artificial
  CRISPR gRNA sequence
ctttcctttaaaattaaaaa

SEQ ID NO: 336465 - DNA, 20 bp, Artificial
  CRISPR gRNA sequence
tcctttaaaattaaaaaaaa

SEQ ID NO: 336466 - DNA, 20 bp, Artificial
  CRISPR gRNA sequence
cctttaaaattaaaaaaaaa

SEQ ID NO: 336467 - DNA, 20 bp, Artificial
  CRISPR gRNA sequence
ctttaaaattaaaaaaaaaa

SEQ ID NO: 336468 - DNA, 20 bp, Artificial
  CRISPR gRNA sequence
taaaattaaaaaaaaaaaaa

SEQ ID NO: 336469 - DNA, 20 bp, Artificial
  CRISPR gRNA sequence
aaaattaaaaaaaaaaaaat

SEQ ID NO: 336470 - DNA, 20 bp, Artificial
  CRISPR gRNA sequence
aaattaaaaaaaaaaaaatt

SEQ ID NO: 336471 - DNA, 20 bp, Artificial
  CRISPR gRNA sequence
aaaaaaaaaaaattaacatt

SEQ ID NO: 336472 - DNA, 20 bp, Artificial
  CRISPR gRNA sequence
acattccaggcttactgtga

SEQ ID NO: 336473 - DNA, 20 bp, Artificial
  CRISPR gRNA sequence
caggcttactgtgaagaaac

SEQ ID NO: 336474 - DNA, 20 bp, Artificial
  CRISPR gRNA sequence
actgtgaagaaacctcttcc

SEQ ID NO: 336475 - DNA, 20 bp, Artificial
  CRISPR gRNA sequence
ctgtgaagaaacctcttccc

SEQ ID NO: 336476 - DNA, 20 bp, Artificial
  CRISPR gRNA sequence
tgaagaaacctcttcccttc

SEQ ID NO: 336477 - DNA, 20 bp, Artificial
  CRISPR gRNA sequence
ttcccttcccaaacccccaa

SEQ ID NO: 336478 - DNA, 20 bp, Artificial
  CRISPR gRNA sequence
cccttcccaaacccccaaat

SEQ ID NO: 336479 - DNA, 20 bp, Artificial
  CRISPR gRNA sequence
ccttcccaaacccccaaatg

SEQ ID NO: 336480 - DNA, 20 bp, Artificial
  CRISPR gRNA sequence
cccaaacccccaaatggagt

SEQ ID NO: 336481 - DNA, 20 bp, Artificial
  CRISPR gRNA sequence
ccaaacccccaaatggagtc

SEQ ID NO: 336482 - DNA, 20 bp, Artificial
  CRISPR gRNA sequence
tgagtctagattttttggct

SEQ ID NO: 336483 - DNA, 20 bp, Artificial
  CRISPR gRNA sequence
gattttttggctgtgttcac

SEQ ID NO: 336484 - DNA, 20 bp, Artificial
  CRISPR gRNA sequence
tttggctgtgttcactgctc

SEQ ID NO: 336485 - DNA, 20 bp, Artificial
  CRISPR gRNA sequence
ttggctgtgttcactgctct

SEQ ID NO: 336486 - DNA, 20 bp, Artificial
  CRISPR gRNA sequence
tggctgtgttcactgctctc

SEQ ID NO: 336487 - DNA, 20 bp, Artificial
  CRISPR gRNA sequence
ggctgtgttcactgctctca

SEQ ID NO: 336488 - DNA, 20 bp, Artificial
  CRISPR gRNA sequence
gctgtgttcactgctctcat

SEQ ID NO: 336489 - DNA, 20 bp, Artificial
  CRISPR gRNA sequence
tgttcactgctctcatgaac

SEQ ID NO: 336490 - DNA, 20 bp, Artificial
  CRISPR gRNA sequence
actgctctcatgaacatgta

SEQ ID NO: 336491 - DNA, 20 bp, Artificial
  CRISPR gRNA sequence
ctctcatgaacatgtattca

SEQ ID NO: 336492 - DNA, 20 bp, Artificial
  CRISPR gRNA sequence
tcatgaacatgtattcaccg

SEQ ID NO: 336493 - DNA, 20 bp, Artificial
  CRISPR gRNA sequence
atgaacatgtattcaccgtt

SEQ ID NO: 336494 - DNA, 20 bp, Artificial
  CRISPR gRNA sequence
accgttagggtcgtgcacac

SEQ ID NO: 336495 - DNA, 20 bp, Artificial
  CRISPR gRNA sequence
gggtcgtgcacactggatga

SEQ ID NO: 336496 - DNA, 20 bp, Artificial
  CRISPR gRNA sequence
gatgaatacttctgaaagaa

SEQ ID NO: 336497 - DNA, 20 bp, Artificial
  CRISPR gRNA sequence
ctgaaagaaaaagccagaaa

SEQ ID NO: 336498 - DNA, 20 bp, Artificial
  CRISPR gRNA sequence
tgaaagaaaaagccagaaac

SEQ ID NO: 336499 - DNA, 20 bp, Artificial
  CRISPR gRNA sequence
aaagaaaaagccagaaacat

SEQ ID NO: 336500 - DNA, 20 bp, Artificial
  CRISPR gRNA sequence
ggtcatcttttcttctccat

SEQ ID NO: 336501 - DNA, 20 bp, Artificial
  CRISPR gRNA sequence
gtcatcttttcttctccatc

SEQ ID NO: 336502 - DNA, 20 bp, Artificial
  CRISPR gRNA sequence
ttcttctccatctctttgtt

SEQ ID NO: 336503 - DNA, 20 bp, Artificial
  CRISPR gRNA sequence
tcttctccatctctttgttt

SEQ ID NO: 336504 - DNA, 20 bp, Artificial
  CRISPR gRNA sequence
cttctccatctctttgtttt

SEQ ID NO: 336505 - DNA, 20 bp, Artificial
  CRISPR gRNA sequence
ttctccatctctttgttttt

SEQ ID NO: 336506 - DNA, 20 bp, Artificial
  CRISPR gRNA sequence
ctccatctctttgttttttg

SEQ ID NO: 336507 - DNA, 20 bp, Artificial
  CRISPR gRNA sequence
tccatctctttgttttttga

SEQ ID NO: 336508 - DNA, 20 bp, Artificial
  CRISPR gRNA sequence
catctctttgttttttgact

SEQ ID NO: 336509 - DNA, 20 bp, Artificial
  CRISPR gRNA sequence
tttgttttttgactgttttc

SEQ ID NO: 336510 - DNA, 20 bp, Artificial
  CRISPR gRNA sequence
tgttttttgactgttttcta

SEQ ID NO: 336511 - DNA, 20 bp, Artificial
  CRISPR gRNA sequence
gttttttgactgttttctat

SEQ ID NO: 336512 - DNA, 20 bp, Artificial
  CRISPR gRNA sequence
ttttttgactgttttctatt

SEQ ID NO: 336513 - DNA, 20 bp, Artificial
  CRISPR gRNA sequence
tttgactgttttctattctt

SEQ ID NO: 336514 - DNA, 20 bp, Artificial
  CRISPR gRNA sequence
ttgactgttttctattcttt

SEQ ID NO: 336515 - DNA, 20 bp, Artificial
  CRISPR gRNA sequence
tgactgttttctattctttg

SEQ ID NO: 336516 - DNA, 20 bp, Artificial
  CRISPR gRNA sequence
gactgttttctattctttgt

SEQ ID NO: 336517 - DNA, 20 bp, Artificial
  CRISPR gRNA sequence
actgttttctattctttgtt

SEQ ID NO: 336518 - DNA, 20 bp, Artificial
  CRISPR gRNA sequence
ttttctattctttgttgaag

SEQ ID NO: 336519 - DNA, 20 bp, Artificial
  CRISPR gRNA sequence
tctattctttgttgaagtgg

SEQ ID NO: 336520 - DNA, 20 bp, Artificial
  CRISPR gRNA sequence
ctattctttgttgaagtggt

SEQ ID NO: 336521 - DNA, 20 bp, Artificial
  CRISPR gRNA sequence
tattctttgttgaagtggta

SEQ ID NO: 336522 - DNA, 20 bp, Artificial
  CRISPR gRNA sequence
ttctttgttgaagtggtatg

SEQ ID NO: 336523 - DNA, 20 bp, Artificial
  CRISPR gRNA sequence
tttgttgaagtggtatgtga

SEQ ID NO: 336524 - DNA, 20 bp, Artificial
  CRISPR gRNA sequence
tgttgaagtggtatgtgaca

SEQ ID NO: 336525 - DNA, 20 bp, Artificial
  CRISPR gRNA sequence
gttgaagtggtatgtgacaa

SEQ ID NO: 336526 - DNA, 20 bp, Artificial
  CRISPR gRNA sequence
ttgaagtggtatgtgacaaa

SEQ ID NO: 336527 - DNA, 20 bp, Artificial
  CRISPR gRNA sequence
aagtggtatgtgacaaaaac

SEQ ID NO: 336528 - DNA, 20 bp, Artificial
  CRISPR gRNA sequence
aggttcctggctttaggcta

SEQ ID NO: 336529 - DNA, 20 bp, Artificial
  CRISPR gRNA sequence
ggttcctggctttaggctaa

SEQ ID NO: 336530 - DNA, 20 bp, Artificial
  CRISPR gRNA sequence
ctggctttaggctaagtaga

SEQ ID NO: 336531 - DNA, 20 bp, Artificial
  CRISPR gRNA sequence
gctttaggctaagtagaaaa

SEQ ID NO: 336532 - DNA, 20 bp, Artificial
  CRISPR gRNA sequence
taggctaagtagaaaaacaa

SEQ ID NO: 336533 - DNA, 20 bp, Artificial
  CRISPR gRNA sequence
aggctaagtagaaaaacaat

SEQ ID NO: 336534 - DNA, 20 bp, Artificial
  CRISPR gRNA sequence
ggctaagtagaaaaacaata

SEQ ID NO: 336535 - DNA, 20 bp, Artificial
  CRISPR gRNA sequence
agtagaaaaacaatatgaaa

SEQ ID NO: 336536 - DNA, 20 bp, Artificial
  CRISPR gRNA sequence
tacataaaaagagctttcta

SEQ ID NO: 336537 - DNA, 20 bp, Artificial
  CRISPR gRNA sequence
acataaaaagagctttctac

SEQ ID NO: 336538 - DNA, 20 bp, Artificial
  CRISPR gRNA sequence
cataaaaagagctttctact

SEQ ID NO: 336539 - DNA, 20 bp, Artificial
  CRISPR gRNA sequence
tctactgaactttcttcctc

SEQ ID NO: 336540 - DNA, 20 bp, Artificial
  CRISPR gRNA sequence
ctactgaactttcttcctcg

SEQ ID NO: 336541 - DNA, 20 bp, Artificial
  CRISPR gRNA sequence
tactgaactttcttcctcgt

SEQ ID NO: 336542 - DNA, 20 bp, Artificial
  CRISPR gRNA sequence
ctgaactttcttcctcgttt

SEQ ID NO: 336543 - DNA, 20 bp, Artificial
  CRISPR gRNA sequence
aactttcttcctcgtttttg

SEQ ID NO: 336544 - DNA, 20 bp, Artificial
  CRISPR gRNA sequence
tcttcctcgtttttgccttt

SEQ ID NO: 336545 - DNA, 20 bp, Artificial
  CRISPR gRNA sequence
cttcctcgtttttgccttta

SEQ ID NO: 336546 - DNA, 20 bp, Artificial
  CRISPR gRNA sequence
ttcctcgtttttgcctttat

SEQ ID NO: 336547 - DNA, 20 bp, Artificial
  CRISPR gRNA sequence
cctcgtttttgcctttattg

SEQ ID NO: 336548 - DNA, 20 bp, Artificial
  CRISPR gRNA sequence
ctcgtttttgcctttattgt

SEQ ID NO: 336549 - DNA, 20 bp, Artificial
  CRISPR gRNA sequence
gtttttgcctttattgtttc

SEQ ID NO: 336550 - DNA, 20 bp, Artificial
  CRISPR gRNA sequence
ttgcctttattgtttctttc

SEQ ID NO: 336551 - DNA, 20 bp, Artificial
  CRISPR gRNA sequence
tgcctttattgtttctttcc

SEQ ID NO: 336552 - DNA, 20 bp, Artificial
  CRISPR gRNA sequence
gcctttattgtttctttccc

SEQ ID NO: 336553 - DNA, 20 bp, Artificial
  CRISPR gRNA sequence
cctttattgtttctttccca

SEQ ID NO: 336554 - DNA, 20 bp, Artificial
  CRISPR gRNA sequence
tattgtttctttcccagcag

SEQ ID NO: 336555 - DNA, 20 bp, Artificial
  CRISPR gRNA sequence
attgtttctttcccagcaga

SEQ ID NO: 336556 - DNA, 20 bp, Artificial
  CRISPR gRNA sequence
ttgtttctttcccagcagac

SEQ ID NO: 336557 - DNA, 20 bp, Artificial
  CRISPR gRNA sequence
tttctttcccagcagactta

SEQ ID NO: 336558 - DNA, 20 bp, Artificial
  CRISPR gRNA sequence
ctttcccagcagacttagac

SEQ ID NO: 336559 - DNA, 20 bp, Artificial
  CRISPR gRNA sequence
tttcccagcagacttagacc

SEQ ID NO: 336560 - DNA, 20 bp, Artificial
  CRISPR gRNA sequence
tcccagcagacttagaccat

SEQ ID NO: 336561 - DNA, 20 bp, Artificial
  CRISPR gRNA sequence
cccagcagacttagaccatg

SEQ ID NO: 336562 - DNA, 20 bp, Artificial
  CRISPR gRNA sequence
ccagcagacttagaccatgg

SEQ ID NO: 336563 - DNA, 20 bp, Artificial
  CRISPR gRNA sequence
agaccatgggcgctatctca

SEQ ID NO: 336564 - DNA, 20 bp, Artificial
  CRISPR gRNA sequence
gaccatgggcgctatctcat

SEQ ID NO: 336565 - DNA, 20 bp, Artificial
  CRISPR gRNA sequence
tctcattctcttccttcttt

SEQ ID NO: 336566 - DNA, 20 bp, Artificial
  CRISPR gRNA sequence
attctcttccttctttatgt

SEQ ID NO: 336567 - DNA, 20 bp, Artificial
  CRISPR gRNA sequence
tcttccttctttatgtctct

SEQ ID NO: 336568 - DNA, 20 bp, Artificial
  CRISPR gRNA sequence
ttccttctttatgtctcttt

SEQ ID NO: 336569 - DNA, 20 bp, Artificial
  CRISPR gRNA sequence
ccttctttatgtctctttcc

SEQ ID NO: 336570 - DNA, 20 bp, Artificial
  CRISPR gRNA sequence
cttctttatgtctctttcca

SEQ ID NO: 336571 - DNA, 20 bp, Artificial
  CRISPR gRNA sequence
ctttatgtctctttccaaat

SEQ ID NO: 336572 - DNA, 20 bp, Artificial
  CRISPR gRNA sequence
tttatgtctctttccaaatt

SEQ ID NO: 336573 - DNA, 20 bp, Artificial
  CRISPR gRNA sequence
tatgtctctttccaaattcc

SEQ ID NO: 336574 - DNA, 20 bp, Artificial
  CRISPR gRNA sequence
atgtctctttccaaattcca

SEQ ID NO: 336575 - DNA, 20 bp, Artificial
  CRISPR gRNA sequence
tgtctctttccaaattccac

SEQ ID NO: 336576 - DNA, 20 bp, Artificial
  CRISPR gRNA sequence
tttccaaattccactctccc

SEQ ID NO: 336577 - DNA, 20 bp, Artificial
  CRISPR gRNA sequence
tccaaattccactctcccac

SEQ ID NO: 336578 - DNA, 20 bp, Artificial
  CRISPR gRNA sequence
ccaaattccactctcccaca

SEQ ID NO: 336579 - DNA, 20 bp, Artificial
  CRISPR gRNA sequence
caaattccactctcccacag

SEQ ID NO: 336580 - DNA, 20 bp, Artificial
  CRISPR gRNA sequence
cactctcccacagatataca

SEQ ID NO: 336581 - DNA, 20 bp, Artificial
  CRISPR gRNA sequence
tcccacagatatacactggc

SEQ ID NO: 336582 - DNA, 20 bp, Artificial
  CRISPR gRNA sequence
ccacagatatacactggcca

SEQ ID NO: 336583 - DNA, 20 bp, Artificial
  CRISPR gRNA sequence
gccaatgaccacactgtgga

SEQ ID NO: 336584 - DNA, 20 bp, Artificial
  CRISPR gRNA sequence
tggatatacttgagtactag

SEQ ID NO: 336585 - DNA, 20 bp, Artificial
  CRISPR gRNA sequence
gagtactagcatactcgcgt

SEQ ID NO: 336586 - DNA, 20 bp, Artificial
  CRISPR gRNA sequence
agtactagcatactcgcgta

SEQ ID NO: 336587 - DNA, 20 bp, Artificial
  CRISPR gRNA sequence
gcatactcgcgtaatatgca

SEQ ID NO: 336588 - DNA, 20 bp, Artificial
  CRISPR gRNA sequence
gcgtaatatgcagagtggtg

SEQ ID NO: 336589 - DNA, 20 bp, Artificial
  CRISPR gRNA sequence
tttgattgagaacctgtaat

SEQ ID NO: 336590 - DNA, 20 bp, Artificial
  CRISPR gRNA sequence
tgattgagaacctgtaatgc

SEQ ID NO: 336591 - DNA, 20 bp, Artificial
  CRISPR gRNA sequence
gattgagaacctgtaatgca

SEQ ID NO: 336592 - DNA, 20 bp, Artificial
  CRISPR gRNA sequence
attgagaacctgtaatgcaa

SEQ ID NO: 336593 - DNA, 20 bp, Artificial
  CRISPR gRNA sequence
agaacctgtaatgcaagaga

SEQ ID NO: 336594 - DNA, 20 bp, Artificial
  CRISPR gRNA sequence
taatgcaagagaccaaaaag

SEQ ID NO: 336595 - DNA, 20 bp, Artificial
  CRISPR gRNA sequence
ttgttgttgtcattgttgtt

SEQ ID NO: 336596 - DNA, 20 bp, Artificial
  CRISPR gRNA sequence
tgttgttgtcattgttgttt

SEQ ID NO: 336597 - DNA, 20 bp, Artificial
  CRISPR gRNA sequence
gttgttgtcattgttgttta

SEQ ID NO: 336598 - DNA, 20 bp, Artificial
  CRISPR gRNA sequence
ttgttgtcattgttgtttat

SEQ ID NO: 336599 - DNA, 20 bp, Artificial
  CRISPR gRNA sequence
ttgtcattgttgtttatctt

SEQ ID NO: 336600 - DNA, 20 bp, Artificial
  CRISPR gRNA sequence
tcattgttgtttatctttct

SEQ ID NO: 336601 - DNA, 20 bp, Artificial
  CRISPR gRNA sequence
ttgtttatctttctaaatag

SEQ ID NO: 336602 - DNA, 20 bp, Artificial
  CRISPR gRNA sequence
tttatctttctaaatagctc

SEQ ID NO: 336603 - DNA, 20 bp, Artificial
  CRISPR gRNA sequence
atctttctaaatagctcctc

SEQ ID NO: 336604 - DNA, 20 bp, Artificial
  CRISPR gRNA sequence
tctttctaaatagctcctca

SEQ ID NO: 336605 - DNA, 20 bp, Artificial
  CRISPR gRNA sequence
tctaaatagctcctcagtgg

SEQ ID NO: 336606 - DNA, 20 bp, Artificial
  CRISPR gRNA sequence
ctaaatagctcctcagtggt

SEQ ID NO: 336607 - DNA, 20 bp, Artificial
  CRISPR gRNA sequence
taaatagctcctcagtggtt

SEQ ID NO: 336608 - DNA, 20 bp, Artificial
  CRISPR gRNA sequence
aatagctcctcagtggtttt

SEQ ID NO: 336609 - DNA, 20 bp, Artificial
  CRISPR gRNA sequence
ctcagtggttttctttaaaa

SEQ ID NO: 336610 - DNA, 20 bp, Artificial
  CRISPR gRNA sequence
agtggttttctttaaaagca

SEQ ID NO: 336611 - DNA, 20 bp, Artificial
  CRISPR gRNA sequence
tctttaaaagcaaggagtct

SEQ ID NO: 336612 - DNA, 20 bp, Artificial
  CRISPR gRNA sequence
ctttaaaagcaaggagtcta

SEQ ID NO: 336613 - DNA, 20 bp, Artificial
  CRISPR gRNA sequence
tttaaaagcaaggagtctaa

SEQ ID NO: 336614 - DNA, 20 bp, Artificial
  CRISPR gRNA sequence
taaaagcaaggagtctaata

SEQ ID NO: 336615 - DNA, 20 bp, Artificial
  CRISPR gRNA sequence
aaaagcaaggagtctaataa

SEQ ID NO: 336616 - DNA, 20 bp, Artificial
  CRISPR gRNA sequence
aaagcaaggagtctaataac

SEQ ID NO: 336617 - DNA, 20 bp, Artificial
  CRISPR gRNA sequence
ataacctaccatgtaaaaaa

SEQ ID NO: 336618 - DNA, 20 bp, Artificial
  CRISPR gRNA sequence
ccatgtaaaaaagttgtcaa

SEQ ID NO: 336619 - DNA, 20 bp, Artificial
  CRISPR gRNA sequence
tcaatttccttctcagctac

SEQ ID NO: 336620 - DNA, 20 bp, Artificial
  CRISPR gRNA sequence
ccttctcagctacaattgac

SEQ ID NO: 336621 - DNA, 20 bp, Artificial
  CRISPR gRNA sequence
cttctcagctacaattgaca

SEQ ID NO: 336622 - DNA, 20 bp, Artificial
  CRISPR gRNA sequence
ctcagctacaattgacacct

SEQ ID NO: 336623 - DNA, 20 bp, Artificial
  CRISPR gRNA sequence
tcagctacaattgacacctt

SEQ ID NO: 336624 - DNA, 20 bp, Artificial
  CRISPR gRNA sequence
agctacaattgacaccttag

SEQ ID NO: 336625 - DNA, 20 bp, Artificial
  CRISPR gRNA sequence
caattgacaccttagaaggc

SEQ ID NO: 336626 - DNA, 20 bp, Artificial
  CRISPR gRNA sequence
acaccttagaaggctttctt

SEQ ID NO: 336627 - DNA, 20 bp, Artificial
  CRISPR gRNA sequence
agaaggctttcttgctgact

SEQ ID NO: 336628 - DNA, 20 bp, Artificial
  CRISPR gRNA sequence
gaaggctttcttgctgactg

SEQ ID NO: 336629 - DNA, 20 bp, Artificial
  CRISPR gRNA sequence
tcttgctgactgtttttaac

SEQ ID NO: 336630 - DNA, 20 bp, Artificial
  CRISPR gRNA sequence
cttgctgactgtttttaact

SEQ ID NO: 336631 - DNA, 20 bp, Artificial
  CRISPR gRNA sequence
ttgctgactgtttttaactt

SEQ ID NO: 336632 - DNA, 20 bp, Artificial
  CRISPR gRNA sequence
gctgactgtttttaacttac

SEQ ID NO: 336633 - DNA, 20 bp, Artificial
  CRISPR gRNA sequence
ctgactgtttttaacttacc

SEQ ID NO: 336634 - DNA, 20 bp, Artificial
  CRISPR gRNA sequence
actgtttttaacttaccagc

SEQ ID NO: 336635 - DNA, 20 bp, Artificial
  CRISPR gRNA sequence
tttttaacttaccagctaag

SEQ ID NO: 336636 - DNA, 20 bp, Artificial
  CRISPR gRNA sequence
ttaacttaccagctaagcaa

SEQ ID NO: 336637 - DNA, 20 bp, Artificial
  CRISPR gRNA sequence
taacttaccagctaagcaaa

SEQ ID NO: 336638 - DNA, 20 bp, Artificial
  CRISPR gRNA sequence
aacttaccagctaagcaaaa

SEQ ID NO: 336639 - DNA, 20 bp, Artificial
  CRISPR gRNA sequence
acttaccagctaagcaaaac

SEQ ID NO: 336640 - DNA, 20 bp, Artificial
  CRISPR gRNA sequence
accagctaagcaaaacttat

SEQ ID NO: 336641 - DNA, 20 bp, Artificial
  CRISPR gRNA sequence
ccagctaagcaaaacttata

SEQ ID NO: 336642 - DNA, 20 bp, Artificial
  CRISPR gRNA sequence
agcaaaacttataactaatt

SEQ ID NO: 336643 - DNA, 20 bp, Artificial
  CRISPR gRNA sequence
ataactaattgtttcatctc

SEQ ID NO: 336644 - DNA, 20 bp, Artificial
  CRISPR gRNA sequence
taactaattgtttcatctct

SEQ ID NO: 336645 - DNA, 20 bp, Artificial
  CRISPR gRNA sequence
attgtttcatctctgccctg

SEQ ID NO: 336646 - DNA, 20 bp, Artificial
  CRISPR gRNA sequence
tttcatctctgccctgcctc

SEQ ID NO: 336647 - DNA, 20 bp, Artificial
  CRISPR gRNA sequence
catctctgccctgcctctca

SEQ ID NO: 336648 - DNA, 20 bp, Artificial
  CRISPR gRNA sequence
atctctgccctgcctctcag

SEQ ID NO: 336649 - DNA, 20 bp, Artificial
  CRISPR gRNA sequence
tgccctgcctctcaggaacc

SEQ ID NO: 336650 - DNA, 20 bp, Artificial
  CRISPR gRNA sequence
ccctgcctctcaggaacctt

SEQ ID NO: 336651 - DNA, 20 bp, Artificial
  CRISPR gRNA sequence
cctctcaggaaccttggatt

SEQ ID NO: 336652 - DNA, 20 bp, Artificial
  CRISPR gRNA sequence
tcaggaaccttggattcaaa

SEQ ID NO: 336653 - DNA, 20 bp, Artificial
  CRISPR gRNA sequence
aggaaccttggattcaaatt

SEQ ID NO: 336654 - DNA, 20 bp, Artificial
  CRISPR gRNA sequence
ggattcaaattcgcagccca

SEQ ID NO: 336655 - DNA, 20 bp, Artificial
  CRISPR gRNA sequence
gattcaaattcgcagcccat

SEQ ID NO: 336656 - DNA, 20 bp, Artificial
  CRISPR gRNA sequence
aaattcgcagcccatgcata

SEQ ID NO: 336657 - DNA, 20 bp, Artificial
  CRISPR gRNA sequence
gcagcccatgcataataatt

SEQ ID NO: 336658 - DNA, 20 bp, Artificial
  CRISPR gRNA sequence
tttaaaaatcagagtcatct

SEQ ID NO: 336659 - DNA, 20 bp, Artificial
  CRISPR gRNA sequence
ttaaaaatcagagtcatcta

SEQ ID NO: 336660 - DNA, 20 bp, Artificial
  CRISPR gRNA sequence
taaaaatcagagtcatctat

SEQ ID NO: 336661 - DNA, 20 bp, Artificial
  CRISPR gRNA sequence
aaaaatcagagtcatctatt

SEQ ID NO: 336662 - DNA, 20 bp, Artificial
  CRISPR gRNA sequence
aaaatcagagtcatctattt

SEQ ID NO: 336663 - DNA, 20 bp, Artificial
  CRISPR gRNA sequence
ttttgatgttttaaccttcc

SEQ ID NO: 336664 - DNA, 20 bp, Artificial
  CRISPR gRNA sequence
tgatgttttaaccttcctcc

SEQ ID NO: 336665 - DNA, 20 bp, Artificial
  CRISPR gRNA sequence
gatgttttaaccttcctcct

SEQ ID NO: 336666 - DNA, 20 bp, Artificial
  CRISPR gRNA sequence
atgttttaaccttcctcctg

SEQ ID NO: 336667 - DNA, 20 bp, Artificial
  CRISPR gRNA sequence
taaccttcctcctgaccttt

SEQ ID NO: 336668 - DNA, 20 bp, Artificial
  CRISPR gRNA sequence
aaccttcctcctgaccttta

SEQ ID NO: 336669 - DNA, 20 bp, Artificial
  CRISPR gRNA sequence
accttcctcctgacctttag

SEQ ID NO: 336670 - DNA, 20 bp, Artificial
  CRISPR gRNA sequence
cctcctgacctttagtcttc

SEQ ID NO: 336671 - DNA, 20 bp, Artificial
  CRISPR gRNA sequence
ctcctgacctttagtcttct

SEQ ID NO: 336672 - DNA, 20 bp, Artificial
  CRISPR gRNA sequence
ctgacctttagtcttctctt

SEQ ID NO: 336673 - DNA, 20 bp, Artificial
  CRISPR gRNA sequence
acctttagtcttctcttgac

SEQ ID NO: 336674 - DNA, 20 bp, Artificial
  CRISPR gRNA sequence
tagtcttctcttgacctcaa

SEQ ID NO: 336675 - DNA, 20 bp, Artificial
  CRISPR gRNA sequence
agtcttctcttgacctcaat

SEQ ID NO: 336676 - DNA, 20 bp, Artificial
  CRISPR gRNA sequence
gtcttctcttgacctcaatt

SEQ ID NO: 336677 - DNA, 20 bp, Artificial
  CRISPR gRNA sequence
ctcttgacctcaatttcctc

SEQ ID NO: 336678 - DNA, 20 bp, Artificial
  CRISPR gRNA sequence
tcttgacctcaatttcctca

SEQ ID NO: 336679 - DNA, 20 bp, Artificial
  CRISPR gRNA sequence
ttgacctcaatttcctcatc

SEQ ID NO: 336680 - DNA, 20 bp, Artificial
  CRISPR gRNA sequence
gacctcaatttcctcatcta

SEQ ID NO: 336681 - DNA, 20 bp, Artificial
  CRISPR gRNA sequence
acctcaatttcctcatctag

SEQ ID NO: 336682 - DNA, 20 bp, Artificial
  CRISPR gRNA sequence
aatttcctcatctagtttga

SEQ ID NO: 336683 - DNA, 20 bp, Artificial
  CRISPR gRNA sequence
cctcatctagtttgaacaat

SEQ ID NO: 336684 - DNA, 20 bp, Artificial
  CRISPR gRNA sequence
ctcatctagtttgaacaata

SEQ ID NO: 336685 - DNA, 20 bp, Artificial
  CRISPR gRNA sequence
atctagtttgaacaataata

SEQ ID NO: 336686 - DNA, 20 bp, Artificial
  CRISPR gRNA sequence
gtttgaacaataataataat

SEQ ID NO: 336687 - DNA, 20 bp, Artificial
  CRISPR gRNA sequence
gaacaataataataataatg

SEQ ID NO: 336688 - DNA, 20 bp, Artificial
  CRISPR gRNA sequence
aacaataataataataatgt

SEQ ID NO: 336689 - DNA, 20 bp, Artificial
  CRISPR gRNA sequence
tctgtaagccatcaagtcaa

SEQ ID NO: 336690 - DNA, 20 bp, Artificial
  CRISPR gRNA sequence
tgtaagccatcaagtcaagt

SEQ ID NO: 336691 - DNA, 20 bp, Artificial
  CRISPR gRNA sequence
taagccatcaagtcaagtcc

SEQ ID NO: 336692 - DNA, 20 bp, Artificial
  CRISPR gRNA sequence
tttggaatgtgtgggctata

SEQ ID NO: 336693 - DNA, 20 bp, Artificial
  CRISPR gRNA sequence
tggaatgtgtgggctataaa

SEQ ID NO: 336694 - DNA, 20 bp, Artificial
  CRISPR gRNA sequence
ggaatgtgtgggctataaaa

SEQ ID NO: 336695 - DNA, 20 bp, Artificial
  CRISPR gRNA sequence
gaatgtgtgggctataaaac

SEQ ID NO: 336696 - DNA, 20 bp, Artificial
  CRISPR gRNA sequence
taaaacaaatacataaattt

SEQ ID NO: 336697 - DNA, 20 bp, Artificial
  CRISPR gRNA sequence
ctgttccaagtgattagttt

SEQ ID NO: 336698 - DNA, 20 bp, Artificial
  CRISPR gRNA sequence
tgttccaagtgattagttta

SEQ ID NO: 336699 - DNA, 20 bp, Artificial
  CRISPR gRNA sequence
ttccaagtgattagtttaat

SEQ ID NO: 336700 - DNA, 20 bp, Artificial
  CRISPR gRNA sequence
caagtgattagtttaattag

SEQ ID NO: 336701 - DNA, 20 bp, Artificial
  CRISPR gRNA sequence
gtttaattagtaggtatgtc

SEQ ID NO: 336702 - DNA, 20 bp, Artificial
  CRISPR gRNA sequence
aattagtaggtatgtcttgg

SEQ ID NO: 336703 - DNA, 20 bp, Artificial
  CRISPR gRNA sequence
attagtaggtatgtcttggg

SEQ ID NO: 336704 - DNA, 20 bp, Artificial
  CRISPR gRNA sequence
gtaggtatgtcttgggggga

SEQ ID NO: 336705 - DNA, 20 bp, Artificial
  CRISPR gRNA sequence
ggggggaaggaattgtctcc

SEQ ID NO: 336706 - DNA, 20 bp, Artificial
  CRISPR gRNA sequence
gggggaaggaattgtctccc

SEQ ID NO: 336707 - DNA, 20 bp, Artificial
  CRISPR gRNA sequence
tctccctgttggtcaaatta

SEQ ID NO: 336708 - DNA, 20 bp, Artificial
  CRISPR gRNA sequence
cctgttggtcaaattactct

SEQ ID NO: 336709 - DNA, 20 bp, Artificial
  CRISPR gRNA sequence
ttggtcaaattactctgaca

SEQ ID NO: 336710 - DNA, 20 bp, Artificial
  CRISPR gRNA sequence
gtcaaattactctgacaaga

SEQ ID NO: 336711 - DNA, 20 bp, Artificial
  CRISPR gRNA sequence
ctctgacaagagccatgtgt

SEQ ID NO: 336712 - DNA, 20 bp, Artificial
  CRISPR gRNA sequence
tgacaagagccatgtgtact

SEQ ID NO: 336713 - DNA, 20 bp, Artificial
  CRISPR gRNA sequence
acaagagccatgtgtacttt

SEQ ID NO: 336714 - DNA, 20 bp, Artificial
  CRISPR gRNA sequence
ttgatgaggaaataatcact

SEQ ID NO: 336715 - DNA, 20 bp, Artificial
  CRISPR gRNA sequence
tgatgaggaaataatcactg

SEQ ID NO: 336716 - DNA, 20 bp, Artificial
  CRISPR gRNA sequence
gatgaggaaataatcactga

SEQ ID NO: 336717 - DNA, 20 bp, Artificial
  CRISPR gRNA sequence
atgaggaaataatcactgat

SEQ ID NO: 336718 - DNA, 20 bp, Artificial
  CRISPR gRNA sequence
atgtgcatctgtaaagcaga

SEQ ID NO: 336719 - DNA, 20 bp, Artificial
  CRISPR gRNA sequence
taaagcagatacaaggaaag

SEQ ID NO: 336720 - DNA, 20 bp, Artificial
  CRISPR gRNA sequence
accttttttgtaagccaaca

SEQ ID NO: 336721 - DNA, 20 bp, Artificial
  CRISPR gRNA sequence
ccttttttgtaagccaacaa

SEQ ID NO: 336722 - DNA, 20 bp, Artificial
  CRISPR gRNA sequence
ttttgtaagccaacaaataa

SEQ ID NO: 336723 - DNA, 20 bp, Artificial
  CRISPR gRNA sequence
tttgtaagccaacaaataag

SEQ ID NO: 336724 - DNA, 20 bp, Artificial
  CRISPR gRNA sequence
ttgtaagccaacaaataagt

SEQ ID NO: 336725 - DNA, 20 bp, Artificial
  CRISPR gRNA sequence
tgtaagccaacaaataagta

SEQ ID NO: 336726 - DNA, 20 bp, Artificial
  CRISPR gRNA sequence
gtaagccaacaaataagtat

SEQ ID NO: 336727 - DNA, 20 bp, Artificial
  CRISPR gRNA sequence
taagccaacaaataagtatg

SEQ ID NO: 336728 - DNA, 20 bp, Artificial
  CRISPR gRNA sequence
caacaaaggctgcacatcct

SEQ ID NO: 336729 - DNA, 20 bp, Artificial
  CRISPR gRNA sequence
cacatcctatgggtaaccag

SEQ ID NO: 336730 - DNA, 20 bp, Artificial
  CRISPR gRNA sequence
tgggtaaccagaacttcagc

SEQ ID NO: 336731 - DNA, 20 bp, Artificial
  CRISPR gRNA sequence
cagctggcaacaaagttgtg

SEQ ID NO: 336732 - DNA, 20 bp, Artificial
  CRISPR gRNA sequence
agctggcaacaaagttgtga

SEQ ID NO: 336733 - DNA, 20 bp, Artificial
  CRISPR gRNA sequence
gcaacaaagttgtgattctg

SEQ ID NO: 336734 - DNA, 20 bp, Artificial
  CRISPR gRNA sequence
tgattctggattggaaaaaa

SEQ ID NO: 336735 - DNA, 20 bp, Artificial
  CRISPR gRNA sequence
tggattggaaaaaaaggtat

SEQ ID NO: 336736 - DNA, 20 bp, Artificial
  CRISPR gRNA sequence
gattggaaaaaaaggtatgt

SEQ ID NO: 336737 - DNA, 20 bp, Artificial
  CRISPR gRNA sequence
gaaaaaaaggtatgttaatg

SEQ ID NO: 336738 - DNA, 20 bp, Artificial
  CRISPR gRNA sequence
atgaaaaattctgctgaacc

SEQ ID NO: 336739 - DNA, 20 bp, Artificial
  CRISPR gRNA sequence
tgctgaaccacaagttctct

SEQ ID NO: 336740 - DNA, 20 bp, Artificial
  CRISPR gRNA sequence
ctgaaccacaagttctctta

SEQ ID NO: 336741 - DNA, 20 bp, Artificial
  CRISPR gRNA sequence
aaccacaagttctcttacca

SEQ ID NO: 336742 - DNA, 20 bp, Artificial
  CRISPR gRNA sequence
tcttaccaaatttaaaagag

SEQ ID NO: 336743 - DNA, 20 bp, Artificial
  CRISPR gRNA sequence
ttaccaaatttaaaagagct

SEQ ID NO: 336744 - DNA, 20 bp, Artificial
  CRISPR gRNA sequence
accaaatttaaaagagctat

SEQ ID NO: 336745 - DNA, 20 bp, Artificial
  CRISPR gRNA sequence
ccaaatttaaaagagctatt

SEQ ID NO: 336746 - DNA, 20 bp, Artificial
  CRISPR gRNA sequence
aaaagagctatttaatcaaa

SEQ ID NO: 336747 - DNA, 20 bp, Artificial
  CRISPR gRNA sequence
aaagagctatttaatcaaat

SEQ ID NO: 336748 - DNA, 20 bp, Artificial
  CRISPR gRNA sequence
tttaatcaaatgaagctttt

SEQ ID NO: 336749 - DNA, 20 bp, Artificial
  CRISPR gRNA sequence
aatcaaatgaagcttttctt

SEQ ID NO: 336750 - DNA, 20 bp, Artificial
  CRISPR gRNA sequence
atcaaatgaagcttttcttt

SEQ ID NO: 336751 - DNA, 20 bp, Artificial
  CRISPR gRNA sequence
ttctttattatagtcatgaa

SEQ ID NO: 336752 - DNA, 20 bp, Artificial
  CRISPR gRNA sequence
tctttattatagtcatgaaa

SEQ ID NO: 336753 - DNA, 20 bp, Artificial
  CRISPR gRNA sequence
ctttattatagtcatgaaat

SEQ ID NO: 336754 - DNA, 20 bp, Artificial
  CRISPR gRNA sequence
tttattatagtcatgaaatc

SEQ ID NO: 336755 - DNA, 20 bp, Artificial
  CRISPR gRNA sequence
tattatagtcatgaaatcca

SEQ ID NO: 336756 - DNA, 20 bp, Artificial
  CRISPR gRNA sequence
attatagtcatgaaatccag

SEQ ID NO: 336757 - DNA, 20 bp, Artificial
  CRISPR gRNA sequence
ttatagtcatgaaatccagt

SEQ ID NO: 336758 - DNA, 20 bp, Artificial
  CRISPR gRNA sequence
tagtcatgaaatccagtaag

SEQ ID NO: 336759 - DNA, 20 bp, Artificial
  CRISPR gRNA sequence
ttagactaacatcatctcag

SEQ ID NO: 336760 - DNA, 20 bp, Artificial
  CRISPR gRNA sequence
gactaacatcatctcagtat

SEQ ID NO: 336761 - DNA, 20 bp, Artificial
  CRISPR gRNA sequence
acatcatctcagtattatgg

SEQ ID NO: 336762 - DNA, 20 bp, Artificial
  CRISPR gRNA sequence
agtattatggcaaggatcca

SEQ ID NO: 336763 - DNA, 20 bp, Artificial
  CRISPR gRNA sequence
tggcaaggatccaggaacta

SEQ ID NO: 336764 - DNA, 20 bp, Artificial
  CRISPR gRNA sequence
aaacttaaaagattatgcat

SEQ ID NO: 336765 - DNA, 20 bp, Artificial
  CRISPR gRNA sequence
aaaagattatgcatataatg

SEQ ID NO: 336766 - DNA, 20 bp, Artificial
  CRISPR gRNA sequence
aaagattatgcatataatgt

SEQ ID NO: 336767 - DNA, 20 bp, Artificial
  CRISPR gRNA sequence
tgcatataatgtatttacaa

SEQ ID NO: 336768 - DNA, 20 bp, Artificial
  CRISPR gRNA sequence
acaaatgtggttaatagaaa

SEQ ID NO: 336769 - DNA, 20 bp, Artificial
  CRISPR gRNA sequence
caaatgtggttaatagaaag

SEQ ID NO: 336770 - DNA, 20 bp, Artificial
  CRISPR gRNA sequence
atagaaagggcttttctgcc

SEQ ID NO: 336771 - DNA, 20 bp, Artificial
  CRISPR gRNA sequence
ttctgcctatatttttataa

SEQ ID NO: 336772 - DNA, 20 bp, Artificial
  CRISPR gRNA sequence
tctgcctatatttttataaa

SEQ ID NO: 336773 - DNA, 20 bp, Artificial
  CRISPR gRNA sequence
ctgcctatatttttataaaa

SEQ ID NO: 336774 - DNA, 20 bp, Artificial
  CRISPR gRNA sequence
tgcctatatttttataaaag

SEQ ID NO: 336775 - DNA, 20 bp, Artificial
  CRISPR gRNA sequence
cctatatttttataaaagag

SEQ ID NO: 336776 - DNA, 20 bp, Artificial
  CRISPR gRNA sequence
tatttttataaaagaggtaa

SEQ ID NO: 336777 - DNA, 20 bp, Artificial
  CRISPR gRNA sequence
ttataaaagaggtaatagta

SEQ ID NO: 336778 - DNA, 20 bp, Artificial
  CRISPR gRNA sequence
tataaaagaggtaatagtaa

SEQ ID NO: 336779 - DNA, 20 bp, Artificial
  CRISPR gRNA sequence
ataaaagaggtaatagtaaa

SEQ ID NO: 336780 - DNA, 20 bp, Artificial
  CRISPR gRNA sequence
taaaagaggtaatagtaaaa

SEQ ID NO: 336781 - DNA, 20 bp, Artificial
  CRISPR gRNA sequence
taaaactatgattttcaatc

SEQ ID NO: 336782 - DNA, 20 bp, Artificial
  CRISPR gRNA sequence
tgattttcaatcatcatact

SEQ ID NO: 336783 - DNA, 20 bp, Artificial
  CRISPR gRNA sequence
tcaatcatcatacttcattc

SEQ ID NO: 336784 - DNA, 20 bp, Artificial
  CRISPR gRNA sequence
caatcatcatacttcattcc

SEQ ID NO: 336785 - DNA, 20 bp, Artificial
  CRISPR gRNA sequence
aatcatcatacttcattcca

SEQ ID NO: 336786 - DNA, 20 bp, Artificial
  CRISPR gRNA sequence
cattccacaaacacagtgca

SEQ ID NO: 336787 - DNA, 20 bp, Artificial
  CRISPR gRNA sequence
attccacaaacacagtgcaa

SEQ ID NO: 336788 - DNA, 20 bp, Artificial
  CRISPR gRNA sequence
cacaaacacagtgcaaaacc

SEQ ID NO: 336789 - DNA, 20 bp, Artificial
  CRISPR gRNA sequence
aaatcttaggtgaatagaga

SEQ ID NO: 336790 - DNA, 20 bp, Artificial
  CRISPR gRNA sequence
aatcttaggtgaatagagat

SEQ ID NO: 336791 - DNA, 20 bp, Artificial
  CRISPR gRNA sequence
aggtgaatagagataatacc

SEQ ID NO: 336792 - DNA, 20 bp, Artificial
  CRISPR gRNA sequence
ggtgaatagagataataccc

SEQ ID NO: 336793 - DNA, 20 bp, Artificial
  CRISPR gRNA sequence
ttaagccataagtttaagta

SEQ ID NO: 336794 - DNA, 20 bp, Artificial
  CRISPR gRNA sequence
agccataagtttaagtattt

SEQ ID NO: 336795 - DNA, 20 bp, Artificial
  CRISPR gRNA sequence
aagtatttgtcttaatgttt

SEQ ID NO: 336796 - DNA, 20 bp, Artificial
  CRISPR gRNA sequence
agtatttgtcttaatgtttt

SEQ ID NO: 336797 - DNA, 20 bp, Artificial
  CRISPR gRNA sequence
gtcttaatgtttttcctgat

SEQ ID NO: 336798 - DNA, 20 bp, Artificial
  CRISPR gRNA sequence
tcttaatgtttttcctgatt

SEQ ID NO: 336799 - DNA, 20 bp, Artificial
  CRISPR gRNA sequence
aatgtttttcctgattttta

SEQ ID NO: 336800 - DNA, 20 bp, Artificial
  CRISPR gRNA sequence
atgtttttcctgatttttaa

SEQ ID NO: 336801 - DNA, 20 bp, Artificial
  CRISPR gRNA sequence
ttcctgatttttaatagcat

SEQ ID NO: 336802 - DNA, 20 bp, Artificial
  CRISPR gRNA sequence
tcctgatttttaatagcata

SEQ ID NO: 336803 - DNA, 20 bp, Artificial
  CRISPR gRNA sequence
cctgatttttaatagcatat

SEQ ID NO: 336804 - DNA, 20 bp, Artificial
  CRISPR gRNA sequence
ctgatttttaatagcatatg

SEQ ID NO: 336805 - DNA, 20 bp, Artificial
  CRISPR gRNA sequence
atttttaatagcatatgtgt

SEQ ID NO: 336806 - DNA, 20 bp, Artificial
  CRISPR gRNA sequence
ttaatagcatatgtgtttaa

SEQ ID NO: 336807 - DNA, 20 bp, Artificial
  CRISPR gRNA sequence
taatagcatatgtgtttaaa

SEQ ID NO: 336808 - DNA, 20 bp, Artificial
  CRISPR gRNA sequence
aatagcatatgtgtttaaaa

SEQ ID NO: 336809 - DNA, 20 bp, Artificial
  CRISPR gRNA sequence
atagcatatgtgtttaaaag

SEQ ID NO: 336810 - DNA, 20 bp, Artificial
  CRISPR gRNA sequence
aaaaggcaatatgatctatt

SEQ ID NO: 336811 - DNA, 20 bp, Artificial
  CRISPR gRNA sequence
aaaggcaatatgatctattt

SEQ ID NO: 336812 - DNA, 20 bp, Artificial
  CRISPR gRNA sequence
tttctgacttagcagtctat

SEQ ID NO: 336813 - DNA, 20 bp, Artificial
  CRISPR gRNA sequence
ctgacttagcagtctatggg

SEQ ID NO: 336814 - DNA, 20 bp, Artificial
  CRISPR gRNA sequence
tgacttagcagtctatggga

SEQ ID NO: 336815 - DNA, 20 bp, Artificial
  CRISPR gRNA sequence
acttagcagtctatgggatt

SEQ ID NO: 336816 - DNA, 20 bp, Artificial
  CRISPR gRNA sequence
agcagtctatgggattacat

SEQ ID NO: 336817 - DNA, 20 bp, Artificial
  CRISPR gRNA sequence
gcagtctatgggattacatt

SEQ ID NO: 336818 - DNA, 20 bp, Artificial
  CRISPR gRNA sequence
tgggattacattgcatattg

SEQ ID NO: 336819 - DNA, 20 bp, Artificial
  CRISPR gRNA sequence
cattgcatattgctgaataa

SEQ ID NO: 336820 - DNA, 20 bp, Artificial
  CRISPR gRNA sequence
catattgctgaataatacta

SEQ ID NO: 336821 - DNA, 20 bp, Artificial
  CRISPR gRNA sequence
ctgaataatactaattatga

SEQ ID NO: 336822 - DNA, 20 bp, Artificial
  CRISPR gRNA sequence
aataatactaattatgatta

SEQ ID NO: 336823 - DNA, 20 bp, Artificial
  CRISPR gRNA sequence
attatgattaatagtaaatc

SEQ ID NO: 336824 - DNA, 20 bp, Artificial
  CRISPR gRNA sequence
tgattaatagtaaatcatca

SEQ ID NO: 336825 - DNA, 20 bp, Artificial
  CRISPR gRNA sequence
atagtaaatcatcacctgta

SEQ ID NO: 336826 - DNA, 20 bp, Artificial
  CRISPR gRNA sequence
tatatcttcattataaatga

SEQ ID NO: 336827 - DNA, 20 bp, Artificial
  CRISPR gRNA sequence
cattataaatgattaccatc

SEQ ID NO: 336828 - DNA, 20 bp, Artificial
  CRISPR gRNA sequence
attataaatgattaccatca

SEQ ID NO: 336829 - DNA, 20 bp, Artificial
  CRISPR gRNA sequence
taaatgattaccatcaactg

SEQ ID NO: 336830 - DNA, 20 bp, Artificial
  CRISPR gRNA sequence
ccatcaactgcatctaagtg

SEQ ID NO: 336831 - DNA, 20 bp, Artificial
  CRISPR gRNA sequence
catctaagtgaactccaaca

SEQ ID NO: 336832 - DNA, 20 bp, Artificial
  CRISPR gRNA sequence
agtgaactccaacacaaaag

SEQ ID NO: 336833 - DNA, 20 bp, Artificial
  CRISPR gRNA sequence
caacacaaaagatatttatt

SEQ ID NO: 336834 - DNA, 20 bp, Artificial
  CRISPR gRNA sequence
atttgtctaattgattttat

SEQ ID NO: 336835 - DNA, 20 bp, Artificial
  CRISPR gRNA sequence
tttgtctaattgattttatt

SEQ ID NO: 336836 - DNA, 20 bp, Artificial
  CRISPR gRNA sequence
gtctaattgattttattagt

SEQ ID NO: 336837 - DNA, 20 bp, Artificial
  CRISPR gRNA sequence
tctaattgattttattagtg

SEQ ID NO: 336838 - DNA, 20 bp, Artificial
  CRISPR gRNA sequence
attgattttattagtgagaa

SEQ ID NO: 336839 - DNA, 20 bp, Artificial
  CRISPR gRNA sequence
attttattagtgagaaaagt

SEQ ID NO: 336840 - DNA, 20 bp, Artificial
  CRISPR gRNA sequence
tattagtgagaaaagttgtc

SEQ ID NO: 336841 - DNA, 20 bp, Artificial
  CRISPR gRNA sequence
attagtgagaaaagttgtca

SEQ ID NO: 336842 - DNA, 20 bp, Artificial
  CRISPR gRNA sequence
ttagtgagaaaagttgtcaa

SEQ ID NO: 336843 - DNA, 20 bp, Artificial
  CRISPR gRNA sequence
gtgagaaaagttgtcaaaac

SEQ ID NO: 336844 - DNA, 20 bp, Artificial
  CRISPR gRNA sequence
tcaaaacatatatatactct

SEQ ID NO: 336845 - DNA, 20 bp, Artificial
  CRISPR gRNA sequence
ttaagtttggaagatgaaag

SEQ ID NO: 336846 - DNA, 20 bp, Artificial
  CRISPR gRNA sequence
aagtttggaagatgaaagca

SEQ ID NO: 336847 - DNA, 20 bp, Artificial
  CRISPR gRNA sequence
agtttggaagatgaaagcaa

SEQ ID NO: 336848 - DNA, 20 bp, Artificial
  CRISPR gRNA sequence
ggaagatgaaagcaatgtct

SEQ ID NO: 336849 - DNA, 20 bp, Artificial
  CRISPR gRNA sequence
gaagatgaaagcaatgtctt

SEQ ID NO: 336850 - DNA, 20 bp, Artificial
  CRISPR gRNA sequence
accataaatatgcaaatatc

SEQ ID NO: 336851 - DNA, 20 bp, Artificial
  CRISPR gRNA sequence
ccataaatatgcaaatatcc

SEQ ID NO: 336852 - DNA, 20 bp, Artificial
  CRISPR gRNA sequence
ctgtaagagttactttaaaa

SEQ ID NO: 336853 - DNA, 20 bp, Artificial
  CRISPR gRNA sequence
taagagttactttaaaagga

SEQ ID NO: 336854 - DNA, 20 bp, Artificial
  CRISPR gRNA sequence
ctttaaaaggaggaggatca

SEQ ID NO: 336855 - DNA, 20 bp, Artificial
  CRISPR gRNA sequence
taaaaggaggaggatcaaaa

SEQ ID NO: 336856 - DNA, 20 bp, Artificial
  CRISPR gRNA sequence
aaaaggaggaggatcaaaaa

SEQ ID NO: 336857 - DNA, 20 bp, Artificial
  CRISPR gRNA sequence
aaaggaggaggatcaaaaat

SEQ ID NO: 336858 - DNA, 20 bp, Artificial
  CRISPR gRNA sequence
ataggttgcagaagtaatag

SEQ ID NO: 336859 - DNA, 20 bp, Artificial
  CRISPR gRNA sequence
cagaagtaatagttggcatg

SEQ ID NO: 336860 - DNA, 20 bp, Artificial
  CRISPR gRNA sequence
gcatgagaatggtccaagtt

SEQ ID NO: 336861 - DNA, 20 bp, Artificial
  CRISPR gRNA sequence
tatagaaaaaaagagacact

SEQ ID NO: 336862 - DNA, 20 bp, Artificial
  CRISPR gRNA sequence
ttgttggataactgagaatg

SEQ ID NO: 336863 - DNA, 20 bp, Artificial
  CRISPR gRNA sequence
ttggataactgagaatggca

SEQ ID NO: 336864 - DNA, 20 bp, Artificial
  CRISPR gRNA sequence
gataactgagaatggcagaa

SEQ ID NO: 336865 - DNA, 20 bp, Artificial
  CRISPR gRNA sequence
agaatggcagaatttcagac

SEQ ID NO: 336866 - DNA, 20 bp, Artificial
  CRISPR gRNA sequence
cagactcttaatggacactg

SEQ ID NO: 336867 - DNA, 20 bp, Artificial
  CRISPR gRNA sequence
agactcttaatggacactgt

SEQ ID NO: 336868 - DNA, 20 bp, Artificial
  CRISPR gRNA sequence
ttaatggacactgtgtttcc

SEQ ID NO: 336869 - DNA, 20 bp, Artificial
  CRISPR gRNA sequence
aatggacactgtgtttccac

SEQ ID NO: 336870 - DNA, 20 bp, Artificial
  CRISPR gRNA sequence
atggacactgtgtttccact

SEQ ID NO: 336871 - DNA, 20 bp, Artificial
  CRISPR gRNA sequence
tgtttccacttccttttgtc

SEQ ID NO: 336872 - DNA, 20 bp, Artificial
  CRISPR gRNA sequence
ccacttccttttgtcttagt

SEQ ID NO: 336873 - DNA, 20 bp, Artificial
  CRISPR gRNA sequence
cacttccttttgtcttagtg

SEQ ID NO: 336874 - DNA, 20 bp, Artificial
  CRISPR gRNA sequence
ccttttgtcttagtgagatc

SEQ ID NO: 336875 - DNA, 20 bp, Artificial
  CRISPR gRNA sequence
cttttgtcttagtgagatcg

SEQ ID NO: 336876 - DNA, 20 bp, Artificial
  CRISPR gRNA sequence
ttgtcttagtgagatcgcag

SEQ ID NO: 336877 - DNA, 20 bp, Artificial
  CRISPR gRNA sequence
tgtcttagtgagatcgcaga

SEQ ID NO: 336878 - DNA, 20 bp, Artificial
  CRISPR gRNA sequence
gtcttagtgagatcgcagag

SEQ ID NO: 336879 - DNA, 20 bp, Artificial
  CRISPR gRNA sequence
tcttagtgagatcgcagagt

SEQ ID NO: 336880 - DNA, 20 bp, Artificial
  CRISPR gRNA sequence
agtgagatcgcagagtattt

SEQ ID NO: 336881 - DNA, 20 bp, Artificial
  CRISPR gRNA sequence
gtgagatcgcagagtatttg

SEQ ID NO: 336882 - DNA, 20 bp, Artificial
  CRISPR gRNA sequence
gcccccctttcagcaactgc

SEQ ID NO: 336883 - DNA, 20 bp, Artificial
  CRISPR gRNA sequence
cccccctttcagcaactgca

SEQ ID NO: 336884 - DNA, 20 bp, Artificial
  CRISPR gRNA sequence
tcagcaactgcattttaaat

SEQ ID NO: 336885 - DNA, 20 bp, Artificial
  CRISPR gRNA sequence
cagcaactgcattttaaatt

SEQ ID NO: 336886 - DNA, 20 bp, Artificial
  CRISPR gRNA sequence
agcaactgcattttaaattg

SEQ ID NO: 336887 - DNA, 20 bp, Artificial
  CRISPR gRNA sequence
cattttaaattgctggacaa

SEQ ID NO: 336888 - DNA, 20 bp, Artificial
  CRISPR gRNA sequence
taaattgctggacaatgtca

SEQ ID NO: 336889 - DNA, 20 bp, Artificial
  CRISPR gRNA sequence
aaattgctggacaatgtcag

SEQ ID NO: 336890 - DNA, 20 bp, Artificial
  CRISPR gRNA sequence
aattgctggacaatgtcagg

SEQ ID NO: 336891 - DNA, 20 bp, Artificial
  CRISPR gRNA sequence
ctggacaatgtcaggatatt

SEQ ID NO: 336892 - DNA, 20 bp, Artificial
  CRISPR gRNA sequence
gacaatgtcaggatatttgc

SEQ ID NO: 336893 - DNA, 20 bp, Artificial
  CRISPR gRNA sequence
gcataaaatttgtacacctc

SEQ ID NO: 336894 - DNA, 20 bp, Artificial
  CRISPR gRNA sequence
cataaaatttgtacacctcc

SEQ ID NO: 336895 - DNA, 20 bp, Artificial
  CRISPR gRNA sequence
gtacacctccgttgtgaaat

SEQ ID NO: 336896 - DNA, 20 bp, Artificial
  CRISPR gRNA sequence
tacacctccgttgtgaaata

SEQ ID NO: 336897 - DNA, 20 bp, Artificial
  CRISPR gRNA sequence
cgttgtgaaatataaacatc

SEQ ID NO: 336898 - DNA, 20 bp, Artificial
  CRISPR gRNA sequence
tgaaatataaacatctcata

SEQ ID NO: 336899 - DNA, 20 bp, Artificial
  CRISPR gRNA sequence
ataattggcagaaccattga

SEQ ID NO: 336900 - DNA, 20 bp, Artificial
  CRISPR gRNA sequence
gcagaaccattgatttctcc

SEQ ID NO: 336901 - DNA, 20 bp, Artificial
  CRISPR gRNA sequence
atttctcctgcataaaaaga

SEQ ID NO: 336902 - DNA, 20 bp, Artificial
  CRISPR gRNA sequence
ctcctgcataaaaagaaaga

SEQ ID NO: 336903 - DNA, 20 bp, Artificial
  CRISPR gRNA sequence
tcctgcataaaaagaaagaa

SEQ ID NO: 336904 - DNA, 20 bp, Artificial
  CRISPR gRNA sequence
ctgcataaaaagaaagaaaa

SEQ ID NO: 336905 - DNA, 20 bp, Artificial
  CRISPR gRNA sequence
cataaaaagaaagaaaacaa

SEQ ID NO: 336906 - DNA, 20 bp, Artificial
  CRISPR gRNA sequence
tataatgttgccctaataat

SEQ ID NO: 336907 - DNA, 20 bp, Artificial
  CRISPR gRNA sequence
ataatgttgccctaataatt

SEQ ID NO: 336908 - DNA, 20 bp, Artificial
  CRISPR gRNA sequence
taatgttgccctaataatta

SEQ ID NO: 336909 - DNA, 20 bp, Artificial
  CRISPR gRNA sequence
ccctaataattatattttaa

SEQ ID NO: 336910 - DNA, 20 bp, Artificial
  CRISPR gRNA sequence
ataattatattttaacataa

SEQ ID NO: 336911 - DNA, 20 bp, Artificial
  CRISPR gRNA sequence
tattttaacataaaagcaat

SEQ ID NO: 336912 - DNA, 20 bp, Artificial
  CRISPR gRNA sequence
taacataaaagcaatttatt

SEQ ID NO: 336913 - DNA, 20 bp, Artificial
  CRISPR gRNA sequence
aacataaaagcaatttattc

SEQ ID NO: 336914 - DNA, 20 bp, Artificial
  CRISPR gRNA sequence
acataaaagcaatttattca

SEQ ID NO: 336915 - DNA, 20 bp, Artificial
  CRISPR gRNA sequence
attcaatgcataaagtcatc

SEQ ID NO: 336916 - DNA, 20 bp, Artificial
  CRISPR gRNA sequence
ttcaatgcataaagtcatct

SEQ ID NO: 336917 - DNA, 20 bp, Artificial
  CRISPR gRNA sequence
aatgcataaagtcatctctg

SEQ ID NO: 336918 - DNA, 20 bp, Artificial
  CRISPR gRNA sequence
tgttgcaccaaaatgaaaca

SEQ ID NO: 336919 - DNA, 20 bp, Artificial
  CRISPR gRNA sequence
ttgcaccaaaatgaaacagc

SEQ ID NO: 336920 - DNA, 20 bp, Artificial
  CRISPR gRNA sequence
caccaaaatgaaacagcttc

SEQ ID NO: 336921 - DNA, 20 bp, Artificial
  CRISPR gRNA sequence
cacattctccctccacccct

SEQ ID NO: 336922 - DNA, 20 bp, Artificial
  CRISPR gRNA sequence
acattctccctccacccctc

SEQ ID NO: 336923 - DNA, 20 bp, Artificial
  CRISPR gRNA sequence
tccctccacccctcaaggaa

SEQ ID NO: 336924 - DNA, 20 bp, Artificial
  CRISPR gRNA sequence
cctccacccctcaaggaaga

SEQ ID NO: 336925 - DNA, 20 bp, Artificial
  CRISPR gRNA sequence
cacccctcaaggaagaacat

SEQ ID NO: 336926 - DNA, 20 bp, Artificial
  CRISPR gRNA sequence
aaggaagaacataagataaa

SEQ ID NO: 336927 - DNA, 20 bp, Artificial
  CRISPR gRNA sequence
tgtcctagagaaaaaaaaat

SEQ ID NO: 336928 - DNA, 20 bp, Artificial
  CRISPR gRNA sequence
gagaaaaaaaaatcctaacc

SEQ ID NO: 336929 - DNA, 20 bp, Artificial
  CRISPR gRNA sequence
accagaaacttgcttgtcat

SEQ ID NO: 336930 - DNA, 20 bp, Artificial
  CRISPR gRNA sequence
gcttgtcatatgtgaatata

SEQ ID NO: 336931 - DNA, 20 bp, Artificial
  CRISPR gRNA sequence
cttgtcatatgtgaatatag

SEQ ID NO: 336932 - DNA, 20 bp, Artificial
  CRISPR gRNA sequence
gtcatatgtgaatatagaat

SEQ ID NO: 336933 - DNA, 20 bp, Artificial
  CRISPR gRNA sequence
tcatatgtgaatatagaata

SEQ ID NO: 336934 - DNA, 20 bp, Artificial
  CRISPR gRNA sequence
aatattaaataatatattta

SEQ ID NO: 336935 - DNA, 20 bp, Artificial
  CRISPR gRNA sequence
aataatatatttacatagtg

SEQ ID NO: 336936 - DNA, 20 bp, Artificial
  CRISPR gRNA sequence
acatagtgtgtatgaatcaa

SEQ ID NO: 336937 - DNA, 20 bp, Artificial
  CRISPR gRNA sequence
catagtgtgtatgaatcaaa

SEQ ID NO: 336938 - DNA, 20 bp, Artificial
  CRISPR gRNA sequence
gtatggcctctgtcctttgg

SEQ ID NO: 336939 - DNA, 20 bp, Artificial
  CRISPR gRNA sequence
tgtcctttggtagctttcat

SEQ ID NO: 336940 - DNA, 20 bp, Artificial
  CRISPR gRNA sequence
tcctttggtagctttcatat

SEQ ID NO: 336941 - DNA, 20 bp, Artificial
  CRISPR gRNA sequence
tggtagctttcatattggag

SEQ ID NO: 336942 - DNA, 20 bp, Artificial
  CRISPR gRNA sequence
ggtagctttcatattggagg

SEQ ID NO: 336943 - DNA, 20 bp, Artificial
  CRISPR gRNA sequence
gtagctttcatattggaggc

SEQ ID NO: 336944 - DNA, 20 bp, Artificial
  CRISPR gRNA sequence
tcatattggaggcagatggt

SEQ ID NO: 336945 - DNA, 20 bp, Artificial
  CRISPR gRNA sequence
catattggaggcagatggta

SEQ ID NO: 336946 - DNA, 20 bp, Artificial
  CRISPR gRNA sequence
atattggaggcagatggtaa

SEQ ID NO: 336947 - DNA, 20 bp, Artificial
  CRISPR gRNA sequence
gaggcagatggtaaaggaat

SEQ ID NO: 336948 - DNA, 20 bp, Artificial
  CRISPR gRNA sequence
gtgataggaatggagtacta

SEQ ID NO: 336949 - DNA, 20 bp, Artificial
  CRISPR gRNA sequence
tgataggaatggagtactat

SEQ ID NO: 336950 - DNA, 20 bp, Artificial
  CRISPR gRNA sequence
tttaaatgaaggtggtagag

SEQ ID NO: 336951 - DNA, 20 bp, Artificial
  CRISPR gRNA sequence
aaatgaaggtggtagagtca

SEQ ID NO: 336952 - DNA, 20 bp, Artificial
  CRISPR gRNA sequence
aatgaaggtggtagagtcag

SEQ ID NO: 336953 - DNA, 20 bp, Artificial
  CRISPR gRNA sequence
taattttgattatagaatca

SEQ ID NO: 336954 - DNA, 20 bp, Artificial
  CRISPR gRNA sequence
tgattatagaatcagaaaat

SEQ ID NO: 336955 - DNA, 20 bp, Artificial
  CRISPR gRNA sequence
gattatagaatcagaaaatg

SEQ ID NO: 336956 - DNA, 20 bp, Artificial
  CRISPR gRNA sequence
attatagaatcagaaaatgc

SEQ ID NO: 336957 - DNA, 20 bp, Artificial
  CRISPR gRNA sequence
tagaatcagaaaatgccgcc

SEQ ID NO: 336958 - DNA, 20 bp, Artificial
  CRISPR gRNA sequence
gaggaagtgagttttaaaat

SEQ ID NO: 336959 - DNA, 20 bp, Artificial
  CRISPR gRNA sequence
aggaagtgagttttaaaatt

SEQ ID NO: 336960 - DNA, 20 bp, Artificial
  CRISPR gRNA sequence
taaaattggaattaaaggat

SEQ ID NO: 336961 - DNA, 20 bp, Artificial
  CRISPR gRNA sequence
aaaattggaattaaaggatt

SEQ ID NO: 336962 - DNA, 20 bp, Artificial
  CRISPR gRNA sequence
aaattggaattaaaggatta

SEQ ID NO: 336963 - DNA, 20 bp, Artificial
  CRISPR gRNA sequence
gaattaaaggattagtagca

SEQ ID NO: 336964 - DNA, 20 bp, Artificial
  CRISPR gRNA sequence
aaggattagtagcacttagc

SEQ ID NO: 336965 - DNA, 20 bp, Artificial
  CRISPR gRNA sequence
gtagcacttagctaaacaga

SEQ ID NO: 336966 - DNA, 20 bp, Artificial
  CRISPR gRNA sequence
agctaaacagagagatatgg

SEQ ID NO: 336967 - DNA, 20 bp, Artificial
  CRISPR gRNA sequence
gctaaacagagagatatggg

SEQ ID NO: 336968 - DNA, 20 bp, Artificial
  CRISPR gRNA sequence
aacagagagatatgggaaaa

SEQ ID NO: 336969 - DNA, 20 bp, Artificial
  CRISPR gRNA sequence
aagtttaggaaaaacttcat

SEQ ID NO: 336970 - DNA, 20 bp, Artificial
  CRISPR gRNA sequence
aggaaaaacttcatttatta

SEQ ID NO: 336971 - DNA, 20 bp, Artificial
  CRISPR gRNA sequence
ggaaaaacttcatttattag

SEQ ID NO: 336972 - DNA, 20 bp, Artificial
  CRISPR gRNA sequence
catttattagtaggtatatc

SEQ ID NO: 336973 - DNA, 20 bp, Artificial
  CRISPR gRNA sequence
atttattagtaggtatatct

SEQ ID NO: 336974 - DNA, 20 bp, Artificial
  CRISPR gRNA sequence
attagtaggtatatcttggg

SEQ ID NO: 336975 - DNA, 20 bp, Artificial
  CRISPR gRNA sequence
ttagtaggtatatcttgggg

SEQ ID NO: 336976 - DNA, 20 bp, Artificial
  CRISPR gRNA sequence
gtaggtatatcttggggaga

SEQ ID NO: 336977 - DNA, 20 bp, Artificial
  CRISPR gRNA sequence
ggggagaaggaattgtctac

SEQ ID NO: 336978 - DNA, 20 bp, Artificial
  CRISPR gRNA sequence
gggagaaggaattgtctacc

SEQ ID NO: 336979 - DNA, 20 bp, Artificial
  CRISPR gRNA sequence
tctacctgttgatcaaacta

SEQ ID NO: 336980 - DNA, 20 bp, Artificial
  CRISPR gRNA sequence
cctgttgatcaaactactct

SEQ ID NO: 336981 - DNA, 20 bp, Artificial
  CRISPR gRNA sequence
ttgatcaaactactctgaca

SEQ ID NO: 336982 - DNA, 20 bp, Artificial
  CRISPR gRNA sequence
atcaaactactctgacaaga

SEQ ID NO: 336983 - DNA, 20 bp, Artificial
  CRISPR gRNA sequence
ctctgacaagaaccatgtgt

SEQ ID NO: 336984 - DNA, 20 bp, Artificial
  CRISPR gRNA sequence
tgacaagaaccatgtgtact

SEQ ID NO: 336985 - DNA, 20 bp, Artificial
  CRISPR gRNA sequence
acaagaaccatgtgtacttc

SEQ ID NO: 336986 - DNA, 20 bp, Artificial
  CRISPR gRNA sequence
ctgatgagtaaataatcact

SEQ ID NO: 336987 - DNA, 20 bp, Artificial
  CRISPR gRNA sequence
tgatgagtaaataatcactg

SEQ ID NO: 336988 - DNA, 20 bp, Artificial
  CRISPR gRNA sequence
atgagtaaataatcactgat

SEQ ID NO: 336989 - DNA, 20 bp, Artificial
  CRISPR gRNA sequence
atgtacatcagtaaagcaga

SEQ ID NO: 336990 - DNA, 20 bp, Artificial
  CRISPR gRNA sequence
ctcactttgtaaaagtacga

SEQ ID NO: 336991 - DNA, 20 bp, Artificial
  CRISPR gRNA sequence
actttgtaaaagtacgaagt

SEQ ID NO: 336992 - DNA, 20 bp, Artificial
  CRISPR gRNA sequence
tgtaaaagtacgaagtagtt

SEQ ID NO: 336993 - DNA, 20 bp, Artificial
  CRISPR gRNA sequence
gtaaaagtacgaagtagttt

SEQ ID NO: 336994 - DNA, 20 bp, Artificial
  CRISPR gRNA sequence
taaaagtacgaagtagttta

SEQ ID NO: 336995 - DNA, 20 bp, Artificial
  CRISPR gRNA sequence
aaaaatgaataattgtatat

SEQ ID NO: 336996 - DNA, 20 bp, Artificial
  CRISPR gRNA sequence
aaaatgaataattgtatata

SEQ ID NO: 336997 - DNA, 20 bp, Artificial
  CRISPR gRNA sequence
tatatatattttatatatgt

SEQ ID NO: 336998 - DNA, 20 bp, Artificial
  CRISPR gRNA sequence
tatatatgtatgtatattac

SEQ ID NO: 336999 - DNA, 20 bp, Artificial
  CRISPR gRNA sequence
atatatgtatgtatattaca

SEQ ID NO: 337000 - DNA, 20 bp, Artificial
  CRISPR gRNA sequence
tatatgtatgtatattacat

SEQ ID NO: 337001 - DNA, 20 bp, Artificial
  CRISPR gRNA sequence
catattatatattaaaatat

SEQ ID NO: 337002 - DNA, 20 bp, Artificial
  CRISPR gRNA sequence
tatattaaaatatatgtatt

SEQ ID NO: 337003 - DNA, 20 bp, Artificial
  CRISPR gRNA sequence
aaatatatgtattatatgta

SEQ ID NO: 337004 - DNA, 20 bp, Artificial
  CRISPR gRNA sequence
tatgtatatgtatattacaa

SEQ ID NO: 337005 - DNA, 20 bp, Artificial
  CRISPR gRNA sequence
caatatatagagactatgtg

SEQ ID NO: 337006 - DNA, 20 bp, Artificial
  CRISPR gRNA sequence
tgtgtgtgtatatatacaaa

SEQ ID NO: 337007 - DNA, 20 bp, Artificial
  CRISPR gRNA sequence
tatacatatacatacatata

SEQ ID NO: 337008 - DNA, 20 bp, Artificial
  CRISPR gRNA sequence
tgtcctcctgctaaagagta

SEQ ID NO: 337009 - DNA, 20 bp, Artificial
  CRISPR gRNA sequence
ctgctaaagagtaaaagaac

SEQ ID NO: 337010 - DNA, 20 bp, Artificial
  CRISPR gRNA sequence
ctaaagagtaaaagaacaga

SEQ ID NO: 337011 - DNA, 20 bp, Artificial
  CRISPR gRNA sequence
aagagtaaaagaacagacta

SEQ ID NO: 337012 - DNA, 20 bp, Artificial
  CRISPR gRNA sequence
atcattttcaaatgacagaa

SEQ ID NO: 337013 - DNA, 20 bp, Artificial
  CRISPR gRNA sequence
tcaaatgacagaaatgtatt

SEQ ID NO: 337014 - DNA, 20 bp, Artificial
  CRISPR gRNA sequence
caaatgacagaaatgtattt

SEQ ID NO: 337015 - DNA, 20 bp, Artificial
  CRISPR gRNA sequence
aaatgacagaaatgtatttt

SEQ ID NO: 337016 - DNA, 20 bp, Artificial
  CRISPR gRNA sequence
tctccaaacctcatccactg

SEQ ID NO: 337017 - DNA, 20 bp, Artificial
  CRISPR gRNA sequence
ctccaaacctcatccactga

SEQ ID NO: 337018 - DNA, 20 bp, Artificial
  CRISPR gRNA sequence
tccaaacctcatccactgag

SEQ ID NO: 337019 - DNA, 20 bp, Artificial
  CRISPR gRNA sequence
caaacctcatccactgagaa

SEQ ID NO: 337020 - DNA, 20 bp, Artificial
  CRISPR gRNA sequence
atccactgagaactgaatca

SEQ ID NO: 337021 - DNA, 20 bp, Artificial
  CRISPR gRNA sequence
agaactgaatcaaggcctga

SEQ ID NO: 337022 - DNA, 20 bp, Artificial
  CRISPR gRNA sequence
aatcaaggcctgataataaa

SEQ ID NO: 337023 - DNA, 20 bp, Artificial
  CRISPR gRNA sequence
ataataaagataaagcccca

SEQ ID NO: 337024 - DNA, 20 bp, Artificial
  CRISPR gRNA sequence
ttgtttactttttctctctc

SEQ ID NO: 337025 - DNA, 20 bp, Artificial
  CRISPR gRNA sequence
tgtttactttttctctctct

SEQ ID NO: 337026 - DNA, 20 bp, Artificial
  CRISPR gRNA sequence
gtttactttttctctctctt

SEQ ID NO: 337027 - DNA, 20 bp, Artificial
  CRISPR gRNA sequence
tttactttttctctctcttt

SEQ ID NO: 337028 - DNA, 20 bp, Artificial
  CRISPR gRNA sequence
actttttctctctctttctt

SEQ ID NO: 337029 - DNA, 20 bp, Artificial
  CRISPR gRNA sequence
ctttttctctctctttcttt

SEQ ID NO: 337030 - DNA, 20 bp, Artificial
  CRISPR gRNA sequence
tttctctctctttcttttct

SEQ ID NO: 337031 - DNA, 20 bp, Artificial
  CRISPR gRNA sequence
ttctctctctttcttttctt

SEQ ID NO: 337032 - DNA, 20 bp, Artificial
  CRISPR gRNA sequence
tctctctctttcttttcttt

SEQ ID NO: 337033 - DNA, 20 bp, Artificial
  CRISPR gRNA sequence
ctctctctttcttttctttt

SEQ ID NO: 337034 - DNA, 20 bp, Artificial
  CRISPR gRNA sequence
tctctctttcttttcttttc

SEQ ID NO: 337035 - DNA, 20 bp, Artificial
  CRISPR gRNA sequence
tctctttcttttcttttctt

SEQ ID NO: 337036 - DNA, 20 bp, Artificial
  CRISPR gRNA sequence
tctttcttttcttttctttt

SEQ ID NO: 337037 - DNA, 20 bp, Artificial
  CRISPR gRNA sequence
tttcttttcttttcttttct

SEQ ID NO: 337038 - DNA, 20 bp, Artificial
  CRISPR gRNA sequence
tcttttcttttcttttcttt

SEQ ID NO: 337039 - DNA, 20 bp, Artificial
  CRISPR gRNA sequence
cttttcttttcttttctttt

SEQ ID NO: 337040 - DNA, 20 bp, Artificial
  CRISPR gRNA sequence
ttttcttttcttttcttttc

SEQ ID NO: 337041 - DNA, 20 bp, Artificial
  CRISPR gRNA sequence
ttcttttcttttcttttcag

SEQ ID NO: 337042 - DNA, 20 bp, Artificial
  CRISPR gRNA sequence
tcttttcttttcttttcaga

SEQ ID NO: 337043 - DNA, 20 bp, Artificial
  CRISPR gRNA sequence
cttttcttttcttttcagag

SEQ ID NO: 337044 - DNA, 20 bp, Artificial
  CRISPR gRNA sequence
ttttcttttcttttcagaga

SEQ ID NO: 337045 - DNA, 20 bp, Artificial
  CRISPR gRNA sequence
ttcttttcttttcagagaaa

SEQ ID NO: 337046 - DNA, 20 bp, Artificial
  CRISPR gRNA sequence
tcttttcttttcagagaaaa

SEQ ID NO: 337047 - DNA, 20 bp, Artificial
  CRISPR gRNA sequence
cttttcttttcagagaaaag

SEQ ID NO: 337048 - DNA, 20 bp, Artificial
  CRISPR gRNA sequence
ttttcttttcagagaaaagg

SEQ ID NO: 337049 - DNA, 20 bp, Artificial
  CRISPR gRNA sequence
ttcttttcagagaaaagggt

SEQ ID NO: 337050 - DNA, 20 bp, Artificial
  CRISPR gRNA sequence
tcttttcagagaaaagggtt

SEQ ID NO: 337051 - DNA, 20 bp, Artificial
  CRISPR gRNA sequence
cttttcagagaaaagggttt

SEQ ID NO: 337052 - DNA, 20 bp, Artificial
  CRISPR gRNA sequence
ttttcagagaaaagggttta

SEQ ID NO: 337053 - DNA, 20 bp, Artificial
  CRISPR gRNA sequence
ttcagagaaaagggtttact

SEQ ID NO: 337054 - DNA, 20 bp, Artificial
  CRISPR gRNA sequence
tcagagaaaagggtttactc

SEQ ID NO: 337055 - DNA, 20 bp, Artificial
  CRISPR gRNA sequence
cagagaaaagggtttactct

SEQ ID NO: 337056 - DNA, 20 bp, Artificial
  CRISPR gRNA sequence
agagaaaagggtttactctg

SEQ ID NO: 337057 - DNA, 20 bp, Artificial
  CRISPR gRNA sequence
actctgttccccaggctaca

SEQ ID NO: 337058 - DNA, 20 bp, Artificial
  CRISPR gRNA sequence
ctctgttccccaggctacag

SEQ ID NO: 337059 - DNA, 20 bp, Artificial
  CRISPR gRNA sequence
tgttccccaggctacagtgc

SEQ ID NO: 337060 - DNA, 20 bp, Artificial
  CRISPR gRNA sequence
ttccccaggctacagtgcag

SEQ ID NO: 337061 - DNA, 20 bp, Artificial
  CRISPR gRNA sequence
cccaggctacagtgcagtgg

SEQ ID NO: 337062 - DNA, 20 bp, Artificial
  CRISPR gRNA sequence
cagtgcagtggcatgatcct

SEQ ID NO: 337063 - DNA, 20 bp, Artificial
  CRISPR gRNA sequence
gctcgttgtagcctccactt

SEQ ID NO: 337064 - DNA, 20 bp, Artificial
  CRISPR gRNA sequence
gttgtagcctccacttcctt

SEQ ID NO: 337065 - DNA, 20 bp, Artificial
  CRISPR gRNA sequence
tagcctccacttccttgact

SEQ ID NO: 337066 - DNA, 20 bp, Artificial
  CRISPR gRNA sequence
cacttccttgactcaagggt

SEQ ID NO: 337067 - DNA, 20 bp, Artificial
  CRISPR gRNA sequence
ccttgactcaagggtccctc

SEQ ID NO: 337068 - DNA, 20 bp, Artificial
  CRISPR gRNA sequence
cttgactcaagggtccctcc

SEQ ID NO: 337069 - DNA, 20 bp, Artificial
  CRISPR gRNA sequence
gactcaagggtccctcctgc

SEQ ID NO: 337070 - DNA, 20 bp, Artificial
  CRISPR gRNA sequence
actcaagggtccctcctgcc

SEQ ID NO: 337071 - DNA, 20 bp, Artificial
  CRISPR gRNA sequence
aagggtccctcctgcctcag

SEQ ID NO: 337072 - DNA, 20 bp, Artificial
  CRISPR gRNA sequence
ctgcctcagcctcccaagaa

SEQ ID NO: 337073 - DNA, 20 bp, Artificial
  CRISPR gRNA sequence
cctcagcctcccaagaagct

SEQ ID NO: 337074 - DNA, 20 bp, Artificial
  CRISPR gRNA sequence
agcctcccaagaagctggga

SEQ ID NO: 337075 - DNA, 20 bp, Artificial
  CRISPR gRNA sequence
ccaagaagctgggaatacag

SEQ ID NO: 337076 - DNA, 20 bp, Artificial
  CRISPR gRNA sequence
ggaatacaggcacacaccac

SEQ ID NO: 337077 - DNA, 20 bp, Artificial
  CRISPR gRNA sequence
gctaactttgaaaaagaaat

SEQ ID NO: 337078 - DNA, 20 bp, Artificial
  CRISPR gRNA sequence
actttgaaaaagaaattttg

SEQ ID NO: 337079 - DNA, 20 bp, Artificial
  CRISPR gRNA sequence
tgaaaaagaaattttgtaga

SEQ ID NO: 337080 - DNA, 20 bp, Artificial
  CRISPR gRNA sequence
gaaaaagaaattttgtagag

SEQ ID NO: 337081 - DNA, 20 bp, Artificial
  CRISPR gRNA sequence
aaaaagaaattttgtagaga

SEQ ID NO: 337082 - DNA, 20 bp, Artificial
  CRISPR gRNA sequence
tgtagagacaggtcttgcta

SEQ ID NO: 337083 - DNA, 20 bp, Artificial
  CRISPR gRNA sequence
gtagagacaggtcttgctat

SEQ ID NO: 337084 - DNA, 20 bp, Artificial
  CRISPR gRNA sequence
tagagacaggtcttgctatg

SEQ ID NO: 337085 - DNA, 20 bp, Artificial
  CRISPR gRNA sequence
gctatgttgcccaggctggt

SEQ ID NO: 337086 - DNA, 20 bp, Artificial
  CRISPR gRNA sequence
ctatgttgcccaggctggtc

SEQ ID NO: 337087 - DNA, 20 bp, Artificial
  CRISPR gRNA sequence
tgttgcccaggctggtcttg

SEQ ID NO: 337088 - DNA, 20 bp, Artificial
  CRISPR gRNA sequence
cccaggctggtcttgaactc

SEQ ID NO: 337089 - DNA, 20 bp, Artificial
  CRISPR gRNA sequence
gtcttgaactcctggcctca

SEQ ID NO: 337090 - DNA, 20 bp, Artificial
  CRISPR gRNA sequence
gaactcctggcctcaagcaa

SEQ ID NO: 337091 - DNA, 20 bp, Artificial
  CRISPR gRNA sequence
aactcctggcctcaagcaat

SEQ ID NO: 337092 - DNA, 20 bp, Artificial
  CRISPR gRNA sequence
ctggcctcaagcaatcctcc

SEQ ID NO: 337093 - DNA, 20 bp, Artificial
  CRISPR gRNA sequence
gcctcaagcaatcctcctgc

SEQ ID NO: 337094 - DNA, 20 bp, Artificial
  CRISPR gRNA sequence
aagcaatcctcctgcctcag

SEQ ID NO: 337095 - DNA, 20 bp, Artificial
  CRISPR gRNA sequence
ctgcctcagcctcttaaagt

SEQ ID NO: 337096 - DNA, 20 bp, Artificial
  CRISPR gRNA sequence
cctcagcctcttaaagtgct

SEQ ID NO: 337097 - DNA, 20 bp, Artificial
  CRISPR gRNA sequence
agcctcttaaagtgctagga

SEQ ID NO: 337098 - DNA, 20 bp, Artificial
  CRISPR gRNA sequence
ttaaagtgctaggattacag

SEQ ID NO: 337099 - DNA, 20 bp, Artificial
  CRISPR gRNA sequence
aaagtgctaggattacagac

SEQ ID NO: 337100 - DNA, 20 bp, Artificial
  CRISPR gRNA sequence
aagtgctaggattacagacg

SEQ ID NO: 337101 - DNA, 20 bp, Artificial
  CRISPR gRNA sequence
ggattacagacgtgaaccac

SEQ ID NO: 337102 - DNA, 20 bp, Artificial
  CRISPR gRNA sequence
cagacgtgaaccaccatgcc

SEQ ID NO: 337103 - DNA, 20 bp, Artificial
  CRISPR gRNA sequence
tttcattttctgaaataaat

SEQ ID NO: 337104 - DNA, 20 bp, Artificial
  CRISPR gRNA sequence
ttcattttctgaaataaatt

SEQ ID NO: 337105 - DNA, 20 bp, Artificial
  CRISPR gRNA sequence
tcattttctgaaataaattt

SEQ ID NO: 337106 - DNA, 20 bp, Artificial
  CRISPR gRNA sequence
cattttctgaaataaattta

SEQ ID NO: 337107 - DNA, 20 bp, Artificial
  CRISPR gRNA sequence
attttctgaaataaatttat

SEQ ID NO: 337108 - DNA, 20 bp, Artificial
  CRISPR gRNA sequence
tctgaaataaatttatgctt

SEQ ID NO: 337109 - DNA, 20 bp, Artificial
  CRISPR gRNA sequence
ctgaaataaatttatgctta

SEQ ID NO: 337110 - DNA, 20 bp, Artificial
  CRISPR gRNA sequence
tgaaataaatttatgcttat

SEQ ID NO: 337111 - DNA, 20 bp, Artificial
  CRISPR gRNA sequence
aaataaatttatgcttatag

SEQ ID NO: 337112 - DNA, 20 bp, Artificial
  CRISPR gRNA sequence
atgcttataggaagccaagg

SEQ ID NO: 337113 - DNA, 20 bp, Artificial
  CRISPR gRNA sequence
tgcttataggaagccaaggt

SEQ ID NO: 337114 - DNA, 20 bp, Artificial
  CRISPR gRNA sequence
ataggaagccaaggttgttt

SEQ ID NO: 337115 - DNA, 20 bp, Artificial
  CRISPR gRNA sequence
taggaagccaaggttgtttt

SEQ ID NO: 337116 - DNA, 20 bp, Artificial
  CRISPR gRNA sequence
tttttgcaagctacatggga

SEQ ID NO: 337117 - DNA, 20 bp, Artificial
  CRISPR gRNA sequence
ttgcaagctacatgggaatc

SEQ ID NO: 337118 - DNA, 20 bp, Artificial
  CRISPR gRNA sequence
tgcaagctacatgggaatca

SEQ ID NO: 337119 - DNA, 20 bp, Artificial
  CRISPR gRNA sequence
gcaagctacatgggaatcac

SEQ ID NO: 337120 - DNA, 20 bp, Artificial
  CRISPR gRNA sequence
caagctacatgggaatcaca

SEQ ID NO: 337121 - DNA, 20 bp, Artificial
  CRISPR gRNA sequence
catgggaatcacagaaggaa

SEQ ID NO: 337122 - DNA, 20 bp, Artificial
  CRISPR gRNA sequence
aaatcaccttggcctggtgg

SEQ ID NO: 337123 - DNA, 20 bp, Artificial
  CRISPR gRNA sequence
ggcctggtggttgcagattc

SEQ ID NO: 337124 - DNA, 20 bp, Artificial
  CRISPR gRNA sequence
gcctggtggttgcagattct

SEQ ID NO: 337125 - DNA, 20 bp, Artificial
  CRISPR gRNA sequence
gtggttgcagattctgagtt

SEQ ID NO: 337126 - DNA, 20 bp, Artificial
  CRISPR gRNA sequence
cagattctgagttattagac

SEQ ID NO: 337127 - DNA, 20 bp, Artificial
  CRISPR gRNA sequence
tgagttattagactataaat

SEQ ID NO: 337128 - DNA, 20 bp, Artificial
  CRISPR gRNA sequence
agttattagactataaattc

SEQ ID NO: 337129 - DNA, 20 bp, Artificial
  CRISPR gRNA sequence
ttagactataaattcaaact

SEQ ID NO: 337130 - DNA, 20 bp, Artificial
  CRISPR gRNA sequence
gactataaattcaaactgct

SEQ ID NO: 337131 - DNA, 20 bp, Artificial
  CRISPR gRNA sequence
taaattcaaactgctcattg

SEQ ID NO: 337132 - DNA, 20 bp, Artificial
  CRISPR gRNA sequence
aaactgctcattgccttctc

SEQ ID NO: 337133 - DNA, 20 bp, Artificial
  CRISPR gRNA sequence
ctcattgccttctctttctt

SEQ ID NO: 337134 - DNA, 20 bp, Artificial
  CRISPR gRNA sequence
attgccttctctttcttttt

SEQ ID NO: 337135 - DNA, 20 bp, Artificial
  CRISPR gRNA sequence
ccttctctttctttttgttt

SEQ ID NO: 337136 - DNA, 20 bp, Artificial
  CRISPR gRNA sequence
ctctttctttttgttttatt

SEQ ID NO: 337137 - DNA, 20 bp, Artificial
  CRISPR gRNA sequence
tctttctttttgttttattt

SEQ ID NO: 337138 - DNA, 20 bp, Artificial
  CRISPR gRNA sequence
tttctttttgttttattttc

SEQ ID NO: 337139 - DNA, 20 bp, Artificial
  CRISPR gRNA sequence
tctttttgttttattttcct

SEQ ID NO: 337140 - DNA, 20 bp, Artificial
  CRISPR gRNA sequence
ctttttgttttattttcctt

SEQ ID NO: 337141 - DNA, 20 bp, Artificial
  CRISPR gRNA sequence
tttttgttttattttccttt

SEQ ID NO: 337142 - DNA, 20 bp, Artificial
  CRISPR gRNA sequence
tttgttttattttccttttt

SEQ ID NO: 337143 - DNA, 20 bp, Artificial
  CRISPR gRNA sequence
ttgttttattttccttttta

SEQ ID NO: 337144 - DNA, 20 bp, Artificial
  CRISPR gRNA sequence
tgttttattttcctttttaa

SEQ ID NO: 337145 - DNA, 20 bp, Artificial
  CRISPR gRNA sequence
gttttattttcctttttaat

SEQ ID NO: 337146 - DNA, 20 bp, Artificial
  CRISPR gRNA sequence
ttttattttcctttttaata

SEQ ID NO: 337147 - DNA, 20 bp, Artificial
  CRISPR gRNA sequence
tattttcctttttaatatga

SEQ ID NO: 337148 - DNA, 20 bp, Artificial
  CRISPR gRNA sequence
attttcctttttaatatgac

SEQ ID NO: 337149 - DNA, 20 bp, Artificial
  CRISPR gRNA sequence
ttttcctttttaatatgaca

SEQ ID NO: 337150 - DNA, 20 bp, Artificial
  CRISPR gRNA sequence
tcctttttaatatgacaaat

SEQ ID NO: 337151 - DNA, 20 bp, Artificial
  CRISPR gRNA sequence
cctttttaatatgacaaatt

SEQ ID NO: 337152 - DNA, 20 bp, Artificial
  CRISPR gRNA sequence
ctttttaatatgacaaattt

SEQ ID NO: 337153 - DNA, 20 bp, Artificial
  CRISPR gRNA sequence
tttaatatgacaaattttca

SEQ ID NO: 337154 - DNA, 20 bp, Artificial
  CRISPR gRNA sequence
ttaatatgacaaattttcat

SEQ ID NO: 337155 - DNA, 20 bp, Artificial
  CRISPR gRNA sequence
taatatgacaaattttcatg

SEQ ID NO: 337156 - DNA, 20 bp, Artificial
  CRISPR gRNA sequence
aatatgacaaattttcatgc

SEQ ID NO: 337157 - DNA, 20 bp, Artificial
  CRISPR gRNA sequence
atatgacaaattttcatgct

SEQ ID NO: 337158 - DNA, 20 bp, Artificial
  CRISPR gRNA sequence
tcatgctgaaattgtttggg

SEQ ID NO: 337159 - DNA, 20 bp, Artificial
  CRISPR gRNA sequence
catgctgaaattgtttggga

SEQ ID NO: 337160 - DNA, 20 bp, Artificial
  CRISPR gRNA sequence
atgctgaaattgtttgggaa

SEQ ID NO: 337161 - DNA, 20 bp, Artificial
  CRISPR gRNA sequence
aaattgtttgggaaaattat

SEQ ID NO: 337162 - DNA, 20 bp, Artificial
  CRISPR gRNA sequence
tttgggaaaattattagtat

SEQ ID NO: 337163 - DNA, 20 bp, Artificial
  CRISPR gRNA sequence
gggaaaattattagtatgct

SEQ ID NO: 337164 - DNA, 20 bp, Artificial
  CRISPR gRNA sequence
ggaaaattattagtatgctg

SEQ ID NO: 337165 - DNA, 20 bp, Artificial
  CRISPR gRNA sequence
ttagtatgctggttttttcc

SEQ ID NO: 337166 - DNA, 20 bp, Artificial
  CRISPR gRNA sequence
gtatgctggttttttcctaa

SEQ ID NO: 337167 - DNA, 20 bp, Artificial
  CRISPR gRNA sequence
gttttttcctaagttttgaa

SEQ ID NO: 337168 - DNA, 20 bp, Artificial
  CRISPR gRNA sequence
tttcctaagttttgaaatct

SEQ ID NO: 337169 - DNA, 20 bp, Artificial
  CRISPR gRNA sequence
ttcctaagttttgaaatctt

SEQ ID NO: 337170 - DNA, 20 bp, Artificial
  CRISPR gRNA sequence
tcctaagttttgaaatcttg

SEQ ID NO: 337171 - DNA, 20 bp, Artificial
  CRISPR gRNA sequence
cctaagttttgaaatcttgg

SEQ ID NO: 337172 - DNA, 20 bp, Artificial
  CRISPR gRNA sequence
ctaagttttgaaatcttggt

SEQ ID NO: 337173 - DNA, 20 bp, Artificial
  CRISPR gRNA sequence
agttttgaaatcttggtctt

SEQ ID NO: 337174 - DNA, 20 bp, Artificial
  CRISPR gRNA sequence
tgaaatcttggtctttgttt

SEQ ID NO: 337175 - DNA, 20 bp, Artificial
  CRISPR gRNA sequence
gaaatcttggtctttgtttt

SEQ ID NO: 337176 - DNA, 20 bp, Artificial
  CRISPR gRNA sequence
aaatcttggtctttgttttt

SEQ ID NO: 337177 - DNA, 20 bp, Artificial
  CRISPR gRNA sequence
ggtctttgtttttgagaaaa

SEQ ID NO: 337178 - DNA, 20 bp, Artificial
  CRISPR gRNA sequence
gtctttgtttttgagaaaac

SEQ ID NO: 337179 - DNA, 20 bp, Artificial
  CRISPR gRNA sequence
tgtttttgagaaaactatgt

SEQ ID NO: 337180 - DNA, 20 bp, Artificial
  CRISPR gRNA sequence
gtttttgagaaaactatgta

SEQ ID NO: 337181 - DNA, 20 bp, Artificial
  CRISPR gRNA sequence
tttttgagaaaactatgtaa

SEQ ID NO: 337182 - DNA, 20 bp, Artificial
  CRISPR gRNA sequence
ttgagaaaactatgtaagtg

SEQ ID NO: 337183 - DNA, 20 bp, Artificial
  CRISPR gRNA sequence
tgagaaaactatgtaagtgt

SEQ ID NO: 337184 - DNA, 20 bp, Artificial
  CRISPR gRNA sequence
gagaaaactatgtaagtgta

SEQ ID NO: 337185 - DNA, 20 bp, Artificial
  CRISPR gRNA sequence
agaaaactatgtaagtgtaa

SEQ ID NO: 337186 - DNA, 20 bp, Artificial
  CRISPR gRNA sequence
tgtaagtgtaaaaaaatttt

SEQ ID NO: 337187 - DNA, 20 bp, Artificial
  CRISPR gRNA sequence
taaggaaaaaaattacctag

SEQ ID NO: 337188 - DNA, 20 bp, Artificial
  CRISPR gRNA sequence
aaggaaaaaaattacctagt

SEQ ID NO: 337189 - DNA, 20 bp, Artificial
  CRISPR gRNA sequence
aggaaaaaaattacctagtt

SEQ ID NO: 337190 - DNA, 20 bp, Artificial
  CRISPR gRNA sequence
cctagttctacagtgaaata

SEQ ID NO: 337191 - DNA, 20 bp, Artificial
  CRISPR gRNA sequence
gttctacagtgaaatagaaa

SEQ ID NO: 337192 - DNA, 20 bp, Artificial
  CRISPR gRNA sequence
tacagtgaaatagaaatact

SEQ ID NO: 337193 - DNA, 20 bp, Artificial
  CRISPR gRNA sequence
cagtgaaatagaaatactat

SEQ ID NO: 337194 - DNA, 20 bp, Artificial
  CRISPR gRNA sequence
tttgtatatttttgctcttt

SEQ ID NO: 337195 - DNA, 20 bp, Artificial
  CRISPR gRNA sequence
gtatatttttgctctttatc

SEQ ID NO: 337196 - DNA, 20 bp, Artificial
  CRISPR gRNA sequence
tatatttttgctctttatct

SEQ ID NO: 337197 - DNA, 20 bp, Artificial
  CRISPR gRNA sequence
ttgctctttatcttgcaaaa

SEQ ID NO: 337198 - DNA, 20 bp, Artificial
  CRISPR gRNA sequence
tgctctttatcttgcaaaaa

SEQ ID NO: 337199 - DNA, 20 bp, Artificial
  CRISPR gRNA sequence
gctctttatcttgcaaaaac

SEQ ID NO: 337200 - DNA, 20 bp, Artificial
  CRISPR gRNA sequence
ctctttatcttgcaaaaaca

SEQ ID NO: 337201 - DNA, 20 bp, Artificial
  CRISPR gRNA sequence
tttatcttgcaaaaacatac

SEQ ID NO: 337202 - DNA, 20 bp, Artificial
  CRISPR gRNA sequence
tatcttgcaaaaacatactt

SEQ ID NO: 337203 - DNA, 20 bp, Artificial
  CRISPR gRNA sequence
atcttgcaaaaacatactta

SEQ ID NO: 337204 - DNA, 20 bp, Artificial
  CRISPR gRNA sequence
tcttgcaaaaacatacttat

SEQ ID NO: 337205 - DNA, 20 bp, Artificial
  CRISPR gRNA sequence
gcaaaaacatacttattatt

SEQ ID NO: 337206 - DNA, 20 bp, Artificial
  CRISPR gRNA sequence
caaaaacatacttattattt

SEQ ID NO: 337207 - DNA, 20 bp, Artificial
  CRISPR gRNA sequence
attatttatagcaaacatgt

SEQ ID NO: 337208 - DNA, 20 bp, Artificial
  CRISPR gRNA sequence
ttatttatagcaaacatgtt

SEQ ID NO: 337209 - DNA, 20 bp, Artificial
  CRISPR gRNA sequence
tttatagcaaacatgttatt

SEQ ID NO: 337210 - DNA, 20 bp, Artificial
  CRISPR gRNA sequence
atagcaaacatgttattttg

SEQ ID NO: 337211 - DNA, 20 bp, Artificial
  CRISPR gRNA sequence
tagcaaacatgttattttgt

SEQ ID NO: 337212 - DNA, 20 bp, Artificial
  CRISPR gRNA sequence
ttttgtgttctgctattgtt

SEQ ID NO: 337213 - DNA, 20 bp, Artificial
  CRISPR gRNA sequence
tgtgttctgctattgttatt

SEQ ID NO: 337214 - DNA, 20 bp, Artificial
  CRISPR gRNA sequence
gtgttctgctattgttattt

SEQ ID NO: 337215 - DNA, 20 bp, Artificial
  CRISPR gRNA sequence
tgttctgctattgttatttt

SEQ ID NO: 337216 - DNA, 20 bp, Artificial
  CRISPR gRNA sequence
tgctattgttattttatgtc

SEQ ID NO: 337217 - DNA, 20 bp, Artificial
  CRISPR gRNA sequence
ctattgttattttatgtcat

SEQ ID NO: 337218 - DNA, 20 bp, Artificial
  CRISPR gRNA sequence
ttgttattttatgtcataaa

SEQ ID NO: 337219 - DNA, 20 bp, Artificial
  CRISPR gRNA sequence
ttattttatgtcataaacat

SEQ ID NO: 337220 - DNA, 20 bp, Artificial
  CRISPR gRNA sequence
ttttatgtcataaacatttc

SEQ ID NO: 337221 - DNA, 20 bp, Artificial
  CRISPR gRNA sequence
tatgtcataaacatttcatt

SEQ ID NO: 337222 - DNA, 20 bp, Artificial
  CRISPR gRNA sequence
atgtcataaacatttcattt

SEQ ID NO: 337223 - DNA, 20 bp, Artificial
  CRISPR gRNA sequence
tgtcataaacatttcatttt

SEQ ID NO: 337224 - DNA, 20 bp, Artificial
  CRISPR gRNA sequence
catttttagtcatcataatt

SEQ ID NO: 337225 - DNA, 20 bp, Artificial
  CRISPR gRNA sequence
atttttagtcatcataatta

SEQ ID NO: 337226 - DNA, 20 bp, Artificial
  CRISPR gRNA sequence
ttagtcatcataattatcct

SEQ ID NO: 337227 - DNA, 20 bp, Artificial
  CRISPR gRNA sequence
tagtcatcataattatcctt

SEQ ID NO: 337228 - DNA, 20 bp, Artificial
  CRISPR gRNA sequence
agtcatcataattatccttt

SEQ ID NO: 337229 - DNA, 20 bp, Artificial
  CRISPR gRNA sequence
gtcatcataattatcctttt

SEQ ID NO: 337230 - DNA, 20 bp, Artificial
  CRISPR gRNA sequence
tcctttttaatgactatatt

SEQ ID NO: 337231 - DNA, 20 bp, Artificial
  CRISPR gRNA sequence
tttaatgactatattattgg

SEQ ID NO: 337232 - DNA, 20 bp, Artificial
  CRISPR gRNA sequence
ttaatgactatattattggc

SEQ ID NO: 337233 - DNA, 20 bp, Artificial
  CRISPR gRNA sequence
taatgactatattattggcc

SEQ ID NO: 337234 - DNA, 20 bp, Artificial
  CRISPR gRNA sequence
aatgactatattattggcca

SEQ ID NO: 337235 - DNA, 20 bp, Artificial
  CRISPR gRNA sequence
atgactatattattggccaa

SEQ ID NO: 337236 - DNA, 20 bp, Artificial
  CRISPR gRNA sequence
tattattggccaaaatgtta

SEQ ID NO: 337237 - DNA, 20 bp, Artificial
  CRISPR gRNA sequence
ttggccaaaatgttaatcta

SEQ ID NO: 337238 - DNA, 20 bp, Artificial
  CRISPR gRNA sequence
gccaaaatgttaatctatca

SEQ ID NO: 337239 - DNA, 20 bp, Artificial
  CRISPR gRNA sequence
atctatcataatttgttaaa

SEQ ID NO: 337240 - DNA, 20 bp, Artificial
  CRISPR gRNA sequence
tcataatttgttaaaactaa

SEQ ID NO: 337241 - DNA, 20 bp, Artificial
  CRISPR gRNA sequence
gttaaaactaaaatactaac

SEQ ID NO: 337242 - DNA, 20 bp, Artificial
  CRISPR gRNA sequence
ttaaaactaaaatactaacg

SEQ ID NO: 337243 - DNA, 20 bp, Artificial
  CRISPR gRNA sequence
aaactaaaatactaacgttg

SEQ ID NO: 337244 - DNA, 20 bp, Artificial
  CRISPR gRNA sequence
aaatactaacgttggatatt

SEQ ID NO: 337245 - DNA, 20 bp, Artificial
  CRISPR gRNA sequence
acgttggatattgggattat

SEQ ID NO: 337246 - DNA, 20 bp, Artificial
  CRISPR gRNA sequence
gatattgggattattttcag

SEQ ID NO: 337247 - DNA, 20 bp, Artificial
  CRISPR gRNA sequence
ggattattttcagcattttg

SEQ ID NO: 337248 - DNA, 20 bp, Artificial
  CRISPR gRNA sequence
ttttcagcattttgctttta

SEQ ID NO: 337249 - DNA, 20 bp, Artificial
  CRISPR gRNA sequence
tcagcattttgcttttatgt

SEQ ID NO: 337250 - DNA, 20 bp, Artificial
  CRISPR gRNA sequence
cagcattttgcttttatgta

SEQ ID NO: 337251 - DNA, 20 bp, Artificial
  CRISPR gRNA sequence
agcattttgcttttatgtaa

SEQ ID NO: 337252 - DNA, 20 bp, Artificial
  CRISPR gRNA sequence
tgcttttatgtaaatattat

SEQ ID NO: 337253 - DNA, 20 bp, Artificial
  CRISPR gRNA sequence
gcttttatgtaaatattatg

SEQ ID NO: 337254 - DNA, 20 bp, Artificial
  CRISPR gRNA sequence
cttttatgtaaatattatga

SEQ ID NO: 337255 - DNA, 20 bp, Artificial
  CRISPR gRNA sequence
ttatgtaaatattatgacat

SEQ ID NO: 337256 - DNA, 20 bp, Artificial
  CRISPR gRNA sequence
tatgtaaatattatgacatt

SEQ ID NO: 337257 - DNA, 20 bp, Artificial
  CRISPR gRNA sequence
atgtaaatattatgacattt

SEQ ID NO: 337258 - DNA, 20 bp, Artificial
  CRISPR gRNA sequence
tgtaaatattatgacatttg

SEQ ID NO: 337259 - DNA, 20 bp, Artificial
  CRISPR gRNA sequence
tgacatttggtcaaaatgtt

SEQ ID NO: 337260 - DNA, 20 bp, Artificial
  CRISPR gRNA sequence
ggtcaaaatgtttaaaagtt

SEQ ID NO: 337261 - DNA, 20 bp, Artificial
  CRISPR gRNA sequence
gtcaaaatgtttaaaagtta

SEQ ID NO: 337262 - DNA, 20 bp, Artificial
  CRISPR gRNA sequence
aaaagttataatactatgta

SEQ ID NO: 337263 - DNA, 20 bp, Artificial
  CRISPR gRNA sequence
aaagttataatactatgtat

SEQ ID NO: 337264 - DNA, 20 bp, Artificial
  CRISPR gRNA sequence
taatactatgtattgccatt

SEQ ID NO: 337265 - DNA, 20 bp, Artificial
  CRISPR gRNA sequence
tgtattgccattttgctttc

SEQ ID NO: 337266 - DNA, 20 bp, Artificial
  CRISPR gRNA sequence
ccattttgctttctgaaatt

SEQ ID NO: 337267 - DNA, 20 bp, Artificial
  CRISPR gRNA sequence
tgctttctgaaatttgtaac

SEQ ID NO: 337268 - DNA, 20 bp, Artificial
  CRISPR gRNA sequence
gctttctgaaatttgtaaca

SEQ ID NO: 337269 - DNA, 20 bp, Artificial
  CRISPR gRNA sequence
ctttctgaaatttgtaacag

SEQ ID NO: 337270 - DNA, 20 bp, Artificial
  CRISPR gRNA sequence
tctgaaatttgtaacaggat

SEQ ID NO: 337271 - DNA, 20 bp, Artificial
  CRISPR gRNA sequence
ctgaaatttgtaacaggatt

SEQ ID NO: 337272 - DNA, 20 bp, Artificial
  CRISPR gRNA sequence
tgaaatttgtaacaggatta

SEQ ID NO: 337273 - DNA, 20 bp, Artificial
  CRISPR gRNA sequence
aaatttgtaacaggattagc

SEQ ID NO: 337274 - DNA, 20 bp, Artificial
  CRISPR gRNA sequence
gtaacaggattagcattatg

SEQ ID NO: 337275 - DNA, 20 bp, Artificial
  CRISPR gRNA sequence
taacaggattagcattatgc

SEQ ID NO: 337276 - DNA, 20 bp, Artificial
  CRISPR gRNA sequence
gcattatgcaggaggggcta

SEQ ID NO: 337277 - DNA, 20 bp, Artificial
  CRISPR gRNA sequence
tgcaggaggggctatttgtc

SEQ ID NO: 337278 - DNA, 20 bp, Artificial
  CRISPR gRNA sequence
tttgtcacacctctacttac

SEQ ID NO: 337279 - DNA, 20 bp, Artificial
  CRISPR gRNA sequence
gtcacacctctacttacact

SEQ ID NO: 337280 - DNA, 20 bp, Artificial
  CRISPR gRNA sequence
tcacacctctacttacacta

SEQ ID NO: 337281 - DNA, 20 bp, Artificial
  CRISPR gRNA sequence
tacttacactagttgcctta

SEQ ID NO: 337282 - DNA, 20 bp, Artificial
  CRISPR gRNA sequence
cttacactagttgccttaat

SEQ ID NO: 337283 - DNA, 20 bp, Artificial
  CRISPR gRNA sequence
acactagttgccttaatttt

SEQ ID NO: 337284 - DNA, 20 bp, Artificial
  CRISPR gRNA sequence
cactagttgccttaatttta

SEQ ID NO: 337285 - DNA, 20 bp, Artificial
  CRISPR gRNA sequence
gttgccttaattttatttaa

SEQ ID NO: 337286 - DNA, 20 bp, Artificial
  CRISPR gRNA sequence
ccttaattttatttaagata

SEQ ID NO: 337287 - DNA, 20 bp, Artificial
  CRISPR gRNA sequence
aattttatttaagatacaca

SEQ ID NO: 337288 - DNA, 20 bp, Artificial
  CRISPR gRNA sequence
attttatttaagatacacaa

SEQ ID NO: 337289 - DNA, 20 bp, Artificial
  CRISPR gRNA sequence
tatttaagatacacaattac

SEQ ID NO: 337290 - DNA, 20 bp, Artificial
  CRISPR gRNA sequence
atttaagatacacaattact

SEQ ID NO: 337291 - DNA, 20 bp, Artificial
  CRISPR gRNA sequence
tttaagatacacaattactt

SEQ ID NO: 337292 - DNA, 20 bp, Artificial
  CRISPR gRNA sequence
aagatacacaattacttatt

SEQ ID NO: 337293 - DNA, 20 bp, Artificial
  CRISPR gRNA sequence
agatacacaattacttattt

SEQ ID NO: 337294 - DNA, 20 bp, Artificial
  CRISPR gRNA sequence
cttattttcttaatgaccct

SEQ ID NO: 337295 - DNA, 20 bp, Artificial
  CRISPR gRNA sequence
attttcttaatgaccctggg

SEQ ID NO: 337296 - DNA, 20 bp, Artificial
  CRISPR gRNA sequence
ttttcttaatgaccctgggc

SEQ ID NO: 337297 - DNA, 20 bp, Artificial
  CRISPR gRNA sequence
tcttaatgaccctgggcttc

SEQ ID NO: 337298 - DNA, 20 bp, Artificial
  CRISPR gRNA sequence
cttaatgaccctgggcttca

SEQ ID NO: 337299 - DNA, 20 bp, Artificial
  CRISPR gRNA sequence
ttaatgaccctgggcttcaa

SEQ ID NO: 337300 - DNA, 20 bp, Artificial
  CRISPR gRNA sequence
aatgaccctgggcttcaatt

SEQ ID NO: 337301 - DNA, 20 bp, Artificial
  CRISPR gRNA sequence
atgaccctgggcttcaattt

SEQ ID NO: 337302 - DNA, 20 bp, Artificial
  CRISPR gRNA sequence
ggcttcaatttatattttcc

SEQ ID NO: 337303 - DNA, 20 bp, Artificial
  CRISPR gRNA sequence
caatttatattttccctata

SEQ ID NO: 337304 - DNA, 20 bp, Artificial
  CRISPR gRNA sequence
aatttatattttccctatat

SEQ ID NO: 337305 - DNA, 20 bp, Artificial
  CRISPR gRNA sequence
atattttccctatatatctt

SEQ ID NO: 337306 - DNA, 20 bp, Artificial
  CRISPR gRNA sequence
tattttccctatatatcttc

SEQ ID NO: 337307 - DNA, 20 bp, Artificial
  CRISPR gRNA sequence
tccctatatatcttcaattt

SEQ ID NO: 337308 - DNA, 20 bp, Artificial
  CRISPR gRNA sequence
ccctatatatcttcaatttg

SEQ ID NO: 337309 - DNA, 20 bp, Artificial
  CRISPR gRNA sequence
cctatatatcttcaatttgg

SEQ ID NO: 337310 - DNA, 20 bp, Artificial
  CRISPR gRNA sequence
tatatcttcaatttgggtga

SEQ ID NO: 337311 - DNA, 20 bp, Artificial
  CRISPR gRNA sequence
caatttgggtgatttgattg

SEQ ID NO: 337312 - DNA, 20 bp, Artificial
  CRISPR gRNA sequence
aatttgggtgatttgattgt

SEQ ID NO: 337313 - DNA, 20 bp, Artificial
  CRISPR gRNA sequence
gggtgatttgattgtgaaaa

SEQ ID NO: 337314 - DNA, 20 bp, Artificial
  CRISPR gRNA sequence
ggtgatttgattgtgaaaat

SEQ ID NO: 337315 - DNA, 20 bp, Artificial
  CRISPR gRNA sequence
gattgtgaaaataagcacaa

SEQ ID NO: 337316 - DNA, 20 bp, Artificial
  CRISPR gRNA sequence
attgtgaaaataagcacaag

SEQ ID NO: 337317 - DNA, 20 bp, Artificial
  CRISPR gRNA sequence
tgaaaataagcacaagtgtt

SEQ ID NO: 337318 - DNA, 20 bp, Artificial
  CRISPR gRNA sequence
tagtcttcagttatagcagt

SEQ ID NO: 337319 - DNA, 20 bp, Artificial
  CRISPR gRNA sequence
gtcttcagttatagcagtcc

SEQ ID NO: 337320 - DNA, 20 bp, Artificial
  CRISPR gRNA sequence
cagttatagcagtccctatt

SEQ ID NO: 337321 - DNA, 20 bp, Artificial
  CRISPR gRNA sequence
agttatagcagtccctatta

SEQ ID NO: 337322 - DNA, 20 bp, Artificial
  CRISPR gRNA sequence
tagcagtccctattattcaa

SEQ ID NO: 337323 - DNA, 20 bp, Artificial
  CRISPR gRNA sequence
ttattcaaactaattctcac

SEQ ID NO: 337324 - DNA, 20 bp, Artificial
  CRISPR gRNA sequence
ttcaaactaattctcacgcc

SEQ ID NO: 337325 - DNA, 20 bp, Artificial
  CRISPR gRNA sequence
aaactaattctcacgccaaa

SEQ ID NO: 337326 - DNA, 20 bp, Artificial
  CRISPR gRNA sequence
attctcacgccaaaacaacc

SEQ ID NO: 337327 - DNA, 20 bp, Artificial
  CRISPR gRNA sequence
tcacgccaaaacaaccaaaa

SEQ ID NO: 337328 - DNA, 20 bp, Artificial
  CRISPR gRNA sequence
acgccaaaacaaccaaaaat

SEQ ID NO: 337329 - DNA, 20 bp, Artificial
  CRISPR gRNA sequence
aacaaatgtccaaaaatatt

SEQ ID NO: 337330 - DNA, 20 bp, Artificial
  CRISPR gRNA sequence
ttaaaagcattaaagaatga

SEQ ID NO: 337331 - DNA, 20 bp, Artificial
  CRISPR gRNA sequence
aaagcattaaagaatgacac

SEQ ID NO: 337332 - DNA, 20 bp, Artificial
  CRISPR gRNA sequence
aagaatgacacaaaggagga

SEQ ID NO: 337333 - DNA, 20 bp, Artificial
  CRISPR gRNA sequence
ccaggctaaatttgaagaga

SEQ ID NO: 337334 - DNA, 20 bp, Artificial
  CRISPR gRNA sequence
aatttgaagagagaaccaga

SEQ ID NO: 337335 - DNA, 20 bp, Artificial
  CRISPR gRNA sequence
gaagagagaaccagaacccc

SEQ ID NO: 337336 - DNA, 20 bp, Artificial
  CRISPR gRNA sequence
aagagagaaccagaaccccg

SEQ ID NO: 337337 - DNA, 20 bp, Artificial
  CRISPR gRNA sequence
ggaagctgcttttactcgga

SEQ ID NO: 337338 - DNA, 20 bp, Artificial
  CRISPR gRNA sequence
gaagctgcttttactcggaa

SEQ ID NO: 337339 - DNA, 20 bp, Artificial
  CRISPR gRNA sequence
cttttactcggaaagcattg

SEQ ID NO: 337340 - DNA, 20 bp, Artificial
  CRISPR gRNA sequence
ttactcggaaagcattgctg

SEQ ID NO: 337341 - DNA, 20 bp, Artificial
  CRISPR gRNA sequence
tactcggaaagcattgctgt

SEQ ID NO: 337342 - DNA, 20 bp, Artificial
  CRISPR gRNA sequence
actcggaaagcattgctgtt

SEQ ID NO: 337343 - DNA, 20 bp, Artificial
  CRISPR gRNA sequence
ctcggaaagcattgctgttc

SEQ ID NO: 337344 - DNA, 20 bp, Artificial
  CRISPR gRNA sequence
ggaaagcattgctgttcttt

SEQ ID NO: 337345 - DNA, 20 bp, Artificial
  CRISPR gRNA sequence
ctgttctttcaaattcaaac

SEQ ID NO: 337346 - DNA, 20 bp, Artificial
  CRISPR gRNA sequence
ttctttcaaattcaaacttt

SEQ ID NO: 337347 - DNA, 20 bp, Artificial
  CRISPR gRNA sequence
tttcaaattcaaacttttgt

SEQ ID NO: 337348 - DNA, 20 bp, Artificial
  CRISPR gRNA sequence
tcaaattcaaacttttgttt

SEQ ID NO: 337349 - DNA, 20 bp, Artificial
  CRISPR gRNA sequence
caaattcaaacttttgtttt

SEQ ID NO: 337350 - DNA, 20 bp, Artificial
  CRISPR gRNA sequence
aaattcaaacttttgttttt

SEQ ID NO: 337351 - DNA, 20 bp, Artificial
  CRISPR gRNA sequence
aaacttttgtttttatgtct

SEQ ID NO: 337352 - DNA, 20 bp, Artificial
  CRISPR gRNA sequence
ttgtttttatgtctcaactc

SEQ ID NO: 337353 - DNA, 20 bp, Artificial
  CRISPR gRNA sequence
tgtttttatgtctcaactcc

SEQ ID NO: 337354 - DNA, 20 bp, Artificial
  CRISPR gRNA sequence
gtttttatgtctcaactccc

SEQ ID NO: 337355 - DNA, 20 bp, Artificial
  CRISPR gRNA sequence
tttttatgtctcaactccca

SEQ ID NO: 337356 - DNA, 20 bp, Artificial
  CRISPR gRNA sequence
ttatgtctcaactcccagaa

SEQ ID NO: 337357 - DNA, 20 bp, Artificial
  CRISPR gRNA sequence
tatgtctcaactcccagaat

SEQ ID NO: 337358 - DNA, 20 bp, Artificial
  CRISPR gRNA sequence
atgtctcaactcccagaatc

SEQ ID NO: 337359 - DNA, 20 bp, Artificial
  CRISPR gRNA sequence
tgtctcaactcccagaatct

SEQ ID NO: 337360 - DNA, 20 bp, Artificial
  CRISPR gRNA sequence
aactcccagaatctgcagag

SEQ ID NO: 337361 - DNA, 20 bp, Artificial
  CRISPR gRNA sequence
ccagaatctgcagagtgagt

SEQ ID NO: 337362 - DNA, 20 bp, Artificial
  CRISPR gRNA sequence
cagagtgagtgatctagcag

SEQ ID NO: 337363 - DNA, 20 bp, Artificial
  CRISPR gRNA sequence
gcagaaaaccctctccccaa

SEQ ID NO: 337364 - DNA, 20 bp, Artificial
  CRISPR gRNA sequence
tccccaataaattgggaccc

SEQ ID NO: 337365 - DNA, 20 bp, Artificial
  CRISPR gRNA sequence
cccaataaattgggacccca

SEQ ID NO: 337366 - DNA, 20 bp, Artificial
  CRISPR gRNA sequence
ggaccccaaagagttacatt

SEQ ID NO: 337367 - DNA, 20 bp, Artificial
  CRISPR gRNA sequence
cattcttggagcacaggtaa

SEQ ID NO: 337368 - DNA, 20 bp, Artificial
  CRISPR gRNA sequence
ttggagcacaggtaaagaaa

SEQ ID NO: 337369 - DNA, 20 bp, Artificial
  CRISPR gRNA sequence
ggagcacaggtaaagaaata

SEQ ID NO: 337370 - DNA, 20 bp, Artificial
  CRISPR gRNA sequence
gagcacaggtaaagaaataa

SEQ ID NO: 337371 - DNA, 20 bp, Artificial
  CRISPR gRNA sequence
attcagattagatggtccag

SEQ ID NO: 337372 - DNA, 20 bp, Artificial
  CRISPR gRNA sequence
agattagatggtccagaaaa

SEQ ID NO: 337373 - DNA, 20 bp, Artificial
  CRISPR gRNA sequence
gatggtccagaaaaatcttc

SEQ ID NO: 337374 - DNA, 20 bp, Artificial
  CRISPR gRNA sequence
ctggacttcaatggttagaa

SEQ ID NO: 337375 - DNA, 20 bp, Artificial
  CRISPR gRNA sequence
tggacttcaatggttagaaa

SEQ ID NO: 337376 - DNA, 20 bp, Artificial
  CRISPR gRNA sequence
gacttcaatggttagaaaac

SEQ ID NO: 337377 - DNA, 20 bp, Artificial
  CRISPR gRNA sequence
caatggttagaaaacctcaa

SEQ ID NO: 337378 - DNA, 20 bp, Artificial
  CRISPR gRNA sequence
aatggttagaaaacctcaat

SEQ ID NO: 337379 - DNA, 20 bp, Artificial
  CRISPR gRNA sequence
gaaaacctcaatccttgaat

SEQ ID NO: 337380 - DNA, 20 bp, Artificial
  CRISPR gRNA sequence
aatccttgaattttctttaa

SEQ ID NO: 337381 - DNA, 20 bp, Artificial
  CRISPR gRNA sequence
gaattttctttaaggagatt

SEQ ID NO: 337382 - DNA, 20 bp, Artificial
  CRISPR gRNA sequence
aattttctttaaggagattt

SEQ ID NO: 337383 - DNA, 20 bp, Artificial
  CRISPR gRNA sequence
tctttaaggagatttgcatt

SEQ ID NO: 337384 - DNA, 20 bp, Artificial
  CRISPR gRNA sequence
ctttaaggagatttgcatta

SEQ ID NO: 337385 - DNA, 20 bp, Artificial
  CRISPR gRNA sequence
tttaaggagatttgcattat

SEQ ID NO: 337386 - DNA, 20 bp, Artificial
  CRISPR gRNA sequence
taaggagatttgcattatta

SEQ ID NO: 337387 - DNA, 20 bp, Artificial
  CRISPR gRNA sequence
aaggagatttgcattattat

SEQ ID NO: 337388 - DNA, 20 bp, Artificial
  CRISPR gRNA sequence
aggagatttgcattattatt

SEQ ID NO: 337389 - DNA, 20 bp, Artificial
  CRISPR gRNA sequence
gcattattattacccttcag

SEQ ID NO: 337390 - DNA, 20 bp, Artificial
  CRISPR gRNA sequence
cattattattacccttcagc

SEQ ID NO: 337391 - DNA, 20 bp, Artificial
  CRISPR gRNA sequence
ttattacccttcagcttttg

SEQ ID NO: 337392 - DNA, 20 bp, Artificial
  CRISPR gRNA sequence
ttacccttcagcttttgaaa

SEQ ID NO: 337393 - DNA, 20 bp, Artificial
  CRISPR gRNA sequence
cccttcagcttttgaaagta

SEQ ID NO: 337394 - DNA, 20 bp, Artificial
  CRISPR gRNA sequence
cagcttttgaaagtaaaaat

SEQ ID NO: 337395 - DNA, 20 bp, Artificial
  CRISPR gRNA sequence
agcttttgaaagtaaaaatg

SEQ ID NO: 337396 - DNA, 20 bp, Artificial
  CRISPR gRNA sequence
ttgaaagtaaaaatgcaaac

SEQ ID NO: 337397 - DNA, 20 bp, Artificial
  CRISPR gRNA sequence
tgaaagtaaaaatgcaaact

SEQ ID NO: 337398 - DNA, 20 bp, Artificial
  CRISPR gRNA sequence
gaaagtaaaaatgcaaacta

SEQ ID NO: 337399 - DNA, 20 bp, Artificial
  CRISPR gRNA sequence
aaagtaaaaatgcaaactat

SEQ ID NO: 337400 - DNA, 20 bp, Artificial
  CRISPR gRNA sequence
ttacaagaagaaaaggttta

SEQ ID NO: 337401 - DNA, 20 bp, Artificial
  CRISPR gRNA sequence
caagaagaaaaggtttacat

SEQ ID NO: 337402 - DNA, 20 bp, Artificial
  CRISPR gRNA sequence
acatcctaggcctcaaaaaa

SEQ ID NO: 337403 - DNA, 20 bp, Artificial
  CRISPR gRNA sequence
catcctaggcctcaaaaaat

SEQ ID NO: 337404 - DNA, 20 bp, Artificial
  CRISPR gRNA sequence
ggcctcaaaaaatttcatac

SEQ ID NO: 337405 - DNA, 20 bp, Artificial
  CRISPR gRNA sequence
aaaaaatttcatacaaataa

SEQ ID NO: 337406 - DNA, 20 bp, Artificial
  CRISPR gRNA sequence
catacaaataatattcacat

SEQ ID NO: 337407 - DNA, 20 bp, Artificial
  CRISPR gRNA sequence
atacaaataatattcacatt

SEQ ID NO: 337408 - DNA, 20 bp, Artificial
  CRISPR gRNA sequence
acattcaatggcaaacacat

SEQ ID NO: 337409 - DNA, 20 bp, Artificial
  CRISPR gRNA sequence
aatggcaaacacatcacaaa

SEQ ID NO: 337410 - DNA, 20 bp, Artificial
  CRISPR gRNA sequence
caaaaacaaactcatgattt

SEQ ID NO: 337411 - DNA, 20 bp, Artificial
  CRISPR gRNA sequence
atgatttatatacctgaatt

SEQ ID NO: 337412 - DNA, 20 bp, Artificial
  CRISPR gRNA sequence
atatacctgaattatcaggt

SEQ ID NO: 337413 - DNA, 20 bp, Artificial
  CRISPR gRNA sequence
tatacctgaattatcaggtc

SEQ ID NO: 337414 - DNA, 20 bp, Artificial
  CRISPR gRNA sequence
aattatcaggtccccaaaat

SEQ ID NO: 337415 - DNA, 20 bp, Artificial
  CRISPR gRNA sequence
tcaggtccccaaaataaagt

SEQ ID NO: 337416 - DNA, 20 bp, Artificial
  CRISPR gRNA sequence
agcttattatgtttaagcaa

SEQ ID NO: 337417 - DNA, 20 bp, Artificial
  CRISPR gRNA sequence
attatgtttaagcaaataag

SEQ ID NO: 337418 - DNA, 20 bp, Artificial
  CRISPR gRNA sequence
ttatgtttaagcaaataaga

SEQ ID NO: 337419 - DNA, 20 bp, Artificial
  CRISPR gRNA sequence
tgtttaagcaaataagagaa

SEQ ID NO: 337420 - DNA, 20 bp, Artificial
  CRISPR gRNA sequence
aagcaaataagagaaaaact

SEQ ID NO: 337421 - DNA, 20 bp, Artificial
  CRISPR gRNA sequence
agcaaataagagaaaaactt

SEQ ID NO: 337422 - DNA, 20 bp, Artificial
  CRISPR gRNA sequence
gtaataatatctgtagtaca

SEQ ID NO: 337423 - DNA, 20 bp, Artificial
  CRISPR gRNA sequence
taataatatctgtagtacac

SEQ ID NO: 337424 - DNA, 20 bp, Artificial
  CRISPR gRNA sequence
tagtacacaggaaaatttaa

SEQ ID NO: 337425 - DNA, 20 bp, Artificial
  CRISPR gRNA sequence
aagtcaactaatttgaaaaa

SEQ ID NO: 337426 - DNA, 20 bp, Artificial
  CRISPR gRNA sequence
agtcaactaatttgaaaaag

SEQ ID NO: 337427 - DNA, 20 bp, Artificial
  CRISPR gRNA sequence
atttgaaaaagaacctacaa

SEQ ID NO: 337428 - DNA, 20 bp, Artificial
  CRISPR gRNA sequence
gaaaaagaacctacaagaat

SEQ ID NO: 337429 - DNA, 20 bp, Artificial
  CRISPR gRNA sequence
aaaaagaacctacaagaatc

SEQ ID NO: 337430 - DNA, 20 bp, Artificial
  CRISPR gRNA sequence
caagaatcggccaaaaaaat

SEQ ID NO: 337431 - DNA, 20 bp, Artificial
  CRISPR gRNA sequence
agatttaaaactcaatagat

SEQ ID NO: 337432 - DNA, 20 bp, Artificial
  CRISPR gRNA sequence
aaaactcaatagataagttt

SEQ ID NO: 337433 - DNA, 20 bp, Artificial
  CRISPR gRNA sequence
aaactcaatagataagttta

SEQ ID NO: 337434 - DNA, 20 bp, Artificial
  CRISPR gRNA sequence
aatagataagtttaatatat

SEQ ID NO: 337435 - DNA, 20 bp, Artificial
  CRISPR gRNA sequence
aatatatattagacagagtt

SEQ ID NO: 337436 - DNA, 20 bp, Artificial
  CRISPR gRNA sequence
atatatattagacagagtta

SEQ ID NO: 337437 - DNA, 20 bp, Artificial
  CRISPR gRNA sequence
gacagagttaaagagaaaat

SEQ ID NO: 337438 - DNA, 20 bp, Artificial
  CRISPR gRNA sequence
aagagaaaattggtgaacca

SEQ ID NO: 337439 - DNA, 20 bp, Artificial
  CRISPR gRNA sequence
gtgaaccagcagataggttg

SEQ ID NO: 337440 - DNA, 20 bp, Artificial
  CRISPR gRNA sequence
gaaaaattagttagaaccca

SEQ ID NO: 337441 - DNA, 20 bp, Artificial
  CRISPR gRNA sequence
gttagaacccagtcacactc

SEQ ID NO: 337442 - DNA, 20 bp, Artificial
  CRISPR gRNA sequence
gaacccagtcacactccaca

SEQ ID NO: 337443 - DNA, 20 bp, Artificial
  CRISPR gRNA sequence
cacagattcaagaatcccaa

SEQ ID NO: 337444 - DNA, 20 bp, Artificial
  CRISPR gRNA sequence
aagaatcccaacaattcaca

SEQ ID NO: 337445 - DNA, 20 bp, Artificial
  CRISPR gRNA sequence
acaagcatattttttaaaag

SEQ ID NO: 337446 - DNA, 20 bp, Artificial
  CRISPR gRNA sequence
tttaaaagtatgcacaccta

SEQ ID NO: 337447 - DNA, 20 bp, Artificial
  CRISPR gRNA sequence
ttaaaagtatgcacacctag

SEQ ID NO: 337448 - DNA, 20 bp, Artificial
  CRISPR gRNA sequence
taaaagtatgcacacctaga

SEQ ID NO: 337449 - DNA, 20 bp, Artificial
  CRISPR gRNA sequence
aaaagtatgcacacctagat

SEQ ID NO: 337450 - DNA, 20 bp, Artificial
  CRISPR gRNA sequence
aaagtatgcacacctagatg

SEQ ID NO: 337451 - DNA, 20 bp, Artificial
  CRISPR gRNA sequence
gatgtatcttagtgaaaatc

SEQ ID NO: 337452 - DNA, 20 bp, Artificial
  CRISPR gRNA sequence
agtgaaaatcctaaaagcag

SEQ ID NO: 337453 - DNA, 20 bp, Artificial
  CRISPR gRNA sequence
gtgaaaatcctaaaagcagc

SEQ ID NO: 337454 - DNA, 20 bp, Artificial
  CRISPR gRNA sequence
aaagcagccagagaaaagag

SEQ ID NO: 337455 - DNA, 20 bp, Artificial
  CRISPR gRNA sequence
attaccttccaaggagcaac

SEQ ID NO: 337456 - DNA, 20 bp, Artificial
  CRISPR gRNA sequence
ccttccaaggagcaactatt

SEQ ID NO: 337457 - DNA, 20 bp, Artificial
  CRISPR gRNA sequence
ccaaggagcaactattagac

SEQ ID NO: 337458 - DNA, 20 bp, Artificial
  CRISPR gRNA sequence
caaggagcaactattagact

SEQ ID NO: 337459 - DNA, 20 bp, Artificial
  CRISPR gRNA sequence
ttagactgtttcaacatcaa

SEQ ID NO: 337460 - DNA, 20 bp, Artificial
  CRISPR gRNA sequence
gactgtttcaacatcaacaa

SEQ ID NO: 337461 - DNA, 20 bp, Artificial
  CRISPR gRNA sequence
tttcaacatcaacaataaaa

SEQ ID NO: 337462 - DNA, 20 bp, Artificial
  CRISPR gRNA sequence
caacatcaacaataaaagcc

SEQ ID NO: 337463 - DNA, 20 bp, Artificial
  CRISPR gRNA sequence
aacatcaacaataaaagccc

SEQ ID NO: 337464 - DNA, 20 bp, Artificial
  CRISPR gRNA sequence
atacagtggaattataacat

SEQ ID NO: 337465 - DNA, 20 bp, Artificial
  CRISPR gRNA sequence
taacatatacctccaatgtg

SEQ ID NO: 337466 - DNA, 20 bp, Artificial
  CRISPR gRNA sequence
caatgtgctaaaagaaacat

SEQ ID NO: 337467 - DNA, 20 bp, Artificial
  CRISPR gRNA sequence
aaagaaacatctgtcaatat

SEQ ID NO: 337468 - DNA, 20 bp, Artificial
  CRISPR gRNA sequence
tcaatatagagcacattgtc

SEQ ID NO: 337469 - DNA, 20 bp, Artificial
  CRISPR gRNA sequence
tctagaaagatagtgaaggt

SEQ ID NO: 337470 - DNA, 20 bp, Artificial
  CRISPR gRNA sequence
gaaagatagtgaaggtatat

SEQ ID NO: 337471 - DNA, 20 bp, Artificial
  CRISPR gRNA sequence
gaaacttttctaagtgaagt

SEQ ID NO: 337472 - DNA, 20 bp, Artificial
  CRISPR gRNA sequence
aaacttttctaagtgaagta

SEQ ID NO: 337473 - DNA, 20 bp, Artificial
  CRISPR gRNA sequence
ttctaagtgaagtatacatg

SEQ ID NO: 337474 - DNA, 20 bp, Artificial
  CRISPR gRNA sequence
tctaagtgaagtatacatgt

SEQ ID NO: 337475 - DNA, 20 bp, Artificial
  CRISPR gRNA sequence
ctaagtgaagtatacatgtt

SEQ ID NO: 337476 - DNA, 20 bp, Artificial
  CRISPR gRNA sequence
taagtgaagtatacatgttt

SEQ ID NO: 337477 - DNA, 20 bp, Artificial
  CRISPR gRNA sequence
agtgaagtatacatgttttg

SEQ ID NO: 337478 - DNA, 20 bp, Artificial
  CRISPR gRNA sequence
tgatttcttccataattact

SEQ ID NO: 337479 - DNA, 20 bp, Artificial
  CRISPR gRNA sequence
gatttcttccataattacta

SEQ ID NO: 337480 - DNA, 20 bp, Artificial
  CRISPR gRNA sequence
atttcttccataattactaa

SEQ ID NO: 337481 - DNA, 20 bp, Artificial
  CRISPR gRNA sequence
cttccataattactaaaaaa

SEQ ID NO: 337482 - DNA, 20 bp, Artificial
  CRISPR gRNA sequence
ttccataattactaaaaaat

SEQ ID NO: 337483 - DNA, 20 bp, Artificial
  CRISPR gRNA sequence
ccataattactaaaaaatag

SEQ ID NO: 337484 - DNA, 20 bp, Artificial
  CRISPR gRNA sequence
cataattactaaaaaataga

SEQ ID NO: 337485 - DNA, 20 bp, Artificial
  CRISPR gRNA sequence
ctaaaaaatagaaatagtta

SEQ ID NO: 337486 - DNA, 20 bp, Artificial
  CRISPR gRNA sequence
aaaaatagaaatagttaata

SEQ ID NO: 337487 - DNA, 20 bp, Artificial
  CRISPR gRNA sequence
atataatctgaattagtatc

SEQ ID NO: 337488 - DNA, 20 bp, Artificial
  CRISPR gRNA sequence
aattagtatcacaaaattca

SEQ ID NO: 337489 - DNA, 20 bp, Artificial
  CRISPR gRNA sequence
gtatcacaaaattcagccta

SEQ ID NO: 337490 - DNA, 20 bp, Artificial
  CRISPR gRNA sequence
agcctaatggttttgtctaa

SEQ ID NO: 337491 - DNA, 20 bp, Artificial
  CRISPR gRNA sequence
atggttttgtctaaagaggg

SEQ ID NO: 337492 - DNA, 20 bp, Artificial
  CRISPR gRNA sequence
tgtctaaagagggagaaaga

SEQ ID NO: 337493 - DNA, 20 bp, Artificial
  CRISPR gRNA sequence
gtctaaagagggagaaagag

SEQ ID NO: 337494 - DNA, 20 bp, Artificial
  CRISPR gRNA sequence
tctaaagagggagaaagagt

SEQ ID NO: 337495 - DNA, 20 bp, Artificial
  CRISPR gRNA sequence
aagagggagaaagagttgga

SEQ ID NO: 337496 - DNA, 20 bp, Artificial
  CRISPR gRNA sequence
gaatcagaaggaaatagggg

SEQ ID NO: 337497 - DNA, 20 bp, Artificial
  CRISPR gRNA sequence
acagtcttgtatttcttgac

SEQ ID NO: 337498 - DNA, 20 bp, Artificial
  CRISPR gRNA sequence
gtatttcttgacctgtggtg

SEQ ID NO: 337499 - DNA, 20 bp, Artificial
  CRISPR gRNA sequence
tatttcttgacctgtggtga

SEQ ID NO: 337500 - DNA, 20 bp, Artificial
  CRISPR gRNA sequence
cttgacctgtggtgattatg

SEQ ID NO: 337501 - DNA, 20 bp, Artificial
  CRISPR gRNA sequence
ttgacctgtggtgattatga

SEQ ID NO: 337502 - DNA, 20 bp, Artificial
  CRISPR gRNA sequence
gacctgtggtgattatgagg

SEQ ID NO: 337503 - DNA, 20 bp, Artificial
  CRISPR gRNA sequence
acctgtggtgattatgaggg

SEQ ID NO: 337504 - DNA, 20 bp, Artificial
  CRISPR gRNA sequence
tggtgattatgagggtaaga

SEQ ID NO: 337505 - DNA, 20 bp, Artificial
  CRISPR gRNA sequence
tgagggtaagatagtatgct

SEQ ID NO: 337506 - DNA, 20 bp, Artificial
  CRISPR gRNA sequence
tagcattattcattaaatta

SEQ ID NO: 337507 - DNA, 20 bp, Artificial
  CRISPR gRNA sequence
agcattattcattaaattat

SEQ ID NO: 337508 - DNA, 20 bp, Artificial
  CRISPR gRNA sequence
gcattattcattaaattata

SEQ ID NO: 337509 - DNA, 20 bp, Artificial
  CRISPR gRNA sequence
ttcattaaattatacatttt

SEQ ID NO: 337510 - DNA, 20 bp, Artificial
  CRISPR gRNA sequence
attaaattatacattttttt

SEQ ID NO: 337511 - DNA, 20 bp, Artificial
  CRISPR gRNA sequence
aattatacatttttttcact

SEQ ID NO: 337512 - DNA, 20 bp, Artificial
  CRISPR gRNA sequence
tacatttttttcacttttct

SEQ ID NO: 337513 - DNA, 20 bp, Artificial
  CRISPR gRNA sequence
ttttcacttttctatatgta

SEQ ID NO: 337514 - DNA, 20 bp, Artificial
  CRISPR gRNA sequence
tttcacttttctatatgtat

SEQ ID NO: 337515 - DNA, 20 bp, Artificial
  CRISPR gRNA sequence
ttcacttttctatatgtatg

SEQ ID NO: 337516 - DNA, 20 bp, Artificial
  CRISPR gRNA sequence
tcacttttctatatgtatgt

SEQ ID NO: 337517 - DNA, 20 bp, Artificial
  CRISPR gRNA sequence
cacttttctatatgtatgtt

SEQ ID NO: 337518 - DNA, 20 bp, Artificial
  CRISPR gRNA sequence
acttttctatatgtatgttt

SEQ ID NO: 337519 - DNA, 20 bp, Artificial
  CRISPR gRNA sequence
ttctatatgtatgttttgtt

SEQ ID NO: 337520 - DNA, 20 bp, Artificial
  CRISPR gRNA sequence
tctatatgtatgttttgttt

SEQ ID NO: 337521 - DNA, 20 bp, Artificial
  CRISPR gRNA sequence
ctatatgtatgttttgtttt

SEQ ID NO: 337522 - DNA, 20 bp, Artificial
  CRISPR gRNA sequence
tatatgtatgttttgtttta

SEQ ID NO: 337523 - DNA, 20 bp, Artificial
  CRISPR gRNA sequence
tatgtatgttttgttttata

SEQ ID NO: 337524 - DNA, 20 bp, Artificial
  CRISPR gRNA sequence
tgttttataataacaagtat

SEQ ID NO: 337525 - DNA, 20 bp, Artificial
  CRISPR gRNA sequence
gttttataataacaagtatg

SEQ ID NO: 337526 - DNA, 20 bp, Artificial
  CRISPR gRNA sequence
ttttataataacaagtatgt

SEQ ID NO: 337527 - DNA, 20 bp, Artificial
  CRISPR gRNA sequence
tataataacaagtatgttta

SEQ ID NO: 337528 - DNA, 20 bp, Artificial
  CRISPR gRNA sequence
ataataacaagtatgtttaa

SEQ ID NO: 337529 - DNA, 20 bp, Artificial
  CRISPR gRNA sequence
taataacaagtatgtttaaa

SEQ ID NO: 337530 - DNA, 20 bp, Artificial
  CRISPR gRNA sequence
aaaagcatacagaaggaaaa

SEQ ID NO: 337531 - DNA, 20 bp, Artificial
  CRISPR gRNA sequence
aaagcatacagaaggaaaat

SEQ ID NO: 337532 - DNA, 20 bp, Artificial
  CRISPR gRNA sequence
gcttcgttttaaaaactgga

SEQ ID NO: 337533 - DNA, 20 bp, Artificial
  CRISPR gRNA sequence
cttcgttttaaaaactggaa

SEQ ID NO: 337534 - DNA, 20 bp, Artificial
  CRISPR gRNA sequence
cgttttaaaaactggaagga

SEQ ID NO: 337535 - DNA, 20 bp, Artificial
  CRISPR gRNA sequence
gttttaaaaactggaaggaa

SEQ ID NO: 337536 - DNA, 20 bp, Artificial
  CRISPR gRNA sequence
taaaaactggaaggaacaat

SEQ ID NO: 337537 - DNA, 20 bp, Artificial
  CRISPR gRNA sequence
aaaaactggaaggaacaata

SEQ ID NO: 337538 - DNA, 20 bp, Artificial
  CRISPR gRNA sequence
aaaactggaaggaacaatat

SEQ ID NO: 337539 - DNA, 20 bp, Artificial
  CRISPR gRNA sequence
gaaggaacaatattatccag

SEQ ID NO: 337540 - DNA, 20 bp, Artificial
  CRISPR gRNA sequence
tccagaggcaaagaaaaaaa

SEQ ID NO: 337541 - DNA, 20 bp, Artificial
  CRISPR gRNA sequence
ttggcatgagaacaggtgca

SEQ ID NO: 337542 - DNA, 20 bp, Artificial
  CRISPR gRNA sequence
gcatgagaacaggtgcagtc

SEQ ID NO: 337543 - DNA, 20 bp, Artificial
  CRISPR gRNA sequence
cattagattaaaacgtaggg

SEQ ID NO: 337544 - DNA, 20 bp, Artificial
  CRISPR gRNA sequence
gattaaaacgtagggtattt

SEQ ID NO: 337545 - DNA, 20 bp, Artificial
  CRISPR gRNA sequence
aaacgtagggtattttgctt

SEQ ID NO: 337546 - DNA, 20 bp, Artificial
  CRISPR gRNA sequence
tgcttggggctttatttgtc

SEQ ID NO: 337547 - DNA, 20 bp, Artificial
  CRISPR gRNA sequence
gcttggggctttatttgtct

SEQ ID NO: 337548 - DNA, 20 bp, Artificial
  CRISPR gRNA sequence
cttggggctttatttgtctg

SEQ ID NO: 337549 - DNA, 20 bp, Artificial
  CRISPR gRNA sequence
ggggctttatttgtctgaca

SEQ ID NO: 337550 - DNA, 20 bp, Artificial
  CRISPR gRNA sequence
gggctttatttgtctgacag

SEQ ID NO: 337551 - DNA, 20 bp, Artificial
  CRISPR gRNA sequence
tatttgtctgacagtaaaat

SEQ ID NO: 337552 - DNA, 20 bp, Artificial
  CRISPR gRNA sequence
atttgtctgacagtaaaata

SEQ ID NO: 337553 - DNA, 20 bp, Artificial
  CRISPR gRNA sequence
tttgtctgacagtaaaatat

SEQ ID NO: 337554 - DNA, 20 bp, Artificial
  CRISPR gRNA sequence
gtctgacagtaaaatatgtt

SEQ ID NO: 337555 - DNA, 20 bp, Artificial
  CRISPR gRNA sequence
tctgacagtaaaatatgttg

SEQ ID NO: 337556 - DNA, 20 bp, Artificial
  CRISPR gRNA sequence
acagtaaaatatgttgcccc

SEQ ID NO: 337557 - DNA, 20 bp, Artificial
  CRISPR gRNA sequence
ccccactgttgctttgatgc

SEQ ID NO: 337558 - DNA, 20 bp, Artificial
  CRISPR gRNA sequence
ttgctttgatgcgtatgtct

SEQ ID NO: 337559 - DNA, 20 bp, Artificial
  CRISPR gRNA sequence
ctttgatgcgtatgtctcta

SEQ ID NO: 337560 - DNA, 20 bp, Artificial
  CRISPR gRNA sequence
tgatgcgtatgtctctaccg

SEQ ID NO: 337561 - DNA, 20 bp, Artificial
  CRISPR gRNA sequence
gatgcgtatgtctctaccgt

SEQ ID NO: 337562 - DNA, 20 bp, Artificial
  CRISPR gRNA sequence
atgcgtatgtctctaccgtc

SEQ ID NO: 337563 - DNA, 20 bp, Artificial
  CRISPR gRNA sequence
taccgtctgctgcagaagat

SEQ ID NO: 337564 - DNA, 20 bp, Artificial
  CRISPR gRNA sequence
ccgtctgctgcagaagataa

SEQ ID NO: 337565 - DNA, 20 bp, Artificial
  CRISPR gRNA sequence
ctgcagaagataaaatcagt

SEQ ID NO: 337566 - DNA, 20 bp, Artificial
  CRISPR gRNA sequence
cagaagataaaatcagtgga

SEQ ID NO: 337567 - DNA, 20 bp, Artificial
  CRISPR gRNA sequence
tcagttcctttagaaatgtt

SEQ ID NO: 337568 - DNA, 20 bp, Artificial
  CRISPR gRNA sequence
agttcctttagaaatgttca

SEQ ID NO: 337569 - DNA, 20 bp, Artificial
  CRISPR gRNA sequence
ctttagaaatgttcacaaaa

SEQ ID NO: 337570 - DNA, 20 bp, Artificial
  CRISPR gRNA sequence
tagaaatgttcacaaaaaat

SEQ ID NO: 337571 - DNA, 20 bp, Artificial
  CRISPR gRNA sequence
agaaatgttcacaaaaaatt

SEQ ID NO: 337572 - DNA, 20 bp, Artificial
  CRISPR gRNA sequence
gaaatgttcacaaaaaattt

SEQ ID NO: 337573 - DNA, 20 bp, Artificial
  CRISPR gRNA sequence
acaaaaaatttcccagagac

SEQ ID NO: 337574 - DNA, 20 bp, Artificial
  CRISPR gRNA sequence
cccagagactttagaatggc

SEQ ID NO: 337575 - DNA, 20 bp, Artificial
  CRISPR gRNA sequence
ccagagactttagaatggca

SEQ ID NO: 337576 - DNA, 20 bp, Artificial
  CRISPR gRNA sequence
tagaatggcagcaagtaaac

SEQ ID NO: 337577 - DNA, 20 bp, Artificial
  CRISPR gRNA sequence
agaatggcagcaagtaaacc

SEQ ID NO: 337578 - DNA, 20 bp, Artificial
  CRISPR gRNA sequence
gaatggcagcaagtaaacca

SEQ ID NO: 337579 - DNA, 20 bp, Artificial
  CRISPR gRNA sequence
ggagccaaagcgtctgtggt

SEQ ID NO: 337580 - DNA, 20 bp, Artificial
  CRISPR gRNA sequence
gagccaaagcgtctgtggtc

SEQ ID NO: 337581 - DNA, 20 bp, Artificial
  CRISPR gRNA sequence
tggtcaccatgtatacacag

SEQ ID NO: 337582 - DNA, 20 bp, Artificial
  CRISPR gRNA sequence
tcttctacttccgaagatga

SEQ ID NO: 337583 - DNA, 20 bp, Artificial
  CRISPR gRNA sequence
ctacttccgaagatgatttt

SEQ ID NO: 337584 - DNA, 20 bp, Artificial
  CRISPR gRNA sequence
tacttccgaagatgattttc

SEQ ID NO: 337585 - DNA, 20 bp, Artificial
  CRISPR gRNA sequence
cttccgaagatgattttctc

SEQ ID NO: 337586 - DNA, 20 bp, Artificial
  CRISPR gRNA sequence
ccgaagatgattttctcagc

SEQ ID NO: 337587 - DNA, 20 bp, Artificial
  CRISPR gRNA sequence
cgaagatgattttctcagca

SEQ ID NO: 337588 - DNA, 20 bp, Artificial
  CRISPR gRNA sequence
tctcagcagatttttccccc

SEQ ID NO: 337589 - DNA, 20 bp, Artificial
  CRISPR gRNA sequence
ctcagcagatttttccccca

SEQ ID NO: 337590 - DNA, 20 bp, Artificial
  CRISPR gRNA sequence
tcagcagatttttcccccat

SEQ ID NO: 337591 - DNA, 20 bp, Artificial
  CRISPR gRNA sequence
agcagatttttcccccattg

SEQ ID NO: 337592 - DNA, 20 bp, Artificial
  CRISPR gRNA sequence
ttcccccattgtgcccgcac

SEQ ID NO: 337593 - DNA, 20 bp, Artificial
  CRISPR gRNA sequence
tcccccattgtgcccgcact

SEQ ID NO: 337594 - DNA, 20 bp, Artificial
  CRISPR gRNA sequence
cccccattgtgcccgcactg

SEQ ID NO: 337595 - DNA, 20 bp, Artificial
  CRISPR gRNA sequence
ccccattgtgcccgcactgt

SEQ ID NO: 337596 - DNA, 20 bp, Artificial
  CRISPR gRNA sequence
tgcccgcactgtggcaaaca

SEQ ID NO: 337597 - DNA, 20 bp, Artificial
  CRISPR gRNA sequence
tggcaaacacaagaggacat

SEQ ID NO: 337598 - DNA, 20 bp, Artificial
  CRISPR gRNA sequence
gcggtgcagtgtggtggaag

SEQ ID NO: 337599 - DNA, 20 bp, Artificial
  CRISPR gRNA sequence
cagtggatcccaaggaaacc

SEQ ID NO: 337600 - DNA, 20 bp, Artificial
  CRISPR gRNA sequence
tggctctgccactagcaagg

SEQ ID NO: 337601 - DNA, 20 bp, Artificial
  CRISPR gRNA sequence
gctctgccactagcaaggct

SEQ ID NO: 337602 - DNA, 20 bp, Artificial
  CRISPR gRNA sequence
tgccactagcaaggctctgt

SEQ ID NO: 337603 - DNA, 20 bp, Artificial
  CRISPR gRNA sequence
ccactagcaaggctctgtgg

SEQ ID NO: 337604 - DNA, 20 bp, Artificial
  CRISPR gRNA sequence
gcaaggctctgtggctaggg

SEQ ID NO: 337605 - DNA, 20 bp, Artificial
  CRISPR gRNA sequence
tgtggctagggtacccctgt

SEQ ID NO: 337606 - DNA, 20 bp, Artificial
  CRISPR gRNA sequence
tggctagggtacccctgtgg

SEQ ID NO: 337607 - DNA, 20 bp, Artificial
  CRISPR gRNA sequence
gggtacccctgtggaattca

SEQ ID NO: 337608 - DNA, 20 bp, Artificial
  CRISPR gRNA sequence
tggaattcagcctcctcatc

SEQ ID NO: 337609 - DNA, 20 bp, Artificial
  CRISPR gRNA sequence
agcctcctcatccgtgaaat

SEQ ID NO: 337610 - DNA, 20 bp, Artificial
  CRISPR gRNA sequence
ctcatccgtgaaatgaagaa

SEQ ID NO: 337611 - DNA, 20 bp, Artificial
  CRISPR gRNA sequence
atccgtgaaatgaagaagtg

SEQ ID NO: 337612 - DNA, 20 bp, Artificial
  CRISPR gRNA sequence
aatgttatttctaacacctg

SEQ ID NO: 337613 - DNA, 20 bp, Artificial
  CRISPR gRNA sequence
atgttatttctaacacctgc

SEQ ID NO: 337614 - DNA, 20 bp, Artificial
  CRISPR gRNA sequence
tttctaacacctgctttctc

SEQ ID NO: 337615 - DNA, 20 bp, Artificial
  CRISPR gRNA sequence
ctaacacctgctttctctgg

SEQ ID NO: 337616 - DNA, 20 bp, Artificial
  CRISPR gRNA sequence
taacacctgctttctctgga

SEQ ID NO: 337617 - DNA, 20 bp, Artificial
  CRISPR gRNA sequence
acacctgctttctctggatt

SEQ ID NO: 337618 - DNA, 20 bp, Artificial
  CRISPR gRNA sequence
ctttctctggattcagcatc

SEQ ID NO: 337619 - DNA, 20 bp, Artificial
  CRISPR gRNA sequence
tctctggattcagcatcaga

SEQ ID NO: 337620 - DNA, 20 bp, Artificial
  CRISPR gRNA sequence
ctctggattcagcatcagaa

SEQ ID NO: 337621 - DNA, 20 bp, Artificial
  CRISPR gRNA sequence
tctggattcagcatcagaat

SEQ ID NO: 337622 - DNA, 20 bp, Artificial
  CRISPR gRNA sequence
tggattcagcatcagaatat

SEQ ID NO: 337623 - DNA, 20 bp, Artificial
  CRISPR gRNA sequence
gattcagcatcagaatatat

SEQ ID NO: 337624 - DNA, 20 bp, Artificial
  CRISPR gRNA sequence
agcatcagaatatatccaga

SEQ ID NO: 337625 - DNA, 20 bp, Artificial
  CRISPR gRNA sequence
caaacaactgagagagctaa

SEQ ID NO: 337626 - DNA, 20 bp, Artificial
  CRISPR gRNA sequence
agagagctaattctttgctg

SEQ ID NO: 337627 - DNA, 20 bp, Artificial
  CRISPR gRNA sequence
attctttgctgttgggtaag

SEQ ID NO: 337628 - DNA, 20 bp, Artificial
  CRISPR gRNA sequence
tttgctgttgggtaagtctt

SEQ ID NO: 337629 - DNA, 20 bp, Artificial
  CRISPR gRNA sequence
tgctgttgggtaagtcttcc

SEQ ID NO: 337630 - DNA, 20 bp, Artificial
  CRISPR gRNA sequence
gctgttgggtaagtcttcca

SEQ ID NO: 337631 - DNA, 20 bp, Artificial
  CRISPR gRNA sequence
ctgttgggtaagtcttccaa

SEQ ID NO: 337632 - DNA, 20 bp, Artificial
  CRISPR gRNA sequence
ttgggtaagtcttccaaagg

SEQ ID NO: 337633 - DNA, 20 bp, Artificial
  CRISPR gRNA sequence
ggtaagtcttccaaagggaa

SEQ ID NO: 337634 - DNA, 20 bp, Artificial
  CRISPR gRNA sequence
ccaaagggaaaacaatgttc

SEQ ID NO: 337635 - DNA, 20 bp, Artificial
  CRISPR gRNA sequence
caaagggaaaacaatgttcc

SEQ ID NO: 337636 - DNA, 20 bp, Artificial
  CRISPR gRNA sequence
ctgttaaccactttctgtct

SEQ ID NO: 337637 - DNA, 20 bp, Artificial
  CRISPR gRNA sequence
ttaaccactttctgtctcaa

SEQ ID NO: 337638 - DNA, 20 bp, Artificial
  CRISPR gRNA sequence
accactttctgtctcaatat

SEQ ID NO: 337639 - DNA, 20 bp, Artificial
  CRISPR gRNA sequence
tctgtctcaatatcataatg

SEQ ID NO: 337640 - DNA, 20 bp, Artificial
  CRISPR gRNA sequence
ctgtctcaatatcataatgg

SEQ ID NO: 337641 - DNA, 20 bp, Artificial
  CRISPR gRNA sequence
tgtctcaatatcataatggg

SEQ ID NO: 337642 - DNA, 20 bp, Artificial
  CRISPR gRNA sequence
tctcaatatcataatgggct

SEQ ID NO: 337643 - DNA, 20 bp, Artificial
  CRISPR gRNA sequence
aatatcataatgggctattc

SEQ ID NO: 337644 - DNA, 20 bp, Artificial
  CRISPR gRNA sequence
ttccagaaagtcagaataaa

SEQ ID NO: 337645 - DNA, 20 bp, Artificial
  CRISPR gRNA sequence
cagaaagtcagaataaatta

SEQ ID NO: 337646 - DNA, 20 bp, Artificial
  CRISPR gRNA sequence
aaataaaggagactgtcttt

SEQ ID NO: 337647 - DNA, 20 bp, Artificial
  CRISPR gRNA sequence
tctttcttgcccacaaaagt

SEQ ID NO: 337648 - DNA, 20 bp, Artificial
  CRISPR gRNA sequence
tcttgcccacaaaagtattt

SEQ ID NO: 337649 - DNA, 20 bp, Artificial
  CRISPR gRNA sequence
cttgcccacaaaagtattta

SEQ ID NO: 337650 - DNA, 20 bp, Artificial
  CRISPR gRNA sequence
ttgcccacaaaagtatttag

SEQ ID NO: 337651 - DNA, 20 bp, Artificial
  CRISPR gRNA sequence
gcccacaaaagtatttaggt

SEQ ID NO: 337652 - DNA, 20 bp, Artificial
  CRISPR gRNA sequence
cccacaaaagtatttaggta

SEQ ID NO: 337653 - DNA, 20 bp, Artificial
  CRISPR gRNA sequence
aggtaggaccaggaatgccg

SEQ ID NO: 337654 - DNA, 20 bp, Artificial
  CRISPR gRNA sequence
ggtaggaccaggaatgccgt

SEQ ID NO: 337655 - DNA, 20 bp, Artificial
  CRISPR gRNA sequence
aatttttcttgaatggcatg

SEQ ID NO: 337656 - DNA, 20 bp, Artificial
  CRISPR gRNA sequence
ttcttgaatggcatgttgag

SEQ ID NO: 337657 - DNA, 20 bp, Artificial
  CRISPR gRNA sequence
tcttgaatggcatgttgaga

SEQ ID NO: 337658 - DNA, 20 bp, Artificial
  CRISPR gRNA sequence
cttgaatggcatgttgagag

SEQ ID NO: 337659 - DNA, 20 bp, Artificial
  CRISPR gRNA sequence
ttgaatggcatgttgagagt

SEQ ID NO: 337660 - DNA, 20 bp, Artificial
  CRISPR gRNA sequence
gaatggcatgttgagagtgt

SEQ ID NO: 337661 - DNA, 20 bp, Artificial
  CRISPR gRNA sequence
aatggcatgttgagagtgtg

SEQ ID NO: 337662 - DNA, 20 bp, Artificial
  CRISPR gRNA sequence
agagtgtgtgccactgacat

SEQ ID NO: 337663 - DNA, 20 bp, Artificial
  CRISPR gRNA sequence
acatcagctgaagatttcag

SEQ ID NO: 337664 - DNA, 20 bp, Artificial
  CRISPR gRNA sequence
aagatttcagagtgtcattt

SEQ ID NO: 337665 - DNA, 20 bp, Artificial
  CRISPR gRNA sequence
cagagtgtcatttctattgg

SEQ ID NO: 337666 - DNA, 20 bp, Artificial
  CRISPR gRNA sequence
agagtgtcatttctattgga

SEQ ID NO: 337667 - DNA, 20 bp, Artificial
  CRISPR gRNA sequence
ctattggacactcttttttt

SEQ ID NO: 337668 - DNA, 20 bp, Artificial
  CRISPR gRNA sequence
tattggacactctttttttt

SEQ ID NO: 337669 - DNA, 20 bp, Artificial
  CRISPR gRNA sequence
ttggacactctttttttttt

SEQ ID NO: 337670 - DNA, 20 bp, Artificial
  CRISPR gRNA sequence
gacactcttttttttttttt

SEQ ID NO: 337671 - DNA, 20 bp, Artificial
  CRISPR gRNA sequence
ttttttttttttttgagatg

SEQ ID NO: 337672 - DNA, 20 bp, Artificial
  CRISPR gRNA sequence
ttttttttttttgagatgga

SEQ ID NO: 337673 - DNA, 20 bp, Artificial
  CRISPR gRNA sequence
tttttttttttgagatggag

SEQ ID NO: 337674 - DNA, 20 bp, Artificial
  CRISPR gRNA sequence
ttttttttttgagatggagt

SEQ ID NO: 337675 - DNA, 20 bp, Artificial
  CRISPR gRNA sequence
tttttttttgagatggagtc

SEQ ID NO: 337676 - DNA, 20 bp, Artificial
  CRISPR gRNA sequence
ttttttttgagatggagtct

SEQ ID NO: 337677 - DNA, 20 bp, Artificial
  CRISPR gRNA sequence
tttttttgagatggagtctt

SEQ ID NO: 337678 - DNA, 20 bp, Artificial
  CRISPR gRNA sequence
ttttttgagatggagtcttg

SEQ ID NO: 337679 - DNA, 20 bp, Artificial
  CRISPR gRNA sequence
tttttgagatggagtcttgt

SEQ ID NO: 337680 - DNA, 20 bp, Artificial
  CRISPR gRNA sequence
ttttgagatggagtcttgtt

SEQ ID NO: 337681 - DNA, 20 bp, Artificial
  CRISPR gRNA sequence
tttgagatggagtcttgttc

SEQ ID NO: 337682 - DNA, 20 bp, Artificial
  CRISPR gRNA sequence
ttgagatggagtcttgttct

SEQ ID NO: 337683 - DNA, 20 bp, Artificial
  CRISPR gRNA sequence
tgagatggagtcttgttctg

SEQ ID NO: 337684 - DNA, 20 bp, Artificial
  CRISPR gRNA sequence
gagatggagtcttgttctgt

SEQ ID NO: 337685 - DNA, 20 bp, Artificial
  CRISPR gRNA sequence
agatggagtcttgttctgtc

SEQ ID NO: 337686 - DNA, 20 bp, Artificial
  CRISPR gRNA sequence
gttctgtcaccagcaggcta

SEQ ID NO: 337687 - DNA, 20 bp, Artificial
  CRISPR gRNA sequence
ttctgtcaccagcaggctag

SEQ ID NO: 337688 - DNA, 20 bp, Artificial
  CRISPR gRNA sequence
tgtcaccagcaggctagagt

SEQ ID NO: 337689 - DNA, 20 bp, Artificial
  CRISPR gRNA sequence
tcaccagcaggctagagtgc

SEQ ID NO: 337690 - DNA, 20 bp, Artificial
  CRISPR gRNA sequence
gagtgcagtggtgcaatctc

SEQ ID NO: 337691 - DNA, 20 bp, Artificial
  CRISPR gRNA sequence
agctcactgcaacctctgcc

SEQ ID NO: 337692 - DNA, 20 bp, Artificial
  CRISPR gRNA sequence
actgcaacctctgcctccta

SEQ ID NO: 337693 - DNA, 20 bp, Artificial
  CRISPR gRNA sequence
caacctctgcctcctaggtt

SEQ ID NO: 337694 - DNA, 20 bp, Artificial
  CRISPR gRNA sequence
tgcctcctaggttcaagcga

SEQ ID NO: 337695 - DNA, 20 bp, Artificial
  CRISPR gRNA sequence
cctcctaggttcaagcgatt

SEQ ID NO: 337696 - DNA, 20 bp, Artificial
  CRISPR gRNA sequence
ctaggttcaagcgattctgc

SEQ ID NO: 337697 - DNA, 20 bp, Artificial
  CRISPR gRNA sequence
ggttcaagcgattctgctgc

SEQ ID NO: 337698 - DNA, 20 bp, Artificial
  CRISPR gRNA sequence
aagcgattctgctgcctcag

SEQ ID NO: 337699 - DNA, 20 bp, Artificial
  CRISPR gRNA sequence
tgctgcctcagcttcccaag

SEQ ID NO: 337700 - DNA, 20 bp, Artificial
  CRISPR gRNA sequence
ctgcctcagcttcccaagta

SEQ ID NO: 337701 - DNA, 20 bp, Artificial
  CRISPR gRNA sequence
cctcagcttcccaagtagct

SEQ ID NO: 337702 - DNA, 20 bp, Artificial
  CRISPR gRNA sequence
agcttcccaagtagctggga

SEQ ID NO: 337703 - DNA, 20 bp, Artificial
  CRISPR gRNA sequence
cccaagtagctgggactaca

SEQ ID NO: 337704 - DNA, 20 bp, Artificial
  CRISPR gRNA sequence
ccaagtagctgggactacag

SEQ ID NO: 337705 - DNA, 20 bp, Artificial
  CRISPR gRNA sequence
ggactacagtcacatgccac

SEQ ID NO: 337706 - DNA, 20 bp, Artificial
  CRISPR gRNA sequence
cagtcacatgccaccatgct

SEQ ID NO: 337707 - DNA, 20 bp, Artificial
  CRISPR gRNA sequence
agctaatttttgtattttta

SEQ ID NO: 337708 - DNA, 20 bp, Artificial
  CRISPR gRNA sequence
atttttgtatttttagtaga

SEQ ID NO: 337709 - DNA, 20 bp, Artificial
  CRISPR gRNA sequence
ttgtatttttagtagagaca

SEQ ID NO: 337710 - DNA, 20 bp, Artificial
  CRISPR gRNA sequence
tgtatttttagtagagacag

SEQ ID NO: 337711 - DNA, 20 bp, Artificial
  CRISPR gRNA sequence
gtatttttagtagagacagg

SEQ ID NO: 337712 - DNA, 20 bp, Artificial
  CRISPR gRNA sequence
tatttttagtagagacaggg

SEQ ID NO: 337713 - DNA, 20 bp, Artificial
  CRISPR gRNA sequence
ttagtagagacagggtttca

SEQ ID NO: 337714 - DNA, 20 bp, Artificial
  CRISPR gRNA sequence
tagtagagacagggtttcac

SEQ ID NO: 337715 - DNA, 20 bp, Artificial
  CRISPR gRNA sequence
agtagagacagggtttcacc

SEQ ID NO: 337716 - DNA, 20 bp, Artificial
  CRISPR gRNA sequence
gtagagacagggtttcaccg

SEQ ID NO: 337717 - DNA, 20 bp, Artificial
  CRISPR gRNA sequence
caccgtgttggccaggatgg

SEQ ID NO: 337718 - DNA, 20 bp, Artificial
  CRISPR gRNA sequence
accgtgttggccaggatggt

SEQ ID NO: 337719 - DNA, 20 bp, Artificial
  CRISPR gRNA sequence
gccaggatggtctccatctc

SEQ ID NO: 337720 - DNA, 20 bp, Artificial
  CRISPR gRNA sequence
catctctttacctcacgatc

SEQ ID NO: 337721 - DNA, 20 bp, Artificial
  CRISPR gRNA sequence
tttacctcacgatccgccca

SEQ ID NO: 337722 - DNA, 20 bp, Artificial
  CRISPR gRNA sequence
tacctcacgatccgcccacc

SEQ ID NO: 337723 - DNA, 20 bp, Artificial
  CRISPR gRNA sequence
acctcacgatccgcccacct

SEQ ID NO: 337724 - DNA, 20 bp, Artificial
  CRISPR gRNA sequence
cctcacgatccgcccacctt

SEQ ID NO: 337725 - DNA, 20 bp, Artificial
  CRISPR gRNA sequence
acgatccgcccaccttggcc

SEQ ID NO: 337726 - DNA, 20 bp, Artificial
  CRISPR gRNA sequence
ggcctcccaaagtgctggga

SEQ ID NO: 337727 - DNA, 20 bp, Artificial
  CRISPR gRNA sequence
gcctcccaaagtgctgggat

SEQ ID NO: 337728 - DNA, 20 bp, Artificial
  CRISPR gRNA sequence
ccaaagtgctgggattataa

SEQ ID NO: 337729 - DNA, 20 bp, Artificial
  CRISPR gRNA sequence
ggattataagcgtgagccac

SEQ ID NO: 337730 - DNA, 20 bp, Artificial
  CRISPR gRNA sequence
taagcgtgagccaccgcacc

SEQ ID NO: 337731 - DNA, 20 bp, Artificial
  CRISPR gRNA sequence
gcctggacgctcttaattac

SEQ ID NO: 337732 - DNA, 20 bp, Artificial
  CRISPR gRNA sequence
gacgctcttaattactcatt

SEQ ID NO: 337733 - DNA, 20 bp, Artificial
  CRISPR gRNA sequence
ttaattactcatttttttat

SEQ ID NO: 337734 - DNA, 20 bp, Artificial
  CRISPR gRNA sequence
aattactcatttttttatct

SEQ ID NO: 337735 - DNA, 20 bp, Artificial
  CRISPR gRNA sequence
attactcatttttttatctt

SEQ ID NO: 337736 - DNA, 20 bp, Artificial
  CRISPR gRNA sequence
ctcatttttttatctttaac

SEQ ID NO: 337737 - DNA, 20 bp, Artificial
  CRISPR gRNA sequence
atttttttatctttaactta

SEQ ID NO: 337738 - DNA, 20 bp, Artificial
  CRISPR gRNA sequence
ttttatctttaacttaaaaa

SEQ ID NO: 337739 - DNA, 20 bp, Artificial
  CRISPR gRNA sequence
tttatctttaacttaaaaac

SEQ ID NO: 337740 - DNA, 20 bp, Artificial
  CRISPR gRNA sequence
ttatctttaacttaaaaact

SEQ ID NO: 337741 - DNA, 20 bp, Artificial
  CRISPR gRNA sequence
tatctttaacttaaaaacta

SEQ ID NO: 337742 - DNA, 20 bp, Artificial
  CRISPR gRNA sequence
atctttaacttaaaaactac

SEQ ID NO: 337743 - DNA, 20 bp, Artificial
  CRISPR gRNA sequence
tctttaacttaaaaactacc

SEQ ID NO: 337744 - DNA, 20 bp, Artificial
  CRISPR gRNA sequence
taacttaaaaactacctgga

SEQ ID NO: 337745 - DNA, 20 bp, Artificial
  CRISPR gRNA sequence
aacttaaaaactacctggat

SEQ ID NO: 337746 - DNA, 20 bp, Artificial
  CRISPR gRNA sequence
acttaaaaactacctggatc

SEQ ID NO: 337747 - DNA, 20 bp, Artificial
  CRISPR gRNA sequence
aaaaactacctggatcgcct

SEQ ID NO: 337748 - DNA, 20 bp, Artificial
  CRISPR gRNA sequence
aaaactacctggatcgccta

SEQ ID NO: 337749 - DNA, 20 bp, Artificial
  CRISPR gRNA sequence
cctggatcgcctatttatta

SEQ ID NO: 337750 - DNA, 20 bp, Artificial
  CRISPR gRNA sequence
gatcgcctatttattatgaa

SEQ ID NO: 337751 - DNA, 20 bp, Artificial
  CRISPR gRNA sequence
tttattatgaaatgtagtga

SEQ ID NO: 337752 - DNA, 20 bp, Artificial
  CRISPR gRNA sequence
attatgaaatgtagtgatca

SEQ ID NO: 337753 - DNA, 20 bp, Artificial
  CRISPR gRNA sequence
ttatgaaatgtagtgatcag

SEQ ID NO: 337754 - DNA, 20 bp, Artificial
  CRISPR gRNA sequence
tgaaatgtagtgatcagaag

SEQ ID NO: 337755 - DNA, 20 bp, Artificial
  CRISPR gRNA sequence
acttaggtttccacatatcc

SEQ ID NO: 337756 - DNA, 20 bp, Artificial
  CRISPR gRNA sequence
aggtttccacatatccagtg

SEQ ID NO: 337757 - DNA, 20 bp, Artificial
  CRISPR gRNA sequence
ggtttccacatatccagtgt

SEQ ID NO: 337758 - DNA, 20 bp, Artificial
  CRISPR gRNA sequence
ccacatatccagtgtttaaa

SEQ ID NO: 337759 - DNA, 20 bp, Artificial
  CRISPR gRNA sequence
cacatatccagtgtttaaac

SEQ ID NO: 337760 - DNA, 20 bp, Artificial
  CRISPR gRNA sequence
aaactttccatctggaaaac

SEQ ID NO: 337761 - DNA, 20 bp, Artificial
  CRISPR gRNA sequence
aactttccatctggaaaacc

SEQ ID NO: 337762 - DNA, 20 bp, Artificial
  CRISPR gRNA sequence
tccatctggaaaaccgcttg

SEQ ID NO: 337763 - DNA, 20 bp, Artificial
  CRISPR gRNA sequence
ccatctggaaaaccgcttga

SEQ ID NO: 337764 - DNA, 20 bp, Artificial
  CRISPR gRNA sequence
catctggaaaaccgcttgac

SEQ ID NO: 337765 - DNA, 20 bp, Artificial
  CRISPR gRNA sequence
gaaaaccgcttgacagctct

SEQ ID NO: 337766 - DNA, 20 bp, Artificial
  CRISPR gRNA sequence
gacagctctaagtctgcagt

SEQ ID NO: 337767 - DNA, 20 bp, Artificial
  CRISPR gRNA sequence
acagctctaagtctgcagtt

SEQ ID NO: 337768 - DNA, 20 bp, Artificial
  CRISPR gRNA sequence
taagtctgcagttcgaatgt

SEQ ID NO: 337769 - DNA, 20 bp, Artificial
  CRISPR gRNA sequence
agtctgcagttcgaatgttt

SEQ ID NO: 337770 - DNA, 20 bp, Artificial
  CRISPR gRNA sequence
cagttcgaatgtttttaact

SEQ ID NO: 337771 - DNA, 20 bp, Artificial
  CRISPR gRNA sequence
gaatgtttttaactatagca

SEQ ID NO: 337772 - DNA, 20 bp, Artificial
  CRISPR gRNA sequence
ttaactatagcatttaatta

SEQ ID NO: 337773 - DNA, 20 bp, Artificial
  CRISPR gRNA sequence
taactatagcatttaattaa

SEQ ID NO: 337774 - DNA, 20 bp, Artificial
  CRISPR gRNA sequence
aactatagcatttaattaat

SEQ ID NO: 337775 - DNA, 20 bp, Artificial
  CRISPR gRNA sequence
actatagcatttaattaatt

SEQ ID NO: 337776 - DNA, 20 bp, Artificial
  CRISPR gRNA sequence
tagcatttaattaattattt

SEQ ID NO: 337777 - DNA, 20 bp, Artificial
  CRISPR gRNA sequence
aattaattatttcataacta

SEQ ID NO: 337778 - DNA, 20 bp, Artificial
  CRISPR gRNA sequence
attaattatttcataactat

SEQ ID NO: 337779 - DNA, 20 bp, Artificial
  CRISPR gRNA sequence
attatttcataactattttg

SEQ ID NO: 337780 - DNA, 20 bp, Artificial
  CRISPR gRNA sequence
tttcataactattttggcag

SEQ ID NO: 337781 - DNA, 20 bp, Artificial
  CRISPR gRNA sequence
cataactattttggcagata

SEQ ID NO: 337782 - DNA, 20 bp, Artificial
  CRISPR gRNA sequence
ataactattttggcagatat

SEQ ID NO: 337783 - DNA, 20 bp, Artificial
  CRISPR gRNA sequence
ttttggcagatatagaacag

SEQ ID NO: 337784 - DNA, 20 bp, Artificial
  CRISPR gRNA sequence
tggcagatatagaacagata

SEQ ID NO: 337785 - DNA, 20 bp, Artificial
  CRISPR gRNA sequence
ggcagatatagaacagatat

SEQ ID NO: 337786 - DNA, 20 bp, Artificial
  CRISPR gRNA sequence
gcagatatagaacagatatg

SEQ ID NO: 337787 - DNA, 20 bp, Artificial
  CRISPR gRNA sequence
gctatagcttgaatgtttgt

SEQ ID NO: 337788 - DNA, 20 bp, Artificial
  CRISPR gRNA sequence
ctatagcttgaatgtttgtc

SEQ ID NO: 337789 - DNA, 20 bp, Artificial
  CRISPR gRNA sequence
tagcttgaatgtttgtcccc

SEQ ID NO: 337790 - DNA, 20 bp, Artificial
  CRISPR gRNA sequence
gaatgtttgtccccctctga

SEQ ID NO: 337791 - DNA, 20 bp, Artificial
  CRISPR gRNA sequence
aatgtttgtccccctctgac

SEQ ID NO: 337792 - DNA, 20 bp, Artificial
  CRISPR gRNA sequence
gtccccctctgactgacact

SEQ ID NO: 337793 - DNA, 20 bp, Artificial
  CRISPR gRNA sequence
tccccctctgactgacactc

SEQ ID NO: 337794 - DNA, 20 bp, Artificial
  CRISPR gRNA sequence
tgactgacactcatattgaa

SEQ ID NO: 337795 - DNA, 20 bp, Artificial
  CRISPR gRNA sequence
actgacactcatattgaaaa

SEQ ID NO: 337796 - DNA, 20 bp, Artificial
  CRISPR gRNA sequence
acactcatattgaaaattaa

SEQ ID NO: 337797 - DNA, 20 bp, Artificial
  CRISPR gRNA sequence
atattgaaaattaatcccca

SEQ ID NO: 337798 - DNA, 20 bp, Artificial
  CRISPR gRNA sequence
aaaattaatccccagtgtaa

SEQ ID NO: 337799 - DNA, 20 bp, Artificial
  CRISPR gRNA sequence
atccccagtgtaatagaatt

SEQ ID NO: 337800 - DNA, 20 bp, Artificial
  CRISPR gRNA sequence
ggaggtggggcctttaagag

SEQ ID NO: 337801 - DNA, 20 bp, Artificial
  CRISPR gRNA sequence
taagagatgattggcagaac

SEQ ID NO: 337802 - DNA, 20 bp, Artificial
  CRISPR gRNA sequence
aagagatgattggcagaacc

SEQ ID NO: 337803 - DNA, 20 bp, Artificial
  CRISPR gRNA sequence
agagatgattggcagaaccc

SEQ ID NO: 337804 - DNA, 20 bp, Artificial
  CRISPR gRNA sequence
gcagaacccccatgaatagc

SEQ ID NO: 337805 - DNA, 20 bp, Artificial
  CRISPR gRNA sequence
aatccaattcatgggttaat

SEQ ID NO: 337806 - DNA, 20 bp, Artificial
  CRISPR gRNA sequence
atccaattcatgggttaatg

SEQ ID NO: 337807 - DNA, 20 bp, Artificial
  CRISPR gRNA sequence
atgggttaatgggttaacag

SEQ ID NO: 337808 - DNA, 20 bp, Artificial
  CRISPR gRNA sequence
atgggttaacagattaatag

SEQ ID NO: 337809 - DNA, 20 bp, Artificial
  CRISPR gRNA sequence
acagattaataggttatcac

SEQ ID NO: 337810 - DNA, 20 bp, Artificial
  CRISPR gRNA sequence
ataggttatcacaggagtgg

SEQ ID NO: 337811 - DNA, 20 bp, Artificial
  CRISPR gRNA sequence
tcacaggagtgggttaatta

SEQ ID NO: 337812 - DNA, 20 bp, Artificial
  CRISPR gRNA sequence
attatcatgagagttagtat

SEQ ID NO: 337813 - DNA, 20 bp, Artificial
  CRISPR gRNA sequence
tcatgagagttagtatgtta

SEQ ID NO: 337814 - DNA, 20 bp, Artificial
  CRISPR gRNA sequence
gtatgttataaacagccaga

SEQ ID NO: 337815 - DNA, 20 bp, Artificial
  CRISPR gRNA sequence
taaacagccagattggctgt

SEQ ID NO: 337816 - DNA, 20 bp, Artificial
  CRISPR gRNA sequence
gctgtctctcaagaacctcc

SEQ ID NO: 337817 - DNA, 20 bp, Artificial
  CRISPR gRNA sequence
tctctcaagaacctcctcat

SEQ ID NO: 337818 - DNA, 20 bp, Artificial
  CRISPR gRNA sequence
tcaagaacctcctcatcatg

SEQ ID NO: 337819 - DNA, 20 bp, Artificial
  CRISPR gRNA sequence
aagaacctcctcatcatgta

SEQ ID NO: 337820 - DNA, 20 bp, Artificial
  CRISPR gRNA sequence
ctcatcatgtaatcctctgt

SEQ ID NO: 337821 - DNA, 20 bp, Artificial
  CRISPR gRNA sequence
atcatgtaatcctctgtact

SEQ ID NO: 337822 - DNA, 20 bp, Artificial
  CRISPR gRNA sequence
tgtactgccttgggcctctg

SEQ ID NO: 337823 - DNA, 20 bp, Artificial
  CRISPR gRNA sequence
tactgccttgggcctctgat

SEQ ID NO: 337824 - DNA, 20 bp, Artificial
  CRISPR gRNA sequence
ccttgggcctctgatgagtg

SEQ ID NO: 337825 - DNA, 20 bp, Artificial
  CRISPR gRNA sequence
gggcctctgatgagtgtccc

SEQ ID NO: 337826 - DNA, 20 bp, Artificial
  CRISPR gRNA sequence
ggcctctgatgagtgtcccc

SEQ ID NO: 337827 - DNA, 20 bp, Artificial
  CRISPR gRNA sequence
tgatgagtgtccccaccaga

SEQ ID NO: 337828 - DNA, 20 bp, Artificial
  CRISPR gRNA sequence
atgagtgtccccaccagaaa

SEQ ID NO: 337829 - DNA, 20 bp, Artificial
  CRISPR gRNA sequence
accagatttcgcccctaggc

SEQ ID NO: 337830 - DNA, 20 bp, Artificial
  CRISPR gRNA sequence
cgcccctaggcctcagccta

SEQ ID NO: 337831 - DNA, 20 bp, Artificial
  CRISPR gRNA sequence
gcccctaggcctcagcctag

SEQ ID NO: 337832 - DNA, 20 bp, Artificial
  CRISPR gRNA sequence
ggcctcagcctagacctagg

SEQ ID NO: 337833 - DNA, 20 bp, Artificial
  CRISPR gRNA sequence
agcctagacctaggccccta

SEQ ID NO: 337834 - DNA, 20 bp, Artificial
  CRISPR gRNA sequence
gacctaggcccctagacccc

SEQ ID NO: 337835 - DNA, 20 bp, Artificial
  CRISPR gRNA sequence
ggcccctagacccctagact

SEQ ID NO: 337836 - DNA, 20 bp, Artificial
  CRISPR gRNA sequence
gacccctagacttaggcccc

SEQ ID NO: 337837 - DNA, 20 bp, Artificial
  CRISPR gRNA sequence
gacttaggccccagcctcca

SEQ ID NO: 337838 - DNA, 20 bp, Artificial
  CRISPR gRNA sequence
aggccccagcctccagaact

SEQ ID NO: 337839 - DNA, 20 bp, Artificial
  CRISPR gRNA sequence
ggccccagcctccagaactg

SEQ ID NO: 337840 - DNA, 20 bp, Artificial
  CRISPR gRNA sequence
cagaactgtaagaaatacat

SEQ ID NO: 337841 - DNA, 20 bp, Artificial
  CRISPR gRNA sequence
taagaaatacatttcttttc

SEQ ID NO: 337842 - DNA, 20 bp, Artificial
  CRISPR gRNA sequence
cttttctttataaattaccc

SEQ ID NO: 337843 - DNA, 20 bp, Artificial
  CRISPR gRNA sequence
ttttctttataaattaccca

SEQ ID NO: 337844 - DNA, 20 bp, Artificial
  CRISPR gRNA sequence
ttctttataaattacccagt

SEQ ID NO: 337845 - DNA, 20 bp, Artificial
  CRISPR gRNA sequence
tctttataaattacccagtc

SEQ ID NO: 337846 - DNA, 20 bp, Artificial
  CRISPR gRNA sequence
ctttataaattacccagtct

SEQ ID NO: 337847 - DNA, 20 bp, Artificial
  CRISPR gRNA sequence
tttataaattacccagtctc

SEQ ID NO: 337848 - DNA, 20 bp, Artificial
  CRISPR gRNA sequence
tataaattacccagtctccg

SEQ ID NO: 337849 - DNA, 20 bp, Artificial
  CRISPR gRNA sequence
ataaattacccagtctccgg

SEQ ID NO: 337850 - DNA, 20 bp, Artificial
  CRISPR gRNA sequence
taaattacccagtctccggt

SEQ ID NO: 337851 - DNA, 20 bp, Artificial
  CRISPR gRNA sequence
cccagtctccggtattcagt

SEQ ID NO: 337852 - DNA, 20 bp, Artificial
  CRISPR gRNA sequence
cggtattcagtgatagcaac

SEQ ID NO: 337853 - DNA, 20 bp, Artificial
  CRISPR gRNA sequence
agtgatagcaacagaaaatg

SEQ ID NO: 337854 - DNA, 20 bp, Artificial
  CRISPR gRNA sequence
agacaatgctcaaatgacaa

SEQ ID NO: 337855 - DNA, 20 bp, Artificial
  CRISPR gRNA sequence
aaatgacaaattacaaattc

SEQ ID NO: 337856 - DNA, 20 bp, Artificial
  CRISPR gRNA sequence
caaattcttcttagcctttg

SEQ ID NO: 337857 - DNA, 20 bp, Artificial
  CRISPR gRNA sequence
ttcttagcctttggtaacat

SEQ ID NO: 337858 - DNA, 20 bp, Artificial
  CRISPR gRNA sequence
cttagcctttggtaacattt

SEQ ID NO: 337859 - DNA, 20 bp, Artificial
  CRISPR gRNA sequence
ttagcctttggtaacatttg

SEQ ID NO: 337860 - DNA, 20 bp, Artificial
  CRISPR gRNA sequence
agcctttggtaacatttgaa

SEQ ID NO: 337861 - DNA, 20 bp, Artificial
  CRISPR gRNA sequence
gcctttggtaacatttgaaa

SEQ ID NO: 337862 - DNA, 20 bp, Artificial
  CRISPR gRNA sequence
tggtaacatttgaaaatagt

SEQ ID NO: 337863 - DNA, 20 bp, Artificial
  CRISPR gRNA sequence
ggtaacatttgaaaatagta

SEQ ID NO: 337864 - DNA, 20 bp, Artificial
  CRISPR gRNA sequence
gtaacatttgaaaatagtat

SEQ ID NO: 337865 - DNA, 20 bp, Artificial
  CRISPR gRNA sequence
gaaaatagtattaaaggaga

SEQ ID NO: 337866 - DNA, 20 bp, Artificial
  CRISPR gRNA sequence
aaaatagtattaaaggagac

SEQ ID NO: 337867 - DNA, 20 bp, Artificial
  CRISPR gRNA sequence
aaggagactgccccttataa

SEQ ID NO: 337868 - DNA, 20 bp, Artificial
  CRISPR gRNA sequence
ccccttataaccatgactaa

SEQ ID NO: 337869 - DNA, 20 bp, Artificial
  CRISPR gRNA sequence
ataaccatgactaaagcatt

SEQ ID NO: 337870 - DNA, 20 bp, Artificial
  CRISPR gRNA sequence
taaccatgactaaagcattt

SEQ ID NO: 337871 - DNA, 20 bp, Artificial
  CRISPR gRNA sequence
aagcatttaatggatagaca

SEQ ID NO: 337872 - DNA, 20 bp, Artificial
  CRISPR gRNA sequence
aatggatagacaatttaagg

SEQ ID NO: 337873 - DNA, 20 bp, Artificial
  CRISPR gRNA sequence
atggatagacaatttaagga

SEQ ID NO: 337874 - DNA, 20 bp, Artificial
  CRISPR gRNA sequence
aaggaagatctgaatacgtt

SEQ ID NO: 337875 - DNA, 20 bp, Artificial
  CRISPR gRNA sequence
aggaagatctgaatacgtta

SEQ ID NO: 337876 - DNA, 20 bp, Artificial
  CRISPR gRNA sequence
aatacgttagtttcttataa

SEQ ID NO: 337877 - DNA, 20 bp, Artificial
  CRISPR gRNA sequence
gtttcttataactgcaaaag

SEQ ID NO: 337878 - DNA, 20 bp, Artificial
  CRISPR gRNA sequence
cttataactgcaaaagcatc

SEQ ID NO: 337879 - DNA, 20 bp, Artificial
  CRISPR gRNA sequence
ttataactgcaaaagcatct

SEQ ID NO: 337880 - DNA, 20 bp, Artificial
  CRISPR gRNA sequence
ataactgcaaaagcatctag

SEQ ID NO: 337881 - DNA, 20 bp, Artificial
  CRISPR gRNA sequence
taactgcaaaagcatctagg

SEQ ID NO: 337882 - DNA, 20 bp, Artificial
  CRISPR gRNA sequence
caaaagcatctaggatcttt

SEQ ID NO: 337883 - DNA, 20 bp, Artificial
  CRISPR gRNA sequence
ggatcttttctccatccttc

SEQ ID NO: 337884 - DNA, 20 bp, Artificial
  CRISPR gRNA sequence
ttctccatccttcttggatg

SEQ ID NO: 337885 - DNA, 20 bp, Artificial
  CRISPR gRNA sequence
tctccatccttcttggatgt

SEQ ID NO: 337886 - DNA, 20 bp, Artificial
  CRISPR gRNA sequence
ctccatccttcttggatgtt

SEQ ID NO: 337887 - DNA, 20 bp, Artificial
  CRISPR gRNA sequence
tccatccttcttggatgttc

SEQ ID NO: 337888 - DNA, 20 bp, Artificial
  CRISPR gRNA sequence
catccttcttggatgttctt

SEQ ID NO: 337889 - DNA, 20 bp, Artificial
  CRISPR gRNA sequence
cttggatgttcttatctcca

SEQ ID NO: 337890 - DNA, 20 bp, Artificial
  CRISPR gRNA sequence
ttggatgttcttatctccaa

SEQ ID NO: 337891 - DNA, 20 bp, Artificial
  CRISPR gRNA sequence
ggatgttcttatctccaagt

SEQ ID NO: 337892 - DNA, 20 bp, Artificial
  CRISPR gRNA sequence
gatgttcttatctccaagtc

SEQ ID NO: 337893 - DNA, 20 bp, Artificial
  CRISPR gRNA sequence
ttatctccaagtctaatact

SEQ ID NO: 337894 - DNA, 20 bp, Artificial
  CRISPR gRNA sequence
atctccaagtctaatactca

SEQ ID NO: 337895 - DNA, 20 bp, Artificial
  CRISPR gRNA sequence
tctccaagtctaatactcag

SEQ ID NO: 337896 - DNA, 20 bp, Artificial
  CRISPR gRNA sequence
caagtctaatactcagcctg

SEQ ID NO: 337897 - DNA, 20 bp, Artificial
  CRISPR gRNA sequence
atactcagcctggaatgctg

SEQ ID NO: 337898 - DNA, 20 bp, Artificial
  CRISPR gRNA sequence
agcctggaatgctggtatga

SEQ ID NO: 337899 - DNA, 20 bp, Artificial
  CRISPR gRNA sequence
gaatgctggtatgatagata

SEQ ID NO: 337900 - DNA, 20 bp, Artificial
  CRISPR gRNA sequence
gtatgatagatagcaccact

SEQ ID NO: 337901 - DNA, 20 bp, Artificial
  CRISPR gRNA sequence
ttatagatagtgtctgctct

SEQ ID NO: 337902 - DNA, 20 bp, Artificial
  CRISPR gRNA sequence
tatagatagtgtctgctctg

SEQ ID NO: 337903 - DNA, 20 bp, Artificial
  CRISPR gRNA sequence
atagatagtgtctgctctga

SEQ ID NO: 337904 - DNA, 20 bp, Artificial
  CRISPR gRNA sequence
tagatagtgtctgctctgat

SEQ ID NO: 337905 - DNA, 20 bp, Artificial
  CRISPR gRNA sequence
ctctgattggtaaggtgtca

SEQ ID NO: 337906 - DNA, 20 bp, Artificial
  CRISPR gRNA sequence
tgattggtaaggtgtcaaat

SEQ ID NO: 337907 - DNA, 20 bp, Artificial
  CRISPR gRNA sequence
attggtaaggtgtcaaatct

SEQ ID NO: 337908 - DNA, 20 bp, Artificial
  CRISPR gRNA sequence
gtaaggtgtcaaatctattt

SEQ ID NO: 337909 - DNA, 20 bp, Artificial
  CRISPR gRNA sequence
tttggtcaattctgttgcca

SEQ ID NO: 337910 - DNA, 20 bp, Artificial
  CRISPR gRNA sequence
ggtcaattctgttgccatac

SEQ ID NO: 337911 - DNA, 20 bp, Artificial
  CRISPR gRNA sequence
gtcaattctgttgccatacc

SEQ ID NO: 337912 - DNA, 20 bp, Artificial
  CRISPR gRNA sequence
tgttgccataccagtagtta

SEQ ID NO: 337913 - DNA, 20 bp, Artificial
  CRISPR gRNA sequence
ttgccataccagtagttaaa

SEQ ID NO: 337914 - DNA, 20 bp, Artificial
  CRISPR gRNA sequence
ccataccagtagttaaaaat

SEQ ID NO: 337915 - DNA, 20 bp, Artificial
  CRISPR gRNA sequence
aaaattgtcagtgttcccct

SEQ ID NO: 337916 - DNA, 20 bp, Artificial
  CRISPR gRNA sequence
tcagtgttccccttaccaat

SEQ ID NO: 337917 - DNA, 20 bp, Artificial
  CRISPR gRNA sequence
cccttaccaatctctctctt

SEQ ID NO: 337918 - DNA, 20 bp, Artificial
  CRISPR gRNA sequence
accaatctctctcttcttgt

SEQ ID NO: 337919 - DNA, 20 bp, Artificial
  CRISPR gRNA sequence
ccaatctctctcttcttgtt

SEQ ID NO: 337920 - DNA, 20 bp, Artificial
  CRISPR gRNA sequence
tctcttcttgttctttcttc

SEQ ID NO: 337921 - DNA, 20 bp, Artificial
  CRISPR gRNA sequence
tcttcttgttctttcttcct

SEQ ID NO: 337922 - DNA, 20 bp, Artificial
  CRISPR gRNA sequence
ttcttgttctttcttccttt

SEQ ID NO: 337923 - DNA, 20 bp, Artificial
  CRISPR gRNA sequence
cttgttctttcttccttttt

SEQ ID NO: 337924 - DNA, 20 bp, Artificial
  CRISPR gRNA sequence
ttgttctttcttcctttttc

SEQ ID NO: 337925 - DNA, 20 bp, Artificial
  CRISPR gRNA sequence
gttctttcttcctttttctc

SEQ ID NO: 337926 - DNA, 20 bp, Artificial
  CRISPR gRNA sequence
ttctttcttcctttttctca

SEQ ID NO: 337927 - DNA, 20 bp, Artificial
  CRISPR gRNA sequence
tttcttcctttttctcatgt

SEQ ID NO: 337928 - DNA, 20 bp, Artificial
  CRISPR gRNA sequence
tcttcctttttctcatgttt

SEQ ID NO: 337929 - DNA, 20 bp, Artificial
  CRISPR gRNA sequence
cttcctttttctcatgtttg

SEQ ID NO: 337930 - DNA, 20 bp, Artificial
  CRISPR gRNA sequence
ttcctttttctcatgtttgc

SEQ ID NO: 337931 - DNA, 20 bp, Artificial
  CRISPR gRNA sequence
cctttttctcatgtttgcct

SEQ ID NO: 337932 - DNA, 20 bp, Artificial
  CRISPR gRNA sequence
ctttttctcatgtttgcctt

SEQ ID NO: 337933 - DNA, 20 bp, Artificial
  CRISPR gRNA sequence
tttctcatgtttgccttttc

SEQ ID NO: 337934 - DNA, 20 bp, Artificial
  CRISPR gRNA sequence
ttctcatgtttgccttttct

SEQ ID NO: 337935 - DNA, 20 bp, Artificial
  CRISPR gRNA sequence
tctcatgtttgccttttctt

SEQ ID NO: 337936 - DNA, 20 bp, Artificial
  CRISPR gRNA sequence
ctcatgtttgccttttcttc

SEQ ID NO: 337937 - DNA, 20 bp, Artificial
  CRISPR gRNA sequence
tcatgtttgccttttcttcc

SEQ ID NO: 337938 - DNA, 20 bp, Artificial
  CRISPR gRNA sequence
atgtttgccttttcttccca

SEQ ID NO: 337939 - DNA, 20 bp, Artificial
  CRISPR gRNA sequence
gccttttcttcccataccac

SEQ ID NO: 337940 - DNA, 20 bp, Artificial
  CRISPR gRNA sequence
ccttttcttcccataccacc

SEQ ID NO: 337941 - DNA, 20 bp, Artificial
  CRISPR gRNA sequence
ttcttcccataccaccttta

SEQ ID NO: 337942 - DNA, 20 bp, Artificial
  CRISPR gRNA sequence
tcttcccataccacctttaa

SEQ ID NO: 337943 - DNA, 20 bp, Artificial
  CRISPR gRNA sequence
cttcccataccacctttaat

SEQ ID NO: 337944 - DNA, 20 bp, Artificial
  CRISPR gRNA sequence
ttcccataccacctttaata

SEQ ID NO: 337945 - DNA, 20 bp, Artificial
  CRISPR gRNA sequence
cccataccacctttaatata

SEQ ID NO: 337946 - DNA, 20 bp, Artificial
  CRISPR gRNA sequence
ccataccacctttaatataa

SEQ ID NO: 337947 - DNA, 20 bp, Artificial
  CRISPR gRNA sequence
taatataaaatcttctccaa

SEQ ID NO: 337948 - DNA, 20 bp, Artificial
  CRISPR gRNA sequence
aatataaaatcttctccaaa

SEQ ID NO: 337949 - DNA, 20 bp, Artificial
  CRISPR gRNA sequence
atataaaatcttctccaaaa

SEQ ID NO: 337950 - DNA, 20 bp, Artificial
  CRISPR gRNA sequence
ctccaaaacatcctctctca

SEQ ID NO: 337951 - DNA, 20 bp, Artificial
  CRISPR gRNA sequence
tccaaaacatcctctctcat

SEQ ID NO: 337952 - DNA, 20 bp, Artificial
  CRISPR gRNA sequence
caaaacatcctctctcatac

SEQ ID NO: 337953 - DNA, 20 bp, Artificial
  CRISPR gRNA sequence
tctcatactatctttgatat

SEQ ID NO: 337954 - DNA, 20 bp, Artificial
  CRISPR gRNA sequence
tcatactatctttgatatgc

SEQ ID NO: 337955 - DNA, 20 bp, Artificial
  CRISPR gRNA sequence
atactatctttgatatgctc

SEQ ID NO: 337956 - DNA, 20 bp, Artificial
  CRISPR gRNA sequence
tctttgatatgctcctcatg

SEQ ID NO: 337957 - DNA, 20 bp, Artificial
  CRISPR gRNA sequence
tgatatgctcctcatgcttc

SEQ ID NO: 337958 - DNA, 20 bp, Artificial
  CRISPR gRNA sequence
gatatgctcctcatgcttcc

SEQ ID NO: 337959 - DNA, 20 bp, Artificial
  CRISPR gRNA sequence
atatgctcctcatgcttcct

SEQ ID NO: 337960 - DNA, 20 bp, Artificial
  CRISPR gRNA sequence
ctcatgcttcctaacatacc

SEQ ID NO: 337961 - DNA, 20 bp, Artificial
  CRISPR gRNA sequence
atgcttcctaacataccatt

SEQ ID NO: 337962 - DNA, 20 bp, Artificial
  CRISPR gRNA sequence
cctaacataccatttccatt

SEQ ID NO: 337963 - DNA, 20 bp, Artificial
  CRISPR gRNA sequence
ctaacataccatttccattg

SEQ ID NO: 337964 - DNA, 20 bp, Artificial
  CRISPR gRNA sequence
acataccatttccattgcta

SEQ ID NO: 337965 - DNA, 20 bp, Artificial
  CRISPR gRNA sequence
ccattgctaataaatttcat

SEQ ID NO: 337966 - DNA, 20 bp, Artificial
  CRISPR gRNA sequence
cattgctaataaatttcatc

SEQ ID NO: 337967 - DNA, 20 bp, Artificial
  CRISPR gRNA sequence
ctaataaatttcatcaacac

SEQ ID NO: 337968 - DNA, 20 bp, Artificial
  CRISPR gRNA sequence
ataaatttcatcaacacttc

SEQ ID NO: 337969 - DNA, 20 bp, Artificial
  CRISPR gRNA sequence
catcaacacttcatgtttca

SEQ ID NO: 337970 - DNA, 20 bp, Artificial
  CRISPR gRNA sequence
atcaacacttcatgtttcag

SEQ ID NO: 337971 - DNA, 20 bp, Artificial
  CRISPR gRNA sequence
catgtttcaggcatcctata

SEQ ID NO: 337972 - DNA, 20 bp, Artificial
  CRISPR gRNA sequence
atgtttcaggcatcctataa

SEQ ID NO: 337973 - DNA, 20 bp, Artificial
  CRISPR gRNA sequence
caggcatcctataaataccc

SEQ ID NO: 337974 - DNA, 20 bp, Artificial
  CRISPR gRNA sequence
aggcatcctataaataccct

SEQ ID NO: 337975 - DNA, 20 bp, Artificial
  CRISPR gRNA sequence
taaataccctcagctttaca

SEQ ID NO: 337976 - DNA, 20 bp, Artificial
  CRISPR gRNA sequence
agctttacactttttgtttc

SEQ ID NO: 337977 - DNA, 20 bp, Artificial
  CRISPR gRNA sequence
tacactttttgtttcctgta

SEQ ID NO: 337978 - DNA, 20 bp, Artificial
  CRISPR gRNA sequence
acactttttgtttcctgtaa

SEQ ID NO: 337979 - DNA, 20 bp, Artificial
  CRISPR gRNA sequence
cactttttgtttcctgtaac

SEQ ID NO: 337980 - DNA, 20 bp, Artificial
  CRISPR gRNA sequence
tttgtttcctgtaacatgat

SEQ ID NO: 337981 - DNA, 20 bp, Artificial
  CRISPR gRNA sequence
ttgtttcctgtaacatgatt

SEQ ID NO: 337982 - DNA, 20 bp, Artificial
  CRISPR gRNA sequence
tgtttcctgtaacatgattc

SEQ ID NO: 337983 - DNA, 20 bp, Artificial
  CRISPR gRNA sequence
gtttcctgtaacatgattca

SEQ ID NO: 337984 - DNA, 20 bp, Artificial
  CRISPR gRNA sequence
tttcctgtaacatgattcaa

SEQ ID NO: 337985 - DNA, 20 bp, Artificial
  CRISPR gRNA sequence
cctgtaacatgattcaacct

SEQ ID NO: 337986 - DNA, 20 bp, Artificial
  CRISPR gRNA sequence
ctgtaacatgattcaacctc

SEQ ID NO: 337987 - DNA, 20 bp, Artificial
  CRISPR gRNA sequence
taacatgattcaacctcttc

SEQ ID NO: 337988 - DNA, 20 bp, Artificial
  CRISPR gRNA sequence
aacctcttctcagcatcata

SEQ ID NO: 337989 - DNA, 20 bp, Artificial
  CRISPR gRNA sequence
ttctcagcatcatacacagt

SEQ ID NO: 337990 - DNA, 20 bp, Artificial
  CRISPR gRNA sequence
ctcagcatcatacacagtca

SEQ ID NO: 337991 - DNA, 20 bp, Artificial
  CRISPR gRNA sequence
tcagcatcatacacagtcag

SEQ ID NO: 337992 - DNA, 20 bp, Artificial
  CRISPR gRNA sequence
agcatcatacacagtcagat

SEQ ID NO: 337993 - DNA, 20 bp, Artificial
  CRISPR gRNA sequence
gtgacctcttttgtgtacat

SEQ ID NO: 337994 - DNA, 20 bp, Artificial
  CRISPR gRNA sequence
ttttgtgtacatacagacaa

SEQ ID NO: 337995 - DNA, 20 bp, Artificial
  CRISPR gRNA sequence
ttgtgtacatacagacaact

SEQ ID NO: 337996 - DNA, 20 bp, Artificial
  CRISPR gRNA sequence
tgtgtacatacagacaactg

SEQ ID NO: 337997 - DNA, 20 bp, Artificial
  CRISPR gRNA sequence
gtgtacatacagacaactga

SEQ ID NO: 337998 - DNA, 20 bp, Artificial
  CRISPR gRNA sequence
tgtacatacagacaactgaa

SEQ ID NO: 337999 - DNA, 20 bp, Artificial
  CRISPR gRNA sequence
aaggcccagacagattaaat

SEQ ID NO: 338000 - DNA, 20 bp, Artificial
  CRISPR gRNA sequence
aattatttgcccgaggtcac

SEQ ID NO: 338001 - DNA, 20 bp, Artificial
  CRISPR gRNA sequence
tttgcccgaggtcacacagc

SEQ ID NO: 338002 - DNA, 20 bp, Artificial
  CRISPR gRNA sequence
gcccgaggtcacacagcttc

SEQ ID NO: 338003 - DNA, 20 bp, Artificial
  CRISPR gRNA sequence
cccgaggtcacacagcttcc

SEQ ID NO: 338004 - DNA, 20 bp, Artificial
  CRISPR gRNA sequence
cctgggtgcatgaaagattt

SEQ ID NO: 338005 - DNA, 20 bp, Artificial
  CRISPR gRNA sequence
ctgggtgcatgaaagatttt

SEQ ID NO: 338006 - DNA, 20 bp, Artificial
  CRISPR gRNA sequence
ggtgcatgaaagatttttgg

SEQ ID NO: 338007 - DNA, 20 bp, Artificial
  CRISPR gRNA sequence
ttggttcaatccacagtcaa

SEQ ID NO: 338008 - DNA, 20 bp, Artificial
  CRISPR gRNA sequence
tggttcaatccacagtcaaa

SEQ ID NO: 338009 - DNA, 20 bp, Artificial
  CRISPR gRNA sequence
ggttcaatccacagtcaaag

SEQ ID NO: 338010 - DNA, 20 bp, Artificial
  CRISPR gRNA sequence
gttcaatccacagtcaaagt

SEQ ID NO: 338011 - DNA, 20 bp, Artificial
  CRISPR gRNA sequence
aatccacagtcaaagtgtca

SEQ ID NO: 338012 - DNA, 20 bp, Artificial
  CRISPR gRNA sequence
gcaacaatcaacagaagtat

SEQ ID NO: 338013 - DNA, 20 bp, Artificial
  CRISPR gRNA sequence
gacagtggtcactaacaact

SEQ ID NO: 338014 - DNA, 20 bp, Artificial
  CRISPR gRNA sequence
acaactgagtgttacaggac

SEQ ID NO: 338015 - DNA, 20 bp, Artificial
  CRISPR gRNA sequence
agtgttacaggaccagtgct

SEQ ID NO: 338016 - DNA, 20 bp, Artificial
  CRISPR gRNA sequence
caggaccagtgctaaaaatc

SEQ ID NO: 338017 - DNA, 20 bp, Artificial
  CRISPR gRNA sequence
aaaatctgtgagcaggaaga

SEQ ID NO: 338018 - DNA, 20 bp, Artificial
  CRISPR gRNA sequence
tgagcaggaagaacgcctaa

SEQ ID NO: 338019 - DNA, 20 bp, Artificial
  CRISPR gRNA sequence
atttccagcacctctgtttt

SEQ ID NO: 338020 - DNA, 20 bp, Artificial
  CRISPR gRNA sequence
ccagcacctctgttttatgt

SEQ ID NO: 338021 - DNA, 20 bp, Artificial
  CRISPR gRNA sequence
cagcacctctgttttatgtc

SEQ ID NO: 338022 - DNA, 20 bp, Artificial
  CRISPR gRNA sequence
tgttttatgtccaacagaat

SEQ ID NO: 338023 - DNA, 20 bp, Artificial
  CRISPR gRNA sequence
ttttatgtccaacagaatct

SEQ ID NO: 338024 - DNA, 20 bp, Artificial
  CRISPR gRNA sequence
tatgtccaacagaatctatc

SEQ ID NO: 338025 - DNA, 20 bp, Artificial
  CRISPR gRNA sequence
atgtccaacagaatctatcc

SEQ ID NO: 338026 - DNA, 20 bp, Artificial
  CRISPR gRNA sequence
tgtccaacagaatctatcca

SEQ ID NO: 338027 - DNA, 20 bp, Artificial
  CRISPR gRNA sequence
tccacttctcctccatctca

SEQ ID NO: 338028 - DNA, 20 bp, Artificial
  CRISPR gRNA sequence
ctcctccatctcagcttcaa

SEQ ID NO: 338029 - DNA, 20 bp, Artificial
  CRISPR gRNA sequence
tcctccatctcagcttcaac

SEQ ID NO: 338030 - DNA, 20 bp, Artificial
  CRISPR gRNA sequence
ctccatctcagcttcaactg

SEQ ID NO: 338031 - DNA, 20 bp, Artificial
  CRISPR gRNA sequence
catctcagcttcaactggtc

SEQ ID NO: 338032 - DNA, 20 bp, Artificial
  CRISPR gRNA sequence
agcttcaactggtccaaacc

SEQ ID NO: 338033 - DNA, 20 bp, Artificial
  CRISPR gRNA sequence
caactggtccaaaccattgt

SEQ ID NO: 338034 - DNA, 20 bp, Artificial
  CRISPR gRNA sequence
aactggtccaaaccattgtc

SEQ ID NO: 338035 - DNA, 20 bp, Artificial
  CRISPR gRNA sequence
gtccaaaccattgtcatctc

SEQ ID NO: 338036 - DNA, 20 bp, Artificial
  CRISPR gRNA sequence
tcatctctctctgggactac

SEQ ID NO: 338037 - DNA, 20 bp, Artificial
  CRISPR gRNA sequence
tctctgggactacaagagct

SEQ ID NO: 338038 - DNA, 20 bp, Artificial
  CRISPR gRNA sequence
tctgggactacaagagcttc

SEQ ID NO: 338039 - DNA, 20 bp, Artificial
  CRISPR gRNA sequence
tgggactacaagagcttctg

SEQ ID NO: 338040 - DNA, 20 bp, Artificial
  CRISPR gRNA sequence
ggactacaagagcttctgct

SEQ ID NO: 338041 - DNA, 20 bp, Artificial
  CRISPR gRNA sequence
caagagcttctgcttttact

SEQ ID NO: 338042 - DNA, 20 bp, Artificial
  CRISPR gRNA sequence
ctgcttttactcctgcccat

SEQ ID NO: 338043 - DNA, 20 bp, Artificial
  CRISPR gRNA sequence
tgcttttactcctgcccatt

SEQ ID NO: 338044 - DNA, 20 bp, Artificial
  CRISPR gRNA sequence
cttttactcctgcccattta

SEQ ID NO: 338045 - DNA, 20 bp, Artificial
  CRISPR gRNA sequence
ttactcctgcccatttacaa

SEQ ID NO: 338046 - DNA, 20 bp, Artificial
  CRISPR gRNA sequence
tactcctgcccatttacaat

SEQ ID NO: 338047 - DNA, 20 bp, Artificial
  CRISPR gRNA sequence
actcctgcccatttacaatc

SEQ ID NO: 338048 - DNA, 20 bp, Artificial
  CRISPR gRNA sequence
ctcctgcccatttacaatcc

SEQ ID NO: 338049 - DNA, 20 bp, Artificial
  CRISPR gRNA sequence
ctgcccatttacaatccatt

SEQ ID NO: 338050 - DNA, 20 bp, Artificial
  CRISPR gRNA sequence
cccatttacaatccattctc

SEQ ID NO: 338051 - DNA, 20 bp, Artificial
  CRISPR gRNA sequence
acaatccattctccacagag

SEQ ID NO: 338052 - DNA, 20 bp, Artificial
  CRISPR gRNA sequence
caatccattctccacagaga

SEQ ID NO: 338053 - DNA, 20 bp, Artificial
  CRISPR gRNA sequence
tccacagagaaaccagaatg

SEQ ID NO: 338054 - DNA, 20 bp, Artificial
  CRISPR gRNA sequence
cacagagaaaccagaatgac

SEQ ID NO: 338055 - DNA, 20 bp, Artificial
  CRISPR gRNA sequence
cttacatgcataatccaata

SEQ ID NO: 338056 - DNA, 20 bp, Artificial
  CRISPR gRNA sequence
ttacatgcataatccaatag

SEQ ID NO: 338057 - DNA, 20 bp, Artificial
  CRISPR gRNA sequence
acatgcataatccaatagag

SEQ ID NO: 338058 - DNA, 20 bp, Artificial
  CRISPR gRNA sequence
catgcataatccaatagagt

SEQ ID NO: 338059 - DNA, 20 bp, Artificial
  CRISPR gRNA sequence
ttctgcttataaaacctcca

SEQ ID NO: 338060 - DNA, 20 bp, Artificial
  CRISPR gRNA sequence
tgcttataaaacctccaggt

SEQ ID NO: 338061 - DNA, 20 bp, Artificial
  CRISPR gRNA sequence
cttataaaacctccaggtgc

SEQ ID NO: 338062 - DNA, 20 bp, Artificial
  CRISPR gRNA sequence
ataaaacctccaggtgcttc

SEQ ID NO: 338063 - DNA, 20 bp, Artificial
  CRISPR gRNA sequence
taaaacctccaggtgcttct

SEQ ID NO: 338064 - DNA, 20 bp, Artificial
  CRISPR gRNA sequence
caggtgcttctcattccact

SEQ ID NO: 338065 - DNA, 20 bp, Artificial
  CRISPR gRNA sequence
ctcattccacttacagtaaa

SEQ ID NO: 338066 - DNA, 20 bp, Artificial
  CRISPR gRNA sequence
tcattccacttacagtaaaa

SEQ ID NO: 338067 - DNA, 20 bp, Artificial
  CRISPR gRNA sequence
attccacttacagtaaaatc

SEQ ID NO: 338068 - DNA, 20 bp, Artificial
  CRISPR gRNA sequence
cacttacagtaaaatctaag

SEQ ID NO: 338069 - DNA, 20 bp, Artificial
  CRISPR gRNA sequence
acagtaaaatctaagttctt

SEQ ID NO: 338070 - DNA, 20 bp, Artificial
  CRISPR gRNA sequence
cagtaaaatctaagttctta

SEQ ID NO: 338071 - DNA, 20 bp, Artificial
  CRISPR gRNA sequence
agttcttaccctggtttccc

SEQ ID NO: 338072 - DNA, 20 bp, Artificial
  CRISPR gRNA sequence
ttaccctggtttcccatgac

SEQ ID NO: 338073 - DNA, 20 bp, Artificial
  CRISPR gRNA sequence
accctggtttcccatgactt

SEQ ID NO: 338074 - DNA, 20 bp, Artificial
  CRISPR gRNA sequence
ccctggtttcccatgacttg

SEQ ID NO: 338075 - DNA, 20 bp, Artificial
  CRISPR gRNA sequence
gtttcccatgacttgcatga

SEQ ID NO: 338076 - DNA, 20 bp, Artificial
  CRISPR gRNA sequence
cccatgacttgcatgacctc

SEQ ID NO: 338077 - DNA, 20 bp, Artificial
  CRISPR gRNA sequence
ccatgacttgcatgacctct

SEQ ID NO: 338078 - DNA, 20 bp, Artificial
  CRISPR gRNA sequence
gcatgacctctcctacctct

SEQ ID NO: 338079 - DNA, 20 bp, Artificial
  CRISPR gRNA sequence
catgacctctcctacctctc

SEQ ID NO: 338080 - DNA, 20 bp, Artificial
  CRISPR gRNA sequence
tcctacctctccccatttta

SEQ ID NO: 338081 - DNA, 20 bp, Artificial
  CRISPR gRNA sequence
ctacctctccccattttata

SEQ ID NO: 338082 - DNA, 20 bp, Artificial
  CRISPR gRNA sequence
cctctccccattttatacca

SEQ ID NO: 338083 - DNA, 20 bp, Artificial
  CRISPR gRNA sequence
tccccattttataccagtca

SEQ ID NO: 338084 - DNA, 20 bp, Artificial
  CRISPR gRNA sequence
cccattttataccagtcaca

SEQ ID NO: 338085 - DNA, 20 bp, Artificial
  CRISPR gRNA sequence
tataccagtcacacactaca

SEQ ID NO: 338086 - DNA, 20 bp, Artificial
  CRISPR gRNA sequence
ataccagtcacacactacac

SEQ ID NO: 338087 - DNA, 20 bp, Artificial
  CRISPR gRNA sequence
taccagtcacacactacacc

SEQ ID NO: 338088 - DNA, 20 bp, Artificial
  CRISPR gRNA sequence
caccacagtcacactgccct

SEQ ID NO: 338089 - DNA, 20 bp, Artificial
  CRISPR gRNA sequence
cccttctttctgttcctcaa

SEQ ID NO: 338090 - DNA, 20 bp, Artificial
  CRISPR gRNA sequence
ctttctgttcctcaaacaca

SEQ ID NO: 338091 - DNA, 20 bp, Artificial
  CRISPR gRNA sequence
tttctgttcctcaaacacac

SEQ ID NO: 338092 - DNA, 20 bp, Artificial
  CRISPR gRNA sequence
tctgttcctcaaacacacaa

SEQ ID NO: 338093 - DNA, 20 bp, Artificial
  CRISPR gRNA sequence
ctgttcctcaaacacacaaa

SEQ ID NO: 338094 - DNA, 20 bp, Artificial
  CRISPR gRNA sequence
tgttcctcaaacacacaaag

SEQ ID NO: 338095 - DNA, 20 bp, Artificial
  CRISPR gRNA sequence
ttcctcaaacacacaaagca

SEQ ID NO: 338096 - DNA, 20 bp, Artificial
  CRISPR gRNA sequence
ctcaaacacacaaagcaggt

SEQ ID NO: 338097 - DNA, 20 bp, Artificial
  CRISPR gRNA sequence
aaacacacaaagcaggttcc

SEQ ID NO: 338098 - DNA, 20 bp, Artificial
  CRISPR gRNA sequence
ccagggcttttaatttctca

SEQ ID NO: 338099 - DNA, 20 bp, Artificial
  CRISPR gRNA sequence
ttaatttctcatttctccac

SEQ ID NO: 338100 - DNA, 20 bp, Artificial
  CRISPR gRNA sequence
taatttctcatttctccacc

SEQ ID NO: 338101 - DNA, 20 bp, Artificial
  CRISPR gRNA sequence
aatttctcatttctccacct

SEQ ID NO: 338102 - DNA, 20 bp, Artificial
  CRISPR gRNA sequence
atttctcatttctccaccta

SEQ ID NO: 338103 - DNA, 20 bp, Artificial
  CRISPR gRNA sequence
ctcatttctccacctagaac

SEQ ID NO: 338104 - DNA, 20 bp, Artificial
  CRISPR gRNA sequence
tcatttctccacctagaaca

SEQ ID NO: 338105 - DNA, 20 bp, Artificial
  CRISPR gRNA sequence
atttctccacctagaacatt

SEQ ID NO: 338106 - DNA, 20 bp, Artificial
  CRISPR gRNA sequence
ctccacctagaacattctct

SEQ ID NO: 338107 - DNA, 20 bp, Artificial
  CRISPR gRNA sequence
tccacctagaacattctctc

SEQ ID NO: 338108 - DNA, 20 bp, Artificial
  CRISPR gRNA sequence
cacctagaacattctctctg

SEQ ID NO: 338109 - DNA, 20 bp, Artificial
  CRISPR gRNA sequence
gaacattctctctgattttc

SEQ ID NO: 338110 - DNA, 20 bp, Artificial
  CRISPR gRNA sequence
tctctgattttcacatggct

SEQ ID NO: 338111 - DNA, 20 bp, Artificial
  CRISPR gRNA sequence
tctgattttcacatggctgc

SEQ ID NO: 338112 - DNA, 20 bp, Artificial
  CRISPR gRNA sequence
tgattttcacatggctgctt

SEQ ID NO: 338113 - DNA, 20 bp, Artificial
  CRISPR gRNA sequence
attttcacatggctgcttct

SEQ ID NO: 338114 - DNA, 20 bp, Artificial
  CRISPR gRNA sequence
tcacatggctgcttctttgt

SEQ ID NO: 338115 - DNA, 20 bp, Artificial
  CRISPR gRNA sequence
cacatggctgcttctttgtc

SEQ ID NO: 338116 - DNA, 20 bp, Artificial
  CRISPR gRNA sequence
acatggctgcttctttgtca

SEQ ID NO: 338117 - DNA, 20 bp, Artificial
  CRISPR gRNA sequence
cttctttgtcatcgttcaag

SEQ ID NO: 338118 - DNA, 20 bp, Artificial
  CRISPR gRNA sequence
ctttgtcatcgttcaagagt

SEQ ID NO: 338119 - DNA, 20 bp, Artificial
  CRISPR gRNA sequence
tttgtcatcgttcaagagta

SEQ ID NO: 338120 - DNA, 20 bp, Artificial
  CRISPR gRNA sequence
tgtcatcgttcaagagtaat

SEQ ID NO: 338121 - DNA, 20 bp, Artificial
  CRISPR gRNA sequence
gtcatcgttcaagagtaatg

SEQ ID NO: 338122 - DNA, 20 bp, Artificial
  CRISPR gRNA sequence
tcatcgttcaagagtaatga

SEQ ID NO: 338123 - DNA, 20 bp, Artificial
  CRISPR gRNA sequence
aagagtaatgacacttcttc

SEQ ID NO: 338124 - DNA, 20 bp, Artificial
  CRISPR gRNA sequence
cttcagtgaccactggccac

SEQ ID NO: 338125 - DNA, 20 bp, Artificial
  CRISPR gRNA sequence
ttcagtgaccactggccacc

SEQ ID NO: 338126 - DNA, 20 bp, Artificial
  CRISPR gRNA sequence
cagtgaccactggccaccca

SEQ ID NO: 338127 - DNA, 20 bp, Artificial
  CRISPR gRNA sequence
agtgaccactggccacccaa

SEQ ID NO: 338128 - DNA, 20 bp, Artificial
  CRISPR gRNA sequence
gccacccaatctaaagaata

SEQ ID NO: 338129 - DNA, 20 bp, Artificial
  CRISPR gRNA sequence
aagaatatatccaggtcatt

SEQ ID NO: 338130 - DNA, 20 bp, Artificial
  CRISPR gRNA sequence
tctagtacattaactgacat

SEQ ID NO: 338131 - DNA, 20 bp, Artificial
  CRISPR gRNA sequence
gtacattaactgacataaag

SEQ ID NO: 338132 - DNA, 20 bp, Artificial
  CRISPR gRNA sequence
actgacataaagcatttatc

SEQ ID NO: 338133 - DNA, 20 bp, Artificial
  CRISPR gRNA sequence
acataaagcatttatcactg

SEQ ID NO: 338134 - DNA, 20 bp, Artificial
  CRISPR gRNA sequence
atcactgtctgaaattatct

SEQ ID NO: 338135 - DNA, 20 bp, Artificial
  CRISPR gRNA sequence
tcactgtctgaaattatctg

SEQ ID NO: 338136 - DNA, 20 bp, Artificial
  CRISPR gRNA sequence
tctgaaattatctggtttat

SEQ ID NO: 338137 - DNA, 20 bp, Artificial
  CRISPR gRNA sequence
aaattatctggtttatctga

SEQ ID NO: 338138 - DNA, 20 bp, Artificial
  CRISPR gRNA sequence
tctggtttatctgattgttt

SEQ ID NO: 338139 - DNA, 20 bp, Artificial
  CRISPR gRNA sequence
gtttatctgattgttttctt

SEQ ID NO: 338140 - DNA, 20 bp, Artificial
  CRISPR gRNA sequence
atctgattgttttcttcttt

SEQ ID NO: 338141 - DNA, 20 bp, Artificial
  CRISPR gRNA sequence
tctgattgttttcttcttta

SEQ ID NO: 338142 - DNA, 20 bp, Artificial
  CRISPR gRNA sequence
attgttttcttctttattgt

SEQ ID NO: 338143 - DNA, 20 bp, Artificial
  CRISPR gRNA sequence
ttttcttctttattgtctgg

SEQ ID NO: 338144 - DNA, 20 bp, Artificial
  CRISPR gRNA sequence
tcttctttattgtctggcta

SEQ ID NO: 338145 - DNA, 20 bp, Artificial
  CRISPR gRNA sequence
cttctttattgtctggctac

SEQ ID NO: 338146 - DNA, 20 bp, Artificial
  CRISPR gRNA sequence
ttctttattgtctggctact

SEQ ID NO: 338147 - DNA, 20 bp, Artificial
  CRISPR gRNA sequence
ctttattgtctggctactcc

SEQ ID NO: 338148 - DNA, 20 bp, Artificial
  CRISPR gRNA sequence
tttattgtctggctactcca

SEQ ID NO: 338149 - DNA, 20 bp, Artificial
  CRISPR gRNA sequence
tattgtctggctactccact

SEQ ID NO: 338150 - DNA, 20 bp, Artificial
  CRISPR gRNA sequence
attgtctggctactccactc

SEQ ID NO: 338151 - DNA, 20 bp, Artificial
  CRISPR gRNA sequence
ttgtctggctactccactct

SEQ ID NO: 338152 - DNA, 20 bp, Artificial
  CRISPR gRNA sequence
tctggctactccactctaag

SEQ ID NO: 338153 - DNA, 20 bp, Artificial
  CRISPR gRNA sequence
gctactccactctaagcttt

SEQ ID NO: 338154 - DNA, 20 bp, Artificial
  CRISPR gRNA sequence
ctccactctaagctttaaaa

SEQ ID NO: 338155 - DNA, 20 bp, Artificial
  CRISPR gRNA sequence
cactctaagctttaaaacca

SEQ ID NO: 338156 - DNA, 20 bp, Artificial
  CRISPR gRNA sequence
taagctttaaaaccagggac

SEQ ID NO: 338157 - DNA, 20 bp, Artificial
  CRISPR gRNA sequence
agctttaaaaccagggacct

SEQ ID NO: 338158 - DNA, 20 bp, Artificial
  CRISPR gRNA sequence
taaaaccagggaccttgttg

SEQ ID NO: 338159 - DNA, 20 bp, Artificial
  CRISPR gRNA sequence
aaaaccagggaccttgttgg

SEQ ID NO: 338160 - DNA, 20 bp, Artificial
  CRISPR gRNA sequence
aaaccagggaccttgttggt

SEQ ID NO: 338161 - DNA, 20 bp, Artificial
  CRISPR gRNA sequence
gttggtcttattcacaaatc

SEQ ID NO: 338162 - DNA, 20 bp, Artificial
  CRISPR gRNA sequence
ttggtcttattcacaaatcc

SEQ ID NO: 338163 - DNA, 20 bp, Artificial
  CRISPR gRNA sequence
gtcttattcacaaatccatc

SEQ ID NO: 338164 - DNA, 20 bp, Artificial
  CRISPR gRNA sequence
attcacaaatccatcccaag

SEQ ID NO: 338165 - DNA, 20 bp, Artificial
  CRISPR gRNA sequence
ttcacaaatccatcccaagt

SEQ ID NO: 338166 - DNA, 20 bp, Artificial
  CRISPR gRNA sequence
acaaatccatcccaagtatc

SEQ ID NO: 338167 - DNA, 20 bp, Artificial
  CRISPR gRNA sequence
caataatacctggtgtgttg

SEQ ID NO: 338168 - DNA, 20 bp, Artificial
  CRISPR gRNA sequence
gtgtgttgtaagctgcaatc

SEQ ID NO: 338169 - DNA, 20 bp, Artificial
  CRISPR gRNA sequence
taagctgcaatcagtattta

SEQ ID NO: 338170 - DNA, 20 bp, Artificial
  CRISPR gRNA sequence
caatcagtatttattggatg

SEQ ID NO: 338171 - DNA, 20 bp, Artificial
  CRISPR gRNA sequence
attggatggatgaaagcatg

SEQ ID NO: 338172 - DNA, 20 bp, Artificial
  CRISPR gRNA sequence
ttggatggatgaaagcatgg

SEQ ID NO: 338173 - DNA, 20 bp, Artificial
  CRISPR gRNA sequence
gatggatgaaagcatggttg

SEQ ID NO: 338174 - DNA, 20 bp, Artificial
  CRISPR gRNA sequence
gatgggcgaacaaatgaata

SEQ ID NO: 338175 - DNA, 20 bp, Artificial
  CRISPR gRNA sequence
taaatctgaggagatgaagc

SEQ ID NO: 338176 - DNA, 20 bp, Artificial
  CRISPR gRNA sequence
aaatctgaggagatgaagca

SEQ ID NO: 338177 - DNA, 20 bp, Artificial
  CRISPR gRNA sequence
aatctgaggagatgaagcac

SEQ ID NO: 338178 - DNA, 20 bp, Artificial
  CRISPR gRNA sequence
aggagatgaagcacaggatt

SEQ ID NO: 338179 - DNA, 20 bp, Artificial
  CRISPR gRNA sequence
ataatataagagccaaaagg

SEQ ID NO: 338180 - DNA, 20 bp, Artificial
  CRISPR gRNA sequence
taatataagagccaaaaggg

SEQ ID NO: 338181 - DNA, 20 bp, Artificial
  CRISPR gRNA sequence
ctagaaatgacaagttaaac

SEQ ID NO: 338182 - DNA, 20 bp, Artificial
  CRISPR gRNA sequence
tagaaatgacaagttaaacc

SEQ ID NO: 338183 - DNA, 20 bp, Artificial
  CRISPR gRNA sequence
gaaatgacaagttaaacctt

SEQ ID NO: 338184 - DNA, 20 bp, Artificial
  CRISPR gRNA sequence
aacctttcattttgcatttt

SEQ ID NO: 338185 - DNA, 20 bp, Artificial
  CRISPR gRNA sequence
tcattttgcattttccattt

SEQ ID NO: 338186 - DNA, 20 bp, Artificial
  CRISPR gRNA sequence
cattttgcattttccatttg

SEQ ID NO: 338187 - DNA, 20 bp, Artificial
  CRISPR gRNA sequence
attttgcattttccatttgc

SEQ ID NO: 338188 - DNA, 20 bp, Artificial
  CRISPR gRNA sequence
tgcattttccatttgcattt

SEQ ID NO: 338189 - DNA, 20 bp, Artificial
  CRISPR gRNA sequence
gcattttccatttgcattta

SEQ ID NO: 338190 - DNA, 20 bp, Artificial
  CRISPR gRNA sequence
cattttccatttgcatttat

SEQ ID NO: 338191 - DNA, 20 bp, Artificial
  CRISPR gRNA sequence
tccatttgcatttatcaaat

SEQ ID NO: 338192 - DNA, 20 bp, Artificial
  CRISPR gRNA sequence
ccatttgcatttatcaaatt

SEQ ID NO: 338193 - DNA, 20 bp, Artificial
  CRISPR gRNA sequence
catttgcatttatcaaatta

SEQ ID NO: 338194 - DNA, 20 bp, Artificial
  CRISPR gRNA sequence
gcatttatcaaattaaacta

SEQ ID NO: 338195 - DNA, 20 bp, Artificial
  CRISPR gRNA sequence
catttatcaaattaaactag

SEQ ID NO: 338196 - DNA, 20 bp, Artificial
  CRISPR gRNA sequence
atcaaattaaactagagcca

SEQ ID NO: 338197 - DNA, 20 bp, Artificial
  CRISPR gRNA sequence
tcaaattaaactagagccag

SEQ ID NO: 338198 - DNA, 20 bp, Artificial
  CRISPR gRNA sequence
aactagagccagaaaaggtg

SEQ ID NO: 338199 - DNA, 20 bp, Artificial
  CRISPR gRNA sequence
gagccagaaaaggtgactat

SEQ ID NO: 338200 - DNA, 20 bp, Artificial
  CRISPR gRNA sequence
tcttgcccaggattacatag

SEQ ID NO: 338201 - DNA, 20 bp, Artificial
  CRISPR gRNA sequence
gcccaggattacatagctca

SEQ ID NO: 338202 - DNA, 20 bp, Artificial
  CRISPR gRNA sequence
cccaggattacatagctcat

SEQ ID NO: 338203 - DNA, 20 bp, Artificial
  CRISPR gRNA sequence
catagctcatagctggggca

SEQ ID NO: 338204 - DNA, 20 bp, Artificial
  CRISPR gRNA sequence
atagctggggcatgatccca

SEQ ID NO: 338205 - DNA, 20 bp, Artificial
  CRISPR gRNA sequence
gggcatgatcccagagttag

SEQ ID NO: 338206 - DNA, 20 bp, Artificial
  CRISPR gRNA sequence
gctatgccatattattgctt

SEQ ID NO: 338207 - DNA, 20 bp, Artificial
  CRISPR gRNA sequence
tgccatattattgcttttct

SEQ ID NO: 338208 - DNA, 20 bp, Artificial
  CRISPR gRNA sequence
ttgcttttcttctggaaaca

SEQ ID NO: 338209 - DNA, 20 bp, Artificial
  CRISPR gRNA sequence
cttttcttctggaaacaagt

SEQ ID NO: 338210 - DNA, 20 bp, Artificial
  CRISPR gRNA sequence
ttcttctggaaacaagtgta

SEQ ID NO: 338211 - DNA, 20 bp, Artificial
  CRISPR gRNA sequence
tcttctggaaacaagtgtat

SEQ ID NO: 338212 - DNA, 20 bp, Artificial
  CRISPR gRNA sequence
cttctggaaacaagtgtatg

SEQ ID NO: 338213 - DNA, 20 bp, Artificial
  CRISPR gRNA sequence
ttctggaaacaagtgtatga

SEQ ID NO: 338214 - DNA, 20 bp, Artificial
  CRISPR gRNA sequence
ctggaaacaagtgtatgaag

SEQ ID NO: 338215 - DNA, 20 bp, Artificial
  CRISPR gRNA sequence
tggaaacaagtgtatgaaga

SEQ ID NO: 338216 - DNA, 20 bp, Artificial
  CRISPR gRNA sequence
gaaacaagtgtatgaagata

SEQ ID NO: 338217 - DNA, 20 bp, Artificial
  CRISPR gRNA sequence
ccccaactgagatgtcatgt

SEQ ID NO: 338218 - DNA, 20 bp, Artificial
  CRISPR gRNA sequence
agatgtcatgttctaatgga

SEQ ID NO: 338219 - DNA, 20 bp, Artificial
  CRISPR gRNA sequence
taatggaaattatctgtctg

SEQ ID NO: 338220 - DNA, 20 bp, Artificial
  CRISPR gRNA sequence
atggaaattatctgtctgag

SEQ ID NO: 338221 - DNA, 20 bp, Artificial
  CRISPR gRNA sequence
tctgtctgagctttaaagaa

SEQ ID NO: 338222 - DNA, 20 bp, Artificial
  CRISPR gRNA sequence
tctgagctttaaagaaaaac

SEQ ID NO: 338223 - DNA, 20 bp, Artificial
  CRISPR gRNA sequence
agctttaaagaaaaactttc

SEQ ID NO: 338224 - DNA, 20 bp, Artificial
  CRISPR gRNA sequence
taaagaaaaactttctttac

SEQ ID NO: 338225 - DNA, 20 bp, Artificial
  CRISPR gRNA sequence
aaagaaaaactttctttacc

SEQ ID NO: 338226 - DNA, 20 bp, Artificial
  CRISPR gRNA sequence
aagaaaaactttctttacct

SEQ ID NO: 338227 - DNA, 20 bp, Artificial
  CRISPR gRNA sequence
tctttaccttcaaatatcca

SEQ ID NO: 338228 - DNA, 20 bp, Artificial
  CRISPR gRNA sequence
ctttaccttcaaatatccac

SEQ ID NO: 338229 - DNA, 20 bp, Artificial
  CRISPR gRNA sequence
tttaccttcaaatatccact

SEQ ID NO: 338230 - DNA, 20 bp, Artificial
  CRISPR gRNA sequence
taccttcaaatatccactgg

SEQ ID NO: 338231 - DNA, 20 bp, Artificial
  CRISPR gRNA sequence
accttcaaatatccactggg

SEQ ID NO: 338232 - DNA, 20 bp, Artificial
  CRISPR gRNA sequence
ccttcaaatatccactgggt

SEQ ID NO: 338233 - DNA, 20 bp, Artificial
  CRISPR gRNA sequence
caaatatccactgggttcat

SEQ ID NO: 338234 - DNA, 20 bp, Artificial
  CRISPR gRNA sequence
aaatatccactgggttcata

SEQ ID NO: 338235 - DNA, 20 bp, Artificial
  CRISPR gRNA sequence
ggttcataaatacttattta

SEQ ID NO: 338236 - DNA, 20 bp, Artificial
  CRISPR gRNA sequence
ataaatacttatttagacag

SEQ ID NO: 338237 - DNA, 20 bp, Artificial
  CRISPR gRNA sequence
atttagacagttgataattc

SEQ ID NO: 338238 - DNA, 20 bp, Artificial
  CRISPR gRNA sequence
tttagacagttgataattct

SEQ ID NO: 338239 - DNA, 20 bp, Artificial
  CRISPR gRNA sequence
agacagttgataattctctt

SEQ ID NO: 338240 - DNA, 20 bp, Artificial
  CRISPR gRNA sequence
gacagttgataattctcttg

SEQ ID NO: 338241 - DNA, 20 bp, Artificial
  CRISPR gRNA sequence
ataattctcttggctcttat

SEQ ID NO: 338242 - DNA, 20 bp, Artificial
  CRISPR gRNA sequence
tcttggctcttatatgtctg

SEQ ID NO: 338243 - DNA, 20 bp, Artificial
  CRISPR gRNA sequence
ttggctcttatatgtctgtg

SEQ ID NO: 338244 - DNA, 20 bp, Artificial
  CRISPR gRNA sequence
ggctcttatatgtctgtgga

SEQ ID NO: 338245 - DNA, 20 bp, Artificial
  CRISPR gRNA sequence
gctcttatatgtctgtggag

SEQ ID NO: 338246 - DNA, 20 bp, Artificial
  CRISPR gRNA sequence
ttatatgtctgtggagggca

SEQ ID NO: 338247 - DNA, 20 bp, Artificial
  CRISPR gRNA sequence
atatgtctgtggagggcagg

SEQ ID NO: 338248 - DNA, 20 bp, Artificial
  CRISPR gRNA sequence
tatgtctgtggagggcagga

SEQ ID NO: 338249 - DNA, 20 bp, Artificial
  CRISPR gRNA sequence
tggagggcaggacaactttg

SEQ ID NO: 338250 - DNA, 20 bp, Artificial
  CRISPR gRNA sequence
tgttccatccaagtgagcaa

SEQ ID NO: 338251 - DNA, 20 bp, Artificial
  CRISPR gRNA sequence
gttccatccaagtgagcaac

SEQ ID NO: 338252 - DNA, 20 bp, Artificial
  CRISPR gRNA sequence
ttccatccaagtgagcaaca

SEQ ID NO: 338253 - DNA, 20 bp, Artificial
  CRISPR gRNA sequence
catccaagtgagcaacaaac

SEQ ID NO: 338254 - DNA, 20 bp, Artificial
  CRISPR gRNA sequence
gttgctcacttggatgtccc

SEQ ID NO: 338255 - DNA, 20 bp, Artificial
  CRISPR gRNA sequence
ctcacttggatgtcccaaag

SEQ ID NO: 338256 - DNA, 20 bp, Artificial
  CRISPR gRNA sequence
acttggatgtcccaaagcgc

SEQ ID NO: 338257 - DNA, 20 bp, Artificial
  CRISPR gRNA sequence
ggatgtcccaaagcgcagcc

SEQ ID NO: 338258 - DNA, 20 bp, Artificial
  CRISPR gRNA sequence
gatgtcccaaagcgcagcca

SEQ ID NO: 338259 - DNA, 20 bp, Artificial
  CRISPR gRNA sequence
catttgcccaatatatgacc

SEQ ID NO: 338260 - DNA, 20 bp, Artificial
  CRISPR gRNA sequence
gcccaatatatgaccaggac

SEQ ID NO: 338261 - DNA, 20 bp, Artificial
  CRISPR gRNA sequence
cccaatatatgaccaggaca

SEQ ID NO: 338262 - DNA, 20 bp, Artificial
  CRISPR gRNA sequence
gaccaatggttgttctaata

SEQ ID NO: 338263 - DNA, 20 bp, Artificial
  CRISPR gRNA sequence
ttctaatataccaagatgtt

SEQ ID NO: 338264 - DNA, 20 bp, Artificial
  CRISPR gRNA sequence
taatataccaagatgtttta

SEQ ID NO: 338265 - DNA, 20 bp, Artificial
  CRISPR gRNA sequence
atataccaagatgttttata

SEQ ID NO: 338266 - DNA, 20 bp, Artificial
  CRISPR gRNA sequence
tataaacacagcatgttagt

SEQ ID NO: 338267 - DNA, 20 bp, Artificial
  CRISPR gRNA sequence
ataaacacagcatgttagtg

SEQ ID NO: 338268 - DNA, 20 bp, Artificial
  CRISPR gRNA sequence
taaacacagcatgttagtgg

SEQ ID NO: 338269 - DNA, 20 bp, Artificial
  CRISPR gRNA sequence
gtggtttgtgatataaacat

SEQ ID NO: 338270 - DNA, 20 bp, Artificial
  CRISPR gRNA sequence
gtgatataaacatcatctta

SEQ ID NO: 338271 - DNA, 20 bp, Artificial
  CRISPR gRNA sequence
tgatataaacatcatcttat

SEQ ID NO: 338272 - DNA, 20 bp, Artificial
  CRISPR gRNA sequence
atatcttttagcacttaata

SEQ ID NO: 338273 - DNA, 20 bp, Artificial
  CRISPR gRNA sequence
tatcttttagcacttaatat

SEQ ID NO: 338274 - DNA, 20 bp, Artificial
  CRISPR gRNA sequence
ttagcacttaatatgttact

SEQ ID NO: 338275 - DNA, 20 bp, Artificial
  CRISPR gRNA sequence
tagcacttaatatgttacta

SEQ ID NO: 338276 - DNA, 20 bp, Artificial
  CRISPR gRNA sequence
agcacttaatatgttactaa

SEQ ID NO: 338277 - DNA, 20 bp, Artificial
  CRISPR gRNA sequence
gcacttaatatgttactaaa

SEQ ID NO: 338278 - DNA, 20 bp, Artificial
  CRISPR gRNA sequence
aatatgttactaaaatcaca

SEQ ID NO: 338279 - DNA, 20 bp, Artificial
  CRISPR gRNA sequence
atatgttactaaaatcacaa

SEQ ID NO: 338280 - DNA, 20 bp, Artificial
  CRISPR gRNA sequence
ctaaaatcacaaaaaggaat

SEQ ID NO: 338281 - DNA, 20 bp, Artificial
  CRISPR gRNA sequence
aaatcacaaaaaggaatatg

SEQ ID NO: 338282 - DNA, 20 bp, Artificial
  CRISPR gRNA sequence
ggatcctggtgatgagtctt

SEQ ID NO: 338283 - DNA, 20 bp, Artificial
  CRISPR gRNA sequence
gatcctggtgatgagtctta

SEQ ID NO: 338284 - DNA, 20 bp, Artificial
  CRISPR gRNA sequence
gtgatgagtcttaaaatctg

SEQ ID NO: 338285 - DNA, 20 bp, Artificial
  CRISPR gRNA sequence
aaaatctgaatattaaacat

SEQ ID NO: 338286 - DNA, 20 bp, Artificial
  CRISPR gRNA sequence
aaatctgaatattaaacatg

SEQ ID NO: 338287 - DNA, 20 bp, Artificial
  CRISPR gRNA sequence
aatattaaacatgaggtttt

SEQ ID NO: 338288 - DNA, 20 bp, Artificial
  CRISPR gRNA sequence
aacatgaggttttgttttgc

SEQ ID NO: 338289 - DNA, 20 bp, Artificial
  CRISPR gRNA sequence
tgttttgctaccatatctgt

SEQ ID NO: 338290 - DNA, 20 bp, Artificial
  CRISPR gRNA sequence
gttttgctaccatatctgtt

SEQ ID NO: 338291 - DNA, 20 bp, Artificial
  CRISPR gRNA sequence
ttttgctaccatatctgttt

SEQ ID NO: 338292 - DNA, 20 bp, Artificial
  CRISPR gRNA sequence
tgctaccatatctgtttact

SEQ ID NO: 338293 - DNA, 20 bp, Artificial
  CRISPR gRNA sequence
gctaccatatctgtttactt

SEQ ID NO: 338294 - DNA, 20 bp, Artificial
  CRISPR gRNA sequence
ctaccatatctgtttacttt

SEQ ID NO: 338295 - DNA, 20 bp, Artificial
  CRISPR gRNA sequence
ccatatctgtttacttttta

SEQ ID NO: 338296 - DNA, 20 bp, Artificial
  CRISPR gRNA sequence
tttactttttattggaaacc

SEQ ID NO: 338297 - DNA, 20 bp, Artificial
  CRISPR gRNA sequence
actttttattggaaacccta

SEQ ID NO: 338298 - DNA, 20 bp, Artificial
  CRISPR gRNA sequence
ctttttattggaaaccctag

SEQ ID NO: 338299 - DNA, 20 bp, Artificial
  CRISPR gRNA sequence
tttattggaaaccctagatt

SEQ ID NO: 338300 - DNA, 20 bp, Artificial
  CRISPR gRNA sequence
ttattggaaaccctagatta

SEQ ID NO: 338301 - DNA, 20 bp, Artificial
  CRISPR gRNA sequence
tattggaaaccctagattat

SEQ ID NO: 338302 - DNA, 20 bp, Artificial
  CRISPR gRNA sequence
attggaaaccctagattata

SEQ ID NO: 338303 - DNA, 20 bp, Artificial
  CRISPR gRNA sequence
ttggaaaccctagattataa

SEQ ID NO: 338304 - DNA, 20 bp, Artificial
  CRISPR gRNA sequence
gaaaccctagattataatca

SEQ ID NO: 338305 - DNA, 20 bp, Artificial
  CRISPR gRNA sequence
gattataatcagtctggaga

SEQ ID NO: 338306 - DNA, 20 bp, Artificial
  CRISPR gRNA sequence
taatcagtctggagaacagg

SEQ ID NO: 338307 - DNA, 20 bp, Artificial
  CRISPR gRNA sequence
gagaacaggtactatatttt

SEQ ID NO: 338308 - DNA, 20 bp, Artificial
  CRISPR gRNA sequence
tattttcttcatcacataga

SEQ ID NO: 338309 - DNA, 20 bp, Artificial
  CRISPR gRNA sequence
tcttcatcacatagaatact

SEQ ID NO: 338310 - DNA, 20 bp, Artificial
  CRISPR gRNA sequence
cttcatcacatagaatactg

SEQ ID NO: 338311 - DNA, 20 bp, Artificial
  CRISPR gRNA sequence
ttcatcacatagaatactgt

SEQ ID NO: 338312 - DNA, 20 bp, Artificial
  CRISPR gRNA sequence
catcacatagaatactgtgt

SEQ ID NO: 338313 - DNA, 20 bp, Artificial
  CRISPR gRNA sequence
atcacatagaatactgtgtc

SEQ ID NO: 338314 - DNA, 20 bp, Artificial
  CRISPR gRNA sequence
tgtctaacagggcatattct

SEQ ID NO: 338315 - DNA, 20 bp, Artificial
  CRISPR gRNA sequence
acagggcatattcttcccag

SEQ ID NO: 338316 - DNA, 20 bp, Artificial
  CRISPR gRNA sequence
ttcccagtagaggctcaaga

SEQ ID NO: 338317 - DNA, 20 bp, Artificial
  CRISPR gRNA sequence
cccagtagaggctcaagact

SEQ ID NO: 338318 - DNA, 20 bp, Artificial
  CRISPR gRNA sequence
ccagtagaggctcaagactg

SEQ ID NO: 338319 - DNA, 20 bp, Artificial
  CRISPR gRNA sequence
aagactgttaactgctgcta

SEQ ID NO: 338320 - DNA, 20 bp, Artificial
  CRISPR gRNA sequence
ttaactgctgctaacaataa

SEQ ID NO: 338321 - DNA, 20 bp, Artificial
  CRISPR gRNA sequence
actgctgctaacaataattt

SEQ ID NO: 338322 - DNA, 20 bp, Artificial
  CRISPR gRNA sequence
ctgctaacaataatttttat

SEQ ID NO: 338323 - DNA, 20 bp, Artificial
  CRISPR gRNA sequence
ctaacaataatttttatagg

SEQ ID NO: 338324 - DNA, 20 bp, Artificial
  CRISPR gRNA sequence
acaataatttttataggccg

SEQ ID NO: 338325 - DNA, 20 bp, Artificial
  CRISPR gRNA sequence
ttataggccgggcgcagtga

SEQ ID NO: 338326 - DNA, 20 bp, Artificial
  CRISPR gRNA sequence
tataggccgggcgcagtgac

SEQ ID NO: 338327 - DNA, 20 bp, Artificial
  CRISPR gRNA sequence
ataggccgggcgcagtgact

SEQ ID NO: 338328 - DNA, 20 bp, Artificial
  CRISPR gRNA sequence
taggccgggcgcagtgactc

SEQ ID NO: 338329 - DNA, 20 bp, Artificial
  CRISPR gRNA sequence
gccctgtaatcccagcactt

SEQ ID NO: 338330 - DNA, 20 bp, Artificial
  CRISPR gRNA sequence
taatcccagcactttgggag

SEQ ID NO: 338331 - DNA, 20 bp, Artificial
  CRISPR gRNA sequence
tgggaggccgaggcaggagg

SEQ ID NO: 338332 - DNA, 20 bp, Artificial
  CRISPR gRNA sequence
gggaggccgaggcaggagga

SEQ ID NO: 338333 - DNA, 20 bp, Artificial
  CRISPR gRNA sequence
ggaggccgaggcaggaggat

SEQ ID NO: 338334 - DNA, 20 bp, Artificial
  CRISPR gRNA sequence
agaccatcctggccaacatg

SEQ ID NO: 338335 - DNA, 20 bp, Artificial
  CRISPR gRNA sequence
gccaacatggtgaaactccg

SEQ ID NO: 338336 - DNA, 20 bp, Artificial
  CRISPR gRNA sequence
cgtctctactaataatataa

SEQ ID NO: 338337 - DNA, 20 bp, Artificial
  CRISPR gRNA sequence
tactaataatataaaaatta

SEQ ID NO: 338338 - DNA, 20 bp, Artificial
  CRISPR gRNA sequence
ctaataatataaaaattagc

SEQ ID NO: 338339 - DNA, 20 bp, Artificial
  CRISPR gRNA sequence
ataatataaaaattagctgg

SEQ ID NO: 338340 - DNA, 20 bp, Artificial
  CRISPR gRNA sequence
gctgggcgtggtggtgtgtg

SEQ ID NO: 338341 - DNA, 20 bp, Artificial
  CRISPR gRNA sequence
ggcgtggtggtgtgtgcctg

SEQ ID NO: 338342 - DNA, 20 bp, Artificial
  CRISPR gRNA sequence
taatcccagctactcaggag

SEQ ID NO: 338343 - DNA, 20 bp, Artificial
  CRISPR gRNA sequence
ctcaggaggctgaggcagga

SEQ ID NO: 338344 - DNA, 20 bp, Artificial
  CRISPR gRNA sequence
aggaggctgaggcaggagaa

SEQ ID NO: 338345 - DNA, 20 bp, Artificial
  CRISPR gRNA sequence
aggcaggagaatcgcttgaa

SEQ ID NO: 338346 - DNA, 20 bp, Artificial
  CRISPR gRNA sequence
gaaccagggagtcagaggtt

SEQ ID NO: 338347 - DNA, 20 bp, Artificial
  CRISPR gRNA sequence
aaccagggagtcagaggttg

SEQ ID NO: 338348 - DNA, 20 bp, Artificial
  CRISPR gRNA sequence
cagtgagccgagattgcacc

SEQ ID NO: 338349 - DNA, 20 bp, Artificial
  CRISPR gRNA sequence
caccactgcactccagcctg

SEQ ID NO: 338350 - DNA, 20 bp, Artificial
  CRISPR gRNA sequence
cactccagcctggcaacaga

SEQ ID NO: 338351 - DNA, 20 bp, Artificial
  CRISPR gRNA sequence
cagcctggcaacagagcaag

SEQ ID NO: 338352 - DNA, 20 bp, Artificial
  CRISPR gRNA sequence
gcaacagagcaagactccgt

SEQ ID NO: 338353 - DNA, 20 bp, Artificial
  CRISPR gRNA sequence
cgtctcaaaaaataataata

SEQ ID NO: 338354 - DNA, 20 bp, Artificial
  CRISPR gRNA sequence
aaaaaataataataataata

SEQ ID NO: 338355 - DNA, 20 bp, Artificial
  CRISPR gRNA sequence
ttataatattactgttgata

SEQ ID NO: 338356 - DNA, 20 bp, Artificial
  CRISPR gRNA sequence
tataatattactgttgatat

SEQ ID NO: 338357 - DNA, 20 bp, Artificial
  CRISPR gRNA sequence
ataatattactgttgatatc

SEQ ID NO: 338358 - DNA, 20 bp, Artificial
  CRISPR gRNA sequence
taatattactgttgatatca

SEQ ID NO: 338359 - DNA, 20 bp, Artificial
  CRISPR gRNA sequence
ctgttgatatcaatagacta

SEQ ID NO: 338360 - DNA, 20 bp, Artificial
  CRISPR gRNA sequence
ttgatatcaatagactaatg

SEQ ID NO: 338361 - DNA, 20 bp, Artificial
  CRISPR gRNA sequence
atatcaatagactaatgttt

SEQ ID NO: 338362 - DNA, 20 bp, Artificial
  CRISPR gRNA sequence
atgttttcaagagtaaaata

SEQ ID NO: 338363 - DNA, 20 bp, Artificial
  CRISPR gRNA sequence
tcaagagtaaaataaaaatc

SEQ ID NO: 338364 - DNA, 20 bp, Artificial
  CRISPR gRNA sequence
caagagtaaaataaaaatct

SEQ ID NO: 338365 - DNA, 20 bp, Artificial
  CRISPR gRNA sequence
aagagtaaaataaaaatctt

SEQ ID NO: 338366 - DNA, 20 bp, Artificial
  CRISPR gRNA sequence
tatattaagtgatctcttta

SEQ ID NO: 338367 - DNA, 20 bp, Artificial
  CRISPR gRNA sequence
atattaagtgatctctttag

SEQ ID NO: 338368 - DNA, 20 bp, Artificial
  CRISPR gRNA sequence
tattaagtgatctctttagg

SEQ ID NO: 338369 - DNA, 20 bp, Artificial
  CRISPR gRNA sequence
agtgatctctttaggttttc

SEQ ID NO: 338370 - DNA, 20 bp, Artificial
  CRISPR gRNA sequence
tttaggttttcaaaatttat

SEQ ID NO: 338371 - DNA, 20 bp, Artificial
  CRISPR gRNA sequence
taggttttcaaaatttataa

SEQ ID NO: 338372 - DNA, 20 bp, Artificial
  CRISPR gRNA sequence
aggttttcaaaatttataaa

SEQ ID NO: 338373 - DNA, 20 bp, Artificial
  CRISPR gRNA sequence
ggttttcaaaatttataaag

SEQ ID NO: 338374 - DNA, 20 bp, Artificial
  CRISPR gRNA sequence
tcaaaatttataaagcacaa

SEQ ID NO: 338375 - DNA, 20 bp, Artificial
  CRISPR gRNA sequence
caaaatttataaagcacaag

SEQ ID NO: 338376 - DNA, 20 bp, Artificial
  CRISPR gRNA sequence
aaaatttataaagcacaaga

SEQ ID NO: 338377 - DNA, 20 bp, Artificial
  CRISPR gRNA sequence
ataaagcacaagaacatttt

SEQ ID NO: 338378 - DNA, 20 bp, Artificial
  CRISPR gRNA sequence
taaagcacaagaacattttc

SEQ ID NO: 338379 - DNA, 20 bp, Artificial
  CRISPR gRNA sequence
tcttcttcttttgggggact

SEQ ID NO: 338380 - DNA, 20 bp, Artificial
  CRISPR gRNA sequence
cttcttcttttgggggacta

SEQ ID NO: 338381 - DNA, 20 bp, Artificial
  CRISPR gRNA sequence
ttcttcttttgggggactat

SEQ ID NO: 338382 - DNA, 20 bp, Artificial
  CRISPR gRNA sequence
cttcttttgggggactatta

SEQ ID NO: 338383 - DNA, 20 bp, Artificial
  CRISPR gRNA sequence
ttcttttgggggactattaa

SEQ ID NO: 338384 - DNA, 20 bp, Artificial
  CRISPR gRNA sequence
cttttgggggactattaaga

SEQ ID NO: 338385 - DNA, 20 bp, Artificial
  CRISPR gRNA sequence
ttttgggggactattaagaa

SEQ ID NO: 338386 - DNA, 20 bp, Artificial
  CRISPR gRNA sequence
ttgggggactattaagaaaa

SEQ ID NO: 338387 - DNA, 20 bp, Artificial
  CRISPR gRNA sequence
tgggggactattaagaaaat

SEQ ID NO: 338388 - DNA, 20 bp, Artificial
  CRISPR gRNA sequence
gggggactattaagaaaatt

SEQ ID NO: 338389 - DNA, 20 bp, Artificial
  CRISPR gRNA sequence
ggggactattaagaaaattt

SEQ ID NO: 338390 - DNA, 20 bp, Artificial
  CRISPR gRNA sequence
ttaagaaaatttctgaagaa

SEQ ID NO: 338391 - DNA, 20 bp, Artificial
  CRISPR gRNA sequence
agaaaatttctgaagaaaag

SEQ ID NO: 338392 - DNA, 20 bp, Artificial
  CRISPR gRNA sequence
ctgaagaaaaggtcattcac

SEQ ID NO: 338393 - DNA, 20 bp, Artificial
  CRISPR gRNA sequence
tgaagaaaaggtcattcacc

SEQ ID NO: 338394 - DNA, 20 bp, Artificial
  CRISPR gRNA sequence
aagaaaaggtcattcacctg

SEQ ID NO: 338395 - DNA, 20 bp, Artificial
  CRISPR gRNA sequence
acctgagaattgcactatag

SEQ ID NO: 338396 - DNA, 20 bp, Artificial
  CRISPR gRNA sequence
agaattgcactatagtgcag

SEQ ID NO: 338397 - DNA, 20 bp, Artificial
  CRISPR gRNA sequence
cactatagtgcagatgagtt

SEQ ID NO: 338398 - DNA, 20 bp, Artificial
  CRISPR gRNA sequence
tagtgcagatgagttcattt

SEQ ID NO: 338399 - DNA, 20 bp, Artificial
  CRISPR gRNA sequence
atttgcaagttgatgctttt

SEQ ID NO: 338400 - DNA, 20 bp, Artificial
  CRISPR gRNA sequence
gcaagttgatgcttttaata

SEQ ID NO: 338401 - DNA, 20 bp, Artificial
  CRISPR gRNA sequence
caagttgatgcttttaatat

SEQ ID NO: 338402 - DNA, 20 bp, Artificial
  CRISPR gRNA sequence
atgcttttaatatctggact

SEQ ID NO: 338403 - DNA, 20 bp, Artificial
  CRISPR gRNA sequence
ttaatatctggactacttca

SEQ ID NO: 338404 - DNA, 20 bp, Artificial
  CRISPR gRNA sequence
taatatctggactacttcat

SEQ ID NO: 338405 - DNA, 20 bp, Artificial
  CRISPR gRNA sequence
aatatctggactacttcatt

SEQ ID NO: 338406 - DNA, 20 bp, Artificial
  CRISPR gRNA sequence
atatctggactacttcattt

SEQ ID NO: 338407 - DNA, 20 bp, Artificial
  CRISPR gRNA sequence
gactacttcatttcaccagt

SEQ ID NO: 338408 - DNA, 20 bp, Artificial
  CRISPR gRNA sequence
cttcatttcaccagtataag

SEQ ID NO: 338409 - DNA, 20 bp, Artificial
  CRISPR gRNA sequence
catttcaccagtataagatg

SEQ ID NO: 338410 - DNA, 20 bp, Artificial
  CRISPR gRNA sequence
atttcaccagtataagatgc

SEQ ID NO: 338411 - DNA, 20 bp, Artificial
  CRISPR gRNA sequence
caccagtataagatgctcat

SEQ ID NO: 338412 - DNA, 20 bp, Artificial
  CRISPR gRNA sequence
accagtataagatgctcatg

SEQ ID NO: 338413 - DNA, 20 bp, Artificial
  CRISPR gRNA sequence
atgcccagacccatcctgct

SEQ ID NO: 338414 - DNA, 20 bp, Artificial
  CRISPR gRNA sequence
ctgggactctttgcaagcag

SEQ ID NO: 338415 - DNA, 20 bp, Artificial
  CRISPR gRNA sequence
ggactctttgcaagcagttg

SEQ ID NO: 338416 - DNA, 20 bp, Artificial
  CRISPR gRNA sequence
tttgcaagcagttgtattgt

SEQ ID NO: 338417 - DNA, 20 bp, Artificial
  CRISPR gRNA sequence
tgcaagcagttgtattgttc

SEQ ID NO: 338418 - DNA, 20 bp, Artificial
  CRISPR gRNA sequence
gcaagcagttgtattgttcc

SEQ ID NO: 338419 - DNA, 20 bp, Artificial
  CRISPR gRNA sequence
caagcagttgtattgttcct

SEQ ID NO: 338420 - DNA, 20 bp, Artificial
  CRISPR gRNA sequence
tattgttcctggttgaaaat

SEQ ID NO: 338421 - DNA, 20 bp, Artificial
  CRISPR gRNA sequence
ttcctggttgaaaatcctct

SEQ ID NO: 338422 - DNA, 20 bp, Artificial
  CRISPR gRNA sequence
ctggttgaaaatcctctgga

SEQ ID NO: 338423 - DNA, 20 bp, Artificial
  CRISPR gRNA sequence
gttgaaaatcctctggagga

SEQ ID NO: 338424 - DNA, 20 bp, Artificial
  CRISPR gRNA sequence
aaaatcctctggaggaaaca

SEQ ID NO: 338425 - DNA, 20 bp, Artificial
  CRISPR gRNA sequence
tggaggaaacatttaaagaa

SEQ ID NO: 338426 - DNA, 20 bp, Artificial
  CRISPR gRNA sequence
gaggaaacatttaaagaacc

SEQ ID NO: 338427 - DNA, 20 bp, Artificial
  CRISPR gRNA sequence
aaagaacccactcagtgcag

SEQ ID NO: 338428 - DNA, 20 bp, Artificial
  CRISPR gRNA sequence
aagaacccactcagtgcaga

SEQ ID NO: 338429 - DNA, 20 bp, Artificial
  CRISPR gRNA sequence
agtgcagagcgtgcaagata

SEQ ID NO: 338430 - DNA, 20 bp, Artificial
  CRISPR gRNA sequence
tattttctttaactcagact

SEQ ID NO: 338431 - DNA, 20 bp, Artificial
  CRISPR gRNA sequence
attttctttaactcagactt

SEQ ID NO: 338432 - DNA, 20 bp, Artificial
  CRISPR gRNA sequence
ttttctttaactcagacttc

SEQ ID NO: 338433 - DNA, 20 bp, Artificial
  CRISPR gRNA sequence
tctttaactcagacttctaa

SEQ ID NO: 338434 - DNA, 20 bp, Artificial
  CRISPR gRNA sequence
ctttaactcagacttctaac

SEQ ID NO: 338435 - DNA, 20 bp, Artificial
  CRISPR gRNA sequence
tttaactcagacttctaacc

SEQ ID NO: 338436 - DNA, 20 bp, Artificial
  CRISPR gRNA sequence
taactcagacttctaaccac

SEQ ID NO: 338437 - DNA, 20 bp, Artificial
  CRISPR gRNA sequence
aactcagacttctaaccaca

SEQ ID NO: 338438 - DNA, 20 bp, Artificial
  CRISPR gRNA sequence
actcagacttctaaccacaa

SEQ ID NO: 338439 - DNA, 20 bp, Artificial
  CRISPR gRNA sequence
agacttctaaccacaaacct

SEQ ID NO: 338440 - DNA, 20 bp, Artificial
  CRISPR gRNA sequence
ctaaccacaaacctccacaa

SEQ ID NO: 338441 - DNA, 20 bp, Artificial
  CRISPR gRNA sequence
taaccacaaacctccacaaa

SEQ ID NO: 338442 - DNA, 20 bp, Artificial
  CRISPR gRNA sequence
accacaaacctccacaaagg

SEQ ID NO: 338443 - DNA, 20 bp, Artificial
  CRISPR gRNA sequence
cacaaaggtctcagagtgat

SEQ ID NO: 338444 - DNA, 20 bp, Artificial
  CRISPR gRNA sequence
agagtgatggaaagataaga

SEQ ID NO: 338445 - DNA, 20 bp, Artificial
  CRISPR gRNA sequence
agtttgtaatcattgatagt

SEQ ID NO: 338446 - DNA, 20 bp, Artificial
  CRISPR gRNA sequence
gtaatcattgatagtgctta

SEQ ID NO: 338447 - DNA, 20 bp, Artificial
  CRISPR gRNA sequence
taatcattgatagtgcttat

SEQ ID NO: 338448 - DNA, 20 bp, Artificial
  CRISPR gRNA sequence
atagtgcttattaaacacat

SEQ ID NO: 338449 - DNA, 20 bp, Artificial
  CRISPR gRNA sequence
attaaacacattttctgtaa

SEQ ID NO: 338450 - DNA, 20 bp, Artificial
  CRISPR gRNA sequence
ttaaacacattttctgtaat

SEQ ID NO: 338451 - DNA, 20 bp, Artificial
  CRISPR gRNA sequence
aacacattttctgtaatcaa

SEQ ID NO: 338452 - DNA, 20 bp, Artificial
  CRISPR gRNA sequence
tctgtaatcaaacaatgata

SEQ ID NO: 338453 - DNA, 20 bp, Artificial
  CRISPR gRNA sequence
ctgtaatcaaacaatgataa

SEQ ID NO: 338454 - DNA, 20 bp, Artificial
  CRISPR gRNA sequence
tgtaatcaaacaatgataag

SEQ ID NO: 338455 - DNA, 20 bp, Artificial
  CRISPR gRNA sequence
taatcaaacaatgataagtg

SEQ ID NO: 338456 - DNA, 20 bp, Artificial
  CRISPR gRNA sequence
gcttagcacagcacatgaat

SEQ ID NO: 338457 - DNA, 20 bp, Artificial
  CRISPR gRNA sequence
agcacagcacatgaatgtga

SEQ ID NO: 338458 - DNA, 20 bp, Artificial
  CRISPR gRNA sequence
gcacagcacatgaatgtgac

SEQ ID NO: 338459 - DNA, 20 bp, Artificial
  CRISPR gRNA sequence
aaaattgcaatgtttatatt

SEQ ID NO: 338460 - DNA, 20 bp, Artificial
  CRISPR gRNA sequence
caatgtttatattaggtttt

SEQ ID NO: 338461 - DNA, 20 bp, Artificial
  CRISPR gRNA sequence
atattaggttttagttatat

SEQ ID NO: 338462 - DNA, 20 bp, Artificial
  CRISPR gRNA sequence
tattaggttttagttatatt

SEQ ID NO: 338463 - DNA, 20 bp, Artificial
  CRISPR gRNA sequence
ggttttagttatatttgatg

SEQ ID NO: 338464 - DNA, 20 bp, Artificial
  CRISPR gRNA sequence
tagttatatttgatgtttta

SEQ ID NO: 338465 - DNA, 20 bp, Artificial
  CRISPR gRNA sequence
agttatatttgatgttttac

SEQ ID NO: 338466 - DNA, 20 bp, Artificial
  CRISPR gRNA sequence
gttatatttgatgttttact

SEQ ID NO: 338467 - DNA, 20 bp, Artificial
  CRISPR gRNA sequence
tatttgatgttttactaaga

SEQ ID NO: 338468 - DNA, 20 bp, Artificial
  CRISPR gRNA sequence
gatgttttactaagaaattc

SEQ ID NO: 338469 - DNA, 20 bp, Artificial
  CRISPR gRNA sequence
atgttttactaagaaattct

SEQ ID NO: 338470 - DNA, 20 bp, Artificial
  CRISPR gRNA sequence
tactaagaaattctggcatt

SEQ ID NO: 338471 - DNA, 20 bp, Artificial
  CRISPR gRNA sequence
actaagaaattctggcatta

SEQ ID NO: 338472 - DNA, 20 bp, Artificial
  CRISPR gRNA sequence
ctaagaaattctggcattaa

SEQ ID NO: 338473 - DNA, 20 bp, Artificial
  CRISPR gRNA sequence
agaaattctggcattaaaaa

SEQ ID NO: 338474 - DNA, 20 bp, Artificial
  CRISPR gRNA sequence
tggcattaaaaaaaaaagta

SEQ ID NO: 338475 - DNA, 20 bp, Artificial
  CRISPR gRNA sequence
gcattaaaaaaaaaagtact

SEQ ID NO: 338476 - DNA, 20 bp, Artificial
  CRISPR gRNA sequence
aaaaaaaaagtacttcctac

SEQ ID NO: 338477 - DNA, 20 bp, Artificial
  CRISPR gRNA sequence
cctaccacttttctcacctt

SEQ ID NO: 338478 - DNA, 20 bp, Artificial
  CRISPR gRNA sequence
ctaccacttttctcaccttt

SEQ ID NO: 338479 - DNA, 20 bp, Artificial
  CRISPR gRNA sequence
ccacttttctcacctttcat

SEQ ID NO: 338480 - DNA, 20 bp, Artificial
  CRISPR gRNA sequence
ttctcacctttcataaaagc

SEQ ID NO: 338481 - DNA, 20 bp, Artificial
  CRISPR gRNA sequence
tctcacctttcataaaagca

SEQ ID NO: 338482 - DNA, 20 bp, Artificial
  CRISPR gRNA sequence
ctcacctttcataaaagcaa

SEQ ID NO: 338483 - DNA, 20 bp, Artificial
  CRISPR gRNA sequence
tcacctttcataaaagcaat

SEQ ID NO: 338484 - DNA, 20 bp, Artificial
  CRISPR gRNA sequence
acctttcataaaagcaatgt

SEQ ID NO: 338485 - DNA, 20 bp, Artificial
  CRISPR gRNA sequence
tcataaaagcaatgtcatgt

SEQ ID NO: 338486 - DNA, 20 bp, Artificial
  CRISPR gRNA sequence
cataaaagcaatgtcatgtc

SEQ ID NO: 338487 - DNA, 20 bp, Artificial
  CRISPR gRNA sequence
ataaaagcaatgtcatgtct

SEQ ID NO: 338488 - DNA, 20 bp, Artificial
  CRISPR gRNA sequence
atgagtctaccagctaaaac

SEQ ID NO: 338489 - DNA, 20 bp, Artificial
  CRISPR gRNA sequence
tgagtctaccagctaaaacc

SEQ ID NO: 338490 - DNA, 20 bp, Artificial
  CRISPR gRNA sequence
ccagctaaaacctttagatc

SEQ ID NO: 338491 - DNA, 20 bp, Artificial
  CRISPR gRNA sequence
aaacctttagatccctggtt

SEQ ID NO: 338492 - DNA, 20 bp, Artificial
  CRISPR gRNA sequence
tagatccctggttagtagat

SEQ ID NO: 338493 - DNA, 20 bp, Artificial
  CRISPR gRNA sequence
agatccctggttagtagatt

SEQ ID NO: 338494 - DNA, 20 bp, Artificial
  CRISPR gRNA sequence
gatccctggttagtagattt

SEQ ID NO: 338495 - DNA, 20 bp, Artificial
  CRISPR gRNA sequence
gttagtagatttttatatat

SEQ ID NO: 338496 - DNA, 20 bp, Artificial
  CRISPR gRNA sequence
gtagatttttatatatgcat

SEQ ID NO: 338497 - DNA, 20 bp, Artificial
  CRISPR gRNA sequence
ttatatatgcatcatttcta

SEQ ID NO: 338498 - DNA, 20 bp, Artificial
  CRISPR gRNA sequence
tatatatgcatcatttctaa

SEQ ID NO: 338499 - DNA, 20 bp, Artificial
  CRISPR gRNA sequence
atatatgcatcatttctaaa

SEQ ID NO: 338500 - DNA, 20 bp, Artificial
  CRISPR gRNA sequence
tatatgcatcatttctaaac

SEQ ID NO: 338501 - DNA, 20 bp, Artificial
  CRISPR gRNA sequence
ctaaacttacattgctattc

SEQ ID NO: 338502 - DNA, 20 bp, Artificial
  CRISPR gRNA sequence
taaacttacattgctattca

SEQ ID NO: 338503 - DNA, 20 bp, Artificial
  CRISPR gRNA sequence
aacttacattgctattcaaa

SEQ ID NO: 338504 - DNA, 20 bp, Artificial
  CRISPR gRNA sequence
acattgctattcaaaggcac

SEQ ID NO: 338505 - DNA, 20 bp, Artificial
  CRISPR gRNA sequence
cattgctattcaaaggcacc

SEQ ID NO: 338506 - DNA, 20 bp, Artificial
  CRISPR gRNA sequence
ctattcaaaggcacccataa

SEQ ID NO: 338507 - DNA, 20 bp, Artificial
  CRISPR gRNA sequence
ttcaaaggcacccataatct

SEQ ID NO: 338508 - DNA, 20 bp, Artificial
  CRISPR gRNA sequence
aaaggcacccataatctaaa

SEQ ID NO: 338509 - DNA, 20 bp, Artificial
  CRISPR gRNA sequence
aagaagtaattgaggcaagg

SEQ ID NO: 338510 - DNA, 20 bp, Artificial
  CRISPR gRNA sequence
aggcaaggaagggagggagg

SEQ ID NO: 338511 - DNA, 20 bp, Artificial
  CRISPR gRNA sequence
acctaaatgcctaacatttg

SEQ ID NO: 338512 - DNA, 20 bp, Artificial
  CRISPR gRNA sequence
aatgcctaacatttggagaa

SEQ ID NO: 338513 - DNA, 20 bp, Artificial
  CRISPR gRNA sequence
acatttggagaaaaaaaaaa

SEQ ID NO: 338514 - DNA, 20 bp, Artificial
  CRISPR gRNA sequence
ggagaaaaaaaaaagaaagc

SEQ ID NO: 338515 - DNA, 20 bp, Artificial
  CRISPR gRNA sequence
gagaaaaaaaaaagaaagca

SEQ ID NO: 338516 - DNA, 20 bp, Artificial
  CRISPR gRNA sequence
atgaacacacacacaatgtg

SEQ ID NO: 338517 - DNA, 20 bp, Artificial
  CRISPR gRNA sequence
ttttactctccaaggaactc

SEQ ID NO: 338518 - DNA, 20 bp, Artificial
  CRISPR gRNA sequence
tactctccaaggaactccat

SEQ ID NO: 338519 - DNA, 20 bp, Artificial
  CRISPR gRNA sequence
actctccaaggaactccata

SEQ ID NO: 338520 - DNA, 20 bp, Artificial
  CRISPR gRNA sequence
ctctccaaggaactccatag

SEQ ID NO: 338521 - DNA, 20 bp, Artificial
  CRISPR gRNA sequence
tccaaggaactccatagggg

SEQ ID NO: 338522 - DNA, 20 bp, Artificial
  CRISPR gRNA sequence
caaggaactccatagggggt

SEQ ID NO: 338523 - DNA, 20 bp, Artificial
  CRISPR gRNA sequence
catagggggtacaaaacaac

SEQ ID NO: 338524 - DNA, 20 bp, Artificial
  CRISPR gRNA sequence
tggttctctaagtgtgtata

SEQ ID NO: 338525 - DNA, 20 bp, Artificial
  CRISPR gRNA sequence
ggttctctaagtgtgtataa

SEQ ID NO: 338526 - DNA, 20 bp, Artificial
  CRISPR gRNA sequence
gttctctaagtgtgtataat

SEQ ID NO: 338527 - DNA, 20 bp, Artificial
  CRISPR gRNA sequence
tctaagtgtgtataataaga

SEQ ID NO: 338528 - DNA, 20 bp, Artificial
  CRISPR gRNA sequence
taagtgtgtataataagaaa

SEQ ID NO: 338529 - DNA, 20 bp, Artificial
  CRISPR gRNA sequence
agtgtgtataataagaaaaa

SEQ ID NO: 338530 - DNA, 20 bp, Artificial
  CRISPR gRNA sequence
attttctcctagttaaaact

SEQ ID NO: 338531 - DNA, 20 bp, Artificial
  CRISPR gRNA sequence
tctcctagttaaaactgatt

SEQ ID NO: 338532 - DNA, 20 bp, Artificial
  CRISPR gRNA sequence
ctcctagttaaaactgattt

SEQ ID NO: 338533 - DNA, 20 bp, Artificial
  CRISPR gRNA sequence
tcctagttaaaactgatttc

SEQ ID NO: 338534 - DNA, 20 bp, Artificial
  CRISPR gRNA sequence
ctagttaaaactgatttctt

SEQ ID NO: 338535 - DNA, 20 bp, Artificial
  CRISPR gRNA sequence
gttaaaactgatttcttcat

SEQ ID NO: 338536 - DNA, 20 bp, Artificial
  CRISPR gRNA sequence
aaactgatttcttcatgaaa

SEQ ID NO: 338537 - DNA, 20 bp, Artificial
  CRISPR gRNA sequence
atttcttcatgaaaaatgaa

SEQ ID NO: 338538 - DNA, 20 bp, Artificial
  CRISPR gRNA sequence
cttcatgaaaaatgaaaaaa

SEQ ID NO: 338539 - DNA, 20 bp, Artificial
  CRISPR gRNA sequence
ttcatgaaaaatgaaaaaat

SEQ ID NO: 338540 - DNA, 20 bp, Artificial
  CRISPR gRNA sequence
catgaaaaatgaaaaaatcc

SEQ ID NO: 338541 - DNA, 20 bp, Artificial
  CRISPR gRNA sequence
atgaaaaatgaaaaaatccc

SEQ ID NO: 338542 - DNA, 20 bp, Artificial
  CRISPR gRNA sequence
taaaactttgtatcaatatt

SEQ ID NO: 338543 - DNA, 20 bp, Artificial
  CRISPR gRNA sequence
tgtatcaatattcacaaagc

SEQ ID NO: 338544 - DNA, 20 bp, Artificial
  CRISPR gRNA sequence
gtatcaatattcacaaagca

SEQ ID NO: 338545 - DNA, 20 bp, Artificial
  CRISPR gRNA sequence
tatcaatattcacaaagcaa

SEQ ID NO: 338546 - DNA, 20 bp, Artificial
  CRISPR gRNA sequence
acaaagcaattaatttacaa

SEQ ID NO: 338547 - DNA, 20 bp, Artificial
  CRISPR gRNA sequence
atttacaaacaagttatttt

SEQ ID NO: 338548 - DNA, 20 bp, Artificial
  CRISPR gRNA sequence
acaaacaagttattttgtta

SEQ ID NO: 338549 - DNA, 20 bp, Artificial
  CRISPR gRNA sequence
caaacaagttattttgttag

SEQ ID NO: 338550 - DNA, 20 bp, Artificial
  CRISPR gRNA sequence
ttttgttagttacttcattg

SEQ ID NO: 338551 - DNA, 20 bp, Artificial
  CRISPR gRNA sequence
tgttagttacttcattgcct

SEQ ID NO: 338552 - DNA, 20 bp, Artificial
  CRISPR gRNA sequence
gttagttacttcattgcctt

SEQ ID NO: 338553 - DNA, 20 bp, Artificial
  CRISPR gRNA sequence
ttagttacttcattgccttt

SEQ ID NO: 338554 - DNA, 20 bp, Artificial
  CRISPR gRNA sequence
gttacttcattgcctttgat

SEQ ID NO: 338555 - DNA, 20 bp, Artificial
  CRISPR gRNA sequence
cttcattgcctttgatttga

SEQ ID NO: 338556 - DNA, 20 bp, Artificial
  CRISPR gRNA sequence
cattgcctttgatttgaaac

SEQ ID NO: 338557 - DNA, 20 bp, Artificial
  CRISPR gRNA sequence
attgcctttgatttgaaact

SEQ ID NO: 338558 - DNA, 20 bp, Artificial
  CRISPR gRNA sequence
cctttgatttgaaactattg

SEQ ID NO: 338559 - DNA, 20 bp, Artificial
  CRISPR gRNA sequence
tgatttgaaactattgtact

SEQ ID NO: 338560 - DNA, 20 bp, Artificial
  CRISPR gRNA sequence
gatttgaaactattgtacta

SEQ ID NO: 338561 - DNA, 20 bp, Artificial
  CRISPR gRNA sequence
atttgaaactattgtactag

SEQ ID NO: 338562 - DNA, 20 bp, Artificial
  CRISPR gRNA sequence
gaaactattgtactagggaa

SEQ ID NO: 338563 - DNA, 20 bp, Artificial
  CRISPR gRNA sequence
aaactattgtactagggaaa

SEQ ID NO: 338564 - DNA, 20 bp, Artificial
  CRISPR gRNA sequence
ttgtactagggaaatcatat

SEQ ID NO: 338565 - DNA, 20 bp, Artificial
  CRISPR gRNA sequence
tactagggaaatcatatgag

SEQ ID NO: 338566 - DNA, 20 bp, Artificial
  CRISPR gRNA sequence
gggaaatcatatgagattaa

SEQ ID NO: 338567 - DNA, 20 bp, Artificial
  CRISPR gRNA sequence
aatgaacccaactctcttcc

SEQ ID NO: 338568 - DNA, 20 bp, Artificial
  CRISPR gRNA sequence
tcttccacagagtgggaggg

SEQ ID NO: 338569 - DNA, 20 bp, Artificial
  CRISPR gRNA sequence
ttccacagagtgggagggag

SEQ ID NO: 338570 - DNA, 20 bp, Artificial
  CRISPR gRNA sequence
ccacagagtgggagggagag

SEQ ID NO: 338571 - DNA, 20 bp, Artificial
  CRISPR gRNA sequence
cacagagtgggagggagaga

SEQ ID NO: 338572 - DNA, 20 bp, Artificial
  CRISPR gRNA sequence
tatccacacctctgaatacc

SEQ ID NO: 338573 - DNA, 20 bp, Artificial
  CRISPR gRNA sequence
atccacacctctgaataccc

SEQ ID NO: 338574 - DNA, 20 bp, Artificial
  CRISPR gRNA sequence
tccacacctctgaataccca

SEQ ID NO: 338575 - DNA, 20 bp, Artificial
  CRISPR gRNA sequence
tgaatacccacattgcttgc

SEQ ID NO: 338576 - DNA, 20 bp, Artificial
  CRISPR gRNA sequence
aatacccacattgcttgcca

SEQ ID NO: 338577 - DNA, 20 bp, Artificial
  CRISPR gRNA sequence
cttgccattgctcagctact

SEQ ID NO: 338578 - DNA, 20 bp, Artificial
  CRISPR gRNA sequence
gccattgctcagctactgtg

SEQ ID NO: 338579 - DNA, 20 bp, Artificial
  CRISPR gRNA sequence
ccattgctcagctactgtgc

SEQ ID NO: 338580 - DNA, 20 bp, Artificial
  CRISPR gRNA sequence
ctcagctactgtgcaaaact

SEQ ID NO: 338581 - DNA, 20 bp, Artificial
  CRISPR gRNA sequence
agctactgtgcaaaactcct

SEQ ID NO: 338582 - DNA, 20 bp, Artificial
  CRISPR gRNA sequence
ctgtgcaaaactccttgggc

SEQ ID NO: 338583 - DNA, 20 bp, Artificial
  CRISPR gRNA sequence
tgcaaaactccttgggcaca

SEQ ID NO: 338584 - DNA, 20 bp, Artificial
  CRISPR gRNA sequence
cttgggcacatggacagggt

SEQ ID NO: 338585 - DNA, 20 bp, Artificial
  CRISPR gRNA sequence
gggcacatggacagggtgtt

SEQ ID NO: 338586 - DNA, 20 bp, Artificial
  CRISPR gRNA sequence
ggcacatggacagggtgttc

SEQ ID NO: 338587 - DNA, 20 bp, Artificial
  CRISPR gRNA sequence
actgcctgaactcatttgca

SEQ ID NO: 338588 - DNA, 20 bp, Artificial
  CRISPR gRNA sequence
cctgaactcatttgcaccta

SEQ ID NO: 338589 - DNA, 20 bp, Artificial
  CRISPR gRNA sequence
aactcatttgcacctatggc

SEQ ID NO: 338590 - DNA, 20 bp, Artificial
  CRISPR gRNA sequence
atttgcacctatggctccag

SEQ ID NO: 338591 - DNA, 20 bp, Artificial
  CRISPR gRNA sequence
gcacctatggctccagctct

SEQ ID NO: 338592 - DNA, 20 bp, Artificial
  CRISPR gRNA sequence
cacctatggctccagctctc

SEQ ID NO: 338593 - DNA, 20 bp, Artificial
  CRISPR gRNA sequence
tggctccagctctcatgtct

SEQ ID NO: 338594 - DNA, 20 bp, Artificial
  CRISPR gRNA sequence
cagctctcatgtctaccccc

SEQ ID NO: 338595 - DNA, 20 bp, Artificial
  CRISPR gRNA sequence
tcatgtctacccccaggagc

SEQ ID NO: 338596 - DNA, 20 bp, Artificial
  CRISPR gRNA sequence
atgtctacccccaggagccc

SEQ ID NO: 338597 - DNA, 20 bp, Artificial
  CRISPR gRNA sequence
cccccaggagcccacatttt

SEQ ID NO: 338598 - DNA, 20 bp, Artificial
  CRISPR gRNA sequence
tctctccagcccaaacttct

SEQ ID NO: 338599 - DNA, 20 bp, Artificial
  CRISPR gRNA sequence
ctctccagcccaaacttcta

SEQ ID NO: 338600 - DNA, 20 bp, Artificial
  CRISPR gRNA sequence
tctccagcccaaacttctag

SEQ ID NO: 338601 - DNA, 20 bp, Artificial
  CRISPR gRNA sequence
tccagcccaaacttctagtt

SEQ ID NO: 338602 - DNA, 20 bp, Artificial
  CRISPR gRNA sequence
cagcccaaacttctagttcc

SEQ ID NO: 338603 - DNA, 20 bp, Artificial
  CRISPR gRNA sequence
ctagttccttgtttccaaat

SEQ ID NO: 338604 - DNA, 20 bp, Artificial
  CRISPR gRNA sequence
tagttccttgtttccaaatt

SEQ ID NO: 338605 - DNA, 20 bp, Artificial
  CRISPR gRNA sequence
gttccttgtttccaaattcc

SEQ ID NO: 338606 - DNA, 20 bp, Artificial
  CRISPR gRNA sequence
cttgtttccaaattcctttc

SEQ ID NO: 338607 - DNA, 20 bp, Artificial
  CRISPR gRNA sequence
gtttccaaattcctttcaac

SEQ ID NO: 338608 - DNA, 20 bp, Artificial
  CRISPR gRNA sequence
tttccaaattcctttcaaca

SEQ ID NO: 338609 - DNA, 20 bp, Artificial
  CRISPR gRNA sequence
ccaaattcctttcaacatca

SEQ ID NO: 338610 - DNA, 20 bp, Artificial
  CRISPR gRNA sequence
caaattcctttcaacatcac

SEQ ID NO: 338611 - DNA, 20 bp, Artificial
  CRISPR gRNA sequence
ctttcaacatcactatctgg

SEQ ID NO: 338612 - DNA, 20 bp, Artificial
  CRISPR gRNA sequence
tcaacatcactatctggttt

SEQ ID NO: 338613 - DNA, 20 bp, Artificial
  CRISPR gRNA sequence
caacatcactatctggtttt

SEQ ID NO: 338614 - DNA, 20 bp, Artificial
  CRISPR gRNA sequence
aacatcactatctggtttta

SEQ ID NO: 338615 - DNA, 20 bp, Artificial
  CRISPR gRNA sequence
tctggttttaccctaacaca

SEQ ID NO: 338616 - DNA, 20 bp, Artificial
  CRISPR gRNA sequence
gttttaccctaacacatcat

SEQ ID NO: 338617 - DNA, 20 bp, Artificial
  CRISPR gRNA sequence
taccctaacacatcatgtat

SEQ ID NO: 338618 - DNA, 20 bp, Artificial
  CRISPR gRNA sequence
accctaacacatcatgtata

SEQ ID NO: 338619 - DNA, 20 bp, Artificial
  CRISPR gRNA sequence
ccctaacacatcatgtatag

SEQ ID NO: 338620 - DNA, 20 bp, Artificial
  CRISPR gRNA sequence
acacatcatgtatagccttt

SEQ ID NO: 338621 - DNA, 20 bp, Artificial
  CRISPR gRNA sequence
tccaaactgagctcagtaca

SEQ ID NO: 338622 - DNA, 20 bp, Artificial
  CRISPR gRNA sequence
ccaaactgagctcagtacag

SEQ ID NO: 338623 - DNA, 20 bp, Artificial
  CRISPR gRNA sequence
caaactgagctcagtacagt

SEQ ID NO: 338624 - DNA, 20 bp, Artificial
  CRISPR gRNA sequence
agctcagtacagtcatgcgc

SEQ ID NO: 338625 - DNA, 20 bp, Artificial
  CRISPR gRNA sequence
agtacagtcatgcgctgcat

SEQ ID NO: 338626 - DNA, 20 bp, Artificial
  CRISPR gRNA sequence
cataaatgacatgttggtca

SEQ ID NO: 338627 - DNA, 20 bp, Artificial
  CRISPR gRNA sequence
gtcaacgatggactgtatat

SEQ ID NO: 338628 - DNA, 20 bp, Artificial
  CRISPR gRNA sequence
tatatatggtggcggtccca

SEQ ID NO: 338629 - DNA, 20 bp, Artificial
  CRISPR gRNA sequence
taatacagaaatttttaatg

SEQ ID NO: 338630 - DNA, 20 bp, Artificial
  CRISPR gRNA sequence
ttaatgtcccttttatgtgt

SEQ ID NO: 338631 - DNA, 20 bp, Artificial
  CRISPR gRNA sequence
taatgtcccttttatgtgtt

SEQ ID NO: 338632 - DNA, 20 bp, Artificial
  CRISPR gRNA sequence
aatgtcccttttatgtgttt

SEQ ID NO: 338633 - DNA, 20 bp, Artificial
  CRISPR gRNA sequence
atgtcccttttatgtgttta

SEQ ID NO: 338634 - DNA, 20 bp, Artificial
  CRISPR gRNA sequence
ttatgtgtttagttacacaa

SEQ ID NO: 338635 - DNA, 20 bp, Artificial
  CRISPR gRNA sequence
tatgtgtttagttacacaaa

SEQ ID NO: 338636 - DNA, 20 bp, Artificial
  CRISPR gRNA sequence
atgtgtttagttacacaaat

SEQ ID NO: 338637 - DNA, 20 bp, Artificial
  CRISPR gRNA sequence
tgtgtttagttacacaaata

SEQ ID NO: 338638 - DNA, 20 bp, Artificial
  CRISPR gRNA sequence
agttacacaaatatttacca

SEQ ID NO: 338639 - DNA, 20 bp, Artificial
  CRISPR gRNA sequence
gttacacaaatatttaccat

SEQ ID NO: 338640 - DNA, 20 bp, Artificial
  CRISPR gRNA sequence
cacaaatatttaccattgtg

SEQ ID NO: 338641 - DNA, 20 bp, Artificial
  CRISPR gRNA sequence
accattgtgctaccatggcc

SEQ ID NO: 338642 - DNA, 20 bp, Artificial
  CRISPR gRNA sequence
ccattgtgctaccatggcct

SEQ ID NO: 338643 - DNA, 20 bp, Artificial
  CRISPR gRNA sequence
tgctaccatggcctgcagta

SEQ ID NO: 338644 - DNA, 20 bp, Artificial
  CRISPR gRNA sequence
ccatggcctgcagtattcag

SEQ ID NO: 338645 - DNA, 20 bp, Artificial
  CRISPR gRNA sequence
cagtattcagtacagtaaca

SEQ ID NO: 338646 - DNA, 20 bp, Artificial
  CRISPR gRNA sequence
agtacagtaacatgctgtac

SEQ ID NO: 338647 - DNA, 20 bp, Artificial
  CRISPR gRNA sequence
tacaggtttgtagcctagaa

SEQ ID NO: 338648 - DNA, 20 bp, Artificial
  CRISPR gRNA sequence
gtagcctagaagcaataggc

SEQ ID NO: 338649 - DNA, 20 bp, Artificial
  CRISPR gRNA sequence
tagcctagaagcaataggct

SEQ ID NO: 338650 - DNA, 20 bp, Artificial
  CRISPR gRNA sequence
gaagcaataggctactccac

SEQ ID NO: 338651 - DNA, 20 bp, Artificial
  CRISPR gRNA sequence
ctccacatagcctaggtagt

SEQ ID NO: 338652 - DNA, 20 bp, Artificial
  CRISPR gRNA sequence
cacatagcctaggtagtgca

SEQ ID NO: 338653 - DNA, 20 bp, Artificial
  CRISPR gRNA sequence
ggtagtgcagtaggctctgc

SEQ ID NO: 338654 - DNA, 20 bp, Artificial
  CRISPR gRNA sequence
tgccatctagtagacatcat

SEQ ID NO: 338655 - DNA, 20 bp, Artificial
  CRISPR gRNA sequence
ccatctagtagacatcattg

SEQ ID NO: 338656 - DNA, 20 bp, Artificial
  CRISPR gRNA sequence
gtagacatcattgcgtcagt

SEQ ID NO: 338657 - DNA, 20 bp, Artificial
  CRISPR gRNA sequence
cgtcagtacgctcgatgatg

SEQ ID NO: 338658 - DNA, 20 bp, Artificial
  CRISPR gRNA sequence
gatgatgttcacacaacaaa

SEQ ID NO: 338659 - DNA, 20 bp, Artificial
  CRISPR gRNA sequence
acacaacaaaatcactaagg

SEQ ID NO: 338660 - DNA, 20 bp, Artificial
  CRISPR gRNA sequence
aggacacatttctcagaatg

SEQ ID NO: 338661 - DNA, 20 bp, Artificial
  CRISPR gRNA sequence
ctcagaatgtattcccatcg

SEQ ID NO: 338662 - DNA, 20 bp, Artificial
  CRISPR gRNA sequence
tcagaatgtattcccatcgt

SEQ ID NO: 338663 - DNA, 20 bp, Artificial
  CRISPR gRNA sequence
agaatgtattcccatcgtca

SEQ ID NO: 338664 - DNA, 20 bp, Artificial
  CRISPR gRNA sequence
ccatcgtcaagtggcacgtg

SEQ ID NO: 338665 - DNA, 20 bp, Artificial
  CRISPR gRNA sequence
tattcattcaccaaatccaa

SEQ ID NO: 338666 - DNA, 20 bp, Artificial
  CRISPR gRNA sequence
attcaccaaatccaaaccct

SEQ ID NO: 338667 - DNA, 20 bp, Artificial
  CRISPR gRNA sequence
accaaatccaaaccctgtct

SEQ ID NO: 338668 - DNA, 20 bp, Artificial
  CRISPR gRNA sequence
tcttttcagggagtcactag

SEQ ID NO: 338669 - DNA, 20 bp, Artificial
  CRISPR gRNA sequence
ttcagggagtcactagtctg

SEQ ID NO: 338670 - DNA, 20 bp, Artificial
  CRISPR gRNA sequence
tcagggagtcactagtctga

SEQ ID NO: 338671 - DNA, 20 bp, Artificial
  CRISPR gRNA sequence
cagggagtcactagtctgac

SEQ ID NO: 338672 - DNA, 20 bp, Artificial
  CRISPR gRNA sequence
agggagtcactagtctgacc

SEQ ID NO: 338673 - DNA, 20 bp, Artificial
  CRISPR gRNA sequence
gtctgaccctaggaacctca

SEQ ID NO: 338674 - DNA, 20 bp, Artificial
  CRISPR gRNA sequence
accctaggaacctcagagtc

SEQ ID NO: 338675 - DNA, 20 bp, Artificial
  CRISPR gRNA sequence
ggaacctcagagtcttcctc

SEQ ID NO: 338676 - DNA, 20 bp, Artificial
  CRISPR gRNA sequence
agagtcttcctcatttcttc

SEQ ID NO: 338677 - DNA, 20 bp, Artificial
  CRISPR gRNA sequence
cctcatttcttcctctctct

SEQ ID NO: 338678 - DNA, 20 bp, Artificial
  CRISPR gRNA sequence
ctcatttcttcctctctctg

SEQ ID NO: 338679 - DNA, 20 bp, Artificial
  CRISPR gRNA sequence
atttcttcctctctctgatt

SEQ ID NO: 338680 - DNA, 20 bp, Artificial
  CRISPR gRNA sequence
cttcctctctctgattttca

SEQ ID NO: 338681 - DNA, 20 bp, Artificial
  CRISPR gRNA sequence
ttcctctctctgattttcat

SEQ ID NO: 338682 - DNA, 20 bp, Artificial
  CRISPR gRNA sequence
cctctctctgattttcatca

SEQ ID NO: 338683 - DNA, 20 bp, Artificial
  CRISPR gRNA sequence
ctctctctgattttcatcat

SEQ ID NO: 338684 - DNA, 20 bp, Artificial
  CRISPR gRNA sequence
tctctgattttcatcatcca

SEQ ID NO: 338685 - DNA, 20 bp, Artificial
  CRISPR gRNA sequence
tctgattttcatcatccaat

SEQ ID NO: 338686 - DNA, 20 bp, Artificial
  CRISPR gRNA sequence
tgattttcatcatccaattg

SEQ ID NO: 338687 - DNA, 20 bp, Artificial
  CRISPR gRNA sequence
attttcatcatccaattggt

SEQ ID NO: 338688 - DNA, 20 bp, Artificial
  CRISPR gRNA sequence
tcatcatccaattggtcacc

SEQ ID NO: 338689 - DNA, 20 bp, Artificial
  CRISPR gRNA sequence
catcatccaattggtcacca

SEQ ID NO: 338690 - DNA, 20 bp, Artificial
  CRISPR gRNA sequence
atcatccaattggtcaccaa

SEQ ID NO: 338691 - DNA, 20 bp, Artificial
  CRISPR gRNA sequence
gtcaccaagtccagttgact

SEQ ID NO: 338692 - DNA, 20 bp, Artificial
  CRISPR gRNA sequence
actccagctcatgaatatct

SEQ ID NO: 338693 - DNA, 20 bp, Artificial
  CRISPR gRNA sequence
cagctcatgaatatctctta

SEQ ID NO: 338694 - DNA, 20 bp, Artificial
  CRISPR gRNA sequence
atgaatatctcttaaattca

SEQ ID NO: 338695 - DNA, 20 bp, Artificial
  CRISPR gRNA sequence
ttaaattcaattctttttct

SEQ ID NO: 338696 - DNA, 20 bp, Artificial
  CRISPR gRNA sequence
aaattcaattctttttctcc

SEQ ID NO: 338697 - DNA, 20 bp, Artificial
  CRISPR gRNA sequence
aattcaattctttttctcca

SEQ ID NO: 338698 - DNA, 20 bp, Artificial
  CRISPR gRNA sequence
aattctttttctccattccc

SEQ ID NO: 338699 - DNA, 20 bp, Artificial
  CRISPR gRNA sequence
tttttctccattcccattgc

SEQ ID NO: 338700 - DNA, 20 bp, Artificial
  CRISPR gRNA sequence
tttctccattcccattgcca

SEQ ID NO: 338701 - DNA, 20 bp, Artificial
  CRISPR gRNA sequence
ttctccattcccattgccaa

SEQ ID NO: 338702 - DNA, 20 bp, Artificial
  CRISPR gRNA sequence
tctccattcccattgccaat

SEQ ID NO: 338703 - DNA, 20 bp, Artificial
  CRISPR gRNA sequence
ctccattcccattgccaatc

SEQ ID NO: 338704 - DNA, 20 bp, Artificial
  CRISPR gRNA sequence
tccattcccattgccaatcc

SEQ ID NO: 338705 - DNA, 20 bp, Artificial
  CRISPR gRNA sequence
cattcccattgccaatccac

SEQ ID NO: 338706 - DNA, 20 bp, Artificial
  CRISPR gRNA sequence
ccattgccaatccacacctt

SEQ ID NO: 338707 - DNA, 20 bp, Artificial
  CRISPR gRNA sequence
ccaatccacacctttttcat

SEQ ID NO: 338708 - DNA, 20 bp, Artificial
  CRISPR gRNA sequence
tttcatgtcttcccttatct

SEQ ID NO: 338709 - DNA, 20 bp, Artificial
  CRISPR gRNA sequence
ttcatgtcttcccttatctg

SEQ ID NO: 338710 - DNA, 20 bp, Artificial
  CRISPR gRNA sequence
tcatgtcttcccttatctgt

SEQ ID NO: 338711 - DNA, 20 bp, Artificial
  CRISPR gRNA sequence
catgtcttcccttatctgtg

SEQ ID NO: 338712 - DNA, 20 bp, Artificial
  CRISPR gRNA sequence
atgtcttcccttatctgtgg

SEQ ID NO: 338713 - DNA, 20 bp, Artificial
  CRISPR gRNA sequence
cccttatctgtggaagcatc

SEQ ID NO: 338714 - DNA, 20 bp, Artificial
  CRISPR gRNA sequence
ccttatctgtggaagcatcc

SEQ ID NO: 338715 - DNA, 20 bp, Artificial
  CRISPR gRNA sequence
atctgtggaagcatcctctt

SEQ ID NO: 338716 - DNA, 20 bp, Artificial
  CRISPR gRNA sequence
tctgtggaagcatcctcttg

SEQ ID NO: 338717 - DNA, 20 bp, Artificial
  CRISPR gRNA sequence
tggaagcatcctcttgactg

SEQ ID NO: 338718 - DNA, 20 bp, Artificial
  CRISPR gRNA sequence
ttgactggccttctcaatac

SEQ ID NO: 338719 - DNA, 20 bp, Artificial
  CRISPR gRNA sequence
gactggccttctcaatactg

SEQ ID NO: 338720 - DNA, 20 bp, Artificial
  CRISPR gRNA sequence
actggccttctcaatactga

SEQ ID NO: 338721 - DNA, 20 bp, Artificial
  CRISPR gRNA sequence
gccttctcaatactgatctc

SEQ ID NO: 338722 - DNA, 20 bp, Artificial
  CRISPR gRNA sequence
ctcaatactgatctctctcc

SEQ ID NO: 338723 - DNA, 20 bp, Artificial
  CRISPR gRNA sequence
tcaatactgatctctctcct

SEQ ID NO: 338724 - DNA, 20 bp, Artificial
  CRISPR gRNA sequence
aatactgatctctctcctcc

SEQ ID NO: 338725 - DNA, 20 bp, Artificial
  CRISPR gRNA sequence
atctctctcctccccatccc

SEQ ID NO: 338726 - DNA, 20 bp, Artificial
  CRISPR gRNA sequence
tctcctccccatccctcctc

SEQ ID NO: 338727 - DNA, 20 bp, Artificial
  CRISPR gRNA sequence
tcctccccatccctcctcca

SEQ ID NO: 338728 - DNA, 20 bp, Artificial
  CRISPR gRNA sequence
ctccccatccctcctccatg

SEQ ID NO: 338729 - DNA, 20 bp, Artificial
  CRISPR gRNA sequence
cccatccctcctccatgctg

SEQ ID NO: 338730 - DNA, 20 bp, Artificial
  CRISPR gRNA sequence
ctccatgctgctcccaaaat

SEQ ID NO: 338731 - DNA, 20 bp, Artificial
  CRISPR gRNA sequence
catgctgctcccaaaattat

SEQ ID NO: 338732 - DNA, 20 bp, Artificial
  CRISPR gRNA sequence
ctcccaaaattatgtttcag

SEQ ID NO: 338733 - DNA, 20 bp, Artificial
  CRISPR gRNA sequence
ccaaaattatgtttcagaaa

SEQ ID NO: 338734 - DNA, 20 bp, Artificial
  CRISPR gRNA sequence
tgtttcagaaaagcatttca

SEQ ID NO: 338735 - DNA, 20 bp, Artificial
  CRISPR gRNA sequence
cagaaaagcatttcactccc

SEQ ID NO: 338736 - DNA, 20 bp, Artificial
  CRISPR gRNA sequence
agaaaagcatttcactcccc

SEQ ID NO: 338737 - DNA, 20 bp, Artificial
  CRISPR gRNA sequence
cactccccagtttaaaagtc

SEQ ID NO: 338738 - DNA, 20 bp, Artificial
  CRISPR gRNA sequence
actccccagtttaaaagtct

SEQ ID NO: 338739 - DNA, 20 bp, Artificial
  CRISPR gRNA sequence
cccagtttaaaagtctctat

SEQ ID NO: 338740 - DNA, 20 bp, Artificial
  CRISPR gRNA sequence
aaaagtctctattagtgttc

SEQ ID NO: 338741 - DNA, 20 bp, Artificial
  CRISPR gRNA sequence
aaagtctctattagtgttct

SEQ ID NO: 338742 - DNA, 20 bp, Artificial
  CRISPR gRNA sequence
tattagtgttctattgctta

SEQ ID NO: 338743 - DNA, 20 bp, Artificial
  CRISPR gRNA sequence
ttagtgttctattgcttata

SEQ ID NO: 338744 - DNA, 20 bp, Artificial
  CRISPR gRNA sequence
gtgttctattgcttataagg

SEQ ID NO: 338745 - DNA, 20 bp, Artificial
  CRISPR gRNA sequence
tattgcttataaggtgtttt

SEQ ID NO: 338746 - DNA, 20 bp, Artificial
  CRISPR gRNA sequence
ttgcttataaggtgttttaa

SEQ ID NO: 338747 - DNA, 20 bp, Artificial
  CRISPR gRNA sequence
cttataaggtgttttaaaat

SEQ ID NO: 338748 - DNA, 20 bp, Artificial
  CRISPR gRNA sequence
ataaggtgttttaaaatata

SEQ ID NO: 338749 - DNA, 20 bp, Artificial
  CRISPR gRNA sequence
taaggtgttttaaaatatat

SEQ ID NO: 338750 - DNA, 20 bp, Artificial
  CRISPR gRNA sequence
taaaatatatatatctggct

SEQ ID NO: 338751 - DNA, 20 bp, Artificial
  CRISPR gRNA sequence
aaaatatatatatctggctt

SEQ ID NO: 338752 - DNA, 20 bp, Artificial
  CRISPR gRNA sequence
aaatatatatatctggcttg

SEQ ID NO: 338753 - DNA, 20 bp, Artificial
  CRISPR gRNA sequence
gcttgacacaaaatgctttc

SEQ ID NO: 338754 - DNA, 20 bp, Artificial
  CRISPR gRNA sequence
gacacaaaatgctttcacaa

SEQ ID NO: 338755 - DNA, 20 bp, Artificial
  CRISPR gRNA sequence
acacaaaatgctttcacaat

SEQ ID NO: 338756 - DNA, 20 bp, Artificial
  CRISPR gRNA sequence
tcacaatctcataggccatc

SEQ ID NO: 338757 - DNA, 20 bp, Artificial
  CRISPR gRNA sequence
cacaatctcataggccatct

SEQ ID NO: 338758 - DNA, 20 bp, Artificial
  CRISPR gRNA sequence
acaatctcataggccatcta

SEQ ID NO: 338759 - DNA, 20 bp, Artificial
  CRISPR gRNA sequence
ataggccatctattgaagcc

SEQ ID NO: 338760 - DNA, 20 bp, Artificial
  CRISPR gRNA sequence
ttgaagccacactgaacttt

SEQ ID NO: 338761 - DNA, 20 bp, Artificial
  CRISPR gRNA sequence
aagccacactgaactttttg

SEQ ID NO: 338762 - DNA, 20 bp, Artificial
  CRISPR gRNA sequence
aactttttggccatttcttt

SEQ ID NO: 338763 - DNA, 20 bp, Artificial
  CRISPR gRNA sequence
tttggccatttctttcacac

SEQ ID NO: 338764 - DNA, 20 bp, Artificial
  CRISPR gRNA sequence
ttggccatttctttcacact

SEQ ID NO: 338765 - DNA, 20 bp, Artificial
  CRISPR gRNA sequence
tggccatttctttcacactt

SEQ ID NO: 338766 - DNA, 20 bp, Artificial
  CRISPR gRNA sequence
ggccatttctttcacacttc

SEQ ID NO: 338767 - DNA, 20 bp, Artificial
  CRISPR gRNA sequence
gccatttctttcacacttct

SEQ ID NO: 338768 - DNA, 20 bp, Artificial
  CRISPR gRNA sequence
ctttcacacttctgttcttt

SEQ ID NO: 338769 - DNA, 20 bp, Artificial
  CRISPR gRNA sequence
tttcacacttctgttcttta

SEQ ID NO: 338770 - DNA, 20 bp, Artificial
  CRISPR gRNA sequence
tcacacttctgttctttact

SEQ ID NO: 338771 - DNA, 20 bp, Artificial
  CRISPR gRNA sequence
cacacttctgttctttacta

SEQ ID NO: 338772 - DNA, 20 bp, Artificial
  CRISPR gRNA sequence
acacttctgttctttactac

SEQ ID NO: 338773 - DNA, 20 bp, Artificial
  CRISPR gRNA sequence
ctgttctttactactagaat

SEQ ID NO: 338774 - DNA, 20 bp, Artificial
  CRISPR gRNA sequence
tgttctttactactagaata

SEQ ID NO: 338775 - DNA, 20 bp, Artificial
  CRISPR gRNA sequence
ttctttactactagaatatg

SEQ ID NO: 338776 - DNA, 20 bp, Artificial
  CRISPR gRNA sequence
tttactactagaatatgctt

SEQ ID NO: 338777 - DNA, 20 bp, Artificial
  CRISPR gRNA sequence
tactactagaatatgcttca

SEQ ID NO: 338778 - DNA, 20 bp, Artificial
  CRISPR gRNA sequence
actactagaatatgcttcac

SEQ ID NO: 338779 - DNA, 20 bp, Artificial
  CRISPR gRNA sequence
ctactagaatatgcttcaca

SEQ ID NO: 338780 - DNA, 20 bp, Artificial
  CRISPR gRNA sequence
ctagaatatgcttcacattt

SEQ ID NO: 338781 - DNA, 20 bp, Artificial
  CRISPR gRNA sequence
gaatatgcttcacatttcat

SEQ ID NO: 338782 - DNA, 20 bp, Artificial
  CRISPR gRNA sequence
cacatttcattatttctgtt

SEQ ID NO: 338783 - DNA, 20 bp, Artificial
  CRISPR gRNA sequence
acatttcattatttctgtta

SEQ ID NO: 338784 - DNA, 20 bp, Artificial
  CRISPR gRNA sequence
cattatttctgttaccatga

SEQ ID NO: 338785 - DNA, 20 bp, Artificial
  CRISPR gRNA sequence
attatttctgttaccatgaa

SEQ ID NO: 338786 - DNA, 20 bp, Artificial
  CRISPR gRNA sequence
tttctgttaccatgaactaa

SEQ ID NO: 338787 - DNA, 20 bp, Artificial
  CRISPR gRNA sequence
ctgttaccatgaactaaaat

SEQ ID NO: 338788 - DNA, 20 bp, Artificial
  CRISPR gRNA sequence
tgttaccatgaactaaaata

SEQ ID NO: 338789 - DNA, 20 bp, Artificial
  CRISPR gRNA sequence
ttaccatgaactaaaatatt

SEQ ID NO: 338790 - DNA, 20 bp, Artificial
  CRISPR gRNA sequence
ccatgaactaaaatatttga

SEQ ID NO: 338791 - DNA, 20 bp, Artificial
  CRISPR gRNA sequence
aaatatttgattacccctta

SEQ ID NO: 338792 - DNA, 20 bp, Artificial
  CRISPR gRNA sequence
gattaccccttaatctgaga

SEQ ID NO: 338793 - DNA, 20 bp, Artificial
  CRISPR gRNA sequence
attaccccttaatctgagaa

SEQ ID NO: 338794 - DNA, 20 bp, Artificial
  CRISPR gRNA sequence
ccccttaatctgagaagaaa

SEQ ID NO: 338795 - DNA, 20 bp, Artificial
  CRISPR gRNA sequence
aatctgagaagaaattctca

SEQ ID NO: 338796 - DNA, 20 bp, Artificial
  CRISPR gRNA sequence
atctgagaagaaattctcat

SEQ ID NO: 338797 - DNA, 20 bp, Artificial
  CRISPR gRNA sequence
agaagaaattctcattcact

SEQ ID NO: 338798 - DNA, 20 bp, Artificial
  CRISPR gRNA sequence
tcattcactcttcaagaacc

SEQ ID NO: 338799 - DNA, 20 bp, Artificial
  CRISPR gRNA sequence
attcactcttcaagaaccat

SEQ ID NO: 338800 - DNA, 20 bp, Artificial
  CRISPR gRNA sequence
actcttcaagaaccatttta

SEQ ID NO: 338801 - DNA, 20 bp, Artificial
  CRISPR gRNA sequence
ttcaagaaccattttaaatg

SEQ ID NO: 338802 - DNA, 20 bp, Artificial
  CRISPR gRNA sequence
caagaaccattttaaatgtc

SEQ ID NO: 338803 - DNA, 20 bp, Artificial
  CRISPR gRNA sequence
aagaaccattttaaatgtca

SEQ ID NO: 338804 - DNA, 20 bp, Artificial
  CRISPR gRNA sequence
taaatgtcaacttctctctt

SEQ ID NO: 338805 - DNA, 20 bp, Artificial
  CRISPR gRNA sequence
aaatgtcaacttctctcttg

SEQ ID NO: 338806 - DNA, 20 bp, Artificial
  CRISPR gRNA sequence
aatgtcaacttctctcttga

SEQ ID NO: 338807 - DNA, 20 bp, Artificial
  CRISPR gRNA sequence
ctctcttgagatatttattt

SEQ ID NO: 338808 - DNA, 20 bp, Artificial
  CRISPR gRNA sequence
tctcttgagatatttatttc

SEQ ID NO: 338809 - DNA, 20 bp, Artificial
  CRISPR gRNA sequence
tcttgagatatttatttcca

SEQ ID NO: 338810 - DNA, 20 bp, Artificial
  CRISPR gRNA sequence
ttgagatatttatttccaag

SEQ ID NO: 338811 - DNA, 20 bp, Artificial
  CRISPR gRNA sequence
gagatatttatttccaagac

SEQ ID NO: 338812 - DNA, 20 bp, Artificial
  CRISPR gRNA sequence
agatatttatttccaagacc

SEQ ID NO: 338813 - DNA, 20 bp, Artificial
  CRISPR gRNA sequence
atttccaagaccaccagaca

SEQ ID NO: 338814 - DNA, 20 bp, Artificial
  CRISPR gRNA sequence
tttccaagaccaccagacaa

SEQ ID NO: 338815 - DNA, 20 bp, Artificial
  CRISPR gRNA sequence
ccaagaccaccagacaaaga

SEQ ID NO: 338816 - DNA, 20 bp, Artificial
  CRISPR gRNA sequence
caagaccaccagacaaagac

SEQ ID NO: 338817 - DNA, 20 bp, Artificial
  CRISPR gRNA sequence
ttatttctatgctcccaata

SEQ ID NO: 338818 - DNA, 20 bp, Artificial
  CRISPR gRNA sequence
atttctatgctcccaataat

SEQ ID NO: 338819 - DNA, 20 bp, Artificial
  CRISPR gRNA sequence
tttctatgctcccaataata

SEQ ID NO: 338820 - DNA, 20 bp, Artificial
  CRISPR gRNA sequence
ctatgctcccaataatactt

SEQ ID NO: 338821 - DNA, 20 bp, Artificial
  CRISPR gRNA sequence
tatgctcccaataatacttt

SEQ ID NO: 338822 - DNA, 20 bp, Artificial
  CRISPR gRNA sequence
tgctcccaataatactttgt

SEQ ID NO: 338823 - DNA, 20 bp, Artificial
  CRISPR gRNA sequence
ccaataatactttgtttagg

SEQ ID NO: 338824 - DNA, 20 bp, Artificial
  CRISPR gRNA sequence
tgtttaggccagtatatttt

SEQ ID NO: 338825 - DNA, 20 bp, Artificial
  CRISPR gRNA sequence
gtttaggccagtatatttta

SEQ ID NO: 338826 - DNA, 20 bp, Artificial
  CRISPR gRNA sequence
tttaggccagtatattttag

SEQ ID NO: 338827 - DNA, 20 bp, Artificial
  CRISPR gRNA sequence
aggccagtatattttagcac

SEQ ID NO: 338828 - DNA, 20 bp, Artificial
  CRISPR gRNA sequence
ggccagtatattttagcaca

SEQ ID NO: 338829 - DNA, 20 bp, Artificial
  CRISPR gRNA sequence
tagcacatagcatcttggat

SEQ ID NO: 338830 - DNA, 20 bp, Artificial
  CRISPR gRNA sequence
agcacatagcatcttggatc

SEQ ID NO: 338831 - DNA, 20 bp, Artificial
  CRISPR gRNA sequence
gcacatagcatcttggatca

SEQ ID NO: 338832 - DNA, 20 bp, Artificial
  CRISPR gRNA sequence
ggatcataattatttttgtc

SEQ ID NO: 338833 - DNA, 20 bp, Artificial
  CRISPR gRNA sequence
gatcataattatttttgtct

SEQ ID NO: 338834 - DNA, 20 bp, Artificial
  CRISPR gRNA sequence
tttttgtctgtcttcctcat

SEQ ID NO: 338835 - DNA, 20 bp, Artificial
  CRISPR gRNA sequence
ttgtctgtcttcctcattta

SEQ ID NO: 338836 - DNA, 20 bp, Artificial
  CRISPR gRNA sequence
tgtctgtcttcctcatttaa

SEQ ID NO: 338837 - DNA, 20 bp, Artificial
  CRISPR gRNA sequence
gtctgtcttcctcatttaac

SEQ ID NO: 338838 - DNA, 20 bp, Artificial
  CRISPR gRNA sequence
tctgtcttcctcatttaacc

SEQ ID NO: 338839 - DNA, 20 bp, Artificial
  CRISPR gRNA sequence
tcttcctcatttaaccatga

SEQ ID NO: 338840 - DNA, 20 bp, Artificial
  CRISPR gRNA sequence
cctcatttaaccatgagctc

SEQ ID NO: 338841 - DNA, 20 bp, Artificial
  CRISPR gRNA sequence
ctcatttaaccatgagctcc

SEQ ID NO: 338842 - DNA, 20 bp, Artificial
  CRISPR gRNA sequence
atttaaccatgagctccaca

SEQ ID NO: 338843 - DNA, 20 bp, Artificial
  CRISPR gRNA sequence
aaccatgagctccacaaaga

SEQ ID NO: 338844 - DNA, 20 bp, Artificial
  CRISPR gRNA sequence
accatgagctccacaaagat

SEQ ID NO: 338845 - DNA, 20 bp, Artificial
  CRISPR gRNA sequence
cacaaagataaggactgcat

SEQ ID NO: 338846 - DNA, 20 bp, Artificial
  CRISPR gRNA sequence
cattacagttgcctaaaaaa

SEQ ID NO: 338847 - DNA, 20 bp, Artificial
  CRISPR gRNA sequence
cagttgcctaaaaaatccca

SEQ ID NO: 338848 - DNA, 20 bp, Artificial
  CRISPR gRNA sequence
cctaaaaaatcccaggacct

SEQ ID NO: 338849 - DNA, 20 bp, Artificial
  CRISPR gRNA sequence
aaaaatcccaggaccttgaa

SEQ ID NO: 338850 - DNA, 20 bp, Artificial
  CRISPR gRNA sequence
gaacatagtggaagctcaat

SEQ ID NO: 338851 - DNA, 20 bp, Artificial
  CRISPR gRNA sequence
aacatagtggaagctcaatc

SEQ ID NO: 338852 - DNA, 20 bp, Artificial
  CRISPR gRNA sequence
aatcatattaaataaaagaa

SEQ ID NO: 338853 - DNA, 20 bp, Artificial
  CRISPR gRNA sequence
aataaaagaattaatattaa

SEQ ID NO: 338854 - DNA, 20 bp, Artificial
  CRISPR gRNA sequence
atattaacagaagaatataa

SEQ ID NO: 338855 - DNA, 20 bp, Artificial
  CRISPR gRNA sequence
acagaagaatataaaggcta

SEQ ID NO: 338856 - DNA, 20 bp, Artificial
  CRISPR gRNA sequence
agcatgtttggtaaatatct

SEQ ID NO: 338857 - DNA, 20 bp, Artificial
  CRISPR gRNA sequence
ggtaaatatctttgtaatgg

SEQ ID NO: 338858 - DNA, 20 bp, Artificial
  CRISPR gRNA sequence
gtaaatatctttgtaatggg

SEQ ID NO: 338859 - DNA, 20 bp, Artificial
  CRISPR gRNA sequence
tgtaatgggccaagaagagg

SEQ ID NO: 338860 - DNA, 20 bp, Artificial
  CRISPR gRNA sequence
gtaatgggccaagaagagga

SEQ ID NO: 338861 - DNA, 20 bp, Artificial
  CRISPR gRNA sequence
taatgggccaagaagaggag

SEQ ID NO: 338862 - DNA, 20 bp, Artificial
  CRISPR gRNA sequence
tttactgaagattgggagat

SEQ ID NO: 338863 - DNA, 20 bp, Artificial
  CRISPR gRNA sequence
actgaagattgggagatact

SEQ ID NO: 338864 - DNA, 20 bp, Artificial
  CRISPR gRNA sequence
ctgaagattgggagatactt

SEQ ID NO: 338865 - DNA, 20 bp, Artificial
  CRISPR gRNA sequence
aagattgggagatacttatt

SEQ ID NO: 338866 - DNA, 20 bp, Artificial
  CRISPR gRNA sequence
ggagatacttatttcccagt

SEQ ID NO: 338867 - DNA, 20 bp, Artificial
  CRISPR gRNA sequence
atttcccagtcaaaaagaaa

SEQ ID NO: 338868 - DNA, 20 bp, Artificial
  CRISPR gRNA sequence
tttcccagtcaaaaagaaaa

SEQ ID NO: 338869 - DNA, 20 bp, Artificial
  CRISPR gRNA sequence
cccagtcaaaaagaaaagac

SEQ ID NO: 338870 - DNA, 20 bp, Artificial
  CRISPR gRNA sequence
ccagtcaaaaagaaaagact

SEQ ID NO: 338871 - DNA, 20 bp, Artificial
  CRISPR gRNA sequence
acgggaaagggagaccctcc

SEQ ID NO: 338872 - DNA, 20 bp, Artificial
  CRISPR gRNA sequence
ctctcccaaacacacactct

SEQ ID NO: 338873 - DNA, 20 bp, Artificial
  CRISPR gRNA sequence
tcccaaacacacactctgac

SEQ ID NO: 338874 - DNA, 20 bp, Artificial
  CRISPR gRNA sequence
ccaaacacacactctgaccg

SEQ ID NO: 338875 - DNA, 20 bp, Artificial
  CRISPR gRNA sequence
tgaccggagaagctgagcgt

SEQ ID NO: 338876 - DNA, 20 bp, Artificial
  CRISPR gRNA sequence
accggagaagctgagcgtct

SEQ ID NO: 338877 - DNA, 20 bp, Artificial
  CRISPR gRNA sequence
agcgtctgtttgtggagaag

SEQ ID NO: 338878 - DNA, 20 bp, Artificial
  CRISPR gRNA sequence
tttgtggagaagtttccgac

SEQ ID NO: 338879 - DNA, 20 bp, Artificial
  CRISPR gRNA sequence
gtggagaagtttccgacttt

SEQ ID NO: 338880 - DNA, 20 bp, Artificial
  CRISPR gRNA sequence
tggagaagtttccgacttta

SEQ ID NO: 338881 - DNA, 20 bp, Artificial
  CRISPR gRNA sequence
ccgactttatctggaggtga

SEQ ID NO: 338882 - DNA, 20 bp, Artificial
  CRISPR gRNA sequence
cgactttatctggaggtgag

SEQ ID NO: 338883 - DNA, 20 bp, Artificial
  CRISPR gRNA sequence
tatctggaggtgagtcaagt

SEQ ID NO: 338884 - DNA, 20 bp, Artificial
  CRISPR gRNA sequence
atctggaggtgagtcaagtt

SEQ ID NO: 338885 - DNA, 20 bp, Artificial
  CRISPR gRNA sequence
tctggaggtgagtcaagtta

SEQ ID NO: 338886 - DNA, 20 bp, Artificial
  CRISPR gRNA sequence
gaggtgagtcaagttagaga

SEQ ID NO: 338887 - DNA, 20 bp, Artificial
  CRISPR gRNA sequence
gagagccaaacggagcaaaa

SEQ ID NO: 338888 - DNA, 20 bp, Artificial
  CRISPR gRNA sequence
cagaaaggctctgggagctc

SEQ ID NO: 338889 - DNA, 20 bp, Artificial
  CRISPR gRNA sequence
tgggagctcaatgggtcccc

SEQ ID NO: 338890 - DNA, 20 bp, Artificial
  CRISPR gRNA sequence
ggagctcaatgggtccccaa

SEQ ID NO: 338891 - DNA, 20 bp, Artificial
  CRISPR gRNA sequence
aatgggtccccaagcagccc

SEQ ID NO: 338892 - DNA, 20 bp, Artificial
  CRISPR gRNA sequence
ttgccaggcaccacagggat

SEQ ID NO: 338893 - DNA, 20 bp, Artificial
  CRISPR gRNA sequence
gccaggcaccacagggatcc

SEQ ID NO: 338894 - DNA, 20 bp, Artificial
  CRISPR gRNA sequence
ccaggcaccacagggatcca

SEQ ID NO: 338895 - DNA, 20 bp, Artificial
  CRISPR gRNA sequence
gagggtggccagaggagcag

SEQ ID NO: 338896 - DNA, 20 bp, Artificial
  CRISPR gRNA sequence
cacagggagaaggaattctc

SEQ ID NO: 338897 - DNA, 20 bp, Artificial
  CRISPR gRNA sequence
tctagctgaactttgtaact

SEQ ID NO: 338898 - DNA, 20 bp, Artificial
  CRISPR gRNA sequence
tagctgaactttgtaactat

SEQ ID NO: 338899 - DNA, 20 bp, Artificial
  CRISPR gRNA sequence
gctgaactttgtaactattt

SEQ ID NO: 338900 - DNA, 20 bp, Artificial
  CRISPR gRNA sequence
aactttgtaactatttgaac

SEQ ID NO: 338901 - DNA, 20 bp, Artificial
  CRISPR gRNA sequence
tgtaactatttgaacagggc

SEQ ID NO: 338902 - DNA, 20 bp, Artificial
  CRISPR gRNA sequence
gtaactatttgaacagggca

SEQ ID NO: 338903 - DNA, 20 bp, Artificial
  CRISPR gRNA sequence
taactatttgaacagggcaa

SEQ ID NO: 338904 - DNA, 20 bp, Artificial
  CRISPR gRNA sequence
tttgaacagggcaagaagtc

SEQ ID NO: 338905 - DNA, 20 bp, Artificial
  CRISPR gRNA sequence
gaacagggcaagaagtctcc

SEQ ID NO: 338906 - DNA, 20 bp, Artificial
  CRISPR gRNA sequence
aacagggcaagaagtctcct

SEQ ID NO: 338907 - DNA, 20 bp, Artificial
  CRISPR gRNA sequence
ctggcctgaactggggggag

SEQ ID NO: 338908 - DNA, 20 bp, Artificial
  CRISPR gRNA sequence
gcctgaactggggggaggcc

SEQ ID NO: 338909 - DNA, 20 bp, Artificial
  CRISPR gRNA sequence
aactggggggaggccgtgaa

SEQ ID NO: 338910 - DNA, 20 bp, Artificial
  CRISPR gRNA sequence
gggggaggccgtgaatccag

SEQ ID NO: 338911 - DNA, 20 bp, Artificial
  CRISPR gRNA sequence
cacatgcaggggaaaaacta

SEQ ID NO: 338912 - DNA, 20 bp, Artificial
  CRISPR gRNA sequence
acatgcaggggaaaaactaa

SEQ ID NO: 338913 - DNA, 20 bp, Artificial
  CRISPR gRNA sequence
aagcccttttctttcacagc

SEQ ID NO: 338914 - DNA, 20 bp, Artificial
  CRISPR gRNA sequence
ttctttcacagctgggaggc

SEQ ID NO: 338915 - DNA, 20 bp, Artificial
  CRISPR gRNA sequence
tctttcacagctgggaggca

SEQ ID NO: 338916 - DNA, 20 bp, Artificial
  CRISPR gRNA sequence
ctttcacagctgggaggcag

SEQ ID NO: 338917 - DNA, 20 bp, Artificial
  CRISPR gRNA sequence
tttcacagctgggaggcaga

SEQ ID NO: 338918 - DNA, 20 bp, Artificial
  CRISPR gRNA sequence
tcacagctgggaggcagaaa

SEQ ID NO: 338919 - DNA, 20 bp, Artificial
  CRISPR gRNA sequence
cacagctgggaggcagaaag

SEQ ID NO: 338920 - DNA, 20 bp, Artificial
  CRISPR gRNA sequence
acagctgggaggcagaaagc

SEQ ID NO: 338921 - DNA, 20 bp, Artificial
  CRISPR gRNA sequence
ggaggcagaaagcctcaggc

SEQ ID NO: 338922 - DNA, 20 bp, Artificial
  CRISPR gRNA sequence
aggcaagttttcaagccagt

SEQ ID NO: 338923 - DNA, 20 bp, Artificial
  CRISPR gRNA sequence
tcaagccagtcttgcccttt

SEQ ID NO: 338924 - DNA, 20 bp, Artificial
  CRISPR gRNA sequence
caagccagtcttgccctttg

SEQ ID NO: 338925 - DNA, 20 bp, Artificial
  CRISPR gRNA sequence
aagccagtcttgccctttgc

SEQ ID NO: 338926 - DNA, 20 bp, Artificial
  CRISPR gRNA sequence
gccctttgcctggaaacaga

SEQ ID NO: 338927 - DNA, 20 bp, Artificial
  CRISPR gRNA sequence
ccctttgcctggaaacagac

SEQ ID NO: 338928 - DNA, 20 bp, Artificial
  CRISPR gRNA sequence
tgcctggaaacagacttggg

SEQ ID NO: 338929 - DNA, 20 bp, Artificial
  CRISPR gRNA sequence
gcctggaaacagacttgggg

SEQ ID NO: 338930 - DNA, 20 bp, Artificial
  CRISPR gRNA sequence
cctggaaacagacttggggc

SEQ ID NO: 338931 - DNA, 20 bp, Artificial
  CRISPR gRNA sequence
gaaacagacttggggcggtt

SEQ ID NO: 338932 - DNA, 20 bp, Artificial
  CRISPR gRNA sequence
ggggcggttagaggaggcat

SEQ ID NO: 338933 - DNA, 20 bp, Artificial
  CRISPR gRNA sequence
gggcggttagaggaggcatg

SEQ ID NO: 338934 - DNA, 20 bp, Artificial
  CRISPR gRNA sequence
gaggaggcatgattagagtg

SEQ ID NO: 338935 - DNA, 20 bp, Artificial
  CRISPR gRNA sequence
gagtgagaccagcccttccg

SEQ ID NO: 338936 - DNA, 20 bp, Artificial
  CRISPR gRNA sequence
ccgtttgcatgggatctgga

SEQ ID NO: 338937 - DNA, 20 bp, Artificial
  CRISPR gRNA sequence
cgtttgcatgggatctggat

SEQ ID NO: 338938 - DNA, 20 bp, Artificial
  CRISPR gRNA sequence
gcatgggatctggatgagac

SEQ ID NO: 338939 - DNA, 20 bp, Artificial
  CRISPR gRNA sequence
catgggatctggatgagacc

SEQ ID NO: 338940 - DNA, 20 bp, Artificial
  CRISPR gRNA sequence
gatgagacctgtgactgccg

SEQ ID NO: 338941 - DNA, 20 bp, Artificial
  CRISPR gRNA sequence
tgactgccggttttccccca

SEQ ID NO: 338942 - DNA, 20 bp, Artificial
  CRISPR gRNA sequence
ccggttttcccccacttccc

SEQ ID NO: 338943 - DNA, 20 bp, Artificial
  CRISPR gRNA sequence
tcccccacttccctgacaac

SEQ ID NO: 338944 - DNA, 20 bp, Artificial
  CRISPR gRNA sequence
cccccacttccctgacaacc

SEQ ID NO: 338945 - DNA, 20 bp, Artificial
  CRISPR gRNA sequence
ccccacttccctgacaacct

SEQ ID NO: 338946 - DNA, 20 bp, Artificial
  CRISPR gRNA sequence
ccctgacaacctgcatgact

SEQ ID NO: 338947 - DNA, 20 bp, Artificial
  CRISPR gRNA sequence
cctgacaacctgcatgactc

SEQ ID NO: 338948 - DNA, 20 bp, Artificial
  CRISPR gRNA sequence
acaacctgcatgactcagca

SEQ ID NO: 338949 - DNA, 20 bp, Artificial
  CRISPR gRNA sequence
catgactcagcagaggcagc

SEQ ID NO: 338950 - DNA, 20 bp, Artificial
  CRISPR gRNA sequence
agcagaggcagccataatcc

SEQ ID NO: 338951 - DNA, 20 bp, Artificial
  CRISPR gRNA sequence
ctaggtacacaactccagtg

SEQ ID NO: 338952 - DNA, 20 bp, Artificial
  CRISPR gRNA sequence
ggtacacaactccagtgacc

SEQ ID NO: 338953 - DNA, 20 bp, Artificial
  CRISPR gRNA sequence
cagtgacctgggaatctcac

SEQ ID NO: 338954 - DNA, 20 bp, Artificial
  CRISPR gRNA sequence
ggaatctcacccacatcccc

SEQ ID NO: 338955 - DNA, 20 bp, Artificial
  CRISPR gRNA sequence
acccacatcccccacagcag

SEQ ID NO: 338956 - DNA, 20 bp, Artificial
  CRISPR gRNA sequence
cccaaggagagtctgagctc

SEQ ID NO: 338957 - DNA, 20 bp, Artificial
  CRISPR gRNA sequence
agctcagacatgcctagccc

SEQ ID NO: 338958 - DNA, 20 bp, Artificial
  CRISPR gRNA sequence
agacatgcctagccctgccc

SEQ ID NO: 338959 - DNA, 20 bp, Artificial
  CRISPR gRNA sequence
gccctgcccttccctaccca

SEQ ID NO: 338960 - DNA, 20 bp, Artificial
  CRISPR gRNA sequence
cccttccctacccaccctgg

SEQ ID NO: 338961 - DNA, 20 bp, Artificial
  CRISPR gRNA sequence
ccctacccaccctggttagc

SEQ ID NO: 338962 - DNA, 20 bp, Artificial
  CRISPR gRNA sequence
cctacccaccctggttagca

SEQ ID NO: 338963 - DNA, 20 bp, Artificial
  CRISPR gRNA sequence
cccaccctggttagcagaac

SEQ ID NO: 338964 - DNA, 20 bp, Artificial
  CRISPR gRNA sequence
gttagcagaacacaaagggc

SEQ ID NO: 338965 - DNA, 20 bp, Artificial
  CRISPR gRNA sequence
gcagaacacaaagggcatat

SEQ ID NO: 338966 - DNA, 20 bp, Artificial
  CRISPR gRNA sequence
ggagttctagggccccaccc

SEQ ID NO: 338967 - DNA, 20 bp, Artificial
  CRISPR gRNA sequence
tagggccccacccaccacca

SEQ ID NO: 338968 - DNA, 20 bp, Artificial
  CRISPR gRNA sequence
gggccccacccaccaccaga

SEQ ID NO: 338969 - DNA, 20 bp, Artificial
  CRISPR gRNA sequence
tctatactattacagctgat

SEQ ID NO: 338970 - DNA, 20 bp, Artificial
  CRISPR gRNA sequence
tatactattacagctgatgc

SEQ ID NO: 338971 - DNA, 20 bp, Artificial
  CRISPR gRNA sequence
tactattacagctgatgctt

SEQ ID NO: 338972 - DNA, 20 bp, Artificial
  CRISPR gRNA sequence
ttacagctgatgctttctgg

SEQ ID NO: 338973 - DNA, 20 bp, Artificial
  CRISPR gRNA sequence
cagctgatgctttctggaaa

SEQ ID NO: 338974 - DNA, 20 bp, Artificial
  CRISPR gRNA sequence
atgctttctggaaagcgcca

SEQ ID NO: 338975 - DNA, 20 bp, Artificial
  CRISPR gRNA sequence
tctggaaagcgccacctcct

SEQ ID NO: 338976 - DNA, 20 bp, Artificial
  CRISPR gRNA sequence
ctggaaagcgccacctcctg

SEQ ID NO: 338977 - DNA, 20 bp, Artificial
  CRISPR gRNA sequence
tggaaagcgccacctcctgg

SEQ ID NO: 338978 - DNA, 20 bp, Artificial
  CRISPR gRNA sequence
gaaagcgccacctcctggca

SEQ ID NO: 338979 - DNA, 20 bp, Artificial
  CRISPR gRNA sequence
ctggcaggaggccaaccagc

SEQ ID NO: 338980 - DNA, 20 bp, Artificial
  CRISPR gRNA sequence
gcaggaggccaaccagcaca

SEQ ID NO: 338981 - DNA, 20 bp, Artificial
  CRISPR gRNA sequence
aaccaccaaagctaaaggcc

SEQ ID NO: 338982 - DNA, 20 bp, Artificial
  CRISPR gRNA sequence
aaggccctcatggagtccat

SEQ ID NO: 338983 - DNA, 20 bp, Artificial
  CRISPR gRNA sequence
atggagtccattgcaccctt

SEQ ID NO: 338984 - DNA, 20 bp, Artificial
  CRISPR gRNA sequence
cacccttcgccacctccacc

SEQ ID NO: 338985 - DNA, 20 bp, Artificial
  CRISPR gRNA sequence
cgccacctccaccagaacag

SEQ ID NO: 338986 - DNA, 20 bp, Artificial
  CRISPR gRNA sequence
gccacctccaccagaacagc

SEQ ID NO: 338987 - DNA, 20 bp, Artificial
  CRISPR gRNA sequence
caccagaacagcactggtat

SEQ ID NO: 338988 - DNA, 20 bp, Artificial
  CRISPR gRNA sequence
gtatccatggctgagagacc

SEQ ID NO: 338989 - DNA, 20 bp, Artificial
  CRISPR gRNA sequence
agagacccatagatggttca

SEQ ID NO: 338990 - DNA, 20 bp, Artificial
  CRISPR gRNA sequence
acatcacaggaatctgtgca

SEQ ID NO: 338991 - DNA, 20 bp, Artificial
  CRISPR gRNA sequence
tgcagacaacccccaatacc

SEQ ID NO: 338992 - DNA, 20 bp, Artificial
  CRISPR gRNA sequence
gctgggtggctagacccaga

SEQ ID NO: 338993 - DNA, 20 bp, Artificial
  CRISPR gRNA sequence
ctgggtggctagacccagaa

SEQ ID NO: 338994 - DNA, 20 bp, Artificial
  CRISPR gRNA sequence
ggtggctagacccagaagag

SEQ ID NO: 338995 - DNA, 20 bp, Artificial
  CRISPR gRNA sequence
gacccagaagagagacaaca

SEQ ID NO: 338996 - DNA, 20 bp, Artificial
  CRISPR gRNA sequence
cagtttggctcactggaagc

SEQ ID NO: 338997 - DNA, 20 bp, Artificial
  CRISPR gRNA sequence
ggctcactggaagccacata

SEQ ID NO: 338998 - DNA, 20 bp, Artificial
  CRISPR gRNA sequence
gctcactggaagccacatac

SEQ ID NO: 338999 - DNA, 20 bp, Artificial
  CRISPR gRNA sequence
actggaagccacatacatag

SEQ ID NO: 339000 - DNA, 20 bp, Artificial
  CRISPR gRNA sequence
gaagccacatacataggaaa

SEQ ID NO: 339001 - DNA, 20 bp, Artificial
  CRISPR gRNA sequence
catgggacaaaaaaaaaatc

SEQ ID NO: 339002 - DNA, 20 bp, Artificial
  CRISPR gRNA sequence
aagaacagccttcagcccta

SEQ ID NO: 339003 - DNA, 20 bp, Artificial
  CRISPR gRNA sequence
cagccctagacctcccctct

SEQ ID NO: 339004 - DNA, 20 bp, Artificial
  CRISPR gRNA sequence
agccctagacctcccctctg

SEQ ID NO: 339005 - DNA, 20 bp, Artificial
  CRISPR gRNA sequence
gacctcccctctgacagcac

SEQ ID NO: 339006 - DNA, 20 bp, Artificial
  CRISPR gRNA sequence
ccctctgacagcacctaccc

SEQ ID NO: 339007 - DNA, 20 bp, Artificial
  CRISPR gRNA sequence
tgacagcacctacccaaatg

SEQ ID NO: 339008 - DNA, 20 bp, Artificial
  CRISPR gRNA sequence
acagcacctacccaaatgag

SEQ ID NO: 339009 - DNA, 20 bp, Artificial
  CRISPR gRNA sequence
cccaaatgagaaggaaccag

SEQ ID NO: 339010 - DNA, 20 bp, Artificial
  CRISPR gRNA sequence
tggtaatatgacaaaacaag

SEQ ID NO: 339011 - DNA, 20 bp, Artificial
  CRISPR gRNA sequence
gtaatatgacaaaacaaggc

SEQ ID NO: 339012 - DNA, 20 bp, Artificial
  CRISPR gRNA sequence
ttcaacacccccaaaaaatc

SEQ ID NO: 339013 - DNA, 20 bp, Artificial
  CRISPR gRNA sequence
caacacccccaaaaaatcac

SEQ ID NO: 339014 - DNA, 20 bp, Artificial
  CRISPR gRNA sequence
aacacccccaaaaaatcaca

SEQ ID NO: 339015 - DNA, 20 bp, Artificial
  CRISPR gRNA sequence
gttcaccagcaatggatcca

SEQ ID NO: 339016 - DNA, 20 bp, Artificial
  CRISPR gRNA sequence
accagcaatggatccaaacc

SEQ ID NO: 339017 - DNA, 20 bp, Artificial
  CRISPR gRNA sequence
ttcatctacctgaaaaagaa

SEQ ID NO: 339018 - DNA, 20 bp, Artificial
  CRISPR gRNA sequence
catctacctgaaaaagaatt

SEQ ID NO: 339019 - DNA, 20 bp, Artificial
  CRISPR gRNA sequence
atctacctgaaaaagaattc

SEQ ID NO: 339020 - DNA, 20 bp, Artificial
  CRISPR gRNA sequence
cctgaaaaagaattcaggag

SEQ ID NO: 339021 - DNA, 20 bp, Artificial
  CRISPR gRNA sequence
aaaaagaattcaggaggtta

SEQ ID NO: 339022 - DNA, 20 bp, Artificial
  CRISPR gRNA sequence
aggaggttagttattaagct

SEQ ID NO: 339023 - DNA, 20 bp, Artificial
  CRISPR gRNA sequence
gttattaagctaatcgggga

SEQ ID NO: 339024 - DNA, 20 bp, Artificial
  CRISPR gRNA sequence
ttaagctaatcggggaggga

SEQ ID NO: 339025 - DNA, 20 bp, Artificial
  CRISPR gRNA sequence
agctaatcggggagggacca

SEQ ID NO: 339026 - DNA, 20 bp, Artificial
  CRISPR gRNA sequence
atcggggagggaccagagaa

SEQ ID NO: 339027 - DNA, 20 bp, Artificial
  CRISPR gRNA sequence
aaggaaatagatagcttaaa

SEQ ID NO: 339028 - DNA, 20 bp, Artificial
  CRISPR gRNA sequence
aaagaaaaaacaataaaaat

SEQ ID NO: 339029 - DNA, 20 bp, Artificial
  CRISPR gRNA sequence
aagaaaaaacaataaaaatt

SEQ ID NO: 339030 - DNA, 20 bp, Artificial
  CRISPR gRNA sequence
caggaaactttggacacaat

SEQ ID NO: 339031 - DNA, 20 bp, Artificial
  CRISPR gRNA sequence
aggaaactttggacacaatt

SEQ ID NO: 339032 - DNA, 20 bp, Artificial
  CRISPR gRNA sequence
tggacacaattttagaaagg

SEQ ID NO: 339033 - DNA, 20 bp, Artificial
  CRISPR gRNA sequence
ggacacaattttagaaaggt

SEQ ID NO: 339034 - DNA, 20 bp, Artificial
  CRISPR gRNA sequence
gacacaattttagaaaggtg

SEQ ID NO: 339035 - DNA, 20 bp, Artificial
  CRISPR gRNA sequence
tagaaaggtgaaatgctctg

SEQ ID NO: 339036 - DNA, 20 bp, Artificial
  CRISPR gRNA sequence
agaaaggtgaaatgctctgg

SEQ ID NO: 339037 - DNA, 20 bp, Artificial
  CRISPR gRNA sequence
gaaaggtgaaatgctctgga

SEQ ID NO: 339038 - DNA, 20 bp, Artificial
  CRISPR gRNA sequence
tggaaagtctcagcaataga

SEQ ID NO: 339039 - DNA, 20 bp, Artificial
  CRISPR gRNA sequence
gaaagtctcagcaatagaat

SEQ ID NO: 339040 - DNA, 20 bp, Artificial
  CRISPR gRNA sequence
agcaatagaattgaacaact

SEQ ID NO: 339041 - DNA, 20 bp, Artificial
  CRISPR gRNA sequence
aacaactagaagaaagaaat

SEQ ID NO: 339042 - DNA, 20 bp, Artificial
  CRISPR gRNA sequence
gaagaaagaaattcagagct

SEQ ID NO: 339043 - DNA, 20 bp, Artificial
  CRISPR gRNA sequence
agagcttgaagacaaggtct

SEQ ID NO: 339044 - DNA, 20 bp, Artificial
  CRISPR gRNA sequence
gaagacaaggtcttcgaatt

SEQ ID NO: 339045 - DNA, 20 bp, Artificial
  CRISPR gRNA sequence
aagacaaggtcttcgaatta

SEQ ID NO: 339046 - DNA, 20 bp, Artificial
  CRISPR gRNA sequence
cgaattaacccagtccaaca

SEQ ID NO: 339047 - DNA, 20 bp, Artificial
  CRISPR gRNA sequence
gaattaacccagtccaacaa

SEQ ID NO: 339048 - DNA, 20 bp, Artificial
  CRISPR gRNA sequence
acccagtccaacaaaaacaa

SEQ ID NO: 339049 - DNA, 20 bp, Artificial
  CRISPR gRNA sequence
gacaccagggtacacacact

SEQ ID NO: 339050 - DNA, 20 bp, Artificial
  CRISPR gRNA sequence
acaccagggtacacacactt

SEQ ID NO: 339051 - DNA, 20 bp, Artificial
  CRISPR gRNA sequence
acttaatctcttcacctaat

SEQ ID NO: 339052 - DNA, 20 bp, Artificial
  CRISPR gRNA sequence
cttaatctcttcacctaata

SEQ ID NO: 339053 - DNA, 20 bp, Artificial
  CRISPR gRNA sequence
aatctcttcacctaataatc

SEQ ID NO: 339054 - DNA, 20 bp, Artificial
  CRISPR gRNA sequence
atctcttcacctaataatct

SEQ ID NO: 339055 - DNA, 20 bp, Artificial
  CRISPR gRNA sequence
ttcacctaataatctagtcc

SEQ ID NO: 339056 - DNA, 20 bp, Artificial
  CRISPR gRNA sequence
cacctaataatctagtccaa

SEQ ID NO: 339057 - DNA, 20 bp, Artificial
  CRISPR gRNA sequence
acctaataatctagtccaat

SEQ ID NO: 339058 - DNA, 20 bp, Artificial
  CRISPR gRNA sequence
ataatctagtccaatcctct

SEQ ID NO: 339059 - DNA, 20 bp, Artificial
  CRISPR gRNA sequence
gtccaatcctctcattgtac

SEQ ID NO: 339060 - DNA, 20 bp, Artificial
  CRISPR gRNA sequence
tcattgtacagaaactaaag

SEQ ID NO: 339061 - DNA, 20 bp, Artificial
  CRISPR gRNA sequence
attgtacagaaactaaagca

SEQ ID NO: 339062 - DNA, 20 bp, Artificial
  CRISPR gRNA sequence
tacagaaactaaagcatcag

SEQ ID NO: 339063 - DNA, 20 bp, Artificial
  CRISPR gRNA sequence
aagcatcagagctaaagaga

SEQ ID NO: 339064 - DNA, 20 bp, Artificial
  CRISPR gRNA sequence
aagagatttgctacgaaata

SEQ ID NO: 339065 - DNA, 20 bp, Artificial
  CRISPR gRNA sequence
gctacgaaataaaaaaacaa

SEQ ID NO: 339066 - DNA, 20 bp, Artificial
  CRISPR gRNA sequence
ctacgaaataaaaaaacaaa

SEQ ID NO: 339067 - DNA, 20 bp, Artificial
  CRISPR gRNA sequence
cgaaataaaaaaacaaaaag

SEQ ID NO: 339068 - DNA, 20 bp, Artificial
  CRISPR gRNA sequence
ttaacattaagctagatatg

SEQ ID NO: 339069 - DNA, 20 bp, Artificial
  CRISPR gRNA sequence
taacattaagctagatatga

SEQ ID NO: 339070 - DNA, 20 bp, Artificial
  CRISPR gRNA sequence
aacattaagctagatatgaa

SEQ ID NO: 339071 - DNA, 20 bp, Artificial
  CRISPR gRNA sequence
acattaagctagatatgaaa

SEQ ID NO: 339072 - DNA, 20 bp, Artificial
  CRISPR gRNA sequence
agctagatatgaaaatgaat

SEQ ID NO: 339073 - DNA, 20 bp, Artificial
  CRISPR gRNA sequence
gatatgaaaatgaatttcag

SEQ ID NO: 339074 - DNA, 20 bp, Artificial
  CRISPR gRNA sequence
caggtatttattttccttct

SEQ ID NO: 339075 - DNA, 20 bp, Artificial
  CRISPR gRNA sequence
aggtatttattttccttcta

SEQ ID NO: 339076 - DNA, 20 bp, Artificial
  CRISPR gRNA sequence
attttccttctaggtatatt

SEQ ID NO: 339077 - DNA, 20 bp, Artificial
  CRISPR gRNA sequence
ttttccttctaggtatattg

SEQ ID NO: 339078 - DNA, 20 bp, Artificial
  CRISPR gRNA sequence
tccttctaggtatattggat

SEQ ID NO: 339079 - DNA, 20 bp, Artificial
  CRISPR gRNA sequence
ccttctaggtatattggata

SEQ ID NO: 339080 - DNA, 20 bp, Artificial
  CRISPR gRNA sequence
cttctaggtatattggatat

SEQ ID NO: 339081 - DNA, 20 bp, Artificial
  CRISPR gRNA sequence
ctaggtatattggatatatt

SEQ ID NO: 339082 - DNA, 20 bp, Artificial
  CRISPR gRNA sequence
taggtatattggatatatta

SEQ ID NO: 339083 - DNA, 20 bp, Artificial
  CRISPR gRNA sequence
ggtatattggatatattatc

SEQ ID NO: 339084 - DNA, 20 bp, Artificial
  CRISPR gRNA sequence
gatatattatcaccttaata

SEQ ID NO: 339085 - DNA, 20 bp, Artificial
  CRISPR gRNA sequence
tcaccttaatacttaaagta

SEQ ID NO: 339086 - DNA, 20 bp, Artificial
  CRISPR gRNA sequence
aatacttaaagtagtattca

SEQ ID NO: 339087 - DNA, 20 bp, Artificial
  CRISPR gRNA sequence
atacttaaagtagtattcac

SEQ ID NO: 339088 - DNA, 20 bp, Artificial
  CRISPR gRNA sequence
aaagtagtattcacattggt

SEQ ID NO: 339089 - DNA, 20 bp, Artificial
  CRISPR gRNA sequence
aagtagtattcacattggtg

SEQ ID NO: 339090 - DNA, 20 bp, Artificial
  CRISPR gRNA sequence
acattggtgccacatatgtg

SEQ ID NO: 339091 - DNA, 20 bp, Artificial
  CRISPR gRNA sequence
gtgccacatatgtgttctgt

SEQ ID NO: 339092 - DNA, 20 bp, Artificial
  CRISPR gRNA sequence
tgtgattgaaagggttatta

SEQ ID NO: 339093 - DNA, 20 bp, Artificial
  CRISPR gRNA sequence
tgattgaaagggttattata

SEQ ID NO: 339094 - DNA, 20 bp, Artificial
  CRISPR gRNA sequence
aaagggttattatatatcaa

SEQ ID NO: 339095 - DNA, 20 bp, Artificial
  CRISPR gRNA sequence
ttatatatcaaaaaattatt

SEQ ID NO: 339096 - DNA, 20 bp, Artificial
  CRISPR gRNA sequence
tatatcaaaaaattatttta

SEQ ID NO: 339097 - DNA, 20 bp, Artificial
  CRISPR gRNA sequence
ttttaaagtgacttagatat

SEQ ID NO: 339098 - DNA, 20 bp, Artificial
  CRISPR gRNA sequence
taaagtgacttagatatgaa

SEQ ID NO: 339099 - DNA, 20 bp, Artificial
  CRISPR gRNA sequence
aaagtgacttagatatgaaa

SEQ ID NO: 339100 - DNA, 20 bp, Artificial
  CRISPR gRNA sequence
aagtgacttagatatgaaat

SEQ ID NO: 339101 - DNA, 20 bp, Artificial
  CRISPR gRNA sequence
agatatgaaattacattgta

SEQ ID NO: 339102 - DNA, 20 bp, Artificial
  CRISPR gRNA sequence
gatatgaaattacattgtac

SEQ ID NO: 339103 - DNA, 20 bp, Artificial
  CRISPR gRNA sequence
cattgtacataacacactca

SEQ ID NO: 339104 - DNA, 20 bp, Artificial
  CRISPR gRNA sequence
tacataacacactcatttcc

SEQ ID NO: 339105 - DNA, 20 bp, Artificial
  CRISPR gRNA sequence
atttccctagacattttcat

SEQ ID NO: 339106 - DNA, 20 bp, Artificial
  CRISPR gRNA sequence
ccctagacattttcattcat

SEQ ID NO: 339107 - DNA, 20 bp, Artificial
  CRISPR gRNA sequence
cctagacattttcattcatc

SEQ ID NO: 339108 - DNA, 20 bp, Artificial
  CRISPR gRNA sequence
gacattttcattcatcagcc

SEQ ID NO: 339109 - DNA, 20 bp, Artificial
  CRISPR gRNA sequence
tcattcatcagccatcatgt

SEQ ID NO: 339110 - DNA, 20 bp, Artificial
  CRISPR gRNA sequence
cattcatcagccatcatgta

SEQ ID NO: 339111 - DNA, 20 bp, Artificial
  CRISPR gRNA sequence
attcatcagccatcatgtat

SEQ ID NO: 339112 - DNA, 20 bp, Artificial
  CRISPR gRNA sequence
atcagccatcatgtattaag

SEQ ID NO: 339113 - DNA, 20 bp, Artificial
  CRISPR gRNA sequence
agctgggctgtcattgtacc

SEQ ID NO: 339114 - DNA, 20 bp, Artificial
  CRISPR gRNA sequence
ggctgtcattgtacctgggt

SEQ ID NO: 339115 - DNA, 20 bp, Artificial
  CRISPR gRNA sequence
tcattgtacctgggttcttc

SEQ ID NO: 339116 - DNA, 20 bp, Artificial
  CRISPR gRNA sequence
tacctgggttcttctctgat

SEQ ID NO: 339117 - DNA, 20 bp, Artificial
  CRISPR gRNA sequence
ggttcttctctgatgaagtc

SEQ ID NO: 339118 - DNA, 20 bp, Artificial
  CRISPR gRNA sequence
ttctctgatgaagtctaaat

SEQ ID NO: 339119 - DNA, 20 bp, Artificial
  CRISPR gRNA sequence
ctctgatgaagtctaaattc

SEQ ID NO: 339120 - DNA, 20 bp, Artificial
  CRISPR gRNA sequence
tctgatgaagtctaaattct

SEQ ID NO: 339121 - DNA, 20 bp, Artificial
  CRISPR gRNA sequence
tgatgaagtctaaattctta

SEQ ID NO: 339122 - DNA, 20 bp, Artificial
  CRISPR gRNA sequence
atgaagtctaaattcttaat

SEQ ID NO: 339123 - DNA, 20 bp, Artificial
  CRISPR gRNA sequence
aattcttaatgattttccca

SEQ ID NO: 339124 - DNA, 20 bp, Artificial
  CRISPR gRNA sequence
ttaatgattttcccatcact

SEQ ID NO: 339125 - DNA, 20 bp, Artificial
  CRISPR gRNA sequence
aatgattttcccatcactta

SEQ ID NO: 339126 - DNA, 20 bp, Artificial
  CRISPR gRNA sequence
atgattttcccatcacttat

SEQ ID NO: 339127 - DNA, 20 bp, Artificial
  CRISPR gRNA sequence
tcccatcacttatctgcctg

SEQ ID NO: 339128 - DNA, 20 bp, Artificial
  CRISPR gRNA sequence
cccatcacttatctgcctgt

SEQ ID NO: 339129 - DNA, 20 bp, Artificial
  CRISPR gRNA sequence
ccatcacttatctgcctgta

SEQ ID NO: 339130 - DNA, 20 bp, Artificial
  CRISPR gRNA sequence
atctgcctgtagaaatgtac

SEQ ID NO: 339131 - DNA, 20 bp, Artificial
  CRISPR gRNA sequence
tctgcctgtagaaatgtaca

SEQ ID NO: 339132 - DNA, 20 bp, Artificial
  CRISPR gRNA sequence
cctgtagaaatgtacagaaa

SEQ ID NO: 339133 - DNA, 20 bp, Artificial
  CRISPR gRNA sequence
tagaaatgtacagaaatgga

SEQ ID NO: 339134 - DNA, 20 bp, Artificial
  CRISPR gRNA sequence
acatatagaagtaaatttca

SEQ ID NO: 339135 - DNA, 20 bp, Artificial
  CRISPR gRNA sequence
catcataattaaataagtgc

SEQ ID NO: 339136 - DNA, 20 bp, Artificial
  CRISPR gRNA sequence
atcataattaaataagtgca

SEQ ID NO: 339137 - DNA, 20 bp, Artificial
  CRISPR gRNA sequence
aataagtgcaaataggcaca

SEQ ID NO: 339138 - DNA, 20 bp, Artificial
  CRISPR gRNA sequence
tgagatttttgcattagtcc

SEQ ID NO: 339139 - DNA, 20 bp, Artificial
  CRISPR gRNA sequence
ttgcattagtcctagatagt

SEQ ID NO: 339140 - DNA, 20 bp, Artificial
  CRISPR gRNA sequence
tgcattagtcctagatagtg

SEQ ID NO: 339141 - DNA, 20 bp, Artificial
  CRISPR gRNA sequence
gcattagtcctagatagtgc

SEQ ID NO: 339142 - DNA, 20 bp, Artificial
  CRISPR gRNA sequence
cattagtcctagatagtgca

SEQ ID NO: 339143 - DNA, 20 bp, Artificial
  CRISPR gRNA sequence
gtcctagatagtgcaaagta

SEQ ID NO: 339144 - DNA, 20 bp, Artificial
  CRISPR gRNA sequence
gatagtgcaaagtaaacaga

SEQ ID NO: 339145 - DNA, 20 bp, Artificial
  CRISPR gRNA sequence
taactgtgagtgcagtagac

SEQ ID NO: 339146 - DNA, 20 bp, Artificial
  CRISPR gRNA sequence
aactgtgagtgcagtagaca

SEQ ID NO: 339147 - DNA, 20 bp, Artificial
  CRISPR gRNA sequence
actgtgagtgcagtagacag

SEQ ID NO: 339148 - DNA, 20 bp, Artificial
  CRISPR gRNA sequence
tgagtgcagtagacagcttg

SEQ ID NO: 339149 - DNA, 20 bp, Artificial
  CRISPR gRNA sequence
gttgttgttattgttgtttt

SEQ ID NO: 339150 - DNA, 20 bp, Artificial
  CRISPR gRNA sequence
ttgttgttattgttgttttt

SEQ ID NO: 339151 - DNA, 20 bp, Artificial
  CRISPR gRNA sequence
ttgttattgttgtttttgca

SEQ ID NO: 339152 - DNA, 20 bp, Artificial
  CRISPR gRNA sequence
ttattgttgtttttgcatgt

SEQ ID NO: 339153 - DNA, 20 bp, Artificial
  CRISPR gRNA sequence
ttgttgtttttgcatgtaca

SEQ ID NO: 339154 - DNA, 20 bp, Artificial
  CRISPR gRNA sequence
ttgtttttgcatgtacagat

SEQ ID NO: 339155 - DNA, 20 bp, Artificial
  CRISPR gRNA sequence
tttttgcatgtacagattct

SEQ ID NO: 339156 - DNA, 20 bp, Artificial
  CRISPR gRNA sequence
ttgcatgtacagattctttg

SEQ ID NO: 339157 - DNA, 20 bp, Artificial
  CRISPR gRNA sequence
tgcatgtacagattctttgt

SEQ ID NO: 339158 - DNA, 20 bp, Artificial
  CRISPR gRNA sequence
gcatgtacagattctttgtt

SEQ ID NO: 339159 - DNA, 20 bp, Artificial
  CRISPR gRNA sequence
catgtacagattctttgttg

SEQ ID NO: 339160 - DNA, 20 bp, Artificial
  CRISPR gRNA sequence
tttgttgcaaagtcctagaa

SEQ ID NO: 339161 - DNA, 20 bp, Artificial
  CRISPR gRNA sequence
tgttgcaaagtcctagaaga

SEQ ID NO: 339162 - DNA, 20 bp, Artificial
  CRISPR gRNA sequence
gttgcaaagtcctagaagaa

SEQ ID NO: 339163 - DNA, 20 bp, Artificial
  CRISPR gRNA sequence
ttgcaaagtcctagaagaac

SEQ ID NO: 339164 - DNA, 20 bp, Artificial
  CRISPR gRNA sequence
caaagtcctagaagaacaca

SEQ ID NO: 339165 - DNA, 20 bp, Artificial
  CRISPR gRNA sequence
gaagaacacaaatacaggct

SEQ ID NO: 339166 - DNA, 20 bp, Artificial
  CRISPR gRNA sequence
taaaaaaaatctatttatca

SEQ ID NO: 339167 - DNA, 20 bp, Artificial
  CRISPR gRNA sequence
tttatcaaattcaaaaaagt

SEQ ID NO: 339168 - DNA, 20 bp, Artificial
  CRISPR gRNA sequence
atcaaattcaaaaaagttac

SEQ ID NO: 339169 - DNA, 20 bp, Artificial
  CRISPR gRNA sequence
tcaaattcaaaaaagttacc

SEQ ID NO: 339170 - DNA, 20 bp, Artificial
  CRISPR gRNA sequence
aaaaaagttacctttaaatg

SEQ ID NO: 339171 - DNA, 20 bp, Artificial
  CRISPR gRNA sequence
cctttaaatgatcattaatt

SEQ ID NO: 339172 - DNA, 20 bp, Artificial
  CRISPR gRNA sequence
taaatgatcattaattgctt

SEQ ID NO: 339173 - DNA, 20 bp, Artificial
  CRISPR gRNA sequence
aaatgatcattaattgctta

SEQ ID NO: 339174 - DNA, 20 bp, Artificial
  CRISPR gRNA sequence
aatgatcattaattgcttat

SEQ ID NO: 339175 - DNA, 20 bp, Artificial
  CRISPR gRNA sequence
attgcttattgaaagtgctg

SEQ ID NO: 339176 - DNA, 20 bp, Artificial
  CRISPR gRNA sequence
cttattgaaagtgctgtgtc

SEQ ID NO: 339177 - DNA, 20 bp, Artificial
  CRISPR gRNA sequence
attgaaagtgctgtgtctgt

SEQ ID NO: 339178 - DNA, 20 bp, Artificial
  CRISPR gRNA sequence
ttgaaagtgctgtgtctgtg

SEQ ID NO: 339179 - DNA, 20 bp, Artificial
  CRISPR gRNA sequence
aaagtgctgtgtctgtgtca

SEQ ID NO: 339180 - DNA, 20 bp, Artificial
  CRISPR gRNA sequence
tgtctgtgtcaacatgactc

SEQ ID NO: 339181 - DNA, 20 bp, Artificial
  CRISPR gRNA sequence
tgtcaacatgactcaaataa

SEQ ID NO: 339182 - DNA, 20 bp, Artificial
  CRISPR gRNA sequence
aaataaacagatcctaacaa

SEQ ID NO: 339183 - DNA, 20 bp, Artificial
  CRISPR gRNA sequence
acaacactcgtggtcaactg

SEQ ID NO: 339184 - DNA, 20 bp, Artificial
  CRISPR gRNA sequence
gtggtcaactggatggaaac

SEQ ID NO: 339185 - DNA, 20 bp, Artificial
  CRISPR gRNA sequence
gatggaaactcctggtctat

SEQ ID NO: 339186 - DNA, 20 bp, Artificial
  CRISPR gRNA sequence
ctggtctatcaccctatttg

SEQ ID NO: 339187 - DNA, 20 bp, Artificial
  CRISPR gRNA sequence
gtctatcaccctatttgggg

SEQ ID NO: 339188 - DNA, 20 bp, Artificial
  CRISPR gRNA sequence
tcaccctatttggggacaac

SEQ ID NO: 339189 - DNA, 20 bp, Artificial
  CRISPR gRNA sequence
tttggggacaacgtgtttct

SEQ ID NO: 339190 - DNA, 20 bp, Artificial
  CRISPR gRNA sequence
ggggacaacgtgtttctttt

SEQ ID NO: 339191 - DNA, 20 bp, Artificial
  CRISPR gRNA sequence
gggacaacgtgtttcttttt

SEQ ID NO: 339192 - DNA, 20 bp, Artificial
  CRISPR gRNA sequence
cttttttttcctcaagcaaa

SEQ ID NO: 339193 - DNA, 20 bp, Artificial
  CRISPR gRNA sequence
ttttttttcctcaagcaaag

SEQ ID NO: 339194 - DNA, 20 bp, Artificial
  CRISPR gRNA sequence
ttttttcctcaagcaaagta

SEQ ID NO: 339195 - DNA, 20 bp, Artificial
  CRISPR gRNA sequence
tttttcctcaagcaaagtag

SEQ ID NO: 339196 - DNA, 20 bp, Artificial
  CRISPR gRNA sequence
ttttcctcaagcaaagtaga

SEQ ID NO: 339197 - DNA, 20 bp, Artificial
  CRISPR gRNA sequence
tttcctcaagcaaagtagat

SEQ ID NO: 339198 - DNA, 20 bp, Artificial
  CRISPR gRNA sequence
ttcctcaagcaaagtagata

SEQ ID NO: 339199 - DNA, 20 bp, Artificial
  CRISPR gRNA sequence
tcctcaagcaaagtagatac

SEQ ID NO: 339200 - DNA, 20 bp, Artificial
  CRISPR gRNA sequence
cctcaagcaaagtagataca

SEQ ID NO: 339201 - DNA, 20 bp, Artificial
  CRISPR gRNA sequence
ctcaagcaaagtagatacaa

SEQ ID NO: 339202 - DNA, 20 bp, Artificial
  CRISPR gRNA sequence
aagcaaagtagatacaagca

SEQ ID NO: 339203 - DNA, 20 bp, Artificial
  CRISPR gRNA sequence
tgttatacatgaaccagaag

SEQ ID NO: 339204 - DNA, 20 bp, Artificial
  CRISPR gRNA sequence
tacatgaaccagaaggaagt

SEQ ID NO: 339205 - DNA, 20 bp, Artificial
  CRISPR gRNA sequence
atatccccagtttctgactc

SEQ ID NO: 339206 - DNA, 20 bp, Artificial
  CRISPR gRNA sequence
ctgactctctaaacttgcaa

SEQ ID NO: 339207 - DNA, 20 bp, Artificial
  CRISPR gRNA sequence
tgactctctaaacttgcaaa

SEQ ID NO: 339208 - DNA, 20 bp, Artificial
  CRISPR gRNA sequence
actctctaaacttgcaaatc

SEQ ID NO: 339209 - DNA, 20 bp, Artificial
  CRISPR gRNA sequence
tctaaacttgcaaatcttta

SEQ ID NO: 339210 - DNA, 20 bp, Artificial
  CRISPR gRNA sequence
taaacttgcaaatctttacc

SEQ ID NO: 339211 - DNA, 20 bp, Artificial
  CRISPR gRNA sequence
aacttgcaaatctttacctg

SEQ ID NO: 339212 - DNA, 20 bp, Artificial
  CRISPR gRNA sequence
gcaaatctttacctgttttg

SEQ ID NO: 339213 - DNA, 20 bp, Artificial
  CRISPR gRNA sequence
caaatctttacctgttttgg

SEQ ID NO: 339214 - DNA, 20 bp, Artificial
  CRISPR gRNA sequence
tacctgttttggtcaacctt

SEQ ID NO: 339215 - DNA, 20 bp, Artificial
  CRISPR gRNA sequence
acctgttttggtcaacctta

SEQ ID NO: 339216 - DNA, 20 bp, Artificial
  CRISPR gRNA sequence
cctgttttggtcaaccttac

SEQ ID NO: 339217 - DNA, 20 bp, Artificial
  CRISPR gRNA sequence
ttttggtcaaccttacaggc

SEQ ID NO: 339218 - DNA, 20 bp, Artificial
  CRISPR gRNA sequence
tggtcaaccttacaggccaa

SEQ ID NO: 339219 - DNA, 20 bp, Artificial
  CRISPR gRNA sequence
ggtcaaccttacaggccaaa

SEQ ID NO: 339220 - DNA, 20 bp, Artificial
  CRISPR gRNA sequence
gtcaaccttacaggccaaac

SEQ ID NO: 339221 - DNA, 20 bp, Artificial
  CRISPR gRNA sequence
acaggccaaactattgaaaa

SEQ ID NO: 339222 - DNA, 20 bp, Artificial
  CRISPR gRNA sequence
caggccaaactattgaaaaa

SEQ ID NO: 339223 - DNA, 20 bp, Artificial
  CRISPR gRNA sequence
ttgaaaaaaaaaatcatttc

SEQ ID NO: 339224 - DNA, 20 bp, Artificial
  CRISPR gRNA sequence
aaaaaaaaaatcatttcttg

SEQ ID NO: 339225 - DNA, 20 bp, Artificial
  CRISPR gRNA sequence
cttgactaacactttcaatt

SEQ ID NO: 339226 - DNA, 20 bp, Artificial
  CRISPR gRNA sequence
ttgactaacactttcaattt

SEQ ID NO: 339227 - DNA, 20 bp, Artificial
  CRISPR gRNA sequence
gactaacactttcaatttgt

SEQ ID NO: 339228 - DNA, 20 bp, Artificial
  CRISPR gRNA sequence
actaacactttcaatttgtg

SEQ ID NO: 339229 - DNA, 20 bp, Artificial
  CRISPR gRNA sequence
acactttcaatttgtgtgac

SEQ ID NO: 339230 - DNA, 20 bp, Artificial
  CRISPR gRNA sequence
tcaatttgtgtgacatatcc

SEQ ID NO: 339231 - DNA, 20 bp, Artificial
  CRISPR gRNA sequence
caatttgtgtgacatatccc

SEQ ID NO: 339232 - DNA, 20 bp, Artificial
  CRISPR gRNA sequence
aatttgtgtgacatatcccc

SEQ ID NO: 339233 - DNA, 20 bp, Artificial
  CRISPR gRNA sequence
gtgtgacatatcccctacat

SEQ ID NO: 339234 - DNA, 20 bp, Artificial
  CRISPR gRNA sequence
tgtgacatatcccctacata

SEQ ID NO: 339235 - DNA, 20 bp, Artificial
  CRISPR gRNA sequence
catacttaagttccactttc

SEQ ID NO: 339236 - DNA, 20 bp, Artificial
  CRISPR gRNA sequence
aagttccactttccaaaata

SEQ ID NO: 339237 - DNA, 20 bp, Artificial
  CRISPR gRNA sequence
agttccactttccaaaatat

SEQ ID NO: 339238 - DNA, 20 bp, Artificial
  CRISPR gRNA sequence
cactttccaaaatataattg

SEQ ID NO: 339239 - DNA, 20 bp, Artificial
  CRISPR gRNA sequence
tccaaaatataattgtgaat

SEQ ID NO: 339240 - DNA, 20 bp, Artificial
  CRISPR gRNA sequence
ccaaaatataattgtgaatt

SEQ ID NO: 339241 - DNA, 20 bp, Artificial
  CRISPR gRNA sequence
caaaatataattgtgaattt

SEQ ID NO: 339242 - DNA, 20 bp, Artificial
  CRISPR gRNA sequence
tgaatttttataaggtttca

SEQ ID NO: 339243 - DNA, 20 bp, Artificial
  CRISPR gRNA sequence
ttataaggtttcaaatgcca

SEQ ID NO: 339244 - DNA, 20 bp, Artificial
  CRISPR gRNA sequence
tataaggtttcaaatgccat

SEQ ID NO: 339245 - DNA, 20 bp, Artificial
  CRISPR gRNA sequence
ataaggtttcaaatgccatg

SEQ ID NO: 339246 - DNA, 20 bp, Artificial
  CRISPR gRNA sequence
taaggtttcaaatgccatgt

SEQ ID NO: 339247 - DNA, 20 bp, Artificial
  CRISPR gRNA sequence
caaatgccatgtttttttca

SEQ ID NO: 339248 - DNA, 20 bp, Artificial
  CRISPR gRNA sequence
aaatgccatgtttttttcac

SEQ ID NO: 339249 - DNA, 20 bp, Artificial
  CRISPR gRNA sequence
ttttcactttgaatgaccaa

SEQ ID NO: 339250 - DNA, 20 bp, Artificial
  CRISPR gRNA sequence
tttcactttgaatgaccaaa

SEQ ID NO: 339251 - DNA, 20 bp, Artificial
  CRISPR gRNA sequence
ttcactttgaatgaccaaaa

SEQ ID NO: 339252 - DNA, 20 bp, Artificial
  CRISPR gRNA sequence
tcactttgaatgaccaaaaa

SEQ ID NO: 339253 - DNA, 20 bp, Artificial
  CRISPR gRNA sequence
cactttgaatgaccaaaaag

SEQ ID NO: 339254 - DNA, 20 bp, Artificial
  CRISPR gRNA sequence
actttgaatgaccaaaaagt

SEQ ID NO: 339255 - DNA, 20 bp, Artificial
  CRISPR gRNA sequence
tgaatgaccaaaaagtgcca

SEQ ID NO: 339256 - DNA, 20 bp, Artificial
  CRISPR gRNA sequence
gaatgaccaaaaagtgccat

SEQ ID NO: 339257 - DNA, 20 bp, Artificial
  CRISPR gRNA sequence
aatgaccaaaaagtgccatt

SEQ ID NO: 339258 - DNA, 20 bp, Artificial
  CRISPR gRNA sequence
gacagacctagtttattaga

SEQ ID NO: 339259 - DNA, 20 bp, Artificial
  CRISPR gRNA sequence
acagacctagtttattagaa

SEQ ID NO: 339260 - DNA, 20 bp, Artificial
  CRISPR gRNA sequence
gtttattagaacagcagtag

SEQ ID NO: 339261 - DNA, 20 bp, Artificial
  CRISPR gRNA sequence
attagaacagcagtagtact

SEQ ID NO: 339262 - DNA, 20 bp, Artificial
  CRISPR gRNA sequence
ttagaacagcagtagtactg

SEQ ID NO: 339263 - DNA, 20 bp, Artificial
  CRISPR gRNA sequence
gaacagcagtagtactgaga

SEQ ID NO: 339264 - DNA, 20 bp, Artificial
  CRISPR gRNA sequence
agatgccatttacagagaaa

SEQ ID NO: 339265 - DNA, 20 bp, Artificial
  CRISPR gRNA sequence
acagagaaattgtgatcttt

SEQ ID NO: 339266 - DNA, 20 bp, Artificial
  CRISPR gRNA sequence
cagagaaattgtgatctttt

SEQ ID NO: 339267 - DNA, 20 bp, Artificial
  CRISPR gRNA sequence
tgatcttttcttcagttatt

SEQ ID NO: 339268 - DNA, 20 bp, Artificial
  CRISPR gRNA sequence
ttcttcagttattgcaagct

SEQ ID NO: 339269 - DNA, 20 bp, Artificial
  CRISPR gRNA sequence
tcttcagttattgcaagcta

SEQ ID NO: 339270 - DNA, 20 bp, Artificial
  CRISPR gRNA sequence
cttcagttattgcaagctac

SEQ ID NO: 339271 - DNA, 20 bp, Artificial
  CRISPR gRNA sequence
ttcagttattgcaagctaca

SEQ ID NO: 339272 - DNA, 20 bp, Artificial
  CRISPR gRNA sequence
cagttattgcaagctacaaa

SEQ ID NO: 339273 - DNA, 20 bp, Artificial
  CRISPR gRNA sequence
agttattgcaagctacaaat

SEQ ID NO: 339274 - DNA, 20 bp, Artificial
  CRISPR gRNA sequence
ttgcaagctacaaatgattt

SEQ ID NO: 339275 - DNA, 20 bp, Artificial
  CRISPR gRNA sequence
caagctacaaatgattttaa

SEQ ID NO: 339276 - DNA, 20 bp, Artificial
  CRISPR gRNA sequence
caaatgattttaaaactcat

SEQ ID NO: 339277 - DNA, 20 bp, Artificial
  CRISPR gRNA sequence
taaaactcatttttaaaaat

SEQ ID NO: 339278 - DNA, 20 bp, Artificial
  CRISPR gRNA sequence
aaaactcatttttaaaaatt

SEQ ID NO: 339279 - DNA, 20 bp, Artificial
  CRISPR gRNA sequence
aaactcatttttaaaaattt

SEQ ID NO: 339280 - DNA, 20 bp, Artificial
  CRISPR gRNA sequence
atttttaaaaatttgcaaag

SEQ ID NO: 339281 - DNA, 20 bp, Artificial
  CRISPR gRNA sequence
ttaaaaatttgcaaagccca

SEQ ID NO: 339282 - DNA, 20 bp, Artificial
  CRISPR gRNA sequence
taaaaatttgcaaagcccag

SEQ ID NO: 339283 - DNA, 20 bp, Artificial
  CRISPR gRNA sequence
aaaaatttgcaaagcccagt

SEQ ID NO: 339284 - DNA, 20 bp, Artificial
  CRISPR gRNA sequence
aaaatttgcaaagcccagta

SEQ ID NO: 339285 - DNA, 20 bp, Artificial
  CRISPR gRNA sequence
gcaaagcccagtaagtcatt

SEQ ID NO: 339286 - DNA, 20 bp, Artificial
  CRISPR gRNA sequence
caaagcccagtaagtcattt

SEQ ID NO: 339287 - DNA, 20 bp, Artificial
  CRISPR gRNA sequence
tgcatataaaactcaatatt

SEQ ID NO: 339288 - DNA, 20 bp, Artificial
  CRISPR gRNA sequence
gcatataaaactcaatattc

SEQ ID NO: 339289 - DNA, 20 bp, Artificial
  CRISPR gRNA sequence
catataaaactcaatattct

SEQ ID NO: 339290 - DNA, 20 bp, Artificial
  CRISPR gRNA sequence
aatattcttagagtagggaa

SEQ ID NO: 339291 - DNA, 20 bp, Artificial
  CRISPR gRNA sequence
ttagagtagggaagcagtat

SEQ ID NO: 339292 - DNA, 20 bp, Artificial
  CRISPR gRNA sequence
agagtagggaagcagtatat

SEQ ID NO: 339293 - DNA, 20 bp, Artificial
  CRISPR gRNA sequence
gagtagggaagcagtatatg

SEQ ID NO: 339294 - DNA, 20 bp, Artificial
  CRISPR gRNA sequence
tagattttgctgtttacaac

SEQ ID NO: 339295 - DNA, 20 bp, Artificial
  CRISPR gRNA sequence
tgctgtttacaactgtgaat

SEQ ID NO: 339296 - DNA, 20 bp, Artificial
  CRISPR gRNA sequence
gctgtttacaactgtgaata

SEQ ID NO: 339297 - DNA, 20 bp, Artificial
  CRISPR gRNA sequence
ctgtttacaactgtgaatac

SEQ ID NO: 339298 - DNA, 20 bp, Artificial
  CRISPR gRNA sequence
tttacaactgtgaatactgg

SEQ ID NO: 339299 - DNA, 20 bp, Artificial
  CRISPR gRNA sequence
acaactgtgaatactgggat

SEQ ID NO: 339300 - DNA, 20 bp, Artificial
  CRISPR gRNA sequence
caactgtgaatactgggatg

SEQ ID NO: 339301 - DNA, 20 bp, Artificial
  CRISPR gRNA sequence
tgaatactgggatgaatttt

SEQ ID NO: 339302 - DNA, 20 bp, Artificial
  CRISPR gRNA sequence
ggatgaatttttttaagcca

SEQ ID NO: 339303 - DNA, 20 bp, Artificial
  CRISPR gRNA sequence
ttttaagccaaataatgcta

SEQ ID NO: 339304 - DNA, 20 bp, Artificial
  CRISPR gRNA sequence
tttaagccaaataatgctat

SEQ ID NO: 339305 - DNA, 20 bp, Artificial
  CRISPR gRNA sequence
ttaagccaaataatgctatg

SEQ ID NO: 339306 - DNA, 20 bp, Artificial
  CRISPR gRNA sequence
taagccaaataatgctatga

SEQ ID NO: 339307 - DNA, 20 bp, Artificial
  CRISPR gRNA sequence
aagccaaataatgctatgaa

SEQ ID NO: 339308 - DNA, 20 bp, Artificial
  CRISPR gRNA sequence
agccaaataatgctatgaat

SEQ ID NO: 339309 - DNA, 20 bp, Artificial
  CRISPR gRNA sequence
tgaatcttacagtgagtaaa

SEQ ID NO: 339310 - DNA, 20 bp, Artificial
  CRISPR gRNA sequence
acagtgagtaaatataagaa

SEQ ID NO: 339311 - DNA, 20 bp, Artificial
  CRISPR gRNA sequence
cagtgagtaaatataagaat

SEQ ID NO: 339312 - DNA, 20 bp, Artificial
  CRISPR gRNA sequence
cagtcccccctacatgcctg

SEQ ID NO: 339313 - DNA, 20 bp, Artificial
  CRISPR gRNA sequence
agtcccccctacatgcctgc

SEQ ID NO: 339314 - DNA, 20 bp, Artificial
  CRISPR gRNA sequence
catgcctgcattttgtttct

SEQ ID NO: 339315 - DNA, 20 bp, Artificial
  CRISPR gRNA sequence
cattttgtttctaccaagaa

SEQ ID NO: 339316 - DNA, 20 bp, Artificial
  CRISPR gRNA sequence
tgtttctaccaagaaatggg

SEQ ID NO: 339317 - DNA, 20 bp, Artificial
  CRISPR gRNA sequence
gtttctaccaagaaatggga

SEQ ID NO: 339318 - DNA, 20 bp, Artificial
  CRISPR gRNA sequence
tttctaccaagaaatgggaa

SEQ ID NO: 339319 - DNA, 20 bp, Artificial
  CRISPR gRNA sequence
ctaccaagaaatgggaatat

SEQ ID NO: 339320 - DNA, 20 bp, Artificial
  CRISPR gRNA sequence
taccaagaaatgggaatatg

SEQ ID NO: 339321 - DNA, 20 bp, Artificial
  CRISPR gRNA sequence
ccaagaaatgggaatatgct

SEQ ID NO: 339322 - DNA, 20 bp, Artificial
  CRISPR gRNA sequence
ctagtaacttaaaactgaaa

SEQ ID NO: 339323 - DNA, 20 bp, Artificial
  CRISPR gRNA sequence
gtaacttaaaactgaaatat

SEQ ID NO: 339324 - DNA, 20 bp, Artificial
  CRISPR gRNA sequence
aaaactgaaatatccatttc

SEQ ID NO: 339325 - DNA, 20 bp, Artificial
  CRISPR gRNA sequence
aaactgaaatatccatttca

SEQ ID NO: 339326 - DNA, 20 bp, Artificial
  CRISPR gRNA sequence
aaatatccatttcatctgaa

SEQ ID NO: 339327 - DNA, 20 bp, Artificial
  CRISPR gRNA sequence
catctgaaggagttgtggtt

SEQ ID NO: 339328 - DNA, 20 bp, Artificial
  CRISPR gRNA sequence
atctgaaggagttgtggtta

SEQ ID NO: 339329 - DNA, 20 bp, Artificial
  CRISPR gRNA sequence
aaggagttgtggttaacaag

SEQ ID NO: 339330 - DNA, 20 bp, Artificial
  CRISPR gRNA sequence
tggttaacaagcaacagcaa

SEQ ID NO: 339331 - DNA, 20 bp, Artificial
  CRISPR gRNA sequence
acaagcaacagcaagttgtg

SEQ ID NO: 339332 - DNA, 20 bp, Artificial
  CRISPR gRNA sequence
tgaaagccattttgttcaca

SEQ ID NO: 339333 - DNA, 20 bp, Artificial
  CRISPR gRNA sequence
tgttcacaaatgatgaaaaa

SEQ ID NO: 339334 - DNA, 20 bp, Artificial
  CRISPR gRNA sequence
gttcacaaatgatgaaaaaa

SEQ ID NO: 339335 - DNA, 20 bp, Artificial
  CRISPR gRNA sequence
ttcacaaatgatgaaaaaat

SEQ ID NO: 339336 - DNA, 20 bp, Artificial
  CRISPR gRNA sequence
acaaatgatgaaaaaataag

SEQ ID NO: 339337 - DNA, 20 bp, Artificial
  CRISPR gRNA sequence
aagatcttacataagaataa

SEQ ID NO: 339338 - DNA, 20 bp, Artificial
  CRISPR gRNA sequence
acataagaataagagacatt

SEQ ID NO: 339339 - DNA, 20 bp, Artificial
  CRISPR gRNA sequence
cataagaataagagacattt

SEQ ID NO: 339340 - DNA, 20 bp, Artificial
  CRISPR gRNA sequence
ctagaaagagtggggaaaaa

SEQ ID NO: 339341 - DNA, 20 bp, Artificial
  CRISPR gRNA sequence
tagaaagagtggggaaaaac

SEQ ID NO: 339342 - DNA, 20 bp, Artificial
  CRISPR gRNA sequence
gaaagagtggggaaaaacag

SEQ ID NO: 339343 - DNA, 20 bp, Artificial
  CRISPR gRNA sequence
aacaaatactaggaaaaaaa

SEQ ID NO: 339344 - DNA, 20 bp, Artificial
  CRISPR gRNA sequence
ggaaaaaaatgactgaaatg

SEQ ID NO: 339345 - DNA, 20 bp, Artificial
  CRISPR gRNA sequence
aaatgaagaataaagcttga

SEQ ID NO: 339346 - DNA, 20 bp, Artificial
  CRISPR gRNA sequence
gagtctagagattgaaaact

SEQ ID NO: 339347 - DNA, 20 bp, Artificial
  CRISPR gRNA sequence
agtctagagattgaaaactt

SEQ ID NO: 339348 - DNA, 20 bp, Artificial
  CRISPR gRNA sequence
gagattgaaaactttcaccc

SEQ ID NO: 339349 - DNA, 20 bp, Artificial
  CRISPR gRNA sequence
aaaactttcacccagtctta

SEQ ID NO: 339350 - DNA, 20 bp, Artificial
  CRISPR gRNA sequence
tcacccagtcttaaaaaaaa

SEQ ID NO: 339351 - DNA, 20 bp, Artificial
  CRISPR gRNA sequence
cacccagtcttaaaaaaaat

SEQ ID NO: 339352 - DNA, 20 bp, Artificial
  CRISPR gRNA sequence
acccagtcttaaaaaaaata

SEQ ID NO: 339353 - DNA, 20 bp, Artificial
  CRISPR gRNA sequence
aaaaaaaataataataaatt

SEQ ID NO: 339354 - DNA, 20 bp, Artificial
  CRISPR gRNA sequence
aaaaaaataataataaatta

SEQ ID NO: 339355 - DNA, 20 bp, Artificial
  CRISPR gRNA sequence
atagaacagcggggcgcggt

SEQ ID NO: 339356 - DNA, 20 bp, Artificial
  CRISPR gRNA sequence
acgcctgtaatcccagcact

SEQ ID NO: 339357 - DNA, 20 bp, Artificial
  CRISPR gRNA sequence
taatcccagcactttgggag

SEQ ID NO: 339358 - DNA, 20 bp, Artificial
  CRISPR gRNA sequence
tgggaggcggaggcggaggc

SEQ ID NO: 339359 - DNA, 20 bp, Artificial
  CRISPR gRNA sequence
gggaggcggaggcggaggcg

SEQ ID NO: 339360 - DNA, 20 bp, Artificial
  CRISPR gRNA sequence
ggaggcggaggcggaggcgg

SEQ ID NO: 339361 - DNA, 20 bp, Artificial
  CRISPR gRNA sequence
agaccatcctggctaacacg

SEQ ID NO: 339362 - DNA, 20 bp, Artificial
  CRISPR gRNA sequence
gctaacacggtgaaaccccg

SEQ ID NO: 339363 - DNA, 20 bp, Artificial
  CRISPR gRNA sequence
acacggtgaaaccccgtctc

SEQ ID NO: 339364 - DNA, 20 bp, Artificial
  CRISPR gRNA sequence
tacgaaaaatacaaaaaaat

SEQ ID NO: 339365 - DNA, 20 bp, Artificial
  CRISPR gRNA sequence
cgaaaaatacaaaaaaatta

SEQ ID NO: 339366 - DNA, 20 bp, Artificial
  CRISPR gRNA sequence
gccaggcgtggtggcgggtg

SEQ ID NO: 339367 - DNA, 20 bp, Artificial
  CRISPR gRNA sequence
tagtctcacctacttgggag

SEQ ID NO: 339368 - DNA, 20 bp, Artificial
  CRISPR gRNA sequence
acctacttgggaggctgagg

SEQ ID NO: 339369 - DNA, 20 bp, Artificial
  CRISPR gRNA sequence
cttgggaggctgaggcagga

SEQ ID NO: 339370 - DNA, 20 bp, Artificial
  CRISPR gRNA sequence
gggaggctgaggcaggagaa

SEQ ID NO: 339371 - DNA, 20 bp, Artificial
  CRISPR gRNA sequence
ggaggctgaggcaggagaat

SEQ ID NO: 339372 - DNA, 20 bp, Artificial
  CRISPR gRNA sequence
aggcaggagaatcgcttcaa

SEQ ID NO: 339373 - DNA, 20 bp, Artificial
  CRISPR gRNA sequence
caacccgggaggtggaggtt

SEQ ID NO: 339374 - DNA, 20 bp, Artificial
  CRISPR gRNA sequence
aacccgggaggtggaggttg

SEQ ID NO: 339375 - DNA, 20 bp, Artificial
  CRISPR gRNA sequence
cagtaagccgagattgcgcc

SEQ ID NO: 339376 - DNA, 20 bp, Artificial
  CRISPR gRNA sequence
cgccactgcactccagcctg

SEQ ID NO: 339377 - DNA, 20 bp, Artificial
  CRISPR gRNA sequence
cactccagcctgggcgacag

SEQ ID NO: 339378 - DNA, 20 bp, Artificial
  CRISPR gRNA sequence
cagcctgggcgacagagtga

SEQ ID NO: 339379 - DNA, 20 bp, Artificial
  CRISPR gRNA sequence
ggcgacagagtgagactccg

SEQ ID NO: 339380 - DNA, 20 bp, Artificial
  CRISPR gRNA sequence
cgcctcaaaaaaaaaattaa

SEQ ID NO: 339381 - DNA, 20 bp, Artificial
  CRISPR gRNA sequence
aaaaaaaaaattaatagaaa

SEQ ID NO: 339382 - DNA, 20 bp, Artificial
  CRISPR gRNA sequence
atagaaacacacagaaagag

SEQ ID NO: 339383 - DNA, 20 bp, Artificial
  CRISPR gRNA sequence
cacatatcctggaggaattc

SEQ ID NO: 339384 - DNA, 20 bp, Artificial
  CRISPR gRNA sequence
gaggaattcctgaattccaa

SEQ ID NO: 339385 - DNA, 20 bp, Artificial
  CRISPR gRNA sequence
ctgaattccaatactgaagt

SEQ ID NO: 339386 - DNA, 20 bp, Artificial
  CRISPR gRNA sequence
aattccaatactgaagtaaa

SEQ ID NO: 339387 - DNA, 20 bp, Artificial
  CRISPR gRNA sequence
caatactgaagtaaatagct

SEQ ID NO: 339388 - DNA, 20 bp, Artificial
  CRISPR gRNA sequence
aagtaaatagctttcaagat

SEQ ID NO: 339389 - DNA, 20 bp, Artificial
  CRISPR gRNA sequence
tcaagattatgaaattctag

SEQ ID NO: 339390 - DNA, 20 bp, Artificial
  CRISPR gRNA sequence
caagattatgaaattctaga

SEQ ID NO: 339391 - DNA, 20 bp, Artificial
  CRISPR gRNA sequence
aagattatgaaattctagag

SEQ ID NO: 339392 - DNA, 20 bp, Artificial
  CRISPR gRNA sequence
tgaaattctagagttttttt

SEQ ID NO: 339393 - DNA, 20 bp, Artificial
  CRISPR gRNA sequence
tagagtttttttttttttta

SEQ ID NO: 339394 - DNA, 20 bp, Artificial
  CRISPR gRNA sequence
gagttttttttttttttaca

SEQ ID NO: 339395 - DNA, 20 bp, Artificial
  CRISPR gRNA sequence
tttttttttttacaaaggaa

SEQ ID NO: 339396 - DNA, 20 bp, Artificial
  CRISPR gRNA sequence
ttttttttttacaaaggaat

SEQ ID NO: 339397 - DNA, 20 bp, Artificial
  CRISPR gRNA sequence
tttttttttacaaaggaatg

SEQ ID NO: 339398 - DNA, 20 bp, Artificial
  CRISPR gRNA sequence
ttttttttacaaaggaatga

SEQ ID NO: 339399 - DNA, 20 bp, Artificial
  CRISPR gRNA sequence
tttttttacaaaggaatgag

SEQ ID NO: 339400 - DNA, 20 bp, Artificial
  CRISPR gRNA sequence
ttttttacaaaggaatgaga

SEQ ID NO: 339401 - DNA, 20 bp, Artificial
  CRISPR gRNA sequence
tttttacaaaggaatgagag

SEQ ID NO: 339402 - DNA, 20 bp, Artificial
  CRISPR gRNA sequence
ttttacaaaggaatgagagt

SEQ ID NO: 339403 - DNA, 20 bp, Artificial
  CRISPR gRNA sequence
tttacaaaggaatgagagtt

SEQ ID NO: 339404 - DNA, 20 bp, Artificial
  CRISPR gRNA sequence
ttacaaaggaatgagagtta

SEQ ID NO: 339405 - DNA, 20 bp, Artificial
  CRISPR gRNA sequence
tacaaaggaatgagagttag

SEQ ID NO: 339406 - DNA, 20 bp, Artificial
  CRISPR gRNA sequence
acaaaggaatgagagttaga

SEQ ID NO: 339407 - DNA, 20 bp, Artificial
  CRISPR gRNA sequence
caaaggaatgagagttagac

SEQ ID NO: 339408 - DNA, 20 bp, Artificial
  CRISPR gRNA sequence
gactaccatcaaactcttca

SEQ ID NO: 339409 - DNA, 20 bp, Artificial
  CRISPR gRNA sequence
ccatcaaactcttcacccac

SEQ ID NO: 339410 - DNA, 20 bp, Artificial
  CRISPR gRNA sequence
ttcacccacaaccctagaag

SEQ ID NO: 339411 - DNA, 20 bp, Artificial
  CRISPR gRNA sequence
cacccacaaccctagaagcc

SEQ ID NO: 339412 - DNA, 20 bp, Artificial
  CRISPR gRNA sequence
acccacaaccctagaagcca

SEQ ID NO: 339413 - DNA, 20 bp, Artificial
  CRISPR gRNA sequence
gaagccagcagacagtggag

SEQ ID NO: 339414 - DNA, 20 bp, Artificial
  CRISPR gRNA sequence
caaccactaagaagaaaggc

SEQ ID NO: 339415 - DNA, 20 bp, Artificial
  CRISPR gRNA sequence
agaagaaaggctgccatcca

SEQ ID NO: 339416 - DNA, 20 bp, Artificial
  CRISPR gRNA sequence
ccatccaggactcctattcc

SEQ ID NO: 339417 - DNA, 20 bp, Artificial
  CRISPR gRNA sequence
ctattcccaggaaagatatc

SEQ ID NO: 339418 - DNA, 20 bp, Artificial
  CRISPR gRNA sequence
ttcccaggaaagatatcagt

SEQ ID NO: 339419 - DNA, 20 bp, Artificial
  CRISPR gRNA sequence
ccaggaaagatatcagtcac

SEQ ID NO: 339420 - DNA, 20 bp, Artificial
  CRISPR gRNA sequence
atcaaggtaaaaggaagaca

SEQ ID NO: 339421 - DNA, 20 bp, Artificial
  CRISPR gRNA sequence
acctgtactggaattcagag

SEQ ID NO: 339422 - DNA, 20 bp, Artificial
  CRISPR gRNA sequence
cctgtactggaattcagaga

SEQ ID NO: 339423 - DNA, 20 bp, Artificial
  CRISPR gRNA sequence
tactggaattcagagagttg

SEQ ID NO: 339424 - DNA, 20 bp, Artificial
  CRISPR gRNA sequence
gaattcagagagttgggggt

SEQ ID NO: 339425 - DNA, 20 bp, Artificial
  CRISPR gRNA sequence
agagagttgggggtatttaa

SEQ ID NO: 339426 - DNA, 20 bp, Artificial
  CRISPR gRNA sequence
ggggtatttaacgaaaataa

SEQ ID NO: 339427 - DNA, 20 bp, Artificial
  CRISPR gRNA sequence
aacgaaaataagagaagtct

SEQ ID NO: 339428 - DNA, 20 bp, Artificial
  CRISPR gRNA sequence
acgaaaataagagaagtctt

SEQ ID NO: 339429 - DNA, 20 bp, Artificial
  CRISPR gRNA sequence
ctgatcattagattagaaca

SEQ ID NO: 339430 - DNA, 20 bp, Artificial
  CRISPR gRNA sequence
tgatcattagattagaacag

SEQ ID NO: 339431 - DNA, 20 bp, Artificial
  CRISPR gRNA sequence
atcattagattagaacagag

SEQ ID NO: 339432 - DNA, 20 bp, Artificial
  CRISPR gRNA sequence
gattagaacagagatcacaa

SEQ ID NO: 339433 - DNA, 20 bp, Artificial
  CRISPR gRNA sequence
gaacagagatcacaagacag

SEQ ID NO: 339434 - DNA, 20 bp, Artificial
  CRISPR gRNA sequence
tcattgaacgtatgtgatgt

SEQ ID NO: 339435 - DNA, 20 bp, Artificial
  CRISPR gRNA sequence
aacgtatgtgatgtaagtgt

SEQ ID NO: 339436 - DNA, 20 bp, Artificial
  CRISPR gRNA sequence
agaaaggattcttgaaacag

SEQ ID NO: 339437 - DNA, 20 bp, Artificial
  CRISPR gRNA sequence
ttgaaacagaagagaaatac

SEQ ID NO: 339438 - DNA, 20 bp, Artificial
  CRISPR gRNA sequence
gaaacagaagagaaatactg

SEQ ID NO: 339439 - DNA, 20 bp, Artificial
  CRISPR gRNA sequence
aaacagaagagaaatactgt

SEQ ID NO: 339440 - DNA, 20 bp, Artificial
  CRISPR gRNA sequence
taagaggaaacctagcaatg

SEQ ID NO: 339441 - DNA, 20 bp, Artificial
  CRISPR gRNA sequence
gcaatgatctgcaactgtaa

SEQ ID NO: 339442 - DNA, 20 bp, Artificial
  CRISPR gRNA sequence
caactgtaagttttaaatta

SEQ ID NO: 339443 - DNA, 20 bp, Artificial
  CRISPR gRNA sequence
taagttttaaattatttcca

SEQ ID NO: 339444 - DNA, 20 bp, Artificial
  CRISPR gRNA sequence
taaattatttccacaaaacc

SEQ ID NO: 339445 - DNA, 20 bp, Artificial
  CRISPR gRNA sequence
aaattatttccacaaaaccc

SEQ ID NO: 339446 - DNA, 20 bp, Artificial
  CRISPR gRNA sequence
aattatttccacaaaaccca

SEQ ID NO: 339447 - DNA, 20 bp, Artificial
  CRISPR gRNA sequence
tttccacaaaacccacgtat

SEQ ID NO: 339448 - DNA, 20 bp, Artificial
  CRISPR gRNA sequence
ccacaaaacccacgtatgga

SEQ ID NO: 339449 - DNA, 20 bp, Artificial
  CRISPR gRNA sequence
cacaaaacccacgtatggag

SEQ ID NO: 339450 - DNA, 20 bp, Artificial
  CRISPR gRNA sequence
tctgggggaagtgtgagagt

SEQ ID NO: 339451 - DNA, 20 bp, Artificial
  CRISPR gRNA sequence
ggggaagtgtgagagtggga

SEQ ID NO: 339452 - DNA, 20 bp, Artificial
  CRISPR gRNA sequence
ttaagttctcatatcagtgc

SEQ ID NO: 339453 - DNA, 20 bp, Artificial
  CRISPR gRNA sequence
aagttctcatatcagtgcag

SEQ ID NO: 339454 - DNA, 20 bp, Artificial
  CRISPR gRNA sequence
agttctcatatcagtgcagg

SEQ ID NO: 339455 - DNA, 20 bp, Artificial
  CRISPR gRNA sequence
tcatatcagtgcaggggatg

SEQ ID NO: 339456 - DNA, 20 bp, Artificial
  CRISPR gRNA sequence
atatcagtgcaggggatggg

SEQ ID NO: 339457 - DNA, 20 bp, Artificial
  CRISPR gRNA sequence
ggcacatcagacaaaggcat

SEQ ID NO: 339458 - DNA, 20 bp, Artificial
  CRISPR gRNA sequence
tcattattttcatacaatga

SEQ ID NO: 339459 - DNA, 20 bp, Artificial
  CRISPR gRNA sequence
cattattttcatacaatgat

SEQ ID NO: 339460 - DNA, 20 bp, Artificial
  CRISPR gRNA sequence
attattttcatacaatgata

SEQ ID NO: 339461 - DNA, 20 bp, Artificial
  CRISPR gRNA sequence
ttttcatacaatgataaaca

SEQ ID NO: 339462 - DNA, 20 bp, Artificial
  CRISPR gRNA sequence
tcatacaatgataaacaagt

SEQ ID NO: 339463 - DNA, 20 bp, Artificial
  CRISPR gRNA sequence
catacaatgataaacaagta

SEQ ID NO: 339464 - DNA, 20 bp, Artificial
  CRISPR gRNA sequence
atacaatgataaacaagtag

SEQ ID NO: 339465 - DNA, 20 bp, Artificial
  CRISPR gRNA sequence
aattaagattctttgaacat

SEQ ID NO: 339466 - DNA, 20 bp, Artificial
  CRISPR gRNA sequence
agattctttgaacatgtcaa

SEQ ID NO: 339467 - DNA, 20 bp, Artificial
  CRISPR gRNA sequence
tttgaacatgtcaattactt

SEQ ID NO: 339468 - DNA, 20 bp, Artificial
  CRISPR gRNA sequence
tgaacatgtcaattacttag

SEQ ID NO: 339469 - DNA, 20 bp, Artificial
  CRISPR gRNA sequence
gaacatgtcaattacttagt

SEQ ID NO: 339470 - DNA, 20 bp, Artificial
  CRISPR gRNA sequence
aacatgtcaattacttagta

SEQ ID NO: 339471 - DNA, 20 bp, Artificial
  CRISPR gRNA sequence
cttagtaaattaagaactgt

SEQ ID NO: 339472 - DNA, 20 bp, Artificial
  CRISPR gRNA sequence
agtaaattaagaactgtagt

SEQ ID NO: 339473 - DNA, 20 bp, Artificial
  CRISPR gRNA sequence
gtaaattaagaactgtagtc

SEQ ID NO: 339474 - DNA, 20 bp, Artificial
  CRISPR gRNA sequence
agaactgtagtcgaccttcc

SEQ ID NO: 339475 - DNA, 20 bp, Artificial
  CRISPR gRNA sequence
tagtcgaccttccaaattaa

SEQ ID NO: 339476 - DNA, 20 bp, Artificial
  CRISPR gRNA sequence
ccaaattaaccggaggcaaa

SEQ ID NO: 339477 - DNA, 20 bp, Artificial
  CRISPR gRNA sequence
caaattaaccggaggcaaag

SEQ ID NO: 339478 - DNA, 20 bp, Artificial
  CRISPR gRNA sequence
accggaggcaaagaggagag

SEQ ID NO: 339479 - DNA, 20 bp, Artificial
  CRISPR gRNA sequence
catcacaccaacaaaaataa

SEQ ID NO: 339480 - DNA, 20 bp, Artificial
  CRISPR gRNA sequence
atcacaccaacaaaaataaa

SEQ ID NO: 339481 - DNA, 20 bp, Artificial
  CRISPR gRNA sequence
atgctgactgggaatggcct

SEQ ID NO: 339482 - DNA, 20 bp, Artificial
  CRISPR gRNA sequence
tgctgactgggaatggcctg

SEQ ID NO: 339483 - DNA, 20 bp, Artificial
  CRISPR gRNA sequence
actgggaatggcctgaattc

SEQ ID NO: 339484 - DNA, 20 bp, Artificial
  CRISPR gRNA sequence
ggaatggcctgaattcatct

SEQ ID NO: 339485 - DNA, 20 bp, Artificial
  CRISPR gRNA sequence
aattcatctatcaaaagaaa

SEQ ID NO: 339486 - DNA, 20 bp, Artificial
  CRISPR gRNA sequence
atctatcaaaagaaaaaatt

SEQ ID NO: 339487 - DNA, 20 bp, Artificial
  CRISPR gRNA sequence
tcaaaagaaaaaattgacaa

SEQ ID NO: 339488 - DNA, 20 bp, Artificial
  CRISPR gRNA sequence
acaactgggatttttgttaa

SEQ ID NO: 339489 - DNA, 20 bp, Artificial
  CRISPR gRNA sequence
ggatttttgttaaatctaac

SEQ ID NO: 339490 - DNA, 20 bp, Artificial
  CRISPR gRNA sequence
ttgttaaatctaacaagaac

SEQ ID NO: 339491 - DNA, 20 bp, Artificial
  CRISPR gRNA sequence
tgttaaatctaacaagaaca

SEQ ID NO: 339492 - DNA, 20 bp, Artificial
  CRISPR gRNA sequence
gttaaatctaacaagaacac

SEQ ID NO: 339493 - DNA, 20 bp, Artificial
  CRISPR gRNA sequence
ttaaatctaacaagaacact

SEQ ID NO: 339494 - DNA, 20 bp, Artificial
  CRISPR gRNA sequence
aatctaacaagaacactctg

SEQ ID NO: 339495 - DNA, 20 bp, Artificial
  CRISPR gRNA sequence
acaagaacactctggaaggg

SEQ ID NO: 339496 - DNA, 20 bp, Artificial
  CRISPR gRNA sequence
tggaagggggtgctgtcagg

SEQ ID NO: 339497 - DNA, 20 bp, Artificial
  CRISPR gRNA sequence
gaagggggtgctgtcaggag

SEQ ID NO: 339498 - DNA, 20 bp, Artificial
  CRISPR gRNA sequence
tcaggagatgacatttactc

SEQ ID NO: 339499 - DNA, 20 bp, Artificial
  CRISPR gRNA sequence
actcagtcgtggagaggcta

SEQ ID NO: 339500 - DNA, 20 bp, Artificial
  CRISPR gRNA sequence
ctcagtcgtggagaggctaa

SEQ ID NO: 339501 - DNA, 20 bp, Artificial
  CRISPR gRNA sequence
agtcgtggagaggctaagag

SEQ ID NO: 339502 - DNA, 20 bp, Artificial
  CRISPR gRNA sequence
agaggggctccaaggtcagt

SEQ ID NO: 339503 - DNA, 20 bp, Artificial
  CRISPR gRNA sequence
caaggtcagtcatcttcaca

SEQ ID NO: 339504 - DNA, 20 bp, Artificial
  CRISPR gRNA sequence
cacagacttctctcagacgc

SEQ ID NO: 339505 - DNA, 20 bp, Artificial
  CRISPR gRNA sequence
acagacttctctcagacgct

SEQ ID NO: 339506 - DNA, 20 bp, Artificial
  CRISPR gRNA sequence
ctctcagacgctggagacac

SEQ ID NO: 339507 - DNA, 20 bp, Artificial
  CRISPR gRNA sequence
tctcagacgctggagacact

SEQ ID NO: 339508 - DNA, 20 bp, Artificial
  CRISPR gRNA sequence
tcagacgctggagacactga

SEQ ID NO: 339509 - DNA, 20 bp, Artificial
  CRISPR gRNA sequence
agacgctggagacactgagg

SEQ ID NO: 339510 - DNA, 20 bp, Artificial
  CRISPR gRNA sequence
gagacactgaggggctcttt

SEQ ID NO: 339511 - DNA, 20 bp, Artificial
  CRISPR gRNA sequence
aggggctcttttcccaagtg

SEQ ID NO: 339512 - DNA, 20 bp, Artificial
  CRISPR gRNA sequence
ttttcccaagtggaattcag

SEQ ID NO: 339513 - DNA, 20 bp, Artificial
  CRISPR gRNA sequence
ttcccaagtggaattcagga

SEQ ID NO: 339514 - DNA, 20 bp, Artificial
  CRISPR gRNA sequence
tcccaagtggaattcaggag

SEQ ID NO: 339515 - DNA, 20 bp, Artificial
  CRISPR gRNA sequence
cccaagtggaattcaggagt

SEQ ID NO: 339516 - DNA, 20 bp, Artificial
  CRISPR gRNA sequence
ccaagtggaattcaggagtc

SEQ ID NO: 339517 - DNA, 20 bp, Artificial
  CRISPR gRNA sequence
aggagtcactaatggaatgc

SEQ ID NO: 339518 - DNA, 20 bp, Artificial
  CRISPR gRNA sequence
atggaatgcctcagtgacaa

SEQ ID NO: 339519 - DNA, 20 bp, Artificial
  CRISPR gRNA sequence
agtgacaaaggaaggctcaa

SEQ ID NO: 339520 - DNA, 20 bp, Artificial
  CRISPR gRNA sequence
aaagtggccttgagggctat

SEQ ID NO: 339521 - DNA, 20 bp, Artificial
  CRISPR gRNA sequence
gagggctatcctcccagctt

SEQ ID NO: 339522 - DNA, 20 bp, Artificial
  CRISPR gRNA sequence
agggctatcctcccagcttc

SEQ ID NO: 339523 - DNA, 20 bp, Artificial
  CRISPR gRNA sequence
tcctcccagcttcctcacag

SEQ ID NO: 339524 - DNA, 20 bp, Artificial
  CRISPR gRNA sequence
ccagcttcctcacagaacac

SEQ ID NO: 339525 - DNA, 20 bp, Artificial
  CRISPR gRNA sequence
cctcacagaacacatcataa

SEQ ID NO: 339526 - DNA, 20 bp, Artificial
  CRISPR gRNA sequence
ctcacagaacacatcataat

SEQ ID NO: 339527 - DNA, 20 bp, Artificial
  CRISPR gRNA sequence
acagaacacatcataataca

SEQ ID NO: 339528 - DNA, 20 bp, Artificial
  CRISPR gRNA sequence
attagacaccctctgccatc

SEQ ID NO: 339529 - DNA, 20 bp, Artificial
  CRISPR gRNA sequence
ttagacaccctctgccatca

SEQ ID NO: 339530 - DNA, 20 bp, Artificial
  CRISPR gRNA sequence
gacaccctctgccatcagcc

SEQ ID NO: 339531 - DNA, 20 bp, Artificial
  CRISPR gRNA sequence
tgccatcagcccttcccaat

SEQ ID NO: 339532 - DNA, 20 bp, Artificial
  CRISPR gRNA sequence
ccatcagcccttcccaatct

SEQ ID NO: 339533 - DNA, 20 bp, Artificial
  CRISPR gRNA sequence
cccaatctggtgtattatcc

SEQ ID NO: 339534 - DNA, 20 bp, Artificial
  CRISPR gRNA sequence
ccaatctggtgtattatcca

SEQ ID NO: 339535 - DNA, 20 bp, Artificial
  CRISPR gRNA sequence
gtgtattatccacactgctt

SEQ ID NO: 339536 - DNA, 20 bp, Artificial
  CRISPR gRNA sequence
tccacactgcttttaaagta

SEQ ID NO: 339537 - DNA, 20 bp, Artificial
  CRISPR gRNA sequence
cttttaaagtagtctttcta

SEQ ID NO: 339538 - DNA, 20 bp, Artificial
  CRISPR gRNA sequence
ttaaagtagtctttctaaaa

SEQ ID NO: 339539 - DNA, 20 bp, Artificial
  CRISPR gRNA sequence
taaagtagtctttctaaaac

SEQ ID NO: 339540 - DNA, 20 bp, Artificial
  CRISPR gRNA sequence
aaagtagtctttctaaaacc

SEQ ID NO: 339541 - DNA, 20 bp, Artificial
  CRISPR gRNA sequence
aagtagtctttctaaaacca

SEQ ID NO: 339542 - DNA, 20 bp, Artificial
  CRISPR gRNA sequence
tctaaaaccagaatttgtcc

SEQ ID NO: 339543 - DNA, 20 bp, Artificial
  CRISPR gRNA sequence
ctaaaaccagaatttgtccc

SEQ ID NO: 339544 - DNA, 20 bp, Artificial
  CRISPR gRNA sequence
taaaaccagaatttgtccca

SEQ ID NO: 339545 - DNA, 20 bp, Artificial
  CRISPR gRNA sequence
aaaccagaatttgtcccatc

SEQ ID NO: 339546 - DNA, 20 bp, Artificial
  CRISPR gRNA sequence
gtcccatcactcatatggtc

SEQ ID NO: 339547 - DNA, 20 bp, Artificial
  CRISPR gRNA sequence
tcccatcactcatatggtcc

SEQ ID NO: 339548 - DNA, 20 bp, Artificial
  CRISPR gRNA sequence
atatggtccctgttgcctat

SEQ ID NO: 339549 - DNA, 20 bp, Artificial
  CRISPR gRNA sequence
ttgcctataaggtctacaaa

SEQ ID NO: 339550 - DNA, 20 bp, Artificial
  CRISPR gRNA sequence
cctataaggtctacaaagag

SEQ ID NO: 339551 - DNA, 20 bp, Artificial
  CRISPR gRNA sequence
taaggtctacaaagagggtc

SEQ ID NO: 339552 - DNA, 20 bp, Artificial
  CRISPR gRNA sequence
caaagagggtcttcaaaatg

SEQ ID NO: 339553 - DNA, 20 bp, Artificial
  CRISPR gRNA sequence
caaaatgtagttagacattc

SEQ ID NO: 339554 - DNA, 20 bp, Artificial
  CRISPR gRNA sequence
aaaatgtagttagacattca

SEQ ID NO: 339555 - DNA, 20 bp, Artificial
  CRISPR gRNA sequence
gacattcacatttttcgtag

SEQ ID NO: 339556 - DNA, 20 bp, Artificial
  CRISPR gRNA sequence
acatttttcgtagatatttt

SEQ ID NO: 339557 - DNA, 20 bp, Artificial
  CRISPR gRNA sequence
ttcgtagatatttttataat

SEQ ID NO: 339558 - DNA, 20 bp, Artificial
  CRISPR gRNA sequence
tcgtagatatttttataatt

SEQ ID NO: 339559 - DNA, 20 bp, Artificial
  CRISPR gRNA sequence
cgtagatatttttataatta

SEQ ID NO: 339560 - DNA, 20 bp, Artificial
  CRISPR gRNA sequence
gtagatatttttataattaa

SEQ ID NO: 339561 - DNA, 20 bp, Artificial
  CRISPR gRNA sequence
ttataattaaaagtgtccta

SEQ ID NO: 339562 - DNA, 20 bp, Artificial
  CRISPR gRNA sequence
tataattaaaagtgtcctat

SEQ ID NO: 339563 - DNA, 20 bp, Artificial
  CRISPR gRNA sequence
ataattaaaagtgtcctatt

SEQ ID NO: 339564 - DNA, 20 bp, Artificial
  CRISPR gRNA sequence
taattaaaagtgtcctattg

SEQ ID NO: 339565 - DNA, 20 bp, Artificial
  CRISPR gRNA sequence
aaagtgtcctattgctccaa

SEQ ID NO: 339566 - DNA, 20 bp, Artificial
  CRISPR gRNA sequence
ttgctccaagttcattaaaa

SEQ ID NO: 339567 - DNA, 20 bp, Artificial
  CRISPR gRNA sequence
ctccaagttcattaaaaaaa

SEQ ID NO: 339568 - DNA, 20 bp, Artificial
  CRISPR gRNA sequence
caagttcattaaaaaaaaac

SEQ ID NO: 339569 - DNA, 20 bp, Artificial
  CRISPR gRNA sequence
attaaaaaaaaacaagactt

SEQ ID NO: 339570 - DNA, 20 bp, Artificial
  CRISPR gRNA sequence
aaaaaaaacaagactttgtt

SEQ ID NO: 339571 - DNA, 20 bp, Artificial
  CRISPR gRNA sequence
tgttaaattctacattgaga

SEQ ID NO: 339572 - DNA, 20 bp, Artificial
  CRISPR gRNA sequence
gttaaattctacattgagat

SEQ ID NO: 339573 - DNA, 20 bp, Artificial
  CRISPR gRNA sequence
ttaaattctacattgagatc

SEQ ID NO: 339574 - DNA, 20 bp, Artificial
  CRISPR gRNA sequence
aattctacattgagatccat

SEQ ID NO: 339575 - DNA, 20 bp, Artificial
  CRISPR gRNA sequence
tacattgagatccatcaaag

SEQ ID NO: 339576 - DNA, 20 bp, Artificial
  CRISPR gRNA sequence
cattgagatccatcaaagac

SEQ ID NO: 339577 - DNA, 20 bp, Artificial
  CRISPR gRNA sequence
agatccatcaaagactagaa

SEQ ID NO: 339578 - DNA, 20 bp, Artificial
  CRISPR gRNA sequence
gaaatcagcaagattcccat

SEQ ID NO: 339579 - DNA, 20 bp, Artificial
  CRISPR gRNA sequence
ccatccttcttaattcacaa

SEQ ID NO: 339580 - DNA, 20 bp, Artificial
  CRISPR gRNA sequence
cttaattcacaaccaaataa

SEQ ID NO: 339581 - DNA, 20 bp, Artificial
  CRISPR gRNA sequence
ttaattcacaaccaaataac

SEQ ID NO: 339582 - DNA, 20 bp, Artificial
  CRISPR gRNA sequence
aattcacaaccaaataacaa

SEQ ID NO: 339583 - DNA, 20 bp, Artificial
  CRISPR gRNA sequence
attcacaaccaaataacaaa

SEQ ID NO: 339584 - DNA, 20 bp, Artificial
  CRISPR gRNA sequence
acaaccaaataacaaaggtg

SEQ ID NO: 339585 - DNA, 20 bp, Artificial
  CRISPR gRNA sequence
agatttacgttcctttagat

SEQ ID NO: 339586 - DNA, 20 bp, Artificial
  CRISPR gRNA sequence
acgttcctttagatttatgt

SEQ ID NO: 339587 - DNA, 20 bp, Artificial
  CRISPR gRNA sequence
cgttcctttagatttatgtt

SEQ ID NO: 339588 - DNA, 20 bp, Artificial
  CRISPR gRNA sequence
ctttagatttatgttacacc

SEQ ID NO: 339589 - DNA, 20 bp, Artificial
  CRISPR gRNA sequence
tagatttatgttacacctcc

SEQ ID NO: 339590 - DNA, 20 bp, Artificial
  CRISPR gRNA sequence
agatttatgttacacctcca

SEQ ID NO: 339591 - DNA, 20 bp, Artificial
  CRISPR gRNA sequence
gatttatgttacacctccac

SEQ ID NO: 339592 - DNA, 20 bp, Artificial
  CRISPR gRNA sequence
atgttacacctccactactt

SEQ ID NO: 339593 - DNA, 20 bp, Artificial
  CRISPR gRNA sequence
tgttacacctccactacttc

SEQ ID NO: 339594 - DNA, 20 bp, Artificial
  CRISPR gRNA sequence
cacctccactacttcaacac

SEQ ID NO: 339595 - DNA, 20 bp, Artificial
  CRISPR gRNA sequence
cactacttcaacacagttta

SEQ ID NO: 339596 - DNA, 20 bp, Artificial
  CRISPR gRNA sequence
cttcaacacagtttagaaag

SEQ ID NO: 339597 - DNA, 20 bp, Artificial
  CRISPR gRNA sequence
caacacagtttagaaagaat

SEQ ID NO: 339598 - DNA, 20 bp, Artificial
  CRISPR gRNA sequence
aacacagtttagaaagaatg

SEQ ID NO: 339599 - DNA, 20 bp, Artificial
  CRISPR gRNA sequence
agaaagaatgtagatgttgg

SEQ ID NO: 339600 - DNA, 20 bp, Artificial
  CRISPR gRNA sequence
gaaagaatgtagatgttgga

SEQ ID NO: 339601 - DNA, 20 bp, Artificial
  CRISPR gRNA sequence
gagtcacattagagttctaa

SEQ ID NO: 339602 - DNA, 20 bp, Artificial
  CRISPR gRNA sequence
gagttctaactttggttctg

SEQ ID NO: 339603 - DNA, 20 bp, Artificial
  CRISPR gRNA sequence
taactttggttctgccacca

SEQ ID NO: 339604 - DNA, 20 bp, Artificial
  CRISPR gRNA sequence
actttggttctgccaccaac

SEQ ID NO: 339605 - DNA, 20 bp, Artificial
  CRISPR gRNA sequence
tggttctgccaccaactact

SEQ ID NO: 339606 - DNA, 20 bp, Artificial
  CRISPR gRNA sequence
ggttctgccaccaactactg

SEQ ID NO: 339607 - DNA, 20 bp, Artificial
  CRISPR gRNA sequence
gttctgccaccaactactgt

SEQ ID NO: 339608 - DNA, 20 bp, Artificial
  CRISPR gRNA sequence
tgccaccaactactgtgtaa

SEQ ID NO: 339609 - DNA, 20 bp, Artificial
  CRISPR gRNA sequence
ccaccaactactgtgtaaca

SEQ ID NO: 339610 - DNA, 20 bp, Artificial
  CRISPR gRNA sequence
ctgtgtaacaaatcacttaa

SEQ ID NO: 339611 - DNA, 20 bp, Artificial
  CRISPR gRNA sequence
tgtaacaaatcacttaacct

SEQ ID NO: 339612 - DNA, 20 bp, Artificial
  CRISPR gRNA sequence
aacctttcctggttggaaat

SEQ ID NO: 339613 - DNA, 20 bp, Artificial
  CRISPR gRNA sequence
acctttcctggttggaaatt

SEQ ID NO: 339614 - DNA, 20 bp, Artificial
  CRISPR gRNA sequence
tcctggttggaaattcttca

SEQ ID NO: 339615 - DNA, 20 bp, Artificial
  CRISPR gRNA sequence
cctggttggaaattcttcaa

SEQ ID NO: 339616 - DNA, 20 bp, Artificial
  CRISPR gRNA sequence
ctggttggaaattcttcaaa

SEQ ID NO: 339617 - DNA, 20 bp, Artificial
  CRISPR gRNA sequence
gttggaaattcttcaaacac

SEQ ID NO: 339618 - DNA, 20 bp, Artificial
  CRISPR gRNA sequence
gaaattcttcaaacactgac

SEQ ID NO: 339619 - DNA, 20 bp, Artificial
  CRISPR gRNA sequence
ttcaaacactgactaaaggt

SEQ ID NO: 339620 - DNA, 20 bp, Artificial
  CRISPR gRNA sequence
caaacactgactaaaggtaa

SEQ ID NO: 339621 - DNA, 20 bp, Artificial
  CRISPR gRNA sequence
aaacactgactaaaggtaag

SEQ ID NO: 339622 - DNA, 20 bp, Artificial
  CRISPR gRNA sequence
actaaaggtaagaatgccta

SEQ ID NO: 339623 - DNA, 20 bp, Artificial
  CRISPR gRNA sequence
aaggtaagaatgcctacatc

SEQ ID NO: 339624 - DNA, 20 bp, Artificial
  CRISPR gRNA sequence
catcttcatggcatgagaaa

SEQ ID NO: 339625 - DNA, 20 bp, Artificial
  CRISPR gRNA sequence
catggcatgagaaagcctat

SEQ ID NO: 339626 - DNA, 20 bp, Artificial
  CRISPR gRNA sequence
atggcatgagaaagcctatg

SEQ ID NO: 339627 - DNA, 20 bp, Artificial
  CRISPR gRNA sequence
tgtaaattgggaggattgaa

SEQ ID NO: 339628 - DNA, 20 bp, Artificial
  CRISPR gRNA sequence
ggaggattgaaaatacaaca

SEQ ID NO: 339629 - DNA, 20 bp, Artificial
  CRISPR gRNA sequence
aaaatacaacagaggacaag

SEQ ID NO: 339630 - DNA, 20 bp, Artificial
  CRISPR gRNA sequence
agtttacttgagtttggctc

SEQ ID NO: 339631 - DNA, 20 bp, Artificial
  CRISPR gRNA sequence
gtttacttgagtttggctct

SEQ ID NO: 339632 - DNA, 20 bp, Artificial
  CRISPR gRNA sequence
acttgagtttggctcttttt

SEQ ID NO: 339633 - DNA, 20 bp, Artificial
  CRISPR gRNA sequence
cttgagtttggctctttttc

SEQ ID NO: 339634 - DNA, 20 bp, Artificial
  CRISPR gRNA sequence
gagtttggctctttttcttt

SEQ ID NO: 339635 - DNA, 20 bp, Artificial
  CRISPR gRNA sequence
agtttggctctttttcttta

SEQ ID NO: 339636 - DNA, 20 bp, Artificial
  CRISPR gRNA sequence
ggctctttttctttagagct

SEQ ID NO: 339637 - DNA, 20 bp, Artificial
  CRISPR gRNA sequence
gctctttttctttagagctt

SEQ ID NO: 339638 - DNA, 20 bp, Artificial
  CRISPR gRNA sequence
tttttctttagagcttttac

SEQ ID NO: 339639 - DNA, 20 bp, Artificial
  CRISPR gRNA sequence
tttctttagagcttttacat

SEQ ID NO: 339640 - DNA, 20 bp, Artificial
  CRISPR gRNA sequence
ttctttagagcttttacatg

SEQ ID NO: 339641 - DNA, 20 bp, Artificial
  CRISPR gRNA sequence
tctttagagcttttacatgg

SEQ ID NO: 339642 - DNA, 20 bp, Artificial
  CRISPR gRNA sequence
ctttagagcttttacatggc

SEQ ID NO: 339643 - DNA, 20 bp, Artificial
  CRISPR gRNA sequence
tttagagcttttacatggca

SEQ ID NO: 339644 - DNA, 20 bp, Artificial
  CRISPR gRNA sequence
tagagcttttacatggcagt

SEQ ID NO: 339645 - DNA, 20 bp, Artificial
  CRISPR gRNA sequence
agagcttttacatggcagtt

SEQ ID NO: 339646 - DNA, 20 bp, Artificial
  CRISPR gRNA sequence
gagcttttacatggcagttt

SEQ ID NO: 339647 - DNA, 20 bp, Artificial
  CRISPR gRNA sequence
ttacatggcagtttctggat

SEQ ID NO: 339648 - DNA, 20 bp, Artificial
  CRISPR gRNA sequence
tacatggcagtttctggata

SEQ ID NO: 339649 - DNA, 20 bp, Artificial
  CRISPR gRNA sequence
acatggcagtttctggatac

SEQ ID NO: 339650 - DNA, 20 bp, Artificial
  CRISPR gRNA sequence
catggcagtttctggataca

SEQ ID NO: 339651 - DNA, 20 bp, Artificial
  CRISPR gRNA sequence
ctggatacatgcattgtgga

SEQ ID NO: 339652 - DNA, 20 bp, Artificial
  CRISPR gRNA sequence
tggatacatgcattgtggag

SEQ ID NO: 339653 - DNA, 20 bp, Artificial
  CRISPR gRNA sequence
gatacatgcattgtggagat

SEQ ID NO: 339654 - DNA, 20 bp, Artificial
  CRISPR gRNA sequence
tggagatattttaaatagga

SEQ ID NO: 339655 - DNA, 20 bp, Artificial
  CRISPR gRNA sequence
taaataggatcattgctagc

SEQ ID NO: 339656 - DNA, 20 bp, Artificial
  CRISPR gRNA sequence
aaataggatcattgctagca

SEQ ID NO: 339657 - DNA, 20 bp, Artificial
  CRISPR gRNA sequence
aataggatcattgctagcag

SEQ ID NO: 339658 - DNA, 20 bp, Artificial
  CRISPR gRNA sequence
ctagcagatttattgttacc

SEQ ID NO: 339659 - DNA, 20 bp, Artificial
  CRISPR gRNA sequence
gcagatttattgttaccatt

SEQ ID NO: 339660 - DNA, 20 bp, Artificial
  CRISPR gRNA sequence
attgttaccatttagccact

SEQ ID NO: 339661 - DNA, 20 bp, Artificial
  CRISPR gRNA sequence
ttgttaccatttagccactc

SEQ ID NO: 339662 - DNA, 20 bp, Artificial
  CRISPR gRNA sequence
ttaccatttagccactcgtg

SEQ ID NO: 339663 - DNA, 20 bp, Artificial
  CRISPR gRNA sequence
ccatttagccactcgtgcct

SEQ ID NO: 339664 - DNA, 20 bp, Artificial
  CRISPR gRNA sequence
agccactcgtgcctcaggtt

SEQ ID NO: 339665 - DNA, 20 bp, Artificial
  CRISPR gRNA sequence
gccactcgtgcctcaggttt

SEQ ID NO: 339666 - DNA, 20 bp, Artificial
  CRISPR gRNA sequence
gtgcctcaggtttgccacat

SEQ ID NO: 339667 - DNA, 20 bp, Artificial
  CRISPR gRNA sequence
aggtttgccacatgccaaac

SEQ ID NO: 339668 - DNA, 20 bp, Artificial
  CRISPR gRNA sequence
gccacatgccaaacagcatg

SEQ ID NO: 339669 - DNA, 20 bp, Artificial
  CRISPR gRNA sequence
ccacatgccaaacagcatgc

SEQ ID NO: 339670 - DNA, 20 bp, Artificial
  CRISPR gRNA sequence
atggctttctttataatgag

SEQ ID NO: 339671 - DNA, 20 bp, Artificial
  CRISPR gRNA sequence
tctttataatgagagtgaac

SEQ ID NO: 339672 - DNA, 20 bp, Artificial
  CRISPR gRNA sequence
ctttataatgagagtgaaca

SEQ ID NO: 339673 - DNA, 20 bp, Artificial
  CRISPR gRNA sequence
tttataatgagagtgaacat

SEQ ID NO: 339674 - DNA, 20 bp, Artificial
  CRISPR gRNA sequence
tataatgagagtgaacattg

SEQ ID NO: 339675 - DNA, 20 bp, Artificial
  CRISPR gRNA sequence
ataatgagagtgaacattgg

SEQ ID NO: 339676 - DNA, 20 bp, Artificial
  CRISPR gRNA sequence
taatgagagtgaacattggt

SEQ ID NO: 339677 - DNA, 20 bp, Artificial
  CRISPR gRNA sequence
gttgtattcatttagaatct

SEQ ID NO: 339678 - DNA, 20 bp, Artificial
  CRISPR gRNA sequence
tattcatttagaatctacga

SEQ ID NO: 339679 - DNA, 20 bp, Artificial
  CRISPR gRNA sequence
atttagaatctacgatgaat

SEQ ID NO: 339680 - DNA, 20 bp, Artificial
  CRISPR gRNA sequence
agaatctacgatgaatattg

SEQ ID NO: 339681 - DNA, 20 bp, Artificial
  CRISPR gRNA sequence
gaatctacgatgaatattgt

SEQ ID NO: 339682 - DNA, 20 bp, Artificial
  CRISPR gRNA sequence
cgatgaatattgttccagaa

SEQ ID NO: 339683 - DNA, 20 bp, Artificial
  CRISPR gRNA sequence
ttccagaatacaaattattc

SEQ ID NO: 339684 - DNA, 20 bp, Artificial
  CRISPR gRNA sequence
cagaatacaaattattcgtc

SEQ ID NO: 339685 - DNA, 20 bp, Artificial
  CRISPR gRNA sequence
ttcgtcagcttaatctggaa

SEQ ID NO: 339686 - DNA, 20 bp, Artificial
  CRISPR gRNA sequence
gtcagcttaatctggaaact

SEQ ID NO: 339687 - DNA, 20 bp, Artificial
  CRISPR gRNA sequence
aatctggaaacttaaaacaa

SEQ ID NO: 339688 - DNA, 20 bp, Artificial
  CRISPR gRNA sequence
atctggaaacttaaaacaat

SEQ ID NO: 339689 - DNA, 20 bp, Artificial
  CRISPR gRNA sequence
gaaacttaaaacaatcctac

SEQ ID NO: 339690 - DNA, 20 bp, Artificial
  CRISPR gRNA sequence
aaaacaatcctacctaaggc

SEQ ID NO: 339691 - DNA, 20 bp, Artificial
  CRISPR gRNA sequence
aaacaatcctacctaaggct

SEQ ID NO: 339692 - DNA, 20 bp, Artificial
  CRISPR gRNA sequence
cctaaggctggatctcacct

SEQ ID NO: 339693 - DNA, 20 bp, Artificial
  CRISPR gRNA sequence
aggctggatctcaccttcca

SEQ ID NO: 339694 - DNA, 20 bp, Artificial
  CRISPR gRNA sequence
gatctcaccttccacagaat

SEQ ID NO: 339695 - DNA, 20 bp, Artificial
  CRISPR gRNA sequence
accttccacagaattgacac

SEQ ID NO: 339696 - DNA, 20 bp, Artificial
  CRISPR gRNA sequence
ccacagaattgacaccgatg

SEQ ID NO: 339697 - DNA, 20 bp, Artificial
  CRISPR gRNA sequence
cacagaattgacaccgatgc

SEQ ID NO: 339698 - DNA, 20 bp, Artificial
  CRISPR gRNA sequence
acaccgatgctactttaatt

SEQ ID NO: 339699 - DNA, 20 bp, Artificial
  CRISPR gRNA sequence
ctttaattctcctgagcata

SEQ ID NO: 339700 - DNA, 20 bp, Artificial
  CRISPR gRNA sequence
taattctcctgagcataata

SEQ ID NO: 339701 - DNA, 20 bp, Artificial
  CRISPR gRNA sequence
aattctcctgagcataatac

SEQ ID NO: 339702 - DNA, 20 bp, Artificial
  CRISPR gRNA sequence
attctcctgagcataatacc

SEQ ID NO: 339703 - DNA, 20 bp, Artificial
  CRISPR gRNA sequence
tcctgagcataataccacaa

SEQ ID NO: 339704 - DNA, 20 bp, Artificial
  CRISPR gRNA sequence
ctgagcataataccacaacc

SEQ ID NO: 339705 - DNA, 20 bp, Artificial
  CRISPR gRNA sequence
agcataataccacaaccaga

SEQ ID NO: 339706 - DNA, 20 bp, Artificial
  CRISPR gRNA sequence
cccaaattggtttggcctag

SEQ ID NO: 339707 - DNA, 20 bp, Artificial
  CRISPR gRNA sequence
gtttggcctagttgaatgat

SEQ ID NO: 339708 - DNA, 20 bp, Artificial
  CRISPR gRNA sequence
ggcctagttgaatgattttt

SEQ ID NO: 339709 - DNA, 20 bp, Artificial
  CRISPR gRNA sequence
gcctagttgaatgattttta

SEQ ID NO: 339710 - DNA, 20 bp, Artificial
  CRISPR gRNA sequence
gttgaatgatttttatcaat

SEQ ID NO: 339711 - DNA, 20 bp, Artificial
  CRISPR gRNA sequence
aatgatttttatcaatacaa

SEQ ID NO: 339712 - DNA, 20 bp, Artificial
  CRISPR gRNA sequence
ttatcaatacaaacaaaccc

SEQ ID NO: 339713 - DNA, 20 bp, Artificial
  CRISPR gRNA sequence
tatcaatacaaacaaaccct

SEQ ID NO: 339714 - DNA, 20 bp, Artificial
  CRISPR gRNA sequence
atcaatacaaacaaaccctt

SEQ ID NO: 339715 - DNA, 20 bp, Artificial
  CRISPR gRNA sequence
tcaatacaaacaaacccttc

SEQ ID NO: 339716 - DNA, 20 bp, Artificial
  CRISPR gRNA sequence
ccacgaatggtaccaacgtt

SEQ ID NO: 339717 - DNA, 20 bp, Artificial
  CRISPR gRNA sequence
cacgaatggtaccaacgttc

SEQ ID NO: 339718 - DNA, 20 bp, Artificial
  CRISPR gRNA sequence
ttggaagaatatccaaaatc

SEQ ID NO: 339719 - DNA, 20 bp, Artificial
  CRISPR gRNA sequence
ggaagaatatccaaaatctg

SEQ ID NO: 339720 - DNA, 20 bp, Artificial
  CRISPR gRNA sequence
gaagaatatccaaaatctgg

SEQ ID NO: 339721 - DNA, 20 bp, Artificial
  CRISPR gRNA sequence
gaacatagactatatggtct

SEQ ID NO: 339722 - DNA, 20 bp, Artificial
  CRISPR gRNA sequence
tatggtctgaatggtctggc

SEQ ID NO: 339723 - DNA, 20 bp, Artificial
  CRISPR gRNA sequence
aatggtctggcctctacttt

SEQ ID NO: 339724 - DNA, 20 bp, Artificial
  CRISPR gRNA sequence
gcctctactttcctttccag

SEQ ID NO: 339725 - DNA, 20 bp, Artificial
  CRISPR gRNA sequence
tactttcctttccagcctca

SEQ ID NO: 339726 - DNA, 20 bp, Artificial
  CRISPR gRNA sequence
ctttcctttccagcctcacc

SEQ ID NO: 339727 - DNA, 20 bp, Artificial
  CRISPR gRNA sequence
tcctttccagcctcaccttg

SEQ ID NO: 339728 - DNA, 20 bp, Artificial
  CRISPR gRNA sequence
cctttccagcctcaccttgg

SEQ ID NO: 339729 - DNA, 20 bp, Artificial
  CRISPR gRNA sequence
ctttccagcctcaccttgga

SEQ ID NO: 339730 - DNA, 20 bp, Artificial
  CRISPR gRNA sequence
tccagcctcaccttggacca

SEQ ID NO: 339731 - DNA, 20 bp, Artificial
  CRISPR gRNA sequence
ccagcctcaccttggaccaa

SEQ ID NO: 339732 - DNA, 20 bp, Artificial
  CRISPR gRNA sequence
cagcctcaccttggaccaac

SEQ ID NO: 339733 - DNA, 20 bp, Artificial
  CRISPR gRNA sequence
accttggaccaacttggacc

SEQ ID NO: 339734 - DNA, 20 bp, Artificial
  CRISPR gRNA sequence
ggaccaacttggaccagttg

SEQ ID NO: 339735 - DNA, 20 bp, Artificial
  CRISPR gRNA sequence
gaccaacttggaccagttgg

SEQ ID NO: 339736 - DNA, 20 bp, Artificial
  CRISPR gRNA sequence
ggaccagttggtcatcttgg

SEQ ID NO: 339737 - DNA, 20 bp, Artificial
  CRISPR gRNA sequence
gaccagttggtcatcttgga

SEQ ID NO: 339738 - DNA, 20 bp, Artificial
  CRISPR gRNA sequence
gtcatcttggaccaagctca

SEQ ID NO: 339739 - DNA, 20 bp, Artificial
  CRISPR gRNA sequence
ggaccaagctcagcctcttc

SEQ ID NO: 339740 - DNA, 20 bp, Artificial
  CRISPR gRNA sequence
gaccaagctcagcctcttcc

SEQ ID NO: 339741 - DNA, 20 bp, Artificial
  CRISPR gRNA sequence
agcctcttccctctttgtgc

SEQ ID NO: 339742 - DNA, 20 bp, Artificial
  CRISPR gRNA sequence
ttccctctttgtgctcaggc

SEQ ID NO: 339743 - DNA, 20 bp, Artificial
  CRISPR gRNA sequence
ccctctttgtgctcaggcac

SEQ ID NO: 339744 - DNA, 20 bp, Artificial
  CRISPR gRNA sequence
cctctttgtgctcaggcaca

SEQ ID NO: 339745 - DNA, 20 bp, Artificial
  CRISPR gRNA sequence
tttgtgctcaggcacatctg

SEQ ID NO: 339746 - DNA, 20 bp, Artificial
  CRISPR gRNA sequence
tgtgctcaggcacatctgtc

SEQ ID NO: 339747 - DNA, 20 bp, Artificial
  CRISPR gRNA sequence
gtgctcaggcacatctgtct

SEQ ID NO: 339748 - DNA, 20 bp, Artificial
  CRISPR gRNA sequence
tgctcaggcacatctgtctg

SEQ ID NO: 339749 - DNA, 20 bp, Artificial
  CRISPR gRNA sequence
aggcacatctgtctgctttc

SEQ ID NO: 339750 - DNA, 20 bp, Artificial
  CRISPR gRNA sequence
tctgctttcttctagttccc

SEQ ID NO: 339751 - DNA, 20 bp, Artificial
  CRISPR gRNA sequence
ctttcttctagttccctaac

SEQ ID NO: 339752 - DNA, 20 bp, Artificial
  CRISPR gRNA sequence
tcttctagttccctaacctt

SEQ ID NO: 339753 - DNA, 20 bp, Artificial
  CRISPR gRNA sequence
cttctagttccctaacctta

SEQ ID NO: 339754 - DNA, 20 bp, Artificial
  CRISPR gRNA sequence
ttctagttccctaaccttac

SEQ ID NO: 339755 - DNA, 20 bp, Artificial
  CRISPR gRNA sequence
ctagttccctaaccttacct

SEQ ID NO: 339756 - DNA, 20 bp, Artificial
  CRISPR gRNA sequence
tagttccctaaccttacctc

SEQ ID NO: 339757 - DNA, 20 bp, Artificial
  CRISPR gRNA sequence
gttccctaaccttacctcat

SEQ ID NO: 339758 - DNA, 20 bp, Artificial
  CRISPR gRNA sequence
cctaaccttacctcattcct

SEQ ID NO: 339759 - DNA, 20 bp, Artificial
  CRISPR gRNA sequence
accttacctcattccttcct

SEQ ID NO: 339760 - DNA, 20 bp, Artificial
  CRISPR gRNA sequence
acctcattccttcctgccac

SEQ ID NO: 339761 - DNA, 20 bp, Artificial
  CRISPR gRNA sequence
cctcattccttcctgccaca

SEQ ID NO: 339762 - DNA, 20 bp, Artificial
  CRISPR gRNA sequence
attccttcctgccacaggct

SEQ ID NO: 339763 - DNA, 20 bp, Artificial
  CRISPR gRNA sequence
cttcctgccacaggctcttt

SEQ ID NO: 339764 - DNA, 20 bp, Artificial
  CRISPR gRNA sequence
cctgccacaggctctttgca

SEQ ID NO: 339765 - DNA, 20 bp, Artificial
  CRISPR gRNA sequence
ctgccacaggctctttgcac

SEQ ID NO: 339766 - DNA, 20 bp, Artificial
  CRISPR gRNA sequence
ccacaggctctttgcacttg

SEQ ID NO: 339767 - DNA, 20 bp, Artificial
  CRISPR gRNA sequence
tttgcacttgttccttccat

SEQ ID NO: 339768 - DNA, 20 bp, Artificial
  CRISPR gRNA sequence
tgcacttgttccttccatgg

SEQ ID NO: 339769 - DNA, 20 bp, Artificial
  CRISPR gRNA sequence
gcacttgttccttccatggt

SEQ ID NO: 339770 - DNA, 20 bp, Artificial
  CRISPR gRNA sequence
cacttgttccttccatggta

SEQ ID NO: 339771 - DNA, 20 bp, Artificial
  CRISPR gRNA sequence
gttccttccatggtatggaa

SEQ ID NO: 339772 - DNA, 20 bp, Artificial
  CRISPR gRNA sequence
ttccttccatggtatggaac

SEQ ID NO: 339773 - DNA, 20 bp, Artificial
  CRISPR gRNA sequence
cttccatggtatggaacgtt

SEQ ID NO: 339774 - DNA, 20 bp, Artificial
  CRISPR gRNA sequence
ccatggtatggaacgttctt

SEQ ID NO: 339775 - DNA, 20 bp, Artificial
  CRISPR gRNA sequence
catggtatggaacgttcttc

SEQ ID NO: 339776 - DNA, 20 bp, Artificial
  CRISPR gRNA sequence
ttccctaccttcataccgtt

SEQ ID NO: 339777 - DNA, 20 bp, Artificial
  CRISPR gRNA sequence
ccctaccttcataccgttct

SEQ ID NO: 339778 - DNA, 20 bp, Artificial
  CRISPR gRNA sequence
cctaccttcataccgttctc

SEQ ID NO: 339779 - DNA, 20 bp, Artificial
  CRISPR gRNA sequence
ccttcataccgttctcccca

SEQ ID NO: 339780 - DNA, 20 bp, Artificial
  CRISPR gRNA sequence
cataccgttctccccattga

SEQ ID NO: 339781 - DNA, 20 bp, Artificial
  CRISPR gRNA sequence
ataccgttctccccattgat

SEQ ID NO: 339782 - DNA, 20 bp, Artificial
  CRISPR gRNA sequence
tccccattgattgctacctt

SEQ ID NO: 339783 - DNA, 20 bp, Artificial
  CRISPR gRNA sequence
cccattgattgctaccttgt

SEQ ID NO: 339784 - DNA, 20 bp, Artificial
  CRISPR gRNA sequence
attgctaccttgtccttgaa

SEQ ID NO: 339785 - DNA, 20 bp, Artificial
  CRISPR gRNA sequence
ctaccttgtccttgaaatct

SEQ ID NO: 339786 - DNA, 20 bp, Artificial
  CRISPR gRNA sequence
ccttgtccttgaaatctccg

SEQ ID NO: 339787 - DNA, 20 bp, Artificial
  CRISPR gRNA sequence
gtccttgaaatctccgctca

SEQ ID NO: 339788 - DNA, 20 bp, Artificial
  CRISPR gRNA sequence
tccttgaaatctccgctcaa

SEQ ID NO: 339789 - DNA, 20 bp, Artificial
  CRISPR gRNA sequence
gaaatctccgctcaagtgcc

SEQ ID NO: 339790 - DNA, 20 bp, Artificial
  CRISPR gRNA sequence
aaatctccgctcaagtgcca

SEQ ID NO: 339791 - DNA, 20 bp, Artificial
  CRISPR gRNA sequence
cgctcaagtgccacttgcac

SEQ ID NO: 339792 - DNA, 20 bp, Artificial
  CRISPR gRNA sequence
aagtgccacttgcacaggaa

SEQ ID NO: 339793 - DNA, 20 bp, Artificial
  CRISPR gRNA sequence
gcacaggaaagacttcaatg

SEQ ID NO: 339794 - DNA, 20 bp, Artificial
  CRISPR gRNA sequence
cacaggaaagacttcaatga

SEQ ID NO: 339795 - DNA, 20 bp, Artificial
  CRISPR gRNA sequence
caatgaaccctgctcctcag

SEQ ID NO: 339796 - DNA, 20 bp, Artificial
  CRISPR gRNA sequence
aatgaaccctgctcctcagc

SEQ ID NO: 339797 - DNA, 20 bp, Artificial
  CRISPR gRNA sequence
ctcctcagctacacctccac

SEQ ID NO: 339798 - DNA, 20 bp, Artificial
  CRISPR gRNA sequence
ctcagctacacctccacacc

SEQ ID NO: 339799 - DNA, 20 bp, Artificial
  CRISPR gRNA sequence
agctacacctccacacccac

SEQ ID NO: 339800 - DNA, 20 bp, Artificial
  CRISPR gRNA sequence
cacctccacacccacccagt

SEQ ID NO: 339801 - DNA, 20 bp, Artificial
  CRISPR gRNA sequence
cacacccacccagtctagtc

SEQ ID NO: 339802 - DNA, 20 bp, Artificial
  CRISPR gRNA sequence
gtcaagctccttgttacatt

SEQ ID NO: 339803 - DNA, 20 bp, Artificial
  CRISPR gRNA sequence
cttgttacattccctcatat

SEQ ID NO: 339804 - DNA, 20 bp, Artificial
  CRISPR gRNA sequence
gttacattccctcatataat

SEQ ID NO: 339805 - DNA, 20 bp, Artificial
  CRISPR gRNA sequence
ttacattccctcatataatt

SEQ ID NO: 339806 - DNA, 20 bp, Artificial
  CRISPR gRNA sequence
cattccctcatataattgag

SEQ ID NO: 339807 - DNA, 20 bp, Artificial
  CRISPR gRNA sequence
cctcatataattgagttttg

SEQ ID NO: 339808 - DNA, 20 bp, Artificial
  CRISPR gRNA sequence
atataattgagttttgcctg

SEQ ID NO: 339809 - DNA, 20 bp, Artificial
  CRISPR gRNA sequence
agttttgcctgtaattatca

SEQ ID NO: 339810 - DNA, 20 bp, Artificial
  CRISPR gRNA sequence
tgcctgtaattatcattaat

SEQ ID NO: 339811 - DNA, 20 bp, Artificial
  CRISPR gRNA sequence
gcctgtaattatcattaatc

SEQ ID NO: 339812 - DNA, 20 bp, Artificial
  CRISPR gRNA sequence
cctgtaattatcattaatca

SEQ ID NO: 339813 - DNA, 20 bp, Artificial
  CRISPR gRNA sequence
taattatcattaatcaatgg

SEQ ID NO: 339814 - DNA, 20 bp, Artificial
  CRISPR gRNA sequence
tcattaatcaatgggattat

SEQ ID NO: 339815 - DNA, 20 bp, Artificial
  CRISPR gRNA sequence
atcaatgggattatttgatt

SEQ ID NO: 339816 - DNA, 20 bp, Artificial
  CRISPR gRNA sequence
tttgattaatatatctctct

SEQ ID NO: 339817 - DNA, 20 bp, Artificial
  CRISPR gRNA sequence
gattaatatatctctctcta

SEQ ID NO: 339818 - DNA, 20 bp, Artificial
  CRISPR gRNA sequence
attaatatatctctctctac

SEQ ID NO: 339819 - DNA, 20 bp, Artificial
  CRISPR gRNA sequence
atatatctctctctaccatg

SEQ ID NO: 339820 - DNA, 20 bp, Artificial
  CRISPR gRNA sequence
tctctaccatgcagttacct

SEQ ID NO: 339821 - DNA, 20 bp, Artificial
  CRISPR gRNA sequence
tctaccatgcagttaccttc

SEQ ID NO: 339822 - DNA, 20 bp, Artificial
  CRISPR gRNA sequence
taccatgcagttaccttcca

SEQ ID NO: 339823 - DNA, 20 bp, Artificial
  CRISPR gRNA sequence
ccatgcagttaccttccaaa

SEQ ID NO: 339824 - DNA, 20 bp, Artificial
  CRISPR gRNA sequence
ccttccaaagaacaggggtt

SEQ ID NO: 339825 - DNA, 20 bp, Artificial
  CRISPR gRNA sequence
ccaaagaacaggggttgacc

SEQ ID NO: 339826 - DNA, 20 bp, Artificial
  CRISPR gRNA sequence
caaagaacaggggttgacct

SEQ ID NO: 339827 - DNA, 20 bp, Artificial
  CRISPR gRNA sequence
acctggttttgctcatcctt

SEQ ID NO: 339828 - DNA, 20 bp, Artificial
  CRISPR gRNA sequence
gttttgctcatccttgtaca

SEQ ID NO: 339829 - DNA, 20 bp, Artificial
  CRISPR gRNA sequence
tgctcatccttgtacataca

SEQ ID NO: 339830 - DNA, 20 bp, Artificial
  CRISPR gRNA sequence
gctcatccttgtacatacac

SEQ ID NO: 339831 - DNA, 20 bp, Artificial
  CRISPR gRNA sequence
ctcatccttgtacatacacc

SEQ ID NO: 339832 - DNA, 20 bp, Artificial
  CRISPR gRNA sequence
atccttgtacatacaccatc

SEQ ID NO: 339833 - DNA, 20 bp, Artificial
  CRISPR gRNA sequence
gtacatacaccatctggcac

SEQ ID NO: 339834 - DNA, 20 bp, Artificial
  CRISPR gRNA sequence
tacatacaccatctggcaca

SEQ ID NO: 339835 - DNA, 20 bp, Artificial
  CRISPR gRNA sequence
gcacagtacctgctaccagg

SEQ ID NO: 339836 - DNA, 20 bp, Artificial
  CRISPR gRNA sequence
ctaccaggcaggtgctcaat

SEQ ID NO: 339837 - DNA, 20 bp, Artificial
  CRISPR gRNA sequence
ccaggcaggtgctcaatgct

SEQ ID NO: 339838 - DNA, 20 bp, Artificial
  CRISPR gRNA sequence
aatgctacatgagtaaatgg

SEQ ID NO: 339839 - DNA, 20 bp, Artificial
  CRISPR gRNA sequence
catgagtaaatggatgaatg

SEQ ID NO: 339840 - DNA, 20 bp, Artificial
  CRISPR gRNA sequence
caaagctgctcatgtcattc

SEQ ID NO: 339841 - DNA, 20 bp, Artificial
  CRISPR gRNA sequence
ctcatgtcattcatgccgct

SEQ ID NO: 339842 - DNA, 20 bp, Artificial
  CRISPR gRNA sequence
atgtcattcatgccgctaaa

SEQ ID NO: 339843 - DNA, 20 bp, Artificial
  CRISPR gRNA sequence
atgccgctaaaggacttcat

SEQ ID NO: 339844 - DNA, 20 bp, Artificial
  CRISPR gRNA sequence
aaggacttcatgagattcta

SEQ ID NO: 339845 - DNA, 20 bp, Artificial
  CRISPR gRNA sequence
catgagattctagaaaaggc

SEQ ID NO: 339846 - DNA, 20 bp, Artificial
  CRISPR gRNA sequence
atgagattctagaaaaggca

SEQ ID NO: 339847 - DNA, 20 bp, Artificial
  CRISPR gRNA sequence
tagaaaaggcataaaccagc

SEQ ID NO: 339848 - DNA, 20 bp, Artificial
  CRISPR gRNA sequence
gaaaaggcataaaccagcaa

SEQ ID NO: 339849 - DNA, 20 bp, Artificial
  CRISPR gRNA sequence
tccttgtgctcattctacat

SEQ ID NO: 339850 - DNA, 20 bp, Artificial
  CRISPR gRNA sequence
gtgctcattctacattcctc

SEQ ID NO: 339851 - DNA, 20 bp, Artificial
  CRISPR gRNA sequence
tgctcattctacattcctca

SEQ ID NO: 339852 - DNA, 20 bp, Artificial
  CRISPR gRNA sequence
attctacattcctcaatcct

SEQ ID NO: 339853 - DNA, 20 bp, Artificial
  CRISPR gRNA sequence
tacattcctcaatcctctta

SEQ ID NO: 339854 - DNA, 20 bp, Artificial
  CRISPR gRNA sequence
cattcctcaatcctcttaac

SEQ ID NO: 339855 - DNA, 20 bp, Artificial
  CRISPR gRNA sequence
ctcaatcctcttaactgcac

SEQ ID NO: 339856 - DNA, 20 bp, Artificial
  CRISPR gRNA sequence
aatcctcttaactgcactta

SEQ ID NO: 339857 - DNA, 20 bp, Artificial
  CRISPR gRNA sequence
ttaactgcacttaactcact

SEQ ID NO: 339858 - DNA, 20 bp, Artificial
  CRISPR gRNA sequence
aactgcacttaactcacttt

SEQ ID NO: 339859 - DNA, 20 bp, Artificial
  CRISPR gRNA sequence
actgcacttaactcactttg

SEQ ID NO: 339860 - DNA, 20 bp, Artificial
  CRISPR gRNA sequence
cacttaactcactttgagcc

SEQ ID NO: 339861 - DNA, 20 bp, Artificial
  CRISPR gRNA sequence
aactcactttgagccagcac

SEQ ID NO: 339862 - DNA, 20 bp, Artificial
  CRISPR gRNA sequence
actcactttgagccagcaca

SEQ ID NO: 339863 - DNA, 20 bp, Artificial
  CRISPR gRNA sequence
actttgagccagcacaagat

SEQ ID NO: 339864 - DNA, 20 bp, Artificial
  CRISPR gRNA sequence
tgagccagcacaagatgaaa

SEQ ID NO: 339865 - DNA, 20 bp, Artificial
  CRISPR gRNA sequence
gagccagcacaagatgaaac

SEQ ID NO: 339866 - DNA, 20 bp, Artificial
  CRISPR gRNA sequence
agccagcacaagatgaaaca

SEQ ID NO: 339867 - DNA, 20 bp, Artificial
  CRISPR gRNA sequence
gatcaatttgatttcatttt

SEQ ID NO: 339868 - DNA, 20 bp, Artificial
  CRISPR gRNA sequence
atcaatttgatttcattttt

SEQ ID NO: 339869 - DNA, 20 bp, Artificial
  CRISPR gRNA sequence
gatttcatttttttttcatt

SEQ ID NO: 339870 - DNA, 20 bp, Artificial
  CRISPR gRNA sequence
atttcatttttttttcattt

SEQ ID NO: 339871 - DNA, 20 bp, Artificial
  CRISPR gRNA sequence
catttttttttcattttttg

SEQ ID NO: 339872 - DNA, 20 bp, Artificial
  CRISPR gRNA sequence
atttttttttcattttttgt

SEQ ID NO: 339873 - DNA, 20 bp, Artificial
  CRISPR gRNA sequence
ttttttcattttttgtaaga

SEQ ID NO: 339874 - DNA, 20 bp, Artificial
  CRISPR gRNA sequence
tttttcattttttgtaagaa

SEQ ID NO: 339875 - DNA, 20 bp, Artificial
  CRISPR gRNA sequence
ttttcattttttgtaagaac

SEQ ID NO: 339876 - DNA, 20 bp, Artificial
  CRISPR gRNA sequence
tttcattttttgtaagaaca

SEQ ID NO: 339877 - DNA, 20 bp, Artificial
  CRISPR gRNA sequence
ttcattttttgtaagaacag

SEQ ID NO: 339878 - DNA, 20 bp, Artificial
  CRISPR gRNA sequence
tcattttttgtaagaacagt

SEQ ID NO: 339879 - DNA, 20 bp, Artificial
  CRISPR gRNA sequence
cattttttgtaagaacagta

SEQ ID NO: 339880 - DNA, 20 bp, Artificial
  CRISPR gRNA sequence
attttttgtaagaacagtaa

SEQ ID NO: 339881 - DNA, 20 bp, Artificial
  CRISPR gRNA sequence
tttgtaagaacagtaaggtc

SEQ ID NO: 339882 - DNA, 20 bp, Artificial
  CRISPR gRNA sequence
ttgtaagaacagtaaggtct

SEQ ID NO: 339883 - DNA, 20 bp, Artificial
  CRISPR gRNA sequence
tgtaagaacagtaaggtcta

SEQ ID NO: 339884 - DNA, 20 bp, Artificial
  CRISPR gRNA sequence
gtaagaacagtaaggtctat

SEQ ID NO: 339885 - DNA, 20 bp, Artificial
  CRISPR gRNA sequence
taagaacagtaaggtctatt

SEQ ID NO: 339886 - DNA, 20 bp, Artificial
  CRISPR gRNA sequence
tttttttgccactgaaaaaa

SEQ ID NO: 339887 - DNA, 20 bp, Artificial
  CRISPR gRNA sequence
ttttgccactgaaaaaatgt

SEQ ID NO: 339888 - DNA, 20 bp, Artificial
  CRISPR gRNA sequence
tttgccactgaaaaaatgta

SEQ ID NO: 339889 - DNA, 20 bp, Artificial
  CRISPR gRNA sequence
ttgccactgaaaaaatgtat

SEQ ID NO: 339890 - DNA, 20 bp, Artificial
  CRISPR gRNA sequence
tgccactgaaaaaatgtatc

SEQ ID NO: 339891 - DNA, 20 bp, Artificial
  CRISPR gRNA sequence
gccactgaaaaaatgtatcc

SEQ ID NO: 339892 - DNA, 20 bp, Artificial
  CRISPR gRNA sequence
ccactgaaaaaatgtatccc

SEQ ID NO: 339893 - DNA, 20 bp, Artificial
  CRISPR gRNA sequence
aaaaaatgtatccctagata

SEQ ID NO: 339894 - DNA, 20 bp, Artificial
  CRISPR gRNA sequence
gataggatcatacctactaa

SEQ ID NO: 339895 - DNA, 20 bp, Artificial
  CRISPR gRNA sequence
ctaaaagttctgccttcact

SEQ ID NO: 339896 - DNA, 20 bp, Artificial
  CRISPR gRNA sequence
aaagttctgccttcactttt

SEQ ID NO: 339897 - DNA, 20 bp, Artificial
  CRISPR gRNA sequence
tgccttcacttttagtttat

SEQ ID NO: 339898 - DNA, 20 bp, Artificial
  CRISPR gRNA sequence
ccttcacttttagtttattt

SEQ ID NO: 339899 - DNA, 20 bp, Artificial
  CRISPR gRNA sequence
cacttttagtttatttgatt

SEQ ID NO: 339900 - DNA, 20 bp, Artificial
  CRISPR gRNA sequence
acttttagtttatttgatta

SEQ ID NO: 339901 - DNA, 20 bp, Artificial
  CRISPR gRNA sequence
ttagtttatttgattattta

SEQ ID NO: 339902 - DNA, 20 bp, Artificial
  CRISPR gRNA sequence
tagtttatttgattatttaa

SEQ ID NO: 339903 - DNA, 20 bp, Artificial
  CRISPR gRNA sequence
agtttatttgattatttaag

SEQ ID NO: 339904 - DNA, 20 bp, Artificial
  CRISPR gRNA sequence
gtttatttgattatttaagt

SEQ ID NO: 339905 - DNA, 20 bp, Artificial
  CRISPR gRNA sequence
atttgattatttaagttatt

SEQ ID NO: 339906 - DNA, 20 bp, Artificial
  CRISPR gRNA sequence
tttgattatttaagttattt

SEQ ID NO: 339907 - DNA, 20 bp, Artificial
  CRISPR gRNA sequence
gattatttaagttatttaat

SEQ ID NO: 339908 - DNA, 20 bp, Artificial
  CRISPR gRNA sequence
attatttaagttatttaata

SEQ ID NO: 339909 - DNA, 20 bp, Artificial
  CRISPR gRNA sequence
tttaagttatttaatattac

SEQ ID NO: 339910 - DNA, 20 bp, Artificial
  CRISPR gRNA sequence
aagttatttaatattactta

SEQ ID NO: 339911 - DNA, 20 bp, Artificial
  CRISPR gRNA sequence
agttatttaatattacttaa

SEQ ID NO: 339912 - DNA, 20 bp, Artificial
  CRISPR gRNA sequence
tttaatattacttaactttc

SEQ ID NO: 339913 - DNA, 20 bp, Artificial
  CRISPR gRNA sequence
aatattacttaactttcctt

SEQ ID NO: 339914 - DNA, 20 bp, Artificial
  CRISPR gRNA sequence
atattacttaactttccttt

SEQ ID NO: 339915 - DNA, 20 bp, Artificial
  CRISPR gRNA sequence
cttaactttccttttttcaa

SEQ ID NO: 339916 - DNA, 20 bp, Artificial
  CRISPR gRNA sequence
aactttccttttttcaacct

SEQ ID NO: 339917 - DNA, 20 bp, Artificial
  CRISPR gRNA sequence
actttccttttttcaacctc

SEQ ID NO: 339918 - DNA, 20 bp, Artificial
  CRISPR gRNA sequence
tccttttttcaacctcaaga

SEQ ID NO: 339919 - DNA, 20 bp, Artificial
  CRISPR gRNA sequence
ccttttttcaacctcaagaa

SEQ ID NO: 339920 - DNA, 20 bp, Artificial
  CRISPR gRNA sequence
cttttttcaacctcaagaat

SEQ ID NO: 339921 - DNA, 20 bp, Artificial
  CRISPR gRNA sequence
ttttcaacctcaagaatagg

SEQ ID NO: 339922 - DNA, 20 bp, Artificial
  CRISPR gRNA sequence
tttcaacctcaagaataggg

SEQ ID NO: 339923 - DNA, 20 bp, Artificial
  CRISPR gRNA sequence
ttcaacctcaagaatagggc

SEQ ID NO: 339924 - DNA, 20 bp, Artificial
  CRISPR gRNA sequence
tcaacctcaagaatagggct

SEQ ID NO: 339925 - DNA, 20 bp, Artificial
  CRISPR gRNA sequence
caacctcaagaatagggctc

SEQ ID NO: 339926 - DNA, 20 bp, Artificial
  CRISPR gRNA sequence
aacctcaagaatagggctca

SEQ ID NO: 339927 - DNA, 20 bp, Artificial
  CRISPR gRNA sequence
aagaatagggctcagtgtga

SEQ ID NO: 339928 - DNA, 20 bp, Artificial
  CRISPR gRNA sequence
agtgtgaaagagaaaacaaa

SEQ ID NO: 339929 - DNA, 20 bp, Artificial
  CRISPR gRNA sequence
tatacagtaaaaagcagcag

SEQ ID NO: 339930 - DNA, 20 bp, Artificial
  CRISPR gRNA sequence
acttacattgtatgtagcat

SEQ ID NO: 339931 - DNA, 20 bp, Artificial
  CRISPR gRNA sequence
acattgtatgtagcattatt

SEQ ID NO: 339932 - DNA, 20 bp, Artificial
  CRISPR gRNA sequence
cattgtatgtagcattattt

SEQ ID NO: 339933 - DNA, 20 bp, Artificial
  CRISPR gRNA sequence
tatgtagcattatttaaatt

SEQ ID NO: 339934 - DNA, 20 bp, Artificial
  CRISPR gRNA sequence
tttaaattgtccatatagag

SEQ ID NO: 339935 - DNA, 20 bp, Artificial
  CRISPR gRNA sequence
aaattgtccatatagagtct

SEQ ID NO: 339936 - DNA, 20 bp, Artificial
  CRISPR gRNA sequence
aattgtccatatagagtctg

SEQ ID NO: 339937 - DNA, 20 bp, Artificial
  CRISPR gRNA sequence
tccatatagagtctgctata

SEQ ID NO: 339938 - DNA, 20 bp, Artificial
  CRISPR gRNA sequence
ctatatgccattcaagagaa

SEQ ID NO: 339939 - DNA, 20 bp, Artificial
  CRISPR gRNA sequence
tatgccattcaagagaagga

SEQ ID NO: 339940 - DNA, 20 bp, Artificial
  CRISPR gRNA sequence
aagagaaggaatcagggact

SEQ ID NO: 339941 - DNA, 20 bp, Artificial
  CRISPR gRNA sequence
cagaatgatcttttttgtaa

SEQ ID NO: 339942 - DNA, 20 bp, Artificial
  CRISPR gRNA sequence
ttttgtaaggtctacagggg

SEQ ID NO: 339943 - DNA, 20 bp, Artificial
  CRISPR gRNA sequence
tttgtaaggtctacaggggc

SEQ ID NO: 339944 - DNA, 20 bp, Artificial
  CRISPR gRNA sequence
ttgtaaggtctacaggggct

SEQ ID NO: 339945 - DNA, 20 bp, Artificial
  CRISPR gRNA sequence
tgtaaggtctacaggggcta

SEQ ID NO: 339946 - DNA, 20 bp, Artificial
  CRISPR gRNA sequence
gtaaggtctacaggggctag

SEQ ID NO: 339947 - DNA, 20 bp, Artificial
  CRISPR gRNA sequence
taaggtctacaggggctagg

SEQ ID NO: 339948 - DNA, 20 bp, Artificial
  CRISPR gRNA sequence
caggggctaggaagtatttt

SEQ ID NO: 339949 - DNA, 20 bp, Artificial
  CRISPR gRNA sequence
ggaagtatttttacattatc

SEQ ID NO: 339950 - DNA, 20 bp, Artificial
  CRISPR gRNA sequence
ttacattatcctttcctcct

SEQ ID NO: 339951 - DNA, 20 bp, Artificial
  CRISPR gRNA sequence
tacattatcctttcctcctt

SEQ ID NO: 339952 - DNA, 20 bp, Artificial
  CRISPR gRNA sequence
acattatcctttcctccttg

SEQ ID NO: 339953 - DNA, 20 bp, Artificial
  CRISPR gRNA sequence
cattatcctttcctccttgg

SEQ ID NO: 339954 - DNA, 20 bp, Artificial
  CRISPR gRNA sequence
tcctttcctccttggctttt

SEQ ID NO: 339955 - DNA, 20 bp, Artificial
  CRISPR gRNA sequence
tcctccttggctttttaggg

SEQ ID NO: 339956 - DNA, 20 bp, Artificial
  CRISPR gRNA sequence
cctccttggctttttagggt

SEQ ID NO: 339957 - DNA, 20 bp, Artificial
  CRISPR gRNA sequence
ctccttggctttttagggtg

SEQ ID NO: 339958 - DNA, 20 bp, Artificial
  CRISPR gRNA sequence
cttggctttttagggtgaac

SEQ ID NO: 339959 - DNA, 20 bp, Artificial
  CRISPR gRNA sequence
ggctttttagggtgaactct

SEQ ID NO: 339960 - DNA, 20 bp, Artificial
  CRISPR gRNA sequence
gctttttagggtgaactctg

SEQ ID NO: 339961 - DNA, 20 bp, Artificial
  CRISPR gRNA sequence
tttagggtgaactctgatac

SEQ ID NO: 339962 - DNA, 20 bp, Artificial
  CRISPR gRNA sequence
ttagggtgaactctgatact

SEQ ID NO: 339963 - DNA, 20 bp, Artificial
  CRISPR gRNA sequence
tagggtgaactctgatactt

SEQ ID NO: 339964 - DNA, 20 bp, Artificial
  CRISPR gRNA sequence
agggtgaactctgatactta

SEQ ID NO: 339965 - DNA, 20 bp, Artificial
  CRISPR gRNA sequence
gggtgaactctgatacttag

SEQ ID NO: 339966 - DNA, 20 bp, Artificial
  CRISPR gRNA sequence
tgatacttagtgtcaataaa

SEQ ID NO: 339967 - DNA, 20 bp, Artificial
  CRISPR gRNA sequence
atacttagtgtcaataaaaa

SEQ ID NO: 339968 - DNA, 20 bp, Artificial
  CRISPR gRNA sequence
agtgtcaataaaaactctat

SEQ ID NO: 339969 - DNA, 20 bp, Artificial
  CRISPR gRNA sequence
gtgtcaataaaaactctatg

SEQ ID NO: 339970 - DNA, 20 bp, Artificial
  CRISPR gRNA sequence
tatggtgccctggacatttc

SEQ ID NO: 339971 - DNA, 20 bp, Artificial
  CRISPR gRNA sequence
tggtgccctggacatttcag

SEQ ID NO: 339972 - DNA, 20 bp, Artificial
  CRISPR gRNA sequence
gacatttcagataacagatc

SEQ ID NO: 339973 - DNA, 20 bp, Artificial
  CRISPR gRNA sequence
cagataacagatcatccagg

SEQ ID NO: 339974 - DNA, 20 bp, Artificial
  CRISPR gRNA sequence
agataacagatcatccaggt

SEQ ID NO: 339975 - DNA, 20 bp, Artificial
  CRISPR gRNA sequence
tctctcctgaccaccacacc

SEQ ID NO: 339976 - DNA, 20 bp, Artificial
  CRISPR gRNA sequence
accacacccggccccactgt

SEQ ID NO: 339977 - DNA, 20 bp, Artificial
  CRISPR gRNA sequence
cacacccggccccactgtga

SEQ ID NO: 339978 - DNA, 20 bp, Artificial
  CRISPR gRNA sequence
ggccccactgtgagagctgt

SEQ ID NO: 339979 - DNA, 20 bp, Artificial
  CRISPR gRNA sequence
agctgtcggcactgtaactc

SEQ ID NO: 339980 - DNA, 20 bp, Artificial
  CRISPR gRNA sequence
gtcggcactgtaactctggt

SEQ ID NO: 339981 - DNA, 20 bp, Artificial
  CRISPR gRNA sequence
tcggcactgtaactctggtg

SEQ ID NO: 339982 - DNA, 20 bp, Artificial
  CRISPR gRNA sequence
gcactgtaactctggtgagg

SEQ ID NO: 339983 - DNA, 20 bp, Artificial
  CRISPR gRNA sequence
cactgtaactctggtgaggt

SEQ ID NO: 339984 - DNA, 20 bp, Artificial
  CRISPR gRNA sequence
gtaactctggtgaggtgggc

SEQ ID NO: 339985 - DNA, 20 bp, Artificial
  CRISPR gRNA sequence
taactctggtgaggtgggca

SEQ ID NO: 339986 - DNA, 20 bp, Artificial
  CRISPR gRNA sequence
aactctggtgaggtgggcaa

SEQ ID NO: 339987 - DNA, 20 bp, Artificial
  CRISPR gRNA sequence
gtgaggtgggcaagggtgtg

SEQ ID NO: 339988 - DNA, 20 bp, Artificial
  CRISPR gRNA sequence
tgaggtgggcaagggtgtgt

SEQ ID NO: 339989 - DNA, 20 bp, Artificial
  CRISPR gRNA sequence
ggtgggcaagggtgtgtagg

SEQ ID NO: 339990 - DNA, 20 bp, Artificial
  CRISPR gRNA sequence
gtgggcaagggtgtgtaggt

SEQ ID NO: 339991 - DNA, 20 bp, Artificial
  CRISPR gRNA sequence
tgggcaagggtgtgtaggtg

SEQ ID NO: 339992 - DNA, 20 bp, Artificial
  CRISPR gRNA sequence
gggtgtgtaggtggggacga

SEQ ID NO: 339993 - DNA, 20 bp, Artificial
  CRISPR gRNA sequence
tgtaggtggggacgatggac

SEQ ID NO: 339994 - DNA, 20 bp, Artificial
  CRISPR gRNA sequence
ggggacgatggacaagcatc

SEQ ID NO: 339995 - DNA, 20 bp, Artificial
  CRISPR gRNA sequence
gggacgatggacaagcatct

SEQ ID NO: 339996 - DNA, 20 bp, Artificial
  CRISPR gRNA sequence
ggacgatggacaagcatctg

SEQ ID NO: 339997 - DNA, 20 bp, Artificial
  CRISPR gRNA sequence
gacgatggacaagcatctgg

SEQ ID NO: 339998 - DNA, 20 bp, Artificial
  CRISPR gRNA sequence
cgatggacaagcatctgggg

SEQ ID NO: 339999 - DNA, 20 bp, Artificial
  CRISPR gRNA sequence
ggacaagcatctgggggagc

SEQ ID NO: 340000 - DNA, 20 bp, Artificial
  CRISPR gRNA sequence
gacaagcatctgggggagca

SEQ ID NO: 340001 - DNA, 20 bp, Artificial
  CRISPR gRNA sequence
agcatctgggggagcaaggc

SEQ ID NO: 340002 - DNA, 20 bp, Artificial
  CRISPR gRNA sequence
tgggggagcaaggctggtga

SEQ ID NO: 340003 - DNA, 20 bp, Artificial
  CRISPR gRNA sequence
gggggagcaaggctggtgac

SEQ ID NO: 340004 - DNA, 20 bp, Artificial
  CRISPR gRNA sequence
agcaaggctggtgacgggtt

SEQ ID NO: 340005 - DNA, 20 bp, Artificial
  CRISPR gRNA sequence
gcaaggctggtgacgggttt

SEQ ID NO: 340006 - DNA, 20 bp, Artificial
  CRISPR gRNA sequence
caaggctggtgacgggtttg

SEQ ID NO: 340007 - DNA, 20 bp, Artificial
  CRISPR gRNA sequence
aaggctggtgacgggtttgg

SEQ ID NO: 340008 - DNA, 20 bp, Artificial
  CRISPR gRNA sequence
ggtgacgggtttgggggtgc

SEQ ID NO: 340009 - DNA, 20 bp, Artificial
  CRISPR gRNA sequence
gtgacgggtttgggggtgca

SEQ ID NO: 340010 - DNA, 20 bp, Artificial
  CRISPR gRNA sequence
gacgggtttgggggtgcaag

SEQ ID NO: 340011 - DNA, 20 bp, Artificial
  CRISPR gRNA sequence
acgggtttgggggtgcaagg

SEQ ID NO: 340012 - DNA, 20 bp, Artificial
  CRISPR gRNA sequence
tgggggtgcaaggaggatga

SEQ ID NO: 340013 - DNA, 20 bp, Artificial
  CRISPR gRNA sequence
gggggtgcaaggaggatgac

SEQ ID NO: 340014 - DNA, 20 bp, Artificial
  CRISPR gRNA sequence
ggggtgcaaggaggatgacg

SEQ ID NO: 340015 - DNA, 20 bp, Artificial
  CRISPR gRNA sequence
caaggaggatgacggggcca

SEQ ID NO: 340016 - DNA, 20 bp, Artificial
  CRISPR gRNA sequence
ggatgacggggccaaagctt

SEQ ID NO: 340017 - DNA, 20 bp, Artificial
  CRISPR gRNA sequence
ccaaagctttggccttcttc

SEQ ID NO: 340018 - DNA, 20 bp, Artificial
  CRISPR gRNA sequence
caaagctttggccttcttca

SEQ ID NO: 340019 - DNA, 20 bp, Artificial
  CRISPR gRNA sequence
ttggccttcttcaaggctca

SEQ ID NO: 340020 - DNA, 20 bp, Artificial
  CRISPR gRNA sequence
ccttcttcaaggctcacagc

SEQ ID NO: 340021 - DNA, 20 bp, Artificial
  CRISPR gRNA sequence
tcttcaaggctcacagcaag

SEQ ID NO: 340022 - DNA, 20 bp, Artificial
  CRISPR gRNA sequence
ttcaaggctcacagcaagtg

SEQ ID NO: 340023 - DNA, 20 bp, Artificial
  CRISPR gRNA sequence
acagcaagtggagccaatgc

SEQ ID NO: 340024 - DNA, 20 bp, Artificial
  CRISPR gRNA sequence
cagcaagtggagccaatgct

SEQ ID NO: 340025 - DNA, 20 bp, Artificial
  CRISPR gRNA sequence
ggagccaatgctgggaaatg

SEQ ID NO: 340026 - DNA, 20 bp, Artificial
  CRISPR gRNA sequence
tgctgggaaatgcggcaccc

SEQ ID NO: 340027 - DNA, 20 bp, Artificial
  CRISPR gRNA sequence
gctgggaaatgcggcaccct

SEQ ID NO: 340028 - DNA, 20 bp, Artificial
  CRISPR gRNA sequence
gggaaatgcggcaccctagg

SEQ ID NO: 340029 - DNA, 20 bp, Artificial
  CRISPR gRNA sequence
ggaaatgcggcaccctaggt

SEQ ID NO: 340030 - DNA, 20 bp, Artificial
  CRISPR gRNA sequence
gaaatgcggcaccctaggtg

SEQ ID NO: 340031 - DNA, 20 bp, Artificial
  CRISPR gRNA sequence
aggtggggcatgaattaacg

SEQ ID NO: 340032 - DNA, 20 bp, Artificial
  CRISPR gRNA sequence
ggtggggcatgaattaacgt

SEQ ID NO: 340033 - DNA, 20 bp, Artificial
  CRISPR gRNA sequence
ggggcatgaattaacgtggg

SEQ ID NO: 340034 - DNA, 20 bp, Artificial
  CRISPR gRNA sequence
aattaacgtgggcagacatc

SEQ ID NO: 340035 - DNA, 20 bp, Artificial
  CRISPR gRNA sequence
tgggcagacatctagtattc

SEQ ID NO: 340036 - DNA, 20 bp, Artificial
  CRISPR gRNA sequence
gggcagacatctagtattcc

SEQ ID NO: 340037 - DNA, 20 bp, Artificial
  CRISPR gRNA sequence
agacatctagtattccagga

SEQ ID NO: 340038 - DNA, 20 bp, Artificial
  CRISPR gRNA sequence
gacatctagtattccaggaa

SEQ ID NO: 340039 - DNA, 20 bp, Artificial
  CRISPR gRNA sequence
acatctagtattccaggaaa

SEQ ID NO: 340040 - DNA, 20 bp, Artificial
  CRISPR gRNA sequence
tattccaggaaagggataaa

SEQ ID NO: 340041 - DNA, 20 bp, Artificial
  CRISPR gRNA sequence
gaaagggataaatagaattt

SEQ ID NO: 340042 - DNA, 20 bp, Artificial
  CRISPR gRNA sequence
aaagggataaatagaatttg

SEQ ID NO: 340043 - DNA, 20 bp, Artificial
  CRISPR gRNA sequence
aagggataaatagaatttga

SEQ ID NO: 340044 - DNA, 20 bp, Artificial
  CRISPR gRNA sequence
ataaatagaatttgagggat

SEQ ID NO: 340045 - DNA, 20 bp, Artificial
  CRISPR gRNA sequence
atagaatttgagggattggt

SEQ ID NO: 340046 - DNA, 20 bp, Artificial
  CRISPR gRNA sequence
atttgagggattggtgagaa

SEQ ID NO: 340047 - DNA, 20 bp, Artificial
  CRISPR gRNA sequence
tttgagggattggtgagaac

SEQ ID NO: 340048 - DNA, 20 bp, Artificial
  CRISPR gRNA sequence
gattggtgagaacgggtcta

SEQ ID NO: 340049 - DNA, 20 bp, Artificial
  CRISPR gRNA sequence
ggtgagaacgggtctatgga

SEQ ID NO: 340050 - DNA, 20 bp, Artificial
  CRISPR gRNA sequence
gtgagaacgggtctatggat

SEQ ID NO: 340051 - DNA, 20 bp, Artificial
  CRISPR gRNA sequence
acgggtctatggataggatc

SEQ ID NO: 340052 - DNA, 20 bp, Artificial
  CRISPR gRNA sequence
taggatcaagacaataaaat

SEQ ID NO: 340053 - DNA, 20 bp, Artificial
  CRISPR gRNA sequence
ggatcaagacaataaaatga

SEQ ID NO: 340054 - DNA, 20 bp, Artificial
  CRISPR gRNA sequence
tcaagacaataaaatgagag

SEQ ID NO: 340055 - DNA, 20 bp, Artificial
  CRISPR gRNA sequence
agacaataaaatgagagaag

SEQ ID NO: 340056 - DNA, 20 bp, Artificial
  CRISPR gRNA sequence
gagaagtggctctatgaccc

SEQ ID NO: 340057 - DNA, 20 bp, Artificial
  CRISPR gRNA sequence
ggctctatgaccccagattt

SEQ ID NO: 340058 - DNA, 20 bp, Artificial
  CRISPR gRNA sequence
gctctatgaccccagatttc

SEQ ID NO: 340059 - DNA, 20 bp, Artificial
  CRISPR gRNA sequence
tatgaccccagatttcgggc

SEQ ID NO: 340060 - DNA, 20 bp, Artificial
  CRISPR gRNA sequence
caataaactgactgtgttcc

SEQ ID NO: 340061 - DNA, 20 bp, Artificial
  CRISPR gRNA sequence
ataaactgactgtgttccca

SEQ ID NO: 340062 - DNA, 20 bp, Artificial
  CRISPR gRNA sequence
gttcccagagtgcacatgtg

SEQ ID NO: 340063 - DNA, 20 bp, Artificial
  CRISPR gRNA sequence
ttcccagagtgcacatgtgc

SEQ ID NO: 340064 - DNA, 20 bp, Artificial
  CRISPR gRNA sequence
cagagtgcacatgtgcaggt

SEQ ID NO: 340065 - DNA, 20 bp, Artificial
  CRISPR gRNA sequence
cacatgtgcaggttggccat

SEQ ID NO: 340066 - DNA, 20 bp, Artificial
  CRISPR gRNA sequence
acatgtgcaggttggccatt

SEQ ID NO: 340067 - DNA, 20 bp, Artificial
  CRISPR gRNA sequence
caggttggccattgggaatt

SEQ ID NO: 340068 - DNA, 20 bp, Artificial
  CRISPR gRNA sequence
aatttggaatacatctttct

SEQ ID NO: 340069 - DNA, 20 bp, Artificial
  CRISPR gRNA sequence
atttggaatacatctttcta

SEQ ID NO: 340070 - DNA, 20 bp, Artificial
  CRISPR gRNA sequence
atctttctaaggaaataaca

SEQ ID NO: 340071 - DNA, 20 bp, Artificial
  CRISPR gRNA sequence
gaaataacaaagcaacccaa

SEQ ID NO: 340072 - DNA, 20 bp, Artificial
  CRISPR gRNA sequence
aaataacaaagcaacccaat

SEQ ID NO: 340073 - DNA, 20 bp, Artificial
  CRISPR gRNA sequence
aacaacctttttttgcacaa

SEQ ID NO: 340074 - DNA, 20 bp, Artificial
  CRISPR gRNA sequence
ttttgcacaaaagccaattt

SEQ ID NO: 340075 - DNA, 20 bp, Artificial
  CRISPR gRNA sequence
aaaagccaatttgagaaaat

SEQ ID NO: 340076 - DNA, 20 bp, Artificial
  CRISPR gRNA sequence
tgagaaaatgagtatgtatg

SEQ ID NO: 340077 - DNA, 20 bp, Artificial
  CRISPR gRNA sequence
tagcctgtgtttttatttta

SEQ ID NO: 340078 - DNA, 20 bp, Artificial
  CRISPR gRNA sequence
attttatagttccaaaaaaa

SEQ ID NO: 340079 - DNA, 20 bp, Artificial
  CRISPR gRNA sequence
ttttatagttccaaaaaaaa

SEQ ID NO: 340080 - DNA, 20 bp, Artificial
  CRISPR gRNA sequence
aaaaaggttttttttaaact

SEQ ID NO: 340081 - DNA, 20 bp, Artificial
  CRISPR gRNA sequence
aaggttttttttaaactaag

SEQ ID NO: 340082 - DNA, 20 bp, Artificial
  CRISPR gRNA sequence
actaagaagtataatatctg

SEQ ID NO: 340083 - DNA, 20 bp, Artificial
  CRISPR gRNA sequence
ctccatcttcgctacaattt

SEQ ID NO: 340084 - DNA, 20 bp, Artificial
  CRISPR gRNA sequence
cgctacaatttcagaaacta

SEQ ID NO: 340085 - DNA, 20 bp, Artificial
  CRISPR gRNA sequence
acaatttcagaaactacggc

SEQ ID NO: 340086 - DNA, 20 bp, Artificial
  CRISPR gRNA sequence
aaactacggccagtatacac

SEQ ID NO: 340087 - DNA, 20 bp, Artificial
  CRISPR gRNA sequence
acggccagtatacactagaa

SEQ ID NO: 340088 - DNA, 20 bp, Artificial
  CRISPR gRNA sequence
gccagtatacactagaatag

SEQ ID NO: 340089 - DNA, 20 bp, Artificial
  CRISPR gRNA sequence
ccagtatacactagaatagc

SEQ ID NO: 340090 - DNA, 20 bp, Artificial
  CRISPR gRNA sequence
cactagaatagcaggcttta

SEQ ID NO: 340091 - DNA, 20 bp, Artificial
  CRISPR gRNA sequence
tagaatagcaggctttaaag

SEQ ID NO: 340092 - DNA, 20 bp, Artificial
  CRISPR gRNA sequence
ccctttgaacaaatgttctc

SEQ ID NO: 340093 - DNA, 20 bp, Artificial
  CRISPR gRNA sequence
ttgaacaaatgttctctagc

SEQ ID NO: 340094 - DNA, 20 bp, Artificial
  CRISPR gRNA sequence
ttctctagcaagacactttt

SEQ ID NO: 340095 - DNA, 20 bp, Artificial
  CRISPR gRNA sequence
agcaagacactttttagaac

SEQ ID NO: 340096 - DNA, 20 bp, Artificial
  CRISPR gRNA sequence
gcaagacactttttagaacc

SEQ ID NO: 340097 - DNA, 20 bp, Artificial
  CRISPR gRNA sequence
acctacttgcaaaacgtgtt

SEQ ID NO: 340098 - DNA, 20 bp, Artificial
  CRISPR gRNA sequence
caaaacgtgtttggtgtcac

SEQ ID NO: 340099 - DNA, 20 bp, Artificial
  CRISPR gRNA sequence
aaaacgtgtttggtgtcact

SEQ ID NO: 340100 - DNA, 20 bp, Artificial
  CRISPR gRNA sequence
tttggtgtcactgggtctct

SEQ ID NO: 340101 - DNA, 20 bp, Artificial
  CRISPR gRNA sequence
gtcactgggtctcttggtac

SEQ ID NO: 340102 - DNA, 20 bp, Artificial
  CRISPR gRNA sequence
tcactgggtctcttggtact

SEQ ID NO: 340103 - DNA, 20 bp, Artificial
  CRISPR gRNA sequence
gtactgggttttgttttgtt

SEQ ID NO: 340104 - DNA, 20 bp, Artificial
  CRISPR gRNA sequence
gggttttgttttgtttagtt

SEQ ID NO: 340105 - DNA, 20 bp, Artificial
  CRISPR gRNA sequence
gttttgttttgtttagttta

SEQ ID NO: 340106 - DNA, 20 bp, Artificial
  CRISPR gRNA sequence
gttttgtttagtttagagac

SEQ ID NO: 340107 - DNA, 20 bp, Artificial
  CRISPR gRNA sequence
ttttgtttagtttagagaca

SEQ ID NO: 340108 - DNA, 20 bp, Artificial
  CRISPR gRNA sequence
tttagtttagagacaaggtc

SEQ ID NO: 340109 - DNA, 20 bp, Artificial
  CRISPR gRNA sequence
caaggtctagctctgtcacc

SEQ ID NO: 340110 - DNA, 20 bp, Artificial
  CRISPR gRNA sequence
aaggtctagctctgtcaccc

SEQ ID NO: 340111 - DNA, 20 bp, Artificial
  CRISPR gRNA sequence
tctagctctgtcacccaggc

SEQ ID NO: 340112 - DNA, 20 bp, Artificial
  CRISPR gRNA sequence
tagctctgtcacccaggctg

SEQ ID NO: 340113 - DNA, 20 bp, Artificial
  CRISPR gRNA sequence
ctgtcacccaggctggagtg

SEQ ID NO: 340114 - DNA, 20 bp, Artificial
  CRISPR gRNA sequence
tcacccaggctggagtgcag

SEQ ID NO: 340115 - DNA, 20 bp, Artificial
  CRISPR gRNA sequence
ggagtgcagtggtgcaatca

SEQ ID NO: 340116 - DNA, 20 bp, Artificial
  CRISPR gRNA sequence
ggtgcaatcatagctcccca

SEQ ID NO: 340117 - DNA, 20 bp, Artificial
  CRISPR gRNA sequence
tccccacagccttgaactcc

SEQ ID NO: 340118 - DNA, 20 bp, Artificial
  CRISPR gRNA sequence
ccccacagccttgaactcct

SEQ ID NO: 340119 - DNA, 20 bp, Artificial
  CRISPR gRNA sequence
agccttgaactcctgggctc

SEQ ID NO: 340120 - DNA, 20 bp, Artificial
  CRISPR gRNA sequence
cctgggctcaagcaatcttc

SEQ ID NO: 340121 - DNA, 20 bp, Artificial
  CRISPR gRNA sequence
ctcaagcaatcttctagtct

SEQ ID NO: 340122 - DNA, 20 bp, Artificial
  CRISPR gRNA sequence
cttctagtctcagcctctga

SEQ ID NO: 340123 - DNA, 20 bp, Artificial
  CRISPR gRNA sequence
gtctcagcctctgaaagtgc

SEQ ID NO: 340124 - DNA, 20 bp, Artificial
  CRISPR gRNA sequence
tctcagcctctgaaagtgcc

SEQ ID NO: 340125 - DNA, 20 bp, Artificial
  CRISPR gRNA sequence
ctctgaaagtgccaggatta

SEQ ID NO: 340126 - DNA, 20 bp, Artificial
  CRISPR gRNA sequence
tctgaaagtgccaggattac

SEQ ID NO: 340127 - DNA, 20 bp, Artificial
  CRISPR gRNA sequence
agtgccaggattacaggtgt

SEQ ID NO: 340128 - DNA, 20 bp, Artificial
  CRISPR gRNA sequence
aggattacaggtgtgagctg

SEQ ID NO: 340129 - DNA, 20 bp, Artificial
  CRISPR gRNA sequence
caggtgtgagctgtagtgcc

SEQ ID NO: 340130 - DNA, 20 bp, Artificial
  CRISPR gRNA sequence
acaaaaacaaaaaccaacac

SEQ ID NO: 340131 - DNA, 20 bp, Artificial
  CRISPR gRNA sequence
acaaaaaccaacaccagatg

SEQ ID NO: 340132 - DNA, 20 bp, Artificial
  CRISPR gRNA sequence
aaaaccaacaccagatgtgg

SEQ ID NO: 340133 - DNA, 20 bp, Artificial
  CRISPR gRNA sequence
gtggctcatgcctataatcc

SEQ ID NO: 340134 - DNA, 20 bp, Artificial
  CRISPR gRNA sequence
atgcctataatcccagcact

SEQ ID NO: 340135 - DNA, 20 bp, Artificial
  CRISPR gRNA sequence
tgcctataatcccagcactt

SEQ ID NO: 340136 - DNA, 20 bp, Artificial
  CRISPR gRNA sequence
cctataatcccagcacttgg

SEQ ID NO: 340137 - DNA, 20 bp, Artificial
  CRISPR gRNA sequence
ctataatcccagcacttggg

SEQ ID NO: 340138 - DNA, 20 bp, Artificial
  CRISPR gRNA sequence
atcccagcacttgggaggcc

SEQ ID NO: 340139 - DNA, 20 bp, Artificial
  CRISPR gRNA sequence
tcccagcacttgggaggcca

SEQ ID NO: 340140 - DNA, 20 bp, Artificial
  CRISPR gRNA sequence
cagcacttgggaggccaagg

SEQ ID NO: 340141 - DNA, 20 bp, Artificial
  CRISPR gRNA sequence
cacttgggaggccaaggcag

SEQ ID NO: 340142 - DNA, 20 bp, Artificial
  CRISPR gRNA sequence
acttgggaggccaaggcaga

SEQ ID NO: 340143 - DNA, 20 bp, Artificial
  CRISPR gRNA sequence
cttgggaggccaaggcagaa

SEQ ID NO: 340144 - DNA, 20 bp, Artificial
  CRISPR gRNA sequence
aagggtatttgcatattttg

SEQ ID NO: 340145 - DNA, 20 bp, Artificial
  CRISPR gRNA sequence
gggtatttgcatattttgta

SEQ ID NO: 340146 - DNA, 20 bp, Artificial
  CRISPR gRNA sequence
tgcatattttgtagagactt

SEQ ID NO: 340147 - DNA, 20 bp, Artificial
  CRISPR gRNA sequence
attttgtagagacttgagcc

SEQ ID NO: 340148 - DNA, 20 bp, Artificial
  CRISPR gRNA sequence
ttttgtagagacttgagccc

SEQ ID NO: 340149 - DNA, 20 bp, Artificial
  CRISPR gRNA sequence
ttgtagagacttgagcccag

SEQ ID NO: 340150 - DNA, 20 bp, Artificial
  CRISPR gRNA sequence
agacttgagcccaggagctt

SEQ ID NO: 340151 - DNA, 20 bp, Artificial
  CRISPR gRNA sequence
tgagcccaggagcttgagac

SEQ ID NO: 340152 - DNA, 20 bp, Artificial
  CRISPR gRNA sequence
cccaggagcttgagaccagc

SEQ ID NO: 340153 - DNA, 20 bp, Artificial
  CRISPR gRNA sequence
ccaggagcttgagaccagct

SEQ ID NO: 340154 - DNA, 20 bp, Artificial
  CRISPR gRNA sequence
ttgagaccagctgggcaaca

SEQ ID NO: 340155 - DNA, 20 bp, Artificial
  CRISPR gRNA sequence
gaccagctgggcaacatagt

SEQ ID NO: 340156 - DNA, 20 bp, Artificial
  CRISPR gRNA sequence
gaccttgtctctaaaaaaat

SEQ ID NO: 340157 - DNA, 20 bp, Artificial
  CRISPR gRNA sequence
ttgtctctaaaaaaattggc

SEQ ID NO: 340158 - DNA, 20 bp, Artificial
  CRISPR gRNA sequence
ctaaaaaaattggctggtca

SEQ ID NO: 340159 - DNA, 20 bp, Artificial
  CRISPR gRNA sequence
aaaaaattggctggtcatgg

SEQ ID NO: 340160 - DNA, 20 bp, Artificial
  CRISPR gRNA sequence
tggtcatggtagtgcacctg

SEQ ID NO: 340161 - DNA, 20 bp, Artificial
  CRISPR gRNA sequence
tggtagtgcacctgcagtcc

SEQ ID NO: 340162 - DNA, 20 bp, Artificial
  CRISPR gRNA sequence
cacctgcagtcccagctact

SEQ ID NO: 340163 - DNA, 20 bp, Artificial
  CRISPR gRNA sequence
acctgcagtcccagctactt

SEQ ID NO: 340164 - DNA, 20 bp, Artificial
  CRISPR gRNA sequence
ctgcagtcccagctacttgg

SEQ ID NO: 340165 - DNA, 20 bp, Artificial
  CRISPR gRNA sequence
tgcagtcccagctacttggg

SEQ ID NO: 340166 - DNA, 20 bp, Artificial
  CRISPR gRNA sequence
tcccagctacttgggaggct

SEQ ID NO: 340167 - DNA, 20 bp, Artificial
  CRISPR gRNA sequence
agctacttgggaggctgaga

SEQ ID NO: 340168 - DNA, 20 bp, Artificial
  CRISPR gRNA sequence
gctacttgggaggctgagat

SEQ ID NO: 340169 - DNA, 20 bp, Artificial
  CRISPR gRNA sequence
acttgggaggctgagatggg

SEQ ID NO: 340170 - DNA, 20 bp, Artificial
  CRISPR gRNA sequence
ctgagatgggaagatcactt

SEQ ID NO: 340171 - DNA, 20 bp, Artificial
  CRISPR gRNA sequence
tgggaagatcacttgagccc

SEQ ID NO: 340172 - DNA, 20 bp, Artificial
  CRISPR gRNA sequence
ggaagatcacttgagcccaa

SEQ ID NO: 340173 - DNA, 20 bp, Artificial
  CRISPR gRNA sequence
gaagatcacttgagcccaag

SEQ ID NO: 340174 - DNA, 20 bp, Artificial
  CRISPR gRNA sequence
cttgagcccaagaggtcccc

SEQ ID NO: 340175 - DNA, 20 bp, Artificial
  CRISPR gRNA sequence
tgagcccaagaggtccccaa

SEQ ID NO: 340176 - DNA, 20 bp, Artificial
  CRISPR gRNA sequence
gagcccaagaggtccccaag

SEQ ID NO: 340177 - DNA, 20 bp, Artificial
  CRISPR gRNA sequence
caagaggtccccaagaggtc

SEQ ID NO: 340178 - DNA, 20 bp, Artificial
  CRISPR gRNA sequence
aagaggtccccaagaggtcc

SEQ ID NO: 340179 - DNA, 20 bp, Artificial
  CRISPR gRNA sequence
ctgctcacatcactgcactc

SEQ ID NO: 340180 - DNA, 20 bp, Artificial
  CRISPR gRNA sequence
cacatcactgcactccagcc

SEQ ID NO: 340181 - DNA, 20 bp, Artificial
  CRISPR gRNA sequence
acatcactgcactccagcct

SEQ ID NO: 340182 - DNA, 20 bp, Artificial
  CRISPR gRNA sequence
ctgcactccagcctgggtaa

SEQ ID NO: 340183 - DNA, 20 bp, Artificial
  CRISPR gRNA sequence
gcactccagcctgggtaaca

SEQ ID NO: 340184 - DNA, 20 bp, Artificial
  CRISPR gRNA sequence
cacacacacacacacacaaa

SEQ ID NO: 340185 - DNA, 20 bp, Artificial
  CRISPR gRNA sequence
cacacacacacacaaaaagc

SEQ ID NO: 340186 - DNA, 20 bp, Artificial
  CRISPR gRNA sequence
cacacacacacaaaaagcca

SEQ ID NO: 340187 - DNA, 20 bp, Artificial
  CRISPR gRNA sequence
acacacacaaaaagccagag

SEQ ID NO: 340188 - DNA, 20 bp, Artificial
  CRISPR gRNA sequence
cacacaaaaagccagagcag

SEQ ID NO: 340189 - DNA, 20 bp, Artificial
  CRISPR gRNA sequence
gtggctcacacttgtaatcc

SEQ ID NO: 340190 - DNA, 20 bp, Artificial
  CRISPR gRNA sequence
cacttgtaatcccagcactt

SEQ ID NO: 340191 - DNA, 20 bp, Artificial
  CRISPR gRNA sequence
acttgtaatcccagcacttt

SEQ ID NO: 340192 - DNA, 20 bp, Artificial
  CRISPR gRNA sequence
ttgtaatcccagcactttag

SEQ ID NO: 340193 - DNA, 20 bp, Artificial
  CRISPR gRNA sequence
tgtaatcccagcactttagg

SEQ ID NO: 340194 - DNA, 20 bp, Artificial
  CRISPR gRNA sequence
tcccagcactttaggaggcc

SEQ ID NO: 340195 - DNA, 20 bp, Artificial
  CRISPR gRNA sequence
cccagcactttaggaggcca

SEQ ID NO: 340196 - DNA, 20 bp, Artificial
  CRISPR gRNA sequence
agcactttaggaggccaagg

SEQ ID NO: 340197 - DNA, 20 bp, Artificial
  CRISPR gRNA sequence
gcactttaggaggccaaggc

SEQ ID NO: 340198 - DNA, 20 bp, Artificial
  CRISPR gRNA sequence
ctttaggaggccaaggcagg

SEQ ID NO: 340199 - DNA, 20 bp, Artificial
  CRISPR gRNA sequence
ccaaggcaggcggatccctt

SEQ ID NO: 340200 - DNA, 20 bp, Artificial
  CRISPR gRNA sequence
gcaggcggatcccttgagcc

SEQ ID NO: 340201 - DNA, 20 bp, Artificial
  CRISPR gRNA sequence
caggcggatcccttgagccc

SEQ ID NO: 340202 - DNA, 20 bp, Artificial
  CRISPR gRNA sequence
ggcggatcccttgagcccag

SEQ ID NO: 340203 - DNA, 20 bp, Artificial
  CRISPR gRNA sequence
tcccttgagcccaggagttt

SEQ ID NO: 340204 - DNA, 20 bp, Artificial
  CRISPR gRNA sequence
ccaggagtttaagaacaccc

SEQ ID NO: 340205 - DNA, 20 bp, Artificial
  CRISPR gRNA sequence
caggagtttaagaacaccct

SEQ ID NO: 340206 - DNA, 20 bp, Artificial
  CRISPR gRNA sequence
taagaacaccctgggcaaca

SEQ ID NO: 340207 - DNA, 20 bp, Artificial
  CRISPR gRNA sequence
gtctctactaaaaatacaaa

SEQ ID NO: 340208 - DNA, 20 bp, Artificial
  CRISPR gRNA sequence
ctactaaaaatacaaaaagt

SEQ ID NO: 340209 - DNA, 20 bp, Artificial
  CRISPR gRNA sequence
taaaaatacaaaaagttagc

SEQ ID NO: 340210 - DNA, 20 bp, Artificial
  CRISPR gRNA sequence
aaaaatacaaaaagttagcc

SEQ ID NO: 340211 - DNA, 20 bp, Artificial
  CRISPR gRNA sequence
tacaaaaagttagccaggcg

SEQ ID NO: 340212 - DNA, 20 bp, Artificial
  CRISPR gRNA sequence
aaaaagttagccaggcgtgg

SEQ ID NO: 340213 - DNA, 20 bp, Artificial
  CRISPR gRNA sequence
ggcgtggtggcacgaacctg

SEQ ID NO: 340214 - DNA, 20 bp, Artificial
  CRISPR gRNA sequence
gtggcacgaacctgtagtcc

SEQ ID NO: 340215 - DNA, 20 bp, Artificial
  CRISPR gRNA sequence
aacctgtagtcccagctact

SEQ ID NO: 340216 - DNA, 20 bp, Artificial
  CRISPR gRNA sequence
ctgtagtcccagctactcag

SEQ ID NO: 340217 - DNA, 20 bp, Artificial
  CRISPR gRNA sequence
tgtagtcccagctactcaga

SEQ ID NO: 340218 - DNA, 20 bp, Artificial
  CRISPR gRNA sequence
cccagctactcagaaggctg

SEQ ID NO: 340219 - DNA, 20 bp, Artificial
  CRISPR gRNA sequence
gctactcagaaggctgaagt

SEQ ID NO: 340220 - DNA, 20 bp, Artificial
  CRISPR gRNA sequence
actcagaaggctgaagtgag

SEQ ID NO: 340221 - DNA, 20 bp, Artificial
  CRISPR gRNA sequence
ctgaagtgagaagatcactt

SEQ ID NO: 340222 - DNA, 20 bp, Artificial
  CRISPR gRNA sequence
gtgagaagatcacttgagtc

SEQ ID NO: 340223 - DNA, 20 bp, Artificial
  CRISPR gRNA sequence
tgagaagatcacttgagtcc

SEQ ID NO: 340224 - DNA, 20 bp, Artificial
  CRISPR gRNA sequence
gaagatcacttgagtccagg

SEQ ID NO: 340225 - DNA, 20 bp, Artificial
  CRISPR gRNA sequence
gatcacttgagtccaggaag

SEQ ID NO: 340226 - DNA, 20 bp, Artificial
  CRISPR gRNA sequence
tcacttgagtccaggaagtg

SEQ ID NO: 340227 - DNA, 20 bp, Artificial
  CRISPR gRNA sequence
cacttgagtccaggaagtgg

SEQ ID NO: 340228 - DNA, 20 bp, Artificial
  CRISPR gRNA sequence
agtccaggaagtggaggctg

SEQ ID NO: 340229 - DNA, 20 bp, Artificial
  CRISPR gRNA sequence
caggaagtggaggctgcagt

SEQ ID NO: 340230 - DNA, 20 bp, Artificial
  CRISPR gRNA sequence
gtgactgtaccactgcactc

SEQ ID NO: 340231 - DNA, 20 bp, Artificial
  CRISPR gRNA sequence
tgtaccactgcactccagct

SEQ ID NO: 340232 - DNA, 20 bp, Artificial
  CRISPR gRNA sequence
gtaccactgcactccagctt

SEQ ID NO: 340233 - DNA, 20 bp, Artificial
  CRISPR gRNA sequence
accactgcactccagcttgg

SEQ ID NO: 340234 - DNA, 20 bp, Artificial
  CRISPR gRNA sequence
ctgcactccagcttgggaga

SEQ ID NO: 340235 - DNA, 20 bp, Artificial
  CRISPR gRNA sequence
gcactccagcttgggagaca

SEQ ID NO: 340236 - DNA, 20 bp, Artificial
  CRISPR gRNA sequence
tccagcttgggagacagagt

SEQ ID NO: 340237 - DNA, 20 bp, Artificial
  CRISPR gRNA sequence
agcttgggagacagagtgag

SEQ ID NO: 340238 - DNA, 20 bp, Artificial
  CRISPR gRNA sequence
cttgggagacagagtgagca

SEQ ID NO: 340239 - DNA, 20 bp, Artificial
  CRISPR gRNA sequence
ggagacagagtgagcagagt

SEQ ID NO: 340240 - DNA, 20 bp, Artificial
  CRISPR gRNA sequence
accctgtttccaaaaaaaaa

SEQ ID NO: 340241 - DNA, 20 bp, Artificial
  CRISPR gRNA sequence
caaaaaaaaaaagaaaacaa

SEQ ID NO: 340242 - DNA, 20 bp, Artificial
  CRISPR gRNA sequence
tccattgcaaatcaaccaaa

SEQ ID NO: 340243 - DNA, 20 bp, Artificial
  CRISPR gRNA sequence
ccattgcaaatcaaccaaaa

SEQ ID NO: 340244 - DNA, 20 bp, Artificial
  CRISPR gRNA sequence
aaggaacgtctttaatacac

SEQ ID NO: 340245 - DNA, 20 bp, Artificial
  CRISPR gRNA sequence
aatacacaagaaatattctt

SEQ ID NO: 340246 - DNA, 20 bp, Artificial
  CRISPR gRNA sequence
acttaaaaatgtaactgtaa

SEQ ID NO: 340247 - DNA, 20 bp, Artificial
  CRISPR gRNA sequence
aatagatgcttttctcttga

SEQ ID NO: 340248 - DNA, 20 bp, Artificial
  CRISPR gRNA sequence
agatgcttttctcttgacag

SEQ ID NO: 340249 - DNA, 20 bp, Artificial
  CRISPR gRNA sequence
ttttctcttgacagcggccc

SEQ ID NO: 340250 - DNA, 20 bp, Artificial
  CRISPR gRNA sequence
tctcttgacagcggccccgg

SEQ ID NO: 340251 - DNA, 20 bp, Artificial
  CRISPR gRNA sequence
ctcttgacagcggccccggc

SEQ ID NO: 340252 - DNA, 20 bp, Artificial
  CRISPR gRNA sequence
tcttgacagcggccccggca

SEQ ID NO: 340253 - DNA, 20 bp, Artificial
  CRISPR gRNA sequence
gacagcggccccggcagggt

SEQ ID NO: 340254 - DNA, 20 bp, Artificial
  CRISPR gRNA sequence
ggcagggttggaacttttcc

SEQ ID NO: 340255 - DNA, 20 bp, Artificial
  CRISPR gRNA sequence
aaacccccctactcactctg

SEQ ID NO: 340256 - DNA, 20 bp, Artificial
  CRISPR gRNA sequence
cactctgcagacccttcctg

SEQ ID NO: 340257 - DNA, 20 bp, Artificial
  CRISPR gRNA sequence
actctgcagacccttcctga

SEQ ID NO: 340258 - DNA, 20 bp, Artificial
  CRISPR gRNA sequence
gaaggtcttcgccccatact

SEQ ID NO: 340259 - DNA, 20 bp, Artificial
  CRISPR gRNA sequence
ccccatactgagcccatctt

SEQ ID NO: 340260 - DNA, 20 bp, Artificial
  CRISPR gRNA sequence
tcccttcacttgttccaaac

SEQ ID NO: 340261 - DNA, 20 bp, Artificial
  CRISPR gRNA sequence
cccaatccatgacccttctc

SEQ ID NO: 340262 - DNA, 20 bp, Artificial
  CRISPR gRNA sequence
ccaatccatgacccttctct

SEQ ID NO: 340263 - DNA, 20 bp, Artificial
  CRISPR gRNA sequence
aatccatgacccttctctgg

SEQ ID NO: 340264 - DNA, 20 bp, Artificial
  CRISPR gRNA sequence
atgacccttctctgggagct

SEQ ID NO: 340265 - DNA, 20 bp, Artificial
  CRISPR gRNA sequence
ttctctgggagctcagccaa

SEQ ID NO: 340266 - DNA, 20 bp, Artificial
  CRISPR gRNA sequence
agctcagccaatagatccca

SEQ ID NO: 340267 - DNA, 20 bp, Artificial
  CRISPR gRNA sequence
caatagatcccaaagtacca

SEQ ID NO: 340268 - DNA, 20 bp, Artificial
  CRISPR gRNA sequence
tagatcccaaagtaccacag

SEQ ID NO: 340269 - DNA, 20 bp, Artificial
  CRISPR gRNA sequence
caaagtaccacagcagcacc

SEQ ID NO: 340270 - DNA, 20 bp, Artificial
  CRISPR gRNA sequence
accacagcagcacctggctg

SEQ ID NO: 340271 - DNA, 20 bp, Artificial
  CRISPR gRNA sequence
acagcagcacctggctgcag

SEQ ID NO: 340272 - DNA, 20 bp, Artificial
  CRISPR gRNA sequence
cagcagcacctggctgcaga

SEQ ID NO: 340273 - DNA, 20 bp, Artificial
  CRISPR gRNA sequence
cctggctgcagaaggacccc

SEQ ID NO: 340274 - DNA, 20 bp, Artificial
  CRISPR gRNA sequence
ctggctgcagaaggaccccc

SEQ ID NO: 340275 - DNA, 20 bp, Artificial
  CRISPR gRNA sequence
agaaggacccccgggaaatg

SEQ ID NO: 340276 - DNA, 20 bp, Artificial
  CRISPR gRNA sequence
ggacccccgggaaatgcagt

SEQ ID NO: 340277 - DNA, 20 bp, Artificial
  CRISPR gRNA sequence
gacccccgggaaatgcagtc

SEQ ID NO: 340278 - DNA, 20 bp, Artificial
  CRISPR gRNA sequence
acccccgggaaatgcagtca

SEQ ID NO: 340279 - DNA, 20 bp, Artificial
  CRISPR gRNA sequence
cccccgggaaatgcagtcag

SEQ ID NO: 340280 - DNA, 20 bp, Artificial
  CRISPR gRNA sequence
cgggaaatgcagtcaggggt

SEQ ID NO: 340281 - DNA, 20 bp, Artificial
  CRISPR gRNA sequence
gaaatgcagtcaggggtgag

SEQ ID NO: 340282 - DNA, 20 bp, Artificial
  CRISPR gRNA sequence
tgcagtcaggggtgagaaga

SEQ ID NO: 340283 - DNA, 20 bp, Artificial
  CRISPR gRNA sequence
gcagtcaggggtgagaagat

SEQ ID NO: 340284 - DNA, 20 bp, Artificial
  CRISPR gRNA sequence
gtcaggggtgagaagatggg

SEQ ID NO: 340285 - DNA, 20 bp, Artificial
  CRISPR gRNA sequence
tcaggggtgagaagatgggt

SEQ ID NO: 340286 - DNA, 20 bp, Artificial
  CRISPR gRNA sequence
agaagatgggtgggctgaat

SEQ ID NO: 340287 - DNA, 20 bp, Artificial
  CRISPR gRNA sequence
atgggtgggctgaatgagct

SEQ ID NO: 340288 - DNA, 20 bp, Artificial
  CRISPR gRNA sequence
tgaatgagctcggccctctc

SEQ ID NO: 340289 - DNA, 20 bp, Artificial
  CRISPR gRNA sequence
gaatgagctcggccctctct

SEQ ID NO: 340290 - DNA, 20 bp, Artificial
  CRISPR gRNA sequence
gctcggccctctctgggcct

SEQ ID NO: 340291 - DNA, 20 bp, Artificial
  CRISPR gRNA sequence
ccctctctgggccttagtgc

SEQ ID NO: 340292 - DNA, 20 bp, Artificial
  CRISPR gRNA sequence
gccttagtgctggcatctat

SEQ ID NO: 340293 - DNA, 20 bp, Artificial
  CRISPR gRNA sequence
agtgctggcatctatgagat

SEQ ID NO: 340294 - DNA, 20 bp, Artificial
  CRISPR gRNA sequence
gtgctggcatctatgagatg

SEQ ID NO: 340295 - DNA, 20 bp, Artificial
  CRISPR gRNA sequence
atgagatgaggacatgcctg

SEQ ID NO: 340296 - DNA, 20 bp, Artificial
  CRISPR gRNA sequence
gatgaggacatgcctgaagt

SEQ ID NO: 340297 - DNA, 20 bp, Artificial
  CRISPR gRNA sequence
ggacatgcctgaagtcagcc

SEQ ID NO: 340298 - DNA, 20 bp, Artificial
  CRISPR gRNA sequence
tgaagtcagcctggaatttt

SEQ ID NO: 340299 - DNA, 20 bp, Artificial
  CRISPR gRNA sequence
tcagcctggaattttgagcc

SEQ ID NO: 340300 - DNA, 20 bp, Artificial
  CRISPR gRNA sequence
cagcctggaattttgagccc

SEQ ID NO: 340301 - DNA, 20 bp, Artificial
  CRISPR gRNA sequence
ttttgagcccaggttatacc

SEQ ID NO: 340302 - DNA, 20 bp, Artificial
  CRISPR gRNA sequence
cccaggttatacctggtaaa

SEQ ID NO: 340303 - DNA, 20 bp, Artificial
  CRISPR gRNA sequence
tacctggtaaatagaactcc

SEQ ID NO: 340304 - DNA, 20 bp, Artificial
  CRISPR gRNA sequence
acctggtaaatagaactccc

SEQ ID NO: 340305 - DNA, 20 bp, Artificial
  CRISPR gRNA sequence
aaatagaactcccaggtctc

SEQ ID NO: 340306 - DNA, 20 bp, Artificial
  CRISPR gRNA sequence
gatactcaccactaaaacaa

SEQ ID NO: 340307 - DNA, 20 bp, Artificial
  CRISPR gRNA sequence
ttgttttttaattatacttt

SEQ ID NO: 340308 - DNA, 20 bp, Artificial
  CRISPR gRNA sequence
tttaattatactttaagttc

SEQ ID NO: 340309 - DNA, 20 bp, Artificial
  CRISPR gRNA sequence
ttaattatactttaagttct

SEQ ID NO: 340310 - DNA, 20 bp, Artificial
  CRISPR gRNA sequence
taattatactttaagttcta

SEQ ID NO: 340311 - DNA, 20 bp, Artificial
  CRISPR gRNA sequence
gggtacatgtacacaatgtg

SEQ ID NO: 340312 - DNA, 20 bp, Artificial
  CRISPR gRNA sequence
ggtacatgtacacaatgtgc

SEQ ID NO: 340313 - DNA, 20 bp, Artificial
  CRISPR gRNA sequence
caatgtgcaggtttgttaca

SEQ ID NO: 340314 - DNA, 20 bp, Artificial
  CRISPR gRNA sequence
aatgtgcaggtttgttacat

SEQ ID NO: 340315 - DNA, 20 bp, Artificial
  CRISPR gRNA sequence
taggtatacatgtgccatgt

SEQ ID NO: 340316 - DNA, 20 bp, Artificial
  CRISPR gRNA sequence
cattaactcatcatttacat

SEQ ID NO: 340317 - DNA, 20 bp, Artificial
  CRISPR gRNA sequence
attaactcatcatttacatt

SEQ ID NO: 340318 - DNA, 20 bp, Artificial
  CRISPR gRNA sequence
tccctccccacaccccacga

SEQ ID NO: 340319 - DNA, 20 bp, Artificial
  CRISPR gRNA sequence
ccctccccacaccccacgac

SEQ ID NO: 340320 - DNA, 20 bp, Artificial
  CRISPR gRNA sequence
ccacaccccacgacaggccc

SEQ ID NO: 340321 - DNA, 20 bp, Artificial
  CRISPR gRNA sequence
atgttccccttcctgtgtcc

SEQ ID NO: 340322 - DNA, 20 bp, Artificial
  CRISPR gRNA sequence
attgttcaattcccacctac

SEQ ID NO: 340323 - DNA, 20 bp, Artificial
  CRISPR gRNA sequence
ttcaattcccacctacgagt

SEQ ID NO: 340324 - DNA, 20 bp, Artificial
  CRISPR gRNA sequence
acattgtttttaaccctccc

SEQ ID NO: 340325 - DNA, 20 bp, Artificial
  CRISPR gRNA sequence
ttgtttttaaccctccccag

SEQ ID NO: 340326 - DNA, 20 bp, Artificial
  CRISPR gRNA sequence
taacccctccatttcccttt

SEQ ID NO: 340327 - DNA, 20 bp, Artificial
  CRISPR gRNA sequence
cccctccatttcccttttgg

SEQ ID NO: 340328 - DNA, 20 bp, Artificial
  CRISPR gRNA sequence
cctccatttcccttttggcg

SEQ ID NO: 340329 - DNA, 20 bp, Artificial
  CRISPR gRNA sequence
tcatcactcctctctaccac

SEQ ID NO: 340330 - DNA, 20 bp, Artificial
  CRISPR gRNA sequence
tctcccctcctgcactgtcc

SEQ ID NO: 340331 - DNA, 20 bp, Artificial
  CRISPR gRNA sequence
ctcccctcctgcactgtccc

SEQ ID NO: 340332 - DNA, 20 bp, Artificial
  CRISPR gRNA sequence
gcttcctcattcttcccttg

SEQ ID NO: 340333 - DNA, 20 bp, Artificial
  CRISPR gRNA sequence
cttcctcattcttcccttgc

SEQ ID NO: 340334 - DNA, 20 bp, Artificial
  CRISPR gRNA sequence
ttgcaggtccttatccaaca

SEQ ID NO: 340335 - DNA, 20 bp, Artificial
  CRISPR gRNA sequence
ccaacatggctcacaattcc

SEQ ID NO: 340336 - DNA, 20 bp, Artificial
  CRISPR gRNA sequence
caacatggctcacaattcct

SEQ ID NO: 340337 - DNA, 20 bp, Artificial
  CRISPR gRNA sequence
catggctcacaattcctggg

SEQ ID NO: 340338 - DNA, 20 bp, Artificial
  CRISPR gRNA sequence
cacaattcctgggaagccac

SEQ ID NO: 340339 - DNA, 20 bp, Artificial
  CRISPR gRNA sequence
acaattcctgggaagccaca

SEQ ID NO: 340340 - DNA, 20 bp, Artificial
  CRISPR gRNA sequence
gccacaaggaaaccaaattc

SEQ ID NO: 340341 - DNA, 20 bp, Artificial
  CRISPR gRNA sequence
acaaggaaaccaaattctag

SEQ ID NO: 340342 - DNA, 20 bp, Artificial
  CRISPR gRNA sequence
accaaattctagtagcaact

SEQ ID NO: 340343 - DNA, 20 bp, Artificial
  CRISPR gRNA sequence
caaattctagtagcaactca

SEQ ID NO: 340344 - DNA, 20 bp, Artificial
  CRISPR gRNA sequence
ttctagtagcaactcagagt

SEQ ID NO: 340345 - DNA, 20 bp, Artificial
  CRISPR gRNA sequence
aactcagagtcagcattcat

SEQ ID NO: 340346 - DNA, 20 bp, Artificial
  CRISPR gRNA sequence
tcagagtcagcattcattag

SEQ ID NO: 340347 - DNA, 20 bp, Artificial
  CRISPR gRNA sequence
cagagtcagcattcattagc

SEQ ID NO: 340348 - DNA, 20 bp, Artificial
  CRISPR gRNA sequence
cagcattcattagcaggtca

SEQ ID NO: 340349 - DNA, 20 bp, Artificial
  CRISPR gRNA sequence
agcattcattagcaggtcac

SEQ ID NO: 340350 - DNA, 20 bp, Artificial
  CRISPR gRNA sequence
gcattcattagcaggtcaca

SEQ ID NO: 340351 - DNA, 20 bp, Artificial
  CRISPR gRNA sequence
ttagcaggtcacagggccat

SEQ ID NO: 340352 - DNA, 20 bp, Artificial
  CRISPR gRNA sequence
tagcaggtcacagggccata

SEQ ID NO: 340353 - DNA, 20 bp, Artificial
  CRISPR gRNA sequence
cacagggccataaggatgcc

SEQ ID NO: 340354 - DNA, 20 bp, Artificial
  CRISPR gRNA sequence
agggccataaggatgccaag

SEQ ID NO: 340355 - DNA, 20 bp, Artificial
  CRISPR gRNA sequence
gggccataaggatgccaaga

SEQ ID NO: 340356 - DNA, 20 bp, Artificial
  CRISPR gRNA sequence
ccctctccttgtcctgacaa

SEQ ID NO: 340357 - DNA, 20 bp, Artificial
  CRISPR gRNA sequence
cctctccttgtcctgacaaa

SEQ ID NO: 340358 - DNA, 20 bp, Artificial
  CRISPR gRNA sequence
cttgtcctgacaaaaggcat

SEQ ID NO: 340359 - DNA, 20 bp, Artificial
  CRISPR gRNA sequence
gtcctgacaaaaggcataag

SEQ ID NO: 340360 - DNA, 20 bp, Artificial
  CRISPR gRNA sequence
ctgacaaaaggcataagtag

SEQ ID NO: 340361 - DNA, 20 bp, Artificial
  CRISPR gRNA sequence
cataagtagaagaaaattgt

SEQ ID NO: 340362 - DNA, 20 bp, Artificial
  CRISPR gRNA sequence
ataagtagaagaaaattgtt

SEQ ID NO: 340363 - DNA, 20 bp, Artificial
  CRISPR gRNA sequence
tagaagaaaattgttaggtt

SEQ ID NO: 340364 - DNA, 20 bp, Artificial
  CRISPR gRNA sequence
tgcacccctcttccacctgt

SEQ ID NO: 340365 - DNA, 20 bp, Artificial
  CRISPR gRNA sequence
gcacccctcttccacctgtc

SEQ ID NO: 340366 - DNA, 20 bp, Artificial
  CRISPR gRNA sequence
cacccctcttccacctgtca

SEQ ID NO: 340367 - DNA, 20 bp, Artificial
  CRISPR gRNA sequence
cttccacctgtcagggcacc

SEQ ID NO: 340368 - DNA, 20 bp, Artificial
  CRISPR gRNA sequence
ttccacctgtcagggcacct

SEQ ID NO: 340369 - DNA, 20 bp, Artificial
  CRISPR gRNA sequence
tccacctgtcagggcaccta

SEQ ID NO: 340370 - DNA, 20 bp, Artificial
  CRISPR gRNA sequence
tcagggcacctagggctccc

SEQ ID NO: 340371 - DNA, 20 bp, Artificial
  CRISPR gRNA sequence
cagggcacctagggctcccc

SEQ ID NO: 340372 - DNA, 20 bp, Artificial
  CRISPR gRNA sequence
agggctccccgggtccccac

SEQ ID NO: 340373 - DNA, 20 bp, Artificial
  CRISPR gRNA sequence
tccccacaagtgtctgccct

SEQ ID NO: 340374 - DNA, 20 bp, Artificial
  CRISPR gRNA sequence
ccccacaagtgtctgcccta

SEQ ID NO: 340375 - DNA, 20 bp, Artificial
  CRISPR gRNA sequence
gtgtctgccctaaggcccac

SEQ ID NO: 340376 - DNA, 20 bp, Artificial
  CRISPR gRNA sequence
tgtctgccctaaggcccacc

SEQ ID NO: 340377 - DNA, 20 bp, Artificial
  CRISPR gRNA sequence
aggcccaccaggctttcttg

SEQ ID NO: 340378 - DNA, 20 bp, Artificial
  CRISPR gRNA sequence
cttgcagcctgtcccacatc

SEQ ID NO: 340379 - DNA, 20 bp, Artificial
  CRISPR gRNA sequence
ttgcagcctgtcccacatct

SEQ ID NO: 340380 - DNA, 20 bp, Artificial
  CRISPR gRNA sequence
gaatcaccctcctctcaaac

SEQ ID NO: 340381 - DNA, 20 bp, Artificial
  CRISPR gRNA sequence
cctcctctcaaaccagccgc

SEQ ID NO: 340382 - DNA, 20 bp, Artificial
  CRISPR gRNA sequence
ctctcaaaccagccgccagc

SEQ ID NO: 340383 - DNA, 20 bp, Artificial
  CRISPR gRNA sequence
aaaccagccgccagcgagcc

SEQ ID NO: 340384 - DNA, 20 bp, Artificial
  CRISPR gRNA sequence
agccgccagcgagcccagcc

SEQ ID NO: 340385 - DNA, 20 bp, Artificial
  CRISPR gRNA sequence
ccagcgagcccagcccagcc

SEQ ID NO: 340386 - DNA, 20 bp, Artificial
  CRISPR gRNA sequence
cgagcccagcccagcccagc

SEQ ID NO: 340387 - DNA, 20 bp, Artificial
  CRISPR gRNA sequence
tgccctaccacacccgcccc

SEQ ID NO: 340388 - DNA, 20 bp, Artificial
  CRISPR gRNA sequence
gccctaccacacccgccccc

SEQ ID NO: 340389 - DNA, 20 bp, Artificial
  CRISPR gRNA sequence
cccccaggataattaacacc

SEQ ID NO: 340390 - DNA, 20 bp, Artificial
  CRISPR gRNA sequence
ataattaacacccagccacc

SEQ ID NO: 340391 - DNA, 20 bp, Artificial
  CRISPR gRNA sequence
aacacccagccacccagcat

SEQ ID NO: 340392 - DNA, 20 bp, Artificial
  CRISPR gRNA sequence
agcatcggacctctacactt

SEQ ID NO: 340393 - DNA, 20 bp, Artificial
  CRISPR gRNA sequence
tgagcaaaatgtatatttta

SEQ ID NO: 340394 - DNA, 20 bp, Artificial
  CRISPR gRNA sequence
gagcaaaatgtatattttaa

SEQ ID NO: 340395 - DNA, 20 bp, Artificial
  CRISPR gRNA sequence
aattctcacgcctgtaatcc

SEQ ID NO: 340396 - DNA, 20 bp, Artificial
  CRISPR gRNA sequence
cgcctgtaatcccagcactt

SEQ ID NO: 340397 - DNA, 20 bp, Artificial
  CRISPR gRNA sequence
gcctgtaatcccagcacttt

SEQ ID NO: 340398 - DNA, 20 bp, Artificial
  CRISPR gRNA sequence
ctgtaatcccagcactttgg

SEQ ID NO: 340399 - DNA, 20 bp, Artificial
  CRISPR gRNA sequence
tgtaatcccagcactttggg

SEQ ID NO: 340400 - DNA, 20 bp, Artificial
  CRISPR gRNA sequence
tcccagcactttgggaggcc

SEQ ID NO: 340401 - DNA, 20 bp, Artificial
  CRISPR gRNA sequence
cccagcactttgggaggcca

SEQ ID NO: 340402 - DNA, 20 bp, Artificial
  CRISPR gRNA sequence
agcactttgggaggccaagg

SEQ ID NO: 340403 - DNA, 20 bp, Artificial
  CRISPR gRNA sequence
gcactttgggaggccaaggc

SEQ ID NO: 340404 - DNA, 20 bp, Artificial
  CRISPR gRNA sequence
ctttgggaggccaaggcggg

SEQ ID NO: 340405 - DNA, 20 bp, Artificial
  CRISPR gRNA sequence
ggccaaggcgggcggatcac

SEQ ID NO: 340406 - DNA, 20 bp, Artificial
  CRISPR gRNA sequence
gccaaggcgggcggatcacg

SEQ ID NO: 340407 - DNA, 20 bp, Artificial
  CRISPR gRNA sequence
aggcgggcggatcacgaggt

SEQ ID NO: 340408 - DNA, 20 bp, Artificial
  CRISPR gRNA sequence
ggcgggcggatcacgaggtc

SEQ ID NO: 340409 - DNA, 20 bp, Artificial
  CRISPR gRNA sequence
cgggcggatcacgaggtcag

SEQ ID NO: 340410 - DNA, 20 bp, Artificial
  CRISPR gRNA sequence
gatcacgaggtcaggagatt

SEQ ID NO: 340411 - DNA, 20 bp, Artificial
  CRISPR gRNA sequence
tcaggagattgagaccatcc

SEQ ID NO: 340412 - DNA, 20 bp, Artificial
  CRISPR gRNA sequence
tgagaccatcctggctaaca

SEQ ID NO: 340413 - DNA, 20 bp, Artificial
  CRISPR gRNA sequence
ctactaaaaatacaaaaaat

SEQ ID NO: 340414 - DNA, 20 bp, Artificial
  CRISPR gRNA sequence
taaaaatacaaaaaattagc

SEQ ID NO: 340415 - DNA, 20 bp, Artificial
  CRISPR gRNA sequence
aaaaatacaaaaaattagcc

SEQ ID NO: 340416 - DNA, 20 bp, Artificial
  CRISPR gRNA sequence
tacaaaaaattagccaggtg

SEQ ID NO: 340417 - DNA, 20 bp, Artificial
  CRISPR gRNA sequence
aaaaaattagccaggtgtgg

SEQ ID NO: 340418 - DNA, 20 bp, Artificial
  CRISPR gRNA sequence
gtggcacacacctgtaatcc

SEQ ID NO: 340419 - DNA, 20 bp, Artificial
  CRISPR gRNA sequence
acacctgtaatcccagctac

SEQ ID NO: 340420 - DNA, 20 bp, Artificial
  CRISPR gRNA sequence
cacctgtaatcccagctact

SEQ ID NO: 340421 - DNA, 20 bp, Artificial
  CRISPR gRNA sequence
acctgtaatcccagctacta

SEQ ID NO: 340422 - DNA, 20 bp, Artificial
  CRISPR gRNA sequence
ctgtaatcccagctactagg

SEQ ID NO: 340423 - DNA, 20 bp, Artificial
  CRISPR gRNA sequence
tgtaatcccagctactaggg

SEQ ID NO: 340424 - DNA, 20 bp, Artificial
  CRISPR gRNA sequence
tcccagctactagggaggct

SEQ ID NO: 340425 - DNA, 20 bp, Artificial
  CRISPR gRNA sequence
cccagctactagggaggctg

SEQ ID NO: 340426 - DNA, 20 bp, Artificial
  CRISPR gRNA sequence
agctactagggaggctgagg

SEQ ID NO: 340427 - DNA, 20 bp, Artificial
  CRISPR gRNA sequence
gctactagggaggctgaggc

SEQ ID NO: 340428 - DNA, 20 bp, Artificial
  CRISPR gRNA sequence
tactagggaggctgaggcag

SEQ ID NO: 340429 - DNA, 20 bp, Artificial
  CRISPR gRNA sequence
gcaggagaatcacttgaact

SEQ ID NO: 340430 - DNA, 20 bp, Artificial
  CRISPR gRNA sequence
caggagaatcacttgaactc

SEQ ID NO: 340431 - DNA, 20 bp, Artificial
  CRISPR gRNA sequence
ggagaatcacttgaactcag

SEQ ID NO: 340432 - DNA, 20 bp, Artificial
  CRISPR gRNA sequence
gagaatcacttgaactcagg

SEQ ID NO: 340433 - DNA, 20 bp, Artificial
  CRISPR gRNA sequence
aatcacttgaactcaggagg

SEQ ID NO: 340434 - DNA, 20 bp, Artificial
  CRISPR gRNA sequence
tcacttgaactcaggaggcg

SEQ ID NO: 340435 - DNA, 20 bp, Artificial
  CRISPR gRNA sequence
cacttgaactcaggaggcgg

SEQ ID NO: 340436 - DNA, 20 bp, Artificial
  CRISPR gRNA sequence
caggaggcggaggttgcact

SEQ ID NO: 340437 - DNA, 20 bp, Artificial
  CRISPR gRNA sequence
ggcggaggttgcactgagcc

SEQ ID NO: 340438 - DNA, 20 bp, Artificial
  CRISPR gRNA sequence
cgtgccactgcactccaacc

SEQ ID NO: 340439 - DNA, 20 bp, Artificial
  CRISPR gRNA sequence
gtgccactgcactccaacct

SEQ ID NO: 340440 - DNA, 20 bp, Artificial
  CRISPR gRNA sequence
gcactccaacctgggcgaca

SEQ ID NO: 340441 - DNA, 20 bp, Artificial
  CRISPR gRNA sequence
tccaacctgggcgacaaagc

SEQ ID NO: 340442 - DNA, 20 bp, Artificial
  CRISPR gRNA sequence
aaaaacaaacaaacaaaata

SEQ ID NO: 340443 - DNA, 20 bp, Artificial
  CRISPR gRNA sequence
aaaacaaacaaacaaaataa

SEQ ID NO: 340444 - DNA, 20 bp, Artificial
  CRISPR gRNA sequence
aaacaaacaaaataaaggct

SEQ ID NO: 340445 - DNA, 20 bp, Artificial
  CRISPR gRNA sequence
aaggctaagtaactgtaatc

SEQ ID NO: 340446 - DNA, 20 bp, Artificial
  CRISPR gRNA sequence
tatttattatttatttattt

SEQ ID NO: 340447 - DNA, 20 bp, Artificial
  CRISPR gRNA sequence
tatttattttagtgtatcca

SEQ ID NO: 340448 - DNA, 20 bp, Artificial
  CRISPR gRNA sequence
atttattttagtgtatccac

SEQ ID NO: 340449 - DNA, 20 bp, Artificial
  CRISPR gRNA sequence
tagtgtatccacaggttgtg

SEQ ID NO: 340450 - DNA, 20 bp, Artificial
  CRISPR gRNA sequence
ctataacattttcgttaccc

SEQ ID NO: 340451 - DNA, 20 bp, Artificial
  CRISPR gRNA sequence
ataacattttcgttacccca

SEQ ID NO: 340452 - DNA, 20 bp, Artificial
  CRISPR gRNA sequence
ccagagaaacttgtacccct

SEQ ID NO: 340453 - DNA, 20 bp, Artificial
  CRISPR gRNA sequence
ttcttccccccaaccaaccc

SEQ ID NO: 340454 - DNA, 20 bp, Artificial
  CRISPR gRNA sequence
cccccaaccaaccccagccc

SEQ ID NO: 340455 - DNA, 20 bp, Artificial
  CRISPR gRNA sequence
accaaccccagccccagccc

SEQ ID NO: 340456 - DNA, 20 bp, Artificial
  CRISPR gRNA sequence
ccagccccagccccagcccc

SEQ ID NO: 340457 - DNA, 20 bp, Artificial
  CRISPR gRNA sequence
cagccccagccccagcccct

SEQ ID NO: 340458 - DNA, 20 bp, Artificial
  CRISPR gRNA sequence
tactttgttttgttttttgt

SEQ ID NO: 340459 - DNA, 20 bp, Artificial
  CRISPR gRNA sequence
tttgttttgttttttgttgg

SEQ ID NO: 340460 - DNA, 20 bp, Artificial
  CRISPR gRNA sequence
gttttttgttggtggtgttt

SEQ ID NO: 340461 - DNA, 20 bp, Artificial
  CRISPR gRNA sequence
tttgttggtggtgtttgaga

SEQ ID NO: 340462 - DNA, 20 bp, Artificial
  CRISPR gRNA sequence
ttgttggtggtgtttgagac

SEQ ID NO: 340463 - DNA, 20 bp, Artificial
  CRISPR gRNA sequence
caggatctcactctgtcacc

SEQ ID NO: 340464 - DNA, 20 bp, Artificial
  CRISPR gRNA sequence
aggatctcactctgtcaccc

SEQ ID NO: 340465 - DNA, 20 bp, Artificial
  CRISPR gRNA sequence
tctcactctgtcacccaggc

SEQ ID NO: 340466 - DNA, 20 bp, Artificial
  CRISPR gRNA sequence
tcactctgtcacccaggctg

SEQ ID NO: 340467 - DNA, 20 bp, Artificial
  CRISPR gRNA sequence
ctgtcacccaggctggagcg

SEQ ID NO: 340468 - DNA, 20 bp, Artificial
  CRISPR gRNA sequence
ggagcgcagtatcatgatct

SEQ ID NO: 340469 - DNA, 20 bp, Artificial
  CRISPR gRNA sequence
tcactgtaacctccacctcc

SEQ ID NO: 340470 - DNA, 20 bp, Artificial
  CRISPR gRNA sequence
cactgtaacctccacctccc

SEQ ID NO: 340471 - DNA, 20 bp, Artificial
  CRISPR gRNA sequence
aacctccacctcccgggctc

SEQ ID NO: 340472 - DNA, 20 bp, Artificial
  CRISPR gRNA sequence
ctcaagcgatcctcccacct

SEQ ID NO: 340473 - DNA, 20 bp, Artificial
  CRISPR gRNA sequence
tcctcccacctcagcctccc

SEQ ID NO: 340474 - DNA, 20 bp, Artificial
  CRISPR gRNA sequence
tcccacctcagcctccccag

SEQ ID NO: 340475 - DNA, 20 bp, Artificial
  CRISPR gRNA sequence
cctcagcctccccagtagct

SEQ ID NO: 340476 - DNA, 20 bp, Artificial
  CRISPR gRNA sequence
ctcagcctccccagtagctt

SEQ ID NO: 340477 - DNA, 20 bp, Artificial
  CRISPR gRNA sequence
tccccagtagcttgggccta

SEQ ID NO: 340478 - DNA, 20 bp, Artificial
  CRISPR gRNA sequence
ccccagtagcttgggcctac

SEQ ID NO: 340479 - DNA, 20 bp, Artificial
  CRISPR gRNA sequence
caggtgtgcaccaccacacc

SEQ ID NO: 340480 - DNA, 20 bp, Artificial
  CRISPR gRNA sequence
gctaatttttgtattttttg

SEQ ID NO: 340481 - DNA, 20 bp, Artificial
  CRISPR gRNA sequence
taatttttgtattttttgta

SEQ ID NO: 340482 - DNA, 20 bp, Artificial
  CRISPR gRNA sequence
ttttgtattttttgtagaga

SEQ ID NO: 340483 - DNA, 20 bp, Artificial
  CRISPR gRNA sequence
tttgtattttttgtagagac

SEQ ID NO: 340484 - DNA, 20 bp, Artificial
  CRISPR gRNA sequence
ttgtattttttgtagagacg

SEQ ID NO: 340485 - DNA, 20 bp, Artificial
  CRISPR gRNA sequence
gagacggggtttcaccatgt

SEQ ID NO: 340486 - DNA, 20 bp, Artificial
  CRISPR gRNA sequence
cggggtttcaccatgttggc

SEQ ID NO: 340487 - DNA, 20 bp, Artificial
  CRISPR gRNA sequence
ggggtttcaccatgttggcc

SEQ ID NO: 340488 - DNA, 20 bp, Artificial
  CRISPR gRNA sequence
tttcaccatgttggccaggc

SEQ ID NO: 340489 - DNA, 20 bp, Artificial
  CRISPR gRNA sequence
caggctggtctcaaactcct

SEQ ID NO: 340490 - DNA, 20 bp, Artificial
  CRISPR gRNA sequence
ggtctcaaactcctgagctc

SEQ ID NO: 340491 - DNA, 20 bp, Artificial
  CRISPR gRNA sequence
ccacccacctcaacctccca

SEQ ID NO: 340492 - DNA, 20 bp, Artificial
  CRISPR gRNA sequence
acctcaacctcccaaagtgc

SEQ ID NO: 340493 - DNA, 20 bp, Artificial
  CRISPR gRNA sequence
cctcaacctcccaaagtgct

SEQ ID NO: 340494 - DNA, 20 bp, Artificial
  CRISPR gRNA sequence
ctcccaaagtgctgggatta

SEQ ID NO: 340495 - DNA, 20 bp, Artificial
  CRISPR gRNA sequence
tcccaaagtgctgggattac

SEQ ID NO: 340496 - DNA, 20 bp, Artificial
  CRISPR gRNA sequence
agtgctgggattacaggcgt

SEQ ID NO: 340497 - DNA, 20 bp, Artificial
  CRISPR gRNA sequence
caggcgtaagccactgcacc

SEQ ID NO: 340498 - DNA, 20 bp, Artificial
  CRISPR gRNA sequence
tttctttttttttttttttt

SEQ ID NO: 340499 - DNA, 20 bp, Artificial
  CRISPR gRNA sequence
ttttttttttttttttgaga

SEQ ID NO: 340500 - DNA, 20 bp, Artificial
  CRISPR gRNA sequence
ttttttttttttttgagacg

SEQ ID NO: 340501 - DNA, 20 bp, Artificial
  CRISPR gRNA sequence
cggagtttcactctgttgcc

SEQ ID NO: 340502 - DNA, 20 bp, Artificial
  CRISPR gRNA sequence
ggagtttcactctgttgccc

SEQ ID NO: 340503 - DNA, 20 bp, Artificial
  CRISPR gRNA sequence
tttcactctgttgcccaggc

SEQ ID NO: 340504 - DNA, 20 bp, Artificial
  CRISPR gRNA sequence
tcactctgttgcccaggctg

SEQ ID NO: 340505 - DNA, 20 bp, Artificial
  CRISPR gRNA sequence
ctgttgcccaggctggagtg

SEQ ID NO: 340506 - DNA, 20 bp, Artificial
  CRISPR gRNA sequence
ttgcccaggctggagtgcag

SEQ ID NO: 340507 - DNA, 20 bp, Artificial
  CRISPR gRNA sequence
ggagtgcagtggcgtgatct

SEQ ID NO: 340508 - DNA, 20 bp, Artificial
  CRISPR gRNA sequence
tcactgcaacttccacctcc

SEQ ID NO: 340509 - DNA, 20 bp, Artificial
  CRISPR gRNA sequence
cactgcaacttccacctccc

SEQ ID NO: 340510 - DNA, 20 bp, Artificial
  CRISPR gRNA sequence
aacttccacctcccgggttc

SEQ ID NO: 340511 - DNA, 20 bp, Artificial
  CRISPR gRNA sequence
aagcaattccctgcctcacc

SEQ ID NO: 340512 - DNA, 20 bp, Artificial
  CRISPR gRNA sequence
tatatttgttgatctgctgc

SEQ ID NO: 340513 - DNA, 20 bp, Artificial
  CRISPR gRNA sequence
ctgctgctggttatgcctgt

SEQ ID NO: 340514 - DNA, 20 bp, Artificial
  CRISPR gRNA sequence
ccaaatttgtacaaattctt

SEQ ID NO: 340515 - DNA, 20 bp, Artificial
  CRISPR gRNA sequence
gtatattatactttaattaa

SEQ ID NO: 340516 - DNA, 20 bp, Artificial
  CRISPR gRNA sequence
actttaattaaaagttatta

SEQ ID NO: 340517 - DNA, 20 bp, Artificial
  CRISPR gRNA sequence
attaaaagttattaaagtat

SEQ ID NO: 340518 - DNA, 20 bp, Artificial
  CRISPR gRNA sequence
ttaaaagttattaaagtatt

SEQ ID NO: 340519 - DNA, 20 bp, Artificial
  CRISPR gRNA sequence
taaaagttattaaagtattg

SEQ ID NO: 340520 - DNA, 20 bp, Artificial
  CRISPR gRNA sequence
gttattaaagtattggggcc

SEQ ID NO: 340521 - DNA, 20 bp, Artificial
  CRISPR gRNA sequence
taaagtattggggccgagca

SEQ ID NO: 340522 - DNA, 20 bp, Artificial
  CRISPR gRNA sequence
agtattggggccgagcacag

SEQ ID NO: 340523 - DNA, 20 bp, Artificial
  CRISPR gRNA sequence
cgcctgtaatcccaacactt

SEQ ID NO: 340524 - DNA, 20 bp, Artificial
  CRISPR gRNA sequence
gcctgtaatcccaacacttt

SEQ ID NO: 340525 - DNA, 20 bp, Artificial
  CRISPR gRNA sequence
ctgtaatcccaacactttgg

SEQ ID NO: 340526 - DNA, 20 bp, Artificial
  CRISPR gRNA sequence
tgtaatcccaacactttggg

SEQ ID NO: 340527 - DNA, 20 bp, Artificial
  CRISPR gRNA sequence
tcccaacactttgggaggct

SEQ ID NO: 340528 - DNA, 20 bp, Artificial
  CRISPR gRNA sequence
cccaacactttgggaggctg

SEQ ID NO: 340529 - DNA, 20 bp, Artificial
  CRISPR gRNA sequence
acactttgggaggctgaggc

SEQ ID NO: 340530 - DNA, 20 bp, Artificial
  CRISPR gRNA sequence
ctgaggctggtgcatcacct

SEQ ID NO: 340531 - DNA, 20 bp, Artificial
  CRISPR gRNA sequence
tgaggctggtgcatcacctg

SEQ ID NO: 340532 - DNA, 20 bp, Artificial
  CRISPR gRNA sequence
gctggtgcatcacctgaggt

SEQ ID NO: 340533 - DNA, 20 bp, Artificial
  CRISPR gRNA sequence
ctggtgcatcacctgaggtc

SEQ ID NO: 340534 - DNA, 20 bp, Artificial
  CRISPR gRNA sequence
ggtgcatcacctgaggtcag

SEQ ID NO: 340535 - DNA, 20 bp, Artificial
  CRISPR gRNA sequence
tgaggtcaggagtttaatac

SEQ ID NO: 340536 - DNA, 20 bp, Artificial
  CRISPR gRNA sequence
tcaggagtttaataccagcc

SEQ ID NO: 340537 - DNA, 20 bp, Artificial
  CRISPR gRNA sequence
taataccagcctggccaata

SEQ ID NO: 340538 - DNA, 20 bp, Artificial
  CRISPR gRNA sequence
ctactaaaaatacaaaaaat

SEQ ID NO: 340539 - DNA, 20 bp, Artificial
  CRISPR gRNA sequence
taaaaatacaaaaaattagc

SEQ ID NO: 340540 - DNA, 20 bp, Artificial
  CRISPR gRNA sequence
aaaaatacaaaaaattagcc

SEQ ID NO: 340541 - DNA, 20 bp, Artificial
  CRISPR gRNA sequence
tacaaaaaattagccgggtg

SEQ ID NO: 340542 - DNA, 20 bp, Artificial
  CRISPR gRNA sequence
aaaaaattagccgggtgtgg

SEQ ID NO: 340543 - DNA, 20 bp, Artificial
  CRISPR gRNA sequence
gtggcacacacctgtaatcc

SEQ ID NO: 340544 - DNA, 20 bp, Artificial
  CRISPR gRNA sequence
cacctgtaatcccagctact

SEQ ID NO: 340545 - DNA, 20 bp, Artificial
  CRISPR gRNA sequence
acctgtaatcccagctactt

SEQ ID NO: 340546 - DNA, 20 bp, Artificial
  CRISPR gRNA sequence
ctgtaatcccagctacttgg

SEQ ID NO: 340547 - DNA, 20 bp, Artificial
  CRISPR gRNA sequence
tgtaatcccagctacttggg

SEQ ID NO: 340548 - DNA, 20 bp, Artificial
  CRISPR gRNA sequence
tcccagctacttgggaggct

SEQ ID NO: 340549 - DNA, 20 bp, Artificial
  CRISPR gRNA sequence
cccagctacttgggaggctg

SEQ ID NO: 340550 - DNA, 20 bp, Artificial
  CRISPR gRNA sequence
agctacttgggaggctgagg

SEQ ID NO: 340551 - DNA, 20 bp, Artificial
  CRISPR gRNA sequence
gctacttgggaggctgaggc

SEQ ID NO: 340552 - DNA, 20 bp, Artificial
  CRISPR gRNA sequence
tacttgggaggctgaggcag

SEQ ID NO: 340553 - DNA, 20 bp, Artificial
  CRISPR gRNA sequence
gcaggagaattgcttgaacc

SEQ ID NO: 340554 - DNA, 20 bp, Artificial
  CRISPR gRNA sequence
caggagaattgcttgaaccc

SEQ ID NO: 340555 - DNA, 20 bp, Artificial
  CRISPR gRNA sequence
ggagaattgcttgaacccgg

SEQ ID NO: 340556 - DNA, 20 bp, Artificial
  CRISPR gRNA sequence
gagaattgcttgaacccggg

SEQ ID NO: 340557 - DNA, 20 bp, Artificial
  CRISPR gRNA sequence
aattgcttgaacccgggagg

SEQ ID NO: 340558 - DNA, 20 bp, Artificial
  CRISPR gRNA sequence
ttgcttgaacccgggaggca

SEQ ID NO: 340559 - DNA, 20 bp, Artificial
  CRISPR gRNA sequence
tgcttgaacccgggaggcag

SEQ ID NO: 340560 - DNA, 20 bp, Artificial
  CRISPR gRNA sequence
cgggaggcagaggttgcaac

SEQ ID NO: 340561 - DNA, 20 bp, Artificial
  CRISPR gRNA sequence
ggcagaggttgcaacgagcc

SEQ ID NO: 340562 - DNA, 20 bp, Artificial
  CRISPR gRNA sequence
gcagaggttgcaacgagcca

SEQ ID NO: 340563 - DNA, 20 bp, Artificial
  CRISPR gRNA sequence
aaggtcacgccattgcactc

SEQ ID NO: 340564 - DNA, 20 bp, Artificial
  CRISPR gRNA sequence
acgccattgcactccagcct

SEQ ID NO: 340565 - DNA, 20 bp, Artificial
  CRISPR gRNA sequence
tgcactccagcctcggcaac

SEQ ID NO: 340566 - DNA, 20 bp, Artificial
  CRISPR gRNA sequence
cactccagcctcggcaacaa

SEQ ID NO: 340567 - DNA, 20 bp, Artificial
  CRISPR gRNA sequence
ccagcctcggcaacaagagc

SEQ ID NO: 340568 - DNA, 20 bp, Artificial
  CRISPR gRNA sequence
ataaaaaataaaaaatgtat

SEQ ID NO: 340569 - DNA, 20 bp, Artificial
  CRISPR gRNA sequence
taaaaaataaaaaatgtatc

SEQ ID NO: 340570 - DNA, 20 bp, Artificial
  CRISPR gRNA sequence
aaaaaataaaaaatgtatca

SEQ ID NO: 340571 - DNA, 20 bp, Artificial
  CRISPR gRNA sequence
aaaataaaaaatgtatcagg

SEQ ID NO: 340572 - DNA, 20 bp, Artificial
  CRISPR gRNA sequence
aaaaatgtatcagggagtac

SEQ ID NO: 340573 - DNA, 20 bp, Artificial
  CRISPR gRNA sequence
aaatgtatcagggagtacaa

SEQ ID NO: 340574 - DNA, 20 bp, Artificial
  CRISPR gRNA sequence
gtatcagggagtacaagaga

SEQ ID NO: 340575 - DNA, 20 bp, Artificial
  CRISPR gRNA sequence
agtacaagagaaagtcatat

SEQ ID NO: 340576 - DNA, 20 bp, Artificial
  CRISPR gRNA sequence
taagctctttctacttttca

SEQ ID NO: 340577 - DNA, 20 bp, Artificial
  CRISPR gRNA sequence
cccatgaatcttccttctga

SEQ ID NO: 340578 - DNA, 20 bp, Artificial
  CRISPR gRNA sequence
ccatgaatcttccttctgaa

SEQ ID NO: 340579 - DNA, 20 bp, Artificial
  CRISPR gRNA sequence
ttctttaataacaataataa

SEQ ID NO: 340580 - DNA, 20 bp, Artificial
  CRISPR gRNA sequence
taataacaataataatggca

SEQ ID NO: 340581 - DNA, 20 bp, Artificial
  CRISPR gRNA sequence
aataacaataataatggcaa

SEQ ID NO: 340582 - DNA, 20 bp, Artificial
  CRISPR gRNA sequence
aataataatggcaaaggcat

SEQ ID NO: 340583 - DNA, 20 bp, Artificial
  CRISPR gRNA sequence
ataataatggcaaaggcatt

SEQ ID NO: 340584 - DNA, 20 bp, Artificial
  CRISPR gRNA sequence
taataatggcaaaggcattg

SEQ ID NO: 340585 - DNA, 20 bp, Artificial
  CRISPR gRNA sequence
aataatggcaaaggcattgg

SEQ ID NO: 340586 - DNA, 20 bp, Artificial
  CRISPR gRNA sequence
caaaggcattgggggaccgt

SEQ ID NO: 340587 - DNA, 20 bp, Artificial
  CRISPR gRNA sequence
gcattgggggaccgtgagca

SEQ ID NO: 340588 - DNA, 20 bp, Artificial
  CRISPR gRNA sequence
cattgggggaccgtgagcaa

SEQ ID NO: 340589 - DNA, 20 bp, Artificial
  CRISPR gRNA sequence
attgggggaccgtgagcaaa

SEQ ID NO: 340590 - DNA, 20 bp, Artificial
  CRISPR gRNA sequence
gggggaccgtgagcaaaggg

SEQ ID NO: 340591 - DNA, 20 bp, Artificial
  CRISPR gRNA sequence
ggggaccgtgagcaaagggc

SEQ ID NO: 340592 - DNA, 20 bp, Artificial
  CRISPR gRNA sequence
gagcaaagggcaggcctttg

SEQ ID NO: 340593 - DNA, 20 bp, Artificial
  CRISPR gRNA sequence
agcaaagggcaggcctttgc

SEQ ID NO: 340594 - DNA, 20 bp, Artificial
  CRISPR gRNA sequence
gcaaagggcaggcctttgca

SEQ ID NO: 340595 - DNA, 20 bp, Artificial
  CRISPR gRNA sequence
caaagggcaggcctttgcag

SEQ ID NO: 340596 - DNA, 20 bp, Artificial
  CRISPR gRNA sequence
agggcaggcctttgcagggg

SEQ ID NO: 340597 - DNA, 20 bp, Artificial
  CRISPR gRNA sequence
gggcaggcctttgcaggggt

SEQ ID NO: 340598 - DNA, 20 bp, Artificial
  CRISPR gRNA sequence
ggcctttgcaggggtgggaa

SEQ ID NO: 340599 - DNA, 20 bp, Artificial
  CRISPR gRNA sequence
tttgcaggggtgggaatgga

SEQ ID NO: 340600 - DNA, 20 bp, Artificial
  CRISPR gRNA sequence
ttgcaggggtgggaatggaa

SEQ ID NO: 340601 - DNA, 20 bp, Artificial
  CRISPR gRNA sequence
tgcaggggtgggaatggaaa

SEQ ID NO: 340602 - DNA, 20 bp, Artificial
  CRISPR gRNA sequence
aggggtgggaatggaaaggg

SEQ ID NO: 340603 - DNA, 20 bp, Artificial
  CRISPR gRNA sequence
tggaaagggaagcacgtccc

SEQ ID NO: 340604 - DNA, 20 bp, Artificial
  CRISPR gRNA sequence
gaaagggaagcacgtcccta

SEQ ID NO: 340605 - DNA, 20 bp, Artificial
  CRISPR gRNA sequence
aaagggaagcacgtccctag

SEQ ID NO: 340606 - DNA, 20 bp, Artificial
  CRISPR gRNA sequence
gggaagcacgtccctagagg

SEQ ID NO: 340607 - DNA, 20 bp, Artificial
  CRISPR gRNA sequence
ggaagcacgtccctagaggt

SEQ ID NO: 340608 - DNA, 20 bp, Artificial
  CRISPR gRNA sequence
cacgtccctagaggtgggcc

SEQ ID NO: 340609 - DNA, 20 bp, Artificial
  CRISPR gRNA sequence
acgtccctagaggtgggcct

SEQ ID NO: 340610 - DNA, 20 bp, Artificial
  CRISPR gRNA sequence
ccctagaggtgggcctggga

SEQ ID NO: 340611 - DNA, 20 bp, Artificial
  CRISPR gRNA sequence
cctagaggtgggcctgggat

SEQ ID NO: 340612 - DNA, 20 bp, Artificial
  CRISPR gRNA sequence
ctagaggtgggcctgggatg

SEQ ID NO: 340613 - DNA, 20 bp, Artificial
  CRISPR gRNA sequence
tagaggtgggcctgggatgg

SEQ ID NO: 340614 - DNA, 20 bp, Artificial
  CRISPR gRNA sequence
ggtgggcctgggatgggggt

SEQ ID NO: 340615 - DNA, 20 bp, Artificial
  CRISPR gRNA sequence
gtgggcctgggatgggggtt

SEQ ID NO: 340616 - DNA, 20 bp, Artificial
  CRISPR gRNA sequence
tgggcctgggatgggggttg

SEQ ID NO: 340617 - DNA, 20 bp, Artificial
  CRISPR gRNA sequence
gggcctgggatgggggttgg

SEQ ID NO: 340618 - DNA, 20 bp, Artificial
  CRISPR gRNA sequence
gggatgggggttgggggatg

SEQ ID NO: 340619 - DNA, 20 bp, Artificial
  CRISPR gRNA sequence
tgggggttgggggatgaagc

SEQ ID NO: 340620 - DNA, 20 bp, Artificial
  CRISPR gRNA sequence
gggttgggggatgaagcaag

SEQ ID NO: 340621 - DNA, 20 bp, Artificial
  CRISPR gRNA sequence
gatgaagcaagtggaccttg

SEQ ID NO: 340622 - DNA, 20 bp, Artificial
  CRISPR gRNA sequence
atgaagcaagtggaccttga

SEQ ID NO: 340623 - DNA, 20 bp, Artificial
  CRISPR gRNA sequence
gtggaccttgaaggtctcca

SEQ ID NO: 340624 - DNA, 20 bp, Artificial
  CRISPR gRNA sequence
tggaccttgaaggtctccac

SEQ ID NO: 340625 - DNA, 20 bp, Artificial
  CRISPR gRNA sequence
ttgaaggtctccacaggtct

SEQ ID NO: 340626 - DNA, 20 bp, Artificial
  CRISPR gRNA sequence
tctgagtgtcctatgctccc

SEQ ID NO: 340627 - DNA, 20 bp, Artificial
  CRISPR gRNA sequence
ctgagtgtcctatgctccct

SEQ ID NO: 340628 - DNA, 20 bp, Artificial
  CRISPR gRNA sequence
tccctgggcctctcttcccc

SEQ ID NO: 340629 - DNA, 20 bp, Artificial
  CRISPR gRNA sequence
ccctgggcctctcttccccc

SEQ ID NO: 340630 - DNA, 20 bp, Artificial
  CRISPR gRNA sequence
gcaccatcactgccaatgct

SEQ ID NO: 340631 - DNA, 20 bp, Artificial
  CRISPR gRNA sequence
gctgagtgtgcctgtcgcaa

SEQ ID NO: 340632 - DNA, 20 bp, Artificial
  CRISPR gRNA sequence
agtgtgcctgtcgcaatggc

SEQ ID NO: 340633 - DNA, 20 bp, Artificial
  CRISPR gRNA sequence
gtgcctgtcgcaatggctgg

SEQ ID NO: 340634 - DNA, 20 bp, Artificial
  CRISPR gRNA sequence
tgtcgcaatggctggcagtg

SEQ ID NO: 340635 - DNA, 20 bp, Artificial
  CRISPR gRNA sequence
gtcgcaatggctggcagtgc

SEQ ID NO: 340636 - DNA, 20 bp, Artificial
  CRISPR gRNA sequence
tcgcaatggctggcagtgca

SEQ ID NO: 340637 - DNA, 20 bp, Artificial
  CRISPR gRNA sequence
atggctggcagtgcagggac

SEQ ID NO: 340638 - DNA, 20 bp, Artificial
  CRISPR gRNA sequence
tggctggcagtgcagggaca

SEQ ID NO: 340639 - DNA, 20 bp, Artificial
  CRISPR gRNA sequence
gctggcagtgcagggacaag

SEQ ID NO: 340640 - DNA, 20 bp, Artificial
  CRISPR gRNA sequence
gcagggacaaggagtgcacc

SEQ ID NO: 340641 - DNA, 20 bp, Artificial
  CRISPR gRNA sequence
caaacccttcgctgaccgct

SEQ ID NO: 340642 - DNA, 20 bp, Artificial
  CRISPR gRNA sequence
cgctgaccgctcggtcgtct

SEQ ID NO: 340643 - DNA, 20 bp, Artificial
  CRISPR gRNA sequence
gctgaccgctcggtcgtctc

SEQ ID NO: 340644 - DNA, 20 bp, Artificial
  CRISPR gRNA sequence
gctcggtcgtctcaggccct

SEQ ID NO: 340645 - DNA, 20 bp, Artificial
  CRISPR gRNA sequence
aggccctgagcccacaccct

SEQ ID NO: 340646 - DNA, 20 bp, Artificial
  CRISPR gRNA sequence
cccacccacttaccttatgt

SEQ ID NO: 340647 - DNA, 20 bp, Artificial
  CRISPR gRNA sequence
acccacttaccttatgtcag

SEQ ID NO: 340648 - DNA, 20 bp, Artificial
  CRISPR gRNA sequence
acttaccttatgtcagtggt

SEQ ID NO: 340649 - DNA, 20 bp, Artificial
  CRISPR gRNA sequence
cttatgtcagtggtaagttc

SEQ ID NO: 340650 - DNA, 20 bp, Artificial
  CRISPR gRNA sequence
ttatgtcagtggtaagttcc

SEQ ID NO: 340651 - DNA, 20 bp, Artificial
  CRISPR gRNA sequence
caactctctgtgccatcacg

SEQ ID NO: 340652 - DNA, 20 bp, Artificial
  CRISPR gRNA sequence
aactctctgtgccatcacgt

SEQ ID NO: 340653 - DNA, 20 bp, Artificial
  CRISPR gRNA sequence
actctctgtgccatcacgtg

SEQ ID NO: 340654 - DNA, 20 bp, Artificial
  CRISPR gRNA sequence
ctctgtgccatcacgtgggg

SEQ ID NO: 340655 - DNA, 20 bp, Artificial
  CRISPR gRNA sequence
tgtgccatcacgtggggtag

SEQ ID NO: 340656 - DNA, 20 bp, Artificial
  CRISPR gRNA sequence
ggtagcggtgataccccaac

SEQ ID NO: 340657 - DNA, 20 bp, Artificial
  CRISPR gRNA sequence
gtactccccactcctacccc

SEQ ID NO: 340658 - DNA, 20 bp, Artificial
  CRISPR gRNA sequence
ccccactcctacccctagat

SEQ ID NO: 340659 - DNA, 20 bp, Artificial
  CRISPR gRNA sequence
cccactcctacccctagata

SEQ ID NO: 340660 - DNA, 20 bp, Artificial
  CRISPR gRNA sequence
ctcctacccctagataaggt

SEQ ID NO: 340661 - DNA, 20 bp, Artificial
  CRISPR gRNA sequence
ttctgccttcccatcccatc

SEQ ID NO: 340662 - DNA, 20 bp, Artificial
  CRISPR gRNA sequence
ccatcccatccagcacctct

SEQ ID NO: 340663 - DNA, 20 bp, Artificial
  CRISPR gRNA sequence
catcccatccagcacctctc

SEQ ID NO: 340664 - DNA, 20 bp, Artificial
  CRISPR gRNA sequence
tccagcacctctcaggcctt

SEQ ID NO: 340665 - DNA, 20 bp, Artificial
  CRISPR gRNA sequence
aggccttcagatgtgcccta

SEQ ID NO: 340666 - DNA, 20 bp, Artificial
  CRISPR gRNA sequence
ggccttcagatgtgccctat

SEQ ID NO: 340667 - DNA, 20 bp, Artificial
  CRISPR gRNA sequence
gccttcagatgtgccctatg

SEQ ID NO: 340668 - DNA, 20 bp, Artificial
  CRISPR gRNA sequence
tcattctgtctctgtttttc

SEQ ID NO: 340669 - DNA, 20 bp, Artificial
  CRISPR gRNA sequence
attctgtctctgtttttcca

SEQ ID NO: 340670 - DNA, 20 bp, Artificial
  CRISPR gRNA sequence
ctctgtttttccagagatgc

SEQ ID NO: 340671 - DNA, 20 bp, Artificial
  CRISPR gRNA sequence
ctgtttttccagagatgctg

SEQ ID NO: 340672 - DNA, 20 bp, Artificial
  CRISPR gRNA sequence
tgtttttccagagatgctgg

SEQ ID NO: 340673 - DNA, 20 bp, Artificial
  CRISPR gRNA sequence
tttccagagatgctggaggc

SEQ ID NO: 340674 - DNA, 20 bp, Artificial
  CRISPR gRNA sequence
ttccagagatgctggaggcc

SEQ ID NO: 340675 - DNA, 20 bp, Artificial
  CRISPR gRNA sequence
agagatgctggaggccagga

SEQ ID NO: 340676 - DNA, 20 bp, Artificial
  CRISPR gRNA sequence
atgctggaggccaggacagc

SEQ ID NO: 340677 - DNA, 20 bp, Artificial
  CRISPR gRNA sequence
tgctggaggccaggacagct

SEQ ID NO: 340678 - DNA, 20 bp, Artificial
  CRISPR gRNA sequence
ccaggacagctgggcacatg

SEQ ID NO: 340679 - DNA, 20 bp, Artificial
  CRISPR gRNA sequence
agctgggcacatgcagactc

SEQ ID NO: 340680 - DNA, 20 bp, Artificial
  CRISPR gRNA sequence
atgcagactctggctgactt

SEQ ID NO: 340681 - DNA, 20 bp, Artificial
  CRISPR gRNA sequence
tgcagactctggctgacttc

SEQ ID NO: 340682 - DNA, 20 bp, Artificial
  CRISPR gRNA sequence
agactctggctgacttcagg

SEQ ID NO: 340683 - DNA, 20 bp, Artificial
  CRISPR gRNA sequence
acttcaggcagctgcctgcc

SEQ ID NO: 340684 - DNA, 20 bp, Artificial
  CRISPR gRNA sequence
cccggactctctctacccac

SEQ ID NO: 340685 - DNA, 20 bp, Artificial
  CRISPR gRNA sequence
tctctacccactggccacgt

SEQ ID NO: 340686 - DNA, 20 bp, Artificial
  CRISPR gRNA sequence
ttctccttaatccccaccgc

SEQ ID NO: 340687 - DNA, 20 bp, Artificial
  CRISPR gRNA sequence
ctccttaatccccaccgcta

SEQ ID NO: 340688 - DNA, 20 bp, Artificial
  CRISPR gRNA sequence
ccttaatccccaccgctaga

SEQ ID NO: 340689 - DNA, 20 bp, Artificial
  CRISPR gRNA sequence
gctagagagaatgcatacac

SEQ ID NO: 340690 - DNA, 20 bp, Artificial
  CRISPR gRNA sequence
ctagagagaatgcatacacg

SEQ ID NO: 340691 - DNA, 20 bp, Artificial
  CRISPR gRNA sequence
tagagagaatgcatacacga

SEQ ID NO: 340692 - DNA, 20 bp, Artificial
  CRISPR gRNA sequence
agagagaatgcatacacgag

SEQ ID NO: 340693 - DNA, 20 bp, Artificial
  CRISPR gRNA sequence
agaatgcatacacgaggggc

SEQ ID NO: 340694 - DNA, 20 bp, Artificial
  CRISPR gRNA sequence
gaatgcatacacgaggggcc

SEQ ID NO: 340695 - DNA, 20 bp, Artificial
  CRISPR gRNA sequence
atgcatacacgaggggccag

SEQ ID NO: 340696 - DNA, 20 bp, Artificial
  CRISPR gRNA sequence
tgcatacacgaggggccagg

SEQ ID NO: 340697 - DNA, 20 bp, Artificial
  CRISPR gRNA sequence
gcatacacgaggggccagga

SEQ ID NO: 340698 - DNA, 20 bp, Artificial
  CRISPR gRNA sequence
tacacgaggggccaggaggg

SEQ ID NO: 340699 - DNA, 20 bp, Artificial
  CRISPR gRNA sequence
cgaggggccaggagggaagc

SEQ ID NO: 340700 - DNA, 20 bp, Artificial
  CRISPR gRNA sequence
gggccaggagggaagccaga

SEQ ID NO: 340701 - DNA, 20 bp, Artificial
  CRISPR gRNA sequence
caggagggaagccagacaga

SEQ ID NO: 340702 - DNA, 20 bp, Artificial
  CRISPR gRNA sequence
gaagccagacagaaagctcc

SEQ ID NO: 340703 - DNA, 20 bp, Artificial
  CRISPR gRNA sequence
aagccagacagaaagctcct

SEQ ID NO: 340704 - DNA, 20 bp, Artificial
  CRISPR gRNA sequence
agacagaaagctcctaggat

SEQ ID NO: 340705 - DNA, 20 bp, Artificial
  CRISPR gRNA sequence
gacagaaagctcctaggatt

SEQ ID NO: 340706 - DNA, 20 bp, Artificial
  CRISPR gRNA sequence
acagaaagctcctaggatta

SEQ ID NO: 340707 - DNA, 20 bp, Artificial
  CRISPR gRNA sequence
aagctcctaggattagggat

SEQ ID NO: 340708 - DNA, 20 bp, Artificial
  CRISPR gRNA sequence
gctcctaggattagggataa

SEQ ID NO: 340709 - DNA, 20 bp, Artificial
  CRISPR gRNA sequence
ctcctaggattagggataag

SEQ ID NO: 340710 - DNA, 20 bp, Artificial
  CRISPR gRNA sequence
cctaggattagggataagag

SEQ ID NO: 340711 - DNA, 20 bp, Artificial
  CRISPR gRNA sequence
ctaggattagggataagagg

SEQ ID NO: 340712 - DNA, 20 bp, Artificial
  CRISPR gRNA sequence
taggattagggataagagga

SEQ ID NO: 340713 - DNA, 20 bp, Artificial
  CRISPR gRNA sequence
aggattagggataagaggag

SEQ ID NO: 340714 - DNA, 20 bp, Artificial
  CRISPR gRNA sequence
agggataagaggaggggaaa

SEQ ID NO: 340715 - DNA, 20 bp, Artificial
  CRISPR gRNA sequence
gataagaggaggggaaaaag

SEQ ID NO: 340716 - DNA, 20 bp, Artificial
  CRISPR gRNA sequence
taagaggaggggaaaaagca

SEQ ID NO: 340717 - DNA, 20 bp, Artificial
  CRISPR gRNA sequence
aaaaagcagagtccactgtt

SEQ ID NO: 340718 - DNA, 20 bp, Artificial
  CRISPR gRNA sequence
aaaagcagagtccactgttt

SEQ ID NO: 340719 - DNA, 20 bp, Artificial
  CRISPR gRNA sequence
aagcagagtccactgtttag

SEQ ID NO: 340720 - DNA, 20 bp, Artificial
  CRISPR gRNA sequence
gcagagtccactgtttagga

SEQ ID NO: 340721 - DNA, 20 bp, Artificial
  CRISPR gRNA sequence
cagagtccactgtttaggag

SEQ ID NO: 340722 - DNA, 20 bp, Artificial
  CRISPR gRNA sequence
gagtccactgtttaggagag

SEQ ID NO: 340723 - DNA, 20 bp, Artificial
  CRISPR gRNA sequence
ccactgtttaggagaggagt

SEQ ID NO: 340724 - DNA, 20 bp, Artificial
  CRISPR gRNA sequence
ttaggagaggagttggccaa

SEQ ID NO: 340725 - DNA, 20 bp, Artificial
  CRISPR gRNA sequence
ggagaggagttggccaacgg

SEQ ID NO: 340726 - DNA, 20 bp, Artificial
  CRISPR gRNA sequence
gaggagttggccaacggtgg

SEQ ID NO: 340727 - DNA, 20 bp, Artificial
  CRISPR gRNA sequence
aggagttggccaacggtggc

SEQ ID NO: 340728 - DNA, 20 bp, Artificial
  CRISPR gRNA sequence
agttggccaacggtggcggg

SEQ ID NO: 340729 - DNA, 20 bp, Artificial
  CRISPR gRNA sequence
gttggccaacggtggcgggt

SEQ ID NO: 340730 - DNA, 20 bp, Artificial
  CRISPR gRNA sequence
gccaacggtggcgggtggga

SEQ ID NO: 340731 - DNA, 20 bp, Artificial
  CRISPR gRNA sequence
ggtggcgggtgggatagaat

SEQ ID NO: 340732 - DNA, 20 bp, Artificial
  CRISPR gRNA sequence
gtggcgggtgggatagaata

SEQ ID NO: 340733 - DNA, 20 bp, Artificial
  CRISPR gRNA sequence
gcgggtgggatagaataagg

SEQ ID NO: 340734 - DNA, 20 bp, Artificial
  CRISPR gRNA sequence
cgggtgggatagaataaggt

SEQ ID NO: 340735 - DNA, 20 bp, Artificial
  CRISPR gRNA sequence
gggtgggatagaataaggtg

SEQ ID NO: 340736 - DNA, 20 bp, Artificial
  CRISPR gRNA sequence
ggtgggatagaataaggtgg

SEQ ID NO: 340737 - DNA, 20 bp, Artificial
  CRISPR gRNA sequence
ggatagaataaggtggggga

SEQ ID NO: 340738 - DNA, 20 bp, Artificial
  CRISPR gRNA sequence
gatagaataaggtgggggaa

SEQ ID NO: 340739 - DNA, 20 bp, Artificial
  CRISPR gRNA sequence
atagaataaggtgggggaaa

SEQ ID NO: 340740 - DNA, 20 bp, Artificial
  CRISPR gRNA sequence
tagaataaggtgggggaaag

SEQ ID NO: 340741 - DNA, 20 bp, Artificial
  CRISPR gRNA sequence
gaataaggtgggggaaaggg

SEQ ID NO: 340742 - DNA, 20 bp, Artificial
  CRISPR gRNA sequence
ataaggtgggggaaagggga

SEQ ID NO: 340743 - DNA, 20 bp, Artificial
  CRISPR gRNA sequence
taaggtgggggaaaggggag

SEQ ID NO: 340744 - DNA, 20 bp, Artificial
  CRISPR gRNA sequence
gtgggggaaaggggagaggc

SEQ ID NO: 340745 - DNA, 20 bp, Artificial
  CRISPR gRNA sequence
tgggggaaaggggagaggca

SEQ ID NO: 340746 - DNA, 20 bp, Artificial
  CRISPR gRNA sequence
aaaggggagaggcaaggtga

SEQ ID NO: 340747 - DNA, 20 bp, Artificial
  CRISPR gRNA sequence
aaggggagaggcaaggtgac

SEQ ID NO: 340748 - DNA, 20 bp, Artificial
  CRISPR gRNA sequence
ggggagaggcaaggtgacag

SEQ ID NO: 340749 - DNA, 20 bp, Artificial
  CRISPR gRNA sequence
gggagaggcaaggtgacagg

SEQ ID NO: 340750 - DNA, 20 bp, Artificial
  CRISPR gRNA sequence
ggagaggcaaggtgacagga

SEQ ID NO: 340751 - DNA, 20 bp, Artificial
  CRISPR gRNA sequence
aggcaaggtgacaggagggc

SEQ ID NO: 340752 - DNA, 20 bp, Artificial
  CRISPR gRNA sequence
ggcaaggtgacaggagggct

SEQ ID NO: 340753 - DNA, 20 bp, Artificial
  CRISPR gRNA sequence
ggtgacaggagggctgggct

SEQ ID NO: 340754 - DNA, 20 bp, Artificial
  CRISPR gRNA sequence
gtgacaggagggctgggctg

SEQ ID NO: 340755 - DNA, 20 bp, Artificial
  CRISPR gRNA sequence
tgacaggagggctgggctga

SEQ ID NO: 340756 - DNA, 20 bp, Artificial
  CRISPR gRNA sequence
acaggagggctgggctgagg

SEQ ID NO: 340757 - DNA, 20 bp, Artificial
  CRISPR gRNA sequence
agggctgggctgagggagcc

SEQ ID NO: 340758 - DNA, 20 bp, Artificial
  CRISPR gRNA sequence
gggctgggctgagggagcca

SEQ ID NO: 340759 - DNA, 20 bp, Artificial
  CRISPR gRNA sequence
ggctgggctgagggagccaa

SEQ ID NO: 340760 - DNA, 20 bp, Artificial
  CRISPR gRNA sequence
gggctgagggagccaagggc

SEQ ID NO: 340761 - DNA, 20 bp, Artificial
  CRISPR gRNA sequence
ctgtgtgtcccctcctatta

SEQ ID NO: 340762 - DNA, 20 bp, Artificial
  CRISPR gRNA sequence
tcccctcctattacagccca

SEQ ID NO: 340763 - DNA, 20 bp, Artificial
  CRISPR gRNA sequence
acagcccaaagatccctgtg

SEQ ID NO: 340764 - DNA, 20 bp, Artificial
  CRISPR gRNA sequence
cgcatccttgtgatcttctc

SEQ ID NO: 340765 - DNA, 20 bp, Artificial
  CRISPR gRNA sequence
aatgttccttgttttcaccc

SEQ ID NO: 340766 - DNA, 20 bp, Artificial
  CRISPR gRNA sequence
ttccttgttttcaccctggc

SEQ ID NO: 340767 - DNA, 20 bp, Artificial
  CRISPR gRNA sequence
tccttgttttcaccctggcc

SEQ ID NO: 340768 - DNA, 20 bp, Artificial
  CRISPR gRNA sequence
ccttgttttcaccctggccg

SEQ ID NO: 340769 - DNA, 20 bp, Artificial
  CRISPR gRNA sequence
gccctgttcctccatcaacg

SEQ ID NO: 340770 - DNA, 20 bp, Artificial
  CRISPR gRNA sequence
ccctgttcctccatcaacga

SEQ ID NO: 340771 - DNA, 20 bp, Artificial
  CRISPR gRNA sequence
ctccatcaacgaaggaaata

SEQ ID NO: 340772 - DNA, 20 bp, Artificial
  CRISPR gRNA sequence
caacgaaggaaatatagatc

SEQ ID NO: 340773 - DNA, 20 bp, Artificial
  CRISPR gRNA sequence
gaaggaaatatagatcaagt

SEQ ID NO: 340774 - DNA, 20 bp, Artificial
  CRISPR gRNA sequence
aggaaatatagatcaagtaa

SEQ ID NO: 340775 - DNA, 20 bp, Artificial
  CRISPR gRNA sequence
aatatagatcaagtaagaga

SEQ ID NO: 340776 - DNA, 20 bp, Artificial
  CRISPR gRNA sequence
atcaagtaagagacagaaca

SEQ ID NO: 340777 - DNA, 20 bp, Artificial
  CRISPR gRNA sequence
tcaagtaagagacagaacac

SEQ ID NO: 340778 - DNA, 20 bp, Artificial
  CRISPR gRNA sequence
agagacagaacacaggcctc

SEQ ID NO: 340779 - DNA, 20 bp, Artificial
  CRISPR gRNA sequence
gcccctgcaccacaccccac

SEQ ID NO: 340780 - DNA, 20 bp, Artificial
  CRISPR gRNA sequence
tcaaccccactgcccacgcc

SEQ ID NO: 340781 - DNA, 20 bp, Artificial
  CRISPR gRNA sequence
ggaatctcactgaaacccac

SEQ ID NO: 340782 - DNA, 20 bp, Artificial
  CRISPR gRNA sequence
acccaccagctccacttcac

SEQ ID NO: 340783 - DNA, 20 bp, Artificial
  CRISPR gRNA sequence
cagctccacttcaccagcct

SEQ ID NO: 340784 - DNA, 20 bp, Artificial
  CRISPR gRNA sequence
tcctaccccttctctcccct

SEQ ID NO: 340785 - DNA, 20 bp, Artificial
  CRISPR gRNA sequence
accccttctctccccttagc

SEQ ID NO: 340786 - DNA, 20 bp, Artificial
  CRISPR gRNA sequence
gctcctgacacccctccccc

SEQ ID NO: 340787 - DNA, 20 bp, Artificial
  CRISPR gRNA sequence
tctccccctgcccccactgc

SEQ ID NO: 340788 - DNA, 20 bp, Artificial
  CRISPR gRNA sequence
ccctgcccccactgctggcc

SEQ ID NO: 340789 - DNA, 20 bp, Artificial
  CRISPR gRNA sequence
cactgctggccaagactcat

SEQ ID NO: 340790 - DNA, 20 bp, Artificial
  CRISPR gRNA sequence
actcatcggatctccttctg

SEQ ID NO: 340791 - DNA, 20 bp, Artificial
  CRISPR gRNA sequence
cggatctccttctgcagaca

SEQ ID NO: 340792 - DNA, 20 bp, Artificial
  CRISPR gRNA sequence
ggatctccttctgcagacaa

SEQ ID NO: 340793 - DNA, 20 bp, Artificial
  CRISPR gRNA sequence
atctccttctgcagacaaag

SEQ ID NO: 340794 - DNA, 20 bp, Artificial
  CRISPR gRNA sequence
ccttctgcagacaaaggaga

SEQ ID NO: 340795 - DNA, 20 bp, Artificial
  CRISPR gRNA sequence
agacaaaggagaaagtcctg

SEQ ID NO: 340796 - DNA, 20 bp, Artificial
  CRISPR gRNA sequence
acaaaggagaaagtcctgtg

SEQ ID NO: 340797 - DNA, 20 bp, Artificial
  CRISPR gRNA sequence
agaaagtcctgtggagcctg

SEQ ID NO: 340798 - DNA, 20 bp, Artificial
  CRISPR gRNA sequence
aaagtcctgtggagcctgca

SEQ ID NO: 340799 - DNA, 20 bp, Artificial
  CRISPR gRNA sequence
cctgcagagccttgtcatta

SEQ ID NO: 340800 - DNA, 20 bp, Artificial
  CRISPR gRNA sequence
ccttgtcattacagctgccc

SEQ ID NO: 340801 - DNA, 20 bp, Artificial
  CRISPR gRNA sequence
cttgtcattacagctgcccc

SEQ ID NO: 340802 - DNA, 20 bp, Artificial
  CRISPR gRNA sequence
ttgtcattacagctgcccca

SEQ ID NO: 340803 - DNA, 20 bp, Artificial
  CRISPR gRNA sequence
gtcattacagctgccccagg

SEQ ID NO: 340804 - DNA, 20 bp, Artificial
  CRISPR gRNA sequence
tcattacagctgccccaggg

SEQ ID NO: 340805 - DNA, 20 bp, Artificial
  CRISPR gRNA sequence
attacagctgccccagggag

SEQ ID NO: 340806 - DNA, 20 bp, Artificial
  CRISPR gRNA sequence
ttacagctgccccagggagg

SEQ ID NO: 340807 - DNA, 20 bp, Artificial
  CRISPR gRNA sequence
acagctgccccagggaggag

SEQ ID NO: 340808 - DNA, 20 bp, Artificial
  CRISPR gRNA sequence
cagctgccccagggaggagg

SEQ ID NO: 340809 - DNA, 20 bp, Artificial
  CRISPR gRNA sequence
agctgccccagggaggagga

SEQ ID NO: 340810 - DNA, 20 bp, Artificial
  CRISPR gRNA sequence
tgccccagggaggaggaggg

SEQ ID NO: 340811 - DNA, 20 bp, Artificial
  CRISPR gRNA sequence
agggcagcaccatccccatc

SEQ ID NO: 340812 - DNA, 20 bp, Artificial
  CRISPR gRNA sequence
gggcagcaccatccccatcc

SEQ ID NO: 340813 - DNA, 20 bp, Artificial
  CRISPR gRNA sequence
gcagcaccatccccatccag

SEQ ID NO: 340814 - DNA, 20 bp, Artificial
  CRISPR gRNA sequence
cagcaccatccccatccagg

SEQ ID NO: 340815 - DNA, 20 bp, Artificial
  CRISPR gRNA sequence
ccaggaggattaccgaaaac

SEQ ID NO: 340816 - DNA, 20 bp, Artificial
  CRISPR gRNA sequence
aggaggattaccgaaaaccg

SEQ ID NO: 340817 - DNA, 20 bp, Artificial
  CRISPR gRNA sequence
ggagcctgcctgctccccct

SEQ ID NO: 340818 - DNA, 20 bp, Artificial
  CRISPR gRNA sequence
cctgcctgctccccctgagc

SEQ ID NO: 340819 - DNA, 20 bp, Artificial
  CRISPR gRNA sequence
tccccctgagccagcacctg

SEQ ID NO: 340820 - DNA, 20 bp, Artificial
  CRISPR gRNA sequence
ccccctgagccagcacctgc

SEQ ID NO: 340821 - DNA, 20 bp, Artificial
  CRISPR gRNA sequence
ccctgagccagcacctgcgg

SEQ ID NO: 340822 - DNA, 20 bp, Artificial
  CRISPR gRNA sequence
cacctgcgggagctgcacta

SEQ ID NO: 340823 - DNA, 20 bp, Artificial
  CRISPR gRNA sequence
cgggagctgcactacagccc

SEQ ID NO: 340824 - DNA, 20 bp, Artificial
  CRISPR gRNA sequence
ccccaccccgccgaccatcc

SEQ ID NO: 340825 - DNA, 20 bp, Artificial
  CRISPR gRNA sequence
cccaccccgccgaccatcca

SEQ ID NO: 340826 - DNA, 20 bp, Artificial
  CRISPR gRNA sequence
ccaccccgccgaccatccaa

SEQ ID NO: 340827 - DNA, 20 bp, Artificial
  CRISPR gRNA sequence
accccgccgaccatccaagg

SEQ ID NO: 340828 - DNA, 20 bp, Artificial
  CRISPR gRNA sequence
cccgccgaccatccaaggga

SEQ ID NO: 340829 - DNA, 20 bp, Artificial
  CRISPR gRNA sequence
ccgaccatccaagggagagt

SEQ ID NO: 340830 - DNA, 20 bp, Artificial
  CRISPR gRNA sequence
atccaagggagagtgagacc

SEQ ID NO: 340831 - DNA, 20 bp, Artificial
  CRISPR gRNA sequence
caagggagagtgagacctgg

SEQ ID NO: 340832 - DNA, 20 bp, Artificial
  CRISPR gRNA sequence
agacctggcagccacaactg

SEQ ID NO: 340833 - DNA, 20 bp, Artificial
  CRISPR gRNA sequence
ctgcagtcccatcctcttgt

SEQ ID NO: 340834 - DNA, 20 bp, Artificial
  CRISPR gRNA sequence
tgcagtcccatcctcttgtc

SEQ ID NO: 340835 - DNA, 20 bp, Artificial
  CRISPR gRNA sequence
gcagtcccatcctcttgtca

SEQ ID NO: 340836 - DNA, 20 bp, Artificial
  CRISPR gRNA sequence
cctttcctgtgtacacgtga

SEQ ID NO: 340837 - DNA, 20 bp, Artificial
  CRISPR gRNA sequence
tttcctgtgtacacgtgaca

SEQ ID NO: 340838 - DNA, 20 bp, Artificial
  CRISPR gRNA sequence
acgtgacagagtgccttttc

SEQ ID NO: 340839 - DNA, 20 bp, Artificial
  CRISPR gRNA sequence
acagagtgccttttcgagac

SEQ ID NO: 340840 - DNA, 20 bp, Artificial
  CRISPR gRNA sequence
gagtgccttttcgagactgg

SEQ ID NO: 340841 - DNA, 20 bp, Artificial
  CRISPR gRNA sequence
agtgccttttcgagactggc

SEQ ID NO: 340842 - DNA, 20 bp, Artificial
  CRISPR gRNA sequence
gtgccttttcgagactggca

SEQ ID NO: 340843 - DNA, 20 bp, Artificial
  CRISPR gRNA sequence
ttttcgagactggcagggac

SEQ ID NO: 340844 - DNA, 20 bp, Artificial
  CRISPR gRNA sequence
tttcgagactggcagggacg

SEQ ID NO: 340845 - DNA, 20 bp, Artificial
  CRISPR gRNA sequence
ggcagggacgaggacaaata

SEQ ID NO: 340846 - DNA, 20 bp, Artificial
  CRISPR gRNA sequence
ggacgaggacaaatatggat

SEQ ID NO: 340847 - DNA, 20 bp, Artificial
  CRISPR gRNA sequence
gacgaggacaaatatggatg

SEQ ID NO: 340848 - DNA, 20 bp, Artificial
  CRISPR gRNA sequence
gaggacaaatatggatgagg

SEQ ID NO: 340849 - DNA, 20 bp, Artificial
  CRISPR gRNA sequence
ggacaaatatggatgaggtg

SEQ ID NO: 340850 - DNA, 20 bp, Artificial
  CRISPR gRNA sequence
acaaatatggatgaggtgga

SEQ ID NO: 340851 - DNA, 20 bp, Artificial
  CRISPR gRNA sequence
aatatggatgaggtggagag

SEQ ID NO: 340852 - DNA, 20 bp, Artificial
  CRISPR gRNA sequence
atatggatgaggtggagagt

SEQ ID NO: 340853 - DNA, 20 bp, Artificial
  CRISPR gRNA sequence
tggatgaggtggagagtggg

SEQ ID NO: 340854 - DNA, 20 bp, Artificial
  CRISPR gRNA sequence
atgaggtggagagtgggaag

SEQ ID NO: 340855 - DNA, 20 bp, Artificial
  CRISPR gRNA sequence
tgaggtggagagtgggaagc

SEQ ID NO: 340856 - DNA, 20 bp, Artificial
  CRISPR gRNA sequence
aggtggagagtgggaagcag

SEQ ID NO: 340857 - DNA, 20 bp, Artificial
  CRISPR gRNA sequence
gagagtgggaagcaggagcc

SEQ ID NO: 340858 - DNA, 20 bp, Artificial
  CRISPR gRNA sequence
gtgggaagcaggagcccagc

SEQ ID NO: 340859 - DNA, 20 bp, Artificial
  CRISPR gRNA sequence
agccagctgcgcctgcgctg

SEQ ID NO: 340860 - DNA, 20 bp, Artificial
  CRISPR gRNA sequence
gccagctgcgcctgcgctgc

SEQ ID NO: 340861 - DNA, 20 bp, Artificial
  CRISPR gRNA sequence
cagctgcgcctgcgctgcag

SEQ ID NO: 340862 - DNA, 20 bp, Artificial
  CRISPR gRNA sequence
agctgcgcctgcgctgcagg

SEQ ID NO: 340863 - DNA, 20 bp, Artificial
  CRISPR gRNA sequence
gctgcgcctgcgctgcagga

SEQ ID NO: 340864 - DNA, 20 bp, Artificial
  CRISPR gRNA sequence
gcgcctgcgctgcaggaggg

SEQ ID NO: 340865 - DNA, 20 bp, Artificial
  CRISPR gRNA sequence
cgcctgcgctgcaggagggc

SEQ ID NO: 340866 - DNA, 20 bp, Artificial
  CRISPR gRNA sequence
gcctgcgctgcaggagggcg

SEQ ID NO: 340867 - DNA, 20 bp, Artificial
  CRISPR gRNA sequence
cctgcgctgcaggagggcgg

SEQ ID NO: 340868 - DNA, 20 bp, Artificial
  CRISPR gRNA sequence
ctgcaggagggcgggggctc

SEQ ID NO: 340869 - DNA, 20 bp, Artificial
  CRISPR gRNA sequence
aaacacacttcctgctgcga

SEQ ID NO: 340870 - DNA, 20 bp, Artificial
  CRISPR gRNA sequence
gcgaaagacccacatgctac

SEQ ID NO: 340871 - DNA, 20 bp, Artificial
  CRISPR gRNA sequence
aagacccacatgctacaaga

SEQ ID NO: 340872 - DNA, 20 bp, Artificial
  CRISPR gRNA sequence
agacccacatgctacaagac

SEQ ID NO: 340873 - DNA, 20 bp, Artificial
  CRISPR gRNA sequence
gctacaagacgggcaaaata

SEQ ID NO: 340874 - DNA, 20 bp, Artificial
  CRISPR gRNA sequence
agacgggcaaaataaagtga

SEQ ID NO: 340875 - DNA, 20 bp, Artificial
  CRISPR gRNA sequence
agtgacagatgaccaccctg

SEQ ID NO: 340876 - DNA, 20 bp, Artificial
  CRISPR gRNA sequence
atgaccaccctgcagctctc

SEQ ID NO: 340877 - DNA, 20 bp, Artificial
  CRISPR gRNA sequence
cagcttcctctctgaaatcc

SEQ ID NO: 340878 - DNA, 20 bp, Artificial
  CRISPR gRNA sequence
gaaatcccagtcccaaaatc

SEQ ID NO: 340879 - DNA, 20 bp, Artificial
  CRISPR gRNA sequence
agtcccaaaatccagtttcc

SEQ ID NO: 340880 - DNA, 20 bp, Artificial
  CRISPR gRNA sequence
ccagtttcctggccgcctcc

SEQ ID NO: 340881 - DNA, 20 bp, Artificial
  CRISPR gRNA sequence
ttcctggccgcctcctggct

SEQ ID NO: 340882 - DNA, 20 bp, Artificial
  CRISPR gRNA sequence
tcctggccgcctcctggctc

SEQ ID NO: 340883 - DNA, 20 bp, Artificial
  CRISPR gRNA sequence
ggccgcctcctggctcaggt

SEQ ID NO: 340884 - DNA, 20 bp, Artificial
  CRISPR gRNA sequence
gccgcctcctggctcaggtc

SEQ ID NO: 340885 - DNA, 20 bp, Artificial
  CRISPR gRNA sequence
tcctggctcaggtcaggatc

SEQ ID NO: 340886 - DNA, 20 bp, Artificial
  CRISPR gRNA sequence
tggctcaggtcaggatctgg

SEQ ID NO: 340887 - DNA, 20 bp, Artificial
  CRISPR gRNA sequence
gctcaggtcaggatctggca

SEQ ID NO: 340888 - DNA, 20 bp, Artificial
  CRISPR gRNA sequence
ctcaggtcaggatctggcag

SEQ ID NO: 340889 - DNA, 20 bp, Artificial
  CRISPR gRNA sequence
caggtcaggatctggcagag

SEQ ID NO: 340890 - DNA, 20 bp, Artificial
  CRISPR gRNA sequence
aggtcaggatctggcagagg

SEQ ID NO: 340891 - DNA, 20 bp, Artificial
  CRISPR gRNA sequence
atctggcagaggaggtttct

SEQ ID NO: 340892 - DNA, 20 bp, Artificial
  CRISPR gRNA sequence
ggcagaggaggtttctcagc

SEQ ID NO: 340893 - DNA, 20 bp, Artificial
  CRISPR gRNA sequence
ggctgagaaacctcctctgc

SEQ ID NO: 340894 - DNA, 20 bp, Artificial
  CRISPR gRNA sequence
cctctgccagatcctgacct

SEQ ID NO: 340895 - DNA, 20 bp, Artificial
  CRISPR gRNA sequence
tgccagatcctgacctgagc

SEQ ID NO: 340896 - DNA, 20 bp, Artificial
  CRISPR gRNA sequence
gccagatcctgacctgagcc

SEQ ID NO: 340897 - DNA, 20 bp, Artificial
  CRISPR gRNA sequence
cagatcctgacctgagccag

SEQ ID NO: 340898 - DNA, 20 bp, Artificial
  CRISPR gRNA sequence
agatcctgacctgagccagg

SEQ ID NO: 340899 - DNA, 20 bp, Artificial
  CRISPR gRNA sequence
tcctgacctgagccaggagg

SEQ ID NO: 340900 - DNA, 20 bp, Artificial
  CRISPR gRNA sequence
gacctgagccaggaggcggc

SEQ ID NO: 340901 - DNA, 20 bp, Artificial
  CRISPR gRNA sequence
acctgagccaggaggcggcc

SEQ ID NO: 340902 - DNA, 20 bp, Artificial
  CRISPR gRNA sequence
ccaggaggcggccaggaaac

SEQ ID NO: 340903 - DNA, 20 bp, Artificial
  CRISPR gRNA sequence
gcggccaggaaactggattt

SEQ ID NO: 340904 - DNA, 20 bp, Artificial
  CRISPR gRNA sequence
cggccaggaaactggatttt

SEQ ID NO: 340905 - DNA, 20 bp, Artificial
  CRISPR gRNA sequence
aggaaactggattttgggac

SEQ ID NO: 340906 - DNA, 20 bp, Artificial
  CRISPR gRNA sequence
ggaaactggattttgggact

SEQ ID NO: 340907 - DNA, 20 bp, Artificial
  CRISPR gRNA sequence
ggattttgggactgggattt

SEQ ID NO: 340908 - DNA, 20 bp, Artificial
  CRISPR gRNA sequence
attttgggactgggatttca

SEQ ID NO: 340909 - DNA, 20 bp, Artificial
  CRISPR gRNA sequence
tttgggactgggatttcaga

SEQ ID NO: 340910 - DNA, 20 bp, Artificial
  CRISPR gRNA sequence
ttgggactgggatttcagag

SEQ ID NO: 340911 - DNA, 20 bp, Artificial
  CRISPR gRNA sequence
ggactgggatttcagagagg

SEQ ID NO: 340912 - DNA, 20 bp, Artificial
  CRISPR gRNA sequence
tgggatttcagagaggaagc

SEQ ID NO: 340913 - DNA, 20 bp, Artificial
  CRISPR gRNA sequence
ggatttcagagaggaagctg

SEQ ID NO: 340914 - DNA, 20 bp, Artificial
  CRISPR gRNA sequence
atttcagagaggaagctgga

SEQ ID NO: 340915 - DNA, 20 bp, Artificial
  CRISPR gRNA sequence
gagaggaagctggagagctg

SEQ ID NO: 340916 - DNA, 20 bp, Artificial
  CRISPR gRNA sequence
agaggaagctggagagctgc

SEQ ID NO: 340917 - DNA, 20 bp, Artificial
  CRISPR gRNA sequence
gaggaagctggagagctgca

SEQ ID NO: 340918 - DNA, 20 bp, Artificial
  CRISPR gRNA sequence
gaagctggagagctgcaggg

SEQ ID NO: 340919 - DNA, 20 bp, Artificial
  CRISPR gRNA sequence
actttattttgcccgtcttg

SEQ ID NO: 340920 - DNA, 20 bp, Artificial
  CRISPR gRNA sequence
tttgcccgtcttgtagcatg

SEQ ID NO: 340921 - DNA, 20 bp, Artificial
  CRISPR gRNA sequence
ttgcccgtcttgtagcatgt

SEQ ID NO: 340922 - DNA, 20 bp, Artificial
  CRISPR gRNA sequence
tgtagcatgtgggtctttcg

SEQ ID NO: 340923 - DNA, 20 bp, Artificial
  CRISPR gRNA sequence
agcatgtgggtctttcgcag

SEQ ID NO: 340924 - DNA, 20 bp, Artificial
  CRISPR gRNA sequence
gcatgtgggtctttcgcagc

SEQ ID NO: 340925 - DNA, 20 bp, Artificial
  CRISPR gRNA sequence
tgtgggtctttcgcagcagg

SEQ ID NO: 340926 - DNA, 20 bp, Artificial
  CRISPR gRNA sequence
caggaagtgtgttttacaac

SEQ ID NO: 340927 - DNA, 20 bp, Artificial
  CRISPR gRNA sequence
ggaagtgtgttttacaacca

SEQ ID NO: 340928 - DNA, 20 bp, Artificial
  CRISPR gRNA sequence
ccagagcccccgccctcctg

SEQ ID NO: 340929 - DNA, 20 bp, Artificial
  CRISPR gRNA sequence
gcccccgccctcctgcagcg

SEQ ID NO: 340930 - DNA, 20 bp, Artificial
  CRISPR gRNA sequence
cccccgccctcctgcagcgc

SEQ ID NO: 340931 - DNA, 20 bp, Artificial
  CRISPR gRNA sequence
gccctcctgcagcgcaggcg

SEQ ID NO: 340932 - DNA, 20 bp, Artificial
  CRISPR gRNA sequence
tcctgcagcgcaggcgcagc

SEQ ID NO: 340933 - DNA, 20 bp, Artificial
  CRISPR gRNA sequence
gcagcgcaggcgcagctggc

SEQ ID NO: 340934 - DNA, 20 bp, Artificial
  CRISPR gRNA sequence
cagcgcaggcgcagctggct

SEQ ID NO: 340935 - DNA, 20 bp, Artificial
  CRISPR gRNA sequence
atatttgtcctcgtccctgc

SEQ ID NO: 340936 - DNA, 20 bp, Artificial
  CRISPR gRNA sequence
tcgtccctgccagtctcgaa

SEQ ID NO: 340937 - DNA, 20 bp, Artificial
  CRISPR gRNA sequence
cgtccctgccagtctcgaaa

SEQ ID NO: 340938 - DNA, 20 bp, Artificial
  CRISPR gRNA sequence
ggcactctgtcacgtgtaca

SEQ ID NO: 340939 - DNA, 20 bp, Artificial
  CRISPR gRNA sequence
gcactctgtcacgtgtacac

SEQ ID NO: 340940 - DNA, 20 bp, Artificial
  CRISPR gRNA sequence
tctgtcacgtgtacacagga

SEQ ID NO: 340941 - DNA, 20 bp, Artificial
  CRISPR gRNA sequence
ctgtcacgtgtacacaggaa

SEQ ID NO: 340942 - DNA, 20 bp, Artificial
  CRISPR gRNA sequence
tgtcacgtgtacacaggaaa

SEQ ID NO: 340943 - DNA, 20 bp, Artificial
  CRISPR gRNA sequence
acacaggaaagggccctgac

SEQ ID NO: 340944 - DNA, 20 bp, Artificial
  CRISPR gRNA sequence
acaggaaagggccctgacaa

SEQ ID NO: 340945 - DNA, 20 bp, Artificial
  CRISPR gRNA sequence
caggaaagggccctgacaag

SEQ ID NO: 340946 - DNA, 20 bp, Artificial
  CRISPR gRNA sequence
aaagggccctgacaagagga

SEQ ID NO: 340947 - DNA, 20 bp, Artificial
  CRISPR gRNA sequence
aagggccctgacaagaggat

SEQ ID NO: 340948 - DNA, 20 bp, Artificial
  CRISPR gRNA sequence
ctgacaagaggatgggactg

SEQ ID NO: 340949 - DNA, 20 bp, Artificial
  CRISPR gRNA sequence
agaggatgggactgcagttg

SEQ ID NO: 340950 - DNA, 20 bp, Artificial
  CRISPR gRNA sequence
gggactgcagttgtggctgc

SEQ ID NO: 340951 - DNA, 20 bp, Artificial
  CRISPR gRNA sequence
ggactgcagttgtggctgcc

SEQ ID NO: 340952 - DNA, 20 bp, Artificial
  CRISPR gRNA sequence
tgccaggtctcactctccct

SEQ ID NO: 340953 - DNA, 20 bp, Artificial
  CRISPR gRNA sequence
aggtctcactctcccttgga

SEQ ID NO: 340954 - DNA, 20 bp, Artificial
  CRISPR gRNA sequence
ctcactctcccttggatggt

SEQ ID NO: 340955 - DNA, 20 bp, Artificial
  CRISPR gRNA sequence
actctcccttggatggtcgg

SEQ ID NO: 340956 - DNA, 20 bp, Artificial
  CRISPR gRNA sequence
ctctcccttggatggtcggc

SEQ ID NO: 340957 - DNA, 20 bp, Artificial
  CRISPR gRNA sequence
tctcccttggatggtcggcg

SEQ ID NO: 340958 - DNA, 20 bp, Artificial
  CRISPR gRNA sequence
cccttggatggtcggcgggg

SEQ ID NO: 340959 - DNA, 20 bp, Artificial
  CRISPR gRNA sequence
ccttggatggtcggcggggt

SEQ ID NO: 340960 - DNA, 20 bp, Artificial
  CRISPR gRNA sequence
cttggatggtcggcggggtg

SEQ ID NO: 340961 - DNA, 20 bp, Artificial
  CRISPR gRNA sequence
ttggatggtcggcggggtgg

SEQ ID NO: 340962 - DNA, 20 bp, Artificial
  CRISPR gRNA sequence
gatggtcggcggggtggggg

SEQ ID NO: 340963 - DNA, 20 bp, Artificial
  CRISPR gRNA sequence
tggtcggcggggtgggggtg

SEQ ID NO: 340964 - DNA, 20 bp, Artificial
  CRISPR gRNA sequence
ggtcggcggggtgggggtgg

SEQ ID NO: 340965 - DNA, 20 bp, Artificial
  CRISPR gRNA sequence
ggcggggtgggggtggaggc

SEQ ID NO: 340966 - DNA, 20 bp, Artificial
  CRISPR gRNA sequence
gcggggtgggggtggaggcc

SEQ ID NO: 340967 - DNA, 20 bp, Artificial
  CRISPR gRNA sequence
cggggtgggggtggaggcca

SEQ ID NO: 340968 - DNA, 20 bp, Artificial
  CRISPR gRNA sequence
gggggtggaggccagggctg

SEQ ID NO: 340969 - DNA, 20 bp, Artificial
  CRISPR gRNA sequence
tggaggccagggctgtagtg

SEQ ID NO: 340970 - DNA, 20 bp, Artificial
  CRISPR gRNA sequence
gggctgtagtgcagctcccg

SEQ ID NO: 340971 - DNA, 20 bp, Artificial
  CRISPR gRNA sequence
ggctgtagtgcagctcccgc

SEQ ID NO: 340972 - DNA, 20 bp, Artificial
  CRISPR gRNA sequence
agtgcagctcccgcaggtgc

SEQ ID NO: 340973 - DNA, 20 bp, Artificial
  CRISPR gRNA sequence
agctcccgcaggtgctggct

SEQ ID NO: 340974 - DNA, 20 bp, Artificial
  CRISPR gRNA sequence
gctcccgcaggtgctggctc

SEQ ID NO: 340975 - DNA, 20 bp, Artificial
  CRISPR gRNA sequence
ctcccgcaggtgctggctca

SEQ ID NO: 340976 - DNA, 20 bp, Artificial
  CRISPR gRNA sequence
tcccgcaggtgctggctcag

SEQ ID NO: 340977 - DNA, 20 bp, Artificial
  CRISPR gRNA sequence
cccgcaggtgctggctcagg

SEQ ID NO: 340978 - DNA, 20 bp, Artificial
  CRISPR gRNA sequence
cgcaggtgctggctcagggg

SEQ ID NO: 340979 - DNA, 20 bp, Artificial
  CRISPR gRNA sequence
aggtgctggctcagggggag

SEQ ID NO: 340980 - DNA, 20 bp, Artificial
  CRISPR gRNA sequence
ggtgctggctcagggggagc

SEQ ID NO: 340981 - DNA, 20 bp, Artificial
  CRISPR gRNA sequence
gctggctcagggggagcagg

SEQ ID NO: 340982 - DNA, 20 bp, Artificial
  CRISPR gRNA sequence
ctggctcagggggagcaggc

SEQ ID NO: 340983 - DNA, 20 bp, Artificial
  CRISPR gRNA sequence
cagggggagcaggcaggctc

SEQ ID NO: 340984 - DNA, 20 bp, Artificial
  CRISPR gRNA sequence
agcaggcaggctccggtttt

SEQ ID NO: 340985 - DNA, 20 bp, Artificial
  CRISPR gRNA sequence
ccggttttcggtaatcctcc

SEQ ID NO: 340986 - DNA, 20 bp, Artificial
  CRISPR gRNA sequence
ttttcggtaatcctcctgga

SEQ ID NO: 340987 - DNA, 20 bp, Artificial
  CRISPR gRNA sequence
tttcggtaatcctcctggat

SEQ ID NO: 340988 - DNA, 20 bp, Artificial
  CRISPR gRNA sequence
ttcggtaatcctcctggatg

SEQ ID NO: 340989 - DNA, 20 bp, Artificial
  CRISPR gRNA sequence
gtaatcctcctggatgggga

SEQ ID NO: 340990 - DNA, 20 bp, Artificial
  CRISPR gRNA sequence
ggtgctgccctcctcctccc

SEQ ID NO: 340991 - DNA, 20 bp, Artificial
  CRISPR gRNA sequence
gtgctgccctcctcctccct

SEQ ID NO: 340992 - DNA, 20 bp, Artificial
  CRISPR gRNA sequence
tgctgccctcctcctccctg

SEQ ID NO: 340993 - DNA, 20 bp, Artificial
  CRISPR gRNA sequence
tgccctcctcctccctgggg

SEQ ID NO: 340994 - DNA, 20 bp, Artificial
  CRISPR gRNA sequence
cctggggcagctgtaatgac

SEQ ID NO: 340995 - DNA, 20 bp, Artificial
  CRISPR gRNA sequence
ctggggcagctgtaatgaca

SEQ ID NO: 340996 - DNA, 20 bp, Artificial
  CRISPR gRNA sequence
gctgtaatgacaaggctctg

SEQ ID NO: 340997 - DNA, 20 bp, Artificial
  CRISPR gRNA sequence
ctgtaatgacaaggctctgc

SEQ ID NO: 340998 - DNA, 20 bp, Artificial
  CRISPR gRNA sequence
acaaggctctgcaggctcca

SEQ ID NO: 340999 - DNA, 20 bp, Artificial
  CRISPR gRNA sequence
caaggctctgcaggctccac

SEQ ID NO: 341000 - DNA, 20 bp, Artificial
  CRISPR gRNA sequence
aggactttctcctttgtctg

SEQ ID NO: 341001 - DNA, 20 bp, Artificial
  CRISPR gRNA sequence
actttctcctttgtctgcag

SEQ ID NO: 341002 - DNA, 20 bp, Artificial
  CRISPR gRNA sequence
ctttctcctttgtctgcaga

SEQ ID NO: 341003 - DNA, 20 bp, Artificial
  CRISPR gRNA sequence
ttctcctttgtctgcagaag

SEQ ID NO: 341004 - DNA, 20 bp, Artificial
  CRISPR gRNA sequence
tctgcagaaggagatccgat

SEQ ID NO: 341005 - DNA, 20 bp, Artificial
  CRISPR gRNA sequence
gaaggagatccgatgagtct

SEQ ID NO: 341006 - DNA, 20 bp, Artificial
  CRISPR gRNA sequence
gagatccgatgagtcttggc

SEQ ID NO: 341007 - DNA, 20 bp, Artificial
  CRISPR gRNA sequence
atccgatgagtcttggccag

SEQ ID NO: 341008 - DNA, 20 bp, Artificial
  CRISPR gRNA sequence
cgatgagtcttggccagcag

SEQ ID NO: 341009 - DNA, 20 bp, Artificial
  CRISPR gRNA sequence
gatgagtcttggccagcagt

SEQ ID NO: 341010 - DNA, 20 bp, Artificial
  CRISPR gRNA sequence
atgagtcttggccagcagtg

SEQ ID NO: 341011 - DNA, 20 bp, Artificial
  CRISPR gRNA sequence
tgagtcttggccagcagtgg

SEQ ID NO: 341012 - DNA, 20 bp, Artificial
  CRISPR gRNA sequence
gtcttggccagcagtggggg

SEQ ID NO: 341013 - DNA, 20 bp, Artificial
  CRISPR gRNA sequence
tcttggccagcagtgggggc

SEQ ID NO: 341014 - DNA, 20 bp, Artificial
  CRISPR gRNA sequence
cttggccagcagtgggggca

SEQ ID NO: 341015 - DNA, 20 bp, Artificial
  CRISPR gRNA sequence
ttggccagcagtgggggcag

SEQ ID NO: 341016 - DNA, 20 bp, Artificial
  CRISPR gRNA sequence
tggccagcagtgggggcagg

SEQ ID NO: 341017 - DNA, 20 bp, Artificial
  CRISPR gRNA sequence
gccagcagtgggggcagggg

SEQ ID NO: 341018 - DNA, 20 bp, Artificial
  CRISPR gRNA sequence
gcagtgggggcagggggaga

SEQ ID NO: 341019 - DNA, 20 bp, Artificial
  CRISPR gRNA sequence
cagtgggggcagggggagac

SEQ ID NO: 341020 - DNA, 20 bp, Artificial
  CRISPR gRNA sequence
gtgggggcagggggagacgg

SEQ ID NO: 341021 - DNA, 20 bp, Artificial
  CRISPR gRNA sequence
ggggcagggggagacgggag

SEQ ID NO: 341022 - DNA, 20 bp, Artificial
  CRISPR gRNA sequence
gggcagggggagacgggaga

SEQ ID NO: 341023 - DNA, 20 bp, Artificial
  CRISPR gRNA sequence
gcagggggagacgggagaag

SEQ ID NO: 341024 - DNA, 20 bp, Artificial
  CRISPR gRNA sequence
ggggagacgggagaaggaga

SEQ ID NO: 341025 - DNA, 20 bp, Artificial
  CRISPR gRNA sequence
gggagacgggagaaggagat

SEQ ID NO: 341026 - DNA, 20 bp, Artificial
  CRISPR gRNA sequence
agacgggagaaggagatggg

SEQ ID NO: 341027 - DNA, 20 bp, Artificial
  CRISPR gRNA sequence
acgggagaaggagatgggta

SEQ ID NO: 341028 - DNA, 20 bp, Artificial
  CRISPR gRNA sequence
cgggagaaggagatgggtag

SEQ ID NO: 341029 - DNA, 20 bp, Artificial
  CRISPR gRNA sequence
gagaaggagatgggtagagg

SEQ ID NO: 341030 - DNA, 20 bp, Artificial
  CRISPR gRNA sequence
agaaggagatgggtagaggc

SEQ ID NO: 341031 - DNA, 20 bp, Artificial
  CRISPR gRNA sequence
tgggtagaggcgggtgcgct

SEQ ID NO: 341032 - DNA, 20 bp, Artificial
  CRISPR gRNA sequence
gggtagaggcgggtgcgctt

SEQ ID NO: 341033 - DNA, 20 bp, Artificial
  CRISPR gRNA sequence
ggtagaggcgggtgcgcttg

SEQ ID NO: 341034 - DNA, 20 bp, Artificial
  CRISPR gRNA sequence
gtagaggcgggtgcgcttgg

SEQ ID NO: 341035 - DNA, 20 bp, Artificial
  CRISPR gRNA sequence
agaggcgggtgcgcttgggg

SEQ ID NO: 341036 - DNA, 20 bp, Artificial
  CRISPR gRNA sequence
gaggcgggtgcgcttggggg

SEQ ID NO: 341037 - DNA, 20 bp, Artificial
  CRISPR gRNA sequence
aggcgggtgcgcttggggga

SEQ ID NO: 341038 - DNA, 20 bp, Artificial
  CRISPR gRNA sequence
ggcgggtgcgcttgggggag

SEQ ID NO: 341039 - DNA, 20 bp, Artificial
  CRISPR gRNA sequence
tgcgcttgggggaggggtgt

SEQ ID NO: 341040 - DNA, 20 bp, Artificial
  CRISPR gRNA sequence
gcgcttgggggaggggtgtc

SEQ ID NO: 341041 - DNA, 20 bp, Artificial
  CRISPR gRNA sequence
gcttgggggaggggtgtcag

SEQ ID NO: 341042 - DNA, 20 bp, Artificial
  CRISPR gRNA sequence
gaggggtgtcaggagcacgc

SEQ ID NO: 341043 - DNA, 20 bp, Artificial
  CRISPR gRNA sequence
gtgtcaggagcacgccagct

SEQ ID NO: 341044 - DNA, 20 bp, Artificial
  CRISPR gRNA sequence
tgtcaggagcacgccagcta

SEQ ID NO: 341045 - DNA, 20 bp, Artificial
  CRISPR gRNA sequence
gtcaggagcacgccagctaa

SEQ ID NO: 341046 - DNA, 20 bp, Artificial
  CRISPR gRNA sequence
tcaggagcacgccagctaag

SEQ ID NO: 341047 - DNA, 20 bp, Artificial
  CRISPR gRNA sequence
aggagcacgccagctaaggg

SEQ ID NO: 341048 - DNA, 20 bp, Artificial
  CRISPR gRNA sequence
gagcacgccagctaagggga

SEQ ID NO: 341049 - DNA, 20 bp, Artificial
  CRISPR gRNA sequence
cacgccagctaaggggagag

SEQ ID NO: 341050 - DNA, 20 bp, Artificial
  CRISPR gRNA sequence
acgccagctaaggggagaga

SEQ ID NO: 341051 - DNA, 20 bp, Artificial
  CRISPR gRNA sequence
cgccagctaaggggagagaa

SEQ ID NO: 341052 - DNA, 20 bp, Artificial
  CRISPR gRNA sequence
gccagctaaggggagagaag

SEQ ID NO: 341053 - DNA, 20 bp, Artificial
  CRISPR gRNA sequence
agctaaggggagagaagggg

SEQ ID NO: 341054 - DNA, 20 bp, Artificial
  CRISPR gRNA sequence
gctaaggggagagaaggggt

SEQ ID NO: 341055 - DNA, 20 bp, Artificial
  CRISPR gRNA sequence
gggagagaaggggtaggacc

SEQ ID NO: 341056 - DNA, 20 bp, Artificial
  CRISPR gRNA sequence
ggagagaaggggtaggacca

SEQ ID NO: 341057 - DNA, 20 bp, Artificial
  CRISPR gRNA sequence
agaaggggtaggaccaaggc

SEQ ID NO: 341058 - DNA, 20 bp, Artificial
  CRISPR gRNA sequence
gggtaggaccaaggctggtg

SEQ ID NO: 341059 - DNA, 20 bp, Artificial
  CRISPR gRNA sequence
taggaccaaggctggtgaag

SEQ ID NO: 341060 - DNA, 20 bp, Artificial
  CRISPR gRNA sequence
ggaccaaggctggtgaagtg

SEQ ID NO: 341061 - DNA, 20 bp, Artificial
  CRISPR gRNA sequence
caaggctggtgaagtggagc

SEQ ID NO: 341062 - DNA, 20 bp, Artificial
  CRISPR gRNA sequence
ggctggtgaagtggagctgg

SEQ ID NO: 341063 - DNA, 20 bp, Artificial
  CRISPR gRNA sequence
gctggtgaagtggagctggt

SEQ ID NO: 341064 - DNA, 20 bp, Artificial
  CRISPR gRNA sequence
gaagtggagctggtgggttt

SEQ ID NO: 341065 - DNA, 20 bp, Artificial
  CRISPR gRNA sequence
tggagctggtgggtttcagt

SEQ ID NO: 341066 - DNA, 20 bp, Artificial
  CRISPR gRNA sequence
ggtgggtttcagtgagattc

SEQ ID NO: 341067 - DNA, 20 bp, Artificial
  CRISPR gRNA sequence
gtgggtttcagtgagattcc

SEQ ID NO: 341068 - DNA, 20 bp, Artificial
  CRISPR gRNA sequence
tttcagtgagattccaggcg

SEQ ID NO: 341069 - DNA, 20 bp, Artificial
  CRISPR gRNA sequence
ttcagtgagattccaggcgt

SEQ ID NO: 341070 - DNA, 20 bp, Artificial
  CRISPR gRNA sequence
agtgagattccaggcgtggg

SEQ ID NO: 341071 - DNA, 20 bp, Artificial
  CRISPR gRNA sequence
gagattccaggcgtgggcag

SEQ ID NO: 341072 - DNA, 20 bp, Artificial
  CRISPR gRNA sequence
agattccaggcgtgggcagt

SEQ ID NO: 341073 - DNA, 20 bp, Artificial
  CRISPR gRNA sequence
gattccaggcgtgggcagtg

SEQ ID NO: 341074 - DNA, 20 bp, Artificial
  CRISPR gRNA sequence
caggcgtgggcagtggggtt

SEQ ID NO: 341075 - DNA, 20 bp, Artificial
  CRISPR gRNA sequence
cgtgggcagtggggttgagc

SEQ ID NO: 341076 - DNA, 20 bp, Artificial
  CRISPR gRNA sequence
gggcagtggggttgagccag

SEQ ID NO: 341077 - DNA, 20 bp, Artificial
  CRISPR gRNA sequence
ggcagtggggttgagccagt

SEQ ID NO: 341078 - DNA, 20 bp, Artificial
  CRISPR gRNA sequence
gcagtggggttgagccagtg

SEQ ID NO: 341079 - DNA, 20 bp, Artificial
  CRISPR gRNA sequence
ggggttgagccagtggggtg

SEQ ID NO: 341080 - DNA, 20 bp, Artificial
  CRISPR gRNA sequence
tgagccagtggggtgtggtg

SEQ ID NO: 341081 - DNA, 20 bp, Artificial
  CRISPR gRNA sequence
gagccagtggggtgtggtgc

SEQ ID NO: 341082 - DNA, 20 bp, Artificial
  CRISPR gRNA sequence
agccagtggggtgtggtgca

SEQ ID NO: 341083 - DNA, 20 bp, Artificial
  CRISPR gRNA sequence
gccagtggggtgtggtgcag

SEQ ID NO: 341084 - DNA, 20 bp, Artificial
  CRISPR gRNA sequence
agtggggtgtggtgcagggg

SEQ ID NO: 341085 - DNA, 20 bp, Artificial
  CRISPR gRNA sequence
gtggggtgtggtgcaggggc

SEQ ID NO: 341086 - DNA, 20 bp, Artificial
  CRISPR gRNA sequence
gtgtggtgcaggggcaggac

SEQ ID NO: 341087 - DNA, 20 bp, Artificial
  CRISPR gRNA sequence
gtggtgcaggggcaggaccg

SEQ ID NO: 341088 - DNA, 20 bp, Artificial
  CRISPR gRNA sequence
tggtgcaggggcaggaccgg

SEQ ID NO: 341089 - DNA, 20 bp, Artificial
  CRISPR gRNA sequence
atctatatttccttcgttga

SEQ ID NO: 341090 - DNA, 20 bp, Artificial
  CRISPR gRNA sequence
ctatatttccttcgttgatg

SEQ ID NO: 341091 - DNA, 20 bp, Artificial
  CRISPR gRNA sequence
tatatttccttcgttgatgg

SEQ ID NO: 341092 - DNA, 20 bp, Artificial
  CRISPR gRNA sequence
ttccttcgttgatggaggaa

SEQ ID NO: 341093 - DNA, 20 bp, Artificial
  CRISPR gRNA sequence
tccttcgttgatggaggaac

SEQ ID NO: 341094 - DNA, 20 bp, Artificial
  CRISPR gRNA sequence
ccttcgttgatggaggaaca

SEQ ID NO: 341095 - DNA, 20 bp, Artificial
  CRISPR gRNA sequence
ttgatggaggaacagggccc

SEQ ID NO: 341096 - DNA, 20 bp, Artificial
  CRISPR gRNA sequence
tggaggaacagggccccggc

SEQ ID NO: 341097 - DNA, 20 bp, Artificial
  CRISPR gRNA sequence
ggaggaacagggccccggcc

SEQ ID NO: 341098 - DNA, 20 bp, Artificial
  CRISPR gRNA sequence
gaggaacagggccccggcca

SEQ ID NO: 341099 - DNA, 20 bp, Artificial
  CRISPR gRNA sequence
gccccggccagggtgaaaac

SEQ ID NO: 341100 - DNA, 20 bp, Artificial
  CRISPR gRNA sequence
ccccggccagggtgaaaaca

SEQ ID NO: 341101 - DNA, 20 bp, Artificial
  CRISPR gRNA sequence
ggtgaaaacaaggaacattc

SEQ ID NO: 341102 - DNA, 20 bp, Artificial
  CRISPR gRNA sequence
tgaaaacaaggaacattcca

SEQ ID NO: 341103 - DNA, 20 bp, Artificial
  CRISPR gRNA sequence
aaacaaggaacattccagag

SEQ ID NO: 341104 - DNA, 20 bp, Artificial
  CRISPR gRNA sequence
aacattccagagaagatcac

SEQ ID NO: 341105 - DNA, 20 bp, Artificial
  CRISPR gRNA sequence
acattccagagaagatcaca

SEQ ID NO: 341106 - DNA, 20 bp, Artificial
  CRISPR gRNA sequence
cacaaggatgcgaataaaat

SEQ ID NO: 341107 - DNA, 20 bp, Artificial
  CRISPR gRNA sequence
caaggatgcgaataaaatcg

SEQ ID NO: 341108 - DNA, 20 bp, Artificial
  CRISPR gRNA sequence
cgaataaaatcggagctgca

SEQ ID NO: 341109 - DNA, 20 bp, Artificial
  CRISPR gRNA sequence
gaataaaatcggagctgcac

SEQ ID NO: 341110 - DNA, 20 bp, Artificial
  CRISPR gRNA sequence
aataaaatcggagctgcaca

SEQ ID NO: 341111 - DNA, 20 bp, Artificial
  CRISPR gRNA sequence
cggagctgcacagggatctt

SEQ ID NO: 341112 - DNA, 20 bp, Artificial
  CRISPR gRNA sequence
ggagctgcacagggatcttt

SEQ ID NO: 341113 - DNA, 20 bp, Artificial
  CRISPR gRNA sequence
cagggatctttgggctgtaa

SEQ ID NO: 341114 - DNA, 20 bp, Artificial
  CRISPR gRNA sequence
agggatctttgggctgtaat

SEQ ID NO: 341115 - DNA, 20 bp, Artificial
  CRISPR gRNA sequence
ggatctttgggctgtaatag

SEQ ID NO: 341116 - DNA, 20 bp, Artificial
  CRISPR gRNA sequence
gatctttgggctgtaatagg

SEQ ID NO: 341117 - DNA, 20 bp, Artificial
  CRISPR gRNA sequence
atctttgggctgtaatagga

SEQ ID NO: 341118 - DNA, 20 bp, Artificial
  CRISPR gRNA sequence
tctttgggctgtaataggag

SEQ ID NO: 341119 - DNA, 20 bp, Artificial
  CRISPR gRNA sequence
ctgtaataggaggggacaca

SEQ ID NO: 341120 - DNA, 20 bp, Artificial
  CRISPR gRNA sequence
tgtaataggaggggacacac

SEQ ID NO: 341121 - DNA, 20 bp, Artificial
  CRISPR gRNA sequence
gtaataggaggggacacaca

SEQ ID NO: 341122 - DNA, 20 bp, Artificial
  CRISPR gRNA sequence
taataggaggggacacacag

SEQ ID NO: 341123 - DNA, 20 bp, Artificial
  CRISPR gRNA sequence
aggaggggacacacaggggt

SEQ ID NO: 341124 - DNA, 20 bp, Artificial
  CRISPR gRNA sequence
ggaggggacacacaggggtt

SEQ ID NO: 341125 - DNA, 20 bp, Artificial
  CRISPR gRNA sequence
gaggggacacacaggggtta

SEQ ID NO: 341126 - DNA, 20 bp, Artificial
  CRISPR gRNA sequence
aggggacacacaggggttag

SEQ ID NO: 341127 - DNA, 20 bp, Artificial
  CRISPR gRNA sequence
gggacacacaggggttaggg

SEQ ID NO: 341128 - DNA, 20 bp, Artificial
  CRISPR gRNA sequence
ggacacacaggggttagggg

SEQ ID NO: 341129 - DNA, 20 bp, Artificial
  CRISPR gRNA sequence
gacacacaggggttagggga

SEQ ID NO: 341130 - DNA, 20 bp, Artificial
  CRISPR gRNA sequence
acaggggttaggggagggtc

SEQ ID NO: 341131 - DNA, 20 bp, Artificial
  CRISPR gRNA sequence
ttaggggagggtctagccct

SEQ ID NO: 341132 - DNA, 20 bp, Artificial
  CRISPR gRNA sequence
ggtctagcccttggctccct

SEQ ID NO: 341133 - DNA, 20 bp, Artificial
  CRISPR gRNA sequence
agcccttggctccctcagcc

SEQ ID NO: 341134 - DNA, 20 bp, Artificial
  CRISPR gRNA sequence
tctatcccacccgccaccgt

SEQ ID NO: 341135 - DNA, 20 bp, Artificial
  CRISPR gRNA sequence
tggccaactcctctcctaaa

SEQ ID NO: 341136 - DNA, 20 bp, Artificial
  CRISPR gRNA sequence
ccaactcctctcctaaacag

SEQ ID NO: 341137 - DNA, 20 bp, Artificial
  CRISPR gRNA sequence
cctcctcttatccctaatcc

SEQ ID NO: 341138 - DNA, 20 bp, Artificial
  CRISPR gRNA sequence
ctcctcttatccctaatcct

SEQ ID NO: 341139 - DNA, 20 bp, Artificial
  CRISPR gRNA sequence
cctcttatccctaatcctag

SEQ ID NO: 341140 - DNA, 20 bp, Artificial
  CRISPR gRNA sequence
aatcctaggagctttctgtc

SEQ ID NO: 341141 - DNA, 20 bp, Artificial
  CRISPR gRNA sequence
tttctgtctggcttccctcc

SEQ ID NO: 341142 - DNA, 20 bp, Artificial
  CRISPR gRNA sequence
cctcgtgtatgcattctctc

SEQ ID NO: 341143 - DNA, 20 bp, Artificial
  CRISPR gRNA sequence
cgtgtatgcattctctctag

SEQ ID NO: 341144 - DNA, 20 bp, Artificial
  CRISPR gRNA sequence
gtatgcattctctctagcgg

SEQ ID NO: 341145 - DNA, 20 bp, Artificial
  CRISPR gRNA sequence
tatgcattctctctagcggt

SEQ ID NO: 341146 - DNA, 20 bp, Artificial
  CRISPR gRNA sequence
atgcattctctctagcggtg

SEQ ID NO: 341147 - DNA, 20 bp, Artificial
  CRISPR gRNA sequence
tctctctagcggtggggatt

SEQ ID NO: 341148 - DNA, 20 bp, Artificial
  CRISPR gRNA sequence
ctctctagcggtggggatta

SEQ ID NO: 341149 - DNA, 20 bp, Artificial
  CRISPR gRNA sequence
ctctagcggtggggattaag

SEQ ID NO: 341150 - DNA, 20 bp, Artificial
  CRISPR gRNA sequence
gattaaggagaaaactcacg

SEQ ID NO: 341151 - DNA, 20 bp, Artificial
  CRISPR gRNA sequence
aaggagaaaactcacgtggc

SEQ ID NO: 341152 - DNA, 20 bp, Artificial
  CRISPR gRNA sequence
gagaaaactcacgtggccag

SEQ ID NO: 341153 - DNA, 20 bp, Artificial
  CRISPR gRNA sequence
agaaaactcacgtggccagt

SEQ ID NO: 341154 - DNA, 20 bp, Artificial
  CRISPR gRNA sequence
aaactcacgtggccagtggg

SEQ ID NO: 341155 - DNA, 20 bp, Artificial
  CRISPR gRNA sequence
actcacgtggccagtgggta

SEQ ID NO: 341156 - DNA, 20 bp, Artificial
  CRISPR gRNA sequence
tcacgtggccagtgggtaga

SEQ ID NO: 341157 - DNA, 20 bp, Artificial
  CRISPR gRNA sequence
acgtggccagtgggtagaga

SEQ ID NO: 341158 - DNA, 20 bp, Artificial
  CRISPR gRNA sequence
gccagtgggtagagagagtc

SEQ ID NO: 341159 - DNA, 20 bp, Artificial
  CRISPR gRNA sequence
ccagtgggtagagagagtcc

SEQ ID NO: 341160 - DNA, 20 bp, Artificial
  CRISPR gRNA sequence
gtgggtagagagagtccggg

SEQ ID NO: 341161 - DNA, 20 bp, Artificial
  CRISPR gRNA sequence
tgggtagagagagtccgggc

SEQ ID NO: 341162 - DNA, 20 bp, Artificial
  CRISPR gRNA sequence
gtagagagagtccgggcagg

SEQ ID NO: 341163 - DNA, 20 bp, Artificial
  CRISPR gRNA sequence
tccgggcaggcagctgcctg

SEQ ID NO: 341164 - DNA, 20 bp, Artificial
  CRISPR gRNA sequence
ggcaggcagctgcctgaagt

SEQ ID NO: 341165 - DNA, 20 bp, Artificial
  CRISPR gRNA sequence
ggcagctgcctgaagtcagc

SEQ ID NO: 341166 - DNA, 20 bp, Artificial
  CRISPR gRNA sequence
cagctgcctgaagtcagcca

SEQ ID NO: 341167 - DNA, 20 bp, Artificial
  CRISPR gRNA sequence
agccagagtctgcatgtgcc

SEQ ID NO: 341168 - DNA, 20 bp, Artificial
  CRISPR gRNA sequence
ctgcatgtgcccagctgtcc

SEQ ID NO: 341169 - DNA, 20 bp, Artificial
  CRISPR gRNA sequence
tgcccagctgtcctggcctc

SEQ ID NO: 341170 - DNA, 20 bp, Artificial
  CRISPR gRNA sequence
gtcctggcctccagcatctc

SEQ ID NO: 341171 - DNA, 20 bp, Artificial
  CRISPR gRNA sequence
ctccagcatctctggaaaaa

SEQ ID NO: 341172 - DNA, 20 bp, Artificial
  CRISPR gRNA sequence
ccagcatctctggaaaaaca

SEQ ID NO: 341173 - DNA, 20 bp, Artificial
  CRISPR gRNA sequence
catctctggaaaaacagaga

SEQ ID NO: 341174 - DNA, 20 bp, Artificial
  CRISPR gRNA sequence
tggaaaaacagagacagaat

SEQ ID NO: 341175 - DNA, 20 bp, Artificial
  CRISPR gRNA sequence
aaaaacagagacagaatgag

SEQ ID NO: 341176 - DNA, 20 bp, Artificial
  CRISPR gRNA sequence
aacagagacagaatgagtag

SEQ ID NO: 341177 - DNA, 20 bp, Artificial
  CRISPR gRNA sequence
agagacagaatgagtagcag

SEQ ID NO: 341178 - DNA, 20 bp, Artificial
  CRISPR gRNA sequence
gagacagaatgagtagcagc

SEQ ID NO: 341179 - DNA, 20 bp, Artificial
  CRISPR gRNA sequence
agacagaatgagtagcagca

SEQ ID NO: 341180 - DNA, 20 bp, Artificial
  CRISPR gRNA sequence
gacagaatgagtagcagcag

SEQ ID NO: 341181 - DNA, 20 bp, Artificial
  CRISPR gRNA sequence
agtagcagcaggggacccca

SEQ ID NO: 341182 - DNA, 20 bp, Artificial
  CRISPR gRNA sequence
gtagcagcaggggaccccat

SEQ ID NO: 341183 - DNA, 20 bp, Artificial
  CRISPR gRNA sequence
tagcagcaggggaccccata

SEQ ID NO: 341184 - DNA, 20 bp, Artificial
  CRISPR gRNA sequence
gaccccatagggcacatctg

SEQ ID NO: 341185 - DNA, 20 bp, Artificial
  CRISPR gRNA sequence
accccatagggcacatctga

SEQ ID NO: 341186 - DNA, 20 bp, Artificial
  CRISPR gRNA sequence
tagggcacatctgaaggcct

SEQ ID NO: 341187 - DNA, 20 bp, Artificial
  CRISPR gRNA sequence
gggcacatctgaaggcctga

SEQ ID NO: 341188 - DNA, 20 bp, Artificial
  CRISPR gRNA sequence
ggcacatctgaaggcctgag

SEQ ID NO: 341189 - DNA, 20 bp, Artificial
  CRISPR gRNA sequence
tctgaaggcctgagaggtgc

SEQ ID NO: 341190 - DNA, 20 bp, Artificial
  CRISPR gRNA sequence
aaggcctgagaggtgctgga

SEQ ID NO: 341191 - DNA, 20 bp, Artificial
  CRISPR gRNA sequence
aggcctgagaggtgctggat

SEQ ID NO: 341192 - DNA, 20 bp, Artificial
  CRISPR gRNA sequence
ctgagaggtgctggatggga

SEQ ID NO: 341193 - DNA, 20 bp, Artificial
  CRISPR gRNA sequence
tgagaggtgctggatgggat

SEQ ID NO: 341194 - DNA, 20 bp, Artificial
  CRISPR gRNA sequence
gaggtgctggatgggatggg

SEQ ID NO: 341195 - DNA, 20 bp, Artificial
  CRISPR gRNA sequence
aggtgctggatgggatggga

SEQ ID NO: 341196 - DNA, 20 bp, Artificial
  CRISPR gRNA sequence
tgctggatgggatgggaagg

SEQ ID NO: 341197 - DNA, 20 bp, Artificial
  CRISPR gRNA sequence
atgggatgggaaggcagaaa

SEQ ID NO: 341198 - DNA, 20 bp, Artificial
  CRISPR gRNA sequence
tgggatgggaaggcagaaac

SEQ ID NO: 341199 - DNA, 20 bp, Artificial
  CRISPR gRNA sequence
agaaacaggctgaccttatc

SEQ ID NO: 341200 - DNA, 20 bp, Artificial
  CRISPR gRNA sequence
gaaacaggctgaccttatct

SEQ ID NO: 341201 - DNA, 20 bp, Artificial
  CRISPR gRNA sequence
aaacaggctgaccttatcta

SEQ ID NO: 341202 - DNA, 20 bp, Artificial
  CRISPR gRNA sequence
aacaggctgaccttatctag

SEQ ID NO: 341203 - DNA, 20 bp, Artificial
  CRISPR gRNA sequence
aggctgaccttatctagggg

SEQ ID NO: 341204 - DNA, 20 bp, Artificial
  CRISPR gRNA sequence
ggctgaccttatctaggggt

SEQ ID NO: 341205 - DNA, 20 bp, Artificial
  CRISPR gRNA sequence
ctgaccttatctaggggtag

SEQ ID NO: 341206 - DNA, 20 bp, Artificial
  CRISPR gRNA sequence
accttatctaggggtaggag

SEQ ID NO: 341207 - DNA, 20 bp, Artificial
  CRISPR gRNA sequence
ccttatctaggggtaggagt

SEQ ID NO: 341208 - DNA, 20 bp, Artificial
  CRISPR gRNA sequence
cttatctaggggtaggagtg

SEQ ID NO: 341209 - DNA, 20 bp, Artificial
  CRISPR gRNA sequence
tatctaggggtaggagtggg

SEQ ID NO: 341210 - DNA, 20 bp, Artificial
  CRISPR gRNA sequence
ggggtaggagtggggagtac

SEQ ID NO: 341211 - DNA, 20 bp, Artificial
  CRISPR gRNA sequence
taggagtggggagtactggt

SEQ ID NO: 341212 - DNA, 20 bp, Artificial
  CRISPR gRNA sequence
aggagtggggagtactggtt

SEQ ID NO: 341213 - DNA, 20 bp, Artificial
  CRISPR gRNA sequence
ggagtggggagtactggttg

SEQ ID NO: 341214 - DNA, 20 bp, Artificial
  CRISPR gRNA sequence
atcaccgctaccccacgtga

SEQ ID NO: 341215 - DNA, 20 bp, Artificial
  CRISPR gRNA sequence
cgctaccccacgtgatggca

SEQ ID NO: 341216 - DNA, 20 bp, Artificial
  CRISPR gRNA sequence
ctaccccacgtgatggcaca

SEQ ID NO: 341217 - DNA, 20 bp, Artificial
  CRISPR gRNA sequence
accccacgtgatggcacaga

SEQ ID NO: 341218 - DNA, 20 bp, Artificial
  CRISPR gRNA sequence
tgatggcacagagagttgcc

SEQ ID NO: 341219 - DNA, 20 bp, Artificial
  CRISPR gRNA sequence
ctggaacttaccactgacat

SEQ ID NO: 341220 - DNA, 20 bp, Artificial
  CRISPR gRNA sequence
tggaacttaccactgacata

SEQ ID NO: 341221 - DNA, 20 bp, Artificial
  CRISPR gRNA sequence
acttaccactgacataaggt

SEQ ID NO: 341222 - DNA, 20 bp, Artificial
  CRISPR gRNA sequence
taccactgacataaggtaag

SEQ ID NO: 341223 - DNA, 20 bp, Artificial
  CRISPR gRNA sequence
accactgacataaggtaagt

SEQ ID NO: 341224 - DNA, 20 bp, Artificial
  CRISPR gRNA sequence
actgacataaggtaagtggg

SEQ ID NO: 341225 - DNA, 20 bp, Artificial
  CRISPR gRNA sequence
ctgacataaggtaagtgggt

SEQ ID NO: 341226 - DNA, 20 bp, Artificial
  CRISPR gRNA sequence
ataaggtaagtgggtgggct

SEQ ID NO: 341227 - DNA, 20 bp, Artificial
  CRISPR gRNA sequence
taaggtaagtgggtgggctg

SEQ ID NO: 341228 - DNA, 20 bp, Artificial
  CRISPR gRNA sequence
aaggtaagtgggtgggctga

SEQ ID NO: 341229 - DNA, 20 bp, Artificial
  CRISPR gRNA sequence
aagtgggtgggctgagggtg

SEQ ID NO: 341230 - DNA, 20 bp, Artificial
  CRISPR gRNA sequence
agtgggtgggctgagggtgt

SEQ ID NO: 341231 - DNA, 20 bp, Artificial
  CRISPR gRNA sequence
gtgggctgagggtgtgggct

SEQ ID NO: 341232 - DNA, 20 bp, Artificial
  CRISPR gRNA sequence
tgggctgagggtgtgggctc

SEQ ID NO: 341233 - DNA, 20 bp, Artificial
  CRISPR gRNA sequence
gggctgagggtgtgggctca

SEQ ID NO: 341234 - DNA, 20 bp, Artificial
  CRISPR gRNA sequence
agggtgtgggctcagggcct

SEQ ID NO: 341235 - DNA, 20 bp, Artificial
  CRISPR gRNA sequence
gctcagggcctgagacgacc

SEQ ID NO: 341236 - DNA, 20 bp, Artificial
  CRISPR gRNA sequence
cagggcctgagacgaccgag

SEQ ID NO: 341237 - DNA, 20 bp, Artificial
  CRISPR gRNA sequence
gcctgagacgaccgagcggt

SEQ ID NO: 341238 - DNA, 20 bp, Artificial
  CRISPR gRNA sequence
agacgaccgagcggtcagcg

SEQ ID NO: 341239 - DNA, 20 bp, Artificial
  CRISPR gRNA sequence
gacgaccgagcggtcagcga

SEQ ID NO: 341240 - DNA, 20 bp, Artificial
  CRISPR gRNA sequence
acgaccgagcggtcagcgaa

SEQ ID NO: 341241 - DNA, 20 bp, Artificial
  CRISPR gRNA sequence
cgagcggtcagcgaagggtt

SEQ ID NO: 341242 - DNA, 20 bp, Artificial
  CRISPR gRNA sequence
gcggtcagcgaagggtttgg

SEQ ID NO: 341243 - DNA, 20 bp, Artificial
  CRISPR gRNA sequence
ggtcagcgaagggtttggaa

SEQ ID NO: 341244 - DNA, 20 bp, Artificial
  CRISPR gRNA sequence
gtcagcgaagggtttggaag

SEQ ID NO: 341245 - DNA, 20 bp, Artificial
  CRISPR gRNA sequence
gtttggaagaggatcacact

SEQ ID NO: 341246 - DNA, 20 bp, Artificial
  CRISPR gRNA sequence
actccttgtccctgcactgc

SEQ ID NO: 341247 - DNA, 20 bp, Artificial
  CRISPR gRNA sequence
tgcactgccagccattgcga

SEQ ID NO: 341248 - DNA, 20 bp, Artificial
  CRISPR gRNA sequence
gcactgccagccattgcgac

SEQ ID NO: 341249 - DNA, 20 bp, Artificial
  CRISPR gRNA sequence
gccattgcgacaggcacact

SEQ ID NO: 341250 - DNA, 20 bp, Artificial
  CRISPR gRNA sequence
gcgacaggcacactcagcat

SEQ ID NO: 341251 - DNA, 20 bp, Artificial
  CRISPR gRNA sequence
acaggcacactcagcattgg

SEQ ID NO: 341252 - DNA, 20 bp, Artificial
  CRISPR gRNA sequence
acactcagcattggcagtga

SEQ ID NO: 341253 - DNA, 20 bp, Artificial
  CRISPR gRNA sequence
cagcattggcagtgatggtg

SEQ ID NO: 341254 - DNA, 20 bp, Artificial
  CRISPR gRNA sequence
gtgatggtgcagttgcgaac

SEQ ID NO: 341255 - DNA, 20 bp, Artificial
  CRISPR gRNA sequence
atggtgcagttgcgaacgag

SEQ ID NO: 341256 - DNA, 20 bp, Artificial
  CRISPR gRNA sequence
cagttgcgaacgagaagacc

SEQ ID NO: 341257 - DNA, 20 bp, Artificial
  CRISPR gRNA sequence
agttgcgaacgagaagacct

SEQ ID NO: 341258 - DNA, 20 bp, Artificial
  CRISPR gRNA sequence
gttgcgaacgagaagacctg

SEQ ID NO: 341259 - DNA, 20 bp, Artificial
  CRISPR gRNA sequence
ttgcgaacgagaagacctgg

SEQ ID NO: 341260 - DNA, 20 bp, Artificial
  CRISPR gRNA sequence
cgaacgagaagacctggggg

SEQ ID NO: 341261 - DNA, 20 bp, Artificial
  CRISPR gRNA sequence
aacgagaagacctgggggaa

SEQ ID NO: 341262 - DNA, 20 bp, Artificial
  CRISPR gRNA sequence
cgagaagacctgggggaaga

SEQ ID NO: 341263 - DNA, 20 bp, Artificial
  CRISPR gRNA sequence
gagaagacctgggggaagag

SEQ ID NO: 341264 - DNA, 20 bp, Artificial
  CRISPR gRNA sequence
gacctgggggaagagaggcc

SEQ ID NO: 341265 - DNA, 20 bp, Artificial
  CRISPR gRNA sequence
acctgggggaagagaggccc

SEQ ID NO: 341266 - DNA, 20 bp, Artificial
  CRISPR gRNA sequence
cctgggggaagagaggccca

SEQ ID NO: 341267 - DNA, 20 bp, Artificial
  CRISPR gRNA sequence
tgggggaagagaggcccagg

SEQ ID NO: 341268 - DNA, 20 bp, Artificial
  CRISPR gRNA sequence
gaagagaggcccagggagca

SEQ ID NO: 341269 - DNA, 20 bp, Artificial
  CRISPR gRNA sequence
aagagaggcccagggagcat

SEQ ID NO: 341270 - DNA, 20 bp, Artificial
  CRISPR gRNA sequence
cccagggagcataggacact

SEQ ID NO: 341271 - DNA, 20 bp, Artificial
  CRISPR gRNA sequence
gcataggacactcagacctg

SEQ ID NO: 341272 - DNA, 20 bp, Artificial
  CRISPR gRNA sequence
ataggacactcagacctgtg

SEQ ID NO: 341273 - DNA, 20 bp, Artificial
  CRISPR gRNA sequence
tcagacctgtggagaccttc

SEQ ID NO: 341274 - DNA, 20 bp, Artificial
  CRISPR gRNA sequence
cagacctgtggagaccttca

SEQ ID NO: 341275 - DNA, 20 bp, Artificial
  CRISPR gRNA sequence
tcatcccccaacccccatcc

SEQ ID NO: 341276 - DNA, 20 bp, Artificial
  CRISPR gRNA sequence
catcccccaacccccatccc

SEQ ID NO: 341277 - DNA, 20 bp, Artificial
  CRISPR gRNA sequence
ccccatcccaggcccacctc

SEQ ID NO: 341278 - DNA, 20 bp, Artificial
  CRISPR gRNA sequence
cccatcccaggcccacctct

SEQ ID NO: 341279 - DNA, 20 bp, Artificial
  CRISPR gRNA sequence
ccatcccaggcccacctcta

SEQ ID NO: 341280 - DNA, 20 bp, Artificial
  CRISPR gRNA sequence
tttccattcccacccctgca

SEQ ID NO: 341281 - DNA, 20 bp, Artificial
  CRISPR gRNA sequence
ttccattcccacccctgcaa

SEQ ID NO: 341282 - DNA, 20 bp, Artificial
  CRISPR gRNA sequence
aaaggcctgccctttgctca

SEQ ID NO: 341283 - DNA, 20 bp, Artificial
  CRISPR gRNA sequence
tgccattattattgttatta

SEQ ID NO: 341284 - DNA, 20 bp, Artificial
  CRISPR gRNA sequence
cattattattgttattaaag

SEQ ID NO: 341285 - DNA, 20 bp, Artificial
  CRISPR gRNA sequence
attattgttattaaagaaga

SEQ ID NO: 341286 - DNA, 20 bp, Artificial
  CRISPR gRNA sequence
ttgttattaaagaagaaagt

SEQ ID NO: 341287 - DNA, 20 bp, Artificial
  CRISPR gRNA sequence
aagaagaaagttggaccttt

SEQ ID NO: 341288 - DNA, 20 bp, Artificial
  CRISPR gRNA sequence
aagaaagttggacctttcag

SEQ ID NO: 341289 - DNA, 20 bp, Artificial
  CRISPR gRNA sequence
agaaagttggacctttcaga

SEQ ID NO: 341290 - DNA, 20 bp, Artificial
  CRISPR gRNA sequence
aagttggacctttcagaagg

SEQ ID NO: 341291 - DNA, 20 bp, Artificial
  CRISPR gRNA sequence
cctttcagaaggaagattca

SEQ ID NO: 341292 - DNA, 20 bp, Artificial
  CRISPR gRNA sequence
ctttcagaaggaagattcat

SEQ ID NO: 341293 - DNA, 20 bp, Artificial
  CRISPR gRNA sequence
agaaggaagattcatgggtt

SEQ ID NO: 341294 - DNA, 20 bp, Artificial
  CRISPR gRNA sequence
aagattcatgggttcagaca

SEQ ID NO: 341295 - DNA, 20 bp, Artificial
  CRISPR gRNA sequence
tcagacatagaaaccatgaa

SEQ ID NO: 341296 - DNA, 20 bp, Artificial
  CRISPR gRNA sequence
gacatagaaaccatgaaaag

SEQ ID NO: 341297 - DNA, 20 bp, Artificial
  CRISPR gRNA sequence
tagaaaccatgaaaagtaga

SEQ ID NO: 341298 - DNA, 20 bp, Artificial
  CRISPR gRNA sequence
gaaaccatgaaaagtagaaa

SEQ ID NO: 341299 - DNA, 20 bp, Artificial
  CRISPR gRNA sequence
tattttttatttattttttt

SEQ ID NO: 341300 - DNA, 20 bp, Artificial
  CRISPR gRNA sequence
ttttatttatttttttgaga

SEQ ID NO: 341301 - DNA, 20 bp, Artificial
  CRISPR gRNA sequence
ttatttatttttttgagatg

SEQ ID NO: 341302 - DNA, 20 bp, Artificial
  CRISPR gRNA sequence
ggagtctcgctcttgttgcc

SEQ ID NO: 341303 - DNA, 20 bp, Artificial
  CRISPR gRNA sequence
gagtctcgctcttgttgccg

SEQ ID NO: 341304 - DNA, 20 bp, Artificial
  CRISPR gRNA sequence
ctcgctcttgttgccgaggc

SEQ ID NO: 341305 - DNA, 20 bp, Artificial
  CRISPR gRNA sequence
cgctcttgttgccgaggctg

SEQ ID NO: 341306 - DNA, 20 bp, Artificial
  CRISPR gRNA sequence
ttgccgaggctggagtgcaa

SEQ ID NO: 341307 - DNA, 20 bp, Artificial
  CRISPR gRNA sequence
ggagtgcaatggcgtgacct

SEQ ID NO: 341308 - DNA, 20 bp, Artificial
  CRISPR gRNA sequence
tcgttgcaacctctgcctcc

SEQ ID NO: 341309 - DNA, 20 bp, Artificial
  CRISPR gRNA sequence
cgttgcaacctctgcctccc

SEQ ID NO: 341310 - DNA, 20 bp, Artificial
  CRISPR gRNA sequence
aacctctgcctcccgggttc

SEQ ID NO: 341311 - DNA, 20 bp, Artificial
  CRISPR gRNA sequence
ttcaagcaattctcctgcct

SEQ ID NO: 341312 - DNA, 20 bp, Artificial
  CRISPR gRNA sequence
ttctcctgcctcagcctccc

SEQ ID NO: 341313 - DNA, 20 bp, Artificial
  CRISPR gRNA sequence
tcctgcctcagcctcccaag

SEQ ID NO: 341314 - DNA, 20 bp, Artificial
  CRISPR gRNA sequence
gcctcagcctcccaagtagc

SEQ ID NO: 341315 - DNA, 20 bp, Artificial
  CRISPR gRNA sequence
cctcagcctcccaagtagct

SEQ ID NO: 341316 - DNA, 20 bp, Artificial
  CRISPR gRNA sequence
ctcccaagtagctgggatta

SEQ ID NO: 341317 - DNA, 20 bp, Artificial
  CRISPR gRNA sequence
tcccaagtagctgggattac

SEQ ID NO: 341318 - DNA, 20 bp, Artificial
  CRISPR gRNA sequence
caggtgtgtgccaccacacc

SEQ ID NO: 341319 - DNA, 20 bp, Artificial
  CRISPR gRNA sequence
cggctaattttttgtatttt

SEQ ID NO: 341320 - DNA, 20 bp, Artificial
  CRISPR gRNA sequence
ctaattttttgtatttttag

SEQ ID NO: 341321 - DNA, 20 bp, Artificial
  CRISPR gRNA sequence
aattttttgtatttttagta

SEQ ID NO: 341322 - DNA, 20 bp, Artificial
  CRISPR gRNA sequence
ttttgtatttttagtagaga

SEQ ID NO: 341323 - DNA, 20 bp, Artificial
  CRISPR gRNA sequence
tttgtatttttagtagagac

SEQ ID NO: 341324 - DNA, 20 bp, Artificial
  CRISPR gRNA sequence
ttgtatttttagtagagacg

SEQ ID NO: 341325 - DNA, 20 bp, Artificial
  CRISPR gRNA sequence
gagacggggttttactgtat

SEQ ID NO: 341326 - DNA, 20 bp, Artificial
  CRISPR gRNA sequence
cggggttttactgtattggc

SEQ ID NO: 341327 - DNA, 20 bp, Artificial
  CRISPR gRNA sequence
ggggttttactgtattggcc

SEQ ID NO: 341328 - DNA, 20 bp, Artificial
  CRISPR gRNA sequence
ttttactgtattggccaggc

SEQ ID NO: 341329 - DNA, 20 bp, Artificial
  CRISPR gRNA sequence
tggtattaaactcctgacct

SEQ ID NO: 341330 - DNA, 20 bp, Artificial
  CRISPR gRNA sequence
ggtattaaactcctgacctc

SEQ ID NO: 341331 - DNA, 20 bp, Artificial
  CRISPR gRNA sequence
cctgacctcaggtgatgcac

SEQ ID NO: 341332 - DNA, 20 bp, Artificial
  CRISPR gRNA sequence
ctcaggtgatgcaccagcct

SEQ ID NO: 341333 - DNA, 20 bp, Artificial
  CRISPR gRNA sequence
gcaccagcctcagcctccca

SEQ ID NO: 341334 - DNA, 20 bp, Artificial
  CRISPR gRNA sequence
gcctcagcctcccaaagtgt

SEQ ID NO: 341335 - DNA, 20 bp, Artificial
  CRISPR gRNA sequence
cctcagcctcccaaagtgtt

SEQ ID NO: 341336 - DNA, 20 bp, Artificial
  CRISPR gRNA sequence
ctcccaaagtgttgggatta

SEQ ID NO: 341337 - DNA, 20 bp, Artificial
  CRISPR gRNA sequence
tcccaaagtgttgggattac

SEQ ID NO: 341338 - DNA, 20 bp, Artificial
  CRISPR gRNA sequence
agtgttgggattacaggcgt

SEQ ID NO: 341339 - DNA, 20 bp, Artificial
  CRISPR gRNA sequence
caggcgtgagccactgtgct

SEQ ID NO: 341340 - DNA, 20 bp, Artificial
  CRISPR gRNA sequence
actttaataacttttaatta

SEQ ID NO: 341341 - DNA, 20 bp, Artificial
  CRISPR gRNA sequence
attaaagtataatatacgta

SEQ ID NO: 341342 - DNA, 20 bp, Artificial
  CRISPR gRNA sequence
taaagtataatatacgtaca

SEQ ID NO: 341343 - DNA, 20 bp, Artificial
  CRISPR gRNA sequence
aagtataatatacgtacaga

SEQ ID NO: 341344 - DNA, 20 bp, Artificial
  CRISPR gRNA sequence
agtataatatacgtacagag

SEQ ID NO: 341345 - DNA, 20 bp, Artificial
  CRISPR gRNA sequence
gagaggcacgcatgattgta

SEQ ID NO: 341346 - DNA, 20 bp, Artificial
  CRISPR gRNA sequence
cacgcatgattgtaaagctt

SEQ ID NO: 341347 - DNA, 20 bp, Artificial
  CRISPR gRNA sequence
cttaagaatttgtacaaatt

SEQ ID NO: 341348 - DNA, 20 bp, Artificial
  CRISPR gRNA sequence
atttgtacaaatttggctca

SEQ ID NO: 341349 - DNA, 20 bp, Artificial
  CRISPR gRNA sequence
tttgtacaaatttggctcac

SEQ ID NO: 341350 - DNA, 20 bp, Artificial
  CRISPR gRNA sequence
atttggctcacaggcataac

SEQ ID NO: 341351 - DNA, 20 bp, Artificial
  CRISPR gRNA sequence
tggctcacaggcataaccag

SEQ ID NO: 341352 - DNA, 20 bp, Artificial
  CRISPR gRNA sequence
ctcacaggcataaccagcag

SEQ ID NO: 341353 - DNA, 20 bp, Artificial
  CRISPR gRNA sequence
gcagatcaacaaatataaaa

SEQ ID NO: 341354 - DNA, 20 bp, Artificial
  CRISPR gRNA sequence
atcaacaaatataaaatagc

SEQ ID NO: 341355 - DNA, 20 bp, Artificial
  CRISPR gRNA sequence
tcaacaaatataaaatagcc

SEQ ID NO: 341356 - DNA, 20 bp, Artificial
  CRISPR gRNA sequence
caaatataaaatagccgggt

SEQ ID NO: 341357 - DNA, 20 bp, Artificial
  CRISPR gRNA sequence
aaatataaaatagccgggtg

SEQ ID NO: 341358 - DNA, 20 bp, Artificial
  CRISPR gRNA sequence
tataaaatagccgggtgagg

SEQ ID NO: 341359 - DNA, 20 bp, Artificial
  CRISPR gRNA sequence
ataaaatagccgggtgaggc

SEQ ID NO: 341360 - DNA, 20 bp, Artificial
  CRISPR gRNA sequence
taaaatagccgggtgaggca

SEQ ID NO: 341361 - DNA, 20 bp, Artificial
  CRISPR gRNA sequence
ggcagggaattgcttgaacc

SEQ ID NO: 341362 - DNA, 20 bp, Artificial
  CRISPR gRNA sequence
gcagggaattgcttgaaccc

SEQ ID NO: 341363 - DNA, 20 bp, Artificial
  CRISPR gRNA sequence
agggaattgcttgaacccgg

SEQ ID NO: 341364 - DNA, 20 bp, Artificial
  CRISPR gRNA sequence
gggaattgcttgaacccggg

SEQ ID NO: 341365 - DNA, 20 bp, Artificial
  CRISPR gRNA sequence
aattgcttgaacccgggagg

SEQ ID NO: 341366 - DNA, 20 bp, Artificial
  CRISPR gRNA sequence
tgcttgaacccgggaggtgg

SEQ ID NO: 341367 - DNA, 20 bp, Artificial
  CRISPR gRNA sequence
aacccgggaggtggaagttg

SEQ ID NO: 341368 - DNA, 20 bp, Artificial
  CRISPR gRNA sequence
cgggaggtggaagttgcagt

SEQ ID NO: 341369 - DNA, 20 bp, Artificial
  CRISPR gRNA sequence
ggtggaagttgcagtgagcc

SEQ ID NO: 341370 - DNA, 20 bp, Artificial
  CRISPR gRNA sequence
gagatcacgccactgcactc

SEQ ID NO: 341371 - DNA, 20 bp, Artificial
  CRISPR gRNA sequence
cacgccactgcactccagcc

SEQ ID NO: 341372 - DNA, 20 bp, Artificial
  CRISPR gRNA sequence
acgccactgcactccagcct

SEQ ID NO: 341373 - DNA, 20 bp, Artificial
  CRISPR gRNA sequence
ctgcactccagcctgggcaa

SEQ ID NO: 341374 - DNA, 20 bp, Artificial
  CRISPR gRNA sequence
gcactccagcctgggcaaca

SEQ ID NO: 341375 - DNA, 20 bp, Artificial
  CRISPR gRNA sequence
cgtctcaaaaaaaaaaaaaa

SEQ ID NO: 341376 - DNA, 20 bp, Artificial
  CRISPR gRNA sequence
caaaaaaaaaaaaaaaagaa

SEQ ID NO: 341377 - DNA, 20 bp, Artificial
  CRISPR gRNA sequence
aaaaaaaaaaaaagaaaaga

SEQ ID NO: 341378 - DNA, 20 bp, Artificial
  CRISPR gRNA sequence
aaaaaaaaagaaaagaaaga

SEQ ID NO: 341379 - DNA, 20 bp, Artificial
  CRISPR gRNA sequence
aagaaaagaaagaaagaaaa

SEQ ID NO: 341380 - DNA, 20 bp, Artificial
  CRISPR gRNA sequence
aaagaaagaaagaaaatagc

SEQ ID NO: 341381 - DNA, 20 bp, Artificial
  CRISPR gRNA sequence
aagaaagaaagaaaatagcc

SEQ ID NO: 341382 - DNA, 20 bp, Artificial
  CRISPR gRNA sequence
agaaagaaaatagccaggtg

SEQ ID NO: 341383 - DNA, 20 bp, Artificial
  CRISPR gRNA sequence
aagaaaatagccaggtgcag

SEQ ID NO: 341384 - DNA, 20 bp, Artificial
  CRISPR gRNA sequence
gtggcttacgcctgtaatcc

SEQ ID NO: 341385 - DNA, 20 bp, Artificial
  CRISPR gRNA sequence
cgcctgtaatcccagcactt

SEQ ID NO: 341386 - DNA, 20 bp, Artificial
  CRISPR gRNA sequence
gcctgtaatcccagcacttt

SEQ ID NO: 341387 - DNA, 20 bp, Artificial
  CRISPR gRNA sequence
ctgtaatcccagcactttgg

SEQ ID NO: 341388 - DNA, 20 bp, Artificial
  CRISPR gRNA sequence
tgtaatcccagcactttggg

SEQ ID NO: 341389 - DNA, 20 bp, Artificial
  CRISPR gRNA sequence
tcccagcactttgggaggtt

SEQ ID NO: 341390 - DNA, 20 bp, Artificial
  CRISPR gRNA sequence
cccagcactttgggaggttg

SEQ ID NO: 341391 - DNA, 20 bp, Artificial
  CRISPR gRNA sequence
agcactttgggaggttgagg

SEQ ID NO: 341392 - DNA, 20 bp, Artificial
  CRISPR gRNA sequence
gcactttgggaggttgaggt

SEQ ID NO: 341393 - DNA, 20 bp, Artificial
  CRISPR gRNA sequence
ctttgggaggttgaggtggg

SEQ ID NO: 341394 - DNA, 20 bp, Artificial
  CRISPR gRNA sequence
ttgaggtgggtggattgctt

SEQ ID NO: 341395 - DNA, 20 bp, Artificial
  CRISPR gRNA sequence
gtgggtggattgcttgagct

SEQ ID NO: 341396 - DNA, 20 bp, Artificial
  CRISPR gRNA sequence
tgggtggattgcttgagctc

SEQ ID NO: 341397 - DNA, 20 bp, Artificial
  CRISPR gRNA sequence
ggtggattgcttgagctcag

SEQ ID NO: 341398 - DNA, 20 bp, Artificial
  CRISPR gRNA sequence
ttgcttgagctcaggagttt

SEQ ID NO: 341399 - DNA, 20 bp, Artificial
  CRISPR gRNA sequence
tgagctcaggagtttgagac

SEQ ID NO: 341400 - DNA, 20 bp, Artificial
  CRISPR gRNA sequence
tcaggagtttgagaccagcc

SEQ ID NO: 341401 - DNA, 20 bp, Artificial
  CRISPR gRNA sequence
tgagaccagcctggccaaca

SEQ ID NO: 341402 - DNA, 20 bp, Artificial
  CRISPR gRNA sequence
tctacaaaaaatacaaaaat

SEQ ID NO: 341403 - DNA, 20 bp, Artificial
  CRISPR gRNA sequence
caaaaaatacaaaaattagc

SEQ ID NO: 341404 - DNA, 20 bp, Artificial
  CRISPR gRNA sequence
aaaaaatacaaaaattagct

SEQ ID NO: 341405 - DNA, 20 bp, Artificial
  CRISPR gRNA sequence
atacaaaaattagctgggtg

SEQ ID NO: 341406 - DNA, 20 bp, Artificial
  CRISPR gRNA sequence
caaaaattagctgggtgtgg

SEQ ID NO: 341407 - DNA, 20 bp, Artificial
  CRISPR gRNA sequence
ggtgtggtggtgcacacctg

SEQ ID NO: 341408 - DNA, 20 bp, Artificial
  CRISPR gRNA sequence
gtgtggtggtgcacacctgt

SEQ ID NO: 341409 - DNA, 20 bp, Artificial
  CRISPR gRNA sequence
tggtgcacacctgtaggccc

SEQ ID NO: 341410 - DNA, 20 bp, Artificial
  CRISPR gRNA sequence
cacctgtaggcccaagctac

SEQ ID NO: 341411 - DNA, 20 bp, Artificial
  CRISPR gRNA sequence
acctgtaggcccaagctact

SEQ ID NO: 341412 - DNA, 20 bp, Artificial
  CRISPR gRNA sequence
cctgtaggcccaagctactg

SEQ ID NO: 341413 - DNA, 20 bp, Artificial
  CRISPR gRNA sequence
tgtaggcccaagctactggg

SEQ ID NO: 341414 - DNA, 20 bp, Artificial
  CRISPR gRNA sequence
gtaggcccaagctactgggg

SEQ ID NO: 341415 - DNA, 20 bp, Artificial
  CRISPR gRNA sequence
cccaagctactggggaggct

SEQ ID NO: 341416 - DNA, 20 bp, Artificial
  CRISPR gRNA sequence
ccaagctactggggaggctg

SEQ ID NO: 341417 - DNA, 20 bp, Artificial
  CRISPR gRNA sequence
agctactggggaggctgagg

SEQ ID NO: 341418 - DNA, 20 bp, Artificial
  CRISPR gRNA sequence
gctactggggaggctgaggt

SEQ ID NO: 341419 - DNA, 20 bp, Artificial
  CRISPR gRNA sequence
tactggggaggctgaggtgg

SEQ ID NO: 341420 - DNA, 20 bp, Artificial
  CRISPR gRNA sequence
actggggaggctgaggtggg

SEQ ID NO: 341421 - DNA, 20 bp, Artificial
  CRISPR gRNA sequence
ctgaggtgggaggatcgctt

SEQ ID NO: 341422 - DNA, 20 bp, Artificial
  CRISPR gRNA sequence
gtgggaggatcgcttgagcc

SEQ ID NO: 341423 - DNA, 20 bp, Artificial
  CRISPR gRNA sequence
tgggaggatcgcttgagccc

SEQ ID NO: 341424 - DNA, 20 bp, Artificial
  CRISPR gRNA sequence
ggaggatcgcttgagcccgg

SEQ ID NO: 341425 - DNA, 20 bp, Artificial
  CRISPR gRNA sequence
gaggatcgcttgagcccggg

SEQ ID NO: 341426 - DNA, 20 bp, Artificial
  CRISPR gRNA sequence
gatcgcttgagcccgggagg

SEQ ID NO: 341427 - DNA, 20 bp, Artificial
  CRISPR gRNA sequence
tcgcttgagcccgggaggtg

SEQ ID NO: 341428 - DNA, 20 bp, Artificial
  CRISPR gRNA sequence
cgcttgagcccgggaggtgg

SEQ ID NO: 341429 - DNA, 20 bp, Artificial
  CRISPR gRNA sequence
agcccgggaggtggaggtta

SEQ ID NO: 341430 - DNA, 20 bp, Artificial
  CRISPR gRNA sequence
cgggaggtggaggttacagt

SEQ ID NO: 341431 - DNA, 20 bp, Artificial
  CRISPR gRNA sequence
ggtggaggttacagtgagct

SEQ ID NO: 341432 - DNA, 20 bp, Artificial
  CRISPR gRNA sequence
gagatcatgatactgcgctc

SEQ ID NO: 341433 - DNA, 20 bp, Artificial
  CRISPR gRNA sequence
catgatactgcgctccagcc

SEQ ID NO: 341434 - DNA, 20 bp, Artificial
  CRISPR gRNA sequence
atgatactgcgctccagcct

SEQ ID NO: 341435 - DNA, 20 bp, Artificial
  CRISPR gRNA sequence
ctgcgctccagcctgggtga

SEQ ID NO: 341436 - DNA, 20 bp, Artificial
  CRISPR gRNA sequence
gcgctccagcctgggtgaca

SEQ ID NO: 341437 - DNA, 20 bp, Artificial
  CRISPR gRNA sequence
tccagcctgggtgacagagt

SEQ ID NO: 341438 - DNA, 20 bp, Artificial
  CRISPR gRNA sequence
caccaacaaaaaacaaaaca

SEQ ID NO: 341439 - DNA, 20 bp, Artificial
  CRISPR gRNA sequence
aaaaacaaaacaaagtatat

SEQ ID NO: 341440 - DNA, 20 bp, Artificial
  CRISPR gRNA sequence
aaaacaaaacaaagtatatt

SEQ ID NO: 341441 - DNA, 20 bp, Artificial
  CRISPR gRNA sequence
aaacaaaacaaagtatatta

SEQ ID NO: 341442 - DNA, 20 bp, Artificial
  CRISPR gRNA sequence
caaagtatattagggattcc

SEQ ID NO: 341443 - DNA, 20 bp, Artificial
  CRISPR gRNA sequence
aaagtatattagggattccc

SEQ ID NO: 341444 - DNA, 20 bp, Artificial
  CRISPR gRNA sequence
aagtatattagggattccca

SEQ ID NO: 341445 - DNA, 20 bp, Artificial
  CRISPR gRNA sequence
agtatattagggattcccag

SEQ ID NO: 341446 - DNA, 20 bp, Artificial
  CRISPR gRNA sequence
tattagggattcccaggggc

SEQ ID NO: 341447 - DNA, 20 bp, Artificial
  CRISPR gRNA sequence
attagggattcccaggggct

SEQ ID NO: 341448 - DNA, 20 bp, Artificial
  CRISPR gRNA sequence
ttagggattcccaggggctg

SEQ ID NO: 341449 - DNA, 20 bp, Artificial
  CRISPR gRNA sequence
ggattcccaggggctggggc

SEQ ID NO: 341450 - DNA, 20 bp, Artificial
  CRISPR gRNA sequence
gattcccaggggctggggct

SEQ ID NO: 341451 - DNA, 20 bp, Artificial
  CRISPR gRNA sequence
attcccaggggctggggctg

SEQ ID NO: 341452 - DNA, 20 bp, Artificial
  CRISPR gRNA sequence
ccaggggctggggctggggc

SEQ ID NO: 341453 - DNA, 20 bp, Artificial
  CRISPR gRNA sequence
caggggctggggctggggct

SEQ ID NO: 341454 - DNA, 20 bp, Artificial
  CRISPR gRNA sequence
aggggctggggctggggctg

SEQ ID NO: 341455 - DNA, 20 bp, Artificial
  CRISPR gRNA sequence
gctggggctggggctggggt

SEQ ID NO: 341456 - DNA, 20 bp, Artificial
  CRISPR gRNA sequence
gggctggggctggggttggt

SEQ ID NO: 341457 - DNA, 20 bp, Artificial
  CRISPR gRNA sequence
ggctggggctggggttggtt

SEQ ID NO: 341458 - DNA, 20 bp, Artificial
  CRISPR gRNA sequence
gctggggctggggttggttg

SEQ ID NO: 341459 - DNA, 20 bp, Artificial
  CRISPR gRNA sequence
ctggggctggggttggttgg

SEQ ID NO: 341460 - DNA, 20 bp, Artificial
  CRISPR gRNA sequence
tggggctggggttggttggg

SEQ ID NO: 341461 - DNA, 20 bp, Artificial
  CRISPR gRNA sequence
ggctggggttggttgggggg

SEQ ID NO: 341462 - DNA, 20 bp, Artificial
  CRISPR gRNA sequence
ggttggttggggggaagaaa

SEQ ID NO: 341463 - DNA, 20 bp, Artificial
  CRISPR gRNA sequence
gttggttggggggaagaaat

SEQ ID NO: 341464 - DNA, 20 bp, Artificial
  CRISPR gRNA sequence
ttggttggggggaagaaatg

SEQ ID NO: 341465 - DNA, 20 bp, Artificial
  CRISPR gRNA sequence
ggttggggggaagaaatggg

SEQ ID NO: 341466 - DNA, 20 bp, Artificial
  CRISPR gRNA sequence
agaaatggggagtcattgct

SEQ ID NO: 341467 - DNA, 20 bp, Artificial
  CRISPR gRNA sequence
gaaatggggagtcattgcta

SEQ ID NO: 341468 - DNA, 20 bp, Artificial
  CRISPR gRNA sequence
aaatggggagtcattgctaa

SEQ ID NO: 341469 - DNA, 20 bp, Artificial
  CRISPR gRNA sequence
aatggggagtcattgctaag

SEQ ID NO: 341470 - DNA, 20 bp, Artificial
  CRISPR gRNA sequence
gagtcattgctaaggggtac

SEQ ID NO: 341471 - DNA, 20 bp, Artificial
  CRISPR gRNA sequence
ctaaggggtacaagtttctc

SEQ ID NO: 341472 - DNA, 20 bp, Artificial
  CRISPR gRNA sequence
taaggggtacaagtttctct

SEQ ID NO: 341473 - DNA, 20 bp, Artificial
  CRISPR gRNA sequence
aaggggtacaagtttctctg

SEQ ID NO: 341474 - DNA, 20 bp, Artificial
  CRISPR gRNA sequence
ctggggtaacgaaaatgtta

SEQ ID NO: 341475 - DNA, 20 bp, Artificial
  CRISPR gRNA sequence
taacgaaaatgttatagaat

SEQ ID NO: 341476 - DNA, 20 bp, Artificial
  CRISPR gRNA sequence
gaaaatgttatagaattaga

SEQ ID NO: 341477 - DNA, 20 bp, Artificial
  CRISPR gRNA sequence
atagaattagatagtgttga

SEQ ID NO: 341478 - DNA, 20 bp, Artificial
  CRISPR gRNA sequence
gttgatggctgcacaacctg

SEQ ID NO: 341479 - DNA, 20 bp, Artificial
  CRISPR gRNA sequence
taaaataaataaataataaa

SEQ ID NO: 341480 - DNA, 20 bp, Artificial
  CRISPR gRNA sequence
aataaatagttacttgatta

SEQ ID NO: 341481 - DNA, 20 bp, Artificial
  CRISPR gRNA sequence
gttacttgattacagttact

SEQ ID NO: 341482 - DNA, 20 bp, Artificial
  CRISPR gRNA sequence
tttgtttgtttgttttttga

SEQ ID NO: 341483 - DNA, 20 bp, Artificial
  CRISPR gRNA sequence
tgtttgtttgttttttgaca

SEQ ID NO: 341484 - DNA, 20 bp, Artificial
  CRISPR gRNA sequence
cagagtcttgctttgtcgcc

SEQ ID NO: 341485 - DNA, 20 bp, Artificial
  CRISPR gRNA sequence
agagtcttgctttgtcgccc

SEQ ID NO: 341486 - DNA, 20 bp, Artificial
  CRISPR gRNA sequence
tcttgctttgtcgcccaggt

SEQ ID NO: 341487 - DNA, 20 bp, Artificial
  CRISPR gRNA sequence
ttgctttgtcgcccaggttg

SEQ ID NO: 341488 - DNA, 20 bp, Artificial
  CRISPR gRNA sequence
ttgtcgcccaggttggagtg

SEQ ID NO: 341489 - DNA, 20 bp, Artificial
  CRISPR gRNA sequence
tcgcccaggttggagtgcag

SEQ ID NO: 341490 - DNA, 20 bp, Artificial
  CRISPR gRNA sequence
ggagtgcagtggcacgatct

SEQ ID NO: 341491 - DNA, 20 bp, Artificial
  CRISPR gRNA sequence
gcagtggcacgatctcggct

SEQ ID NO: 341492 - DNA, 20 bp, Artificial
  CRISPR gRNA sequence
cagtgcaacctccgcctcct

SEQ ID NO: 341493 - DNA, 20 bp, Artificial
  CRISPR gRNA sequence
aacctccgcctcctgagttc

SEQ ID NO: 341494 - DNA, 20 bp, Artificial
  CRISPR gRNA sequence
ttcaagtgattctcctgcct

SEQ ID NO: 341495 - DNA, 20 bp, Artificial
  CRISPR gRNA sequence
ttctcctgcctcagcctccc

SEQ ID NO: 341496 - DNA, 20 bp, Artificial
  CRISPR gRNA sequence
tcctgcctcagcctccctag

SEQ ID NO: 341497 - DNA, 20 bp, Artificial
  CRISPR gRNA sequence
gcctcagcctccctagtagc

SEQ ID NO: 341498 - DNA, 20 bp, Artificial
  CRISPR gRNA sequence
cctcagcctccctagtagct

SEQ ID NO: 341499 - DNA, 20 bp, Artificial
  CRISPR gRNA sequence
ctccctagtagctgggatta

SEQ ID NO: 341500 - DNA, 20 bp, Artificial
  CRISPR gRNA sequence
tccctagtagctgggattac

SEQ ID NO: 341501 - DNA, 20 bp, Artificial
  CRISPR gRNA sequence
caggtgtgtgccaccacacc

SEQ ID NO: 341502 - DNA, 20 bp, Artificial
  CRISPR gRNA sequence
tggctaattttttgtatttt

SEQ ID NO: 341503 - DNA, 20 bp, Artificial
  CRISPR gRNA sequence
ctaattttttgtatttttag

SEQ ID NO: 341504 - DNA, 20 bp, Artificial
  CRISPR gRNA sequence
aattttttgtatttttagta

SEQ ID NO: 341505 - DNA, 20 bp, Artificial
  CRISPR gRNA sequence
ttttgtatttttagtagaga

SEQ ID NO: 341506 - DNA, 20 bp, Artificial
  CRISPR gRNA sequence
tttgtatttttagtagagac

SEQ ID NO: 341507 - DNA, 20 bp, Artificial
  CRISPR gRNA sequence
ttgtatttttagtagagacg

SEQ ID NO: 341508 - DNA, 20 bp, Artificial
  CRISPR gRNA sequence
gagacggggtttcaccgtgt

SEQ ID NO: 341509 - DNA, 20 bp, Artificial
  CRISPR gRNA sequence
cggggtttcaccgtgttagc

SEQ ID NO: 341510 - DNA, 20 bp, Artificial
  CRISPR gRNA sequence
ggggtttcaccgtgttagcc

SEQ ID NO: 341511 - DNA, 20 bp, Artificial
  CRISPR gRNA sequence
tttcaccgtgttagccagga

SEQ ID NO: 341512 - DNA, 20 bp, Artificial
  CRISPR gRNA sequence
acctcgtgatccgcccgcct

SEQ ID NO: 341513 - DNA, 20 bp, Artificial
  CRISPR gRNA sequence
ccgcccgccttggcctccca

SEQ ID NO: 341514 - DNA, 20 bp, Artificial
  CRISPR gRNA sequence
gccttggcctcccaaagtgc

SEQ ID NO: 341515 - DNA, 20 bp, Artificial
  CRISPR gRNA sequence
ccttggcctcccaaagtgct

SEQ ID NO: 341516 - DNA, 20 bp, Artificial
  CRISPR gRNA sequence
ctcccaaagtgctgggatta

SEQ ID NO: 341517 - DNA, 20 bp, Artificial
  CRISPR gRNA sequence
tcccaaagtgctgggattac

SEQ ID NO: 341518 - DNA, 20 bp, Artificial
  CRISPR gRNA sequence
agtgctgggattacaggcgt

SEQ ID NO: 341519 - DNA, 20 bp, Artificial
  CRISPR gRNA sequence
ttaaaatatacattttgctc

SEQ ID NO: 341520 - DNA, 20 bp, Artificial
  CRISPR gRNA sequence
atatacattttgctcaagtg

SEQ ID NO: 341521 - DNA, 20 bp, Artificial
  CRISPR gRNA sequence
atacattttgctcaagtgta

SEQ ID NO: 341522 - DNA, 20 bp, Artificial
  CRISPR gRNA sequence
tacattttgctcaagtgtag

SEQ ID NO: 341523 - DNA, 20 bp, Artificial
  CRISPR gRNA sequence
caagtgtagaggtccgatgc

SEQ ID NO: 341524 - DNA, 20 bp, Artificial
  CRISPR gRNA sequence
aagtgtagaggtccgatgct

SEQ ID NO: 341525 - DNA, 20 bp, Artificial
  CRISPR gRNA sequence
tgtagaggtccgatgctggg

SEQ ID NO: 341526 - DNA, 20 bp, Artificial
  CRISPR gRNA sequence
gaggtccgatgctgggtggc

SEQ ID NO: 341527 - DNA, 20 bp, Artificial
  CRISPR gRNA sequence
aggtccgatgctgggtggct

SEQ ID NO: 341528 - DNA, 20 bp, Artificial
  CRISPR gRNA sequence
tggctgggtgttaattatcc

SEQ ID NO: 341529 - DNA, 20 bp, Artificial
  CRISPR gRNA sequence
ggctgggtgttaattatcct

SEQ ID NO: 341530 - DNA, 20 bp, Artificial
  CRISPR gRNA sequence
gctgggtgttaattatcctg

SEQ ID NO: 341531 - DNA, 20 bp, Artificial
  CRISPR gRNA sequence
ctgggtgttaattatcctgg

SEQ ID NO: 341532 - DNA, 20 bp, Artificial
  CRISPR gRNA sequence
ggtgttaattatcctggggg

SEQ ID NO: 341533 - DNA, 20 bp, Artificial
  CRISPR gRNA sequence
gtgttaattatcctgggggc

SEQ ID NO: 341534 - DNA, 20 bp, Artificial
  CRISPR gRNA sequence
aattatcctgggggcgggtg

SEQ ID NO: 341535 - DNA, 20 bp, Artificial
  CRISPR gRNA sequence
tatcctgggggcgggtgtgg

SEQ ID NO: 341536 - DNA, 20 bp, Artificial
  CRISPR gRNA sequence
atcctgggggcgggtgtggt

SEQ ID NO: 341537 - DNA, 20 bp, Artificial
  CRISPR gRNA sequence
tcctgggggcgggtgtggta

SEQ ID NO: 341538 - DNA, 20 bp, Artificial
  CRISPR gRNA sequence
gggcgggtgtggtagggcac

SEQ ID NO: 341539 - DNA, 20 bp, Artificial
  CRISPR gRNA sequence
gggtgtggtagggcactagc

SEQ ID NO: 341540 - DNA, 20 bp, Artificial
  CRISPR gRNA sequence
ggtgtggtagggcactagct

SEQ ID NO: 341541 - DNA, 20 bp, Artificial
  CRISPR gRNA sequence
tggtagggcactagctgggc

SEQ ID NO: 341542 - DNA, 20 bp, Artificial
  CRISPR gRNA sequence
ggtagggcactagctgggct

SEQ ID NO: 341543 - DNA, 20 bp, Artificial
  CRISPR gRNA sequence
gggcactagctgggctgggc

SEQ ID NO: 341544 - DNA, 20 bp, Artificial
  CRISPR gRNA sequence
ggcactagctgggctgggct

SEQ ID NO: 341545 - DNA, 20 bp, Artificial
  CRISPR gRNA sequence
ctgggctgggctgggctcgc

SEQ ID NO: 341546 - DNA, 20 bp, Artificial
  CRISPR gRNA sequence
ggctgggctgggctcgctgg

SEQ ID NO: 341547 - DNA, 20 bp, Artificial
  CRISPR gRNA sequence
gggctgggctcgctggcggc

SEQ ID NO: 341548 - DNA, 20 bp, Artificial
  CRISPR gRNA sequence
ggctcgctggcggctggttt

SEQ ID NO: 341549 - DNA, 20 bp, Artificial
  CRISPR gRNA sequence
ctcgctggcggctggtttga

SEQ ID NO: 341550 - DNA, 20 bp, Artificial
  CRISPR gRNA sequence
tcgctggcggctggtttgag

SEQ ID NO: 341551 - DNA, 20 bp, Artificial
  CRISPR gRNA sequence
gctggcggctggtttgagag

SEQ ID NO: 341552 - DNA, 20 bp, Artificial
  CRISPR gRNA sequence
ctggcggctggtttgagagg

SEQ ID NO: 341553 - DNA, 20 bp, Artificial
  CRISPR gRNA sequence
tggcggctggtttgagagga

SEQ ID NO: 341554 - DNA, 20 bp, Artificial
  CRISPR gRNA sequence
ggtttgagaggagggtgatt

SEQ ID NO: 341555 - DNA, 20 bp, Artificial
  CRISPR gRNA sequence
tttgagaggagggtgattca

SEQ ID NO: 341556 - DNA, 20 bp, Artificial
  CRISPR gRNA sequence
ttgagaggagggtgattcag

SEQ ID NO: 341557 - DNA, 20 bp, Artificial
  CRISPR gRNA sequence
agaggagggtgattcagagg

SEQ ID NO: 341558 - DNA, 20 bp, Artificial
  CRISPR gRNA sequence
gaggagggtgattcagagga

SEQ ID NO: 341559 - DNA, 20 bp, Artificial
  CRISPR gRNA sequence
gagggtgattcagaggaagg

SEQ ID NO: 341560 - DNA, 20 bp, Artificial
  CRISPR gRNA sequence
cagaggaaggcagtgacacc

SEQ ID NO: 341561 - DNA, 20 bp, Artificial
  CRISPR gRNA sequence
aaggcagtgacacccagatg

SEQ ID NO: 341562 - DNA, 20 bp, Artificial
  CRISPR gRNA sequence
aggcagtgacacccagatgt

SEQ ID NO: 341563 - DNA, 20 bp, Artificial
  CRISPR gRNA sequence
agtgacacccagatgtggga

SEQ ID NO: 341564 - DNA, 20 bp, Artificial
  CRISPR gRNA sequence
gtgacacccagatgtgggac

SEQ ID NO: 341565 - DNA, 20 bp, Artificial
  CRISPR gRNA sequence
ccagatgtgggacaggctgc

SEQ ID NO: 341566 - DNA, 20 bp, Artificial
  CRISPR gRNA sequence
atgtgggacaggctgcaaga

SEQ ID NO: 341567 - DNA, 20 bp, Artificial
  CRISPR gRNA sequence
ggacaggctgcaagaaagcc

SEQ ID NO: 341568 - DNA, 20 bp, Artificial
  CRISPR gRNA sequence
caggctgcaagaaagcctgg

SEQ ID NO: 341569 - DNA, 20 bp, Artificial
  CRISPR gRNA sequence
aggctgcaagaaagcctggt

SEQ ID NO: 341570 - DNA, 20 bp, Artificial
  CRISPR gRNA sequence
caagaaagcctggtgggcct

SEQ ID NO: 341571 - DNA, 20 bp, Artificial
  CRISPR gRNA sequence
aagaaagcctggtgggcctt

SEQ ID NO: 341572 - DNA, 20 bp, Artificial
  CRISPR gRNA sequence
agaaagcctggtgggcctta

SEQ ID NO: 341573 - DNA, 20 bp, Artificial
  CRISPR gRNA sequence
aagcctggtgggccttaggg

SEQ ID NO: 341574 - DNA, 20 bp, Artificial
  CRISPR gRNA sequence
ggccttagggcagacacttg

SEQ ID NO: 341575 - DNA, 20 bp, Artificial
  CRISPR gRNA sequence
gccttagggcagacacttgt

SEQ ID NO: 341576 - DNA, 20 bp, Artificial
  CRISPR gRNA sequence
ccttagggcagacacttgtg

SEQ ID NO: 341577 - DNA, 20 bp, Artificial
  CRISPR gRNA sequence
ggcagacacttgtggggacc

SEQ ID NO: 341578 - DNA, 20 bp, Artificial
  CRISPR gRNA sequence
gcagacacttgtggggaccc

SEQ ID NO: 341579 - DNA, 20 bp, Artificial
  CRISPR gRNA sequence
cagacacttgtggggacccg

SEQ ID NO: 341580 - DNA, 20 bp, Artificial
  CRISPR gRNA sequence
gacacttgtggggacccggg

SEQ ID NO: 341581 - DNA, 20 bp, Artificial
  CRISPR gRNA sequence
tgtggggacccggggagccc

SEQ ID NO: 341582 - DNA, 20 bp, Artificial
  CRISPR gRNA sequence
gtggggacccggggagccct

SEQ ID NO: 341583 - DNA, 20 bp, Artificial
  CRISPR gRNA sequence
gggagccctaggtgccctga

SEQ ID NO: 341584 - DNA, 20 bp, Artificial
  CRISPR gRNA sequence
ggagccctaggtgccctgac

SEQ ID NO: 341585 - DNA, 20 bp, Artificial
  CRISPR gRNA sequence
gccctaggtgccctgacagg

SEQ ID NO: 341586 - DNA, 20 bp, Artificial
  CRISPR gRNA sequence
ctaggtgccctgacaggtgg

SEQ ID NO: 341587 - DNA, 20 bp, Artificial
  CRISPR gRNA sequence
aggtgccctgacaggtggaa

SEQ ID NO: 341588 - DNA, 20 bp, Artificial
  CRISPR gRNA sequence
ggtgccctgacaggtggaag

SEQ ID NO: 341589 - DNA, 20 bp, Artificial
  CRISPR gRNA sequence
gtgccctgacaggtggaaga

SEQ ID NO: 341590 - DNA, 20 bp, Artificial
  CRISPR gRNA sequence
tgccctgacaggtggaagag

SEQ ID NO: 341591 - DNA, 20 bp, Artificial
  CRISPR gRNA sequence
tgacaggtggaagaggggtg

SEQ ID NO: 341592 - DNA, 20 bp, Artificial
  CRISPR gRNA sequence
aggtggaagaggggtgcaga

SEQ ID NO: 341593 - DNA, 20 bp, Artificial
  CRISPR gRNA sequence
ggtggaagaggggtgcagaa

SEQ ID NO: 341594 - DNA, 20 bp, Artificial
  CRISPR gRNA sequence
gtggaagaggggtgcagaaa

SEQ ID NO: 341595 - DNA, 20 bp, Artificial
  CRISPR gRNA sequence
ggaagaggggtgcagaaagg

SEQ ID NO: 341596 - DNA, 20 bp, Artificial
  CRISPR gRNA sequence
gaagaggggtgcagaaaggg

SEQ ID NO: 341597 - DNA, 20 bp, Artificial
  CRISPR gRNA sequence
tgcagaaagggaggatgtca

SEQ ID NO: 341598 - DNA, 20 bp, Artificial
  CRISPR gRNA sequence
cagaaagggaggatgtcaaa

SEQ ID NO: 341599 - DNA, 20 bp, Artificial
  CRISPR gRNA sequence
gaaagggaggatgtcaaaga

SEQ ID NO: 341600 - DNA, 20 bp, Artificial
  CRISPR gRNA sequence
atgtcaaagagagaatgtca

SEQ ID NO: 341601 - DNA, 20 bp, Artificial
  CRISPR gRNA sequence
tgtcaaagagagaatgtcaa

SEQ ID NO: 341602 - DNA, 20 bp, Artificial
  CRISPR gRNA sequence
cttctacttatgccttttgt

SEQ ID NO: 341603 - DNA, 20 bp, Artificial
  CRISPR gRNA sequence
ttctacttatgccttttgtc

SEQ ID NO: 341604 - DNA, 20 bp, Artificial
  CRISPR gRNA sequence
cttatgccttttgtcaggac

SEQ ID NO: 341605 - DNA, 20 bp, Artificial
  CRISPR gRNA sequence
ttatgccttttgtcaggaca

SEQ ID NO: 341606 - DNA, 20 bp, Artificial
  CRISPR gRNA sequence
atgccttttgtcaggacaag

SEQ ID NO: 341607 - DNA, 20 bp, Artificial
  CRISPR gRNA sequence
gccttttgtcaggacaagga

SEQ ID NO: 341608 - DNA, 20 bp, Artificial
  CRISPR gRNA sequence
ccttttgtcaggacaaggag

SEQ ID NO: 341609 - DNA, 20 bp, Artificial
  CRISPR gRNA sequence
cttttgtcaggacaaggaga

SEQ ID NO: 341610 - DNA, 20 bp, Artificial
  CRISPR gRNA sequence
gagagggacaaattccttct

SEQ ID NO: 341611 - DNA, 20 bp, Artificial
  CRISPR gRNA sequence
attccttcttggcatcctta

SEQ ID NO: 341612 - DNA, 20 bp, Artificial
  CRISPR gRNA sequence
tgctaatgaatgctgactct

SEQ ID NO: 341613 - DNA, 20 bp, Artificial
  CRISPR gRNA sequence
tgctgactctgagttgctac

SEQ ID NO: 341614 - DNA, 20 bp, Artificial
  CRISPR gRNA sequence
tctgagttgctactagaatt

SEQ ID NO: 341615 - DNA, 20 bp, Artificial
  CRISPR gRNA sequence
actagaatttggtttccttg

SEQ ID NO: 341616 - DNA, 20 bp, Artificial
  CRISPR gRNA sequence
ttggtttccttgtggcttcc

SEQ ID NO: 341617 - DNA, 20 bp, Artificial
  CRISPR gRNA sequence
tggtttccttgtggcttccc

SEQ ID NO: 341618 - DNA, 20 bp, Artificial
  CRISPR gRNA sequence
tgtggcttcccaggaattgt

SEQ ID NO: 341619 - DNA, 20 bp, Artificial
  CRISPR gRNA sequence
ccaggaattgtgagccatgt

SEQ ID NO: 341620 - DNA, 20 bp, Artificial
  CRISPR gRNA sequence
aattgtgagccatgttggat

SEQ ID NO: 341621 - DNA, 20 bp, Artificial
  CRISPR gRNA sequence
attgtgagccatgttggata

SEQ ID NO: 341622 - DNA, 20 bp, Artificial
  CRISPR gRNA sequence
catgttggataaggacctgc

SEQ ID NO: 341623 - DNA, 20 bp, Artificial
  CRISPR gRNA sequence
atgttggataaggacctgca

SEQ ID NO: 341624 - DNA, 20 bp, Artificial
  CRISPR gRNA sequence
tgttggataaggacctgcaa

SEQ ID NO: 341625 - DNA, 20 bp, Artificial
  CRISPR gRNA sequence
tggataaggacctgcaaggg

SEQ ID NO: 341626 - DNA, 20 bp, Artificial
  CRISPR gRNA sequence
aggacctgcaagggaagaat

SEQ ID NO: 341627 - DNA, 20 bp, Artificial
  CRISPR gRNA sequence
ggacctgcaagggaagaatg

SEQ ID NO: 341628 - DNA, 20 bp, Artificial
  CRISPR gRNA sequence
cctgcaagggaagaatgagg

SEQ ID NO: 341629 - DNA, 20 bp, Artificial
  CRISPR gRNA sequence
aagggaagaatgaggaagcc

SEQ ID NO: 341630 - DNA, 20 bp, Artificial
  CRISPR gRNA sequence
agggaagaatgaggaagcct

SEQ ID NO: 341631 - DNA, 20 bp, Artificial
  CRISPR gRNA sequence
aagaatgaggaagcctggga

SEQ ID NO: 341632 - DNA, 20 bp, Artificial
  CRISPR gRNA sequence
tgaggaagcctgggacagtg

SEQ ID NO: 341633 - DNA, 20 bp, Artificial
  CRISPR gRNA sequence
gaggaagcctgggacagtgc

SEQ ID NO: 341634 - DNA, 20 bp, Artificial
  CRISPR gRNA sequence
ggaagcctgggacagtgcag

SEQ ID NO: 341635 - DNA, 20 bp, Artificial
  CRISPR gRNA sequence
gaagcctgggacagtgcagg

SEQ ID NO: 341636 - DNA, 20 bp, Artificial
  CRISPR gRNA sequence
aagcctgggacagtgcagga

SEQ ID NO: 341637 - DNA, 20 bp, Artificial
  CRISPR gRNA sequence
agcctgggacagtgcaggag

SEQ ID NO: 341638 - DNA, 20 bp, Artificial
  CRISPR gRNA sequence
cctgggacagtgcaggaggg

SEQ ID NO: 341639 - DNA, 20 bp, Artificial
  CRISPR gRNA sequence
tgggacagtgcaggagggga

SEQ ID NO: 341640 - DNA, 20 bp, Artificial
  CRISPR gRNA sequence
agtgcaggaggggagagcac

SEQ ID NO: 341641 - DNA, 20 bp, Artificial
  CRISPR gRNA sequence
gcaggaggggagagcactgg

SEQ ID NO: 341642 - DNA, 20 bp, Artificial
  CRISPR gRNA sequence
ggaggggagagcactggtgg

SEQ ID NO: 341643 - DNA, 20 bp, Artificial
  CRISPR gRNA sequence
aggggagagcactggtggta

SEQ ID NO: 341644 - DNA, 20 bp, Artificial
  CRISPR gRNA sequence
gggagagcactggtggtaga

SEQ ID NO: 341645 - DNA, 20 bp, Artificial
  CRISPR gRNA sequence
ggagagcactggtggtagag

SEQ ID NO: 341646 - DNA, 20 bp, Artificial
  CRISPR gRNA sequence
agagcactggtggtagagag

SEQ ID NO: 341647 - DNA, 20 bp, Artificial
  CRISPR gRNA sequence
tggtagagaggagtgatgac

SEQ ID NO: 341648 - DNA, 20 bp, Artificial
  CRISPR gRNA sequence
ggtagagaggagtgatgaca

SEQ ID NO: 341649 - DNA, 20 bp, Artificial
  CRISPR gRNA sequence
gtagagaggagtgatgacaa

SEQ ID NO: 341650 - DNA, 20 bp, Artificial
  CRISPR gRNA sequence
atgacaagggtctccgccaa

SEQ ID NO: 341651 - DNA, 20 bp, Artificial
  CRISPR gRNA sequence
tgacaagggtctccgccaaa

SEQ ID NO: 341652 - DNA, 20 bp, Artificial
  CRISPR gRNA sequence
gacaagggtctccgccaaaa

SEQ ID NO: 341653 - DNA, 20 bp, Artificial
  CRISPR gRNA sequence
ggtctccgccaaaagggaaa

SEQ ID NO: 341654 - DNA, 20 bp, Artificial
  CRISPR gRNA sequence
tctccgccaaaagggaaatg

SEQ ID NO: 341655 - DNA, 20 bp, Artificial
  CRISPR gRNA sequence
ctccgccaaaagggaaatgg

SEQ ID NO: 341656 - DNA, 20 bp, Artificial
  CRISPR gRNA sequence
tccgccaaaagggaaatgga

SEQ ID NO: 341657 - DNA, 20 bp, Artificial
  CRISPR gRNA sequence
ccgccaaaagggaaatggag

SEQ ID NO: 341658 - DNA, 20 bp, Artificial
  CRISPR gRNA sequence
aaagggaaatggaggggtta

SEQ ID NO: 341659 - DNA, 20 bp, Artificial
  CRISPR gRNA sequence
gggaaatggaggggttaaag

SEQ ID NO: 341660 - DNA, 20 bp, Artificial
  CRISPR gRNA sequence
ggaggggttaaagaagctgc

SEQ ID NO: 341661 - DNA, 20 bp, Artificial
  CRISPR gRNA sequence
gaggggttaaagaagctgct

SEQ ID NO: 341662 - DNA, 20 bp, Artificial
  CRISPR gRNA sequence
aggggttaaagaagctgctg

SEQ ID NO: 341663 - DNA, 20 bp, Artificial
  CRISPR gRNA sequence
gggttaaagaagctgctggg

SEQ ID NO: 341664 - DNA, 20 bp, Artificial
  CRISPR gRNA sequence
ggttaaagaagctgctgggg

SEQ ID NO: 341665 - DNA, 20 bp, Artificial
  CRISPR gRNA sequence
gttaaagaagctgctgggga

SEQ ID NO: 341666 - DNA, 20 bp, Artificial
  CRISPR gRNA sequence
aaacaatgtgttctcactcg

SEQ ID NO: 341667 - DNA, 20 bp, Artificial
  CRISPR gRNA sequence
aacaatgtgttctcactcgt

SEQ ID NO: 341668 - DNA, 20 bp, Artificial
  CRISPR gRNA sequence
aatgtgttctcactcgtagg

SEQ ID NO: 341669 - DNA, 20 bp, Artificial
  CRISPR gRNA sequence
atgtgttctcactcgtaggt

SEQ ID NO: 341670 - DNA, 20 bp, Artificial
  CRISPR gRNA sequence
gtaggtgggaattgaacaat

SEQ ID NO: 341671 - DNA, 20 bp, Artificial
  CRISPR gRNA sequence
aattgaacaatgagaacact

SEQ ID NO: 341672 - DNA, 20 bp, Artificial
  CRISPR gRNA sequence
acaatgagaacacttggaca

SEQ ID NO: 341673 - DNA, 20 bp, Artificial
  CRISPR gRNA sequence
caatgagaacacttggacac

SEQ ID NO: 341674 - DNA, 20 bp, Artificial
  CRISPR gRNA sequence
tgagaacacttggacacagg

SEQ ID NO: 341675 - DNA, 20 bp, Artificial
  CRISPR gRNA sequence
gagaacacttggacacagga

SEQ ID NO: 341676 - DNA, 20 bp, Artificial
  CRISPR gRNA sequence
agaacacttggacacaggaa

SEQ ID NO: 341677 - DNA, 20 bp, Artificial
  CRISPR gRNA sequence
gaacacttggacacaggaag

SEQ ID NO: 341678 - DNA, 20 bp, Artificial
  CRISPR gRNA sequence
ggaaggggaacatcacacac

SEQ ID NO: 341679 - DNA, 20 bp, Artificial
  CRISPR gRNA sequence
gaaggggaacatcacacact

SEQ ID NO: 341680 - DNA, 20 bp, Artificial
  CRISPR gRNA sequence
aaggggaacatcacacactg

SEQ ID NO: 341681 - DNA, 20 bp, Artificial
  CRISPR gRNA sequence
tcacacactggggcctgtcg

SEQ ID NO: 341682 - DNA, 20 bp, Artificial
  CRISPR gRNA sequence
cacacactggggcctgtcgt

SEQ ID NO: 341683 - DNA, 20 bp, Artificial
  CRISPR gRNA sequence
acacactggggcctgtcgtg

SEQ ID NO: 341684 - DNA, 20 bp, Artificial
  CRISPR gRNA sequence
ctggggcctgtcgtggggtg

SEQ ID NO: 341685 - DNA, 20 bp, Artificial
  CRISPR gRNA sequence
tggggcctgtcgtggggtgt

SEQ ID NO: 341686 - DNA, 20 bp, Artificial
  CRISPR gRNA sequence
ggggcctgtcgtggggtgtg

SEQ ID NO: 341687 - DNA, 20 bp, Artificial
  CRISPR gRNA sequence
ggcctgtcgtggggtgtggg

SEQ ID NO: 341688 - DNA, 20 bp, Artificial
  CRISPR gRNA sequence
gcctgtcgtggggtgtgggg

SEQ ID NO: 341689 - DNA, 20 bp, Artificial
  CRISPR gRNA sequence
cctgtcgtggggtgtgggga

SEQ ID NO: 341690 - DNA, 20 bp, Artificial
  CRISPR gRNA sequence
tgtcgtggggtgtggggagg

SEQ ID NO: 341691 - DNA, 20 bp, Artificial
  CRISPR gRNA sequence
gtcgtggggtgtggggaggg

SEQ ID NO: 341692 - DNA, 20 bp, Artificial
  CRISPR gRNA sequence
cgtggggtgtggggagggag

SEQ ID NO: 341693 - DNA, 20 bp, Artificial
  CRISPR gRNA sequence
gtggggtgtggggagggagg

SEQ ID NO: 341694 - DNA, 20 bp, Artificial
  CRISPR gRNA sequence
tggggtgtggggagggagga

SEQ ID NO: 341695 - DNA, 20 bp, Artificial
  CRISPR gRNA sequence
gtgtggggagggaggaggga

SEQ ID NO: 341696 - DNA, 20 bp, Artificial
  CRISPR gRNA sequence
ggagggaggagggatagcat

SEQ ID NO: 341697 - DNA, 20 bp, Artificial
  CRISPR gRNA sequence
gagggaggagggatagcatt

SEQ ID NO: 341698 - DNA, 20 bp, Artificial
  CRISPR gRNA sequence
gggaggagggatagcattag

SEQ ID NO: 341699 - DNA, 20 bp, Artificial
  CRISPR gRNA sequence
atatacctaatgtaaatgat

SEQ ID NO: 341700 - DNA, 20 bp, Artificial
  CRISPR gRNA sequence
taatgtaaatgatgagttaa

SEQ ID NO: 341701 - DNA, 20 bp, Artificial
  CRISPR gRNA sequence
aatgtaaatgatgagttaat

SEQ ID NO: 341702 - DNA, 20 bp, Artificial
  CRISPR gRNA sequence
aaatgatgagttaatgggtg

SEQ ID NO: 341703 - DNA, 20 bp, Artificial
  CRISPR gRNA sequence
atgggtgcagcacaccaaca

SEQ ID NO: 341704 - DNA, 20 bp, Artificial
  CRISPR gRNA sequence
cacattgtgtacatgtaccc

SEQ ID NO: 341705 - DNA, 20 bp, Artificial
  CRISPR gRNA sequence
tacatgtaccctagaactta

SEQ ID NO: 341706 - DNA, 20 bp, Artificial
  CRISPR gRNA sequence
caaaacaaaacaaaaacaat

SEQ ID NO: 341707 - DNA, 20 bp, Artificial
  CRISPR gRNA sequence
aaaacaaaacaaaaacaatg

SEQ ID NO: 341708 - DNA, 20 bp, Artificial
  CRISPR gRNA sequence
acaatgaggtgctattgttt

SEQ ID NO: 341709 - DNA, 20 bp, Artificial
  CRISPR gRNA sequence
atgaggtgctattgttttag

SEQ ID NO: 341710 - DNA, 20 bp, Artificial
  CRISPR gRNA sequence
ggtgctattgttttagtggt

SEQ ID NO: 341711 - DNA, 20 bp, Artificial
  CRISPR gRNA sequence
ttgttttagtggtgagtatc

SEQ ID NO: 341712 - DNA, 20 bp, Artificial
  CRISPR gRNA sequence
gttttagtggtgagtatccg

SEQ ID NO: 341713 - DNA, 20 bp, Artificial
  CRISPR gRNA sequence
gtggtgagtatccggagacc

SEQ ID NO: 341714 - DNA, 20 bp, Artificial
  CRISPR gRNA sequence
tggtgagtatccggagacct

SEQ ID NO: 341715 - DNA, 20 bp, Artificial
  CRISPR gRNA sequence
gtgagtatccggagacctgg

SEQ ID NO: 341716 - DNA, 20 bp, Artificial
  CRISPR gRNA sequence
gacctgggagttctatttac

SEQ ID NO: 341717 - DNA, 20 bp, Artificial
  CRISPR gRNA sequence
acctgggagttctatttacc

SEQ ID NO: 341718 - DNA, 20 bp, Artificial
  CRISPR gRNA sequence
tctatttaccaggtataacc

SEQ ID NO: 341719 - DNA, 20 bp, Artificial
  CRISPR gRNA sequence
ctatttaccaggtataacct

SEQ ID NO: 341720 - DNA, 20 bp, Artificial
  CRISPR gRNA sequence
ataacctgggctcaaaattc

SEQ ID NO: 341721 - DNA, 20 bp, Artificial
  CRISPR gRNA sequence
taacctgggctcaaaattcc

SEQ ID NO: 341722 - DNA, 20 bp, Artificial
  CRISPR gRNA sequence
tcaaaattccaggctgactt

SEQ ID NO: 341723 - DNA, 20 bp, Artificial
  CRISPR gRNA sequence
caaaattccaggctgacttc

SEQ ID NO: 341724 - DNA, 20 bp, Artificial
  CRISPR gRNA sequence
tcaggcatgtcctcatctca

SEQ ID NO: 341725 - DNA, 20 bp, Artificial
  CRISPR gRNA sequence
tgtcctcatctcatagatgc

SEQ ID NO: 341726 - DNA, 20 bp, Artificial
  CRISPR gRNA sequence
atctcatagatgccagcact

SEQ ID NO: 341727 - DNA, 20 bp, Artificial
  CRISPR gRNA sequence
tctcatagatgccagcacta

SEQ ID NO: 341728 - DNA, 20 bp, Artificial
  CRISPR gRNA sequence
tagatgccagcactaaggcc

SEQ ID NO: 341729 - DNA, 20 bp, Artificial
  CRISPR gRNA sequence
gatgccagcactaaggccca

SEQ ID NO: 341730 - DNA, 20 bp, Artificial
  CRISPR gRNA sequence
tgccagcactaaggcccaga

SEQ ID NO: 341731 - DNA, 20 bp, Artificial
  CRISPR gRNA sequence
gccagcactaaggcccagag

SEQ ID NO: 341732 - DNA, 20 bp, Artificial
  CRISPR gRNA sequence
ccagcactaaggcccagaga

SEQ ID NO: 341733 - DNA, 20 bp, Artificial
  CRISPR gRNA sequence
actaaggcccagagagggcc

SEQ ID NO: 341734 - DNA, 20 bp, Artificial
  CRISPR gRNA sequence
cagagagggccgagctcatt

SEQ ID NO: 341735 - DNA, 20 bp, Artificial
  CRISPR gRNA sequence
tcacccctgactgcatttcc

SEQ ID NO: 341736 - DNA, 20 bp, Artificial
  CRISPR gRNA sequence
cacccctgactgcatttccc

SEQ ID NO: 341737 - DNA, 20 bp, Artificial
  CRISPR gRNA sequence
acccctgactgcatttcccg

SEQ ID NO: 341738 - DNA, 20 bp, Artificial
  CRISPR gRNA sequence
cccctgactgcatttcccgg

SEQ ID NO: 341739 - DNA, 20 bp, Artificial
  CRISPR gRNA sequence
atttcccgggggtccttctg

SEQ ID NO: 341740 - DNA, 20 bp, Artificial
  CRISPR gRNA sequence
cccgggggtccttctgcagc

SEQ ID NO: 341741 - DNA, 20 bp, Artificial
  CRISPR gRNA sequence
ccgggggtccttctgcagcc

SEQ ID NO: 341742 - DNA, 20 bp, Artificial
  CRISPR gRNA sequence
tctgcagccaggtgctgctg

SEQ ID NO: 341743 - DNA, 20 bp, Artificial
  CRISPR gRNA sequence
caggtgctgctgtggtactt

SEQ ID NO: 341744 - DNA, 20 bp, Artificial
  CRISPR gRNA sequence
aggtgctgctgtggtacttt

SEQ ID NO: 341745 - DNA, 20 bp, Artificial
  CRISPR gRNA sequence
tgtggtactttgggatctat

SEQ ID NO: 341746 - DNA, 20 bp, Artificial
  CRISPR gRNA sequence
tactttgggatctattggct

SEQ ID NO: 341747 - DNA, 20 bp, Artificial
  CRISPR gRNA sequence
ggatctattggctgagctcc

SEQ ID NO: 341748 - DNA, 20 bp, Artificial
  CRISPR gRNA sequence
atctattggctgagctccca

SEQ ID NO: 341749 - DNA, 20 bp, Artificial
  CRISPR gRNA sequence
tattggctgagctcccagag

SEQ ID NO: 341750 - DNA, 20 bp, Artificial
  CRISPR gRNA sequence
attggctgagctcccagaga

SEQ ID NO: 341751 - DNA, 20 bp, Artificial
  CRISPR gRNA sequence
ttggctgagctcccagagaa

SEQ ID NO: 341752 - DNA, 20 bp, Artificial
  CRISPR gRNA sequence
gagctcccagagaagggtca

SEQ ID NO: 341753 - DNA, 20 bp, Artificial
  CRISPR gRNA sequence
cccagagaagggtcatggat

SEQ ID NO: 341754 - DNA, 20 bp, Artificial
  CRISPR gRNA sequence
ccagagaagggtcatggatt

SEQ ID NO: 341755 - DNA, 20 bp, Artificial
  CRISPR gRNA sequence
agaagggtcatggattgggc

SEQ ID NO: 341756 - DNA, 20 bp, Artificial
  CRISPR gRNA sequence
ggtcatggattgggctagtt

SEQ ID NO: 341757 - DNA, 20 bp, Artificial
  CRISPR gRNA sequence
ggattgggctagtttggaac

SEQ ID NO: 341758 - DNA, 20 bp, Artificial
  CRISPR gRNA sequence
gggctagtttggaacaagtg

SEQ ID NO: 341759 - DNA, 20 bp, Artificial
  CRISPR gRNA sequence
ggctagtttggaacaagtga

SEQ ID NO: 341760 - DNA, 20 bp, Artificial
  CRISPR gRNA sequence
gctagtttggaacaagtgaa

SEQ ID NO: 341761 - DNA, 20 bp, Artificial
  CRISPR gRNA sequence
tggaacaagtgaagggactg

SEQ ID NO: 341762 - DNA, 20 bp, Artificial
  CRISPR gRNA sequence
acaagtgaagggactgaaga

SEQ ID NO: 341763 - DNA, 20 bp, Artificial
  CRISPR gRNA sequence
caagtgaagggactgaagat

SEQ ID NO: 341764 - DNA, 20 bp, Artificial
  CRISPR gRNA sequence
gaagggactgaagatgggct

SEQ ID NO: 341765 - DNA, 20 bp, Artificial
  CRISPR gRNA sequence
gactgaagatgggctcagta

SEQ ID NO: 341766 - DNA, 20 bp, Artificial
  CRISPR gRNA sequence
actgaagatgggctcagtat

SEQ ID NO: 341767 - DNA, 20 bp, Artificial
  CRISPR gRNA sequence
ctgaagatgggctcagtatg

SEQ ID NO: 341768 - DNA, 20 bp, Artificial
  CRISPR gRNA sequence
gatgggctcagtatggggcg

SEQ ID NO: 341769 - DNA, 20 bp, Artificial
  CRISPR gRNA sequence
cagtatggggcgaagacctt

SEQ ID NO: 341770 - DNA, 20 bp, Artificial
  CRISPR gRNA sequence
agtatggggcgaagaccttc

SEQ ID NO: 341771 - DNA, 20 bp, Artificial
  CRISPR gRNA sequence
atggggcgaagaccttcagg

SEQ ID NO: 341772 - DNA, 20 bp, Artificial
  CRISPR gRNA sequence
tggggcgaagaccttcagga

SEQ ID NO: 341773 - DNA, 20 bp, Artificial
  CRISPR gRNA sequence
ggggcgaagaccttcaggaa

SEQ ID NO: 341774 - DNA, 20 bp, Artificial
  CRISPR gRNA sequence
agaccttcaggaagggtctg

SEQ ID NO: 341775 - DNA, 20 bp, Artificial
  CRISPR gRNA sequence
accttcaggaagggtctgca

SEQ ID NO: 341776 - DNA, 20 bp, Artificial
  CRISPR gRNA sequence
tcaggaagggtctgcagagt

SEQ ID NO: 341777 - DNA, 20 bp, Artificial
  CRISPR gRNA sequence
ggaagggtctgcagagtgag

SEQ ID NO: 341778 - DNA, 20 bp, Artificial
  CRISPR gRNA sequence
gaagggtctgcagagtgagt

SEQ ID NO: 341779 - DNA, 20 bp, Artificial
  CRISPR gRNA sequence
aagggtctgcagagtgagta

SEQ ID NO: 341780 - DNA, 20 bp, Artificial
  CRISPR gRNA sequence
agggtctgcagagtgagtag

SEQ ID NO: 341781 - DNA, 20 bp, Artificial
  CRISPR gRNA sequence
gggtctgcagagtgagtagg

SEQ ID NO: 341782 - DNA, 20 bp, Artificial
  CRISPR gRNA sequence
ggtctgcagagtgagtaggg

SEQ ID NO: 341783 - DNA, 20 bp, Artificial
  CRISPR gRNA sequence
gtgagtaggggggttttgac

SEQ ID NO: 341784 - DNA, 20 bp, Artificial
  CRISPR gRNA sequence
tgagtaggggggttttgact

SEQ ID NO: 341785 - DNA, 20 bp, Artificial
  CRISPR gRNA sequence
aggggggttttgactaggaa

SEQ ID NO: 341786 - DNA, 20 bp, Artificial
  CRISPR gRNA sequence
aggaaaagttccaaccctgc

SEQ ID NO: 341787 - DNA, 20 bp, Artificial
  CRISPR gRNA sequence
ggaaaagttccaaccctgcc

SEQ ID NO: 341788 - DNA, 20 bp, Artificial
  CRISPR gRNA sequence
gaaaagttccaaccctgccg

SEQ ID NO: 341789 - DNA, 20 bp, Artificial
  CRISPR gRNA sequence
accctgccggggccgctgtc

SEQ ID NO: 341790 - DNA, 20 bp, Artificial
  CRISPR gRNA sequence
cctgccggggccgctgtcaa

SEQ ID NO: 341791 - DNA, 20 bp, Artificial
  CRISPR gRNA sequence
cggggccgctgtcaagagaa

SEQ ID NO: 341792 - DNA, 20 bp, Artificial
  CRISPR gRNA sequence
caagagaaaagcatctatta

SEQ ID NO: 341793 - DNA, 20 bp, Artificial
  CRISPR gRNA sequence
tctattacagttacattttt

SEQ ID NO: 341794 - DNA, 20 bp, Artificial
  CRISPR gRNA sequence
tacagttacatttttaagtt

SEQ ID NO: 341795 - DNA, 20 bp, Artificial
  CRISPR gRNA sequence
agttacatttttaagttaag

SEQ ID NO: 341796 - DNA, 20 bp, Artificial
  CRISPR gRNA sequence
tttttaagttaagtagactg

SEQ ID NO: 341797 - DNA, 20 bp, Artificial
  CRISPR gRNA sequence
agaatatttcttgtgtatta

SEQ ID NO: 341798 - DNA, 20 bp, Artificial
  CRISPR gRNA sequence
gtattaaagacgttcctttt

SEQ ID NO: 341799 - DNA, 20 bp, Artificial
  CRISPR gRNA sequence
cctttttggttgatttgcaa

SEQ ID NO: 341800 - DNA, 20 bp, Artificial
  CRISPR gRNA sequence
ttggttgatttgcaatggaa

SEQ ID NO: 341801 - DNA, 20 bp, Artificial
  CRISPR gRNA sequence
ttttgttttctttttttttt

SEQ ID NO: 341802 - DNA, 20 bp, Artificial
  CRISPR gRNA sequence
tttctttttttttttggaaa

SEQ ID NO: 341803 - DNA, 20 bp, Artificial
  CRISPR gRNA sequence
ttctttttttttttggaaac

SEQ ID NO: 341804 - DNA, 20 bp, Artificial
  CRISPR gRNA sequence
tctttttttttttggaaaca

SEQ ID NO: 341805 - DNA, 20 bp, Artificial
  CRISPR gRNA sequence
ctctgctcactctgtctccc

SEQ ID NO: 341806 - DNA, 20 bp, Artificial
  CRISPR gRNA sequence
gctcactctgtctcccaagc

SEQ ID NO: 341807 - DNA, 20 bp, Artificial
  CRISPR gRNA sequence
tcactctgtctcccaagctg

SEQ ID NO: 341808 - DNA, 20 bp, Artificial
  CRISPR gRNA sequence
ctgtctcccaagctggagtg

SEQ ID NO: 341809 - DNA, 20 bp, Artificial
  CRISPR gRNA sequence
tctcccaagctggagtgcag

SEQ ID NO: 341810 - DNA, 20 bp, Artificial
  CRISPR gRNA sequence
caagctggagtgcagtggta

SEQ ID NO: 341811 - DNA, 20 bp, Artificial
  CRISPR gRNA sequence
ggagtgcagtggtacagtca

SEQ ID NO: 341812 - DNA, 20 bp, Artificial
  CRISPR gRNA sequence
ggtacagtcacggctcactg

SEQ ID NO: 341813 - DNA, 20 bp, Artificial
  CRISPR gRNA sequence
tcactgcagcctccacttcc

SEQ ID NO: 341814 - DNA, 20 bp, Artificial
  CRISPR gRNA sequence
agcctccacttcctggactc

SEQ ID NO: 341815 - DNA, 20 bp, Artificial
  CRISPR gRNA sequence
ctcaagtgatcttctcactt

SEQ ID NO: 341816 - DNA, 20 bp, Artificial
  CRISPR gRNA sequence
tcttctcacttcagccttct

SEQ ID NO: 341817 - DNA, 20 bp, Artificial
  CRISPR gRNA sequence
tctcacttcagccttctgag

SEQ ID NO: 341818 - DNA, 20 bp, Artificial
  CRISPR gRNA sequence
acttcagccttctgagtagc

SEQ ID NO: 341819 - DNA, 20 bp, Artificial
  CRISPR gRNA sequence
cttcagccttctgagtagct

SEQ ID NO: 341820 - DNA, 20 bp, Artificial
  CRISPR gRNA sequence
cttctgagtagctgggacta

SEQ ID NO: 341821 - DNA, 20 bp, Artificial
  CRISPR gRNA sequence
ttctgagtagctgggactac

SEQ ID NO: 341822 - DNA, 20 bp, Artificial
  CRISPR gRNA sequence
caggttcgtgccaccacgcc

SEQ ID NO: 341823 - DNA, 20 bp, Artificial
  CRISPR gRNA sequence
tggctaactttttgtatttt

SEQ ID NO: 341824 - DNA, 20 bp, Artificial
  CRISPR gRNA sequence
ctaactttttgtatttttag

SEQ ID NO: 341825 - DNA, 20 bp, Artificial
  CRISPR gRNA sequence
aactttttgtatttttagta

SEQ ID NO: 341826 - DNA, 20 bp, Artificial
  CRISPR gRNA sequence
ttttgtatttttagtagaga

SEQ ID NO: 341827 - DNA, 20 bp, Artificial
  CRISPR gRNA sequence
tttgtatttttagtagagac

SEQ ID NO: 341828 - DNA, 20 bp, Artificial
  CRISPR gRNA sequence
ttgtatttttagtagagaca

SEQ ID NO: 341829 - DNA, 20 bp, Artificial
  CRISPR gRNA sequence
cagggttttgccatgttgcc

SEQ ID NO: 341830 - DNA, 20 bp, Artificial
  CRISPR gRNA sequence
agggttttgccatgttgccc

SEQ ID NO: 341831 - DNA, 20 bp, Artificial
  CRISPR gRNA sequence
gggttttgccatgttgccca

SEQ ID NO: 341832 - DNA, 20 bp, Artificial
  CRISPR gRNA sequence
ccagggtgttcttaaactcc

SEQ ID NO: 341833 - DNA, 20 bp, Artificial
  CRISPR gRNA sequence
cagggtgttcttaaactcct

SEQ ID NO: 341834 - DNA, 20 bp, Artificial
  CRISPR gRNA sequence
gttcttaaactcctgggctc

SEQ ID NO: 341835 - DNA, 20 bp, Artificial
  CRISPR gRNA sequence
ttcttaaactcctgggctca

SEQ ID NO: 341836 - DNA, 20 bp, Artificial
  CRISPR gRNA sequence
tcttaaactcctgggctcaa

SEQ ID NO: 341837 - DNA, 20 bp, Artificial
  CRISPR gRNA sequence
ctcaagggatccgcctgcct

SEQ ID NO: 341838 - DNA, 20 bp, Artificial
  CRISPR gRNA sequence
ccgcctgccttggcctccta

SEQ ID NO: 341839 - DNA, 20 bp, Artificial
  CRISPR gRNA sequence
gccttggcctcctaaagtgc

SEQ ID NO: 341840 - DNA, 20 bp, Artificial
  CRISPR gRNA sequence
ccttggcctcctaaagtgct

SEQ ID NO: 341841 - DNA, 20 bp, Artificial
  CRISPR gRNA sequence
tcctaaagtgctgggattac

SEQ ID NO: 341842 - DNA, 20 bp, Artificial
  CRISPR gRNA sequence
agtgctgggattacaagtgt

SEQ ID NO: 341843 - DNA, 20 bp, Artificial
  CRISPR gRNA sequence
acaagtgtgagccactgctc

SEQ ID NO: 341844 - DNA, 20 bp, Artificial
  CRISPR gRNA sequence
gtgtgtgtgtgtgtgtgaaa

SEQ ID NO: 341845 - DNA, 20 bp, Artificial
  CRISPR gRNA sequence
tgtgtgtgtgtgtgtgaaaa

SEQ ID NO: 341846 - DNA, 20 bp, Artificial
  CRISPR gRNA sequence
gtgtgtgtgtgtgtgaaaaa

SEQ ID NO: 341847 - DNA, 20 bp, Artificial
  CRISPR gRNA sequence
aagggttttgctctgttacc

SEQ ID NO: 341848 - DNA, 20 bp, Artificial
  CRISPR gRNA sequence
agggttttgctctgttaccc

SEQ ID NO: 341849 - DNA, 20 bp, Artificial
  CRISPR gRNA sequence
ttttgctctgttacccaggc

SEQ ID NO: 341850 - DNA, 20 bp, Artificial
  CRISPR gRNA sequence
ttgctctgttacccaggctg

SEQ ID NO: 341851 - DNA, 20 bp, Artificial
  CRISPR gRNA sequence
ctgttacccaggctggagtg

SEQ ID NO: 341852 - DNA, 20 bp, Artificial
  CRISPR gRNA sequence
aggctggagtgcagtgatgt

SEQ ID NO: 341853 - DNA, 20 bp, Artificial
  CRISPR gRNA sequence
ctggagtgcagtgatgtgag

SEQ ID NO: 341854 - DNA, 20 bp, Artificial
  CRISPR gRNA sequence
gtgcagtgatgtgagcagcc

SEQ ID NO: 341855 - DNA, 20 bp, Artificial
  CRISPR gRNA sequence
tgtgagcagcctggacctct

SEQ ID NO: 341856 - DNA, 20 bp, Artificial
  CRISPR gRNA sequence
gtgagcagcctggacctctt

SEQ ID NO: 341857 - DNA, 20 bp, Artificial
  CRISPR gRNA sequence
tgagcagcctggacctcttg

SEQ ID NO: 341858 - DNA, 20 bp, Artificial
  CRISPR gRNA sequence
tggacctcttggggacctct

SEQ ID NO: 341859 - DNA, 20 bp, Artificial
  CRISPR gRNA sequence
ggacctcttggggacctctt

SEQ ID NO: 341860 - DNA, 20 bp, Artificial
  CRISPR gRNA sequence
cttggggacctcttgggctc

SEQ ID NO: 341861 - DNA, 20 bp, Artificial
  CRISPR gRNA sequence
ctcaagtgatcttcccatct

SEQ ID NO: 341862 - DNA, 20 bp, Artificial
  CRISPR gRNA sequence
tcttcccatctcagcctccc

SEQ ID NO: 341863 - DNA, 20 bp, Artificial
  CRISPR gRNA sequence
tcccatctcagcctcccaag

SEQ ID NO: 341864 - DNA, 20 bp, Artificial
  CRISPR gRNA sequence
atctcagcctcccaagtagc

SEQ ID NO: 341865 - DNA, 20 bp, Artificial
  CRISPR gRNA sequence
tctcagcctcccaagtagct

SEQ ID NO: 341866 - DNA, 20 bp, Artificial
  CRISPR gRNA sequence
ctcccaagtagctgggactg

SEQ ID NO: 341867 - DNA, 20 bp, Artificial
  CRISPR gRNA sequence
tcccaagtagctgggactgc

SEQ ID NO: 341868 - DNA, 20 bp, Artificial
  CRISPR gRNA sequence
tgcaggtgcactaccatgac

SEQ ID NO: 341869 - DNA, 20 bp, Artificial
  CRISPR gRNA sequence
ccatgaccagccaatttttt

SEQ ID NO: 341870 - DNA, 20 bp, Artificial
  CRISPR gRNA sequence
atgaccagccaattttttta

SEQ ID NO: 341871 - DNA, 20 bp, Artificial
  CRISPR gRNA sequence
cagccaatttttttagagac

SEQ ID NO: 341872 - DNA, 20 bp, Artificial
  CRISPR gRNA sequence
agccaatttttttagagaca

SEQ ID NO: 341873 - DNA, 20 bp, Artificial
  CRISPR gRNA sequence
caaggtctcactatgttgcc

SEQ ID NO: 341874 - DNA, 20 bp, Artificial
  CRISPR gRNA sequence
gtctcactatgttgcccagc

SEQ ID NO: 341875 - DNA, 20 bp, Artificial
  CRISPR gRNA sequence
tatgttgcccagctggtctc

SEQ ID NO: 341876 - DNA, 20 bp, Artificial
  CRISPR gRNA sequence
cccagctggtctcaagctcc

SEQ ID NO: 341877 - DNA, 20 bp, Artificial
  CRISPR gRNA sequence
ccagctggtctcaagctcct

SEQ ID NO: 341878 - DNA, 20 bp, Artificial
  CRISPR gRNA sequence
ggtctcaagctcctgggctc

SEQ ID NO: 341879 - DNA, 20 bp, Artificial
  CRISPR gRNA sequence
atgcaaatacccttctgcct

SEQ ID NO: 341880 - DNA, 20 bp, Artificial
  CRISPR gRNA sequence
cccttctgccttggcctccc

SEQ ID NO: 341881 - DNA, 20 bp, Artificial
  CRISPR gRNA sequence
tgccttggcctcccaagtgc

SEQ ID NO: 341882 - DNA, 20 bp, Artificial
  CRISPR gRNA sequence
gccttggcctcccaagtgct

SEQ ID NO: 341883 - DNA, 20 bp, Artificial
  CRISPR gRNA sequence
cctcccaagtgctgggatta

SEQ ID NO: 341884 - DNA, 20 bp, Artificial
  CRISPR gRNA sequence
ctcccaagtgctgggattat

SEQ ID NO: 341885 - DNA, 20 bp, Artificial
  CRISPR gRNA sequence
agtgctgggattataggcat

SEQ ID NO: 341886 - DNA, 20 bp, Artificial
  CRISPR gRNA sequence
taggcatgagccaccacatc

SEQ ID NO: 341887 - DNA, 20 bp, Artificial
  CRISPR gRNA sequence
tgagccaccacatctggtgt

SEQ ID NO: 341888 - DNA, 20 bp, Artificial
  CRISPR gRNA sequence
ggtttttgtttttgttttta

SEQ ID NO: 341889 - DNA, 20 bp, Artificial
  CRISPR gRNA sequence
gtttttgtttttgtttttac

SEQ ID NO: 341890 - DNA, 20 bp, Artificial
  CRISPR gRNA sequence
tgtttttgtttttacgggac

SEQ ID NO: 341891 - DNA, 20 bp, Artificial
  CRISPR gRNA sequence
gtttttgtttttacgggacc

SEQ ID NO: 341892 - DNA, 20 bp, Artificial
  CRISPR gRNA sequence
ttttacgggaccaggcacta

SEQ ID NO: 341893 - DNA, 20 bp, Artificial
  CRISPR gRNA sequence
acagctcacacctgtaatcc

SEQ ID NO: 341894 - DNA, 20 bp, Artificial
  CRISPR gRNA sequence
acctgtaatcctggcacttt

SEQ ID NO: 341895 - DNA, 20 bp, Artificial
  CRISPR gRNA sequence
ctgtaatcctggcactttca

SEQ ID NO: 341896 - DNA, 20 bp, Artificial
  CRISPR gRNA sequence
tgtaatcctggcactttcag

SEQ ID NO: 341897 - DNA, 20 bp, Artificial
  CRISPR gRNA sequence
tcctggcactttcagaggct

SEQ ID NO: 341898 - DNA, 20 bp, Artificial
  CRISPR gRNA sequence
gcactttcagaggctgagac

SEQ ID NO: 341899 - DNA, 20 bp, Artificial
  CRISPR gRNA sequence
ctttcagaggctgagactag

SEQ ID NO: 341900 - DNA, 20 bp, Artificial
  CRISPR gRNA sequence
ctgagactagaagattgctt

SEQ ID NO: 341901 - DNA, 20 bp, Artificial
  CRISPR gRNA sequence
actagaagattgcttgagcc

SEQ ID NO: 341902 - DNA, 20 bp, Artificial
  CRISPR gRNA sequence
ctagaagattgcttgagccc

SEQ ID NO: 341903 - DNA, 20 bp, Artificial
  CRISPR gRNA sequence
agaagattgcttgagcccag

SEQ ID NO: 341904 - DNA, 20 bp, Artificial
  CRISPR gRNA sequence
ttgcttgagcccaggagttc

SEQ ID NO: 341905 - DNA, 20 bp, Artificial
  CRISPR gRNA sequence
tgcttgagcccaggagttca

SEQ ID NO: 341906 - DNA, 20 bp, Artificial
  CRISPR gRNA sequence
agcccaggagttcaaggctg

SEQ ID NO: 341907 - DNA, 20 bp, Artificial
  CRISPR gRNA sequence
gcccaggagttcaaggctgt

SEQ ID NO: 341908 - DNA, 20 bp, Artificial
  CRISPR gRNA sequence
cccaggagttcaaggctgtg

SEQ ID NO: 341909 - DNA, 20 bp, Artificial
  CRISPR gRNA sequence
caggagttcaaggctgtggg

SEQ ID NO: 341910 - DNA, 20 bp, Artificial
  CRISPR gRNA sequence
atgattgcaccactgcactc

SEQ ID NO: 341911 - DNA, 20 bp, Artificial
  CRISPR gRNA sequence
tgcaccactgcactccagcc

SEQ ID NO: 341912 - DNA, 20 bp, Artificial
  CRISPR gRNA sequence
gcaccactgcactccagcct

SEQ ID NO: 341913 - DNA, 20 bp, Artificial
  CRISPR gRNA sequence
ctgcactccagcctgggtga

SEQ ID NO: 341914 - DNA, 20 bp, Artificial
  CRISPR gRNA sequence
gcactccagcctgggtgaca

SEQ ID NO: 341915 - DNA, 20 bp, Artificial
  CRISPR gRNA sequence
tccagcctgggtgacagagc

SEQ ID NO: 341916 - DNA, 20 bp, Artificial
  CRISPR gRNA sequence
aaactaaacaaaacaaaacc

SEQ ID NO: 341917 - DNA, 20 bp, Artificial
  CRISPR gRNA sequence
acaaaacaaaacccagtacc

SEQ ID NO: 341918 - DNA, 20 bp, Artificial
  CRISPR gRNA sequence
aaaacaaaacccagtaccaa

SEQ ID NO: 341919 - DNA, 20 bp, Artificial
  CRISPR gRNA sequence
aaacccagtaccaagagacc

SEQ ID NO: 341920 - DNA, 20 bp, Artificial
  CRISPR gRNA sequence
tgacaccaaacacgttttgc

SEQ ID NO: 341921 - DNA, 20 bp, Artificial
  CRISPR gRNA sequence
caccaaacacgttttgcaag

SEQ ID NO: 341922 - DNA, 20 bp, Artificial
  CRISPR gRNA sequence
accaaacacgttttgcaagt

SEQ ID NO: 341923 - DNA, 20 bp, Artificial
  CRISPR gRNA sequence
aaacacgttttgcaagtagg

SEQ ID NO: 341924 - DNA, 20 bp, Artificial
  CRISPR gRNA sequence
tttgcaagtaggtagtttaa

SEQ ID NO: 341925 - DNA, 20 bp, Artificial
  CRISPR gRNA sequence
agtaggtagtttaatagtta

SEQ ID NO: 341926 - DNA, 20 bp, Artificial
  CRISPR gRNA sequence
gtttaatagttacagttacc

SEQ ID NO: 341927 - DNA, 20 bp, Artificial
  CRISPR gRNA sequence
tacagttacctggttctaaa

SEQ ID NO: 341928 - DNA, 20 bp, Artificial
  CRISPR gRNA sequence
ggttctaaaaagtgtcttgc

SEQ ID NO: 341929 - DNA, 20 bp, Artificial
  CRISPR gRNA sequence
ttctaaaaagtgtcttgcta

SEQ ID NO: 341930 - DNA, 20 bp, Artificial
  CRISPR gRNA sequence
tgctagagaacatttgttca

SEQ ID NO: 341931 - DNA, 20 bp, Artificial
  CRISPR gRNA sequence
gctagagaacatttgttcaa

SEQ ID NO: 341932 - DNA, 20 bp, Artificial
  CRISPR gRNA sequence
ctagagaacatttgttcaaa

SEQ ID NO: 341933 - DNA, 20 bp, Artificial
  CRISPR gRNA sequence
tagagaacatttgttcaaag

SEQ ID NO: 341934 - DNA, 20 bp, Artificial
  CRISPR gRNA sequence
tgttcaaaggggccacttta

SEQ ID NO: 341935 - DNA, 20 bp, Artificial
  CRISPR gRNA sequence
cactttaaagcctgctattc

SEQ ID NO: 341936 - DNA, 20 bp, Artificial
  CRISPR gRNA sequence
cctgctattctagtgtatac

SEQ ID NO: 341937 - DNA, 20 bp, Artificial
  CRISPR gRNA sequence
attctagtgtatactggccg

SEQ ID NO: 341938 - DNA, 20 bp, Artificial
  CRISPR gRNA sequence
ggccgtagtttctgaaattg

SEQ ID NO: 341939 - DNA, 20 bp, Artificial
  CRISPR gRNA sequence
tagtttctgaaattgtagcg

SEQ ID NO: 341940 - DNA, 20 bp, Artificial
  CRISPR gRNA sequence
ttctgaaattgtagcgaaga

SEQ ID NO: 341941 - DNA, 20 bp, Artificial
  CRISPR gRNA sequence
ctgaaattgtagcgaagatg

SEQ ID NO: 341942 - DNA, 20 bp, Artificial
  CRISPR gRNA sequence
cgaagatggagaaataataa

SEQ ID NO: 341943 - DNA, 20 bp, Artificial
  CRISPR gRNA sequence
gaaataataacagcattcat

SEQ ID NO: 341944 - DNA, 20 bp, Artificial
  CRISPR gRNA sequence
agcattcataagcacaactg

SEQ ID NO: 341945 - DNA, 20 bp, Artificial
  CRISPR gRNA sequence
actgcagatattatacttct

SEQ ID NO: 341946 - DNA, 20 bp, Artificial
  CRISPR gRNA sequence
ttaaaaaaaacctttttttt

SEQ ID NO: 341947 - DNA, 20 bp, Artificial
  CRISPR gRNA sequence
ggaactataaaataaaaaca

SEQ ID NO: 341948 - DNA, 20 bp, Artificial
  CRISPR gRNA sequence
gaactataaaataaaaacac

SEQ ID NO: 341949 - DNA, 20 bp, Artificial
  CRISPR gRNA sequence
acatactcattttctcaaat

SEQ ID NO: 341950 - DNA, 20 bp, Artificial
  CRISPR gRNA sequence
aattggcttttgtgcaaaaa

SEQ ID NO: 341951 - DNA, 20 bp, Artificial
  CRISPR gRNA sequence
attggcttttgtgcaaaaaa

SEQ ID NO: 341952 - DNA, 20 bp, Artificial
  CRISPR gRNA sequence
aaaaaaaggttgttacctat

SEQ ID NO: 341953 - DNA, 20 bp, Artificial
  CRISPR gRNA sequence
aaaaaaggttgttacctatt

SEQ ID NO: 341954 - DNA, 20 bp, Artificial
  CRISPR gRNA sequence
gggttgctttgttatttcct

SEQ ID NO: 341955 - DNA, 20 bp, Artificial
  CRISPR gRNA sequence
tgctttgttatttccttaga

SEQ ID NO: 341956 - DNA, 20 bp, Artificial
  CRISPR gRNA sequence
gatgtattccaaattcccaa

SEQ ID NO: 341957 - DNA, 20 bp, Artificial
  CRISPR gRNA sequence
caacctgcacatgtgcactc

SEQ ID NO: 341958 - DNA, 20 bp, Artificial
  CRISPR gRNA sequence
aacctgcacatgtgcactct

SEQ ID NO: 341959 - DNA, 20 bp, Artificial
  CRISPR gRNA sequence
acatgtgcactctgggaaca

SEQ ID NO: 341960 - DNA, 20 bp, Artificial
  CRISPR gRNA sequence
gtgcactctgggaacacagt

SEQ ID NO: 341961 - DNA, 20 bp, Artificial
  CRISPR gRNA sequence
tgggaacacagtcagtttat

SEQ ID NO: 341962 - DNA, 20 bp, Artificial
  CRISPR gRNA sequence
aacacagtcagtttattggt

SEQ ID NO: 341963 - DNA, 20 bp, Artificial
  CRISPR gRNA sequence
acacagtcagtttattggtt

SEQ ID NO: 341964 - DNA, 20 bp, Artificial
  CRISPR gRNA sequence
cacagtcagtttattggttg

SEQ ID NO: 341965 - DNA, 20 bp, Artificial
  CRISPR gRNA sequence
acagtcagtttattggttgg

SEQ ID NO: 341966 - DNA, 20 bp, Artificial
  CRISPR gRNA sequence
ggggttgcttgcccgaaatc

SEQ ID NO: 341967 - DNA, 20 bp, Artificial
  CRISPR gRNA sequence
gggttgcttgcccgaaatct

SEQ ID NO: 341968 - DNA, 20 bp, Artificial
  CRISPR gRNA sequence
ggttgcttgcccgaaatctg

SEQ ID NO: 341969 - DNA, 20 bp, Artificial
  CRISPR gRNA sequence
ttgcccgaaatctggggtca

SEQ ID NO: 341970 - DNA, 20 bp, Artificial
  CRISPR gRNA sequence
gcccgaaatctggggtcata

SEQ ID NO: 341971 - DNA, 20 bp, Artificial
  CRISPR gRNA sequence
tattgtcttgatcctatcca

SEQ ID NO: 341972 - DNA, 20 bp, Artificial
  CRISPR gRNA sequence
aattctatttatccctttcc

SEQ ID NO: 341973 - DNA, 20 bp, Artificial
  CRISPR gRNA sequence
ttatccctttcctggaatac

SEQ ID NO: 341974 - DNA, 20 bp, Artificial
  CRISPR gRNA sequence
acgttaattcatgccccacc

SEQ ID NO: 341975 - DNA, 20 bp, Artificial
  CRISPR gRNA sequence
cgttaattcatgccccacct

SEQ ID NO: 341976 - DNA, 20 bp, Artificial
  CRISPR gRNA sequence
gttaattcatgccccaccta

SEQ ID NO: 341977 - DNA, 20 bp, Artificial
  CRISPR gRNA sequence
acctagggtgccgcatttcc

SEQ ID NO: 341978 - DNA, 20 bp, Artificial
  CRISPR gRNA sequence
ggtgccgcatttcccagcat

SEQ ID NO: 341979 - DNA, 20 bp, Artificial
  CRISPR gRNA sequence
gcattggctccacttgctgt

SEQ ID NO: 341980 - DNA, 20 bp, Artificial
  CRISPR gRNA sequence
tccacttgctgtgagccttg

SEQ ID NO: 341981 - DNA, 20 bp, Artificial
  CRISPR gRNA sequence
acttgctgtgagccttgaag

SEQ ID NO: 341982 - DNA, 20 bp, Artificial
  CRISPR gRNA sequence
cttgctgtgagccttgaaga

SEQ ID NO: 341983 - DNA, 20 bp, Artificial
  CRISPR gRNA sequence
gtgagccttgaagaaggcca

SEQ ID NO: 341984 - DNA, 20 bp, Artificial
  CRISPR gRNA sequence
cttgaagaaggccaaagctt

SEQ ID NO: 341985 - DNA, 20 bp, Artificial
  CRISPR gRNA sequence
tgcacccccaaacccgtcac

SEQ ID NO: 341986 - DNA, 20 bp, Artificial
  CRISPR gRNA sequence
cgtcaccagccttgctcccc

SEQ ID NO: 341987 - DNA, 20 bp, Artificial
  CRISPR gRNA sequence
cacacccttgcccacctcac

SEQ ID NO: 341988 - DNA, 20 bp, Artificial
  CRISPR gRNA sequence
cacccttgcccacctcacca

SEQ ID NO: 341989 - DNA, 20 bp, Artificial
  CRISPR gRNA sequence
tgcccacctcaccagagtta

SEQ ID NO: 341990 - DNA, 20 bp, Artificial
  CRISPR gRNA sequence
caccagagttacagtgccga

SEQ ID NO: 341991 - DNA, 20 bp, Artificial
  CRISPR gRNA sequence
tacagtgccgacagctctca

SEQ ID NO: 341992 - DNA, 20 bp, Artificial
  CRISPR gRNA sequence
agtgccgacagctctcacag

SEQ ID NO: 341993 - DNA, 20 bp, Artificial
  CRISPR gRNA sequence
gtgccgacagctctcacagt

SEQ ID NO: 341994 - DNA, 20 bp, Artificial
  CRISPR gRNA sequence
tgccgacagctctcacagtg

SEQ ID NO: 341995 - DNA, 20 bp, Artificial
  CRISPR gRNA sequence
gacagctctcacagtggggc

SEQ ID NO: 341996 - DNA, 20 bp, Artificial
  CRISPR gRNA sequence
acagctctcacagtggggcc

SEQ ID NO: 341997 - DNA, 20 bp, Artificial
  CRISPR gRNA sequence
tctcacagtggggccgggtg

SEQ ID NO: 341998 - DNA, 20 bp, Artificial
  CRISPR gRNA sequence
cacagtggggccgggtgtgg

SEQ ID NO: 341999 - DNA, 20 bp, Artificial
  CRISPR gRNA sequence
gtggggccgggtgtggtggt

SEQ ID NO: 342000 - DNA, 20 bp, Artificial
  CRISPR gRNA sequence
tggggccgggtgtggtggtc

SEQ ID NO: 342001 - DNA, 20 bp, Artificial
  CRISPR gRNA sequence
gggccgggtgtggtggtcag

SEQ ID NO: 342002 - DNA, 20 bp, Artificial
  CRISPR gRNA sequence
gccgggtgtggtggtcagga

SEQ ID NO: 342003 - DNA, 20 bp, Artificial
  CRISPR gRNA sequence
gggtgtggtggtcaggagag

SEQ ID NO: 342004 - DNA, 20 bp, Artificial
  CRISPR gRNA sequence
ggtgtggtggtcaggagaga

SEQ ID NO: 342005 - DNA, 20 bp, Artificial
  CRISPR gRNA sequence
tgtggtggtcaggagagaag

SEQ ID NO: 342006 - DNA, 20 bp, Artificial
  CRISPR gRNA sequence
gtaactctggtgaggtgggc

SEQ ID NO: 342007 - DNA, 20 bp, Artificial
  CRISPR gRNA sequence
ctgggggagcaaggctggtg

SEQ ID NO: 342008 - DNA, 20 bp, Artificial
  CRISPR gRNA sequence
gcaaggctggtgacgggttt

SEQ ID NO: 342009 - DNA, 20 bp, Artificial
  CRISPR gRNA sequence
gacgggtttgggggtgcaag

SEQ ID NO: 342010 - DNA, 20 bp, Artificial
  CRISPR gRNA sequence
tgcggcaccctaggtggggc

SEQ ID NO: 342011 - DNA, 20 bp, Artificial
  CRISPR gRNA sequence
gacatctagtattccaggaa

SEQ ID NO: 342012 - DNA, 20 bp, Artificial
  CRISPR gRNA sequence
tattccaggaaagggataaa

SEQ ID NO: 342013 - DNA, 20 bp, Artificial
  CRISPR gRNA sequence
aaagggataaatagaatttg

SEQ ID NO: 342014 - DNA, 20 bp, Artificial
  CRISPR gRNA sequence
aatttgagggattggtgaga

SEQ ID NO: 342015 - DNA, 20 bp, Artificial
  CRISPR gRNA sequence
ggattggtgagaacgggtct

SEQ ID NO: 342016 - DNA, 20 bp, Artificial
  CRISPR gRNA sequence
ggtgagaacgggtctatgga

SEQ ID NO: 342017 - DNA, 20 bp, Artificial
  CRISPR gRNA sequence
caataaactgactgtgttcc

SEQ ID NO: 342018 - DNA, 20 bp, Artificial
  CRISPR gRNA sequence
acatgtgcaggttggccatt

SEQ ID NO: 342019 - DNA, 20 bp, Artificial
  CRISPR gRNA sequence
caggttggccattgggaatt

SEQ ID NO: 342020 - DNA, 20 bp, Artificial
  CRISPR gRNA sequence
acaaaagccaatttgagaaa

SEQ ID NO: 342021 - DNA, 20 bp, Artificial
  CRISPR gRNA sequence
taatatctgcagttgtgctt

SEQ ID NO: 342022 - DNA, 20 bp, Artificial
  CRISPR gRNA sequence
aaactacggccagtatacac

SEQ ID NO: 342023 - DNA, 20 bp, Artificial
  CRISPR gRNA sequence
gcaaaacgtgtttggtgtca

SEQ ID NO: 342024 - DNA, 20 bp, Artificial
  CRISPR gRNA sequence
tgtcactgggtctcttggta

SEQ ID NO: 342025 - DNA, 20 bp, Artificial
  CRISPR gRNA sequence
tctagctctgtcacccaggc

SEQ ID NO: 342026 - DNA, 20 bp, Artificial
  CRISPR gRNA sequence
gtctcagcctctgaaagtgc

SEQ ID NO: 342027 - DNA, 20 bp, Artificial
  CRISPR gRNA sequence
cacttgggaggccaaggcag

SEQ ID NO: 342028 - DNA, 20 bp, Artificial
  CRISPR gRNA sequence
tcacatcactgcactccagc

SEQ ID NO: 342029 - DNA, 20 bp, Artificial
  CRISPR gRNA sequence
actttaggaggccaaggcag

SEQ ID NO: 342030 - DNA, 20 bp, Artificial
  CRISPR gRNA sequence
caggcggatcccttgagccc

SEQ ID NO: 342031 - DNA, 20 bp, Artificial
  CRISPR gRNA sequence
ggctgaagtgagaagatcac

SEQ ID NO: 342032 - DNA, 20 bp, Artificial
  CRISPR gRNA sequence
ctgcactccagcttgggaga

SEQ ID NO: 342033 - DNA, 20 bp, Artificial
  CRISPR gRNA sequence
agcttgggagacagagtgag

SEQ ID NO: 342034 - DNA, 20 bp, Artificial
  CRISPR gRNA sequence
tctcttgacagcggccccgg

SEQ ID NO: 342035 - DNA, 20 bp, Artificial
  CRISPR gRNA sequence
gacccccgggaaatgcagtc

SEQ ID NO: 342036 - DNA, 20 bp, Artificial
  CRISPR gRNA sequence
atgcagtcaggggtgagaag

SEQ ID NO: 342037 - DNA, 20 bp, Artificial
  CRISPR gRNA sequence
ggggtgagaagatgggtggg

SEQ ID NO: 342038 - DNA, 20 bp, Artificial
  CRISPR gRNA sequence
ggacatgcctgaagtcagcc

SEQ ID NO: 342039 - DNA, 20 bp, Artificial
  CRISPR gRNA sequence
taaatagaactcccaggtct

SEQ ID NO: 342040 - DNA, 20 bp, Artificial
  CRISPR gRNA sequence
tttaattatactttaagttc

SEQ ID NO: 342041 - DNA, 20 bp, Artificial
  CRISPR gRNA sequence
tcattgttcaattcccacct

SEQ ID NO: 342042 - DNA, 20 bp, Artificial
  CRISPR gRNA sequence
accaaattctagtagcaact

SEQ ID NO: 342043 - DNA, 20 bp, Artificial
  CRISPR gRNA sequence
ttagcaggtcacagggccat

SEQ ID NO: 342044 - DNA, 20 bp, Artificial
  CRISPR gRNA sequence
gggccataaggatgccaaga

SEQ ID NO: 342045 - DNA, 20 bp, Artificial
  CRISPR gRNA sequence
gtcagggcacctagggctcc

SEQ ID NO: 342046 - DNA, 20 bp, Artificial
  CRISPR gRNA sequence
tcttgcagcctgtcccacat

SEQ ID NO: 342047 - DNA, 20 bp, Artificial
  CRISPR gRNA sequence
ctgggtgtcactgccttcct

SEQ ID NO: 342048 - DNA, 20 bp, Artificial
  CRISPR gRNA sequence
tgccctaccacacccgcccc

SEQ ID NO: 342049 - DNA, 20 bp, Artificial
  CRISPR gRNA sequence
actttgggaggccaaggcgg

SEQ ID NO: 342050 - DNA, 20 bp, Artificial
  CRISPR gRNA sequence
tactagggaggctgaggcag

SEQ ID NO: 342051 - DNA, 20 bp, Artificial
  CRISPR gRNA sequence
cagccccagccccagcccct

SEQ ID NO: 342052 - DNA, 20 bp, Artificial
  CRISPR gRNA sequence
tttgttggtggtgtttgaga

SEQ ID NO: 342053 - DNA, 20 bp, Artificial
  CRISPR gRNA sequence
ttttgtattttttgtagaga

SEQ ID NO: 342054 - DNA, 20 bp, Artificial
  CRISPR gRNA sequence
acctcaacctcccaaagtgc

SEQ ID NO: 342055 - DNA, 20 bp, Artificial
  CRISPR gRNA sequence
ttttttttttttttttgaga

SEQ ID NO: 342056 - DNA, 20 bp, Artificial
  CRISPR gRNA sequence
tttcactctgttgcccaggc

SEQ ID NO: 342057 - DNA, 20 bp, Artificial
  CRISPR gRNA sequence
ctcactgcaacttccacctc

SEQ ID NO: 342058 - DNA, 20 bp, Artificial
  CRISPR gRNA sequence
ctggtgcatcacctgaggtc

SEQ ID NO: 342059 - DNA, 20 bp, Artificial
  CRISPR gRNA sequence
ctaaaaatacaaaaaattag

SEQ ID NO: 342060 - DNA, 20 bp, Artificial
  CRISPR gRNA sequence
tacttgggaggctgaggcag

SEQ ID NO: 342061 - DNA, 20 bp, Artificial
  CRISPR gRNA sequence
aaaaaataaaaaatgtatca

SEQ ID NO: 342062 - DNA, 20 bp, Artificial
  CRISPR gRNA sequence
tggtttctatgtctgaaccc

SEQ ID NO: 342063 - DNA, 20 bp, Artificial
  CRISPR gRNA sequence
agcaaagggcaggcctttgc

SEQ ID NO: 342064 - DNA, 20 bp, Artificial
  CRISPR gRNA sequence
gggcaggcctttgcaggggt

SEQ ID NO: 342065 - DNA, 20 bp, Artificial
  CRISPR gRNA sequence
cacgtccctagaggtgggcc

SEQ ID NO: 342066 - DNA, 20 bp, Artificial
  CRISPR gRNA sequence
cctagaggtgggcctgggat

SEQ ID NO: 342067 - DNA, 20 bp, Artificial
  CRISPR gRNA sequence
tgggcctgggatgggggttg

SEQ ID NO: 342068 - DNA, 20 bp, Artificial
  CRISPR gRNA sequence
ccttgaaggtctccacaggt

SEQ ID NO: 342069 - DNA, 20 bp, Artificial
  CRISPR gRNA sequence
ctgcaccatcactgccaatg

SEQ ID NO: 342070 - DNA, 20 bp, Artificial
  CRISPR gRNA sequence
tggctggcagtgcagggaca

SEQ ID NO: 342071 - DNA, 20 bp, Artificial
  CRISPR gRNA sequence
gtgcagggacaaggagtgca

SEQ ID NO: 342072 - DNA, 20 bp, Artificial
  CRISPR gRNA sequence
caactctctgtgccatcacg

SEQ ID NO: 342073 - DNA, 20 bp, Artificial
  CRISPR gRNA sequence
aggccttcagatgtgcccta

SEQ ID NO: 342074 - DNA, 20 bp, Artificial
  CRISPR gRNA sequence
tctctctacccactggccac

SEQ ID NO: 342075 - DNA, 20 bp, Artificial
  CRISPR gRNA sequence
ccttaatccccaccgctaga

SEQ ID NO: 342076 - DNA, 20 bp, Artificial
  CRISPR gRNA sequence
gaagccagacagaaagctcc

SEQ ID NO: 342077 - DNA, 20 bp, Artificial
  CRISPR gRNA sequence
gacagaaagctcctaggatt

SEQ ID NO: 342078 - DNA, 20 bp, Artificial
  CRISPR gRNA sequence
gataagaggaggggaaaaag

SEQ ID NO: 342079 - DNA, 20 bp, Artificial
  CRISPR gRNA sequence
cagagtccactgtttaggag

SEQ ID NO: 342080 - DNA, 20 bp, Artificial
  CRISPR gRNA sequence
agaggagttggccaacggtg

SEQ ID NO: 342081 - DNA, 20 bp, Artificial
  CRISPR gRNA sequence
agttggccaacggtggcggg

SEQ ID NO: 342082 - DNA, 20 bp, Artificial
  CRISPR gRNA sequence
gccaacggtggcgggtggga

SEQ ID NO: 342083 - DNA, 20 bp, Artificial
  CRISPR gRNA sequence
cgcatccttgtgatcttctc

SEQ ID NO: 342084 - DNA, 20 bp, Artificial
  CRISPR gRNA sequence
tcaaccccactgcccacgcc

SEQ ID NO: 342085 - DNA, 20 bp, Artificial
  CRISPR gRNA sequence
ccactgctggccaagactca

SEQ ID NO: 342086 - DNA, 20 bp, Artificial
  CRISPR gRNA sequence
gcagcaccatccccatccag

SEQ ID NO: 342087 - DNA, 20 bp, Artificial
  CRISPR gRNA sequence
accccgccgaccatccaagg

SEQ ID NO: 342088 - DNA, 20 bp, Artificial
  CRISPR gRNA sequence
cctttcctgtgtacacgtga

SEQ ID NO: 342089 - DNA, 20 bp, Artificial
  CRISPR gRNA sequence
tggcagggacgaggacaaat

SEQ ID NO: 342090 - DNA, 20 bp, Artificial
  CRISPR gRNA sequence
ggacaaatatggatgaggtg

SEQ ID NO: 342091 - DNA, 20 bp, Artificial
  CRISPR gRNA sequence
ggccgcctcctggctcaggt

SEQ ID NO: 342092 - DNA, 20 bp, Artificial
  CRISPR gRNA sequence
gccaggaggcggccaggaaa

SEQ ID NO: 342093 - DNA, 20 bp, Artificial
  CRISPR gRNA sequence
aggaaactggattttgggac

SEQ ID NO: 342094 - DNA, 20 bp, Artificial
  CRISPR gRNA sequence
gagaggaagctggagagctg

SEQ ID NO: 342095 - DNA, 20 bp, Artificial
  CRISPR gRNA sequence
ttttgcccgtcttgtagcat

SEQ ID NO: 342096 - DNA, 20 bp, Artificial
  CRISPR gRNA sequence
acaggaaagggccctgacaa

SEQ ID NO: 342097 - DNA, 20 bp, Artificial
  CRISPR gRNA sequence
ctgccaggtctcactctccc

SEQ ID NO: 342098 - DNA, 20 bp, Artificial
  CRISPR gRNA sequence
actctcccttggatggtcgg

SEQ ID NO: 342099 - DNA, 20 bp, Artificial
  CRISPR gRNA sequence
ccttggatggtcggcggggt

SEQ ID NO: 342100 - DNA, 20 bp, Artificial
  CRISPR gRNA sequence
tccggttttcggtaatcctc

SEQ ID NO: 342101 - DNA, 20 bp, Artificial
  CRISPR gRNA sequence
tttcggtaatcctcctggat

SEQ ID NO: 342102 - DNA, 20 bp, Artificial
  CRISPR gRNA sequence
tgtctgcagaaggagatccg

SEQ ID NO: 342103 - DNA, 20 bp, Artificial
  CRISPR gRNA sequence
gggggagacgggagaaggag

SEQ ID NO: 342104 - DNA, 20 bp, Artificial
  CRISPR gRNA sequence
ggagaaggagatgggtagag

SEQ ID NO: 342105 - DNA, 20 bp, Artificial
  CRISPR gRNA sequence
gaggcgggtgcgcttggggg

SEQ ID NO: 342106 - DNA, 20 bp, Artificial
  CRISPR gRNA sequence
acgccagctaaggggagaga

SEQ ID NO: 342107 - DNA, 20 bp, Artificial
  CRISPR gRNA sequence
aggctggtgaagtggagctg

SEQ ID NO: 342108 - DNA, 20 bp, Artificial
  CRISPR gRNA sequence
gagattccaggcgtgggcag

SEQ ID NO: 342109 - DNA, 20 bp, Artificial
  CRISPR gRNA sequence
gggcagtggggttgagccag

SEQ ID NO: 342110 - DNA, 20 bp, Artificial
  CRISPR gRNA sequence
tggaggaacagggccccggc

SEQ ID NO: 342111 - DNA, 20 bp, Artificial
  CRISPR gRNA sequence
aacattccagagaagatcac

SEQ ID NO: 342112 - DNA, 20 bp, Artificial
  CRISPR gRNA sequence
ccagagaagatcacaaggat

SEQ ID NO: 342113 - DNA, 20 bp, Artificial
  CRISPR gRNA sequence
gaataaaatcggagctgcac

SEQ ID NO: 342114 - DNA, 20 bp, Artificial
  CRISPR gRNA sequence
tgtaataggaggggacacac

SEQ ID NO: 342115 - DNA, 20 bp, Artificial
  CRISPR gRNA sequence
gggacacacaggggttaggg

SEQ ID NO: 342116 - DNA, 20 bp, Artificial
  CRISPR gRNA sequence
tatgcattctctctagcggt

SEQ ID NO: 342117 - DNA, 20 bp, Artificial
  CRISPR gRNA sequence
ggagaaaactcacgtggcca

SEQ ID NO: 342118 - DNA, 20 bp, Artificial
  CRISPR gRNA sequence
tcacgtggccagtgggtaga

SEQ ID NO: 342119 - DNA, 20 bp, Artificial
  CRISPR gRNA sequence
ggcagctgcctgaagtcagc

SEQ ID NO: 342120 - DNA, 20 bp, Artificial
  CRISPR gRNA sequence
catctctggaaaaacagaga

SEQ ID NO: 342121 - DNA, 20 bp, Artificial
  CRISPR gRNA sequence
tctggaaaaacagagacaga

SEQ ID NO: 342122 - DNA, 20 bp, Artificial
  CRISPR gRNA sequence
atctgaaggcctgagaggtg

SEQ ID NO: 342123 - DNA, 20 bp, Artificial
  CRISPR gRNA sequence
aaggcctgagaggtgctgga

SEQ ID NO: 342124 - DNA, 20 bp, Artificial
  CRISPR gRNA sequence
gaaacaggctgaccttatct

SEQ ID NO: 342125 - DNA, 20 bp, Artificial
  CRISPR gRNA sequence
ggctgaccttatctaggggt

SEQ ID NO: 342126 - DNA, 20 bp, Artificial
  CRISPR gRNA sequence
cttatctaggggtaggagtg

SEQ ID NO: 342127 - DNA, 20 bp, Artificial
  CRISPR gRNA sequence
taggagtggggagtactggt

SEQ ID NO: 342128 - DNA, 20 bp, Artificial
  CRISPR gRNA sequence
ctaccccacgtgatggcaca

SEQ ID NO: 342129 - DNA, 20 bp, Artificial
  CRISPR gRNA sequence
ttaccactgacataaggtaa

SEQ ID NO: 342130 - DNA, 20 bp, Artificial
  CRISPR gRNA sequence
ataaggtaagtgggtgggct

SEQ ID NO: 342131 - DNA, 20 bp, Artificial
  CRISPR gRNA sequence
agacgaccgagcggtcagcg

SEQ ID NO: 342132 - DNA, 20 bp, Artificial
  CRISPR gRNA sequence
ggtcagcgaagggtttggaa

SEQ ID NO: 342133 - DNA, 20 bp, Artificial
  CRISPR gRNA sequence
acctttcagaaggaagattc

SEQ ID NO: 342134 - DNA, 20 bp, Artificial
  CRISPR gRNA sequence
ttttatttatttttttgaga

SEQ ID NO: 342135 - DNA, 20 bp, Artificial
  CRISPR gRNA sequence
ctcgctcttgttgccgaggc

SEQ ID NO: 342136 - DNA, 20 bp, Artificial
  CRISPR gRNA sequence
ctcgttgcaacctctgcctc

SEQ ID NO: 342137 - DNA, 20 bp, Artificial
  CRISPR gRNA sequence
gcctcagcctcccaagtagc

SEQ ID NO: 342138 - DNA, 20 bp, Artificial
  CRISPR gRNA sequence
ttttgtatttttagtagaga

SEQ ID NO: 342139 - DNA, 20 bp, Artificial
  CRISPR gRNA sequence
gcctcagcctcccaaagtgt

SEQ ID NO: 342140 - DNA, 20 bp, Artificial
  CRISPR gRNA sequence
cacgcatgattgtaaagctt

SEQ ID NO: 342141 - DNA, 20 bp, Artificial
  CRISPR gRNA sequence
gatcaacaaatataaaatag

SEQ ID NO: 342142 - DNA, 20 bp, Artificial
  CRISPR gRNA sequence
taaaatagccgggtgaggca

SEQ ID NO: 342143 - DNA, 20 bp, Artificial
  CRISPR gRNA sequence
ctgcactccagcctgggcaa

SEQ ID NO: 342144 - DNA, 20 bp, Artificial
  CRISPR gRNA sequence
cagcactttgggaggttgag

SEQ ID NO: 342145 - DNA, 20 bp, Artificial
  CRISPR gRNA sequence
actttgggaggttgaggtgg

SEQ ID NO: 342146 - DNA, 20 bp, Artificial
  CRISPR gRNA sequence
tgggtggattgcttgagctc

SEQ ID NO: 342147 - DNA, 20 bp, Artificial
  CRISPR gRNA sequence
acaaaaaatacaaaaattag

SEQ ID NO: 342148 - DNA, 20 bp, Artificial
  CRISPR gRNA sequence
tactggggaggctgaggtgg

SEQ ID NO: 342149 - DNA, 20 bp, Artificial
  CRISPR gRNA sequence
tcatgatactgcgctccagc

SEQ ID NO: 342150 - DNA, 20 bp, Artificial
  CRISPR gRNA sequence
ctgcgctccagcctgggtga

SEQ ID NO: 342151 - DNA, 20 bp, Artificial
  CRISPR gRNA sequence
aaaacaaaacaaagtatatt

SEQ ID NO: 342152 - DNA, 20 bp, Artificial
  CRISPR gRNA sequence
ccaggggctggggctggggc

SEQ ID NO: 342153 - DNA, 20 bp, Artificial
  CRISPR gRNA sequence
ttggttggggggaagaaatg

SEQ ID NO: 342154 - DNA, 20 bp, Artificial
  CRISPR gRNA sequence
gaaatggggagtcattgcta

SEQ ID NO: 342155 - DNA, 20 bp, Artificial
  CRISPR gRNA sequence
ctaaggggtacaagtttctc

SEQ ID NO: 342156 - DNA, 20 bp, Artificial
  CRISPR gRNA sequence
ctggggtaacgaaaatgtta

SEQ ID NO: 342157 - DNA, 20 bp, Artificial
  CRISPR gRNA sequence
tgttgatggctgcacaacct

SEQ ID NO: 342158 - DNA, 20 bp, Artificial
  CRISPR gRNA sequence
tttgtttgtttgttttttga

SEQ ID NO: 342159 - DNA, 20 bp, Artificial
  CRISPR gRNA sequence
tcttgctttgtcgcccaggt

SEQ ID NO: 342160 - DNA, 20 bp, Artificial
  CRISPR gRNA sequence
ctcagtgcaacctccgcctc

SEQ ID NO: 342161 - DNA, 20 bp, Artificial
  CRISPR gRNA sequence
gcctcagcctccctagtagc

SEQ ID NO: 342162 - DNA, 20 bp, Artificial
  CRISPR gRNA sequence
ttttgtatttttagtagaga

SEQ ID NO: 342163 - DNA, 20 bp, Artificial
  CRISPR gRNA sequence
cggggtttcaccgtgttagc

SEQ ID NO: 342164 - DNA, 20 bp, Artificial
  CRISPR gRNA sequence
gccttggcctcccaaagtgc

SEQ ID NO: 342165 - DNA, 20 bp, Artificial
  CRISPR gRNA sequence
agtgctgggattacaggcgt

SEQ ID NO: 342166 - DNA, 20 bp, Artificial
  CRISPR gRNA sequence
tcaagtgtagaggtccgatg

SEQ ID NO: 342167 - DNA, 20 bp, Artificial
  CRISPR gRNA sequence
agaggtccgatgctgggtgg

SEQ ID NO: 342168 - DNA, 20 bp, Artificial
  CRISPR gRNA sequence
gggtgttaattatcctgggg

SEQ ID NO: 342169 - DNA, 20 bp, Artificial
  CRISPR gRNA sequence
gctggcggctggtttgagag

SEQ ID NO: 342170 - DNA, 20 bp, Artificial
  CRISPR gRNA sequence
ggtgccctgacaggtggaag

SEQ ID NO: 342171 - DNA, 20 bp, Artificial
  CRISPR gRNA sequence
ggaagaggggtgcagaaagg

SEQ ID NO: 342172 - DNA, 20 bp, Artificial
  CRISPR gRNA sequence
gaaagggaggatgtcaaaga

SEQ ID NO: 342173 - DNA, 20 bp, Artificial
  CRISPR gRNA sequence
tatggccctgtgacctgcta

SEQ ID NO: 342174 - DNA, 20 bp, Artificial
  CRISPR gRNA sequence
cctgctaatgaatgctgact

SEQ ID NO: 342175 - DNA, 20 bp, Artificial
  CRISPR gRNA sequence
tgctgactctgagttgctac

SEQ ID NO: 342176 - DNA, 20 bp, Artificial
  CRISPR gRNA sequence
tggtttccttgtggcttccc

SEQ ID NO: 342177 - DNA, 20 bp, Artificial
  CRISPR gRNA sequence
cccaggaattgtgagccatg

SEQ ID NO: 342178 - DNA, 20 bp, Artificial
  CRISPR gRNA sequence
tggataaggacctgcaaggg

SEQ ID NO: 342179 - DNA, 20 bp, Artificial
  CRISPR gRNA sequence
ggagagcactggtggtagag

SEQ ID NO: 342180 - DNA, 20 bp, Artificial
  CRISPR gRNA sequence
tggtagagaggagtgatgac

SEQ ID NO: 342181 - DNA, 20 bp, Artificial
  CRISPR gRNA sequence
ctccgccaaaagggaaatgg

SEQ ID NO: 342182 - DNA, 20 bp, Artificial
  CRISPR gRNA sequence
gggttaaagaagctgctggg

SEQ ID NO: 342183 - DNA, 20 bp, Artificial
  CRISPR gRNA sequence
atgtgttctcactcgtaggt

SEQ ID NO: 342184 - DNA, 20 bp, Artificial
  CRISPR gRNA sequence
tcacacactggggcctgtcg

SEQ ID NO: 342185 - DNA, 20 bp, Artificial
  CRISPR gRNA sequence
gtggggtgtggggagggagg

SEQ ID NO: 342186 - DNA, 20 bp, Artificial
  CRISPR gRNA sequence
agatatacctaatgtaaatg

SEQ ID NO: 342187 - DNA, 20 bp, Artificial
  CRISPR gRNA sequence
ctaatgtaaatgatgagtta

SEQ ID NO: 342188 - DNA, 20 bp, Artificial
  CRISPR gRNA sequence
gaggtgctattgttttagtg

SEQ ID NO: 342189 - DNA, 20 bp, Artificial
  CRISPR gRNA sequence
tggtgagtatccggagacct

SEQ ID NO: 342190 - DNA, 20 bp, Artificial
  CRISPR gRNA sequence
cacccctgactgcatttccc

SEQ ID NO: 342191 - DNA, 20 bp, Artificial
  CRISPR gRNA sequence
caggtgctgctgtggtactt

SEQ ID NO: 342192 - DNA, 20 bp, Artificial
  CRISPR gRNA sequence
tattggctgagctcccagag

SEQ ID NO: 342193 - DNA, 20 bp, Artificial
  CRISPR gRNA sequence
tgagctcccagagaagggtc

SEQ ID NO: 342194 - DNA, 20 bp, Artificial
  CRISPR gRNA sequence
atggggcgaagaccttcagg

SEQ ID NO: 342195 - DNA, 20 bp, Artificial
  CRISPR gRNA sequence
agaccttcaggaagggtctg

SEQ ID NO: 342196 - DNA, 20 bp, Artificial
  CRISPR gRNA sequence
cttcaggaagggtctgcaga

SEQ ID NO: 342197 - DNA, 20 bp, Artificial
  CRISPR gRNA sequence
agggtctgcagagtgagtag

SEQ ID NO: 342198 - DNA, 20 bp, Artificial
  CRISPR gRNA sequence
tttttaagttaagtagactg

SEQ ID NO: 342199 - DNA, 20 bp, Artificial
  CRISPR gRNA sequence
tttctttttttttttggaaa

SEQ ID NO: 342200 - DNA, 20 bp, Artificial
  CRISPR gRNA sequence
gctcactctgtctcccaagc

SEQ ID NO: 342201 - DNA, 20 bp, Artificial
  CRISPR gRNA sequence
gatcttctcacttcagcctt

SEQ ID NO: 342202 - DNA, 20 bp, Artificial
  CRISPR gRNA sequence
ttttgtatttttagtagaga

SEQ ID NO: 342203 - DNA, 20 bp, Artificial
  CRISPR gRNA sequence
cagggttttgccatgttgcc

SEQ ID NO: 342204 - DNA, 20 bp, Artificial
  CRISPR gRNA sequence
ttcttaaactcctgggctca

SEQ ID NO: 342205 - DNA, 20 bp, Artificial
  CRISPR gRNA sequence
gccttggcctcctaaagtgc

SEQ ID NO: 342206 - DNA, 20 bp, Artificial
  CRISPR gRNA sequence
gtgtgtgtgtgtgtgtgaaa

SEQ ID NO: 342207 - DNA, 20 bp, Artificial
  CRISPR gRNA sequence
ttttgctctgttacccaggc

SEQ ID NO: 342208 - DNA, 20 bp, Artificial
  CRISPR gRNA sequence
tgccttggcctcccaagtgc

SEQ ID NO: 342209 - DNA, 20 bp, Artificial
  CRISPR gRNA sequence
ctagaagattgcttgagccc

SEQ ID NO: 342210 - DNA, 20 bp, Artificial
  CRISPR gRNA sequence
ttgcaccactgcactccagc

SEQ ID NO: 342211 - DNA, 20 bp, Artificial
  CRISPR gRNA sequence
caaaaaaaggttgttaccta

SEQ ID NO: 342212 - DNA, 20 bp, Artificial
  CRISPR gRNA sequence
acacagtcagtttattggtt

SEQ ID NO: 342213 - DNA, 20 bp, Artificial
  CRISPR gRNA sequence
ggggttgcttgcccgaaatc

SEQ ID NO: 342214 - DNA, 20 bp, Artificial
  CRISPR gRNA sequence
aattctatttatccctttcc

SEQ ID NO: 342215 - DNA, 20 bp, Artificial
  CRISPR gRNA sequence
acgttaattcatgccccacc

SEQ ID NO: 342216 - DNA, 20 bp, Artificial
  CRISPR gRNA sequence
cacacccttgcccacctcac

SEQ ID NO: 342217 - DNA, 20 bp, Artificial
  CRISPR gRNA sequence
cgacagctctcacagtgggg

SEQ ID NO: 342218 - DNA, 20 bp, Artificial
  CRISPR gRNA sequence
ctgggggagcaaggctggtg

SEQ ID NO: 342219 - DNA, 20 bp, Artificial
  CRISPR gRNA sequence
tgcaaggaggatgacggggc

SEQ ID NO: 342220 - DNA, 20 bp, Artificial
  CRISPR gRNA sequence
gaaagggataaatagaattt

SEQ ID NO: 342221 - DNA, 20 bp, Artificial
  CRISPR gRNA sequence
gagagaagtggctctatgac

SEQ ID NO: 342222 - DNA, 20 bp, Artificial
  CRISPR gRNA sequence
aaaatgagtatgtatgtagc

SEQ ID NO: 342223 - DNA, 20 bp, Artificial
  CRISPR gRNA sequence
tattttatagttccaaaaaa

SEQ ID NO: 342224 - DNA, 20 bp, Artificial
  CRISPR gRNA sequence
aagaagtataatatctgcag

SEQ ID NO: 342225 - DNA, 20 bp, Artificial
  CRISPR gRNA sequence
ggccagtatacactagaata

SEQ ID NO: 342226 - DNA, 20 bp, Artificial
  CRISPR gRNA sequence
ttaaactacctacttgcaaa

SEQ ID NO: 342227 - DNA, 20 bp, Artificial
  CRISPR gRNA sequence
tgtcactgggtctcttggta

SEQ ID NO: 342228 - DNA, 20 bp, Artificial
  CRISPR gRNA sequence
ctgggtctcttggtactggg

SEQ ID NO: 342229 - DNA, 20 bp, Artificial
  CRISPR gRNA sequence
tctcttggtactgggttttg

SEQ ID NO: 342230 - DNA, 20 bp, Artificial
  CRISPR gRNA sequence
tggtactgggttttgttttg

SEQ ID NO: 342231 - DNA, 20 bp, Artificial
  CRISPR gRNA sequence
agtctcagcctctgaaagtg

SEQ ID NO: 342232 - DNA, 20 bp, Artificial
  CRISPR gRNA sequence
ttttgtagagacttgagccc

SEQ ID NO: 342233 - DNA, 20 bp, Artificial
  CRISPR gRNA sequence
caggcggatcccttgagccc

SEQ ID NO: 342234 - DNA, 20 bp, Artificial
  CRISPR gRNA sequence
ccgtgactgtaccactgcac

SEQ ID NO: 342235 - DNA, 20 bp, Artificial
  CRISPR gRNA sequence
acagagtgagcagagtgaga

SEQ ID NO: 342236 - DNA, 20 bp, Artificial
  CRISPR gRNA sequence
tccaaaaaaaaaaagaaaac

SEQ ID NO: 342237 - DNA, 20 bp, Artificial
  CRISPR gRNA sequence
cttaaaaatgtaactgtaat

SEQ ID NO: 342238 - DNA, 20 bp, Artificial
  CRISPR gRNA sequence
ccactaaaacaatagcacct

SEQ ID NO: 342239 - DNA, 20 bp, Artificial
  CRISPR gRNA sequence
aaacaatagcacctcattgt

SEQ ID NO: 342240 - DNA, 20 bp, Artificial
  CRISPR gRNA sequence
atagcacctcattgtttttg

SEQ ID NO: 342241 - DNA, 20 bp, Artificial
  CRISPR gRNA sequence
acctcattgtttttgttttg

SEQ ID NO: 342242 - DNA, 20 bp, Artificial
  CRISPR gRNA sequence
attgtttttgttttgttttg

SEQ ID NO: 342243 - DNA, 20 bp, Artificial
  CRISPR gRNA sequence
agggtacatgtacacaatgt

SEQ ID NO: 342244 - DNA, 20 bp, Artificial
  CRISPR gRNA sequence
cccacctacgagtgagaaca

SEQ ID NO: 342245 - DNA, 20 bp, Artificial
  CRISPR gRNA sequence
cattgtttttaaccctcccc

SEQ ID NO: 342246 - DNA, 20 bp, Artificial
  CRISPR gRNA sequence
ctctcccctcctgcactgtc

SEQ ID NO: 342247 - DNA, 20 bp, Artificial
  CRISPR gRNA sequence
gcataagtagaagaaaattg

SEQ ID NO: 342248 - DNA, 20 bp, Artificial
  CRISPR gRNA sequence
agtgtctgccctaaggccca

SEQ ID NO: 342249 - DNA, 20 bp, Artificial
  CRISPR gRNA sequence
ggcgggcggatcacgaggtc

SEQ ID NO: 342250 - DNA, 20 bp, Artificial
  CRISPR gRNA sequence
ccctgggaatccctaatata

SEQ ID NO: 342251 - DNA, 20 bp, Artificial
  CRISPR gRNA sequence
ggaatccctaatatactttg

SEQ ID NO: 342252 - DNA, 20 bp, Artificial
  CRISPR gRNA sequence
tttgttttgttttttgttgg

SEQ ID NO: 342253 - DNA, 20 bp, Artificial
  CRISPR gRNA sequence
cctcccacctcagcctcccc

SEQ ID NO: 342254 - DNA, 20 bp, Artificial
  CRISPR gRNA sequence
ttttgtattttttgtagaga

SEQ ID NO: 342255 - DNA, 20 bp, Artificial
  CRISPR gRNA sequence
cacctcaacctcccaaagtg

SEQ ID NO: 342256 - DNA, 20 bp, Artificial
  CRISPR gRNA sequence
ttttttttttttttttgaga

SEQ ID NO: 342257 - DNA, 20 bp, Artificial
  CRISPR gRNA sequence
agccaaatttgtacaaattc

SEQ ID NO: 342258 - DNA, 20 bp, Artificial
  CRISPR gRNA sequence
ctggtgcatcacctgaggtc

SEQ ID NO: 342259 - DNA, 20 bp, Artificial
  CRISPR gRNA sequence
ttgggaggctgaggcaggag

SEQ ID NO: 342260 - DNA, 20 bp, Artificial
  CRISPR gRNA sequence
tataagctctttctactttt

SEQ ID NO: 342261 - DNA, 20 bp, Artificial
  CRISPR gRNA sequence
cctacccctagataaggtca

SEQ ID NO: 342262 - DNA, 20 bp, Artificial
  CRISPR gRNA sequence
cctgctgctactcattctgt

SEQ ID NO: 342263 - DNA, 20 bp, Artificial
  CRISPR gRNA sequence
tctctctacccactggccac

SEQ ID NO: 342264 - DNA, 20 bp, Artificial
  CRISPR gRNA sequence
ggaagccagacagaaagctc

SEQ ID NO: 342265 - DNA, 20 bp, Artificial
  CRISPR gRNA sequence
ggaggggaaaaagcagagtc

SEQ ID NO: 342266 - DNA, 20 bp, Artificial
  CRISPR gRNA sequence
gcccaaagatccctgtgcag

SEQ ID NO: 342267 - DNA, 20 bp, Artificial
  CRISPR gRNA sequence
gtgatcttctctggaatgtt

SEQ ID NO: 342268 - DNA, 20 bp, Artificial
  CRISPR gRNA sequence
ggcagcaccatccccatcca

SEQ ID NO: 342269 - DNA, 20 bp, Artificial
  CRISPR gRNA sequence
agatgaccaccctgcagctc

SEQ ID NO: 342270 - DNA, 20 bp, Artificial
  CRISPR gRNA sequence
ctgaaatcccagtcccaaaa

SEQ ID NO: 342271 - DNA, 20 bp, Artificial
  CRISPR gRNA sequence
tcaggtcaggatctggcaga

SEQ ID NO: 342272 - DNA, 20 bp, Artificial
  CRISPR gRNA sequence
agccaggaggcggccaggaa

SEQ ID NO: 342273 - DNA, 20 bp, Artificial
  CRISPR gRNA sequence
caggaaactggattttggga

SEQ ID NO: 342274 - DNA, 20 bp, Artificial
  CRISPR gRNA sequence
tgggtctttcgcagcaggaa

SEQ ID NO: 342275 - DNA, 20 bp, Artificial
  CRISPR gRNA sequence
gcaggcgcagctggctgggc

SEQ ID NO: 342276 - DNA, 20 bp, Artificial
  CRISPR gRNA sequence
ctcagggggagcaggcaggc

SEQ ID NO: 342277 - DNA, 20 bp, Artificial
  CRISPR gRNA sequence
aaggagatgggtagaggcgg

SEQ ID NO: 342278 - DNA, 20 bp, Artificial
  CRISPR gRNA sequence
aggctggtgaagtggagctg

SEQ ID NO: 342279 - DNA, 20 bp, Artificial
  CRISPR gRNA sequence
agtggagctggtgggtttca

SEQ ID NO: 342280 - DNA, 20 bp, Artificial
  CRISPR gRNA sequence
ctcctctcctaaacagtgga

SEQ ID NO: 342281 - DNA, 20 bp, Artificial
  CRISPR gRNA sequence
ctcctcttatccctaatcct

SEQ ID NO: 342282 - DNA, 20 bp, Artificial
  CRISPR gRNA sequence
ctaatcctaggagctttctg

SEQ ID NO: 342283 - DNA, 20 bp, Artificial
  CRISPR gRNA sequence
gtatgcattctctctagcgg

SEQ ID NO: 342284 - DNA, 20 bp, Artificial
  CRISPR gRNA sequence
agacgaccgagcggtcagcg

SEQ ID NO: 342285 - DNA, 20 bp, Artificial
  CRISPR gRNA sequence
tgtggagaccttcaaggtcc

SEQ ID NO: 342286 - DNA, 20 bp, Artificial
  CRISPR gRNA sequence
tcccaggcccacctctaggg

SEQ ID NO: 342287 - DNA, 20 bp, Artificial
  CRISPR gRNA sequence
gaaagttggacctttcagaa

SEQ ID NO: 342288 - DNA, 20 bp, Artificial
  CRISPR gRNA sequence
tagaaaccatgaaaagtaga

SEQ ID NO: 342289 - DNA, 20 bp, Artificial
  CRISPR gRNA sequence
tgcctcagcctcccaagtag

SEQ ID NO: 342290 - DNA, 20 bp, Artificial
  CRISPR gRNA sequence
ttttgtatttttagtagaga

SEQ ID NO: 342291 - DNA, 20 bp, Artificial
  CRISPR gRNA sequence
agcctcagcctcccaaagtg

SEQ ID NO: 342292 - DNA, 20 bp, Artificial
  CRISPR gRNA sequence
atatacgtacagagaggcac

SEQ ID NO: 342293 - DNA, 20 bp, Artificial
  CRISPR gRNA sequence
cagagaggcacgcatgattg

SEQ ID NO: 342294 - DNA, 20 bp, Artificial
  CRISPR gRNA sequence
aatagccgggtgaggcaggg

SEQ ID NO: 342295 - DNA, 20 bp, Artificial
  CRISPR gRNA sequence
gaaagaaaatagccaggtgc

SEQ ID NO: 342296 - DNA, 20 bp, Artificial
  CRISPR gRNA sequence
cactttgggaggttgaggtg

SEQ ID NO: 342297 - DNA, 20 bp, Artificial
  CRISPR gRNA sequence
ttgggaggttgaggtgggtg

SEQ ID NO: 342298 - DNA, 20 bp, Artificial
  CRISPR gRNA sequence
tgggtggattgcttgagctc

SEQ ID NO: 342299 - DNA, 20 bp, Artificial
  CRISPR gRNA sequence
tggggaggctgaggtgggag

SEQ ID NO: 342300 - DNA, 20 bp, Artificial
  CRISPR gRNA sequence
aaaaacaaaacaaagtatat

SEQ ID NO: 342301 - DNA, 20 bp, Artificial
  CRISPR gRNA sequence
gggagtcattgctaaggggt

SEQ ID NO: 342302 - DNA, 20 bp, Artificial
  CRISPR gRNA sequence
taaataaataataaatagtt

SEQ ID NO: 342303 - DNA, 20 bp, Artificial
  CRISPR gRNA sequence
ttacagttacttagccttta

SEQ ID NO: 342304 - DNA, 20 bp, Artificial
  CRISPR gRNA sequence
agttacttagcctttatttt

SEQ ID NO: 342305 - DNA, 20 bp, Artificial
  CRISPR gRNA sequence
acttagcctttattttgttt

SEQ ID NO: 342306 - DNA, 20 bp, Artificial
  CRISPR gRNA sequence
ttgtttgttttttgacagag

SEQ ID NO: 342307 - DNA, 20 bp, Artificial
  CRISPR gRNA sequence
aacctccgcctcctgagttc

SEQ ID NO: 342308 - DNA, 20 bp, Artificial
  CRISPR gRNA sequence
tgcctcagcctccctagtag

SEQ ID NO: 342309 - DNA, 20 bp, Artificial
  CRISPR gRNA sequence
ttttgtatttttagtagaga

SEQ ID NO: 342310 - DNA, 20 bp, Artificial
  CRISPR gRNA sequence
cgccttggcctcccaaagtg

SEQ ID NO: 342311 - DNA, 20 bp, Artificial
  CRISPR gRNA sequence
ctgggctgggctcgctggcg

SEQ ID NO: 342312 - DNA, 20 bp, Artificial
  CRISPR gRNA sequence
tggcggctggtttgagagga

SEQ ID NO: 342313 - DNA, 20 bp, Artificial
  CRISPR gRNA sequence
actctgagttgctactagaa

SEQ ID NO: 342314 - DNA, 20 bp, Artificial
  CRISPR gRNA sequence
ctactagaatttggtttcct

SEQ ID NO: 342315 - DNA, 20 bp, Artificial
  CRISPR gRNA sequence
aaacaaaaacaatgaggtgc

SEQ ID NO: 342316 - DNA, 20 bp, Artificial
  CRISPR gRNA sequence
ctgagctcccagagaagggt

SEQ ID NO: 342317 - DNA, 20 bp, Artificial
  CRISPR gRNA sequence
agagaagggtcatggattgg

SEQ ID NO: 342318 - DNA, 20 bp, Artificial
  CRISPR gRNA sequence
agggtctgcagagtgagtag

SEQ ID NO: 342319 - DNA, 20 bp, Artificial
  CRISPR gRNA sequence
tattaaagacgttccttttt

SEQ ID NO: 342320 - DNA, 20 bp, Artificial
  CRISPR gRNA sequence
ttttggttgatttgcaatgg

SEQ ID NO: 342321 - DNA, 20 bp, Artificial
  CRISPR gRNA sequence
ttgatttgcaatggaaaagc

SEQ ID NO: 342322 - DNA, 20 bp, Artificial
  CRISPR gRNA sequence
ttttgtatttttagtagaga

SEQ ID NO: 342323 - DNA, 20 bp, Artificial
  CRISPR gRNA sequence
tgccttggcctcctaaagtg

SEQ ID NO: 342324 - DNA, 20 bp, Artificial
  CRISPR gRNA sequence
ttacaagtgtgagccactgc

SEQ ID NO: 342325 - DNA, 20 bp, Artificial
  CRISPR gRNA sequence
gtgtgtgtgtgtgtgtgaaa

SEQ ID NO: 342326 - DNA, 20 bp, Artificial
  CRISPR gRNA sequence
ctgccttggcctcccaagtg

SEQ ID NO: 342327 - DNA, 20 bp, Artificial
  CRISPR gRNA sequence
catgagccaccacatctggt

SEQ ID NO: 342328 - DNA, 20 bp, Artificial
  CRISPR gRNA sequence
ccaccacatctggtgttggt

SEQ ID NO: 342329 - DNA, 20 bp, Artificial
  CRISPR gRNA sequence
catctggtgttggtttttgt

SEQ ID NO: 342330 - DNA, 20 bp, Artificial
  CRISPR gRNA sequence
cactttcagaggctgagact

SEQ ID NO: 342331 - DNA, 20 bp, Artificial
  CRISPR gRNA sequence
ttcagaggctgagactagaa

SEQ ID NO: 342332 - DNA, 20 bp, Artificial
  CRISPR gRNA sequence
gagttcaaggctgtggggag

SEQ ID NO: 342333 - DNA, 20 bp, Artificial
  CRISPR gRNA sequence
aagagacccagtgacaccaa

SEQ ID NO: 342334 - DNA, 20 bp, Artificial
  CRISPR gRNA sequence
ccaaacacgttttgcaagta

SEQ ID NO: 342335 - DNA, 20 bp, Artificial
  CRISPR gRNA sequence
ctattctagtgtatactggc

SEQ ID NO: 342336 - DNA, 20 bp, Artificial
  CRISPR gRNA sequence
caactgcagatattatactt

SEQ ID NO: 342337 - DNA, 20 bp, Artificial
  CRISPR gRNA sequence
atacatactcattttctcaa

SEQ ID NO: 342338 - DNA, 20 bp, Artificial
  CRISPR gRNA sequence
aaaaaggttgttacctattg

SEQ ID NO: 342339 - DNA, 20 bp, Artificial
  CRISPR gRNA sequence
atgtgcactctgggaacaca

SEQ ID NO: 342340 - DNA, 20 bp, Artificial
  CRISPR gRNA sequence
cagtcagtttattggttggg

SEQ ID NO: 342341 - DNA, 20 bp, Artificial
  CRISPR gRNA sequence
ctgtgagccttgaagaaggc

SEQ ID NO: 342342 - DNA, 20 bp, Artificial
  CRISPR gRNA sequence
gtcaccagccttgctccccc

SEQ ID NO: 342343 - DNA, 20 bp, Artificial
  CRISPR gRNA sequence
gtattccaggaaagggataa

SEQ ID NO: 342344 - DNA, 20 bp, Artificial
  CRISPR gRNA sequence
tttttgcacaaaagccaatt

SEQ ID NO: 342345 - DNA, 20 bp, Artificial
  CRISPR gRNA sequence
tctccatcttcgctacaatt

SEQ ID NO: 342346 - DNA, 20 bp, Artificial
  CRISPR gRNA sequence
gaaactacggccagtataca

SEQ ID NO: 342347 - DNA, 20 bp, Artificial
  CRISPR gRNA sequence
gaccctgtttccaaaaaaaa

SEQ ID NO: 342348 - DNA, 20 bp, Artificial
  CRISPR gRNA sequence
aaaggaacgtctttaataca

SEQ ID NO: 342349 - DNA, 20 bp, Artificial
  CRISPR gRNA sequence
cctgacaaaaggcataagta

SEQ ID NO: 342350 - DNA, 20 bp, Artificial
  CRISPR gRNA sequence
ctactagggaggctgaggca

SEQ ID NO: 342351 - DNA, 20 bp, Artificial
  CRISPR gRNA sequence
tataacattttcgttacccc

SEQ ID NO: 342352 - DNA, 20 bp, Artificial
  CRISPR gRNA sequence
ctacttgggaggctgaggca

SEQ ID NO: 342353 - DNA, 20 bp, Artificial
  CRISPR gRNA sequence
aaaatgtatcagggagtaca

SEQ ID NO: 342354 - DNA, 20 bp, Artificial
  CRISPR gRNA sequence
tccttaatccccaccgctag

SEQ ID NO: 342355 - DNA, 20 bp, Artificial
  CRISPR gRNA sequence
ggggccaggagggaagccag

SEQ ID NO: 342356 - DNA, 20 bp, Artificial
  CRISPR gRNA sequence
ggccaacggtggcgggtggg

SEQ ID NO: 342357 - DNA, 20 bp, Artificial
  CRISPR gRNA sequence
gatctccttctgcagacaaa

SEQ ID NO: 342358 - DNA, 20 bp, Artificial
  CRISPR gRNA sequence
tctctagcggtggggattaa

SEQ ID NO: 342359 - DNA, 20 bp, Artificial
  CRISPR gRNA sequence
gcatctctggaaaaacagag

SEQ ID NO: 342360 - DNA, 20 bp, Artificial
  CRISPR gRNA sequence
gtgctggatgggatgggaag

SEQ ID NO: 342361 - DNA, 20 bp, Artificial
  CRISPR gRNA sequence
ccattattattgttattaaa

SEQ ID NO: 342362 - DNA, 20 bp, Artificial
  CRISPR gRNA sequence
gaagattcatgggttcagac

SEQ ID NO: 342363 - DNA, 20 bp, Artificial
  CRISPR gRNA sequence
agacatagaaaccatgaaaa

SEQ ID NO: 342364 - DNA, 20 bp, Artificial
  CRISPR gRNA sequence
gcacgcatgattgtaaagct

SEQ ID NO: 342365 - DNA, 20 bp, Artificial
  CRISPR gRNA sequence
ccgtctcaaaaaaaaaaaaa

SEQ ID NO: 342366 - DNA, 20 bp, Artificial
  CRISPR gRNA sequence
tcaaaaaaaaaaaaaaaaga

SEQ ID NO: 342367 - DNA, 20 bp, Artificial
  CRISPR gRNA sequence
aaaaaaaaaaaaaagaaaag

SEQ ID NO: 342368 - DNA, 20 bp, Artificial
  CRISPR gRNA sequence
aaaaaaaaaagaaaagaaag

SEQ ID NO: 342369 - DNA, 20 bp, Artificial
  CRISPR gRNA sequence
gggctggggttggttggggg

SEQ ID NO: 342370 - DNA, 20 bp, Artificial
  CRISPR gRNA sequence
tctggggtaacgaaaatgtt

SEQ ID NO: 342371 - DNA, 20 bp, Artificial
  CRISPR gRNA sequence
aagtgctgggattacaggcg

SEQ ID NO: 342372 - DNA, 20 bp, Artificial
  CRISPR gRNA sequence
cccagatgtgggacaggctg

SEQ ID NO: 342373 - DNA, 20 bp, Artificial
  CRISPR gRNA sequence
ctgacaggtggaagaggggt

SEQ ID NO: 342374 - DNA, 20 bp, Artificial
  CRISPR gRNA sequence
agaaagggaggatgtcaaag

SEQ ID NO: 342375 - DNA, 20 bp, Artificial
  CRISPR gRNA sequence
atgctgactctgagttgcta

SEQ ID NO: 342376 - DNA, 20 bp, Artificial
  CRISPR gRNA sequence
ttggataaggacctgcaagg

SEQ ID NO: 342377 - DNA, 20 bp, Artificial
  CRISPR gRNA sequence
ccctgccggggccgctgtca

SEQ ID NO: 342378 - DNA, 20 bp, Artificial
  CRISPR gRNA sequence
atttttaagttaagtagact

SEQ ID NO: 342379 - DNA, 20 bp, Artificial
  CRISPR gRNA sequence
tctgaaattgtagcgaagat

SEQ ID NO: 342380 - DNA, 20 bp, Artificial
  CRISPR gRNA sequence
tgggttgctttgttatttcc

SEQ ID NO: 342381 - DNA, 20 bp, Artificial
  CRISPR gRNA sequence
actattaaactacctacttg

SEQ ID NO: 342382 - DNA, 20 bp, Artificial
  CRISPR gRNA sequence
gctgtagtgcctggtcccgt

SEQ ID NO: 342383 - DNA, 20 bp, Artificial
  CRISPR gRNA sequence
gtgcctggtcccgtaaaaac

SEQ ID NO: 342384 - DNA, 20 bp, Artificial
  CRISPR gRNA sequence
ggtcccgtaaaaacaaaaac

SEQ ID NO: 342385 - DNA, 20 bp, Artificial
  CRISPR gRNA sequence
ctccagcctgggtaacagag

SEQ ID NO: 342386 - DNA, 20 bp, Artificial
  CRISPR gRNA sequence
gaacaccctgggcaacatgg

SEQ ID NO: 342387 - DNA, 20 bp, Artificial
  CRISPR gRNA sequence
cctgtttccaaaaaaaaaaa

SEQ ID NO: 342388 - DNA, 20 bp, Artificial
  CRISPR gRNA sequence
gggttggaacttttcctagt

SEQ ID NO: 342389 - DNA, 20 bp, Artificial
  CRISPR gRNA sequence
ggtctccggatactcaccac

SEQ ID NO: 342390 - DNA, 20 bp, Artificial
  CRISPR gRNA sequence
gacaaagcaagactctgtca

SEQ ID NO: 342391 - DNA, 20 bp, Artificial
  CRISPR gRNA sequence
taccagcctggccaatacag

SEQ ID NO: 342392 - DNA, 20 bp, Artificial
  CRISPR gRNA sequence
ccccatccaggaggattacc

SEQ ID NO: 342393 - DNA, 20 bp, Artificial
  CRISPR gRNA sequence
gagggcgggggctctggttg

SEQ ID NO: 342394 - DNA, 20 bp, Artificial
  CRISPR gRNA sequence
aacagggccccggccagggt

SEQ ID NO: 342395 - DNA, 20 bp, Artificial
  CRISPR gRNA sequence
ctagcggtggggattaagga

SEQ ID NO: 342396 - DNA, 20 bp, Artificial
  CRISPR gRNA sequence
ctggcctccagcatctctgg

SEQ ID NO: 342397 - DNA, 20 bp, Artificial
  CRISPR gRNA sequence
tgtctcaaacaccaccaaca

SEQ ID NO: 342398 - DNA, 20 bp, Artificial
  CRISPR gRNA sequence
caaacaccaccaacaaaaaa

SEQ ID NO: 342399 - DNA, 20 bp, Artificial
  CRISPR gRNA sequence
agaagctgctggggagggtt

SEQ ID NO: 342400 - DNA, 20 bp, Artificial
  CRISPR gRNA sequence
tagaacttaaagtataatta

SEQ ID NO: 342401 - DNA, 20 bp, Artificial
  CRISPR gRNA sequence
cttaaagtataattaaaaaa

SEQ ID NO: 342402 - DNA, 20 bp, Artificial
  CRISPR gRNA sequence
agtataattaaaaaacaaaa

SEQ ID NO: 342403 - DNA, 20 bp, Artificial
  CRISPR gRNA sequence
aattaaaaaacaaaacaaaa

SEQ ID NO: 342404 - DNA, 20 bp, Artificial
  CRISPR gRNA sequence
aaaacaaaacaaaacaaaac

SEQ ID NO: 342405 - DNA, 20 bp, Artificial
  CRISPR gRNA sequence
gaccttgtctctaaactaaa

SEQ ID NO: 342406 - DNA, 20 bp, Artificial
  CRISPR gRNA sequence
tgtctctaaactaaacaaaa

SEQ ID NO: 342407 - DNA, 20 bp, Artificial
  CRISPR gRNA sequence
attatacttcttagtttaaa

SEQ ID NO: 342408 - DNA, 20 bp, Artificial
  CRISPR gRNA sequence
tttttttggaactataaaat

SEQ ID NO: 342409 - DNA, 20 bp, Artificial
  CRISPR gRNA sequence
cttctctcctgaccaccaca

SEQ ID NO: 342410 - DNA, 20 bp, Artificial
  CRISPR gRNA sequence
ctctcctgaccaccacaccc

SEQ ID NO: 342411 - DNA, 20 bp, Artificial
  CRISPR gRNA sequence
tctcctgaccaccacacccg

SEQ ID NO: 342412 - DNA, 20 bp, Artificial
  CRISPR gRNA sequence
tcctgaccaccacacccggc

SEQ ID NO: 342413 - DNA, 20 bp, Artificial
  CRISPR gRNA sequence
ctgaccaccacacccggccc

SEQ ID NO: 342414 - DNA, 20 bp, Artificial
  CRISPR gRNA sequence
accaccacacccggccccac

SEQ ID NO: 342415 - DNA, 20 bp, Artificial
  CRISPR gRNA sequence
tgagagctgtcggcactgta

SEQ ID NO: 342416 - DNA, 20 bp, Artificial
  CRISPR gRNA sequence
tcggcactgtaactctggtg

SEQ ID NO: 342417 - DNA, 20 bp, Artificial
  CRISPR gRNA sequence
taactctggtgaggtgggca

SEQ ID NO: 342418 - DNA, 20 bp, Artificial
  CRISPR gRNA sequence
tggtgaggtgggcaagggtg

SEQ ID NO: 342419 - DNA, 20 bp, Artificial
  CRISPR gRNA sequence
gtgaggtgggcaagggtgtg

SEQ ID NO: 342420 - DNA, 20 bp, Artificial
  CRISPR gRNA sequence
ggggagcaaggctggtgacg

SEQ ID NO: 342421 - DNA, 20 bp, Artificial
  CRISPR gRNA sequence
gtgacgggtttgggggtgca

SEQ ID NO: 342422 - DNA, 20 bp, Artificial
  CRISPR gRNA sequence
gggggtgcaaggaggatgac

SEQ ID NO: 342423 - DNA, 20 bp, Artificial
  CRISPR gRNA sequence
ggggtgcaaggaggatgacg

SEQ ID NO: 342424 - DNA, 20 bp, Artificial
  CRISPR gRNA sequence
tggccttcttcaaggctcac

SEQ ID NO: 342425 - DNA, 20 bp, Artificial
  CRISPR gRNA sequence
ggccttcttcaaggctcaca

SEQ ID NO: 342426 - DNA, 20 bp, Artificial
  CRISPR gRNA sequence
gccttcttcaaggctcacag

SEQ ID NO: 342427 - DNA, 20 bp, Artificial
  CRISPR gRNA sequence
cttcaaggctcacagcaagt

SEQ ID NO: 342428 - DNA, 20 bp, Artificial
  CRISPR gRNA sequence
ttcaaggctcacagcaagtg

SEQ ID NO: 342429 - DNA, 20 bp, Artificial
  CRISPR gRNA sequence
caaggctcacagcaagtgga

SEQ ID NO: 342430 - DNA, 20 bp, Artificial
  CRISPR gRNA sequence
aaggctcacagcaagtggag

SEQ ID NO: 342431 - DNA, 20 bp, Artificial
  CRISPR gRNA sequence
acagcaagtggagccaatgc

SEQ ID NO: 342432 - DNA, 20 bp, Artificial
  CRISPR gRNA sequence
ggaaatgcggcaccctaggt

SEQ ID NO: 342433 - DNA, 20 bp, Artificial
  CRISPR gRNA sequence
ggtggggcatgaattaacgt

SEQ ID NO: 342434 - DNA, 20 bp, Artificial
  CRISPR gRNA sequence
acgtgggcagacatctagta

SEQ ID NO: 342435 - DNA, 20 bp, Artificial
  CRISPR gRNA sequence
gtattccaggaaagggataa

SEQ ID NO: 342436 - DNA, 20 bp, Artificial
  CRISPR gRNA sequence
caggaaagggataaatagaa

SEQ ID NO: 342437 - DNA, 20 bp, Artificial
  CRISPR gRNA sequence
gagggattggtgagaacggg

SEQ ID NO: 342438 - DNA, 20 bp, Artificial
  CRISPR gRNA sequence
agggattggtgagaacgggt

SEQ ID NO: 342439 - DNA, 20 bp, Artificial
  CRISPR gRNA sequence
gtgagaacgggtctatggat

SEQ ID NO: 342440 - DNA, 20 bp, Artificial
  CRISPR gRNA sequence
tggataggatcaagacaata

SEQ ID NO: 342441 - DNA, 20 bp, Artificial
  CRISPR gRNA sequence
tatgaccccagatttcgggc

SEQ ID NO: 342442 - DNA, 20 bp, Artificial
  CRISPR gRNA sequence
tgaccccagatttcgggcaa

SEQ ID NO: 342443 - DNA, 20 bp, Artificial
  CRISPR gRNA sequence
cgggcaagcaacccccaacc

SEQ ID NO: 342444 - DNA, 20 bp, Artificial
  CRISPR gRNA sequence
gggcaagcaacccccaacca

SEQ ID NO: 342445 - DNA, 20 bp, Artificial
  CRISPR gRNA sequence
actgtgttcccagagtgcac

SEQ ID NO: 342446 - DNA, 20 bp, Artificial
  CRISPR gRNA sequence
tgttcccagagtgcacatgt

SEQ ID NO: 342447 - DNA, 20 bp, Artificial
  CRISPR gRNA sequence
ccagagtgcacatgtgcagg

SEQ ID NO: 342448 - DNA, 20 bp, Artificial
  CRISPR gRNA sequence
gccattgggaatttggaata

SEQ ID NO: 342449 - DNA, 20 bp, Artificial
  CRISPR gRNA sequence
ggaatttggaatacatcttt

SEQ ID NO: 342450 - DNA, 20 bp, Artificial
  CRISPR gRNA sequence
ggaatacatctttctaagga

SEQ ID NO: 342451 - DNA, 20 bp, Artificial
  CRISPR gRNA sequence
gaatacatctttctaaggaa

SEQ ID NO: 342452 - DNA, 20 bp, Artificial
  CRISPR gRNA sequence
tctaaggaaataacaaagca

SEQ ID NO: 342453 - DNA, 20 bp, Artificial
  CRISPR gRNA sequence
ctaaggaaataacaaagcaa

SEQ ID NO: 342454 - DNA, 20 bp, Artificial
  CRISPR gRNA sequence
taaggaaataacaaagcaac

SEQ ID NO: 342455 - DNA, 20 bp, Artificial
  CRISPR gRNA sequence
aggaaataacaaagcaaccc

SEQ ID NO: 342456 - DNA, 20 bp, Artificial
  CRISPR gRNA sequence
tttttgcacaaaagccaatt

SEQ ID NO: 342457 - DNA, 20 bp, Artificial
  CRISPR gRNA sequence
ttttgcacaaaagccaattt

SEQ ID NO: 342458 - DNA, 20 bp, Artificial
  CRISPR gRNA sequence
tttgcacaaaagccaatttg

SEQ ID NO: 342459 - DNA, 20 bp, Artificial
  CRISPR gRNA sequence
ttgcacaaaagccaatttga

SEQ ID NO: 342460 - DNA, 20 bp, Artificial
  CRISPR gRNA sequence
tgcacaaaagccaatttgag

SEQ ID NO: 342461 - DNA, 20 bp, Artificial
  CRISPR gRNA sequence
gcacaaaagccaatttgaga

SEQ ID NO: 342462 - DNA, 20 bp, Artificial
  CRISPR gRNA sequence
cacaaaagccaatttgagaa

SEQ ID NO: 342463 - DNA, 20 bp, Artificial
  CRISPR gRNA sequence
gagaaaatgagtatgtatgt

SEQ ID NO: 342464 - DNA, 20 bp, Artificial
  CRISPR gRNA sequence
agaaaatgagtatgtatgta

SEQ ID NO: 342465 - DNA, 20 bp, Artificial
  CRISPR gRNA sequence
tgtttttattttatagttcc

SEQ ID NO: 342466 - DNA, 20 bp, Artificial
  CRISPR gRNA sequence
ttattttatagttccaaaaa

SEQ ID NO: 342467 - DNA, 20 bp, Artificial
  CRISPR gRNA sequence
tattttatagttccaaaaaa

SEQ ID NO: 342468 - DNA, 20 bp, Artificial
  CRISPR gRNA sequence
attttatagttccaaaaaaa

SEQ ID NO: 342469 - DNA, 20 bp, Artificial
  CRISPR gRNA sequence
ttttatagttccaaaaaaaa

SEQ ID NO: 342470 - DNA, 20 bp, Artificial
  CRISPR gRNA sequence
tatagttccaaaaaaaaagg

SEQ ID NO: 342471 - DNA, 20 bp, Artificial
  CRISPR gRNA sequence
atagttccaaaaaaaaaggt

SEQ ID NO: 342472 - DNA, 20 bp, Artificial
  CRISPR gRNA sequence
tagttccaaaaaaaaaggtt

SEQ ID NO: 342473 - DNA, 20 bp, Artificial
  CRISPR gRNA sequence
caaaaaaaaaggtttttttt

SEQ ID NO: 342474 - DNA, 20 bp, Artificial
  CRISPR gRNA sequence
tttttaaactaagaagtata

SEQ ID NO: 342475 - DNA, 20 bp, Artificial
  CRISPR gRNA sequence
ttttaaactaagaagtataa

SEQ ID NO: 342476 - DNA, 20 bp, Artificial
  CRISPR gRNA sequence
tttaaactaagaagtataat

SEQ ID NO: 342477 - DNA, 20 bp, Artificial
  CRISPR gRNA sequence
ttaaactaagaagtataata

SEQ ID NO: 342478 - DNA, 20 bp, Artificial
  CRISPR gRNA sequence
taaactaagaagtataatat

SEQ ID NO: 342479 - DNA, 20 bp, Artificial
  CRISPR gRNA sequence
aaactaagaagtataatatc

SEQ ID NO: 342480 - DNA, 20 bp, Artificial
  CRISPR gRNA sequence
aactaagaagtataatatct

SEQ ID NO: 342481 - DNA, 20 bp, Artificial
  CRISPR gRNA sequence
agaagtataatatctgcagt

SEQ ID NO: 342482 - DNA, 20 bp, Artificial
  CRISPR gRNA sequence
cagttgtgcttatgaatgct

SEQ ID NO: 342483 - DNA, 20 bp, Artificial
  CRISPR gRNA sequence
tgcttatgaatgctgttatt

SEQ ID NO: 342484 - DNA, 20 bp, Artificial
  CRISPR gRNA sequence
atgaatgctgttattatttc

SEQ ID NO: 342485 - DNA, 20 bp, Artificial
  CRISPR gRNA sequence
tgaatgctgttattatttct

SEQ ID NO: 342486 - DNA, 20 bp, Artificial
  CRISPR gRNA sequence
ttattatttctccatcttcg

SEQ ID NO: 342487 - DNA, 20 bp, Artificial
  CRISPR gRNA sequence
ttatttctccatcttcgcta

SEQ ID NO: 342488 - DNA, 20 bp, Artificial
  CRISPR gRNA sequence
tttctccatcttcgctacaa

SEQ ID NO: 342489 - DNA, 20 bp, Artificial
  CRISPR gRNA sequence
ctccatcttcgctacaattt

SEQ ID NO: 342490 - DNA, 20 bp, Artificial
  CRISPR gRNA sequence
tccatcttcgctacaatttc

SEQ ID NO: 342491 - DNA, 20 bp, Artificial
  CRISPR gRNA sequence
catcttcgctacaatttcag

SEQ ID NO: 342492 - DNA, 20 bp, Artificial
  CRISPR gRNA sequence
cgctacaatttcagaaacta

SEQ ID NO: 342493 - DNA, 20 bp, Artificial
  CRISPR gRNA sequence
gctacaatttcagaaactac

SEQ ID NO: 342494 - DNA, 20 bp, Artificial
  CRISPR gRNA sequence
caatttcagaaactacggcc

SEQ ID NO: 342495 - DNA, 20 bp, Artificial
  CRISPR gRNA sequence
cagaaactacggccagtata

SEQ ID NO: 342496 - DNA, 20 bp, Artificial
  CRISPR gRNA sequence
agaaactacggccagtatac

SEQ ID NO: 342497 - DNA, 20 bp, Artificial
  CRISPR gRNA sequence
cggccagtatacactagaat

SEQ ID NO: 342498 - DNA, 20 bp, Artificial
  CRISPR gRNA sequence
gaatagcaggctttaaagtg

SEQ ID NO: 342499 - DNA, 20 bp, Artificial
  CRISPR gRNA sequence
taaagtggcccctttgaaca

SEQ ID NO: 342500 - DNA, 20 bp, Artificial
  CRISPR gRNA sequence
aaagtggcccctttgaacaa

SEQ ID NO: 342501 - DNA, 20 bp, Artificial
  CRISPR gRNA sequence
aagtggcccctttgaacaaa

SEQ ID NO: 342502 - DNA, 20 bp, Artificial
  CRISPR gRNA sequence
tgaacaaatgttctctagca

SEQ ID NO: 342503 - DNA, 20 bp, Artificial
  CRISPR gRNA sequence
gaacaaatgttctctagcaa

SEQ ID NO: 342504 - DNA, 20 bp, Artificial
  CRISPR gRNA sequence
aacaaatgttctctagcaag

SEQ ID NO: 342505 - DNA, 20 bp, Artificial
  CRISPR gRNA sequence
tctagcaagacactttttag

SEQ ID NO: 342506 - DNA, 20 bp, Artificial
  CRISPR gRNA sequence
tagcaagacactttttagaa

SEQ ID NO: 342507 - DNA, 20 bp, Artificial
  CRISPR gRNA sequence
gcaagacactttttagaacc

SEQ ID NO: 342508 - DNA, 20 bp, Artificial
  CRISPR gRNA sequence
tttagaaccaggtaactgta

SEQ ID NO: 342509 - DNA, 20 bp, Artificial
  CRISPR gRNA sequence
ttagaaccaggtaactgtaa

SEQ ID NO: 342510 - DNA, 20 bp, Artificial
  CRISPR gRNA sequence
tagaaccaggtaactgtaac

SEQ ID NO: 342511 - DNA, 20 bp, Artificial
  CRISPR gRNA sequence
agaaccaggtaactgtaact

SEQ ID NO: 342512 - DNA, 20 bp, Artificial
  CRISPR gRNA sequence
gaaccaggtaactgtaacta

SEQ ID NO: 342513 - DNA, 20 bp, Artificial
  CRISPR gRNA sequence
taactattaaactacctact

SEQ ID NO: 342514 - DNA, 20 bp, Artificial
  CRISPR gRNA sequence
ttaaactacctacttgcaaa

SEQ ID NO: 342515 - DNA, 20 bp, Artificial
  CRISPR gRNA sequence
aactacctacttgcaaaacg

SEQ ID NO: 342516 - DNA, 20 bp, Artificial
  CRISPR gRNA sequence
cctacttgcaaaacgtgttt

SEQ ID NO: 342517 - DNA, 20 bp, Artificial
  CRISPR gRNA sequence
cttgcaaaacgtgtttggtg

SEQ ID NO: 342518 - DNA, 20 bp, Artificial
  CRISPR gRNA sequence
gcaaaacgtgtttggtgtca

SEQ ID NO: 342519 - DNA, 20 bp, Artificial
  CRISPR gRNA sequence
caaaacgtgtttggtgtcac

SEQ ID NO: 342520 - DNA, 20 bp, Artificial
  CRISPR gRNA sequence
ggtgtcactgggtctcttgg

SEQ ID NO: 342521 - DNA, 20 bp, Artificial
  CRISPR gRNA sequence
gtgtcactgggtctcttggt

SEQ ID NO: 342522 - DNA, 20 bp, Artificial
  CRISPR gRNA sequence
ggtctcttggtactgggttt

SEQ ID NO: 342523 - DNA, 20 bp, Artificial
  CRISPR gRNA sequence
ttggtactgggttttgtttt

SEQ ID NO: 342524 - DNA, 20 bp, Artificial
  CRISPR gRNA sequence
ggtactgggttttgttttgt

SEQ ID NO: 342525 - DNA, 20 bp, Artificial
  CRISPR gRNA sequence
gtactgggttttgttttgtt

SEQ ID NO: 342526 - DNA, 20 bp, Artificial
  CRISPR gRNA sequence
ggttttgttttgtttagttt

SEQ ID NO: 342527 - DNA, 20 bp, Artificial
  CRISPR gRNA sequence
tgttttgtttagtttagaga

SEQ ID NO: 342528 - DNA, 20 bp, Artificial
  CRISPR gRNA sequence
gttttgtttagtttagagac

SEQ ID NO: 342529 - DNA, 20 bp, Artificial
  CRISPR gRNA sequence
ttttgtttagtttagagaca

SEQ ID NO: 342530 - DNA, 20 bp, Artificial
  CRISPR gRNA sequence
tgtttagtttagagacaagg

SEQ ID NO: 342531 - DNA, 20 bp, Artificial
  CRISPR gRNA sequence
gtttagtttagagacaaggt

SEQ ID NO: 342532 - DNA, 20 bp, Artificial
  CRISPR gRNA sequence
tttagtttagagacaaggtc

SEQ ID NO: 342533 - DNA, 20 bp, Artificial
  CRISPR gRNA sequence
agtttagagacaaggtctag

SEQ ID NO: 342534 - DNA, 20 bp, Artificial
  CRISPR gRNA sequence
gtttagagacaaggtctagc

SEQ ID NO: 342535 - DNA, 20 bp, Artificial
  CRISPR gRNA sequence
agagacaaggtctagctctg

SEQ ID NO: 342536 - DNA, 20 bp, Artificial
  CRISPR gRNA sequence
gagacaaggtctagctctgt

SEQ ID NO: 342537 - DNA, 20 bp, Artificial
  CRISPR gRNA sequence
gctctgtcacccaggctgga

SEQ ID NO: 342538 - DNA, 20 bp, Artificial
  CRISPR gRNA sequence
tgtcacccaggctggagtgc

SEQ ID NO: 342539 - DNA, 20 bp, Artificial
  CRISPR gRNA sequence
tcacccaggctggagtgcag

SEQ ID NO: 342540 - DNA, 20 bp, Artificial
  CRISPR gRNA sequence
gagtgcagtggtgcaatcat

SEQ ID NO: 342541 - DNA, 20 bp, Artificial
  CRISPR gRNA sequence
cccacagccttgaactcctg

SEQ ID NO: 342542 - DNA, 20 bp, Artificial
  CRISPR gRNA sequence
gaactcctgggctcaagcaa

SEQ ID NO: 342543 - DNA, 20 bp, Artificial
  CRISPR gRNA sequence
aactcctgggctcaagcaat

SEQ ID NO: 342544 - DNA, 20 bp, Artificial
  CRISPR gRNA sequence
ctgggctcaagcaatcttct

SEQ ID NO: 342545 - DNA, 20 bp, Artificial
  CRISPR gRNA sequence
ggctcaagcaatcttctagt

SEQ ID NO: 342546 - DNA, 20 bp, Artificial
  CRISPR gRNA sequence
aagcaatcttctagtctcag

SEQ ID NO: 342547 - DNA, 20 bp, Artificial
  CRISPR gRNA sequence
ctagtctcagcctctgaaag

SEQ ID NO: 342548 - DNA, 20 bp, Artificial
  CRISPR gRNA sequence
tagtctcagcctctgaaagt

SEQ ID NO: 342549 - DNA, 20 bp, Artificial
  CRISPR gRNA sequence
gtctcagcctctgaaagtgc

SEQ ID NO: 342550 - DNA, 20 bp, Artificial
  CRISPR gRNA sequence
agcctctgaaagtgccagga

SEQ ID NO: 342551 - DNA, 20 bp, Artificial
  CRISPR gRNA sequence
tgaaagtgccaggattacag

SEQ ID NO: 342552 - DNA, 20 bp, Artificial
  CRISPR gRNA sequence
aaagtgccaggattacaggt

SEQ ID NO: 342553 - DNA, 20 bp, Artificial
  CRISPR gRNA sequence
caggtgtgagctgtagtgcc

SEQ ID NO: 342554 - DNA, 20 bp, Artificial
  CRISPR gRNA sequence
tagtgcctggtcccgtaaaa

SEQ ID NO: 342555 - DNA, 20 bp, Artificial
  CRISPR gRNA sequence
gtcccgtaaaaacaaaaaca

SEQ ID NO: 342556 - DNA, 20 bp, Artificial
  CRISPR gRNA sequence
atgcctataatcccagcact

SEQ ID NO: 342557 - DNA, 20 bp, Artificial
  CRISPR gRNA sequence
taatcccagcacttgggagg

SEQ ID NO: 342558 - DNA, 20 bp, Artificial
  CRISPR gRNA sequence
gggaggccaaggcagaaggg

SEQ ID NO: 342559 - DNA, 20 bp, Artificial
  CRISPR gRNA sequence
ggaggccaaggcagaagggt

SEQ ID NO: 342560 - DNA, 20 bp, Artificial
  CRISPR gRNA sequence
gcatattttgtagagacttg

SEQ ID NO: 342561 - DNA, 20 bp, Artificial
  CRISPR gRNA sequence
catattttgtagagacttga

SEQ ID NO: 342562 - DNA, 20 bp, Artificial
  CRISPR gRNA sequence
tgtagagacttgagcccagg

SEQ ID NO: 342563 - DNA, 20 bp, Artificial
  CRISPR gRNA sequence
gtagagacttgagcccagga

SEQ ID NO: 342564 - DNA, 20 bp, Artificial
  CRISPR gRNA sequence
tagagacttgagcccaggag

SEQ ID NO: 342565 - DNA, 20 bp, Artificial
  CRISPR gRNA sequence
gagcccaggagcttgagacc

SEQ ID NO: 342566 - DNA, 20 bp, Artificial
  CRISPR gRNA sequence
agcccaggagcttgagacca

SEQ ID NO: 342567 - DNA, 20 bp, Artificial
  CRISPR gRNA sequence
gagaccagctgggcaacata

SEQ ID NO: 342568 - DNA, 20 bp, Artificial
  CRISPR gRNA sequence
agaccagctgggcaacatag

SEQ ID NO: 342569 - DNA, 20 bp, Artificial
  CRISPR gRNA sequence
ggcaacatagtgagaccttg

SEQ ID NO: 342570 - DNA, 20 bp, Artificial
  CRISPR gRNA sequence
gtctctaaaaaaattggctg

SEQ ID NO: 342571 - DNA, 20 bp, Artificial
  CRISPR gRNA sequence
tctctaaaaaaattggctgg

SEQ ID NO: 342572 - DNA, 20 bp, Artificial
  CRISPR gRNA sequence
taaaaaaattggctggtcat

SEQ ID NO: 342573 - DNA, 20 bp, Artificial
  CRISPR gRNA sequence
aaaaaattggctggtcatgg

SEQ ID NO: 342574 - DNA, 20 bp, Artificial
  CRISPR gRNA sequence
gctggtcatggtagtgcacc

SEQ ID NO: 342575 - DNA, 20 bp, Artificial
  CRISPR gRNA sequence
gtcatggtagtgcacctgca

SEQ ID NO: 342576 - DNA, 20 bp, Artificial
  CRISPR gRNA sequence
cagtcccagctacttgggag

SEQ ID NO: 342577 - DNA, 20 bp, Artificial
  CRISPR gRNA sequence
cttgggaggctgagatggga

SEQ ID NO: 342578 - DNA, 20 bp, Artificial
  CRISPR gRNA sequence
gggaggctgagatgggaaga

SEQ ID NO: 342579 - DNA, 20 bp, Artificial
  CRISPR gRNA sequence
ggaggctgagatgggaagat

SEQ ID NO: 342580 - DNA, 20 bp, Artificial
  CRISPR gRNA sequence
agatgggaagatcacttgag

SEQ ID NO: 342581 - DNA, 20 bp, Artificial
  CRISPR gRNA sequence
gagcccaagaggtccccaag

SEQ ID NO: 342582 - DNA, 20 bp, Artificial
  CRISPR gRNA sequence
agcccaagaggtccccaaga

SEQ ID NO: 342583 - DNA, 20 bp, Artificial
  CRISPR gRNA sequence
ctcacatcactgcactccag

SEQ ID NO: 342584 - DNA, 20 bp, Artificial
  CRISPR gRNA sequence
acatcactgcactccagcct

SEQ ID NO: 342585 - DNA, 20 bp, Artificial
  CRISPR gRNA sequence
cactccagcctgggtaacag

SEQ ID NO: 342586 - DNA, 20 bp, Artificial
  CRISPR gRNA sequence
cagcctgggtaacagagcaa

SEQ ID NO: 342587 - DNA, 20 bp, Artificial
  CRISPR gRNA sequence
ggtaacagagcaaaaccctt

SEQ ID NO: 342588 - DNA, 20 bp, Artificial
  CRISPR gRNA sequence
tttcacacacacacacacac

SEQ ID NO: 342589 - DNA, 20 bp, Artificial
  CRISPR gRNA sequence
ttcacacacacacacacaca

SEQ ID NO: 342590 - DNA, 20 bp, Artificial
  CRISPR gRNA sequence
tcacacacacacacacacac

SEQ ID NO: 342591 - DNA, 20 bp, Artificial
  CRISPR gRNA sequence
cacacacacacacacacaca

SEQ ID NO: 342592 - DNA, 20 bp, Artificial
  CRISPR gRNA sequence
acacacacacacacacacac

SEQ ID NO: 342593 - DNA, 20 bp, Artificial
  CRISPR gRNA sequence
acacttgtaatcccagcact

SEQ ID NO: 342594 - DNA, 20 bp, Artificial
  CRISPR gRNA sequence
gtaatcccagcactttagga

SEQ ID NO: 342595 - DNA, 20 bp, Artificial
  CRISPR gRNA sequence
taatcccagcactttaggag

SEQ ID NO: 342596 - DNA, 20 bp, Artificial
  CRISPR gRNA sequence
taggaggccaaggcaggcgg

SEQ ID NO: 342597 - DNA, 20 bp, Artificial
  CRISPR gRNA sequence
aggaggccaaggcaggcgga

SEQ ID NO: 342598 - DNA, 20 bp, Artificial
  CRISPR gRNA sequence
ggaggccaaggcaggcggat

SEQ ID NO: 342599 - DNA, 20 bp, Artificial
  CRISPR gRNA sequence
gagcccaggagtttaagaac

SEQ ID NO: 342600 - DNA, 20 bp, Artificial
  CRISPR gRNA sequence
agcccaggagtttaagaaca

SEQ ID NO: 342601 - DNA, 20 bp, Artificial
  CRISPR gRNA sequence
aagaacaccctgggcaacat

SEQ ID NO: 342602 - DNA, 20 bp, Artificial
  CRISPR gRNA sequence
agaacaccctgggcaacatg

SEQ ID NO: 342603 - DNA, 20 bp, Artificial
  CRISPR gRNA sequence
ggcaacatggcaaaaccctg

SEQ ID NO: 342604 - DNA, 20 bp, Artificial
  CRISPR gRNA sequence
tctctactaaaaatacaaaa

SEQ ID NO: 342605 - DNA, 20 bp, Artificial
  CRISPR gRNA sequence
tactaaaaatacaaaaagtt

SEQ ID NO: 342606 - DNA, 20 bp, Artificial
  CRISPR gRNA sequence
ctaaaaatacaaaaagttag

SEQ ID NO: 342607 - DNA, 20 bp, Artificial
  CRISPR gRNA sequence
aaaatacaaaaagttagcca

SEQ ID NO: 342608 - DNA, 20 bp, Artificial
  CRISPR gRNA sequence
gccaggcgtggtggcacgaa

SEQ ID NO: 342609 - DNA, 20 bp, Artificial
  CRISPR gRNA sequence
tagtcccagctactcagaag

SEQ ID NO: 342610 - DNA, 20 bp, Artificial
  CRISPR gRNA sequence
ctcagaaggctgaagtgaga

SEQ ID NO: 342611 - DNA, 20 bp, Artificial
  CRISPR gRNA sequence
agaaggctgaagtgagaaga

SEQ ID NO: 342612 - DNA, 20 bp, Artificial
  CRISPR gRNA sequence
aagtgagaagatcacttgag

SEQ ID NO: 342613 - DNA, 20 bp, Artificial
  CRISPR gRNA sequence
gagtccaggaagtggaggct

SEQ ID NO: 342614 - DNA, 20 bp, Artificial
  CRISPR gRNA sequence
agtccaggaagtggaggctg

SEQ ID NO: 342615 - DNA, 20 bp, Artificial
  CRISPR gRNA sequence
cagtgagccgtgactgtacc

SEQ ID NO: 342616 - DNA, 20 bp, Artificial
  CRISPR gRNA sequence
taccactgcactccagcttg

SEQ ID NO: 342617 - DNA, 20 bp, Artificial
  CRISPR gRNA sequence
cactccagcttgggagacag

SEQ ID NO: 342618 - DNA, 20 bp, Artificial
  CRISPR gRNA sequence
cagcttgggagacagagtga

SEQ ID NO: 342619 - DNA, 20 bp, Artificial
  CRISPR gRNA sequence
gggagacagagtgagcagag

SEQ ID NO: 342620 - DNA, 20 bp, Artificial
  CRISPR gRNA sequence
ggagacagagtgagcagagt

SEQ ID NO: 342621 - DNA, 20 bp, Artificial
  CRISPR gRNA sequence
tttccaaaaaaaaaaagaaa

SEQ ID NO: 342622 - DNA, 20 bp, Artificial
  CRISPR gRNA sequence
ccaaaaaaaaaaagaaaaca

SEQ ID NO: 342623 - DNA, 20 bp, Artificial
  CRISPR gRNA sequence
caaaaaaaaaaagaaaacaa

SEQ ID NO: 342624 - DNA, 20 bp, Artificial
  CRISPR gRNA sequence
ttccattgcaaatcaaccaa

SEQ ID NO: 342625 - DNA, 20 bp, Artificial
  CRISPR gRNA sequence
tccattgcaaatcaaccaaa

SEQ ID NO: 342626 - DNA, 20 bp, Artificial
  CRISPR gRNA sequence
ccattgcaaatcaaccaaaa

SEQ ID NO: 342627 - DNA, 20 bp, Artificial
  CRISPR gRNA sequence
cattgcaaatcaaccaaaaa

SEQ ID NO: 342628 - DNA, 20 bp, Artificial
  CRISPR gRNA sequence
caaatcaaccaaaaaggaac

SEQ ID NO: 342629 - DNA, 20 bp, Artificial
  CRISPR gRNA sequence
taatacacaagaaatattct

SEQ ID NO: 342630 - DNA, 20 bp, Artificial
  CRISPR gRNA sequence
aatacacaagaaatattctt

SEQ ID NO: 342631 - DNA, 20 bp, Artificial
  CRISPR gRNA sequence
atacacaagaaatattcttc

SEQ ID NO: 342632 - DNA, 20 bp, Artificial
  CRISPR gRNA sequence
ttcagtctacttaacttaaa

SEQ ID NO: 342633 - DNA, 20 bp, Artificial
  CRISPR gRNA sequence
cagtctacttaacttaaaaa

SEQ ID NO: 342634 - DNA, 20 bp, Artificial
  CRISPR gRNA sequence
agtctacttaacttaaaaat

SEQ ID NO: 342635 - DNA, 20 bp, Artificial
  CRISPR gRNA sequence
cttaacttaaaaatgtaact

SEQ ID NO: 342636 - DNA, 20 bp, Artificial
  CRISPR gRNA sequence
aacttaaaaatgtaactgta

SEQ ID NO: 342637 - DNA, 20 bp, Artificial
  CRISPR gRNA sequence
acttaaaaatgtaactgtaa

SEQ ID NO: 342638 - DNA, 20 bp, Artificial
  CRISPR gRNA sequence
aaaaatgtaactgtaataga

SEQ ID NO: 342639 - DNA, 20 bp, Artificial
  CRISPR gRNA sequence
aaaatgtaactgtaatagat

SEQ ID NO: 342640 - DNA, 20 bp, Artificial
  CRISPR gRNA sequence
taatagatgcttttctcttg

SEQ ID NO: 342641 - DNA, 20 bp, Artificial
  CRISPR gRNA sequence
ttctcttgacagcggccccg

SEQ ID NO: 342642 - DNA, 20 bp, Artificial
  CRISPR gRNA sequence
tctcttgacagcggccccgg

SEQ ID NO: 342643 - DNA, 20 bp, Artificial
  CRISPR gRNA sequence
ctcttgacagcggccccggc

SEQ ID NO: 342644 - DNA, 20 bp, Artificial
  CRISPR gRNA sequence
tcttgacagcggccccggca

SEQ ID NO: 342645 - DNA, 20 bp, Artificial
  CRISPR gRNA sequence
ttgacagcggccccggcagg

SEQ ID NO: 342646 - DNA, 20 bp, Artificial
  CRISPR gRNA sequence
gacagcggccccggcagggt

SEQ ID NO: 342647 - DNA, 20 bp, Artificial
  CRISPR gRNA sequence
acagcggccccggcagggtt

SEQ ID NO: 342648 - DNA, 20 bp, Artificial
  CRISPR gRNA sequence
gaacttttcctagtcaaaac

SEQ ID NO: 342649 - DNA, 20 bp, Artificial
  CRISPR gRNA sequence
ttcctagtcaaaacccccct

SEQ ID NO: 342650 - DNA, 20 bp, Artificial
  CRISPR gRNA sequence
tcctagtcaaaaccccccta

SEQ ID NO: 342651 - DNA, 20 bp, Artificial
  CRISPR gRNA sequence
cctagtcaaaacccccctac

SEQ ID NO: 342652 - DNA, 20 bp, Artificial
  CRISPR gRNA sequence
ctagtcaaaacccccctact

SEQ ID NO: 342653 - DNA, 20 bp, Artificial
  CRISPR gRNA sequence
gtcaaaacccccctactcac

SEQ ID NO: 342654 - DNA, 20 bp, Artificial
  CRISPR gRNA sequence
ctcactctgcagacccttcc

SEQ ID NO: 342655 - DNA, 20 bp, Artificial
  CRISPR gRNA sequence
actctgcagacccttcctga

SEQ ID NO: 342656 - DNA, 20 bp, Artificial
  CRISPR gRNA sequence
tgcagacccttcctgaaggt

SEQ ID NO: 342657 - DNA, 20 bp, Artificial
  CRISPR gRNA sequence
cagacccttcctgaaggtct

SEQ ID NO: 342658 - DNA, 20 bp, Artificial
  CRISPR gRNA sequence
cctgaaggtcttcgccccat

SEQ ID NO: 342659 - DNA, 20 bp, Artificial
  CRISPR gRNA sequence
ctgaaggtcttcgccccata

SEQ ID NO: 342660 - DNA, 20 bp, Artificial
  CRISPR gRNA sequence
aaggtcttcgccccatactg

SEQ ID NO: 342661 - DNA, 20 bp, Artificial
  CRISPR gRNA sequence
cgccccatactgagcccatc

SEQ ID NO: 342662 - DNA, 20 bp, Artificial
  CRISPR gRNA sequence
gccccatactgagcccatct

SEQ ID NO: 342663 - DNA, 20 bp, Artificial
  CRISPR gRNA sequence
agcccatcttcagtcccttc

SEQ ID NO: 342664 - DNA, 20 bp, Artificial
  CRISPR gRNA sequence
cagtcccttcacttgttcca

SEQ ID NO: 342665 - DNA, 20 bp, Artificial
  CRISPR gRNA sequence
agtcccttcacttgttccaa

SEQ ID NO: 342666 - DNA, 20 bp, Artificial
  CRISPR gRNA sequence
cacttgttccaaactagccc

SEQ ID NO: 342667 - DNA, 20 bp, Artificial
  CRISPR gRNA sequence
acttgttccaaactagccca

SEQ ID NO: 342668 - DNA, 20 bp, Artificial
  CRISPR gRNA sequence
gttccaaactagcccaatcc

SEQ ID NO: 342669 - DNA, 20 bp, Artificial
  CRISPR gRNA sequence
ttccaaactagcccaatcca

SEQ ID NO: 342670 - DNA, 20 bp, Artificial
  CRISPR gRNA sequence
caaactagcccaatccatga

SEQ ID NO: 342671 - DNA, 20 bp, Artificial
  CRISPR gRNA sequence
gcccaatccatgacccttct

SEQ ID NO: 342672 - DNA, 20 bp, Artificial
  CRISPR gRNA sequence
ctctgggagctcagccaata

SEQ ID NO: 342673 - DNA, 20 bp, Artificial
  CRISPR gRNA sequence
tctgggagctcagccaatag

SEQ ID NO: 342674 - DNA, 20 bp, Artificial
  CRISPR gRNA sequence
tgggagctcagccaatagat

SEQ ID NO: 342675 - DNA, 20 bp, Artificial
  CRISPR gRNA sequence
ggagctcagccaatagatcc

SEQ ID NO: 342676 - DNA, 20 bp, Artificial
  CRISPR gRNA sequence
agccaatagatcccaaagta

SEQ ID NO: 342677 - DNA, 20 bp, Artificial
  CRISPR gRNA sequence
gctgcagaaggacccccggg

SEQ ID NO: 342678 - DNA, 20 bp, Artificial
  CRISPR gRNA sequence
cagaaggacccccgggaaat

SEQ ID NO: 342679 - DNA, 20 bp, Artificial
  CRISPR gRNA sequence
aatgagctcggccctctctg

SEQ ID NO: 342680 - DNA, 20 bp, Artificial
  CRISPR gRNA sequence
ggccctctctgggccttagt

SEQ ID NO: 342681 - DNA, 20 bp, Artificial
  CRISPR gRNA sequence
tctgggccttagtgctggca

SEQ ID NO: 342682 - DNA, 20 bp, Artificial
  CRISPR gRNA sequence
tgggccttagtgctggcatc

SEQ ID NO: 342683 - DNA, 20 bp, Artificial
  CRISPR gRNA sequence
ggccttagtgctggcatcta

SEQ ID NO: 342684 - DNA, 20 bp, Artificial
  CRISPR gRNA sequence
agtgctggcatctatgagat

SEQ ID NO: 342685 - DNA, 20 bp, Artificial
  CRISPR gRNA sequence
gtgctggcatctatgagatg

SEQ ID NO: 342686 - DNA, 20 bp, Artificial
  CRISPR gRNA sequence
gcatctatgagatgaggaca

SEQ ID NO: 342687 - DNA, 20 bp, Artificial
  CRISPR gRNA sequence
tgagatgaggacatgcctga

SEQ ID NO: 342688 - DNA, 20 bp, Artificial
  CRISPR gRNA sequence
aagtcagcctggaattttga

SEQ ID NO: 342689 - DNA, 20 bp, Artificial
  CRISPR gRNA sequence
gaattttgagcccaggttat

SEQ ID NO: 342690 - DNA, 20 bp, Artificial
  CRISPR gRNA sequence
tgagcccaggttatacctgg

SEQ ID NO: 342691 - DNA, 20 bp, Artificial
  CRISPR gRNA sequence
gagcccaggttatacctggt

SEQ ID NO: 342692 - DNA, 20 bp, Artificial
  CRISPR gRNA sequence
agcccaggttatacctggta

SEQ ID NO: 342693 - DNA, 20 bp, Artificial
  CRISPR gRNA sequence
tacctggtaaatagaactcc

SEQ ID NO: 342694 - DNA, 20 bp, Artificial
  CRISPR gRNA sequence
gtaaatagaactcccaggtc

SEQ ID NO: 342695 - DNA, 20 bp, Artificial
  CRISPR gRNA sequence
ccaggtctccggatactcac

SEQ ID NO: 342696 - DNA, 20 bp, Artificial
  CRISPR gRNA sequence
cggatactcaccactaaaac

SEQ ID NO: 342697 - DNA, 20 bp, Artificial
  CRISPR gRNA sequence
accactaaaacaatagcacc

SEQ ID NO: 342698 - DNA, 20 bp, Artificial
  CRISPR gRNA sequence
aaacaatagcacctcattgt

SEQ ID NO: 342699 - DNA, 20 bp, Artificial
  CRISPR gRNA sequence
attgtttttgttttgttttg

SEQ ID NO: 342700 - DNA, 20 bp, Artificial
  CRISPR gRNA sequence
tttttgttttgttttgtttt

SEQ ID NO: 342701 - DNA, 20 bp, Artificial
  CRISPR gRNA sequence
ttgttttgttttgttttgtt

SEQ ID NO: 342702 - DNA, 20 bp, Artificial
  CRISPR gRNA sequence
tgttttgttttgttttgttt

SEQ ID NO: 342703 - DNA, 20 bp, Artificial
  CRISPR gRNA sequence
gttttgttttgttttgtttt

SEQ ID NO: 342704 - DNA, 20 bp, Artificial
  CRISPR gRNA sequence
ttttgttttgttttgttttt

SEQ ID NO: 342705 - DNA, 20 bp, Artificial
  CRISPR gRNA sequence
tgttttgttttgttttttaa

SEQ ID NO: 342706 - DNA, 20 bp, Artificial
  CRISPR gRNA sequence
gttttgttttgttttttaat

SEQ ID NO: 342707 - DNA, 20 bp, Artificial
  CRISPR gRNA sequence
ttttgttttgttttttaatt

SEQ ID NO: 342708 - DNA, 20 bp, Artificial
  CRISPR gRNA sequence
tgttttgttttttaattata

SEQ ID NO: 342709 - DNA, 20 bp, Artificial
  CRISPR gRNA sequence
gttttgttttttaattatac

SEQ ID NO: 342710 - DNA, 20 bp, Artificial
  CRISPR gRNA sequence
ttttgttttttaattatact

SEQ ID NO: 342711 - DNA, 20 bp, Artificial
  CRISPR gRNA sequence
tgttttttaattatacttta

SEQ ID NO: 342712 - DNA, 20 bp, Artificial
  CRISPR gRNA sequence
gttttttaattatactttaa

SEQ ID NO: 342713 - DNA, 20 bp, Artificial
  CRISPR gRNA sequence
ttttttaattatactttaag

SEQ ID NO: 342714 - DNA, 20 bp, Artificial
  CRISPR gRNA sequence
tttaattatactttaagttc

SEQ ID NO: 342715 - DNA, 20 bp, Artificial
  CRISPR gRNA sequence
ttaattatactttaagttct

SEQ ID NO: 342716 - DNA, 20 bp, Artificial
  CRISPR gRNA sequence
taattatactttaagttcta

SEQ ID NO: 342717 - DNA, 20 bp, Artificial
  CRISPR gRNA sequence
aattatactttaagttctag

SEQ ID NO: 342718 - DNA, 20 bp, Artificial
  CRISPR gRNA sequence
attatactttaagttctagg

SEQ ID NO: 342719 - DNA, 20 bp, Artificial
  CRISPR gRNA sequence
tactttaagttctagggtac

SEQ ID NO: 342720 - DNA, 20 bp, Artificial
  CRISPR gRNA sequence
taagttctagggtacatgta

SEQ ID NO: 342721 - DNA, 20 bp, Artificial
  CRISPR gRNA sequence
aagttctagggtacatgtac

SEQ ID NO: 342722 - DNA, 20 bp, Artificial
  CRISPR gRNA sequence
agttctagggtacatgtaca

SEQ ID NO: 342723 - DNA, 20 bp, Artificial
  CRISPR gRNA sequence
tagggtacatgtacacaatg

SEQ ID NO: 342724 - DNA, 20 bp, Artificial
  CRISPR gRNA sequence
gggtacatgtacacaatgtg

SEQ ID NO: 342725 - DNA, 20 bp, Artificial
  CRISPR gRNA sequence
gttacataggtatacatgtg

SEQ ID NO: 342726 - DNA, 20 bp, Artificial
  CRISPR gRNA sequence
ttacataggtatacatgtgc

SEQ ID NO: 342727 - DNA, 20 bp, Artificial
  CRISPR gRNA sequence
cataggtatacatgtgccat

SEQ ID NO: 342728 - DNA, 20 bp, Artificial
  CRISPR gRNA sequence
gtgtgctgcacccattaact

SEQ ID NO: 342729 - DNA, 20 bp, Artificial
  CRISPR gRNA sequence
cacccattaactcatcattt

SEQ ID NO: 342730 - DNA, 20 bp, Artificial
  CRISPR gRNA sequence
actcatcatttacattaggt

SEQ ID NO: 342731 - DNA, 20 bp, Artificial
  CRISPR gRNA sequence
atcatttacattaggtatat

SEQ ID NO: 342732 - DNA, 20 bp, Artificial
  CRISPR gRNA sequence
acattaggtatatctcctaa

SEQ ID NO: 342733 - DNA, 20 bp, Artificial
  CRISPR gRNA sequence
cattaggtatatctcctaat

SEQ ID NO: 342734 - DNA, 20 bp, Artificial
  CRISPR gRNA sequence
ggtatatctcctaatgctat

SEQ ID NO: 342735 - DNA, 20 bp, Artificial
  CRISPR gRNA sequence
ctaatgctatccctcctccc

SEQ ID NO: 342736 - DNA, 20 bp, Artificial
  CRISPR gRNA sequence
atgctatccctcctccctcc

SEQ ID NO: 342737 - DNA, 20 bp, Artificial
  CRISPR gRNA sequence
tccctcctccctccccacac

SEQ ID NO: 342738 - DNA, 20 bp, Artificial
  CRISPR gRNA sequence
ctccctccccacaccccacg

SEQ ID NO: 342739 - DNA, 20 bp, Artificial
  CRISPR gRNA sequence
cctccccacaccccacgaca

SEQ ID NO: 342740 - DNA, 20 bp, Artificial
  CRISPR gRNA sequence
cccacaccccacgacaggcc

SEQ ID NO: 342741 - DNA, 20 bp, Artificial
  CRISPR gRNA sequence
cccttcctgtgtccaagtgt

SEQ ID NO: 342742 - DNA, 20 bp, Artificial
  CRISPR gRNA sequence
cctgtgtccaagtgttctca

SEQ ID NO: 342743 - DNA, 20 bp, Artificial
  CRISPR gRNA sequence
ctgtgtccaagtgttctcat

SEQ ID NO: 342744 - DNA, 20 bp, Artificial
  CRISPR gRNA sequence
tgtccaagtgttctcattgt

SEQ ID NO: 342745 - DNA, 20 bp, Artificial
  CRISPR gRNA sequence
tcattgttcaattcccacct

SEQ ID NO: 342746 - DNA, 20 bp, Artificial
  CRISPR gRNA sequence
attgttcaattcccacctac

SEQ ID NO: 342747 - DNA, 20 bp, Artificial
  CRISPR gRNA sequence
ttcaattcccacctacgagt

SEQ ID NO: 342748 - DNA, 20 bp, Artificial
  CRISPR gRNA sequence
aattcccacctacgagtgag

SEQ ID NO: 342749 - DNA, 20 bp, Artificial
  CRISPR gRNA sequence
ccacctacgagtgagaacac

SEQ ID NO: 342750 - DNA, 20 bp, Artificial
  CRISPR gRNA sequence
cgagtgagaacacattgttt

SEQ ID NO: 342751 - DNA, 20 bp, Artificial
  CRISPR gRNA sequence
tttttaaccctccccagcag

SEQ ID NO: 342752 - DNA, 20 bp, Artificial
  CRISPR gRNA sequence
ttaaccctccccagcagctt

SEQ ID NO: 342753 - DNA, 20 bp, Artificial
  CRISPR gRNA sequence
taaccctccccagcagcttc

SEQ ID NO: 342754 - DNA, 20 bp, Artificial
  CRISPR gRNA sequence
aaccctccccagcagcttct

SEQ ID NO: 342755 - DNA, 20 bp, Artificial
  CRISPR gRNA sequence
accctccccagcagcttctt

SEQ ID NO: 342756 - DNA, 20 bp, Artificial
  CRISPR gRNA sequence
cccagcagcttctttaaccc

SEQ ID NO: 342757 - DNA, 20 bp, Artificial
  CRISPR gRNA sequence
ctttaacccctccatttccc

SEQ ID NO: 342758 - DNA, 20 bp, Artificial
  CRISPR gRNA sequence
tttaacccctccatttccct

SEQ ID NO: 342759 - DNA, 20 bp, Artificial
  CRISPR gRNA sequence
taacccctccatttcccttt

SEQ ID NO: 342760 - DNA, 20 bp, Artificial
  CRISPR gRNA sequence
aacccctccatttccctttt

SEQ ID NO: 342761 - DNA, 20 bp, Artificial
  CRISPR gRNA sequence
acccctccatttcccttttg

SEQ ID NO: 342762 - DNA, 20 bp, Artificial
  CRISPR gRNA sequence
catttcccttttggcggaga

SEQ ID NO: 342763 - DNA, 20 bp, Artificial
  CRISPR gRNA sequence
cccttttggcggagaccctt

SEQ ID NO: 342764 - DNA, 20 bp, Artificial
  CRISPR gRNA sequence
ccttttggcggagacccttg

SEQ ID NO: 342765 - DNA, 20 bp, Artificial
  CRISPR gRNA sequence
ttggcggagacccttgtcat

SEQ ID NO: 342766 - DNA, 20 bp, Artificial
  CRISPR gRNA sequence
tggcggagacccttgtcatc

SEQ ID NO: 342767 - DNA, 20 bp, Artificial
  CRISPR gRNA sequence
ggcggagacccttgtcatca

SEQ ID NO: 342768 - DNA, 20 bp, Artificial
  CRISPR gRNA sequence
gcggagacccttgtcatcac

SEQ ID NO: 342769 - DNA, 20 bp, Artificial
  CRISPR gRNA sequence
gtcatcactcctctctacca

SEQ ID NO: 342770 - DNA, 20 bp, Artificial
  CRISPR gRNA sequence
tcatcactcctctctaccac

SEQ ID NO: 342771 - DNA, 20 bp, Artificial
  CRISPR gRNA sequence
ctctctaccaccagtgctct

SEQ ID NO: 342772 - DNA, 20 bp, Artificial
  CRISPR gRNA sequence
tctaccaccagtgctctccc

SEQ ID NO: 342773 - DNA, 20 bp, Artificial
  CRISPR gRNA sequence
taccaccagtgctctcccct

SEQ ID NO: 342774 - DNA, 20 bp, Artificial
  CRISPR gRNA sequence
ccaccagtgctctcccctcc

SEQ ID NO: 342775 - DNA, 20 bp, Artificial
  CRISPR gRNA sequence
tcccctcctgcactgtccca

SEQ ID NO: 342776 - DNA, 20 bp, Artificial
  CRISPR gRNA sequence
ccctcctgcactgtcccagg

SEQ ID NO: 342777 - DNA, 20 bp, Artificial
  CRISPR gRNA sequence
ctgcactgtcccaggcttcc

SEQ ID NO: 342778 - DNA, 20 bp, Artificial
  CRISPR gRNA sequence
cactgtcccaggcttcctca

SEQ ID NO: 342779 - DNA, 20 bp, Artificial
  CRISPR gRNA sequence
tcccaggcttcctcattctt

SEQ ID NO: 342780 - DNA, 20 bp, Artificial
  CRISPR gRNA sequence
cctcattcttcccttgcagg

SEQ ID NO: 342781 - DNA, 20 bp, Artificial
  CRISPR gRNA sequence
ctcattcttcccttgcaggt

SEQ ID NO: 342782 - DNA, 20 bp, Artificial
  CRISPR gRNA sequence
attcttcccttgcaggtcct

SEQ ID NO: 342783 - DNA, 20 bp, Artificial
  CRISPR gRNA sequence
ttcccttgcaggtccttatc

SEQ ID NO: 342784 - DNA, 20 bp, Artificial
  CRISPR gRNA sequence
cccttgcaggtccttatcca

SEQ ID NO: 342785 - DNA, 20 bp, Artificial
  CRISPR gRNA sequence
ccttgcaggtccttatccaa

SEQ ID NO: 342786 - DNA, 20 bp, Artificial
  CRISPR gRNA sequence
gcaggtccttatccaacatg

SEQ ID NO: 342787 - DNA, 20 bp, Artificial
  CRISPR gRNA sequence
caggtccttatccaacatgg

SEQ ID NO: 342788 - DNA, 20 bp, Artificial
  CRISPR gRNA sequence
atccaacatggctcacaatt

SEQ ID NO: 342789 - DNA, 20 bp, Artificial
  CRISPR gRNA sequence
tccaacatggctcacaattc

SEQ ID NO: 342790 - DNA, 20 bp, Artificial
  CRISPR gRNA sequence
acaattcctgggaagccaca

SEQ ID NO: 342791 - DNA, 20 bp, Artificial
  CRISPR gRNA sequence
ctgggaagccacaaggaaac

SEQ ID NO: 342792 - DNA, 20 bp, Artificial
  CRISPR gRNA sequence
ggaagccacaaggaaaccaa

SEQ ID NO: 342793 - DNA, 20 bp, Artificial
  CRISPR gRNA sequence
tagtagcaactcagagtcag

SEQ ID NO: 342794 - DNA, 20 bp, Artificial
  CRISPR gRNA sequence
gtagcaactcagagtcagca

SEQ ID NO: 342795 - DNA, 20 bp, Artificial
  CRISPR gRNA sequence
agagtcagcattcattagca

SEQ ID NO: 342796 - DNA, 20 bp, Artificial
  CRISPR gRNA sequence
attagcaggtcacagggcca

SEQ ID NO: 342797 - DNA, 20 bp, Artificial
  CRISPR gRNA sequence
gcaggtcacagggccataag

SEQ ID NO: 342798 - DNA, 20 bp, Artificial
  CRISPR gRNA sequence
gtccctctccttgtcctgac

SEQ ID NO: 342799 - DNA, 20 bp, Artificial
  CRISPR gRNA sequence
tccctctccttgtcctgaca

SEQ ID NO: 342800 - DNA, 20 bp, Artificial
  CRISPR gRNA sequence
tccttgtcctgacaaaaggc

SEQ ID NO: 342801 - DNA, 20 bp, Artificial
  CRISPR gRNA sequence
cttgtcctgacaaaaggcat

SEQ ID NO: 342802 - DNA, 20 bp, Artificial
  CRISPR gRNA sequence
gtcctgacaaaaggcataag

SEQ ID NO: 342803 - DNA, 20 bp, Artificial
  CRISPR gRNA sequence
tcctgacaaaaggcataagt

SEQ ID NO: 342804 - DNA, 20 bp, Artificial
  CRISPR gRNA sequence
acaaaaggcataagtagaag

SEQ ID NO: 342805 - DNA, 20 bp, Artificial
  CRISPR gRNA sequence
ttaggtttggttatgacctt

SEQ ID NO: 342806 - DNA, 20 bp, Artificial
  CRISPR gRNA sequence
ggtttggttatgacctttga

SEQ ID NO: 342807 - DNA, 20 bp, Artificial
  CRISPR gRNA sequence
ggttatgacctttgacattc

SEQ ID NO: 342808 - DNA, 20 bp, Artificial
  CRISPR gRNA sequence
gttatgacctttgacattct

SEQ ID NO: 342809 - DNA, 20 bp, Artificial
  CRISPR gRNA sequence
tgacctttgacattctctct

SEQ ID NO: 342810 - DNA, 20 bp, Artificial
  CRISPR gRNA sequence
tgacattctctctttgacat

SEQ ID NO: 342811 - DNA, 20 bp, Artificial
  CRISPR gRNA sequence
gacattctctctttgacatc

SEQ ID NO: 342812 - DNA, 20 bp, Artificial
  CRISPR gRNA sequence
acattctctctttgacatcc

SEQ ID NO: 342813 - DNA, 20 bp, Artificial
  CRISPR gRNA sequence
tctctttgacatcctccctt

SEQ ID NO: 342814 - DNA, 20 bp, Artificial
  CRISPR gRNA sequence
tctttgacatcctccctttc

SEQ ID NO: 342815 - DNA, 20 bp, Artificial
  CRISPR gRNA sequence
tttgacatcctccctttctg

SEQ ID NO: 342816 - DNA, 20 bp, Artificial
  CRISPR gRNA sequence
tgacatcctccctttctgca

SEQ ID NO: 342817 - DNA, 20 bp, Artificial
  CRISPR gRNA sequence
gacatcctccctttctgcac

SEQ ID NO: 342818 - DNA, 20 bp, Artificial
  CRISPR gRNA sequence
acatcctccctttctgcacc

SEQ ID NO: 342819 - DNA, 20 bp, Artificial
  CRISPR gRNA sequence
cctttctgcacccctcttcc

SEQ ID NO: 342820 - DNA, 20 bp, Artificial
  CRISPR gRNA sequence
tctgcacccctcttccacct

SEQ ID NO: 342821 - DNA, 20 bp, Artificial
  CRISPR gRNA sequence
ctgcacccctcttccacctg

SEQ ID NO: 342822 - DNA, 20 bp, Artificial
  CRISPR gRNA sequence
tgcacccctcttccacctgt

SEQ ID NO: 342823 - DNA, 20 bp, Artificial
  CRISPR gRNA sequence
cacccctcttccacctgtca

SEQ ID NO: 342824 - DNA, 20 bp, Artificial
  CRISPR gRNA sequence
ttccacctgtcagggcacct

SEQ ID NO: 342825 - DNA, 20 bp, Artificial
  CRISPR gRNA sequence
ccacctgtcagggcacctag

SEQ ID NO: 342826 - DNA, 20 bp, Artificial
  CRISPR gRNA sequence
cacctgtcagggcacctagg

SEQ ID NO: 342827 - DNA, 20 bp, Artificial
  CRISPR gRNA sequence
tcagggcacctagggctccc

SEQ ID NO: 342828 - DNA, 20 bp, Artificial
  CRISPR gRNA sequence
gggctccccgggtccccaca

SEQ ID NO: 342829 - DNA, 20 bp, Artificial
  CRISPR gRNA sequence
cccgggtccccacaagtgtc

SEQ ID NO: 342830 - DNA, 20 bp, Artificial
  CRISPR gRNA sequence
ccctaaggcccaccaggctt

SEQ ID NO: 342831 - DNA, 20 bp, Artificial
  CRISPR gRNA sequence
aggcccaccaggctttcttg

SEQ ID NO: 342832 - DNA, 20 bp, Artificial
  CRISPR gRNA sequence
tcttgcagcctgtcccacat

SEQ ID NO: 342833 - DNA, 20 bp, Artificial
  CRISPR gRNA sequence
cttgcagcctgtcccacatc

SEQ ID NO: 342834 - DNA, 20 bp, Artificial
  CRISPR gRNA sequence
ttgcagcctgtcccacatct

SEQ ID NO: 342835 - DNA, 20 bp, Artificial
  CRISPR gRNA sequence
gcagcctgtcccacatctgg

SEQ ID NO: 342836 - DNA, 20 bp, Artificial
  CRISPR gRNA sequence
cagcctgtcccacatctggg

SEQ ID NO: 342837 - DNA, 20 bp, Artificial
  CRISPR gRNA sequence
tcccacatctgggtgtcact

SEQ ID NO: 342838 - DNA, 20 bp, Artificial
  CRISPR gRNA sequence
ggtgtcactgccttcctctg

SEQ ID NO: 342839 - DNA, 20 bp, Artificial
  CRISPR gRNA sequence
ccttcctctgaatcaccctc

SEQ ID NO: 342840 - DNA, 20 bp, Artificial
  CRISPR gRNA sequence
cctctgaatcaccctcctct

SEQ ID NO: 342841 - DNA, 20 bp, Artificial
  CRISPR gRNA sequence
ctctgaatcaccctcctctc

SEQ ID NO: 342842 - DNA, 20 bp, Artificial
  CRISPR gRNA sequence
tgaatcaccctcctctcaaa

SEQ ID NO: 342843 - DNA, 20 bp, Artificial
  CRISPR gRNA sequence
aatcaccctcctctcaaacc

SEQ ID NO: 342844 - DNA, 20 bp, Artificial
  CRISPR gRNA sequence
ctctcaaaccagccgccagc

SEQ ID NO: 342845 - DNA, 20 bp, Artificial
  CRISPR gRNA sequence
tcaaaccagccgccagcgag

SEQ ID NO: 342846 - DNA, 20 bp, Artificial
  CRISPR gRNA sequence
aaaccagccgccagcgagcc

SEQ ID NO: 342847 - DNA, 20 bp, Artificial
  CRISPR gRNA sequence
gtgccctaccacacccgccc

SEQ ID NO: 342848 - DNA, 20 bp, Artificial
  CRISPR gRNA sequence
ccacacccgcccccaggata

SEQ ID NO: 342849 - DNA, 20 bp, Artificial
  CRISPR gRNA sequence
acacccagccacccagcatc

SEQ ID NO: 342850 - DNA, 20 bp, Artificial
  CRISPR gRNA sequence
tacacttgagcaaaatgtat

SEQ ID NO: 342851 - DNA, 20 bp, Artificial
  CRISPR gRNA sequence
cacttgagcaaaatgtatat

SEQ ID NO: 342852 - DNA, 20 bp, Artificial
  CRISPR gRNA sequence
gagcaaaatgtatattttaa

SEQ ID NO: 342853 - DNA, 20 bp, Artificial
  CRISPR gRNA sequence
agcaaaatgtatattttaaa

SEQ ID NO: 342854 - DNA, 20 bp, Artificial
  CRISPR gRNA sequence
taaaggcaaattctcacgcc

SEQ ID NO: 342855 - DNA, 20 bp, Artificial
  CRISPR gRNA sequence
aaaggcaaattctcacgcct

SEQ ID NO: 342856 - DNA, 20 bp, Artificial
  CRISPR gRNA sequence
aaggcaaattctcacgcctg

SEQ ID NO: 342857 - DNA, 20 bp, Artificial
  CRISPR gRNA sequence
tcacgcctgtaatcccagca

SEQ ID NO: 342858 - DNA, 20 bp, Artificial
  CRISPR gRNA sequence
acgcctgtaatcccagcact

SEQ ID NO: 342859 - DNA, 20 bp, Artificial
  CRISPR gRNA sequence
taatcccagcactttgggag

SEQ ID NO: 342860 - DNA, 20 bp, Artificial
  CRISPR gRNA sequence
tgggaggccaaggcgggcgg

SEQ ID NO: 342861 - DNA, 20 bp, Artificial
  CRISPR gRNA sequence
gggaggccaaggcgggcgga

SEQ ID NO: 342862 - DNA, 20 bp, Artificial
  CRISPR gRNA sequence
ggaggccaaggcgggcggat

SEQ ID NO: 342863 - DNA, 20 bp, Artificial
  CRISPR gRNA sequence
agaccatcctggctaacacg

SEQ ID NO: 342864 - DNA, 20 bp, Artificial
  CRISPR gRNA sequence
gctaacacggtgaaaccccg

SEQ ID NO: 342865 - DNA, 20 bp, Artificial
  CRISPR gRNA sequence
acacggtgaaaccccgtctc

SEQ ID NO: 342866 - DNA, 20 bp, Artificial
  CRISPR gRNA sequence
tactaaaaatacaaaaaatt

SEQ ID NO: 342867 - DNA, 20 bp, Artificial
  CRISPR gRNA sequence
ctaaaaatacaaaaaattag

SEQ ID NO: 342868 - DNA, 20 bp, Artificial
  CRISPR gRNA sequence
aaaatacaaaaaattagcca

SEQ ID NO: 342869 - DNA, 20 bp, Artificial
  CRISPR gRNA sequence
gccaggtgtggtggcacaca

SEQ ID NO: 342870 - DNA, 20 bp, Artificial
  CRISPR gRNA sequence
taatcccagctactagggag

SEQ ID NO: 342871 - DNA, 20 bp, Artificial
  CRISPR gRNA sequence
ctagggaggctgaggcagga

SEQ ID NO: 342872 - DNA, 20 bp, Artificial
  CRISPR gRNA sequence
gggaggctgaggcaggagaa

SEQ ID NO: 342873 - DNA, 20 bp, Artificial
  CRISPR gRNA sequence
aggcaggagaatcacttgaa

SEQ ID NO: 342874 - DNA, 20 bp, Artificial
  CRISPR gRNA sequence
gaactcaggaggcggaggtt

SEQ ID NO: 342875 - DNA, 20 bp, Artificial
  CRISPR gRNA sequence
aactcaggaggcggaggttg

SEQ ID NO: 342876 - DNA, 20 bp, Artificial
  CRISPR gRNA sequence
aggaggcggaggttgcactg

SEQ ID NO: 342877 - DNA, 20 bp, Artificial
  CRISPR gRNA sequence
cactgagccgagatcgtgcc

SEQ ID NO: 342878 - DNA, 20 bp, Artificial
  CRISPR gRNA sequence
agccgagatcgtgccactgc

SEQ ID NO: 342879 - DNA, 20 bp, Artificial
  CRISPR gRNA sequence
cactccaacctgggcgacaa

SEQ ID NO: 342880 - DNA, 20 bp, Artificial
  CRISPR gRNA sequence
caacctgggcgacaaagcaa

SEQ ID NO: 342881 - DNA, 20 bp, Artificial
  CRISPR gRNA sequence
ggcgacaaagcaagactctg

SEQ ID NO: 342882 - DNA, 20 bp, Artificial
  CRISPR gRNA sequence
tgtcaaaaaacaaacaaaca

SEQ ID NO: 342883 - DNA, 20 bp, Artificial
  CRISPR gRNA sequence
tcaaaaaacaaacaaacaaa

SEQ ID NO: 342884 - DNA, 20 bp, Artificial
  CRISPR gRNA sequence
agtaactgtaatcaagtaac

SEQ ID NO: 342885 - DNA, 20 bp, Artificial
  CRISPR gRNA sequence
taatcaagtaactatttatt

SEQ ID NO: 342886 - DNA, 20 bp, Artificial
  CRISPR gRNA sequence
tttattatttatttatttta

SEQ ID NO: 342887 - DNA, 20 bp, Artificial
  CRISPR gRNA sequence
attatttatttattttagtg

SEQ ID NO: 342888 - DNA, 20 bp, Artificial
  CRISPR gRNA sequence
ttatttatttattttagtgt

SEQ ID NO: 342889 - DNA, 20 bp, Artificial
  CRISPR gRNA sequence
tttatttattttagtgtatc

SEQ ID NO: 342890 - DNA, 20 bp, Artificial
  CRISPR gRNA sequence
atttattttagtgtatccac

SEQ ID NO: 342891 - DNA, 20 bp, Artificial
  CRISPR gRNA sequence
tttattttagtgtatccaca

SEQ ID NO: 342892 - DNA, 20 bp, Artificial
  CRISPR gRNA sequence
attttagtgtatccacaggt

SEQ ID NO: 342893 - DNA, 20 bp, Artificial
  CRISPR gRNA sequence
ttttagtgtatccacaggtt

SEQ ID NO: 342894 - DNA, 20 bp, Artificial
  CRISPR gRNA sequence
tagtgtatccacaggttgtg

SEQ ID NO: 342895 - DNA, 20 bp, Artificial
  CRISPR gRNA sequence
agtgtatccacaggttgtgc

SEQ ID NO: 342896 - DNA, 20 bp, Artificial
  CRISPR gRNA sequence
gtgtatccacaggttgtgca

SEQ ID NO: 342897 - DNA, 20 bp, Artificial
  CRISPR gRNA sequence
tgcagccatcaacactatct

SEQ ID NO: 342898 - DNA, 20 bp, Artificial
  CRISPR gRNA sequence
tctaattctataacattttc

SEQ ID NO: 342899 - DNA, 20 bp, Artificial
  CRISPR gRNA sequence
attctataacattttcgtta

SEQ ID NO: 342900 - DNA, 20 bp, Artificial
  CRISPR gRNA sequence
tataacattttcgttacccc

SEQ ID NO: 342901 - DNA, 20 bp, Artificial
  CRISPR gRNA sequence
taacattttcgttaccccag

SEQ ID NO: 342902 - DNA, 20 bp, Artificial
  CRISPR gRNA sequence
tcgttaccccagagaaactt

SEQ ID NO: 342903 - DNA, 20 bp, Artificial
  CRISPR gRNA sequence
cgttaccccagagaaacttg

SEQ ID NO: 342904 - DNA, 20 bp, Artificial
  CRISPR gRNA sequence
gttaccccagagaaacttgt

SEQ ID NO: 342905 - DNA, 20 bp, Artificial
  CRISPR gRNA sequence
ccccagagaaacttgtaccc

SEQ ID NO: 342906 - DNA, 20 bp, Artificial
  CRISPR gRNA sequence
gtaccccttagcaatgactc

SEQ ID NO: 342907 - DNA, 20 bp, Artificial
  CRISPR gRNA sequence
taccccttagcaatgactcc

SEQ ID NO: 342908 - DNA, 20 bp, Artificial
  CRISPR gRNA sequence
agcaatgactccccatttct

SEQ ID NO: 342909 - DNA, 20 bp, Artificial
  CRISPR gRNA sequence
gcaatgactccccatttctt

SEQ ID NO: 342910 - DNA, 20 bp, Artificial
  CRISPR gRNA sequence
cccatttcttccccccaacc

SEQ ID NO: 342911 - DNA, 20 bp, Artificial
  CRISPR gRNA sequence
cttccccccaaccaacccca

SEQ ID NO: 342912 - DNA, 20 bp, Artificial
  CRISPR gRNA sequence
ttccccccaaccaaccccag

SEQ ID NO: 342913 - DNA, 20 bp, Artificial
  CRISPR gRNA sequence
ccccccaaccaaccccagcc

SEQ ID NO: 342914 - DNA, 20 bp, Artificial
  CRISPR gRNA sequence
cccccaaccaaccccagccc

SEQ ID NO: 342915 - DNA, 20 bp, Artificial
  CRISPR gRNA sequence
ggaatccctaatatactttg

SEQ ID NO: 342916 - DNA, 20 bp, Artificial
  CRISPR gRNA sequence
atatactttgttttgttttt

SEQ ID NO: 342917 - DNA, 20 bp, Artificial
  CRISPR gRNA sequence
tgttttgttttttgttggtg

SEQ ID NO: 342918 - DNA, 20 bp, Artificial
  CRISPR gRNA sequence
gttttgttttttgttggtgg

SEQ ID NO: 342919 - DNA, 20 bp, Artificial
  CRISPR gRNA sequence
ttttgttttttgttggtggt

SEQ ID NO: 342920 - DNA, 20 bp, Artificial
  CRISPR gRNA sequence
tgttttttgttggtggtgtt

SEQ ID NO: 342921 - DNA, 20 bp, Artificial
  CRISPR gRNA sequence
gttttttgttggtggtgttt

SEQ ID NO: 342922 - DNA, 20 bp, Artificial
  CRISPR gRNA sequence
ttttttgttggtggtgtttg

SEQ ID NO: 342923 - DNA, 20 bp, Artificial
  CRISPR gRNA sequence
tttgttggtggtgtttgaga

SEQ ID NO: 342924 - DNA, 20 bp, Artificial
  CRISPR gRNA sequence
ttgttggtggtgtttgagac

SEQ ID NO: 342925 - DNA, 20 bp, Artificial
  CRISPR gRNA sequence
tgttggtggtgtttgagaca

SEQ ID NO: 342926 - DNA, 20 bp, Artificial
  CRISPR gRNA sequence
gttggtggtgtttgagacag

SEQ ID NO: 342927 - DNA, 20 bp, Artificial
  CRISPR gRNA sequence
ttggtggtgtttgagacagg

SEQ ID NO: 342928 - DNA, 20 bp, Artificial
  CRISPR gRNA sequence
gtggtgtttgagacaggatc

SEQ ID NO: 342929 - DNA, 20 bp, Artificial
  CRISPR gRNA sequence
gagacaggatctcactctgt

SEQ ID NO: 342930 - DNA, 20 bp, Artificial
  CRISPR gRNA sequence
agacaggatctcactctgtc

SEQ ID NO: 342931 - DNA, 20 bp, Artificial
  CRISPR gRNA sequence
actctgtcacccaggctgga

SEQ ID NO: 342932 - DNA, 20 bp, Artificial
  CRISPR gRNA sequence
tgtcacccaggctggagcgc

SEQ ID NO: 342933 - DNA, 20 bp, Artificial
  CRISPR gRNA sequence
tcacccaggctggagcgcag

SEQ ID NO: 342934 - DNA, 20 bp, Artificial
  CRISPR gRNA sequence
gagcgcagtatcatgatctc

SEQ ID NO: 342935 - DNA, 20 bp, Artificial
  CRISPR gRNA sequence
agctcactgtaacctccacc

SEQ ID NO: 342936 - DNA, 20 bp, Artificial
  CRISPR gRNA sequence
actgtaacctccacctcccg

SEQ ID NO: 342937 - DNA, 20 bp, Artificial
  CRISPR gRNA sequence
taacctccacctcccgggct

SEQ ID NO: 342938 - DNA, 20 bp, Artificial
  CRISPR gRNA sequence
cacctcccgggctcaagcga

SEQ ID NO: 342939 - DNA, 20 bp, Artificial
  CRISPR gRNA sequence
ccgggctcaagcgatcctcc

SEQ ID NO: 342940 - DNA, 20 bp, Artificial
  CRISPR gRNA sequence
aagcgatcctcccacctcag

SEQ ID NO: 342941 - DNA, 20 bp, Artificial
  CRISPR gRNA sequence
ccacctcagcctccccagta

SEQ ID NO: 342942 - DNA, 20 bp, Artificial
  CRISPR gRNA sequence
agcctccccagtagcttggg

SEQ ID NO: 342943 - DNA, 20 bp, Artificial
  CRISPR gRNA sequence
cccagtagcttgggcctaca

SEQ ID NO: 342944 - DNA, 20 bp, Artificial
  CRISPR gRNA sequence
gggcctacaggtgtgcacca

SEQ ID NO: 342945 - DNA, 20 bp, Artificial
  CRISPR gRNA sequence
ggcctacaggtgtgcaccac

SEQ ID NO: 342946 - DNA, 20 bp, Artificial
  CRISPR gRNA sequence
caggtgtgcaccaccacacc

SEQ ID NO: 342947 - DNA, 20 bp, Artificial
  CRISPR gRNA sequence
atttttgtattttttgtaga

SEQ ID NO: 342948 - DNA, 20 bp, Artificial
  CRISPR gRNA sequence
ttgtattttttgtagagacg

SEQ ID NO: 342949 - DNA, 20 bp, Artificial
  CRISPR gRNA sequence
tgtattttttgtagagacgg

SEQ ID NO: 342950 - DNA, 20 bp, Artificial
  CRISPR gRNA sequence
gtattttttgtagagacggg

SEQ ID NO: 342951 - DNA, 20 bp, Artificial
  CRISPR gRNA sequence
tattttttgtagagacgggg

SEQ ID NO: 342952 - DNA, 20 bp, Artificial
  CRISPR gRNA sequence
tttgtagagacggggtttca

SEQ ID NO: 342953 - DNA, 20 bp, Artificial
  CRISPR gRNA sequence
ttgtagagacggggtttcac

SEQ ID NO: 342954 - DNA, 20 bp, Artificial
  CRISPR gRNA sequence
tgtagagacggggtttcacc

SEQ ID NO: 342955 - DNA, 20 bp, Artificial
  CRISPR gRNA sequence
gtagagacggggtttcacca

SEQ ID NO: 342956 - DNA, 20 bp, Artificial
  CRISPR gRNA sequence
tagagacggggtttcaccat

SEQ ID NO: 342957 - DNA, 20 bp, Artificial
  CRISPR gRNA sequence
caccatgttggccaggctgg

SEQ ID NO: 342958 - DNA, 20 bp, Artificial
  CRISPR gRNA sequence
accatgttggccaggctggt

SEQ ID NO: 342959 - DNA, 20 bp, Artificial
  CRISPR gRNA sequence
gccaggctggtctcaaactc

SEQ ID NO: 342960 - DNA, 20 bp, Artificial
  CRISPR gRNA sequence
gtctcaaactcctgagctca

SEQ ID NO: 342961 - DNA, 20 bp, Artificial
  CRISPR gRNA sequence
aaactcctgagctcaagcaa

SEQ ID NO: 342962 - DNA, 20 bp, Artificial
  CRISPR gRNA sequence
ctgagctcaagcaatccacc

SEQ ID NO: 342963 - DNA, 20 bp, Artificial
  CRISPR gRNA sequence
agctcaagcaatccacccac

SEQ ID NO: 342964 - DNA, 20 bp, Artificial
  CRISPR gRNA sequence
aagcaatccacccacctcaa

SEQ ID NO: 342965 - DNA, 20 bp, Artificial
  CRISPR gRNA sequence
aacctcccaaagtgctggga

SEQ ID NO: 342966 - DNA, 20 bp, Artificial
  CRISPR gRNA sequence
ccaaagtgctgggattacag

SEQ ID NO: 342967 - DNA, 20 bp, Artificial
  CRISPR gRNA sequence
ggattacaggcgtaagccac

SEQ ID NO: 342968 - DNA, 20 bp, Artificial
  CRISPR gRNA sequence
caggcgtaagccactgcacc

SEQ ID NO: 342969 - DNA, 20 bp, Artificial
  CRISPR gRNA sequence
cacctggctattttctttct

SEQ ID NO: 342970 - DNA, 20 bp, Artificial
  CRISPR gRNA sequence
gctattttctttctttcttt

SEQ ID NO: 342971 - DNA, 20 bp, Artificial
  CRISPR gRNA sequence
ttttctttctttcttttctt

SEQ ID NO: 342972 - DNA, 20 bp, Artificial
  CRISPR gRNA sequence
tctttctttcttttcttttt

SEQ ID NO: 342973 - DNA, 20 bp, Artificial
  CRISPR gRNA sequence
ctttctttcttttctttttt

SEQ ID NO: 342974 - DNA, 20 bp, Artificial
  CRISPR gRNA sequence
tttctttcttttcttttttt

SEQ ID NO: 342975 - DNA, 20 bp, Artificial
  CRISPR gRNA sequence
tctttcttttcttttttttt

SEQ ID NO: 342976 - DNA, 20 bp, Artificial
  CRISPR gRNA sequence
ctttcttttctttttttttt

SEQ ID NO: 342977 - DNA, 20 bp, Artificial
  CRISPR gRNA sequence
tttcttttcttttttttttt

SEQ ID NO: 342978 - DNA, 20 bp, Artificial
  CRISPR gRNA sequence
tcttttcttttttttttttt

SEQ ID NO: 342979 - DNA, 20 bp, Artificial
  CRISPR gRNA sequence
cttttctttttttttttttt

SEQ ID NO: 342980 - DNA, 20 bp, Artificial
  CRISPR gRNA sequence
ttttcttttttttttttttt

SEQ ID NO: 342981 - DNA, 20 bp, Artificial
  CRISPR gRNA sequence
ttcttttttttttttttttg

SEQ ID NO: 342982 - DNA, 20 bp, Artificial
  CRISPR gRNA sequence
tcttttttttttttttttga

SEQ ID NO: 342983 - DNA, 20 bp, Artificial
  CRISPR gRNA sequence
cttttttttttttttttgag

SEQ ID NO: 342984 - DNA, 20 bp, Artificial
  CRISPR gRNA sequence
ttttttttttttttttgaga

SEQ ID NO: 342985 - DNA, 20 bp, Artificial
  CRISPR gRNA sequence
ttttttttttttttgagacg

SEQ ID NO: 342986 - DNA, 20 bp, Artificial
  CRISPR gRNA sequence
tttttttttttttgagacgg

SEQ ID NO: 342987 - DNA, 20 bp, Artificial
  CRISPR gRNA sequence
ttttttttttttgagacgga

SEQ ID NO: 342988 - DNA, 20 bp, Artificial
  CRISPR gRNA sequence
tttttttttttgagacggag

SEQ ID NO: 342989 - DNA, 20 bp, Artificial
  CRISPR gRNA sequence
ttttttttttgagacggagt

SEQ ID NO: 342990 - DNA, 20 bp, Artificial
  CRISPR gRNA sequence
tttttttttgagacggagtt

SEQ ID NO: 342991 - DNA, 20 bp, Artificial
  CRISPR gRNA sequence
ttttttttgagacggagttt

SEQ ID NO: 342992 - DNA, 20 bp, Artificial
  CRISPR gRNA sequence
tttttttgagacggagtttc

SEQ ID NO: 342993 - DNA, 20 bp, Artificial
  CRISPR gRNA sequence
ttttttgagacggagtttca

SEQ ID NO: 342994 - DNA, 20 bp, Artificial
  CRISPR gRNA sequence
tttttgagacggagtttcac

SEQ ID NO: 342995 - DNA, 20 bp, Artificial
  CRISPR gRNA sequence
ttttgagacggagtttcact

SEQ ID NO: 342996 - DNA, 20 bp, Artificial
  CRISPR gRNA sequence
tttgagacggagtttcactc

SEQ ID NO: 342997 - DNA, 20 bp, Artificial
  CRISPR gRNA sequence
ttgagacggagtttcactct

SEQ ID NO: 342998 - DNA, 20 bp, Artificial
  CRISPR gRNA sequence
tgagacggagtttcactctg

SEQ ID NO: 342999 - DNA, 20 bp, Artificial
  CRISPR gRNA sequence
gagacggagtttcactctgt

SEQ ID NO: 343000 - DNA, 20 bp, Artificial
  CRISPR gRNA sequence
agacggagtttcactctgtt

SEQ ID NO: 343001 - DNA, 20 bp, Artificial
  CRISPR gRNA sequence
cactctgttgcccaggctgg

SEQ ID NO: 343002 - DNA, 20 bp, Artificial
  CRISPR gRNA sequence
actctgttgcccaggctgga

SEQ ID NO: 343003 - DNA, 20 bp, Artificial
  CRISPR gRNA sequence
tgttgcccaggctggagtgc

SEQ ID NO: 343004 - DNA, 20 bp, Artificial
  CRISPR gRNA sequence
ttgcccaggctggagtgcag

SEQ ID NO: 343005 - DNA, 20 bp, Artificial
  CRISPR gRNA sequence
cccaggctggagtgcagtgg

SEQ ID NO: 343006 - DNA, 20 bp, Artificial
  CRISPR gRNA sequence
gagtgcagtggcgtgatctc

SEQ ID NO: 343007 - DNA, 20 bp, Artificial
  CRISPR gRNA sequence
ggctcactgcaacttccacc

SEQ ID NO: 343008 - DNA, 20 bp, Artificial
  CRISPR gRNA sequence
actgcaacttccacctcccg

SEQ ID NO: 343009 - DNA, 20 bp, Artificial
  CRISPR gRNA sequence
caacttccacctcccgggtt

SEQ ID NO: 343010 - DNA, 20 bp, Artificial
  CRISPR gRNA sequence
ccacctcccgggttcaagca

SEQ ID NO: 343011 - DNA, 20 bp, Artificial
  CRISPR gRNA sequence
cacctcccgggttcaagcaa

SEQ ID NO: 343012 - DNA, 20 bp, Artificial
  CRISPR gRNA sequence
ccgggttcaagcaattccct

SEQ ID NO: 343013 - DNA, 20 bp, Artificial
  CRISPR gRNA sequence
aagcaattccctgcctcacc

SEQ ID NO: 343014 - DNA, 20 bp, Artificial
  CRISPR gRNA sequence
cctgcctcacccggctattt

SEQ ID NO: 343015 - DNA, 20 bp, Artificial
  CRISPR gRNA sequence
cctcacccggctattttata

SEQ ID NO: 343016 - DNA, 20 bp, Artificial
  CRISPR gRNA sequence
acccggctattttatatttg

SEQ ID NO: 343017 - DNA, 20 bp, Artificial
  CRISPR gRNA sequence
ttttatatttgttgatctgc

SEQ ID NO: 343018 - DNA, 20 bp, Artificial
  CRISPR gRNA sequence
tatatttgttgatctgctgc

SEQ ID NO: 343019 - DNA, 20 bp, Artificial
  CRISPR gRNA sequence
atatttgttgatctgctgct

SEQ ID NO: 343020 - DNA, 20 bp, Artificial
  CRISPR gRNA sequence
tatttgttgatctgctgctg

SEQ ID NO: 343021 - DNA, 20 bp, Artificial
  CRISPR gRNA sequence
gttgatctgctgctggttat

SEQ ID NO: 343022 - DNA, 20 bp, Artificial
  CRISPR gRNA sequence
ttgatctgctgctggttatg

SEQ ID NO: 343023 - DNA, 20 bp, Artificial
  CRISPR gRNA sequence
atctgctgctggttatgcct

SEQ ID NO: 343024 - DNA, 20 bp, Artificial
  CRISPR gRNA sequence
ctgctggttatgcctgtgag

SEQ ID NO: 343025 - DNA, 20 bp, Artificial
  CRISPR gRNA sequence
ctggttatgcctgtgagcca

SEQ ID NO: 343026 - DNA, 20 bp, Artificial
  CRISPR gRNA sequence
gttatgcctgtgagccaaat

SEQ ID NO: 343027 - DNA, 20 bp, Artificial
  CRISPR gRNA sequence
tgcctgtgagccaaatttgt

SEQ ID NO: 343028 - DNA, 20 bp, Artificial
  CRISPR gRNA sequence
tgagccaaatttgtacaaat

SEQ ID NO: 343029 - DNA, 20 bp, Artificial
  CRISPR gRNA sequence
gtacaaattcttaagcttta

SEQ ID NO: 343030 - DNA, 20 bp, Artificial
  CRISPR gRNA sequence
tacaaattcttaagctttac

SEQ ID NO: 343031 - DNA, 20 bp, Artificial
  CRISPR gRNA sequence
ttaagctttacaatcatgcg

SEQ ID NO: 343032 - DNA, 20 bp, Artificial
  CRISPR gRNA sequence
aagctttacaatcatgcgtg

SEQ ID NO: 343033 - DNA, 20 bp, Artificial
  CRISPR gRNA sequence
agctttacaatcatgcgtgc

SEQ ID NO: 343034 - DNA, 20 bp, Artificial
  CRISPR gRNA sequence
tacaatcatgcgtgcctctc

SEQ ID NO: 343035 - DNA, 20 bp, Artificial
  CRISPR gRNA sequence
acaatcatgcgtgcctctct

SEQ ID NO: 343036 - DNA, 20 bp, Artificial
  CRISPR gRNA sequence
caatcatgcgtgcctctctg

SEQ ID NO: 343037 - DNA, 20 bp, Artificial
  CRISPR gRNA sequence
tctgtacgtatattatactt

SEQ ID NO: 343038 - DNA, 20 bp, Artificial
  CRISPR gRNA sequence
tgtacgtatattatacttta

SEQ ID NO: 343039 - DNA, 20 bp, Artificial
  CRISPR gRNA sequence
tacgtatattatactttaat

SEQ ID NO: 343040 - DNA, 20 bp, Artificial
  CRISPR gRNA sequence
tactttaattaaaagttatt

SEQ ID NO: 343041 - DNA, 20 bp, Artificial
  CRISPR gRNA sequence
taattaaaagttattaaagt

SEQ ID NO: 343042 - DNA, 20 bp, Artificial
  CRISPR gRNA sequence
aattaaaagttattaaagta

SEQ ID NO: 343043 - DNA, 20 bp, Artificial
  CRISPR gRNA sequence
attaaaagttattaaagtat

SEQ ID NO: 343044 - DNA, 20 bp, Artificial
  CRISPR gRNA sequence
aaagttattaaagtattggg

SEQ ID NO: 343045 - DNA, 20 bp, Artificial
  CRISPR gRNA sequence
ttaaagtattggggccgagc

SEQ ID NO: 343046 - DNA, 20 bp, Artificial
  CRISPR gRNA sequence
aagtattggggccgagcaca

SEQ ID NO: 343047 - DNA, 20 bp, Artificial
  CRISPR gRNA sequence
gggccgagcacagtggctca

SEQ ID NO: 343048 - DNA, 20 bp, Artificial
  CRISPR gRNA sequence
acgcctgtaatcccaacact

SEQ ID NO: 343049 - DNA, 20 bp, Artificial
  CRISPR gRNA sequence
taatcccaacactttgggag

SEQ ID NO: 343050 - DNA, 20 bp, Artificial
  CRISPR gRNA sequence
tgggaggctgaggctggtgc

SEQ ID NO: 343051 - DNA, 20 bp, Artificial
  CRISPR gRNA sequence
gggaggctgaggctggtgca

SEQ ID NO: 343052 - DNA, 20 bp, Artificial
  CRISPR gRNA sequence
ggaggctgaggctggtgcat

SEQ ID NO: 343053 - DNA, 20 bp, Artificial
  CRISPR gRNA sequence
aggctggtgcatcacctgag

SEQ ID NO: 343054 - DNA, 20 bp, Artificial
  CRISPR gRNA sequence
gtgcatcacctgaggtcagg

SEQ ID NO: 343055 - DNA, 20 bp, Artificial
  CRISPR gRNA sequence
aggtcaggagtttaatacca

SEQ ID NO: 343056 - DNA, 20 bp, Artificial
  CRISPR gRNA sequence
aataccagcctggccaatac

SEQ ID NO: 343057 - DNA, 20 bp, Artificial
  CRISPR gRNA sequence
ataccagcctggccaataca

SEQ ID NO: 343058 - DNA, 20 bp, Artificial
  CRISPR gRNA sequence
gccaatacagtaaaaccccg

SEQ ID NO: 343059 - DNA, 20 bp, Artificial
  CRISPR gRNA sequence
tactaaaaatacaaaaaatt

SEQ ID NO: 343060 - DNA, 20 bp, Artificial
  CRISPR gRNA sequence
ctaaaaatacaaaaaattag

SEQ ID NO: 343061 - DNA, 20 bp, Artificial
  CRISPR gRNA sequence
aaaatacaaaaaattagccg

SEQ ID NO: 343062 - DNA, 20 bp, Artificial
  CRISPR gRNA sequence
gccgggtgtggtggcacaca

SEQ ID NO: 343063 - DNA, 20 bp, Artificial
  CRISPR gRNA sequence
taatcccagctacttgggag

SEQ ID NO: 343064 - DNA, 20 bp, Artificial
  CRISPR gRNA sequence
cttgggaggctgaggcagga

SEQ ID NO: 343065 - DNA, 20 bp, Artificial
  CRISPR gRNA sequence
gggaggctgaggcaggagaa

SEQ ID NO: 343066 - DNA, 20 bp, Artificial
  CRISPR gRNA sequence
ggaggctgaggcaggagaat

SEQ ID NO: 343067 - DNA, 20 bp, Artificial
  CRISPR gRNA sequence
aggcaggagaattgcttgaa

SEQ ID NO: 343068 - DNA, 20 bp, Artificial
  CRISPR gRNA sequence
cttgaacccgggaggcagag

SEQ ID NO: 343069 - DNA, 20 bp, Artificial
  CRISPR gRNA sequence
gaacccgggaggcagaggtt

SEQ ID NO: 343070 - DNA, 20 bp, Artificial
  CRISPR gRNA sequence
aacccgggaggcagaggttg

SEQ ID NO: 343071 - DNA, 20 bp, Artificial
  CRISPR gRNA sequence
caacgagccaaggtcacgcc

SEQ ID NO: 343072 - DNA, 20 bp, Artificial
  CRISPR gRNA sequence
cactccagcctcggcaacaa

SEQ ID NO: 343073 - DNA, 20 bp, Artificial
  CRISPR gRNA sequence
cagcctcggcaacaagagcg

SEQ ID NO: 343074 - DNA, 20 bp, Artificial
  CRISPR gRNA sequence
ggcaacaagagcgagactcc

SEQ ID NO: 343075 - DNA, 20 bp, Artificial
  CRISPR gRNA sequence
catctcaaaaaaataaataa

SEQ ID NO: 343076 - DNA, 20 bp, Artificial
  CRISPR gRNA sequence
aaaaaaataaataaaaaata

SEQ ID NO: 343077 - DNA, 20 bp, Artificial
  CRISPR gRNA sequence
tttctacttttcatggtttc

SEQ ID NO: 343078 - DNA, 20 bp, Artificial
  CRISPR gRNA sequence
tctacttttcatggtttcta

SEQ ID NO: 343079 - DNA, 20 bp, Artificial
  CRISPR gRNA sequence
ctacttttcatggtttctat

SEQ ID NO: 343080 - DNA, 20 bp, Artificial
  CRISPR gRNA sequence
tacttttcatggtttctatg

SEQ ID NO: 343081 - DNA, 20 bp, Artificial
  CRISPR gRNA sequence
cttttcatggtttctatgtc

SEQ ID NO: 343082 - DNA, 20 bp, Artificial
  CRISPR gRNA sequence
ttcatggtttctatgtctga

SEQ ID NO: 343083 - DNA, 20 bp, Artificial
  CRISPR gRNA sequence
tcatggtttctatgtctgaa

SEQ ID NO: 343084 - DNA, 20 bp, Artificial
  CRISPR gRNA sequence
catggtttctatgtctgaac

SEQ ID NO: 343085 - DNA, 20 bp, Artificial
  CRISPR gRNA sequence
atggtttctatgtctgaacc

SEQ ID NO: 343086 - DNA, 20 bp, Artificial
  CRISPR gRNA sequence
ctatgtctgaacccatgaat

SEQ ID NO: 343087 - DNA, 20 bp, Artificial
  CRISPR gRNA sequence
tatgtctgaacccatgaatc

SEQ ID NO: 343088 - DNA, 20 bp, Artificial
  CRISPR gRNA sequence
tgtctgaacccatgaatctt

SEQ ID NO: 343089 - DNA, 20 bp, Artificial
  CRISPR gRNA sequence
aacccatgaatcttccttct

SEQ ID NO: 343090 - DNA, 20 bp, Artificial
  CRISPR gRNA sequence
ccttctgaaaggtccaactt

SEQ ID NO: 343091 - DNA, 20 bp, Artificial
  CRISPR gRNA sequence
cttctgaaaggtccaacttt

SEQ ID NO: 343092 - DNA, 20 bp, Artificial
  CRISPR gRNA sequence
ctgaaaggtccaactttctt

SEQ ID NO: 343093 - DNA, 20 bp, Artificial
  CRISPR gRNA sequence
tgaaaggtccaactttcttc

SEQ ID NO: 343094 - DNA, 20 bp, Artificial
  CRISPR gRNA sequence
aaaggtccaactttcttctt

SEQ ID NO: 343095 - DNA, 20 bp, Artificial
  CRISPR gRNA sequence
tcttctttaataacaataat

SEQ ID NO: 343096 - DNA, 20 bp, Artificial
  CRISPR gRNA sequence
cttctttaataacaataata

SEQ ID NO: 343097 - DNA, 20 bp, Artificial
  CRISPR gRNA sequence
ttctttaataacaataataa

SEQ ID NO: 343098 - DNA, 20 bp, Artificial
  CRISPR gRNA sequence
ctttaataacaataataatg

SEQ ID NO: 343099 - DNA, 20 bp, Artificial
  CRISPR gRNA sequence
tttaataacaataataatgg

SEQ ID NO: 343100 - DNA, 20 bp, Artificial
  CRISPR gRNA sequence
taataacaataataatggca

SEQ ID NO: 343101 - DNA, 20 bp, Artificial
  CRISPR gRNA sequence
aataacaataataatggcaa

SEQ ID NO: 343102 - DNA, 20 bp, Artificial
  CRISPR gRNA sequence
ataacaataataatggcaaa

SEQ ID NO: 343103 - DNA, 20 bp, Artificial
  CRISPR gRNA sequence
ggggaccgtgagcaaagggc

SEQ ID NO: 343104 - DNA, 20 bp, Artificial
  CRISPR gRNA sequence
tgcaggggtgggaatggaaa

SEQ ID NO: 343105 - DNA, 20 bp, Artificial
  CRISPR gRNA sequence
gcaggggtgggaatggaaag

SEQ ID NO: 343106 - DNA, 20 bp, Artificial
  CRISPR gRNA sequence
caggggtgggaatggaaagg

SEQ ID NO: 343107 - DNA, 20 bp, Artificial
  CRISPR gRNA sequence
gaggtgggcctgggatgggg

SEQ ID NO: 343108 - DNA, 20 bp, Artificial
  CRISPR gRNA sequence
ggatgggggttgggggatga

SEQ ID NO: 343109 - DNA, 20 bp, Artificial
  CRISPR gRNA sequence
ggggatgaagcaagtggacc

SEQ ID NO: 343110 - DNA, 20 bp, Artificial
  CRISPR gRNA sequence
gaaggtctccacaggtctga

SEQ ID NO: 343111 - DNA, 20 bp, Artificial
  CRISPR gRNA sequence
aaggtctccacaggtctgag

SEQ ID NO: 343112 - DNA, 20 bp, Artificial
  CRISPR gRNA sequence
cacaggtctgagtgtcctat

SEQ ID NO: 343113 - DNA, 20 bp, Artificial
  CRISPR gRNA sequence
agtgtcctatgctccctggg

SEQ ID NO: 343114 - DNA, 20 bp, Artificial
  CRISPR gRNA sequence
tgctccctgggcctctcttc

SEQ ID NO: 343115 - DNA, 20 bp, Artificial
  CRISPR gRNA sequence
cctgggcctctcttccccca

SEQ ID NO: 343116 - DNA, 20 bp, Artificial
  CRISPR gRNA sequence
ggcctctcttcccccaggtc

SEQ ID NO: 343117 - DNA, 20 bp, Artificial
  CRISPR gRNA sequence
tcttcccccaggtcttctcg

SEQ ID NO: 343118 - DNA, 20 bp, Artificial
  CRISPR gRNA sequence
ttcccccaggtcttctcgtt

SEQ ID NO: 343119 - DNA, 20 bp, Artificial
  CRISPR gRNA sequence
cccccaggtcttctcgttcg

SEQ ID NO: 343120 - DNA, 20 bp, Artificial
  CRISPR gRNA sequence
ccccaggtcttctcgttcgc

SEQ ID NO: 343121 - DNA, 20 bp, Artificial
  CRISPR gRNA sequence
ctcgttcgcaactgcaccat

SEQ ID NO: 343122 - DNA, 20 bp, Artificial
  CRISPR gRNA sequence
tcgttcgcaactgcaccatc

SEQ ID NO: 343123 - DNA, 20 bp, Artificial
  CRISPR gRNA sequence
gttcgcaactgcaccatcac

SEQ ID NO: 343124 - DNA, 20 bp, Artificial
  CRISPR gRNA sequence
gcaactgcaccatcactgcc

SEQ ID NO: 343125 - DNA, 20 bp, Artificial
  CRISPR gRNA sequence
caccatcactgccaatgctg

SEQ ID NO: 343126 - DNA, 20 bp, Artificial
  CRISPR gRNA sequence
ccaatgctgagtgtgcctgt

SEQ ID NO: 343127 - DNA, 20 bp, Artificial
  CRISPR gRNA sequence
agtgtgcctgtcgcaatggc

SEQ ID NO: 343128 - DNA, 20 bp, Artificial
  CRISPR gRNA sequence
tcgcaatggctggcagtgca

SEQ ID NO: 343129 - DNA, 20 bp, Artificial
  CRISPR gRNA sequence
gcagtgcagggacaaggagt

SEQ ID NO: 343130 - DNA, 20 bp, Artificial
  CRISPR gRNA sequence
ttccaaacccttcgctgacc

SEQ ID NO: 343131 - DNA, 20 bp, Artificial
  CRISPR gRNA sequence
ccaaacccttcgctgaccgc

SEQ ID NO: 343132 - DNA, 20 bp, Artificial
  CRISPR gRNA sequence
caaacccttcgctgaccgct

SEQ ID NO: 343133 - DNA, 20 bp, Artificial
  CRISPR gRNA sequence
cgctgaccgctcggtcgtct

SEQ ID NO: 343134 - DNA, 20 bp, Artificial
  CRISPR gRNA sequence
gctgaccgctcggtcgtctc

SEQ ID NO: 343135 - DNA, 20 bp, Artificial
  CRISPR gRNA sequence
accgctcggtcgtctcaggc

SEQ ID NO: 343136 - DNA, 20 bp, Artificial
  CRISPR gRNA sequence
ggtcgtctcaggccctgagc

SEQ ID NO: 343137 - DNA, 20 bp, Artificial
  CRISPR gRNA sequence
aggccctgagcccacaccct

SEQ ID NO: 343138 - DNA, 20 bp, Artificial
  CRISPR gRNA sequence
agcccacaccctcagcccac

SEQ ID NO: 343139 - DNA, 20 bp, Artificial
  CRISPR gRNA sequence
agcccacccacttaccttat

SEQ ID NO: 343140 - DNA, 20 bp, Artificial
  CRISPR gRNA sequence
accttatgtcagtggtaagt

SEQ ID NO: 343141 - DNA, 20 bp, Artificial
  CRISPR gRNA sequence
ccttatgtcagtggtaagtt

SEQ ID NO: 343142 - DNA, 20 bp, Artificial
  CRISPR gRNA sequence
atgtcagtggtaagttccag

SEQ ID NO: 343143 - DNA, 20 bp, Artificial
  CRISPR gRNA sequence
tgtcagtggtaagttccagg

SEQ ID NO: 343144 - DNA, 20 bp, Artificial
  CRISPR gRNA sequence
caggcaactctctgtgccat

SEQ ID NO: 343145 - DNA, 20 bp, Artificial
  CRISPR gRNA sequence
tctgtgccatcacgtggggt

SEQ ID NO: 343146 - DNA, 20 bp, Artificial
  CRISPR gRNA sequence
tgtgccatcacgtggggtag

SEQ ID NO: 343147 - DNA, 20 bp, Artificial
  CRISPR gRNA sequence
tgccatcacgtggggtagcg

SEQ ID NO: 343148 - DNA, 20 bp, Artificial
  CRISPR gRNA sequence
cccactcctacccctagata

SEQ ID NO: 343149 - DNA, 20 bp, Artificial
  CRISPR gRNA sequence
ctacccctagataaggtcag

SEQ ID NO: 343150 - DNA, 20 bp, Artificial
  CRISPR gRNA sequence
cccctagataaggtcagcct

SEQ ID NO: 343151 - DNA, 20 bp, Artificial
  CRISPR gRNA sequence
gataaggtcagcctgtttct

SEQ ID NO: 343152 - DNA, 20 bp, Artificial
  CRISPR gRNA sequence
tttctgccttcccatcccat

SEQ ID NO: 343153 - DNA, 20 bp, Artificial
  CRISPR gRNA sequence
ctgccttcccatcccatcca

SEQ ID NO: 343154 - DNA, 20 bp, Artificial
  CRISPR gRNA sequence
tgccttcccatcccatccag

SEQ ID NO: 343155 - DNA, 20 bp, Artificial
  CRISPR gRNA sequence
ccttcccatcccatccagca

SEQ ID NO: 343156 - DNA, 20 bp, Artificial
  CRISPR gRNA sequence
cccatcccatccagcacctc

SEQ ID NO: 343157 - DNA, 20 bp, Artificial
  CRISPR gRNA sequence
ccatcccatccagcacctct

SEQ ID NO: 343158 - DNA, 20 bp, Artificial
  CRISPR gRNA sequence
tcaggccttcagatgtgccc

SEQ ID NO: 343159 - DNA, 20 bp, Artificial
  CRISPR gRNA sequence
aggccttcagatgtgcccta

SEQ ID NO: 343160 - DNA, 20 bp, Artificial
  CRISPR gRNA sequence
cagatgtgccctatggggtc

SEQ ID NO: 343161 - DNA, 20 bp, Artificial
  CRISPR gRNA sequence
agatgtgccctatggggtcc

SEQ ID NO: 343162 - DNA, 20 bp, Artificial
  CRISPR gRNA sequence
tggggtcccctgctgctact

SEQ ID NO: 343163 - DNA, 20 bp, Artificial
  CRISPR gRNA sequence
ctgctactcattctgtctct

SEQ ID NO: 343164 - DNA, 20 bp, Artificial
  CRISPR gRNA sequence
ctactcattctgtctctgtt

SEQ ID NO: 343165 - DNA, 20 bp, Artificial
  CRISPR gRNA sequence
ctcattctgtctctgttttt

SEQ ID NO: 343166 - DNA, 20 bp, Artificial
  CRISPR gRNA sequence
attctgtctctgtttttcca

SEQ ID NO: 343167 - DNA, 20 bp, Artificial
  CRISPR gRNA sequence
tgtctctgtttttccagaga

SEQ ID NO: 343168 - DNA, 20 bp, Artificial
  CRISPR gRNA sequence
tctctgtttttccagagatg

SEQ ID NO: 343169 - DNA, 20 bp, Artificial
  CRISPR gRNA sequence
tgtttttccagagatgctgg

SEQ ID NO: 343170 - DNA, 20 bp, Artificial
  CRISPR gRNA sequence
tttttccagagatgctggag

SEQ ID NO: 343171 - DNA, 20 bp, Artificial
  CRISPR gRNA sequence
ttccagagatgctggaggcc

SEQ ID NO: 343172 - DNA, 20 bp, Artificial
  CRISPR gRNA sequence
tccagagatgctggaggcca

SEQ ID NO: 343173 - DNA, 20 bp, Artificial
  CRISPR gRNA sequence
ccagagatgctggaggccag

SEQ ID NO: 343174 - DNA, 20 bp, Artificial
  CRISPR gRNA sequence
cagagatgctggaggccagg

SEQ ID NO: 343175 - DNA, 20 bp, Artificial
  CRISPR gRNA sequence
gaggccaggacagctgggca

SEQ ID NO: 343176 - DNA, 20 bp, Artificial
  CRISPR gRNA sequence
ggcacatgcagactctggct

SEQ ID NO: 343177 - DNA, 20 bp, Artificial
  CRISPR gRNA sequence
tggctgacttcaggcagctg

SEQ ID NO: 343178 - DNA, 20 bp, Artificial
  CRISPR gRNA sequence
gctgacttcaggcagctgcc

SEQ ID NO: 343179 - DNA, 20 bp, Artificial
  CRISPR gRNA sequence
acttcaggcagctgcctgcc

SEQ ID NO: 343180 - DNA, 20 bp, Artificial
  CRISPR gRNA sequence
caggcagctgcctgcccgga

SEQ ID NO: 343181 - DNA, 20 bp, Artificial
  CRISPR gRNA sequence
aggcagctgcctgcccggac

SEQ ID NO: 343182 - DNA, 20 bp, Artificial
  CRISPR gRNA sequence
cctgcccggactctctctac

SEQ ID NO: 343183 - DNA, 20 bp, Artificial
  CRISPR gRNA sequence
cccggactctctctacccac

SEQ ID NO: 343184 - DNA, 20 bp, Artificial
  CRISPR gRNA sequence
tctctacccactggccacgt

SEQ ID NO: 343185 - DNA, 20 bp, Artificial
  CRISPR gRNA sequence
tctacccactggccacgtga

SEQ ID NO: 343186 - DNA, 20 bp, Artificial
  CRISPR gRNA sequence
tacccactggccacgtgagt

SEQ ID NO: 343187 - DNA, 20 bp, Artificial
  CRISPR gRNA sequence
cccactggccacgtgagttt

SEQ ID NO: 343188 - DNA, 20 bp, Artificial
  CRISPR gRNA sequence
gccacgtgagttttctcctt

SEQ ID NO: 343189 - DNA, 20 bp, Artificial
  CRISPR gRNA sequence
tctccttaatccccaccgct

SEQ ID NO: 343190 - DNA, 20 bp, Artificial
  CRISPR gRNA sequence
ctccttaatccccaccgcta

SEQ ID NO: 343191 - DNA, 20 bp, Artificial
  CRISPR gRNA sequence
tccttaatccccaccgctag

SEQ ID NO: 343192 - DNA, 20 bp, Artificial
  CRISPR gRNA sequence
cttaatccccaccgctagag

SEQ ID NO: 343193 - DNA, 20 bp, Artificial
  CRISPR gRNA sequence
aatccccaccgctagagaga

SEQ ID NO: 343194 - DNA, 20 bp, Artificial
  CRISPR gRNA sequence
atccccaccgctagagagaa

SEQ ID NO: 343195 - DNA, 20 bp, Artificial
  CRISPR gRNA sequence
gagagaatgcatacacgagg

SEQ ID NO: 343196 - DNA, 20 bp, Artificial
  CRISPR gRNA sequence
ctaggattagggataagagg

SEQ ID NO: 343197 - DNA, 20 bp, Artificial
  CRISPR gRNA sequence
ggattagggataagaggagg

SEQ ID NO: 343198 - DNA, 20 bp, Artificial
  CRISPR gRNA sequence
gggataagaggaggggaaaa

SEQ ID NO: 343199 - DNA, 20 bp, Artificial
  CRISPR gRNA sequence
tttaggagaggagttggcca

SEQ ID NO: 343200 - DNA, 20 bp, Artificial
  CRISPR gRNA sequence
aggagaggagttggccaacg

SEQ ID NO: 343201 - DNA, 20 bp, Artificial
  CRISPR gRNA sequence
ggagaggagttggccaacgg

SEQ ID NO: 343202 - DNA, 20 bp, Artificial
  CRISPR gRNA sequence
gccaacggtggcgggtggga

SEQ ID NO: 343203 - DNA, 20 bp, Artificial
  CRISPR gRNA sequence
ggctgagggagccaagggct

SEQ ID NO: 343204 - DNA, 20 bp, Artificial
  CRISPR gRNA sequence
agggagccaagggctagacc

SEQ ID NO: 343205 - DNA, 20 bp, Artificial
  CRISPR gRNA sequence
gaccctcccctaacccctgt

SEQ ID NO: 343206 - DNA, 20 bp, Artificial
  CRISPR gRNA sequence
ccctaacccctgtgtgtccc

SEQ ID NO: 343207 - DNA, 20 bp, Artificial
  CRISPR gRNA sequence
acccctgtgtgtcccctcct

SEQ ID NO: 343208 - DNA, 20 bp, Artificial
  CRISPR gRNA sequence
tgtgtcccctcctattacag

SEQ ID NO: 343209 - DNA, 20 bp, Artificial
  CRISPR gRNA sequence
ctattacagcccaaagatcc

SEQ ID NO: 343210 - DNA, 20 bp, Artificial
  CRISPR gRNA sequence
ttacagcccaaagatccctg

SEQ ID NO: 343211 - DNA, 20 bp, Artificial
  CRISPR gRNA sequence
cagcccaaagatccctgtgc

SEQ ID NO: 343212 - DNA, 20 bp, Artificial
  CRISPR gRNA sequence
tgcagctccgattttattcg

SEQ ID NO: 343213 - DNA, 20 bp, Artificial
  CRISPR gRNA sequence
cgattttattcgcatccttg

SEQ ID NO: 343214 - DNA, 20 bp, Artificial
  CRISPR gRNA sequence
tattcgcatccttgtgatct

SEQ ID NO: 343215 - DNA, 20 bp, Artificial
  CRISPR gRNA sequence
attcgcatccttgtgatctt

SEQ ID NO: 343216 - DNA, 20 bp, Artificial
  CRISPR gRNA sequence
ttcgcatccttgtgatcttc

SEQ ID NO: 343217 - DNA, 20 bp, Artificial
  CRISPR gRNA sequence
gcatccttgtgatcttctct

SEQ ID NO: 343218 - DNA, 20 bp, Artificial
  CRISPR gRNA sequence
gtgatcttctctggaatgtt

SEQ ID NO: 343219 - DNA, 20 bp, Artificial
  CRISPR gRNA sequence
tgatcttctctggaatgttc

SEQ ID NO: 343220 - DNA, 20 bp, Artificial
  CRISPR gRNA sequence
ctctggaatgttccttgttt

SEQ ID NO: 343221 - DNA, 20 bp, Artificial
  CRISPR gRNA sequence
tctggaatgttccttgtttt

SEQ ID NO: 343222 - DNA, 20 bp, Artificial
  CRISPR gRNA sequence
tggaatgttccttgttttca

SEQ ID NO: 343223 - DNA, 20 bp, Artificial
  CRISPR gRNA sequence
gaatgttccttgttttcacc

SEQ ID NO: 343224 - DNA, 20 bp, Artificial
  CRISPR gRNA sequence
cttgttttcaccctggccgg

SEQ ID NO: 343225 - DNA, 20 bp, Artificial
  CRISPR gRNA sequence
gttttcaccctggccggggc

SEQ ID NO: 343226 - DNA, 20 bp, Artificial
  CRISPR gRNA sequence
ttttcaccctggccggggcc

SEQ ID NO: 343227 - DNA, 20 bp, Artificial
  CRISPR gRNA sequence
tcaccctggccggggccctg

SEQ ID NO: 343228 - DNA, 20 bp, Artificial
  CRISPR gRNA sequence
caccctggccggggccctgt

SEQ ID NO: 343229 - DNA, 20 bp, Artificial
  CRISPR gRNA sequence
accctggccggggccctgtt

SEQ ID NO: 343230 - DNA, 20 bp, Artificial
  CRISPR gRNA sequence
gccggggccctgttcctcca

SEQ ID NO: 343231 - DNA, 20 bp, Artificial
  CRISPR gRNA sequence
ttcctccatcaacgaaggaa

SEQ ID NO: 343232 - DNA, 20 bp, Artificial
  CRISPR gRNA sequence
ctccatcaacgaaggaaata

SEQ ID NO: 343233 - DNA, 20 bp, Artificial
  CRISPR gRNA sequence
catcaacgaaggaaatatag

SEQ ID NO: 343234 - DNA, 20 bp, Artificial
  CRISPR gRNA sequence
cggtcctgcccctgcaccac

SEQ ID NO: 343235 - DNA, 20 bp, Artificial
  CRISPR gRNA sequence
cccctgcaccacaccccact

SEQ ID NO: 343236 - DNA, 20 bp, Artificial
  CRISPR gRNA sequence
caccacaccccactggctca

SEQ ID NO: 343237 - DNA, 20 bp, Artificial
  CRISPR gRNA sequence
gctcaaccccactgcccacg

SEQ ID NO: 343238 - DNA, 20 bp, Artificial
  CRISPR gRNA sequence
aaccccactgcccacgcctg

SEQ ID NO: 343239 - DNA, 20 bp, Artificial
  CRISPR gRNA sequence
cccacgcctggaatctcact

SEQ ID NO: 343240 - DNA, 20 bp, Artificial
  CRISPR gRNA sequence
gaatctcactgaaacccacc

SEQ ID NO: 343241 - DNA, 20 bp, Artificial
  CRISPR gRNA sequence
actgaaacccaccagctcca

SEQ ID NO: 343242 - DNA, 20 bp, Artificial
  CRISPR gRNA sequence
aaacccaccagctccacttc

SEQ ID NO: 343243 - DNA, 20 bp, Artificial
  CRISPR gRNA sequence
cacttcaccagccttggtcc

SEQ ID NO: 343244 - DNA, 20 bp, Artificial
  CRISPR gRNA sequence
caccagccttggtcctaccc

SEQ ID NO: 343245 - DNA, 20 bp, Artificial
  CRISPR gRNA sequence
accagccttggtcctacccc

SEQ ID NO: 343246 - DNA, 20 bp, Artificial
  CRISPR gRNA sequence
ggtcctaccccttctctccc

SEQ ID NO: 343247 - DNA, 20 bp, Artificial
  CRISPR gRNA sequence
gtcctaccccttctctcccc

SEQ ID NO: 343248 - DNA, 20 bp, Artificial
  CRISPR gRNA sequence
ccccttctctccccttagct

SEQ ID NO: 343249 - DNA, 20 bp, Artificial
  CRISPR gRNA sequence
ctctccccttagctggcgtg

SEQ ID NO: 343250 - DNA, 20 bp, Artificial
  CRISPR gRNA sequence
tctccccttagctggcgtgc

SEQ ID NO: 343251 - DNA, 20 bp, Artificial
  CRISPR gRNA sequence
tccccttagctggcgtgctc

SEQ ID NO: 343252 - DNA, 20 bp, Artificial
  CRISPR gRNA sequence
cccttagctggcgtgctcct

SEQ ID NO: 343253 - DNA, 20 bp, Artificial
  CRISPR gRNA sequence
agctggcgtgctcctgacac

SEQ ID NO: 343254 - DNA, 20 bp, Artificial
  CRISPR gRNA sequence
gctggcgtgctcctgacacc

SEQ ID NO: 343255 - DNA, 20 bp, Artificial
  CRISPR gRNA sequence
gcgtgctcctgacacccctc

SEQ ID NO: 343256 - DNA, 20 bp, Artificial
  CRISPR gRNA sequence
ctgacacccctcccccaagc

SEQ ID NO: 343257 - DNA, 20 bp, Artificial
  CRISPR gRNA sequence
acacccctcccccaagcgca

SEQ ID NO: 343258 - DNA, 20 bp, Artificial
  CRISPR gRNA sequence
ccccaagcgcacccgcctct

SEQ ID NO: 343259 - DNA, 20 bp, Artificial
  CRISPR gRNA sequence
tacccatctccttctcccgt

SEQ ID NO: 343260 - DNA, 20 bp, Artificial
  CRISPR gRNA sequence
cccatctccttctcccgtct

SEQ ID NO: 343261 - DNA, 20 bp, Artificial
  CRISPR gRNA sequence
cttctcccgtctccccctgc

SEQ ID NO: 343262 - DNA, 20 bp, Artificial
  CRISPR gRNA sequence
ctcccgtctccccctgcccc

SEQ ID NO: 343263 - DNA, 20 bp, Artificial
  CRISPR gRNA sequence
tcccgtctccccctgccccc

SEQ ID NO: 343264 - DNA, 20 bp, Artificial
  CRISPR gRNA sequence
ccgtctccccctgcccccac

SEQ ID NO: 343265 - DNA, 20 bp, Artificial
  CRISPR gRNA sequence
cccctgcccccactgctggc

SEQ ID NO: 343266 - DNA, 20 bp, Artificial
  CRISPR gRNA sequence
cccccactgctggccaagac

SEQ ID NO: 343267 - DNA, 20 bp, Artificial
  CRISPR gRNA sequence
ctggccaagactcatcggat

SEQ ID NO: 343268 - DNA, 20 bp, Artificial
  CRISPR gRNA sequence
gccaagactcatcggatctc

SEQ ID NO: 343269 - DNA, 20 bp, Artificial
  CRISPR gRNA sequence
atcggatctccttctgcaga

SEQ ID NO: 343270 - DNA, 20 bp, Artificial
  CRISPR gRNA sequence
cttctgcagacaaaggagaa

SEQ ID NO: 343271 - DNA, 20 bp, Artificial
  CRISPR gRNA sequence
ctgcagacaaaggagaaagt

SEQ ID NO: 343272 - DNA, 20 bp, Artificial
  CRISPR gRNA sequence
tgcagacaaaggagaaagtc

SEQ ID NO: 343273 - DNA, 20 bp, Artificial
  CRISPR gRNA sequence
cagacaaaggagaaagtcct

SEQ ID NO: 343274 - DNA, 20 bp, Artificial
  CRISPR gRNA sequence
tggagcctgcagagccttgt

SEQ ID NO: 343275 - DNA, 20 bp, Artificial
  CRISPR gRNA sequence
cagagccttgtcattacagc

SEQ ID NO: 343276 - DNA, 20 bp, Artificial
  CRISPR gRNA sequence
gtcattacagctgccccagg

SEQ ID NO: 343277 - DNA, 20 bp, Artificial
  CRISPR gRNA sequence
tcattacagctgccccaggg

SEQ ID NO: 343278 - DNA, 20 bp, Artificial
  CRISPR gRNA sequence
cagctgccccagggaggagg

SEQ ID NO: 343279 - DNA, 20 bp, Artificial
  CRISPR gRNA sequence
ccccagggaggaggagggca

SEQ ID NO: 343280 - DNA, 20 bp, Artificial
  CRISPR gRNA sequence
ccgaaaaccggagcctgcct

SEQ ID NO: 343281 - DNA, 20 bp, Artificial
  CRISPR gRNA sequence
cctgctccccctgagccagc

SEQ ID NO: 343282 - DNA, 20 bp, Artificial
  CRISPR gRNA sequence
ctccccctgagccagcacct

SEQ ID NO: 343283 - DNA, 20 bp, Artificial
  CRISPR gRNA sequence
cccctgagccagcacctgcg

SEQ ID NO: 343284 - DNA, 20 bp, Artificial
  CRISPR gRNA sequence
agccagcacctgcgggagct

SEQ ID NO: 343285 - DNA, 20 bp, Artificial
  CRISPR gRNA sequence
cgggagctgcactacagccc

SEQ ID NO: 343286 - DNA, 20 bp, Artificial
  CRISPR gRNA sequence
cactacagccctggcctcca

SEQ ID NO: 343287 - DNA, 20 bp, Artificial
  CRISPR gRNA sequence
cagccctggcctccaccccc

SEQ ID NO: 343288 - DNA, 20 bp, Artificial
  CRISPR gRNA sequence
gcctccacccccaccccgcc

SEQ ID NO: 343289 - DNA, 20 bp, Artificial
  CRISPR gRNA sequence
cacccccaccccgccgacca

SEQ ID NO: 343290 - DNA, 20 bp, Artificial
  CRISPR gRNA sequence
gcagccacaactgcagtccc

SEQ ID NO: 343291 - DNA, 20 bp, Artificial
  CRISPR gRNA sequence
cagtcccatcctcttgtcag

SEQ ID NO: 343292 - DNA, 20 bp, Artificial
  CRISPR gRNA sequence
ttgtcagggccctttcctgt

SEQ ID NO: 343293 - DNA, 20 bp, Artificial
  CRISPR gRNA sequence
gtcagggccctttcctgtgt

SEQ ID NO: 343294 - DNA, 20 bp, Artificial
  CRISPR gRNA sequence
tcagggccctttcctgtgta

SEQ ID NO: 343295 - DNA, 20 bp, Artificial
  CRISPR gRNA sequence
tcctgtgtacacgtgacaga

SEQ ID NO: 343296 - DNA, 20 bp, Artificial
  CRISPR gRNA sequence
cctgtgtacacgtgacagag

SEQ ID NO: 343297 - DNA, 20 bp, Artificial
  CRISPR gRNA sequence
ctgtgtacacgtgacagagt

SEQ ID NO: 343298 - DNA, 20 bp, Artificial
  CRISPR gRNA sequence
tgtacacgtgacagagtgcc

SEQ ID NO: 343299 - DNA, 20 bp, Artificial
  CRISPR gRNA sequence
ttcgagactggcagggacga

SEQ ID NO: 343300 - DNA, 20 bp, Artificial
  CRISPR gRNA sequence
tcgagactggcagggacgag

SEQ ID NO: 343301 - DNA, 20 bp, Artificial
  CRISPR gRNA sequence
cgagactggcagggacgagg

SEQ ID NO: 343302 - DNA, 20 bp, Artificial
  CRISPR gRNA sequence
gagactggcagggacgagga

SEQ ID NO: 343303 - DNA, 20 bp, Artificial
  CRISPR gRNA sequence
gcagggacgaggacaaatat

SEQ ID NO: 343304 - DNA, 20 bp, Artificial
  CRISPR gRNA sequence
cgcctgcgctgcaggagggc

SEQ ID NO: 343305 - DNA, 20 bp, Artificial
  CRISPR gRNA sequence
cgctgcaggagggcgggggc

SEQ ID NO: 343306 - DNA, 20 bp, Artificial
  CRISPR gRNA sequence
caggagggcgggggctctgg

SEQ ID NO: 343307 - DNA, 20 bp, Artificial
  CRISPR gRNA sequence
tggttgtaaaacacacttcc

SEQ ID NO: 343308 - DNA, 20 bp, Artificial
  CRISPR gRNA sequence
gttgtaaaacacacttcctg

SEQ ID NO: 343309 - DNA, 20 bp, Artificial
  CRISPR gRNA sequence
taaaacacacttcctgctgc

SEQ ID NO: 343310 - DNA, 20 bp, Artificial
  CRISPR gRNA sequence
cctgctgcgaaagacccaca

SEQ ID NO: 343311 - DNA, 20 bp, Artificial
  CRISPR gRNA sequence
ctgctgcgaaagacccacat

SEQ ID NO: 343312 - DNA, 20 bp, Artificial
  CRISPR gRNA sequence
ctgcgaaagacccacatgct

SEQ ID NO: 343313 - DNA, 20 bp, Artificial
  CRISPR gRNA sequence
cgaaagacccacatgctaca

SEQ ID NO: 343314 - DNA, 20 bp, Artificial
  CRISPR gRNA sequence
caagacgggcaaaataaagt

SEQ ID NO: 343315 - DNA, 20 bp, Artificial
  CRISPR gRNA sequence
cagctctccagcttcctctc

SEQ ID NO: 343316 - DNA, 20 bp, Artificial
  CRISPR gRNA sequence
tccagcttcctctctgaaat

SEQ ID NO: 343317 - DNA, 20 bp, Artificial
  CRISPR gRNA sequence
cagcttcctctctgaaatcc

SEQ ID NO: 343318 - DNA, 20 bp, Artificial
  CRISPR gRNA sequence
cctctctgaaatcccagtcc

SEQ ID NO: 343319 - DNA, 20 bp, Artificial
  CRISPR gRNA sequence
ctctctgaaatcccagtccc

SEQ ID NO: 343320 - DNA, 20 bp, Artificial
  CRISPR gRNA sequence
tctgaaatcccagtcccaaa

SEQ ID NO: 343321 - DNA, 20 bp, Artificial
  CRISPR gRNA sequence
tgaaatcccagtcccaaaat

SEQ ID NO: 343322 - DNA, 20 bp, Artificial
  CRISPR gRNA sequence
aaatcccagtcccaaaatcc

SEQ ID NO: 343323 - DNA, 20 bp, Artificial
  CRISPR gRNA sequence
cctggccgcctcctggctca

SEQ ID NO: 343324 - DNA, 20 bp, Artificial
  CRISPR gRNA sequence
ctggccgcctcctggctcag

SEQ ID NO: 343325 - DNA, 20 bp, Artificial
  CRISPR gRNA sequence
gccgcctcctggctcaggtc

SEQ ID NO: 343326 - DNA, 20 bp, Artificial
  CRISPR gRNA sequence
ctggctcaggtcaggatctg

SEQ ID NO: 343327 - DNA, 20 bp, Artificial
  CRISPR gRNA sequence
gctcaggtcaggatctggca

SEQ ID NO: 343328 - DNA, 20 bp, Artificial
  CRISPR gRNA sequence
aggtcaggatctggcagagg

SEQ ID NO: 343329 - DNA, 20 bp, Artificial
  CRISPR gRNA sequence
gcagaggaggtttctcagcc

SEQ ID NO: 343330 - DNA, 20 bp, Artificial
  CRISPR gRNA sequence
agaaacctcctctgccagat

SEQ ID NO: 343331 - DNA, 20 bp, Artificial
  CRISPR gRNA sequence
ctctgccagatcctgacctg

SEQ ID NO: 343332 - DNA, 20 bp, Artificial
  CRISPR gRNA sequence
tgccagatcctgacctgagc

SEQ ID NO: 343333 - DNA, 20 bp, Artificial
  CRISPR gRNA sequence
ccagatcctgacctgagcca

SEQ ID NO: 343334 - DNA, 20 bp, Artificial
  CRISPR gRNA sequence
acctgagccaggaggcggcc

SEQ ID NO: 343335 - DNA, 20 bp, Artificial
  CRISPR gRNA sequence
agccaggaggcggccaggaa

SEQ ID NO: 343336 - DNA, 20 bp, Artificial
  CRISPR gRNA sequence
gattttgggactgggatttc

SEQ ID NO: 343337 - DNA, 20 bp, Artificial
  CRISPR gRNA sequence
tgggactgggatttcagaga

SEQ ID NO: 343338 - DNA, 20 bp, Artificial
  CRISPR gRNA sequence
gggactgggatttcagagag

SEQ ID NO: 343339 - DNA, 20 bp, Artificial
  CRISPR gRNA sequence
ggactgggatttcagagagg

SEQ ID NO: 343340 - DNA, 20 bp, Artificial
  CRISPR gRNA sequence
ggatttcagagaggaagctg

SEQ ID NO: 343341 - DNA, 20 bp, Artificial
  CRISPR gRNA sequence
cagagaggaagctggagagc

SEQ ID NO: 343342 - DNA, 20 bp, Artificial
  CRISPR gRNA sequence
agagaggaagctggagagct

SEQ ID NO: 343343 - DNA, 20 bp, Artificial
  CRISPR gRNA sequence
gagagctgcagggtggtcat

SEQ ID NO: 343344 - DNA, 20 bp, Artificial
  CRISPR gRNA sequence
cagggtggtcatctgtcact

SEQ ID NO: 343345 - DNA, 20 bp, Artificial
  CRISPR gRNA sequence
tcactttattttgcccgtct

SEQ ID NO: 343346 - DNA, 20 bp, Artificial
  CRISPR gRNA sequence
tattttgcccgtcttgtagc

SEQ ID NO: 343347 - DNA, 20 bp, Artificial
  CRISPR gRNA sequence
attttgcccgtcttgtagca

SEQ ID NO: 343348 - DNA, 20 bp, Artificial
  CRISPR gRNA sequence
ttttgcccgtcttgtagcat

SEQ ID NO: 343349 - DNA, 20 bp, Artificial
  CRISPR gRNA sequence
tgcccgtcttgtagcatgtg

SEQ ID NO: 343350 - DNA, 20 bp, Artificial
  CRISPR gRNA sequence
gcccgtcttgtagcatgtgg

SEQ ID NO: 343351 - DNA, 20 bp, Artificial
  CRISPR gRNA sequence
cccgtcttgtagcatgtggg

SEQ ID NO: 343352 - DNA, 20 bp, Artificial
  CRISPR gRNA sequence
gtagcatgtgggtctttcgc

SEQ ID NO: 343353 - DNA, 20 bp, Artificial
  CRISPR gRNA sequence
tagcatgtgggtctttcgca

SEQ ID NO: 343354 - DNA, 20 bp, Artificial
  CRISPR gRNA sequence
tcgcagcaggaagtgtgttt

SEQ ID NO: 343355 - DNA, 20 bp, Artificial
  CRISPR gRNA sequence
cgcagcaggaagtgtgtttt

SEQ ID NO: 343356 - DNA, 20 bp, Artificial
  CRISPR gRNA sequence
gcagcaggaagtgtgtttta

SEQ ID NO: 343357 - DNA, 20 bp, Artificial
  CRISPR gRNA sequence
tacaaccagagcccccgccc

SEQ ID NO: 343358 - DNA, 20 bp, Artificial
  CRISPR gRNA sequence
acaaccagagcccccgccct

SEQ ID NO: 343359 - DNA, 20 bp, Artificial
  CRISPR gRNA sequence
caaccagagcccccgccctc

SEQ ID NO: 343360 - DNA, 20 bp, Artificial
  CRISPR gRNA sequence
ctgcagcgcaggcgcagctg

SEQ ID NO: 343361 - DNA, 20 bp, Artificial
  CRISPR gRNA sequence
cagcgcaggcgcagctggct

SEQ ID NO: 343362 - DNA, 20 bp, Artificial
  CRISPR gRNA sequence
gctgggctcctgcttcccac

SEQ ID NO: 343363 - DNA, 20 bp, Artificial
  CRISPR gRNA sequence
ggctcctgcttcccactctc

SEQ ID NO: 343364 - DNA, 20 bp, Artificial
  CRISPR gRNA sequence
ctgcttcccactctccacct

SEQ ID NO: 343365 - DNA, 20 bp, Artificial
  CRISPR gRNA sequence
cttcccactctccacctcat

SEQ ID NO: 343366 - DNA, 20 bp, Artificial
  CRISPR gRNA sequence
cccactctccacctcatcca

SEQ ID NO: 343367 - DNA, 20 bp, Artificial
  CRISPR gRNA sequence
ccactctccacctcatccat

SEQ ID NO: 343368 - DNA, 20 bp, Artificial
  CRISPR gRNA sequence
tccacctcatccatatttgt

SEQ ID NO: 343369 - DNA, 20 bp, Artificial
  CRISPR gRNA sequence
cacctcatccatatttgtcc

SEQ ID NO: 343370 - DNA, 20 bp, Artificial
  CRISPR gRNA sequence
atccatatttgtcctcgtcc

SEQ ID NO: 343371 - DNA, 20 bp, Artificial
  CRISPR gRNA sequence
gtcctcgtccctgccagtct

SEQ ID NO: 343372 - DNA, 20 bp, Artificial
  CRISPR gRNA sequence
tcctcgtccctgccagtctc

SEQ ID NO: 343373 - DNA, 20 bp, Artificial
  CRISPR gRNA sequence
gtccctgccagtctcgaaaa

SEQ ID NO: 343374 - DNA, 20 bp, Artificial
  CRISPR gRNA sequence
ccagtctcgaaaaggcactc

SEQ ID NO: 343375 - DNA, 20 bp, Artificial
  CRISPR gRNA sequence
gaaaaggcactctgtcacgt

SEQ ID NO: 343376 - DNA, 20 bp, Artificial
  CRISPR gRNA sequence
tgtcacgtgtacacaggaaa

SEQ ID NO: 343377 - DNA, 20 bp, Artificial
  CRISPR gRNA sequence
tcacgtgtacacaggaaagg

SEQ ID NO: 343378 - DNA, 20 bp, Artificial
  CRISPR gRNA sequence
acaagaggatgggactgcag

SEQ ID NO: 343379 - DNA, 20 bp, Artificial
  CRISPR gRNA sequence
cagttgtggctgccaggtct

SEQ ID NO: 343380 - DNA, 20 bp, Artificial
  CRISPR gRNA sequence
tggctgccaggtctcactct

SEQ ID NO: 343381 - DNA, 20 bp, Artificial
  CRISPR gRNA sequence
ccaggtctcactctcccttg

SEQ ID NO: 343382 - DNA, 20 bp, Artificial
  CRISPR gRNA sequence
actctcccttggatggtcgg

SEQ ID NO: 343383 - DNA, 20 bp, Artificial
  CRISPR gRNA sequence
tcccttggatggtcggcggg

SEQ ID NO: 343384 - DNA, 20 bp, Artificial
  CRISPR gRNA sequence
ccttggatggtcggcggggt

SEQ ID NO: 343385 - DNA, 20 bp, Artificial
  CRISPR gRNA sequence
ggatggtcggcggggtgggg

SEQ ID NO: 343386 - DNA, 20 bp, Artificial
  CRISPR gRNA sequence
gatggtcggcggggtggggg

SEQ ID NO: 343387 - DNA, 20 bp, Artificial
  CRISPR gRNA sequence
tagtgcagctcccgcaggtg

SEQ ID NO: 343388 - DNA, 20 bp, Artificial
  CRISPR gRNA sequence
ccgcaggtgctggctcaggg

SEQ ID NO: 343389 - DNA, 20 bp, Artificial
  CRISPR gRNA sequence
gctcagggggagcaggcagg

SEQ ID NO: 343390 - DNA, 20 bp, Artificial
  CRISPR gRNA sequence
agggggagcaggcaggctcc

SEQ ID NO: 343391 - DNA, 20 bp, Artificial
  CRISPR gRNA sequence
cggttttcggtaatcctcct

SEQ ID NO: 343392 - DNA, 20 bp, Artificial
  CRISPR gRNA sequence
tcggtaatcctcctggatgg

SEQ ID NO: 343393 - DNA, 20 bp, Artificial
  CRISPR gRNA sequence
cggtaatcctcctggatggg

SEQ ID NO: 343394 - DNA, 20 bp, Artificial
  CRISPR gRNA sequence
ggtaatcctcctggatgggg

SEQ ID NO: 343395 - DNA, 20 bp, Artificial
  CRISPR gRNA sequence
ctggatggggatggtgctgc

SEQ ID NO: 343396 - DNA, 20 bp, Artificial
  CRISPR gRNA sequence
gatggggatggtgctgccct

SEQ ID NO: 343397 - DNA, 20 bp, Artificial
  CRISPR gRNA sequence
ccctcctcctccctggggca

SEQ ID NO: 343398 - DNA, 20 bp, Artificial
  CRISPR gRNA sequence
ctcctccctggggcagctgt

SEQ ID NO: 343399 - DNA, 20 bp, Artificial
  CRISPR gRNA sequence
ctccctggggcagctgtaat

SEQ ID NO: 343400 - DNA, 20 bp, Artificial
  CRISPR gRNA sequence
cctggggcagctgtaatgac

SEQ ID NO: 343401 - DNA, 20 bp, Artificial
  CRISPR gRNA sequence
gggcagctgtaatgacaagg

SEQ ID NO: 343402 - DNA, 20 bp, Artificial
  CRISPR gRNA sequence
taatgacaaggctctgcagg

SEQ ID NO: 343403 - DNA, 20 bp, Artificial
  CRISPR gRNA sequence
tgcaggctccacaggacttt

SEQ ID NO: 343404 - DNA, 20 bp, Artificial
  CRISPR gRNA sequence
caggctccacaggactttct

SEQ ID NO: 343405 - DNA, 20 bp, Artificial
  CRISPR gRNA sequence
cacaggactttctcctttgt

SEQ ID NO: 343406 - DNA, 20 bp, Artificial
  CRISPR gRNA sequence
tctcctttgtctgcagaagg

SEQ ID NO: 343407 - DNA, 20 bp, Artificial
  CRISPR gRNA sequence
ctcctttgtctgcagaagga

SEQ ID NO: 343408 - DNA, 20 bp, Artificial
  CRISPR gRNA sequence
tcctttgtctgcagaaggag

SEQ ID NO: 343409 - DNA, 20 bp, Artificial
  CRISPR gRNA sequence
ctttgtctgcagaaggagat

SEQ ID NO: 343410 - DNA, 20 bp, Artificial
  CRISPR gRNA sequence
tgtctgcagaaggagatccg

SEQ ID NO: 343411 - DNA, 20 bp, Artificial
  CRISPR gRNA sequence
gtctgcagaaggagatccga

SEQ ID NO: 343412 - DNA, 20 bp, Artificial
  CRISPR gRNA sequence
tctgcagaaggagatccgat

SEQ ID NO: 343413 - DNA, 20 bp, Artificial
  CRISPR gRNA sequence
cagaaggagatccgatgagt

SEQ ID NO: 343414 - DNA, 20 bp, Artificial
  CRISPR gRNA sequence
ggccagcagtgggggcaggg

SEQ ID NO: 343415 - DNA, 20 bp, Artificial
  CRISPR gRNA sequence
gccagcagtgggggcagggg

SEQ ID NO: 343416 - DNA, 20 bp, Artificial
  CRISPR gRNA sequence
gggggaggggtgtcaggagc

SEQ ID NO: 343417 - DNA, 20 bp, Artificial
  CRISPR gRNA sequence
ggggaggggtgtcaggagca

SEQ ID NO: 343418 - DNA, 20 bp, Artificial
  CRISPR gRNA sequence
aggggagagaaggggtagga

SEQ ID NO: 343419 - DNA, 20 bp, Artificial
  CRISPR gRNA sequence
gtgaagtggagctggtgggt

SEQ ID NO: 343420 - DNA, 20 bp, Artificial
  CRISPR gRNA sequence
gtgggtttcagtgagattcc

SEQ ID NO: 343421 - DNA, 20 bp, Artificial
  CRISPR gRNA sequence
cagtgagattccaggcgtgg

SEQ ID NO: 343422 - DNA, 20 bp, Artificial
  CRISPR gRNA sequence
agtgagattccaggcgtggg

SEQ ID NO: 343423 - DNA, 20 bp, Artificial
  CRISPR gRNA sequence
caggcgtgggcagtggggtt

SEQ ID NO: 343424 - DNA, 20 bp, Artificial
  CRISPR gRNA sequence
agccagtggggtgtggtgca

SEQ ID NO: 343425 - DNA, 20 bp, Artificial
  CRISPR gRNA sequence
tgttctgtctcttacttgat

SEQ ID NO: 343426 - DNA, 20 bp, Artificial
  CRISPR gRNA sequence
tgtctcttacttgatctata

SEQ ID NO: 343427 - DNA, 20 bp, Artificial
  CRISPR gRNA sequence
tctcttacttgatctatatt

SEQ ID NO: 343428 - DNA, 20 bp, Artificial
  CRISPR gRNA sequence
ttacttgatctatatttcct

SEQ ID NO: 343429 - DNA, 20 bp, Artificial
  CRISPR gRNA sequence
acttgatctatatttccttc

SEQ ID NO: 343430 - DNA, 20 bp, Artificial
  CRISPR gRNA sequence
cttgatctatatttccttcg

SEQ ID NO: 343431 - DNA, 20 bp, Artificial
  CRISPR gRNA sequence
gatctatatttccttcgttg

SEQ ID NO: 343432 - DNA, 20 bp, Artificial
  CRISPR gRNA sequence
atctatatttccttcgttga

SEQ ID NO: 343433 - DNA, 20 bp, Artificial
  CRISPR gRNA sequence
tatttccttcgttgatggag

SEQ ID NO: 343434 - DNA, 20 bp, Artificial
  CRISPR gRNA sequence
ccttcgttgatggaggaaca

SEQ ID NO: 343435 - DNA, 20 bp, Artificial
  CRISPR gRNA sequence
cttcgttgatggaggaacag

SEQ ID NO: 343436 - DNA, 20 bp, Artificial
  CRISPR gRNA sequence
cgttgatggaggaacagggc

SEQ ID NO: 343437 - DNA, 20 bp, Artificial
  CRISPR gRNA sequence
gttgatggaggaacagggcc

SEQ ID NO: 343438 - DNA, 20 bp, Artificial
  CRISPR gRNA sequence
atggaggaacagggccccgg

SEQ ID NO: 343439 - DNA, 20 bp, Artificial
  CRISPR gRNA sequence
cagagaagatcacaaggatg

SEQ ID NO: 343440 - DNA, 20 bp, Artificial
  CRISPR gRNA sequence
cacagggatctttgggctgt

SEQ ID NO: 343441 - DNA, 20 bp, Artificial
  CRISPR gRNA sequence
tgggctgtaataggagggga

SEQ ID NO: 343442 - DNA, 20 bp, Artificial
  CRISPR gRNA sequence
gggctgtaataggaggggac

SEQ ID NO: 343443 - DNA, 20 bp, Artificial
  CRISPR gRNA sequence
ggctgtaataggaggggaca

SEQ ID NO: 343444 - DNA, 20 bp, Artificial
  CRISPR gRNA sequence
taataggaggggacacacag

SEQ ID NO: 343445 - DNA, 20 bp, Artificial
  CRISPR gRNA sequence
ggggagggtctagcccttgg

SEQ ID NO: 343446 - DNA, 20 bp, Artificial
  CRISPR gRNA sequence
gcccttggctccctcagccc

SEQ ID NO: 343447 - DNA, 20 bp, Artificial
  CRISPR gRNA sequence
ggctccctcagcccagccct

SEQ ID NO: 343448 - DNA, 20 bp, Artificial
  CRISPR gRNA sequence
gctccctcagcccagccctc

SEQ ID NO: 343449 - DNA, 20 bp, Artificial
  CRISPR gRNA sequence
cctcagcccagccctcctgt

SEQ ID NO: 343450 - DNA, 20 bp, Artificial
  CRISPR gRNA sequence
agcccagccctcctgtcacc

SEQ ID NO: 343451 - DNA, 20 bp, Artificial
  CRISPR gRNA sequence
ctgtcaccttgcctctcccc

SEQ ID NO: 343452 - DNA, 20 bp, Artificial
  CRISPR gRNA sequence
tcaccttgcctctccccttt

SEQ ID NO: 343453 - DNA, 20 bp, Artificial
  CRISPR gRNA sequence
gcctctcccctttcccccac

SEQ ID NO: 343454 - DNA, 20 bp, Artificial
  CRISPR gRNA sequence
cctctcccctttcccccacc

SEQ ID NO: 343455 - DNA, 20 bp, Artificial
  CRISPR gRNA sequence
tcccctttcccccaccttat

SEQ ID NO: 343456 - DNA, 20 bp, Artificial
  CRISPR gRNA sequence
ccctttcccccaccttattc

SEQ ID NO: 343457 - DNA, 20 bp, Artificial
  CRISPR gRNA sequence
tcccccaccttattctatcc

SEQ ID NO: 343458 - DNA, 20 bp, Artificial
  CRISPR gRNA sequence
cccccaccttattctatccc

SEQ ID NO: 343459 - DNA, 20 bp, Artificial
  CRISPR gRNA sequence
ccccaccttattctatccca

SEQ ID NO: 343460 - DNA, 20 bp, Artificial
  CRISPR gRNA sequence
attctatcccacccgccacc

SEQ ID NO: 343461 - DNA, 20 bp, Artificial
  CRISPR gRNA sequence
ttctatcccacccgccaccg

SEQ ID NO: 343462 - DNA, 20 bp, Artificial
  CRISPR gRNA sequence
tatcccacccgccaccgttg

SEQ ID NO: 343463 - DNA, 20 bp, Artificial
  CRISPR gRNA sequence
tcccacccgccaccgttggc

SEQ ID NO: 343464 - DNA, 20 bp, Artificial
  CRISPR gRNA sequence
gccaactcctctcctaaaca

SEQ ID NO: 343465 - DNA, 20 bp, Artificial
  CRISPR gRNA sequence
ctctcctaaacagtggactc

SEQ ID NO: 343466 - DNA, 20 bp, Artificial
  CRISPR gRNA sequence
tcctaaacagtggactctgc

SEQ ID NO: 343467 - DNA, 20 bp, Artificial
  CRISPR gRNA sequence
ctaaacagtggactctgctt

SEQ ID NO: 343468 - DNA, 20 bp, Artificial
  CRISPR gRNA sequence
aacagtggactctgcttttt

SEQ ID NO: 343469 - DNA, 20 bp, Artificial
  CRISPR gRNA sequence
tgctttttcccctcctctta

SEQ ID NO: 343470 - DNA, 20 bp, Artificial
  CRISPR gRNA sequence
ctttttcccctcctcttatc

SEQ ID NO: 343471 - DNA, 20 bp, Artificial
  CRISPR gRNA sequence
tttcccctcctcttatccct

SEQ ID NO: 343472 - DNA, 20 bp, Artificial
  CRISPR gRNA sequence
ttcccctcctcttatcccta

SEQ ID NO: 343473 - DNA, 20 bp, Artificial
  CRISPR gRNA sequence
tcccctcctcttatccctaa

SEQ ID NO: 343474 - DNA, 20 bp, Artificial
  CRISPR gRNA sequence
cccctcctcttatccctaat

SEQ ID NO: 343475 - DNA, 20 bp, Artificial
  CRISPR gRNA sequence
ccctcctcttatccctaatc

SEQ ID NO: 343476 - DNA, 20 bp, Artificial
  CRISPR gRNA sequence
ctcttatccctaatcctagg

SEQ ID NO: 343477 - DNA, 20 bp, Artificial
  CRISPR gRNA sequence
ttatccctaatcctaggagc

SEQ ID NO: 343478 - DNA, 20 bp, Artificial
  CRISPR gRNA sequence
atccctaatcctaggagctt

SEQ ID NO: 343479 - DNA, 20 bp, Artificial
  CRISPR gRNA sequence
tccctaatcctaggagcttt

SEQ ID NO: 343480 - DNA, 20 bp, Artificial
  CRISPR gRNA sequence
atcctaggagctttctgtct

SEQ ID NO: 343481 - DNA, 20 bp, Artificial
  CRISPR gRNA sequence
ggagctttctgtctggcttc

SEQ ID NO: 343482 - DNA, 20 bp, Artificial
  CRISPR gRNA sequence
tctgtctggcttccctcctg

SEQ ID NO: 343483 - DNA, 20 bp, Artificial
  CRISPR gRNA sequence
ctgtctggcttccctcctgg

SEQ ID NO: 343484 - DNA, 20 bp, Artificial
  CRISPR gRNA sequence
tgtctggcttccctcctggc

SEQ ID NO: 343485 - DNA, 20 bp, Artificial
  CRISPR gRNA sequence
tctggcttccctcctggccc

SEQ ID NO: 343486 - DNA, 20 bp, Artificial
  CRISPR gRNA sequence
gcttccctcctggcccctcg

SEQ ID NO: 343487 - DNA, 20 bp, Artificial
  CRISPR gRNA sequence
ccctcctggcccctcgtgta

SEQ ID NO: 343488 - DNA, 20 bp, Artificial
  CRISPR gRNA sequence
cctcctggcccctcgtgtat

SEQ ID NO: 343489 - DNA, 20 bp, Artificial
  CRISPR gRNA sequence
ctggcccctcgtgtatgcat

SEQ ID NO: 343490 - DNA, 20 bp, Artificial
  CRISPR gRNA sequence
gcccctcgtgtatgcattct

SEQ ID NO: 343491 - DNA, 20 bp, Artificial
  CRISPR gRNA sequence
gtgtatgcattctctctagc

SEQ ID NO: 343492 - DNA, 20 bp, Artificial
  CRISPR gRNA sequence
tctctagcggtggggattaa

SEQ ID NO: 343493 - DNA, 20 bp, Artificial
  CRISPR gRNA sequence
tctagcggtggggattaagg

SEQ ID NO: 343494 - DNA, 20 bp, Artificial
  CRISPR gRNA sequence
tagcggtggggattaaggag

SEQ ID NO: 343495 - DNA, 20 bp, Artificial
  CRISPR gRNA sequence
gcggtggggattaaggagaa

SEQ ID NO: 343496 - DNA, 20 bp, Artificial
  CRISPR gRNA sequence
aggagaaaactcacgtggcc

SEQ ID NO: 343497 - DNA, 20 bp, Artificial
  CRISPR gRNA sequence
acgtggccagtgggtagaga

SEQ ID NO: 343498 - DNA, 20 bp, Artificial
  CRISPR gRNA sequence
cctgaagtcagccagagtct

SEQ ID NO: 343499 - DNA, 20 bp, Artificial
  CRISPR gRNA sequence
aagtcagccagagtctgcat

SEQ ID NO: 343500 - DNA, 20 bp, Artificial
  CRISPR gRNA sequence
catgtgcccagctgtcctgg

SEQ ID NO: 343501 - DNA, 20 bp, Artificial
  CRISPR gRNA sequence
tcctggcctccagcatctct

SEQ ID NO: 343502 - DNA, 20 bp, Artificial
  CRISPR gRNA sequence
gcctccagcatctctggaaa

SEQ ID NO: 343503 - DNA, 20 bp, Artificial
  CRISPR gRNA sequence
cagcatctctggaaaaacag

SEQ ID NO: 343504 - DNA, 20 bp, Artificial
  CRISPR gRNA sequence
tggaaaaacagagacagaat

SEQ ID NO: 343505 - DNA, 20 bp, Artificial
  CRISPR gRNA sequence
gaaaaacagagacagaatga

SEQ ID NO: 343506 - DNA, 20 bp, Artificial
  CRISPR gRNA sequence
aaggcctgagaggtgctgga

SEQ ID NO: 343507 - DNA, 20 bp, Artificial
  CRISPR gRNA sequence
agaggtgctggatgggatgg

SEQ ID NO: 343508 - DNA, 20 bp, Artificial
  CRISPR gRNA sequence
gatgggatgggaaggcagaa

SEQ ID NO: 343509 - DNA, 20 bp, Artificial
  CRISPR gRNA sequence
accttatctaggggtaggag

SEQ ID NO: 343510 - DNA, 20 bp, Artificial
  CRISPR gRNA sequence
atctaggggtaggagtgggg

SEQ ID NO: 343511 - DNA, 20 bp, Artificial
  CRISPR gRNA sequence
tctaggggtaggagtgggga

SEQ ID NO: 343512 - DNA, 20 bp, Artificial
  CRISPR gRNA sequence
ggggtaggagtggggagtac

SEQ ID NO: 343513 - DNA, 20 bp, Artificial
  CRISPR gRNA sequence
gttggggtatcaccgctacc

SEQ ID NO: 343514 - DNA, 20 bp, Artificial
  CRISPR gRNA sequence
gggtatcaccgctaccccac

SEQ ID NO: 343515 - DNA, 20 bp, Artificial
  CRISPR gRNA sequence
ccccacgtgatggcacagag

SEQ ID NO: 343516 - DNA, 20 bp, Artificial
  CRISPR gRNA sequence
cctggaacttaccactgaca

SEQ ID NO: 343517 - DNA, 20 bp, Artificial
  CRISPR gRNA sequence
gaacttaccactgacataag

SEQ ID NO: 343518 - DNA, 20 bp, Artificial
  CRISPR gRNA sequence
accactgacataaggtaagt

SEQ ID NO: 343519 - DNA, 20 bp, Artificial
  CRISPR gRNA sequence
ccactgacataaggtaagtg

SEQ ID NO: 343520 - DNA, 20 bp, Artificial
  CRISPR gRNA sequence
acataaggtaagtgggtggg

SEQ ID NO: 343521 - DNA, 20 bp, Artificial
  CRISPR gRNA sequence
agggtgtgggctcagggcct

SEQ ID NO: 343522 - DNA, 20 bp, Artificial
  CRISPR gRNA sequence
agggcctgagacgaccgagc

SEQ ID NO: 343523 - DNA, 20 bp, Artificial
  CRISPR gRNA sequence
agacgaccgagcggtcagcg

SEQ ID NO: 343524 - DNA, 20 bp, Artificial
  CRISPR gRNA sequence
ggaagaggatcacactcggt

SEQ ID NO: 343525 - DNA, 20 bp, Artificial
  CRISPR gRNA sequence
gaagaggatcacactcggtg

SEQ ID NO: 343526 - DNA, 20 bp, Artificial
  CRISPR gRNA sequence
ggtgcactccttgtccctgc

SEQ ID NO: 343527 - DNA, 20 bp, Artificial
  CRISPR gRNA sequence
cttgtccctgcactgccagc

SEQ ID NO: 343528 - DNA, 20 bp, Artificial
  CRISPR gRNA sequence
gtccctgcactgccagccat

SEQ ID NO: 343529 - DNA, 20 bp, Artificial
  CRISPR gRNA sequence
tccctgcactgccagccatt

SEQ ID NO: 343530 - DNA, 20 bp, Artificial
  CRISPR gRNA sequence
cactgccagccattgcgaca

SEQ ID NO: 343531 - DNA, 20 bp, Artificial
  CRISPR gRNA sequence
ccagccattgcgacaggcac

SEQ ID NO: 343532 - DNA, 20 bp, Artificial
  CRISPR gRNA sequence
cgacaggcacactcagcatt

SEQ ID NO: 343533 - DNA, 20 bp, Artificial
  CRISPR gRNA sequence
agcattggcagtgatggtgc

SEQ ID NO: 343534 - DNA, 20 bp, Artificial
  CRISPR gRNA sequence
gcagtgatggtgcagttgcg

SEQ ID NO: 343535 - DNA, 20 bp, Artificial
  CRISPR gRNA sequence
cgaacgagaagacctggggg

SEQ ID NO: 343536 - DNA, 20 bp, Artificial
  CRISPR gRNA sequence
ggggaagagaggcccaggga

SEQ ID NO: 343537 - DNA, 20 bp, Artificial
  CRISPR gRNA sequence
agacctgtggagaccttcaa

SEQ ID NO: 343538 - DNA, 20 bp, Artificial
  CRISPR gRNA sequence
tggagaccttcaaggtccac

SEQ ID NO: 343539 - DNA, 20 bp, Artificial
  CRISPR gRNA sequence
caaggtccacttgcttcatc

SEQ ID NO: 343540 - DNA, 20 bp, Artificial
  CRISPR gRNA sequence
aaggtccacttgcttcatcc

SEQ ID NO: 343541 - DNA, 20 bp, Artificial
  CRISPR gRNA sequence
gcttcatcccccaaccccca

SEQ ID NO: 343542 - DNA, 20 bp, Artificial
  CRISPR gRNA sequence
cttcatcccccaacccccat

SEQ ID NO: 343543 - DNA, 20 bp, Artificial
  CRISPR gRNA sequence
catcccccaacccccatccc

SEQ ID NO: 343544 - DNA, 20 bp, Artificial
  CRISPR gRNA sequence
atcccccaacccccatccca

SEQ ID NO: 343545 - DNA, 20 bp, Artificial
  CRISPR gRNA sequence
tagggacgtgcttccctttc

SEQ ID NO: 343546 - DNA, 20 bp, Artificial
  CRISPR gRNA sequence
gggacgtgcttccctttcca

SEQ ID NO: 343547 - DNA, 20 bp, Artificial
  CRISPR gRNA sequence
ccctttccattcccacccct

SEQ ID NO: 343548 - DNA, 20 bp, Artificial
  CRISPR gRNA sequence
cctttccattcccacccctg

SEQ ID NO: 343549 - DNA, 20 bp, Artificial
  CRISPR gRNA sequence
tccattcccacccctgcaaa

SEQ ID NO: 343550 - DNA, 20 bp, Artificial
  CRISPR gRNA sequence
ccattcccacccctgcaaag

SEQ ID NO: 343551 - DNA, 20 bp, Artificial
  CRISPR gRNA sequence
cattcccacccctgcaaagg

SEQ ID NO: 343552 - DNA, 20 bp, Artificial
  CRISPR gRNA sequence
ccacccctgcaaaggcctgc

SEQ ID NO: 343553 - DNA, 20 bp, Artificial
  CRISPR gRNA sequence
caaaggcctgccctttgctc

SEQ ID NO: 343554 - DNA, 20 bp, Artificial
  CRISPR gRNA sequence
ccctttgctcacggtccccc

SEQ ID NO: 343555 - DNA, 20 bp, Artificial
  CRISPR gRNA sequence
tgctcacggtcccccaatgc

SEQ ID NO: 343556 - DNA, 20 bp, Artificial
  CRISPR gRNA sequence
gctcacggtcccccaatgcc

SEQ ID NO: 343557 - DNA, 20 bp, Artificial
  CRISPR gRNA sequence
ctcacggtcccccaatgcct

SEQ ID NO: 343558 - DNA, 20 bp, Artificial
  CRISPR gRNA sequence
acggtcccccaatgcctttg

SEQ ID NO: 343559 - DNA, 20 bp, Artificial
  CRISPR gRNA sequence
tgccattattattgttatta

SEQ ID NO: 343560 - DNA, 20 bp, Artificial
  CRISPR gRNA sequence
gccattattattgttattaa

SEQ ID NO: 343561 - DNA, 20 bp, Artificial
  CRISPR gRNA sequence
ccattattattgttattaaa

SEQ ID NO: 343562 - DNA, 20 bp, Artificial
  CRISPR gRNA sequence
ttattgttattaaagaagaa

SEQ ID NO: 343563 - DNA, 20 bp, Artificial
  CRISPR gRNA sequence
ttgttattaaagaagaaagt

SEQ ID NO: 343564 - DNA, 20 bp, Artificial
  CRISPR gRNA sequence
ttattaaagaagaaagttgg

SEQ ID NO: 343565 - DNA, 20 bp, Artificial
  CRISPR gRNA sequence
ttaaagaagaaagttggacc

SEQ ID NO: 343566 - DNA, 20 bp, Artificial
  CRISPR gRNA sequence
aagaagaaagttggaccttt

SEQ ID NO: 343567 - DNA, 20 bp, Artificial
  CRISPR gRNA sequence
gacctttcagaaggaagatt

SEQ ID NO: 343568 - DNA, 20 bp, Artificial
  CRISPR gRNA sequence
tcagaaggaagattcatggg

SEQ ID NO: 343569 - DNA, 20 bp, Artificial
  CRISPR gRNA sequence
cagaaggaagattcatgggt

SEQ ID NO: 343570 - DNA, 20 bp, Artificial
  CRISPR gRNA sequence
agaaggaagattcatgggtt

SEQ ID NO: 343571 - DNA, 20 bp, Artificial
  CRISPR gRNA sequence
atgggttcagacatagaaac

SEQ ID NO: 343572 - DNA, 20 bp, Artificial
  CRISPR gRNA sequence
agacatagaaaccatgaaaa

SEQ ID NO: 343573 - DNA, 20 bp, Artificial
  CRISPR gRNA sequence
atatgactttctcttgtact

SEQ ID NO: 343574 - DNA, 20 bp, Artificial
  CRISPR gRNA sequence
tatgactttctcttgtactc

SEQ ID NO: 343575 - DNA, 20 bp, Artificial
  CRISPR gRNA sequence
tctcttgtactccctgatac

SEQ ID NO: 343576 - DNA, 20 bp, Artificial
  CRISPR gRNA sequence
ctcttgtactccctgataca

SEQ ID NO: 343577 - DNA, 20 bp, Artificial
  CRISPR gRNA sequence
tcttgtactccctgatacat

SEQ ID NO: 343578 - DNA, 20 bp, Artificial
  CRISPR gRNA sequence
ttgtactccctgatacattt

SEQ ID NO: 343579 - DNA, 20 bp, Artificial
  CRISPR gRNA sequence
gtactccctgatacattttt

SEQ ID NO: 343580 - DNA, 20 bp, Artificial
  CRISPR gRNA sequence
tactccctgatacatttttt

SEQ ID NO: 343581 - DNA, 20 bp, Artificial
  CRISPR gRNA sequence
cctgatacattttttatttt

SEQ ID NO: 343582 - DNA, 20 bp, Artificial
  CRISPR gRNA sequence
atacattttttattttttat

SEQ ID NO: 343583 - DNA, 20 bp, Artificial
  CRISPR gRNA sequence
tttattttttatttattttt

SEQ ID NO: 343584 - DNA, 20 bp, Artificial
  CRISPR gRNA sequence
ttattttttatttatttttt

SEQ ID NO: 343585 - DNA, 20 bp, Artificial
  CRISPR gRNA sequence
tattttttatttattttttt

SEQ ID NO: 343586 - DNA, 20 bp, Artificial
  CRISPR gRNA sequence
attttttatttatttttttg

SEQ ID NO: 343587 - DNA, 20 bp, Artificial
  CRISPR gRNA sequence
ttttttatttatttttttga

SEQ ID NO: 343588 - DNA, 20 bp, Artificial
  CRISPR gRNA sequence
tttatttatttttttgagat

SEQ ID NO: 343589 - DNA, 20 bp, Artificial
  CRISPR gRNA sequence
ttatttatttttttgagatg

SEQ ID NO: 343590 - DNA, 20 bp, Artificial
  CRISPR gRNA sequence
tatttatttttttgagatgg

SEQ ID NO: 343591 - DNA, 20 bp, Artificial
  CRISPR gRNA sequence
atttatttttttgagatgga

SEQ ID NO: 343592 - DNA, 20 bp, Artificial
  CRISPR gRNA sequence
tttatttttttgagatggag

SEQ ID NO: 343593 - DNA, 20 bp, Artificial
  CRISPR gRNA sequence
atttttttgagatggagtct

SEQ ID NO: 343594 - DNA, 20 bp, Artificial
  CRISPR gRNA sequence
tttttttgagatggagtctc

SEQ ID NO: 343595 - DNA, 20 bp, Artificial
  CRISPR gRNA sequence
ttttgagatggagtctcgct

SEQ ID NO: 343596 - DNA, 20 bp, Artificial
  CRISPR gRNA sequence
tttgagatggagtctcgctc

SEQ ID NO: 343597 - DNA, 20 bp, Artificial
  CRISPR gRNA sequence
ttgagatggagtctcgctct

SEQ ID NO: 343598 - DNA, 20 bp, Artificial
  CRISPR gRNA sequence
tgagatggagtctcgctctt

SEQ ID NO: 343599 - DNA, 20 bp, Artificial
  CRISPR gRNA sequence
gagatggagtctcgctcttg

SEQ ID NO: 343600 - DNA, 20 bp, Artificial
  CRISPR gRNA sequence
agatggagtctcgctcttgt

SEQ ID NO: 343601 - DNA, 20 bp, Artificial
  CRISPR gRNA sequence
gctcttgttgccgaggctgg

SEQ ID NO: 343602 - DNA, 20 bp, Artificial
  CRISPR gRNA sequence
ttgttgccgaggctggagtg

SEQ ID NO: 343603 - DNA, 20 bp, Artificial
  CRISPR gRNA sequence
gttgccgaggctggagtgca

SEQ ID NO: 343604 - DNA, 20 bp, Artificial
  CRISPR gRNA sequence
ttgccgaggctggagtgcaa

SEQ ID NO: 343605 - DNA, 20 bp, Artificial
  CRISPR gRNA sequence
ccgaggctggagtgcaatgg

SEQ ID NO: 343606 - DNA, 20 bp, Artificial
  CRISPR gRNA sequence
gagtgcaatggcgtgacctt

SEQ ID NO: 343607 - DNA, 20 bp, Artificial
  CRISPR gRNA sequence
ggctcgttgcaacctctgcc

SEQ ID NO: 343608 - DNA, 20 bp, Artificial
  CRISPR gRNA sequence
gctcgttgcaacctctgcct

SEQ ID NO: 343609 - DNA, 20 bp, Artificial
  CRISPR gRNA sequence
gttgcaacctctgcctcccg

SEQ ID NO: 343610 - DNA, 20 bp, Artificial
  CRISPR gRNA sequence
caacctctgcctcccgggtt

SEQ ID NO: 343611 - DNA, 20 bp, Artificial
  CRISPR gRNA sequence
tgcctcccgggttcaagcaa

SEQ ID NO: 343612 - DNA, 20 bp, Artificial
  CRISPR gRNA sequence
cctcccgggttcaagcaatt

SEQ ID NO: 343613 - DNA, 20 bp, Artificial
  CRISPR gRNA sequence
ccgggttcaagcaattctcc

SEQ ID NO: 343614 - DNA, 20 bp, Artificial
  CRISPR gRNA sequence
aagcaattctcctgcctcag

SEQ ID NO: 343615 - DNA, 20 bp, Artificial
  CRISPR gRNA sequence
tcctgcctcagcctcccaag

SEQ ID NO: 343616 - DNA, 20 bp, Artificial
  CRISPR gRNA sequence
ctgcctcagcctcccaagta

SEQ ID NO: 343617 - DNA, 20 bp, Artificial
  CRISPR gRNA sequence
cctcagcctcccaagtagct

SEQ ID NO: 343618 - DNA, 20 bp, Artificial
  CRISPR gRNA sequence
agcctcccaagtagctggga

SEQ ID NO: 343619 - DNA, 20 bp, Artificial
  CRISPR gRNA sequence
ccaagtagctgggattacag

SEQ ID NO: 343620 - DNA, 20 bp, Artificial
  CRISPR gRNA sequence
ggattacaggtgtgtgccac

SEQ ID NO: 343621 - DNA, 20 bp, Artificial
  CRISPR gRNA sequence
caggtgtgtgccaccacacc

SEQ ID NO: 343622 - DNA, 20 bp, Artificial
  CRISPR gRNA sequence
attttttgtatttttagtag

SEQ ID NO: 343623 - DNA, 20 bp, Artificial
  CRISPR gRNA sequence
tttgtatttttagtagagac

SEQ ID NO: 343624 - DNA, 20 bp, Artificial
  CRISPR gRNA sequence
ttgtatttttagtagagacg

SEQ ID NO: 343625 - DNA, 20 bp, Artificial
  CRISPR gRNA sequence
tgtatttttagtagagacgg

SEQ ID NO: 343626 - DNA, 20 bp, Artificial
  CRISPR gRNA sequence
gtatttttagtagagacggg

SEQ ID NO: 343627 - DNA, 20 bp, Artificial
  CRISPR gRNA sequence
tatttttagtagagacgggg

SEQ ID NO: 343628 - DNA, 20 bp, Artificial
  CRISPR gRNA sequence
ttagtagagacggggtttta

SEQ ID NO: 343629 - DNA, 20 bp, Artificial
  CRISPR gRNA sequence
tagtagagacggggttttac

SEQ ID NO: 343630 - DNA, 20 bp, Artificial
  CRISPR gRNA sequence
agtagagacggggttttact

SEQ ID NO: 343631 - DNA, 20 bp, Artificial
  CRISPR gRNA sequence
gtagagacggggttttactg

SEQ ID NO: 343632 - DNA, 20 bp, Artificial
  CRISPR gRNA sequence
tactgtattggccaggctgg

SEQ ID NO: 343633 - DNA, 20 bp, Artificial
  CRISPR gRNA sequence
actgtattggccaggctggt

SEQ ID NO: 343634 - DNA, 20 bp, Artificial
  CRISPR gRNA sequence
ctgtattggccaggctggta

SEQ ID NO: 343635 - DNA, 20 bp, Artificial
  CRISPR gRNA sequence
tattggccaggctggtatta

SEQ ID NO: 343636 - DNA, 20 bp, Artificial
  CRISPR gRNA sequence
gccaggctggtattaaactc

SEQ ID NO: 343637 - DNA, 20 bp, Artificial
  CRISPR gRNA sequence
gtattaaactcctgacctca

SEQ ID NO: 343638 - DNA, 20 bp, Artificial
  CRISPR gRNA sequence
aactcctgacctcaggtgat

SEQ ID NO: 343639 - DNA, 20 bp, Artificial
  CRISPR gRNA sequence
ctgacctcaggtgatgcacc

SEQ ID NO: 343640 - DNA, 20 bp, Artificial
  CRISPR gRNA sequence
acctcaggtgatgcaccagc

SEQ ID NO: 343641 - DNA, 20 bp, Artificial
  CRISPR gRNA sequence
aggtgatgcaccagcctcag

SEQ ID NO: 343642 - DNA, 20 bp, Artificial
  CRISPR gRNA sequence
agcctcccaaagtgttggga

SEQ ID NO: 343643 - DNA, 20 bp, Artificial
  CRISPR gRNA sequence
ccaaagtgttgggattacag

SEQ ID NO: 343644 - DNA, 20 bp, Artificial
  CRISPR gRNA sequence
ggattacaggcgtgagccac

SEQ ID NO: 343645 - DNA, 20 bp, Artificial
  CRISPR gRNA sequence
caggcgtgagccactgtgct

SEQ ID NO: 343646 - DNA, 20 bp, Artificial
  CRISPR gRNA sequence
tgctcggccccaatacttta

SEQ ID NO: 343647 - DNA, 20 bp, Artificial
  CRISPR gRNA sequence
ggccccaatactttaataac

SEQ ID NO: 343648 - DNA, 20 bp, Artificial
  CRISPR gRNA sequence
taataacttttaattaaagt

SEQ ID NO: 343649 - DNA, 20 bp, Artificial
  CRISPR gRNA sequence
aataacttttaattaaagta

SEQ ID NO: 343650 - DNA, 20 bp, Artificial
  CRISPR gRNA sequence
ataacttttaattaaagtat

SEQ ID NO: 343651 - DNA, 20 bp, Artificial
  CRISPR gRNA sequence
ttaattaaagtataatatac

SEQ ID NO: 343652 - DNA, 20 bp, Artificial
  CRISPR gRNA sequence
taattaaagtataatatacg

SEQ ID NO: 343653 - DNA, 20 bp, Artificial
  CRISPR gRNA sequence
aattaaagtataatatacgt

SEQ ID NO: 343654 - DNA, 20 bp, Artificial
  CRISPR gRNA sequence
attaaagtataatatacgta

SEQ ID NO: 343655 - DNA, 20 bp, Artificial
  CRISPR gRNA sequence
aagtataatatacgtacaga

SEQ ID NO: 343656 - DNA, 20 bp, Artificial
  CRISPR gRNA sequence
taaagcttaagaatttgtac

SEQ ID NO: 343657 - DNA, 20 bp, Artificial
  CRISPR gRNA sequence
aagaatttgtacaaatttgg

SEQ ID NO: 343658 - DNA, 20 bp, Artificial
  CRISPR gRNA sequence
agaatttgtacaaatttggc

SEQ ID NO: 343659 - DNA, 20 bp, Artificial
  CRISPR gRNA sequence
gtacaaatttggctcacagg

SEQ ID NO: 343660 - DNA, 20 bp, Artificial
  CRISPR gRNA sequence
tacaaatttggctcacaggc

SEQ ID NO: 343661 - DNA, 20 bp, Artificial
  CRISPR gRNA sequence
ggctcacaggcataaccagc

SEQ ID NO: 343662 - DNA, 20 bp, Artificial
  CRISPR gRNA sequence
gctcacaggcataaccagca

SEQ ID NO: 343663 - DNA, 20 bp, Artificial
  CRISPR gRNA sequence
acaggcataaccagcagcag

SEQ ID NO: 343664 - DNA, 20 bp, Artificial
  CRISPR gRNA sequence
cttgaacccgggaggtggaa

SEQ ID NO: 343665 - DNA, 20 bp, Artificial
  CRISPR gRNA sequence
gaacccgggaggtggaagtt

SEQ ID NO: 343666 - DNA, 20 bp, Artificial
  CRISPR gRNA sequence
aacccgggaggtggaagttg

SEQ ID NO: 343667 - DNA, 20 bp, Artificial
  CRISPR gRNA sequence
cagtgagccgagatcacgcc

SEQ ID NO: 343668 - DNA, 20 bp, Artificial
  CRISPR gRNA sequence
cactccagcctgggcaacag

SEQ ID NO: 343669 - DNA, 20 bp, Artificial
  CRISPR gRNA sequence
cagcctgggcaacagagtga

SEQ ID NO: 343670 - DNA, 20 bp, Artificial
  CRISPR gRNA sequence
ggcaacagagtgaaactccg

SEQ ID NO: 343671 - DNA, 20 bp, Artificial
  CRISPR gRNA sequence
cgtctcaaaaaaaaaaaaaa

SEQ ID NO: 343672 - DNA, 20 bp, Artificial
  CRISPR gRNA sequence
aaaaaaaaaaaaaaaagaaa

SEQ ID NO: 343673 - DNA, 20 bp, Artificial
  CRISPR gRNA sequence
acgcctgtaatcccagcact

SEQ ID NO: 343674 - DNA, 20 bp, Artificial
  CRISPR gRNA sequence
cgcctgtaatcccagcactt

SEQ ID NO: 343675 - DNA, 20 bp, Artificial
  CRISPR gRNA sequence
taatcccagcactttgggag

SEQ ID NO: 343676 - DNA, 20 bp, Artificial
  CRISPR gRNA sequence
tgggaggttgaggtgggtgg

SEQ ID NO: 343677 - DNA, 20 bp, Artificial
  CRISPR gRNA sequence
gggaggttgaggtgggtgga

SEQ ID NO: 343678 - DNA, 20 bp, Artificial
  CRISPR gRNA sequence
ggaggttgaggtgggtggat

SEQ ID NO: 343679 - DNA, 20 bp, Artificial
  CRISPR gRNA sequence
aggtgggtggattgcttgag

SEQ ID NO: 343680 - DNA, 20 bp, Artificial
  CRISPR gRNA sequence
cttgagctcaggagtttgag

SEQ ID NO: 343681 - DNA, 20 bp, Artificial
  CRISPR gRNA sequence
gagctcaggagtttgagacc

SEQ ID NO: 343682 - DNA, 20 bp, Artificial
  CRISPR gRNA sequence
agctcaggagtttgagacca

SEQ ID NO: 343683 - DNA, 20 bp, Artificial
  CRISPR gRNA sequence
aggagtttgagaccagcctg

SEQ ID NO: 343684 - DNA, 20 bp, Artificial
  CRISPR gRNA sequence
gagaccagcctggccaacat

SEQ ID NO: 343685 - DNA, 20 bp, Artificial
  CRISPR gRNA sequence
agaccagcctggccaacatg

SEQ ID NO: 343686 - DNA, 20 bp, Artificial
  CRISPR gRNA sequence
gccaacatggtgaaaccccg

SEQ ID NO: 343687 - DNA, 20 bp, Artificial
  CRISPR gRNA sequence
tacaaaaaatacaaaaatta

SEQ ID NO: 343688 - DNA, 20 bp, Artificial
  CRISPR gRNA sequence
caaaaaatacaaaaattagc

SEQ ID NO: 343689 - DNA, 20 bp, Artificial
  CRISPR gRNA sequence
gctgggtgtggtggtgcaca

SEQ ID NO: 343690 - DNA, 20 bp, Artificial
  CRISPR gRNA sequence
ggtgtggtggtgcacacctg

SEQ ID NO: 343691 - DNA, 20 bp, Artificial
  CRISPR gRNA sequence
taggcccaagctactgggga

SEQ ID NO: 343692 - DNA, 20 bp, Artificial
  CRISPR gRNA sequence
ctggggaggctgaggtggga

SEQ ID NO: 343693 - DNA, 20 bp, Artificial
  CRISPR gRNA sequence
gggaggctgaggtgggagga

SEQ ID NO: 343694 - DNA, 20 bp, Artificial
  CRISPR gRNA sequence
aggtgggaggatcgcttgag

SEQ ID NO: 343695 - DNA, 20 bp, Artificial
  CRISPR gRNA sequence
gagcccgggaggtggaggtt

SEQ ID NO: 343696 - DNA, 20 bp, Artificial
  CRISPR gRNA sequence
agcccgggaggtggaggtta

SEQ ID NO: 343697 - DNA, 20 bp, Artificial
  CRISPR gRNA sequence
cagtgagctgagatcatgat

SEQ ID NO: 343698 - DNA, 20 bp, Artificial
  CRISPR gRNA sequence
agatcatgatactgcgctcc

SEQ ID NO: 343699 - DNA, 20 bp, Artificial
  CRISPR gRNA sequence
cgctccagcctgggtgacag

SEQ ID NO: 343700 - DNA, 20 bp, Artificial
  CRISPR gRNA sequence
cagcctgggtgacagagtga

SEQ ID NO: 343701 - DNA, 20 bp, Artificial
  CRISPR gRNA sequence
ggtgacagagtgagatcctg

SEQ ID NO: 343702 - DNA, 20 bp, Artificial
  CRISPR gRNA sequence
tctcaaacaccaccaacaaa

SEQ ID NO: 343703 - DNA, 20 bp, Artificial
  CRISPR gRNA sequence
aaacaccaccaacaaaaaac

SEQ ID NO: 343704 - DNA, 20 bp, Artificial
  CRISPR gRNA sequence
gggattcccaggggctgggg

SEQ ID NO: 343705 - DNA, 20 bp, Artificial
  CRISPR gRNA sequence
ccaggggctggggctggggc

SEQ ID NO: 343706 - DNA, 20 bp, Artificial
  CRISPR gRNA sequence
gggctggggctggggttggt

SEQ ID NO: 343707 - DNA, 20 bp, Artificial
  CRISPR gRNA sequence
gggctggggttggttggggg

SEQ ID NO: 343708 - DNA, 20 bp, Artificial
  CRISPR gRNA sequence
gggttggttggggggaagaa

SEQ ID NO: 343709 - DNA, 20 bp, Artificial
  CRISPR gRNA sequence
gttggggggaagaaatgggg

SEQ ID NO: 343710 - DNA, 20 bp, Artificial
  CRISPR gRNA sequence
gggggaagaaatggggagtc

SEQ ID NO: 343711 - DNA, 20 bp, Artificial
  CRISPR gRNA sequence
ctaaggggtacaagtttctc

SEQ ID NO: 343712 - DNA, 20 bp, Artificial
  CRISPR gRNA sequence
aggggtacaagtttctctgg

SEQ ID NO: 343713 - DNA, 20 bp, Artificial
  CRISPR gRNA sequence
ctctggggtaacgaaaatgt

SEQ ID NO: 343714 - DNA, 20 bp, Artificial
  CRISPR gRNA sequence
tctggggtaacgaaaatgtt

SEQ ID NO: 343715 - DNA, 20 bp, Artificial
  CRISPR gRNA sequence
tggggtaacgaaaatgttat

SEQ ID NO: 343716 - DNA, 20 bp, Artificial
  CRISPR gRNA sequence
gggtaacgaaaatgttatag

SEQ ID NO: 343717 - DNA, 20 bp, Artificial
  CRISPR gRNA sequence
tagaattagatagtgttgat

SEQ ID NO: 343718 - DNA, 20 bp, Artificial
  CRISPR gRNA sequence
gatagtgttgatggctgcac

SEQ ID NO: 343719 - DNA, 20 bp, Artificial
  CRISPR gRNA sequence
atggctgcacaacctgtgga

SEQ ID NO: 343720 - DNA, 20 bp, Artificial
  CRISPR gRNA sequence
cacaacctgtggatacacta

SEQ ID NO: 343721 - DNA, 20 bp, Artificial
  CRISPR gRNA sequence
tggatacactaaaataaata

SEQ ID NO: 343722 - DNA, 20 bp, Artificial
  CRISPR gRNA sequence
aaataaataaataataaata

SEQ ID NO: 343723 - DNA, 20 bp, Artificial
  CRISPR gRNA sequence
cttgattacagttacttagc

SEQ ID NO: 343724 - DNA, 20 bp, Artificial
  CRISPR gRNA sequence
gattacagttacttagcctt

SEQ ID NO: 343725 - DNA, 20 bp, Artificial
  CRISPR gRNA sequence
attacagttacttagccttt

SEQ ID NO: 343726 - DNA, 20 bp, Artificial
  CRISPR gRNA sequence
cagttacttagcctttattt

SEQ ID NO: 343727 - DNA, 20 bp, Artificial
  CRISPR gRNA sequence
cttagcctttattttgtttg

SEQ ID NO: 343728 - DNA, 20 bp, Artificial
  CRISPR gRNA sequence
agcctttattttgtttgttt

SEQ ID NO: 343729 - DNA, 20 bp, Artificial
  CRISPR gRNA sequence
gcctttattttgtttgtttg

SEQ ID NO: 343730 - DNA, 20 bp, Artificial
  CRISPR gRNA sequence
tattttgtttgtttgttttt

SEQ ID NO: 343731 - DNA, 20 bp, Artificial
  CRISPR gRNA sequence
attttgtttgtttgtttttt

SEQ ID NO: 343732 - DNA, 20 bp, Artificial
  CRISPR gRNA sequence
ttttgtttgtttgttttttg

SEQ ID NO: 343733 - DNA, 20 bp, Artificial
  CRISPR gRNA sequence
tgtttgtttgttttttgaca

SEQ ID NO: 343734 - DNA, 20 bp, Artificial
  CRISPR gRNA sequence
gtttgtttgttttttgacag

SEQ ID NO: 343735 - DNA, 20 bp, Artificial
  CRISPR gRNA sequence
tttgtttgttttttgacaga

SEQ ID NO: 343736 - DNA, 20 bp, Artificial
  CRISPR gRNA sequence
gtttgttttttgacagagtc

SEQ ID NO: 343737 - DNA, 20 bp, Artificial
  CRISPR gRNA sequence
tttgttttttgacagagtct

SEQ ID NO: 343738 - DNA, 20 bp, Artificial
  CRISPR gRNA sequence
gttttttgacagagtcttgc

SEQ ID NO: 343739 - DNA, 20 bp, Artificial
  CRISPR gRNA sequence
ttttttgacagagtcttgct

SEQ ID NO: 343740 - DNA, 20 bp, Artificial
  CRISPR gRNA sequence
tttgacagagtcttgctttg

SEQ ID NO: 343741 - DNA, 20 bp, Artificial
  CRISPR gRNA sequence
ttgacagagtcttgctttgt

SEQ ID NO: 343742 - DNA, 20 bp, Artificial
  CRISPR gRNA sequence
tgacagagtcttgctttgtc

SEQ ID NO: 343743 - DNA, 20 bp, Artificial
  CRISPR gRNA sequence
gacagagtcttgctttgtcg

SEQ ID NO: 343744 - DNA, 20 bp, Artificial
  CRISPR gRNA sequence
acagagtcttgctttgtcgc

SEQ ID NO: 343745 - DNA, 20 bp, Artificial
  CRISPR gRNA sequence
gctttgtcgcccaggttgga

SEQ ID NO: 343746 - DNA, 20 bp, Artificial
  CRISPR gRNA sequence
ctttgtcgcccaggttggag

SEQ ID NO: 343747 - DNA, 20 bp, Artificial
  CRISPR gRNA sequence
tgtcgcccaggttggagtgc

SEQ ID NO: 343748 - DNA, 20 bp, Artificial
  CRISPR gRNA sequence
gtcgcccaggttggagtgca

SEQ ID NO: 343749 - DNA, 20 bp, Artificial
  CRISPR gRNA sequence
tcgcccaggttggagtgcag

SEQ ID NO: 343750 - DNA, 20 bp, Artificial
  CRISPR gRNA sequence
gagtgcagtggcacgatctc

SEQ ID NO: 343751 - DNA, 20 bp, Artificial
  CRISPR gRNA sequence
ggctcagtgcaacctccgcc

SEQ ID NO: 343752 - DNA, 20 bp, Artificial
  CRISPR gRNA sequence
agtgcaacctccgcctcctg

SEQ ID NO: 343753 - DNA, 20 bp, Artificial
  CRISPR gRNA sequence
cgcctcctgagttcaagtga

SEQ ID NO: 343754 - DNA, 20 bp, Artificial
  CRISPR gRNA sequence
ctgagttcaagtgattctcc

SEQ ID NO: 343755 - DNA, 20 bp, Artificial
  CRISPR gRNA sequence
agttcaagtgattctcctgc

SEQ ID NO: 343756 - DNA, 20 bp, Artificial
  CRISPR gRNA sequence
aagtgattctcctgcctcag

SEQ ID NO: 343757 - DNA, 20 bp, Artificial
  CRISPR gRNA sequence
tcctgcctcagcctccctag

SEQ ID NO: 343758 - DNA, 20 bp, Artificial
  CRISPR gRNA sequence
ctgcctcagcctccctagta

SEQ ID NO: 343759 - DNA, 20 bp, Artificial
  CRISPR gRNA sequence
cctcagcctccctagtagct

SEQ ID NO: 343760 - DNA, 20 bp, Artificial
  CRISPR gRNA sequence
agcctccctagtagctggga

SEQ ID NO: 343761 - DNA, 20 bp, Artificial
  CRISPR gRNA sequence
cctagtagctgggattacag

SEQ ID NO: 343762 - DNA, 20 bp, Artificial
  CRISPR gRNA sequence
gtagctgggattacaggtgt

SEQ ID NO: 343763 - DNA, 20 bp, Artificial
  CRISPR gRNA sequence
ggattacaggtgtgtgccac

SEQ ID NO: 343764 - DNA, 20 bp, Artificial
  CRISPR gRNA sequence
caggtgtgtgccaccacacc

SEQ ID NO: 343765 - DNA, 20 bp, Artificial
  CRISPR gRNA sequence
gctaattttttgtattttta

SEQ ID NO: 343766 - DNA, 20 bp, Artificial
  CRISPR gRNA sequence
attttttgtatttttagtag

SEQ ID NO: 343767 - DNA, 20 bp, Artificial
  CRISPR gRNA sequence
tttgtatttttagtagagac

SEQ ID NO: 343768 - DNA, 20 bp, Artificial
  CRISPR gRNA sequence
ttgtatttttagtagagacg

SEQ ID NO: 343769 - DNA, 20 bp, Artificial
  CRISPR gRNA sequence
tgtatttttagtagagacgg

SEQ ID NO: 343770 - DNA, 20 bp, Artificial
  CRISPR gRNA sequence
gtatttttagtagagacggg

SEQ ID NO: 343771 - DNA, 20 bp, Artificial
  CRISPR gRNA sequence
tatttttagtagagacgggg

SEQ ID NO: 343772 - DNA, 20 bp, Artificial
  CRISPR gRNA sequence
ttagtagagacggggtttca

SEQ ID NO: 343773 - DNA, 20 bp, Artificial
  CRISPR gRNA sequence
tagtagagacggggtttcac

SEQ ID NO: 343774 - DNA, 20 bp, Artificial
  CRISPR gRNA sequence
agtagagacggggtttcacc

SEQ ID NO: 343775 - DNA, 20 bp, Artificial
  CRISPR gRNA sequence
gtagagacggggtttcaccg

SEQ ID NO: 343776 - DNA, 20 bp, Artificial
  CRISPR gRNA sequence
caccgtgttagccaggatgg

SEQ ID NO: 343777 - DNA, 20 bp, Artificial
  CRISPR gRNA sequence
accgtgttagccaggatggt

SEQ ID NO: 343778 - DNA, 20 bp, Artificial
  CRISPR gRNA sequence
gccaggatggtctcaatctc

SEQ ID NO: 343779 - DNA, 20 bp, Artificial
  CRISPR gRNA sequence
aatctcctgacctcgtgatc

SEQ ID NO: 343780 - DNA, 20 bp, Artificial
  CRISPR gRNA sequence
ctgacctcgtgatccgcccg

SEQ ID NO: 343781 - DNA, 20 bp, Artificial
  CRISPR gRNA sequence
acctcgtgatccgcccgcct

SEQ ID NO: 343782 - DNA, 20 bp, Artificial
  CRISPR gRNA sequence
gtgatccgcccgccttggcc

SEQ ID NO: 343783 - DNA, 20 bp, Artificial
  CRISPR gRNA sequence
ggcctcccaaagtgctggga

SEQ ID NO: 343784 - DNA, 20 bp, Artificial
  CRISPR gRNA sequence
gcctcccaaagtgctgggat

SEQ ID NO: 343785 - DNA, 20 bp, Artificial
  CRISPR gRNA sequence
ccaaagtgctgggattacag

SEQ ID NO: 343786 - DNA, 20 bp, Artificial
  CRISPR gRNA sequence
ggattacaggcgtgagaatt

SEQ ID NO: 343787 - DNA, 20 bp, Artificial
  CRISPR gRNA sequence
caggcgtgagaatttgcctt

SEQ ID NO: 343788 - DNA, 20 bp, Artificial
  CRISPR gRNA sequence
gcctttaaaatatacatttt

SEQ ID NO: 343789 - DNA, 20 bp, Artificial
  CRISPR gRNA sequence
cctttaaaatatacattttg

SEQ ID NO: 343790 - DNA, 20 bp, Artificial
  CRISPR gRNA sequence
taaaatatacattttgctca

SEQ ID NO: 343791 - DNA, 20 bp, Artificial
  CRISPR gRNA sequence
aaaatatacattttgctcaa

SEQ ID NO: 343792 - DNA, 20 bp, Artificial
  CRISPR gRNA sequence
aaatatacattttgctcaag

SEQ ID NO: 343793 - DNA, 20 bp, Artificial
  CRISPR gRNA sequence
tgctcaagtgtagaggtccg

SEQ ID NO: 343794 - DNA, 20 bp, Artificial
  CRISPR gRNA sequence
gctcaagtgtagaggtccga

SEQ ID NO: 343795 - DNA, 20 bp, Artificial
  CRISPR gRNA sequence
ctcaagtgtagaggtccgat

SEQ ID NO: 343796 - DNA, 20 bp, Artificial
  CRISPR gRNA sequence
aagtgtagaggtccgatgct

SEQ ID NO: 343797 - DNA, 20 bp, Artificial
  CRISPR gRNA sequence
ggtggctgggtgttaattat

SEQ ID NO: 343798 - DNA, 20 bp, Artificial
  CRISPR gRNA sequence
ggtgttaattatcctggggg

SEQ ID NO: 343799 - DNA, 20 bp, Artificial
  CRISPR gRNA sequence
attatcctgggggcgggtgt

SEQ ID NO: 343800 - DNA, 20 bp, Artificial
  CRISPR gRNA sequence
tcctgggggcgggtgtggta

SEQ ID NO: 343801 - DNA, 20 bp, Artificial
  CRISPR gRNA sequence
ggggcgggtgtggtagggca

SEQ ID NO: 343802 - DNA, 20 bp, Artificial
  CRISPR gRNA sequence
gctgggctgggctgggctcg

SEQ ID NO: 343803 - DNA, 20 bp, Artificial
  CRISPR gRNA sequence
ggctgggctgggctcgctgg

SEQ ID NO: 343804 - DNA, 20 bp, Artificial
  CRISPR gRNA sequence
ggctgggctcgctggcggct

SEQ ID NO: 343805 - DNA, 20 bp, Artificial
  CRISPR gRNA sequence
ggctcgctggcggctggttt

SEQ ID NO: 343806 - DNA, 20 bp, Artificial
  CRISPR gRNA sequence
gctggcggctggtttgagag

SEQ ID NO: 343807 - DNA, 20 bp, Artificial
  CRISPR gRNA sequence
gcggctggtttgagaggagg

SEQ ID NO: 343808 - DNA, 20 bp, Artificial
  CRISPR gRNA sequence
gtttgagaggagggtgattc

SEQ ID NO: 343809 - DNA, 20 bp, Artificial
  CRISPR gRNA sequence
gagaggagggtgattcagag

SEQ ID NO: 343810 - DNA, 20 bp, Artificial
  CRISPR gRNA sequence
agaggagggtgattcagagg

SEQ ID NO: 343811 - DNA, 20 bp, Artificial
  CRISPR gRNA sequence
agaggaaggcagtgacaccc

SEQ ID NO: 343812 - DNA, 20 bp, Artificial
  CRISPR gRNA sequence
caagaaagcctggtgggcct

SEQ ID NO: 343813 - DNA, 20 bp, Artificial
  CRISPR gRNA sequence
gtgggccttagggcagacac

SEQ ID NO: 343814 - DNA, 20 bp, Artificial
  CRISPR gRNA sequence
agggcagacacttgtgggga

SEQ ID NO: 343815 - DNA, 20 bp, Artificial
  CRISPR gRNA sequence
gggcagacacttgtggggac

SEQ ID NO: 343816 - DNA, 20 bp, Artificial
  CRISPR gRNA sequence
gtggggacccggggagccct

SEQ ID NO: 343817 - DNA, 20 bp, Artificial
  CRISPR gRNA sequence
tggggacccggggagcccta

SEQ ID NO: 343818 - DNA, 20 bp, Artificial
  CRISPR gRNA sequence
ggtgccctgacaggtggaag

SEQ ID NO: 343819 - DNA, 20 bp, Artificial
  CRISPR gRNA sequence
acaggtggaagaggggtgca

SEQ ID NO: 343820 - DNA, 20 bp, Artificial
  CRISPR gRNA sequence
acaattttcttctacttatg

SEQ ID NO: 343821 - DNA, 20 bp, Artificial
  CRISPR gRNA sequence
tcttctacttatgccttttg

SEQ ID NO: 343822 - DNA, 20 bp, Artificial
  CRISPR gRNA sequence
cttctacttatgccttttgt

SEQ ID NO: 343823 - DNA, 20 bp, Artificial
  CRISPR gRNA sequence
ttctacttatgccttttgtc

SEQ ID NO: 343824 - DNA, 20 bp, Artificial
  CRISPR gRNA sequence
ctacttatgccttttgtcag

SEQ ID NO: 343825 - DNA, 20 bp, Artificial
  CRISPR gRNA sequence
tacttatgccttttgtcagg

SEQ ID NO: 343826 - DNA, 20 bp, Artificial
  CRISPR gRNA sequence
cttatgccttttgtcaggac

SEQ ID NO: 343827 - DNA, 20 bp, Artificial
  CRISPR gRNA sequence
atgccttttgtcaggacaag

SEQ ID NO: 343828 - DNA, 20 bp, Artificial
  CRISPR gRNA sequence
tgccttttgtcaggacaagg

SEQ ID NO: 343829 - DNA, 20 bp, Artificial
  CRISPR gRNA sequence
ttgtcaggacaaggagaggg

SEQ ID NO: 343830 - DNA, 20 bp, Artificial
  CRISPR gRNA sequence
tgtcaggacaaggagaggga

SEQ ID NO: 343831 - DNA, 20 bp, Artificial
  CRISPR gRNA sequence
gtcaggacaaggagagggac

SEQ ID NO: 343832 - DNA, 20 bp, Artificial
  CRISPR gRNA sequence
tcaggacaaggagagggaca

SEQ ID NO: 343833 - DNA, 20 bp, Artificial
  CRISPR gRNA sequence
cttcttggcatccttatggc

SEQ ID NO: 343834 - DNA, 20 bp, Artificial
  CRISPR gRNA sequence
cttggcatccttatggccct

SEQ ID NO: 343835 - DNA, 20 bp, Artificial
  CRISPR gRNA sequence
ttggcatccttatggccctg

SEQ ID NO: 343836 - DNA, 20 bp, Artificial
  CRISPR gRNA sequence
ggcatccttatggccctgtg

SEQ ID NO: 343837 - DNA, 20 bp, Artificial
  CRISPR gRNA sequence
gcatccttatggccctgtga

SEQ ID NO: 343838 - DNA, 20 bp, Artificial
  CRISPR gRNA sequence
atggccctgtgacctgctaa

SEQ ID NO: 343839 - DNA, 20 bp, Artificial
  CRISPR gRNA sequence
tggccctgtgacctgctaat

SEQ ID NO: 343840 - DNA, 20 bp, Artificial
  CRISPR gRNA sequence
tgacctgctaatgaatgctg

SEQ ID NO: 343841 - DNA, 20 bp, Artificial
  CRISPR gRNA sequence
ctaatgaatgctgactctga

SEQ ID NO: 343842 - DNA, 20 bp, Artificial
  CRISPR gRNA sequence
atgaatgctgactctgagtt

SEQ ID NO: 343843 - DNA, 20 bp, Artificial
  CRISPR gRNA sequence
actctgagttgctactagaa

SEQ ID NO: 343844 - DNA, 20 bp, Artificial
  CRISPR gRNA sequence
tgagttgctactagaatttg

SEQ ID NO: 343845 - DNA, 20 bp, Artificial
  CRISPR gRNA sequence
agttgctactagaatttggt

SEQ ID NO: 343846 - DNA, 20 bp, Artificial
  CRISPR gRNA sequence
ctactagaatttggtttcct

SEQ ID NO: 343847 - DNA, 20 bp, Artificial
  CRISPR gRNA sequence
ctagaatttggtttccttgt

SEQ ID NO: 343848 - DNA, 20 bp, Artificial
  CRISPR gRNA sequence
gaatttggtttccttgtggc

SEQ ID NO: 343849 - DNA, 20 bp, Artificial
  CRISPR gRNA sequence
ggtttccttgtggcttccca

SEQ ID NO: 343850 - DNA, 20 bp, Artificial
  CRISPR gRNA sequence
gtttccttgtggcttcccag

SEQ ID NO: 343851 - DNA, 20 bp, Artificial
  CRISPR gRNA sequence
ccttgtggcttcccaggaat

SEQ ID NO: 343852 - DNA, 20 bp, Artificial
  CRISPR gRNA sequence
cttgtggcttcccaggaatt

SEQ ID NO: 343853 - DNA, 20 bp, Artificial
  CRISPR gRNA sequence
gtggcttcccaggaattgtg

SEQ ID NO: 343854 - DNA, 20 bp, Artificial
  CRISPR gRNA sequence
tggcttcccaggaattgtga

SEQ ID NO: 343855 - DNA, 20 bp, Artificial
  CRISPR gRNA sequence
cccaggaattgtgagccatg

SEQ ID NO: 343856 - DNA, 20 bp, Artificial
  CRISPR gRNA sequence
ccaggaattgtgagccatgt

SEQ ID NO: 343857 - DNA, 20 bp, Artificial
  CRISPR gRNA sequence
tgagccatgttggataagga

SEQ ID NO: 343858 - DNA, 20 bp, Artificial
  CRISPR gRNA sequence
gataaggacctgcaagggaa

SEQ ID NO: 343859 - DNA, 20 bp, Artificial
  CRISPR gRNA sequence
caagggaagaatgaggaagc

SEQ ID NO: 343860 - DNA, 20 bp, Artificial
  CRISPR gRNA sequence
ggacagtgcaggaggggaga

SEQ ID NO: 343861 - DNA, 20 bp, Artificial
  CRISPR gRNA sequence
gtggtagagaggagtgatga

SEQ ID NO: 343862 - DNA, 20 bp, Artificial
  CRISPR gRNA sequence
cgccaaaagggaaatggagg

SEQ ID NO: 343863 - DNA, 20 bp, Artificial
  CRISPR gRNA sequence
aagaagctgctggggagggt

SEQ ID NO: 343864 - DNA, 20 bp, Artificial
  CRISPR gRNA sequence
ctggggagggttaaaaacaa

SEQ ID NO: 343865 - DNA, 20 bp, Artificial
  CRISPR gRNA sequence
gggagggttaaaaacaatgt

SEQ ID NO: 343866 - DNA, 20 bp, Artificial
  CRISPR gRNA sequence
aaaacaatgtgttctcactc

SEQ ID NO: 343867 - DNA, 20 bp, Artificial
  CRISPR gRNA sequence
tcactcgtaggtgggaattg

SEQ ID NO: 343868 - DNA, 20 bp, Artificial
  CRISPR gRNA sequence
actcgtaggtgggaattgaa

SEQ ID NO: 343869 - DNA, 20 bp, Artificial
  CRISPR gRNA sequence
gtaggtgggaattgaacaat

SEQ ID NO: 343870 - DNA, 20 bp, Artificial
  CRISPR gRNA sequence
aacaatgagaacacttggac

SEQ ID NO: 343871 - DNA, 20 bp, Artificial
  CRISPR gRNA sequence
ggacacaggaaggggaacat

SEQ ID NO: 343872 - DNA, 20 bp, Artificial
  CRISPR gRNA sequence
gacacaggaaggggaacatc

SEQ ID NO: 343873 - DNA, 20 bp, Artificial
  CRISPR gRNA sequence
gggcctgtcgtggggtgtgg

SEQ ID NO: 343874 - DNA, 20 bp, Artificial
  CRISPR gRNA sequence
tcgtggggtgtggggaggga

SEQ ID NO: 343875 - DNA, 20 bp, Artificial
  CRISPR gRNA sequence
ggagatatacctaatgtaaa

SEQ ID NO: 343876 - DNA, 20 bp, Artificial
  CRISPR gRNA sequence
atgtaaatgatgagttaatg

SEQ ID NO: 343877 - DNA, 20 bp, Artificial
  CRISPR gRNA sequence
atgggtgcagcacaccaaca

SEQ ID NO: 343878 - DNA, 20 bp, Artificial
  CRISPR gRNA sequence
tgtaacaaacctgcacattg

SEQ ID NO: 343879 - DNA, 20 bp, Artificial
  CRISPR gRNA sequence
cacattgtgtacatgtaccc

SEQ ID NO: 343880 - DNA, 20 bp, Artificial
  CRISPR gRNA sequence
tgtacatgtaccctagaact

SEQ ID NO: 343881 - DNA, 20 bp, Artificial
  CRISPR gRNA sequence
gaacttaaagtataattaaa

SEQ ID NO: 343882 - DNA, 20 bp, Artificial
  CRISPR gRNA sequence
aaagtataattaaaaaacaa

SEQ ID NO: 343883 - DNA, 20 bp, Artificial
  CRISPR gRNA sequence
aagtataattaaaaaacaaa

SEQ ID NO: 343884 - DNA, 20 bp, Artificial
  CRISPR gRNA sequence
aaaaacaaaacaaaacaaaa

SEQ ID NO: 343885 - DNA, 20 bp, Artificial
  CRISPR gRNA sequence
ttgttttagtggtgagtatc

SEQ ID NO: 343886 - DNA, 20 bp, Artificial
  CRISPR gRNA sequence
ttttagtggtgagtatccgg

SEQ ID NO: 343887 - DNA, 20 bp, Artificial
  CRISPR gRNA sequence
tagtggtgagtatccggaga

SEQ ID NO: 343888 - DNA, 20 bp, Artificial
  CRISPR gRNA sequence
agtggtgagtatccggagac

SEQ ID NO: 343889 - DNA, 20 bp, Artificial
  CRISPR gRNA sequence
gtggtgagtatccggagacc

SEQ ID NO: 343890 - DNA, 20 bp, Artificial
  CRISPR gRNA sequence
ggagttctatttaccaggta

SEQ ID NO: 343891 - DNA, 20 bp, Artificial
  CRISPR gRNA sequence
tatttaccaggtataacctg

SEQ ID NO: 343892 - DNA, 20 bp, Artificial
  CRISPR gRNA sequence
tttaccaggtataacctggg

SEQ ID NO: 343893 - DNA, 20 bp, Artificial
  CRISPR gRNA sequence
accaggtataacctgggctc

SEQ ID NO: 343894 - DNA, 20 bp, Artificial
  CRISPR gRNA sequence
ccaggtataacctgggctca

SEQ ID NO: 343895 - DNA, 20 bp, Artificial
  CRISPR gRNA sequence
ggctcaaaattccaggctga

SEQ ID NO: 343896 - DNA, 20 bp, Artificial
  CRISPR gRNA sequence
aaaattccaggctgacttca

SEQ ID NO: 343897 - DNA, 20 bp, Artificial
  CRISPR gRNA sequence
caggctgacttcaggcatgt

SEQ ID NO: 343898 - DNA, 20 bp, Artificial
  CRISPR gRNA sequence
acttcaggcatgtcctcatc

SEQ ID NO: 343899 - DNA, 20 bp, Artificial
  CRISPR gRNA sequence
caggcatgtcctcatctcat

SEQ ID NO: 343900 - DNA, 20 bp, Artificial
  CRISPR gRNA sequence
aggcatgtcctcatctcata

SEQ ID NO: 343901 - DNA, 20 bp, Artificial
  CRISPR gRNA sequence
atctcatagatgccagcact

SEQ ID NO: 343902 - DNA, 20 bp, Artificial
  CRISPR gRNA sequence
atagatgccagcactaaggc

SEQ ID NO: 343903 - DNA, 20 bp, Artificial
  CRISPR gRNA sequence
aggcccagagagggccgagc

SEQ ID NO: 343904 - DNA, 20 bp, Artificial
  CRISPR gRNA sequence
attcagcccacccatcttct

SEQ ID NO: 343905 - DNA, 20 bp, Artificial
  CRISPR gRNA sequence
agcccacccatcttctcacc

SEQ ID NO: 343906 - DNA, 20 bp, Artificial
  CRISPR gRNA sequence
ctcacccctgactgcatttc

SEQ ID NO: 343907 - DNA, 20 bp, Artificial
  CRISPR gRNA sequence
tcacccctgactgcatttcc

SEQ ID NO: 343908 - DNA, 20 bp, Artificial
  CRISPR gRNA sequence
acccctgactgcatttcccg

SEQ ID NO: 343909 - DNA, 20 bp, Artificial
  CRISPR gRNA sequence
actgcatttcccgggggtcc

SEQ ID NO: 343910 - DNA, 20 bp, Artificial
  CRISPR gRNA sequence
catttcccgggggtccttct

SEQ ID NO: 343911 - DNA, 20 bp, Artificial
  CRISPR gRNA sequence
cccgggggtccttctgcagc

SEQ ID NO: 343912 - DNA, 20 bp, Artificial
  CRISPR gRNA sequence
ccgggggtccttctgcagcc

SEQ ID NO: 343913 - DNA, 20 bp, Artificial
  CRISPR gRNA sequence
ctgcagccaggtgctgctgt

SEQ ID NO: 343914 - DNA, 20 bp, Artificial
  CRISPR gRNA sequence
tgcagccaggtgctgctgtg

SEQ ID NO: 343915 - DNA, 20 bp, Artificial
  CRISPR gRNA sequence
cagccaggtgctgctgtggt

SEQ ID NO: 343916 - DNA, 20 bp, Artificial
  CRISPR gRNA sequence
ctgtggtactttgggatcta

SEQ ID NO: 343917 - DNA, 20 bp, Artificial
  CRISPR gRNA sequence
tggtactttgggatctattg

SEQ ID NO: 343918 - DNA, 20 bp, Artificial
  CRISPR gRNA sequence
tgggatctattggctgagct

SEQ ID NO: 343919 - DNA, 20 bp, Artificial
  CRISPR gRNA sequence
gggatctattggctgagctc

SEQ ID NO: 343920 - DNA, 20 bp, Artificial
  CRISPR gRNA sequence
ggatctattggctgagctcc

SEQ ID NO: 343921 - DNA, 20 bp, Artificial
  CRISPR gRNA sequence
ttggctgagctcccagagaa

SEQ ID NO: 343922 - DNA, 20 bp, Artificial
  CRISPR gRNA sequence
gctgagctcccagagaaggg

SEQ ID NO: 343923 - DNA, 20 bp, Artificial
  CRISPR gRNA sequence
agctcccagagaagggtcat

SEQ ID NO: 343924 - DNA, 20 bp, Artificial
  CRISPR gRNA sequence
ccagagaagggtcatggatt

SEQ ID NO: 343925 - DNA, 20 bp, Artificial
  CRISPR gRNA sequence
ggctagtttggaacaagtga

SEQ ID NO: 343926 - DNA, 20 bp, Artificial
  CRISPR gRNA sequence
gtttggaacaagtgaaggga

SEQ ID NO: 343927 - DNA, 20 bp, Artificial
  CRISPR gRNA sequence
ggaacaagtgaagggactga

SEQ ID NO: 343928 - DNA, 20 bp, Artificial
  CRISPR gRNA sequence
gaacaagtgaagggactgaa

SEQ ID NO: 343929 - DNA, 20 bp, Artificial
  CRISPR gRNA sequence
aagatgggctcagtatgggg

SEQ ID NO: 343930 - DNA, 20 bp, Artificial
  CRISPR gRNA sequence
agtatggggcgaagaccttc

SEQ ID NO: 343931 - DNA, 20 bp, Artificial
  CRISPR gRNA sequence
caggaagggtctgcagagtg

SEQ ID NO: 343932 - DNA, 20 bp, Artificial
  CRISPR gRNA sequence
aggaagggtctgcagagtga

SEQ ID NO: 343933 - DNA, 20 bp, Artificial
  CRISPR gRNA sequence
cagagtgagtaggggggttt

SEQ ID NO: 343934 - DNA, 20 bp, Artificial
  CRISPR gRNA sequence
tgactaggaaaagttccaac

SEQ ID NO: 343935 - DNA, 20 bp, Artificial
  CRISPR gRNA sequence
gactaggaaaagttccaacc

SEQ ID NO: 343936 - DNA, 20 bp, Artificial
  CRISPR gRNA sequence
actaggaaaagttccaaccc

SEQ ID NO: 343937 - DNA, 20 bp, Artificial
  CRISPR gRNA sequence
ggaaaagttccaaccctgcc

SEQ ID NO: 343938 - DNA, 20 bp, Artificial
  CRISPR gRNA sequence
caaccctgccggggccgctg

SEQ ID NO: 343939 - DNA, 20 bp, Artificial
  CRISPR gRNA sequence
ccggggccgctgtcaagaga

SEQ ID NO: 343940 - DNA, 20 bp, Artificial
  CRISPR gRNA sequence
tcaagagaaaagcatctatt

SEQ ID NO: 343941 - DNA, 20 bp, Artificial
  CRISPR gRNA sequence
ttacagttacatttttaagt

SEQ ID NO: 343942 - DNA, 20 bp, Artificial
  CRISPR gRNA sequence
cagttacatttttaagttaa

SEQ ID NO: 343943 - DNA, 20 bp, Artificial
  CRISPR gRNA sequence
catttttaagttaagtagac

SEQ ID NO: 343944 - DNA, 20 bp, Artificial
  CRISPR gRNA sequence
ttaagttaagtagactgaag

SEQ ID NO: 343945 - DNA, 20 bp, Artificial
  CRISPR gRNA sequence
taagttaagtagactgaaga

SEQ ID NO: 343946 - DNA, 20 bp, Artificial
  CRISPR gRNA sequence
aagttaagtagactgaagaa

SEQ ID NO: 343947 - DNA, 20 bp, Artificial
  CRISPR gRNA sequence
agttaagtagactgaagaat

SEQ ID NO: 343948 - DNA, 20 bp, Artificial
  CRISPR gRNA sequence
agtagactgaagaatatttc

SEQ ID NO: 343949 - DNA, 20 bp, Artificial
  CRISPR gRNA sequence
aagaatatttcttgtgtatt

SEQ ID NO: 343950 - DNA, 20 bp, Artificial
  CRISPR gRNA sequence
cttgtgtattaaagacgttc

SEQ ID NO: 343951 - DNA, 20 bp, Artificial
  CRISPR gRNA sequence
ttgtgtattaaagacgttcc

SEQ ID NO: 343952 - DNA, 20 bp, Artificial
  CRISPR gRNA sequence
gtgtattaaagacgttcctt

SEQ ID NO: 343953 - DNA, 20 bp, Artificial
  CRISPR gRNA sequence
tgtattaaagacgttccttt

SEQ ID NO: 343954 - DNA, 20 bp, Artificial
  CRISPR gRNA sequence
aagacgttcctttttggttg

SEQ ID NO: 343955 - DNA, 20 bp, Artificial
  CRISPR gRNA sequence
ctttttggttgatttgcaat

SEQ ID NO: 343956 - DNA, 20 bp, Artificial
  CRISPR gRNA sequence
tttggttgatttgcaatgga

SEQ ID NO: 343957 - DNA, 20 bp, Artificial
  CRISPR gRNA sequence
ttggttgatttgcaatggaa

SEQ ID NO: 343958 - DNA, 20 bp, Artificial
  CRISPR gRNA sequence
tggttgatttgcaatggaaa

SEQ ID NO: 343959 - DNA, 20 bp, Artificial
  CRISPR gRNA sequence
ggttgatttgcaatggaaaa

SEQ ID NO: 343960 - DNA, 20 bp, Artificial
  CRISPR gRNA sequence
gttgatttgcaatggaaaag

SEQ ID NO: 343961 - DNA, 20 bp, Artificial
  CRISPR gRNA sequence
atttgcaatggaaaagcttt

SEQ ID NO: 343962 - DNA, 20 bp, Artificial
  CRISPR gRNA sequence
gcaatggaaaagcttttgtt

SEQ ID NO: 343963 - DNA, 20 bp, Artificial
  CRISPR gRNA sequence
caatggaaaagcttttgttt

SEQ ID NO: 343964 - DNA, 20 bp, Artificial
  CRISPR gRNA sequence
ttgttttctttttttttttg

SEQ ID NO: 343965 - DNA, 20 bp, Artificial
  CRISPR gRNA sequence
tgttttctttttttttttgg

SEQ ID NO: 343966 - DNA, 20 bp, Artificial
  CRISPR gRNA sequence
gttttctttttttttttgga

SEQ ID NO: 343967 - DNA, 20 bp, Artificial
  CRISPR gRNA sequence
ttttctttttttttttggaa

SEQ ID NO: 343968 - DNA, 20 bp, Artificial
  CRISPR gRNA sequence
tctttttttttttggaaaca

SEQ ID NO: 343969 - DNA, 20 bp, Artificial
  CRISPR gRNA sequence
ctttttttttttggaaacag

SEQ ID NO: 343970 - DNA, 20 bp, Artificial
  CRISPR gRNA sequence
tttttttttttggaaacagg

SEQ ID NO: 343971 - DNA, 20 bp, Artificial
  CRISPR gRNA sequence
tttttttttggaaacagggt

SEQ ID NO: 343972 - DNA, 20 bp, Artificial
  CRISPR gRNA sequence
ttttttttggaaacagggtc

SEQ ID NO: 343973 - DNA, 20 bp, Artificial
  CRISPR gRNA sequence
tttttttggaaacagggtct

SEQ ID NO: 343974 - DNA, 20 bp, Artificial
  CRISPR gRNA sequence
ttttttggaaacagggtctc

SEQ ID NO: 343975 - DNA, 20 bp, Artificial
  CRISPR gRNA sequence
tttttggaaacagggtctca

SEQ ID NO: 343976 - DNA, 20 bp, Artificial
  CRISPR gRNA sequence
ttttggaaacagggtctcac

SEQ ID NO: 343977 - DNA, 20 bp, Artificial
  CRISPR gRNA sequence
tttggaaacagggtctcact

SEQ ID NO: 343978 - DNA, 20 bp, Artificial
  CRISPR gRNA sequence
ttggaaacagggtctcactc

SEQ ID NO: 343979 - DNA, 20 bp, Artificial
  CRISPR gRNA sequence
tggaaacagggtctcactct

SEQ ID NO: 343980 - DNA, 20 bp, Artificial
  CRISPR gRNA sequence
ggaaacagggtctcactctg

SEQ ID NO: 343981 - DNA, 20 bp, Artificial
  CRISPR gRNA sequence
gaaacagggtctcactctgc

SEQ ID NO: 343982 - DNA, 20 bp, Artificial
  CRISPR gRNA sequence
actctgctcactctgtctcc

SEQ ID NO: 343983 - DNA, 20 bp, Artificial
  CRISPR gRNA sequence
tgctcactctgtctcccaag

SEQ ID NO: 343984 - DNA, 20 bp, Artificial
  CRISPR gRNA sequence
ctcactctgtctcccaagct

SEQ ID NO: 343985 - DNA, 20 bp, Artificial
  CRISPR gRNA sequence
actctgtctcccaagctgga

SEQ ID NO: 343986 - DNA, 20 bp, Artificial
  CRISPR gRNA sequence
tgtctcccaagctggagtgc

SEQ ID NO: 343987 - DNA, 20 bp, Artificial
  CRISPR gRNA sequence
tctcccaagctggagtgcag

SEQ ID NO: 343988 - DNA, 20 bp, Artificial
  CRISPR gRNA sequence
ccaagctggagtgcagtggt

SEQ ID NO: 343989 - DNA, 20 bp, Artificial
  CRISPR gRNA sequence
gagtgcagtggtacagtcac

SEQ ID NO: 343990 - DNA, 20 bp, Artificial
  CRISPR gRNA sequence
actgcagcctccacttcctg

SEQ ID NO: 343991 - DNA, 20 bp, Artificial
  CRISPR gRNA sequence
cagcctccacttcctggact

SEQ ID NO: 343992 - DNA, 20 bp, Artificial
  CRISPR gRNA sequence
cacttcctggactcaagtga

SEQ ID NO: 343993 - DNA, 20 bp, Artificial
  CRISPR gRNA sequence
cctggactcaagtgatcttc

SEQ ID NO: 343994 - DNA, 20 bp, Artificial
  CRISPR gRNA sequence
ctggactcaagtgatcttct

SEQ ID NO: 343995 - DNA, 20 bp, Artificial
  CRISPR gRNA sequence
gactcaagtgatcttctcac

SEQ ID NO: 343996 - DNA, 20 bp, Artificial
  CRISPR gRNA sequence
aagtgatcttctcacttcag

SEQ ID NO: 343997 - DNA, 20 bp, Artificial
  CRISPR gRNA sequence
ctcacttcagccttctgagt

SEQ ID NO: 343998 - DNA, 20 bp, Artificial
  CRISPR gRNA sequence
tcacttcagccttctgagta

SEQ ID NO: 343999 - DNA, 20 bp, Artificial
  CRISPR gRNA sequence
acttcagccttctgagtagc

SEQ ID NO: 344000 - DNA, 20 bp, Artificial
  CRISPR gRNA sequence
cagccttctgagtagctggg

SEQ ID NO: 344001 - DNA, 20 bp, Artificial
  CRISPR gRNA sequence
agccttctgagtagctggga

SEQ ID NO: 344002 - DNA, 20 bp, Artificial
  CRISPR gRNA sequence
ctgagtagctgggactacag

SEQ ID NO: 344003 - DNA, 20 bp, Artificial
  CRISPR gRNA sequence
tgagtagctgggactacagg

SEQ ID NO: 344004 - DNA, 20 bp, Artificial
  CRISPR gRNA sequence
agtagctgggactacaggtt

SEQ ID NO: 344005 - DNA, 20 bp, Artificial
  CRISPR gRNA sequence
ggactacaggttcgtgccac

SEQ ID NO: 344006 - DNA, 20 bp, Artificial
  CRISPR gRNA sequence
caggttcgtgccaccacgcc

SEQ ID NO: 344007 - DNA, 20 bp, Artificial
  CRISPR gRNA sequence
gtgccaccacgcctggctaa

SEQ ID NO: 344008 - DNA, 20 bp, Artificial
  CRISPR gRNA sequence
gctaactttttgtattttta

SEQ ID NO: 344009 - DNA, 20 bp, Artificial
  CRISPR gRNA sequence
actttttgtatttttagtag

SEQ ID NO: 344010 - DNA, 20 bp, Artificial
  CRISPR gRNA sequence
tttgtatttttagtagagac

SEQ ID NO: 344011 - DNA, 20 bp, Artificial
  CRISPR gRNA sequence
ttgtatttttagtagagaca

SEQ ID NO: 344012 - DNA, 20 bp, Artificial
  CRISPR gRNA sequence
tgtatttttagtagagacag

SEQ ID NO: 344013 - DNA, 20 bp, Artificial
  CRISPR gRNA sequence
gtatttttagtagagacagg

SEQ ID NO: 344014 - DNA, 20 bp, Artificial
  CRISPR gRNA sequence
tatttttagtagagacaggg

SEQ ID NO: 344015 - DNA, 20 bp, Artificial
  CRISPR gRNA sequence
ttagtagagacagggttttg

SEQ ID NO: 344016 - DNA, 20 bp, Artificial
  CRISPR gRNA sequence
tagtagagacagggttttgc

SEQ ID NO: 344017 - DNA, 20 bp, Artificial
  CRISPR gRNA sequence
agtagagacagggttttgcc

SEQ ID NO: 344018 - DNA, 20 bp, Artificial
  CRISPR gRNA sequence
gtagagacagggttttgcca

SEQ ID NO: 344019 - DNA, 20 bp, Artificial
  CRISPR gRNA sequence
tgccatgttgcccagggtgt

SEQ ID NO: 344020 - DNA, 20 bp, Artificial
  CRISPR gRNA sequence
gccatgttgcccagggtgtt

SEQ ID NO: 344021 - DNA, 20 bp, Artificial
  CRISPR gRNA sequence
ccatgttgcccagggtgttc

SEQ ID NO: 344022 - DNA, 20 bp, Artificial
  CRISPR gRNA sequence
cccagggtgttcttaaactc

SEQ ID NO: 344023 - DNA, 20 bp, Artificial
  CRISPR gRNA sequence
ttaaactcctgggctcaagg

SEQ ID NO: 344024 - DNA, 20 bp, Artificial
  CRISPR gRNA sequence
aaactcctgggctcaaggga

SEQ ID NO: 344025 - DNA, 20 bp, Artificial
  CRISPR gRNA sequence
aactcctgggctcaagggat

SEQ ID NO: 344026 - DNA, 20 bp, Artificial
  CRISPR gRNA sequence
ctgggctcaagggatccgcc

SEQ ID NO: 344027 - DNA, 20 bp, Artificial
  CRISPR gRNA sequence
ggctcaagggatccgcctgc

SEQ ID NO: 344028 - DNA, 20 bp, Artificial
  CRISPR gRNA sequence
aagggatccgcctgccttgg

SEQ ID NO: 344029 - DNA, 20 bp, Artificial
  CRISPR gRNA sequence
ccttggcctcctaaagtgct

SEQ ID NO: 344030 - DNA, 20 bp, Artificial
  CRISPR gRNA sequence
ggcctcctaaagtgctggga

SEQ ID NO: 344031 - DNA, 20 bp, Artificial
  CRISPR gRNA sequence
gcctcctaaagtgctgggat

SEQ ID NO: 344032 - DNA, 20 bp, Artificial
  CRISPR gRNA sequence
ctaaagtgctgggattacaa

SEQ ID NO: 344033 - DNA, 20 bp, Artificial
  CRISPR gRNA sequence
aagtgctgggattacaagtg

SEQ ID NO: 344034 - DNA, 20 bp, Artificial
  CRISPR gRNA sequence
ggattacaagtgtgagccac

SEQ ID NO: 344035 - DNA, 20 bp, Artificial
  CRISPR gRNA sequence
caagtgtgagccactgctct

SEQ ID NO: 344036 - DNA, 20 bp, Artificial
  CRISPR gRNA sequence
ctctggctttttgtgtgtgt

SEQ ID NO: 344037 - DNA, 20 bp, Artificial
  CRISPR gRNA sequence
tggctttttgtgtgtgtgtg

SEQ ID NO: 344038 - DNA, 20 bp, Artificial
  CRISPR gRNA sequence
gctttttgtgtgtgtgtgtg

SEQ ID NO: 344039 - DNA, 20 bp, Artificial
  CRISPR gRNA sequence
tttgtgtgtgtgtgtgtgtg

SEQ ID NO: 344040 - DNA, 20 bp, Artificial
  CRISPR gRNA sequence
ttgtgtgtgtgtgtgtgtgt

SEQ ID NO: 344041 - DNA, 20 bp, Artificial
  CRISPR gRNA sequence
tgtgtgtgtgtgtgtgtgtg

SEQ ID NO: 344042 - DNA, 20 bp, Artificial
  CRISPR gRNA sequence
gtgtgtgtgtgtgtgtgtgt

SEQ ID NO: 344043 - DNA, 20 bp, Artificial
  CRISPR gRNA sequence
tgtgtgtgtgtgtgtgtgtg

SEQ ID NO: 344044 - DNA, 20 bp, Artificial
  CRISPR gRNA sequence
tgctctgttacccaggctgg

SEQ ID NO: 344045 - DNA, 20 bp, Artificial
  CRISPR gRNA sequence
gctctgttacccaggctgga

SEQ ID NO: 344046 - DNA, 20 bp, Artificial
  CRISPR gRNA sequence
ctctgttacccaggctggag

SEQ ID NO: 344047 - DNA, 20 bp, Artificial
  CRISPR gRNA sequence
tgttacccaggctggagtgc

SEQ ID NO: 344048 - DNA, 20 bp, Artificial
  CRISPR gRNA sequence
ttacccaggctggagtgcag

SEQ ID NO: 344049 - DNA, 20 bp, Artificial
  CRISPR gRNA sequence
cccaggctggagtgcagtga

SEQ ID NO: 344050 - DNA, 20 bp, Artificial
  CRISPR gRNA sequence
gagtgcagtgatgtgagcag

SEQ ID NO: 344051 - DNA, 20 bp, Artificial
  CRISPR gRNA sequence
gacctcttggggacctcttg

SEQ ID NO: 344052 - DNA, 20 bp, Artificial
  CRISPR gRNA sequence
ttggggacctcttgggctca

SEQ ID NO: 344053 - DNA, 20 bp, Artificial
  CRISPR gRNA sequence
ggggacctcttgggctcaag

SEQ ID NO: 344054 - DNA, 20 bp, Artificial
  CRISPR gRNA sequence
gggacctcttgggctcaagt

SEQ ID NO: 344055 - DNA, 20 bp, Artificial
  CRISPR gRNA sequence
ttgggctcaagtgatcttcc

SEQ ID NO: 344056 - DNA, 20 bp, Artificial
  CRISPR gRNA sequence
gggctcaagtgatcttccca

SEQ ID NO: 344057 - DNA, 20 bp, Artificial
  CRISPR gRNA sequence
ggctcaagtgatcttcccat

SEQ ID NO: 344058 - DNA, 20 bp, Artificial
  CRISPR gRNA sequence
aagtgatcttcccatctcag

SEQ ID NO: 344059 - DNA, 20 bp, Artificial
  CRISPR gRNA sequence
cccatctcagcctcccaagt

SEQ ID NO: 344060 - DNA, 20 bp, Artificial
  CRISPR gRNA sequence
ccatctcagcctcccaagta

SEQ ID NO: 344061 - DNA, 20 bp, Artificial
  CRISPR gRNA sequence
agcctcccaagtagctggga

SEQ ID NO: 344062 - DNA, 20 bp, Artificial
  CRISPR gRNA sequence
ccaagtagctgggactgcag

SEQ ID NO: 344063 - DNA, 20 bp, Artificial
  CRISPR gRNA sequence
ggactgcaggtgcactacca

SEQ ID NO: 344064 - DNA, 20 bp, Artificial
  CRISPR gRNA sequence
caggtgcactaccatgacca

SEQ ID NO: 344065 - DNA, 20 bp, Artificial
  CRISPR gRNA sequence
ccatgaccagccaatttttt

SEQ ID NO: 344066 - DNA, 20 bp, Artificial
  CRISPR gRNA sequence
ttttagagacaaggtctcac

SEQ ID NO: 344067 - DNA, 20 bp, Artificial
  CRISPR gRNA sequence
tttagagacaaggtctcact

SEQ ID NO: 344068 - DNA, 20 bp, Artificial
  CRISPR gRNA sequence
ttagagacaaggtctcacta

SEQ ID NO: 344069 - DNA, 20 bp, Artificial
  CRISPR gRNA sequence
tagagacaaggtctcactat

SEQ ID NO: 344070 - DNA, 20 bp, Artificial
  CRISPR gRNA sequence
agagacaaggtctcactatg

SEQ ID NO: 344071 - DNA, 20 bp, Artificial
  CRISPR gRNA sequence
gagacaaggtctcactatgt

SEQ ID NO: 344072 - DNA, 20 bp, Artificial
  CRISPR gRNA sequence
actatgttgcccagctggtc

SEQ ID NO: 344073 - DNA, 20 bp, Artificial
  CRISPR gRNA sequence
tgttgcccagctggtctcaa

SEQ ID NO: 344074 - DNA, 20 bp, Artificial
  CRISPR gRNA sequence
cccagctggtctcaagctcc

SEQ ID NO: 344075 - DNA, 20 bp, Artificial
  CRISPR gRNA sequence
gtctcaagctcctgggctca

SEQ ID NO: 344076 - DNA, 20 bp, Artificial
  CRISPR gRNA sequence
aagctcctgggctcaagtct

SEQ ID NO: 344077 - DNA, 20 bp, Artificial
  CRISPR gRNA sequence
ctgggctcaagtctctacaa

SEQ ID NO: 344078 - DNA, 20 bp, Artificial
  CRISPR gRNA sequence
ggctcaagtctctacaaaat

SEQ ID NO: 344079 - DNA, 20 bp, Artificial
  CRISPR gRNA sequence
aagtctctacaaaatatgca

SEQ ID NO: 344080 - DNA, 20 bp, Artificial
  CRISPR gRNA sequence
tacaaaatatgcaaataccc

SEQ ID NO: 344081 - DNA, 20 bp, Artificial
  CRISPR gRNA sequence
caaaatatgcaaataccctt

SEQ ID NO: 344082 - DNA, 20 bp, Artificial
  CRISPR gRNA sequence
ctgccttggcctcccaagtg

SEQ ID NO: 344083 - DNA, 20 bp, Artificial
  CRISPR gRNA sequence
tgccttggcctcccaagtgc

SEQ ID NO: 344084 - DNA, 20 bp, Artificial
  CRISPR gRNA sequence
ccttggcctcccaagtgctg

SEQ ID NO: 344085 - DNA, 20 bp, Artificial
  CRISPR gRNA sequence
ggcctcccaagtgctgggat

SEQ ID NO: 344086 - DNA, 20 bp, Artificial
  CRISPR gRNA sequence
gcctcccaagtgctgggatt

SEQ ID NO: 344087 - DNA, 20 bp, Artificial
  CRISPR gRNA sequence
ccaagtgctgggattatagg

SEQ ID NO: 344088 - DNA, 20 bp, Artificial
  CRISPR gRNA sequence
ggattataggcatgagccac

SEQ ID NO: 344089 - DNA, 20 bp, Artificial
  CRISPR gRNA sequence
taggcatgagccaccacatc

SEQ ID NO: 344090 - DNA, 20 bp, Artificial
  CRISPR gRNA sequence
gtgttggtttttgtttttgt

SEQ ID NO: 344091 - DNA, 20 bp, Artificial
  CRISPR gRNA sequence
gtttttgtttttgtttttac

SEQ ID NO: 344092 - DNA, 20 bp, Artificial
  CRISPR gRNA sequence
ttgtttttgtttttacggga

SEQ ID NO: 344093 - DNA, 20 bp, Artificial
  CRISPR gRNA sequence
tgtttttgtttttacgggac

SEQ ID NO: 344094 - DNA, 20 bp, Artificial
  CRISPR gRNA sequence
gtttttgtttttacgggacc

SEQ ID NO: 344095 - DNA, 20 bp, Artificial
  CRISPR gRNA sequence
tttttgtttttacgggacca

SEQ ID NO: 344096 - DNA, 20 bp, Artificial
  CRISPR gRNA sequence
ttgtttttacgggaccaggc

SEQ ID NO: 344097 - DNA, 20 bp, Artificial
  CRISPR gRNA sequence
tgtttttacgggaccaggca

SEQ ID NO: 344098 - DNA, 20 bp, Artificial
  CRISPR gRNA sequence
gtttttacgggaccaggcac

SEQ ID NO: 344099 - DNA, 20 bp, Artificial
  CRISPR gRNA sequence
tttttacgggaccaggcact

SEQ ID NO: 344100 - DNA, 20 bp, Artificial
  CRISPR gRNA sequence
ttacgggaccaggcactaca

SEQ ID NO: 344101 - DNA, 20 bp, Artificial
  CRISPR gRNA sequence
tacgggaccaggcactacag

SEQ ID NO: 344102 - DNA, 20 bp, Artificial
  CRISPR gRNA sequence
acgggaccaggcactacagc

SEQ ID NO: 344103 - DNA, 20 bp, Artificial
  CRISPR gRNA sequence
cgggaccaggcactacagct

SEQ ID NO: 344104 - DNA, 20 bp, Artificial
  CRISPR gRNA sequence
cagctcacacctgtaatcct

SEQ ID NO: 344105 - DNA, 20 bp, Artificial
  CRISPR gRNA sequence
acacctgtaatcctggcact

SEQ ID NO: 344106 - DNA, 20 bp, Artificial
  CRISPR gRNA sequence
taatcctggcactttcagag

SEQ ID NO: 344107 - DNA, 20 bp, Artificial
  CRISPR gRNA sequence
gcactttcagaggctgagac

SEQ ID NO: 344108 - DNA, 20 bp, Artificial
  CRISPR gRNA sequence
tcagaggctgagactagaag

SEQ ID NO: 344109 - DNA, 20 bp, Artificial
  CRISPR gRNA sequence
cagaggctgagactagaaga

SEQ ID NO: 344110 - DNA, 20 bp, Artificial
  CRISPR gRNA sequence
agaggctgagactagaagat

SEQ ID NO: 344111 - DNA, 20 bp, Artificial
  CRISPR gRNA sequence
agactagaagattgcttgag

SEQ ID NO: 344112 - DNA, 20 bp, Artificial
  CRISPR gRNA sequence
gaagattgcttgagcccagg

SEQ ID NO: 344113 - DNA, 20 bp, Artificial
  CRISPR gRNA sequence
cttgagcccaggagttcaag

SEQ ID NO: 344114 - DNA, 20 bp, Artificial
  CRISPR gRNA sequence
gagcccaggagttcaaggct

SEQ ID NO: 344115 - DNA, 20 bp, Artificial
  CRISPR gRNA sequence
agcccaggagttcaaggctg

SEQ ID NO: 344116 - DNA, 20 bp, Artificial
  CRISPR gRNA sequence
aaggctgtggggagctatga

SEQ ID NO: 344117 - DNA, 20 bp, Artificial
  CRISPR gRNA sequence
tggggagctatgattgcacc

SEQ ID NO: 344118 - DNA, 20 bp, Artificial
  CRISPR gRNA sequence
tgattgcaccactgcactcc

SEQ ID NO: 344119 - DNA, 20 bp, Artificial
  CRISPR gRNA sequence
caccactgcactccagcctg

SEQ ID NO: 344120 - DNA, 20 bp, Artificial
  CRISPR gRNA sequence
cactccagcctgggtgacag

SEQ ID NO: 344121 - DNA, 20 bp, Artificial
  CRISPR gRNA sequence
cagcctgggtgacagagcta

SEQ ID NO: 344122 - DNA, 20 bp, Artificial
  CRISPR gRNA sequence
ggtgacagagctagaccttg

SEQ ID NO: 344123 - DNA, 20 bp, Artificial
  CRISPR gRNA sequence
gaccttgtctctaaactaaa

SEQ ID NO: 344124 - DNA, 20 bp, Artificial
  CRISPR gRNA sequence
gtctctaaactaaacaaaac

SEQ ID NO: 344125 - DNA, 20 bp, Artificial
  CRISPR gRNA sequence
tctctaaactaaacaaaaca

SEQ ID NO: 344126 - DNA, 20 bp, Artificial
  CRISPR gRNA sequence
taaactaaacaaaacaaaac

SEQ ID NO: 344127 - DNA, 20 bp, Artificial
  CRISPR gRNA sequence
aactaaacaaaacaaaaccc

SEQ ID NO: 344128 - DNA, 20 bp, Artificial
  CRISPR gRNA sequence
aacaaaacaaaacccagtac

SEQ ID NO: 344129 - DNA, 20 bp, Artificial
  CRISPR gRNA sequence
tgcaagtaggtagtttaata

SEQ ID NO: 344130 - DNA, 20 bp, Artificial
  CRISPR gRNA sequence
gcaagtaggtagtttaatag

SEQ ID NO: 344131 - DNA, 20 bp, Artificial
  CRISPR gRNA sequence
caagtaggtagtttaatagt

SEQ ID NO: 344132 - DNA, 20 bp, Artificial
  CRISPR gRNA sequence
aatagttacagttacctggt

SEQ ID NO: 344133 - DNA, 20 bp, Artificial
  CRISPR gRNA sequence
atagttacagttacctggtt

SEQ ID NO: 344134 - DNA, 20 bp, Artificial
  CRISPR gRNA sequence
cagttacctggttctaaaaa

SEQ ID NO: 344135 - DNA, 20 bp, Artificial
  CRISPR gRNA sequence
cctggttctaaaaagtgtct

SEQ ID NO: 344136 - DNA, 20 bp, Artificial
  CRISPR gRNA sequence
gttctaaaaagtgtcttgct

SEQ ID NO: 344137 - DNA, 20 bp, Artificial
  CRISPR gRNA sequence
taaaaagtgtcttgctagag

SEQ ID NO: 344138 - DNA, 20 bp, Artificial
  CRISPR gRNA sequence
aaaagtgtcttgctagagaa

SEQ ID NO: 344139 - DNA, 20 bp, Artificial
  CRISPR gRNA sequence
gctagagaacatttgttcaa

SEQ ID NO: 344140 - DNA, 20 bp, Artificial
  CRISPR gRNA sequence
ctagagaacatttgttcaaa

SEQ ID NO: 344141 - DNA, 20 bp, Artificial
  CRISPR gRNA sequence
gagaacatttgttcaaaggg

SEQ ID NO: 344142 - DNA, 20 bp, Artificial
  CRISPR gRNA sequence
gttcaaaggggccactttaa

SEQ ID NO: 344143 - DNA, 20 bp, Artificial
  CRISPR gRNA sequence
ttcaaaggggccactttaaa

SEQ ID NO: 344144 - DNA, 20 bp, Artificial
  CRISPR gRNA sequence
aaaggggccactttaaagcc

SEQ ID NO: 344145 - DNA, 20 bp, Artificial
  CRISPR gRNA sequence
taaagcctgctattctagtg

SEQ ID NO: 344146 - DNA, 20 bp, Artificial
  CRISPR gRNA sequence
aaagcctgctattctagtgt

SEQ ID NO: 344147 - DNA, 20 bp, Artificial
  CRISPR gRNA sequence
aagcctgctattctagtgta

SEQ ID NO: 344148 - DNA, 20 bp, Artificial
  CRISPR gRNA sequence
ctattctagtgtatactggc

SEQ ID NO: 344149 - DNA, 20 bp, Artificial
  CRISPR gRNA sequence
ttctagtgtatactggccgt

SEQ ID NO: 344150 - DNA, 20 bp, Artificial
  CRISPR gRNA sequence
tagtgtatactggccgtagt

SEQ ID NO: 344151 - DNA, 20 bp, Artificial
  CRISPR gRNA sequence
gtgtatactggccgtagttt

SEQ ID NO: 344152 - DNA, 20 bp, Artificial
  CRISPR gRNA sequence
gccgtagtttctgaaattgt

SEQ ID NO: 344153 - DNA, 20 bp, Artificial
  CRISPR gRNA sequence
ctgaaattgtagcgaagatg

SEQ ID NO: 344154 - DNA, 20 bp, Artificial
  CRISPR gRNA sequence
tgaaattgtagcgaagatgg

SEQ ID NO: 344155 - DNA, 20 bp, Artificial
  CRISPR gRNA sequence
aaattgtagcgaagatggag

SEQ ID NO: 344156 - DNA, 20 bp, Artificial
  CRISPR gRNA sequence
tagcgaagatggagaaataa

SEQ ID NO: 344157 - DNA, 20 bp, Artificial
  CRISPR gRNA sequence
ataagcacaactgcagatat

SEQ ID NO: 344158 - DNA, 20 bp, Artificial
  CRISPR gRNA sequence
cagatattatacttcttagt

SEQ ID NO: 344159 - DNA, 20 bp, Artificial
  CRISPR gRNA sequence
tacttcttagtttaaaaaaa

SEQ ID NO: 344160 - DNA, 20 bp, Artificial
  CRISPR gRNA sequence
cttagtttaaaaaaaacctt

SEQ ID NO: 344161 - DNA, 20 bp, Artificial
  CRISPR gRNA sequence
ttagtttaaaaaaaaccttt

SEQ ID NO: 344162 - DNA, 20 bp, Artificial
  CRISPR gRNA sequence
agtttaaaaaaaaccttttt

SEQ ID NO: 344163 - DNA, 20 bp, Artificial
  CRISPR gRNA sequence
gtttaaaaaaaacctttttt

SEQ ID NO: 344164 - DNA, 20 bp, Artificial
  CRISPR gRNA sequence
aaaaaaaacctttttttttg

SEQ ID NO: 344165 - DNA, 20 bp, Artificial
  CRISPR gRNA sequence
aaaaaaacctttttttttgg

SEQ ID NO: 344166 - DNA, 20 bp, Artificial
  CRISPR gRNA sequence
tttttttggaactataaaat

SEQ ID NO: 344167 - DNA, 20 bp, Artificial
  CRISPR gRNA sequence
ttttttggaactataaaata

SEQ ID NO: 344168 - DNA, 20 bp, Artificial
  CRISPR gRNA sequence
tttttggaactataaaataa

SEQ ID NO: 344169 - DNA, 20 bp, Artificial
  CRISPR gRNA sequence
ttttggaactataaaataaa

SEQ ID NO: 344170 - DNA, 20 bp, Artificial
  CRISPR gRNA sequence
tttggaactataaaataaaa

SEQ ID NO: 344171 - DNA, 20 bp, Artificial
  CRISPR gRNA sequence
ttggaactataaaataaaaa

SEQ ID NO: 344172 - DNA, 20 bp, Artificial
  CRISPR gRNA sequence
tggaactataaaataaaaac

SEQ ID NO: 344173 - DNA, 20 bp, Artificial
  CRISPR gRNA sequence
ggaactataaaataaaaaca

SEQ ID NO: 344174 - DNA, 20 bp, Artificial
  CRISPR gRNA sequence
gaactataaaataaaaacac

SEQ ID NO: 344175 - DNA, 20 bp, Artificial
  CRISPR gRNA sequence
taaaataaaaacacaggcta

SEQ ID NO: 344176 - DNA, 20 bp, Artificial
  CRISPR gRNA sequence
catacatactcattttctca

SEQ ID NO: 344177 - DNA, 20 bp, Artificial
  CRISPR gRNA sequence
attttctcaaattggctttt

SEQ ID NO: 344178 - DNA, 20 bp, Artificial
  CRISPR gRNA sequence
tctcaaattggcttttgtgc

SEQ ID NO: 344179 - DNA, 20 bp, Artificial
  CRISPR gRNA sequence
ctcaaattggcttttgtgca

SEQ ID NO: 344180 - DNA, 20 bp, Artificial
  CRISPR gRNA sequence
tcaaattggcttttgtgcaa

SEQ ID NO: 344181 - DNA, 20 bp, Artificial
  CRISPR gRNA sequence
aaattggcttttgtgcaaaa

SEQ ID NO: 344182 - DNA, 20 bp, Artificial
  CRISPR gRNA sequence
gcttttgtgcaaaaaaaggt

SEQ ID NO: 344183 - DNA, 20 bp, Artificial
  CRISPR gRNA sequence
ttgtgcaaaaaaaggttgtt

SEQ ID NO: 344184 - DNA, 20 bp, Artificial
  CRISPR gRNA sequence
tgtgcaaaaaaaggttgtta

SEQ ID NO: 344185 - DNA, 20 bp, Artificial
  CRISPR gRNA sequence
gtgcaaaaaaaggttgttac

SEQ ID NO: 344186 - DNA, 20 bp, Artificial
  CRISPR gRNA sequence
tgcaaaaaaaggttgttacc

SEQ ID NO: 344187 - DNA, 20 bp, Artificial
  CRISPR gRNA sequence
ttacctattgggttgctttg

SEQ ID NO: 344188 - DNA, 20 bp, Artificial
  CRISPR gRNA sequence
cctattgggttgctttgtta

SEQ ID NO: 344189 - DNA, 20 bp, Artificial
  CRISPR gRNA sequence
ttgggttgctttgttatttc

SEQ ID NO: 344190 - DNA, 20 bp, Artificial
  CRISPR gRNA sequence
ggttgctttgttatttcctt

SEQ ID NO: 344191 - DNA, 20 bp, Artificial
  CRISPR gRNA sequence
ctttgttatttccttagaaa

SEQ ID NO: 344192 - DNA, 20 bp, Artificial
  CRISPR gRNA sequence
tgttatttccttagaaagat

SEQ ID NO: 344193 - DNA, 20 bp, Artificial
  CRISPR gRNA sequence
gttatttccttagaaagatg

SEQ ID NO: 344194 - DNA, 20 bp, Artificial
  CRISPR gRNA sequence
ttatttccttagaaagatgt

SEQ ID NO: 344195 - DNA, 20 bp, Artificial
  CRISPR gRNA sequence
tttccttagaaagatgtatt

SEQ ID NO: 344196 - DNA, 20 bp, Artificial
  CRISPR gRNA sequence
ccttagaaagatgtattcca

SEQ ID NO: 344197 - DNA, 20 bp, Artificial
  CRISPR gRNA sequence
cttagaaagatgtattccaa

SEQ ID NO: 344198 - DNA, 20 bp, Artificial
  CRISPR gRNA sequence
agaaagatgtattccaaatt

SEQ ID NO: 344199 - DNA, 20 bp, Artificial
  CRISPR gRNA sequence
gaaagatgtattccaaattc

SEQ ID NO: 344200 - DNA, 20 bp, Artificial
  CRISPR gRNA sequence
caaattcccaatggccaacc

SEQ ID NO: 344201 - DNA, 20 bp, Artificial
  CRISPR gRNA sequence
ccaatggccaacctgcacat

SEQ ID NO: 344202 - DNA, 20 bp, Artificial
  CRISPR gRNA sequence
cacatgtgcactctgggaac

SEQ ID NO: 344203 - DNA, 20 bp, Artificial
  CRISPR gRNA sequence
tgggaacacagtcagtttat

SEQ ID NO: 344204 - DNA, 20 bp, Artificial
  CRISPR gRNA sequence
ggaacacagtcagtttattg

SEQ ID NO: 344205 - DNA, 20 bp, Artificial
  CRISPR gRNA sequence
attggttgggggttgcttgc

SEQ ID NO: 344206 - DNA, 20 bp, Artificial
  CRISPR gRNA sequence
ttggttgggggttgcttgcc

SEQ ID NO: 344207 - DNA, 20 bp, Artificial
  CRISPR gRNA sequence
gttgggggttgcttgcccga

SEQ ID NO: 344208 - DNA, 20 bp, Artificial
  CRISPR gRNA sequence
ggggttgcttgcccgaaatc

SEQ ID NO: 344209 - DNA, 20 bp, Artificial
  CRISPR gRNA sequence
cttgcccgaaatctggggtc

SEQ ID NO: 344210 - DNA, 20 bp, Artificial
  CRISPR gRNA sequence
gcccgaaatctggggtcata

SEQ ID NO: 344211 - DNA, 20 bp, Artificial
  CRISPR gRNA sequence
cccgaaatctggggtcatag

SEQ ID NO: 344212 - DNA, 20 bp, Artificial
  CRISPR gRNA sequence
gggtcatagagccacttctc

SEQ ID NO: 344213 - DNA, 20 bp, Artificial
  CRISPR gRNA sequence
ctctcattttattgtcttga

SEQ ID NO: 344214 - DNA, 20 bp, Artificial
  CRISPR gRNA sequence
tctcattttattgtcttgat

SEQ ID NO: 344215 - DNA, 20 bp, Artificial
  CRISPR gRNA sequence
tcattttattgtcttgatcc

SEQ ID NO: 344216 - DNA, 20 bp, Artificial
  CRISPR gRNA sequence
attttattgtcttgatccta

SEQ ID NO: 344217 - DNA, 20 bp, Artificial
  CRISPR gRNA sequence
tattgtcttgatcctatcca

SEQ ID NO: 344218 - DNA, 20 bp, Artificial
  CRISPR gRNA sequence
attgtcttgatcctatccat

SEQ ID NO: 344219 - DNA, 20 bp, Artificial
  CRISPR gRNA sequence
ttgtcttgatcctatccata

SEQ ID NO: 344220 - DNA, 20 bp, Artificial
  CRISPR gRNA sequence
tcttgatcctatccatagac

SEQ ID NO: 344221 - DNA, 20 bp, Artificial
  CRISPR gRNA sequence
gatcctatccatagacccgt

SEQ ID NO: 344222 - DNA, 20 bp, Artificial
  CRISPR gRNA sequence
atcctatccatagacccgtt

SEQ ID NO: 344223 - DNA, 20 bp, Artificial
  CRISPR gRNA sequence
tccatagacccgttctcacc

SEQ ID NO: 344224 - DNA, 20 bp, Artificial
  CRISPR gRNA sequence
tcaccaatccctcaaattct

SEQ ID NO: 344225 - DNA, 20 bp, Artificial
  CRISPR gRNA sequence
accaatccctcaaattctat

SEQ ID NO: 344226 - DNA, 20 bp, Artificial
  CRISPR gRNA sequence
aaattctatttatccctttc

SEQ ID NO: 344227 - DNA, 20 bp, Artificial
  CRISPR gRNA sequence
tatttatccctttcctggaa

SEQ ID NO: 344228 - DNA, 20 bp, Artificial
  CRISPR gRNA sequence
tttatccctttcctggaata

SEQ ID NO: 344229 - DNA, 20 bp, Artificial
  CRISPR gRNA sequence
atccctttcctggaatacta

SEQ ID NO: 344230 - DNA, 20 bp, Artificial
  CRISPR gRNA sequence
tccctttcctggaatactag

SEQ ID NO: 344231 - DNA, 20 bp, Artificial
  CRISPR gRNA sequence
tcctggaatactagatgtct

SEQ ID NO: 344232 - DNA, 20 bp, Artificial
  CRISPR gRNA sequence
cctggaatactagatgtctg

SEQ ID NO: 344233 - DNA, 20 bp, Artificial
  CRISPR gRNA sequence
ctggaatactagatgtctgc

SEQ ID NO: 344234 - DNA, 20 bp, Artificial
  CRISPR gRNA sequence
gaatactagatgtctgccca

SEQ ID NO: 344235 - DNA, 20 bp, Artificial
  CRISPR gRNA sequence
gatgtctgcccacgttaatt

SEQ ID NO: 344236 - DNA, 20 bp, Artificial
  CRISPR gRNA sequence
cccacgttaattcatgcccc

SEQ ID NO: 344237 - DNA, 20 bp, Artificial
  CRISPR gRNA sequence
attcatgccccacctagggt

SEQ ID NO: 344238 - DNA, 20 bp, Artificial
  CRISPR gRNA sequence
atgccccacctagggtgccg

SEQ ID NO: 344239 - DNA, 20 bp, Artificial
  CRISPR gRNA sequence
gggtgccgcatttcccagca

SEQ ID NO: 344240 - DNA, 20 bp, Artificial
  CRISPR gRNA sequence
cccagcattggctccacttg

SEQ ID NO: 344241 - DNA, 20 bp, Artificial
  CRISPR gRNA sequence
ccagcattggctccacttgc

SEQ ID NO: 344242 - DNA, 20 bp, Artificial
  CRISPR gRNA sequence
gctccacttgctgtgagcct

SEQ ID NO: 344243 - DNA, 20 bp, Artificial
  CRISPR gRNA sequence
cacttgctgtgagccttgaa

SEQ ID NO: 344244 - DNA, 20 bp, Artificial
  CRISPR gRNA sequence
gctgtgagccttgaagaagg

SEQ ID NO: 344245 - DNA, 20 bp, Artificial
  CRISPR gRNA sequence
ctgtgagccttgaagaaggc

SEQ ID NO: 344246 - DNA, 20 bp, Artificial
  CRISPR gRNA sequence
tgagccttgaagaaggccaa

SEQ ID NO: 344247 - DNA, 20 bp, Artificial
  CRISPR gRNA sequence
gaagaaggccaaagctttgg

SEQ ID NO: 344248 - DNA, 20 bp, Artificial
  CRISPR gRNA sequence
aagaaggccaaagctttggc

SEQ ID NO: 344249 - DNA, 20 bp, Artificial
  CRISPR gRNA sequence
tggccccgtcatcctccttg

SEQ ID NO: 344250 - DNA, 20 bp, Artificial
  CRISPR gRNA sequence
ggccccgtcatcctccttgc

SEQ ID NO: 344251 - DNA, 20 bp, Artificial
  CRISPR gRNA sequence
gccccgtcatcctccttgca

SEQ ID NO: 344252 - DNA, 20 bp, Artificial
  CRISPR gRNA sequence
cttgcacccccaaacccgtc

SEQ ID NO: 344253 - DNA, 20 bp, Artificial
  CRISPR gRNA sequence
gcacccccaaacccgtcacc

SEQ ID NO: 344254 - DNA, 20 bp, Artificial
  CRISPR gRNA sequence
cacccccaaacccgtcacca

SEQ ID NO: 344255 - DNA, 20 bp, Artificial
  CRISPR gRNA sequence
gctcccccagatgcttgtcc

SEQ ID NO: 344256 - DNA, 20 bp, Artificial
  CRISPR gRNA sequence
ctcccccagatgcttgtcca

SEQ ID NO: 344257 - DNA, 20 bp, Artificial
  CRISPR gRNA sequence
ccccagatgcttgtccatcg

SEQ ID NO: 344258 - DNA, 20 bp, Artificial
  CRISPR gRNA sequence
gtccatcgtccccacctaca

SEQ ID NO: 344259 - DNA, 20 bp, Artificial
  CRISPR gRNA sequence
tccatcgtccccacctacac

SEQ ID NO: 344260 - DNA, 20 bp, Artificial
  CRISPR gRNA sequence
cacacccttgcccacctcac

SEQ ID NO: 344261 - DNA, 20 bp, Artificial
  CRISPR gRNA sequence
gcccacctcaccagagttac

SEQ ID NO: 344262 - DNA, 20 bp, Artificial
  CRISPR gRNA sequence
cccacctcaccagagttaca

SEQ ID NO: 344263 - DNA, 20 bp, Artificial
  CRISPR gRNA sequence
accagagttacagtgccgac

SEQ ID NO: 344264 - DNA, 20 bp, Artificial
  CRISPR gRNA sequence
cagtgccgacagctctcaca

SEQ ID NO: 344265 - DNA, 20 bp, Artificial
  CRISPR gRNA sequence
tcacagtggggccgggtgtg

SEQ ID NO: 344266 - DNA, 20 bp, Artificial
  CRISPR gRNA sequence
acagtggggccgggtgtggt

SEQ ID NO: 344267 - DNA, 20 bp, Artificial
  CRISPR gRNA sequence
gggaaacacagatggacttt

SEQ ID NO: 344268 - DNA, 20 bp, Artificial
  CRISPR gRNA sequence
ggaaacacagatggactttg

SEQ ID NO: 344269 - DNA, 20 bp, Artificial
  CRISPR gRNA sequence
gaaacacagatggactttgg

SEQ ID NO: 344270 - DNA, 20 bp, Artificial
  CRISPR gRNA sequence
aaacacagatggactttggg

SEQ ID NO: 344271 - DNA, 20 bp, Artificial
  CRISPR gRNA sequence
ttggggggctcccccttcta

SEQ ID NO: 344272 - DNA, 20 bp, Artificial
  CRISPR gRNA sequence
tggggggctcccccttctac

SEQ ID NO: 344273 - DNA, 20 bp, Artificial
  CRISPR gRNA sequence
tcccccttctacaggaaacc

SEQ ID NO: 344274 - DNA, 20 bp, Artificial
  CRISPR gRNA sequence
ccccttctacaggaaacccg

SEQ ID NO: 344275 - DNA, 20 bp, Artificial
  CRISPR gRNA sequence
cttctacaggaaacccggag

SEQ ID NO: 344276 - DNA, 20 bp, Artificial
  CRISPR gRNA sequence
acaggaaacccggagtggac

SEQ ID NO: 344277 - DNA, 20 bp, Artificial
  CRISPR gRNA sequence
aaacccggagtggactggaa

SEQ ID NO: 344278 - DNA, 20 bp, Artificial
  CRISPR gRNA sequence
cggagtggactggaatggtg

SEQ ID NO: 344279 - DNA, 20 bp, Artificial
  CRISPR gRNA sequence
ggagtggactggaatggtgc

SEQ ID NO: 344280 - DNA, 20 bp, Artificial
  CRISPR gRNA sequence
gagtggactggaatggtgca

SEQ ID NO: 344281 - DNA, 20 bp, Artificial
  CRISPR gRNA sequence
agtggactggaatggtgcag

SEQ ID NO: 344282 - DNA, 20 bp, Artificial
  CRISPR gRNA sequence
gtggactggaatggtgcagg

SEQ ID NO: 344283 - DNA, 20 bp, Artificial
  CRISPR gRNA sequence
ggactggaatggtgcagggg

SEQ ID NO: 344284 - DNA, 20 bp, Artificial
  CRISPR gRNA sequence
ggagaactcgcccctcccat

SEQ ID NO: 344285 - DNA, 20 bp, Artificial
  CRISPR gRNA sequence
gagaactcgcccctcccatc

SEQ ID NO: 344286 - DNA, 20 bp, Artificial
  CRISPR gRNA sequence
atcgggcgcctccttcatac

SEQ ID NO: 344287 - DNA, 20 bp, Artificial
  CRISPR gRNA sequence
ttcataccggcccttcccct

SEQ ID NO: 344288 - DNA, 20 bp, Artificial
  CRISPR gRNA sequence
cccttcccctcggctttgcc

SEQ ID NO: 344289 - DNA, 20 bp, Artificial
  CRISPR gRNA sequence
tcccctcggctttgcctgga

SEQ ID NO: 344290 - DNA, 20 bp, Artificial
  CRISPR gRNA sequence
tggacagctcctgcctcccg

SEQ ID NO: 344291 - DNA, 20 bp, Artificial
  CRISPR gRNA sequence
ggacagctcctgcctcccgc

SEQ ID NO: 344292 - DNA, 20 bp, Artificial
  CRISPR gRNA sequence
gacagctcctgcctcccgca

SEQ ID NO: 344293 - DNA, 20 bp, Artificial
  CRISPR gRNA sequence
cagggcccacctgtgtcccc

SEQ ID NO: 344294 - DNA, 20 bp, Artificial
  CRISPR gRNA sequence
tcccccagcgccgctccacc

SEQ ID NO: 344295 - DNA, 20 bp, Artificial
  CRISPR gRNA sequence
cccagcgccgctccacccag

SEQ ID NO: 344296 - DNA, 20 bp, Artificial
  CRISPR gRNA sequence
ccagcgccgctccacccagc

SEQ ID NO: 344297 - DNA, 20 bp, Artificial
  CRISPR gRNA sequence
ccgctccacccagcaggcct

SEQ ID NO: 344298 - DNA, 20 bp, Artificial
  CRISPR gRNA sequence
cctgagcccctctctgctgc

SEQ ID NO: 344299 - DNA, 20 bp, Artificial
  CRISPR gRNA sequence
ctgcccactctcctgctgct

SEQ ID NO: 344300 - DNA, 20 bp, Artificial
  CRISPR gRNA sequence
tgcccactctcctgctgctc

SEQ ID NO: 344301 - DNA, 20 bp, Artificial
  CRISPR gRNA sequence
tctcctgctgctcgggttct

SEQ ID NO: 344302 - DNA, 20 bp, Artificial
  CRISPR gRNA sequence
ctcctgctgctcgggttctg

SEQ ID NO: 344303 - DNA, 20 bp, Artificial
  CRISPR gRNA sequence
gctgctcgggttctgaggca

SEQ ID NO: 344304 - DNA, 20 bp, Artificial
  CRISPR gRNA sequence
gaggcacagcttgtcacacc

SEQ ID NO: 344305 - DNA, 20 bp, Artificial
  CRISPR gRNA sequence
aggcacagcttgtcacaccg

SEQ ID NO: 344306 - DNA, 20 bp, Artificial
  CRISPR gRNA sequence
cacagcttgtcacaccgagg

SEQ ID NO: 344307 - DNA, 20 bp, Artificial
  CRISPR gRNA sequence
ttctctttctctttctcttc

SEQ ID NO: 344308 - DNA, 20 bp, Artificial
  CRISPR gRNA sequence
tctctttctcttctggccca

SEQ ID NO: 344309 - DNA, 20 bp, Artificial
  CRISPR gRNA sequence
tctcttctggcccacagccg

SEQ ID NO: 344310 - DNA, 20 bp, Artificial
  CRISPR gRNA sequence
ctggcccacagccgcagcaa

SEQ ID NO: 344311 - DNA, 20 bp, Artificial
  CRISPR gRNA sequence
acagccgcagcaatggcgct

SEQ ID NO: 344312 - DNA, 20 bp, Artificial
  CRISPR gRNA sequence
atggcgctgagttcctctgc

SEQ ID NO: 344313 - DNA, 20 bp, Artificial
  CRISPR gRNA sequence
ggcgctgagttcctctgctg

SEQ ID NO: 344314 - DNA, 20 bp, Artificial
  CRISPR gRNA sequence
tctgctggagttcatcctgc

SEQ ID NO: 344315 - DNA, 20 bp, Artificial
  CRISPR gRNA sequence
ctggagttcatcctgctagc

SEQ ID NO: 344316 - DNA, 20 bp, Artificial
  CRISPR gRNA sequence
tggagttcatcctgctagct

SEQ ID NO: 344317 - DNA, 20 bp, Artificial
  CRISPR gRNA sequence
atcctgctagctgggttccc

SEQ ID NO: 344318 - DNA, 20 bp, Artificial
  CRISPR gRNA sequence
tagctgggttcccgagctgc

SEQ ID NO: 344319 - DNA, 20 bp, Artificial
  CRISPR gRNA sequence
ggttcccgagctgccggtct

SEQ ID NO: 344320 - DNA, 20 bp, Artificial
  CRISPR gRNA sequence
cgagctgccggtctgagcct

SEQ ID NO: 344321 - DNA, 20 bp, Artificial
  CRISPR gRNA sequence
gagctgccggtctgagcctg

SEQ ID NO: 344322 - DNA, 20 bp, Artificial
  CRISPR gRNA sequence
cggtctgagcctgaggccat

SEQ ID NO: 344323 - DNA, 20 bp, Artificial
  CRISPR gRNA sequence
gcctgaggccatgagcctcc

SEQ ID NO: 344324 - DNA, 20 bp, Artificial
  CRISPR gRNA sequence
ctgaggccatgagcctcctg

SEQ ID NO: 344325 - DNA, 20 bp, Artificial
  CRISPR gRNA sequence
gccatgagcctcctggagac

SEQ ID NO: 344326 - DNA, 20 bp, Artificial
  CRISPR gRNA sequence
ccatgagcctcctggagact

SEQ ID NO: 344327 - DNA, 20 bp, Artificial
  CRISPR gRNA sequence
catgagcctcctggagactg

SEQ ID NO: 344328 - DNA, 20 bp, Artificial
  CRISPR gRNA sequence
atgagcctcctggagactgg

SEQ ID NO: 344329 - DNA, 20 bp, Artificial
  CRISPR gRNA sequence
gagactgggggcctcctccc

SEQ ID NO: 344330 - DNA, 20 bp, Artificial
  CRISPR gRNA sequence
gactgggggcctcctccctg

SEQ ID NO: 344331 - DNA, 20 bp, Artificial
  CRISPR gRNA sequence
acccccaaaaccgacgtctt

SEQ ID NO: 344332 - DNA, 20 bp, Artificial
  CRISPR gRNA sequence
cccccaaaaccgacgtcttg

SEQ ID NO: 344333 - DNA, 20 bp, Artificial
  CRISPR gRNA sequence
caaaaccgacgtcttgaggc

SEQ ID NO: 344334 - DNA, 20 bp, Artificial
  CRISPR gRNA sequence
accgacgtcttgaggctggt

SEQ ID NO: 344335 - DNA, 20 bp, Artificial
  CRISPR gRNA sequence
cttgaggctggtgagccccc

SEQ ID NO: 344336 - DNA, 20 bp, Artificial
  CRISPR gRNA sequence
gcctcctctccgtctgctcg

SEQ ID NO: 344337 - DNA, 20 bp, Artificial
  CRISPR gRNA sequence
ctccgtctgctcgcagatcc

SEQ ID NO: 344338 - DNA, 20 bp, Artificial
  CRISPR gRNA sequence
gcagatcccagttctgaccc

SEQ ID NO: 344339 - DNA, 20 bp, Artificial
  CRISPR gRNA sequence
cagatcccagttctgacccc

SEQ ID NO: 344340 - DNA, 20 bp, Artificial
  CRISPR gRNA sequence
agatcccagttctgacccca

SEQ ID NO: 344341 - DNA, 20 bp, Artificial
  CRISPR gRNA sequence
tctgaccccagggcctccca

SEQ ID NO: 344342 - DNA, 20 bp, Artificial
  CRISPR gRNA sequence
tcttccccatgcccctgtcc

SEQ ID NO: 344343 - DNA, 20 bp, Artificial
  CRISPR gRNA sequence
gcccctgtcctggccgttgc

SEQ ID NO: 344344 - DNA, 20 bp, Artificial
  CRISPR gRNA sequence
gtcctggccgttgctggctc

SEQ ID NO: 344345 - DNA, 20 bp, Artificial
  CRISPR gRNA sequence
ccgttgctggctccggcgtc

SEQ ID NO: 344346 - DNA, 20 bp, Artificial
  CRISPR gRNA sequence
ccagcccgtcccctgctgcc

SEQ ID NO: 344347 - DNA, 20 bp, Artificial
  CRISPR gRNA sequence
cagcccgtcccctgctgcct

SEQ ID NO: 344348 - DNA, 20 bp, Artificial
  CRISPR gRNA sequence
agcccgtcccctgctgcctg

SEQ ID NO: 344349 - DNA, 20 bp, Artificial
  CRISPR gRNA sequence
cccctgctgcctggggctct

SEQ ID NO: 344350 - DNA, 20 bp, Artificial
  CRISPR gRNA sequence
ccctgctgcctggggctctc

SEQ ID NO: 344351 - DNA, 20 bp, Artificial
  CRISPR gRNA sequence
ctggggctctcgggtcaacc

SEQ ID NO: 344352 - DNA, 20 bp, Artificial
  CRISPR gRNA sequence
ctcgggtcaacccagacccc

SEQ ID NO: 344353 - DNA, 20 bp, Artificial
  CRISPR gRNA sequence
tcaacccagacccccagcac

SEQ ID NO: 344354 - DNA, 20 bp, Artificial
  CRISPR gRNA sequence
caacccagacccccagcact

SEQ ID NO: 344355 - DNA, 20 bp, Artificial
  CRISPR gRNA sequence
ccccagcactgggctcacca

SEQ ID NO: 344356 - DNA, 20 bp, Artificial
  CRISPR gRNA sequence
cagcactgggctcaccacag

SEQ ID NO: 344357 - DNA, 20 bp, Artificial
  CRISPR gRNA sequence
agcactgggctcaccacagt

SEQ ID NO: 344358 - DNA, 20 bp, Artificial
  CRISPR gRNA sequence
gcactgggctcaccacagtg

SEQ ID NO: 344359 - DNA, 20 bp, Artificial
  CRISPR gRNA sequence
tgggctcaccacagtggggt

SEQ ID NO: 344360 - DNA, 20 bp, Artificial
  CRISPR gRNA sequence
gctcaccacagtggggtgag

SEQ ID NO: 344361 - DNA, 20 bp, Artificial
  CRISPR gRNA sequence
caccacagtggggtgagcag

SEQ ID NO: 344362 - DNA, 20 bp, Artificial
  CRISPR gRNA sequence
ccacagtggggtgagcagca

SEQ ID NO: 344363 - DNA, 20 bp, Artificial
  CRISPR gRNA sequence
tggggtgagcagcagagcca

SEQ ID NO: 344364 - DNA, 20 bp, Artificial
  CRISPR gRNA sequence
agcagagccacagccctacc

SEQ ID NO: 344365 - DNA, 20 bp, Artificial
  CRISPR gRNA sequence
agagccacagccctacccag

SEQ ID NO: 344366 - DNA, 20 bp, Artificial
  CRISPR gRNA sequence
cccactcaccactccgtcca

SEQ ID NO: 344367 - DNA, 20 bp, Artificial
  CRISPR gRNA sequence
ccactcaccactccgtccac

SEQ ID NO: 344368 - DNA, 20 bp, Artificial
  CRISPR gRNA sequence
ctcaccactccgtccacggg

SEQ ID NO: 344369 - DNA, 20 bp, Artificial
  CRISPR gRNA sequence
ccactccgtccacgggcagc

SEQ ID NO: 344370 - DNA, 20 bp, Artificial
  CRISPR gRNA sequence
tccgtccacgggcagctggt

SEQ ID NO: 344371 - DNA, 20 bp, Artificial
  CRISPR gRNA sequence
gcagctggtgagcccccatt

SEQ ID NO: 344372 - DNA, 20 bp, Artificial
  CRISPR gRNA sequence
ctggtgagcccccatttggc

SEQ ID NO: 344373 - DNA, 20 bp, Artificial
  CRISPR gRNA sequence
agcccccatttggccggatg

SEQ ID NO: 344374 - DNA, 20 bp, Artificial
  CRISPR gRNA sequence
gcccccatttggccggatgt

SEQ ID NO: 344375 - DNA, 20 bp, Artificial
  CRISPR gRNA sequence
tggccggatgtgggcacttc

SEQ ID NO: 344376 - DNA, 20 bp, Artificial
  CRISPR gRNA sequence
ggccggatgtgggcacttct

SEQ ID NO: 344377 - DNA, 20 bp, Artificial
  CRISPR gRNA sequence
gccggatgtgggcacttctg

SEQ ID NO: 344378 - DNA, 20 bp, Artificial
  CRISPR gRNA sequence
ccggatgtgggcacttctgg

SEQ ID NO: 344379 - DNA, 20 bp, Artificial
  CRISPR gRNA sequence
atgtgggcacttctgggggc

SEQ ID NO: 344380 - DNA, 20 bp, Artificial
  CRISPR gRNA sequence
tgtgggcacttctgggggct

SEQ ID NO: 344381 - DNA, 20 bp, Artificial
  CRISPR gRNA sequence
ttctgggggctgggtgtctc

SEQ ID NO: 344382 - DNA, 20 bp, Artificial
  CRISPR gRNA sequence
tctgggggctgggtgtctct

SEQ ID NO: 344383 - DNA, 20 bp, Artificial
  CRISPR gRNA sequence
tgggtgtctctgggcgtctc

SEQ ID NO: 344384 - DNA, 20 bp, Artificial
  CRISPR gRNA sequence
gggtgtctctgggcgtctct

SEQ ID NO: 344385 - DNA, 20 bp, Artificial
  CRISPR gRNA sequence
tgtctctgggcgtctctggg

SEQ ID NO: 344386 - DNA, 20 bp, Artificial
  CRISPR gRNA sequence
gtctctgggcgtctctgggc

SEQ ID NO: 344387 - DNA, 20 bp, Artificial
  CRISPR gRNA sequence
tctctgggcgtctctgggcg

SEQ ID NO: 344388 - DNA, 20 bp, Artificial
  CRISPR gRNA sequence
cgtctctgggcggggccctc

SEQ ID NO: 344389 - DNA, 20 bp, Artificial
  CRISPR gRNA sequence
ctctgggcggggccctcgag

SEQ ID NO: 344390 - DNA, 20 bp, Artificial
  CRISPR gRNA sequence
tctgggcggggccctcgagc

SEQ ID NO: 344391 - DNA, 20 bp, Artificial
  CRISPR gRNA sequence
gagcaggtgacccaactccc

SEQ ID NO: 344392 - DNA, 20 bp, Artificial
  CRISPR gRNA sequence
caggtgacccaactccccgg

SEQ ID NO: 344393 - DNA, 20 bp, Artificial
  CRISPR gRNA sequence
ctccccggcagccctgacct

SEQ ID NO: 344394 - DNA, 20 bp, Artificial
  CRISPR gRNA sequence
ggcagccctgaccttggtga

SEQ ID NO: 344395 - DNA, 20 bp, Artificial
  CRISPR gRNA sequence
gcagccctgaccttggtgac

SEQ ID NO: 344396 - DNA, 20 bp, Artificial
  CRISPR gRNA sequence
tgaccttggtgacaggtgat

SEQ ID NO: 344397 - DNA, 20 bp, Artificial
  CRISPR gRNA sequence
ttggtgacaggtgataagat

SEQ ID NO: 344398 - DNA, 20 bp, Artificial
  CRISPR gRNA sequence
caggtgataagatcagtgtg

SEQ ID NO: 344399 - DNA, 20 bp, Artificial
  CRISPR gRNA sequence
gtgataagatcagtgtgcag

SEQ ID NO: 344400 - DNA, 20 bp, Artificial
  CRISPR gRNA sequence
tgataagatcagtgtgcagc

SEQ ID NO: 344401 - DNA, 20 bp, Artificial
  CRISPR gRNA sequence
gataagatcagtgtgcagca

SEQ ID NO: 344402 - DNA, 20 bp, Artificial
  CRISPR gRNA sequence
ataagatcagtgtgcagcag

SEQ ID NO: 344403 - DNA, 20 bp, Artificial
  CRISPR gRNA sequence
taagatcagtgtgcagcagg

SEQ ID NO: 344404 - DNA, 20 bp, Artificial
  CRISPR gRNA sequence
atcagtgtgcagcagggggc

SEQ ID NO: 344405 - DNA, 20 bp, Artificial
  CRISPR gRNA sequence
gtgcagcagggggctggacc

SEQ ID NO: 344406 - DNA, 20 bp, Artificial
  CRISPR gRNA sequence
tgcagcagggggctggaccc

SEQ ID NO: 344407 - DNA, 20 bp, Artificial
  CRISPR gRNA sequence
agcagggggctggacccagg

SEQ ID NO: 344408 - DNA, 20 bp, Artificial
  CRISPR gRNA sequence
gcagggggctggacccaggt

SEQ ID NO: 344409 - DNA, 20 bp, Artificial
  CRISPR gRNA sequence
gggggctggacccaggtggg

SEQ ID NO: 344410 - DNA, 20 bp, Artificial
  CRISPR gRNA sequence
ggggctggacccaggtgggt

SEQ ID NO: 344411 - DNA, 20 bp, Artificial
  CRISPR gRNA sequence
gggctggacccaggtgggtg

SEQ ID NO: 344412 - DNA, 20 bp, Artificial
  CRISPR gRNA sequence
ctggacccaggtgggtgggg

SEQ ID NO: 344413 - DNA, 20 bp, Artificial
  CRISPR gRNA sequence
tggacccaggtgggtggggt

SEQ ID NO: 344414 - DNA, 20 bp, Artificial
  CRISPR gRNA sequence
ggacccaggtgggtggggtg

SEQ ID NO: 344415 - DNA, 20 bp, Artificial
  CRISPR gRNA sequence
ggatactctccatgctcatg

SEQ ID NO: 344416 - DNA, 20 bp, Artificial
  CRISPR gRNA sequence
atgtggcactcctgcctgtc

SEQ ID NO: 344417 - DNA, 20 bp, Artificial
  CRISPR gRNA sequence
tgtccagccactatccccat

SEQ ID NO: 344418 - DNA, 20 bp, Artificial
  CRISPR gRNA sequence
gtccagccactatccccatc

SEQ ID NO: 344419 - DNA, 20 bp, Artificial
  CRISPR gRNA sequence
tccagccactatccccatca

SEQ ID NO: 344420 - DNA, 20 bp, Artificial
  CRISPR gRNA sequence
ccagccactatccccatcag

SEQ ID NO: 344421 - DNA, 20 bp, Artificial
  CRISPR gRNA sequence
aggggcccccgactgcccat

SEQ ID NO: 344422 - DNA, 20 bp, Artificial
  CRISPR gRNA sequence
gcccccgactgcccatcagc

SEQ ID NO: 344423 - DNA, 20 bp, Artificial
  CRISPR gRNA sequence
cgactgcccatcagccagcc

SEQ ID NO: 344424 - DNA, 20 bp, Artificial
  CRISPR gRNA sequence
gactgcccatcagccagccc

SEQ ID NO: 344425 - DNA, 20 bp, Artificial
  CRISPR gRNA sequence
ccatcagccagcccaggaac

SEQ ID NO: 344426 - DNA, 20 bp, Artificial
  CRISPR gRNA sequence
catcagccagcccaggaacg

SEQ ID NO: 344427 - DNA, 20 bp, Artificial
  CRISPR gRNA sequence
ccagcccaggaacgaggcca

SEQ ID NO: 344428 - DNA, 20 bp, Artificial
  CRISPR gRNA sequence
gcccaggaacgaggccacgg

SEQ ID NO: 344429 - DNA, 20 bp, Artificial
  CRISPR gRNA sequence
ccaggaacgaggccacggca

SEQ ID NO: 344430 - DNA, 20 bp, Artificial
  CRISPR gRNA sequence
cagagccaccctccccgatg

SEQ ID NO: 344431 - DNA, 20 bp, Artificial
  CRISPR gRNA sequence
ctccccgatgtggccctgat

SEQ ID NO: 344432 - DNA, 20 bp, Artificial
  CRISPR gRNA sequence
tcagcctgtcacccactgtc

SEQ ID NO: 344433 - DNA, 20 bp, Artificial
  CRISPR gRNA sequence
tcacccactgtctggcttgt

SEQ ID NO: 344434 - DNA, 20 bp, Artificial
  CRISPR gRNA sequence
ctgtctggcttgtgagcctc

SEQ ID NO: 344435 - DNA, 20 bp, Artificial
  CRISPR gRNA sequence
tgtctggcttgtgagcctct

SEQ ID NO: 344436 - DNA, 20 bp, Artificial
  CRISPR gRNA sequence
gtctggcttgtgagcctctg

SEQ ID NO: 344437 - DNA, 20 bp, Artificial
  CRISPR gRNA sequence
gagcctctggggcccatccc

SEQ ID NO: 344438 - DNA, 20 bp, Artificial
  CRISPR gRNA sequence
ccatccctggctgcccctgc

SEQ ID NO: 344439 - DNA, 20 bp, Artificial
  CRISPR gRNA sequence
ggctgcccctgctggctctt

SEQ ID NO: 344440 - DNA, 20 bp, Artificial
  CRISPR gRNA sequence
gctgcccctgctggctcttc

SEQ ID NO: 344441 - DNA, 20 bp, Artificial
  CRISPR gRNA sequence
ctgcccctgctggctcttca

SEQ ID NO: 344442 - DNA, 20 bp, Artificial
  CRISPR gRNA sequence
tgcccctgctggctcttcag

SEQ ID NO: 344443 - DNA, 20 bp, Artificial
  CRISPR gRNA sequence
cctgctggctcttcaggggt

SEQ ID NO: 344444 - DNA, 20 bp, Artificial
  CRISPR gRNA sequence
gctggctcttcaggggtcag

SEQ ID NO: 344445 - DNA, 20 bp, Artificial
  CRISPR gRNA sequence
ctggctcttcaggggtcagc

SEQ ID NO: 344446 - DNA, 20 bp, Artificial
  CRISPR gRNA sequence
aggggtcagcaggtccaacc

SEQ ID NO: 344447 - DNA, 20 bp, Artificial
  CRISPR gRNA sequence
ggggtcagcaggtccaacct

SEQ ID NO: 344448 - DNA, 20 bp, Artificial
  CRISPR gRNA sequence
tcagcaggtccaacctaggc

SEQ ID NO: 344449 - DNA, 20 bp, Artificial
  CRISPR gRNA sequence
gcaggtccaacctaggccag

SEQ ID NO: 344450 - DNA, 20 bp, Artificial
  CRISPR gRNA sequence
caggtccaacctaggccagc

SEQ ID NO: 344451 - DNA, 20 bp, Artificial
  CRISPR gRNA sequence
aggtccaacctaggccagca

SEQ ID NO: 344452 - DNA, 20 bp, Artificial
  CRISPR gRNA sequence
ggtccaacctaggccagcag

SEQ ID NO: 344453 - DNA, 20 bp, Artificial
  CRISPR gRNA sequence
gtccaacctaggccagcagg

SEQ ID NO: 344454 - DNA, 20 bp, Artificial
  CRISPR gRNA sequence
tccaacctaggccagcaggg

SEQ ID NO: 344455 - DNA, 20 bp, Artificial
  CRISPR gRNA sequence
acctaggccagcaggggggc

SEQ ID NO: 344456 - DNA, 20 bp, Artificial
  CRISPR gRNA sequence
taggccagcaggggggccgg

SEQ ID NO: 344457 - DNA, 20 bp, Artificial
  CRISPR gRNA sequence
aggccagcaggggggccggc

SEQ ID NO: 344458 - DNA, 20 bp, Artificial
  CRISPR gRNA sequence
gggccggcaggttgtctgcc

SEQ ID NO: 344459 - DNA, 20 bp, Artificial
  CRISPR gRNA sequence
ccggcaggttgtctgcccag

SEQ ID NO: 344460 - DNA, 20 bp, Artificial
  CRISPR gRNA sequence
cggcaggttgtctgcccagt

SEQ ID NO: 344461 - DNA, 20 bp, Artificial
  CRISPR gRNA sequence
cccagtgggctcaatgctcc

SEQ ID NO: 344462 - DNA, 20 bp, Artificial
  CRISPR gRNA sequence
ccagtgggctcaatgctccc

SEQ ID NO: 344463 - DNA, 20 bp, Artificial
  CRISPR gRNA sequence
gggctcaatgctcccaggtg

SEQ ID NO: 344464 - DNA, 20 bp, Artificial
  CRISPR gRNA sequence
ggctcaatgctcccaggtgt

SEQ ID NO: 344465 - DNA, 20 bp, Artificial
  CRISPR gRNA sequence
gctcaatgctcccaggtgtg

SEQ ID NO: 344466 - DNA, 20 bp, Artificial
  CRISPR gRNA sequence
atgctcccaggtgtggggtg

SEQ ID NO: 344467 - DNA, 20 bp, Artificial
  CRISPR gRNA sequence
tgctcccaggtgtggggtgt

SEQ ID NO: 344468 - DNA, 20 bp, Artificial
  CRISPR gRNA sequence
gctcccaggtgtggggtgtg

SEQ ID NO: 344469 - DNA, 20 bp, Artificial
  CRISPR gRNA sequence
ggtgtggggtgtggggtccc

SEQ ID NO: 344470 - DNA, 20 bp, Artificial
  CRISPR gRNA sequence
tggggtgtggggtccctggc

SEQ ID NO: 344471 - DNA, 20 bp, Artificial
  CRISPR gRNA sequence
ggggtgtggggtccctggcg

SEQ ID NO: 344472 - DNA, 20 bp, Artificial
  CRISPR gRNA sequence
gggtgtggggtccctggcga

SEQ ID NO: 344473 - DNA, 20 bp, Artificial
  CRISPR gRNA sequence
tgtggggtccctggcgaggg

SEQ ID NO: 344474 - DNA, 20 bp, Artificial
  CRISPR gRNA sequence
tggggtccctggcgagggca

SEQ ID NO: 344475 - DNA, 20 bp, Artificial
  CRISPR gRNA sequence
ccctggcgagggcagagttc

SEQ ID NO: 344476 - DNA, 20 bp, Artificial
  CRISPR gRNA sequence
gagggcagagttccagttcc

SEQ ID NO: 344477 - DNA, 20 bp, Artificial
  CRISPR gRNA sequence
agggcagagttccagttccc

SEQ ID NO: 344478 - DNA, 20 bp, Artificial
  CRISPR gRNA sequence
gggcagagttccagttccca

SEQ ID NO: 344479 - DNA, 20 bp, Artificial
  CRISPR gRNA sequence
ttcccagggctccgcgctgc

SEQ ID NO: 344480 - DNA, 20 bp, Artificial
  CRISPR gRNA sequence
tcccagggctccgcgctgcc

SEQ ID NO: 344481 - DNA, 20 bp, Artificial
  CRISPR gRNA sequence
cagggctccgcgctgccagg

SEQ ID NO: 344482 - DNA, 20 bp, Artificial
  CRISPR gRNA sequence
gcgctgccaggcagcgtcat

SEQ ID NO: 344483 - DNA, 20 bp, Artificial
  CRISPR gRNA sequence
cgctgccaggcagcgtcatc

SEQ ID NO: 344484 - DNA, 20 bp, Artificial
  CRISPR gRNA sequence
gctgccaggcagcgtcatca

SEQ ID NO: 344485 - DNA, 20 bp, Artificial
  CRISPR gRNA sequence
ccaggcagcgtcatcagggc

SEQ ID NO: 344486 - DNA, 20 bp, Artificial
  CRISPR gRNA sequence
aggcagcgtcatcagggctg

SEQ ID NO: 344487 - DNA, 20 bp, Artificial
  CRISPR gRNA sequence
ggcagcgtcatcagggctgg

SEQ ID NO: 344488 - DNA, 20 bp, Artificial
  CRISPR gRNA sequence
cagcgtcatcagggctggag

SEQ ID NO: 344489 - DNA, 20 bp, Artificial
  CRISPR gRNA sequence
agcgtcatcagggctggagg

SEQ ID NO: 344490 - DNA, 20 bp, Artificial
  CRISPR gRNA sequence
gcgtcatcagggctggagga

SEQ ID NO: 344491 - DNA, 20 bp, Artificial
  CRISPR gRNA sequence
cgtcatcagggctggaggag

SEQ ID NO: 344492 - DNA, 20 bp, Artificial
  CRISPR gRNA sequence
catcagggctggaggagggg

SEQ ID NO: 344493 - DNA, 20 bp, Artificial
  CRISPR gRNA sequence
gggcggtccccaccctatcc

SEQ ID NO: 344494 - DNA, 20 bp, Artificial
  CRISPR gRNA sequence
ggcggtccccaccctatccc

SEQ ID NO: 344495 - DNA, 20 bp, Artificial
  CRISPR gRNA sequence
ccccaccctatcccgggctc

SEQ ID NO: 344496 - DNA, 20 bp, Artificial
  CRISPR gRNA sequence
caccctatcccgggctccag

SEQ ID NO: 344497 - DNA, 20 bp, Artificial
  CRISPR gRNA sequence
ctatcccgggctccagcggt

SEQ ID NO: 344498 - DNA, 20 bp, Artificial
  CRISPR gRNA sequence
cccgggctccagcggtcggc

SEQ ID NO: 344499 - DNA, 20 bp, Artificial
  CRISPR gRNA sequence
ccgggctccagcggtcggca

SEQ ID NO: 344500 - DNA, 20 bp, Artificial
  CRISPR gRNA sequence
ggtcggcaaggttgttccat

SEQ ID NO: 344501 - DNA, 20 bp, Artificial
  CRISPR gRNA sequence
gcaaggttgttccatgagcc

SEQ ID NO: 344502 - DNA, 20 bp, Artificial
  CRISPR gRNA sequence
gttgttccatgagcctggcc

SEQ ID NO: 344503 - DNA, 20 bp, Artificial
  CRISPR gRNA sequence
ttgttccatgagcctggcct

SEQ ID NO: 344504 - DNA, 20 bp, Artificial
  CRISPR gRNA sequence
tgttccatgagcctggcctg

SEQ ID NO: 344505 - DNA, 20 bp, Artificial
  CRISPR gRNA sequence
cccgcttctgtcctctctac

SEQ ID NO: 344506 - DNA, 20 bp, Artificial
  CRISPR gRNA sequence
ccgcttctgtcctctctacc

SEQ ID NO: 344507 - DNA, 20 bp, Artificial
  CRISPR gRNA sequence
tgccgctcctccccattgca

SEQ ID NO: 344508 - DNA, 20 bp, Artificial
  CRISPR gRNA sequence
ccgctcctccccattgcaca

SEQ ID NO: 344509 - DNA, 20 bp, Artificial
  CRISPR gRNA sequence
cgctcctccccattgcacag

SEQ ID NO: 344510 - DNA, 20 bp, Artificial
  CRISPR gRNA sequence
gctcctccccattgcacaga

SEQ ID NO: 344511 - DNA, 20 bp, Artificial
  CRISPR gRNA sequence
tcctccccattgcacagagg

SEQ ID NO: 344512 - DNA, 20 bp, Artificial
  CRISPR gRNA sequence
ccattgcacagagggagatt

SEQ ID NO: 344513 - DNA, 20 bp, Artificial
  CRISPR gRNA sequence
cattgcacagagggagattc

SEQ ID NO: 344514 - DNA, 20 bp, Artificial
  CRISPR gRNA sequence
acagagggagattcaggctg

SEQ ID NO: 344515 - DNA, 20 bp, Artificial
  CRISPR gRNA sequence
cagagggagattcaggctgt

SEQ ID NO: 344516 - DNA, 20 bp, Artificial
  CRISPR gRNA sequence
agagggagattcaggctgtg

SEQ ID NO: 344517 - DNA, 20 bp, Artificial
  CRISPR gRNA sequence
gagattcaggctgtggggcc

SEQ ID NO: 344518 - DNA, 20 bp, Artificial
  CRISPR gRNA sequence
tcaggctgtggggccaagcc

SEQ ID NO: 344519 - DNA, 20 bp, Artificial
  CRISPR gRNA sequence
ggctgtggggccaagcctgg

SEQ ID NO: 344520 - DNA, 20 bp, Artificial
  CRISPR gRNA sequence
ctgtggggccaagcctggca

SEQ ID NO: 344521 - DNA, 20 bp, Artificial
  CRISPR gRNA sequence
gccaagcctggcagagccca

SEQ ID NO: 344522 - DNA, 20 bp, Artificial
  CRISPR gRNA sequence
ccaagcctggcagagcccac

SEQ ID NO: 344523 - DNA, 20 bp, Artificial
  CRISPR gRNA sequence
caagcctggcagagcccaca

SEQ ID NO: 344524 - DNA, 20 bp, Artificial
  CRISPR gRNA sequence
gcctggcagagcccacaggg

SEQ ID NO: 344525 - DNA, 20 bp, Artificial
  CRISPR gRNA sequence
ggcagagcccacagggcagc

SEQ ID NO: 344526 - DNA, 20 bp, Artificial
  CRISPR gRNA sequence
gcagagcccacagggcagcc

SEQ ID NO: 344527 - DNA, 20 bp, Artificial
  CRISPR gRNA sequence
cagagcccacagggcagcca

SEQ ID NO: 344528 - DNA, 20 bp, Artificial
  CRISPR gRNA sequence
aatgcctgtcctgaccccct

SEQ ID NO: 344529 - DNA, 20 bp, Artificial
  CRISPR gRNA sequence
atgcctgtcctgaccccctt

SEQ ID NO: 344530 - DNA, 20 bp, Artificial
  CRISPR gRNA sequence
ggtgctgtatctcaccttcc

SEQ ID NO: 344531 - DNA, 20 bp, Artificial
  CRISPR gRNA sequence
gtgctgtatctcaccttcct

SEQ ID NO: 344532 - DNA, 20 bp, Artificial
  CRISPR gRNA sequence
gctgtatctcaccttcctgg

SEQ ID NO: 344533 - DNA, 20 bp, Artificial
  CRISPR gRNA sequence
gggagccccctgctacgccc

SEQ ID NO: 344534 - DNA, 20 bp, Artificial
  CRISPR gRNA sequence
ccccagctctgccgtcctgc

SEQ ID NO: 344535 - DNA, 20 bp, Artificial
  CRISPR gRNA sequence
cccagctctgccgtcctgca

SEQ ID NO: 344536 - DNA, 20 bp, Artificial
  CRISPR gRNA sequence
cagctctgccgtcctgcaag

SEQ ID NO: 344537 - DNA, 20 bp, Artificial
  CRISPR gRNA sequence
agctctgccgtcctgcaagg

SEQ ID NO: 344538 - DNA, 20 bp, Artificial
  CRISPR gRNA sequence
tgccgtcctgcaaggaggac

SEQ ID NO: 344539 - DNA, 20 bp, Artificial
  CRISPR gRNA sequence
ctgcaaggaggacgagtacc

SEQ ID NO: 344540 - DNA, 20 bp, Artificial
  CRISPR gRNA sequence
caaggaggacgagtacccag

SEQ ID NO: 344541 - DNA, 20 bp, Artificial
  CRISPR gRNA sequence
aaggaggacgagtacccagt

SEQ ID NO: 344542 - DNA, 20 bp, Artificial
  CRISPR gRNA sequence
acgagtacccagtgggctcc

SEQ ID NO: 344543 - DNA, 20 bp, Artificial
  CRISPR gRNA sequence
tgggctccgagtgctgcccc

SEQ ID NO: 344544 - DNA, 20 bp, Artificial
  CRISPR gRNA sequence
tccgagtgctgccccaagtg

SEQ ID NO: 344545 - DNA, 20 bp, Artificial
  CRISPR gRNA sequence
gtgctgccccaagtgcagtc

SEQ ID NO: 344546 - DNA, 20 bp, Artificial
  CRISPR gRNA sequence
tgctgccccaagtgcagtcc

SEQ ID NO: 344547 - DNA, 20 bp, Artificial
  CRISPR gRNA sequence
tgccccaagtgcagtccagg

SEQ ID NO: 344548 - DNA, 20 bp, Artificial
  CRISPR gRNA sequence
gccccaagtgcagtccaggt

SEQ ID NO: 344549 - DNA, 20 bp, Artificial
  CRISPR gRNA sequence
aagtgcagtccaggtaggtg

SEQ ID NO: 344550 - DNA, 20 bp, Artificial
  CRISPR gRNA sequence
tccaggtaggtgcagccctt

SEQ ID NO: 344551 - DNA, 20 bp, Artificial
  CRISPR gRNA sequence
aggtaggtgcagccctttgg

SEQ ID NO: 344552 - DNA, 20 bp, Artificial
  CRISPR gRNA sequence
ggtaggtgcagccctttggc

SEQ ID NO: 344553 - DNA, 20 bp, Artificial
  CRISPR gRNA sequence
ggtgcagccctttggcgggc

SEQ ID NO: 344554 - DNA, 20 bp, Artificial
  CRISPR gRNA sequence
cctttggcgggccagctctg

SEQ ID NO: 344555 - DNA, 20 bp, Artificial
  CRISPR gRNA sequence
ctttggcgggccagctctgt

SEQ ID NO: 344556 - DNA, 20 bp, Artificial
  CRISPR gRNA sequence
gcgggccagctctgtgggcc

SEQ ID NO: 344557 - DNA, 20 bp, Artificial
  CRISPR gRNA sequence
cgggccagctctgtgggccg

SEQ ID NO: 344558 - DNA, 20 bp, Artificial
  CRISPR gRNA sequence
gggccagctctgtgggccga

SEQ ID NO: 344559 - DNA, 20 bp, Artificial
  CRISPR gRNA sequence
ccagctctgtgggccgaggg

SEQ ID NO: 344560 - DNA, 20 bp, Artificial
  CRISPR gRNA sequence
actcttgcccccttctgccc

SEQ ID NO: 344561 - DNA, 20 bp, Artificial
  CRISPR gRNA sequence
ccctgtgttctctgccccca

SEQ ID NO: 344562 - DNA, 20 bp, Artificial
  CRISPR gRNA sequence
gttctctgcccccacagcca

SEQ ID NO: 344563 - DNA, 20 bp, Artificial
  CRISPR gRNA sequence
ttctctgcccccacagccat

SEQ ID NO: 344564 - DNA, 20 bp, Artificial
  CRISPR gRNA sequence
ccacagccatgggtgtgatg

SEQ ID NO: 344565 - DNA, 20 bp, Artificial
  CRISPR gRNA sequence
ccatgggtgtgatgaagccc

SEQ ID NO: 344566 - DNA, 20 bp, Artificial
  CRISPR gRNA sequence
catgggtgtgatgaagccct

SEQ ID NO: 344567 - DNA, 20 bp, Artificial
  CRISPR gRNA sequence
atgggtgtgatgaagccctg

SEQ ID NO: 344568 - DNA, 20 bp, Artificial
  CRISPR gRNA sequence
gtgtgatgaagccctggggc

SEQ ID NO: 344569 - DNA, 20 bp, Artificial
  CRISPR gRNA sequence
tgtgatgaagccctggggct

SEQ ID NO: 344570 - DNA, 20 bp, Artificial
  CRISPR gRNA sequence
aagccctggggctaggtgtg

SEQ ID NO: 344571 - DNA, 20 bp, Artificial
  CRISPR gRNA sequence
cctggggctaggtgtgcaga

SEQ ID NO: 344572 - DNA, 20 bp, Artificial
  CRISPR gRNA sequence
gggctaggtgtgcagacagt

SEQ ID NO: 344573 - DNA, 20 bp, Artificial
  CRISPR gRNA sequence
ggctaggtgtgcagacagtg

SEQ ID NO: 344574 - DNA, 20 bp, Artificial
  CRISPR gRNA sequence
gctaggtgtgcagacagtga

SEQ ID NO: 344575 - DNA, 20 bp, Artificial
  CRISPR gRNA sequence
aggtgtgcagacagtgaggg

SEQ ID NO: 344576 - DNA, 20 bp, Artificial
  CRISPR gRNA sequence
gacagtgagggcagaacccc

SEQ ID NO: 344577 - DNA, 20 bp, Artificial
  CRISPR gRNA sequence
acagtgagggcagaaccccc

SEQ ID NO: 344578 - DNA, 20 bp, Artificial
  CRISPR gRNA sequence
tgagggcagaacccccaggc

SEQ ID NO: 344579 - DNA, 20 bp, Artificial
  CRISPR gRNA sequence
gggcagaacccccaggccag

SEQ ID NO: 344580 - DNA, 20 bp, Artificial
  CRISPR gRNA sequence
gaacccccaggccagcagct

SEQ ID NO: 344581 - DNA, 20 bp, Artificial
  CRISPR gRNA sequence
gcagcttggactcttcaccc

SEQ ID NO: 344582 - DNA, 20 bp, Artificial
  CRISPR gRNA sequence
cagcttggactcttcaccct

SEQ ID NO: 344583 - DNA, 20 bp, Artificial
  CRISPR gRNA sequence
agcttggactcttcaccctg

SEQ ID NO: 344584 - DNA, 20 bp, Artificial
  CRISPR gRNA sequence
gcttggactcttcaccctgg

SEQ ID NO: 344585 - DNA, 20 bp, Artificial
  CRISPR gRNA sequence
ttcaccctgggggaccctca

SEQ ID NO: 344586 - DNA, 20 bp, Artificial
  CRISPR gRNA sequence
accctcacagtcacactgca

SEQ ID NO: 344587 - DNA, 20 bp, Artificial
  CRISPR gRNA sequence
ccctcacagtcacactgcac

SEQ ID NO: 344588 - DNA, 20 bp, Artificial
  CRISPR gRNA sequence
cctcacagtcacactgcaca

SEQ ID NO: 344589 - DNA, 20 bp, Artificial
  CRISPR gRNA sequence
ctcacagtcacactgcacag

SEQ ID NO: 344590 - DNA, 20 bp, Artificial
  CRISPR gRNA sequence
tcacagtcacactgcacagg

SEQ ID NO: 344591 - DNA, 20 bp, Artificial
  CRISPR gRNA sequence
cagtcacactgcacaggggg

SEQ ID NO: 344592 - DNA, 20 bp, Artificial
  CRISPR gRNA sequence
agtcacactgcacagggggt

SEQ ID NO: 344593 - DNA, 20 bp, Artificial
  CRISPR gRNA sequence
actgcacagggggtgggtct

SEQ ID NO: 344594 - DNA, 20 bp, Artificial
  CRISPR gRNA sequence
tgcacagggggtgggtctga

SEQ ID NO: 344595 - DNA, 20 bp, Artificial
  CRISPR gRNA sequence
gggggtgggtctgagagacg

SEQ ID NO: 344596 - DNA, 20 bp, Artificial
  CRISPR gRNA sequence
gtgggtctgagagacgtggc

SEQ ID NO: 344597 - DNA, 20 bp, Artificial
  CRISPR gRNA sequence
gagacgtggctggcccaccg

SEQ ID NO: 344598 - DNA, 20 bp, Artificial
  CRISPR gRNA sequence
cgtggctggcccaccgtggc

SEQ ID NO: 344599 - DNA, 20 bp, Artificial
  CRISPR gRNA sequence
tggctggcccaccgtggcca

SEQ ID NO: 344600 - DNA, 20 bp, Artificial
  CRISPR gRNA sequence
gcccaccgtggccagagaca

SEQ ID NO: 344601 - DNA, 20 bp, Artificial
  CRISPR gRNA sequence
cccaccgtggccagagacat

SEQ ID NO: 344602 - DNA, 20 bp, Artificial
  CRISPR gRNA sequence
cgtggccagagacatgggct

SEQ ID NO: 344603 - DNA, 20 bp, Artificial
  CRISPR gRNA sequence
gtggccagagacatgggctc

SEQ ID NO: 344604 - DNA, 20 bp, Artificial
  CRISPR gRNA sequence
tggccagagacatgggctcg

SEQ ID NO: 344605 - DNA, 20 bp, Artificial
  CRISPR gRNA sequence
ggccagagacatgggctcgg

SEQ ID NO: 344606 - DNA, 20 bp, Artificial
  CRISPR gRNA sequence
atgggctcgggggcacatac

SEQ ID NO: 344607 - DNA, 20 bp, Artificial
  CRISPR gRNA sequence
gggctcgggggcacatacca

SEQ ID NO: 344608 - DNA, 20 bp, Artificial
  CRISPR gRNA sequence
tcgggggcacataccagagc

SEQ ID NO: 344609 - DNA, 20 bp, Artificial
  CRISPR gRNA sequence
cgggggcacataccagagcc

SEQ ID NO: 344610 - DNA, 20 bp, Artificial
  CRISPR gRNA sequence
ggcacataccagagccgggc

SEQ ID NO: 344611 - DNA, 20 bp, Artificial
  CRISPR gRNA sequence
gcacataccagagccgggcc

SEQ ID NO: 344612 - DNA, 20 bp, Artificial
  CRISPR gRNA sequence
cagagccgggccaggtgtcc

SEQ ID NO: 344613 - DNA, 20 bp, Artificial
  CRISPR gRNA sequence
agagccgggccaggtgtccc

SEQ ID NO: 344614 - DNA, 20 bp, Artificial
  CRISPR gRNA sequence
agccgggccaggtgtcccag

SEQ ID NO: 344615 - DNA, 20 bp, Artificial
  CRISPR gRNA sequence
gccgggccaggtgtcccagg

SEQ ID NO: 344616 - DNA, 20 bp, Artificial
  CRISPR gRNA sequence
caggaggccccatgtgcttc

SEQ ID NO: 344617 - DNA, 20 bp, Artificial
  CRISPR gRNA sequence
cagaactttccgattttccc

SEQ ID NO: 344618 - DNA, 20 bp, Artificial
  CRISPR gRNA sequence
gaactttccgattttcccca

SEQ ID NO: 344619 - DNA, 20 bp, Artificial
  CRISPR gRNA sequence
ctttccgattttccccagag

SEQ ID NO: 344620 - DNA, 20 bp, Artificial
  CRISPR gRNA sequence
ccccagagcagctctgctca

SEQ ID NO: 344621 - DNA, 20 bp, Artificial
  CRISPR gRNA sequence
gcagctctgctcatggctga

SEQ ID NO: 344622 - DNA, 20 bp, Artificial
  CRISPR gRNA sequence
cagctctgctcatggctgat

SEQ ID NO: 344623 - DNA, 20 bp, Artificial
  CRISPR gRNA sequence
agctctgctcatggctgatg

SEQ ID NO: 344624 - DNA, 20 bp, Artificial
  CRISPR gRNA sequence
gatggggctgctgtgtcccg

SEQ ID NO: 344625 - DNA, 20 bp, Artificial
  CRISPR gRNA sequence
atggggctgctgtgtcccgt

SEQ ID NO: 344626 - DNA, 20 bp, Artificial
  CRISPR gRNA sequence
tggggctgctgtgtcccgtg

SEQ ID NO: 344627 - DNA, 20 bp, Artificial
  CRISPR gRNA sequence
gctgtgtcccgtggggctca

SEQ ID NO: 344628 - DNA, 20 bp, Artificial
  CRISPR gRNA sequence
ctgtgtcccgtggggctcat

SEQ ID NO: 344629 - DNA, 20 bp, Artificial
  CRISPR gRNA sequence
gtggggctcatgggccattt

SEQ ID NO: 344630 - DNA, 20 bp, Artificial
  CRISPR gRNA sequence
atgggccatttgagtcccct

SEQ ID NO: 344631 - DNA, 20 bp, Artificial
  CRISPR gRNA sequence
gccatttgagtccccttagc

SEQ ID NO: 344632 - DNA, 20 bp, Artificial
  CRISPR gRNA sequence
ttagctggtgtctccctgct

SEQ ID NO: 344633 - DNA, 20 bp, Artificial
  CRISPR gRNA sequence
tagctggtgtctccctgctt

SEQ ID NO: 344634 - DNA, 20 bp, Artificial
  CRISPR gRNA sequence
gtgtctccctgcttgggctc

SEQ ID NO: 344635 - DNA, 20 bp, Artificial
  CRISPR gRNA sequence
tgtctccctgcttgggctct

SEQ ID NO: 344636 - DNA, 20 bp, Artificial
  CRISPR gRNA sequence
ccctgcttgggctctgggcg

SEQ ID NO: 344637 - DNA, 20 bp, Artificial
  CRISPR gRNA sequence
cctgcttgggctctgggcgc

SEQ ID NO: 344638 - DNA, 20 bp, Artificial
  CRISPR gRNA sequence
gcttgggctctgggcgcggg

SEQ ID NO: 344639 - DNA, 20 bp, Artificial
  CRISPR gRNA sequence
ttgggctctgggcgcgggtg

SEQ ID NO: 344640 - DNA, 20 bp, Artificial
  CRISPR gRNA sequence
tctgggcgcgggtggagtga

SEQ ID NO: 344641 - DNA, 20 bp, Artificial
  CRISPR gRNA sequence
ctgggcgcgggtggagtgat

SEQ ID NO: 344642 - DNA, 20 bp, Artificial
  CRISPR gRNA sequence
ggcgcgggtggagtgatggg

SEQ ID NO: 344643 - DNA, 20 bp, Artificial
  CRISPR gRNA sequence
gcgcgggtggagtgatgggt

SEQ ID NO: 344644 - DNA, 20 bp, Artificial
  CRISPR gRNA sequence
gagtgatgggtgggctcccg

SEQ ID NO: 344645 - DNA, 20 bp, Artificial
  CRISPR gRNA sequence
agtgatgggtgggctcccga

SEQ ID NO: 344646 - DNA, 20 bp, Artificial
  CRISPR gRNA sequence
gtgatgggtgggctcccgaa

SEQ ID NO: 344647 - DNA, 20 bp, Artificial
  CRISPR gRNA sequence
tgatgggtgggctcccgaag

SEQ ID NO: 344648 - DNA, 20 bp, Artificial
  CRISPR gRNA sequence
gctcccgaaggggcctcccg

SEQ ID NO: 344649 - DNA, 20 bp, Artificial
  CRISPR gRNA sequence
gggcctcccgcagacttgcg

SEQ ID NO: 344650 - DNA, 20 bp, Artificial
  CRISPR gRNA sequence
cttgcgaagttcccactctc

SEQ ID NO: 344651 - DNA, 20 bp, Artificial
  CRISPR gRNA sequence
ttgcgaagttcccactctct

SEQ ID NO: 344652 - DNA, 20 bp, Artificial
  CRISPR gRNA sequence
cgaagttcccactctctggg

SEQ ID NO: 344653 - DNA, 20 bp, Artificial
  CRISPR gRNA sequence
agttcccactctctgggcgg

SEQ ID NO: 344654 - DNA, 20 bp, Artificial
  CRISPR gRNA sequence
gttcccactctctgggcggc

SEQ ID NO: 344655 - DNA, 20 bp, Artificial
  CRISPR gRNA sequence
gggcggcaggttatcgtgtg

SEQ ID NO: 344656 - DNA, 20 bp, Artificial
  CRISPR gRNA sequence
ggcggcaggttatcgtgtga

SEQ ID NO: 344657 - DNA, 20 bp, Artificial
  CRISPR gRNA sequence
cggcaggttatcgtgtgaag

SEQ ID NO: 344658 - DNA, 20 bp, Artificial
  CRISPR gRNA sequence
ggcaggttatcgtgtgaagg

SEQ ID NO: 344659 - DNA, 20 bp, Artificial
  CRISPR gRNA sequence
tatcgtgtgaaggaggcctg

SEQ ID NO: 344660 - DNA, 20 bp, Artificial
  CRISPR gRNA sequence
atcgtgtgaaggaggcctgc

SEQ ID NO: 344661 - DNA, 20 bp, Artificial
  CRISPR gRNA sequence
tcgtgtgaaggaggcctgcg

SEQ ID NO: 344662 - DNA, 20 bp, Artificial
  CRISPR gRNA sequence
gtgtgaaggaggcctgcggg

SEQ ID NO: 344663 - DNA, 20 bp, Artificial
  CRISPR gRNA sequence
ggaggcctgcggggagctga

SEQ ID NO: 344664 - DNA, 20 bp, Artificial
  CRISPR gRNA sequence
gaggcctgcggggagctgac

SEQ ID NO: 344665 - DNA, 20 bp, Artificial
  CRISPR gRNA sequence
ctgcggggagctgacgggca

SEQ ID NO: 344666 - DNA, 20 bp, Artificial
  CRISPR gRNA sequence
agtgtgtgaaccctgccctc

SEQ ID NO: 344667 - DNA, 20 bp, Artificial
  CRISPR gRNA sequence
gtgtgtgaaccctgccctcc

SEQ ID NO: 344668 - DNA, 20 bp, Artificial
  CRISPR gRNA sequence
acctacattgcccacctcaa

SEQ ID NO: 344669 - DNA, 20 bp, Artificial
  CRISPR gRNA sequence
attgcccacctcaatggcct

SEQ ID NO: 344670 - DNA, 20 bp, Artificial
  CRISPR gRNA sequence
cccacctcaatggcctaagc

SEQ ID NO: 344671 - DNA, 20 bp, Artificial
  CRISPR gRNA sequence
atggcctaagcaagtgtctg

SEQ ID NO: 344672 - DNA, 20 bp, Artificial
  CRISPR gRNA sequence
gcagtgccaaatgtgtgacc

SEQ ID NO: 344673 - DNA, 20 bp, Artificial
  CRISPR gRNA sequence
cagtgccaaatgtgtgaccc

SEQ ID NO: 344674 - DNA, 20 bp, Artificial
  CRISPR gRNA sequence
gccaaatgtgtgacccaggt

SEQ ID NO: 344675 - DNA, 20 bp, Artificial
  CRISPR gRNA sequence
caaatgtgtgacccaggtaa

SEQ ID NO: 344676 - DNA, 20 bp, Artificial
  CRISPR gRNA sequence
aaatgtgtgacccaggtaag

SEQ ID NO: 344677 - DNA, 20 bp, Artificial
  CRISPR gRNA sequence
gtgtgacccaggtaagaggc

SEQ ID NO: 344678 - DNA, 20 bp, Artificial
  CRISPR gRNA sequence
acccaggtaagaggccagca

SEQ ID NO: 344679 - DNA, 20 bp, Artificial
  CRISPR gRNA sequence
aggtaagaggccagcacagc

SEQ ID NO: 344680 - DNA, 20 bp, Artificial
  CRISPR gRNA sequence
agaggccagcacagccggcc

SEQ ID NO: 344681 - DNA, 20 bp, Artificial
  CRISPR gRNA sequence
cagccggcccagcctccgct

SEQ ID NO: 344682 - DNA, 20 bp, Artificial
  CRISPR gRNA sequence
agccggcccagcctccgctt

SEQ ID NO: 344683 - DNA, 20 bp, Artificial
  CRISPR gRNA sequence
cggcccagcctccgcttggg

SEQ ID NO: 344684 - DNA, 20 bp, Artificial
  CRISPR gRNA sequence
cagcctccgcttgggcagcc

SEQ ID NO: 344685 - DNA, 20 bp, Artificial
  CRISPR gRNA sequence
caccctgcaccctctctcca

SEQ ID NO: 344686 - DNA, 20 bp, Artificial
  CRISPR gRNA sequence
gcaccctctctccatggcca

SEQ ID NO: 344687 - DNA, 20 bp, Artificial
  CRISPR gRNA sequence
tctccatggccacagtgccc

SEQ ID NO: 344688 - DNA, 20 bp, Artificial
  CRISPR gRNA sequence
ctccatggccacagtgcccc

SEQ ID NO: 344689 - DNA, 20 bp, Artificial
  CRISPR gRNA sequence
catggccacagtgccccagg

SEQ ID NO: 344690 - DNA, 20 bp, Artificial
  CRISPR gRNA sequence
atggccacagtgccccagga

SEQ ID NO: 344691 - DNA, 20 bp, Artificial
  CRISPR gRNA sequence
acagtgccccaggaaggccc

SEQ ID NO: 344692 - DNA, 20 bp, Artificial
  CRISPR gRNA sequence
caggaaggccccggctgccc

SEQ ID NO: 344693 - DNA, 20 bp, Artificial
  CRISPR gRNA sequence
aggaaggccccggctgcccc

SEQ ID NO: 344694 - DNA, 20 bp, Artificial
  CRISPR gRNA sequence
aggccccggctgccccaggc

SEQ ID NO: 344695 - DNA, 20 bp, Artificial
  CRISPR gRNA sequence
ggccccggctgccccaggcc

SEQ ID NO: 344696 - DNA, 20 bp, Artificial
  CRISPR gRNA sequence
aggtcccaaccccatctcca

SEQ ID NO: 344697 - DNA, 20 bp, Artificial
  CRISPR gRNA sequence
atctccatggatgcaccctg

SEQ ID NO: 344698 - DNA, 20 bp, Artificial
  CRISPR gRNA sequence
tctccatggatgcaccctgc

SEQ ID NO: 344699 - DNA, 20 bp, Artificial
  CRISPR gRNA sequence
ctccatggatgcaccctgca

SEQ ID NO: 344700 - DNA, 20 bp, Artificial
  CRISPR gRNA sequence
tccatggatgcaccctgcag

SEQ ID NO: 344701 - DNA, 20 bp, Artificial
  CRISPR gRNA sequence
caccctgcaggggacgcctt

SEQ ID NO: 344702 - DNA, 20 bp, Artificial
  CRISPR gRNA sequence
accctgcaggggacgccttg

SEQ ID NO: 344703 - DNA, 20 bp, Artificial
  CRISPR gRNA sequence
tgcaggggacgccttgaggt

SEQ ID NO: 344704 - DNA, 20 bp, Artificial
  CRISPR gRNA sequence
gacgccttgaggtcagcctc

SEQ ID NO: 344705 - DNA, 20 bp, Artificial
  CRISPR gRNA sequence
acctctcactttgtcaccgc

SEQ ID NO: 344706 - DNA, 20 bp, Artificial
  CRISPR gRNA sequence
cctctcactttgtcaccgcc

SEQ ID NO: 344707 - DNA, 20 bp, Artificial
  CRISPR gRNA sequence
ctcactttgtcaccgccagg

SEQ ID NO: 344708 - DNA, 20 bp, Artificial
  CRISPR gRNA sequence
tcactttgtcaccgccaggt

SEQ ID NO: 344709 - DNA, 20 bp, Artificial
  CRISPR gRNA sequence
accgccaggtgggccatcct

SEQ ID NO: 344710 - DNA, 20 bp, Artificial
  CRISPR gRNA sequence
caggtgggccatcctgagct

SEQ ID NO: 344711 - DNA, 20 bp, Artificial
  CRISPR gRNA sequence
tgacccttatccctcgtcct

SEQ ID NO: 344712 - DNA, 20 bp, Artificial
  CRISPR gRNA sequence
tccctcgtccttggctcctc

SEQ ID NO: 344713 - DNA, 20 bp, Artificial
  CRISPR gRNA sequence
tccttggctcctctggtgcc

SEQ ID NO: 344714 - DNA, 20 bp, Artificial
  CRISPR gRNA sequence
ccttggctcctctggtgccc

SEQ ID NO: 344715 - DNA, 20 bp, Artificial
  CRISPR gRNA sequence
cttggctcctctggtgcccg

SEQ ID NO: 344716 - DNA, 20 bp, Artificial
  CRISPR gRNA sequence
ggctcctctggtgcccgggg

SEQ ID NO: 344717 - DNA, 20 bp, Artificial
  CRISPR gRNA sequence
gctcctctggtgcccggggt

SEQ ID NO: 344718 - DNA, 20 bp, Artificial
  CRISPR gRNA sequence
tggtgcccggggtgggtgcc

SEQ ID NO: 344719 - DNA, 20 bp, Artificial
  CRISPR gRNA sequence
ctctcctgtgcccacgtccc

SEQ ID NO: 344720 - DNA, 20 bp, Artificial
  CRISPR gRNA sequence
tgcccacgtccctagctgca

SEQ ID NO: 344721 - DNA, 20 bp, Artificial
  CRISPR gRNA sequence
ccacgtccctagctgcaaag

SEQ ID NO: 344722 - DNA, 20 bp, Artificial
  CRISPR gRNA sequence
tccctagctgcaaagtggaa

SEQ ID NO: 344723 - DNA, 20 bp, Artificial
  CRISPR gRNA sequence
ccctagctgcaaagtggaat

SEQ ID NO: 344724 - DNA, 20 bp, Artificial
  CRISPR gRNA sequence
agctgcaaagtggaatggga

SEQ ID NO: 344725 - DNA, 20 bp, Artificial
  CRISPR gRNA sequence
aaagtggaatgggatggtgc

SEQ ID NO: 344726 - DNA, 20 bp, Artificial
  CRISPR gRNA sequence
aagtggaatgggatggtgct

SEQ ID NO: 344727 - DNA, 20 bp, Artificial
  CRISPR gRNA sequence
gggatggtgctgggactctc

SEQ ID NO: 344728 - DNA, 20 bp, Artificial
  CRISPR gRNA sequence
tggtgctgggactctccggc

SEQ ID NO: 344729 - DNA, 20 bp, Artificial
  CRISPR gRNA sequence
gggactctccggccggcact

SEQ ID NO: 344730 - DNA, 20 bp, Artificial
  CRISPR gRNA sequence
ggactctccggccggcactc

SEQ ID NO: 344731 - DNA, 20 bp, Artificial
  CRISPR gRNA sequence
tcgggcctgctgcttcccca

SEQ ID NO: 344732 - DNA, 20 bp, Artificial
  CRISPR gRNA sequence
cgggcctgctgcttccccac

SEQ ID NO: 344733 - DNA, 20 bp, Artificial
  CRISPR gRNA sequence
gggcctgctgcttccccaca

SEQ ID NO: 344734 - DNA, 20 bp, Artificial
  CRISPR gRNA sequence
cttcttgtccctttctcctc

SEQ ID NO: 344735 - DNA, 20 bp, Artificial
  CRISPR gRNA sequence
tccctttctcctccagatat

SEQ ID NO: 344736 - DNA, 20 bp, Artificial
  CRISPR gRNA sequence
attggttccccctgtgacct

SEQ ID NO: 344737 - DNA, 20 bp, Artificial
  CRISPR gRNA sequence
ttggttccccctgtgacctc

SEQ ID NO: 344738 - DNA, 20 bp, Artificial
  CRISPR gRNA sequence
tggttccccctgtgacctca

SEQ ID NO: 344739 - DNA, 20 bp, Artificial
  CRISPR gRNA sequence
ggttccccctgtgacctcag

SEQ ID NO: 344740 - DNA, 20 bp, Artificial
  CRISPR gRNA sequence
tccccctgtgacctcagggg

SEQ ID NO: 344741 - DNA, 20 bp, Artificial
  CRISPR gRNA sequence
cccctgtgacctcaggggaa

SEQ ID NO: 344742 - DNA, 20 bp, Artificial
  CRISPR gRNA sequence
ccctgtgacctcaggggaag

SEQ ID NO: 344743 - DNA, 20 bp, Artificial
  CRISPR gRNA sequence
cctcaggggaagaggtcacc

SEQ ID NO: 344744 - DNA, 20 bp, Artificial
  CRISPR gRNA sequence
tcaggggaagaggtcacctg

SEQ ID NO: 344745 - DNA, 20 bp, Artificial
  CRISPR gRNA sequence
caggggaagaggtcacctgg

SEQ ID NO: 344746 - DNA, 20 bp, Artificial
  CRISPR gRNA sequence
ggaagaggtcacctggaggc

SEQ ID NO: 344747 - DNA, 20 bp, Artificial
  CRISPR gRNA sequence
ctggaggctggtgcccacct

SEQ ID NO: 344748 - DNA, 20 bp, Artificial
  CRISPR gRNA sequence
ggctggtgcccacctgagtc

SEQ ID NO: 344749 - DNA, 20 bp, Artificial
  CRISPR gRNA sequence
gctggtgcccacctgagtcc

SEQ ID NO: 344750 - DNA, 20 bp, Artificial
  CRISPR gRNA sequence
ggtgcccacctgagtccagg

SEQ ID NO: 344751 - DNA, 20 bp, Artificial
  CRISPR gRNA sequence
cccacctgagtccaggcaga

SEQ ID NO: 344752 - DNA, 20 bp, Artificial
  CRISPR gRNA sequence
cctgagtccaggcagacaga

SEQ ID NO: 344753 - DNA, 20 bp, Artificial
  CRISPR gRNA sequence
ctgagtccaggcagacagaa

SEQ ID NO: 344754 - DNA, 20 bp, Artificial
  CRISPR gRNA sequence
tgagtccaggcagacagaaa

SEQ ID NO: 344755 - DNA, 20 bp, Artificial
  CRISPR gRNA sequence
gagtccaggcagacagaaag

SEQ ID NO: 344756 - DNA, 20 bp, Artificial
  CRISPR gRNA sequence
aggcagacagaaaggggaac

SEQ ID NO: 344757 - DNA, 20 bp, Artificial
  CRISPR gRNA sequence
acagaaaggggaaccagacc

SEQ ID NO: 344758 - DNA, 20 bp, Artificial
  CRISPR gRNA sequence
agaaaggggaaccagaccca

SEQ ID NO: 344759 - DNA, 20 bp, Artificial
  CRISPR gRNA sequence
gaaaggggaaccagacccag

SEQ ID NO: 344760 - DNA, 20 bp, Artificial
  CRISPR gRNA sequence
aggggaaccagacccagagg

SEQ ID NO: 344761 - DNA, 20 bp, Artificial
  CRISPR gRNA sequence
cagacccagaggtggccttt

SEQ ID NO: 344762 - DNA, 20 bp, Artificial
  CRISPR gRNA sequence
gaggtggcctttgagtcact

SEQ ID NO: 344763 - DNA, 20 bp, Artificial
  CRISPR gRNA sequence
ggcctttgagtcactgagcg

SEQ ID NO: 344764 - DNA, 20 bp, Artificial
  CRISPR gRNA sequence
cctttgagtcactgagcgca

SEQ ID NO: 344765 - DNA, 20 bp, Artificial
  CRISPR gRNA sequence
gagcgcagagcctgtccatg

SEQ ID NO: 344766 - DNA, 20 bp, Artificial
  CRISPR gRNA sequence
gagcctgtccatgcggccaa

SEQ ID NO: 344767 - DNA, 20 bp, Artificial
  CRISPR gRNA sequence
ggccaacggctctgtcccct

SEQ ID NO: 344768 - DNA, 20 bp, Artificial
  CRISPR gRNA sequence
ccaacggctctgtccccttg

SEQ ID NO: 344769 - DNA, 20 bp, Artificial
  CRISPR gRNA sequence
gtccccttggagcctcatgc

SEQ ID NO: 344770 - DNA, 20 bp, Artificial
  CRISPR gRNA sequence
tccccttggagcctcatgcc

SEQ ID NO: 344771 - DNA, 20 bp, Artificial
  CRISPR gRNA sequence
ttggagcctcatgccaggct

SEQ ID NO: 344772 - DNA, 20 bp, Artificial
  CRISPR gRNA sequence
gcctcatgccaggctcagca

SEQ ID NO: 344773 - DNA, 20 bp, Artificial
  CRISPR gRNA sequence
catgccaggctcagcatggc

SEQ ID NO: 344774 - DNA, 20 bp, Artificial
  CRISPR gRNA sequence
agcatggccagtgctccctg

SEQ ID NO: 344775 - DNA, 20 bp, Artificial
  CRISPR gRNA sequence
tggccagtgctccctgcggc

SEQ ID NO: 344776 - DNA, 20 bp, Artificial
  CRISPR gRNA sequence
ggccagtgctccctgcggcc

SEQ ID NO: 344777 - DNA, 20 bp, Artificial
  CRISPR gRNA sequence
cagtgctccctgcggccagg

SEQ ID NO: 344778 - DNA, 20 bp, Artificial
  CRISPR gRNA sequence
agtgctccctgcggccaggc

SEQ ID NO: 344779 - DNA, 20 bp, Artificial
  CRISPR gRNA sequence
gccaggcaggactgcacctg

SEQ ID NO: 344780 - DNA, 20 bp, Artificial
  CRISPR gRNA sequence
ccaggcaggactgcacctgc

SEQ ID NO: 344781 - DNA, 20 bp, Artificial
  CRISPR gRNA sequence
gcaggactgcacctgcggga

SEQ ID NO: 344782 - DNA, 20 bp, Artificial
  CRISPR gRNA sequence
caggactgcacctgcgggac

SEQ ID NO: 344783 - DNA, 20 bp, Artificial
  CRISPR gRNA sequence
aggactgcacctgcgggaca

SEQ ID NO: 344784 - DNA, 20 bp, Artificial
  CRISPR gRNA sequence
cacctgcgggacagggctga

SEQ ID NO: 344785 - DNA, 20 bp, Artificial
  CRISPR gRNA sequence
gacagggctgacggcacacc

SEQ ID NO: 344786 - DNA, 20 bp, Artificial
  CRISPR gRNA sequence
acagggctgacggcacacct

SEQ ID NO: 344787 - DNA, 20 bp, Artificial
  CRISPR gRNA sequence
cagggctgacggcacacctg

SEQ ID NO: 344788 - DNA, 20 bp, Artificial
  CRISPR gRNA sequence
agggctgacggcacacctgg

SEQ ID NO: 344789 - DNA, 20 bp, Artificial
  CRISPR gRNA sequence
gctgacggcacacctggggg

SEQ ID NO: 344790 - DNA, 20 bp, Artificial
  CRISPR gRNA sequence
ctgacggcacacctgggggc

SEQ ID NO: 344791 - DNA, 20 bp, Artificial
  CRISPR gRNA sequence
tgacggcacacctgggggca

SEQ ID NO: 344792 - DNA, 20 bp, Artificial
  CRISPR gRNA sequence
cacacctgggggcagggcct

SEQ ID NO: 344793 - DNA, 20 bp, Artificial
  CRISPR gRNA sequence
gggggcagggcctgagccta

SEQ ID NO: 344794 - DNA, 20 bp, Artificial
  CRISPR gRNA sequence
ggggcagggcctgagcctac

SEQ ID NO: 344795 - DNA, 20 bp, Artificial
  CRISPR gRNA sequence
gggcagggcctgagcctaca

SEQ ID NO: 344796 - DNA, 20 bp, Artificial
  CRISPR gRNA sequence
gcagggcctgagcctacagg

SEQ ID NO: 344797 - DNA, 20 bp, Artificial
  CRISPR gRNA sequence
cagggcctgagcctacaggg

SEQ ID NO: 344798 - DNA, 20 bp, Artificial
  CRISPR gRNA sequence
cctgagcctacagggaggca

SEQ ID NO: 344799 - DNA, 20 bp, Artificial
  CRISPR gRNA sequence
ctgagcctacagggaggcac

SEQ ID NO: 344800 - DNA, 20 bp, Artificial
  CRISPR gRNA sequence
tgagcctacagggaggcaca

SEQ ID NO: 344801 - DNA, 20 bp, Artificial
  CRISPR gRNA sequence
gcctacagggaggcacaggg

SEQ ID NO: 344802 - DNA, 20 bp, Artificial
  CRISPR gRNA sequence
cctacagggaggcacagggc

SEQ ID NO: 344803 - DNA, 20 bp, Artificial
  CRISPR gRNA sequence
acagggaggcacagggcagg

SEQ ID NO: 344804 - DNA, 20 bp, Artificial
  CRISPR gRNA sequence
cagggaggcacagggcaggt

SEQ ID NO: 344805 - DNA, 20 bp, Artificial
  CRISPR gRNA sequence
gaggcacagggcaggtgggc

SEQ ID NO: 344806 - DNA, 20 bp, Artificial
  CRISPR gRNA sequence
gcaggtgggctagccatgaa

SEQ ID NO: 344807 - DNA, 20 bp, Artificial
  CRISPR gRNA sequence
ggtgggctagccatgaacag

SEQ ID NO: 344808 - DNA, 20 bp, Artificial
  CRISPR gRNA sequence
tgggctagccatgaacagaa

SEQ ID NO: 344809 - DNA, 20 bp, Artificial
  CRISPR gRNA sequence
gggctagccatgaacagaag

SEQ ID NO: 344810 - DNA, 20 bp, Artificial
  CRISPR gRNA sequence
ctagccatgaacagaagagg

SEQ ID NO: 344811 - DNA, 20 bp, Artificial
  CRISPR gRNA sequence
ccatgaacagaagaggaagc

SEQ ID NO: 344812 - DNA, 20 bp, Artificial
  CRISPR gRNA sequence
atgaacagaagaggaagctg

SEQ ID NO: 344813 - DNA, 20 bp, Artificial
  CRISPR gRNA sequence
aagaggaagctggagtgctt

SEQ ID NO: 344814 - DNA, 20 bp, Artificial
  CRISPR gRNA sequence
agaggaagctggagtgcttt

SEQ ID NO: 344815 - DNA, 20 bp, Artificial
  CRISPR gRNA sequence
gaggaagctggagtgctttg

SEQ ID NO: 344816 - DNA, 20 bp, Artificial
  CRISPR gRNA sequence
aggaagctggagtgctttgg

SEQ ID NO: 344817 - DNA, 20 bp, Artificial
  CRISPR gRNA sequence
gctttgggggttcatgcatg

SEQ ID NO: 344818 - DNA, 20 bp, Artificial
  CRISPR gRNA sequence
ctttgggggttcatgcatgt

SEQ ID NO: 344819 - DNA, 20 bp, Artificial
  CRISPR gRNA sequence
gggggttcatgcatgtaggc

SEQ ID NO: 344820 - DNA, 20 bp, Artificial
  CRISPR gRNA sequence
ggggttcatgcatgtaggct

SEQ ID NO: 344821 - DNA, 20 bp, Artificial
  CRISPR gRNA sequence
catgcatgtaggctgggatt

SEQ ID NO: 344822 - DNA, 20 bp, Artificial
  CRISPR gRNA sequence
atgcatgtaggctgggattt

SEQ ID NO: 344823 - DNA, 20 bp, Artificial
  CRISPR gRNA sequence
tgcatgtaggctgggatttg

SEQ ID NO: 344824 - DNA, 20 bp, Artificial
  CRISPR gRNA sequence
cacacctcaacctgcatgcc

SEQ ID NO: 344825 - DNA, 20 bp, Artificial
  CRISPR gRNA sequence
atgcccctcccctcttgtga

SEQ ID NO: 344826 - DNA, 20 bp, Artificial
  CRISPR gRNA sequence
tgtgaaagcacctgtctact

SEQ ID NO: 344827 - DNA, 20 bp, Artificial
  CRISPR gRNA sequence
gtgaaagcacctgtctactt

SEQ ID NO: 344828 - DNA, 20 bp, Artificial
  CRISPR gRNA sequence
agcacctgtctacttgggct

SEQ ID NO: 344829 - DNA, 20 bp, Artificial
  CRISPR gRNA sequence
gcacctgtctacttgggctg

SEQ ID NO: 344830 - DNA, 20 bp, Artificial
  CRISPR gRNA sequence
gtctacttgggctgaggatg

SEQ ID NO: 344831 - DNA, 20 bp, Artificial
  CRISPR gRNA sequence
tctacttgggctgaggatgt

SEQ ID NO: 344832 - DNA, 20 bp, Artificial
  CRISPR gRNA sequence
ctacttgggctgaggatgtg

SEQ ID NO: 344833 - DNA, 20 bp, Artificial
  CRISPR gRNA sequence
tacttgggctgaggatgtgg

SEQ ID NO: 344834 - DNA, 20 bp, Artificial
  CRISPR gRNA sequence
gggctgaggatgtgggggca

SEQ ID NO: 344835 - DNA, 20 bp, Artificial
  CRISPR gRNA sequence
ggctgaggatgtgggggcac

SEQ ID NO: 344836 - DNA, 20 bp, Artificial
  CRISPR gRNA sequence
tgaggatgtgggggcacagg

SEQ ID NO: 344837 - DNA, 20 bp, Artificial
  CRISPR gRNA sequence
ggatgtgggggcacaggtgg

SEQ ID NO: 344838 - DNA, 20 bp, Artificial
  CRISPR gRNA sequence
gatgtgggggcacaggtggc

SEQ ID NO: 344839 - DNA, 20 bp, Artificial
  CRISPR gRNA sequence
tgggggcacaggtggcaggt

SEQ ID NO: 344840 - DNA, 20 bp, Artificial
  CRISPR gRNA sequence
gggggcacaggtggcaggtg

SEQ ID NO: 344841 - DNA, 20 bp, Artificial
  CRISPR gRNA sequence
gtggcaggtgaggctgccct

SEQ ID NO: 344842 - DNA, 20 bp, Artificial
  CRISPR gRNA sequence
tggcaggtgaggctgccctc

SEQ ID NO: 344843 - DNA, 20 bp, Artificial
  CRISPR gRNA sequence
gcaggtgaggctgccctcag

SEQ ID NO: 344844 - DNA, 20 bp, Artificial
  CRISPR gRNA sequence
caggtgaggctgccctcagg

SEQ ID NO: 344845 - DNA, 20 bp, Artificial
  CRISPR gRNA sequence
aggtgaggctgccctcagga

SEQ ID NO: 344846 - DNA, 20 bp, Artificial
  CRISPR gRNA sequence
ggtgaggctgccctcaggag

SEQ ID NO: 344847 - DNA, 20 bp, Artificial
  CRISPR gRNA sequence
ggctgccctcaggaggggcc

SEQ ID NO: 344848 - DNA, 20 bp, Artificial
  CRISPR gRNA sequence
gctgccctcaggaggggccc

SEQ ID NO: 344849 - DNA, 20 bp, Artificial
  CRISPR gRNA sequence
cctcaggaggggcccaggcc

SEQ ID NO: 344850 - DNA, 20 bp, Artificial
  CRISPR gRNA sequence
agcttgtaccccacctccac

SEQ ID NO: 344851 - DNA, 20 bp, Artificial
  CRISPR gRNA sequence
cccacctccaccagtacctg

SEQ ID NO: 344852 - DNA, 20 bp, Artificial
  CRISPR gRNA sequence
acctccaccagtacctgaag

SEQ ID NO: 344853 - DNA, 20 bp, Artificial
  CRISPR gRNA sequence
tccaccagtacctgaagaag

SEQ ID NO: 344854 - DNA, 20 bp, Artificial
  CRISPR gRNA sequence
ccaccagtacctgaagaagt

SEQ ID NO: 344855 - DNA, 20 bp, Artificial
  CRISPR gRNA sequence
caccagtacctgaagaagtg

SEQ ID NO: 344856 - DNA, 20 bp, Artificial
  CRISPR gRNA sequence
accctacctgcctctgccat

SEQ ID NO: 344857 - DNA, 20 bp, Artificial
  CRISPR gRNA sequence
acctgcctctgccattggaa

SEQ ID NO: 344858 - DNA, 20 bp, Artificial
  CRISPR gRNA sequence
cctctgccattggaatggcc

SEQ ID NO: 344859 - DNA, 20 bp, Artificial
  CRISPR gRNA sequence
ttggaatggcctggtttgca

SEQ ID NO: 344860 - DNA, 20 bp, Artificial
  CRISPR gRNA sequence
aatggcctggtttgcacaga

SEQ ID NO: 344861 - DNA, 20 bp, Artificial
  CRISPR gRNA sequence
atggcctggtttgcacagat

SEQ ID NO: 344862 - DNA, 20 bp, Artificial
  CRISPR gRNA sequence
acagatgggaaacccgtttg

SEQ ID NO: 344863 - DNA, 20 bp, Artificial
  CRISPR gRNA sequence
cagatgggaaacccgtttgc

SEQ ID NO: 344864 - DNA, 20 bp, Artificial
  CRISPR gRNA sequence
agatgggaaacccgtttgcg

SEQ ID NO: 344865 - DNA, 20 bp, Artificial
  CRISPR gRNA sequence
tgggaaacccgtttgcgggg

SEQ ID NO: 344866 - DNA, 20 bp, Artificial
  CRISPR gRNA sequence
gggaaacccgtttgcggggt

SEQ ID NO: 344867 - DNA, 20 bp, Artificial
  CRISPR gRNA sequence
ccgtttgcggggtgggtgtc

SEQ ID NO: 344868 - DNA, 20 bp, Artificial
  CRISPR gRNA sequence
cgtttgcggggtgggtgtct

SEQ ID NO: 344869 - DNA, 20 bp, Artificial
  CRISPR gRNA sequence
ttgcggggtgggtgtctggg

SEQ ID NO: 344870 - DNA, 20 bp, Artificial
  CRISPR gRNA sequence
tgcggggtgggtgtctgggt

SEQ ID NO: 344871 - DNA, 20 bp, Artificial
  CRISPR gRNA sequence
tgggtgtctgggtgggcacg

SEQ ID NO: 344872 - DNA, 20 bp, Artificial
  CRISPR gRNA sequence
gggtgtctgggtgggcacgt

SEQ ID NO: 344873 - DNA, 20 bp, Artificial
  CRISPR gRNA sequence
ggtgtctgggtgggcacgtg

SEQ ID NO: 344874 - DNA, 20 bp, Artificial
  CRISPR gRNA sequence
tctgggtgggcacgtggggc

SEQ ID NO: 344875 - DNA, 20 bp, Artificial
  CRISPR gRNA sequence
ctgggtgggcacgtggggcg

SEQ ID NO: 344876 - DNA, 20 bp, Artificial
  CRISPR gRNA sequence
gtggggcgaggacctgcctg

SEQ ID NO: 344877 - DNA, 20 bp, Artificial
  CRISPR gRNA sequence
tggggcgaggacctgcctgc

SEQ ID NO: 344878 - DNA, 20 bp, Artificial
  CRISPR gRNA sequence
ctgcctgcgggaccctgccc

SEQ ID NO: 344879 - DNA, 20 bp, Artificial
  CRISPR gRNA sequence
ggaccctgccctggaactga

SEQ ID NO: 344880 - DNA, 20 bp, Artificial
  CRISPR gRNA sequence
tgccctggaactgacagtgc

SEQ ID NO: 344881 - DNA, 20 bp, Artificial
  CRISPR gRNA sequence
tggaactgacagtgcaagct

SEQ ID NO: 344882 - DNA, 20 bp, Artificial
  CRISPR gRNA sequence
agctcggcgtcctgcccatc

SEQ ID NO: 344883 - DNA, 20 bp, Artificial
  CRISPR gRNA sequence
gctcggcgtcctgcccatct

SEQ ID NO: 344884 - DNA, 20 bp, Artificial
  CRISPR gRNA sequence
cggcgtcctgcccatctggg

SEQ ID NO: 344885 - DNA, 20 bp, Artificial
  CRISPR gRNA sequence
cgtcctgcccatctgggcag

SEQ ID NO: 344886 - DNA, 20 bp, Artificial
  CRISPR gRNA sequence
gtcctgcccatctgggcaga

SEQ ID NO: 344887 - DNA, 20 bp, Artificial
  CRISPR gRNA sequence
tgcccatctgggcagaaggc

SEQ ID NO: 344888 - DNA, 20 bp, Artificial
  CRISPR gRNA sequence
gctggtttctcccatcaacg

SEQ ID NO: 344889 - DNA, 20 bp, Artificial
  CRISPR gRNA sequence
tcccatcaacgaagccctcc

SEQ ID NO: 344890 - DNA, 20 bp, Artificial
  CRISPR gRNA sequence
cccatcaacgaagccctccc

SEQ ID NO: 344891 - DNA, 20 bp, Artificial
  CRISPR gRNA sequence
ccctcccaggaccttcctgc

SEQ ID NO: 344892 - DNA, 20 bp, Artificial
  CRISPR gRNA sequence
gcaagccctcgtcccacacg

SEQ ID NO: 344893 - DNA, 20 bp, Artificial
  CRISPR gRNA sequence
cacgcagctctgccgtccct

SEQ ID NO: 344894 - DNA, 20 bp, Artificial
  CRISPR gRNA sequence
ccgtcccttggtgtccctcc

SEQ ID NO: 344895 - DNA, 20 bp, Artificial
  CRISPR gRNA sequence
cttggtgtccctcccggcct

SEQ ID NO: 344896 - DNA, 20 bp, Artificial
  CRISPR gRNA sequence
ttggtgtccctcccggcctc

SEQ ID NO: 344897 - DNA, 20 bp, Artificial
  CRISPR gRNA sequence
cggcctcaggtcctccatgc

SEQ ID NO: 344898 - DNA, 20 bp, Artificial
  CRISPR gRNA sequence
ggcctcaggtcctccatgct

SEQ ID NO: 344899 - DNA, 20 bp, Artificial
  CRISPR gRNA sequence
tcctccatgctgggtacctc

SEQ ID NO: 344900 - DNA, 20 bp, Artificial
  CRISPR gRNA sequence
cctccatgctgggtacctct

SEQ ID NO: 344901 - DNA, 20 bp, Artificial
  CRISPR gRNA sequence
gtacctctgggcacctcgtt

SEQ ID NO: 344902 - DNA, 20 bp, Artificial
  CRISPR gRNA sequence
tctgggcacctcgtttggct

SEQ ID NO: 344903 - DNA, 20 bp, Artificial
  CRISPR gRNA sequence
ggcacctcgtttggctgagc

SEQ ID NO: 344904 - DNA, 20 bp, Artificial
  CRISPR gRNA sequence
gcacctcgtttggctgagcc

SEQ ID NO: 344905 - DNA, 20 bp, Artificial
  CRISPR gRNA sequence
cacctcgtttggctgagcca

SEQ ID NO: 344906 - DNA, 20 bp, Artificial
  CRISPR gRNA sequence
acctcgtttggctgagccag

SEQ ID NO: 344907 - DNA, 20 bp, Artificial
  CRISPR gRNA sequence
gtttggctgagccaggggtt

SEQ ID NO: 344908 - DNA, 20 bp, Artificial
  CRISPR gRNA sequence
gctgagccaggggttcagcc

SEQ ID NO: 344909 - DNA, 20 bp, Artificial
  CRISPR gRNA sequence
gagccaggggttcagcctgg

SEQ ID NO: 344910 - DNA, 20 bp, Artificial
  CRISPR gRNA sequence
agccaggggttcagcctggc

SEQ ID NO: 344911 - DNA, 20 bp, Artificial
  CRISPR gRNA sequence
gccaggggttcagcctggca

SEQ ID NO: 344912 - DNA, 20 bp, Artificial
  CRISPR gRNA sequence
ttcagcctggcagggcgccc

SEQ ID NO: 344913 - DNA, 20 bp, Artificial
  CRISPR gRNA sequence
agcctggcagggcgccctgg

SEQ ID NO: 344914 - DNA, 20 bp, Artificial
  CRISPR gRNA sequence
ctggcagggcgccctggcag

SEQ ID NO: 344915 - DNA, 20 bp, Artificial
  CRISPR gRNA sequence
ggcgccctggcagcagtcct

SEQ ID NO: 344916 - DNA, 20 bp, Artificial
  CRISPR gRNA sequence
tggcagcagtccttggcctg

SEQ ID NO: 344917 - DNA, 20 bp, Artificial
  CRISPR gRNA sequence
ttggcctgtggatgctgtcc

SEQ ID NO: 344918 - DNA, 20 bp, Artificial
  CRISPR gRNA sequence
gtggatgctgtcctggcccg

SEQ ID NO: 344919 - DNA, 20 bp, Artificial
  CRISPR gRNA sequence
atgctgtcctggcccgtgga

SEQ ID NO: 344920 - DNA, 20 bp, Artificial
  CRISPR gRNA sequence
ctggcccgtggatggtgtcc

SEQ ID NO: 344921 - DNA, 20 bp, Artificial
  CRISPR gRNA sequence
cggcctccacgtacccctct

SEQ ID NO: 344922 - DNA, 20 bp, Artificial
  CRISPR gRNA sequence
cccctctcagcccctcctct

SEQ ID NO: 344923 - DNA, 20 bp, Artificial
  CRISPR gRNA sequence
cagcccctcctcttggactc

SEQ ID NO: 344924 - DNA, 20 bp, Artificial
  CRISPR gRNA sequence
ctcctcttggactccagcca

SEQ ID NO: 344925 - DNA, 20 bp, Artificial
  CRISPR gRNA sequence
tcctcttggactccagccat

SEQ ID NO: 344926 - DNA, 20 bp, Artificial
  CRISPR gRNA sequence
ccagccatgggcctgcgcgc

SEQ ID NO: 344927 - DNA, 20 bp, Artificial
  CRISPR gRNA sequence
ccatgggcctgcgcgcgagc

SEQ ID NO: 344928 - DNA, 20 bp, Artificial
  CRISPR gRNA sequence
cgcgcgagccggaactgctc

SEQ ID NO: 344929 - DNA, 20 bp, Artificial
  CRISPR gRNA sequence
gcgcgagccggaactgctcc

SEQ ID NO: 344930 - DNA, 20 bp, Artificial
  CRISPR gRNA sequence
gagccggaactgctccagga

SEQ ID NO: 344931 - DNA, 20 bp, Artificial
  CRISPR gRNA sequence
gccggaactgctccaggaca

SEQ ID NO: 344932 - DNA, 20 bp, Artificial
  CRISPR gRNA sequence
aggacagagaacgccgtgtg

SEQ ID NO: 344933 - DNA, 20 bp, Artificial
  CRISPR gRNA sequence
gagaacgccgtgtgtggctg

SEQ ID NO: 344934 - DNA, 20 bp, Artificial
  CRISPR gRNA sequence
cgccgtgtgtggctgcagcc

SEQ ID NO: 344935 - DNA, 20 bp, Artificial
  CRISPR gRNA sequence
gccgtgtgtggctgcagccc

SEQ ID NO: 344936 - DNA, 20 bp, Artificial
  CRISPR gRNA sequence
caggccacttctgcatcgtc

SEQ ID NO: 344937 - DNA, 20 bp, Artificial
  CRISPR gRNA sequence
aggccacttctgcatcgtcc

SEQ ID NO: 344938 - DNA, 20 bp, Artificial
  CRISPR gRNA sequence
cacttctgcatcgtccagga

SEQ ID NO: 344939 - DNA, 20 bp, Artificial
  CRISPR gRNA sequence
acttctgcatcgtccaggac

SEQ ID NO: 344940 - DNA, 20 bp, Artificial
  CRISPR gRNA sequence
cttctgcatcgtccaggacg

SEQ ID NO: 344941 - DNA, 20 bp, Artificial
  CRISPR gRNA sequence
tgccgcgcttacgccacctc

SEQ ID NO: 344942 - DNA, 20 bp, Artificial
  CRISPR gRNA sequence
cgcttacgccacctccagcc

SEQ ID NO: 344943 - DNA, 20 bp, Artificial
  CRISPR gRNA sequence
gcttacgccacctccagccc

SEQ ID NO: 344944 - DNA, 20 bp, Artificial
  CRISPR gRNA sequence
acgccacctccagcccgggc

SEQ ID NO: 344945 - DNA, 20 bp, Artificial
  CRISPR gRNA sequence
gccacctccagcccgggcca

SEQ ID NO: 344946 - DNA, 20 bp, Artificial
  CRISPR gRNA sequence
ccacctccagcccgggccag

SEQ ID NO: 344947 - DNA, 20 bp, Artificial
  CRISPR gRNA sequence
cacctccagcccgggccaga

SEQ ID NO: 344948 - DNA, 20 bp, Artificial
  CRISPR gRNA sequence
ccagcccgggccagagggtg

SEQ ID NO: 344949 - DNA, 20 bp, Artificial
  CRISPR gRNA sequence
gcccgggccagagggtgcag

SEQ ID NO: 344950 - DNA, 20 bp, Artificial
  CRISPR gRNA sequence
cccgggccagagggtgcaga

SEQ ID NO: 344951 - DNA, 20 bp, Artificial
  CRISPR gRNA sequence
ccgggccagagggtgcagaa

SEQ ID NO: 344952 - DNA, 20 bp, Artificial
  CRISPR gRNA sequence
gggccagagggtgcagaagg

SEQ ID NO: 344953 - DNA, 20 bp, Artificial
  CRISPR gRNA sequence
ggccagagggtgcagaaggg

SEQ ID NO: 344954 - DNA, 20 bp, Artificial
  CRISPR gRNA sequence
agagggtgcagaagggaggt

SEQ ID NO: 344955 - DNA, 20 bp, Artificial
  CRISPR gRNA sequence
gggtgcagaagggaggtaag

SEQ ID NO: 344956 - DNA, 20 bp, Artificial
  CRISPR gRNA sequence
tgcagaagggaggtaagcgg

SEQ ID NO: 344957 - DNA, 20 bp, Artificial
  CRISPR gRNA sequence
gcagaagggaggtaagcggt

SEQ ID NO: 344958 - DNA, 20 bp, Artificial
  CRISPR gRNA sequence
gaagggaggtaagcggtggg

SEQ ID NO: 344959 - DNA, 20 bp, Artificial
  CRISPR gRNA sequence
gggaggtaagcggtgggtgg

SEQ ID NO: 344960 - DNA, 20 bp, Artificial
  CRISPR gRNA sequence
cacccctcccatttccaccc

SEQ ID NO: 344961 - DNA, 20 bp, Artificial
  CRISPR gRNA sequence
cccatttccaccctggtccc

SEQ ID NO: 344962 - DNA, 20 bp, Artificial
  CRISPR gRNA sequence
gtccccagtgccccgctgtc

SEQ ID NO: 344963 - DNA, 20 bp, Artificial
  CRISPR gRNA sequence
ccccagtgccccgctgtctg

SEQ ID NO: 344964 - DNA, 20 bp, Artificial
  CRISPR gRNA sequence
tgccccgctgtctggagccc

SEQ ID NO: 344965 - DNA, 20 bp, Artificial
  CRISPR gRNA sequence
gccccgctgtctggagcccc

SEQ ID NO: 344966 - DNA, 20 bp, Artificial
  CRISPR gRNA sequence
ggagccccaggtttcctcga

SEQ ID NO: 344967 - DNA, 20 bp, Artificial
  CRISPR gRNA sequence
cccaggtttcctcgacggca

SEQ ID NO: 344968 - DNA, 20 bp, Artificial
  CRISPR gRNA sequence
cctcgacggcatggcctgcc

SEQ ID NO: 344969 - DNA, 20 bp, Artificial
  CRISPR gRNA sequence
ctcgacggcatggcctgccc

SEQ ID NO: 344970 - DNA, 20 bp, Artificial
  CRISPR gRNA sequence
tcgacggcatggcctgccca

SEQ ID NO: 344971 - DNA, 20 bp, Artificial
  CRISPR gRNA sequence
cgacggcatggcctgcccag

SEQ ID NO: 344972 - DNA, 20 bp, Artificial
  CRISPR gRNA sequence
catggcctgcccaggggccc

SEQ ID NO: 344973 - DNA, 20 bp, Artificial
  CRISPR gRNA sequence
gcctgcccaggggccctggt

SEQ ID NO: 344974 - DNA, 20 bp, Artificial
  CRISPR gRNA sequence
gcccaggggccctggtgaga

SEQ ID NO: 344975 - DNA, 20 bp, Artificial
  CRISPR gRNA sequence
gccctggtgagacagaacct

SEQ ID NO: 344976 - DNA, 20 bp, Artificial
  CRISPR gRNA sequence
tggtgagacagaaccttggc

SEQ ID NO: 344977 - DNA, 20 bp, Artificial
  CRISPR gRNA sequence
gacagaaccttggccagccc

SEQ ID NO: 344978 - DNA, 20 bp, Artificial
  CRISPR gRNA sequence
acagaaccttggccagcccc

SEQ ID NO: 344979 - DNA, 20 bp, Artificial
  CRISPR gRNA sequence
agccccaggcccacccactt

SEQ ID NO: 344980 - DNA, 20 bp, Artificial
  CRISPR gRNA sequence
cacccacttcagccctgtcc

SEQ ID NO: 344981 - DNA, 20 bp, Artificial
  CRISPR gRNA sequence
ccacttcagccctgtcctgg

SEQ ID NO: 344982 - DNA, 20 bp, Artificial
  CRISPR gRNA sequence
cttcagccctgtcctggaag

SEQ ID NO: 344983 - DNA, 20 bp, Artificial
  CRISPR gRNA sequence
gccctgtcctggaagcagcc

SEQ ID NO: 344984 - DNA, 20 bp, Artificial
  CRISPR gRNA sequence
ctgtcctggaagcagcccag

SEQ ID NO: 344985 - DNA, 20 bp, Artificial
  CRISPR gRNA sequence
tgtcctggaagcagcccagt

SEQ ID NO: 344986 - DNA, 20 bp, Artificial
  CRISPR gRNA sequence
gtcctggaagcagcccagtg

SEQ ID NO: 344987 - DNA, 20 bp, Artificial
  CRISPR gRNA sequence
ggaagcagcccagtggggaa

SEQ ID NO: 344988 - DNA, 20 bp, Artificial
  CRISPR gRNA sequence
gaagcagcccagtggggaac

SEQ ID NO: 344989 - DNA, 20 bp, Artificial
  CRISPR gRNA sequence
gcccagtggggaacaggtga

SEQ ID NO: 344990 - DNA, 20 bp, Artificial
  CRISPR gRNA sequence
ccagtggggaacaggtgatg

SEQ ID NO: 344991 - DNA, 20 bp, Artificial
  CRISPR gRNA sequence
cagtggggaacaggtgatgg

SEQ ID NO: 344992 - DNA, 20 bp, Artificial
  CRISPR gRNA sequence
tggggaacaggtgatggagg

SEQ ID NO: 344993 - DNA, 20 bp, Artificial
  CRISPR gRNA sequence
ggggaacaggtgatggaggc

SEQ ID NO: 344994 - DNA, 20 bp, Artificial
  CRISPR gRNA sequence
gggaacaggtgatggaggca

SEQ ID NO: 344995 - DNA, 20 bp, Artificial
  CRISPR gRNA sequence
ggaacaggtgatggaggcag

SEQ ID NO: 344996 - DNA, 20 bp, Artificial
  CRISPR gRNA sequence
acaggtgatggaggcagggg

SEQ ID NO: 344997 - DNA, 20 bp, Artificial
  CRISPR gRNA sequence
caggtgatggaggcagggga

SEQ ID NO: 344998 - DNA, 20 bp, Artificial
  CRISPR gRNA sequence
aggtgatggaggcaggggaa

SEQ ID NO: 344999 - DNA, 20 bp, Artificial
  CRISPR gRNA sequence
ggtgatggaggcaggggaag

SEQ ID NO: 345000 - DNA, 20 bp, Artificial
  CRISPR gRNA sequence
atggaggcaggggaaggggc

SEQ ID NO: 345001 - DNA, 20 bp, Artificial
  CRISPR gRNA sequence
tggaggcaggggaaggggca

SEQ ID NO: 345002 - DNA, 20 bp, Artificial
  CRISPR gRNA sequence
aggcaggggaaggggcaagg

SEQ ID NO: 345003 - DNA, 20 bp, Artificial
  CRISPR gRNA sequence
ggcaggggaaggggcaagga

SEQ ID NO: 345004 - DNA, 20 bp, Artificial
  CRISPR gRNA sequence
gcaggggaaggggcaaggaa

SEQ ID NO: 345005 - DNA, 20 bp, Artificial
  CRISPR gRNA sequence
ggggcaaggaagggccaccc

SEQ ID NO: 345006 - DNA, 20 bp, Artificial
  CRISPR gRNA sequence
gggcaaggaagggccacccc

SEQ ID NO: 345007 - DNA, 20 bp, Artificial
  CRISPR gRNA sequence
caccccaggttgctccacct

SEQ ID NO: 345008 - DNA, 20 bp, Artificial
  CRISPR gRNA sequence
accccaggttgctccacctc

SEQ ID NO: 345009 - DNA, 20 bp, Artificial
  CRISPR gRNA sequence
ccccaggttgctccacctcg

SEQ ID NO: 345010 - DNA, 20 bp, Artificial
  CRISPR gRNA sequence
gttgctccacctcggggttc

SEQ ID NO: 345011 - DNA, 20 bp, Artificial
  CRISPR gRNA sequence
ttgctccacctcggggttct

SEQ ID NO: 345012 - DNA, 20 bp, Artificial
  CRISPR gRNA sequence
ctcggggttctgggacttcc

SEQ ID NO: 345013 - DNA, 20 bp, Artificial
  CRISPR gRNA sequence
ttctgggacttcccagtccc

SEQ ID NO: 345014 - DNA, 20 bp, Artificial
  CRISPR gRNA sequence
tctgggacttcccagtcccc

SEQ ID NO: 345015 - DNA, 20 bp, Artificial
  CRISPR gRNA sequence
cagtccccaggcctcgctct

SEQ ID NO: 345016 - DNA, 20 bp, Artificial
  CRISPR gRNA sequence
agtccccaggcctcgctctc

SEQ ID NO: 345017 - DNA, 20 bp, Artificial
  CRISPR gRNA sequence
aggcctcgctctcgggcccc

SEQ ID NO: 345018 - DNA, 20 bp, Artificial
  CRISPR gRNA sequence
tcgctctcgggcccctggtc

SEQ ID NO: 345019 - DNA, 20 bp, Artificial
  CRISPR gRNA sequence
gctctcgggcccctggtctg

SEQ ID NO: 345020 - DNA, 20 bp, Artificial
  CRISPR gRNA sequence
cgggcccctggtctggagcc

SEQ ID NO: 345021 - DNA, 20 bp, Artificial
  CRISPR gRNA sequence
gggcccctggtctggagcct

SEQ ID NO: 345022 - DNA, 20 bp, Artificial
  CRISPR gRNA sequence
tggtctggagcctgggttta

SEQ ID NO: 345023 - DNA, 20 bp, Artificial
  CRISPR gRNA sequence
ggtctggagcctgggtttat

SEQ ID NO: 345024 - DNA, 20 bp, Artificial
  CRISPR gRNA sequence
tctggagcctgggtttatgg

SEQ ID NO: 345025 - DNA, 20 bp, Artificial
  CRISPR gRNA sequence
tgggtttatgggagtgacca

SEQ ID NO: 345026 - DNA, 20 bp, Artificial
  CRISPR gRNA sequence
catggttaatgccactgttc

SEQ ID NO: 345027 - DNA, 20 bp, Artificial
  CRISPR gRNA sequence
ttaatgccactgttcaagct

SEQ ID NO: 345028 - DNA, 20 bp, Artificial
  CRISPR gRNA sequence
gccactgttcaagctaagtc

SEQ ID NO: 345029 - DNA, 20 bp, Artificial
  CRISPR gRNA sequence
ccactgttcaagctaagtct

SEQ ID NO: 345030 - DNA, 20 bp, Artificial
  CRISPR gRNA sequence
actgttcaagctaagtctag

SEQ ID NO: 345031 - DNA, 20 bp, Artificial
  CRISPR gRNA sequence
ctgttcaagctaagtctagg

SEQ ID NO: 345032 - DNA, 20 bp, Artificial
  CRISPR gRNA sequence
gttcaagctaagtctaggag

SEQ ID NO: 345033 - DNA, 20 bp, Artificial
  CRISPR gRNA sequence
aagctaagtctaggaggagt

SEQ ID NO: 345034 - DNA, 20 bp, Artificial
  CRISPR gRNA sequence
gtctaggaggagtaagtgtc

SEQ ID NO: 345035 - DNA, 20 bp, Artificial
  CRISPR gRNA sequence
gaggagtaagtgtccagccc

SEQ ID NO: 345036 - DNA, 20 bp, Artificial
  CRISPR gRNA sequence
gtccagccctggcctgcatc

SEQ ID NO: 345037 - DNA, 20 bp, Artificial
  CRISPR gRNA sequence
agccctggcctgcatctggc

SEQ ID NO: 345038 - DNA, 20 bp, Artificial
  CRISPR gRNA sequence
gccctggcctgcatctggcc

SEQ ID NO: 345039 - DNA, 20 bp, Artificial
  CRISPR gRNA sequence
ctggcctgcatctggccggg

SEQ ID NO: 345040 - DNA, 20 bp, Artificial
  CRISPR gRNA sequence
atctggccgggcagcccccg

SEQ ID NO: 345041 - DNA, 20 bp, Artificial
  CRISPR gRNA sequence
gggcagcccccgcagcactg

SEQ ID NO: 345042 - DNA, 20 bp, Artificial
  CRISPR gRNA sequence
ggcagcccccgcagcactgc

SEQ ID NO: 345043 - DNA, 20 bp, Artificial
  CRISPR gRNA sequence
ccccgcagcactgcaggatg

SEQ ID NO: 345044 - DNA, 20 bp, Artificial
  CRISPR gRNA sequence
agcactgcaggatgtggaca

SEQ ID NO: 345045 - DNA, 20 bp, Artificial
  CRISPR gRNA sequence
cactgcaggatgtggacaca

SEQ ID NO: 345046 - DNA, 20 bp, Artificial
  CRISPR gRNA sequence
actgcaggatgtggacacag

SEQ ID NO: 345047 - DNA, 20 bp, Artificial
  CRISPR gRNA sequence
ctgcaggatgtggacacaga

SEQ ID NO: 345048 - DNA, 20 bp, Artificial
  CRISPR gRNA sequence
tgtggacacagagggactcc

SEQ ID NO: 345049 - DNA, 20 bp, Artificial
  CRISPR gRNA sequence
agagggactcccggactcat

SEQ ID NO: 345050 - DNA, 20 bp, Artificial
  CRISPR gRNA sequence
ctcccggactcatgagatcc

SEQ ID NO: 345051 - DNA, 20 bp, Artificial
  CRISPR gRNA sequence
tcatgagatcccagctactc

SEQ ID NO: 345052 - DNA, 20 bp, Artificial
  CRISPR gRNA sequence
catgagatcccagctactca

SEQ ID NO: 345053 - DNA, 20 bp, Artificial
  CRISPR gRNA sequence
agatcccagctactcaaggc

SEQ ID NO: 345054 - DNA, 20 bp, Artificial
  CRISPR gRNA sequence
gatcccagctactcaaggcc

SEQ ID NO: 345055 - DNA, 20 bp, Artificial
  CRISPR gRNA sequence
ccagctactcaaggccggga

SEQ ID NO: 345056 - DNA, 20 bp, Artificial
  CRISPR gRNA sequence
ctactcaaggccgggacagc

SEQ ID NO: 345057 - DNA, 20 bp, Artificial
  CRISPR gRNA sequence
actcaaggccgggacagcca

SEQ ID NO: 345058 - DNA, 20 bp, Artificial
  CRISPR gRNA sequence
gacagccagagccaccaccc

SEQ ID NO: 345059 - DNA, 20 bp, Artificial
  CRISPR gRNA sequence
acagccagagccaccacccc

SEQ ID NO: 345060 - DNA, 20 bp, Artificial
  CRISPR gRNA sequence
ccaccccaggccccacctcc

SEQ ID NO: 345061 - DNA, 20 bp, Artificial
  CRISPR gRNA sequence
aggccccacctccaagactc

SEQ ID NO: 345062 - DNA, 20 bp, Artificial
  CRISPR gRNA sequence
cccacctccaagactctgga

SEQ ID NO: 345063 - DNA, 20 bp, Artificial
  CRISPR gRNA sequence
ccacctccaagactctggac

SEQ ID NO: 345064 - DNA, 20 bp, Artificial
  CRISPR gRNA sequence
cacctccaagactctggaca

SEQ ID NO: 345065 - DNA, 20 bp, Artificial
  CRISPR gRNA sequence
cctccaagactctggacagg

SEQ ID NO: 345066 - DNA, 20 bp, Artificial
  CRISPR gRNA sequence
gggagcctgcccctccccgc

SEQ ID NO: 345067 - DNA, 20 bp, Artificial
  CRISPR gRNA sequence
gctggtcctcccatcacccg

SEQ ID NO: 345068 - DNA, 20 bp, Artificial
  CRISPR gRNA sequence
tggtcctcccatcacccgta

SEQ ID NO: 345069 - DNA, 20 bp, Artificial
  CRISPR gRNA sequence
cccatcacccgtagagcacc

SEQ ID NO: 345070 - DNA, 20 bp, Artificial
  CRISPR gRNA sequence
ccatcacccgtagagcaccc

SEQ ID NO: 345071 - DNA, 20 bp, Artificial
  CRISPR gRNA sequence
acccgtagagcacccaggtc

SEQ ID NO: 345072 - DNA, 20 bp, Artificial
  CRISPR gRNA sequence
cgtagagcacccaggtctag

SEQ ID NO: 345073 - DNA, 20 bp, Artificial
  CRISPR gRNA sequence
cacccaggtctagaagctca

SEQ ID NO: 345074 - DNA, 20 bp, Artificial
  CRISPR gRNA sequence
aggtctagaagctcacagac

SEQ ID NO: 345075 - DNA, 20 bp, Artificial
  CRISPR gRNA sequence
tctagaagctcacagacaag

SEQ ID NO: 345076 - DNA, 20 bp, Artificial
  CRISPR gRNA sequence
gctcacagacaagcagtccc

SEQ ID NO: 345077 - DNA, 20 bp, Artificial
  CRISPR gRNA sequence
gacaagcagtccctagccgc

SEQ ID NO: 345078 - DNA, 20 bp, Artificial
  CRISPR gRNA sequence
cctagccgccagccccctcc

SEQ ID NO: 345079 - DNA, 20 bp, Artificial
  CRISPR gRNA sequence
ccgccagccccctcctggcc

SEQ ID NO: 345080 - DNA, 20 bp, Artificial
  CRISPR gRNA sequence
ccctcctggcctggtgccct

SEQ ID NO: 345081 - DNA, 20 bp, Artificial
  CRISPR gRNA sequence
tctgtccgtccctctcttct

SEQ ID NO: 345082 - DNA, 20 bp, Artificial
  CRISPR gRNA sequence
ctgtccgtccctctcttctc

SEQ ID NO: 345083 - DNA, 20 bp, Artificial
  CRISPR gRNA sequence
tccctctcttctcaggcacc

SEQ ID NO: 345084 - DNA, 20 bp, Artificial
  CRISPR gRNA sequence
cctctcttctcaggcaccga

SEQ ID NO: 345085 - DNA, 20 bp, Artificial
  CRISPR gRNA sequence
tcttctcaggcaccgagagt

SEQ ID NO: 345086 - DNA, 20 bp, Artificial
  CRISPR gRNA sequence
cttctcaggcaccgagagtc

SEQ ID NO: 345087 - DNA, 20 bp, Artificial
  CRISPR gRNA sequence
agagtcaggacaccctgtgt

SEQ ID NO: 345088 - DNA, 20 bp, Artificial
  CRISPR gRNA sequence
cctgtgtcagaactgccccc

SEQ ID NO: 345089 - DNA, 20 bp, Artificial
  CRISPR gRNA sequence
ctgtgtcagaactgcccccc

SEQ ID NO: 345090 - DNA, 20 bp, Artificial
  CRISPR gRNA sequence
tgtgtcagaactgccccccg

SEQ ID NO: 345091 - DNA, 20 bp, Artificial
  CRISPR gRNA sequence
ccggggaccttctctcccaa

SEQ ID NO: 345092 - DNA, 20 bp, Artificial
  CRISPR gRNA sequence
cggggaccttctctcccaat

SEQ ID NO: 345093 - DNA, 20 bp, Artificial
  CRISPR gRNA sequence
cttctctcccaatgggaccc

SEQ ID NO: 345094 - DNA, 20 bp, Artificial
  CRISPR gRNA sequence
tctctcccaatgggaccctg

SEQ ID NO: 345095 - DNA, 20 bp, Artificial
  CRISPR gRNA sequence
ctctcccaatgggaccctgg

SEQ ID NO: 345096 - DNA, 20 bp, Artificial
  CRISPR gRNA sequence
atgggaccctggaggaatgt

SEQ ID NO: 345097 - DNA, 20 bp, Artificial
  CRISPR gRNA sequence
ccctggaggaatgtcagcac

SEQ ID NO: 345098 - DNA, 20 bp, Artificial
  CRISPR gRNA sequence
aggaatgtcagcaccagacc

SEQ ID NO: 345099 - DNA, 20 bp, Artificial
  CRISPR gRNA sequence
atgtcagcaccagaccaagt

SEQ ID NO: 345100 - DNA, 20 bp, Artificial
  CRISPR gRNA sequence
ccagaccaagtaagtgaacc

SEQ ID NO: 345101 - DNA, 20 bp, Artificial
  CRISPR gRNA sequence
cagaccaagtaagtgaaccc

SEQ ID NO: 345102 - DNA, 20 bp, Artificial
  CRISPR gRNA sequence
agaccaagtaagtgaacccg

SEQ ID NO: 345103 - DNA, 20 bp, Artificial
  CRISPR gRNA sequence
gaccaagtaagtgaacccgg

SEQ ID NO: 345104 - DNA, 20 bp, Artificial
  CRISPR gRNA sequence
ccaagtaagtgaacccgggg

SEQ ID NO: 345105 - DNA, 20 bp, Artificial
  CRISPR gRNA sequence
caagtaagtgaacccggggg

SEQ ID NO: 345106 - DNA, 20 bp, Artificial
  CRISPR gRNA sequence
aagtgaacccgggggaggcc

SEQ ID NO: 345107 - DNA, 20 bp, Artificial
  CRISPR gRNA sequence
ggaggcccagctctgtgccc

SEQ ID NO: 345108 - DNA, 20 bp, Artificial
  CRISPR gRNA sequence
gaggcccagctctgtgccct

SEQ ID NO: 345109 - DNA, 20 bp, Artificial
  CRISPR gRNA sequence
aggcccagctctgtgccctg

SEQ ID NO: 345110 - DNA, 20 bp, Artificial
  CRISPR gRNA sequence
gcccagctctgtgccctggg

SEQ ID NO: 345111 - DNA, 20 bp, Artificial
  CRISPR gRNA sequence
cccagctctgtgccctgggg

SEQ ID NO: 345112 - DNA, 20 bp, Artificial
  CRISPR gRNA sequence
ccagctctgtgccctgggga

SEQ ID NO: 345113 - DNA, 20 bp, Artificial
  CRISPR gRNA sequence
cagctctgtgccctggggag

SEQ ID NO: 345114 - DNA, 20 bp, Artificial
  CRISPR gRNA sequence
agctctgtgccctggggagg

SEQ ID NO: 345115 - DNA, 20 bp, Artificial
  CRISPR gRNA sequence
ggggctccacgttgcttccc

SEQ ID NO: 345116 - DNA, 20 bp, Artificial
  CRISPR gRNA sequence
gggctccacgttgcttccct

SEQ ID NO: 345117 - DNA, 20 bp, Artificial
  CRISPR gRNA sequence
gctccacgttgcttccctgg

SEQ ID NO: 345118 - DNA, 20 bp, Artificial
  CRISPR gRNA sequence
tgggagatgaccgtcttctc

SEQ ID NO: 345119 - DNA, 20 bp, Artificial
  CRISPR gRNA sequence
gagatgaccgtcttctccag

SEQ ID NO: 345120 - DNA, 20 bp, Artificial
  CRISPR gRNA sequence
tgaccgtcttctccagcaga

SEQ ID NO: 345121 - DNA, 20 bp, Artificial
  CRISPR gRNA sequence
gaccgtcttctccagcagaa

SEQ ID NO: 345122 - DNA, 20 bp, Artificial
  CRISPR gRNA sequence
ttctccagcagaaaggcttg

SEQ ID NO: 345123 - DNA, 20 bp, Artificial
  CRISPR gRNA sequence
tctccagcagaaaggcttga

SEQ ID NO: 345124 - DNA, 20 bp, Artificial
  CRISPR gRNA sequence
aggcttgaaggtcccaccct

SEQ ID NO: 345125 - DNA, 20 bp, Artificial
  CRISPR gRNA sequence
cttgaaggtcccaccctgag

SEQ ID NO: 345126 - DNA, 20 bp, Artificial
  CRISPR gRNA sequence
tcccaccctgagcggcaccc

SEQ ID NO: 345127 - DNA, 20 bp, Artificial
  CRISPR gRNA sequence
cctggtcacatgcctgcgtc

SEQ ID NO: 345128 - DNA, 20 bp, Artificial
  CRISPR gRNA sequence
ctggtcacatgcctgcgtcc

SEQ ID NO: 345129 - DNA, 20 bp, Artificial
  CRISPR gRNA sequence
ggtcacatgcctgcgtccag

SEQ ID NO: 345130 - DNA, 20 bp, Artificial
  CRISPR gRNA sequence
tcacatgcctgcgtccagga

SEQ ID NO: 345131 - DNA, 20 bp, Artificial
  CRISPR gRNA sequence
gcctgcgtccaggagagctg

SEQ ID NO: 345132 - DNA, 20 bp, Artificial
  CRISPR gRNA sequence
cctgcgtccaggagagctgc

SEQ ID NO: 345133 - DNA, 20 bp, Artificial
  CRISPR gRNA sequence
ctgcgtccaggagagctgca

SEQ ID NO: 345134 - DNA, 20 bp, Artificial
  CRISPR gRNA sequence
ccaggagagctgcagggctg

SEQ ID NO: 345135 - DNA, 20 bp, Artificial
  CRISPR gRNA sequence
gggctgaagcctgtgtgccc

SEQ ID NO: 345136 - DNA, 20 bp, Artificial
  CRISPR gRNA sequence
gccccagataaccccttcca

SEQ ID NO: 345137 - DNA, 20 bp, Artificial
  CRISPR gRNA sequence
ccccagataaccccttccat

SEQ ID NO: 345138 - DNA, 20 bp, Artificial
  CRISPR gRNA sequence
gataaccccttccatgggcc

SEQ ID NO: 345139 - DNA, 20 bp, Artificial
  CRISPR gRNA sequence
cccttccatgggcccagaca

SEQ ID NO: 345140 - DNA, 20 bp, Artificial
  CRISPR gRNA sequence
gggcccagacaaagcctcat

SEQ ID NO: 345141 - DNA, 20 bp, Artificial
  CRISPR gRNA sequence
gacaaagcctcatcagatct

SEQ ID NO: 345142 - DNA, 20 bp, Artificial
  CRISPR gRNA sequence
ctcatcagatctgagcttcc

SEQ ID NO: 345143 - DNA, 20 bp, Artificial
  CRISPR gRNA sequence
catcagatctgagcttcctg

SEQ ID NO: 345144 - DNA, 20 bp, Artificial
  CRISPR gRNA sequence
atcagatctgagcttcctgg

SEQ ID NO: 345145 - DNA, 20 bp, Artificial
  CRISPR gRNA sequence
atctgagcttcctggaggct

SEQ ID NO: 345146 - DNA, 20 bp, Artificial
  CRISPR gRNA sequence
tctgagcttcctggaggctc

SEQ ID NO: 345147 - DNA, 20 bp, Artificial
  CRISPR gRNA sequence
agcttcctggaggctcagga

SEQ ID NO: 345148 - DNA, 20 bp, Artificial
  CRISPR gRNA sequence
gcttcctggaggctcaggat

SEQ ID NO: 345149 - DNA, 20 bp, Artificial
  CRISPR gRNA sequence
aggctcaggatgggccttcc

SEQ ID NO: 345150 - DNA, 20 bp, Artificial
  CRISPR gRNA sequence
ctcaggatgggccttcccag

SEQ ID NO: 345151 - DNA, 20 bp, Artificial
  CRISPR gRNA sequence
aggatgggccttcccagaag

SEQ ID NO: 345152 - DNA, 20 bp, Artificial
  CRISPR gRNA sequence
ggatgggccttcccagaagc

SEQ ID NO: 345153 - DNA, 20 bp, Artificial
  CRISPR gRNA sequence
ggccttcccagaagcaggcc

SEQ ID NO: 345154 - DNA, 20 bp, Artificial
  CRISPR gRNA sequence
ccttcccagaagcaggccca

SEQ ID NO: 345155 - DNA, 20 bp, Artificial
  CRISPR gRNA sequence
cttcccagaagcaggcccag

SEQ ID NO: 345156 - DNA, 20 bp, Artificial
  CRISPR gRNA sequence
ttcccagaagcaggcccaga

SEQ ID NO: 345157 - DNA, 20 bp, Artificial
  CRISPR gRNA sequence
cccagaagcaggcccagagg

SEQ ID NO: 345158 - DNA, 20 bp, Artificial
  CRISPR gRNA sequence
ccagaagcaggcccagaggg

SEQ ID NO: 345159 - DNA, 20 bp, Artificial
  CRISPR gRNA sequence
gcccagagggaggctgcctc

SEQ ID NO: 345160 - DNA, 20 bp, Artificial
  CRISPR gRNA sequence
cctccagatcccctgtcccc

SEQ ID NO: 345161 - DNA, 20 bp, Artificial
  CRISPR gRNA sequence
ctccagatcccctgtcccct

SEQ ID NO: 345162 - DNA, 20 bp, Artificial
  CRISPR gRNA sequence
tccagatcccctgtcccctg

SEQ ID NO: 345163 - DNA, 20 bp, Artificial
  CRISPR gRNA sequence
tcccctgtcccctggggctg

SEQ ID NO: 345164 - DNA, 20 bp, Artificial
  CRISPR gRNA sequence
cccctgtcccctggggctgt

SEQ ID NO: 345165 - DNA, 20 bp, Artificial
  CRISPR gRNA sequence
ctgtgggtgtccctgaatgt

SEQ ID NO: 345166 - DNA, 20 bp, Artificial
  CRISPR gRNA sequence
tgtgggtgtccctgaatgtc

SEQ ID NO: 345167 - DNA, 20 bp, Artificial
  CRISPR gRNA sequence
gtgggtgtccctgaatgtca

SEQ ID NO: 345168 - DNA, 20 bp, Artificial
  CRISPR gRNA sequence
gtccctgaatgtcagggcca

SEQ ID NO: 345169 - DNA, 20 bp, Artificial
  CRISPR gRNA sequence
tccctgaatgtcagggccat

SEQ ID NO: 345170 - DNA, 20 bp, Artificial
  CRISPR gRNA sequence
cctgaatgtcagggccatgg

SEQ ID NO: 345171 - DNA, 20 bp, Artificial
  CRISPR gRNA sequence
ctgaatgtcagggccatggg

SEQ ID NO: 345172 - DNA, 20 bp, Artificial
  CRISPR gRNA sequence
tgaatgtcagggccatggga

SEQ ID NO: 345173 - DNA, 20 bp, Artificial
  CRISPR gRNA sequence
cagggccatgggagggcccc

SEQ ID NO: 345174 - DNA, 20 bp, Artificial
  CRISPR gRNA sequence
agggccatgggagggcccct

SEQ ID NO: 345175 - DNA, 20 bp, Artificial
  CRISPR gRNA sequence
atgggagggcccctgggctt

SEQ ID NO: 345176 - DNA, 20 bp, Artificial
  CRISPR gRNA sequence
tgggagggcccctgggcttc

SEQ ID NO: 345177 - DNA, 20 bp, Artificial
  CRISPR gRNA sequence
gggagggcccctgggcttca

SEQ ID NO: 345178 - DNA, 20 bp, Artificial
  CRISPR gRNA sequence
ggagggcccctgggcttcag

SEQ ID NO: 345179 - DNA, 20 bp, Artificial
  CRISPR gRNA sequence
ggcccctgggcttcaggggt

SEQ ID NO: 345180 - DNA, 20 bp, Artificial
  CRISPR gRNA sequence
gcccctgggcttcaggggtt

SEQ ID NO: 345181 - DNA, 20 bp, Artificial
  CRISPR gRNA sequence
cccctgggcttcaggggttg

SEQ ID NO: 345182 - DNA, 20 bp, Artificial
  CRISPR gRNA sequence
tgggcttcaggggttgggga

SEQ ID NO: 345183 - DNA, 20 bp, Artificial
  CRISPR gRNA sequence
ctctgctctttgtccacctt

SEQ ID NO: 345184 - DNA, 20 bp, Artificial
  CRISPR gRNA sequence
tctgctctttgtccaccttc

SEQ ID NO: 345185 - DNA, 20 bp, Artificial
  CRISPR gRNA sequence
tgctctttgtccaccttcgg

SEQ ID NO: 345186 - DNA, 20 bp, Artificial
  CRISPR gRNA sequence
gctctttgtccaccttcggg

SEQ ID NO: 345187 - DNA, 20 bp, Artificial
  CRISPR gRNA sequence
acaccttcaaatgctgaccc

SEQ ID NO: 345188 - DNA, 20 bp, Artificial
  CRISPR gRNA sequence
caccttcaaatgctgaccct

SEQ ID NO: 345189 - DNA, 20 bp, Artificial
  CRISPR gRNA sequence
cctgggcccctaactgacct

SEQ ID NO: 345190 - DNA, 20 bp, Artificial
  CRISPR gRNA sequence
ccctaactgacctgagactt

SEQ ID NO: 345191 - DNA, 20 bp, Artificial
  CRISPR gRNA sequence
ctaactgacctgagacttca

SEQ ID NO: 345192 - DNA, 20 bp, Artificial
  CRISPR gRNA sequence
cctgagacttcagagcttct

SEQ ID NO: 345193 - DNA, 20 bp, Artificial
  CRISPR gRNA sequence
ctgagacttcagagcttctt

SEQ ID NO: 345194 - DNA, 20 bp, Artificial
  CRISPR gRNA sequence
gagacttcagagcttcttgg

SEQ ID NO: 345195 - DNA, 20 bp, Artificial
  CRISPR gRNA sequence
agacttcagagcttcttggg

SEQ ID NO: 345196 - DNA, 20 bp, Artificial
  CRISPR gRNA sequence
acttcagagcttcttgggag

SEQ ID NO: 345197 - DNA, 20 bp, Artificial
  CRISPR gRNA sequence
cagagcttcttgggaggagc

SEQ ID NO: 345198 - DNA, 20 bp, Artificial
  CRISPR gRNA sequence
agagcttcttgggaggagct

SEQ ID NO: 345199 - DNA, 20 bp, Artificial
  CRISPR gRNA sequence
gagcttcttgggaggagctg

SEQ ID NO: 345200 - DNA, 20 bp, Artificial
  CRISPR gRNA sequence
tgggaggagctggggtcccc

SEQ ID NO: 345201 - DNA, 20 bp, Artificial
  CRISPR gRNA sequence
gaggagctggggtcccccag

SEQ ID NO: 345202 - DNA, 20 bp, Artificial
  CRISPR gRNA sequence
ggagctggggtcccccagcg

SEQ ID NO: 345203 - DNA, 20 bp, Artificial
  CRISPR gRNA sequence
tggggtcccccagcggagcc

SEQ ID NO: 345204 - DNA, 20 bp, Artificial
  CRISPR gRNA sequence
ggggtcccccagcggagcct

SEQ ID NO: 345205 - DNA, 20 bp, Artificial
  CRISPR gRNA sequence
tcccccagcggagcctggga

SEQ ID NO: 345206 - DNA, 20 bp, Artificial
  CRISPR gRNA sequence
ccccagcggagcctgggatg

SEQ ID NO: 345207 - DNA, 20 bp, Artificial
  CRISPR gRNA sequence
cagcggagcctgggatggag

SEQ ID NO: 345208 - DNA, 20 bp, Artificial
  CRISPR gRNA sequence
agcggagcctgggatggagc

SEQ ID NO: 345209 - DNA, 20 bp, Artificial
  CRISPR gRNA sequence
gcggagcctgggatggagca

SEQ ID NO: 345210 - DNA, 20 bp, Artificial
  CRISPR gRNA sequence
agcctgggatggagcaggga

SEQ ID NO: 345211 - DNA, 20 bp, Artificial
  CRISPR gRNA sequence
tggagcagggatggctgccc

SEQ ID NO: 345212 - DNA, 20 bp, Artificial
  CRISPR gRNA sequence
ggagcagggatggctgcccc

SEQ ID NO: 345213 - DNA, 20 bp, Artificial
  CRISPR gRNA sequence
gagcagggatggctgcccca

SEQ ID NO: 345214 - DNA, 20 bp, Artificial
  CRISPR gRNA sequence
gcagggatggctgccccagg

SEQ ID NO: 345215 - DNA, 20 bp, Artificial
  CRISPR gRNA sequence
cagggatggctgccccaggg

SEQ ID NO: 345216 - DNA, 20 bp, Artificial
  CRISPR gRNA sequence
agggatggctgccccaggga

SEQ ID NO: 345217 - DNA, 20 bp, Artificial
  CRISPR gRNA sequence
gggatggctgccccagggag

SEQ ID NO: 345218 - DNA, 20 bp, Artificial
  CRISPR gRNA sequence
ggatggctgccccagggagg

SEQ ID NO: 345219 - DNA, 20 bp, Artificial
  CRISPR gRNA sequence
tggctgccccagggaggggg

SEQ ID NO: 345220 - DNA, 20 bp, Artificial
  CRISPR gRNA sequence
ctgccccagggagggggcgg

SEQ ID NO: 345221 - DNA, 20 bp, Artificial
  CRISPR gRNA sequence
tgccccagggagggggcggt

SEQ ID NO: 345222 - DNA, 20 bp, Artificial
  CRISPR gRNA sequence
gccccagggagggggcggtg

SEQ ID NO: 345223 - DNA, 20 bp, Artificial
  CRISPR gRNA sequence
gctctgccctcctcgtcctc

SEQ ID NO: 345224 - DNA, 20 bp, Artificial
  CRISPR gRNA sequence
ccctcctcgtcctctggccc

SEQ ID NO: 345225 - DNA, 20 bp, Artificial
  CRISPR gRNA sequence
ctcgtcctctggccccagct

SEQ ID NO: 345226 - DNA, 20 bp, Artificial
  CRISPR gRNA sequence
agctcagtcctgtccatctc

SEQ ID NO: 345227 - DNA, 20 bp, Artificial
  CRISPR gRNA sequence
aaccatttttgtcccgacac

SEQ ID NO: 345228 - DNA, 20 bp, Artificial
  CRISPR gRNA sequence
cttctgtccttgtctgccac

SEQ ID NO: 345229 - DNA, 20 bp, Artificial
  CRISPR gRNA sequence
gccactggtctcccgtgctc

SEQ ID NO: 345230 - DNA, 20 bp, Artificial
  CRISPR gRNA sequence
ccactggtctcccgtgctct

SEQ ID NO: 345231 - DNA, 20 bp, Artificial
  CRISPR gRNA sequence
cactggtctcccgtgctctg

SEQ ID NO: 345232 - DNA, 20 bp, Artificial
  CRISPR gRNA sequence
ctctggggtctctgcactgc

SEQ ID NO: 345233 - DNA, 20 bp, Artificial
  CRISPR gRNA sequence
gccgtcctgtctcctttgcc

SEQ ID NO: 345234 - DNA, 20 bp, Artificial
  CRISPR gRNA sequence
tccttctctccacctcccca

SEQ ID NO: 345235 - DNA, 20 bp, Artificial
  CRISPR gRNA sequence
ctctccacctccccatagcc

SEQ ID NO: 345236 - DNA, 20 bp, Artificial
  CRISPR gRNA sequence
cacctccccatagccgagct

SEQ ID NO: 345237 - DNA, 20 bp, Artificial
  CRISPR gRNA sequence
ccccatagccgagcttggaa

SEQ ID NO: 345238 - DNA, 20 bp, Artificial
  CRISPR gRNA sequence
atagccgagcttggaaaagt

SEQ ID NO: 345239 - DNA, 20 bp, Artificial
  CRISPR gRNA sequence
ccgagcttggaaaagtcaga

SEQ ID NO: 345240 - DNA, 20 bp, Artificial
  CRISPR gRNA sequence
gaaaagtcagacagacctct

SEQ ID NO: 345241 - DNA, 20 bp, Artificial
  CRISPR gRNA sequence
aaaagtcagacagacctctg

SEQ ID NO: 345242 - DNA, 20 bp, Artificial
  CRISPR gRNA sequence
agacctctgaggtctcatcc

SEQ ID NO: 345243 - DNA, 20 bp, Artificial
  CRISPR gRNA sequence
acctctgaggtctcatcctg

SEQ ID NO: 345244 - DNA, 20 bp, Artificial
  CRISPR gRNA sequence
tctcatcctggagctgccac

SEQ ID NO: 345245 - DNA, 20 bp, Artificial
  CRISPR gRNA sequence
tcctggagctgccaccagcc

SEQ ID NO: 345246 - DNA, 20 bp, Artificial
  CRISPR gRNA sequence
tgccaccagcccagcctccc

SEQ ID NO: 345247 - DNA, 20 bp, Artificial
  CRISPR gRNA sequence
gccaccagcccagcctccct

SEQ ID NO: 345248 - DNA, 20 bp, Artificial
  CRISPR gRNA sequence
tgggacctgtcttcactgcc

SEQ ID NO: 345249 - DNA, 20 bp, Artificial
  CRISPR gRNA sequence
gggacctgtcttcactgcct

SEQ ID NO: 345250 - DNA, 20 bp, Artificial
  CRISPR gRNA sequence
ggacctgtcttcactgcctg

SEQ ID NO: 345251 - DNA, 20 bp, Artificial
  CRISPR gRNA sequence
gtcttcactgcctggggccc

SEQ ID NO: 345252 - DNA, 20 bp, Artificial
  CRISPR gRNA sequence
tcttcactgcctggggccct

SEQ ID NO: 345253 - DNA, 20 bp, Artificial
  CRISPR gRNA sequence
ttcactgcctggggccctgg

SEQ ID NO: 345254 - DNA, 20 bp, Artificial
  CRISPR gRNA sequence
ctgcctggggccctgggagc

SEQ ID NO: 345255 - DNA, 20 bp, Artificial
  CRISPR gRNA sequence
tgcctggggccctgggagcc

SEQ ID NO: 345256 - DNA, 20 bp, Artificial
  CRISPR gRNA sequence
gcctggggccctgggagcca

SEQ ID NO: 345257 - DNA, 20 bp, Artificial
  CRISPR gRNA sequence
ctggggccctgggagccagg

SEQ ID NO: 345258 - DNA, 20 bp, Artificial
  CRISPR gRNA sequence
tggggccctgggagccaggg

SEQ ID NO: 345259 - DNA, 20 bp, Artificial
  CRISPR gRNA sequence
gggagccagggaggctccct

SEQ ID NO: 345260 - DNA, 20 bp, Artificial
  CRISPR gRNA sequence
ggagccagggaggctccctg

SEQ ID NO: 345261 - DNA, 20 bp, Artificial
  CRISPR gRNA sequence
cagggaggctccctgaggct

SEQ ID NO: 345262 - DNA, 20 bp, Artificial
  CRISPR gRNA sequence
ccctgaggctgagtgaacac

SEQ ID NO: 345263 - DNA, 20 bp, Artificial
  CRISPR gRNA sequence
cctgaggctgagtgaacact

SEQ ID NO: 345264 - DNA, 20 bp, Artificial
  CRISPR gRNA sequence
acctgcctctcccacgtcct

SEQ ID NO: 345265 - DNA, 20 bp, Artificial
  CRISPR gRNA sequence
cgtcctcggccccactcccg

SEQ ID NO: 345266 - DNA, 20 bp, Artificial
  CRISPR gRNA sequence
gtcctcggccccactcccgc

SEQ ID NO: 345267 - DNA, 20 bp, Artificial
  CRISPR gRNA sequence
cggccccactcccgcaggtg

SEQ ID NO: 345268 - DNA, 20 bp, Artificial
  CRISPR gRNA sequence
cccactcccgcaggtgcagc

SEQ ID NO: 345269 - DNA, 20 bp, Artificial
  CRISPR gRNA sequence
ctcccgcaggtgcagctggc

SEQ ID NO: 345270 - DNA, 20 bp, Artificial
  CRISPR gRNA sequence
ggtgcagctggctggtgacg

SEQ ID NO: 345271 - DNA, 20 bp, Artificial
  CRISPR gRNA sequence
gtgcagctggctggtgacga

SEQ ID NO: 345272 - DNA, 20 bp, Artificial
  CRISPR gRNA sequence
agctggctggtgacgaaggc

SEQ ID NO: 345273 - DNA, 20 bp, Artificial
  CRISPR gRNA sequence
ctggctggtgacgaaggccg

SEQ ID NO: 345274 - DNA, 20 bp, Artificial
  CRISPR gRNA sequence
ctggtgacgaaggccggagc

SEQ ID NO: 345275 - DNA, 20 bp, Artificial
  CRISPR gRNA sequence
tggtgacgaaggccggagct

SEQ ID NO: 345276 - DNA, 20 bp, Artificial
  CRISPR gRNA sequence
acgaaggccggagctgggac

SEQ ID NO: 345277 - DNA, 20 bp, Artificial
  CRISPR gRNA sequence
aaggccggagctgggaccag

SEQ ID NO: 345278 - DNA, 20 bp, Artificial
  CRISPR gRNA sequence
ctgggaccagcagctcccac

SEQ ID NO: 345279 - DNA, 20 bp, Artificial
  CRISPR gRNA sequence
tgggaccagcagctcccact

SEQ ID NO: 345280 - DNA, 20 bp, Artificial
  CRISPR gRNA sequence
ccagcagctcccactgggta

SEQ ID NO: 345281 - DNA, 20 bp, Artificial
  CRISPR gRNA sequence
gcagctcccactgggtatgg

SEQ ID NO: 345282 - DNA, 20 bp, Artificial
  CRISPR gRNA sequence
ctgggtatggtggtttctct

SEQ ID NO: 345283 - DNA, 20 bp, Artificial
  CRISPR gRNA sequence
tgggtatggtggtttctctc

SEQ ID NO: 345284 - DNA, 20 bp, Artificial
  CRISPR gRNA sequence
gggtatggtggtttctctca

SEQ ID NO: 345285 - DNA, 20 bp, Artificial
  CRISPR gRNA sequence
gtatggtggtttctctcagg

SEQ ID NO: 345286 - DNA, 20 bp, Artificial
  CRISPR gRNA sequence
catcgtcattgtttgctcca

SEQ ID NO: 345287 - DNA, 20 bp, Artificial
  CRISPR gRNA sequence
gtcattgtttgctccacagt

SEQ ID NO: 345288 - DNA, 20 bp, Artificial
  CRISPR gRNA sequence
ggcctaatcatatgtgtgaa

SEQ ID NO: 345289 - DNA, 20 bp, Artificial
  CRISPR gRNA sequence
ctaatcatatgtgtgaaaag

SEQ ID NO: 345290 - DNA, 20 bp, Artificial
  CRISPR gRNA sequence
tcatatgtgtgaaaagaaga

SEQ ID NO: 345291 - DNA, 20 bp, Artificial
  CRISPR gRNA sequence
tgtgtgaaaagaagaaagcc

SEQ ID NO: 345292 - DNA, 20 bp, Artificial
  CRISPR gRNA sequence
gtgtgaaaagaagaaagcca

SEQ ID NO: 345293 - DNA, 20 bp, Artificial
  CRISPR gRNA sequence
tgtgaaaagaagaaagccaa

SEQ ID NO: 345294 - DNA, 20 bp, Artificial
  CRISPR gRNA sequence
gtgaaaagaagaaagccaag

SEQ ID NO: 345295 - DNA, 20 bp, Artificial
  CRISPR gRNA sequence
aaagaagaaagccaaggggt

SEQ ID NO: 345296 - DNA, 20 bp, Artificial
  CRISPR gRNA sequence
aaagccaaggggtgagcaca

SEQ ID NO: 345297 - DNA, 20 bp, Artificial
  CRISPR gRNA sequence
gccaaggggtgagcacacgg

SEQ ID NO: 345298 - DNA, 20 bp, Artificial
  CRISPR gRNA sequence
tgagcacacggcggccccat

SEQ ID NO: 345299 - DNA, 20 bp, Artificial
  CRISPR gRNA sequence
gagcacacggcggccccatc

SEQ ID NO: 345300 - DNA, 20 bp, Artificial
  CRISPR gRNA sequence
agcacacggcggccccatca

SEQ ID NO: 345301 - DNA, 20 bp, Artificial
  CRISPR gRNA sequence
cccatcagggctcatgtccc

SEQ ID NO: 345302 - DNA, 20 bp, Artificial
  CRISPR gRNA sequence
tgtccccagccgtcacctct

SEQ ID NO: 345303 - DNA, 20 bp, Artificial
  CRISPR gRNA sequence
tccccagccgtcacctcttg

SEQ ID NO: 345304 - DNA, 20 bp, Artificial
  CRISPR gRNA sequence
tcttggagctctgtcacccc

SEQ ID NO: 345305 - DNA, 20 bp, Artificial
  CRISPR gRNA sequence
gagctctgtcaccccaagcc

SEQ ID NO: 345306 - DNA, 20 bp, Artificial
  CRISPR gRNA sequence
agctctgtcaccccaagcct

SEQ ID NO: 345307 - DNA, 20 bp, Artificial
  CRISPR gRNA sequence
ctctgtcaccccaagcctgg

SEQ ID NO: 345308 - DNA, 20 bp, Artificial
  CRISPR gRNA sequence
tctgtcaccccaagcctggg

SEQ ID NO: 345309 - DNA, 20 bp, Artificial
  CRISPR gRNA sequence
gtcaccccaagcctgggagg

SEQ ID NO: 345310 - DNA, 20 bp, Artificial
  CRISPR gRNA sequence
ccaagcctgggaggtggccc

SEQ ID NO: 345311 - DNA, 20 bp, Artificial
  CRISPR gRNA sequence
aagcctgggaggtggcccca

SEQ ID NO: 345312 - DNA, 20 bp, Artificial
  CRISPR gRNA sequence
aggtggccccagagcttttc

SEQ ID NO: 345313 - DNA, 20 bp, Artificial
  CRISPR gRNA sequence
ggtggccccagagcttttcc

SEQ ID NO: 345314 - DNA, 20 bp, Artificial
  CRISPR gRNA sequence
cagagcttttccaggatccg

SEQ ID NO: 345315 - DNA, 20 bp, Artificial
  CRISPR gRNA sequence
ccaggatccgcggctcctcc

SEQ ID NO: 345316 - DNA, 20 bp, Artificial
  CRISPR gRNA sequence
caggatccgcggctcctccc

SEQ ID NO: 345317 - DNA, 20 bp, Artificial
  CRISPR gRNA sequence
aggatccgcggctcctccca

SEQ ID NO: 345318 - DNA, 20 bp, Artificial
  CRISPR gRNA sequence
atccgcggctcctcccaggg

SEQ ID NO: 345319 - DNA, 20 bp, Artificial
  CRISPR gRNA sequence
tcctcccagggcagccactg

SEQ ID NO: 345320 - DNA, 20 bp, Artificial
  CRISPR gRNA sequence
cctcccagggcagccactgc

SEQ ID NO: 345321 - DNA, 20 bp, Artificial
  CRISPR gRNA sequence
ccagggcagccactgcaggc

SEQ ID NO: 345322 - DNA, 20 bp, Artificial
  CRISPR gRNA sequence
cagggcagccactgcaggct

SEQ ID NO: 345323 - DNA, 20 bp, Artificial
  CRISPR gRNA sequence
agggcagccactgcaggctg

SEQ ID NO: 345324 - DNA, 20 bp, Artificial
  CRISPR gRNA sequence
gcagccactgcaggctgggg

SEQ ID NO: 345325 - DNA, 20 bp, Artificial
  CRISPR gRNA sequence
cagccactgcaggctggggc

SEQ ID NO: 345326 - DNA, 20 bp, Artificial
  CRISPR gRNA sequence
ccactgcaggctggggcagg

SEQ ID NO: 345327 - DNA, 20 bp, Artificial
  CRISPR gRNA sequence
cactgcaggctggggcaggt

SEQ ID NO: 345328 - DNA, 20 bp, Artificial
  CRISPR gRNA sequence
ggcaggtgggctttctgctg

SEQ ID NO: 345329 - DNA, 20 bp, Artificial
  CRISPR gRNA sequence
ggtgggctttctgctgtggc

SEQ ID NO: 345330 - DNA, 20 bp, Artificial
  CRISPR gRNA sequence
tgggctttctgctgtggcca

SEQ ID NO: 345331 - DNA, 20 bp, Artificial
  CRISPR gRNA sequence
tttctgctgtggccagagcc

SEQ ID NO: 345332 - DNA, 20 bp, Artificial
  CRISPR gRNA sequence
ttctgctgtggccagagccc

SEQ ID NO: 345333 - DNA, 20 bp, Artificial
  CRISPR gRNA sequence
tgtggccagagcccaggtgt

SEQ ID NO: 345334 - DNA, 20 bp, Artificial
  CRISPR gRNA sequence
gccagagcccaggtgtcagc

SEQ ID NO: 345335 - DNA, 20 bp, Artificial
  CRISPR gRNA sequence
caggtgtcagctggcctccc

SEQ ID NO: 345336 - DNA, 20 bp, Artificial
  CRISPR gRNA sequence
aggtgtcagctggcctccct

SEQ ID NO: 345337 - DNA, 20 bp, Artificial
  CRISPR gRNA sequence
ggtgtcagctggcctccctg

SEQ ID NO: 345338 - DNA, 20 bp, Artificial
  CRISPR gRNA sequence
gtgtcagctggcctccctgg

SEQ ID NO: 345339 - DNA, 20 bp, Artificial
  CRISPR gRNA sequence
tcagctggcctccctggggg

SEQ ID NO: 345340 - DNA, 20 bp, Artificial
  CRISPR gRNA sequence
cagctggcctccctggggga

SEQ ID NO: 345341 - DNA, 20 bp, Artificial
  CRISPR gRNA sequence
agctggcctccctgggggaa

SEQ ID NO: 345342 - DNA, 20 bp, Artificial
  CRISPR gRNA sequence
tggcctccctgggggaaggg

SEQ ID NO: 345343 - DNA, 20 bp, Artificial
  CRISPR gRNA sequence
ggcctccctgggggaaggga

SEQ ID NO: 345344 - DNA, 20 bp, Artificial
  CRISPR gRNA sequence
ctccctgggggaagggaagg

SEQ ID NO: 345345 - DNA, 20 bp, Artificial
  CRISPR gRNA sequence
tccctgggggaagggaaggt

SEQ ID NO: 345346 - DNA, 20 bp, Artificial
  CRISPR gRNA sequence
gaaggtgggacccctgaccg

SEQ ID NO: 345347 - DNA, 20 bp, Artificial
  CRISPR gRNA sequence
aggtgggacccctgaccgtg

SEQ ID NO: 345348 - DNA, 20 bp, Artificial
  CRISPR gRNA sequence
acccctgaccgtggagccct

SEQ ID NO: 345349 - DNA, 20 bp, Artificial
  CRISPR gRNA sequence
gtgctcctgcctgccccctg

SEQ ID NO: 345350 - DNA, 20 bp, Artificial
  CRISPR gRNA sequence
tgctcctgcctgccccctgt

SEQ ID NO: 345351 - DNA, 20 bp, Artificial
  CRISPR gRNA sequence
tgcctgccccctgtgggatg

SEQ ID NO: 345352 - DNA, 20 bp, Artificial
  CRISPR gRNA sequence
gcctgccccctgtgggatgt

SEQ ID NO: 345353 - DNA, 20 bp, Artificial
  CRISPR gRNA sequence
cctgccccctgtgggatgtg

SEQ ID NO: 345354 - DNA, 20 bp, Artificial
  CRISPR gRNA sequence
tgccccctgtgggatgtggg

SEQ ID NO: 345355 - DNA, 20 bp, Artificial
  CRISPR gRNA sequence
cccctgtgggatgtggggag

SEQ ID NO: 345356 - DNA, 20 bp, Artificial
  CRISPR gRNA sequence
ccctgtgggatgtggggagc

SEQ ID NO: 345357 - DNA, 20 bp, Artificial
  CRISPR gRNA sequence
gtgggatgtggggagcagga

SEQ ID NO: 345358 - DNA, 20 bp, Artificial
  CRISPR gRNA sequence
tgggatgtggggagcaggac

SEQ ID NO: 345359 - DNA, 20 bp, Artificial
  CRISPR gRNA sequence
ggagcaggacaggccctgct

SEQ ID NO: 345360 - DNA, 20 bp, Artificial
  CRISPR gRNA sequence
caggacaggccctgctcagc

SEQ ID NO: 345361 - DNA, 20 bp, Artificial
  CRISPR gRNA sequence
aggacaggccctgctcagct

SEQ ID NO: 345362 - DNA, 20 bp, Artificial
  CRISPR gRNA sequence
gacaggccctgctcagctgg

SEQ ID NO: 345363 - DNA, 20 bp, Artificial
  CRISPR gRNA sequence
aggccctgctcagctgggag

SEQ ID NO: 345364 - DNA, 20 bp, Artificial
  CRISPR gRNA sequence
tgctcagctgggagaagctc

SEQ ID NO: 345365 - DNA, 20 bp, Artificial
  CRISPR gRNA sequence
gctcagctgggagaagctct

SEQ ID NO: 345366 - DNA, 20 bp, Artificial
  CRISPR gRNA sequence
gctgggagaagctctgggct

SEQ ID NO: 345367 - DNA, 20 bp, Artificial
  CRISPR gRNA sequence
ctgggagaagctctgggctg

SEQ ID NO: 345368 - DNA, 20 bp, Artificial
  CRISPR gRNA sequence
tgggagaagctctgggctga

SEQ ID NO: 345369 - DNA, 20 bp, Artificial
  CRISPR gRNA sequence
agctctgggctgagggtcaa

SEQ ID NO: 345370 - DNA, 20 bp, Artificial
  CRISPR gRNA sequence
agggtcaacagccgccctgc

SEQ ID NO: 345371 - DNA, 20 bp, Artificial
  CRISPR gRNA sequence
gggtcaacagccgccctgct

SEQ ID NO: 345372 - DNA, 20 bp, Artificial
  CRISPR gRNA sequence
ggtcaacagccgccctgctg

SEQ ID NO: 345373 - DNA, 20 bp, Artificial
  CRISPR gRNA sequence
acagccgccctgctggggac

SEQ ID NO: 345374 - DNA, 20 bp, Artificial
  CRISPR gRNA sequence
cagccgccctgctggggaca

SEQ ID NO: 345375 - DNA, 20 bp, Artificial
  CRISPR gRNA sequence
gacaaggctttgtcctcatt

SEQ ID NO: 345376 - DNA, 20 bp, Artificial
  CRISPR gRNA sequence
acaaggctttgtcctcattg

SEQ ID NO: 345377 - DNA, 20 bp, Artificial
  CRISPR gRNA sequence
aaggctttgtcctcattgag

SEQ ID NO: 345378 - DNA, 20 bp, Artificial
  CRISPR gRNA sequence
ggctttgtcctcattgagga

SEQ ID NO: 345379 - DNA, 20 bp, Artificial
  CRISPR gRNA sequence
ttgtcctcattgaggagagt

SEQ ID NO: 345380 - DNA, 20 bp, Artificial
  CRISPR gRNA sequence
tgtcctcattgaggagagta

SEQ ID NO: 345381 - DNA, 20 bp, Artificial
  CRISPR gRNA sequence
attcatccacctatccgccc

SEQ ID NO: 345382 - DNA, 20 bp, Artificial
  CRISPR gRNA sequence
tccacctatccgccctggtc

SEQ ID NO: 345383 - DNA, 20 bp, Artificial
  CRISPR gRNA sequence
ccacctatccgccctggtct

SEQ ID NO: 345384 - DNA, 20 bp, Artificial
  CRISPR gRNA sequence
ctgggcacctgtgctgtgcc

SEQ ID NO: 345385 - DNA, 20 bp, Artificial
  CRISPR gRNA sequence
tgtgcctggcctcctgtgcc

SEQ ID NO: 345386 - DNA, 20 bp, Artificial
  CRISPR gRNA sequence
gcctcctgtgcctggcctcc

SEQ ID NO: 345387 - DNA, 20 bp, Artificial
  CRISPR gRNA sequence
cctcctgtgcctggcctcct

SEQ ID NO: 345388 - DNA, 20 bp, Artificial
  CRISPR gRNA sequence
tgggcactgaccccgctgtg

SEQ ID NO: 345389 - DNA, 20 bp, Artificial
  CRISPR gRNA sequence
ctgaccccgctgtgtggacc

SEQ ID NO: 345390 - DNA, 20 bp, Artificial
  CRISPR gRNA sequence
ccgctgtgtggacccggctg

SEQ ID NO: 345391 - DNA, 20 bp, Artificial
  CRISPR gRNA sequence
tgtggacccggctgtggccc

SEQ ID NO: 345392 - DNA, 20 bp, Artificial
  CRISPR gRNA sequence
gtggacccggctgtggccct

SEQ ID NO: 345393 - DNA, 20 bp, Artificial
  CRISPR gRNA sequence
ggacccggctgtggccctgg

SEQ ID NO: 345394 - DNA, 20 bp, Artificial
  CRISPR gRNA sequence
ggccctgggagccctgtgca

SEQ ID NO: 345395 - DNA, 20 bp, Artificial
  CRISPR gRNA sequence
ggagccctgtgcacagcccc

SEQ ID NO: 345396 - DNA, 20 bp, Artificial
  CRISPR gRNA sequence
gagccctgtgcacagccccc

SEQ ID NO: 345397 - DNA, 20 bp, Artificial
  CRISPR gRNA sequence
agccctgtgcacagcccccg

SEQ ID NO: 345398 - DNA, 20 bp, Artificial
  CRISPR gRNA sequence
gtgcacagcccccggggacg

SEQ ID NO: 345399 - DNA, 20 bp, Artificial
  CRISPR gRNA sequence
cccccggggacgcagcttct

SEQ ID NO: 345400 - DNA, 20 bp, Artificial
  CRISPR gRNA sequence
ggacgcagcttctaagcatt

SEQ ID NO: 345401 - DNA, 20 bp, Artificial
  CRISPR gRNA sequence
gacgcagcttctaagcattg

SEQ ID NO: 345402 - DNA, 20 bp, Artificial
  CRISPR gRNA sequence
cttctaagcattgaggtctg

SEQ ID NO: 345403 - DNA, 20 bp, Artificial
  CRISPR gRNA sequence
ttctaagcattgaggtctga

SEQ ID NO: 345404 - DNA, 20 bp, Artificial
  CRISPR gRNA sequence
tctaagcattgaggtctgaa

SEQ ID NO: 345405 - DNA, 20 bp, Artificial
  CRISPR gRNA sequence
agcattgaggtctgaaggga

SEQ ID NO: 345406 - DNA, 20 bp, Artificial
  CRISPR gRNA sequence
ttgaggtctgaagggaaagt

SEQ ID NO: 345407 - DNA, 20 bp, Artificial
  CRISPR gRNA sequence
ggaaagtcagccccatcctc

SEQ ID NO: 345408 - DNA, 20 bp, Artificial
  CRISPR gRNA sequence
agtcagccccatcctccagc

SEQ ID NO: 345409 - DNA, 20 bp, Artificial
  CRISPR gRNA sequence
gtcagccccatcctccagcc

SEQ ID NO: 345410 - DNA, 20 bp, Artificial
  CRISPR gRNA sequence
agccccatcctccagccagg

SEQ ID NO: 345411 - DNA, 20 bp, Artificial
  CRISPR gRNA sequence
cccatcctccagccaggcgg

SEQ ID NO: 345412 - DNA, 20 bp, Artificial
  CRISPR gRNA sequence
cctccagccaggcggcagca

SEQ ID NO: 345413 - DNA, 20 bp, Artificial
  CRISPR gRNA sequence
aaagccacctgatcctcacc

SEQ ID NO: 345414 - DNA, 20 bp, Artificial
  CRISPR gRNA sequence
aagccacctgatcctcaccc

SEQ ID NO: 345415 - DNA, 20 bp, Artificial
  CRISPR gRNA sequence
agccacctgatcctcacccg

SEQ ID NO: 345416 - DNA, 20 bp, Artificial
  CRISPR gRNA sequence
ctcacccggggcctccaatg

SEQ ID NO: 345417 - DNA, 20 bp, Artificial
  CRISPR gRNA sequence
tcacccggggcctccaatgc

SEQ ID NO: 345418 - DNA, 20 bp, Artificial
  CRISPR gRNA sequence
cacccggggcctccaatgcg

SEQ ID NO: 345419 - DNA, 20 bp, Artificial
  CRISPR gRNA sequence
cccggggcctccaatgcggg

SEQ ID NO: 345420 - DNA, 20 bp, Artificial
  CRISPR gRNA sequence
ccggggcctccaatgcgggg

SEQ ID NO: 345421 - DNA, 20 bp, Artificial
  CRISPR gRNA sequence
cctccaatgcggggaggtct

SEQ ID NO: 345422 - DNA, 20 bp, Artificial
  CRISPR gRNA sequence
ctccaatgcggggaggtctc

SEQ ID NO: 345423 - DNA, 20 bp, Artificial
  CRISPR gRNA sequence
tccaatgcggggaggtctcg

SEQ ID NO: 345424 - DNA, 20 bp, Artificial
  CRISPR gRNA sequence
gcggggaggtctcggggcct

SEQ ID NO: 345425 - DNA, 20 bp, Artificial
  CRISPR gRNA sequence
cggggaggtctcggggcctc

SEQ ID NO: 345426 - DNA, 20 bp, Artificial
  CRISPR gRNA sequence
ggtctcggggcctcaggctc

SEQ ID NO: 345427 - DNA, 20 bp, Artificial
  CRISPR gRNA sequence
gtctcggggcctcaggctct

SEQ ID NO: 345428 - DNA, 20 bp, Artificial
  CRISPR gRNA sequence
tctcggggcctcaggctcta

SEQ ID NO: 345429 - DNA, 20 bp, Artificial
  CRISPR gRNA sequence
cggggcctcaggctctaggg

SEQ ID NO: 345430 - DNA, 20 bp, Artificial
  CRISPR gRNA sequence
ggggcctcaggctctagggt

SEQ ID NO: 345431 - DNA, 20 bp, Artificial
  CRISPR gRNA sequence
cctcaggctctagggtaggc

SEQ ID NO: 345432 - DNA, 20 bp, Artificial
  CRISPR gRNA sequence
ctcaggctctagggtaggcc

SEQ ID NO: 345433 - DNA, 20 bp, Artificial
  CRISPR gRNA sequence
aggctctagggtaggccggg

SEQ ID NO: 345434 - DNA, 20 bp, Artificial
  CRISPR gRNA sequence
ctctagggtaggccgggcag

SEQ ID NO: 345435 - DNA, 20 bp, Artificial
  CRISPR gRNA sequence
gggtaggccgggcagcagct

SEQ ID NO: 345436 - DNA, 20 bp, Artificial
  CRISPR gRNA sequence
gcagcttagtctcacccaac

SEQ ID NO: 345437 - DNA, 20 bp, Artificial
  CRISPR gRNA sequence
cagcttagtctcacccaact

SEQ ID NO: 345438 - DNA, 20 bp, Artificial
  CRISPR gRNA sequence
tcacccaactgggcacctgc

SEQ ID NO: 345439 - DNA, 20 bp, Artificial
  CRISPR gRNA sequence
caactgggcacctgctggta

SEQ ID NO: 345440 - DNA, 20 bp, Artificial
  CRISPR gRNA sequence
ctgggcacctgctggtatgg

SEQ ID NO: 345441 - DNA, 20 bp, Artificial
  CRISPR gRNA sequence
tgggcacctgctggtatggt

SEQ ID NO: 345442 - DNA, 20 bp, Artificial
  CRISPR gRNA sequence
gcacctgctggtatggtggg

SEQ ID NO: 345443 - DNA, 20 bp, Artificial
  CRISPR gRNA sequence
cacctgctggtatggtgggc

SEQ ID NO: 345444 - DNA, 20 bp, Artificial
  CRISPR gRNA sequence
acctgctggtatggtgggca

SEQ ID NO: 345445 - DNA, 20 bp, Artificial
  CRISPR gRNA sequence
ggcagggcctctccactgtg

SEQ ID NO: 345446 - DNA, 20 bp, Artificial
  CRISPR gRNA sequence
aagcgcttgttcccctccca

SEQ ID NO: 345447 - DNA, 20 bp, Artificial
  CRISPR gRNA sequence
tgttcccctcccatagatga

SEQ ID NO: 345448 - DNA, 20 bp, Artificial
  CRISPR gRNA sequence
cccatagatgacggttgaat

SEQ ID NO: 345449 - DNA, 20 bp, Artificial
  CRISPR gRNA sequence
ccatagatgacggttgaatt

SEQ ID NO: 345450 - DNA, 20 bp, Artificial
  CRISPR gRNA sequence
catagatgacggttgaatta

SEQ ID NO: 345451 - DNA, 20 bp, Artificial
  CRISPR gRNA sequence
gatgacggttgaattagggt

SEQ ID NO: 345452 - DNA, 20 bp, Artificial
  CRISPR gRNA sequence
attagggttagttatgcact

SEQ ID NO: 345453 - DNA, 20 bp, Artificial
  CRISPR gRNA sequence
ttagggttagttatgcactt

SEQ ID NO: 345454 - DNA, 20 bp, Artificial
  CRISPR gRNA sequence
tagggttagttatgcacttg

SEQ ID NO: 345455 - DNA, 20 bp, Artificial
  CRISPR gRNA sequence
agggttagttatgcacttgg

SEQ ID NO: 345456 - DNA, 20 bp, Artificial
  CRISPR gRNA sequence
agttatgcacttgggggcct

SEQ ID NO: 345457 - DNA, 20 bp, Artificial
  CRISPR gRNA sequence
atgcacttgggggcctcagc

SEQ ID NO: 345458 - DNA, 20 bp, Artificial
  CRISPR gRNA sequence
tgcacttgggggcctcagct

SEQ ID NO: 345459 - DNA, 20 bp, Artificial
  CRISPR gRNA sequence
gcacttgggggcctcagctg

SEQ ID NO: 345460 - DNA, 20 bp, Artificial
  CRISPR gRNA sequence
acttgggggcctcagctggg

SEQ ID NO: 345461 - DNA, 20 bp, Artificial
  CRISPR gRNA sequence
cttgggggcctcagctgggg

SEQ ID NO: 345462 - DNA, 20 bp, Artificial
  CRISPR gRNA sequence
gggggcctcagctggggagg

SEQ ID NO: 345463 - DNA, 20 bp, Artificial
  CRISPR gRNA sequence
ggggcctcagctggggaggt

SEQ ID NO: 345464 - DNA, 20 bp, Artificial
  CRISPR gRNA sequence
cctcagctggggaggtgggc

SEQ ID NO: 345465 - DNA, 20 bp, Artificial
  CRISPR gRNA sequence
ctcagctggggaggtgggcc

SEQ ID NO: 345466 - DNA, 20 bp, Artificial
  CRISPR gRNA sequence
ggaggtgggccgggcgcccc

SEQ ID NO: 345467 - DNA, 20 bp, Artificial
  CRISPR gRNA sequence
cccagtcctatcacccatgc

SEQ ID NO: 345468 - DNA, 20 bp, Artificial
  CRISPR gRNA sequence
ccagtcctatcacccatgct

SEQ ID NO: 345469 - DNA, 20 bp, Artificial
  CRISPR gRNA sequence
atcacccatgctgggcctcc

SEQ ID NO: 345470 - DNA, 20 bp, Artificial
  CRISPR gRNA sequence
tcacccatgctgggcctcct

SEQ ID NO: 345471 - DNA, 20 bp, Artificial
  CRISPR gRNA sequence
cacccatgctgggcctcctg

SEQ ID NO: 345472 - DNA, 20 bp, Artificial
  CRISPR gRNA sequence
catgctgggcctcctgggga

SEQ ID NO: 345473 - DNA, 20 bp, Artificial
  CRISPR gRNA sequence
atgctgggcctcctggggac

SEQ ID NO: 345474 - DNA, 20 bp, Artificial
  CRISPR gRNA sequence
tgggcctcctggggacaggc

SEQ ID NO: 345475 - DNA, 20 bp, Artificial
  CRISPR gRNA sequence
gggcctcctggggacaggct

SEQ ID NO: 345476 - DNA, 20 bp, Artificial
  CRISPR gRNA sequence
ctcctggggacaggctgggc

SEQ ID NO: 345477 - DNA, 20 bp, Artificial
  CRISPR gRNA sequence
ctggggacaggctgggctag

SEQ ID NO: 345478 - DNA, 20 bp, Artificial
  CRISPR gRNA sequence
ctgggctagcagtcccaaca

SEQ ID NO: 345479 - DNA, 20 bp, Artificial
  CRISPR gRNA sequence
gctagcagtcccaacacagt

SEQ ID NO: 345480 - DNA, 20 bp, Artificial
  CRISPR gRNA sequence
cagttggcctcctctgctct

SEQ ID NO: 345481 - DNA, 20 bp, Artificial
  CRISPR gRNA sequence
gttggcctcctctgctctca

SEQ ID NO: 345482 - DNA, 20 bp, Artificial
  CRISPR gRNA sequence
tggcctcctctgctctcaga

SEQ ID NO: 345483 - DNA, 20 bp, Artificial
  CRISPR gRNA sequence
ggcctcctctgctctcagag

SEQ ID NO: 345484 - DNA, 20 bp, Artificial
  CRISPR gRNA sequence
gcctcctctgctctcagaga

SEQ ID NO: 345485 - DNA, 20 bp, Artificial
  CRISPR gRNA sequence
cctctgctctcagagagggt

SEQ ID NO: 345486 - DNA, 20 bp, Artificial
  CRISPR gRNA sequence
ctcagagagggtcagtccct

SEQ ID NO: 345487 - DNA, 20 bp, Artificial
  CRISPR gRNA sequence
tcagagagggtcagtccctt

SEQ ID NO: 345488 - DNA, 20 bp, Artificial
  CRISPR gRNA sequence
cagagagggtcagtcccttg

SEQ ID NO: 345489 - DNA, 20 bp, Artificial
  CRISPR gRNA sequence
gagggtcagtcccttgggga

SEQ ID NO: 345490 - DNA, 20 bp, Artificial
  CRISPR gRNA sequence
gtcccttggggacggtctcc

SEQ ID NO: 345491 - DNA, 20 bp, Artificial
  CRISPR gRNA sequence
tcccttggggacggtctccc

SEQ ID NO: 345492 - DNA, 20 bp, Artificial
  CRISPR gRNA sequence
cccttggggacggtctccca

SEQ ID NO: 345493 - DNA, 20 bp, Artificial
  CRISPR gRNA sequence
cttggggacggtctcccagg

SEQ ID NO: 345494 - DNA, 20 bp, Artificial
  CRISPR gRNA sequence
ggggacggtctcccagggag

SEQ ID NO: 345495 - DNA, 20 bp, Artificial
  CRISPR gRNA sequence
gacggtctcccagggagaag

SEQ ID NO: 345496 - DNA, 20 bp, Artificial
  CRISPR gRNA sequence
acggtctcccagggagaagc

SEQ ID NO: 345497 - DNA, 20 bp, Artificial
  CRISPR gRNA sequence
ggtctcccagggagaagcag

SEQ ID NO: 345498 - DNA, 20 bp, Artificial
  CRISPR gRNA sequence
tgtgcctccgccaccgctgt

SEQ ID NO: 345499 - DNA, 20 bp, Artificial
  CRISPR gRNA sequence
cgctgtgagaccattgccat

SEQ ID NO: 345500 - DNA, 20 bp, Artificial
  CRISPR gRNA sequence
atgagcctgtgtcccctgat

SEQ ID NO: 345501 - DNA, 20 bp, Artificial
  CRISPR gRNA sequence
acctgtgtgtctgtgtattg

SEQ ID NO: 345502 - DNA, 20 bp, Artificial
  CRISPR gRNA sequence
cctgtgtgtctgtgtattgc

SEQ ID NO: 345503 - DNA, 20 bp, Artificial
  CRISPR gRNA sequence
tctgtgtattgcaggtgatg

SEQ ID NO: 345504 - DNA, 20 bp, Artificial
  CRISPR gRNA sequence
gtattgcaggtgatgtagtc

SEQ ID NO: 345505 - DNA, 20 bp, Artificial
  CRISPR gRNA sequence
tattgcaggtgatgtagtca

SEQ ID NO: 345506 - DNA, 20 bp, Artificial
  CRISPR gRNA sequence
tcaaggtgatcgtctccgtc

SEQ ID NO: 345507 - DNA, 20 bp, Artificial
  CRISPR gRNA sequence
caaggtgatcgtctccgtcc

SEQ ID NO: 345508 - DNA, 20 bp, Artificial
  CRISPR gRNA sequence
cccacctcccctctccccgc

SEQ ID NO: 345509 - DNA, 20 bp, Artificial
  CRISPR gRNA sequence
ccacctcccctctccccgct

SEQ ID NO: 345510 - DNA, 20 bp, Artificial
  CRISPR gRNA sequence
cacctcccctctccccgctg

SEQ ID NO: 345511 - DNA, 20 bp, Artificial
  CRISPR gRNA sequence
tcccctctccccgctggggc

SEQ ID NO: 345512 - DNA, 20 bp, Artificial
  CRISPR gRNA sequence
cccgctggggctggtgtttc

SEQ ID NO: 345513 - DNA, 20 bp, Artificial
  CRISPR gRNA sequence
gctggtgtttctggtgtaca

SEQ ID NO: 345514 - DNA, 20 bp, Artificial
  CRISPR gRNA sequence
ggtgtttctggtgtacatgg

SEQ ID NO: 345515 - DNA, 20 bp, Artificial
  CRISPR gRNA sequence
gtgtttctggtgtacatggt

SEQ ID NO: 345516 - DNA, 20 bp, Artificial
  CRISPR gRNA sequence
tgtttctggtgtacatggtg

SEQ ID NO: 345517 - DNA, 20 bp, Artificial
  CRISPR gRNA sequence
gtttctggtgtacatggtgg

SEQ ID NO: 345518 - DNA, 20 bp, Artificial
  CRISPR gRNA sequence
gtgtacatggtgggggctcc

SEQ ID NO: 345519 - DNA, 20 bp, Artificial
  CRISPR gRNA sequence
gtgggggctcccagttctct

SEQ ID NO: 345520 - DNA, 20 bp, Artificial
  CRISPR gRNA sequence
tgggggctcccagttctctg

SEQ ID NO: 345521 - DNA, 20 bp, Artificial
  CRISPR gRNA sequence
gggggctcccagttctctga

SEQ ID NO: 345522 - DNA, 20 bp, Artificial
  CRISPR gRNA sequence
cccagttctctgagggtcct

SEQ ID NO: 345523 - DNA, 20 bp, Artificial
  CRISPR gRNA sequence
ctgagggtcctgagtctttc

SEQ ID NO: 345524 - DNA, 20 bp, Artificial
  CRISPR gRNA sequence
ggtcctgagtctttcaagta

SEQ ID NO: 345525 - DNA, 20 bp, Artificial
  CRISPR gRNA sequence
gagtctttcaagtacagcca

SEQ ID NO: 345526 - DNA, 20 bp, Artificial
  CRISPR gRNA sequence
tctttcaagtacagccacgg

SEQ ID NO: 345527 - DNA, 20 bp, Artificial
  CRISPR gRNA sequence
caagtacagccacggtagct

SEQ ID NO: 345528 - DNA, 20 bp, Artificial
  CRISPR gRNA sequence
aagtacagccacggtagctc

SEQ ID NO: 345529 - DNA, 20 bp, Artificial
  CRISPR gRNA sequence
acagccacggtagctcagga

SEQ ID NO: 345530 - DNA, 20 bp, Artificial
  CRISPR gRNA sequence
aacccaccccctcaaactga

SEQ ID NO: 345531 - DNA, 20 bp, Artificial
  CRISPR gRNA sequence
ccaccccctcaaactgaaag

SEQ ID NO: 345532 - DNA, 20 bp, Artificial
  CRISPR gRNA sequence
gaaagcagtaaaatgaaccc

SEQ ID NO: 345533 - DNA, 20 bp, Artificial
  CRISPR gRNA sequence
gtaaaatgaacccgagaacc

SEQ ID NO: 345534 - DNA, 20 bp, Artificial
  CRISPR gRNA sequence
aaaatgaacccgagaacctg

SEQ ID NO: 345535 - DNA, 20 bp, Artificial
  CRISPR gRNA sequence
aacccgagaacctggagtcc

SEQ ID NO: 345536 - DNA, 20 bp, Artificial
  CRISPR gRNA sequence
acccgagaacctggagtccc

SEQ ID NO: 345537 - DNA, 20 bp, Artificial
  CRISPR gRNA sequence
cccgagaacctggagtccca

SEQ ID NO: 345538 - DNA, 20 bp, Artificial
  CRISPR gRNA sequence
ccgagaacctggagtcccag

SEQ ID NO: 345539 - DNA, 20 bp, Artificial
  CRISPR gRNA sequence
cgagaacctggagtcccagg

SEQ ID NO: 345540 - DNA, 20 bp, Artificial
  CRISPR gRNA sequence
gagaacctggagtcccaggg

SEQ ID NO: 345541 - DNA, 20 bp, Artificial
  CRISPR gRNA sequence
ctggagtcccaggggggcct

SEQ ID NO: 345542 - DNA, 20 bp, Artificial
  CRISPR gRNA sequence
gagtcccaggggggcctgag

SEQ ID NO: 345543 - DNA, 20 bp, Artificial
  CRISPR gRNA sequence
agtcccaggggggcctgagc

SEQ ID NO: 345544 - DNA, 20 bp, Artificial
  CRISPR gRNA sequence
cccaggggggcctgagcagg

SEQ ID NO: 345545 - DNA, 20 bp, Artificial
  CRISPR gRNA sequence
ccaggggggcctgagcaggc

SEQ ID NO: 345546 - DNA, 20 bp, Artificial
  CRISPR gRNA sequence
caggggggcctgagcaggca

SEQ ID NO: 345547 - DNA, 20 bp, Artificial
  CRISPR gRNA sequence
ctccacgattcgtgtgctca

SEQ ID NO: 345548 - DNA, 20 bp, Artificial
  CRISPR gRNA sequence
cacgattcgtgtgctcacag

SEQ ID NO: 345549 - DNA, 20 bp, Artificial
  CRISPR gRNA sequence
ttcgtgtgctcacagcggaa

SEQ ID NO: 345550 - DNA, 20 bp, Artificial
  CRISPR gRNA sequence
tgtgctcacagcggaaaaga

SEQ ID NO: 345551 - DNA, 20 bp, Artificial
  CRISPR gRNA sequence
gtgctcacagcggaaaagac

SEQ ID NO: 345552 - DNA, 20 bp, Artificial
  CRISPR gRNA sequence
gctcacagcggaaaagacag

SEQ ID NO: 345553 - DNA, 20 bp, Artificial
  CRISPR gRNA sequence
ctcacagcggaaaagacagg

SEQ ID NO: 345554 - DNA, 20 bp, Artificial
  CRISPR gRNA sequence
acagcggaaaagacaggagg

SEQ ID NO: 345555 - DNA, 20 bp, Artificial
  CRISPR gRNA sequence
gcggaaaagacaggaggcag

SEQ ID NO: 345556 - DNA, 20 bp, Artificial
  CRISPR gRNA sequence
cggaaaagacaggaggcaga

SEQ ID NO: 345557 - DNA, 20 bp, Artificial
  CRISPR gRNA sequence
aaagacaggaggcagaaggt

SEQ ID NO: 345558 - DNA, 20 bp, Artificial
  CRISPR gRNA sequence
aagacaggaggcagaaggtg

SEQ ID NO: 345559 - DNA, 20 bp, Artificial
  CRISPR gRNA sequence
ggaggcagaaggtgaggcca

SEQ ID NO: 345560 - DNA, 20 bp, Artificial
  CRISPR gRNA sequence
aaggtgaggccacagtcatt

SEQ ID NO: 345561 - DNA, 20 bp, Artificial
  CRISPR gRNA sequence
aggtgaggccacagtcattg

SEQ ID NO: 345562 - DNA, 20 bp, Artificial
  CRISPR gRNA sequence
ccacagtcattgaggccctg

SEQ ID NO: 345563 - DNA, 20 bp, Artificial
  CRISPR gRNA sequence
cacagtcattgaggccctgc

SEQ ID NO: 345564 - DNA, 20 bp, Artificial
  CRISPR gRNA sequence
tgaggccctgcaggcccctc

SEQ ID NO: 345565 - DNA, 20 bp, Artificial
  CRISPR gRNA sequence
ggcccctccggacgtcacca

SEQ ID NO: 345566 - DNA, 20 bp, Artificial
  CRISPR gRNA sequence
ccctccggacgtcaccacgg

SEQ ID NO: 345567 - DNA, 20 bp, Artificial
  CRISPR gRNA sequence
ggacgtcaccacggtggccg

SEQ ID NO: 345568 - DNA, 20 bp, Artificial
  CRISPR gRNA sequence
acgtcaccacggtggccgtg

SEQ ID NO: 345569 - DNA, 20 bp, Artificial
  CRISPR gRNA sequence
cgtcaccacggtggccgtgg

SEQ ID NO: 345570 - DNA, 20 bp, Artificial
  CRISPR gRNA sequence
tcaccacggtggccgtggag

SEQ ID NO: 345571 - DNA, 20 bp, Artificial
  CRISPR gRNA sequence
ggagacaataccctcattca

SEQ ID NO: 345572 - DNA, 20 bp, Artificial
  CRISPR gRNA sequence
gagacaataccctcattcac

SEQ ID NO: 345573 - DNA, 20 bp, Artificial
  CRISPR gRNA sequence
agacaataccctcattcacg

SEQ ID NO: 345574 - DNA, 20 bp, Artificial
  CRISPR gRNA sequence
acaataccctcattcacggg

SEQ ID NO: 345575 - DNA, 20 bp, Artificial
  CRISPR gRNA sequence
caataccctcattcacgggg

SEQ ID NO: 345576 - DNA, 20 bp, Artificial
  CRISPR gRNA sequence
ataccctcattcacggggag

SEQ ID NO: 345577 - DNA, 20 bp, Artificial
  CRISPR gRNA sequence
gagcccaaaccactgaccca

SEQ ID NO: 345578 - DNA, 20 bp, Artificial
  CRISPR gRNA sequence
cagactctgcaccccgacgc

SEQ ID NO: 345579 - DNA, 20 bp, Artificial
  CRISPR gRNA sequence
gactctgcaccccgacgcca

SEQ ID NO: 345580 - DNA, 20 bp, Artificial
  CRISPR gRNA sequence
accccgacgccagagatacc

SEQ ID NO: 345581 - DNA, 20 bp, Artificial
  CRISPR gRNA sequence
cccgacgccagagatacctg

SEQ ID NO: 345582 - DNA, 20 bp, Artificial
  CRISPR gRNA sequence
gccagagatacctggagcga

SEQ ID NO: 345583 - DNA, 20 bp, Artificial
  CRISPR gRNA sequence
cctggagcgacggctgctga

SEQ ID NO: 345584 - DNA, 20 bp, Artificial
  CRISPR gRNA sequence
tggagcgacggctgctgaaa

SEQ ID NO: 345585 - DNA, 20 bp, Artificial
  CRISPR gRNA sequence
ggagcgacggctgctgaaag

SEQ ID NO: 345586 - DNA, 20 bp, Artificial
  CRISPR gRNA sequence
gctgaaagaggctgtccacc

SEQ ID NO: 345587 - DNA, 20 bp, Artificial
  CRISPR gRNA sequence
gaaagaggctgtccacctgg

SEQ ID NO: 345588 - DNA, 20 bp, Artificial
  CRISPR gRNA sequence
tgtccacctggcggaaccac

SEQ ID NO: 345589 - DNA, 20 bp, Artificial
  CRISPR gRNA sequence
tccacctggcggaaccaccg

SEQ ID NO: 345590 - DNA, 20 bp, Artificial
  CRISPR gRNA sequence
ctggcggaaccaccggagcc

SEQ ID NO: 345591 - DNA, 20 bp, Artificial
  CRISPR gRNA sequence
ggcggaaccaccggagcccg

SEQ ID NO: 345592 - DNA, 20 bp, Artificial
  CRISPR gRNA sequence
gcggaaccaccggagcccgg

SEQ ID NO: 345593 - DNA, 20 bp, Artificial
  CRISPR gRNA sequence
accaccggagcccggaggct

SEQ ID NO: 345594 - DNA, 20 bp, Artificial
  CRISPR gRNA sequence
ccaccggagcccggaggctt

SEQ ID NO: 345595 - DNA, 20 bp, Artificial
  CRISPR gRNA sequence
caccggagcccggaggcttg

SEQ ID NO: 345596 - DNA, 20 bp, Artificial
  CRISPR gRNA sequence
accggagcccggaggcttgg

SEQ ID NO: 345597 - DNA, 20 bp, Artificial
  CRISPR gRNA sequence
gaggcttgggggctccgccc

SEQ ID NO: 345598 - DNA, 20 bp, Artificial
  CRISPR gRNA sequence
aggcttgggggctccgccct

SEQ ID NO: 345599 - DNA, 20 bp, Artificial
  CRISPR gRNA sequence
ttgggggctccgccctgggc

SEQ ID NO: 345600 - DNA, 20 bp, Artificial
  CRISPR gRNA sequence
gggctggcttccgtctcctc

SEQ ID NO: 345601 - DNA, 20 bp, Artificial
  CRISPR gRNA sequence
ctggcttccgtctcctccag

SEQ ID NO: 345602 - DNA, 20 bp, Artificial
  CRISPR gRNA sequence
ggcttccgtctcctccagtg

SEQ ID NO: 345603 - DNA, 20 bp, Artificial
  CRISPR gRNA sequence
gcttccgtctcctccagtgg

SEQ ID NO: 345604 - DNA, 20 bp, Artificial
  CRISPR gRNA sequence
cttccgtctcctccagtgga

SEQ ID NO: 345605 - DNA, 20 bp, Artificial
  CRISPR gRNA sequence
tccgtctcctccagtggagg

SEQ ID NO: 345606 - DNA, 20 bp, Artificial
  CRISPR gRNA sequence
cgtctcctccagtggaggga

SEQ ID NO: 345607 - DNA, 20 bp, Artificial
  CRISPR gRNA sequence
gtctcctccagtggagggag

SEQ ID NO: 345608 - DNA, 20 bp, Artificial
  CRISPR gRNA sequence
tcctccagtggagggagagg

SEQ ID NO: 345609 - DNA, 20 bp, Artificial
  CRISPR gRNA sequence
cctccagtggagggagaggt

SEQ ID NO: 345610 - DNA, 20 bp, Artificial
  CRISPR gRNA sequence
ctccagtggagggagaggtg

SEQ ID NO: 345611 - DNA, 20 bp, Artificial
  CRISPR gRNA sequence
gggagaggtggggcccctgc

SEQ ID NO: 345612 - DNA, 20 bp, Artificial
  CRISPR gRNA sequence
ggagaggtggggcccctgct

SEQ ID NO: 345613 - DNA, 20 bp, Artificial
  CRISPR gRNA sequence
gagaggtggggcccctgctg

SEQ ID NO: 345614 - DNA, 20 bp, Artificial
  CRISPR gRNA sequence
aggtggggcccctgctgggg

SEQ ID NO: 345615 - DNA, 20 bp, Artificial
  CRISPR gRNA sequence
gtggggcccctgctggggta

SEQ ID NO: 345616 - DNA, 20 bp, Artificial
  CRISPR gRNA sequence
ggcccctgctggggtagagc

SEQ ID NO: 345617 - DNA, 20 bp, Artificial
  CRISPR gRNA sequence
gcccctgctggggtagagct

SEQ ID NO: 345618 - DNA, 20 bp, Artificial
  CRISPR gRNA sequence
cccctgctggggtagagctg

SEQ ID NO: 345619 - DNA, 20 bp, Artificial
  CRISPR gRNA sequence
gacgccacgtgccattccca

SEQ ID NO: 345620 - DNA, 20 bp, Artificial
  CRISPR gRNA sequence
acgccacgtgccattcccat

SEQ ID NO: 345621 - DNA, 20 bp, Artificial
  CRISPR gRNA sequence
cacgtgccattcccatgggc

SEQ ID NO: 345622 - DNA, 20 bp, Artificial
  CRISPR gRNA sequence
tgccattcccatgggccagt

SEQ ID NO: 345623 - DNA, 20 bp, Artificial
  CRISPR gRNA sequence
gccattcccatgggccagtg

SEQ ID NO: 345624 - DNA, 20 bp, Artificial
  CRISPR gRNA sequence
ccattcccatgggccagtga

SEQ ID NO: 345625 - DNA, 20 bp, Artificial
  CRISPR gRNA sequence
cccatgggccagtgagggcc

SEQ ID NO: 345626 - DNA, 20 bp, Artificial
  CRISPR gRNA sequence
ccatgggccagtgagggcct

SEQ ID NO: 345627 - DNA, 20 bp, Artificial
  CRISPR gRNA sequence
catgggccagtgagggcctg

SEQ ID NO: 345628 - DNA, 20 bp, Artificial
  CRISPR gRNA sequence
ctggggcctctgttctgctg

SEQ ID NO: 345629 - DNA, 20 bp, Artificial
  CRISPR gRNA sequence
cctctgttctgctgtggcct

SEQ ID NO: 345630 - DNA, 20 bp, Artificial
  CRISPR gRNA sequence
ctgctgtggcctgagctccc

SEQ ID NO: 345631 - DNA, 20 bp, Artificial
  CRISPR gRNA sequence
gctgtggcctgagctcccca

SEQ ID NO: 345632 - DNA, 20 bp, Artificial
  CRISPR gRNA sequence
cctgagctccccagagtcct

SEQ ID NO: 345633 - DNA, 20 bp, Artificial
  CRISPR gRNA sequence
ctgagctccccagagtcctg

SEQ ID NO: 345634 - DNA, 20 bp, Artificial
  CRISPR gRNA sequence
gagctccccagagtcctgag

SEQ ID NO: 345635 - DNA, 20 bp, Artificial
  CRISPR gRNA sequence
agctccccagagtcctgagg

SEQ ID NO: 345636 - DNA, 20 bp, Artificial
  CRISPR gRNA sequence
ctccccagagtcctgaggag

SEQ ID NO: 345637 - DNA, 20 bp, Artificial
  CRISPR gRNA sequence
agagtcctgaggaggagcgc

SEQ ID NO: 345638 - DNA, 20 bp, Artificial
  CRISPR gRNA sequence
cgccagttgcccctcgctca

SEQ ID NO: 345639 - DNA, 20 bp, Artificial
  CRISPR gRNA sequence
tcgctcacagaccacacacc

SEQ ID NO: 345640 - DNA, 20 bp, Artificial
  CRISPR gRNA sequence
gaccacacacccagccctcc

SEQ ID NO: 345641 - DNA, 20 bp, Artificial
  CRISPR gRNA sequence
accacacacccagccctcct

SEQ ID NO: 345642 - DNA, 20 bp, Artificial
  CRISPR gRNA sequence
cacacccagccctcctgggc

SEQ ID NO: 345643 - DNA, 20 bp, Artificial
  CRISPR gRNA sequence
ccagccctcctgggccagcc

SEQ ID NO: 345644 - DNA, 20 bp, Artificial
  CRISPR gRNA sequence
agccctcctgggccagccca

SEQ ID NO: 345645 - DNA, 20 bp, Artificial
  CRISPR gRNA sequence
gccctcctgggccagcccag

SEQ ID NO: 345646 - DNA, 20 bp, Artificial
  CRISPR gRNA sequence
ccctcctgggccagcccaga

SEQ ID NO: 345647 - DNA, 20 bp, Artificial
  CRISPR gRNA sequence
ggccagcccagagggccctt

SEQ ID NO: 345648 - DNA, 20 bp, Artificial
  CRISPR gRNA sequence
ccagagggcccttcagaccc

SEQ ID NO: 345649 - DNA, 20 bp, Artificial
  CRISPR gRNA sequence
gtctgcgcgtctgactcttg

SEQ ID NO: 345650 - DNA, 20 bp, Artificial
  CRISPR gRNA sequence
gcgtctgactcttgtggcct

SEQ ID NO: 345651 - DNA, 20 bp, Artificial
  CRISPR gRNA sequence
tctgactcttgtggcctcag

SEQ ID NO: 345652 - DNA, 20 bp, Artificial
  CRISPR gRNA sequence
ctgactcttgtggcctcagc

SEQ ID NO: 345653 - DNA, 20 bp, Artificial
  CRISPR gRNA sequence
ctcttgtggcctcagcagga

SEQ ID NO: 345654 - DNA, 20 bp, Artificial
  CRISPR gRNA sequence
tcttgtggcctcagcaggac

SEQ ID NO: 345655 - DNA, 20 bp, Artificial
  CRISPR gRNA sequence
ggcctcagcaggacaggccc

SEQ ID NO: 345656 - DNA, 20 bp, Artificial
  CRISPR gRNA sequence
gcctcagcaggacaggcccc

SEQ ID NO: 345657 - DNA, 20 bp, Artificial
  CRISPR gRNA sequence
aggccccgggcactgcctca

SEQ ID NO: 345658 - DNA, 20 bp, Artificial
  CRISPR gRNA sequence
ccgggcactgcctcacagcc

SEQ ID NO: 345659 - DNA, 20 bp, Artificial
  CRISPR gRNA sequence
cgggcactgcctcacagcca

SEQ ID NO: 345660 - DNA, 20 bp, Artificial
  CRISPR gRNA sequence
cactgcctcacagccaaggc

SEQ ID NO: 345661 - DNA, 20 bp, Artificial
  CRISPR gRNA sequence
cctcacagccaaggctggac

SEQ ID NO: 345662 - DNA, 20 bp, Artificial
  CRISPR gRNA sequence
ctcacagccaaggctggact

SEQ ID NO: 345663 - DNA, 20 bp, Artificial
  CRISPR gRNA sequence
cagccaaggctggactgggt

SEQ ID NO: 345664 - DNA, 20 bp, Artificial
  CRISPR gRNA sequence
aggctggactgggttggctg

SEQ ID NO: 345665 - DNA, 20 bp, Artificial
  CRISPR gRNA sequence
ggactgggttggctgcagtg

SEQ ID NO: 345666 - DNA, 20 bp, Artificial
  CRISPR gRNA sequence
gttggctgcagtgtggtgtt

SEQ ID NO: 345667 - DNA, 20 bp, Artificial
  CRISPR gRNA sequence
ggctgcagtgtggtgtttag

SEQ ID NO: 345668 - DNA, 20 bp, Artificial
  CRISPR gRNA sequence
gtgtttagtggataccacat

SEQ ID NO: 345669 - DNA, 20 bp, Artificial
  CRISPR gRNA sequence
tttagtggataccacatcgg

SEQ ID NO: 345670 - DNA, 20 bp, Artificial
  CRISPR gRNA sequence
tcggaagtgattttctaaat

SEQ ID NO: 345671 - DNA, 20 bp, Artificial
  CRISPR gRNA sequence
ttctaaattggatttgaatt

SEQ ID NO: 345672 - DNA, 20 bp, Artificial
  CRISPR gRNA sequence
gttttctatttgtcatgaaa

SEQ ID NO: 345673 - DNA, 20 bp, Artificial
  CRISPR gRNA sequence
ttgtcatgaaacagtgtatt

SEQ ID NO: 345674 - DNA, 20 bp, Artificial
  CRISPR gRNA sequence
tgtcatgaaacagtgtattt

SEQ ID NO: 345675 - DNA, 20 bp, Artificial
  CRISPR gRNA sequence
gtcatgaaacagtgtatttg

SEQ ID NO: 345676 - DNA, 20 bp, Artificial
  CRISPR gRNA sequence
catgaaacagtgtatttggg

SEQ ID NO: 345677 - DNA, 20 bp, Artificial
  CRISPR gRNA sequence
gtgtatttggggagatgctg

SEQ ID NO: 345678 - DNA, 20 bp, Artificial
  CRISPR gRNA sequence
tgtatttggggagatgctgt

SEQ ID NO: 345679 - DNA, 20 bp, Artificial
  CRISPR gRNA sequence
tatttggggagatgctgtgg

SEQ ID NO: 345680 - DNA, 20 bp, Artificial
  CRISPR gRNA sequence
atttggggagatgctgtggg

SEQ ID NO: 345681 - DNA, 20 bp, Artificial
  CRISPR gRNA sequence
ctcctcaaactgtcacctcc

SEQ ID NO: 345682 - DNA, 20 bp, Artificial
  CRISPR gRNA sequence
cccggtgtttcttgctgaac

SEQ ID NO: 345683 - DNA, 20 bp, Artificial
  CRISPR gRNA sequence
ccggtgtttcttgctgaaca

SEQ ID NO: 345684 - DNA, 20 bp, Artificial
  CRISPR gRNA sequence
ggtgtttcttgctgaacaag

SEQ ID NO: 345685 - DNA, 20 bp, Artificial
  CRISPR gRNA sequence
tcttgctgaacaaggagttc

SEQ ID NO: 345686 - DNA, 20 bp, Artificial
  CRISPR gRNA sequence
cttgctgaacaaggagttcc

SEQ ID NO: 345687 - DNA, 20 bp, Artificial
  CRISPR gRNA sequence
ctgaacaaggagttccagga

SEQ ID NO: 345688 - DNA, 20 bp, Artificial
  CRISPR gRNA sequence
aggagttccaggatggctgc

SEQ ID NO: 345689 - DNA, 20 bp, Artificial
  CRISPR gRNA sequence
ggagttccaggatggctgct

SEQ ID NO: 345690 - DNA, 20 bp, Artificial
  CRISPR gRNA sequence
aggatggctgctgggctgtt

SEQ ID NO: 345691 - DNA, 20 bp, Artificial
  CRISPR gRNA sequence
ggatggctgctgggctgttc

SEQ ID NO: 345692 - DNA, 20 bp, Artificial
  CRISPR gRNA sequence
gatggctgctgggctgttcg

SEQ ID NO: 345693 - DNA, 20 bp, Artificial
  CRISPR gRNA sequence
atggctgctgggctgttcgg

SEQ ID NO: 345694 - DNA, 20 bp, Artificial
  CRISPR gRNA sequence
tgccctcctcccgtcatgcc

SEQ ID NO: 345695 - DNA, 20 bp, Artificial
  CRISPR gRNA sequence
gccctcctcccgtcatgcct

SEQ ID NO: 345696 - DNA, 20 bp, Artificial
  CRISPR gRNA sequence
ccctcctcccgtcatgcctg

SEQ ID NO: 345697 - DNA, 20 bp, Artificial
  CRISPR gRNA sequence
cctcctcccgtcatgcctgg

SEQ ID NO: 345698 - DNA, 20 bp, Artificial
  CRISPR gRNA sequence
gcctgggggttcactccacc

SEQ ID NO: 345699 - DNA, 20 bp, Artificial
  CRISPR gRNA sequence
ctgggggttcactccaccca

SEQ ID NO: 345700 - DNA, 20 bp, Artificial
  CRISPR gRNA sequence
gggggttcactccacccaga

SEQ ID NO: 345701 - DNA, 20 bp, Artificial
  CRISPR gRNA sequence
ggggttcactccacccagag

SEQ ID NO: 345702 - DNA, 20 bp, Artificial
  CRISPR gRNA sequence
ggttcactccacccagagag

SEQ ID NO: 345703 - DNA, 20 bp, Artificial
  CRISPR gRNA sequence
ctccacccagagaggagccc

SEQ ID NO: 345704 - DNA, 20 bp, Artificial
  CRISPR gRNA sequence
gccgccccttcatatcccaa

SEQ ID NO: 345705 - DNA, 20 bp, Artificial
  CRISPR gRNA sequence
cccttcatatcccaacagct

SEQ ID NO: 345706 - DNA, 20 bp, Artificial
  CRISPR gRNA sequence
tatcccaacagctgagctct

SEQ ID NO: 345707 - DNA, 20 bp, Artificial
  CRISPR gRNA sequence
cccaacagctgagctctcag

SEQ ID NO: 345708 - DNA, 20 bp, Artificial
  CRISPR gRNA sequence
ccaacagctgagctctcagt

SEQ ID NO: 345709 - DNA, 20 bp, Artificial
  CRISPR gRNA sequence
gtgggctcttctgacctctg

SEQ ID NO: 345710 - DNA, 20 bp, Artificial
  CRISPR gRNA sequence
tgacctctgtggctccgtcc

SEQ ID NO: 345711 - DNA, 20 bp, Artificial
  CRISPR gRNA sequence
gacctctgtggctccgtccg

SEQ ID NO: 345712 - DNA, 20 bp, Artificial
  CRISPR gRNA sequence
tccgtccgaggctattgctg

SEQ ID NO: 345713 - DNA, 20 bp, Artificial
  CRISPR gRNA sequence
tgtggattctgatgctcaaa

SEQ ID NO: 345714 - DNA, 20 bp, Artificial
  CRISPR gRNA sequence
ttctgatgctcaaatggtgt

SEQ ID NO: 345715 - DNA, 20 bp, Artificial
  CRISPR gRNA sequence
caaatggtgtcagatttgcc

SEQ ID NO: 345716 - DNA, 20 bp, Artificial
  CRISPR gRNA sequence
gatttgcccagtaaaaaccc

SEQ ID NO: 345717 - DNA, 20 bp, Artificial
  CRISPR gRNA sequence
tacatctgacctacacttcc

SEQ ID NO: 345718 - DNA, 20 bp, Artificial
  CRISPR gRNA sequence
acttcccagctgtgtccacc

SEQ ID NO: 345719 - DNA, 20 bp, Artificial
  CRISPR gRNA sequence
ctgtgtccaccgagaaaccc

SEQ ID NO: 345720 - DNA, 20 bp, Artificial
  CRISPR gRNA sequence
ccaccgagaaaccccagtat

SEQ ID NO: 345721 - DNA, 20 bp, Artificial
  CRISPR gRNA sequence
tcagtgacgcctgctgtgcc

SEQ ID NO: 345722 - DNA, 20 bp, Artificial
  CRISPR gRNA sequence
ccagccctctccacctgctc

SEQ ID NO: 345723 - DNA, 20 bp, Artificial
  CRISPR gRNA sequence
cagccctctccacctgctcc

SEQ ID NO: 345724 - DNA, 20 bp, Artificial
  CRISPR gRNA sequence
cacctgctccgggaacccgc

SEQ ID NO: 345725 - DNA, 20 bp, Artificial
  CRISPR gRNA sequence
acctgctccgggaacccgcc

SEQ ID NO: 345726 - DNA, 20 bp, Artificial
  CRISPR gRNA sequence
ctccgggaacccgccaggcc

SEQ ID NO: 345727 - DNA, 20 bp, Artificial
  CRISPR gRNA sequence
tccgggaacccgccaggccc

SEQ ID NO: 345728 - DNA, 20 bp, Artificial
  CRISPR gRNA sequence
ccgccaggcccaggtcccgc

SEQ ID NO: 345729 - DNA, 20 bp, Artificial
  CRISPR gRNA sequence
ccaggcccaggtcccgctgg

SEQ ID NO: 345730 - DNA, 20 bp, Artificial
  CRISPR gRNA sequence
caggcccaggtcccgctggc

SEQ ID NO: 345731 - DNA, 20 bp, Artificial
  CRISPR gRNA sequence
aggcccaggtcccgctggca

SEQ ID NO: 345732 - DNA, 20 bp, Artificial
  CRISPR gRNA sequence
ggcccaggtcccgctggcag

SEQ ID NO: 345733 - DNA, 20 bp, Artificial
  CRISPR gRNA sequence
cccgctggcaggggcttcac

SEQ ID NO: 345734 - DNA, 20 bp, Artificial
  CRISPR gRNA sequence
ccgctggcaggggcttcacc

SEQ ID NO: 345735 - DNA, 20 bp, Artificial
  CRISPR gRNA sequence
aggggcttcaccaggcctct

SEQ ID NO: 345736 - DNA, 20 bp, Artificial
  CRISPR gRNA sequence
tgagccacacattcatttaa

SEQ ID NO: 345737 - DNA, 20 bp, Artificial
  CRISPR gRNA sequence
ccacacattcatttaatggt

SEQ ID NO: 345738 - DNA, 20 bp, Artificial
  CRISPR gRNA sequence
cacacattcatttaatggtc

SEQ ID NO: 345739 - DNA, 20 bp, Artificial
  CRISPR gRNA sequence
attcatttaatggtcgggat

SEQ ID NO: 345740 - DNA, 20 bp, Artificial
  CRISPR gRNA sequence
ttcatttaatggtcgggatg

SEQ ID NO: 345741 - DNA, 20 bp, Artificial
  CRISPR gRNA sequence
ggcccctttccccacatctg

SEQ ID NO: 345742 - DNA, 20 bp, Artificial
  CRISPR gRNA sequence
cctttccccacatctgaagt

SEQ ID NO: 345743 - DNA, 20 bp, Artificial
  CRISPR gRNA sequence
ttccccacatctgaagttag

SEQ ID NO: 345744 - DNA, 20 bp, Artificial
  CRISPR gRNA sequence
cccacatctgaagttagaag

SEQ ID NO: 345745 - DNA, 20 bp, Artificial
  CRISPR gRNA sequence
catctgaagttagaagcggt

SEQ ID NO: 345746 - DNA, 20 bp, Artificial
  CRISPR gRNA sequence
atctgaagttagaagcggtg

SEQ ID NO: 345747 - DNA, 20 bp, Artificial
  CRISPR gRNA sequence
tctgaagttagaagcggtga

SEQ ID NO: 345748 - DNA, 20 bp, Artificial
  CRISPR gRNA sequence
ctgaagttagaagcggtgag

SEQ ID NO: 345749 - DNA, 20 bp, Artificial
  CRISPR gRNA sequence
cggtgaggggaatgaccctg

SEQ ID NO: 345750 - DNA, 20 bp, Artificial
  CRISPR gRNA sequence
tgaccctgcagccatgccat

SEQ ID NO: 345751 - DNA, 20 bp, Artificial
  CRISPR gRNA sequence
gaccctgcagccatgccatg

SEQ ID NO: 345752 - DNA, 20 bp, Artificial
  CRISPR gRNA sequence
ctgcagccatgccatgagga

SEQ ID NO: 345753 - DNA, 20 bp, Artificial
  CRISPR gRNA sequence
gcagccatgccatgaggatg

SEQ ID NO: 345754 - DNA, 20 bp, Artificial
  CRISPR gRNA sequence
cagccatgccatgaggatgg

SEQ ID NO: 345755 - DNA, 20 bp, Artificial
  CRISPR gRNA sequence
ccatgaggatggaggccaca

SEQ ID NO: 345756 - DNA, 20 bp, Artificial
  CRISPR gRNA sequence
ggaggccacatagcccctcc

SEQ ID NO: 345757 - DNA, 20 bp, Artificial
  CRISPR gRNA sequence
ctttccttgtcacctgcctc

SEQ ID NO: 345758 - DNA, 20 bp, Artificial
  CRISPR gRNA sequence
tccttgtcacctgcctccag

SEQ ID NO: 345759 - DNA, 20 bp, Artificial
  CRISPR gRNA sequence
cttgtcacctgcctccagca

SEQ ID NO: 345760 - DNA, 20 bp, Artificial
  CRISPR gRNA sequence
cctgcctccagcagagcccc

SEQ ID NO: 345761 - DNA, 20 bp, Artificial
  CRISPR gRNA sequence
ctgcctccagcagagccccc

SEQ ID NO: 345762 - DNA, 20 bp, Artificial
  CRISPR gRNA sequence
tccagcagagcccccaggct

SEQ ID NO: 345763 - DNA, 20 bp, Artificial
  CRISPR gRNA sequence
tcctgccaccccttgtcctg

SEQ ID NO: 345764 - DNA, 20 bp, Artificial
  CRISPR gRNA sequence
tgccaccccttgtcctgtgg

SEQ ID NO: 345765 - DNA, 20 bp, Artificial
  CRISPR gRNA sequence
cccttgtcctgtggaagctt

SEQ ID NO: 345766 - DNA, 20 bp, Artificial
  CRISPR gRNA sequence
gtcctgtggaagctttggct

SEQ ID NO: 345767 - DNA, 20 bp, Artificial
  CRISPR gRNA sequence
gaagctttggcttagcgtcc

SEQ ID NO: 345768 - DNA, 20 bp, Artificial
  CRISPR gRNA sequence
aagctttggcttagcgtcct

SEQ ID NO: 345769 - DNA, 20 bp, Artificial
  CRISPR gRNA sequence
agctttggcttagcgtcctg

SEQ ID NO: 345770 - DNA, 20 bp, Artificial
  CRISPR gRNA sequence
tggcttagcgtcctggggtg

SEQ ID NO: 345771 - DNA, 20 bp, Artificial
  CRISPR gRNA sequence
gcttagcgtcctggggtgtg

SEQ ID NO: 345772 - DNA, 20 bp, Artificial
  CRISPR gRNA sequence
ttagcgtcctggggtgtgga

SEQ ID NO: 345773 - DNA, 20 bp, Artificial
  CRISPR gRNA sequence
tagcgtcctggggtgtggag

SEQ ID NO: 345774 - DNA, 20 bp, Artificial
  CRISPR gRNA sequence
ggggtgtggagaggcccatg

SEQ ID NO: 345775 - DNA, 20 bp, Artificial
  CRISPR gRNA sequence
gggtgtggagaggcccatgc

SEQ ID NO: 345776 - DNA, 20 bp, Artificial
  CRISPR gRNA sequence
gtggagaggcccatgcaggc

SEQ ID NO: 345777 - DNA, 20 bp, Artificial
  CRISPR gRNA sequence
tggagaggcccatgcaggcc

SEQ ID NO: 345778 - DNA, 20 bp, Artificial
  CRISPR gRNA sequence
agaggcccatgcaggccagg

SEQ ID NO: 345779 - DNA, 20 bp, Artificial
  CRISPR gRNA sequence
aggcccatgcaggccaggtg

SEQ ID NO: 345780 - DNA, 20 bp, Artificial
  CRISPR gRNA sequence
atgcaggccaggtggagccc

SEQ ID NO: 345781 - DNA, 20 bp, Artificial
  CRISPR gRNA sequence
tgcaggccaggtggagccct

SEQ ID NO: 345782 - DNA, 20 bp, Artificial
  CRISPR gRNA sequence
caggtggagccctgggcccc

SEQ ID NO: 345783 - DNA, 20 bp, Artificial
  CRISPR gRNA sequence
tggagccctgggcccctaga

SEQ ID NO: 345784 - DNA, 20 bp, Artificial
  CRISPR gRNA sequence
agccctgggcccctagaaag

SEQ ID NO: 345785 - DNA, 20 bp, Artificial
  CRISPR gRNA sequence
cccctagaaagcagcacttc

SEQ ID NO: 345786 - DNA, 20 bp, Artificial
  CRISPR gRNA sequence
cgtgtcaccctctccccaac

SEQ ID NO: 345787 - DNA, 20 bp, Artificial
  CRISPR gRNA sequence
tgtcaccctctccccaactg

SEQ ID NO: 345788 - DNA, 20 bp, Artificial
  CRISPR gRNA sequence
gtcaccctctccccaactgg

SEQ ID NO: 345789 - DNA, 20 bp, Artificial
  CRISPR gRNA sequence
cctctccccaactggaggcg

SEQ ID NO: 345790 - DNA, 20 bp, Artificial
  CRISPR gRNA sequence
ccaactggaggcgtggtctc

SEQ ID NO: 345791 - DNA, 20 bp, Artificial
  CRISPR gRNA sequence
caactggaggcgtggtctcc

SEQ ID NO: 345792 - DNA, 20 bp, Artificial
  CRISPR gRNA sequence
aactggaggcgtggtctcca

SEQ ID NO: 345793 - DNA, 20 bp, Artificial
  CRISPR gRNA sequence
ggcgtggtctccagggacca

SEQ ID NO: 345794 - DNA, 20 bp, Artificial
  CRISPR gRNA sequence
gcgtggtctccagggaccac

SEQ ID NO: 345795 - DNA, 20 bp, Artificial
  CRISPR gRNA sequence
accacgggcctccctgtgca

SEQ ID NO: 345796 - DNA, 20 bp, Artificial
  CRISPR gRNA sequence
gggcctccctgtgcatggac

SEQ ID NO: 345797 - DNA, 20 bp, Artificial
  CRISPR gRNA sequence
accggctcctgaccaccgtc

SEQ ID NO: 345798 - DNA, 20 bp, Artificial
  CRISPR gRNA sequence
ccggctcctgaccaccgtcc

SEQ ID NO: 345799 - DNA, 20 bp, Artificial
  CRISPR gRNA sequence
cggctcctgaccaccgtcca

SEQ ID NO: 345800 - DNA, 20 bp, Artificial
  CRISPR gRNA sequence
ccaccgtccagggtcattgc

SEQ ID NO: 345801 - DNA, 20 bp, Artificial
  CRISPR gRNA sequence
caccgtccagggtcattgcc

SEQ ID NO: 345802 - DNA, 20 bp, Artificial
  CRISPR gRNA sequence
accgtccagggtcattgcca

SEQ ID NO: 345803 - DNA, 20 bp, Artificial
  CRISPR gRNA sequence
tcattgccagggtacctttt

SEQ ID NO: 345804 - DNA, 20 bp, Artificial
  CRISPR gRNA sequence
attgccagggtaccttttca

SEQ ID NO: 345805 - DNA, 20 bp, Artificial
  CRISPR gRNA sequence
ttgccagggtaccttttcag

SEQ ID NO: 345806 - DNA, 20 bp, Artificial
  CRISPR gRNA sequence
cttttcagaggctgacccca

SEQ ID NO: 345807 - DNA, 20 bp, Artificial
  CRISPR gRNA sequence
agaggctgaccccatagacc

SEQ ID NO: 345808 - DNA, 20 bp, Artificial
  CRISPR gRNA sequence
ccatagacctggctgccccc

SEQ ID NO: 345809 - DNA, 20 bp, Artificial
  CRISPR gRNA sequence
acctggctgccccccagtgc

SEQ ID NO: 345810 - DNA, 20 bp, Artificial
  CRISPR gRNA sequence
ggctgccccccagtgctaga

SEQ ID NO: 345811 - DNA, 20 bp, Artificial
  CRISPR gRNA sequence
gctgccccccagtgctagat

SEQ ID NO: 345812 - DNA, 20 bp, Artificial
  CRISPR gRNA sequence
tgccccccagtgctagatgg

SEQ ID NO: 345813 - DNA, 20 bp, Artificial
  CRISPR gRNA sequence
cccagtgctagatgggagcc

SEQ ID NO: 345814 - DNA, 20 bp, Artificial
  CRISPR gRNA sequence
tgctagatgggagccaagca

SEQ ID NO: 345815 - DNA, 20 bp, Artificial
  CRISPR gRNA sequence
acagcctgcccttctgccca

SEQ ID NO: 345816 - DNA, 20 bp, Artificial
  CRISPR gRNA sequence
tgcccttctgcccacagtcc

SEQ ID NO: 345817 - DNA, 20 bp, Artificial
  CRISPR gRNA sequence
gcccttctgcccacagtccc

SEQ ID NO: 345818 - DNA, 20 bp, Artificial
  CRISPR gRNA sequence
cccttctgcccacagtcccg

SEQ ID NO: 345819 - DNA, 20 bp, Artificial
  CRISPR gRNA sequence
ccttctgcccacagtcccgg

SEQ ID NO: 345820 - DNA, 20 bp, Artificial
  CRISPR gRNA sequence
tctgcccacagtcccggggg

SEQ ID NO: 345821 - DNA, 20 bp, Artificial
  CRISPR gRNA sequence
ctgcccacagtcccgggggc

SEQ ID NO: 345822 - DNA, 20 bp, Artificial
  CRISPR gRNA sequence
cccacagtcccgggggcagg

SEQ ID NO: 345823 - DNA, 20 bp, Artificial
  CRISPR gRNA sequence
ccacagtcccgggggcaggt

SEQ ID NO: 345824 - DNA, 20 bp, Artificial
  CRISPR gRNA sequence
acagtcccgggggcaggtgg

SEQ ID NO: 345825 - DNA, 20 bp, Artificial
  CRISPR gRNA sequence
cccgggggcaggtgggagca

SEQ ID NO: 345826 - DNA, 20 bp, Artificial
  CRISPR gRNA sequence
ccgggggcaggtgggagcat

SEQ ID NO: 345827 - DNA, 20 bp, Artificial
  CRISPR gRNA sequence
cgggggcaggtgggagcatg

SEQ ID NO: 345828 - DNA, 20 bp, Artificial
  CRISPR gRNA sequence
caggtgggagcatggggcca

SEQ ID NO: 345829 - DNA, 20 bp, Artificial
  CRISPR gRNA sequence
ggtgggagcatggggccatg

SEQ ID NO: 345830 - DNA, 20 bp, Artificial
  CRISPR gRNA sequence
ggagcatggggccatggagt

SEQ ID NO: 345831 - DNA, 20 bp, Artificial
  CRISPR gRNA sequence
gcatggggccatggagtgag

SEQ ID NO: 345832 - DNA, 20 bp, Artificial
  CRISPR gRNA sequence
catggggccatggagtgagc

SEQ ID NO: 345833 - DNA, 20 bp, Artificial
  CRISPR gRNA sequence
ggggccatggagtgagcggg

SEQ ID NO: 345834 - DNA, 20 bp, Artificial
  CRISPR gRNA sequence
gggccatggagtgagcgggc

SEQ ID NO: 345835 - DNA, 20 bp, Artificial
  CRISPR gRNA sequence
ggccatggagtgagcgggca

SEQ ID NO: 345836 - DNA, 20 bp, Artificial
  CRISPR gRNA sequence
gccatggagtgagcgggcag

SEQ ID NO: 345837 - DNA, 20 bp, Artificial
  CRISPR gRNA sequence
atggagtgagcgggcagggg

SEQ ID NO: 345838 - DNA, 20 bp, Artificial
  CRISPR gRNA sequence
gagtgagcgggcaggggtgg

SEQ ID NO: 345839 - DNA, 20 bp, Artificial
  CRISPR gRNA sequence
gtgagcgggcaggggtggca

SEQ ID NO: 345840 - DNA, 20 bp, Artificial
  CRISPR gRNA sequence
tgagcgggcaggggtggcag

SEQ ID NO: 345841 - DNA, 20 bp, Artificial
  CRISPR gRNA sequence
gagcgggcaggggtggcaga

SEQ ID NO: 345842 - DNA, 20 bp, Artificial
  CRISPR gRNA sequence
aggggtggcagagggctccc

SEQ ID NO: 345843 - DNA, 20 bp, Artificial
  CRISPR gRNA sequence
gtggcagagggctccctggt

SEQ ID NO: 345844 - DNA, 20 bp, Artificial
  CRISPR gRNA sequence
tggcagagggctccctggtc

SEQ ID NO: 345845 - DNA, 20 bp, Artificial
  CRISPR gRNA sequence
ggcagagggctccctggtca

SEQ ID NO: 345846 - DNA, 20 bp, Artificial
  CRISPR gRNA sequence
gcagagggctccctggtcag

SEQ ID NO: 345847 - DNA, 20 bp, Artificial
  CRISPR gRNA sequence
ggccccaacttcccttcccc

SEQ ID NO: 345848 - DNA, 20 bp, Artificial
  CRISPR gRNA sequence
gccccaacttcccttccccc

SEQ ID NO: 345849 - DNA, 20 bp, Artificial
  CRISPR gRNA sequence
ccccaacttcccttccccca

SEQ ID NO: 345850 - DNA, 20 bp, Artificial
  CRISPR gRNA sequence
ccaacttcccttcccccagg

SEQ ID NO: 345851 - DNA, 20 bp, Artificial
  CRISPR gRNA sequence
caacttcccttcccccaggg

SEQ ID NO: 345852 - DNA, 20 bp, Artificial
  CRISPR gRNA sequence
cagggaggccacctgacatc

SEQ ID NO: 345853 - DNA, 20 bp, Artificial
  CRISPR gRNA sequence
agggaggccacctgacatct

SEQ ID NO: 345854 - DNA, 20 bp, Artificial
  CRISPR gRNA sequence
gccacctgacatctgggctc

SEQ ID NO: 345855 - DNA, 20 bp, Artificial
  CRISPR gRNA sequence
ccacctgacatctgggctcc

SEQ ID NO: 345856 - DNA, 20 bp, Artificial
  CRISPR gRNA sequence
tgacatctgggctccaggca

SEQ ID NO: 345857 - DNA, 20 bp, Artificial
  CRISPR gRNA sequence
catctgggctccaggcacag

SEQ ID NO: 345858 - DNA, 20 bp, Artificial
  CRISPR gRNA sequence
atctgggctccaggcacagc

SEQ ID NO: 345859 - DNA, 20 bp, Artificial
  CRISPR gRNA sequence
tgggctccaggcacagcagg

SEQ ID NO: 345860 - DNA, 20 bp, Artificial
  CRISPR gRNA sequence
agcccacctgccccaacctg

SEQ ID NO: 345861 - DNA, 20 bp, Artificial
  CRISPR gRNA sequence
caacctgtagctcctcctcc

SEQ ID NO: 345862 - DNA, 20 bp, Artificial
  CRISPR gRNA sequence
aacctgtagctcctcctcct

SEQ ID NO: 345863 - DNA, 20 bp, Artificial
  CRISPR gRNA sequence
cctgtagctcctcctcctgg

SEQ ID NO: 345864 - DNA, 20 bp, Artificial
  CRISPR gRNA sequence
ctgtagctcctcctcctggg

SEQ ID NO: 345865 - DNA, 20 bp, Artificial
  CRISPR gRNA sequence
gtagctcctcctcctgggag

SEQ ID NO: 345866 - DNA, 20 bp, Artificial
  CRISPR gRNA sequence
cctcctcctgggaggagcca

SEQ ID NO: 345867 - DNA, 20 bp, Artificial
  CRISPR gRNA sequence
ctgggaggagccatggatcc

SEQ ID NO: 345868 - DNA, 20 bp, Artificial
  CRISPR gRNA sequence
aggagccatggatcctggaa

SEQ ID NO: 345869 - DNA, 20 bp, Artificial
  CRISPR gRNA sequence
catggatcctggaaaagctc

SEQ ID NO: 345870 - DNA, 20 bp, Artificial
  CRISPR gRNA sequence
atggatcctggaaaagctct

SEQ ID NO: 345871 - DNA, 20 bp, Artificial
  CRISPR gRNA sequence
tggatcctggaaaagctctg

SEQ ID NO: 345872 - DNA, 20 bp, Artificial
  CRISPR gRNA sequence
aaagctctggggccacctcc

SEQ ID NO: 345873 - DNA, 20 bp, Artificial
  CRISPR gRNA sequence
aagctctggggccacctccc

SEQ ID NO: 345874 - DNA, 20 bp, Artificial
  CRISPR gRNA sequence
ctggggccacctcccaggtt

SEQ ID NO: 345875 - DNA, 20 bp, Artificial
  CRISPR gRNA sequence
tggggccacctcccaggttt

SEQ ID NO: 345876 - DNA, 20 bp, Artificial
  CRISPR gRNA sequence
ggggccacctcccaggtttg

SEQ ID NO: 345877 - DNA, 20 bp, Artificial
  CRISPR gRNA sequence
gggccacctcccaggtttgg

SEQ ID NO: 345878 - DNA, 20 bp, Artificial
  CRISPR gRNA sequence
ggccacctcccaggtttggg

SEQ ID NO: 345879 - DNA, 20 bp, Artificial
  CRISPR gRNA sequence
acctcccaggtttgggggga

SEQ ID NO: 345880 - DNA, 20 bp, Artificial
  CRISPR gRNA sequence
ctcccaggtttggggggaca

SEQ ID NO: 345881 - DNA, 20 bp, Artificial
  CRISPR gRNA sequence
gtttggggggacagagctcc

SEQ ID NO: 345882 - DNA, 20 bp, Artificial
  CRISPR gRNA sequence
ttggggggacagagctccaa

SEQ ID NO: 345883 - DNA, 20 bp, Artificial
  CRISPR gRNA sequence
gacagagctccaagagacga

SEQ ID NO: 345884 - DNA, 20 bp, Artificial
  CRISPR gRNA sequence
gagctccaagagacgacggc

SEQ ID NO: 345885 - DNA, 20 bp, Artificial
  CRISPR gRNA sequence
agctccaagagacgacggct

SEQ ID NO: 345886 - DNA, 20 bp, Artificial
  CRISPR gRNA sequence
gctccaagagacgacggctg

SEQ ID NO: 345887 - DNA, 20 bp, Artificial
  CRISPR gRNA sequence
gagacgacggctggggacac

SEQ ID NO: 345888 - DNA, 20 bp, Artificial
  CRISPR gRNA sequence
gctggggacacgagccctca

SEQ ID NO: 345889 - DNA, 20 bp, Artificial
  CRISPR gRNA sequence
ctggggacacgagccctcat

SEQ ID NO: 345890 - DNA, 20 bp, Artificial
  CRISPR gRNA sequence
tggggacacgagccctcatg

SEQ ID NO: 345891 - DNA, 20 bp, Artificial
  CRISPR gRNA sequence
attttcttcttttcatgcat

SEQ ID NO: 345892 - DNA, 20 bp, Artificial
  CRISPR gRNA sequence
cttcttttcatgcatgagat

SEQ ID NO: 345893 - DNA, 20 bp, Artificial
  CRISPR gRNA sequence
ttcttttcatgcatgagatt

SEQ ID NO: 345894 - DNA, 20 bp, Artificial
  CRISPR gRNA sequence
ttcatgcatgagattaggcc

SEQ ID NO: 345895 - DNA, 20 bp, Artificial
  CRISPR gRNA sequence
gcatgagattaggccaagtg

SEQ ID NO: 345896 - DNA, 20 bp, Artificial
  CRISPR gRNA sequence
atgagattaggccaagtgtg

SEQ ID NO: 345897 - DNA, 20 bp, Artificial
  CRISPR gRNA sequence
aaatcaatgatgttgacgat

SEQ ID NO: 345898 - DNA, 20 bp, Artificial
  CRISPR gRNA sequence
aatcaatgatgttgacgatg

SEQ ID NO: 345899 - DNA, 20 bp, Artificial
  CRISPR gRNA sequence
tgttgacgatgaggctccct

SEQ ID NO: 345900 - DNA, 20 bp, Artificial
  CRISPR gRNA sequence
ttgacgatgaggctccctga

SEQ ID NO: 345901 - DNA, 20 bp, Artificial
  CRISPR gRNA sequence
tccctgagagaaatcacacc

SEQ ID NO: 345902 - DNA, 20 bp, Artificial
  CRISPR gRNA sequence
ctgagagaaatcacacccag

SEQ ID NO: 345903 - DNA, 20 bp, Artificial
  CRISPR gRNA sequence
tgagagaaatcacacccagc

SEQ ID NO: 345904 - DNA, 20 bp, Artificial
  CRISPR gRNA sequence
agagaaatcacacccagcgg

SEQ ID NO: 345905 - DNA, 20 bp, Artificial
  CRISPR gRNA sequence
ccagcgggagctgctgctcc

SEQ ID NO: 345906 - DNA, 20 bp, Artificial
  CRISPR gRNA sequence
cagcgggagctgctgctccc

SEQ ID NO: 345907 - DNA, 20 bp, Artificial
  CRISPR gRNA sequence
ggagctgctgctcccaggtc

SEQ ID NO: 345908 - DNA, 20 bp, Artificial
  CRISPR gRNA sequence
gctgctcccaggtctggcct

SEQ ID NO: 345909 - DNA, 20 bp, Artificial
  CRISPR gRNA sequence
ccaggtctggcctcggtcac

SEQ ID NO: 345910 - DNA, 20 bp, Artificial
  CRISPR gRNA sequence
ccagccacctgctgcatccg

SEQ ID NO: 345911 - DNA, 20 bp, Artificial
  CRISPR gRNA sequence
cagccacctgctgcatccgc

SEQ ID NO: 345912 - DNA, 20 bp, Artificial
  CRISPR gRNA sequence
gccacctgctgcatccgcgg

SEQ ID NO: 345913 - DNA, 20 bp, Artificial
  CRISPR gRNA sequence
acctgctgcatccgcgggag

SEQ ID NO: 345914 - DNA, 20 bp, Artificial
  CRISPR gRNA sequence
cctgctgcatccgcgggagt

SEQ ID NO: 345915 - DNA, 20 bp, Artificial
  CRISPR gRNA sequence
ctgctgcatccgcgggagtg

SEQ ID NO: 345916 - DNA, 20 bp, Artificial
  CRISPR gRNA sequence
gcatccgcgggagtggggcc

SEQ ID NO: 345917 - DNA, 20 bp, Artificial
  CRISPR gRNA sequence
catccgcgggagtggggccg

SEQ ID NO: 345918 - DNA, 20 bp, Artificial
  CRISPR gRNA sequence
cgggagtggggccgaggaca

SEQ ID NO: 345919 - DNA, 20 bp, Artificial
  CRISPR gRNA sequence
gggagtggggccgaggacat

SEQ ID NO: 345920 - DNA, 20 bp, Artificial
  CRISPR gRNA sequence
gagtggggccgaggacatgg

SEQ ID NO: 345921 - DNA, 20 bp, Artificial
  CRISPR gRNA sequence
tggggccgaggacatgggag

SEQ ID NO: 345922 - DNA, 20 bp, Artificial
  CRISPR gRNA sequence
ggccgaggacatgggagtgg

SEQ ID NO: 345923 - DNA, 20 bp, Artificial
  CRISPR gRNA sequence
gccgaggacatgggagtggc

SEQ ID NO: 345924 - DNA, 20 bp, Artificial
  CRISPR gRNA sequence
ggacatgggagtggcaggtg

SEQ ID NO: 345925 - DNA, 20 bp, Artificial
  CRISPR gRNA sequence
ggagtggcaggtgcagcccc

SEQ ID NO: 345926 - DNA, 20 bp, Artificial
  CRISPR gRNA sequence
tgcagcccccggtactcact

SEQ ID NO: 345927 - DNA, 20 bp, Artificial
  CRISPR gRNA sequence
ccccggtactcactcagccc

SEQ ID NO: 345928 - DNA, 20 bp, Artificial
  CRISPR gRNA sequence
cccggtactcactcagcccc

SEQ ID NO: 345929 - DNA, 20 bp, Artificial
  CRISPR gRNA sequence
ccggtactcactcagcccca

SEQ ID NO: 345930 - DNA, 20 bp, Artificial
  CRISPR gRNA sequence
ggtactcactcagccccagg

SEQ ID NO: 345931 - DNA, 20 bp, Artificial
  CRISPR gRNA sequence
tcagccccagggagtgtccc

SEQ ID NO: 345932 - DNA, 20 bp, Artificial
  CRISPR gRNA sequence
cagggagtgtccctggctcc

SEQ ID NO: 345933 - DNA, 20 bp, Artificial
  CRISPR gRNA sequence
agggagtgtccctggctccc

SEQ ID NO: 345934 - DNA, 20 bp, Artificial
  CRISPR gRNA sequence
gggagtgtccctggctccca

SEQ ID NO: 345935 - DNA, 20 bp, Artificial
  CRISPR gRNA sequence
gtccctggctcccagggctc

SEQ ID NO: 345936 - DNA, 20 bp, Artificial
  CRISPR gRNA sequence
tccctggctcccagggctct

SEQ ID NO: 345937 - DNA, 20 bp, Artificial
  CRISPR gRNA sequence
cctggctcccagggctctgg

SEQ ID NO: 345938 - DNA, 20 bp, Artificial
  CRISPR gRNA sequence
ctggctcccagggctctggg

SEQ ID NO: 345939 - DNA, 20 bp, Artificial
  CRISPR gRNA sequence
ctcccagggctctgggaggt

SEQ ID NO: 345940 - DNA, 20 bp, Artificial
  CRISPR gRNA sequence
tcccagggctctgggaggtg

SEQ ID NO: 345941 - DNA, 20 bp, Artificial
  CRISPR gRNA sequence
cccagggctctgggaggtga

SEQ ID NO: 345942 - DNA, 20 bp, Artificial
  CRISPR gRNA sequence
agggctctgggaggtgaggg

SEQ ID NO: 345943 - DNA, 20 bp, Artificial
  CRISPR gRNA sequence
gggctctgggaggtgagggc

SEQ ID NO: 345944 - DNA, 20 bp, Artificial
  CRISPR gRNA sequence
tgggaggtgagggcaggtcc

SEQ ID NO: 345945 - DNA, 20 bp, Artificial
  CRISPR gRNA sequence
gggaggtgagggcaggtccc

SEQ ID NO: 345946 - DNA, 20 bp, Artificial
  CRISPR gRNA sequence
ggaggtgagggcaggtcccg

SEQ ID NO: 345947 - DNA, 20 bp, Artificial
  CRISPR gRNA sequence
gaggtgagggcaggtcccgg

SEQ ID NO: 345948 - DNA, 20 bp, Artificial
  CRISPR gRNA sequence
ggtgagggcaggtcccgggg

SEQ ID NO: 345949 - DNA, 20 bp, Artificial
  CRISPR gRNA sequence
gtgagggcaggtcccggggg

SEQ ID NO: 345950 - DNA, 20 bp, Artificial
  CRISPR gRNA sequence
gggcaggtcccgggggaggc

SEQ ID NO: 345951 - DNA, 20 bp, Artificial
  CRISPR gRNA sequence
ggcaggtcccgggggaggct

SEQ ID NO: 345952 - DNA, 20 bp, Artificial
  CRISPR gRNA sequence
ggtcccgggggaggctgggt

SEQ ID NO: 345953 - DNA, 20 bp, Artificial
  CRISPR gRNA sequence
cccgggggaggctgggttag

SEQ ID NO: 345954 - DNA, 20 bp, Artificial
  CRISPR gRNA sequence
gggggaggctgggttagtgg

SEQ ID NO: 345955 - DNA, 20 bp, Artificial
  CRISPR gRNA sequence
ggctgggttagtggcagctc

SEQ ID NO: 345956 - DNA, 20 bp, Artificial
  CRISPR gRNA sequence
gctgggttagtggcagctcc

SEQ ID NO: 345957 - DNA, 20 bp, Artificial
  CRISPR gRNA sequence
gttagtggcagctccgggat

SEQ ID NO: 345958 - DNA, 20 bp, Artificial
  CRISPR gRNA sequence
gcagctccgggatgagacct

SEQ ID NO: 345959 - DNA, 20 bp, Artificial
  CRISPR gRNA sequence
agctccgggatgagacctca

SEQ ID NO: 345960 - DNA, 20 bp, Artificial
  CRISPR gRNA sequence
gctccgggatgagacctcag

SEQ ID NO: 345961 - DNA, 20 bp, Artificial
  CRISPR gRNA sequence
gaggtctgtctgacttgtcc

SEQ ID NO: 345962 - DNA, 20 bp, Artificial
  CRISPR gRNA sequence
ctgtctgacttgtccaagcc

SEQ ID NO: 345963 - DNA, 20 bp, Artificial
  CRISPR gRNA sequence
gacttgtccaagcccggcta

SEQ ID NO: 345964 - DNA, 20 bp, Artificial
  CRISPR gRNA sequence
acttgtccaagcccggctat

SEQ ID NO: 345965 - DNA, 20 bp, Artificial
  CRISPR gRNA sequence
cttgtccaagcccggctatg

SEQ ID NO: 345966 - DNA, 20 bp, Artificial
  CRISPR gRNA sequence
tgtccaagcccggctatggg

SEQ ID NO: 345967 - DNA, 20 bp, Artificial
  CRISPR gRNA sequence
gtccaagcccggctatgggg

SEQ ID NO: 345968 - DNA, 20 bp, Artificial
  CRISPR gRNA sequence
caagcccggctatggggagg

SEQ ID NO: 345969 - DNA, 20 bp, Artificial
  CRISPR gRNA sequence
aagcccggctatggggaggt

SEQ ID NO: 345970 - DNA, 20 bp, Artificial
  CRISPR gRNA sequence
agcccggctatggggaggtg

SEQ ID NO: 345971 - DNA, 20 bp, Artificial
  CRISPR gRNA sequence
gcccggctatggggaggtgg

SEQ ID NO: 345972 - DNA, 20 bp, Artificial
  CRISPR gRNA sequence
cccggctatggggaggtggg

SEQ ID NO: 345973 - DNA, 20 bp, Artificial
  CRISPR gRNA sequence
ggctatggggaggtgggggg

SEQ ID NO: 345974 - DNA, 20 bp, Artificial
  CRISPR gRNA sequence
gctatggggaggtgggggga

SEQ ID NO: 345975 - DNA, 20 bp, Artificial
  CRISPR gRNA sequence
atggggaggtggggggaagg

SEQ ID NO: 345976 - DNA, 20 bp, Artificial
  CRISPR gRNA sequence
tggggaggtggggggaagga

SEQ ID NO: 345977 - DNA, 20 bp, Artificial
  CRISPR gRNA sequence
ggaggtggggggaaggaagg

SEQ ID NO: 345978 - DNA, 20 bp, Artificial
  CRISPR gRNA sequence
aggtggggggaaggaaggaa

SEQ ID NO: 345979 - DNA, 20 bp, Artificial
  CRISPR gRNA sequence
ggtggggggaaggaaggaag

SEQ ID NO: 345980 - DNA, 20 bp, Artificial
  CRISPR gRNA sequence
tggggggaaggaaggaagag

SEQ ID NO: 345981 - DNA, 20 bp, Artificial
  CRISPR gRNA sequence
gggggaaggaaggaagagga

SEQ ID NO: 345982 - DNA, 20 bp, Artificial
  CRISPR gRNA sequence
ggaaggaagaggagagaaat

SEQ ID NO: 345983 - DNA, 20 bp, Artificial
  CRISPR gRNA sequence
gaaggaagaggagagaaata

SEQ ID NO: 345984 - DNA, 20 bp, Artificial
  CRISPR gRNA sequence
aggaagaggagagaaataag

SEQ ID NO: 345985 - DNA, 20 bp, Artificial
  CRISPR gRNA sequence
gaagaggagagaaataagga

SEQ ID NO: 345986 - DNA, 20 bp, Artificial
  CRISPR gRNA sequence
aagaggagagaaataaggag

SEQ ID NO: 345987 - DNA, 20 bp, Artificial
  CRISPR gRNA sequence
ggagagaaataaggagaggc

SEQ ID NO: 345988 - DNA, 20 bp, Artificial
  CRISPR gRNA sequence
gagagaaataaggagaggct

SEQ ID NO: 345989 - DNA, 20 bp, Artificial
  CRISPR gRNA sequence
aaataaggagaggctgggca

SEQ ID NO: 345990 - DNA, 20 bp, Artificial
  CRISPR gRNA sequence
taaggagaggctgggcaaag

SEQ ID NO: 345991 - DNA, 20 bp, Artificial
  CRISPR gRNA sequence
gagaggctgggcaaagaaga

SEQ ID NO: 345992 - DNA, 20 bp, Artificial
  CRISPR gRNA sequence
agaggctgggcaaagaagac

SEQ ID NO: 345993 - DNA, 20 bp, Artificial
  CRISPR gRNA sequence
gctgggcaaagaagacagga

SEQ ID NO: 345994 - DNA, 20 bp, Artificial
  CRISPR gRNA sequence
gggcaaagaagacaggacgg

SEQ ID NO: 345995 - DNA, 20 bp, Artificial
  CRISPR gRNA sequence
gcaaagaagacaggacggca

SEQ ID NO: 345996 - DNA, 20 bp, Artificial
  CRISPR gRNA sequence
caaagaagacaggacggcag

SEQ ID NO: 345997 - DNA, 20 bp, Artificial
  CRISPR gRNA sequence
aaagaagacaggacggcaga

SEQ ID NO: 345998 - DNA, 20 bp, Artificial
  CRISPR gRNA sequence
agaagacaggacggcagagg

SEQ ID NO: 345999 - DNA, 20 bp, Artificial
  CRISPR gRNA sequence
aagacaggacggcagaggga

SEQ ID NO: 346000 - DNA, 20 bp, Artificial
  CRISPR gRNA sequence
agacaggacggcagagggag

SEQ ID NO: 346001 - DNA, 20 bp, Artificial
  CRISPR gRNA sequence
gacaggacggcagagggaga

SEQ ID NO: 346002 - DNA, 20 bp, Artificial
  CRISPR gRNA sequence
acaggacggcagagggagag

SEQ ID NO: 346003 - DNA, 20 bp, Artificial
  CRISPR gRNA sequence
aggacggcagagggagaggg

SEQ ID NO: 346004 - DNA, 20 bp, Artificial
  CRISPR gRNA sequence
gacggcagagggagagggga

SEQ ID NO: 346005 - DNA, 20 bp, Artificial
  CRISPR gRNA sequence
ggcagagggagaggggagag

SEQ ID NO: 346006 - DNA, 20 bp, Artificial
  CRISPR gRNA sequence
agagggagaggggagagaag

SEQ ID NO: 346007 - DNA, 20 bp, Artificial
  CRISPR gRNA sequence
gagggagaggggagagaagt

SEQ ID NO: 346008 - DNA, 20 bp, Artificial
  CRISPR gRNA sequence
gggagaggggagagaagtgg

SEQ ID NO: 346009 - DNA, 20 bp, Artificial
  CRISPR gRNA sequence
ggagaggggagagaagtggg

SEQ ID NO: 346010 - DNA, 20 bp, Artificial
  CRISPR gRNA sequence
gaggggagagaagtgggagg

SEQ ID NO: 346011 - DNA, 20 bp, Artificial
  CRISPR gRNA sequence
ggagagaagtgggaggcagc

SEQ ID NO: 346012 - DNA, 20 bp, Artificial
  CRISPR gRNA sequence
gagaagtgggaggcagccag

SEQ ID NO: 346013 - DNA, 20 bp, Artificial
  CRISPR gRNA sequence
gtgggaggcagccagcagcg

SEQ ID NO: 346014 - DNA, 20 bp, Artificial
  CRISPR gRNA sequence
tgggaggcagccagcagcgc

SEQ ID NO: 346015 - DNA, 20 bp, Artificial
  CRISPR gRNA sequence
gggaggcagccagcagcgca

SEQ ID NO: 346016 - DNA, 20 bp, Artificial
  CRISPR gRNA sequence
agccagcagcgcagggccct

SEQ ID NO: 346017 - DNA, 20 bp, Artificial
  CRISPR gRNA sequence
ccagcagcgcagggccctga

SEQ ID NO: 346018 - DNA, 20 bp, Artificial
  CRISPR gRNA sequence
gcagggccctgagagtattt

SEQ ID NO: 346019 - DNA, 20 bp, Artificial
  CRISPR gRNA sequence
gggccctgagagtatttcag

SEQ ID NO: 346020 - DNA, 20 bp, Artificial
  CRISPR gRNA sequence
tttcagcggcaccgctgtcc

SEQ ID NO: 346021 - DNA, 20 bp, Artificial
  CRISPR gRNA sequence
ttcagcggcaccgctgtcct

SEQ ID NO: 346022 - DNA, 20 bp, Artificial
  CRISPR gRNA sequence
caccgctgtcctgggccgcc

SEQ ID NO: 346023 - DNA, 20 bp, Artificial
  CRISPR gRNA sequence
cggtgccacatctttgaaaa

SEQ ID NO: 346024 - DNA, 20 bp, Artificial
  CRISPR gRNA sequence
tgaaaacagttgtttaattt

SEQ ID NO: 346025 - DNA, 20 bp, Artificial
  CRISPR gRNA sequence
ttaatttaagcttgtccact

SEQ ID NO: 346026 - DNA, 20 bp, Artificial
  CRISPR gRNA sequence
atttaagcttgtccactcag

SEQ ID NO: 346027 - DNA, 20 bp, Artificial
  CRISPR gRNA sequence
cactcagtagctgttgaatg

SEQ ID NO: 346028 - DNA, 20 bp, Artificial
  CRISPR gRNA sequence
actcagtagctgttgaatgt

SEQ ID NO: 346029 - DNA, 20 bp, Artificial
  CRISPR gRNA sequence
tcagtagctgttgaatgtgg

SEQ ID NO: 346030 - DNA, 20 bp, Artificial
  CRISPR gRNA sequence
cagtagctgttgaatgtggg

SEQ ID NO: 346031 - DNA, 20 bp, Artificial
  CRISPR gRNA sequence
gaggttatcttgttctattc

SEQ ID NO: 346032 - DNA, 20 bp, Artificial
  CRISPR gRNA sequence
tataaaaataaaaactacca

SEQ ID NO: 346033 - DNA, 20 bp, Artificial
  CRISPR gRNA sequence
aaataaaaactaccatagac

SEQ ID NO: 346034 - DNA, 20 bp, Artificial
  CRISPR gRNA sequence
aataaaaactaccatagact

SEQ ID NO: 346035 - DNA, 20 bp, Artificial
  CRISPR gRNA sequence
aaaaactaccatagactggg

SEQ ID NO: 346036 - DNA, 20 bp, Artificial
  CRISPR gRNA sequence
catagactgggtggcttaac

SEQ ID NO: 346037 - DNA, 20 bp, Artificial
  CRISPR gRNA sequence
actgggtggcttaacaagaa

SEQ ID NO: 346038 - DNA, 20 bp, Artificial
  CRISPR gRNA sequence
gcttaacaagaacagaaatt

SEQ ID NO: 346039 - DNA, 20 bp, Artificial
  CRISPR gRNA sequence
taacaagaacagaaattcgg

SEQ ID NO: 346040 - DNA, 20 bp, Artificial
  CRISPR gRNA sequence
aacaagaacagaaattcggc

SEQ ID NO: 346041 - DNA, 20 bp, Artificial
  CRISPR gRNA sequence
acaagaacagaaattcggca

SEQ ID NO: 346042 - DNA, 20 bp, Artificial
  CRISPR gRNA sequence
gaacagaaattcggcagggc

SEQ ID NO: 346043 - DNA, 20 bp, Artificial
  CRISPR gRNA sequence
aacagaaattcggcagggcg

SEQ ID NO: 346044 - DNA, 20 bp, Artificial
  CRISPR gRNA sequence
agaaattcggcagggcgagg

SEQ ID NO: 346045 - DNA, 20 bp, Artificial
  CRISPR gRNA sequence
cgcctgtaatccccacactt

SEQ ID NO: 346046 - DNA, 20 bp, Artificial
  CRISPR gRNA sequence
gcctgtaatccccacacttt

SEQ ID NO: 346047 - DNA, 20 bp, Artificial
  CRISPR gRNA sequence
ctgtaatccccacactttgg

SEQ ID NO: 346048 - DNA, 20 bp, Artificial
  CRISPR gRNA sequence
tgtaatccccacactttggg

SEQ ID NO: 346049 - DNA, 20 bp, Artificial
  CRISPR gRNA sequence
ccccacactttgggaggccg

SEQ ID NO: 346050 - DNA, 20 bp, Artificial
  CRISPR gRNA sequence
cacactttgggaggccgaag

SEQ ID NO: 346051 - DNA, 20 bp, Artificial
  CRISPR gRNA sequence
acactttgggaggccgaagc

SEQ ID NO: 346052 - DNA, 20 bp, Artificial
  CRISPR gRNA sequence
ctttgggaggccgaagcggg

SEQ ID NO: 346053 - DNA, 20 bp, Artificial
  CRISPR gRNA sequence
cgaagcgggcagatcatttg

SEQ ID NO: 346054 - DNA, 20 bp, Artificial
  CRISPR gRNA sequence
gcgggcagatcatttgaagt

SEQ ID NO: 346055 - DNA, 20 bp, Artificial
  CRISPR gRNA sequence
ggcagatcatttgaagtcag

SEQ ID NO: 346056 - DNA, 20 bp, Artificial
  CRISPR gRNA sequence
ttcaaatgatctgcccgctt

SEQ ID NO: 346057 - DNA, 20 bp, Artificial
  CRISPR gRNA sequence
ctgcccgcttcggcctccca

SEQ ID NO: 346058 - DNA, 20 bp, Artificial
  CRISPR gRNA sequence
cgcttcggcctcccaaagtg

SEQ ID NO: 346059 - DNA, 20 bp, Artificial
  CRISPR gRNA sequence
gcttcggcctcccaaagtgt

SEQ ID NO: 346060 - DNA, 20 bp, Artificial
  CRISPR gRNA sequence
cttcggcctcccaaagtgtg

SEQ ID NO: 346061 - DNA, 20 bp, Artificial
  CRISPR gRNA sequence
ctcccaaagtgtggggatta

SEQ ID NO: 346062 - DNA, 20 bp, Artificial
  CRISPR gRNA sequence
tcccaaagtgtggggattac

SEQ ID NO: 346063 - DNA, 20 bp, Artificial
  CRISPR gRNA sequence
agtgtggggattacaggcgt

SEQ ID NO: 346064 - DNA, 20 bp, Artificial
  CRISPR gRNA sequence
gccgaatttctgttcttgtt

SEQ ID NO: 346065 - DNA, 20 bp, Artificial
  CRISPR gRNA sequence
tctgttcttgttaagccacc

SEQ ID NO: 346066 - DNA, 20 bp, Artificial
  CRISPR gRNA sequence
ttgttaagccacccagtcta

SEQ ID NO: 346067 - DNA, 20 bp, Artificial
  CRISPR gRNA sequence
ttaagccacccagtctatgg

SEQ ID NO: 346068 - DNA, 20 bp, Artificial
  CRISPR gRNA sequence
tatggtagtttttattttta

SEQ ID NO: 346069 - DNA, 20 bp, Artificial
  CRISPR gRNA sequence
tatttttatagcaacttgaa

SEQ ID NO: 346070 - DNA, 20 bp, Artificial
  CRISPR gRNA sequence
tatagcaacttgaatagaac

SEQ ID NO: 346071 - DNA, 20 bp, Artificial
  CRISPR gRNA sequence
agataacctcccacattcaa

SEQ ID NO: 346072 - DNA, 20 bp, Artificial
  CRISPR gRNA sequence
tcccacattcaacagctact

SEQ ID NO: 346073 - DNA, 20 bp, Artificial
  CRISPR gRNA sequence
cacattcaacagctactgag

SEQ ID NO: 346074 - DNA, 20 bp, Artificial
  CRISPR gRNA sequence
tcaacagctactgagtggac

SEQ ID NO: 346075 - DNA, 20 bp, Artificial
  CRISPR gRNA sequence
aaattaaacaactgttttca

SEQ ID NO: 346076 - DNA, 20 bp, Artificial
  CRISPR gRNA sequence
aacaactgttttcaaagatg

SEQ ID NO: 346077 - DNA, 20 bp, Artificial
  CRISPR gRNA sequence
tgttttcaaagatgtggcac

SEQ ID NO: 346078 - DNA, 20 bp, Artificial
  CRISPR gRNA sequence
gttttcaaagatgtggcacc

SEQ ID NO: 346079 - DNA, 20 bp, Artificial
  CRISPR gRNA sequence
ttcaaagatgtggcaccggg

SEQ ID NO: 346080 - DNA, 20 bp, Artificial
  CRISPR gRNA sequence
agatgtggcaccgggcggcc

SEQ ID NO: 346081 - DNA, 20 bp, Artificial
  CRISPR gRNA sequence
gatgtggcaccgggcggccc

SEQ ID NO: 346082 - DNA, 20 bp, Artificial
  CRISPR gRNA sequence
tggcaccgggcggcccagga

SEQ ID NO: 346083 - DNA, 20 bp, Artificial
  CRISPR gRNA sequence
caccgggcggcccaggacag

SEQ ID NO: 346084 - DNA, 20 bp, Artificial
  CRISPR gRNA sequence
cggtgccgctgaaatactct

SEQ ID NO: 346085 - DNA, 20 bp, Artificial
  CRISPR gRNA sequence
ggtgccgctgaaatactctc

SEQ ID NO: 346086 - DNA, 20 bp, Artificial
  CRISPR gRNA sequence
gtgccgctgaaatactctca

SEQ ID NO: 346087 - DNA, 20 bp, Artificial
  CRISPR gRNA sequence
ctctcagggccctgcgctgc

SEQ ID NO: 346088 - DNA, 20 bp, Artificial
  CRISPR gRNA sequence
gccgtcctgtcttctttgcc

SEQ ID NO: 346089 - DNA, 20 bp, Artificial
  CRISPR gRNA sequence
tccttccccccacctcccca

SEQ ID NO: 346090 - DNA, 20 bp, Artificial
  CRISPR gRNA sequence
tccccccacctccccatagc

SEQ ID NO: 346091 - DNA, 20 bp, Artificial
  CRISPR gRNA sequence
ccccccacctccccatagcc

SEQ ID NO: 346092 - DNA, 20 bp, Artificial
  CRISPR gRNA sequence
cacctccccatagccgggct

SEQ ID NO: 346093 - DNA, 20 bp, Artificial
  CRISPR gRNA sequence
ccccatagccgggcttggac

SEQ ID NO: 346094 - DNA, 20 bp, Artificial
  CRISPR gRNA sequence
atagccgggcttggacaagt

SEQ ID NO: 346095 - DNA, 20 bp, Artificial
  CRISPR gRNA sequence
ccgggcttggacaagtcaga

SEQ ID NO: 346096 - DNA, 20 bp, Artificial
  CRISPR gRNA sequence
gacaagtcagacagacctct

SEQ ID NO: 346097 - DNA, 20 bp, Artificial
  CRISPR gRNA sequence
acaagtcagacagacctctg

SEQ ID NO: 346098 - DNA, 20 bp, Artificial
  CRISPR gRNA sequence
agacctctgaggtctcatcc

SEQ ID NO: 346099 - DNA, 20 bp, Artificial
  CRISPR gRNA sequence
acctctgaggtctcatcccg

SEQ ID NO: 346100 - DNA, 20 bp, Artificial
  CRISPR gRNA sequence
tcccggagctgccactaacc

SEQ ID NO: 346101 - DNA, 20 bp, Artificial
  CRISPR gRNA sequence
gccactaacccagcctcccc

SEQ ID NO: 346102 - DNA, 20 bp, Artificial
  CRISPR gRNA sequence
ccactaacccagcctccccc

SEQ ID NO: 346103 - DNA, 20 bp, Artificial
  CRISPR gRNA sequence
cgggacctgccctcacctcc

SEQ ID NO: 346104 - DNA, 20 bp, Artificial
  CRISPR gRNA sequence
ggacctgccctcacctccca

SEQ ID NO: 346105 - DNA, 20 bp, Artificial
  CRISPR gRNA sequence
gccctcacctcccagagccc

SEQ ID NO: 346106 - DNA, 20 bp, Artificial
  CRISPR gRNA sequence
ccctcacctcccagagccct

SEQ ID NO: 346107 - DNA, 20 bp, Artificial
  CRISPR gRNA sequence
ctcacctcccagagccctgg

SEQ ID NO: 346108 - DNA, 20 bp, Artificial
  CRISPR gRNA sequence
cctcccagagccctgggagc

SEQ ID NO: 346109 - DNA, 20 bp, Artificial
  CRISPR gRNA sequence
ctcccagagccctgggagcc

SEQ ID NO: 346110 - DNA, 20 bp, Artificial
  CRISPR gRNA sequence
tcccagagccctgggagcca

SEQ ID NO: 346111 - DNA, 20 bp, Artificial
  CRISPR gRNA sequence
tgggagccagggacactccc

SEQ ID NO: 346112 - DNA, 20 bp, Artificial
  CRISPR gRNA sequence
gggagccagggacactccct

SEQ ID NO: 346113 - DNA, 20 bp, Artificial
  CRISPR gRNA sequence
ggagccagggacactccctg

SEQ ID NO: 346114 - DNA, 20 bp, Artificial
  CRISPR gRNA sequence
cagggacactccctggggct

SEQ ID NO: 346115 - DNA, 20 bp, Artificial
  CRISPR gRNA sequence
gacactccctggggctgagt

SEQ ID NO: 346116 - DNA, 20 bp, Artificial
  CRISPR gRNA sequence
ccctggggctgagtgagtac

SEQ ID NO: 346117 - DNA, 20 bp, Artificial
  CRISPR gRNA sequence
cctggggctgagtgagtacc

SEQ ID NO: 346118 - DNA, 20 bp, Artificial
  CRISPR gRNA sequence
ctggggctgagtgagtaccg

SEQ ID NO: 346119 - DNA, 20 bp, Artificial
  CRISPR gRNA sequence
tggggctgagtgagtaccgg

SEQ ID NO: 346120 - DNA, 20 bp, Artificial
  CRISPR gRNA sequence
acctgccactcccatgtcct

SEQ ID NO: 346121 - DNA, 20 bp, Artificial
  CRISPR gRNA sequence
tgtcctcggccccactcccg

SEQ ID NO: 346122 - DNA, 20 bp, Artificial
  CRISPR gRNA sequence
cggccccactcccgcggatg

SEQ ID NO: 346123 - DNA, 20 bp, Artificial
  CRISPR gRNA sequence
ccccactcccgcggatgcag

SEQ ID NO: 346124 - DNA, 20 bp, Artificial
  CRISPR gRNA sequence
cccactcccgcggatgcagc

SEQ ID NO: 346125 - DNA, 20 bp, Artificial
  CRISPR gRNA sequence
actcccgcggatgcagcagg

SEQ ID NO: 346126 - DNA, 20 bp, Artificial
  CRISPR gRNA sequence
ccgcggatgcagcaggtggc

SEQ ID NO: 346127 - DNA, 20 bp, Artificial
  CRISPR gRNA sequence
gcagcaggtggctggtgacc

SEQ ID NO: 346128 - DNA, 20 bp, Artificial
  CRISPR gRNA sequence
cagcaggtggctggtgaccg

SEQ ID NO: 346129 - DNA, 20 bp, Artificial
  CRISPR gRNA sequence
aggtggctggtgaccgaggc

SEQ ID NO: 346130 - DNA, 20 bp, Artificial
  CRISPR gRNA sequence
ctggtgaccgaggccagacc

SEQ ID NO: 346131 - DNA, 20 bp, Artificial
  CRISPR gRNA sequence
tggtgaccgaggccagacct

SEQ ID NO: 346132 - DNA, 20 bp, Artificial
  CRISPR gRNA sequence
gtgaccgaggccagacctgg

SEQ ID NO: 346133 - DNA, 20 bp, Artificial
  CRISPR gRNA sequence
accgaggccagacctgggag

SEQ ID NO: 346134 - DNA, 20 bp, Artificial
  CRISPR gRNA sequence
gaggccagacctgggagcag

SEQ ID NO: 346135 - DNA, 20 bp, Artificial
  CRISPR gRNA sequence
ctgggagcagcagctcccgc

SEQ ID NO: 346136 - DNA, 20 bp, Artificial
  CRISPR gRNA sequence
tgggagcagcagctcccgct

SEQ ID NO: 346137 - DNA, 20 bp, Artificial
  CRISPR gRNA sequence
ccgctgggtgtgatttctct

SEQ ID NO: 346138 - DNA, 20 bp, Artificial
  CRISPR gRNA sequence
cgctgggtgtgatttctctc

SEQ ID NO: 346139 - DNA, 20 bp, Artificial
  CRISPR gRNA sequence
gctgggtgtgatttctctca

SEQ ID NO: 346140 - DNA, 20 bp, Artificial
  CRISPR gRNA sequence
tgggtgtgatttctctcagg

SEQ ID NO: 346141 - DNA, 20 bp, Artificial
  CRISPR gRNA sequence
atcattgatttctccacact

SEQ ID NO: 346142 - DNA, 20 bp, Artificial
  CRISPR gRNA sequence
ggcctaatctcatgcatgaa

SEQ ID NO: 346143 - DNA, 20 bp, Artificial
  CRISPR gRNA sequence
ctaatctcatgcatgaaaag

SEQ ID NO: 346144 - DNA, 20 bp, Artificial
  CRISPR gRNA sequence
tgcatgaaaagaagaaaatc

SEQ ID NO: 346145 - DNA, 20 bp, Artificial
  CRISPR gRNA sequence
gcatgaaaagaagaaaatca

SEQ ID NO: 346146 - DNA, 20 bp, Artificial
  CRISPR gRNA sequence
catgaaaagaagaaaatcaa

SEQ ID NO: 346147 - DNA, 20 bp, Artificial
  CRISPR gRNA sequence
atgaaaagaagaaaatcaag

SEQ ID NO: 346148 - DNA, 20 bp, Artificial
  CRISPR gRNA sequence
aaagaagaaaatcaaggggt

SEQ ID NO: 346149 - DNA, 20 bp, Artificial
  CRISPR gRNA sequence
aaaatcaaggggtgagcaca

SEQ ID NO: 346150 - DNA, 20 bp, Artificial
  CRISPR gRNA sequence
atcaaggggtgagcacacag

SEQ ID NO: 346151 - DNA, 20 bp, Artificial
  CRISPR gRNA sequence
tgagcacacagcggccccat

SEQ ID NO: 346152 - DNA, 20 bp, Artificial
  CRISPR gRNA sequence
gagcacacagcggccccatg

SEQ ID NO: 346153 - DNA, 20 bp, Artificial
  CRISPR gRNA sequence
agcacacagcggccccatga

SEQ ID NO: 346154 - DNA, 20 bp, Artificial
  CRISPR gRNA sequence
cccatgagggctcgtgtccc

SEQ ID NO: 346155 - DNA, 20 bp, Artificial
  CRISPR gRNA sequence
tgtccccagccgtcgtctct

SEQ ID NO: 346156 - DNA, 20 bp, Artificial
  CRISPR gRNA sequence
tccccagccgtcgtctcttg

SEQ ID NO: 346157 - DNA, 20 bp, Artificial
  CRISPR gRNA sequence
gagctctgtccccccaaacc

SEQ ID NO: 346158 - DNA, 20 bp, Artificial
  CRISPR gRNA sequence
agctctgtccccccaaacct

SEQ ID NO: 346159 - DNA, 20 bp, Artificial
  CRISPR gRNA sequence
ctctgtccccccaaacctgg

SEQ ID NO: 346160 - DNA, 20 bp, Artificial
  CRISPR gRNA sequence
tctgtccccccaaacctggg

SEQ ID NO: 346161 - DNA, 20 bp, Artificial
  CRISPR gRNA sequence
gtccccccaaacctgggagg

SEQ ID NO: 346162 - DNA, 20 bp, Artificial
  CRISPR gRNA sequence
ccaaacctgggaggtggccc

SEQ ID NO: 346163 - DNA, 20 bp, Artificial
  CRISPR gRNA sequence
aaacctgggaggtggcccca

SEQ ID NO: 346164 - DNA, 20 bp, Artificial
  CRISPR gRNA sequence
aggtggccccagagcttttc

SEQ ID NO: 346165 - DNA, 20 bp, Artificial
  CRISPR gRNA sequence
ggtggccccagagcttttcc

SEQ ID NO: 346166 - DNA, 20 bp, Artificial
  CRISPR gRNA sequence
cagagcttttccaggatcca

SEQ ID NO: 346167 - DNA, 20 bp, Artificial
  CRISPR gRNA sequence
ccaggatccatggctcctcc

SEQ ID NO: 346168 - DNA, 20 bp, Artificial
  CRISPR gRNA sequence
caggatccatggctcctccc

SEQ ID NO: 346169 - DNA, 20 bp, Artificial
  CRISPR gRNA sequence
ggatccatggctcctcccag

SEQ ID NO: 346170 - DNA, 20 bp, Artificial
  CRISPR gRNA sequence
gatccatggctcctcccagg

SEQ ID NO: 346171 - DNA, 20 bp, Artificial
  CRISPR gRNA sequence
tccatggctcctcccaggag

SEQ ID NO: 346172 - DNA, 20 bp, Artificial
  CRISPR gRNA sequence
ccatggctcctcccaggagg

SEQ ID NO: 346173 - DNA, 20 bp, Artificial
  CRISPR gRNA sequence
atggctcctcccaggaggag

SEQ ID NO: 346174 - DNA, 20 bp, Artificial
  CRISPR gRNA sequence
cctcccaggaggaggagcta

SEQ ID NO: 346175 - DNA, 20 bp, Artificial
  CRISPR gRNA sequence
ctcccaggaggaggagctac

SEQ ID NO: 346176 - DNA, 20 bp, Artificial
  CRISPR gRNA sequence
caggaggaggagctacaggt

SEQ ID NO: 346177 - DNA, 20 bp, Artificial
  CRISPR gRNA sequence
aggaggaggagctacaggtt

SEQ ID NO: 346178 - DNA, 20 bp, Artificial
  CRISPR gRNA sequence
ggaggaggagctacaggttg

SEQ ID NO: 346179 - DNA, 20 bp, Artificial
  CRISPR gRNA sequence
ggaggagctacaggttgggg

SEQ ID NO: 346180 - DNA, 20 bp, Artificial
  CRISPR gRNA sequence
gaggagctacaggttggggc

SEQ ID NO: 346181 - DNA, 20 bp, Artificial
  CRISPR gRNA sequence
gagctacaggttggggcagg

SEQ ID NO: 346182 - DNA, 20 bp, Artificial
  CRISPR gRNA sequence
agctacaggttggggcaggt

SEQ ID NO: 346183 - DNA, 20 bp, Artificial
  CRISPR gRNA sequence
ggtgggcttcctgctgtgcc

SEQ ID NO: 346184 - DNA, 20 bp, Artificial
  CRISPR gRNA sequence
tgggcttcctgctgtgcctg

SEQ ID NO: 346185 - DNA, 20 bp, Artificial
  CRISPR gRNA sequence
ttcctgctgtgcctggagcc

SEQ ID NO: 346186 - DNA, 20 bp, Artificial
  CRISPR gRNA sequence
tgtgcctggagcccagatgt

SEQ ID NO: 346187 - DNA, 20 bp, Artificial
  CRISPR gRNA sequence
gtgcctggagcccagatgtc

SEQ ID NO: 346188 - DNA, 20 bp, Artificial
  CRISPR gRNA sequence
cctggagcccagatgtcagg

SEQ ID NO: 346189 - DNA, 20 bp, Artificial
  CRISPR gRNA sequence
cagatgtcaggtggcctccc

SEQ ID NO: 346190 - DNA, 20 bp, Artificial
  CRISPR gRNA sequence
agatgtcaggtggcctccct

SEQ ID NO: 346191 - DNA, 20 bp, Artificial
  CRISPR gRNA sequence
gatgtcaggtggcctccctg

SEQ ID NO: 346192 - DNA, 20 bp, Artificial
  CRISPR gRNA sequence
atgtcaggtggcctccctgg

SEQ ID NO: 346193 - DNA, 20 bp, Artificial
  CRISPR gRNA sequence
tcaggtggcctccctggggg

SEQ ID NO: 346194 - DNA, 20 bp, Artificial
  CRISPR gRNA sequence
caggtggcctccctggggga

SEQ ID NO: 346195 - DNA, 20 bp, Artificial
  CRISPR gRNA sequence
aggtggcctccctgggggaa

SEQ ID NO: 346196 - DNA, 20 bp, Artificial
  CRISPR gRNA sequence
tggcctccctgggggaaggg

SEQ ID NO: 346197 - DNA, 20 bp, Artificial
  CRISPR gRNA sequence
ctccctgggggaagggaagt

SEQ ID NO: 346198 - DNA, 20 bp, Artificial
  CRISPR gRNA sequence
tccctgggggaagggaagtt

SEQ ID NO: 346199 - DNA, 20 bp, Artificial
  CRISPR gRNA sequence
ccctgggggaagggaagttg

SEQ ID NO: 346200 - DNA, 20 bp, Artificial
  CRISPR gRNA sequence
gggaagttggggcccctgac

SEQ ID NO: 346201 - DNA, 20 bp, Artificial
  CRISPR gRNA sequence
ggaagttggggcccctgacc

SEQ ID NO: 346202 - DNA, 20 bp, Artificial
  CRISPR gRNA sequence
gaagttggggcccctgacca

SEQ ID NO: 346203 - DNA, 20 bp, Artificial
  CRISPR gRNA sequence
agttggggcccctgaccagg

SEQ ID NO: 346204 - DNA, 20 bp, Artificial
  CRISPR gRNA sequence
acccctgcccgctcactcca

SEQ ID NO: 346205 - DNA, 20 bp, Artificial
  CRISPR gRNA sequence
cccatgctcccacctgcccc

SEQ ID NO: 346206 - DNA, 20 bp, Artificial
  CRISPR gRNA sequence
ccatgctcccacctgccccc

SEQ ID NO: 346207 - DNA, 20 bp, Artificial
  CRISPR gRNA sequence
cccacctgcccccgggactg

SEQ ID NO: 346208 - DNA, 20 bp, Artificial
  CRISPR gRNA sequence
ccacctgcccccgggactgt

SEQ ID NO: 346209 - DNA, 20 bp, Artificial
  CRISPR gRNA sequence
cctgcccccgggactgtggg

SEQ ID NO: 346210 - DNA, 20 bp, Artificial
  CRISPR gRNA sequence
gcccccgggactgtgggcag

SEQ ID NO: 346211 - DNA, 20 bp, Artificial
  CRISPR gRNA sequence
cccccgggactgtgggcaga

SEQ ID NO: 346212 - DNA, 20 bp, Artificial
  CRISPR gRNA sequence
ccccgggactgtgggcagaa

SEQ ID NO: 346213 - DNA, 20 bp, Artificial
  CRISPR gRNA sequence
cgggactgtgggcagaaggg

SEQ ID NO: 346214 - DNA, 20 bp, Artificial
  CRISPR gRNA sequence
gggactgtgggcagaagggc

SEQ ID NO: 346215 - DNA, 20 bp, Artificial
  CRISPR gRNA sequence
gcagaagggcaggctgtgct

SEQ ID NO: 346216 - DNA, 20 bp, Artificial
  CRISPR gRNA sequence
ggctgtgcttggctcccatc

SEQ ID NO: 346217 - DNA, 20 bp, Artificial
  CRISPR gRNA sequence
gcttggctcccatctagcac

SEQ ID NO: 346218 - DNA, 20 bp, Artificial
  CRISPR gRNA sequence
cttggctcccatctagcact

SEQ ID NO: 346219 - DNA, 20 bp, Artificial
  CRISPR gRNA sequence
ttggctcccatctagcactg

SEQ ID NO: 346220 - DNA, 20 bp, Artificial
  CRISPR gRNA sequence
tggctcccatctagcactgg

SEQ ID NO: 346221 - DNA, 20 bp, Artificial
  CRISPR gRNA sequence
ggctcccatctagcactggg

SEQ ID NO: 346222 - DNA, 20 bp, Artificial
  CRISPR gRNA sequence
tcccatctagcactgggggg

SEQ ID NO: 346223 - DNA, 20 bp, Artificial
  CRISPR gRNA sequence
atctagcactggggggcagc

SEQ ID NO: 346224 - DNA, 20 bp, Artificial
  CRISPR gRNA sequence
tctagcactggggggcagcc

SEQ ID NO: 346225 - DNA, 20 bp, Artificial
  CRISPR gRNA sequence
ctggggggcagccaggtcta

SEQ ID NO: 346226 - DNA, 20 bp, Artificial
  CRISPR gRNA sequence
tggggggcagccaggtctat

SEQ ID NO: 346227 - DNA, 20 bp, Artificial
  CRISPR gRNA sequence
ggggggcagccaggtctatg

SEQ ID NO: 346228 - DNA, 20 bp, Artificial
  CRISPR gRNA sequence
ggcagccaggtctatggggt

SEQ ID NO: 346229 - DNA, 20 bp, Artificial
  CRISPR gRNA sequence
ctatggggtcagcctctgaa

SEQ ID NO: 346230 - DNA, 20 bp, Artificial
  CRISPR gRNA sequence
tatggggtcagcctctgaaa

SEQ ID NO: 346231 - DNA, 20 bp, Artificial
  CRISPR gRNA sequence
cagcctctgaaaaggtaccc

SEQ ID NO: 346232 - DNA, 20 bp, Artificial
  CRISPR gRNA sequence
aggtaccctggcaatgaccc

SEQ ID NO: 346233 - DNA, 20 bp, Artificial
  CRISPR gRNA sequence
accctggcaatgaccctgga

SEQ ID NO: 346234 - DNA, 20 bp, Artificial
  CRISPR gRNA sequence
ctggcaatgaccctggacgg

SEQ ID NO: 346235 - DNA, 20 bp, Artificial
  CRISPR gRNA sequence
caatgaccctggacggtggt

SEQ ID NO: 346236 - DNA, 20 bp, Artificial
  CRISPR gRNA sequence
aatgaccctggacggtggtc

SEQ ID NO: 346237 - DNA, 20 bp, Artificial
  CRISPR gRNA sequence
tgaccctggacggtggtcag

SEQ ID NO: 346238 - DNA, 20 bp, Artificial
  CRISPR gRNA sequence
cctggacggtggtcaggagc

SEQ ID NO: 346239 - DNA, 20 bp, Artificial
  CRISPR gRNA sequence
gtcaggagccggtccatgca

SEQ ID NO: 346240 - DNA, 20 bp, Artificial
  CRISPR gRNA sequence
tcaggagccggtccatgcac

SEQ ID NO: 346241 - DNA, 20 bp, Artificial
  CRISPR gRNA sequence
caggagccggtccatgcaca

SEQ ID NO: 346242 - DNA, 20 bp, Artificial
  CRISPR gRNA sequence
ggagccggtccatgcacagg

SEQ ID NO: 346243 - DNA, 20 bp, Artificial
  CRISPR gRNA sequence
gagccggtccatgcacaggg

SEQ ID NO: 346244 - DNA, 20 bp, Artificial
  CRISPR gRNA sequence
tccatgcacagggaggcccg

SEQ ID NO: 346245 - DNA, 20 bp, Artificial
  CRISPR gRNA sequence
acagggaggcccgtggtccc

SEQ ID NO: 346246 - DNA, 20 bp, Artificial
  CRISPR gRNA sequence
agggaggcccgtggtccctg

SEQ ID NO: 346247 - DNA, 20 bp, Artificial
  CRISPR gRNA sequence
gtccctggagaccacgcctc

SEQ ID NO: 346248 - DNA, 20 bp, Artificial
  CRISPR gRNA sequence
ctggagaccacgcctccagt

SEQ ID NO: 346249 - DNA, 20 bp, Artificial
  CRISPR gRNA sequence
tggagaccacgcctccagtt

SEQ ID NO: 346250 - DNA, 20 bp, Artificial
  CRISPR gRNA sequence
ggagaccacgcctccagttg

SEQ ID NO: 346251 - DNA, 20 bp, Artificial
  CRISPR gRNA sequence
agaccacgcctccagttggg

SEQ ID NO: 346252 - DNA, 20 bp, Artificial
  CRISPR gRNA sequence
accacgcctccagttgggga

SEQ ID NO: 346253 - DNA, 20 bp, Artificial
  CRISPR gRNA sequence
ccacgcctccagttggggag

SEQ ID NO: 346254 - DNA, 20 bp, Artificial
  CRISPR gRNA sequence
cacgcctccagttggggaga

SEQ ID NO: 346255 - DNA, 20 bp, Artificial
  CRISPR gRNA sequence
cagttggggagagggtgaca

SEQ ID NO: 346256 - DNA, 20 bp, Artificial
  CRISPR gRNA sequence
agttggggagagggtgacac

SEQ ID NO: 346257 - DNA, 20 bp, Artificial
  CRISPR gRNA sequence
gttggggagagggtgacacg

SEQ ID NO: 346258 - DNA, 20 bp, Artificial
  CRISPR gRNA sequence
ggggagagggtgacacgggg

SEQ ID NO: 346259 - DNA, 20 bp, Artificial
  CRISPR gRNA sequence
gggagagggtgacacggggt

SEQ ID NO: 346260 - DNA, 20 bp, Artificial
  CRISPR gRNA sequence
ggagagggtgacacggggtg

SEQ ID NO: 346261 - DNA, 20 bp, Artificial
  CRISPR gRNA sequence
gagggtgacacggggtgggg

SEQ ID NO: 346262 - DNA, 20 bp, Artificial
  CRISPR gRNA sequence
gtgacacggggtggggcagc

SEQ ID NO: 346263 - DNA, 20 bp, Artificial
  CRISPR gRNA sequence
acacggggtggggcagccag

SEQ ID NO: 346264 - DNA, 20 bp, Artificial
  CRISPR gRNA sequence
cagccagaagtgctgctttc

SEQ ID NO: 346265 - DNA, 20 bp, Artificial
  CRISPR gRNA sequence
agccagaagtgctgctttct

SEQ ID NO: 346266 - DNA, 20 bp, Artificial
  CRISPR gRNA sequence
gccagaagtgctgctttcta

SEQ ID NO: 346267 - DNA, 20 bp, Artificial
  CRISPR gRNA sequence
ccagaagtgctgctttctag

SEQ ID NO: 346268 - DNA, 20 bp, Artificial
  CRISPR gRNA sequence
agtgctgctttctaggggcc

SEQ ID NO: 346269 - DNA, 20 bp, Artificial
  CRISPR gRNA sequence
gtgctgctttctaggggccc

SEQ ID NO: 346270 - DNA, 20 bp, Artificial
  CRISPR gRNA sequence
tgctgctttctaggggccca

SEQ ID NO: 346271 - DNA, 20 bp, Artificial
  CRISPR gRNA sequence
taggggcccagggctccacc

SEQ ID NO: 346272 - DNA, 20 bp, Artificial
  CRISPR gRNA sequence
agggctccacctggcctgca

SEQ ID NO: 346273 - DNA, 20 bp, Artificial
  CRISPR gRNA sequence
gggctccacctggcctgcat

SEQ ID NO: 346274 - DNA, 20 bp, Artificial
  CRISPR gRNA sequence
gcatgggcctctccacaccc

SEQ ID NO: 346275 - DNA, 20 bp, Artificial
  CRISPR gRNA sequence
catgggcctctccacacccc

SEQ ID NO: 346276 - DNA, 20 bp, Artificial
  CRISPR gRNA sequence
tctccacaccccaggacgct

SEQ ID NO: 346277 - DNA, 20 bp, Artificial
  CRISPR gRNA sequence
caccccaggacgctaagcca

SEQ ID NO: 346278 - DNA, 20 bp, Artificial
  CRISPR gRNA sequence
acgctaagccaaagcttcca

SEQ ID NO: 346279 - DNA, 20 bp, Artificial
  CRISPR gRNA sequence
cgctaagccaaagcttccac

SEQ ID NO: 346280 - DNA, 20 bp, Artificial
  CRISPR gRNA sequence
agccaaagcttccacaggac

SEQ ID NO: 346281 - DNA, 20 bp, Artificial
  CRISPR gRNA sequence
gccaaagcttccacaggaca

SEQ ID NO: 346282 - DNA, 20 bp, Artificial
  CRISPR gRNA sequence
ccaaagcttccacaggacaa

SEQ ID NO: 346283 - DNA, 20 bp, Artificial
  CRISPR gRNA sequence
caaagcttccacaggacaag

SEQ ID NO: 346284 - DNA, 20 bp, Artificial
  CRISPR gRNA sequence
agcttccacaggacaagggg

SEQ ID NO: 346285 - DNA, 20 bp, Artificial
  CRISPR gRNA sequence
ttccacaggacaaggggtgg

SEQ ID NO: 346286 - DNA, 20 bp, Artificial
  CRISPR gRNA sequence
tccacaggacaaggggtggc

SEQ ID NO: 346287 - DNA, 20 bp, Artificial
  CRISPR gRNA sequence
cacaggacaaggggtggcag

SEQ ID NO: 346288 - DNA, 20 bp, Artificial
  CRISPR gRNA sequence
caggacaaggggtggcagga

SEQ ID NO: 346289 - DNA, 20 bp, Artificial
  CRISPR gRNA sequence
aggacaaggggtggcaggag

SEQ ID NO: 346290 - DNA, 20 bp, Artificial
  CRISPR gRNA sequence
gacaaggggtggcaggagag

SEQ ID NO: 346291 - DNA, 20 bp, Artificial
  CRISPR gRNA sequence
aggggtggcaggagaggagt

SEQ ID NO: 346292 - DNA, 20 bp, Artificial
  CRISPR gRNA sequence
ggggtggcaggagaggagtt

SEQ ID NO: 346293 - DNA, 20 bp, Artificial
  CRISPR gRNA sequence
gggtggcaggagaggagttg

SEQ ID NO: 346294 - DNA, 20 bp, Artificial
  CRISPR gRNA sequence
tggcaggagaggagttgggg

SEQ ID NO: 346295 - DNA, 20 bp, Artificial
  CRISPR gRNA sequence
ggcaggagaggagttggggt

SEQ ID NO: 346296 - DNA, 20 bp, Artificial
  CRISPR gRNA sequence
aggagaggagttggggtggg

SEQ ID NO: 346297 - DNA, 20 bp, Artificial
  CRISPR gRNA sequence
aggagttggggtgggtggct

SEQ ID NO: 346298 - DNA, 20 bp, Artificial
  CRISPR gRNA sequence
ttggggtgggtggctcagcc

SEQ ID NO: 346299 - DNA, 20 bp, Artificial
  CRISPR gRNA sequence
tggggtgggtggctcagcct

SEQ ID NO: 346300 - DNA, 20 bp, Artificial
  CRISPR gRNA sequence
ggggtgggtggctcagcctg

SEQ ID NO: 346301 - DNA, 20 bp, Artificial
  CRISPR gRNA sequence
gggtgggtggctcagcctgg

SEQ ID NO: 346302 - DNA, 20 bp, Artificial
  CRISPR gRNA sequence
gctcagcctgggggctctgc

SEQ ID NO: 346303 - DNA, 20 bp, Artificial
  CRISPR gRNA sequence
tcagcctgggggctctgctg

SEQ ID NO: 346304 - DNA, 20 bp, Artificial
  CRISPR gRNA sequence
cagcctgggggctctgctgg

SEQ ID NO: 346305 - DNA, 20 bp, Artificial
  CRISPR gRNA sequence
cctgggggctctgctggagg

SEQ ID NO: 346306 - DNA, 20 bp, Artificial
  CRISPR gRNA sequence
ctgggggctctgctggaggc

SEQ ID NO: 346307 - DNA, 20 bp, Artificial
  CRISPR gRNA sequence
ctctgctggaggcaggtgac

SEQ ID NO: 346308 - DNA, 20 bp, Artificial
  CRISPR gRNA sequence
tctgctggaggcaggtgaca

SEQ ID NO: 346309 - DNA, 20 bp, Artificial
  CRISPR gRNA sequence
ctggaggcaggtgacaagga

SEQ ID NO: 346310 - DNA, 20 bp, Artificial
  CRISPR gRNA sequence
tggaggcaggtgacaaggaa

SEQ ID NO: 346311 - DNA, 20 bp, Artificial
  CRISPR gRNA sequence
gaggcaggtgacaaggaaag

SEQ ID NO: 346312 - DNA, 20 bp, Artificial
  CRISPR gRNA sequence
ggcaggtgacaaggaaagga

SEQ ID NO: 346313 - DNA, 20 bp, Artificial
  CRISPR gRNA sequence
gcaggtgacaaggaaaggag

SEQ ID NO: 346314 - DNA, 20 bp, Artificial
  CRISPR gRNA sequence
caggtgacaaggaaaggaga

SEQ ID NO: 346315 - DNA, 20 bp, Artificial
  CRISPR gRNA sequence
aggtgacaaggaaaggagag

SEQ ID NO: 346316 - DNA, 20 bp, Artificial
  CRISPR gRNA sequence
ggtgacaaggaaaggagagg

SEQ ID NO: 346317 - DNA, 20 bp, Artificial
  CRISPR gRNA sequence
gacaaggaaaggagaggggg

SEQ ID NO: 346318 - DNA, 20 bp, Artificial
  CRISPR gRNA sequence
acaaggaaaggagagggggt

SEQ ID NO: 346319 - DNA, 20 bp, Artificial
  CRISPR gRNA sequence
caaggaaaggagagggggta

SEQ ID NO: 346320 - DNA, 20 bp, Artificial
  CRISPR gRNA sequence
ggaaaggagagggggtaggg

SEQ ID NO: 346321 - DNA, 20 bp, Artificial
  CRISPR gRNA sequence
gaaaggagagggggtagggc

SEQ ID NO: 346322 - DNA, 20 bp, Artificial
  CRISPR gRNA sequence
aaaggagagggggtagggcg

SEQ ID NO: 346323 - DNA, 20 bp, Artificial
  CRISPR gRNA sequence
ggagagggggtagggcgggg

SEQ ID NO: 346324 - DNA, 20 bp, Artificial
  CRISPR gRNA sequence
agagggggtagggcggggtg

SEQ ID NO: 346325 - DNA, 20 bp, Artificial
  CRISPR gRNA sequence
gggggtagggcggggtggag

SEQ ID NO: 346326 - DNA, 20 bp, Artificial
  CRISPR gRNA sequence
ggggtagggcggggtggagc

SEQ ID NO: 346327 - DNA, 20 bp, Artificial
  CRISPR gRNA sequence
cggggtggagcgggcatgct

SEQ ID NO: 346328 - DNA, 20 bp, Artificial
  CRISPR gRNA sequence
gggtggagcgggcatgctcg

SEQ ID NO: 346329 - DNA, 20 bp, Artificial
  CRISPR gRNA sequence
ggtggagcgggcatgctcgg

SEQ ID NO: 346330 - DNA, 20 bp, Artificial
  CRISPR gRNA sequence
gtggagcgggcatgctcgga

SEQ ID NO: 346331 - DNA, 20 bp, Artificial
  CRISPR gRNA sequence
tggagcgggcatgctcggag

SEQ ID NO: 346332 - DNA, 20 bp, Artificial
  CRISPR gRNA sequence
gcatgctcggaggggctatg

SEQ ID NO: 346333 - DNA, 20 bp, Artificial
  CRISPR gRNA sequence
ctatgtggcctccatcctca

SEQ ID NO: 346334 - DNA, 20 bp, Artificial
  CRISPR gRNA sequence
tggcctccatcctcatggca

SEQ ID NO: 346335 - DNA, 20 bp, Artificial
  CRISPR gRNA sequence
ccatcctcatggcatggctg

SEQ ID NO: 346336 - DNA, 20 bp, Artificial
  CRISPR gRNA sequence
catcctcatggcatggctgc

SEQ ID NO: 346337 - DNA, 20 bp, Artificial
  CRISPR gRNA sequence
atcctcatggcatggctgca

SEQ ID NO: 346338 - DNA, 20 bp, Artificial
  CRISPR gRNA sequence
cccctcaccgcttctaactt

SEQ ID NO: 346339 - DNA, 20 bp, Artificial
  CRISPR gRNA sequence
accgcttctaacttcagatg

SEQ ID NO: 346340 - DNA, 20 bp, Artificial
  CRISPR gRNA sequence
ccgcttctaacttcagatgt

SEQ ID NO: 346341 - DNA, 20 bp, Artificial
  CRISPR gRNA sequence
cgcttctaacttcagatgtg

SEQ ID NO: 346342 - DNA, 20 bp, Artificial
  CRISPR gRNA sequence
tctaacttcagatgtgggga

SEQ ID NO: 346343 - DNA, 20 bp, Artificial
  CRISPR gRNA sequence
ctaacttcagatgtggggaa

SEQ ID NO: 346344 - DNA, 20 bp, Artificial
  CRISPR gRNA sequence
taacttcagatgtggggaaa

SEQ ID NO: 346345 - DNA, 20 bp, Artificial
  CRISPR gRNA sequence
aacttcagatgtggggaaag

SEQ ID NO: 346346 - DNA, 20 bp, Artificial
  CRISPR gRNA sequence
ccgaccattaaatgaatgtg

SEQ ID NO: 346347 - DNA, 20 bp, Artificial
  CRISPR gRNA sequence
cattaaatgaatgtgtggct

SEQ ID NO: 346348 - DNA, 20 bp, Artificial
  CRISPR gRNA sequence
ttaaatgaatgtgtggctca

SEQ ID NO: 346349 - DNA, 20 bp, Artificial
  CRISPR gRNA sequence
taaatgaatgtgtggctcag

SEQ ID NO: 346350 - DNA, 20 bp, Artificial
  CRISPR gRNA sequence
gaatgtgtggctcagaggcc

SEQ ID NO: 346351 - DNA, 20 bp, Artificial
  CRISPR gRNA sequence
tgtggctcagaggcctggtg

SEQ ID NO: 346352 - DNA, 20 bp, Artificial
  CRISPR gRNA sequence
aggcctggtgaagcccctgc

SEQ ID NO: 346353 - DNA, 20 bp, Artificial
  CRISPR gRNA sequence
cctggtgaagcccctgccag

SEQ ID NO: 346354 - DNA, 20 bp, Artificial
  CRISPR gRNA sequence
ctggtgaagcccctgccagc

SEQ ID NO: 346355 - DNA, 20 bp, Artificial
  CRISPR gRNA sequence
aagcccctgccagcgggacc

SEQ ID NO: 346356 - DNA, 20 bp, Artificial
  CRISPR gRNA sequence
agcccctgccagcgggacct

SEQ ID NO: 346357 - DNA, 20 bp, Artificial
  CRISPR gRNA sequence
ctgccagcgggacctgggcc

SEQ ID NO: 346358 - DNA, 20 bp, Artificial
  CRISPR gRNA sequence
ccagcgggacctgggcctgg

SEQ ID NO: 346359 - DNA, 20 bp, Artificial
  CRISPR gRNA sequence
cagcgggacctgggcctggc

SEQ ID NO: 346360 - DNA, 20 bp, Artificial
  CRISPR gRNA sequence
acctgggcctggcgggttcc

SEQ ID NO: 346361 - DNA, 20 bp, Artificial
  CRISPR gRNA sequence
ctgggcctggcgggttcccg

SEQ ID NO: 346362 - DNA, 20 bp, Artificial
  CRISPR gRNA sequence
ggcctggcgggttcccggag

SEQ ID NO: 346363 - DNA, 20 bp, Artificial
  CRISPR gRNA sequence
gcctggcgggttcccggagc

SEQ ID NO: 346364 - DNA, 20 bp, Artificial
  CRISPR gRNA sequence
tggcgggttcccggagcagg

SEQ ID NO: 346365 - DNA, 20 bp, Artificial
  CRISPR gRNA sequence
gcgggttcccggagcaggtg

SEQ ID NO: 346366 - DNA, 20 bp, Artificial
  CRISPR gRNA sequence
gggttcccggagcaggtgga

SEQ ID NO: 346367 - DNA, 20 bp, Artificial
  CRISPR gRNA sequence
ggttcccggagcaggtggag

SEQ ID NO: 346368 - DNA, 20 bp, Artificial
  CRISPR gRNA sequence
gttcccggagcaggtggaga

SEQ ID NO: 346369 - DNA, 20 bp, Artificial
  CRISPR gRNA sequence
ccggagcaggtggagagggc

SEQ ID NO: 346370 - DNA, 20 bp, Artificial
  CRISPR gRNA sequence
cggagcaggtggagagggct

SEQ ID NO: 346371 - DNA, 20 bp, Artificial
  CRISPR gRNA sequence
caggtggagagggctgggca

SEQ ID NO: 346372 - DNA, 20 bp, Artificial
  CRISPR gRNA sequence
gtggagagggctgggcacag

SEQ ID NO: 346373 - DNA, 20 bp, Artificial
  CRISPR gRNA sequence
tggagagggctgggcacagc

SEQ ID NO: 346374 - DNA, 20 bp, Artificial
  CRISPR gRNA sequence
acagcaggcgtcactgatac

SEQ ID NO: 346375 - DNA, 20 bp, Artificial
  CRISPR gRNA sequence
cagcaggcgtcactgatact

SEQ ID NO: 346376 - DNA, 20 bp, Artificial
  CRISPR gRNA sequence
agcaggcgtcactgatactg

SEQ ID NO: 346377 - DNA, 20 bp, Artificial
  CRISPR gRNA sequence
tcactgatactggggtttct

SEQ ID NO: 346378 - DNA, 20 bp, Artificial
  CRISPR gRNA sequence
ctgatactggggtttctcgg

SEQ ID NO: 346379 - DNA, 20 bp, Artificial
  CRISPR gRNA sequence
ctggggtttctcggtggaca

SEQ ID NO: 346380 - DNA, 20 bp, Artificial
  CRISPR gRNA sequence
ggtttctcggtggacacagc

SEQ ID NO: 346381 - DNA, 20 bp, Artificial
  CRISPR gRNA sequence
gtttctcggtggacacagct

SEQ ID NO: 346382 - DNA, 20 bp, Artificial
  CRISPR gRNA sequence
tctcggtggacacagctggg

SEQ ID NO: 346383 - DNA, 20 bp, Artificial
  CRISPR gRNA sequence
gtggacacagctgggaagtg

SEQ ID NO: 346384 - DNA, 20 bp, Artificial
  CRISPR gRNA sequence
tggacacagctgggaagtgt

SEQ ID NO: 346385 - DNA, 20 bp, Artificial
  CRISPR gRNA sequence
cacagctgggaagtgtaggt

SEQ ID NO: 346386 - DNA, 20 bp, Artificial
  CRISPR gRNA sequence
tgggaagtgtaggtcagatg

SEQ ID NO: 346387 - DNA, 20 bp, Artificial
  CRISPR gRNA sequence
gtgtaggtcagatgtagatc

SEQ ID NO: 346388 - DNA, 20 bp, Artificial
  CRISPR gRNA sequence
tgtaggtcagatgtagatct

SEQ ID NO: 346389 - DNA, 20 bp, Artificial
  CRISPR gRNA sequence
gtaggtcagatgtagatctg

SEQ ID NO: 346390 - DNA, 20 bp, Artificial
  CRISPR gRNA sequence
tgtagatctggggtttttac

SEQ ID NO: 346391 - DNA, 20 bp, Artificial
  CRISPR gRNA sequence
gtagatctggggtttttact

SEQ ID NO: 346392 - DNA, 20 bp, Artificial
  CRISPR gRNA sequence
gggcaaatctgacaccattt

SEQ ID NO: 346393 - DNA, 20 bp, Artificial
  CRISPR gRNA sequence
atctgacaccatttgagcat

SEQ ID NO: 346394 - DNA, 20 bp, Artificial
  CRISPR gRNA sequence
catttgagcatcagaatcca

SEQ ID NO: 346395 - DNA, 20 bp, Artificial
  CRISPR gRNA sequence
agcatcagaatccacagcaa

SEQ ID NO: 346396 - DNA, 20 bp, Artificial
  CRISPR gRNA sequence
agaatccacagcaatagcct

SEQ ID NO: 346397 - DNA, 20 bp, Artificial
  CRISPR gRNA sequence
tccacagcaatagcctcgga

SEQ ID NO: 346398 - DNA, 20 bp, Artificial
  CRISPR gRNA sequence
cacagcaatagcctcggacg

SEQ ID NO: 346399 - DNA, 20 bp, Artificial
  CRISPR gRNA sequence
aatagcctcggacggagcca

SEQ ID NO: 346400 - DNA, 20 bp, Artificial
  CRISPR gRNA sequence
tagcctcggacggagccaca

SEQ ID NO: 346401 - DNA, 20 bp, Artificial
  CRISPR gRNA sequence
agcctcggacggagccacag

SEQ ID NO: 346402 - DNA, 20 bp, Artificial
  CRISPR gRNA sequence
tcggacggagccacagaggt

SEQ ID NO: 346403 - DNA, 20 bp, Artificial
  CRISPR gRNA sequence
gacggagccacagaggtcag

SEQ ID NO: 346404 - DNA, 20 bp, Artificial
  CRISPR gRNA sequence
cggagccacagaggtcagaa

SEQ ID NO: 346405 - DNA, 20 bp, Artificial
  CRISPR gRNA sequence
agaggtcagaagagcccact

SEQ ID NO: 346406 - DNA, 20 bp, Artificial
  CRISPR gRNA sequence
aggtcagaagagcccactga

SEQ ID NO: 346407 - DNA, 20 bp, Artificial
  CRISPR gRNA sequence
agaagagcccactgagagct

SEQ ID NO: 346408 - DNA, 20 bp, Artificial
  CRISPR gRNA sequence
cccactgagagctcagctgt

SEQ ID NO: 346409 - DNA, 20 bp, Artificial
  CRISPR gRNA sequence
ccactgagagctcagctgtt

SEQ ID NO: 346410 - DNA, 20 bp, Artificial
  CRISPR gRNA sequence
agctcagctgttgggatatg

SEQ ID NO: 346411 - DNA, 20 bp, Artificial
  CRISPR gRNA sequence
gctcagctgttgggatatga

SEQ ID NO: 346412 - DNA, 20 bp, Artificial
  CRISPR gRNA sequence
ctcagctgttgggatatgaa

SEQ ID NO: 346413 - DNA, 20 bp, Artificial
  CRISPR gRNA sequence
tcagctgttgggatatgaag

SEQ ID NO: 346414 - DNA, 20 bp, Artificial
  CRISPR gRNA sequence
gctgttgggatatgaagggg

SEQ ID NO: 346415 - DNA, 20 bp, Artificial
  CRISPR gRNA sequence
ttgggatatgaaggggcggc

SEQ ID NO: 346416 - DNA, 20 bp, Artificial
  CRISPR gRNA sequence
tgggatatgaaggggcggcc

SEQ ID NO: 346417 - DNA, 20 bp, Artificial
  CRISPR gRNA sequence
gggatatgaaggggcggcca

SEQ ID NO: 346418 - DNA, 20 bp, Artificial
  CRISPR gRNA sequence
gggcggccagggctcctctc

SEQ ID NO: 346419 - DNA, 20 bp, Artificial
  CRISPR gRNA sequence
ggcggccagggctcctctct

SEQ ID NO: 346420 - DNA, 20 bp, Artificial
  CRISPR gRNA sequence
ggccagggctcctctctggg

SEQ ID NO: 346421 - DNA, 20 bp, Artificial
  CRISPR gRNA sequence
ccagggctcctctctgggtg

SEQ ID NO: 346422 - DNA, 20 bp, Artificial
  CRISPR gRNA sequence
ctctgggtggagtgaacccc

SEQ ID NO: 346423 - DNA, 20 bp, Artificial
  CRISPR gRNA sequence
tctgggtggagtgaaccccc

SEQ ID NO: 346424 - DNA, 20 bp, Artificial
  CRISPR gRNA sequence
gagtgaacccccaggcatga

SEQ ID NO: 346425 - DNA, 20 bp, Artificial
  CRISPR gRNA sequence
agtgaacccccaggcatgac

SEQ ID NO: 346426 - DNA, 20 bp, Artificial
  CRISPR gRNA sequence
tgaacccccaggcatgacgg

SEQ ID NO: 346427 - DNA, 20 bp, Artificial
  CRISPR gRNA sequence
gaacccccaggcatgacggg

SEQ ID NO: 346428 - DNA, 20 bp, Artificial
  CRISPR gRNA sequence
acccccaggcatgacgggag

SEQ ID NO: 346429 - DNA, 20 bp, Artificial
  CRISPR gRNA sequence
cccccaggcatgacgggagg

SEQ ID NO: 346430 - DNA, 20 bp, Artificial
  CRISPR gRNA sequence
ccccaggcatgacgggagga

SEQ ID NO: 346431 - DNA, 20 bp, Artificial
  CRISPR gRNA sequence
caggcatgacgggaggaggg

SEQ ID NO: 346432 - DNA, 20 bp, Artificial
  CRISPR gRNA sequence
aggcatgacgggaggagggc

SEQ ID NO: 346433 - DNA, 20 bp, Artificial
  CRISPR gRNA sequence
ggcatgacgggaggagggca

SEQ ID NO: 346434 - DNA, 20 bp, Artificial
  CRISPR gRNA sequence
gcatgacgggaggagggcag

SEQ ID NO: 346435 - DNA, 20 bp, Artificial
  CRISPR gRNA sequence
gagggcaggggtcccccgaa

SEQ ID NO: 346436 - DNA, 20 bp, Artificial
  CRISPR gRNA sequence
caggggtcccccgaacagcc

SEQ ID NO: 346437 - DNA, 20 bp, Artificial
  CRISPR gRNA sequence
gggtcccccgaacagcccag

SEQ ID NO: 346438 - DNA, 20 bp, Artificial
  CRISPR gRNA sequence
gaacagcccagcagccatcc

SEQ ID NO: 346439 - DNA, 20 bp, Artificial
  CRISPR gRNA sequence
ccatcctggaactccttgtt

SEQ ID NO: 346440 - DNA, 20 bp, Artificial
  CRISPR gRNA sequence
cctggaactccttgttcagc

SEQ ID NO: 346441 - DNA, 20 bp, Artificial
  CRISPR gRNA sequence
ccttgttcagcaagaaacac

SEQ ID NO: 346442 - DNA, 20 bp, Artificial
  CRISPR gRNA sequence
cttgttcagcaagaaacacc

SEQ ID NO: 346443 - DNA, 20 bp, Artificial
  CRISPR gRNA sequence
tgttcagcaagaaacaccgg

SEQ ID NO: 346444 - DNA, 20 bp, Artificial
  CRISPR gRNA sequence
gttcagcaagaaacaccggg

SEQ ID NO: 346445 - DNA, 20 bp, Artificial
  CRISPR gRNA sequence
caagaaacaccgggaggtga

SEQ ID NO: 346446 - DNA, 20 bp, Artificial
  CRISPR gRNA sequence
acaccgggaggtgacagttt

SEQ ID NO: 346447 - DNA, 20 bp, Artificial
  CRISPR gRNA sequence
caccgggaggtgacagtttg

SEQ ID NO: 346448 - DNA, 20 bp, Artificial
  CRISPR gRNA sequence
ccgggaggtgacagtttgag

SEQ ID NO: 346449 - DNA, 20 bp, Artificial
  CRISPR gRNA sequence
gtgacagtttgaggagaaac

SEQ ID NO: 346450 - DNA, 20 bp, Artificial
  CRISPR gRNA sequence
aagatatttacatcctccca

SEQ ID NO: 346451 - DNA, 20 bp, Artificial
  CRISPR gRNA sequence
atacactgtttcatgacaaa

SEQ ID NO: 346452 - DNA, 20 bp, Artificial
  CRISPR gRNA sequence
gtttcatgacaaatagaaaa

SEQ ID NO: 346453 - DNA, 20 bp, Artificial
  CRISPR gRNA sequence
tttcatgacaaatagaaaac

SEQ ID NO: 346454 - DNA, 20 bp, Artificial
  CRISPR gRNA sequence
tcatgacaaatagaaaacag

SEQ ID NO: 346455 - DNA, 20 bp, Artificial
  CRISPR gRNA sequence
agccgaattcaaatccaatt

SEQ ID NO: 346456 - DNA, 20 bp, Artificial
  CRISPR gRNA sequence
ttagaaaatcacttccgatg

SEQ ID NO: 346457 - DNA, 20 bp, Artificial
  CRISPR gRNA sequence
atccactaaacaccacactg

SEQ ID NO: 346458 - DNA, 20 bp, Artificial
  CRISPR gRNA sequence
acaccacactgcagccaacc

SEQ ID NO: 346459 - DNA, 20 bp, Artificial
  CRISPR gRNA sequence
acactgcagccaacccagtc

SEQ ID NO: 346460 - DNA, 20 bp, Artificial
  CRISPR gRNA sequence
cagccaacccagtccagcct

SEQ ID NO: 346461 - DNA, 20 bp, Artificial
  CRISPR gRNA sequence
cccagtccagccttggctgt

SEQ ID NO: 346462 - DNA, 20 bp, Artificial
  CRISPR gRNA sequence
ccagtccagccttggctgtg

SEQ ID NO: 346463 - DNA, 20 bp, Artificial
  CRISPR gRNA sequence
gtccagccttggctgtgagg

SEQ ID NO: 346464 - DNA, 20 bp, Artificial
  CRISPR gRNA sequence
cttggctgtgaggcagtgcc

SEQ ID NO: 346465 - DNA, 20 bp, Artificial
  CRISPR gRNA sequence
ttggctgtgaggcagtgccc

SEQ ID NO: 346466 - DNA, 20 bp, Artificial
  CRISPR gRNA sequence
tggctgtgaggcagtgcccg

SEQ ID NO: 346467 - DNA, 20 bp, Artificial
  CRISPR gRNA sequence
tgcccggggcctgtcctgct

SEQ ID NO: 346468 - DNA, 20 bp, Artificial
  CRISPR gRNA sequence
gcccggggcctgtcctgctg

SEQ ID NO: 346469 - DNA, 20 bp, Artificial
  CRISPR gRNA sequence
gcctgtcctgctgaggccac

SEQ ID NO: 346470 - DNA, 20 bp, Artificial
  CRISPR gRNA sequence
ctgtcctgctgaggccacaa

SEQ ID NO: 346471 - DNA, 20 bp, Artificial
  CRISPR gRNA sequence
cctgctgaggccacaagagt

SEQ ID NO: 346472 - DNA, 20 bp, Artificial
  CRISPR gRNA sequence
ggccacaagagtcagacgcg

SEQ ID NO: 346473 - DNA, 20 bp, Artificial
  CRISPR gRNA sequence
acaagagtcagacgcgcaga

SEQ ID NO: 346474 - DNA, 20 bp, Artificial
  CRISPR gRNA sequence
gagtcagacgcgcagacagc

SEQ ID NO: 346475 - DNA, 20 bp, Artificial
  CRISPR gRNA sequence
agtcagacgcgcagacagct

SEQ ID NO: 346476 - DNA, 20 bp, Artificial
  CRISPR gRNA sequence
gtcagacgcgcagacagctg

SEQ ID NO: 346477 - DNA, 20 bp, Artificial
  CRISPR gRNA sequence
gcgcagacagctggggtctg

SEQ ID NO: 346478 - DNA, 20 bp, Artificial
  CRISPR gRNA sequence
cgcagacagctggggtctga

SEQ ID NO: 346479 - DNA, 20 bp, Artificial
  CRISPR gRNA sequence
gcagacagctggggtctgaa

SEQ ID NO: 346480 - DNA, 20 bp, Artificial
  CRISPR gRNA sequence
ctggggtctgaagggccctc

SEQ ID NO: 346481 - DNA, 20 bp, Artificial
  CRISPR gRNA sequence
tggggtctgaagggccctct

SEQ ID NO: 346482 - DNA, 20 bp, Artificial
  CRISPR gRNA sequence
gtctgaagggccctctgggc

SEQ ID NO: 346483 - DNA, 20 bp, Artificial
  CRISPR gRNA sequence
aagggccctctgggctggcc

SEQ ID NO: 346484 - DNA, 20 bp, Artificial
  CRISPR gRNA sequence
agggccctctgggctggccc

SEQ ID NO: 346485 - DNA, 20 bp, Artificial
  CRISPR gRNA sequence
ggccctctgggctggcccag

SEQ ID NO: 346486 - DNA, 20 bp, Artificial
  CRISPR gRNA sequence
gccctctgggctggcccagg

SEQ ID NO: 346487 - DNA, 20 bp, Artificial
  CRISPR gRNA sequence
ccctctgggctggcccagga

SEQ ID NO: 346488 - DNA, 20 bp, Artificial
  CRISPR gRNA sequence
ctgggctggcccaggagggc

SEQ ID NO: 346489 - DNA, 20 bp, Artificial
  CRISPR gRNA sequence
tgggctggcccaggagggct

SEQ ID NO: 346490 - DNA, 20 bp, Artificial
  CRISPR gRNA sequence
gcccaggagggctgggtgtg

SEQ ID NO: 346491 - DNA, 20 bp, Artificial
  CRISPR gRNA sequence
gggctgggtgtgtggtctgt

SEQ ID NO: 346492 - DNA, 20 bp, Artificial
  CRISPR gRNA sequence
tgggtgtgtggtctgtgagc

SEQ ID NO: 346493 - DNA, 20 bp, Artificial
  CRISPR gRNA sequence
gggtgtgtggtctgtgagcg

SEQ ID NO: 346494 - DNA, 20 bp, Artificial
  CRISPR gRNA sequence
ggtgtgtggtctgtgagcga

SEQ ID NO: 346495 - DNA, 20 bp, Artificial
  CRISPR gRNA sequence
gtgtgtggtctgtgagcgag

SEQ ID NO: 346496 - DNA, 20 bp, Artificial
  CRISPR gRNA sequence
gtctgtgagcgaggggcaac

SEQ ID NO: 346497 - DNA, 20 bp, Artificial
  CRISPR gRNA sequence
gggcaactggcgctcctcct

SEQ ID NO: 346498 - DNA, 20 bp, Artificial
  CRISPR gRNA sequence
ggcaactggcgctcctcctc

SEQ ID NO: 346499 - DNA, 20 bp, Artificial
  CRISPR gRNA sequence
ggcgctcctcctcaggactc

SEQ ID NO: 346500 - DNA, 20 bp, Artificial
  CRISPR gRNA sequence
gcgctcctcctcaggactct

SEQ ID NO: 346501 - DNA, 20 bp, Artificial
  CRISPR gRNA sequence
cgctcctcctcaggactctg

SEQ ID NO: 346502 - DNA, 20 bp, Artificial
  CRISPR gRNA sequence
ctcctcctcaggactctggg

SEQ ID NO: 346503 - DNA, 20 bp, Artificial
  CRISPR gRNA sequence
cctcaggactctggggagct

SEQ ID NO: 346504 - DNA, 20 bp, Artificial
  CRISPR gRNA sequence
ctcaggactctggggagctc

SEQ ID NO: 346505 - DNA, 20 bp, Artificial
  CRISPR gRNA sequence
actctggggagctcaggcca

SEQ ID NO: 346506 - DNA, 20 bp, Artificial
  CRISPR gRNA sequence
ctggggagctcaggccacag

SEQ ID NO: 346507 - DNA, 20 bp, Artificial
  CRISPR gRNA sequence
gagctcaggccacagcagaa

SEQ ID NO: 346508 - DNA, 20 bp, Artificial
  CRISPR gRNA sequence
gctcaggccacagcagaaca

SEQ ID NO: 346509 - DNA, 20 bp, Artificial
  CRISPR gRNA sequence
ctcaggccacagcagaacag

SEQ ID NO: 346510 - DNA, 20 bp, Artificial
  CRISPR gRNA sequence
ccacagcagaacagaggccc

SEQ ID NO: 346511 - DNA, 20 bp, Artificial
  CRISPR gRNA sequence
cacagcagaacagaggcccc

SEQ ID NO: 346512 - DNA, 20 bp, Artificial
  CRISPR gRNA sequence
cagaggccccaggccctcac

SEQ ID NO: 346513 - DNA, 20 bp, Artificial
  CRISPR gRNA sequence
cccaggccctcactggccca

SEQ ID NO: 346514 - DNA, 20 bp, Artificial
  CRISPR gRNA sequence
ccaggccctcactggcccat

SEQ ID NO: 346515 - DNA, 20 bp, Artificial
  CRISPR gRNA sequence
ccctcactggcccatgggaa

SEQ ID NO: 346516 - DNA, 20 bp, Artificial
  CRISPR gRNA sequence
tggcccatgggaatggcacg

SEQ ID NO: 346517 - DNA, 20 bp, Artificial
  CRISPR gRNA sequence
ggaatggcacgtggcgtccc

SEQ ID NO: 346518 - DNA, 20 bp, Artificial
  CRISPR gRNA sequence
tggcgtccccagctctaccc

SEQ ID NO: 346519 - DNA, 20 bp, Artificial
  CRISPR gRNA sequence
cgtccccagctctaccccag

SEQ ID NO: 346520 - DNA, 20 bp, Artificial
  CRISPR gRNA sequence
gtccccagctctaccccagc

SEQ ID NO: 346521 - DNA, 20 bp, Artificial
  CRISPR gRNA sequence
tccccagctctaccccagca

SEQ ID NO: 346522 - DNA, 20 bp, Artificial
  CRISPR gRNA sequence
ccccagctctaccccagcag

SEQ ID NO: 346523 - DNA, 20 bp, Artificial
  CRISPR gRNA sequence
ggccccacctctccctccac

SEQ ID NO: 346524 - DNA, 20 bp, Artificial
  CRISPR gRNA sequence
ccccacctctccctccactg

SEQ ID NO: 346525 - DNA, 20 bp, Artificial
  CRISPR gRNA sequence
cccacctctccctccactgg

SEQ ID NO: 346526 - DNA, 20 bp, Artificial
  CRISPR gRNA sequence
cacctctccctccactggag

SEQ ID NO: 346527 - DNA, 20 bp, Artificial
  CRISPR gRNA sequence
tctccctccactggaggaga

SEQ ID NO: 346528 - DNA, 20 bp, Artificial
  CRISPR gRNA sequence
ccctccactggaggagacgg

SEQ ID NO: 346529 - DNA, 20 bp, Artificial
  CRISPR gRNA sequence
ccactggaggagacggaagc

SEQ ID NO: 346530 - DNA, 20 bp, Artificial
  CRISPR gRNA sequence
ggaggagacggaagccagcc

SEQ ID NO: 346531 - DNA, 20 bp, Artificial
  CRISPR gRNA sequence
gaggagacggaagccagccc

SEQ ID NO: 346532 - DNA, 20 bp, Artificial
  CRISPR gRNA sequence
aggagacggaagccagccca

SEQ ID NO: 346533 - DNA, 20 bp, Artificial
  CRISPR gRNA sequence
agacggaagccagcccaggg

SEQ ID NO: 346534 - DNA, 20 bp, Artificial
  CRISPR gRNA sequence
acggaagccagcccagggcg

SEQ ID NO: 346535 - DNA, 20 bp, Artificial
  CRISPR gRNA sequence
cagcccagggcggagccccc

SEQ ID NO: 346536 - DNA, 20 bp, Artificial
  CRISPR gRNA sequence
gggcggagcccccaagcctc

SEQ ID NO: 346537 - DNA, 20 bp, Artificial
  CRISPR gRNA sequence
ggcggagcccccaagcctcc

SEQ ID NO: 346538 - DNA, 20 bp, Artificial
  CRISPR gRNA sequence
gcccccaagcctccgggctc

SEQ ID NO: 346539 - DNA, 20 bp, Artificial
  CRISPR gRNA sequence
cccaagcctccgggctccgg

SEQ ID NO: 346540 - DNA, 20 bp, Artificial
  CRISPR gRNA sequence
ccgggctccggtggttccgc

SEQ ID NO: 346541 - DNA, 20 bp, Artificial
  CRISPR gRNA sequence
cgggctccggtggttccgcc

SEQ ID NO: 346542 - DNA, 20 bp, Artificial
  CRISPR gRNA sequence
gctccggtggttccgccagg

SEQ ID NO: 346543 - DNA, 20 bp, Artificial
  CRISPR gRNA sequence
cggtggttccgccaggtgga

SEQ ID NO: 346544 - DNA, 20 bp, Artificial
  CRISPR gRNA sequence
gccaggtggacagcctcttt

SEQ ID NO: 346545 - DNA, 20 bp, Artificial
  CRISPR gRNA sequence
aggtggacagcctctttcag

SEQ ID NO: 346546 - DNA, 20 bp, Artificial
  CRISPR gRNA sequence
tctttcagcagccgtcgctc

SEQ ID NO: 346547 - DNA, 20 bp, Artificial
  CRISPR gRNA sequence
ctttcagcagccgtcgctcc

SEQ ID NO: 346548 - DNA, 20 bp, Artificial
  CRISPR gRNA sequence
gccgtcgctccaggtatctc

SEQ ID NO: 346549 - DNA, 20 bp, Artificial
  CRISPR gRNA sequence
gctccaggtatctctggcgt

SEQ ID NO: 346550 - DNA, 20 bp, Artificial
  CRISPR gRNA sequence
ctccaggtatctctggcgtc

SEQ ID NO: 346551 - DNA, 20 bp, Artificial
  CRISPR gRNA sequence
tccaggtatctctggcgtcg

SEQ ID NO: 346552 - DNA, 20 bp, Artificial
  CRISPR gRNA sequence
gtatctctggcgtcggggtg

SEQ ID NO: 346553 - DNA, 20 bp, Artificial
  CRISPR gRNA sequence
atctctggcgtcggggtgca

SEQ ID NO: 346554 - DNA, 20 bp, Artificial
  CRISPR gRNA sequence
gcgtcggggtgcagagtctg

SEQ ID NO: 346555 - DNA, 20 bp, Artificial
  CRISPR gRNA sequence
cgtcggggtgcagagtctgt

SEQ ID NO: 346556 - DNA, 20 bp, Artificial
  CRISPR gRNA sequence
ggggtgcagagtctgtgggt

SEQ ID NO: 346557 - DNA, 20 bp, Artificial
  CRISPR gRNA sequence
gtgcagagtctgtgggtcag

SEQ ID NO: 346558 - DNA, 20 bp, Artificial
  CRISPR gRNA sequence
gagtctgtgggtcagtggtt

SEQ ID NO: 346559 - DNA, 20 bp, Artificial
  CRISPR gRNA sequence
agtctgtgggtcagtggttt

SEQ ID NO: 346560 - DNA, 20 bp, Artificial
  CRISPR gRNA sequence
ttgggctcctccccgtgaat

SEQ ID NO: 346561 - DNA, 20 bp, Artificial
  CRISPR gRNA sequence
tgggctcctccccgtgaatg

SEQ ID NO: 346562 - DNA, 20 bp, Artificial
  CRISPR gRNA sequence
gggctcctccccgtgaatga

SEQ ID NO: 346563 - DNA, 20 bp, Artificial
  CRISPR gRNA sequence
tgagggtattgtctcctcca

SEQ ID NO: 346564 - DNA, 20 bp, Artificial
  CRISPR gRNA sequence
tgtctcctccacggccaccg

SEQ ID NO: 346565 - DNA, 20 bp, Artificial
  CRISPR gRNA sequence
acggccaccgtggtgacgtc

SEQ ID NO: 346566 - DNA, 20 bp, Artificial
  CRISPR gRNA sequence
ggccaccgtggtgacgtccg

SEQ ID NO: 346567 - DNA, 20 bp, Artificial
  CRISPR gRNA sequence
gccaccgtggtgacgtccgg

SEQ ID NO: 346568 - DNA, 20 bp, Artificial
  CRISPR gRNA sequence
ccaccgtggtgacgtccgga

SEQ ID NO: 346569 - DNA, 20 bp, Artificial
  CRISPR gRNA sequence
caccgtggtgacgtccggag

SEQ ID NO: 346570 - DNA, 20 bp, Artificial
  CRISPR gRNA sequence
gtgacgtccggaggggcctg

SEQ ID NO: 346571 - DNA, 20 bp, Artificial
  CRISPR gRNA sequence
tgacgtccggaggggcctgc

SEQ ID NO: 346572 - DNA, 20 bp, Artificial
  CRISPR gRNA sequence
gacgtccggaggggcctgca

SEQ ID NO: 346573 - DNA, 20 bp, Artificial
  CRISPR gRNA sequence
ctgcagggcctcaatgactg

SEQ ID NO: 346574 - DNA, 20 bp, Artificial
  CRISPR gRNA sequence
cctcctgtcttttccgctgt

SEQ ID NO: 346575 - DNA, 20 bp, Artificial
  CRISPR gRNA sequence
cgctgtgagcacacgaatcg

SEQ ID NO: 346576 - DNA, 20 bp, Artificial
  CRISPR gRNA sequence
ctgtgagcacacgaatcgtg

SEQ ID NO: 346577 - DNA, 20 bp, Artificial
  CRISPR gRNA sequence
tcgtggagaccctgcctgct

SEQ ID NO: 346578 - DNA, 20 bp, Artificial
  CRISPR gRNA sequence
cgtggagaccctgcctgctc

SEQ ID NO: 346579 - DNA, 20 bp, Artificial
  CRISPR gRNA sequence
cctgcctgctcaggcccccc

SEQ ID NO: 346580 - DNA, 20 bp, Artificial
  CRISPR gRNA sequence
ctgcctgctcaggcccccct

SEQ ID NO: 346581 - DNA, 20 bp, Artificial
  CRISPR gRNA sequence
ctcaggcccccctgggactc

SEQ ID NO: 346582 - DNA, 20 bp, Artificial
  CRISPR gRNA sequence
tcaggcccccctgggactcc

SEQ ID NO: 346583 - DNA, 20 bp, Artificial
  CRISPR gRNA sequence
cccctgggactccaggttct

SEQ ID NO: 346584 - DNA, 20 bp, Artificial
  CRISPR gRNA sequence
ccctgggactccaggttctc

SEQ ID NO: 346585 - DNA, 20 bp, Artificial
  CRISPR gRNA sequence
cgggttcattttactgcttt

SEQ ID NO: 346586 - DNA, 20 bp, Artificial
  CRISPR gRNA sequence
cattttactgctttcagttt

SEQ ID NO: 346587 - DNA, 20 bp, Artificial
  CRISPR gRNA sequence
attttactgctttcagtttg

SEQ ID NO: 346588 - DNA, 20 bp, Artificial
  CRISPR gRNA sequence
ttttactgctttcagtttga

SEQ ID NO: 346589 - DNA, 20 bp, Artificial
  CRISPR gRNA sequence
tttactgctttcagtttgag

SEQ ID NO: 346590 - DNA, 20 bp, Artificial
  CRISPR gRNA sequence
ttactgctttcagtttgagg

SEQ ID NO: 346591 - DNA, 20 bp, Artificial
  CRISPR gRNA sequence
ctgctttcagtttgaggggg

SEQ ID NO: 346592 - DNA, 20 bp, Artificial
  CRISPR gRNA sequence
tgctttcagtttgagggggt

SEQ ID NO: 346593 - DNA, 20 bp, Artificial
  CRISPR gRNA sequence
gagggggtgggttctttcct

SEQ ID NO: 346594 - DNA, 20 bp, Artificial
  CRISPR gRNA sequence
ggttctttcctgagctaccg

SEQ ID NO: 346595 - DNA, 20 bp, Artificial
  CRISPR gRNA sequence
gctaccgtggctgtacttga

SEQ ID NO: 346596 - DNA, 20 bp, Artificial
  CRISPR gRNA sequence
gtggctgtacttgaaagact

SEQ ID NO: 346597 - DNA, 20 bp, Artificial
  CRISPR gRNA sequence
tggctgtacttgaaagactc

SEQ ID NO: 346598 - DNA, 20 bp, Artificial
  CRISPR gRNA sequence
cttgaaagactcaggaccct

SEQ ID NO: 346599 - DNA, 20 bp, Artificial
  CRISPR gRNA sequence
tgaaagactcaggaccctca

SEQ ID NO: 346600 - DNA, 20 bp, Artificial
  CRISPR gRNA sequence
actcaggaccctcagagaac

SEQ ID NO: 346601 - DNA, 20 bp, Artificial
  CRISPR gRNA sequence
ctcaggaccctcagagaact

SEQ ID NO: 346602 - DNA, 20 bp, Artificial
  CRISPR gRNA sequence
caggaccctcagagaactgg

SEQ ID NO: 346603 - DNA, 20 bp, Artificial
  CRISPR gRNA sequence
ggagcccccaccatgtacac

SEQ ID NO: 346604 - DNA, 20 bp, Artificial
  CRISPR gRNA sequence
accatgtacaccagaaacac

SEQ ID NO: 346605 - DNA, 20 bp, Artificial
  CRISPR gRNA sequence
tacaccagaaacaccagccc

SEQ ID NO: 346606 - DNA, 20 bp, Artificial
  CRISPR gRNA sequence
accagaaacaccagccccag

SEQ ID NO: 346607 - DNA, 20 bp, Artificial
  CRISPR gRNA sequence
ccagaaacaccagccccagc

SEQ ID NO: 346608 - DNA, 20 bp, Artificial
  CRISPR gRNA sequence
cagaaacaccagccccagcg

SEQ ID NO: 346609 - DNA, 20 bp, Artificial
  CRISPR gRNA sequence
gaaacaccagccccagcggg

SEQ ID NO: 346610 - DNA, 20 bp, Artificial
  CRISPR gRNA sequence
aacaccagccccagcgggga

SEQ ID NO: 346611 - DNA, 20 bp, Artificial
  CRISPR gRNA sequence
acaccagccccagcggggag

SEQ ID NO: 346612 - DNA, 20 bp, Artificial
  CRISPR gRNA sequence
caccagccccagcggggaga

SEQ ID NO: 346613 - DNA, 20 bp, Artificial
  CRISPR gRNA sequence
accagccccagcggggagag

SEQ ID NO: 346614 - DNA, 20 bp, Artificial
  CRISPR gRNA sequence
cagccccagcggggagaggg

SEQ ID NO: 346615 - DNA, 20 bp, Artificial
  CRISPR gRNA sequence
agccccagcggggagagggg

SEQ ID NO: 346616 - DNA, 20 bp, Artificial
  CRISPR gRNA sequence
cccagcggggagaggggagg

SEQ ID NO: 346617 - DNA, 20 bp, Artificial
  CRISPR gRNA sequence
ccagcggggagaggggaggt

SEQ ID NO: 346618 - DNA, 20 bp, Artificial
  CRISPR gRNA sequence
gcggggagaggggaggtggg

SEQ ID NO: 346619 - DNA, 20 bp, Artificial
  CRISPR gRNA sequence
cggggagaggggaggtggga

SEQ ID NO: 346620 - DNA, 20 bp, Artificial
  CRISPR gRNA sequence
ggagaggggaggtgggaagg

SEQ ID NO: 346621 - DNA, 20 bp, Artificial
  CRISPR gRNA sequence
agaggggaggtgggaaggtg

SEQ ID NO: 346622 - DNA, 20 bp, Artificial
  CRISPR gRNA sequence
gaggggaggtgggaaggtgg

SEQ ID NO: 346623 - DNA, 20 bp, Artificial
  CRISPR gRNA sequence
aggggaggtgggaaggtgga

SEQ ID NO: 346624 - DNA, 20 bp, Artificial
  CRISPR gRNA sequence
ggggaggtgggaaggtggag

SEQ ID NO: 346625 - DNA, 20 bp, Artificial
  CRISPR gRNA sequence
gggaggtgggaaggtggagg

SEQ ID NO: 346626 - DNA, 20 bp, Artificial
  CRISPR gRNA sequence
ggaggtgggaaggtggaggg

SEQ ID NO: 346627 - DNA, 20 bp, Artificial
  CRISPR gRNA sequence
aggtgggaaggtggaggggg

SEQ ID NO: 346628 - DNA, 20 bp, Artificial
  CRISPR gRNA sequence
ggtgggaaggtggagggggg

SEQ ID NO: 346629 - DNA, 20 bp, Artificial
  CRISPR gRNA sequence
gtgggaaggtggagggggga

SEQ ID NO: 346630 - DNA, 20 bp, Artificial
  CRISPR gRNA sequence
gggaaggtggaggggggagg

SEQ ID NO: 346631 - DNA, 20 bp, Artificial
  CRISPR gRNA sequence
gaaggtggaggggggaggga

SEQ ID NO: 346632 - DNA, 20 bp, Artificial
  CRISPR gRNA sequence
aaggtggaggggggagggag

SEQ ID NO: 346633 - DNA, 20 bp, Artificial
  CRISPR gRNA sequence
aggtggaggggggagggaga

SEQ ID NO: 346634 - DNA, 20 bp, Artificial
  CRISPR gRNA sequence
ggtggaggggggagggagag

SEQ ID NO: 346635 - DNA, 20 bp, Artificial
  CRISPR gRNA sequence
gtggaggggggagggagagg

SEQ ID NO: 346636 - DNA, 20 bp, Artificial
  CRISPR gRNA sequence
ggaggggggagggagagggg

SEQ ID NO: 346637 - DNA, 20 bp, Artificial
  CRISPR gRNA sequence
gaggggggagggagaggggg

SEQ ID NO: 346638 - DNA, 20 bp, Artificial
  CRISPR gRNA sequence
ggggggagggagagggggag

SEQ ID NO: 346639 - DNA, 20 bp, Artificial
  CRISPR gRNA sequence
gggggagggagagggggagg

SEQ ID NO: 346640 - DNA, 20 bp, Artificial
  CRISPR gRNA sequence
gggggaggaggatcaatacc

SEQ ID NO: 346641 - DNA, 20 bp, Artificial
  CRISPR gRNA sequence
gaggaggatcaatacctgga

SEQ ID NO: 346642 - DNA, 20 bp, Artificial
  CRISPR gRNA sequence
ggaggatcaatacctggacg

SEQ ID NO: 346643 - DNA, 20 bp, Artificial
  CRISPR gRNA sequence
actacatcacctgcaataca

SEQ ID NO: 346644 - DNA, 20 bp, Artificial
  CRISPR gRNA sequence
acctgcaatacacagacaca

SEQ ID NO: 346645 - DNA, 20 bp, Artificial
  CRISPR gRNA sequence
cctgcaatacacagacacac

SEQ ID NO: 346646 - DNA, 20 bp, Artificial
  CRISPR gRNA sequence
caatacacagacacacaggt

SEQ ID NO: 346647 - DNA, 20 bp, Artificial
  CRISPR gRNA sequence
aatacacagacacacaggtc

SEQ ID NO: 346648 - DNA, 20 bp, Artificial
  CRISPR gRNA sequence
atacacagacacacaggtca

SEQ ID NO: 346649 - DNA, 20 bp, Artificial
  CRISPR gRNA sequence
acacagacacacaggtcagg

SEQ ID NO: 346650 - DNA, 20 bp, Artificial
  CRISPR gRNA sequence
cacagacacacaggtcaggg

SEQ ID NO: 346651 - DNA, 20 bp, Artificial
  CRISPR gRNA sequence
acagacacacaggtcaggga

SEQ ID NO: 346652 - DNA, 20 bp, Artificial
  CRISPR gRNA sequence
cagacacacaggtcagggag

SEQ ID NO: 346653 - DNA, 20 bp, Artificial
  CRISPR gRNA sequence
acacacaggtcagggagggg

SEQ ID NO: 346654 - DNA, 20 bp, Artificial
  CRISPR gRNA sequence
agggaggggcagtgtctgat

SEQ ID NO: 346655 - DNA, 20 bp, Artificial
  CRISPR gRNA sequence
gggaggggcagtgtctgatc

SEQ ID NO: 346656 - DNA, 20 bp, Artificial
  CRISPR gRNA sequence
ggaggggcagtgtctgatca

SEQ ID NO: 346657 - DNA, 20 bp, Artificial
  CRISPR gRNA sequence
gaggggcagtgtctgatcag

SEQ ID NO: 346658 - DNA, 20 bp, Artificial
  CRISPR gRNA sequence
cagtgtctgatcaggggaca

SEQ ID NO: 346659 - DNA, 20 bp, Artificial
  CRISPR gRNA sequence
agtgtctgatcaggggacac

SEQ ID NO: 346660 - DNA, 20 bp, Artificial
  CRISPR gRNA sequence
gatcaggggacacaggctca

SEQ ID NO: 346661 - DNA, 20 bp, Artificial
  CRISPR gRNA sequence
gggacacaggctcatggcaa

SEQ ID NO: 346662 - DNA, 20 bp, Artificial
  CRISPR gRNA sequence
ggctcatggcaatggtctca

SEQ ID NO: 346663 - DNA, 20 bp, Artificial
  CRISPR gRNA sequence
tcatggcaatggtctcacag

SEQ ID NO: 346664 - DNA, 20 bp, Artificial
  CRISPR gRNA sequence
tggcaatggtctcacagcgg

SEQ ID NO: 346665 - DNA, 20 bp, Artificial
  CRISPR gRNA sequence
caatggtctcacagcggtgg

SEQ ID NO: 346666 - DNA, 20 bp, Artificial
  CRISPR gRNA sequence
atggtctcacagcggtggcg

SEQ ID NO: 346667 - DNA, 20 bp, Artificial
  CRISPR gRNA sequence
tggtctcacagcggtggcgg

SEQ ID NO: 346668 - DNA, 20 bp, Artificial
  CRISPR gRNA sequence
gcacaactcctgcttctccc

SEQ ID NO: 346669 - DNA, 20 bp, Artificial
  CRISPR gRNA sequence
cacaactcctgcttctccct

SEQ ID NO: 346670 - DNA, 20 bp, Artificial
  CRISPR gRNA sequence
caactcctgcttctccctgg

SEQ ID NO: 346671 - DNA, 20 bp, Artificial
  CRISPR gRNA sequence
ctccctgggagaccgtcccc

SEQ ID NO: 346672 - DNA, 20 bp, Artificial
  CRISPR gRNA sequence
tccctgggagaccgtcccca

SEQ ID NO: 346673 - DNA, 20 bp, Artificial
  CRISPR gRNA sequence
ccctgggagaccgtccccaa

SEQ ID NO: 346674 - DNA, 20 bp, Artificial
  CRISPR gRNA sequence
ccaagggactgaccctctct

SEQ ID NO: 346675 - DNA, 20 bp, Artificial
  CRISPR gRNA sequence
aagggactgaccctctctga

SEQ ID NO: 346676 - DNA, 20 bp, Artificial
  CRISPR gRNA sequence
ggactgaccctctctgagag

SEQ ID NO: 346677 - DNA, 20 bp, Artificial
  CRISPR gRNA sequence
actgaccctctctgagagca

SEQ ID NO: 346678 - DNA, 20 bp, Artificial
  CRISPR gRNA sequence
ctgaccctctctgagagcag

SEQ ID NO: 346679 - DNA, 20 bp, Artificial
  CRISPR gRNA sequence
gaccctctctgagagcagag

SEQ ID NO: 346680 - DNA, 20 bp, Artificial
  CRISPR gRNA sequence
accctctctgagagcagagg

SEQ ID NO: 346681 - DNA, 20 bp, Artificial
  CRISPR gRNA sequence
gcagaggaggccaactgtgt

SEQ ID NO: 346682 - DNA, 20 bp, Artificial
  CRISPR gRNA sequence
cagaggaggccaactgtgtt

SEQ ID NO: 346683 - DNA, 20 bp, Artificial
  CRISPR gRNA sequence
gccaactgtgttgggactgc

SEQ ID NO: 346684 - DNA, 20 bp, Artificial
  CRISPR gRNA sequence
ctgtgttgggactgctagcc

SEQ ID NO: 346685 - DNA, 20 bp, Artificial
  CRISPR gRNA sequence
ctgctagcccagcctgtccc

SEQ ID NO: 346686 - DNA, 20 bp, Artificial
  CRISPR gRNA sequence
tgctagcccagcctgtcccc

SEQ ID NO: 346687 - DNA, 20 bp, Artificial
  CRISPR gRNA sequence
ctagcccagcctgtccccag

SEQ ID NO: 346688 - DNA, 20 bp, Artificial
  CRISPR gRNA sequence
tagcccagcctgtccccagg

SEQ ID NO: 346689 - DNA, 20 bp, Artificial
  CRISPR gRNA sequence
cagcctgtccccaggaggcc

SEQ ID NO: 346690 - DNA, 20 bp, Artificial
  CRISPR gRNA sequence
tgtccccaggaggcccagca

SEQ ID NO: 346691 - DNA, 20 bp, Artificial
  CRISPR gRNA sequence
gtccccaggaggcccagcat

SEQ ID NO: 346692 - DNA, 20 bp, Artificial
  CRISPR gRNA sequence
aggaggcccagcatgggtga

SEQ ID NO: 346693 - DNA, 20 bp, Artificial
  CRISPR gRNA sequence
ggaggcccagcatgggtgat

SEQ ID NO: 346694 - DNA, 20 bp, Artificial
  CRISPR gRNA sequence
cccagcatgggtgataggac

SEQ ID NO: 346695 - DNA, 20 bp, Artificial
  CRISPR gRNA sequence
ccagcatgggtgataggact

SEQ ID NO: 346696 - DNA, 20 bp, Artificial
  CRISPR gRNA sequence
cagcatgggtgataggactg

SEQ ID NO: 346697 - DNA, 20 bp, Artificial
  CRISPR gRNA sequence
agcatgggtgataggactgg

SEQ ID NO: 346698 - DNA, 20 bp, Artificial
  CRISPR gRNA sequence
gtgataggactgggggcgcc

SEQ ID NO: 346699 - DNA, 20 bp, Artificial
  CRISPR gRNA sequence
gggcgcccggcccacctccc

SEQ ID NO: 346700 - DNA, 20 bp, Artificial
  CRISPR gRNA sequence
cccggcccacctccccagct

SEQ ID NO: 346701 - DNA, 20 bp, Artificial
  CRISPR gRNA sequence
ccggcccacctccccagctg

SEQ ID NO: 346702 - DNA, 20 bp, Artificial
  CRISPR gRNA sequence
cctccccagctgaggccccc

SEQ ID NO: 346703 - DNA, 20 bp, Artificial
  CRISPR gRNA sequence
cctaattcaaccgtcatcta

SEQ ID NO: 346704 - DNA, 20 bp, Artificial
  CRISPR gRNA sequence
ctaattcaaccgtcatctat

SEQ ID NO: 346705 - DNA, 20 bp, Artificial
  CRISPR gRNA sequence
aattcaaccgtcatctatgg

SEQ ID NO: 346706 - DNA, 20 bp, Artificial
  CRISPR gRNA sequence
attcaaccgtcatctatggg

SEQ ID NO: 346707 - DNA, 20 bp, Artificial
  CRISPR gRNA sequence
ttcaaccgtcatctatggga

SEQ ID NO: 346708 - DNA, 20 bp, Artificial
  CRISPR gRNA sequence
tcaaccgtcatctatgggag

SEQ ID NO: 346709 - DNA, 20 bp, Artificial
  CRISPR gRNA sequence
gtcatctatgggaggggaac

SEQ ID NO: 346710 - DNA, 20 bp, Artificial
  CRISPR gRNA sequence
ggaggggaacaagcgcttca

SEQ ID NO: 346711 - DNA, 20 bp, Artificial
  CRISPR gRNA sequence
ggggaacaagcgcttcacag

SEQ ID NO: 346712 - DNA, 20 bp, Artificial
  CRISPR gRNA sequence
ggaacaagcgcttcacagtg

SEQ ID NO: 346713 - DNA, 20 bp, Artificial
  CRISPR gRNA sequence
aacaagcgcttcacagtgga

SEQ ID NO: 346714 - DNA, 20 bp, Artificial
  CRISPR gRNA sequence
acaagcgcttcacagtggag

SEQ ID NO: 346715 - DNA, 20 bp, Artificial
  CRISPR gRNA sequence
agaggccctgcccaccatac

SEQ ID NO: 346716 - DNA, 20 bp, Artificial
  CRISPR gRNA sequence
ggccctgcccaccataccag

SEQ ID NO: 346717 - DNA, 20 bp, Artificial
  CRISPR gRNA sequence
gccctgcccaccataccagc

SEQ ID NO: 346718 - DNA, 20 bp, Artificial
  CRISPR gRNA sequence
ccaccataccagcaggtgcc

SEQ ID NO: 346719 - DNA, 20 bp, Artificial
  CRISPR gRNA sequence
cataccagcaggtgcccagt

SEQ ID NO: 346720 - DNA, 20 bp, Artificial
  CRISPR gRNA sequence
ataccagcaggtgcccagtt

SEQ ID NO: 346721 - DNA, 20 bp, Artificial
  CRISPR gRNA sequence
cagcaggtgcccagttgggt

SEQ ID NO: 346722 - DNA, 20 bp, Artificial
  CRISPR gRNA sequence
gtgcccagttgggtgagact

SEQ ID NO: 346723 - DNA, 20 bp, Artificial
  CRISPR gRNA sequence
ggtgagactaagctgctgcc

SEQ ID NO: 346724 - DNA, 20 bp, Artificial
  CRISPR gRNA sequence
agctgctgcccggcctaccc

SEQ ID NO: 346725 - DNA, 20 bp, Artificial
  CRISPR gRNA sequence
ctgctgcccggcctacccta

SEQ ID NO: 346726 - DNA, 20 bp, Artificial
  CRISPR gRNA sequence
cccggcctaccctagagcct

SEQ ID NO: 346727 - DNA, 20 bp, Artificial
  CRISPR gRNA sequence
ccggcctaccctagagcctg

SEQ ID NO: 346728 - DNA, 20 bp, Artificial
  CRISPR gRNA sequence
accctagagcctgaggcccc

SEQ ID NO: 346729 - DNA, 20 bp, Artificial
  CRISPR gRNA sequence
gccccgagacctccccgcat

SEQ ID NO: 346730 - DNA, 20 bp, Artificial
  CRISPR gRNA sequence
cccgagacctccccgcattg

SEQ ID NO: 346731 - DNA, 20 bp, Artificial
  CRISPR gRNA sequence
ccgagacctccccgcattgg

SEQ ID NO: 346732 - DNA, 20 bp, Artificial
  CRISPR gRNA sequence
cctccccgcattggaggccc

SEQ ID NO: 346733 - DNA, 20 bp, Artificial
  CRISPR gRNA sequence
ctccccgcattggaggcccc

SEQ ID NO: 346734 - DNA, 20 bp, Artificial
  CRISPR gRNA sequence
ccgcattggaggccccgggt

SEQ ID NO: 346735 - DNA, 20 bp, Artificial
  CRISPR gRNA sequence
cgcattggaggccccgggtg

SEQ ID NO: 346736 - DNA, 20 bp, Artificial
  CRISPR gRNA sequence
tggaggccccgggtgaggat

SEQ ID NO: 346737 - DNA, 20 bp, Artificial
  CRISPR gRNA sequence
ggaggccccgggtgaggatc

SEQ ID NO: 346738 - DNA, 20 bp, Artificial
  CRISPR gRNA sequence
ggccccgggtgaggatcagg

SEQ ID NO: 346739 - DNA, 20 bp, Artificial
  CRISPR gRNA sequence
caggtggctttgctgccgcc

SEQ ID NO: 346740 - DNA, 20 bp, Artificial
  CRISPR gRNA sequence
tggctttgctgccgcctggc

SEQ ID NO: 346741 - DNA, 20 bp, Artificial
  CRISPR gRNA sequence
gctttgctgccgcctggctg

SEQ ID NO: 346742 - DNA, 20 bp, Artificial
  CRISPR gRNA sequence
ctttgctgccgcctggctgg

SEQ ID NO: 346743 - DNA, 20 bp, Artificial
  CRISPR gRNA sequence
gctgccgcctggctggagga

SEQ ID NO: 346744 - DNA, 20 bp, Artificial
  CRISPR gRNA sequence
ctgccgcctggctggaggat

SEQ ID NO: 346745 - DNA, 20 bp, Artificial
  CRISPR gRNA sequence
tgccgcctggctggaggatg

SEQ ID NO: 346746 - DNA, 20 bp, Artificial
  CRISPR gRNA sequence
gatggggctgactttccctt

SEQ ID NO: 346747 - DNA, 20 bp, Artificial
  CRISPR gRNA sequence
tcccttcagacctcaatgct

SEQ ID NO: 346748 - DNA, 20 bp, Artificial
  CRISPR gRNA sequence
cttcagacctcaatgcttag

SEQ ID NO: 346749 - DNA, 20 bp, Artificial
  CRISPR gRNA sequence
atgcttagaagctgcgtccc

SEQ ID NO: 346750 - DNA, 20 bp, Artificial
  CRISPR gRNA sequence
tgcttagaagctgcgtcccc

SEQ ID NO: 346751 - DNA, 20 bp, Artificial
  CRISPR gRNA sequence
gcttagaagctgcgtccccg

SEQ ID NO: 346752 - DNA, 20 bp, Artificial
  CRISPR gRNA sequence
cttagaagctgcgtccccgg

SEQ ID NO: 346753 - DNA, 20 bp, Artificial
  CRISPR gRNA sequence
gcgtccccgggggctgtgca

SEQ ID NO: 346754 - DNA, 20 bp, Artificial
  CRISPR gRNA sequence
cgtccccgggggctgtgcac

SEQ ID NO: 346755 - DNA, 20 bp, Artificial
  CRISPR gRNA sequence
gtccccgggggctgtgcaca

SEQ ID NO: 346756 - DNA, 20 bp, Artificial
  CRISPR gRNA sequence
ggggctgtgcacagggctcc

SEQ ID NO: 346757 - DNA, 20 bp, Artificial
  CRISPR gRNA sequence
gggctgtgcacagggctccc

SEQ ID NO: 346758 - DNA, 20 bp, Artificial
  CRISPR gRNA sequence
ggctgtgcacagggctccca

SEQ ID NO: 346759 - DNA, 20 bp, Artificial
  CRISPR gRNA sequence
gcacagggctcccagggcca

SEQ ID NO: 346760 - DNA, 20 bp, Artificial
  CRISPR gRNA sequence
agggctcccagggccacagc

SEQ ID NO: 346761 - DNA, 20 bp, Artificial
  CRISPR gRNA sequence
gggctcccagggccacagcc

SEQ ID NO: 346762 - DNA, 20 bp, Artificial
  CRISPR gRNA sequence
gggccacagccgggtccaca

SEQ ID NO: 346763 - DNA, 20 bp, Artificial
  CRISPR gRNA sequence
ccacagccgggtccacacag

SEQ ID NO: 346764 - DNA, 20 bp, Artificial
  CRISPR gRNA sequence
cacagccgggtccacacagc

SEQ ID NO: 346765 - DNA, 20 bp, Artificial
  CRISPR gRNA sequence
acagccgggtccacacagcg

SEQ ID NO: 346766 - DNA, 20 bp, Artificial
  CRISPR gRNA sequence
ccgggtccacacagcggggt

SEQ ID NO: 346767 - DNA, 20 bp, Artificial
  CRISPR gRNA sequence
cacacagcggggtcagtgcc

SEQ ID NO: 346768 - DNA, 20 bp, Artificial
  CRISPR gRNA sequence
acacagcggggtcagtgccc

SEQ ID NO: 346769 - DNA, 20 bp, Artificial
  CRISPR gRNA sequence
acagcggggtcagtgcccag

SEQ ID NO: 346770 - DNA, 20 bp, Artificial
  CRISPR gRNA sequence
cagcggggtcagtgcccagg

SEQ ID NO: 346771 - DNA, 20 bp, Artificial
  CRISPR gRNA sequence
ggggtcagtgcccaggaggc

SEQ ID NO: 346772 - DNA, 20 bp, Artificial
  CRISPR gRNA sequence
gggtcagtgcccaggaggcc

SEQ ID NO: 346773 - DNA, 20 bp, Artificial
  CRISPR gRNA sequence
agtgcccaggaggccaggca

SEQ ID NO: 346774 - DNA, 20 bp, Artificial
  CRISPR gRNA sequence
gtgcccaggaggccaggcac

SEQ ID NO: 346775 - DNA, 20 bp, Artificial
  CRISPR gRNA sequence
gcccaggaggccaggcacag

SEQ ID NO: 346776 - DNA, 20 bp, Artificial
  CRISPR gRNA sequence
cccaggaggccaggcacagg

SEQ ID NO: 346777 - DNA, 20 bp, Artificial
  CRISPR gRNA sequence
ggaggccaggcacaggaggc

SEQ ID NO: 346778 - DNA, 20 bp, Artificial
  CRISPR gRNA sequence
gaggccaggcacaggaggcc

SEQ ID NO: 346779 - DNA, 20 bp, Artificial
  CRISPR gRNA sequence
caggcacaggaggccaggca

SEQ ID NO: 346780 - DNA, 20 bp, Artificial
  CRISPR gRNA sequence
acaggaggccaggcacagca

SEQ ID NO: 346781 - DNA, 20 bp, Artificial
  CRISPR gRNA sequence
caggaggccaggcacagcac

SEQ ID NO: 346782 - DNA, 20 bp, Artificial
  CRISPR gRNA sequence
ccaggcacagcacaggtgcc

SEQ ID NO: 346783 - DNA, 20 bp, Artificial
  CRISPR gRNA sequence
cacagcacaggtgcccagac

SEQ ID NO: 346784 - DNA, 20 bp, Artificial
  CRISPR gRNA sequence
acagcacaggtgcccagacc

SEQ ID NO: 346785 - DNA, 20 bp, Artificial
  CRISPR gRNA sequence
cagcacaggtgcccagacca

SEQ ID NO: 346786 - DNA, 20 bp, Artificial
  CRISPR gRNA sequence
cacaggtgcccagaccaggg

SEQ ID NO: 346787 - DNA, 20 bp, Artificial
  CRISPR gRNA sequence
ggtgcccagaccagggcgga

SEQ ID NO: 346788 - DNA, 20 bp, Artificial
  CRISPR gRNA sequence
gtgcccagaccagggcggat

SEQ ID NO: 346789 - DNA, 20 bp, Artificial
  CRISPR gRNA sequence
cccagaccagggcggatagg

SEQ ID NO: 346790 - DNA, 20 bp, Artificial
  CRISPR gRNA sequence
tgaatgaatgaatgaatgaa

SEQ ID NO: 346791 - DNA, 20 bp, Artificial
  CRISPR gRNA sequence
atggccttactctcctcaat

SEQ ID NO: 346792 - DNA, 20 bp, Artificial
  CRISPR gRNA sequence
tggccttactctcctcaatg

SEQ ID NO: 346793 - DNA, 20 bp, Artificial
  CRISPR gRNA sequence
tactctcctcaatgaggaca

SEQ ID NO: 346794 - DNA, 20 bp, Artificial
  CRISPR gRNA sequence
tgaggacaaagccttgtccc

SEQ ID NO: 346795 - DNA, 20 bp, Artificial
  CRISPR gRNA sequence
ggacaaagccttgtccccag

SEQ ID NO: 346796 - DNA, 20 bp, Artificial
  CRISPR gRNA sequence
gacaaagccttgtccccagc

SEQ ID NO: 346797 - DNA, 20 bp, Artificial
  CRISPR gRNA sequence
acaaagccttgtccccagca

SEQ ID NO: 346798 - DNA, 20 bp, Artificial
  CRISPR gRNA sequence
aagccttgtccccagcaggg

SEQ ID NO: 346799 - DNA, 20 bp, Artificial
  CRISPR gRNA sequence
gcagggcggctgttgaccct

SEQ ID NO: 346800 - DNA, 20 bp, Artificial
  CRISPR gRNA sequence
gcggctgttgaccctcagcc

SEQ ID NO: 346801 - DNA, 20 bp, Artificial
  CRISPR gRNA sequence
ggctgttgaccctcagccca

SEQ ID NO: 346802 - DNA, 20 bp, Artificial
  CRISPR gRNA sequence
cctcagcccagagcttctcc

SEQ ID NO: 346803 - DNA, 20 bp, Artificial
  CRISPR gRNA sequence
gcccagagcttctcccagct

SEQ ID NO: 346804 - DNA, 20 bp, Artificial
  CRISPR gRNA sequence
cagagcttctcccagctgag

SEQ ID NO: 346805 - DNA, 20 bp, Artificial
  CRISPR gRNA sequence
agagcttctcccagctgagc

SEQ ID NO: 346806 - DNA, 20 bp, Artificial
  CRISPR gRNA sequence
gagcttctcccagctgagca

SEQ ID NO: 346807 - DNA, 20 bp, Artificial
  CRISPR gRNA sequence
gtcctgctccccacatccca

SEQ ID NO: 346808 - DNA, 20 bp, Artificial
  CRISPR gRNA sequence
tcctgctccccacatcccac

SEQ ID NO: 346809 - DNA, 20 bp, Artificial
  CRISPR gRNA sequence
cctgctccccacatcccaca

SEQ ID NO: 346810 - DNA, 20 bp, Artificial
  CRISPR gRNA sequence
ctgctccccacatcccacag

SEQ ID NO: 346811 - DNA, 20 bp, Artificial
  CRISPR gRNA sequence
tgctccccacatcccacagg

SEQ ID NO: 346812 - DNA, 20 bp, Artificial
  CRISPR gRNA sequence
tccccacatcccacaggggg

SEQ ID NO: 346813 - DNA, 20 bp, Artificial
  CRISPR gRNA sequence
ccccacatcccacagggggc

SEQ ID NO: 346814 - DNA, 20 bp, Artificial
  CRISPR gRNA sequence
cacatcccacagggggcagg

SEQ ID NO: 346815 - DNA, 20 bp, Artificial
  CRISPR gRNA sequence
acatcccacagggggcaggc

SEQ ID NO: 346816 - DNA, 20 bp, Artificial
  CRISPR gRNA sequence
atcccacagggggcaggcag

SEQ ID NO: 346817 - DNA, 20 bp, Artificial
  CRISPR gRNA sequence
acagggggcaggcaggagca

SEQ ID NO: 346818 - DNA, 20 bp, Artificial
  CRISPR gRNA sequence
cagggggcaggcaggagcac

SEQ ID NO: 346819 - DNA, 20 bp, Artificial
  CRISPR gRNA sequence
agggggcaggcaggagcaca

SEQ ID NO: 346820 - DNA, 20 bp, Artificial
  CRISPR gRNA sequence
caggcaggagcacagggtca

SEQ ID NO: 346821 - DNA, 20 bp, Artificial
  CRISPR gRNA sequence
ggcaggagcacagggtcata

SEQ ID NO: 346822 - DNA, 20 bp, Artificial
  CRISPR gRNA sequence
gcacagggtcatagagtgcg

SEQ ID NO: 346823 - DNA, 20 bp, Artificial
  CRISPR gRNA sequence
cacagggtcatagagtgcgt

SEQ ID NO: 346824 - DNA, 20 bp, Artificial
  CRISPR gRNA sequence
agggtcatagagtgcgtggg

SEQ ID NO: 346825 - DNA, 20 bp, Artificial
  CRISPR gRNA sequence
gggtcatagagtgcgtgggc

SEQ ID NO: 346826 - DNA, 20 bp, Artificial
  CRISPR gRNA sequence
ggtcatagagtgcgtgggca

SEQ ID NO: 346827 - DNA, 20 bp, Artificial
  CRISPR gRNA sequence
gtcatagagtgcgtgggcag

SEQ ID NO: 346828 - DNA, 20 bp, Artificial
  CRISPR gRNA sequence
atagagtgcgtgggcagggg

SEQ ID NO: 346829 - DNA, 20 bp, Artificial
  CRISPR gRNA sequence
gtgcgtgggcaggggtggct

SEQ ID NO: 346830 - DNA, 20 bp, Artificial
  CRISPR gRNA sequence
tgcgtgggcaggggtggctg

SEQ ID NO: 346831 - DNA, 20 bp, Artificial
  CRISPR gRNA sequence
gcgtgggcaggggtggctga

SEQ ID NO: 346832 - DNA, 20 bp, Artificial
  CRISPR gRNA sequence
aggggtggctgagggctcca

SEQ ID NO: 346833 - DNA, 20 bp, Artificial
  CRISPR gRNA sequence
gtggctgagggctccacggt

SEQ ID NO: 346834 - DNA, 20 bp, Artificial
  CRISPR gRNA sequence
tggctgagggctccacggtc

SEQ ID NO: 346835 - DNA, 20 bp, Artificial
  CRISPR gRNA sequence
ggctgagggctccacggtca

SEQ ID NO: 346836 - DNA, 20 bp, Artificial
  CRISPR gRNA sequence
gctgagggctccacggtcag

SEQ ID NO: 346837 - DNA, 20 bp, Artificial
  CRISPR gRNA sequence
ggtcccaccttcccttcccc

SEQ ID NO: 346838 - DNA, 20 bp, Artificial
  CRISPR gRNA sequence
gtcccaccttcccttccccc

SEQ ID NO: 346839 - DNA, 20 bp, Artificial
  CRISPR gRNA sequence
tcccaccttcccttccccca

SEQ ID NO: 346840 - DNA, 20 bp, Artificial
  CRISPR gRNA sequence
ccaccttcccttcccccagg

SEQ ID NO: 346841 - DNA, 20 bp, Artificial
  CRISPR gRNA sequence
caccttcccttcccccaggg

SEQ ID NO: 346842 - DNA, 20 bp, Artificial
  CRISPR gRNA sequence
ttcccttcccccagggaggc

SEQ ID NO: 346843 - DNA, 20 bp, Artificial
  CRISPR gRNA sequence
cagggaggccagctgacacc

SEQ ID NO: 346844 - DNA, 20 bp, Artificial
  CRISPR gRNA sequence
agggaggccagctgacacct

SEQ ID NO: 346845 - DNA, 20 bp, Artificial
  CRISPR gRNA sequence
gccagctgacacctgggctc

SEQ ID NO: 346846 - DNA, 20 bp, Artificial
  CRISPR gRNA sequence
tgacacctgggctctggcca

SEQ ID NO: 346847 - DNA, 20 bp, Artificial
  CRISPR gRNA sequence
cacctgggctctggccacag

SEQ ID NO: 346848 - DNA, 20 bp, Artificial
  CRISPR gRNA sequence
tgggctctggccacagcaga

SEQ ID NO: 346849 - DNA, 20 bp, Artificial
  CRISPR gRNA sequence
agcagaaagcccacctgccc

SEQ ID NO: 346850 - DNA, 20 bp, Artificial
  CRISPR gRNA sequence
agcccacctgccccagcctg

SEQ ID NO: 346851 - DNA, 20 bp, Artificial
  CRISPR gRNA sequence
ccacctgccccagcctgcag

SEQ ID NO: 346852 - DNA, 20 bp, Artificial
  CRISPR gRNA sequence
ccagcctgcagtggctgccc

SEQ ID NO: 346853 - DNA, 20 bp, Artificial
  CRISPR gRNA sequence
cagcctgcagtggctgccct

SEQ ID NO: 346854 - DNA, 20 bp, Artificial
  CRISPR gRNA sequence
gcctgcagtggctgccctgg

SEQ ID NO: 346855 - DNA, 20 bp, Artificial
  CRISPR gRNA sequence
cctgcagtggctgccctggg

SEQ ID NO: 346856 - DNA, 20 bp, Artificial
  CRISPR gRNA sequence
tgcagtggctgccctgggag

SEQ ID NO: 346857 - DNA, 20 bp, Artificial
  CRISPR gRNA sequence
ggctgccctgggaggagccg

SEQ ID NO: 346858 - DNA, 20 bp, Artificial
  CRISPR gRNA sequence
ctgggaggagccgcggatcc

SEQ ID NO: 346859 - DNA, 20 bp, Artificial
  CRISPR gRNA sequence
aggagccgcggatcctggaa

SEQ ID NO: 346860 - DNA, 20 bp, Artificial
  CRISPR gRNA sequence
cgcggatcctggaaaagctc

SEQ ID NO: 346861 - DNA, 20 bp, Artificial
  CRISPR gRNA sequence
gcggatcctggaaaagctct

SEQ ID NO: 346862 - DNA, 20 bp, Artificial
  CRISPR gRNA sequence
cggatcctggaaaagctctg

SEQ ID NO: 346863 - DNA, 20 bp, Artificial
  CRISPR gRNA sequence
aaagctctggggccacctcc

SEQ ID NO: 346864 - DNA, 20 bp, Artificial
  CRISPR gRNA sequence
aagctctggggccacctccc

SEQ ID NO: 346865 - DNA, 20 bp, Artificial
  CRISPR gRNA sequence
ctggggccacctcccaggct

SEQ ID NO: 346866 - DNA, 20 bp, Artificial
  CRISPR gRNA sequence
tggggccacctcccaggctt

SEQ ID NO: 346867 - DNA, 20 bp, Artificial
  CRISPR gRNA sequence
ggggccacctcccaggcttg

SEQ ID NO: 346868 - DNA, 20 bp, Artificial
  CRISPR gRNA sequence
acctcccaggcttggggtga

SEQ ID NO: 346869 - DNA, 20 bp, Artificial
  CRISPR gRNA sequence
ctcccaggcttggggtgaca

SEQ ID NO: 346870 - DNA, 20 bp, Artificial
  CRISPR gRNA sequence
gcttggggtgacagagctcc

SEQ ID NO: 346871 - DNA, 20 bp, Artificial
  CRISPR gRNA sequence
ttggggtgacagagctccaa

SEQ ID NO: 346872 - DNA, 20 bp, Artificial
  CRISPR gRNA sequence
tggggtgacagagctccaag

SEQ ID NO: 346873 - DNA, 20 bp, Artificial
  CRISPR gRNA sequence
gacagagctccaagaggtga

SEQ ID NO: 346874 - DNA, 20 bp, Artificial
  CRISPR gRNA sequence
gagctccaagaggtgacggc

SEQ ID NO: 346875 - DNA, 20 bp, Artificial
  CRISPR gRNA sequence
agctccaagaggtgacggct

SEQ ID NO: 346876 - DNA, 20 bp, Artificial
  CRISPR gRNA sequence
gctccaagaggtgacggctg

SEQ ID NO: 346877 - DNA, 20 bp, Artificial
  CRISPR gRNA sequence
gaggtgacggctggggacat

SEQ ID NO: 346878 - DNA, 20 bp, Artificial
  CRISPR gRNA sequence
gctggggacatgagccctga

SEQ ID NO: 346879 - DNA, 20 bp, Artificial
  CRISPR gRNA sequence
ctggggacatgagccctgat

SEQ ID NO: 346880 - DNA, 20 bp, Artificial
  CRISPR gRNA sequence
tggggacatgagccctgatg

SEQ ID NO: 346881 - DNA, 20 bp, Artificial
  CRISPR gRNA sequence
gccgccgtgtgctcacccct

SEQ ID NO: 346882 - DNA, 20 bp, Artificial
  CRISPR gRNA sequence
cttcttttcacacatatgat

SEQ ID NO: 346883 - DNA, 20 bp, Artificial
  CRISPR gRNA sequence
ttcttttcacacatatgatt

SEQ ID NO: 346884 - DNA, 20 bp, Artificial
  CRISPR gRNA sequence
acatatgattaggccaactg

SEQ ID NO: 346885 - DNA, 20 bp, Artificial
  CRISPR gRNA sequence
atatgattaggccaactgtg

SEQ ID NO: 346886 - DNA, 20 bp, Artificial
  CRISPR gRNA sequence
gagcaaacaatgacgatgac

SEQ ID NO: 346887 - DNA, 20 bp, Artificial
  CRISPR gRNA sequence
agcaaacaatgacgatgacg

SEQ ID NO: 346888 - DNA, 20 bp, Artificial
  CRISPR gRNA sequence
tgacgatgacgaggctccct

SEQ ID NO: 346889 - DNA, 20 bp, Artificial
  CRISPR gRNA sequence
acgatgacgaggctccctga

SEQ ID NO: 346890 - DNA, 20 bp, Artificial
  CRISPR gRNA sequence
ctgagagaaaccaccatacc

SEQ ID NO: 346891 - DNA, 20 bp, Artificial
  CRISPR gRNA sequence
agagaaaccaccatacccag

SEQ ID NO: 346892 - DNA, 20 bp, Artificial
  CRISPR gRNA sequence
gagaaaccaccatacccagt

SEQ ID NO: 346893 - DNA, 20 bp, Artificial
  CRISPR gRNA sequence
gaaaccaccatacccagtgg

SEQ ID NO: 346894 - DNA, 20 bp, Artificial
  CRISPR gRNA sequence
ccatacccagtgggagctgc

SEQ ID NO: 346895 - DNA, 20 bp, Artificial
  CRISPR gRNA sequence
ccagtgggagctgctggtcc

SEQ ID NO: 346896 - DNA, 20 bp, Artificial
  CRISPR gRNA sequence
ggagctgctggtcccagctc

SEQ ID NO: 346897 - DNA, 20 bp, Artificial
  CRISPR gRNA sequence
ccagctccggccttcgtcac

SEQ ID NO: 346898 - DNA, 20 bp, Artificial
  CRISPR gRNA sequence
ctccggccttcgtcaccagc

SEQ ID NO: 346899 - DNA, 20 bp, Artificial
  CRISPR gRNA sequence
tcaccagccagctgcacctg

SEQ ID NO: 346900 - DNA, 20 bp, Artificial
  CRISPR gRNA sequence
caccagccagctgcacctgc

SEQ ID NO: 346901 - DNA, 20 bp, Artificial
  CRISPR gRNA sequence
ccagccagctgcacctgcgg

SEQ ID NO: 346902 - DNA, 20 bp, Artificial
  CRISPR gRNA sequence
gccagctgcacctgcgggag

SEQ ID NO: 346903 - DNA, 20 bp, Artificial
  CRISPR gRNA sequence
ccagctgcacctgcgggagt

SEQ ID NO: 346904 - DNA, 20 bp, Artificial
  CRISPR gRNA sequence
cagctgcacctgcgggagtg

SEQ ID NO: 346905 - DNA, 20 bp, Artificial
  CRISPR gRNA sequence
gcacctgcgggagtggggcc

SEQ ID NO: 346906 - DNA, 20 bp, Artificial
  CRISPR gRNA sequence
cacctgcgggagtggggccg

SEQ ID NO: 346907 - DNA, 20 bp, Artificial
  CRISPR gRNA sequence
cgggagtggggccgaggacg

SEQ ID NO: 346908 - DNA, 20 bp, Artificial
  CRISPR gRNA sequence
gggagtggggccgaggacgt

SEQ ID NO: 346909 - DNA, 20 bp, Artificial
  CRISPR gRNA sequence
gagtggggccgaggacgtgg

SEQ ID NO: 346910 - DNA, 20 bp, Artificial
  CRISPR gRNA sequence
gtggggccgaggacgtggga

SEQ ID NO: 346911 - DNA, 20 bp, Artificial
  CRISPR gRNA sequence
tggggccgaggacgtgggag

SEQ ID NO: 346912 - DNA, 20 bp, Artificial
  CRISPR gRNA sequence
ggccgaggacgtgggagagg

SEQ ID NO: 346913 - DNA, 20 bp, Artificial
  CRISPR gRNA sequence
gccgaggacgtgggagaggc

SEQ ID NO: 346914 - DNA, 20 bp, Artificial
  CRISPR gRNA sequence
ggacgtgggagaggcaggtg

SEQ ID NO: 346915 - DNA, 20 bp, Artificial
  CRISPR gRNA sequence
ggagaggcaggtgcagcgcc

SEQ ID NO: 346916 - DNA, 20 bp, Artificial
  CRISPR gRNA sequence
tgcagcgcccagtgttcact

SEQ ID NO: 346917 - DNA, 20 bp, Artificial
  CRISPR gRNA sequence
gcccagtgttcactcagcct

SEQ ID NO: 346918 - DNA, 20 bp, Artificial
  CRISPR gRNA sequence
cccagtgttcactcagcctc

SEQ ID NO: 346919 - DNA, 20 bp, Artificial
  CRISPR gRNA sequence
ccagtgttcactcagcctca

SEQ ID NO: 346920 - DNA, 20 bp, Artificial
  CRISPR gRNA sequence
agtgttcactcagcctcagg

SEQ ID NO: 346921 - DNA, 20 bp, Artificial
  CRISPR gRNA sequence
tcagcctcagggagcctccc

SEQ ID NO: 346922 - DNA, 20 bp, Artificial
  CRISPR gRNA sequence
cagggagcctccctggctcc

SEQ ID NO: 346923 - DNA, 20 bp, Artificial
  CRISPR gRNA sequence
agggagcctccctggctccc

SEQ ID NO: 346924 - DNA, 20 bp, Artificial
  CRISPR gRNA sequence
gggagcctccctggctccca

SEQ ID NO: 346925 - DNA, 20 bp, Artificial
  CRISPR gRNA sequence
ctccctggctcccagggccc

SEQ ID NO: 346926 - DNA, 20 bp, Artificial
  CRISPR gRNA sequence
tccctggctcccagggcccc

SEQ ID NO: 346927 - DNA, 20 bp, Artificial
  CRISPR gRNA sequence
ctggctcccagggccccagg

SEQ ID NO: 346928 - DNA, 20 bp, Artificial
  CRISPR gRNA sequence
tcccagggccccaggcagtg

SEQ ID NO: 346929 - DNA, 20 bp, Artificial
  CRISPR gRNA sequence
agggccccaggcagtgaaga

SEQ ID NO: 346930 - DNA, 20 bp, Artificial
  CRISPR gRNA sequence
gggccccaggcagtgaagac

SEQ ID NO: 346931 - DNA, 20 bp, Artificial
  CRISPR gRNA sequence
caggcagtgaagacaggtcc

SEQ ID NO: 346932 - DNA, 20 bp, Artificial
  CRISPR gRNA sequence
aggcagtgaagacaggtccc

SEQ ID NO: 346933 - DNA, 20 bp, Artificial
  CRISPR gRNA sequence
ggcagtgaagacaggtccca

SEQ ID NO: 346934 - DNA, 20 bp, Artificial
  CRISPR gRNA sequence
cagtgaagacaggtcccagg

SEQ ID NO: 346935 - DNA, 20 bp, Artificial
  CRISPR gRNA sequence
agtgaagacaggtcccaggg

SEQ ID NO: 346936 - DNA, 20 bp, Artificial
  CRISPR gRNA sequence
aagacaggtcccagggaggc

SEQ ID NO: 346937 - DNA, 20 bp, Artificial
  CRISPR gRNA sequence
agacaggtcccagggaggct

SEQ ID NO: 346938 - DNA, 20 bp, Artificial
  CRISPR gRNA sequence
aggtcccagggaggctgggc

SEQ ID NO: 346939 - DNA, 20 bp, Artificial
  CRISPR gRNA sequence
tcccagggaggctgggctgg

SEQ ID NO: 346940 - DNA, 20 bp, Artificial
  CRISPR gRNA sequence
cagggaggctgggctggtgg

SEQ ID NO: 346941 - DNA, 20 bp, Artificial
  CRISPR gRNA sequence
ggctgggctggtggcagctc

SEQ ID NO: 346942 - DNA, 20 bp, Artificial
  CRISPR gRNA sequence
gctgggctggtggcagctcc

SEQ ID NO: 346943 - DNA, 20 bp, Artificial
  CRISPR gRNA sequence
gctggtggcagctccaggat

SEQ ID NO: 346944 - DNA, 20 bp, Artificial
  CRISPR gRNA sequence
gcagctccaggatgagacct

SEQ ID NO: 346945 - DNA, 20 bp, Artificial
  CRISPR gRNA sequence
agctccaggatgagacctca

SEQ ID NO: 346946 - DNA, 20 bp, Artificial
  CRISPR gRNA sequence
gctccaggatgagacctcag

SEQ ID NO: 346947 - DNA, 20 bp, Artificial
  CRISPR gRNA sequence
gaggtctgtctgacttttcc

SEQ ID NO: 346948 - DNA, 20 bp, Artificial
  CRISPR gRNA sequence
ctgtctgacttttccaagct

SEQ ID NO: 346949 - DNA, 20 bp, Artificial
  CRISPR gRNA sequence
gacttttccaagctcggcta

SEQ ID NO: 346950 - DNA, 20 bp, Artificial
  CRISPR gRNA sequence
acttttccaagctcggctat

SEQ ID NO: 346951 - DNA, 20 bp, Artificial
  CRISPR gRNA sequence
cttttccaagctcggctatg

SEQ ID NO: 346952 - DNA, 20 bp, Artificial
  CRISPR gRNA sequence
tttccaagctcggctatggg

SEQ ID NO: 346953 - DNA, 20 bp, Artificial
  CRISPR gRNA sequence
ttccaagctcggctatgggg

SEQ ID NO: 346954 - DNA, 20 bp, Artificial
  CRISPR gRNA sequence
caagctcggctatggggagg

SEQ ID NO: 346955 - DNA, 20 bp, Artificial
  CRISPR gRNA sequence
agctcggctatggggaggtg

SEQ ID NO: 346956 - DNA, 20 bp, Artificial
  CRISPR gRNA sequence
ctcggctatggggaggtgga

SEQ ID NO: 346957 - DNA, 20 bp, Artificial
  CRISPR gRNA sequence
ggctatggggaggtggagag

SEQ ID NO: 346958 - DNA, 20 bp, Artificial
  CRISPR gRNA sequence
gctatggggaggtggagaga

SEQ ID NO: 346959 - DNA, 20 bp, Artificial
  CRISPR gRNA sequence
atggggaggtggagagaagg

SEQ ID NO: 346960 - DNA, 20 bp, Artificial
  CRISPR gRNA sequence
tggggaggtggagagaagga

SEQ ID NO: 346961 - DNA, 20 bp, Artificial
  CRISPR gRNA sequence
gggaggtggagagaaggaag

SEQ ID NO: 346962 - DNA, 20 bp, Artificial
  CRISPR gRNA sequence
ggaggtggagagaaggaagg

SEQ ID NO: 346963 - DNA, 20 bp, Artificial
  CRISPR gRNA sequence
aggtggagagaaggaaggag

SEQ ID NO: 346964 - DNA, 20 bp, Artificial
  CRISPR gRNA sequence
tggagagaaggaaggaggag

SEQ ID NO: 346965 - DNA, 20 bp, Artificial
  CRISPR gRNA sequence
gagagaaggaaggaggagaa

SEQ ID NO: 346966 - DNA, 20 bp, Artificial
  CRISPR gRNA sequence
ggaaggaggagaagagaaac

SEQ ID NO: 346967 - DNA, 20 bp, Artificial
  CRISPR gRNA sequence
gaaggaggagaagagaaaca

SEQ ID NO: 346968 - DNA, 20 bp, Artificial
  CRISPR gRNA sequence
aggaggagaagagaaacaag

SEQ ID NO: 346969 - DNA, 20 bp, Artificial
  CRISPR gRNA sequence
gaggagaagagaaacaagga

SEQ ID NO: 346970 - DNA, 20 bp, Artificial
  CRISPR gRNA sequence
gaagagaaacaaggagagac

SEQ ID NO: 346971 - DNA, 20 bp, Artificial
  CRISPR gRNA sequence
aagagaaacaaggagagact

SEQ ID NO: 346972 - DNA, 20 bp, Artificial
  CRISPR gRNA sequence
aaacaaggagagactgggca

SEQ ID NO: 346973 - DNA, 20 bp, Artificial
  CRISPR gRNA sequence
aacaaggagagactgggcaa

SEQ ID NO: 346974 - DNA, 20 bp, Artificial
  CRISPR gRNA sequence
caaggagagactgggcaaag

SEQ ID NO: 346975 - DNA, 20 bp, Artificial
  CRISPR gRNA sequence
gagagactgggcaaaggaga

SEQ ID NO: 346976 - DNA, 20 bp, Artificial
  CRISPR gRNA sequence
agagactgggcaaaggagac

SEQ ID NO: 346977 - DNA, 20 bp, Artificial
  CRISPR gRNA sequence
actgggcaaaggagacagga

SEQ ID NO: 346978 - DNA, 20 bp, Artificial
  CRISPR gRNA sequence
gggcaaaggagacaggacgg

SEQ ID NO: 346979 - DNA, 20 bp, Artificial
  CRISPR gRNA sequence
gcaaaggagacaggacggca

SEQ ID NO: 346980 - DNA, 20 bp, Artificial
  CRISPR gRNA sequence
caaaggagacaggacggcag

SEQ ID NO: 346981 - DNA, 20 bp, Artificial
  CRISPR gRNA sequence
aaaggagacaggacggcaga

SEQ ID NO: 346982 - DNA, 20 bp, Artificial
  CRISPR gRNA sequence
aggagacaggacggcagagg

SEQ ID NO: 346983 - DNA, 20 bp, Artificial
  CRISPR gRNA sequence
gagacaggacggcagaggga

SEQ ID NO: 346984 - DNA, 20 bp, Artificial
  CRISPR gRNA sequence
agacaggacggcagagggag

SEQ ID NO: 346985 - DNA, 20 bp, Artificial
  CRISPR gRNA sequence
gacaggacggcagagggaga

SEQ ID NO: 346986 - DNA, 20 bp, Artificial
  CRISPR gRNA sequence
acaggacggcagagggagag

SEQ ID NO: 346987 - DNA, 20 bp, Artificial
  CRISPR gRNA sequence
aggacggcagagggagaggg

SEQ ID NO: 346988 - DNA, 20 bp, Artificial
  CRISPR gRNA sequence
gacggcagagggagagggga

SEQ ID NO: 346989 - DNA, 20 bp, Artificial
  CRISPR gRNA sequence
ggcagagggagaggggagag

SEQ ID NO: 346990 - DNA, 20 bp, Artificial
  CRISPR gRNA sequence
agagggagaggggagagaag

SEQ ID NO: 346991 - DNA, 20 bp, Artificial
  CRISPR gRNA sequence
gagggagaggggagagaagc

SEQ ID NO: 346992 - DNA, 20 bp, Artificial
  CRISPR gRNA sequence
gggagaggggagagaagcgg

SEQ ID NO: 346993 - DNA, 20 bp, Artificial
  CRISPR gRNA sequence
ggagaggggagagaagcggg

SEQ ID NO: 346994 - DNA, 20 bp, Artificial
  CRISPR gRNA sequence
gaggggagagaagcgggagg

SEQ ID NO: 346995 - DNA, 20 bp, Artificial
  CRISPR gRNA sequence
ggagagaagcgggaggcagc

SEQ ID NO: 346996 - DNA, 20 bp, Artificial
  CRISPR gRNA sequence
gagaagcgggaggcagccag

SEQ ID NO: 346997 - DNA, 20 bp, Artificial
  CRISPR gRNA sequence
gcgggaggcagccagcagtg

SEQ ID NO: 346998 - DNA, 20 bp, Artificial
  CRISPR gRNA sequence
gggaggcagccagcagtgca

SEQ ID NO: 346999 - DNA, 20 bp, Artificial
  CRISPR gRNA sequence
agccagcagtgcagagaccc

SEQ ID NO: 347000 - DNA, 20 bp, Artificial
  CRISPR gRNA sequence
ccagcagtgcagagacccca

SEQ ID NO: 347001 - DNA, 20 bp, Artificial
  CRISPR gRNA sequence
agtgcagagaccccagagca

SEQ ID NO: 347002 - DNA, 20 bp, Artificial
  CRISPR gRNA sequence
gtgcagagaccccagagcac

SEQ ID NO: 347003 - DNA, 20 bp, Artificial
  CRISPR gRNA sequence
gcagagaccccagagcacgg

SEQ ID NO: 347004 - DNA, 20 bp, Artificial
  CRISPR gRNA sequence
gaccccagagcacgggagac

SEQ ID NO: 347005 - DNA, 20 bp, Artificial
  CRISPR gRNA sequence
cccagagcacgggagaccag

SEQ ID NO: 347006 - DNA, 20 bp, Artificial
  CRISPR gRNA sequence
agagcacgggagaccagtgg

SEQ ID NO: 347007 - DNA, 20 bp, Artificial
  CRISPR gRNA sequence
acgggagaccagtggcagac

SEQ ID NO: 347008 - DNA, 20 bp, Artificial
  CRISPR gRNA sequence
cgggagaccagtggcagaca

SEQ ID NO: 347009 - DNA, 20 bp, Artificial
  CRISPR gRNA sequence
agaccagtggcagacaagga

SEQ ID NO: 347010 - DNA, 20 bp, Artificial
  CRISPR gRNA sequence
ccagtggcagacaaggacag

SEQ ID NO: 347011 - DNA, 20 bp, Artificial
  CRISPR gRNA sequence
cagtggcagacaaggacaga

SEQ ID NO: 347012 - DNA, 20 bp, Artificial
  CRISPR gRNA sequence
tggcagacaaggacagaagg

SEQ ID NO: 347013 - DNA, 20 bp, Artificial
  CRISPR gRNA sequence
gcagacaaggacagaaggta

SEQ ID NO: 347014 - DNA, 20 bp, Artificial
  CRISPR gRNA sequence
cagacaaggacagaaggtag

SEQ ID NO: 347015 - DNA, 20 bp, Artificial
  CRISPR gRNA sequence
agacaaggacagaaggtaga

SEQ ID NO: 347016 - DNA, 20 bp, Artificial
  CRISPR gRNA sequence
acaaggacagaaggtagagg

SEQ ID NO: 347017 - DNA, 20 bp, Artificial
  CRISPR gRNA sequence
aaggacagaaggtagaggga

SEQ ID NO: 347018 - DNA, 20 bp, Artificial
  CRISPR gRNA sequence
acagaaggtagagggagagc

SEQ ID NO: 347019 - DNA, 20 bp, Artificial
  CRISPR gRNA sequence
ggtagagggagagccagtgt

SEQ ID NO: 347020 - DNA, 20 bp, Artificial
  CRISPR gRNA sequence
gtagagggagagccagtgtc

SEQ ID NO: 347021 - DNA, 20 bp, Artificial
  CRISPR gRNA sequence
agccagtgtcgggacaaaaa

SEQ ID NO: 347022 - DNA, 20 bp, Artificial
  CRISPR gRNA sequence
agtgtcgggacaaaaatggt

SEQ ID NO: 347023 - DNA, 20 bp, Artificial
  CRISPR gRNA sequence
tgtcgggacaaaaatggtta

SEQ ID NO: 347024 - DNA, 20 bp, Artificial
  CRISPR gRNA sequence
gggacaaaaatggttagagc

SEQ ID NO: 347025 - DNA, 20 bp, Artificial
  CRISPR gRNA sequence
gacaaaaatggttagagctg

SEQ ID NO: 347026 - DNA, 20 bp, Artificial
  CRISPR gRNA sequence
aaaatggttagagctggaga

SEQ ID NO: 347027 - DNA, 20 bp, Artificial
  CRISPR gRNA sequence
tggttagagctggagatgga

SEQ ID NO: 347028 - DNA, 20 bp, Artificial
  CRISPR gRNA sequence
ggttagagctggagatggac

SEQ ID NO: 347029 - DNA, 20 bp, Artificial
  CRISPR gRNA sequence
agctggagatggacaggact

SEQ ID NO: 347030 - DNA, 20 bp, Artificial
  CRISPR gRNA sequence
ggagatggacaggactgagc

SEQ ID NO: 347031 - DNA, 20 bp, Artificial
  CRISPR gRNA sequence
gagatggacaggactgagct

SEQ ID NO: 347032 - DNA, 20 bp, Artificial
  CRISPR gRNA sequence
agatggacaggactgagctg

SEQ ID NO: 347033 - DNA, 20 bp, Artificial
  CRISPR gRNA sequence
ggacaggactgagctggggc

SEQ ID NO: 347034 - DNA, 20 bp, Artificial
  CRISPR gRNA sequence
acaggactgagctggggcca

SEQ ID NO: 347035 - DNA, 20 bp, Artificial
  CRISPR gRNA sequence
caggactgagctggggccag

SEQ ID NO: 347036 - DNA, 20 bp, Artificial
  CRISPR gRNA sequence
ctgagctggggccagaggac

SEQ ID NO: 347037 - DNA, 20 bp, Artificial
  CRISPR gRNA sequence
tgagctggggccagaggacg

SEQ ID NO: 347038 - DNA, 20 bp, Artificial
  CRISPR gRNA sequence
agctggggccagaggacgag

SEQ ID NO: 347039 - DNA, 20 bp, Artificial
  CRISPR gRNA sequence
gctggggccagaggacgagg

SEQ ID NO: 347040 - DNA, 20 bp, Artificial
  CRISPR gRNA sequence
ctggggccagaggacgagga

SEQ ID NO: 347041 - DNA, 20 bp, Artificial
  CRISPR gRNA sequence
gggccagaggacgaggaggg

SEQ ID NO: 347042 - DNA, 20 bp, Artificial
  CRISPR gRNA sequence
gccagaggacgaggagggca

SEQ ID NO: 347043 - DNA, 20 bp, Artificial
  CRISPR gRNA sequence
agaggacgaggagggcagag

SEQ ID NO: 347044 - DNA, 20 bp, Artificial
  CRISPR gRNA sequence
gaggacgaggagggcagagc

SEQ ID NO: 347045 - DNA, 20 bp, Artificial
  CRISPR gRNA sequence
acgaggagggcagagcagga

SEQ ID NO: 347046 - DNA, 20 bp, Artificial
  CRISPR gRNA sequence
aggagggcagagcaggatgg

SEQ ID NO: 347047 - DNA, 20 bp, Artificial
  CRISPR gRNA sequence
ggagggcagagcaggatgga

SEQ ID NO: 347048 - DNA, 20 bp, Artificial
  CRISPR gRNA sequence
aggccccaccgccccctccc

SEQ ID NO: 347049 - DNA, 20 bp, Artificial
  CRISPR gRNA sequence
ggccccaccgccccctccct

SEQ ID NO: 347050 - DNA, 20 bp, Artificial
  CRISPR gRNA sequence
gccccaccgccccctccctg

SEQ ID NO: 347051 - DNA, 20 bp, Artificial
  CRISPR gRNA sequence
ccaccgccccctccctgggg

SEQ ID NO: 347052 - DNA, 20 bp, Artificial
  CRISPR gRNA sequence
cagccatccctgctccatcc

SEQ ID NO: 347053 - DNA, 20 bp, Artificial
  CRISPR gRNA sequence
agccatccctgctccatccc

SEQ ID NO: 347054 - DNA, 20 bp, Artificial
  CRISPR gRNA sequence
tgctccatcccaggctccgc

SEQ ID NO: 347055 - DNA, 20 bp, Artificial
  CRISPR gRNA sequence
gctccatcccaggctccgct

SEQ ID NO: 347056 - DNA, 20 bp, Artificial
  CRISPR gRNA sequence
ctccatcccaggctccgctg

SEQ ID NO: 347057 - DNA, 20 bp, Artificial
  CRISPR gRNA sequence
tccatcccaggctccgctgg

SEQ ID NO: 347058 - DNA, 20 bp, Artificial
  CRISPR gRNA sequence
caggctccgctgggggaccc

SEQ ID NO: 347059 - DNA, 20 bp, Artificial
  CRISPR gRNA sequence
gggggaccccagctcctccc

SEQ ID NO: 347060 - DNA, 20 bp, Artificial
  CRISPR gRNA sequence
ggaccccagctcctcccaag

SEQ ID NO: 347061 - DNA, 20 bp, Artificial
  CRISPR gRNA sequence
gctcctcccaagaagctctg

SEQ ID NO: 347062 - DNA, 20 bp, Artificial
  CRISPR gRNA sequence
cccaagaagctctgaagtct

SEQ ID NO: 347063 - DNA, 20 bp, Artificial
  CRISPR gRNA sequence
ccaagaagctctgaagtctc

SEQ ID NO: 347064 - DNA, 20 bp, Artificial
  CRISPR gRNA sequence
gaagctctgaagtctcaggt

SEQ ID NO: 347065 - DNA, 20 bp, Artificial
  CRISPR gRNA sequence
ctctgaagtctcaggtcagt

SEQ ID NO: 347066 - DNA, 20 bp, Artificial
  CRISPR gRNA sequence
tctgaagtctcaggtcagtt

SEQ ID NO: 347067 - DNA, 20 bp, Artificial
  CRISPR gRNA sequence
ctgaagtctcaggtcagtta

SEQ ID NO: 347068 - DNA, 20 bp, Artificial
  CRISPR gRNA sequence
tgaagtctcaggtcagttag

SEQ ID NO: 347069 - DNA, 20 bp, Artificial
  CRISPR gRNA sequence
tctcaggtcagttaggggcc

SEQ ID NO: 347070 - DNA, 20 bp, Artificial
  CRISPR gRNA sequence
ctcaggtcagttaggggccc

SEQ ID NO: 347071 - DNA, 20 bp, Artificial
  CRISPR gRNA sequence
tcaggtcagttaggggccca

SEQ ID NO: 347072 - DNA, 20 bp, Artificial
  CRISPR gRNA sequence
gtcagttaggggcccagggt

SEQ ID NO: 347073 - DNA, 20 bp, Artificial
  CRISPR gRNA sequence
gggcccagggtcagcatttg

SEQ ID NO: 347074 - DNA, 20 bp, Artificial
  CRISPR gRNA sequence
ggcccagggtcagcatttga

SEQ ID NO: 347075 - DNA, 20 bp, Artificial
  CRISPR gRNA sequence
catttgaaggtgtcctcccg

SEQ ID NO: 347076 - DNA, 20 bp, Artificial
  CRISPR gRNA sequence
atttgaaggtgtcctcccga

SEQ ID NO: 347077 - DNA, 20 bp, Artificial
  CRISPR gRNA sequence
tgaaggtgtcctcccgaagg

SEQ ID NO: 347078 - DNA, 20 bp, Artificial
  CRISPR gRNA sequence
tgtcctcccgaaggtggaca

SEQ ID NO: 347079 - DNA, 20 bp, Artificial
  CRISPR gRNA sequence
tcctcccgaaggtggacaaa

SEQ ID NO: 347080 - DNA, 20 bp, Artificial
  CRISPR gRNA sequence
tcccgaaggtggacaaagag

SEQ ID NO: 347081 - DNA, 20 bp, Artificial
  CRISPR gRNA sequence
ccgaaggtggacaaagagca

SEQ ID NO: 347082 - DNA, 20 bp, Artificial
  CRISPR gRNA sequence
ttcactttccccaacccctg

SEQ ID NO: 347083 - DNA, 20 bp, Artificial
  CRISPR gRNA sequence
tttccccaacccctgaagcc

SEQ ID NO: 347084 - DNA, 20 bp, Artificial
  CRISPR gRNA sequence
ttccccaacccctgaagccc

SEQ ID NO: 347085 - DNA, 20 bp, Artificial
  CRISPR gRNA sequence
tccccaacccctgaagccca

SEQ ID NO: 347086 - DNA, 20 bp, Artificial
  CRISPR gRNA sequence
ccccaacccctgaagcccag

SEQ ID NO: 347087 - DNA, 20 bp, Artificial
  CRISPR gRNA sequence
gaagcccaggggccctccca

SEQ ID NO: 347088 - DNA, 20 bp, Artificial
  CRISPR gRNA sequence
cctcccatggccctgacatt

SEQ ID NO: 347089 - DNA, 20 bp, Artificial
  CRISPR gRNA sequence
ctcccatggccctgacattc

SEQ ID NO: 347090 - DNA, 20 bp, Artificial
  CRISPR gRNA sequence
tcccatggccctgacattca

SEQ ID NO: 347091 - DNA, 20 bp, Artificial
  CRISPR gRNA sequence
ctgacattcagggacaccca

SEQ ID NO: 347092 - DNA, 20 bp, Artificial
  CRISPR gRNA sequence
ttcagggacacccacagccc

SEQ ID NO: 347093 - DNA, 20 bp, Artificial
  CRISPR gRNA sequence
tcagggacacccacagcccc

SEQ ID NO: 347094 - DNA, 20 bp, Artificial
  CRISPR gRNA sequence
cagggacacccacagcccca

SEQ ID NO: 347095 - DNA, 20 bp, Artificial
  CRISPR gRNA sequence
agggacacccacagccccag

SEQ ID NO: 347096 - DNA, 20 bp, Artificial
  CRISPR gRNA sequence
acacccacagccccagggga

SEQ ID NO: 347097 - DNA, 20 bp, Artificial
  CRISPR gRNA sequence
cacccacagccccaggggac

SEQ ID NO: 347098 - DNA, 20 bp, Artificial
  CRISPR gRNA sequence
acccacagccccaggggaca

SEQ ID NO: 347099 - DNA, 20 bp, Artificial
  CRISPR gRNA sequence
cccacagccccaggggacag

SEQ ID NO: 347100 - DNA, 20 bp, Artificial
  CRISPR gRNA sequence
gccccaggggacaggggatc

SEQ ID NO: 347101 - DNA, 20 bp, Artificial
  CRISPR gRNA sequence
cccaggggacaggggatctg

SEQ ID NO: 347102 - DNA, 20 bp, Artificial
  CRISPR gRNA sequence
ccaggggacaggggatctgg

SEQ ID NO: 347103 - DNA, 20 bp, Artificial
  CRISPR gRNA sequence
ggggacaggggatctggagg

SEQ ID NO: 347104 - DNA, 20 bp, Artificial
  CRISPR gRNA sequence
atctggaggcagcctccctc

SEQ ID NO: 347105 - DNA, 20 bp, Artificial
  CRISPR gRNA sequence
tctggaggcagcctccctct

SEQ ID NO: 347106 - DNA, 20 bp, Artificial
  CRISPR gRNA sequence
cctccctctgggcctgcttc

SEQ ID NO: 347107 - DNA, 20 bp, Artificial
  CRISPR gRNA sequence
ctccctctgggcctgcttct

SEQ ID NO: 347108 - DNA, 20 bp, Artificial
  CRISPR gRNA sequence
cctctgggcctgcttctggg

SEQ ID NO: 347109 - DNA, 20 bp, Artificial
  CRISPR gRNA sequence
ctctgggcctgcttctggga

SEQ ID NO: 347110 - DNA, 20 bp, Artificial
  CRISPR gRNA sequence
cttctgggaaggcccatcct

SEQ ID NO: 347111 - DNA, 20 bp, Artificial
  CRISPR gRNA sequence
gaaggcccatcctgagcctc

SEQ ID NO: 347112 - DNA, 20 bp, Artificial
  CRISPR gRNA sequence
aaggcccatcctgagcctcc

SEQ ID NO: 347113 - DNA, 20 bp, Artificial
  CRISPR gRNA sequence
gcccatcctgagcctccagg

SEQ ID NO: 347114 - DNA, 20 bp, Artificial
  CRISPR gRNA sequence
tcctgagcctccaggaagct

SEQ ID NO: 347115 - DNA, 20 bp, Artificial
  CRISPR gRNA sequence
ccaggaagctcagatctgat

SEQ ID NO: 347116 - DNA, 20 bp, Artificial
  CRISPR gRNA sequence
caggaagctcagatctgatg

SEQ ID NO: 347117 - DNA, 20 bp, Artificial
  CRISPR gRNA sequence
agatctgatgaggctttgtc

SEQ ID NO: 347118 - DNA, 20 bp, Artificial
  CRISPR gRNA sequence
gatctgatgaggctttgtct

SEQ ID NO: 347119 - DNA, 20 bp, Artificial
  CRISPR gRNA sequence
tgaggctttgtctgggccca

SEQ ID NO: 347120 - DNA, 20 bp, Artificial
  CRISPR gRNA sequence
ggctttgtctgggcccatgg

SEQ ID NO: 347121 - DNA, 20 bp, Artificial
  CRISPR gRNA sequence
gctttgtctgggcccatgga

SEQ ID NO: 347122 - DNA, 20 bp, Artificial
  CRISPR gRNA sequence
ctttgtctgggcccatggaa

SEQ ID NO: 347123 - DNA, 20 bp, Artificial
  CRISPR gRNA sequence
tttgtctgggcccatggaag

SEQ ID NO: 347124 - DNA, 20 bp, Artificial
  CRISPR gRNA sequence
ggcccatggaaggggttatc

SEQ ID NO: 347125 - DNA, 20 bp, Artificial
  CRISPR gRNA sequence
gcccatggaaggggttatct

SEQ ID NO: 347126 - DNA, 20 bp, Artificial
  CRISPR gRNA sequence
cccatggaaggggttatctg

SEQ ID NO: 347127 - DNA, 20 bp, Artificial
  CRISPR gRNA sequence
aaggggttatctggggcaca

SEQ ID NO: 347128 - DNA, 20 bp, Artificial
  CRISPR gRNA sequence
aggggttatctggggcacac

SEQ ID NO: 347129 - DNA, 20 bp, Artificial
  CRISPR gRNA sequence
tatctggggcacacaggctt

SEQ ID NO: 347130 - DNA, 20 bp, Artificial
  CRISPR gRNA sequence
gcacacaggcttcagccctg

SEQ ID NO: 347131 - DNA, 20 bp, Artificial
  CRISPR gRNA sequence
cttcagccctgcagctctcc

SEQ ID NO: 347132 - DNA, 20 bp, Artificial
  CRISPR gRNA sequence
ccctgcagctctcctggacg

SEQ ID NO: 347133 - DNA, 20 bp, Artificial
  CRISPR gRNA sequence
cctgcagctctcctggacgc

SEQ ID NO: 347134 - DNA, 20 bp, Artificial
  CRISPR gRNA sequence
cctggacgcaggcatgtgac

SEQ ID NO: 347135 - DNA, 20 bp, Artificial
  CRISPR gRNA sequence
ctggacgcaggcatgtgacc

SEQ ID NO: 347136 - DNA, 20 bp, Artificial
  CRISPR gRNA sequence
tggacgcaggcatgtgacca

SEQ ID NO: 347137 - DNA, 20 bp, Artificial
  CRISPR gRNA sequence
catgtgaccagggtgccgct

SEQ ID NO: 347138 - DNA, 20 bp, Artificial
  CRISPR gRNA sequence
atgtgaccagggtgccgctc

SEQ ID NO: 347139 - DNA, 20 bp, Artificial
  CRISPR gRNA sequence
tgtgaccagggtgccgctca

SEQ ID NO: 347140 - DNA, 20 bp, Artificial
  CRISPR gRNA sequence
gaccagggtgccgctcaggg

SEQ ID NO: 347141 - DNA, 20 bp, Artificial
  CRISPR gRNA sequence
accagggtgccgctcagggt

SEQ ID NO: 347142 - DNA, 20 bp, Artificial
  CRISPR gRNA sequence
ccgctcagggtgggaccttc

SEQ ID NO: 347143 - DNA, 20 bp, Artificial
  CRISPR gRNA sequence
ggaccttcaagcctttctgc

SEQ ID NO: 347144 - DNA, 20 bp, Artificial
  CRISPR gRNA sequence
accttcaagcctttctgctg

SEQ ID NO: 347145 - DNA, 20 bp, Artificial
  CRISPR gRNA sequence
ttcaagcctttctgctggag

SEQ ID NO: 347146 - DNA, 20 bp, Artificial
  CRISPR gRNA sequence
agcctttctgctggagaaga

SEQ ID NO: 347147 - DNA, 20 bp, Artificial
  CRISPR gRNA sequence
tggagaagacggtcatctcc

SEQ ID NO: 347148 - DNA, 20 bp, Artificial
  CRISPR gRNA sequence
ggagaagacggtcatctccc

SEQ ID NO: 347149 - DNA, 20 bp, Artificial
  CRISPR gRNA sequence
gagaagacggtcatctccca

SEQ ID NO: 347150 - DNA, 20 bp, Artificial
  CRISPR gRNA sequence
aagacggtcatctcccaggg

SEQ ID NO: 347151 - DNA, 20 bp, Artificial
  CRISPR gRNA sequence
catctcccagggaagcaacg

SEQ ID NO: 347152 - DNA, 20 bp, Artificial
  CRISPR gRNA sequence
tctcccagggaagcaacgtg

SEQ ID NO: 347153 - DNA, 20 bp, Artificial
  CRISPR gRNA sequence
gcaacgtggagccccctccc

SEQ ID NO: 347154 - DNA, 20 bp, Artificial
  CRISPR gRNA sequence
caacgtggagccccctcccc

SEQ ID NO: 347155 - DNA, 20 bp, Artificial
  CRISPR gRNA sequence
aacgtggagccccctcccca

SEQ ID NO: 347156 - DNA, 20 bp, Artificial
  CRISPR gRNA sequence
ggagccccctccccagggca

SEQ ID NO: 347157 - DNA, 20 bp, Artificial
  CRISPR gRNA sequence
agccccctccccagggcaca

SEQ ID NO: 347158 - DNA, 20 bp, Artificial
  CRISPR gRNA sequence
ccctccccagggcacagagc

SEQ ID NO: 347159 - DNA, 20 bp, Artificial
  CRISPR gRNA sequence
cctccccagggcacagagct

SEQ ID NO: 347160 - DNA, 20 bp, Artificial
  CRISPR gRNA sequence
gcacagagctgggcctcccc

SEQ ID NO: 347161 - DNA, 20 bp, Artificial
  CRISPR gRNA sequence
cacagagctgggcctccccc

SEQ ID NO: 347162 - DNA, 20 bp, Artificial
  CRISPR gRNA sequence
ctcccccgggttcacttact

SEQ ID NO: 347163 - DNA, 20 bp, Artificial
  CRISPR gRNA sequence
ccgggttcacttacttggtc

SEQ ID NO: 347164 - DNA, 20 bp, Artificial
  CRISPR gRNA sequence
gtctggtgctgacattcctc

SEQ ID NO: 347165 - DNA, 20 bp, Artificial
  CRISPR gRNA sequence
tctggtgctgacattcctcc

SEQ ID NO: 347166 - DNA, 20 bp, Artificial
  CRISPR gRNA sequence
ctggtgctgacattcctcca

SEQ ID NO: 347167 - DNA, 20 bp, Artificial
  CRISPR gRNA sequence
acattcctccagggtcccat

SEQ ID NO: 347168 - DNA, 20 bp, Artificial
  CRISPR gRNA sequence
cattcctccagggtcccatt

SEQ ID NO: 347169 - DNA, 20 bp, Artificial
  CRISPR gRNA sequence
ttcctccagggtcccattgg

SEQ ID NO: 347170 - DNA, 20 bp, Artificial
  CRISPR gRNA sequence
cctccagggtcccattggga

SEQ ID NO: 347171 - DNA, 20 bp, Artificial
  CRISPR gRNA sequence
ccagggtcccattgggagag

SEQ ID NO: 347172 - DNA, 20 bp, Artificial
  CRISPR gRNA sequence
cagggtcccattgggagaga

SEQ ID NO: 347173 - DNA, 20 bp, Artificial
  CRISPR gRNA sequence
ccattgggagagaaggtccc

SEQ ID NO: 347174 - DNA, 20 bp, Artificial
  CRISPR gRNA sequence
cattgggagagaaggtcccc

SEQ ID NO: 347175 - DNA, 20 bp, Artificial
  CRISPR gRNA sequence
attgggagagaaggtccccg

SEQ ID NO: 347176 - DNA, 20 bp, Artificial
  CRISPR gRNA sequence
ttgggagagaaggtccccgg

SEQ ID NO: 347177 - DNA, 20 bp, Artificial
  CRISPR gRNA sequence
tgggagagaaggtccccggg

SEQ ID NO: 347178 - DNA, 20 bp, Artificial
  CRISPR gRNA sequence
gagagaaggtccccgggggg

SEQ ID NO: 347179 - DNA, 20 bp, Artificial
  CRISPR gRNA sequence
cccggggggcagttctgaca

SEQ ID NO: 347180 - DNA, 20 bp, Artificial
  CRISPR gRNA sequence
ccggggggcagttctgacac

SEQ ID NO: 347181 - DNA, 20 bp, Artificial
  CRISPR gRNA sequence
cggggggcagttctgacaca

SEQ ID NO: 347182 - DNA, 20 bp, Artificial
  CRISPR gRNA sequence
acacagggtgtcctgactct

SEQ ID NO: 347183 - DNA, 20 bp, Artificial
  CRISPR gRNA sequence
tgtcctgactctcggtgcct

SEQ ID NO: 347184 - DNA, 20 bp, Artificial
  CRISPR gRNA sequence
cctgactctcggtgcctgag

SEQ ID NO: 347185 - DNA, 20 bp, Artificial
  CRISPR gRNA sequence
tgactctcggtgcctgagaa

SEQ ID NO: 347186 - DNA, 20 bp, Artificial
  CRISPR gRNA sequence
actctcggtgcctgagaaga

SEQ ID NO: 347187 - DNA, 20 bp, Artificial
  CRISPR gRNA sequence
ctctcggtgcctgagaagag

SEQ ID NO: 347188 - DNA, 20 bp, Artificial
  CRISPR gRNA sequence
tctcggtgcctgagaagaga

SEQ ID NO: 347189 - DNA, 20 bp, Artificial
  CRISPR gRNA sequence
ggtgcctgagaagagaggga

SEQ ID NO: 347190 - DNA, 20 bp, Artificial
  CRISPR gRNA sequence
cctgagaagagagggacgga

SEQ ID NO: 347191 - DNA, 20 bp, Artificial
  CRISPR gRNA sequence
tgagaagagagggacggaca

SEQ ID NO: 347192 - DNA, 20 bp, Artificial
  CRISPR gRNA sequence
gagaagagagggacggacag

SEQ ID NO: 347193 - DNA, 20 bp, Artificial
  CRISPR gRNA sequence
agaagagagggacggacaga

SEQ ID NO: 347194 - DNA, 20 bp, Artificial
  CRISPR gRNA sequence
gaagagagggacggacagag

SEQ ID NO: 347195 - DNA, 20 bp, Artificial
  CRISPR gRNA sequence
aagagagggacggacagagg

SEQ ID NO: 347196 - DNA, 20 bp, Artificial
  CRISPR gRNA sequence
agggacggacagagggggct

SEQ ID NO: 347197 - DNA, 20 bp, Artificial
  CRISPR gRNA sequence
gggacggacagagggggctg

SEQ ID NO: 347198 - DNA, 20 bp, Artificial
  CRISPR gRNA sequence
ggacggacagagggggctga

SEQ ID NO: 347199 - DNA, 20 bp, Artificial
  CRISPR gRNA sequence
acagagggggctgagggcac

SEQ ID NO: 347200 - DNA, 20 bp, Artificial
  CRISPR gRNA sequence
cagagggggctgagggcacc

SEQ ID NO: 347201 - DNA, 20 bp, Artificial
  CRISPR gRNA sequence
gggggctgagggcaccaggc

SEQ ID NO: 347202 - DNA, 20 bp, Artificial
  CRISPR gRNA sequence
ggggctgagggcaccaggcc

SEQ ID NO: 347203 - DNA, 20 bp, Artificial
  CRISPR gRNA sequence
ggctgagggcaccaggccag

SEQ ID NO: 347204 - DNA, 20 bp, Artificial
  CRISPR gRNA sequence
gctgagggcaccaggccagg

SEQ ID NO: 347205 - DNA, 20 bp, Artificial
  CRISPR gRNA sequence
ctgagggcaccaggccagga

SEQ ID NO: 347206 - DNA, 20 bp, Artificial
  CRISPR gRNA sequence
tgagggcaccaggccaggag

SEQ ID NO: 347207 - DNA, 20 bp, Artificial
  CRISPR gRNA sequence
gagggcaccaggccaggagg

SEQ ID NO: 347208 - DNA, 20 bp, Artificial
  CRISPR gRNA sequence
gcaccaggccaggagggggc

SEQ ID NO: 347209 - DNA, 20 bp, Artificial
  CRISPR gRNA sequence
ccaggccaggagggggctgg

SEQ ID NO: 347210 - DNA, 20 bp, Artificial
  CRISPR gRNA sequence
gccaggagggggctggcggc

SEQ ID NO: 347211 - DNA, 20 bp, Artificial
  CRISPR gRNA sequence
ccaggagggggctggcggct

SEQ ID NO: 347212 - DNA, 20 bp, Artificial
  CRISPR gRNA sequence
caggagggggctggcggcta

SEQ ID NO: 347213 - DNA, 20 bp, Artificial
  CRISPR gRNA sequence
gctagggactgcttgtctgt

SEQ ID NO: 347214 - DNA, 20 bp, Artificial
  CRISPR gRNA sequence
actgcttgtctgtgagcttc

SEQ ID NO: 347215 - DNA, 20 bp, Artificial
  CRISPR gRNA sequence
tgtctgtgagcttctagacc

SEQ ID NO: 347216 - DNA, 20 bp, Artificial
  CRISPR gRNA sequence
gtctgtgagcttctagacct

SEQ ID NO: 347217 - DNA, 20 bp, Artificial
  CRISPR gRNA sequence
ttctagacctgggtgctcta

SEQ ID NO: 347218 - DNA, 20 bp, Artificial
  CRISPR gRNA sequence
tctagacctgggtgctctac

SEQ ID NO: 347219 - DNA, 20 bp, Artificial
  CRISPR gRNA sequence
cctgggtgctctacgggtga

SEQ ID NO: 347220 - DNA, 20 bp, Artificial
  CRISPR gRNA sequence
ctgggtgctctacgggtgat

SEQ ID NO: 347221 - DNA, 20 bp, Artificial
  CRISPR gRNA sequence
gggtgctctacgggtgatgg

SEQ ID NO: 347222 - DNA, 20 bp, Artificial
  CRISPR gRNA sequence
ggtgctctacgggtgatggg

SEQ ID NO: 347223 - DNA, 20 bp, Artificial
  CRISPR gRNA sequence
tctacgggtgatgggaggac

SEQ ID NO: 347224 - DNA, 20 bp, Artificial
  CRISPR gRNA sequence
acgggtgatgggaggaccag

SEQ ID NO: 347225 - DNA, 20 bp, Artificial
  CRISPR gRNA sequence
cgggtgatgggaggaccagc

SEQ ID NO: 347226 - DNA, 20 bp, Artificial
  CRISPR gRNA sequence
gggtgatgggaggaccagcg

SEQ ID NO: 347227 - DNA, 20 bp, Artificial
  CRISPR gRNA sequence
gtgatgggaggaccagcggg

SEQ ID NO: 347228 - DNA, 20 bp, Artificial
  CRISPR gRNA sequence
tgatgggaggaccagcgggg

SEQ ID NO: 347229 - DNA, 20 bp, Artificial
  CRISPR gRNA sequence
gatgggaggaccagcgggga

SEQ ID NO: 347230 - DNA, 20 bp, Artificial
  CRISPR gRNA sequence
atgggaggaccagcggggag

SEQ ID NO: 347231 - DNA, 20 bp, Artificial
  CRISPR gRNA sequence
ggaggaccagcggggagggg

SEQ ID NO: 347232 - DNA, 20 bp, Artificial
  CRISPR gRNA sequence
gaggaccagcggggaggggc

SEQ ID NO: 347233 - DNA, 20 bp, Artificial
  CRISPR gRNA sequence
ggaggggcaggctccctgtc

SEQ ID NO: 347234 - DNA, 20 bp, Artificial
  CRISPR gRNA sequence
aggggcaggctccctgtcca

SEQ ID NO: 347235 - DNA, 20 bp, Artificial
  CRISPR gRNA sequence
aggctccctgtccagagtct

SEQ ID NO: 347236 - DNA, 20 bp, Artificial
  CRISPR gRNA sequence
gctccctgtccagagtcttg

SEQ ID NO: 347237 - DNA, 20 bp, Artificial
  CRISPR gRNA sequence
ctccctgtccagagtcttgg

SEQ ID NO: 347238 - DNA, 20 bp, Artificial
  CRISPR gRNA sequence
cctgtccagagtcttggagg

SEQ ID NO: 347239 - DNA, 20 bp, Artificial
  CRISPR gRNA sequence
ctgtccagagtcttggaggt

SEQ ID NO: 347240 - DNA, 20 bp, Artificial
  CRISPR gRNA sequence
tgtccagagtcttggaggtg

SEQ ID NO: 347241 - DNA, 20 bp, Artificial
  CRISPR gRNA sequence
agagtcttggaggtggggcc

SEQ ID NO: 347242 - DNA, 20 bp, Artificial
  CRISPR gRNA sequence
gagtcttggaggtggggcct

SEQ ID NO: 347243 - DNA, 20 bp, Artificial
  CRISPR gRNA sequence
agtcttggaggtggggcctg

SEQ ID NO: 347244 - DNA, 20 bp, Artificial
  CRISPR gRNA sequence
cttggaggtggggcctgggg

SEQ ID NO: 347245 - DNA, 20 bp, Artificial
  CRISPR gRNA sequence
ggaggtggggcctggggtgg

SEQ ID NO: 347246 - DNA, 20 bp, Artificial
  CRISPR gRNA sequence
ggggcctggggtggtggctc

SEQ ID NO: 347247 - DNA, 20 bp, Artificial
  CRISPR gRNA sequence
ggtggtggctctggctgtcc

SEQ ID NO: 347248 - DNA, 20 bp, Artificial
  CRISPR gRNA sequence
gctctggctgtcccggcctt

SEQ ID NO: 347249 - DNA, 20 bp, Artificial
  CRISPR gRNA sequence
ctggctgtcccggccttgag

SEQ ID NO: 347250 - DNA, 20 bp, Artificial
  CRISPR gRNA sequence
ctgtcccggccttgagtagc

SEQ ID NO: 347251 - DNA, 20 bp, Artificial
  CRISPR gRNA sequence
tgtcccggccttgagtagct

SEQ ID NO: 347252 - DNA, 20 bp, Artificial
  CRISPR gRNA sequence
ttgagtagctgggatctcat

SEQ ID NO: 347253 - DNA, 20 bp, Artificial
  CRISPR gRNA sequence
tagctgggatctcatgagtc

SEQ ID NO: 347254 - DNA, 20 bp, Artificial
  CRISPR gRNA sequence
agctgggatctcatgagtcc

SEQ ID NO: 347255 - DNA, 20 bp, Artificial
  CRISPR gRNA sequence
ctgggatctcatgagtccgg

SEQ ID NO: 347256 - DNA, 20 bp, Artificial
  CRISPR gRNA sequence
ccctctgtgtccacatcctg

SEQ ID NO: 347257 - DNA, 20 bp, Artificial
  CRISPR gRNA sequence
gtccacatcctgcagtgctg

SEQ ID NO: 347258 - DNA, 20 bp, Artificial
  CRISPR gRNA sequence
tccacatcctgcagtgctgc

SEQ ID NO: 347259 - DNA, 20 bp, Artificial
  CRISPR gRNA sequence
ccacatcctgcagtgctgcg

SEQ ID NO: 347260 - DNA, 20 bp, Artificial
  CRISPR gRNA sequence
cacatcctgcagtgctgcgg

SEQ ID NO: 347261 - DNA, 20 bp, Artificial
  CRISPR gRNA sequence
gcagtgctgcgggggctgcc

SEQ ID NO: 347262 - DNA, 20 bp, Artificial
  CRISPR gRNA sequence
tgctgcgggggctgcccggc

SEQ ID NO: 347263 - DNA, 20 bp, Artificial
  CRISPR gRNA sequence
gggggctgcccggccagatg

SEQ ID NO: 347264 - DNA, 20 bp, Artificial
  CRISPR gRNA sequence
ggggctgcccggccagatgc

SEQ ID NO: 347265 - DNA, 20 bp, Artificial
  CRISPR gRNA sequence
ctgcccggccagatgcaggc

SEQ ID NO: 347266 - DNA, 20 bp, Artificial
  CRISPR gRNA sequence
tgcccggccagatgcaggcc

SEQ ID NO: 347267 - DNA, 20 bp, Artificial
  CRISPR gRNA sequence
gcccggccagatgcaggcca

SEQ ID NO: 347268 - DNA, 20 bp, Artificial
  CRISPR gRNA sequence
ggccagatgcaggccagggc

SEQ ID NO: 347269 - DNA, 20 bp, Artificial
  CRISPR gRNA sequence
ggctggacacttactcctcc

SEQ ID NO: 347270 - DNA, 20 bp, Artificial
  CRISPR gRNA sequence
acacttactcctcctagact

SEQ ID NO: 347271 - DNA, 20 bp, Artificial
  CRISPR gRNA sequence
cctcctagacttagcttgaa

SEQ ID NO: 347272 - DNA, 20 bp, Artificial
  CRISPR gRNA sequence
cctagacttagcttgaacag

SEQ ID NO: 347273 - DNA, 20 bp, Artificial
  CRISPR gRNA sequence
ttgaacagtggcattaacca

SEQ ID NO: 347274 - DNA, 20 bp, Artificial
  CRISPR gRNA sequence
catggtcactcccataaacc

SEQ ID NO: 347275 - DNA, 20 bp, Artificial
  CRISPR gRNA sequence
atggtcactcccataaaccc

SEQ ID NO: 347276 - DNA, 20 bp, Artificial
  CRISPR gRNA sequence
actcccataaacccaggctc

SEQ ID NO: 347277 - DNA, 20 bp, Artificial
  CRISPR gRNA sequence
cataaacccaggctccagac

SEQ ID NO: 347278 - DNA, 20 bp, Artificial
  CRISPR gRNA sequence
ataaacccaggctccagacc

SEQ ID NO: 347279 - DNA, 20 bp, Artificial
  CRISPR gRNA sequence
taaacccaggctccagacca

SEQ ID NO: 347280 - DNA, 20 bp, Artificial
  CRISPR gRNA sequence
aaacccaggctccagaccag

SEQ ID NO: 347281 - DNA, 20 bp, Artificial
  CRISPR gRNA sequence
aggctccagaccaggggccc

SEQ ID NO: 347282 - DNA, 20 bp, Artificial
  CRISPR gRNA sequence
gctccagaccaggggcccga

SEQ ID NO: 347283 - DNA, 20 bp, Artificial
  CRISPR gRNA sequence
cagaccaggggcccgagagc

SEQ ID NO: 347284 - DNA, 20 bp, Artificial
  CRISPR gRNA sequence
agaccaggggcccgagagcg

SEQ ID NO: 347285 - DNA, 20 bp, Artificial
  CRISPR gRNA sequence
aggggcccgagagcgaggcc

SEQ ID NO: 347286 - DNA, 20 bp, Artificial
  CRISPR gRNA sequence
ggggcccgagagcgaggcct

SEQ ID NO: 347287 - DNA, 20 bp, Artificial
  CRISPR gRNA sequence
gggcccgagagcgaggcctg

SEQ ID NO: 347288 - DNA, 20 bp, Artificial
  CRISPR gRNA sequence
cgagagcgaggcctggggac

SEQ ID NO: 347289 - DNA, 20 bp, Artificial
  CRISPR gRNA sequence
gagagcgaggcctggggact

SEQ ID NO: 347290 - DNA, 20 bp, Artificial
  CRISPR gRNA sequence
agcgaggcctggggactggg

SEQ ID NO: 347291 - DNA, 20 bp, Artificial
  CRISPR gRNA sequence
gcctggggactgggaagtcc

SEQ ID NO: 347292 - DNA, 20 bp, Artificial
  CRISPR gRNA sequence
ctgggaagtcccagaacccc

SEQ ID NO: 347293 - DNA, 20 bp, Artificial
  CRISPR gRNA sequence
tgggaagtcccagaaccccg

SEQ ID NO: 347294 - DNA, 20 bp, Artificial
  CRISPR gRNA sequence
gaagtcccagaaccccgagg

SEQ ID NO: 347295 - DNA, 20 bp, Artificial
  CRISPR gRNA sequence
agtcccagaaccccgaggtg

SEQ ID NO: 347296 - DNA, 20 bp, Artificial
  CRISPR gRNA sequence
aaccccgaggtggagcaacc

SEQ ID NO: 347297 - DNA, 20 bp, Artificial
  CRISPR gRNA sequence
accccgaggtggagcaacct

SEQ ID NO: 347298 - DNA, 20 bp, Artificial
  CRISPR gRNA sequence
ccccgaggtggagcaacctg

SEQ ID NO: 347299 - DNA, 20 bp, Artificial
  CRISPR gRNA sequence
cgaggtggagcaacctgggg

SEQ ID NO: 347300 - DNA, 20 bp, Artificial
  CRISPR gRNA sequence
ctccatcacctgttccccac

SEQ ID NO: 347301 - DNA, 20 bp, Artificial
  CRISPR gRNA sequence
tccatcacctgttccccact

SEQ ID NO: 347302 - DNA, 20 bp, Artificial
  CRISPR gRNA sequence
gttccccactgggctgcttc

SEQ ID NO: 347303 - DNA, 20 bp, Artificial
  CRISPR gRNA sequence
ttccccactgggctgcttcc

SEQ ID NO: 347304 - DNA, 20 bp, Artificial
  CRISPR gRNA sequence
ccactgggctgcttccagga

SEQ ID NO: 347305 - DNA, 20 bp, Artificial
  CRISPR gRNA sequence
cactgggctgcttccaggac

SEQ ID NO: 347306 - DNA, 20 bp, Artificial
  CRISPR gRNA sequence
actgggctgcttccaggaca

SEQ ID NO: 347307 - DNA, 20 bp, Artificial
  CRISPR gRNA sequence
ctgcttccaggacagggctg

SEQ ID NO: 347308 - DNA, 20 bp, Artificial
  CRISPR gRNA sequence
cttccaggacagggctgaag

SEQ ID NO: 347309 - DNA, 20 bp, Artificial
  CRISPR gRNA sequence
ttccaggacagggctgaagt

SEQ ID NO: 347310 - DNA, 20 bp, Artificial
  CRISPR gRNA sequence
caggacagggctgaagtggg

SEQ ID NO: 347311 - DNA, 20 bp, Artificial
  CRISPR gRNA sequence
aggacagggctgaagtgggt

SEQ ID NO: 347312 - DNA, 20 bp, Artificial
  CRISPR gRNA sequence
agggctgaagtgggtgggcc

SEQ ID NO: 347313 - DNA, 20 bp, Artificial
  CRISPR gRNA sequence
gggctgaagtgggtgggcct

SEQ ID NO: 347314 - DNA, 20 bp, Artificial
  CRISPR gRNA sequence
ggctgaagtgggtgggcctg

SEQ ID NO: 347315 - DNA, 20 bp, Artificial
  CRISPR gRNA sequence
gaagtgggtgggcctggggc

SEQ ID NO: 347316 - DNA, 20 bp, Artificial
  CRISPR gRNA sequence
gggtgggcctggggctggcc

SEQ ID NO: 347317 - DNA, 20 bp, Artificial
  CRISPR gRNA sequence
ggtgggcctggggctggcca

SEQ ID NO: 347318 - DNA, 20 bp, Artificial
  CRISPR gRNA sequence
tggccaaggttctgtctcac

SEQ ID NO: 347319 - DNA, 20 bp, Artificial
  CRISPR gRNA sequence
ggccaaggttctgtctcacc

SEQ ID NO: 347320 - DNA, 20 bp, Artificial
  CRISPR gRNA sequence
gccaaggttctgtctcacca

SEQ ID NO: 347321 - DNA, 20 bp, Artificial
  CRISPR gRNA sequence
ttctgtctcaccagggcccc

SEQ ID NO: 347322 - DNA, 20 bp, Artificial
  CRISPR gRNA sequence
tctgtctcaccagggcccct

SEQ ID NO: 347323 - DNA, 20 bp, Artificial
  CRISPR gRNA sequence
gtctcaccagggcccctggg

SEQ ID NO: 347324 - DNA, 20 bp, Artificial
  CRISPR gRNA sequence
tctcaccagggcccctgggc

SEQ ID NO: 347325 - DNA, 20 bp, Artificial
  CRISPR gRNA sequence
cctgggcaggccatgccgtc

SEQ ID NO: 347326 - DNA, 20 bp, Artificial
  CRISPR gRNA sequence
ctgggcaggccatgccgtcg

SEQ ID NO: 347327 - DNA, 20 bp, Artificial
  CRISPR gRNA sequence
gccatgccgtcgaggaaacc

SEQ ID NO: 347328 - DNA, 20 bp, Artificial
  CRISPR gRNA sequence
ccatgccgtcgaggaaacct

SEQ ID NO: 347329 - DNA, 20 bp, Artificial
  CRISPR gRNA sequence
catgccgtcgaggaaacctg

SEQ ID NO: 347330 - DNA, 20 bp, Artificial
  CRISPR gRNA sequence
gtcgaggaaacctggggctc

SEQ ID NO: 347331 - DNA, 20 bp, Artificial
  CRISPR gRNA sequence
aggaaacctggggctccaga

SEQ ID NO: 347332 - DNA, 20 bp, Artificial
  CRISPR gRNA sequence
aaacctggggctccagacag

SEQ ID NO: 347333 - DNA, 20 bp, Artificial
  CRISPR gRNA sequence
aacctggggctccagacagc

SEQ ID NO: 347334 - DNA, 20 bp, Artificial
  CRISPR gRNA sequence
acctggggctccagacagcg

SEQ ID NO: 347335 - DNA, 20 bp, Artificial
  CRISPR gRNA sequence
ggctccagacagcggggcac

SEQ ID NO: 347336 - DNA, 20 bp, Artificial
  CRISPR gRNA sequence
gctccagacagcggggcact

SEQ ID NO: 347337 - DNA, 20 bp, Artificial
  CRISPR gRNA sequence
ctccagacagcggggcactg

SEQ ID NO: 347338 - DNA, 20 bp, Artificial
  CRISPR gRNA sequence
gacagcggggcactggggac

SEQ ID NO: 347339 - DNA, 20 bp, Artificial
  CRISPR gRNA sequence
acagcggggcactggggacc

SEQ ID NO: 347340 - DNA, 20 bp, Artificial
  CRISPR gRNA sequence
cagcggggcactggggacca

SEQ ID NO: 347341 - DNA, 20 bp, Artificial
  CRISPR gRNA sequence
cggggcactggggaccaggg

SEQ ID NO: 347342 - DNA, 20 bp, Artificial
  CRISPR gRNA sequence
actggggaccagggtggaaa

SEQ ID NO: 347343 - DNA, 20 bp, Artificial
  CRISPR gRNA sequence
ctggggaccagggtggaaat

SEQ ID NO: 347344 - DNA, 20 bp, Artificial
  CRISPR gRNA sequence
ggggaccagggtggaaatgg

SEQ ID NO: 347345 - DNA, 20 bp, Artificial
  CRISPR gRNA sequence
gggaccagggtggaaatggg

SEQ ID NO: 347346 - DNA, 20 bp, Artificial
  CRISPR gRNA sequence
ggaccagggtggaaatggga

SEQ ID NO: 347347 - DNA, 20 bp, Artificial
  CRISPR gRNA sequence
gaccagggtggaaatgggag

SEQ ID NO: 347348 - DNA, 20 bp, Artificial
  CRISPR gRNA sequence
tacctcccttctgcaccctc

SEQ ID NO: 347349 - DNA, 20 bp, Artificial
  CRISPR gRNA sequence
cccttctgcaccctctggcc

SEQ ID NO: 347350 - DNA, 20 bp, Artificial
  CRISPR gRNA sequence
ccttctgcaccctctggccc

SEQ ID NO: 347351 - DNA, 20 bp, Artificial
  CRISPR gRNA sequence
ctgcaccctctggcccgggc

SEQ ID NO: 347352 - DNA, 20 bp, Artificial
  CRISPR gRNA sequence
gcaccctctggcccgggctg

SEQ ID NO: 347353 - DNA, 20 bp, Artificial
  CRISPR gRNA sequence
caccctctggcccgggctgg

SEQ ID NO: 347354 - DNA, 20 bp, Artificial
  CRISPR gRNA sequence
cctctggcccgggctggagg

SEQ ID NO: 347355 - DNA, 20 bp, Artificial
  CRISPR gRNA sequence
gcccgggctggaggtggcgt

SEQ ID NO: 347356 - DNA, 20 bp, Artificial
  CRISPR gRNA sequence
ggctggaggtggcgtaagcg

SEQ ID NO: 347357 - DNA, 20 bp, Artificial
  CRISPR gRNA sequence
ggtggcgtaagcgcggcacg

SEQ ID NO: 347358 - DNA, 20 bp, Artificial
  CRISPR gRNA sequence
cgtaagcgcggcacgcggcg

SEQ ID NO: 347359 - DNA, 20 bp, Artificial
  CRISPR gRNA sequence
aagcgcggcacgcggcgcag

SEQ ID NO: 347360 - DNA, 20 bp, Artificial
  CRISPR gRNA sequence
cggcgcagtggtccccgtcc

SEQ ID NO: 347361 - DNA, 20 bp, Artificial
  CRISPR gRNA sequence
ggtccccgtcctggacgatg

SEQ ID NO: 347362 - DNA, 20 bp, Artificial
  CRISPR gRNA sequence
ccccgtcctggacgatgcag

SEQ ID NO: 347363 - DNA, 20 bp, Artificial
  CRISPR gRNA sequence
cgtcctggacgatgcagaag

SEQ ID NO: 347364 - DNA, 20 bp, Artificial
  CRISPR gRNA sequence
tggacgatgcagaagtggcc

SEQ ID NO: 347365 - DNA, 20 bp, Artificial
  CRISPR gRNA sequence
ggacgatgcagaagtggcct

SEQ ID NO: 347366 - DNA, 20 bp, Artificial
  CRISPR gRNA sequence
tgcagaagtggcctgggctg

SEQ ID NO: 347367 - DNA, 20 bp, Artificial
  CRISPR gRNA sequence
gcctgggctgcagccacaca

SEQ ID NO: 347368 - DNA, 20 bp, Artificial
  CRISPR gRNA sequence
acacacggcgttctctgtcc

SEQ ID NO: 347369 - DNA, 20 bp, Artificial
  CRISPR gRNA sequence
acacggcgttctctgtcctg

SEQ ID NO: 347370 - DNA, 20 bp, Artificial
  CRISPR gRNA sequence
cggcgttctctgtcctggag

SEQ ID NO: 347371 - DNA, 20 bp, Artificial
  CRISPR gRNA sequence
tctctgtcctggagcagttc

SEQ ID NO: 347372 - DNA, 20 bp, Artificial
  CRISPR gRNA sequence
gagcagttccggctcgcgcg

SEQ ID NO: 347373 - DNA, 20 bp, Artificial
  CRISPR gRNA sequence
agcagttccggctcgcgcgc

SEQ ID NO: 347374 - DNA, 20 bp, Artificial
  CRISPR gRNA sequence
ccggctcgcgcgcaggccca

SEQ ID NO: 347375 - DNA, 20 bp, Artificial
  CRISPR gRNA sequence
ctcgcgcgcaggcccatggc

SEQ ID NO: 347376 - DNA, 20 bp, Artificial
  CRISPR gRNA sequence
cgcgcgcaggcccatggctg

SEQ ID NO: 347377 - DNA, 20 bp, Artificial
  CRISPR gRNA sequence
caggcccatggctggagtcc

SEQ ID NO: 347378 - DNA, 20 bp, Artificial
  CRISPR gRNA sequence
ggcccatggctggagtccaa

SEQ ID NO: 347379 - DNA, 20 bp, Artificial
  CRISPR gRNA sequence
gcccatggctggagtccaag

SEQ ID NO: 347380 - DNA, 20 bp, Artificial
  CRISPR gRNA sequence
ccatggctggagtccaagag

SEQ ID NO: 347381 - DNA, 20 bp, Artificial
  CRISPR gRNA sequence
catggctggagtccaagagg

SEQ ID NO: 347382 - DNA, 20 bp, Artificial
  CRISPR gRNA sequence
atggctggagtccaagagga

SEQ ID NO: 347383 - DNA, 20 bp, Artificial
  CRISPR gRNA sequence
tggctggagtccaagaggag

SEQ ID NO: 347384 - DNA, 20 bp, Artificial
  CRISPR gRNA sequence
ggagtccaagaggaggggct

SEQ ID NO: 347385 - DNA, 20 bp, Artificial
  CRISPR gRNA sequence
agtccaagaggaggggctga

SEQ ID NO: 347386 - DNA, 20 bp, Artificial
  CRISPR gRNA sequence
gtccaagaggaggggctgag

SEQ ID NO: 347387 - DNA, 20 bp, Artificial
  CRISPR gRNA sequence
tccaagaggaggggctgaga

SEQ ID NO: 347388 - DNA, 20 bp, Artificial
  CRISPR gRNA sequence
ccaagaggaggggctgagag

SEQ ID NO: 347389 - DNA, 20 bp, Artificial
  CRISPR gRNA sequence
gaggggctgagaggggtacg

SEQ ID NO: 347390 - DNA, 20 bp, Artificial
  CRISPR gRNA sequence
ggggctgagaggggtacgtg

SEQ ID NO: 347391 - DNA, 20 bp, Artificial
  CRISPR gRNA sequence
gggctgagaggggtacgtgg

SEQ ID NO: 347392 - DNA, 20 bp, Artificial
  CRISPR gRNA sequence
tgagaggggtacgtggaggc

SEQ ID NO: 347393 - DNA, 20 bp, Artificial
  CRISPR gRNA sequence
gagaggggtacgtggaggcc

SEQ ID NO: 347394 - DNA, 20 bp, Artificial
  CRISPR gRNA sequence
ggaggccgggacaccatcca

SEQ ID NO: 347395 - DNA, 20 bp, Artificial
  CRISPR gRNA sequence
gaggccgggacaccatccac

SEQ ID NO: 347396 - DNA, 20 bp, Artificial
  CRISPR gRNA sequence
ccgggacaccatccacgggc

SEQ ID NO: 347397 - DNA, 20 bp, Artificial
  CRISPR gRNA sequence
cgggacaccatccacgggcc

SEQ ID NO: 347398 - DNA, 20 bp, Artificial
  CRISPR gRNA sequence
acaccatccacgggccagga

SEQ ID NO: 347399 - DNA, 20 bp, Artificial
  CRISPR gRNA sequence
acgggccaggacagcatcca

SEQ ID NO: 347400 - DNA, 20 bp, Artificial
  CRISPR gRNA sequence
cgggccaggacagcatccac

SEQ ID NO: 347401 - DNA, 20 bp, Artificial
  CRISPR gRNA sequence
caggacagcatccacaggcc

SEQ ID NO: 347402 - DNA, 20 bp, Artificial
  CRISPR gRNA sequence
aggacagcatccacaggcca

SEQ ID NO: 347403 - DNA, 20 bp, Artificial
  CRISPR gRNA sequence
cacaggccaaggactgctgc

SEQ ID NO: 347404 - DNA, 20 bp, Artificial
  CRISPR gRNA sequence
acaggccaaggactgctgcc

SEQ ID NO: 347405 - DNA, 20 bp, Artificial
  CRISPR gRNA sequence
caggccaaggactgctgcca

SEQ ID NO: 347406 - DNA, 20 bp, Artificial
  CRISPR gRNA sequence
ctgctgccagggcgccctgc

SEQ ID NO: 347407 - DNA, 20 bp, Artificial
  CRISPR gRNA sequence
tgctgccagggcgccctgcc

SEQ ID NO: 347408 - DNA, 20 bp, Artificial
  CRISPR gRNA sequence
gccctgccaggctgaacccc

SEQ ID NO: 347409 - DNA, 20 bp, Artificial
  CRISPR gRNA sequence
gccaggctgaacccctggct

SEQ ID NO: 347410 - DNA, 20 bp, Artificial
  CRISPR gRNA sequence
aacccctggctcagccaaac

SEQ ID NO: 347411 - DNA, 20 bp, Artificial
  CRISPR gRNA sequence
acccctggctcagccaaacg

SEQ ID NO: 347412 - DNA, 20 bp, Artificial
  CRISPR gRNA sequence
gctcagccaaacgaggtgcc

SEQ ID NO: 347413 - DNA, 20 bp, Artificial
  CRISPR gRNA sequence
tcagccaaacgaggtgccca

SEQ ID NO: 347414 - DNA, 20 bp, Artificial
  CRISPR gRNA sequence
cagccaaacgaggtgcccag

SEQ ID NO: 347415 - DNA, 20 bp, Artificial
  CRISPR gRNA sequence
acgaggtgcccagaggtacc

SEQ ID NO: 347416 - DNA, 20 bp, Artificial
  CRISPR gRNA sequence
gtgcccagaggtacccagca

SEQ ID NO: 347417 - DNA, 20 bp, Artificial
  CRISPR gRNA sequence
gcccagaggtacccagcatg

SEQ ID NO: 347418 - DNA, 20 bp, Artificial
  CRISPR gRNA sequence
cccagaggtacccagcatgg

SEQ ID NO: 347419 - DNA, 20 bp, Artificial
  CRISPR gRNA sequence
gtacccagcatggaggacct

SEQ ID NO: 347420 - DNA, 20 bp, Artificial
  CRISPR gRNA sequence
tacccagcatggaggacctg

SEQ ID NO: 347421 - DNA, 20 bp, Artificial
  CRISPR gRNA sequence
cagcatggaggacctgaggc

SEQ ID NO: 347422 - DNA, 20 bp, Artificial
  CRISPR gRNA sequence
agcatggaggacctgaggcc

SEQ ID NO: 347423 - DNA, 20 bp, Artificial
  CRISPR gRNA sequence
catggaggacctgaggccgg

SEQ ID NO: 347424 - DNA, 20 bp, Artificial
  CRISPR gRNA sequence
atggaggacctgaggccggg

SEQ ID NO: 347425 - DNA, 20 bp, Artificial
  CRISPR gRNA sequence
tggaggacctgaggccggga

SEQ ID NO: 347426 - DNA, 20 bp, Artificial
  CRISPR gRNA sequence
ctgaggccgggagggacacc

SEQ ID NO: 347427 - DNA, 20 bp, Artificial
  CRISPR gRNA sequence
tgaggccgggagggacacca

SEQ ID NO: 347428 - DNA, 20 bp, Artificial
  CRISPR gRNA sequence
gaggccgggagggacaccaa

SEQ ID NO: 347429 - DNA, 20 bp, Artificial
  CRISPR gRNA sequence
ccgggagggacaccaaggga

SEQ ID NO: 347430 - DNA, 20 bp, Artificial
  CRISPR gRNA sequence
ggagggacaccaagggacgg

SEQ ID NO: 347431 - DNA, 20 bp, Artificial
  CRISPR gRNA sequence
agggacaccaagggacggca

SEQ ID NO: 347432 - DNA, 20 bp, Artificial
  CRISPR gRNA sequence
agggacggcagagctgcgtg

SEQ ID NO: 347433 - DNA, 20 bp, Artificial
  CRISPR gRNA sequence
gggacggcagagctgcgtgt

SEQ ID NO: 347434 - DNA, 20 bp, Artificial
  CRISPR gRNA sequence
ggcagagctgcgtgtgggac

SEQ ID NO: 347435 - DNA, 20 bp, Artificial
  CRISPR gRNA sequence
gcagagctgcgtgtgggacg

SEQ ID NO: 347436 - DNA, 20 bp, Artificial
  CRISPR gRNA sequence
cagagctgcgtgtgggacga

SEQ ID NO: 347437 - DNA, 20 bp, Artificial
  CRISPR gRNA sequence
gcgtgtgggacgagggcttg

SEQ ID NO: 347438 - DNA, 20 bp, Artificial
  CRISPR gRNA sequence
cgtgtgggacgagggcttgc

SEQ ID NO: 347439 - DNA, 20 bp, Artificial
  CRISPR gRNA sequence
gtgggacgagggcttgcagg

SEQ ID NO: 347440 - DNA, 20 bp, Artificial
  CRISPR gRNA sequence
tgggacgagggcttgcagga

SEQ ID NO: 347441 - DNA, 20 bp, Artificial
  CRISPR gRNA sequence
gagggcttgcaggaaggtcc

SEQ ID NO: 347442 - DNA, 20 bp, Artificial
  CRISPR gRNA sequence
agggcttgcaggaaggtcct

SEQ ID NO: 347443 - DNA, 20 bp, Artificial
  CRISPR gRNA sequence
ggcttgcaggaaggtcctgg

SEQ ID NO: 347444 - DNA, 20 bp, Artificial
  CRISPR gRNA sequence
gcttgcaggaaggtcctggg

SEQ ID NO: 347445 - DNA, 20 bp, Artificial
  CRISPR gRNA sequence
cttgcaggaaggtcctggga

SEQ ID NO: 347446 - DNA, 20 bp, Artificial
  CRISPR gRNA sequence
tcctgggagggcttcgttga

SEQ ID NO: 347447 - DNA, 20 bp, Artificial
  CRISPR gRNA sequence
cctgggagggcttcgttgat

SEQ ID NO: 347448 - DNA, 20 bp, Artificial
  CRISPR gRNA sequence
tgggagggcttcgttgatgg

SEQ ID NO: 347449 - DNA, 20 bp, Artificial
  CRISPR gRNA sequence
gcttcgttgatgggagaaac

SEQ ID NO: 347450 - DNA, 20 bp, Artificial
  CRISPR gRNA sequence
ggagaaaccagccttctgcc

SEQ ID NO: 347451 - DNA, 20 bp, Artificial
  CRISPR gRNA sequence
aaaccagccttctgcccaga

SEQ ID NO: 347452 - DNA, 20 bp, Artificial
  CRISPR gRNA sequence
aaccagccttctgcccagat

SEQ ID NO: 347453 - DNA, 20 bp, Artificial
  CRISPR gRNA sequence
cagccttctgcccagatggg

SEQ ID NO: 347454 - DNA, 20 bp, Artificial
  CRISPR gRNA sequence
agccttctgcccagatgggc

SEQ ID NO: 347455 - DNA, 20 bp, Artificial
  CRISPR gRNA sequence
gcccagatgggcaggacgcc

SEQ ID NO: 347456 - DNA, 20 bp, Artificial
  CRISPR gRNA sequence
ggacgccgagcttgcactgt

SEQ ID NO: 347457 - DNA, 20 bp, Artificial
  CRISPR gRNA sequence
cgagcttgcactgtcagttc

SEQ ID NO: 347458 - DNA, 20 bp, Artificial
  CRISPR gRNA sequence
gagcttgcactgtcagttcc

SEQ ID NO: 347459 - DNA, 20 bp, Artificial
  CRISPR gRNA sequence
agcttgcactgtcagttcca

SEQ ID NO: 347460 - DNA, 20 bp, Artificial
  CRISPR gRNA sequence
ttgcactgtcagttccaggg

SEQ ID NO: 347461 - DNA, 20 bp, Artificial
  CRISPR gRNA sequence
tgcactgtcagttccagggc

SEQ ID NO: 347462 - DNA, 20 bp, Artificial
  CRISPR gRNA sequence
gcactgtcagttccagggca

SEQ ID NO: 347463 - DNA, 20 bp, Artificial
  CRISPR gRNA sequence
agttccagggcagggtcccg

SEQ ID NO: 347464 - DNA, 20 bp, Artificial
  CRISPR gRNA sequence
gttccagggcagggtcccgc

SEQ ID NO: 347465 - DNA, 20 bp, Artificial
  CRISPR gRNA sequence
ccagggcagggtcccgcagg

SEQ ID NO: 347466 - DNA, 20 bp, Artificial
  CRISPR gRNA sequence
cagggcagggtcccgcaggc

SEQ ID NO: 347467 - DNA, 20 bp, Artificial
  CRISPR gRNA sequence
cctcgccccacgtgcccacc

SEQ ID NO: 347468 - DNA, 20 bp, Artificial
  CRISPR gRNA sequence
ccagacacccaccccgcaaa

SEQ ID NO: 347469 - DNA, 20 bp, Artificial
  CRISPR gRNA sequence
cagacacccaccccgcaaac

SEQ ID NO: 347470 - DNA, 20 bp, Artificial
  CRISPR gRNA sequence
ggtttcccatctgtgcaaac

SEQ ID NO: 347471 - DNA, 20 bp, Artificial
  CRISPR gRNA sequence
gtttcccatctgtgcaaacc

SEQ ID NO: 347472 - DNA, 20 bp, Artificial
  CRISPR gRNA sequence
tgcaaaccaggccattccaa

SEQ ID NO: 347473 - DNA, 20 bp, Artificial
  CRISPR gRNA sequence
aaaccaggccattccaatgg

SEQ ID NO: 347474 - DNA, 20 bp, Artificial
  CRISPR gRNA sequence
accaggccattccaatggca

SEQ ID NO: 347475 - DNA, 20 bp, Artificial
  CRISPR gRNA sequence
ccaggccattccaatggcag

SEQ ID NO: 347476 - DNA, 20 bp, Artificial
  CRISPR gRNA sequence
ggccattccaatggcagagg

SEQ ID NO: 347477 - DNA, 20 bp, Artificial
  CRISPR gRNA sequence
gccattccaatggcagaggc

SEQ ID NO: 347478 - DNA, 20 bp, Artificial
  CRISPR gRNA sequence
attccaatggcagaggcagg

SEQ ID NO: 347479 - DNA, 20 bp, Artificial
  CRISPR gRNA sequence
ttccaatggcagaggcaggt

SEQ ID NO: 347480 - DNA, 20 bp, Artificial
  CRISPR gRNA sequence
tccaatggcagaggcaggta

SEQ ID NO: 347481 - DNA, 20 bp, Artificial
  CRISPR gRNA sequence
atggcagaggcaggtagggt

SEQ ID NO: 347482 - DNA, 20 bp, Artificial
  CRISPR gRNA sequence
ggcagaggcaggtagggtga

SEQ ID NO: 347483 - DNA, 20 bp, Artificial
  CRISPR gRNA sequence
gggtgagagccccacttctt

SEQ ID NO: 347484 - DNA, 20 bp, Artificial
  CRISPR gRNA sequence
ggtgagagccccacttcttc

SEQ ID NO: 347485 - DNA, 20 bp, Artificial
  CRISPR gRNA sequence
agccccacttcttcaggtac

SEQ ID NO: 347486 - DNA, 20 bp, Artificial
  CRISPR gRNA sequence
cccacttcttcaggtactgg

SEQ ID NO: 347487 - DNA, 20 bp, Artificial
  CRISPR gRNA sequence
cacttcttcaggtactggtg

SEQ ID NO: 347488 - DNA, 20 bp, Artificial
  CRISPR gRNA sequence
acttcttcaggtactggtgg

SEQ ID NO: 347489 - DNA, 20 bp, Artificial
  CRISPR gRNA sequence
tcttcaggtactggtggagg

SEQ ID NO: 347490 - DNA, 20 bp, Artificial
  CRISPR gRNA sequence
cttcaggtactggtggaggt

SEQ ID NO: 347491 - DNA, 20 bp, Artificial
  CRISPR gRNA sequence
ttcaggtactggtggaggtg

SEQ ID NO: 347492 - DNA, 20 bp, Artificial
  CRISPR gRNA sequence
tactggtggaggtggggtac

SEQ ID NO: 347493 - DNA, 20 bp, Artificial
  CRISPR gRNA sequence
ggtggaggtggggtacaagc

SEQ ID NO: 347494 - DNA, 20 bp, Artificial
  CRISPR gRNA sequence
gtggaggtggggtacaagct

SEQ ID NO: 347495 - DNA, 20 bp, Artificial
  CRISPR gRNA sequence
ggtggggtacaagctgggcc

SEQ ID NO: 347496 - DNA, 20 bp, Artificial
  CRISPR gRNA sequence
gtggggtacaagctgggcct

SEQ ID NO: 347497 - DNA, 20 bp, Artificial
  CRISPR gRNA sequence
gctgggcctgggcccctcct

SEQ ID NO: 347498 - DNA, 20 bp, Artificial
  CRISPR gRNA sequence
ctgggcctgggcccctcctg

SEQ ID NO: 347499 - DNA, 20 bp, Artificial
  CRISPR gRNA sequence
tgggcctgggcccctcctga

SEQ ID NO: 347500 - DNA, 20 bp, Artificial
  CRISPR gRNA sequence
gcctgggcccctcctgaggg

SEQ ID NO: 347501 - DNA, 20 bp, Artificial
  CRISPR gRNA sequence
cacctgtgcccccacatcct

SEQ ID NO: 347502 - DNA, 20 bp, Artificial
  CRISPR gRNA sequence
tgcccccacatcctcagccc

SEQ ID NO: 347503 - DNA, 20 bp, Artificial
  CRISPR gRNA sequence
ccccacatcctcagcccaag

SEQ ID NO: 347504 - DNA, 20 bp, Artificial
  CRISPR gRNA sequence
acatcctcagcccaagtaga

SEQ ID NO: 347505 - DNA, 20 bp, Artificial
  CRISPR gRNA sequence
catcctcagcccaagtagac

SEQ ID NO: 347506 - DNA, 20 bp, Artificial
  CRISPR gRNA sequence
aagtagacaggtgctttcac

SEQ ID NO: 347507 - DNA, 20 bp, Artificial
  CRISPR gRNA sequence
gtagacaggtgctttcacaa

SEQ ID NO: 347508 - DNA, 20 bp, Artificial
  CRISPR gRNA sequence
tagacaggtgctttcacaag

SEQ ID NO: 347509 - DNA, 20 bp, Artificial
  CRISPR gRNA sequence
agacaggtgctttcacaaga

SEQ ID NO: 347510 - DNA, 20 bp, Artificial
  CRISPR gRNA sequence
gacaggtgctttcacaagag

SEQ ID NO: 347511 - DNA, 20 bp, Artificial
  CRISPR gRNA sequence
caggtgctttcacaagaggg

SEQ ID NO: 347512 - DNA, 20 bp, Artificial
  CRISPR gRNA sequence
aggtgctttcacaagagggg

SEQ ID NO: 347513 - DNA, 20 bp, Artificial
  CRISPR gRNA sequence
ggtgctttcacaagagggga

SEQ ID NO: 347514 - DNA, 20 bp, Artificial
  CRISPR gRNA sequence
gtgctttcacaagaggggag

SEQ ID NO: 347515 - DNA, 20 bp, Artificial
  CRISPR gRNA sequence
ttcacaagaggggaggggca

SEQ ID NO: 347516 - DNA, 20 bp, Artificial
  CRISPR gRNA sequence
agaggggaggggcatggaac

SEQ ID NO: 347517 - DNA, 20 bp, Artificial
  CRISPR gRNA sequence
gaggggaggggcatggaact

SEQ ID NO: 347518 - DNA, 20 bp, Artificial
  CRISPR gRNA sequence
ggggcatggaactgggcatg

SEQ ID NO: 347519 - DNA, 20 bp, Artificial
  CRISPR gRNA sequence
gggcatggaactgggcatgc

SEQ ID NO: 347520 - DNA, 20 bp, Artificial
  CRISPR gRNA sequence
tggaactgggcatgcaggtt

SEQ ID NO: 347521 - DNA, 20 bp, Artificial
  CRISPR gRNA sequence
ggaactgggcatgcaggttg

SEQ ID NO: 347522 - DNA, 20 bp, Artificial
  CRISPR gRNA sequence
gggcatgcaggttgaggtgt

SEQ ID NO: 347523 - DNA, 20 bp, Artificial
  CRISPR gRNA sequence
gaggtgtgagccccaaatcc

SEQ ID NO: 347524 - DNA, 20 bp, Artificial
  CRISPR gRNA sequence
cctacatgcatgaaccccca

SEQ ID NO: 347525 - DNA, 20 bp, Artificial
  CRISPR gRNA sequence
catgaacccccaaagcactc

SEQ ID NO: 347526 - DNA, 20 bp, Artificial
  CRISPR gRNA sequence
ccagcttcctcttctgttca

SEQ ID NO: 347527 - DNA, 20 bp, Artificial
  CRISPR gRNA sequence
cttcctcttctgttcatggc

SEQ ID NO: 347528 - DNA, 20 bp, Artificial
  CRISPR gRNA sequence
acctgccctgtgcctccctg

SEQ ID NO: 347529 - DNA, 20 bp, Artificial
  CRISPR gRNA sequence
cctgccctgtgcctccctgt

SEQ ID NO: 347530 - DNA, 20 bp, Artificial
  CRISPR gRNA sequence
cctgtgcctccctgtaggct

SEQ ID NO: 347531 - DNA, 20 bp, Artificial
  CRISPR gRNA sequence
ctgtgcctccctgtaggctc

SEQ ID NO: 347532 - DNA, 20 bp, Artificial
  CRISPR gRNA sequence
gtaggctcaggccctgcccc

SEQ ID NO: 347533 - DNA, 20 bp, Artificial
  CRISPR gRNA sequence
taggctcaggccctgccccc

SEQ ID NO: 347534 - DNA, 20 bp, Artificial
  CRISPR gRNA sequence
cctgcccccaggtgtgccgt

SEQ ID NO: 347535 - DNA, 20 bp, Artificial
  CRISPR gRNA sequence
gtgccgtcagccctgtcccg

SEQ ID NO: 347536 - DNA, 20 bp, Artificial
  CRISPR gRNA sequence
tgccgtcagccctgtcccgc

SEQ ID NO: 347537 - DNA, 20 bp, Artificial
  CRISPR gRNA sequence
tcagccctgtcccgcaggtg

SEQ ID NO: 347538 - DNA, 20 bp, Artificial
  CRISPR gRNA sequence
cccgcaggtgcagtcctgcc

SEQ ID NO: 347539 - DNA, 20 bp, Artificial
  CRISPR gRNA sequence
ggtgcagtcctgcctggccg

SEQ ID NO: 347540 - DNA, 20 bp, Artificial
  CRISPR gRNA sequence
gtgcagtcctgcctggccgc

SEQ ID NO: 347541 - DNA, 20 bp, Artificial
  CRISPR gRNA sequence
tgcagtcctgcctggccgca

SEQ ID NO: 347542 - DNA, 20 bp, Artificial
  CRISPR gRNA sequence
cagtcctgcctggccgcagg

SEQ ID NO: 347543 - DNA, 20 bp, Artificial
  CRISPR gRNA sequence
tgcctggccgcagggagcac

SEQ ID NO: 347544 - DNA, 20 bp, Artificial
  CRISPR gRNA sequence
cagggagcactggccatgct

SEQ ID NO: 347545 - DNA, 20 bp, Artificial
  CRISPR gRNA sequence
agcactggccatgctgagcc

SEQ ID NO: 347546 - DNA, 20 bp, Artificial
  CRISPR gRNA sequence
ggccatgctgagcctggcat

SEQ ID NO: 347547 - DNA, 20 bp, Artificial
  CRISPR gRNA sequence
gccatgctgagcctggcatg

SEQ ID NO: 347548 - DNA, 20 bp, Artificial
  CRISPR gRNA sequence
tgagcctggcatgaggctcc

SEQ ID NO: 347549 - DNA, 20 bp, Artificial
  CRISPR gRNA sequence
gagcctggcatgaggctcca

SEQ ID NO: 347550 - DNA, 20 bp, Artificial
  CRISPR gRNA sequence
agcctggcatgaggctccaa

SEQ ID NO: 347551 - DNA, 20 bp, Artificial
  CRISPR gRNA sequence
gcctggcatgaggctccaag

SEQ ID NO: 347552 - DNA, 20 bp, Artificial
  CRISPR gRNA sequence
ggcatgaggctccaagggga

SEQ ID NO: 347553 - DNA, 20 bp, Artificial
  CRISPR gRNA sequence
catgaggctccaaggggaca

SEQ ID NO: 347554 - DNA, 20 bp, Artificial
  CRISPR gRNA sequence
ctccaaggggacagagccgt

SEQ ID NO: 347555 - DNA, 20 bp, Artificial
  CRISPR gRNA sequence
ggacagagccgttggccgca

SEQ ID NO: 347556 - DNA, 20 bp, Artificial
  CRISPR gRNA sequence
agagccgttggccgcatgga

SEQ ID NO: 347557 - DNA, 20 bp, Artificial
  CRISPR gRNA sequence
gagccgttggccgcatggac

SEQ ID NO: 347558 - DNA, 20 bp, Artificial
  CRISPR gRNA sequence
gcatggacaggctctgcgct

SEQ ID NO: 347559 - DNA, 20 bp, Artificial
  CRISPR gRNA sequence
gctctgcgctcagtgactca

SEQ ID NO: 347560 - DNA, 20 bp, Artificial
  CRISPR gRNA sequence
ctctgcgctcagtgactcaa

SEQ ID NO: 347561 - DNA, 20 bp, Artificial
  CRISPR gRNA sequence
agtgactcaaaggccacctc

SEQ ID NO: 347562 - DNA, 20 bp, Artificial
  CRISPR gRNA sequence
gtgactcaaaggccacctct

SEQ ID NO: 347563 - DNA, 20 bp, Artificial
  CRISPR gRNA sequence
tcaaaggccacctctgggtc

SEQ ID NO: 347564 - DNA, 20 bp, Artificial
  CRISPR gRNA sequence
ggttcccctttctgtctgcc

SEQ ID NO: 347565 - DNA, 20 bp, Artificial
  CRISPR gRNA sequence
cctttctgtctgcctggact

SEQ ID NO: 347566 - DNA, 20 bp, Artificial
  CRISPR gRNA sequence
ctttctgtctgcctggactc

SEQ ID NO: 347567 - DNA, 20 bp, Artificial
  CRISPR gRNA sequence
tctgtctgcctggactcagg

SEQ ID NO: 347568 - DNA, 20 bp, Artificial
  CRISPR gRNA sequence
ctgtctgcctggactcaggt

SEQ ID NO: 347569 - DNA, 20 bp, Artificial
  CRISPR gRNA sequence
gcctggactcaggtgggcac

SEQ ID NO: 347570 - DNA, 20 bp, Artificial
  CRISPR gRNA sequence
ctcaggtgggcaccagcctc

SEQ ID NO: 347571 - DNA, 20 bp, Artificial
  CRISPR gRNA sequence
tcaggtgggcaccagcctcc

SEQ ID NO: 347572 - DNA, 20 bp, Artificial
  CRISPR gRNA sequence
tccaggtgacctcttcccct

SEQ ID NO: 347573 - DNA, 20 bp, Artificial
  CRISPR gRNA sequence
ccaggtgacctcttcccctg

SEQ ID NO: 347574 - DNA, 20 bp, Artificial
  CRISPR gRNA sequence
gacctcttcccctgaggtca

SEQ ID NO: 347575 - DNA, 20 bp, Artificial
  CRISPR gRNA sequence
acctcttcccctgaggtcac

SEQ ID NO: 347576 - DNA, 20 bp, Artificial
  CRISPR gRNA sequence
cctcttcccctgaggtcaca

SEQ ID NO: 347577 - DNA, 20 bp, Artificial
  CRISPR gRNA sequence
ctcttcccctgaggtcacag

SEQ ID NO: 347578 - DNA, 20 bp, Artificial
  CRISPR gRNA sequence
tcttcccctgaggtcacagg

SEQ ID NO: 347579 - DNA, 20 bp, Artificial
  CRISPR gRNA sequence
tcacagggggaaccaatatc

SEQ ID NO: 347580 - DNA, 20 bp, Artificial
  CRISPR gRNA sequence
acagggggaaccaatatctg

SEQ ID NO: 347581 - DNA, 20 bp, Artificial
  CRISPR gRNA sequence
cagggggaaccaatatctgg

SEQ ID NO: 347582 - DNA, 20 bp, Artificial
  CRISPR gRNA sequence
gggggaaccaatatctggag

SEQ ID NO: 347583 - DNA, 20 bp, Artificial
  CRISPR gRNA sequence
gaaccaatatctggaggaga

SEQ ID NO: 347584 - DNA, 20 bp, Artificial
  CRISPR gRNA sequence
aaccaatatctggaggagaa

SEQ ID NO: 347585 - DNA, 20 bp, Artificial
  CRISPR gRNA sequence
accaatatctggaggagaaa

SEQ ID NO: 347586 - DNA, 20 bp, Artificial
  CRISPR gRNA sequence
tatctggaggagaaagggac

SEQ ID NO: 347587 - DNA, 20 bp, Artificial
  CRISPR gRNA sequence
ctggaggagaaagggacaag

SEQ ID NO: 347588 - DNA, 20 bp, Artificial
  CRISPR gRNA sequence
gaaagggacaagaagccctg

SEQ ID NO: 347589 - DNA, 20 bp, Artificial
  CRISPR gRNA sequence
aaagggacaagaagccctgt

SEQ ID NO: 347590 - DNA, 20 bp, Artificial
  CRISPR gRNA sequence
aagggacaagaagccctgtg

SEQ ID NO: 347591 - DNA, 20 bp, Artificial
  CRISPR gRNA sequence
ggacaagaagccctgtgggg

SEQ ID NO: 347592 - DNA, 20 bp, Artificial
  CRISPR gRNA sequence
caagaagccctgtggggaag

SEQ ID NO: 347593 - DNA, 20 bp, Artificial
  CRISPR gRNA sequence
gaagccctgtggggaagcag

SEQ ID NO: 347594 - DNA, 20 bp, Artificial
  CRISPR gRNA sequence
aagccctgtggggaagcagc

SEQ ID NO: 347595 - DNA, 20 bp, Artificial
  CRISPR gRNA sequence
tgtggggaagcagcaggccc

SEQ ID NO: 347596 - DNA, 20 bp, Artificial
  CRISPR gRNA sequence
gaagcagcaggcccgagtgc

SEQ ID NO: 347597 - DNA, 20 bp, Artificial
  CRISPR gRNA sequence
cagcaggcccgagtgccggc

SEQ ID NO: 347598 - DNA, 20 bp, Artificial
  CRISPR gRNA sequence
gcaggcccgagtgccggccg

SEQ ID NO: 347599 - DNA, 20 bp, Artificial
  CRISPR gRNA sequence
aggcccgagtgccggccgga

SEQ ID NO: 347600 - DNA, 20 bp, Artificial
  CRISPR gRNA sequence
gagtgccggccggagagtcc

SEQ ID NO: 347601 - DNA, 20 bp, Artificial
  CRISPR gRNA sequence
caccatcccattccactttg

SEQ ID NO: 347602 - DNA, 20 bp, Artificial
  CRISPR gRNA sequence
atcccattccactttgcagc

SEQ ID NO: 347603 - DNA, 20 bp, Artificial
  CRISPR gRNA sequence
tcccattccactttgcagct

SEQ ID NO: 347604 - DNA, 20 bp, Artificial
  CRISPR gRNA sequence
cccattccactttgcagcta

SEQ ID NO: 347605 - DNA, 20 bp, Artificial
  CRISPR gRNA sequence
ccactttgcagctagggacg

SEQ ID NO: 347606 - DNA, 20 bp, Artificial
  CRISPR gRNA sequence
cactttgcagctagggacgt

SEQ ID NO: 347607 - DNA, 20 bp, Artificial
  CRISPR gRNA sequence
tgcagctagggacgtgggca

SEQ ID NO: 347608 - DNA, 20 bp, Artificial
  CRISPR gRNA sequence
gcagctagggacgtgggcac

SEQ ID NO: 347609 - DNA, 20 bp, Artificial
  CRISPR gRNA sequence
agctagggacgtgggcacag

SEQ ID NO: 347610 - DNA, 20 bp, Artificial
  CRISPR gRNA sequence
ctagggacgtgggcacagga

SEQ ID NO: 347611 - DNA, 20 bp, Artificial
  CRISPR gRNA sequence
tagggacgtgggcacaggag

SEQ ID NO: 347612 - DNA, 20 bp, Artificial
  CRISPR gRNA sequence
acgtgggcacaggagaggtc

SEQ ID NO: 347613 - DNA, 20 bp, Artificial
  CRISPR gRNA sequence
cgtgggcacaggagaggtct

SEQ ID NO: 347614 - DNA, 20 bp, Artificial
  CRISPR gRNA sequence
agaggtctgggcacccaccc

SEQ ID NO: 347615 - DNA, 20 bp, Artificial
  CRISPR gRNA sequence
gaggtctgggcacccacccc

SEQ ID NO: 347616 - DNA, 20 bp, Artificial
  CRISPR gRNA sequence
tgggcacccaccccgggcac

SEQ ID NO: 347617 - DNA, 20 bp, Artificial
  CRISPR gRNA sequence
ggcacccaccccgggcacca

SEQ ID NO: 347618 - DNA, 20 bp, Artificial
  CRISPR gRNA sequence
gcacccaccccgggcaccag

SEQ ID NO: 347619 - DNA, 20 bp, Artificial
  CRISPR gRNA sequence
acccaccccgggcaccagag

SEQ ID NO: 347620 - DNA, 20 bp, Artificial
  CRISPR gRNA sequence
ccccgggcaccagaggagcc

SEQ ID NO: 347621 - DNA, 20 bp, Artificial
  CRISPR gRNA sequence
cccgggcaccagaggagcca

SEQ ID NO: 347622 - DNA, 20 bp, Artificial
  CRISPR gRNA sequence
gcaccagaggagccaaggac

SEQ ID NO: 347623 - DNA, 20 bp, Artificial
  CRISPR gRNA sequence
caccagaggagccaaggacg

SEQ ID NO: 347624 - DNA, 20 bp, Artificial
  CRISPR gRNA sequence
accagaggagccaaggacga

SEQ ID NO: 347625 - DNA, 20 bp, Artificial
  CRISPR gRNA sequence
aggagccaaggacgagggat

SEQ ID NO: 347626 - DNA, 20 bp, Artificial
  CRISPR gRNA sequence
ggagccaaggacgagggata

SEQ ID NO: 347627 - DNA, 20 bp, Artificial
  CRISPR gRNA sequence
gagccaaggacgagggataa

SEQ ID NO: 347628 - DNA, 20 bp, Artificial
  CRISPR gRNA sequence
caaggacgagggataagggt

SEQ ID NO: 347629 - DNA, 20 bp, Artificial
  CRISPR gRNA sequence
agggataagggtcagtcgcc

SEQ ID NO: 347630 - DNA, 20 bp, Artificial
  CRISPR gRNA sequence
taagggtcagtcgccaagct

SEQ ID NO: 347631 - DNA, 20 bp, Artificial
  CRISPR gRNA sequence
aagggtcagtcgccaagctc

SEQ ID NO: 347632 - DNA, 20 bp, Artificial
  CRISPR gRNA sequence
gtcagtcgccaagctcagga

SEQ ID NO: 347633 - DNA, 20 bp, Artificial
  CRISPR gRNA sequence
caagctcaggatggcccacc

SEQ ID NO: 347634 - DNA, 20 bp, Artificial
  CRISPR gRNA sequence
gctcaggatggcccacctgg

SEQ ID NO: 347635 - DNA, 20 bp, Artificial
  CRISPR gRNA sequence
tggcccacctggcggtgaca

SEQ ID NO: 347636 - DNA, 20 bp, Artificial
  CRISPR gRNA sequence
ccacctggcggtgacaaagt

SEQ ID NO: 347637 - DNA, 20 bp, Artificial
  CRISPR gRNA sequence
acctggcggtgacaaagtga

SEQ ID NO: 347638 - DNA, 20 bp, Artificial
  CRISPR gRNA sequence
cctggcggtgacaaagtgag

SEQ ID NO: 347639 - DNA, 20 bp, Artificial
  CRISPR gRNA sequence
gcggtgacaaagtgagaggt

SEQ ID NO: 347640 - DNA, 20 bp, Artificial
  CRISPR gRNA sequence
tgacaaagtgagaggtgaga

SEQ ID NO: 347641 - DNA, 20 bp, Artificial
  CRISPR gRNA sequence
acaaagtgagaggtgagaca

SEQ ID NO: 347642 - DNA, 20 bp, Artificial
  CRISPR gRNA sequence
caaagtgagaggtgagacag

SEQ ID NO: 347643 - DNA, 20 bp, Artificial
  CRISPR gRNA sequence
agtgagaggtgagacagagg

SEQ ID NO: 347644 - DNA, 20 bp, Artificial
  CRISPR gRNA sequence
agaggtgagacagaggtgga

SEQ ID NO: 347645 - DNA, 20 bp, Artificial
  CRISPR gRNA sequence
gaggtgagacagaggtggac

SEQ ID NO: 347646 - DNA, 20 bp, Artificial
  CRISPR gRNA sequence
aggtgagacagaggtggacg

SEQ ID NO: 347647 - DNA, 20 bp, Artificial
  CRISPR gRNA sequence
ggtgagacagaggtggacgg

SEQ ID NO: 347648 - DNA, 20 bp, Artificial
  CRISPR gRNA sequence
agacagaggtggacgggggc

SEQ ID NO: 347649 - DNA, 20 bp, Artificial
  CRISPR gRNA sequence
acagaggtggacgggggccg

SEQ ID NO: 347650 - DNA, 20 bp, Artificial
  CRISPR gRNA sequence
cagaggtggacgggggccgg

SEQ ID NO: 347651 - DNA, 20 bp, Artificial
  CRISPR gRNA sequence
gggggccggaggctgacctc

SEQ ID NO: 347652 - DNA, 20 bp, Artificial
  CRISPR gRNA sequence
ggggccggaggctgacctca

SEQ ID NO: 347653 - DNA, 20 bp, Artificial
  CRISPR gRNA sequence
tgacctcaaggcgtcccctg

SEQ ID NO: 347654 - DNA, 20 bp, Artificial
  CRISPR gRNA sequence
gacctcaaggcgtcccctgc

SEQ ID NO: 347655 - DNA, 20 bp, Artificial
  CRISPR gRNA sequence
acctcaaggcgtcccctgca

SEQ ID NO: 347656 - DNA, 20 bp, Artificial
  CRISPR gRNA sequence
tcccctgcagggtgcatcca

SEQ ID NO: 347657 - DNA, 20 bp, Artificial
  CRISPR gRNA sequence
ccctgcagggtgcatccatg

SEQ ID NO: 347658 - DNA, 20 bp, Artificial
  CRISPR gRNA sequence
gcagggtgcatccatggaga

SEQ ID NO: 347659 - DNA, 20 bp, Artificial
  CRISPR gRNA sequence
cagggtgcatccatggagat

SEQ ID NO: 347660 - DNA, 20 bp, Artificial
  CRISPR gRNA sequence
agggtgcatccatggagatg

SEQ ID NO: 347661 - DNA, 20 bp, Artificial
  CRISPR gRNA sequence
tgcatccatggagatggggt

SEQ ID NO: 347662 - DNA, 20 bp, Artificial
  CRISPR gRNA sequence
gcatccatggagatggggtt

SEQ ID NO: 347663 - DNA, 20 bp, Artificial
  CRISPR gRNA sequence
atggagatggggttgggacc

SEQ ID NO: 347664 - DNA, 20 bp, Artificial
  CRISPR gRNA sequence
gatggggttgggacctggcc

SEQ ID NO: 347665 - DNA, 20 bp, Artificial
  CRISPR gRNA sequence
atggggttgggacctggcct

SEQ ID NO: 347666 - DNA, 20 bp, Artificial
  CRISPR gRNA sequence
tggggttgggacctggcctg

SEQ ID NO: 347667 - DNA, 20 bp, Artificial
  CRISPR gRNA sequence
ggttgggacctggcctgggg

SEQ ID NO: 347668 - DNA, 20 bp, Artificial
  CRISPR gRNA sequence
gggacctggcctggggcagc

SEQ ID NO: 347669 - DNA, 20 bp, Artificial
  CRISPR gRNA sequence
ggacctggcctggggcagcc

SEQ ID NO: 347670 - DNA, 20 bp, Artificial
  CRISPR gRNA sequence
gacctggcctggggcagccg

SEQ ID NO: 347671 - DNA, 20 bp, Artificial
  CRISPR gRNA sequence
tggggcagccggggccttcc

SEQ ID NO: 347672 - DNA, 20 bp, Artificial
  CRISPR gRNA sequence
ggggcagccggggccttcct

SEQ ID NO: 347673 - DNA, 20 bp, Artificial
  CRISPR gRNA sequence
gggcagccggggccttcctg

SEQ ID NO: 347674 - DNA, 20 bp, Artificial
  CRISPR gRNA sequence
ggggccttcctggggcactg

SEQ ID NO: 347675 - DNA, 20 bp, Artificial
  CRISPR gRNA sequence
ttcctggggcactgtggcca

SEQ ID NO: 347676 - DNA, 20 bp, Artificial
  CRISPR gRNA sequence
cctggggcactgtggccatg

SEQ ID NO: 347677 - DNA, 20 bp, Artificial
  CRISPR gRNA sequence
tggggcactgtggccatgga

SEQ ID NO: 347678 - DNA, 20 bp, Artificial
  CRISPR gRNA sequence
gggcactgtggccatggaga

SEQ ID NO: 347679 - DNA, 20 bp, Artificial
  CRISPR gRNA sequence
ggcactgtggccatggagag

SEQ ID NO: 347680 - DNA, 20 bp, Artificial
  CRISPR gRNA sequence
gcactgtggccatggagaga

SEQ ID NO: 347681 - DNA, 20 bp, Artificial
  CRISPR gRNA sequence
gtggccatggagagagggtg

SEQ ID NO: 347682 - DNA, 20 bp, Artificial
  CRISPR gRNA sequence
tggccatggagagagggtgc

SEQ ID NO: 347683 - DNA, 20 bp, Artificial
  CRISPR gRNA sequence
ggccatggagagagggtgca

SEQ ID NO: 347684 - DNA, 20 bp, Artificial
  CRISPR gRNA sequence
tggagagagggtgcagggtg

SEQ ID NO: 347685 - DNA, 20 bp, Artificial
  CRISPR gRNA sequence
ggagagagggtgcagggtgc

SEQ ID NO: 347686 - DNA, 20 bp, Artificial
  CRISPR gRNA sequence
gagagagggtgcagggtgcg

SEQ ID NO: 347687 - DNA, 20 bp, Artificial
  CRISPR gRNA sequence
agagagggtgcagggtgcgg

SEQ ID NO: 347688 - DNA, 20 bp, Artificial
  CRISPR gRNA sequence
gtgcagggtgcgggggcatc

SEQ ID NO: 347689 - DNA, 20 bp, Artificial
  CRISPR gRNA sequence
tgcagggtgcgggggcatcc

SEQ ID NO: 347690 - DNA, 20 bp, Artificial
  CRISPR gRNA sequence
cgggggcatccaggctgccc

SEQ ID NO: 347691 - DNA, 20 bp, Artificial
  CRISPR gRNA sequence
gggcatccaggctgcccaag

SEQ ID NO: 347692 - DNA, 20 bp, Artificial
  CRISPR gRNA sequence
gcatccaggctgcccaagcg

SEQ ID NO: 347693 - DNA, 20 bp, Artificial
  CRISPR gRNA sequence
catccaggctgcccaagcgg

SEQ ID NO: 347694 - DNA, 20 bp, Artificial
  CRISPR gRNA sequence
caggctgcccaagcggaggc

SEQ ID NO: 347695 - DNA, 20 bp, Artificial
  CRISPR gRNA sequence
aggctgcccaagcggaggct

SEQ ID NO: 347696 - DNA, 20 bp, Artificial
  CRISPR gRNA sequence
tgcccaagcggaggctgggc

SEQ ID NO: 347697 - DNA, 20 bp, Artificial
  CRISPR gRNA sequence
ggaggctgggccggctgtgc

SEQ ID NO: 347698 - DNA, 20 bp, Artificial
  CRISPR gRNA sequence
ggctgtgctggcctcttacc

SEQ ID NO: 347699 - DNA, 20 bp, Artificial
  CRISPR gRNA sequence
gctgtgctggcctcttacct

SEQ ID NO: 347700 - DNA, 20 bp, Artificial
  CRISPR gRNA sequence
tcttacctgggtcacacatt

SEQ ID NO: 347701 - DNA, 20 bp, Artificial
  CRISPR gRNA sequence
gggtcacacatttggcactg

SEQ ID NO: 347702 - DNA, 20 bp, Artificial
  CRISPR gRNA sequence
tggcactgcagacacttgct

SEQ ID NO: 347703 - DNA, 20 bp, Artificial
  CRISPR gRNA sequence
ggcactgcagacacttgctt

SEQ ID NO: 347704 - DNA, 20 bp, Artificial
  CRISPR gRNA sequence
agacacttgcttaggccatt

SEQ ID NO: 347705 - DNA, 20 bp, Artificial
  CRISPR gRNA sequence
gacacttgcttaggccattg

SEQ ID NO: 347706 - DNA, 20 bp, Artificial
  CRISPR gRNA sequence
acttgcttaggccattgagg

SEQ ID NO: 347707 - DNA, 20 bp, Artificial
  CRISPR gRNA sequence
cttgcttaggccattgaggt

SEQ ID NO: 347708 - DNA, 20 bp, Artificial
  CRISPR gRNA sequence
ggccattgaggtgggcaatg

SEQ ID NO: 347709 - DNA, 20 bp, Artificial
  CRISPR gRNA sequence
gccattgaggtgggcaatgt

SEQ ID NO: 347710 - DNA, 20 bp, Artificial
  CRISPR gRNA sequence
aggtgggcaatgtaggtgcc

SEQ ID NO: 347711 - DNA, 20 bp, Artificial
  CRISPR gRNA sequence
gtgggcaatgtaggtgcctg

SEQ ID NO: 347712 - DNA, 20 bp, Artificial
  CRISPR gRNA sequence
tgggcaatgtaggtgcctgg

SEQ ID NO: 347713 - DNA, 20 bp, Artificial
  CRISPR gRNA sequence
gggcaatgtaggtgcctgga

SEQ ID NO: 347714 - DNA, 20 bp, Artificial
  CRISPR gRNA sequence
caatgtaggtgcctggaggg

SEQ ID NO: 347715 - DNA, 20 bp, Artificial
  CRISPR gRNA sequence
aatgtaggtgcctggagggc

SEQ ID NO: 347716 - DNA, 20 bp, Artificial
  CRISPR gRNA sequence
atgtaggtgcctggagggca

SEQ ID NO: 347717 - DNA, 20 bp, Artificial
  CRISPR gRNA sequence
ggttcacacactgtgcccgt

SEQ ID NO: 347718 - DNA, 20 bp, Artificial
  CRISPR gRNA sequence
ctgtgcccgtcagctccccg

SEQ ID NO: 347719 - DNA, 20 bp, Artificial
  CRISPR gRNA sequence
tgtgcccgtcagctccccgc

SEQ ID NO: 347720 - DNA, 20 bp, Artificial
  CRISPR gRNA sequence
tcacacgataacctgccgcc

SEQ ID NO: 347721 - DNA, 20 bp, Artificial
  CRISPR gRNA sequence
acacgataacctgccgccca

SEQ ID NO: 347722 - DNA, 20 bp, Artificial
  CRISPR gRNA sequence
acgataacctgccgcccaga

SEQ ID NO: 347723 - DNA, 20 bp, Artificial
  CRISPR gRNA sequence
ataacctgccgcccagagag

SEQ ID NO: 347724 - DNA, 20 bp, Artificial
  CRISPR gRNA sequence
taacctgccgcccagagagt

SEQ ID NO: 347725 - DNA, 20 bp, Artificial
  CRISPR gRNA sequence
ccagagagtgggaacttcgc

SEQ ID NO: 347726 - DNA, 20 bp, Artificial
  CRISPR gRNA sequence
gtgggaacttcgcaagtctg

SEQ ID NO: 347727 - DNA, 20 bp, Artificial
  CRISPR gRNA sequence
tgggaacttcgcaagtctgc

SEQ ID NO: 347728 - DNA, 20 bp, Artificial
  CRISPR gRNA sequence
ggaacttcgcaagtctgcgg

SEQ ID NO: 347729 - DNA, 20 bp, Artificial
  CRISPR gRNA sequence
gaacttcgcaagtctgcggg

SEQ ID NO: 347730 - DNA, 20 bp, Artificial
  CRISPR gRNA sequence
aagtctgcgggaggcccctt

SEQ ID NO: 347731 - DNA, 20 bp, Artificial
  CRISPR gRNA sequence
agtctgcgggaggccccttc

SEQ ID NO: 347732 - DNA, 20 bp, Artificial
  CRISPR gRNA sequence
tctgcgggaggccccttcgg

SEQ ID NO: 347733 - DNA, 20 bp, Artificial
  CRISPR gRNA sequence
cccatcactccacccgcgcc

SEQ ID NO: 347734 - DNA, 20 bp, Artificial
  CRISPR gRNA sequence
catcactccacccgcgccca

SEQ ID NO: 347735 - DNA, 20 bp, Artificial
  CRISPR gRNA sequence
tccacccgcgcccagagccc

SEQ ID NO: 347736 - DNA, 20 bp, Artificial
  CRISPR gRNA sequence
acccgcgcccagagcccaag

SEQ ID NO: 347737 - DNA, 20 bp, Artificial
  CRISPR gRNA sequence
cccgcgcccagagcccaagc

SEQ ID NO: 347738 - DNA, 20 bp, Artificial
  CRISPR gRNA sequence
ccgcgcccagagcccaagca

SEQ ID NO: 347739 - DNA, 20 bp, Artificial
  CRISPR gRNA sequence
gcgcccagagcccaagcagg

SEQ ID NO: 347740 - DNA, 20 bp, Artificial
  CRISPR gRNA sequence
gagcccaagcagggagacac

SEQ ID NO: 347741 - DNA, 20 bp, Artificial
  CRISPR gRNA sequence
caagcagggagacaccagct

SEQ ID NO: 347742 - DNA, 20 bp, Artificial
  CRISPR gRNA sequence
aagcagggagacaccagcta

SEQ ID NO: 347743 - DNA, 20 bp, Artificial
  CRISPR gRNA sequence
agcagggagacaccagctaa

SEQ ID NO: 347744 - DNA, 20 bp, Artificial
  CRISPR gRNA sequence
gcagggagacaccagctaag

SEQ ID NO: 347745 - DNA, 20 bp, Artificial
  CRISPR gRNA sequence
accagctaaggggactcaaa

SEQ ID NO: 347746 - DNA, 20 bp, Artificial
  CRISPR gRNA sequence
aggggactcaaatggcccat

SEQ ID NO: 347747 - DNA, 20 bp, Artificial
  CRISPR gRNA sequence
caaatggcccatgagcccca

SEQ ID NO: 347748 - DNA, 20 bp, Artificial
  CRISPR gRNA sequence
aaatggcccatgagccccac

SEQ ID NO: 347749 - DNA, 20 bp, Artificial
  CRISPR gRNA sequence
cccatgagccccacgggaca

SEQ ID NO: 347750 - DNA, 20 bp, Artificial
  CRISPR gRNA sequence
atgagccccacgggacacag

SEQ ID NO: 347751 - DNA, 20 bp, Artificial
  CRISPR gRNA sequence
acgggacacagcagccccat

SEQ ID NO: 347752 - DNA, 20 bp, Artificial
  CRISPR gRNA sequence
acagcagccccatcagccat

SEQ ID NO: 347753 - DNA, 20 bp, Artificial
  CRISPR gRNA sequence
gcagccccatcagccatgag

SEQ ID NO: 347754 - DNA, 20 bp, Artificial
  CRISPR gRNA sequence
agccccatcagccatgagca

SEQ ID NO: 347755 - DNA, 20 bp, Artificial
  CRISPR gRNA sequence
agccatgagcagagctgctc

SEQ ID NO: 347756 - DNA, 20 bp, Artificial
  CRISPR gRNA sequence
gccatgagcagagctgctct

SEQ ID NO: 347757 - DNA, 20 bp, Artificial
  CRISPR gRNA sequence
ccatgagcagagctgctctg

SEQ ID NO: 347758 - DNA, 20 bp, Artificial
  CRISPR gRNA sequence
agagctgctctggggaaaat

SEQ ID NO: 347759 - DNA, 20 bp, Artificial
  CRISPR gRNA sequence
ctgctctggggaaaatcgga

SEQ ID NO: 347760 - DNA, 20 bp, Artificial
  CRISPR gRNA sequence
tggggaaaatcggaaagttc

SEQ ID NO: 347761 - DNA, 20 bp, Artificial
  CRISPR gRNA sequence
ggaaaatcggaaagttctgg

SEQ ID NO: 347762 - DNA, 20 bp, Artificial
  CRISPR gRNA sequence
cggaaagttctggaagcaca

SEQ ID NO: 347763 - DNA, 20 bp, Artificial
  CRISPR gRNA sequence
ggaaagttctggaagcacat

SEQ ID NO: 347764 - DNA, 20 bp, Artificial
  CRISPR gRNA sequence
gaaagttctggaagcacatg

SEQ ID NO: 347765 - DNA, 20 bp, Artificial
  CRISPR gRNA sequence
tggaagcacatggggcctcc

SEQ ID NO: 347766 - DNA, 20 bp, Artificial
  CRISPR gRNA sequence
ggaagcacatggggcctcct

SEQ ID NO: 347767 - DNA, 20 bp, Artificial
  CRISPR gRNA sequence
atggggcctcctgggacacc

SEQ ID NO: 347768 - DNA, 20 bp, Artificial
  CRISPR gRNA sequence
gcctcctgggacacctggcc

SEQ ID NO: 347769 - DNA, 20 bp, Artificial
  CRISPR gRNA sequence
tgggacacctggcccggctc

SEQ ID NO: 347770 - DNA, 20 bp, Artificial
  CRISPR gRNA sequence
cggctctggtatgtgccccc

SEQ ID NO: 347771 - DNA, 20 bp, Artificial
  CRISPR gRNA sequence
tgcccccgagcccatgtctc

SEQ ID NO: 347772 - DNA, 20 bp, Artificial
  CRISPR gRNA sequence
cgagcccatgtctctggcca

SEQ ID NO: 347773 - DNA, 20 bp, Artificial
  CRISPR gRNA sequence
gcccatgtctctggccacgg

SEQ ID NO: 347774 - DNA, 20 bp, Artificial
  CRISPR gRNA sequence
cccatgtctctggccacggt

SEQ ID NO: 347775 - DNA, 20 bp, Artificial
  CRISPR gRNA sequence
tgtctctggccacggtgggc

SEQ ID NO: 347776 - DNA, 20 bp, Artificial
  CRISPR gRNA sequence
ggtgggccagccacgtctct

SEQ ID NO: 347777 - DNA, 20 bp, Artificial
  CRISPR gRNA sequence
tctcagacccaccccctgtg

SEQ ID NO: 347778 - DNA, 20 bp, Artificial
  CRISPR gRNA sequence
cccctgtgcagtgtgactgt

SEQ ID NO: 347779 - DNA, 20 bp, Artificial
  CRISPR gRNA sequence
ccctgtgcagtgtgactgtg

SEQ ID NO: 347780 - DNA, 20 bp, Artificial
  CRISPR gRNA sequence
cctgtgcagtgtgactgtga

SEQ ID NO: 347781 - DNA, 20 bp, Artificial
  CRISPR gRNA sequence
gtgtgactgtgagggtcccc

SEQ ID NO: 347782 - DNA, 20 bp, Artificial
  CRISPR gRNA sequence
tgtgactgtgagggtccccc

SEQ ID NO: 347783 - DNA, 20 bp, Artificial
  CRISPR gRNA sequence
gtgactgtgagggtccccca

SEQ ID NO: 347784 - DNA, 20 bp, Artificial
  CRISPR gRNA sequence
tgtgagggtcccccagggtg

SEQ ID NO: 347785 - DNA, 20 bp, Artificial
  CRISPR gRNA sequence
tgagggtcccccagggtgaa

SEQ ID NO: 347786 - DNA, 20 bp, Artificial
  CRISPR gRNA sequence
tcccccagggtgaagagtcc

SEQ ID NO: 347787 - DNA, 20 bp, Artificial
  CRISPR gRNA sequence
gggtgaagagtccaagctgc

SEQ ID NO: 347788 - DNA, 20 bp, Artificial
  CRISPR gRNA sequence
aagagtccaagctgctggcc

SEQ ID NO: 347789 - DNA, 20 bp, Artificial
  CRISPR gRNA sequence
agagtccaagctgctggcct

SEQ ID NO: 347790 - DNA, 20 bp, Artificial
  CRISPR gRNA sequence
gagtccaagctgctggcctg

SEQ ID NO: 347791 - DNA, 20 bp, Artificial
  CRISPR gRNA sequence
agtccaagctgctggcctgg

SEQ ID NO: 347792 - DNA, 20 bp, Artificial
  CRISPR gRNA sequence
gccctcactgtctgcacacc

SEQ ID NO: 347793 - DNA, 20 bp, Artificial
  CRISPR gRNA sequence
actgtctgcacacctagccc

SEQ ID NO: 347794 - DNA, 20 bp, Artificial
  CRISPR gRNA sequence
ctgtctgcacacctagcccc

SEQ ID NO: 347795 - DNA, 20 bp, Artificial
  CRISPR gRNA sequence
tgtctgcacacctagcccca

SEQ ID NO: 347796 - DNA, 20 bp, Artificial
  CRISPR gRNA sequence
ccagggcttcatcacaccca

SEQ ID NO: 347797 - DNA, 20 bp, Artificial
  CRISPR gRNA sequence
cttcatcacacccatggctg

SEQ ID NO: 347798 - DNA, 20 bp, Artificial
  CRISPR gRNA sequence
ttcatcacacccatggctgt

SEQ ID NO: 347799 - DNA, 20 bp, Artificial
  CRISPR gRNA sequence
tcatcacacccatggctgtg

SEQ ID NO: 347800 - DNA, 20 bp, Artificial
  CRISPR gRNA sequence
catcacacccatggctgtgg

SEQ ID NO: 347801 - DNA, 20 bp, Artificial
  CRISPR gRNA sequence
cacacccatggctgtggggg

SEQ ID NO: 347802 - DNA, 20 bp, Artificial
  CRISPR gRNA sequence
cacccatggctgtgggggca

SEQ ID NO: 347803 - DNA, 20 bp, Artificial
  CRISPR gRNA sequence
ggctgtgggggcagagaaca

SEQ ID NO: 347804 - DNA, 20 bp, Artificial
  CRISPR gRNA sequence
gctgtgggggcagagaacac

SEQ ID NO: 347805 - DNA, 20 bp, Artificial
  CRISPR gRNA sequence
ctgtgggggcagagaacaca

SEQ ID NO: 347806 - DNA, 20 bp, Artificial
  CRISPR gRNA sequence
tgtgggggcagagaacacag

SEQ ID NO: 347807 - DNA, 20 bp, Artificial
  CRISPR gRNA sequence
gcagagaacacaggggtgtc

SEQ ID NO: 347808 - DNA, 20 bp, Artificial
  CRISPR gRNA sequence
cagagaacacaggggtgtct

SEQ ID NO: 347809 - DNA, 20 bp, Artificial
  CRISPR gRNA sequence
agagaacacaggggtgtctg

SEQ ID NO: 347810 - DNA, 20 bp, Artificial
  CRISPR gRNA sequence
gaacacaggggtgtctgggg

SEQ ID NO: 347811 - DNA, 20 bp, Artificial
  CRISPR gRNA sequence
cacaggggtgtctggggcag

SEQ ID NO: 347812 - DNA, 20 bp, Artificial
  CRISPR gRNA sequence
acaggggtgtctggggcaga

SEQ ID NO: 347813 - DNA, 20 bp, Artificial
  CRISPR gRNA sequence
caggggtgtctggggcagaa

SEQ ID NO: 347814 - DNA, 20 bp, Artificial
  CRISPR gRNA sequence
aggggtgtctggggcagaag

SEQ ID NO: 347815 - DNA, 20 bp, Artificial
  CRISPR gRNA sequence
ggggtgtctggggcagaagg

SEQ ID NO: 347816 - DNA, 20 bp, Artificial
  CRISPR gRNA sequence
tgtctggggcagaagggggc

SEQ ID NO: 347817 - DNA, 20 bp, Artificial
  CRISPR gRNA sequence
tctggggcagaagggggcaa

SEQ ID NO: 347818 - DNA, 20 bp, Artificial
  CRISPR gRNA sequence
ggggcaagagtgtctgccct

SEQ ID NO: 347819 - DNA, 20 bp, Artificial
  CRISPR gRNA sequence
gagtgtctgccctcggccca

SEQ ID NO: 347820 - DNA, 20 bp, Artificial
  CRISPR gRNA sequence
gtgtctgccctcggcccaca

SEQ ID NO: 347821 - DNA, 20 bp, Artificial
  CRISPR gRNA sequence
ctgccctcggcccacagagc

SEQ ID NO: 347822 - DNA, 20 bp, Artificial
  CRISPR gRNA sequence
cccacagagctggcccgcca

SEQ ID NO: 347823 - DNA, 20 bp, Artificial
  CRISPR gRNA sequence
ccacagagctggcccgccaa

SEQ ID NO: 347824 - DNA, 20 bp, Artificial
  CRISPR gRNA sequence
cacagagctggcccgccaaa

SEQ ID NO: 347825 - DNA, 20 bp, Artificial
  CRISPR gRNA sequence
gccaaagggctgcacctacc

SEQ ID NO: 347826 - DNA, 20 bp, Artificial
  CRISPR gRNA sequence
gcacctacctggactgcact

SEQ ID NO: 347827 - DNA, 20 bp, Artificial
  CRISPR gRNA sequence
cacctacctggactgcactt

SEQ ID NO: 347828 - DNA, 20 bp, Artificial
  CRISPR gRNA sequence
acctacctggactgcacttg

SEQ ID NO: 347829 - DNA, 20 bp, Artificial
  CRISPR gRNA sequence
tacctggactgcacttgggg

SEQ ID NO: 347830 - DNA, 20 bp, Artificial
  CRISPR gRNA sequence
actgcacttggggcagcact

SEQ ID NO: 347831 - DNA, 20 bp, Artificial
  CRISPR gRNA sequence
tgcacttggggcagcactcg

SEQ ID NO: 347832 - DNA, 20 bp, Artificial
  CRISPR gRNA sequence
gggcagcactcggagcccac

SEQ ID NO: 347833 - DNA, 20 bp, Artificial
  CRISPR gRNA sequence
ggcagcactcggagcccact

SEQ ID NO: 347834 - DNA, 20 bp, Artificial
  CRISPR gRNA sequence
ctgggtactcgtcctccttg

SEQ ID NO: 347835 - DNA, 20 bp, Artificial
  CRISPR gRNA sequence
tgggtactcgtcctccttgc

SEQ ID NO: 347836 - DNA, 20 bp, Artificial
  CRISPR gRNA sequence
tactcgtcctccttgcagga

SEQ ID NO: 347837 - DNA, 20 bp, Artificial
  CRISPR gRNA sequence
tcgtcctccttgcaggacgg

SEQ ID NO: 347838 - DNA, 20 bp, Artificial
  CRISPR gRNA sequence
gtcctccttgcaggacggca

SEQ ID NO: 347839 - DNA, 20 bp, Artificial
  CRISPR gRNA sequence
tccttgcaggacggcagagc

SEQ ID NO: 347840 - DNA, 20 bp, Artificial
  CRISPR gRNA sequence
ccttgcaggacggcagagct

SEQ ID NO: 347841 - DNA, 20 bp, Artificial
  CRISPR gRNA sequence
cttgcaggacggcagagctg

SEQ ID NO: 347842 - DNA, 20 bp, Artificial
  CRISPR gRNA sequence
aggacggcagagctggggcg

SEQ ID NO: 347843 - DNA, 20 bp, Artificial
  CRISPR gRNA sequence
acggcagagctggggcgtag

SEQ ID NO: 347844 - DNA, 20 bp, Artificial
  CRISPR gRNA sequence
cggcagagctggggcgtagc

SEQ ID NO: 347845 - DNA, 20 bp, Artificial
  CRISPR gRNA sequence
ggcagagctggggcgtagca

SEQ ID NO: 347846 - DNA, 20 bp, Artificial
  CRISPR gRNA sequence
gcagagctggggcgtagcag

SEQ ID NO: 347847 - DNA, 20 bp, Artificial
  CRISPR gRNA sequence
cagagctggggcgtagcagg

SEQ ID NO: 347848 - DNA, 20 bp, Artificial
  CRISPR gRNA sequence
ggggcgtagcagggggctcc

SEQ ID NO: 347849 - DNA, 20 bp, Artificial
  CRISPR gRNA sequence
gggcgtagcagggggctccc

SEQ ID NO: 347850 - DNA, 20 bp, Artificial
  CRISPR gRNA sequence
cgtagcagggggctcccagg

SEQ ID NO: 347851 - DNA, 20 bp, Artificial
  CRISPR gRNA sequence
gtagcagggggctcccagga

SEQ ID NO: 347852 - DNA, 20 bp, Artificial
  CRISPR gRNA sequence
cagggggctcccaggaaggt

SEQ ID NO: 347853 - DNA, 20 bp, Artificial
  CRISPR gRNA sequence
gctcccaggaaggtgagata

SEQ ID NO: 347854 - DNA, 20 bp, Artificial
  CRISPR gRNA sequence
gaaggtgagatacagcacct

SEQ ID NO: 347855 - DNA, 20 bp, Artificial
  CRISPR gRNA sequence
aaggtgagatacagcaccta

SEQ ID NO: 347856 - DNA, 20 bp, Artificial
  CRISPR gRNA sequence
aggtgagatacagcacctaa

SEQ ID NO: 347857 - DNA, 20 bp, Artificial
  CRISPR gRNA sequence
ggtgagatacagcacctaag

SEQ ID NO: 347858 - DNA, 20 bp, Artificial
  CRISPR gRNA sequence
gtgagatacagcacctaagg

SEQ ID NO: 347859 - DNA, 20 bp, Artificial
  CRISPR gRNA sequence
gatacagcacctaagggggt

SEQ ID NO: 347860 - DNA, 20 bp, Artificial
  CRISPR gRNA sequence
atacagcacctaagggggtc

SEQ ID NO: 347861 - DNA, 20 bp, Artificial
  CRISPR gRNA sequence
agcacctaagggggtcagga

SEQ ID NO: 347862 - DNA, 20 bp, Artificial
  CRISPR gRNA sequence
gcacctaagggggtcaggac

SEQ ID NO: 347863 - DNA, 20 bp, Artificial
  CRISPR gRNA sequence
aagggggtcaggacaggcat

SEQ ID NO: 347864 - DNA, 20 bp, Artificial
  CRISPR gRNA sequence
agggggtcaggacaggcatt

SEQ ID NO: 347865 - DNA, 20 bp, Artificial
  CRISPR gRNA sequence
ggggtcaggacaggcattgg

SEQ ID NO: 347866 - DNA, 20 bp, Artificial
  CRISPR gRNA sequence
acaggcattgggagatgccc

SEQ ID NO: 347867 - DNA, 20 bp, Artificial
  CRISPR gRNA sequence
gagatgccctggctgccctg

SEQ ID NO: 347868 - DNA, 20 bp, Artificial
  CRISPR gRNA sequence
agatgccctggctgccctgt

SEQ ID NO: 347869 - DNA, 20 bp, Artificial
  CRISPR gRNA sequence
ggctgccctgtgggctctgc

SEQ ID NO: 347870 - DNA, 20 bp, Artificial
  CRISPR gRNA sequence
gctgccctgtgggctctgcc

SEQ ID NO: 347871 - DNA, 20 bp, Artificial
  CRISPR gRNA sequence
cctgtgggctctgccaggct

SEQ ID NO: 347872 - DNA, 20 bp, Artificial
  CRISPR gRNA sequence
ctctgccaggcttggcccca

SEQ ID NO: 347873 - DNA, 20 bp, Artificial
  CRISPR gRNA sequence
ctgaatctccctctgtgcaa

SEQ ID NO: 347874 - DNA, 20 bp, Artificial
  CRISPR gRNA sequence
tgaatctccctctgtgcaat

SEQ ID NO: 347875 - DNA, 20 bp, Artificial
  CRISPR gRNA sequence
gaatctccctctgtgcaatg

SEQ ID NO: 347876 - DNA, 20 bp, Artificial
  CRISPR gRNA sequence
atctccctctgtgcaatggg

SEQ ID NO: 347877 - DNA, 20 bp, Artificial
  CRISPR gRNA sequence
tctccctctgtgcaatgggg

SEQ ID NO: 347878 - DNA, 20 bp, Artificial
  CRISPR gRNA sequence
tccctctgtgcaatggggag

SEQ ID NO: 347879 - DNA, 20 bp, Artificial
  CRISPR gRNA sequence
ctctgtgcaatggggaggag

SEQ ID NO: 347880 - DNA, 20 bp, Artificial
  CRISPR gRNA sequence
tgtgcaatggggaggagcgg

SEQ ID NO: 347881 - DNA, 20 bp, Artificial
  CRISPR gRNA sequence
tggggaggagcggcagtgcc

SEQ ID NO: 347882 - DNA, 20 bp, Artificial
  CRISPR gRNA sequence
ggaggagcggcagtgcctgg

SEQ ID NO: 347883 - DNA, 20 bp, Artificial
  CRISPR gRNA sequence
aggagcggcagtgcctggta

SEQ ID NO: 347884 - DNA, 20 bp, Artificial
  CRISPR gRNA sequence
gagcggcagtgcctggtaga

SEQ ID NO: 347885 - DNA, 20 bp, Artificial
  CRISPR gRNA sequence
agcggcagtgcctggtagag

SEQ ID NO: 347886 - DNA, 20 bp, Artificial
  CRISPR gRNA sequence
gcagtgcctggtagagagga

SEQ ID NO: 347887 - DNA, 20 bp, Artificial
  CRISPR gRNA sequence
gtgcctggtagagaggacag

SEQ ID NO: 347888 - DNA, 20 bp, Artificial
  CRISPR gRNA sequence
cctggtagagaggacagaag

SEQ ID NO: 347889 - DNA, 20 bp, Artificial
  CRISPR gRNA sequence
ctggtagagaggacagaagc

SEQ ID NO: 347890 - DNA, 20 bp, Artificial
  CRISPR gRNA sequence
gagaggacagaagcgggccc

SEQ ID NO: 347891 - DNA, 20 bp, Artificial
  CRISPR gRNA sequence
agaggacagaagcgggcccc

SEQ ID NO: 347892 - DNA, 20 bp, Artificial
  CRISPR gRNA sequence
gacagaagcgggccccaggc

SEQ ID NO: 347893 - DNA, 20 bp, Artificial
  CRISPR gRNA sequence
acagaagcgggccccaggcc

SEQ ID NO: 347894 - DNA, 20 bp, Artificial
  CRISPR gRNA sequence
cgggccccaggccaggctca

SEQ ID NO: 347895 - DNA, 20 bp, Artificial
  CRISPR gRNA sequence
ggaacaaccttgccgaccgc

SEQ ID NO: 347896 - DNA, 20 bp, Artificial
  CRISPR gRNA sequence
aacaaccttgccgaccgctg

SEQ ID NO: 347897 - DNA, 20 bp, Artificial
  CRISPR gRNA sequence
ccttgccgaccgctggagcc

SEQ ID NO: 347898 - DNA, 20 bp, Artificial
  CRISPR gRNA sequence
cttgccgaccgctggagccc

SEQ ID NO: 347899 - DNA, 20 bp, Artificial
  CRISPR gRNA sequence
ccgaccgctggagcccggga

SEQ ID NO: 347900 - DNA, 20 bp, Artificial
  CRISPR gRNA sequence
cgaccgctggagcccgggat

SEQ ID NO: 347901 - DNA, 20 bp, Artificial
  CRISPR gRNA sequence
gaccgctggagcccgggata

SEQ ID NO: 347902 - DNA, 20 bp, Artificial
  CRISPR gRNA sequence
cgctggagcccgggataggg

SEQ ID NO: 347903 - DNA, 20 bp, Artificial
  CRISPR gRNA sequence
gctggagcccgggatagggt

SEQ ID NO: 347904 - DNA, 20 bp, Artificial
  CRISPR gRNA sequence
ctggagcccgggatagggtg

SEQ ID NO: 347905 - DNA, 20 bp, Artificial
  CRISPR gRNA sequence
ggtggggaccgcccctcctc

SEQ ID NO: 347906 - DNA, 20 bp, Artificial
  CRISPR gRNA sequence
ccagccctgatgacgctgcc

SEQ ID NO: 347907 - DNA, 20 bp, Artificial
  CRISPR gRNA sequence
gccctgatgacgctgcctgg

SEQ ID NO: 347908 - DNA, 20 bp, Artificial
  CRISPR gRNA sequence
gatgacgctgcctggcagcg

SEQ ID NO: 347909 - DNA, 20 bp, Artificial
  CRISPR gRNA sequence
tgacgctgcctggcagcgcg

SEQ ID NO: 347910 - DNA, 20 bp, Artificial
  CRISPR gRNA sequence
tgcctggcagcgcggagccc

SEQ ID NO: 347911 - DNA, 20 bp, Artificial
  CRISPR gRNA sequence
gcctggcagcgcggagccct

SEQ ID NO: 347912 - DNA, 20 bp, Artificial
  CRISPR gRNA sequence
cagcgcggagccctgggaac

SEQ ID NO: 347913 - DNA, 20 bp, Artificial
  CRISPR gRNA sequence
aactggaactctgccctcgc

SEQ ID NO: 347914 - DNA, 20 bp, Artificial
  CRISPR gRNA sequence
actggaactctgccctcgcc

SEQ ID NO: 347915 - DNA, 20 bp, Artificial
  CRISPR gRNA sequence
ctggaactctgccctcgcca

SEQ ID NO: 347916 - DNA, 20 bp, Artificial
  CRISPR gRNA sequence
gggaccccacaccccacacc

SEQ ID NO: 347917 - DNA, 20 bp, Artificial
  CRISPR gRNA sequence
ggaccccacaccccacacct

SEQ ID NO: 347918 - DNA, 20 bp, Artificial
  CRISPR gRNA sequence
accccacaccccacacctgg

SEQ ID NO: 347919 - DNA, 20 bp, Artificial
  CRISPR gRNA sequence
accccacacctgggagcatt

SEQ ID NO: 347920 - DNA, 20 bp, Artificial
  CRISPR gRNA sequence
cctgggagcattgagcccac

SEQ ID NO: 347921 - DNA, 20 bp, Artificial
  CRISPR gRNA sequence
ctgggagcattgagcccact

SEQ ID NO: 347922 - DNA, 20 bp, Artificial
  CRISPR gRNA sequence
ggagcattgagcccactggg

SEQ ID NO: 347923 - DNA, 20 bp, Artificial
  CRISPR gRNA sequence
ccactgggcagacaacctgc

SEQ ID NO: 347924 - DNA, 20 bp, Artificial
  CRISPR gRNA sequence
caacctgccggcccccctgc

SEQ ID NO: 347925 - DNA, 20 bp, Artificial
  CRISPR gRNA sequence
tgccggcccccctgctggcc

SEQ ID NO: 347926 - DNA, 20 bp, Artificial
  CRISPR gRNA sequence
gccggcccccctgctggcct

SEQ ID NO: 347927 - DNA, 20 bp, Artificial
  CRISPR gRNA sequence
gcccccctgctggcctaggt

SEQ ID NO: 347928 - DNA, 20 bp, Artificial
  CRISPR gRNA sequence
gttggacctgctgacccctg

SEQ ID NO: 347929 - DNA, 20 bp, Artificial
  CRISPR gRNA sequence
tggacctgctgacccctgaa

SEQ ID NO: 347930 - DNA, 20 bp, Artificial
  CRISPR gRNA sequence
cctgctgacccctgaagagc

SEQ ID NO: 347931 - DNA, 20 bp, Artificial
  CRISPR gRNA sequence
gctgacccctgaagagccag

SEQ ID NO: 347932 - DNA, 20 bp, Artificial
  CRISPR gRNA sequence
ctgacccctgaagagccagc

SEQ ID NO: 347933 - DNA, 20 bp, Artificial
  CRISPR gRNA sequence
tgacccctgaagagccagca

SEQ ID NO: 347934 - DNA, 20 bp, Artificial
  CRISPR gRNA sequence
gacccctgaagagccagcag

SEQ ID NO: 347935 - DNA, 20 bp, Artificial
  CRISPR gRNA sequence
ccctgaagagccagcagggg

SEQ ID NO: 347936 - DNA, 20 bp, Artificial
  CRISPR gRNA sequence
gaagagccagcaggggcagc

SEQ ID NO: 347937 - DNA, 20 bp, Artificial
  CRISPR gRNA sequence
aagagccagcaggggcagcc

SEQ ID NO: 347938 - DNA, 20 bp, Artificial
  CRISPR gRNA sequence
agagccagcaggggcagcca

SEQ ID NO: 347939 - DNA, 20 bp, Artificial
  CRISPR gRNA sequence
ccagcaggggcagccaggga

SEQ ID NO: 347940 - DNA, 20 bp, Artificial
  CRISPR gRNA sequence
cagcaggggcagccagggat

SEQ ID NO: 347941 - DNA, 20 bp, Artificial
  CRISPR gRNA sequence
gggcagccagggatgggccc

SEQ ID NO: 347942 - DNA, 20 bp, Artificial
  CRISPR gRNA sequence
gcagccagggatgggcccca

SEQ ID NO: 347943 - DNA, 20 bp, Artificial
  CRISPR gRNA sequence
cagccagggatgggccccag

SEQ ID NO: 347944 - DNA, 20 bp, Artificial
  CRISPR gRNA sequence
gatgggccccagaggctcac

SEQ ID NO: 347945 - DNA, 20 bp, Artificial
  CRISPR gRNA sequence
ggccccagaggctcacaagc

SEQ ID NO: 347946 - DNA, 20 bp, Artificial
  CRISPR gRNA sequence
ccagaggctcacaagccaga

SEQ ID NO: 347947 - DNA, 20 bp, Artificial
  CRISPR gRNA sequence
gaggctcacaagccagacag

SEQ ID NO: 347948 - DNA, 20 bp, Artificial
  CRISPR gRNA sequence
aggctcacaagccagacagt

SEQ ID NO: 347949 - DNA, 20 bp, Artificial
  CRISPR gRNA sequence
acaagccagacagtgggtga

SEQ ID NO: 347950 - DNA, 20 bp, Artificial
  CRISPR gRNA sequence
caagccagacagtgggtgac

SEQ ID NO: 347951 - DNA, 20 bp, Artificial
  CRISPR gRNA sequence
acagtgggtgacaggctgat

SEQ ID NO: 347952 - DNA, 20 bp, Artificial
  CRISPR gRNA sequence
cagtgggtgacaggctgatc

SEQ ID NO: 347953 - DNA, 20 bp, Artificial
  CRISPR gRNA sequence
agtgggtgacaggctgatca

SEQ ID NO: 347954 - DNA, 20 bp, Artificial
  CRISPR gRNA sequence
caggctgatcagggccacat

SEQ ID NO: 347955 - DNA, 20 bp, Artificial
  CRISPR gRNA sequence
aggctgatcagggccacatc

SEQ ID NO: 347956 - DNA, 20 bp, Artificial
  CRISPR gRNA sequence
ggctgatcagggccacatcg

SEQ ID NO: 347957 - DNA, 20 bp, Artificial
  CRISPR gRNA sequence
ctgatcagggccacatcggg

SEQ ID NO: 347958 - DNA, 20 bp, Artificial
  CRISPR gRNA sequence
tgatcagggccacatcgggg

SEQ ID NO: 347959 - DNA, 20 bp, Artificial
  CRISPR gRNA sequence
gatcagggccacatcgggga

SEQ ID NO: 347960 - DNA, 20 bp, Artificial
  CRISPR gRNA sequence
cagggccacatcggggaggg

SEQ ID NO: 347961 - DNA, 20 bp, Artificial
  CRISPR gRNA sequence
cggggagggtggctctgccg

SEQ ID NO: 347962 - DNA, 20 bp, Artificial
  CRISPR gRNA sequence
ctctgccgtggcctcgttcc

SEQ ID NO: 347963 - DNA, 20 bp, Artificial
  CRISPR gRNA sequence
tctgccgtggcctcgttcct

SEQ ID NO: 347964 - DNA, 20 bp, Artificial
  CRISPR gRNA sequence
ccgtggcctcgttcctgggc

SEQ ID NO: 347965 - DNA, 20 bp, Artificial
  CRISPR gRNA sequence
ctcgttcctgggctggctga

SEQ ID NO: 347966 - DNA, 20 bp, Artificial
  CRISPR gRNA sequence
tcgttcctgggctggctgat

SEQ ID NO: 347967 - DNA, 20 bp, Artificial
  CRISPR gRNA sequence
ttcctgggctggctgatggg

SEQ ID NO: 347968 - DNA, 20 bp, Artificial
  CRISPR gRNA sequence
tgggctggctgatgggcagt

SEQ ID NO: 347969 - DNA, 20 bp, Artificial
  CRISPR gRNA sequence
gggctggctgatgggcagtc

SEQ ID NO: 347970 - DNA, 20 bp, Artificial
  CRISPR gRNA sequence
ggctggctgatgggcagtcg

SEQ ID NO: 347971 - DNA, 20 bp, Artificial
  CRISPR gRNA sequence
gctggctgatgggcagtcgg

SEQ ID NO: 347972 - DNA, 20 bp, Artificial
  CRISPR gRNA sequence
gggcagtcgggggcccctga

SEQ ID NO: 347973 - DNA, 20 bp, Artificial
  CRISPR gRNA sequence
ggcagtcgggggcccctgat

SEQ ID NO: 347974 - DNA, 20 bp, Artificial
  CRISPR gRNA sequence
gcagtcgggggcccctgatg

SEQ ID NO: 347975 - DNA, 20 bp, Artificial
  CRISPR gRNA sequence
tcgggggcccctgatgggga

SEQ ID NO: 347976 - DNA, 20 bp, Artificial
  CRISPR gRNA sequence
ggggcccctgatggggatag

SEQ ID NO: 347977 - DNA, 20 bp, Artificial
  CRISPR gRNA sequence
cccctgatggggatagtggc

SEQ ID NO: 347978 - DNA, 20 bp, Artificial
  CRISPR gRNA sequence
tgatggggatagtggctgga

SEQ ID NO: 347979 - DNA, 20 bp, Artificial
  CRISPR gRNA sequence
gatggggatagtggctggac

SEQ ID NO: 347980 - DNA, 20 bp, Artificial
  CRISPR gRNA sequence
ggggatagtggctggacagg

SEQ ID NO: 347981 - DNA, 20 bp, Artificial
  CRISPR gRNA sequence
gggatagtggctggacaggc

SEQ ID NO: 347982 - DNA, 20 bp, Artificial
  CRISPR gRNA sequence
gatagtggctggacaggcag

SEQ ID NO: 347983 - DNA, 20 bp, Artificial
  CRISPR gRNA sequence
gacaggcaggagtgccacat

SEQ ID NO: 347984 - DNA, 20 bp, Artificial
  CRISPR gRNA sequence
gcaggagtgccacatgagca

SEQ ID NO: 347985 - DNA, 20 bp, Artificial
  CRISPR gRNA sequence
aggagtgccacatgagcatg

SEQ ID NO: 347986 - DNA, 20 bp, Artificial
  CRISPR gRNA sequence
gagtgccacatgagcatgga

SEQ ID NO: 347987 - DNA, 20 bp, Artificial
  CRISPR gRNA sequence
gtatccccaccccacccacc

SEQ ID NO: 347988 - DNA, 20 bp, Artificial
  CRISPR gRNA sequence
tatccccaccccacccacct

SEQ ID NO: 347989 - DNA, 20 bp, Artificial
  CRISPR gRNA sequence
ccaccccacccacctgggtc

SEQ ID NO: 347990 - DNA, 20 bp, Artificial
  CRISPR gRNA sequence
tgatcttatcacctgtcacc

SEQ ID NO: 347991 - DNA, 20 bp, Artificial
  CRISPR gRNA sequence
gatcttatcacctgtcacca

SEQ ID NO: 347992 - DNA, 20 bp, Artificial
  CRISPR gRNA sequence
ttatcacctgtcaccaaggt

SEQ ID NO: 347993 - DNA, 20 bp, Artificial
  CRISPR gRNA sequence
tatcacctgtcaccaaggtc

SEQ ID NO: 347994 - DNA, 20 bp, Artificial
  CRISPR gRNA sequence
atcacctgtcaccaaggtca

SEQ ID NO: 347995 - DNA, 20 bp, Artificial
  CRISPR gRNA sequence
gtcaccaaggtcagggctgc

SEQ ID NO: 347996 - DNA, 20 bp, Artificial
  CRISPR gRNA sequence
tcaccaaggtcagggctgcc

SEQ ID NO: 347997 - DNA, 20 bp, Artificial
  CRISPR gRNA sequence
caccaaggtcagggctgccg

SEQ ID NO: 347998 - DNA, 20 bp, Artificial
  CRISPR gRNA sequence
ccaaggtcagggctgccggg

SEQ ID NO: 347999 - DNA, 20 bp, Artificial
  CRISPR gRNA sequence
ggtcagggctgccggggagt

SEQ ID NO: 348000 - DNA, 20 bp, Artificial
  CRISPR gRNA sequence
gtcagggctgccggggagtt

SEQ ID NO: 348001 - DNA, 20 bp, Artificial
  CRISPR gRNA sequence
gggagttgggtcacctgctc

SEQ ID NO: 348002 - DNA, 20 bp, Artificial
  CRISPR gRNA sequence
ggagttgggtcacctgctcg

SEQ ID NO: 348003 - DNA, 20 bp, Artificial
  CRISPR gRNA sequence
gagttgggtcacctgctcga

SEQ ID NO: 348004 - DNA, 20 bp, Artificial
  CRISPR gRNA sequence
acctgctcgagggccccgcc

SEQ ID NO: 348005 - DNA, 20 bp, Artificial
  CRISPR gRNA sequence
ctgctcgagggccccgccca

SEQ ID NO: 348006 - DNA, 20 bp, Artificial
  CRISPR gRNA sequence
gggccccgcccagagacgcc

SEQ ID NO: 348007 - DNA, 20 bp, Artificial
  CRISPR gRNA sequence
gccccgcccagagacgccca

SEQ ID NO: 348008 - DNA, 20 bp, Artificial
  CRISPR gRNA sequence
cagagacgcccagagacacc

SEQ ID NO: 348009 - DNA, 20 bp, Artificial
  CRISPR gRNA sequence
gcccagagacacccagcccc

SEQ ID NO: 348010 - DNA, 20 bp, Artificial
  CRISPR gRNA sequence
cagagacacccagcccccag

SEQ ID NO: 348011 - DNA, 20 bp, Artificial
  CRISPR gRNA sequence
cccccagaagtgcccacatc

SEQ ID NO: 348012 - DNA, 20 bp, Artificial
  CRISPR gRNA sequence
agtgcccacatccggccaaa

SEQ ID NO: 348013 - DNA, 20 bp, Artificial
  CRISPR gRNA sequence
gtgcccacatccggccaaat

SEQ ID NO: 348014 - DNA, 20 bp, Artificial
  CRISPR gRNA sequence
tgcccacatccggccaaatg

SEQ ID NO: 348015 - DNA, 20 bp, Artificial
  CRISPR gRNA sequence
gcccacatccggccaaatgg

SEQ ID NO: 348016 - DNA, 20 bp, Artificial
  CRISPR gRNA sequence
ccggccaaatgggggctcac

SEQ ID NO: 348017 - DNA, 20 bp, Artificial
  CRISPR gRNA sequence
gggggctcaccagctgcccg

SEQ ID NO: 348018 - DNA, 20 bp, Artificial
  CRISPR gRNA sequence
gctcaccagctgcccgtgga

SEQ ID NO: 348019 - DNA, 20 bp, Artificial
  CRISPR gRNA sequence
tcaccagctgcccgtggacg

SEQ ID NO: 348020 - DNA, 20 bp, Artificial
  CRISPR gRNA sequence
ccagctgcccgtggacggag

SEQ ID NO: 348021 - DNA, 20 bp, Artificial
  CRISPR gRNA sequence
ctgcccgtggacggagtggt

SEQ ID NO: 348022 - DNA, 20 bp, Artificial
  CRISPR gRNA sequence
cccgtggacggagtggtgag

SEQ ID NO: 348023 - DNA, 20 bp, Artificial
  CRISPR gRNA sequence
ccgtggacggagtggtgagt

SEQ ID NO: 348024 - DNA, 20 bp, Artificial
  CRISPR gRNA sequence
cgtggacggagtggtgagtg

SEQ ID NO: 348025 - DNA, 20 bp, Artificial
  CRISPR gRNA sequence
gtggacggagtggtgagtgg

SEQ ID NO: 348026 - DNA, 20 bp, Artificial
  CRISPR gRNA sequence
tggtgagtgggggacacacg

SEQ ID NO: 348027 - DNA, 20 bp, Artificial
  CRISPR gRNA sequence
ggtgagtgggggacacacgc

SEQ ID NO: 348028 - DNA, 20 bp, Artificial
  CRISPR gRNA sequence
tgagtgggggacacacgcag

SEQ ID NO: 348029 - DNA, 20 bp, Artificial
  CRISPR gRNA sequence
gagtgggggacacacgcagg

SEQ ID NO: 348030 - DNA, 20 bp, Artificial
  CRISPR gRNA sequence
gtgggggacacacgcaggag

SEQ ID NO: 348031 - DNA, 20 bp, Artificial
  CRISPR gRNA sequence
tgggggacacacgcaggagg

SEQ ID NO: 348032 - DNA, 20 bp, Artificial
  CRISPR gRNA sequence
acacgcaggaggaggtctgc

SEQ ID NO: 348033 - DNA, 20 bp, Artificial
  CRISPR gRNA sequence
cacgcaggaggaggtctgct

SEQ ID NO: 348034 - DNA, 20 bp, Artificial
  CRISPR gRNA sequence
gcaggaggaggtctgctggg

SEQ ID NO: 348035 - DNA, 20 bp, Artificial
  CRISPR gRNA sequence
caggaggaggtctgctgggt

SEQ ID NO: 348036 - DNA, 20 bp, Artificial
  CRISPR gRNA sequence
aggaggaggtctgctgggta

SEQ ID NO: 348037 - DNA, 20 bp, Artificial
  CRISPR gRNA sequence
aggtctgctgggtagggctg

SEQ ID NO: 348038 - DNA, 20 bp, Artificial
  CRISPR gRNA sequence
ctctgctgctcaccccactg

SEQ ID NO: 348039 - DNA, 20 bp, Artificial
  CRISPR gRNA sequence
gctgctcaccccactgtggt

SEQ ID NO: 348040 - DNA, 20 bp, Artificial
  CRISPR gRNA sequence
tcaccccactgtggtgagcc

SEQ ID NO: 348041 - DNA, 20 bp, Artificial
  CRISPR gRNA sequence
cactgtggtgagcccagtgc

SEQ ID NO: 348042 - DNA, 20 bp, Artificial
  CRISPR gRNA sequence
actgtggtgagcccagtgct

SEQ ID NO: 348043 - DNA, 20 bp, Artificial
  CRISPR gRNA sequence
ctgtggtgagcccagtgctg

SEQ ID NO: 348044 - DNA, 20 bp, Artificial
  CRISPR gRNA sequence
tgtggtgagcccagtgctgg

SEQ ID NO: 348045 - DNA, 20 bp, Artificial
  CRISPR gRNA sequence
tgagcccagtgctgggggtc

SEQ ID NO: 348046 - DNA, 20 bp, Artificial
  CRISPR gRNA sequence
gagcccagtgctgggggtct

SEQ ID NO: 348047 - DNA, 20 bp, Artificial
  CRISPR gRNA sequence
ctgggggtctgggttgaccc

SEQ ID NO: 348048 - DNA, 20 bp, Artificial
  CRISPR gRNA sequence
gggggtctgggttgacccga

SEQ ID NO: 348049 - DNA, 20 bp, Artificial
  CRISPR gRNA sequence
ctgggttgacccgagagccc

SEQ ID NO: 348050 - DNA, 20 bp, Artificial
  CRISPR gRNA sequence
tgggttgacccgagagcccc

SEQ ID NO: 348051 - DNA, 20 bp, Artificial
  CRISPR gRNA sequence
gttgacccgagagccccagg

SEQ ID NO: 348052 - DNA, 20 bp, Artificial
  CRISPR gRNA sequence
gacccgagagccccaggcag

SEQ ID NO: 348053 - DNA, 20 bp, Artificial
  CRISPR gRNA sequence
acccgagagccccaggcagc

SEQ ID NO: 348054 - DNA, 20 bp, Artificial
  CRISPR gRNA sequence
cccgagagccccaggcagca

SEQ ID NO: 348055 - DNA, 20 bp, Artificial
  CRISPR gRNA sequence
ccgagagccccaggcagcag

SEQ ID NO: 348056 - DNA, 20 bp, Artificial
  CRISPR gRNA sequence
gagccccaggcagcagggga

SEQ ID NO: 348057 - DNA, 20 bp, Artificial
  CRISPR gRNA sequence
agccccaggcagcaggggac

SEQ ID NO: 348058 - DNA, 20 bp, Artificial
  CRISPR gRNA sequence
ccaggcagcaggggacgggc

SEQ ID NO: 348059 - DNA, 20 bp, Artificial
  CRISPR gRNA sequence
gcaggggacgggctggacgc

SEQ ID NO: 348060 - DNA, 20 bp, Artificial
  CRISPR gRNA sequence
aggggacgggctggacgccg

SEQ ID NO: 348061 - DNA, 20 bp, Artificial
  CRISPR gRNA sequence
gacgggctggacgccggagc

SEQ ID NO: 348062 - DNA, 20 bp, Artificial
  CRISPR gRNA sequence
ctggacgccggagccagcaa

SEQ ID NO: 348063 - DNA, 20 bp, Artificial
  CRISPR gRNA sequence
acgccggagccagcaacggc

SEQ ID NO: 348064 - DNA, 20 bp, Artificial
  CRISPR gRNA sequence
cgccggagccagcaacggcc

SEQ ID NO: 348065 - DNA, 20 bp, Artificial
  CRISPR gRNA sequence
ggagccagcaacggccagga

SEQ ID NO: 348066 - DNA, 20 bp, Artificial
  CRISPR gRNA sequence
gagccagcaacggccaggac

SEQ ID NO: 348067 - DNA, 20 bp, Artificial
  CRISPR gRNA sequence
agccagcaacggccaggaca

SEQ ID NO: 348068 - DNA, 20 bp, Artificial
  CRISPR gRNA sequence
gccagcaacggccaggacag

SEQ ID NO: 348069 - DNA, 20 bp, Artificial
  CRISPR gRNA sequence
caacggccaggacaggggca

SEQ ID NO: 348070 - DNA, 20 bp, Artificial
  CRISPR gRNA sequence
aacggccaggacaggggcat

SEQ ID NO: 348071 - DNA, 20 bp, Artificial
  CRISPR gRNA sequence
acggccaggacaggggcatg

SEQ ID NO: 348072 - DNA, 20 bp, Artificial
  CRISPR gRNA sequence
gccaggacaggggcatgggg

SEQ ID NO: 348073 - DNA, 20 bp, Artificial
  CRISPR gRNA sequence
caggacaggggcatggggaa

SEQ ID NO: 348074 - DNA, 20 bp, Artificial
  CRISPR gRNA sequence
gggcatggggaagagatctg

SEQ ID NO: 348075 - DNA, 20 bp, Artificial
  CRISPR gRNA sequence
ggcatggggaagagatctgt

SEQ ID NO: 348076 - DNA, 20 bp, Artificial
  CRISPR gRNA sequence
catggggaagagatctgtgg

SEQ ID NO: 348077 - DNA, 20 bp, Artificial
  CRISPR gRNA sequence
atggggaagagatctgtggg

SEQ ID NO: 348078 - DNA, 20 bp, Artificial
  CRISPR gRNA sequence
aagagatctgtgggaggccc

SEQ ID NO: 348079 - DNA, 20 bp, Artificial
  CRISPR gRNA sequence
agagatctgtgggaggccct

SEQ ID NO: 348080 - DNA, 20 bp, Artificial
  CRISPR gRNA sequence
gagatctgtgggaggccctg

SEQ ID NO: 348081 - DNA, 20 bp, Artificial
  CRISPR gRNA sequence
tctgtgggaggccctggggt

SEQ ID NO: 348082 - DNA, 20 bp, Artificial
  CRISPR gRNA sequence
ggaggccctggggtcagaac

SEQ ID NO: 348083 - DNA, 20 bp, Artificial
  CRISPR gRNA sequence
gaggccctggggtcagaact

SEQ ID NO: 348084 - DNA, 20 bp, Artificial
  CRISPR gRNA sequence
gggtcagaactgggatctgc

SEQ ID NO: 348085 - DNA, 20 bp, Artificial
  CRISPR gRNA sequence
tcagaactgggatctgcgag

SEQ ID NO: 348086 - DNA, 20 bp, Artificial
  CRISPR gRNA sequence
aactgggatctgcgagcaga

SEQ ID NO: 348087 - DNA, 20 bp, Artificial
  CRISPR gRNA sequence
ctgggatctgcgagcagacg

SEQ ID NO: 348088 - DNA, 20 bp, Artificial
  CRISPR gRNA sequence
gggatctgcgagcagacgga

SEQ ID NO: 348089 - DNA, 20 bp, Artificial
  CRISPR gRNA sequence
ggatctgcgagcagacggag

SEQ ID NO: 348090 - DNA, 20 bp, Artificial
  CRISPR gRNA sequence
atctgcgagcagacggagag

SEQ ID NO: 348091 - DNA, 20 bp, Artificial
  CRISPR gRNA sequence
tctgcgagcagacggagagg

SEQ ID NO: 348092 - DNA, 20 bp, Artificial
  CRISPR gRNA sequence
gagcagacggagaggaggct

SEQ ID NO: 348093 - DNA, 20 bp, Artificial
  CRISPR gRNA sequence
agcagacggagaggaggctc

SEQ ID NO: 348094 - DNA, 20 bp, Artificial
  CRISPR gRNA sequence
gcagacggagaggaggctcg

SEQ ID NO: 348095 - DNA, 20 bp, Artificial
  CRISPR gRNA sequence
cagacggagaggaggctcgg

SEQ ID NO: 348096 - DNA, 20 bp, Artificial
  CRISPR gRNA sequence
gaggaggctcgggggctcac

SEQ ID NO: 348097 - DNA, 20 bp, Artificial
  CRISPR gRNA sequence
ctcgggggctcaccagcctc

SEQ ID NO: 348098 - DNA, 20 bp, Artificial
  CRISPR gRNA sequence
gctcaccagcctcaagacgt

SEQ ID NO: 348099 - DNA, 20 bp, Artificial
  CRISPR gRNA sequence
cagcctcaagacgtcggttt

SEQ ID NO: 348100 - DNA, 20 bp, Artificial
  CRISPR gRNA sequence
agcctcaagacgtcggtttt

SEQ ID NO: 348101 - DNA, 20 bp, Artificial
  CRISPR gRNA sequence
gcctcaagacgtcggttttg

SEQ ID NO: 348102 - DNA, 20 bp, Artificial
  CRISPR gRNA sequence
cctcaagacgtcggttttgg

SEQ ID NO: 348103 - DNA, 20 bp, Artificial
  CRISPR gRNA sequence
caagacgtcggttttggggg

SEQ ID NO: 348104 - DNA, 20 bp, Artificial
  CRISPR gRNA sequence
cggttttgggggtggatctc

SEQ ID NO: 348105 - DNA, 20 bp, Artificial
  CRISPR gRNA sequence
ggttttgggggtggatctcc

SEQ ID NO: 348106 - DNA, 20 bp, Artificial
  CRISPR gRNA sequence
gttttgggggtggatctcca

SEQ ID NO: 348107 - DNA, 20 bp, Artificial
  CRISPR gRNA sequence
tttgggggtggatctccagg

SEQ ID NO: 348108 - DNA, 20 bp, Artificial
  CRISPR gRNA sequence
ttgggggtggatctccaggg

SEQ ID NO: 348109 - DNA, 20 bp, Artificial
  CRISPR gRNA sequence
gggggtggatctccagggag

SEQ ID NO: 348110 - DNA, 20 bp, Artificial
  CRISPR gRNA sequence
ggggtggatctccagggagg

SEQ ID NO: 348111 - DNA, 20 bp, Artificial
  CRISPR gRNA sequence
atctccagggaggaggcccc

SEQ ID NO: 348112 - DNA, 20 bp, Artificial
  CRISPR gRNA sequence
gggaggaggcccccagtctc

SEQ ID NO: 348113 - DNA, 20 bp, Artificial
  CRISPR gRNA sequence
ggaggaggcccccagtctcc

SEQ ID NO: 348114 - DNA, 20 bp, Artificial
  CRISPR gRNA sequence
aggaggcccccagtctccag

SEQ ID NO: 348115 - DNA, 20 bp, Artificial
  CRISPR gRNA sequence
ggaggcccccagtctccagg

SEQ ID NO: 348116 - DNA, 20 bp, Artificial
  CRISPR gRNA sequence
cccagtctccaggaggctca

SEQ ID NO: 348117 - DNA, 20 bp, Artificial
  CRISPR gRNA sequence
ctccaggaggctcatggcct

SEQ ID NO: 348118 - DNA, 20 bp, Artificial
  CRISPR gRNA sequence
tccaggaggctcatggcctc

SEQ ID NO: 348119 - DNA, 20 bp, Artificial
  CRISPR gRNA sequence
gaggctcatggcctcaggct

SEQ ID NO: 348120 - DNA, 20 bp, Artificial
  CRISPR gRNA sequence
tcatggcctcaggctcagac

SEQ ID NO: 348121 - DNA, 20 bp, Artificial
  CRISPR gRNA sequence
tggcctcaggctcagaccgg

SEQ ID NO: 348122 - DNA, 20 bp, Artificial
  CRISPR gRNA sequence
tcaggctcagaccggcagct

SEQ ID NO: 348123 - DNA, 20 bp, Artificial
  CRISPR gRNA sequence
caggctcagaccggcagctc

SEQ ID NO: 348124 - DNA, 20 bp, Artificial
  CRISPR gRNA sequence
agaccggcagctcgggaacc

SEQ ID NO: 348125 - DNA, 20 bp, Artificial
  CRISPR gRNA sequence
cggcagctcgggaacccagc

SEQ ID NO: 348126 - DNA, 20 bp, Artificial
  CRISPR gRNA sequence
cagctcgggaacccagctag

SEQ ID NO: 348127 - DNA, 20 bp, Artificial
  CRISPR gRNA sequence
agctcgggaacccagctagc

SEQ ID NO: 348128 - DNA, 20 bp, Artificial
  CRISPR gRNA sequence
ccagctagcaggatgaactc

SEQ ID NO: 348129 - DNA, 20 bp, Artificial
  CRISPR gRNA sequence
gctagcaggatgaactccag

SEQ ID NO: 348130 - DNA, 20 bp, Artificial
  CRISPR gRNA sequence
tagcaggatgaactccagca

SEQ ID NO: 348131 - DNA, 20 bp, Artificial
  CRISPR gRNA sequence
agcaggatgaactccagcag

SEQ ID NO: 348132 - DNA, 20 bp, Artificial
  CRISPR gRNA sequence
tgaactccagcagaggaact

SEQ ID NO: 348133 - DNA, 20 bp, Artificial
  CRISPR gRNA sequence
ggaactcagcgccattgctg

SEQ ID NO: 348134 - DNA, 20 bp, Artificial
  CRISPR gRNA sequence
cagcgccattgctgcggctg

SEQ ID NO: 348135 - DNA, 20 bp, Artificial
  CRISPR gRNA sequence
agcgccattgctgcggctgt

SEQ ID NO: 348136 - DNA, 20 bp, Artificial
  CRISPR gRNA sequence
ccattgctgcggctgtgggc

SEQ ID NO: 348137 - DNA, 20 bp, Artificial
  CRISPR gRNA sequence
ttgctgcggctgtgggccag

SEQ ID NO: 348138 - DNA, 20 bp, Artificial
  CRISPR gRNA sequence
gctgcggctgtgggccagaa

SEQ ID NO: 348139 - DNA, 20 bp, Artificial
  CRISPR gRNA sequence
cggctgtgggccagaagaga

SEQ ID NO: 348140 - DNA, 20 bp, Artificial
  CRISPR gRNA sequence
gctgtgggccagaagagaaa

SEQ ID NO: 348141 - DNA, 20 bp, Artificial
  CRISPR gRNA sequence
tgggccagaagagaaagaga

SEQ ID NO: 348142 - DNA, 20 bp, Artificial
  CRISPR gRNA sequence
ggccagaagagaaagagaaa

SEQ ID NO: 348143 - DNA, 20 bp, Artificial
  CRISPR gRNA sequence
agaagagaaagagaaagaga

SEQ ID NO: 348144 - DNA, 20 bp, Artificial
  CRISPR gRNA sequence
aagagaaagagaaagagaaa

SEQ ID NO: 348145 - DNA, 20 bp, Artificial
  CRISPR gRNA sequence
aagagaaagagaatccgcct

SEQ ID NO: 348146 - DNA, 20 bp, Artificial
  CRISPR gRNA sequence
agaatccgcctcggtgtgac

SEQ ID NO: 348147 - DNA, 20 bp, Artificial
  CRISPR gRNA sequence
cggtgtgacaagctgtgcct

SEQ ID NO: 348148 - DNA, 20 bp, Artificial
  CRISPR gRNA sequence
caagctgtgcctcagaaccc

SEQ ID NO: 348149 - DNA, 20 bp, Artificial
  CRISPR gRNA sequence
gctgtgcctcagaacccgag

SEQ ID NO: 348150 - DNA, 20 bp, Artificial
  CRISPR gRNA sequence
gtgcctcagaacccgagcag

SEQ ID NO: 348151 - DNA, 20 bp, Artificial
  CRISPR gRNA sequence
tgcctcagaacccgagcagc

SEQ ID NO: 348152 - DNA, 20 bp, Artificial
  CRISPR gRNA sequence
cctcagaacccgagcagcag

SEQ ID NO: 348153 - DNA, 20 bp, Artificial
  CRISPR gRNA sequence
tcagaacccgagcagcagga

SEQ ID NO: 348154 - DNA, 20 bp, Artificial
  CRISPR gRNA sequence
gaacccgagcagcaggagag

SEQ ID NO: 348155 - DNA, 20 bp, Artificial
  CRISPR gRNA sequence
aacccgagcagcaggagagt

SEQ ID NO: 348156 - DNA, 20 bp, Artificial
  CRISPR gRNA sequence
ccgagcagcaggagagtggg

SEQ ID NO: 348157 - DNA, 20 bp, Artificial
  CRISPR gRNA sequence
agcagcaggagagtgggcag

SEQ ID NO: 348158 - DNA, 20 bp, Artificial
  CRISPR gRNA sequence
gcagcaggagagtgggcagc

SEQ ID NO: 348159 - DNA, 20 bp, Artificial
  CRISPR gRNA sequence
cagcaggagagtgggcagca

SEQ ID NO: 348160 - DNA, 20 bp, Artificial
  CRISPR gRNA sequence
agcaggagagtgggcagcag

SEQ ID NO: 348161 - DNA, 20 bp, Artificial
  CRISPR gRNA sequence
gcaggagagtgggcagcagg

SEQ ID NO: 348162 - DNA, 20 bp, Artificial
  CRISPR gRNA sequence
agtgggcagcagggggtgtc

SEQ ID NO: 348163 - DNA, 20 bp, Artificial
  CRISPR gRNA sequence
gggcagcagggggtgtctgg

SEQ ID NO: 348164 - DNA, 20 bp, Artificial
  CRISPR gRNA sequence
cagcagggggtgtctggcag

SEQ ID NO: 348165 - DNA, 20 bp, Artificial
  CRISPR gRNA sequence
gcagggggtgtctggcagca

SEQ ID NO: 348166 - DNA, 20 bp, Artificial
  CRISPR gRNA sequence
agggggtgtctggcagcaga

SEQ ID NO: 348167 - DNA, 20 bp, Artificial
  CRISPR gRNA sequence
gggggtgtctggcagcagag

SEQ ID NO: 348168 - DNA, 20 bp, Artificial
  CRISPR gRNA sequence
ggggtgtctggcagcagaga

SEQ ID NO: 348169 - DNA, 20 bp, Artificial
  CRISPR gRNA sequence
gggtgtctggcagcagagag

SEQ ID NO: 348170 - DNA, 20 bp, Artificial
  CRISPR gRNA sequence
tctggcagcagagaggggct

SEQ ID NO: 348171 - DNA, 20 bp, Artificial
  CRISPR gRNA sequence
ctggcagcagagaggggctc

SEQ ID NO: 348172 - DNA, 20 bp, Artificial
  CRISPR gRNA sequence
agagaggggctcaggcctgc

SEQ ID NO: 348173 - DNA, 20 bp, Artificial
  CRISPR gRNA sequence
gagaggggctcaggcctgct

SEQ ID NO: 348174 - DNA, 20 bp, Artificial
  CRISPR gRNA sequence
aggggctcaggcctgctggg

SEQ ID NO: 348175 - DNA, 20 bp, Artificial
  CRISPR gRNA sequence
gggctcaggcctgctgggtg

SEQ ID NO: 348176 - DNA, 20 bp, Artificial
  CRISPR gRNA sequence
ctcaggcctgctgggtggag

SEQ ID NO: 348177 - DNA, 20 bp, Artificial
  CRISPR gRNA sequence
cctgctgggtggagcggcgc

SEQ ID NO: 348178 - DNA, 20 bp, Artificial
  CRISPR gRNA sequence
ctgctgggtggagcggcgct

SEQ ID NO: 348179 - DNA, 20 bp, Artificial
  CRISPR gRNA sequence
tgctgggtggagcggcgctg

SEQ ID NO: 348180 - DNA, 20 bp, Artificial
  CRISPR gRNA sequence
gctgggtggagcggcgctgg

SEQ ID NO: 348181 - DNA, 20 bp, Artificial
  CRISPR gRNA sequence
tggagcggcgctgggggaca

SEQ ID NO: 348182 - DNA, 20 bp, Artificial
  CRISPR gRNA sequence
ggagcggcgctgggggacac

SEQ ID NO: 348183 - DNA, 20 bp, Artificial
  CRISPR gRNA sequence
gcggcgctgggggacacagg

SEQ ID NO: 348184 - DNA, 20 bp, Artificial
  CRISPR gRNA sequence
cggcgctgggggacacaggt

SEQ ID NO: 348185 - DNA, 20 bp, Artificial
  CRISPR gRNA sequence
ggggacacaggtgggccctg

SEQ ID NO: 348186 - DNA, 20 bp, Artificial
  CRISPR gRNA sequence
gggacacaggtgggccctgc

SEQ ID NO: 348187 - DNA, 20 bp, Artificial
  CRISPR gRNA sequence
gacacaggtgggccctgcgg

SEQ ID NO: 348188 - DNA, 20 bp, Artificial
  CRISPR gRNA sequence
acacaggtgggccctgcggg

SEQ ID NO: 348189 - DNA, 20 bp, Artificial
  CRISPR gRNA sequence
caggtgggccctgcgggagg

SEQ ID NO: 348190 - DNA, 20 bp, Artificial
  CRISPR gRNA sequence
aggtgggccctgcgggaggc

SEQ ID NO: 348191 - DNA, 20 bp, Artificial
  CRISPR gRNA sequence
gtgggccctgcgggaggcag

SEQ ID NO: 348192 - DNA, 20 bp, Artificial
  CRISPR gRNA sequence
tgcgggaggcaggagctgtc

SEQ ID NO: 348193 - DNA, 20 bp, Artificial
  CRISPR gRNA sequence
gcgggaggcaggagctgtcc

SEQ ID NO: 348194 - DNA, 20 bp, Artificial
  CRISPR gRNA sequence
aggcaggagctgtccaggca

SEQ ID NO: 348195 - DNA, 20 bp, Artificial
  CRISPR gRNA sequence
ggagctgtccaggcaaagcc

SEQ ID NO: 348196 - DNA, 20 bp, Artificial
  CRISPR gRNA sequence
gagctgtccaggcaaagccg

SEQ ID NO: 348197 - DNA, 20 bp, Artificial
  CRISPR gRNA sequence
agctgtccaggcaaagccga

SEQ ID NO: 348198 - DNA, 20 bp, Artificial
  CRISPR gRNA sequence
gctgtccaggcaaagccgag

SEQ ID NO: 348199 - DNA, 20 bp, Artificial
  CRISPR gRNA sequence
gtccaggcaaagccgagggg

SEQ ID NO: 348200 - DNA, 20 bp, Artificial
  CRISPR gRNA sequence
tccaggcaaagccgagggga

SEQ ID NO: 348201 - DNA, 20 bp, Artificial
  CRISPR gRNA sequence
ccaggcaaagccgaggggaa

SEQ ID NO: 348202 - DNA, 20 bp, Artificial
  CRISPR gRNA sequence
gcaaagccgaggggaagggc

SEQ ID NO: 348203 - DNA, 20 bp, Artificial
  CRISPR gRNA sequence
cgaggggaagggccggtatg

SEQ ID NO: 348204 - DNA, 20 bp, Artificial
  CRISPR gRNA sequence
gaggggaagggccggtatga

SEQ ID NO: 348205 - DNA, 20 bp, Artificial
  CRISPR gRNA sequence
ggggaagggccggtatgaag

SEQ ID NO: 348206 - DNA, 20 bp, Artificial
  CRISPR gRNA sequence
gggaagggccggtatgaagg

SEQ ID NO: 348207 - DNA, 20 bp, Artificial
  CRISPR gRNA sequence
ggtatgaaggaggcgcccga

SEQ ID NO: 348208 - DNA, 20 bp, Artificial
  CRISPR gRNA sequence
gtatgaaggaggcgcccgat

SEQ ID NO: 348209 - DNA, 20 bp, Artificial
  CRISPR gRNA sequence
atgaaggaggcgcccgatgg

SEQ ID NO: 348210 - DNA, 20 bp, Artificial
  CRISPR gRNA sequence
tgaaggaggcgcccgatggg

SEQ ID NO: 348211 - DNA, 20 bp, Artificial
  CRISPR gRNA sequence
gaaggaggcgcccgatggga

SEQ ID NO: 348212 - DNA, 20 bp, Artificial
  CRISPR gRNA sequence
aaggaggcgcccgatgggag

SEQ ID NO: 348213 - DNA, 20 bp, Artificial
  CRISPR gRNA sequence
aggcgcccgatgggaggggc

SEQ ID NO: 348214 - DNA, 20 bp, Artificial
  CRISPR gRNA sequence
gttctccccctgcaccattc

SEQ ID NO: 348215 - DNA, 20 bp, Artificial
  CRISPR gRNA sequence
tgcaccattccagtccactc

SEQ ID NO: 348216 - DNA, 20 bp, Artificial
  CRISPR gRNA sequence
gcaccattccagtccactcc

SEQ ID NO: 348217 - DNA, 20 bp, Artificial
  CRISPR gRNA sequence
agtccactccgggtttcctg

SEQ ID NO: 348218 - DNA, 20 bp, Artificial
  CRISPR gRNA sequence
ccactccgggtttcctgtag

SEQ ID NO: 348219 - DNA, 20 bp, Artificial
  CRISPR gRNA sequence
cactccgggtttcctgtaga

SEQ ID NO: 348220 - DNA, 20 bp, Artificial
  CRISPR gRNA sequence
actccgggtttcctgtagaa

SEQ ID NO: 348221 - DNA, 20 bp, Artificial
  CRISPR gRNA sequence
ctccgggtttcctgtagaag

SEQ ID NO: 348222 - DNA, 20 bp, Artificial
  CRISPR gRNA sequence
tccgggtttcctgtagaagg

SEQ ID NO: 348223 - DNA, 20 bp, Artificial
  CRISPR gRNA sequence
cgggtttcctgtagaagggg

SEQ ID NO: 348224 - DNA, 20 bp, Artificial
  CRISPR gRNA sequence
gtagaagggggagcccccca

SEQ ID NO: 348225 - DNA, 20 bp, Artificial
  CRISPR gRNA sequence
tcccccttctacaggaaacc

SEQ ID NO: 348226 - DNA, 20 bp, Artificial
  CRISPR gRNA sequence
acaggaaacccggagtggac

SEQ ID NO: 348227 - DNA, 20 bp, Artificial
  CRISPR gRNA sequence
gctgcccactctcctgctgc

SEQ ID NO: 348228 - DNA, 20 bp, Artificial
  CRISPR gRNA sequence
gcacagcttgtcacaccgag

SEQ ID NO: 348229 - DNA, 20 bp, Artificial
  CRISPR gRNA sequence
ccacagccgcagcaatggcg

SEQ ID NO: 348230 - DNA, 20 bp, Artificial
  CRISPR gRNA sequence
atggcgctgagttcctctgc

SEQ ID NO: 348231 - DNA, 20 bp, Artificial
  CRISPR gRNA sequence
gctggagttcatcctgctag

SEQ ID NO: 348232 - DNA, 20 bp, Artificial
  CRISPR gRNA sequence
tcccctgctgcctggggctc

SEQ ID NO: 348233 - DNA, 20 bp, Artificial
  CRISPR gRNA sequence
cagcactgggctcaccacag

SEQ ID NO: 348234 - DNA, 20 bp, Artificial
  CRISPR gRNA sequence
gctggtgagcccccatttgg

SEQ ID NO: 348235 - DNA, 20 bp, Artificial
  CRISPR gRNA sequence
gatgtgggcacttctggggg

SEQ ID NO: 348236 - DNA, 20 bp, Artificial
  CRISPR gRNA sequence
cagcagggggctggacccag

SEQ ID NO: 348237 - DNA, 20 bp, Artificial
  CRISPR gRNA sequence
gggggctggacccaggtggg

SEQ ID NO: 348238 - DNA, 20 bp, Artificial
  CRISPR gRNA sequence
tggacccaggtgggtggggt

SEQ ID NO: 348239 - DNA, 20 bp, Artificial
  CRISPR gRNA sequence
gctgcccctgctggctcttc

SEQ ID NO: 348240 - DNA, 20 bp, Artificial
  CRISPR gRNA sequence
gggctcaatgctcccaggtg

SEQ ID NO: 348241 - DNA, 20 bp, Artificial
  CRISPR gRNA sequence
atgctcccaggtgtggggtg

SEQ ID NO: 348242 - DNA, 20 bp, Artificial
  CRISPR gRNA sequence
tgtggggtccctggcgaggg

SEQ ID NO: 348243 - DNA, 20 bp, Artificial
  CRISPR gRNA sequence
tctgccgtcctgcaaggagg

SEQ ID NO: 348244 - DNA, 20 bp, Artificial
  CRISPR gRNA sequence
ggacgagtacccagtgggct

SEQ ID NO: 348245 - DNA, 20 bp, Artificial
  CRISPR gRNA sequence
tgttctctgcccccacagcc

SEQ ID NO: 348246 - DNA, 20 bp, Artificial
  CRISPR gRNA sequence
cctcacagtcacactgcaca

SEQ ID NO: 348247 - DNA, 20 bp, Artificial
  CRISPR gRNA sequence
acagtcacactgcacagggg

SEQ ID NO: 348248 - DNA, 20 bp, Artificial
  CRISPR gRNA sequence
ccgtggggctcatgggccat

SEQ ID NO: 348249 - DNA, 20 bp, Artificial
  CRISPR gRNA sequence
tccctgcttgggctctgggc

SEQ ID NO: 348250 - DNA, 20 bp, Artificial
  CRISPR gRNA sequence
gcttgggctctgggcgcggg

SEQ ID NO: 348251 - DNA, 20 bp, Artificial
  CRISPR gRNA sequence
ctctgggcgcgggtggagtg

SEQ ID NO: 348252 - DNA, 20 bp, Artificial
  CRISPR gRNA sequence
ccagcctccgcttgggcagc

SEQ ID NO: 348253 - DNA, 20 bp, Artificial
  CRISPR gRNA sequence
caggtcccaaccccatctcc

SEQ ID NO: 348254 - DNA, 20 bp, Artificial
  CRISPR gRNA sequence
tccttggctcctctggtgcc

SEQ ID NO: 348255 - DNA, 20 bp, Artificial
  CRISPR gRNA sequence
tggctcctctggtgcccggg

SEQ ID NO: 348256 - DNA, 20 bp, Artificial
  CRISPR gRNA sequence
ccacgtccctagctgcaaag

SEQ ID NO: 348257 - DNA, 20 bp, Artificial
  CRISPR gRNA sequence
tccctagctgcaaagtggaa

SEQ ID NO: 348258 - DNA, 20 bp, Artificial
  CRISPR gRNA sequence
acctggaggctggtgcccac

SEQ ID NO: 348259 - DNA, 20 bp, Artificial
  CRISPR gRNA sequence
accagacccagaggtggcct

SEQ ID NO: 348260 - DNA, 20 bp, Artificial
  CRISPR gRNA sequence
ccatgaacagaagaggaagc

SEQ ID NO: 348261 - DNA, 20 bp, Artificial
  CRISPR gRNA sequence
agaggaagctggagtgcttt

SEQ ID NO: 348262 - DNA, 20 bp, Artificial
  CRISPR gRNA sequence
gggggttcatgcatgtaggc

SEQ ID NO: 348263 - DNA, 20 bp, Artificial
  CRISPR gRNA sequence
agcacctgtctacttgggct

SEQ ID NO: 348264 - DNA, 20 bp, Artificial
  CRISPR gRNA sequence
accctacctgcctctgccat

SEQ ID NO: 348265 - DNA, 20 bp, Artificial
  CRISPR gRNA sequence
acagatgggaaacccgtttg

SEQ ID NO: 348266 - DNA, 20 bp, Artificial
  CRISPR gRNA sequence
atgggaaacccgtttgcggg

SEQ ID NO: 348267 - DNA, 20 bp, Artificial
  CRISPR gRNA sequence
cccgtttgcggggtgggtgt

SEQ ID NO: 348268 - DNA, 20 bp, Artificial
  CRISPR gRNA sequence
ccggcctcaggtcctccatg

SEQ ID NO: 348269 - DNA, 20 bp, Artificial
  CRISPR gRNA sequence
gcacctcgtttggctgagcc

SEQ ID NO: 348270 - DNA, 20 bp, Artificial
  CRISPR gRNA sequence
ctggcagcagtccttggcct

SEQ ID NO: 348271 - DNA, 20 bp, Artificial
  CRISPR gRNA sequence
tgtggatgctgtcctggccc

SEQ ID NO: 348272 - DNA, 20 bp, Artificial
  CRISPR gRNA sequence
gccacctccagcccgggcca

SEQ ID NO: 348273 - DNA, 20 bp, Artificial
  CRISPR gRNA sequence
gtgcagaagggaggtaagcg

SEQ ID NO: 348274 - DNA, 20 bp, Artificial
  CRISPR gRNA sequence
caccccaggttgctccacct

SEQ ID NO: 348275 - DNA, 20 bp, Artificial
  CRISPR gRNA sequence
tcgggcccctggtctggagc

SEQ ID NO: 348276 - DNA, 20 bp, Artificial
  CRISPR gRNA sequence
ggtctggagcctgggtttat

SEQ ID NO: 348277 - DNA, 20 bp, Artificial
  CRISPR gRNA sequence
ctgttcaagctaagtctagg

SEQ ID NO: 348278 - DNA, 20 bp, Artificial
  CRISPR gRNA sequence
gggcagcccccgcagcactg

SEQ ID NO: 348279 - DNA, 20 bp, Artificial
  CRISPR gRNA sequence
tccctctcttctcaggcacc

SEQ ID NO: 348280 - DNA, 20 bp, Artificial
  CRISPR gRNA sequence
ctctcccaatgggaccctgg

SEQ ID NO: 348281 - DNA, 20 bp, Artificial
  CRISPR gRNA sequence
atctgagcttcctggaggct

SEQ ID NO: 348282 - DNA, 20 bp, Artificial
  CRISPR gRNA sequence
atcccctgtcccctggggct

SEQ ID NO: 348283 - DNA, 20 bp, Artificial
  CRISPR gRNA sequence
ccctggggctgtgggtgtcc

SEQ ID NO: 348284 - DNA, 20 bp, Artificial
  CRISPR gRNA sequence
tgggagggcccctgggcttc

SEQ ID NO: 348285 - DNA, 20 bp, Artificial
  CRISPR gRNA sequence
cagagcttcttgggaggagc

SEQ ID NO: 348286 - DNA, 20 bp, Artificial
  CRISPR gRNA sequence
tggggtcccccagcggagcc

SEQ ID NO: 348287 - DNA, 20 bp, Artificial
  CRISPR gRNA sequence
agcggagcctgggatggagc

SEQ ID NO: 348288 - DNA, 20 bp, Artificial
  CRISPR gRNA sequence
gccactggtctcccgtgctc

SEQ ID NO: 348289 - DNA, 20 bp, Artificial
  CRISPR gRNA sequence
gccagggaggctccctgagg

SEQ ID NO: 348290 - DNA, 20 bp, Artificial
  CRISPR gRNA sequence
gctgggaccagcagctccca

SEQ ID NO: 348291 - DNA, 20 bp, Artificial
  CRISPR gRNA sequence
gtgtgaaaagaagaaagcca

SEQ ID NO: 348292 - DNA, 20 bp, Artificial
  CRISPR gRNA sequence
aggtggccccagagcttttc

SEQ ID NO: 348293 - DNA, 20 bp, Artificial
  CRISPR gRNA sequence
gtgctcctgcctgccccctg

SEQ ID NO: 348294 - DNA, 20 bp, Artificial
  CRISPR gRNA sequence
gctgggagaagctctgggct

SEQ ID NO: 348295 - DNA, 20 bp, Artificial
  CRISPR gRNA sequence
aaggctttgtcctcattgag

SEQ ID NO: 348296 - DNA, 20 bp, Artificial
  CRISPR gRNA sequence
ggtctcggggcctcaggctc

SEQ ID NO: 348297 - DNA, 20 bp, Artificial
  CRISPR gRNA sequence
tcccctcccatagatgacgg

SEQ ID NO: 348298 - DNA, 20 bp, Artificial
  CRISPR gRNA sequence
cccatagatgacggttgaat

SEQ ID NO: 348299 - DNA, 20 bp, Artificial
  CRISPR gRNA sequence
tggcctcctctgctctcaga

SEQ ID NO: 348300 - DNA, 20 bp, Artificial
  CRISPR gRNA sequence
acggtctcccagggagaagc

SEQ ID NO: 348301 - DNA, 20 bp, Artificial
  CRISPR gRNA sequence
gtgggggctcccagttctct

SEQ ID NO: 348302 - DNA, 20 bp, Artificial
  CRISPR gRNA sequence
ctcccagttctctgagggtc

SEQ ID NO: 348303 - DNA, 20 bp, Artificial
  CRISPR gRNA sequence
gtaaaatgaacccgagaacc

SEQ ID NO: 348304 - DNA, 20 bp, Artificial
  CRISPR gRNA sequence
cccaggggggcctgagcagg

SEQ ID NO: 348305 - DNA, 20 bp, Artificial
  CRISPR gRNA sequence
gggagaggtggggcccctgc

SEQ ID NO: 348306 - DNA, 20 bp, Artificial
  CRISPR gRNA sequence
ctgctgtggcctgagctccc

SEQ ID NO: 348307 - DNA, 20 bp, Artificial
  CRISPR gRNA sequence
gcctcacagccaaggctgga

SEQ ID NO: 348308 - DNA, 20 bp, Artificial
  CRISPR gRNA sequence
tggctgcagtgtggtgttta

SEQ ID NO: 348309 - DNA, 20 bp, Artificial
  CRISPR gRNA sequence
atcggaagtgattttctaaa

SEQ ID NO: 348310 - DNA, 20 bp, Artificial
  CRISPR gRNA sequence
agtgattttctaaattggat

SEQ ID NO: 348311 - DNA, 20 bp, Artificial
  CRISPR gRNA sequence
tatttggggagatgctgtgg

SEQ ID NO: 348312 - DNA, 20 bp, Artificial
  CRISPR gRNA sequence
ccggtgtttcttgctgaaca

SEQ ID NO: 348313 - DNA, 20 bp, Artificial
  CRISPR gRNA sequence
tcttgctgaacaaggagttc

SEQ ID NO: 348314 - DNA, 20 bp, Artificial
  CRISPR gRNA sequence
gccctcctcccgtcatgcct

SEQ ID NO: 348315 - DNA, 20 bp, Artificial
  CRISPR gRNA sequence
ctccgtccgaggctattgct

SEQ ID NO: 348316 - DNA, 20 bp, Artificial
  CRISPR gRNA sequence
ccacacattcatttaatggt

SEQ ID NO: 348317 - DNA, 20 bp, Artificial
  CRISPR gRNA sequence
ctgaagttagaagcggtgag

SEQ ID NO: 348318 - DNA, 20 bp, Artificial
  CRISPR gRNA sequence
tgaccctgcagccatgccat

SEQ ID NO: 348319 - DNA, 20 bp, Artificial
  CRISPR gRNA sequence
gaagctttggcttagcgtcc

SEQ ID NO: 348320 - DNA, 20 bp, Artificial
  CRISPR gRNA sequence
accggctcctgaccaccgtc

SEQ ID NO: 348321 - DNA, 20 bp, Artificial
  CRISPR gRNA sequence
ccaccgtccagggtcattgc

SEQ ID NO: 348322 - DNA, 20 bp, Artificial
  CRISPR gRNA sequence
caggtgggagcatggggcca

SEQ ID NO: 348323 - DNA, 20 bp, Artificial
  CRISPR gRNA sequence
gggccatggagtgagcgggc

SEQ ID NO: 348324 - DNA, 20 bp, Artificial
  CRISPR gRNA sequence
tcctcctcctgggaggagcc

SEQ ID NO: 348325 - DNA, 20 bp, Artificial
  CRISPR gRNA sequence
cagccacctgctgcatccgc

SEQ ID NO: 348326 - DNA, 20 bp, Artificial
  CRISPR gRNA sequence
gggagtggggccgaggacat

SEQ ID NO: 348327 - DNA, 20 bp, Artificial
  CRISPR gRNA sequence
ccggtactcactcagcccca

SEQ ID NO: 348328 - DNA, 20 bp, Artificial
  CRISPR gRNA sequence
agggcaggtcccgggggagg

SEQ ID NO: 348329 - DNA, 20 bp, Artificial
  CRISPR gRNA sequence
ggctgggttagtggcagctc

SEQ ID NO: 348330 - DNA, 20 bp, Artificial
  CRISPR gRNA sequence
agccagcagcgcagggccct

SEQ ID NO: 348331 - DNA, 20 bp, Artificial
  CRISPR gRNA sequence
gcttgtccactcagtagctg

SEQ ID NO: 348332 - DNA, 20 bp, Artificial
  CRISPR gRNA sequence
aaaataaaaactaccataga

SEQ ID NO: 348333 - DNA, 20 bp, Artificial
  CRISPR gRNA sequence
gcttcggcctcccaaagtgt

SEQ ID NO: 348334 - DNA, 20 bp, Artificial
  CRISPR gRNA sequence
gcgtgagccacctcgccctg

SEQ ID NO: 348335 - DNA, 20 bp, Artificial
  CRISPR gRNA sequence
gtttttatttttatagcaac

SEQ ID NO: 348336 - DNA, 20 bp, Artificial
  CRISPR gRNA sequence
cctcccacattcaacagcta

SEQ ID NO: 348337 - DNA, 20 bp, Artificial
  CRISPR gRNA sequence
gccagggacactccctgggg

SEQ ID NO: 348338 - DNA, 20 bp, Artificial
  CRISPR gRNA sequence
gggacactccctggggctga

SEQ ID NO: 348339 - DNA, 20 bp, Artificial
  CRISPR gRNA sequence
atgtcctcggccccactccc

SEQ ID NO: 348340 - DNA, 20 bp, Artificial
  CRISPR gRNA sequence
cctgggagcagcagctcccg

SEQ ID NO: 348341 - DNA, 20 bp, Artificial
  CRISPR gRNA sequence
gcatgaaaagaagaaaatca

SEQ ID NO: 348342 - DNA, 20 bp, Artificial
  CRISPR gRNA sequence
aggtggccccagagcttttc

SEQ ID NO: 348343 - DNA, 20 bp, Artificial
  CRISPR gRNA sequence
ctggggggcagccaggtcta

SEQ ID NO: 348344 - DNA, 20 bp, Artificial
  CRISPR gRNA sequence
accacgcctccagttgggga

SEQ ID NO: 348345 - DNA, 20 bp, Artificial
  CRISPR gRNA sequence
cagttggggagagggtgaca

SEQ ID NO: 348346 - DNA, 20 bp, Artificial
  CRISPR gRNA sequence
gccaaagcttccacaggaca

SEQ ID NO: 348347 - DNA, 20 bp, Artificial
  CRISPR gRNA sequence
aggacaaggggtggcaggag

SEQ ID NO: 348348 - DNA, 20 bp, Artificial
  CRISPR gRNA sequence
aggggtggcaggagaggagt

SEQ ID NO: 348349 - DNA, 20 bp, Artificial
  CRISPR gRNA sequence
gtggcaggagaggagttggg

SEQ ID NO: 348350 - DNA, 20 bp, Artificial
  CRISPR gRNA sequence
caggtgacaaggaaaggaga

SEQ ID NO: 348351 - DNA, 20 bp, Artificial
  CRISPR gRNA sequence
ggaaaggagagggggtaggg

SEQ ID NO: 348352 - DNA, 20 bp, Artificial
  CRISPR gRNA sequence
ccatcctcatggcatggctg

SEQ ID NO: 348353 - DNA, 20 bp, Artificial
  CRISPR gRNA sequence
ggcctcatcccgaccattaa

SEQ ID NO: 348354 - DNA, 20 bp, Artificial
  CRISPR gRNA sequence
gccagcgggacctgggcctg

SEQ ID NO: 348355 - DNA, 20 bp, Artificial
  CRISPR gRNA sequence
acagcaggcgtcactgatac

SEQ ID NO: 348356 - DNA, 20 bp, Artificial
  CRISPR gRNA sequence
gtgtaggtcagatgtagatc

SEQ ID NO: 348357 - DNA, 20 bp, Artificial
  CRISPR gRNA sequence
atctgacaccatttgagcat

SEQ ID NO: 348358 - DNA, 20 bp, Artificial
  CRISPR gRNA sequence
cccactgagagctcagctgt

SEQ ID NO: 348359 - DNA, 20 bp, Artificial
  CRISPR gRNA sequence
ggggcggccagggctcctct

SEQ ID NO: 348360 - DNA, 20 bp, Artificial
  CRISPR gRNA sequence
ggccagggctcctctctggg

SEQ ID NO: 348361 - DNA, 20 bp, Artificial
  CRISPR gRNA sequence
aggcatgacgggaggagggc

SEQ ID NO: 348362 - DNA, 20 bp, Artificial
  CRISPR gRNA sequence
tgacaaatagaaaacaggag

SEQ ID NO: 348363 - DNA, 20 bp, Artificial
  CRISPR gRNA sequence
gcctgtcctgctgaggccac

SEQ ID NO: 348364 - DNA, 20 bp, Artificial
  CRISPR gRNA sequence
gagtcagacgcgcagacagc

SEQ ID NO: 348365 - DNA, 20 bp, Artificial
  CRISPR gRNA sequence
tctgggctggcccaggaggg

SEQ ID NO: 348366 - DNA, 20 bp, Artificial
  CRISPR gRNA sequence
ccaggccctcactggcccat

SEQ ID NO: 348367 - DNA, 20 bp, Artificial
  CRISPR gRNA sequence
gctccaggtatctctggcgt

SEQ ID NO: 348368 - DNA, 20 bp, Artificial
  CRISPR gRNA sequence
gtatctctggcgtcggggtg

SEQ ID NO: 348369 - DNA, 20 bp, Artificial
  CRISPR gRNA sequence
ggcgtcggggtgcagagtct

SEQ ID NO: 348370 - DNA, 20 bp, Artificial
  CRISPR gRNA sequence
agtggtttgggctcctcccc

SEQ ID NO: 348371 - DNA, 20 bp, Artificial
  CRISPR gRNA sequence
ttgggctcctccccgtgaat

SEQ ID NO: 348372 - DNA, 20 bp, Artificial
  CRISPR gRNA sequence
gtcttttccgctgtgagcac

SEQ ID NO: 348373 - DNA, 20 bp, Artificial
  CRISPR gRNA sequence
ccccctgggactccaggttc

SEQ ID NO: 348374 - DNA, 20 bp, Artificial
  CRISPR gRNA sequence
ttttactgctttcagtttga

SEQ ID NO: 348375 - DNA, 20 bp, Artificial
  CRISPR gRNA sequence
actgctttcagtttgagggg

SEQ ID NO: 348376 - DNA, 20 bp, Artificial
  CRISPR gRNA sequence
ggggggagggagagggggag

SEQ ID NO: 348377 - DNA, 20 bp, Artificial
  CRISPR gRNA sequence
ctgtccccaggaggcccagc

SEQ ID NO: 348378 - DNA, 20 bp, Artificial
  CRISPR gRNA sequence
ccataccagcaggtgcccag

SEQ ID NO: 348379 - DNA, 20 bp, Artificial
  CRISPR gRNA sequence
acctccccgcattggaggcc

SEQ ID NO: 348380 - DNA, 20 bp, Artificial
  CRISPR gRNA sequence
ccgcattggaggccccgggt

SEQ ID NO: 348381 - DNA, 20 bp, Artificial
  CRISPR gRNA sequence
gctttgctgccgcctggctg

SEQ ID NO: 348382 - DNA, 20 bp, Artificial
  CRISPR gRNA sequence
cagggctcccagggccacag

SEQ ID NO: 348383 - DNA, 20 bp, Artificial
  CRISPR gRNA sequence
ccacagccgggtccacacag

SEQ ID NO: 348384 - DNA, 20 bp, Artificial
  CRISPR gRNA sequence
gcacaggtgcccagaccagg

SEQ ID NO: 348385 - DNA, 20 bp, Artificial
  CRISPR gRNA sequence
gcccagaccagggcggatag

SEQ ID NO: 348386 - DNA, 20 bp, Artificial
  CRISPR gRNA sequence
agaccagggcggataggtgg

SEQ ID NO: 348387 - DNA, 20 bp, Artificial
  CRISPR gRNA sequence
cagggcggataggtggatga

SEQ ID NO: 348388 - DNA, 20 bp, Artificial
  CRISPR gRNA sequence
gcggataggtggatgaatga

SEQ ID NO: 348389 - DNA, 20 bp, Artificial
  CRISPR gRNA sequence
ataggtggatgaatgaatga

SEQ ID NO: 348390 - DNA, 20 bp, Artificial
  CRISPR gRNA sequence
gtggatgaatgaatgaatga

SEQ ID NO: 348391 - DNA, 20 bp, Artificial
  CRISPR gRNA sequence
acagggggcaggcaggagca

SEQ ID NO: 348392 - DNA, 20 bp, Artificial
  CRISPR gRNA sequence
caggcaggagcacagggtca

SEQ ID NO: 348393 - DNA, 20 bp, Artificial
  CRISPR gRNA sequence
gggtcatagagtgcgtgggc

SEQ ID NO: 348394 - DNA, 20 bp, Artificial
  CRISPR gRNA sequence
tggctgagggctccacggtc

SEQ ID NO: 348395 - DNA, 20 bp, Artificial
  CRISPR gRNA sequence
tggctgccctgggaggagcc

SEQ ID NO: 348396 - DNA, 20 bp, Artificial
  CRISPR gRNA sequence
ctggggccacctcccaggct

SEQ ID NO: 348397 - DNA, 20 bp, Artificial
  CRISPR gRNA sequence
caccagccagctgcacctgc

SEQ ID NO: 348398 - DNA, 20 bp, Artificial
  CRISPR gRNA sequence
ggctgggctggtggcagctc

SEQ ID NO: 348399 - DNA, 20 bp, Artificial
  CRISPR gRNA sequence
agaggacgaggagggcagag

SEQ ID NO: 348400 - DNA, 20 bp, Artificial
  CRISPR gRNA sequence
tctcaggtcagttaggggcc

SEQ ID NO: 348401 - DNA, 20 bp, Artificial
  CRISPR gRNA sequence
tcccgaaggtggacaaagag

SEQ ID NO: 348402 - DNA, 20 bp, Artificial
  CRISPR gRNA sequence
acccacagccccaggggaca

SEQ ID NO: 348403 - DNA, 20 bp, Artificial
  CRISPR gRNA sequence
gctttgtctgggcccatgga

SEQ ID NO: 348404 - DNA, 20 bp, Artificial
  CRISPR gRNA sequence
cctggacgcaggcatgtgac

SEQ ID NO: 348405 - DNA, 20 bp, Artificial
  CRISPR gRNA sequence
catgtgaccagggtgccgct

SEQ ID NO: 348406 - DNA, 20 bp, Artificial
  CRISPR gRNA sequence
ggcacagagctgggcctccc

SEQ ID NO: 348407 - DNA, 20 bp, Artificial
  CRISPR gRNA sequence
gtctggtgctgacattcctc

SEQ ID NO: 348408 - DNA, 20 bp, Artificial
  CRISPR gRNA sequence
cccggggggcagttctgaca

SEQ ID NO: 348409 - DNA, 20 bp, Artificial
  CRISPR gRNA sequence
ttgtctgtgagcttctagac

SEQ ID NO: 348410 - DNA, 20 bp, Artificial
  CRISPR gRNA sequence
cttctagacctgggtgctct

SEQ ID NO: 348411 - DNA, 20 bp, Artificial
  CRISPR gRNA sequence
ggaggggcaggctccctgtc

SEQ ID NO: 348412 - DNA, 20 bp, Artificial
  CRISPR gRNA sequence
agagtcttggaggtggggcc

SEQ ID NO: 348413 - DNA, 20 bp, Artificial
  CRISPR gRNA sequence
tggctctggctgtcccggcc

SEQ ID NO: 348414 - DNA, 20 bp, Artificial
  CRISPR gRNA sequence
ctgtcccggccttgagtagc

SEQ ID NO: 348415 - DNA, 20 bp, Artificial
  CRISPR gRNA sequence
ccttgagtagctgggatctc

SEQ ID NO: 348416 - DNA, 20 bp, Artificial
  CRISPR gRNA sequence
agctgggatctcatgagtcc

SEQ ID NO: 348417 - DNA, 20 bp, Artificial
  CRISPR gRNA sequence
aaccccgaggtggagcaacc

SEQ ID NO: 348418 - DNA, 20 bp, Artificial
  CRISPR gRNA sequence
gcttccaggacagggctgaa

SEQ ID NO: 348419 - DNA, 20 bp, Artificial
  CRISPR gRNA sequence
gacagcggggcactggggac

SEQ ID NO: 348420 - DNA, 20 bp, Artificial
  CRISPR gRNA sequence
gggaccagggtggaaatggg

SEQ ID NO: 348421 - DNA, 20 bp, Artificial
  CRISPR gRNA sequence
ctcgcgcgcaggcccatggc

SEQ ID NO: 348422 - DNA, 20 bp, Artificial
  CRISPR gRNA sequence
gtccaagaggaggggctgag

SEQ ID NO: 348423 - DNA, 20 bp, Artificial
  CRISPR gRNA sequence
ttgcactgtcagttccaggg

SEQ ID NO: 348424 - DNA, 20 bp, Artificial
  CRISPR gRNA sequence
cccagacacccaccccgcaa

SEQ ID NO: 348425 - DNA, 20 bp, Artificial
  CRISPR gRNA sequence
attccaatggcagaggcagg

SEQ ID NO: 348426 - DNA, 20 bp, Artificial
  CRISPR gRNA sequence
tcttcaggtactggtggagg

SEQ ID NO: 348427 - DNA, 20 bp, Artificial
  CRISPR gRNA sequence
cagtgactcaaaggccacct

SEQ ID NO: 348428 - DNA, 20 bp, Artificial
  CRISPR gRNA sequence
cctgtggggaagcagcaggc

SEQ ID NO: 348429 - DNA, 20 bp, Artificial
  CRISPR gRNA sequence
gcaggcccgagtgccggccg

SEQ ID NO: 348430 - DNA, 20 bp, Artificial
  CRISPR gRNA sequence
caccagaggagccaaggacg

SEQ ID NO: 348431 - DNA, 20 bp, Artificial
  CRISPR gRNA sequence
aggagccaaggacgagggat

SEQ ID NO: 348432 - DNA, 20 bp, Artificial
  CRISPR gRNA sequence
taagggtcagtcgccaagct

SEQ ID NO: 348433 - DNA, 20 bp, Artificial
  CRISPR gRNA sequence
tgacctcaaggcgtcccctg

SEQ ID NO: 348434 - DNA, 20 bp, Artificial
  CRISPR gRNA sequence
gcagggtgcatccatggaga

SEQ ID NO: 348435 - DNA, 20 bp, Artificial
  CRISPR gRNA sequence
gggcactgtggccatggaga

SEQ ID NO: 348436 - DNA, 20 bp, Artificial
  CRISPR gRNA sequence
gtggccatggagagagggtg

SEQ ID NO: 348437 - DNA, 20 bp, Artificial
  CRISPR gRNA sequence
cggctgtgctggcctcttac

SEQ ID NO: 348438 - DNA, 20 bp, Artificial
  CRISPR gRNA sequence
caatgtaggtgcctggaggg

SEQ ID NO: 348439 - DNA, 20 bp, Artificial
  CRISPR gRNA sequence
acacgataacctgccgccca

SEQ ID NO: 348440 - DNA, 20 bp, Artificial
  CRISPR gRNA sequence
cccctgtgcagtgtgactgt

SEQ ID NO: 348441 - DNA, 20 bp, Artificial
  CRISPR gRNA sequence
gtgtgactgtgagggtcccc

SEQ ID NO: 348442 - DNA, 20 bp, Artificial
  CRISPR gRNA sequence
tgtgagggtcccccagggtg

SEQ ID NO: 348443 - DNA, 20 bp, Artificial
  CRISPR gRNA sequence
agagtccaagctgctggcct

SEQ ID NO: 348444 - DNA, 20 bp, Artificial
  CRISPR gRNA sequence
gctgtgggggcagagaacac

SEQ ID NO: 348445 - DNA, 20 bp, Artificial
  CRISPR gRNA sequence
tgtctggggcagaagggggc

SEQ ID NO: 348446 - DNA, 20 bp, Artificial
  CRISPR gRNA sequence
ggggcagcactcggagccca

SEQ ID NO: 348447 - DNA, 20 bp, Artificial
  CRISPR gRNA sequence
aggtgagatacagcacctaa

SEQ ID NO: 348448 - DNA, 20 bp, Artificial
  CRISPR gRNA sequence
gccaggcttggccccacagc

SEQ ID NO: 348449 - DNA, 20 bp, Artificial
  CRISPR gRNA sequence
ccttgccgaccgctggagcc

SEQ ID NO: 348450 - DNA, 20 bp, Artificial
  CRISPR gRNA sequence
ccgaccgctggagcccggga

SEQ ID NO: 348451 - DNA, 20 bp, Artificial
  CRISPR gRNA sequence
aagagccagcaggggcagcc

SEQ ID NO: 348452 - DNA, 20 bp, Artificial
  CRISPR gRNA sequence
agaggctcacaagccagaca

SEQ ID NO: 348453 - DNA, 20 bp, Artificial
  CRISPR gRNA sequence
ctgatcagggccacatcggg

SEQ ID NO: 348454 - DNA, 20 bp, Artificial
  CRISPR gRNA sequence
ggcagtcgggggcccctgat

SEQ ID NO: 348455 - DNA, 20 bp, Artificial
  CRISPR gRNA sequence
gggatagtggctggacaggc

SEQ ID NO: 348456 - DNA, 20 bp, Artificial
  CRISPR gRNA sequence
aggagtgccacatgagcatg

SEQ ID NO: 348457 - DNA, 20 bp, Artificial
  CRISPR gRNA sequence
agtatccccaccccacccac

SEQ ID NO: 348458 - DNA, 20 bp, Artificial
  CRISPR gRNA sequence
caccaaggtcagggctgccg

SEQ ID NO: 348459 - DNA, 20 bp, Artificial
  CRISPR gRNA sequence
aggtcagggctgccggggag

SEQ ID NO: 348460 - DNA, 20 bp, Artificial
  CRISPR gRNA sequence
gctcaccagctgcccgtgga

SEQ ID NO: 348461 - DNA, 20 bp, Artificial
  CRISPR gRNA sequence
agctgcccgtggacggagtg

SEQ ID NO: 348462 - DNA, 20 bp, Artificial
  CRISPR gRNA sequence
cacacgcaggaggaggtctg

SEQ ID NO: 348463 - DNA, 20 bp, Artificial
  CRISPR gRNA sequence
actgtggtgagcccagtgct

SEQ ID NO: 348464 - DNA, 20 bp, Artificial
  CRISPR gRNA sequence
gtgagcccagtgctgggggt

SEQ ID NO: 348465 - DNA, 20 bp, Artificial
  CRISPR gRNA sequence
aagagatctgtgggaggccc

SEQ ID NO: 348466 - DNA, 20 bp, Artificial
  CRISPR gRNA sequence
ggaggccctggggtcagaac

SEQ ID NO: 348467 - DNA, 20 bp, Artificial
  CRISPR gRNA sequence
agcctcaagacgtcggtttt

SEQ ID NO: 348468 - DNA, 20 bp, Artificial
  CRISPR gRNA sequence
tcaagacgtcggttttgggg

SEQ ID NO: 348469 - DNA, 20 bp, Artificial
  CRISPR gRNA sequence
cagctcgggaacccagctag

SEQ ID NO: 348470 - DNA, 20 bp, Artificial
  CRISPR gRNA sequence
aagagaaagagaaagagaaa

SEQ ID NO: 348471 - DNA, 20 bp, Artificial
  CRISPR gRNA sequence
cctcagaacccgagcagcag

SEQ ID NO: 348472 - DNA, 20 bp, Artificial
  CRISPR gRNA sequence
cagcaggagagtgggcagca

SEQ ID NO: 348473 - DNA, 20 bp, Artificial
  CRISPR gRNA sequence
cagagaggggctcaggcctg

SEQ ID NO: 348474 - DNA, 20 bp, Artificial
  CRISPR gRNA sequence
ggaggcgcccgatgggaggg

SEQ ID NO: 348475 - DNA, 20 bp, Artificial
  CRISPR gRNA sequence
ctgcaccattccagtccact

SEQ ID NO: 348476 - DNA, 20 bp, Artificial
  CRISPR gRNA sequence
ccttcataccggcccttccc

SEQ ID NO: 348477 - DNA, 20 bp, Artificial
  CRISPR gRNA sequence
ctgctgctcgggttctgagg

SEQ ID NO: 348478 - DNA, 20 bp, Artificial
  CRISPR gRNA sequence
ggcacagcttgtcacaccga

SEQ ID NO: 348479 - DNA, 20 bp, Artificial
  CRISPR gRNA sequence
gatcagcctgtcacccactg

SEQ ID NO: 348480 - DNA, 20 bp, Artificial
  CRISPR gRNA sequence
ttccatgagcctggcctggg

SEQ ID NO: 348481 - DNA, 20 bp, Artificial
  CRISPR gRNA sequence
gctcctccccattgcacaga

SEQ ID NO: 348482 - DNA, 20 bp, Artificial
  CRISPR gRNA sequence
gagggcagaacccccaggcc

SEQ ID NO: 348483 - DNA, 20 bp, Artificial
  CRISPR gRNA sequence
caggtgtcccaggaggcccc

SEQ ID NO: 348484 - DNA, 20 bp, Artificial
  CRISPR gRNA sequence
ccccatgtgcttccagaact

SEQ ID NO: 348485 - DNA, 20 bp, Artificial
  CRISPR gRNA sequence
agtccccttagctggtgtct

SEQ ID NO: 348486 - DNA, 20 bp, Artificial
  CRISPR gRNA sequence
gccagcacagccggcccagc

SEQ ID NO: 348487 - DNA, 20 bp, Artificial
  CRISPR gRNA sequence
tcaccgccaggtgggccatc

SEQ ID NO: 348488 - DNA, 20 bp, Artificial
  CRISPR gRNA sequence
ctccggccggcactcgggcc

SEQ ID NO: 348489 - DNA, 20 bp, Artificial
  CRISPR gRNA sequence
tcgggcctgctgcttcccca

SEQ ID NO: 348490 - DNA, 20 bp, Artificial
  CRISPR gRNA sequence
atgaacagaagaggaagctg

SEQ ID NO: 348491 - DNA, 20 bp, Artificial
  CRISPR gRNA sequence
tgggggttcatgcatgtagg

SEQ ID NO: 348492 - DNA, 20 bp, Artificial
  CRISPR gRNA sequence
gccctcaggaggggcccagg

SEQ ID NO: 348493 - DNA, 20 bp, Artificial
  CRISPR gRNA sequence
tgcctctgccattggaatgg

SEQ ID NO: 348494 - DNA, 20 bp, Artificial
  CRISPR gRNA sequence
ctggtttgcacagatgggaa

SEQ ID NO: 348495 - DNA, 20 bp, Artificial
  CRISPR gRNA sequence
cctgcccatctgggcagaag

SEQ ID NO: 348496 - DNA, 20 bp, Artificial
  CRISPR gRNA sequence
atgctgggtacctctgggca

SEQ ID NO: 348497 - DNA, 20 bp, Artificial
  CRISPR gRNA sequence
ggggaccactgcgccgcgtg

SEQ ID NO: 348498 - DNA, 20 bp, Artificial
  CRISPR gRNA sequence
gtgccccgctgtctggagcc

SEQ ID NO: 348499 - DNA, 20 bp, Artificial
  CRISPR gRNA sequence
tcgggcccctggtctggagc

SEQ ID NO: 348500 - DNA, 20 bp, Artificial
  CRISPR gRNA sequence
gccctggggagggggctcca

SEQ ID NO: 348501 - DNA, 20 bp, Artificial
  CRISPR gRNA sequence
atgaccgtcttctccagcag

SEQ ID NO: 348502 - DNA, 20 bp, Artificial
  CRISPR gRNA sequence
cagacaaagcctcatcagat

SEQ ID NO: 348503 - DNA, 20 bp, Artificial
  CRISPR gRNA sequence
tcagggccatgggagggccc

SEQ ID NO: 348504 - DNA, 20 bp, Artificial
  CRISPR gRNA sequence
ccctaactgacctgagactt

SEQ ID NO: 348505 - DNA, 20 bp, Artificial
  CRISPR gRNA sequence
tctctgcactgctggctgcc

SEQ ID NO: 348506 - DNA, 20 bp, Artificial
  CRISPR gRNA sequence
gtctcctttgcccagtctct

SEQ ID NO: 348507 - DNA, 20 bp, Artificial
  CRISPR gRNA sequence
ttctctccacctccccatag

SEQ ID NO: 348508 - DNA, 20 bp, Artificial
  CRISPR gRNA sequence
cagcagctcccactgggtat

SEQ ID NO: 348509 - DNA, 20 bp, Artificial
  CRISPR gRNA sequence
tcagggagcctcgtcatcgt

SEQ ID NO: 348510 - DNA, 20 bp, Artificial
  CRISPR gRNA sequence
ccaagcctgggaggtggccc

SEQ ID NO: 348511 - DNA, 20 bp, Artificial
  CRISPR gRNA sequence
gccactgcaggctggggcag

SEQ ID NO: 348512 - DNA, 20 bp, Artificial
  CRISPR gRNA sequence
aacagccgccctgctgggga

SEQ ID NO: 348513 - DNA, 20 bp, Artificial
  CRISPR gRNA sequence
ctgtgcacagcccccgggga

SEQ ID NO: 348514 - DNA, 20 bp, Artificial
  CRISPR gRNA sequence
ggctctagggtaggccgggc

SEQ ID NO: 348515 - DNA, 20 bp, Artificial
  CRISPR gRNA sequence
ggcagggcctctccactgtg

SEQ ID NO: 348516 - DNA, 20 bp, Artificial
  CRISPR gRNA sequence
tcccctctccccgctggggc

SEQ ID NO: 348517 - DNA, 20 bp, Artificial
  CRISPR gRNA sequence
ggcctgagcaggcagggtct

SEQ ID NO: 348518 - DNA, 20 bp, Artificial
  CRISPR gRNA sequence
tggcggaaccaccggagccc

SEQ ID NO: 348519 - DNA, 20 bp, Artificial
  CRISPR gRNA sequence
gcttgggggctccgccctgg

SEQ ID NO: 348520 - DNA, 20 bp, Artificial
  CRISPR gRNA sequence
ggactgggttggctgcagtg

SEQ ID NO: 348521 - DNA, 20 bp, Artificial
  CRISPR gRNA sequence
tttagtggataccacatcgg

SEQ ID NO: 348522 - DNA, 20 bp, Artificial
  CRISPR gRNA sequence
catcggaagtgattttctaa

SEQ ID NO: 348523 - DNA, 20 bp, Artificial
  CRISPR gRNA sequence
aaattggatttgaattcggc

SEQ ID NO: 348524 - DNA, 20 bp, Artificial
  CRISPR gRNA sequence
gctgtgggaggatgtaaata

SEQ ID NO: 348525 - DNA, 20 bp, Artificial
  CRISPR gRNA sequence
ctcctcaaactgtcacctcc

SEQ ID NO: 348526 - DNA, 20 bp, Artificial
  CRISPR gRNA sequence
gctccgtccgaggctattgc

SEQ ID NO: 348527 - DNA, 20 bp, Artificial
  CRISPR gRNA sequence
gattctgatgctcaaatggt

SEQ ID NO: 348528 - DNA, 20 bp, Artificial
  CRISPR gRNA sequence
caggcccaggtcccgctggc

SEQ ID NO: 348529 - DNA, 20 bp, Artificial
  CRISPR gRNA sequence
cctgccaccccttgtcctgt

SEQ ID NO: 348530 - DNA, 20 bp, Artificial
  CRISPR gRNA sequence
accccttgtcctgtggaagc

SEQ ID NO: 348531 - DNA, 20 bp, Artificial
  CRISPR gRNA sequence
aaaagctctggggccacctc

SEQ ID NO: 348532 - DNA, 20 bp, Artificial
  CRISPR gRNA sequence
ggggccgctgtgtgctcacc

SEQ ID NO: 348533 - DNA, 20 bp, Artificial
  CRISPR gRNA sequence
tgattttcttcttttcatgc

SEQ ID NO: 348534 - DNA, 20 bp, Artificial
  CRISPR gRNA sequence
ggtgccacatctttgaaaac

SEQ ID NO: 348535 - DNA, 20 bp, Artificial
  CRISPR gRNA sequence
tttgaaaacagttgtttaat

SEQ ID NO: 348536 - DNA, 20 bp, Artificial
  CRISPR gRNA sequence
ataaaaactaccatagactg

SEQ ID NO: 348537 - DNA, 20 bp, Artificial
  CRISPR gRNA sequence
cttctgacttcaaatgatct

SEQ ID NO: 348538 - DNA, 20 bp, Artificial
  CRISPR gRNA sequence
cgcttcggcctcccaaagtg

SEQ ID NO: 348539 - DNA, 20 bp, Artificial
  CRISPR gRNA sequence
tgttaagccacccagtctat

SEQ ID NO: 348540 - DNA, 20 bp, Artificial
  CRISPR gRNA sequence
attcaacagctactgagtgg

SEQ ID NO: 348541 - DNA, 20 bp, Artificial
  CRISPR gRNA sequence
tggacaagcttaaattaaac

SEQ ID NO: 348542 - DNA, 20 bp, Artificial
  CRISPR gRNA sequence
ttccccccacctccccatag

SEQ ID NO: 348543 - DNA, 20 bp, Artificial
  CRISPR gRNA sequence
ggagcagcagctcccgctgg

SEQ ID NO: 348544 - DNA, 20 bp, Artificial
  CRISPR gRNA sequence
gggagcctcatcgtcaacat

SEQ ID NO: 348545 - DNA, 20 bp, Artificial
  CRISPR gRNA sequence
ccaaacctgggaggtggccc

SEQ ID NO: 348546 - DNA, 20 bp, Artificial
  CRISPR gRNA sequence
ggagctacaggttggggcag

SEQ ID NO: 348547 - DNA, 20 bp, Artificial
  CRISPR gRNA sequence
actgtgggcagaagggcagg

SEQ ID NO: 348548 - DNA, 20 bp, Artificial
  CRISPR gRNA sequence
cggggtggggcagccagaag

SEQ ID NO: 348549 - DNA, 20 bp, Artificial
  CRISPR gRNA sequence
cacaccccaggacgctaagc

SEQ ID NO: 348550 - DNA, 20 bp, Artificial
  CRISPR gRNA sequence
ggctgcagggtcattcccct

SEQ ID NO: 348551 - DNA, 20 bp, Artificial
  CRISPR gRNA sequence
acagcaggcgtcactgatac

SEQ ID NO: 348552 - DNA, 20 bp, Artificial
  CRISPR gRNA sequence
gtgtaggtcagatgtagatc

SEQ ID NO: 348553 - DNA, 20 bp, Artificial
  CRISPR gRNA sequence
agcaagaaacaccgggaggt

SEQ ID NO: 348554 - DNA, 20 bp, Artificial
  CRISPR gRNA sequence
ccacagcatctccccaaata

SEQ ID NO: 348555 - DNA, 20 bp, Artificial
  CRISPR gRNA sequence
gggtgcagagtctgtgggtc

SEQ ID NO: 348556 - DNA, 20 bp, Artificial
  CRISPR gRNA sequence
ccaggttctcgggttcattt

SEQ ID NO: 348557 - DNA, 20 bp, Artificial
  CRISPR gRNA sequence
ctcgggttcattttactgct

SEQ ID NO: 348558 - DNA, 20 bp, Artificial
  CRISPR gRNA sequence
agcggtggcggaggcacaac

SEQ ID NO: 348559 - DNA, 20 bp, Artificial
  CRISPR gRNA sequence
gtcatctatgggaggggaac

SEQ ID NO: 348560 - DNA, 20 bp, Artificial
  CRISPR gRNA sequence
gaggccccgggtgaggatca

SEQ ID NO: 348561 - DNA, 20 bp, Artificial
  CRISPR gRNA sequence
ctgactttcccttcagacct

SEQ ID NO: 348562 - DNA, 20 bp, Artificial
  CRISPR gRNA sequence
gcggctgttgaccctcagcc

SEQ ID NO: 348563 - DNA, 20 bp, Artificial
  CRISPR gRNA sequence
aaaagctctggggccacctc

SEQ ID NO: 348564 - DNA, 20 bp, Artificial
  CRISPR gRNA sequence
gggccgccgtgtgctcaccc

SEQ ID NO: 348565 - DNA, 20 bp, Artificial
  CRISPR gRNA sequence
tggctttcttcttttcacac

SEQ ID NO: 348566 - DNA, 20 bp, Artificial
  CRISPR gRNA sequence
tggaggcagcctccctctgg

SEQ ID NO: 348567 - DNA, 20 bp, Artificial
  CRISPR gRNA sequence
tccaggaagctcagatctga

SEQ ID NO: 348568 - DNA, 20 bp, Artificial
  CRISPR gRNA sequence
gaaggggttatctggggcac

SEQ ID NO: 348569 - DNA, 20 bp, Artificial
  CRISPR gRNA sequence
ggagggggctggcggctagg

SEQ ID NO: 348570 - DNA, 20 bp, Artificial
  CRISPR gRNA sequence
cggctagggactgcttgtct

SEQ ID NO: 348571 - DNA, 20 bp, Artificial
  CRISPR gRNA sequence
ggacacttactcctcctaga

SEQ ID NO: 348572 - DNA, 20 bp, Artificial
  CRISPR gRNA sequence
ccatcacctgttccccactg

SEQ ID NO: 348573 - DNA, 20 bp, Artificial
  CRISPR gRNA sequence
tgggaggggtgtccgccacc

SEQ ID NO: 348574 - DNA, 20 bp, Artificial
  CRISPR gRNA sequence
ggcagagctgcgtgtgggac

SEQ ID NO: 348575 - DNA, 20 bp, Artificial
  CRISPR gRNA sequence
ggcttgcaggaaggtcctgg

SEQ ID NO: 348576 - DNA, 20 bp, Artificial
  CRISPR gRNA sequence
ctgcccagatgggcaggacg

SEQ ID NO: 348577 - DNA, 20 bp, Artificial
  CRISPR gRNA sequence
cccagacacccaccccgcaa

SEQ ID NO: 348578 - DNA, 20 bp, Artificial
  CRISPR gRNA sequence
catcctcagcccaagtagac

SEQ ID NO: 348579 - DNA, 20 bp, Artificial
  CRISPR gRNA sequence
tgcatgaacccccaaagcac

SEQ ID NO: 348580 - DNA, 20 bp, Artificial
  CRISPR gRNA sequence
acacatttggcactgcagac

SEQ ID NO: 348581 - DNA, 20 bp, Artificial
  CRISPR gRNA sequence
actgtctgcacacctagccc

SEQ ID NO: 348582 - DNA, 20 bp, Artificial
  CRISPR gRNA sequence
tggctgccctgtgggctctg

SEQ ID NO: 348583 - DNA, 20 bp, Artificial
  CRISPR gRNA sequence
gggctcaccagcctcaagac

SEQ ID NO: 348584 - DNA, 20 bp, Artificial
  CRISPR gRNA sequence
ctgcaccattccagtccact

SEQ ID NO: 348585 - DNA, 20 bp, Artificial
  CRISPR gRNA sequence
gggagccccccaaagtccat

SEQ ID NO: 348586 - DNA, 20 bp, Artificial
  CRISPR gRNA sequence
gcccacctgagtccaggcag

SEQ ID NO: 348587 - DNA, 20 bp, Artificial
  CRISPR gRNA sequence
ggagatgaccgtcttctcca

SEQ ID NO: 348588 - DNA, 20 bp, Artificial
  CRISPR gRNA sequence
cctaatcatatgtgtgaaaa

SEQ ID NO: 348589 - DNA, 20 bp, Artificial
  CRISPR gRNA sequence
cacttcccagctgtgtccac

SEQ ID NO: 348590 - DNA, 20 bp, Artificial
  CRISPR gRNA sequence
ccaggtggagccctgggccc

SEQ ID NO: 348591 - DNA, 20 bp, Artificial
  CRISPR gRNA sequence
catgagattaggccaagtgt

SEQ ID NO: 348592 - DNA, 20 bp, Artificial
  CRISPR gRNA sequence
gttgacgatgaggctccctg

SEQ ID NO: 348593 - DNA, 20 bp, Artificial
  CRISPR gRNA sequence
ggggggaaggaaggaagagg

SEQ ID NO: 348594 - DNA, 20 bp, Artificial
  CRISPR gRNA sequence
gactgggtggcttaacaaga

SEQ ID NO: 348595 - DNA, 20 bp, Artificial
  CRISPR gRNA sequence
cctaatctcatgcatgaaaa

SEQ ID NO: 348596 - DNA, 20 bp, Artificial
  CRISPR gRNA sequence
aatctgacaccatttgagca

SEQ ID NO: 348597 - DNA, 20 bp, Artificial
  CRISPR gRNA sequence
tcctggaactccttgttcag

SEQ ID NO: 348598 - DNA, 20 bp, Artificial
  CRISPR gRNA sequence
accgggaggtgacagtttga

SEQ ID NO: 348599 - DNA, 20 bp, Artificial
  CRISPR gRNA sequence
aatacactgtttcatgacaa

SEQ ID NO: 348600 - DNA, 20 bp, Artificial
  CRISPR gRNA sequence
gagccgaattcaaatccaat

SEQ ID NO: 348601 - DNA, 20 bp, Artificial
  CRISPR gRNA sequence
gggagcccccaccatgtaca

SEQ ID NO: 348602 - DNA, 20 bp, Artificial
  CRISPR gRNA sequence
acacctgggctctggccaca

SEQ ID NO: 348603 - DNA, 20 bp, Artificial
  CRISPR gRNA sequence
gacgatgacgaggctccctg

SEQ ID NO: 348604 - DNA, 20 bp, Artificial
  CRISPR gRNA sequence
ggagagaaggaaggaggaga

SEQ ID NO: 348605 - DNA, 20 bp, Artificial
  CRISPR gRNA sequence
ctgggagggcttcgttgatg

SEQ ID NO: 348606 - DNA, 20 bp, Artificial
  CRISPR gRNA sequence
agggggaaccaatatctgga

SEQ ID NO: 348607 - DNA, 20 bp, Artificial
  CRISPR gRNA sequence
tgctgcggctgtgggccaga

SEQ ID NO: 348608 - DNA, 20 bp, Artificial
  CRISPR gRNA sequence
ggctgtgggccagaagagaa

SEQ ID NO: 348609 - DNA, 20 bp, Artificial
  CRISPR gRNA sequence
gggccagaagagaaagagaa

SEQ ID NO: 348610 - DNA, 20 bp, Artificial
  CRISPR gRNA sequence
gaagagaaagagaaagagaa

SEQ ID NO: 348611 - DNA, 20 bp, Artificial
  CRISPR gRNA sequence
cctccctggagatccacccc

SEQ ID NO: 348612 - DNA, 20 bp, Artificial
  CRISPR gRNA sequence
tggtgtcagatttgcccagt

SEQ ID NO: 348613 - DNA, 20 bp, Artificial
  CRISPR gRNA sequence
ccgcccggtgccacatcttt

SEQ ID NO: 348614 - DNA, 20 bp, Artificial
  CRISPR gRNA sequence
attcaagttgctataaaaat

SEQ ID NO: 348615 - DNA, 20 bp, Artificial
  CRISPR gRNA sequence
acactgtttcatgacaaata

SEQ ID NO: 348616 - DNA, 20 bp, Artificial
  CRISPR gRNA sequence
tggggggctcccccttctac

SEQ ID NO: 348617 - DNA, 20 bp, Artificial
  CRISPR gRNA sequence
ggggggctcccccttctaca

SEQ ID NO: 348618 - DNA, 20 bp, Artificial
  CRISPR gRNA sequence
gggggctcccccttctacag

SEQ ID NO: 348619 - DNA, 20 bp, Artificial
  CRISPR gRNA sequence
ccccttctacaggaaacccg

SEQ ID NO: 348620 - DNA, 20 bp, Artificial
  CRISPR gRNA sequence
ctacaggaaacccggagtgg

SEQ ID NO: 348621 - DNA, 20 bp, Artificial
  CRISPR gRNA sequence
tacaggaaacccggagtgga

SEQ ID NO: 348622 - DNA, 20 bp, Artificial
  CRISPR gRNA sequence
caggaaacccggagtggact

SEQ ID NO: 348623 - DNA, 20 bp, Artificial
  CRISPR gRNA sequence
gaatggtgcagggggagaac

SEQ ID NO: 348624 - DNA, 20 bp, Artificial
  CRISPR gRNA sequence
gcccctcccatcgggcgcct

SEQ ID NO: 348625 - DNA, 20 bp, Artificial
  CRISPR gRNA sequence
ccatcgggcgcctccttcat

SEQ ID NO: 348626 - DNA, 20 bp, Artificial
  CRISPR gRNA sequence
cttcataccggcccttcccc

SEQ ID NO: 348627 - DNA, 20 bp, Artificial
  CRISPR gRNA sequence
cataccggcccttcccctcg

SEQ ID NO: 348628 - DNA, 20 bp, Artificial
  CRISPR gRNA sequence
ataccggcccttcccctcgg

SEQ ID NO: 348629 - DNA, 20 bp, Artificial
  CRISPR gRNA sequence
cccctcggctttgcctggac

SEQ ID NO: 348630 - DNA, 20 bp, Artificial
  CRISPR gRNA sequence
ccctcggctttgcctggaca

SEQ ID NO: 348631 - DNA, 20 bp, Artificial
  CRISPR gRNA sequence
ggctttgcctggacagctcc

SEQ ID NO: 348632 - DNA, 20 bp, Artificial
  CRISPR gRNA sequence
tgcctggacagctcctgcct

SEQ ID NO: 348633 - DNA, 20 bp, Artificial
  CRISPR gRNA sequence
gcctggacagctcctgcctc

SEQ ID NO: 348634 - DNA, 20 bp, Artificial
  CRISPR gRNA sequence
cctggacagctcctgcctcc

SEQ ID NO: 348635 - DNA, 20 bp, Artificial
  CRISPR gRNA sequence
gacagctcctgcctcccgca

SEQ ID NO: 348636 - DNA, 20 bp, Artificial
  CRISPR gRNA sequence
ctgcctcccgcagggcccac

SEQ ID NO: 348637 - DNA, 20 bp, Artificial
  CRISPR gRNA sequence
cctcccgcagggcccacctg

SEQ ID NO: 348638 - DNA, 20 bp, Artificial
  CRISPR gRNA sequence
ccgcagggcccacctgtgtc

SEQ ID NO: 348639 - DNA, 20 bp, Artificial
  CRISPR gRNA sequence
tgtcccccagcgccgctcca

SEQ ID NO: 348640 - DNA, 20 bp, Artificial
  CRISPR gRNA sequence
cacccagcaggcctgagccc

SEQ ID NO: 348641 - DNA, 20 bp, Artificial
  CRISPR gRNA sequence
agcccctctctgctgccaga

SEQ ID NO: 348642 - DNA, 20 bp, Artificial
  CRISPR gRNA sequence
tctgctgccagacaccccct

SEQ ID NO: 348643 - DNA, 20 bp, Artificial
  CRISPR gRNA sequence
tgctgccagacaccccctgc

SEQ ID NO: 348644 - DNA, 20 bp, Artificial
  CRISPR gRNA sequence
ctgccagacaccccctgctg

SEQ ID NO: 348645 - DNA, 20 bp, Artificial
  CRISPR gRNA sequence
ccagacaccccctgctgccc

SEQ ID NO: 348646 - DNA, 20 bp, Artificial
  CRISPR gRNA sequence
ctgcccactctcctgctgct

SEQ ID NO: 348647 - DNA, 20 bp, Artificial
  CRISPR gRNA sequence
cccactctcctgctgctcgg

SEQ ID NO: 348648 - DNA, 20 bp, Artificial
  CRISPR gRNA sequence
tcctgctgctcgggttctga

SEQ ID NO: 348649 - DNA, 20 bp, Artificial
  CRISPR gRNA sequence
ctgctgctcgggttctgagg

SEQ ID NO: 348650 - DNA, 20 bp, Artificial
  CRISPR gRNA sequence
ctgctcgggttctgaggcac

SEQ ID NO: 348651 - DNA, 20 bp, Artificial
  CRISPR gRNA sequence
ctcgggttctgaggcacagc

SEQ ID NO: 348652 - DNA, 20 bp, Artificial
  CRISPR gRNA sequence
gggttctgaggcacagcttg

SEQ ID NO: 348653 - DNA, 20 bp, Artificial
  CRISPR gRNA sequence
tgaggcacagcttgtcacac

SEQ ID NO: 348654 - DNA, 20 bp, Artificial
  CRISPR gRNA sequence
aggcacagcttgtcacaccg

SEQ ID NO: 348655 - DNA, 20 bp, Artificial
  CRISPR gRNA sequence
gtcacaccgaggcggattct

SEQ ID NO: 348656 - DNA, 20 bp, Artificial
  CRISPR gRNA sequence
tcacaccgaggcggattctc

SEQ ID NO: 348657 - DNA, 20 bp, Artificial
  CRISPR gRNA sequence
tctttctctttctctttctc

SEQ ID NO: 348658 - DNA, 20 bp, Artificial
  CRISPR gRNA sequence
tttctctttctctttctctt

SEQ ID NO: 348659 - DNA, 20 bp, Artificial
  CRISPR gRNA sequence
tctctttctctttctcttct

SEQ ID NO: 348660 - DNA, 20 bp, Artificial
  CRISPR gRNA sequence
ctctttctctttctcttctg

SEQ ID NO: 348661 - DNA, 20 bp, Artificial
  CRISPR gRNA sequence
tctttctctttctcttctgg

SEQ ID NO: 348662 - DNA, 20 bp, Artificial
  CRISPR gRNA sequence
tttctctttctcttctggcc

SEQ ID NO: 348663 - DNA, 20 bp, Artificial
  CRISPR gRNA sequence
tctctttctcttctggccca

SEQ ID NO: 348664 - DNA, 20 bp, Artificial
  CRISPR gRNA sequence
ctctttctcttctggcccac

SEQ ID NO: 348665 - DNA, 20 bp, Artificial
  CRISPR gRNA sequence
tctttctcttctggcccaca

SEQ ID NO: 348666 - DNA, 20 bp, Artificial
  CRISPR gRNA sequence
tttctcttctggcccacagc

SEQ ID NO: 348667 - DNA, 20 bp, Artificial
  CRISPR gRNA sequence
tctcttctggcccacagccg

SEQ ID NO: 348668 - DNA, 20 bp, Artificial
  CRISPR gRNA sequence
ctcttctggcccacagccgc

SEQ ID NO: 348669 - DNA, 20 bp, Artificial
  CRISPR gRNA sequence
tcttctggcccacagccgca

SEQ ID NO: 348670 - DNA, 20 bp, Artificial
  CRISPR gRNA sequence
ttctggcccacagccgcagc

SEQ ID NO: 348671 - DNA, 20 bp, Artificial
  CRISPR gRNA sequence
ctggcccacagccgcagcaa

SEQ ID NO: 348672 - DNA, 20 bp, Artificial
  CRISPR gRNA sequence
tggcccacagccgcagcaat

SEQ ID NO: 348673 - DNA, 20 bp, Artificial
  CRISPR gRNA sequence
gcccacagccgcagcaatgg

SEQ ID NO: 348674 - DNA, 20 bp, Artificial
  CRISPR gRNA sequence
agttcctctgctggagttca

SEQ ID NO: 348675 - DNA, 20 bp, Artificial
  CRISPR gRNA sequence
ctctgctggagttcatcctg

SEQ ID NO: 348676 - DNA, 20 bp, Artificial
  CRISPR gRNA sequence
tgctggagttcatcctgcta

SEQ ID NO: 348677 - DNA, 20 bp, Artificial
  CRISPR gRNA sequence
ctggagttcatcctgctagc

SEQ ID NO: 348678 - DNA, 20 bp, Artificial
  CRISPR gRNA sequence
gagttcatcctgctagctgg

SEQ ID NO: 348679 - DNA, 20 bp, Artificial
  CRISPR gRNA sequence
atcctgctagctgggttccc

SEQ ID NO: 348680 - DNA, 20 bp, Artificial
  CRISPR gRNA sequence
ctagctgggttcccgagctg

SEQ ID NO: 348681 - DNA, 20 bp, Artificial
  CRISPR gRNA sequence
gctgggttcccgagctgccg

SEQ ID NO: 348682 - DNA, 20 bp, Artificial
  CRISPR gRNA sequence
ggttcccgagctgccggtct

SEQ ID NO: 348683 - DNA, 20 bp, Artificial
  CRISPR gRNA sequence
ccgagctgccggtctgagcc

SEQ ID NO: 348684 - DNA, 20 bp, Artificial
  CRISPR gRNA sequence
ccggtctgagcctgaggcca

SEQ ID NO: 348685 - DNA, 20 bp, Artificial
  CRISPR gRNA sequence
agcctgaggccatgagcctc

SEQ ID NO: 348686 - DNA, 20 bp, Artificial
  CRISPR gRNA sequence
aggccatgagcctcctggag

SEQ ID NO: 348687 - DNA, 20 bp, Artificial
  CRISPR gRNA sequence
ctggagactgggggcctcct

SEQ ID NO: 348688 - DNA, 20 bp, Artificial
  CRISPR gRNA sequence
gagactgggggcctcctccc

SEQ ID NO: 348689 - DNA, 20 bp, Artificial
  CRISPR gRNA sequence
ggggcctcctccctggagat

SEQ ID NO: 348690 - DNA, 20 bp, Artificial
  CRISPR gRNA sequence
ctccctggagatccaccccc

SEQ ID NO: 348691 - DNA, 20 bp, Artificial
  CRISPR gRNA sequence
cctggagatccacccccaaa

SEQ ID NO: 348692 - DNA, 20 bp, Artificial
  CRISPR gRNA sequence
gagatccacccccaaaaccg

SEQ ID NO: 348693 - DNA, 20 bp, Artificial
  CRISPR gRNA sequence
gaggctggtgagcccccgag

SEQ ID NO: 348694 - DNA, 20 bp, Artificial
  CRISPR gRNA sequence
aggctggtgagcccccgagc

SEQ ID NO: 348695 - DNA, 20 bp, Artificial
  CRISPR gRNA sequence
gtgagcccccgagcctcctc

SEQ ID NO: 348696 - DNA, 20 bp, Artificial
  CRISPR gRNA sequence
ctctccgtctgctcgcagat

SEQ ID NO: 348697 - DNA, 20 bp, Artificial
  CRISPR gRNA sequence
tccgtctgctcgcagatccc

SEQ ID NO: 348698 - DNA, 20 bp, Artificial
  CRISPR gRNA sequence
cgtctgctcgcagatcccag

SEQ ID NO: 348699 - DNA, 20 bp, Artificial
  CRISPR gRNA sequence
ctcgcagatcccagttctga

SEQ ID NO: 348700 - DNA, 20 bp, Artificial
  CRISPR gRNA sequence
gcagatcccagttctgaccc

SEQ ID NO: 348701 - DNA, 20 bp, Artificial
  CRISPR gRNA sequence
tgaccccagggcctcccaca

SEQ ID NO: 348702 - DNA, 20 bp, Artificial
  CRISPR gRNA sequence
accccagggcctcccacaga

SEQ ID NO: 348703 - DNA, 20 bp, Artificial
  CRISPR gRNA sequence
ccacagatctcttccccatg

SEQ ID NO: 348704 - DNA, 20 bp, Artificial
  CRISPR gRNA sequence
ttccccatgcccctgtcctg

SEQ ID NO: 348705 - DNA, 20 bp, Artificial
  CRISPR gRNA sequence
ccccatgcccctgtcctggc

SEQ ID NO: 348706 - DNA, 20 bp, Artificial
  CRISPR gRNA sequence
cccatgcccctgtcctggcc

SEQ ID NO: 348707 - DNA, 20 bp, Artificial
  CRISPR gRNA sequence
tcctggccgttgctggctcc

SEQ ID NO: 348708 - DNA, 20 bp, Artificial
  CRISPR gRNA sequence
gccgttgctggctccggcgt

SEQ ID NO: 348709 - DNA, 20 bp, Artificial
  CRISPR gRNA sequence
ctggctccggcgtccagccc

SEQ ID NO: 348710 - DNA, 20 bp, Artificial
  CRISPR gRNA sequence
gctccggcgtccagcccgtc

SEQ ID NO: 348711 - DNA, 20 bp, Artificial
  CRISPR gRNA sequence
cggcgtccagcccgtcccct

SEQ ID NO: 348712 - DNA, 20 bp, Artificial
  CRISPR gRNA sequence
ctgcctggggctctcgggtc

SEQ ID NO: 348713 - DNA, 20 bp, Artificial
  CRISPR gRNA sequence
cctggggctctcgggtcaac

SEQ ID NO: 348714 - DNA, 20 bp, Artificial
  CRISPR gRNA sequence
gggctctcgggtcaacccag

SEQ ID NO: 348715 - DNA, 20 bp, Artificial
  CRISPR gRNA sequence
tcgggtcaacccagaccccc

SEQ ID NO: 348716 - DNA, 20 bp, Artificial
  CRISPR gRNA sequence
gggtcaacccagacccccag

SEQ ID NO: 348717 - DNA, 20 bp, Artificial
  CRISPR gRNA sequence
ggctcaccacagtggggtga

SEQ ID NO: 348718 - DNA, 20 bp, Artificial
  CRISPR gRNA sequence
accacagtggggtgagcagc

SEQ ID NO: 348719 - DNA, 20 bp, Artificial
  CRISPR gRNA sequence
cccagcagacctcctcctgc

SEQ ID NO: 348720 - DNA, 20 bp, Artificial
  CRISPR gRNA sequence
ctcctgcgtgtgtcccccac

SEQ ID NO: 348721 - DNA, 20 bp, Artificial
  CRISPR gRNA sequence
ctgcgtgtgtcccccactca

SEQ ID NO: 348722 - DNA, 20 bp, Artificial
  CRISPR gRNA sequence
cgtgtgtcccccactcacca

SEQ ID NO: 348723 - DNA, 20 bp, Artificial
  CRISPR gRNA sequence
accactccgtccacgggcag

SEQ ID NO: 348724 - DNA, 20 bp, Artificial
  CRISPR gRNA sequence
cgtccacgggcagctggtga

SEQ ID NO: 348725 - DNA, 20 bp, Artificial
  CRISPR gRNA sequence
gtgagcccccatttggccgg

SEQ ID NO: 348726 - DNA, 20 bp, Artificial
  CRISPR gRNA sequence
ggccggatgtgggcacttct

SEQ ID NO: 348727 - DNA, 20 bp, Artificial
  CRISPR gRNA sequence
gccggatgtgggcacttctg

SEQ ID NO: 348728 - DNA, 20 bp, Artificial
  CRISPR gRNA sequence
ctgggggctgggtgtctctg

SEQ ID NO: 348729 - DNA, 20 bp, Artificial
  CRISPR gRNA sequence
tgggggctgggtgtctctgg

SEQ ID NO: 348730 - DNA, 20 bp, Artificial
  CRISPR gRNA sequence
ggggctgggtgtctctgggc

SEQ ID NO: 348731 - DNA, 20 bp, Artificial
  CRISPR gRNA sequence
ggtgtctctgggcgtctctg

SEQ ID NO: 348732 - DNA, 20 bp, Artificial
  CRISPR gRNA sequence
tgggcgtctctgggcggggc

SEQ ID NO: 348733 - DNA, 20 bp, Artificial
  CRISPR gRNA sequence
ggcgtctctgggcggggccc

SEQ ID NO: 348734 - DNA, 20 bp, Artificial
  CRISPR gRNA sequence
tgggcggggccctcgagcag

SEQ ID NO: 348735 - DNA, 20 bp, Artificial
  CRISPR gRNA sequence
ggcggggccctcgagcaggt

SEQ ID NO: 348736 - DNA, 20 bp, Artificial
  CRISPR gRNA sequence
gagcaggtgacccaactccc

SEQ ID NO: 348737 - DNA, 20 bp, Artificial
  CRISPR gRNA sequence
cccggcagccctgaccttgg

SEQ ID NO: 348738 - DNA, 20 bp, Artificial
  CRISPR gRNA sequence
accttggtgacaggtgataa

SEQ ID NO: 348739 - DNA, 20 bp, Artificial
  CRISPR gRNA sequence
ggtgacaggtgataagatca

SEQ ID NO: 348740 - DNA, 20 bp, Artificial
  CRISPR gRNA sequence
gtgacaggtgataagatcag

SEQ ID NO: 348741 - DNA, 20 bp, Artificial
  CRISPR gRNA sequence
gacccaggtgggtggggtgg

SEQ ID NO: 348742 - DNA, 20 bp, Artificial
  CRISPR gRNA sequence
tccatgctcatgtggcactc

SEQ ID NO: 348743 - DNA, 20 bp, Artificial
  CRISPR gRNA sequence
catgctcatgtggcactcct

SEQ ID NO: 348744 - DNA, 20 bp, Artificial
  CRISPR gRNA sequence
atgtggcactcctgcctgtc

SEQ ID NO: 348745 - DNA, 20 bp, Artificial
  CRISPR gRNA sequence
ctgcctgtccagccactatc

SEQ ID NO: 348746 - DNA, 20 bp, Artificial
  CRISPR gRNA sequence
cctgtccagccactatcccc

SEQ ID NO: 348747 - DNA, 20 bp, Artificial
  CRISPR gRNA sequence
tccagccactatccccatca

SEQ ID NO: 348748 - DNA, 20 bp, Artificial
  CRISPR gRNA sequence
tccccatcaggggcccccga

SEQ ID NO: 348749 - DNA, 20 bp, Artificial
  CRISPR gRNA sequence
cccatcagccagcccaggaa

SEQ ID NO: 348750 - DNA, 20 bp, Artificial
  CRISPR gRNA sequence
cccgatgtggccctgatcag

SEQ ID NO: 348751 - DNA, 20 bp, Artificial
  CRISPR gRNA sequence
atcagcctgtcacccactgt

SEQ ID NO: 348752 - DNA, 20 bp, Artificial
  CRISPR gRNA sequence
tcacccactgtctggcttgt

SEQ ID NO: 348753 - DNA, 20 bp, Artificial
  CRISPR gRNA sequence
tctggcttgtgagcctctgg

SEQ ID NO: 348754 - DNA, 20 bp, Artificial
  CRISPR gRNA sequence
gcttgtgagcctctggggcc

SEQ ID NO: 348755 - DNA, 20 bp, Artificial
  CRISPR gRNA sequence
gtgagcctctggggcccatc

SEQ ID NO: 348756 - DNA, 20 bp, Artificial
  CRISPR gRNA sequence
tgagcctctggggcccatcc

SEQ ID NO: 348757 - DNA, 20 bp, Artificial
  CRISPR gRNA sequence
tggggcccatccctggctgc

SEQ ID NO: 348758 - DNA, 20 bp, Artificial
  CRISPR gRNA sequence
gggcccatccctggctgccc

SEQ ID NO: 348759 - DNA, 20 bp, Artificial
  CRISPR gRNA sequence
gctgcccctgctggctcttc

SEQ ID NO: 348760 - DNA, 20 bp, Artificial
  CRISPR gRNA sequence
cccctgctggctcttcaggg

SEQ ID NO: 348761 - DNA, 20 bp, Artificial
  CRISPR gRNA sequence
ctggctcttcaggggtcagc

SEQ ID NO: 348762 - DNA, 20 bp, Artificial
  CRISPR gRNA sequence
gctcttcaggggtcagcagg

SEQ ID NO: 348763 - DNA, 20 bp, Artificial
  CRISPR gRNA sequence
ttcaggggtcagcaggtcca

SEQ ID NO: 348764 - DNA, 20 bp, Artificial
  CRISPR gRNA sequence
caggggtcagcaggtccaac

SEQ ID NO: 348765 - DNA, 20 bp, Artificial
  CRISPR gRNA sequence
aggggtcagcaggtccaacc

SEQ ID NO: 348766 - DNA, 20 bp, Artificial
  CRISPR gRNA sequence
ggccagcaggggggccggca

SEQ ID NO: 348767 - DNA, 20 bp, Artificial
  CRISPR gRNA sequence
tctgcccagtgggctcaatg

SEQ ID NO: 348768 - DNA, 20 bp, Artificial
  CRISPR gRNA sequence
cccagtgggctcaatgctcc

SEQ ID NO: 348769 - DNA, 20 bp, Artificial
  CRISPR gRNA sequence
aatgctcccaggtgtggggt

SEQ ID NO: 348770 - DNA, 20 bp, Artificial
  CRISPR gRNA sequence
ccaggtgtggggtgtggggt

SEQ ID NO: 348771 - DNA, 20 bp, Artificial
  CRISPR gRNA sequence
gcgagggcagagttccagtt

SEQ ID NO: 348772 - DNA, 20 bp, Artificial
  CRISPR gRNA sequence
cagttcccagggctccgcgc

SEQ ID NO: 348773 - DNA, 20 bp, Artificial
  CRISPR gRNA sequence
ccagggctccgcgctgccag

SEQ ID NO: 348774 - DNA, 20 bp, Artificial
  CRISPR gRNA sequence
cgcgctgccaggcagcgtca

SEQ ID NO: 348775 - DNA, 20 bp, Artificial
  CRISPR gRNA sequence
ccaggcagcgtcatcagggc

SEQ ID NO: 348776 - DNA, 20 bp, Artificial
  CRISPR gRNA sequence
gaggaggggcggtccccacc

SEQ ID NO: 348777 - DNA, 20 bp, Artificial
  CRISPR gRNA sequence
tcccgggctccagcggtcgg

SEQ ID NO: 348778 - DNA, 20 bp, Artificial
  CRISPR gRNA sequence
cagcggtcggcaaggttgtt

SEQ ID NO: 348779 - DNA, 20 bp, Artificial
  CRISPR gRNA sequence
ttccatgagcctggcctggg

SEQ ID NO: 348780 - DNA, 20 bp, Artificial
  CRISPR gRNA sequence
catgagcctggcctggggcc

SEQ ID NO: 348781 - DNA, 20 bp, Artificial
  CRISPR gRNA sequence
gcctggggcccgcttctgtc

SEQ ID NO: 348782 - DNA, 20 bp, Artificial
  CRISPR gRNA sequence
gggcccgcttctgtcctctc

SEQ ID NO: 348783 - DNA, 20 bp, Artificial
  CRISPR gRNA sequence
ctgtcctctctaccaggcac

SEQ ID NO: 348784 - DNA, 20 bp, Artificial
  CRISPR gRNA sequence
tgtcctctctaccaggcact

SEQ ID NO: 348785 - DNA, 20 bp, Artificial
  CRISPR gRNA sequence
tcctctctaccaggcactgc

SEQ ID NO: 348786 - DNA, 20 bp, Artificial
  CRISPR gRNA sequence
tctaccaggcactgccgctc

SEQ ID NO: 348787 - DNA, 20 bp, Artificial
  CRISPR gRNA sequence
taccaggcactgccgctcct

SEQ ID NO: 348788 - DNA, 20 bp, Artificial
  CRISPR gRNA sequence
ccaggcactgccgctcctcc

SEQ ID NO: 348789 - DNA, 20 bp, Artificial
  CRISPR gRNA sequence
ccgctcctccccattgcaca

SEQ ID NO: 348790 - DNA, 20 bp, Artificial
  CRISPR gRNA sequence
ctccccattgcacagaggga

SEQ ID NO: 348791 - DNA, 20 bp, Artificial
  CRISPR gRNA sequence
cccattgcacagagggagat

SEQ ID NO: 348792 - DNA, 20 bp, Artificial
  CRISPR gRNA sequence
cacagagggagattcaggct

SEQ ID NO: 348793 - DNA, 20 bp, Artificial
  CRISPR gRNA sequence
aggctgtggggccaagcctg

SEQ ID NO: 348794 - DNA, 20 bp, Artificial
  CRISPR gRNA sequence
tggggccaagcctggcagag

SEQ ID NO: 348795 - DNA, 20 bp, Artificial
  CRISPR gRNA sequence
gcagagcccacagggcagcc

SEQ ID NO: 348796 - DNA, 20 bp, Artificial
  CRISPR gRNA sequence
ccaatgcctgtcctgacccc

SEQ ID NO: 348797 - DNA, 20 bp, Artificial
  CRISPR gRNA sequence
tcctgacccccttaggtgct

SEQ ID NO: 348798 - DNA, 20 bp, Artificial
  CRISPR gRNA sequence
acccccttaggtgctgtatc

SEQ ID NO: 348799 - DNA, 20 bp, Artificial
  CRISPR gRNA sequence
aggtgctgtatctcaccttc

SEQ ID NO: 348800 - DNA, 20 bp, Artificial
  CRISPR gRNA sequence
ggtgctgtatctcaccttcc

SEQ ID NO: 348801 - DNA, 20 bp, Artificial
  CRISPR gRNA sequence
tatctcaccttcctgggagc

SEQ ID NO: 348802 - DNA, 20 bp, Artificial
  CRISPR gRNA sequence
accttcctgggagccccctg

SEQ ID NO: 348803 - DNA, 20 bp, Artificial
  CRISPR gRNA sequence
cctgggagccccctgctacg

SEQ ID NO: 348804 - DNA, 20 bp, Artificial
  CRISPR gRNA sequence
ctgggagccccctgctacgc

SEQ ID NO: 348805 - DNA, 20 bp, Artificial
  CRISPR gRNA sequence
ggagccccctgctacgcccc

SEQ ID NO: 348806 - DNA, 20 bp, Artificial
  CRISPR gRNA sequence
ctacgccccagctctgccgt

SEQ ID NO: 348807 - DNA, 20 bp, Artificial
  CRISPR gRNA sequence
cgccccagctctgccgtcct

SEQ ID NO: 348808 - DNA, 20 bp, Artificial
  CRISPR gRNA sequence
tgccgtcctgcaaggaggac

SEQ ID NO: 348809 - DNA, 20 bp, Artificial
  CRISPR gRNA sequence
ccgtcctgcaaggaggacga

SEQ ID NO: 348810 - DNA, 20 bp, Artificial
  CRISPR gRNA sequence
caaggaggacgagtacccag

SEQ ID NO: 348811 - DNA, 20 bp, Artificial
  CRISPR gRNA sequence
cgagtgctgccccaagtgca

SEQ ID NO: 348812 - DNA, 20 bp, Artificial
  CRISPR gRNA sequence
ccccaagtgcagtccaggta

SEQ ID NO: 348813 - DNA, 20 bp, Artificial
  CRISPR gRNA sequence
tggcgggccagctctgtggg

SEQ ID NO: 348814 - DNA, 20 bp, Artificial
  CRISPR gRNA sequence
ggcgggccagctctgtgggc

SEQ ID NO: 348815 - DNA, 20 bp, Artificial
  CRISPR gRNA sequence
gcgggccagctctgtgggcc

SEQ ID NO: 348816 - DNA, 20 bp, Artificial
  CRISPR gRNA sequence
tgtgggccgagggcagacac

SEQ ID NO: 348817 - DNA, 20 bp, Artificial
  CRISPR gRNA sequence
tgggccgagggcagacactc

SEQ ID NO: 348818 - DNA, 20 bp, Artificial
  CRISPR gRNA sequence
ttgcccccttctgccccaga

SEQ ID NO: 348819 - DNA, 20 bp, Artificial
  CRISPR gRNA sequence
gcccccttctgccccagaca

SEQ ID NO: 348820 - DNA, 20 bp, Artificial
  CRISPR gRNA sequence
cccccttctgccccagacac

SEQ ID NO: 348821 - DNA, 20 bp, Artificial
  CRISPR gRNA sequence
ctgccccagacacccctgtg

SEQ ID NO: 348822 - DNA, 20 bp, Artificial
  CRISPR gRNA sequence
tgccccagacacccctgtgt

SEQ ID NO: 348823 - DNA, 20 bp, Artificial
  CRISPR gRNA sequence
ccccagacacccctgtgttc

SEQ ID NO: 348824 - DNA, 20 bp, Artificial
  CRISPR gRNA sequence
tgttctctgcccccacagcc

SEQ ID NO: 348825 - DNA, 20 bp, Artificial
  CRISPR gRNA sequence
tctgcccccacagccatggg

SEQ ID NO: 348826 - DNA, 20 bp, Artificial
  CRISPR gRNA sequence
tgcccccacagccatgggtg

SEQ ID NO: 348827 - DNA, 20 bp, Artificial
  CRISPR gRNA sequence
cccccacagccatgggtgtg

SEQ ID NO: 348828 - DNA, 20 bp, Artificial
  CRISPR gRNA sequence
gggctaggtgtgcagacagt

SEQ ID NO: 348829 - DNA, 20 bp, Artificial
  CRISPR gRNA sequence
ggtgtgcagacagtgagggc

SEQ ID NO: 348830 - DNA, 20 bp, Artificial
  CRISPR gRNA sequence
ggactcttcaccctggggga

SEQ ID NO: 348831 - DNA, 20 bp, Artificial
  CRISPR gRNA sequence
gactcttcaccctgggggac

SEQ ID NO: 348832 - DNA, 20 bp, Artificial
  CRISPR gRNA sequence
ttcaccctgggggaccctca

SEQ ID NO: 348833 - DNA, 20 bp, Artificial
  CRISPR gRNA sequence
caccctgggggaccctcaca

SEQ ID NO: 348834 - DNA, 20 bp, Artificial
  CRISPR gRNA sequence
accctgggggaccctcacag

SEQ ID NO: 348835 - DNA, 20 bp, Artificial
  CRISPR gRNA sequence
ggggaccctcacagtcacac

SEQ ID NO: 348836 - DNA, 20 bp, Artificial
  CRISPR gRNA sequence
acagtcacactgcacagggg

SEQ ID NO: 348837 - DNA, 20 bp, Artificial
  CRISPR gRNA sequence
cacagggggtgggtctgaga

SEQ ID NO: 348838 - DNA, 20 bp, Artificial
  CRISPR gRNA sequence
agagacgtggctggcccacc

SEQ ID NO: 348839 - DNA, 20 bp, Artificial
  CRISPR gRNA sequence
gcccaccgtggccagagaca

SEQ ID NO: 348840 - DNA, 20 bp, Artificial
  CRISPR gRNA sequence
gggggcacataccagagccg

SEQ ID NO: 348841 - DNA, 20 bp, Artificial
  CRISPR gRNA sequence
ccagaactttccgattttcc

SEQ ID NO: 348842 - DNA, 20 bp, Artificial
  CRISPR gRNA sequence
cagaactttccgattttccc

SEQ ID NO: 348843 - DNA, 20 bp, Artificial
  CRISPR gRNA sequence
tccgattttccccagagcag

SEQ ID NO: 348844 - DNA, 20 bp, Artificial
  CRISPR gRNA sequence
ccgattttccccagagcagc

SEQ ID NO: 348845 - DNA, 20 bp, Artificial
  CRISPR gRNA sequence
cgattttccccagagcagct

SEQ ID NO: 348846 - DNA, 20 bp, Artificial
  CRISPR gRNA sequence
tccccagagcagctctgctc

SEQ ID NO: 348847 - DNA, 20 bp, Artificial
  CRISPR gRNA sequence
ccccagagcagctctgctca

SEQ ID NO: 348848 - DNA, 20 bp, Artificial
  CRISPR gRNA sequence
cccagagcagctctgctcat

SEQ ID NO: 348849 - DNA, 20 bp, Artificial
  CRISPR gRNA sequence
tgctcatggctgatggggct

SEQ ID NO: 348850 - DNA, 20 bp, Artificial
  CRISPR gRNA sequence
ctcatggctgatggggctgc

SEQ ID NO: 348851 - DNA, 20 bp, Artificial
  CRISPR gRNA sequence
atggctgatggggctgctgt

SEQ ID NO: 348852 - DNA, 20 bp, Artificial
  CRISPR gRNA sequence
atggggctgctgtgtcccgt

SEQ ID NO: 348853 - DNA, 20 bp, Artificial
  CRISPR gRNA sequence
ctgtgtcccgtggggctcat

SEQ ID NO: 348854 - DNA, 20 bp, Artificial
  CRISPR gRNA sequence
tgtcccgtggggctcatggg

SEQ ID NO: 348855 - DNA, 20 bp, Artificial
  CRISPR gRNA sequence
atgggccatttgagtcccct

SEQ ID NO: 348856 - DNA, 20 bp, Artificial
  CRISPR gRNA sequence
gagtccccttagctggtgtc

SEQ ID NO: 348857 - DNA, 20 bp, Artificial
  CRISPR gRNA sequence
agtccccttagctggtgtct

SEQ ID NO: 348858 - DNA, 20 bp, Artificial
  CRISPR gRNA sequence
agctggtgtctccctgcttg

SEQ ID NO: 348859 - DNA, 20 bp, Artificial
  CRISPR gRNA sequence
gctggtgtctccctgcttgg

SEQ ID NO: 348860 - DNA, 20 bp, Artificial
  CRISPR gRNA sequence
gtgtctccctgcttgggctc

SEQ ID NO: 348861 - DNA, 20 bp, Artificial
  CRISPR gRNA sequence
cctgcttgggctctgggcgc

SEQ ID NO: 348862 - DNA, 20 bp, Artificial
  CRISPR gRNA sequence
cttgggctctgggcgcgggt

SEQ ID NO: 348863 - DNA, 20 bp, Artificial
  CRISPR gRNA sequence
gggctctgggcgcgggtgga

SEQ ID NO: 348864 - DNA, 20 bp, Artificial
  CRISPR gRNA sequence
ggctctgggcgcgggtggag

SEQ ID NO: 348865 - DNA, 20 bp, Artificial
  CRISPR gRNA sequence
tgggcgcgggtggagtgatg

SEQ ID NO: 348866 - DNA, 20 bp, Artificial
  CRISPR gRNA sequence
ggcgcgggtggagtgatggg

SEQ ID NO: 348867 - DNA, 20 bp, Artificial
  CRISPR gRNA sequence
ccgaaggggcctcccgcaga

SEQ ID NO: 348868 - DNA, 20 bp, Artificial
  CRISPR gRNA sequence
ccgcagacttgcgaagttcc

SEQ ID NO: 348869 - DNA, 20 bp, Artificial
  CRISPR gRNA sequence
gcgaagttcccactctctgg

SEQ ID NO: 348870 - DNA, 20 bp, Artificial
  CRISPR gRNA sequence
cgaagttcccactctctggg

SEQ ID NO: 348871 - DNA, 20 bp, Artificial
  CRISPR gRNA sequence
ccactctctgggcggcaggt

SEQ ID NO: 348872 - DNA, 20 bp, Artificial
  CRISPR gRNA sequence
tctgggcggcaggttatcgt

SEQ ID NO: 348873 - DNA, 20 bp, Artificial
  CRISPR gRNA sequence
tgggcggcaggttatcgtgt

SEQ ID NO: 348874 - DNA, 20 bp, Artificial
  CRISPR gRNA sequence
ggcggcaggttatcgtgtga

SEQ ID NO: 348875 - DNA, 20 bp, Artificial
  CRISPR gRNA sequence
tcgtgtgaaggaggcctgcg

SEQ ID NO: 348876 - DNA, 20 bp, Artificial
  CRISPR gRNA sequence
cggggagctgacgggcacag

SEQ ID NO: 348877 - DNA, 20 bp, Artificial
  CRISPR gRNA sequence
acgggcacagtgtgtgaacc

SEQ ID NO: 348878 - DNA, 20 bp, Artificial
  CRISPR gRNA sequence
ccctccaggcacctacattg

SEQ ID NO: 348879 - DNA, 20 bp, Artificial
  CRISPR gRNA sequence
caggcacctacattgcccac

SEQ ID NO: 348880 - DNA, 20 bp, Artificial
  CRISPR gRNA sequence
cattgcccacctcaatggcc

SEQ ID NO: 348881 - DNA, 20 bp, Artificial
  CRISPR gRNA sequence
cccacctcaatggcctaagc

SEQ ID NO: 348882 - DNA, 20 bp, Artificial
  CRISPR gRNA sequence
aatggcctaagcaagtgtct

SEQ ID NO: 348883 - DNA, 20 bp, Artificial
  CRISPR gRNA sequence
agcaagtgtctgcagtgcca

SEQ ID NO: 348884 - DNA, 20 bp, Artificial
  CRISPR gRNA sequence
cagtgccaaatgtgtgaccc

SEQ ID NO: 348885 - DNA, 20 bp, Artificial
  CRISPR gRNA sequence
cgcttgggcagcctggatgc

SEQ ID NO: 348886 - DNA, 20 bp, Artificial
  CRISPR gRNA sequence
gggcagcctggatgcccccg

SEQ ID NO: 348887 - DNA, 20 bp, Artificial
  CRISPR gRNA sequence
ggcagcctggatgcccccgc

SEQ ID NO: 348888 - DNA, 20 bp, Artificial
  CRISPR gRNA sequence
gatgcccccgcaccctgcac

SEQ ID NO: 348889 - DNA, 20 bp, Artificial
  CRISPR gRNA sequence
caccctctctccatggccac

SEQ ID NO: 348890 - DNA, 20 bp, Artificial
  CRISPR gRNA sequence
tctccatggccacagtgccc

SEQ ID NO: 348891 - DNA, 20 bp, Artificial
  CRISPR gRNA sequence
tccatggccacagtgcccca

SEQ ID NO: 348892 - DNA, 20 bp, Artificial
  CRISPR gRNA sequence
catggccacagtgccccagg

SEQ ID NO: 348893 - DNA, 20 bp, Artificial
  CRISPR gRNA sequence
ccccaggccaggtcccaacc

SEQ ID NO: 348894 - DNA, 20 bp, Artificial
  CRISPR gRNA sequence
catggatgcaccctgcaggg

SEQ ID NO: 348895 - DNA, 20 bp, Artificial
  CRISPR gRNA sequence
caggggacgccttgaggtca

SEQ ID NO: 348896 - DNA, 20 bp, Artificial
  CRISPR gRNA sequence
gaggtcagcctccggccccc

SEQ ID NO: 348897 - DNA, 20 bp, Artificial
  CRISPR gRNA sequence
aggtcagcctccggcccccg

SEQ ID NO: 348898 - DNA, 20 bp, Artificial
  CRISPR gRNA sequence
cggcccccgtccacctctgt

SEQ ID NO: 348899 - DNA, 20 bp, Artificial
  CRISPR gRNA sequence
tgtctcacctctcactttgt

SEQ ID NO: 348900 - DNA, 20 bp, Artificial
  CRISPR gRNA sequence
tctcacctctcactttgtca

SEQ ID NO: 348901 - DNA, 20 bp, Artificial
  CRISPR gRNA sequence
acctctcactttgtcaccgc

SEQ ID NO: 348902 - DNA, 20 bp, Artificial
  CRISPR gRNA sequence
tcactttgtcaccgccaggt

SEQ ID NO: 348903 - DNA, 20 bp, Artificial
  CRISPR gRNA sequence
actttgtcaccgccaggtgg

SEQ ID NO: 348904 - DNA, 20 bp, Artificial
  CRISPR gRNA sequence
tgtcaccgccaggtgggcca

SEQ ID NO: 348905 - DNA, 20 bp, Artificial
  CRISPR gRNA sequence
gtcaccgccaggtgggccat

SEQ ID NO: 348906 - DNA, 20 bp, Artificial
  CRISPR gRNA sequence
tcaccgccaggtgggccatc

SEQ ID NO: 348907 - DNA, 20 bp, Artificial
  CRISPR gRNA sequence
agcttggcgactgaccctta

SEQ ID NO: 348908 - DNA, 20 bp, Artificial
  CRISPR gRNA sequence
ggcgactgacccttatccct

SEQ ID NO: 348909 - DNA, 20 bp, Artificial
  CRISPR gRNA sequence
gcgactgacccttatccctc

SEQ ID NO: 348910 - DNA, 20 bp, Artificial
  CRISPR gRNA sequence
acccttatccctcgtccttg

SEQ ID NO: 348911 - DNA, 20 bp, Artificial
  CRISPR gRNA sequence
atccctcgtccttggctcct

SEQ ID NO: 348912 - DNA, 20 bp, Artificial
  CRISPR gRNA sequence
tccctcgtccttggctcctc

SEQ ID NO: 348913 - DNA, 20 bp, Artificial
  CRISPR gRNA sequence
gtccttggctcctctggtgc

SEQ ID NO: 348914 - DNA, 20 bp, Artificial
  CRISPR gRNA sequence
ggctcctctggtgcccgggg

SEQ ID NO: 348915 - DNA, 20 bp, Artificial
  CRISPR gRNA sequence
gctcctctggtgcccggggt

SEQ ID NO: 348916 - DNA, 20 bp, Artificial
  CRISPR gRNA sequence
ctctggtgcccggggtgggt

SEQ ID NO: 348917 - DNA, 20 bp, Artificial
  CRISPR gRNA sequence
tggtgcccggggtgggtgcc

SEQ ID NO: 348918 - DNA, 20 bp, Artificial
  CRISPR gRNA sequence
gtgcccggggtgggtgccca

SEQ ID NO: 348919 - DNA, 20 bp, Artificial
  CRISPR gRNA sequence
tcctgtgcccacgtccctag

SEQ ID NO: 348920 - DNA, 20 bp, Artificial
  CRISPR gRNA sequence
ctgtgcccacgtccctagct

SEQ ID NO: 348921 - DNA, 20 bp, Artificial
  CRISPR gRNA sequence
tgcccacgtccctagctgca

SEQ ID NO: 348922 - DNA, 20 bp, Artificial
  CRISPR gRNA sequence
gctgcaaagtggaatgggat

SEQ ID NO: 348923 - DNA, 20 bp, Artificial
  CRISPR gRNA sequence
caaagtggaatgggatggtg

SEQ ID NO: 348924 - DNA, 20 bp, Artificial
  CRISPR gRNA sequence
ggactctccggccggcactc

SEQ ID NO: 348925 - DNA, 20 bp, Artificial
  CRISPR gRNA sequence
tccggccggcactcgggcct

SEQ ID NO: 348926 - DNA, 20 bp, Artificial
  CRISPR gRNA sequence
cggccggcactcgggcctgc

SEQ ID NO: 348927 - DNA, 20 bp, Artificial
  CRISPR gRNA sequence
gggcctgctgcttccccaca

SEQ ID NO: 348928 - DNA, 20 bp, Artificial
  CRISPR gRNA sequence
ctgcttccccacagggcttc

SEQ ID NO: 348929 - DNA, 20 bp, Artificial
  CRISPR gRNA sequence
cttccccacagggcttcttg

SEQ ID NO: 348930 - DNA, 20 bp, Artificial
  CRISPR gRNA sequence
ccccacagggcttcttgtcc

SEQ ID NO: 348931 - DNA, 20 bp, Artificial
  CRISPR gRNA sequence
cccacagggcttcttgtccc

SEQ ID NO: 348932 - DNA, 20 bp, Artificial
  CRISPR gRNA sequence
cttgtccctttctcctccag

SEQ ID NO: 348933 - DNA, 20 bp, Artificial
  CRISPR gRNA sequence
ttgtccctttctcctccaga

SEQ ID NO: 348934 - DNA, 20 bp, Artificial
  CRISPR gRNA sequence
gtccctttctcctccagata

SEQ ID NO: 348935 - DNA, 20 bp, Artificial
  CRISPR gRNA sequence
tccctttctcctccagatat

SEQ ID NO: 348936 - DNA, 20 bp, Artificial
  CRISPR gRNA sequence
tctcctccagatattggttc

SEQ ID NO: 348937 - DNA, 20 bp, Artificial
  CRISPR gRNA sequence
ctcctccagatattggttcc

SEQ ID NO: 348938 - DNA, 20 bp, Artificial
  CRISPR gRNA sequence
tcctccagatattggttccc

SEQ ID NO: 348939 - DNA, 20 bp, Artificial
  CRISPR gRNA sequence
ctccagatattggttccccc

SEQ ID NO: 348940 - DNA, 20 bp, Artificial
  CRISPR gRNA sequence
cagatattggttccccctgt

SEQ ID NO: 348941 - DNA, 20 bp, Artificial
  CRISPR gRNA sequence
gttccccctgtgacctcagg

SEQ ID NO: 348942 - DNA, 20 bp, Artificial
  CRISPR gRNA sequence
cccctgtgacctcaggggaa

SEQ ID NO: 348943 - DNA, 20 bp, Artificial
  CRISPR gRNA sequence
tgacctcaggggaagaggtc

SEQ ID NO: 348944 - DNA, 20 bp, Artificial
  CRISPR gRNA sequence
aggggaagaggtcacctgga

SEQ ID NO: 348945 - DNA, 20 bp, Artificial
  CRISPR gRNA sequence
gaggctggtgcccacctgag

SEQ ID NO: 348946 - DNA, 20 bp, Artificial
  CRISPR gRNA sequence
gtgcccacctgagtccaggc

SEQ ID NO: 348947 - DNA, 20 bp, Artificial
  CRISPR gRNA sequence
agtccaggcagacagaaagg

SEQ ID NO: 348948 - DNA, 20 bp, Artificial
  CRISPR gRNA sequence
tgagtcactgagcgcagagc

SEQ ID NO: 348949 - DNA, 20 bp, Artificial
  CRISPR gRNA sequence
gagtcactgagcgcagagcc

SEQ ID NO: 348950 - DNA, 20 bp, Artificial
  CRISPR gRNA sequence
agtcactgagcgcagagcct

SEQ ID NO: 348951 - DNA, 20 bp, Artificial
  CRISPR gRNA sequence
agcgcagagcctgtccatgc

SEQ ID NO: 348952 - DNA, 20 bp, Artificial
  CRISPR gRNA sequence
tccatgcggccaacggctct

SEQ ID NO: 348953 - DNA, 20 bp, Artificial
  CRISPR gRNA sequence
tgtccccttggagcctcatg

SEQ ID NO: 348954 - DNA, 20 bp, Artificial
  CRISPR gRNA sequence
tccccttggagcctcatgcc

SEQ ID NO: 348955 - DNA, 20 bp, Artificial
  CRISPR gRNA sequence
ggagcctcatgccaggctca

SEQ ID NO: 348956 - DNA, 20 bp, Artificial
  CRISPR gRNA sequence
gagcctcatgccaggctcag

SEQ ID NO: 348957 - DNA, 20 bp, Artificial
  CRISPR gRNA sequence
atgccaggctcagcatggcc

SEQ ID NO: 348958 - DNA, 20 bp, Artificial
  CRISPR gRNA sequence
agcatggccagtgctccctg

SEQ ID NO: 348959 - DNA, 20 bp, Artificial
  CRISPR gRNA sequence
cctgcggccaggcaggactg

SEQ ID NO: 348960 - DNA, 20 bp, Artificial
  CRISPR gRNA sequence
cggccaggcaggactgcacc

SEQ ID NO: 348961 - DNA, 20 bp, Artificial
  CRISPR gRNA sequence
cacctgcgggacagggctga

SEQ ID NO: 348962 - DNA, 20 bp, Artificial
  CRISPR gRNA sequence
cgggacagggctgacggcac

SEQ ID NO: 348963 - DNA, 20 bp, Artificial
  CRISPR gRNA sequence
acggcacacctgggggcagg

SEQ ID NO: 348964 - DNA, 20 bp, Artificial
  CRISPR gRNA sequence
ggggcagggcctgagcctac

SEQ ID NO: 348965 - DNA, 20 bp, Artificial
  CRISPR gRNA sequence
agcctacagggaggcacagg

SEQ ID NO: 348966 - DNA, 20 bp, Artificial
  CRISPR gRNA sequence
cagggaggcacagggcaggt

SEQ ID NO: 348967 - DNA, 20 bp, Artificial
  CRISPR gRNA sequence
gccatgaacagaagaggaag

SEQ ID NO: 348968 - DNA, 20 bp, Artificial
  CRISPR gRNA sequence
gagtgctttgggggttcatg

SEQ ID NO: 348969 - DNA, 20 bp, Artificial
  CRISPR gRNA sequence
tgggggttcatgcatgtagg

SEQ ID NO: 348970 - DNA, 20 bp, Artificial
  CRISPR gRNA sequence
gggggttcatgcatgtaggc

SEQ ID NO: 348971 - DNA, 20 bp, Artificial
  CRISPR gRNA sequence
ggggttcatgcatgtaggct

SEQ ID NO: 348972 - DNA, 20 bp, Artificial
  CRISPR gRNA sequence
atgcatgtaggctgggattt

SEQ ID NO: 348973 - DNA, 20 bp, Artificial
  CRISPR gRNA sequence
ggatttggggctcacacctc

SEQ ID NO: 348974 - DNA, 20 bp, Artificial
  CRISPR gRNA sequence
ggggctcacacctcaacctg

SEQ ID NO: 348975 - DNA, 20 bp, Artificial
  CRISPR gRNA sequence
gggctcacacctcaacctgc

SEQ ID NO: 348976 - DNA, 20 bp, Artificial
  CRISPR gRNA sequence
acacctcaacctgcatgccc

SEQ ID NO: 348977 - DNA, 20 bp, Artificial
  CRISPR gRNA sequence
aacctgcatgcccagttcca

SEQ ID NO: 348978 - DNA, 20 bp, Artificial
  CRISPR gRNA sequence
catgcccagttccatgcccc

SEQ ID NO: 348979 - DNA, 20 bp, Artificial
  CRISPR gRNA sequence
catgcccctcccctcttgtg

SEQ ID NO: 348980 - DNA, 20 bp, Artificial
  CRISPR gRNA sequence
ccctcttgtgaaagcacctg

SEQ ID NO: 348981 - DNA, 20 bp, Artificial
  CRISPR gRNA sequence
ttgtgaaagcacctgtctac

SEQ ID NO: 348982 - DNA, 20 bp, Artificial
  CRISPR gRNA sequence
gtgaaagcacctgtctactt

SEQ ID NO: 348983 - DNA, 20 bp, Artificial
  CRISPR gRNA sequence
tgaaagcacctgtctacttg

SEQ ID NO: 348984 - DNA, 20 bp, Artificial
  CRISPR gRNA sequence
tctacttgggctgaggatgt

SEQ ID NO: 348985 - DNA, 20 bp, Artificial
  CRISPR gRNA sequence
cttgggctgaggatgtgggg

SEQ ID NO: 348986 - DNA, 20 bp, Artificial
  CRISPR gRNA sequence
gggctgaggatgtgggggca

SEQ ID NO: 348987 - DNA, 20 bp, Artificial
  CRISPR gRNA sequence
ggctgaggatgtgggggcac

SEQ ID NO: 348988 - DNA, 20 bp, Artificial
  CRISPR gRNA sequence
aggatgtgggggcacaggtg

SEQ ID NO: 348989 - DNA, 20 bp, Artificial
  CRISPR gRNA sequence
ccctcaggaggggcccaggc

SEQ ID NO: 348990 - DNA, 20 bp, Artificial
  CRISPR gRNA sequence
aggaggggcccaggcccagc

SEQ ID NO: 348991 - DNA, 20 bp, Artificial
  CRISPR gRNA sequence
gtaccccacctccaccagta

SEQ ID NO: 348992 - DNA, 20 bp, Artificial
  CRISPR gRNA sequence
taccccacctccaccagtac

SEQ ID NO: 348993 - DNA, 20 bp, Artificial
  CRISPR gRNA sequence
caccagtacctgaagaagtg

SEQ ID NO: 348994 - DNA, 20 bp, Artificial
  CRISPR gRNA sequence
aagaagtggggctctcaccc

SEQ ID NO: 348995 - DNA, 20 bp, Artificial
  CRISPR gRNA sequence
tcaccctacctgcctctgcc

SEQ ID NO: 348996 - DNA, 20 bp, Artificial
  CRISPR gRNA sequence
accctacctgcctctgccat

SEQ ID NO: 348997 - DNA, 20 bp, Artificial
  CRISPR gRNA sequence
cctgcctctgccattggaat

SEQ ID NO: 348998 - DNA, 20 bp, Artificial
  CRISPR gRNA sequence
cctctgccattggaatggcc

SEQ ID NO: 348999 - DNA, 20 bp, Artificial
  CRISPR gRNA sequence
tgccattggaatggcctggt

SEQ ID NO: 349000 - DNA, 20 bp, Artificial
  CRISPR gRNA sequence
ccattggaatggcctggttt

SEQ ID NO: 349001 - DNA, 20 bp, Artificial
  CRISPR gRNA sequence
gaatggcctggtttgcacag

SEQ ID NO: 349002 - DNA, 20 bp, Artificial
  CRISPR gRNA sequence
gtttgcacagatgggaaacc

SEQ ID NO: 349003 - DNA, 20 bp, Artificial
  CRISPR gRNA sequence
gcacagatgggaaacccgtt

SEQ ID NO: 349004 - DNA, 20 bp, Artificial
  CRISPR gRNA sequence
cacagatgggaaacccgttt

SEQ ID NO: 349005 - DNA, 20 bp, Artificial
  CRISPR gRNA sequence
gcggggtgggtgtctgggtg

SEQ ID NO: 349006 - DNA, 20 bp, Artificial
  CRISPR gRNA sequence
cggggtgggtgtctgggtgg

SEQ ID NO: 349007 - DNA, 20 bp, Artificial
  CRISPR gRNA sequence
ggtgggcacgtggggcgagg

SEQ ID NO: 349008 - DNA, 20 bp, Artificial
  CRISPR gRNA sequence
cctgcgggaccctgccctgg

SEQ ID NO: 349009 - DNA, 20 bp, Artificial
  CRISPR gRNA sequence
cgggaccctgccctggaact

SEQ ID NO: 349010 - DNA, 20 bp, Artificial
  CRISPR gRNA sequence
ccctggaactgacagtgcaa

SEQ ID NO: 349011 - DNA, 20 bp, Artificial
  CRISPR gRNA sequence
gaactgacagtgcaagctcg

SEQ ID NO: 349012 - DNA, 20 bp, Artificial
  CRISPR gRNA sequence
acagtgcaagctcggcgtcc

SEQ ID NO: 349013 - DNA, 20 bp, Artificial
  CRISPR gRNA sequence
ggcgtcctgcccatctgggc

SEQ ID NO: 349014 - DNA, 20 bp, Artificial
  CRISPR gRNA sequence
cccatctgggcagaaggctg

SEQ ID NO: 349015 - DNA, 20 bp, Artificial
  CRISPR gRNA sequence
ggcagaaggctggtttctcc

SEQ ID NO: 349016 - DNA, 20 bp, Artificial
  CRISPR gRNA sequence
gtttctcccatcaacgaagc

SEQ ID NO: 349017 - DNA, 20 bp, Artificial
  CRISPR gRNA sequence
ctcccatcaacgaagccctc

SEQ ID NO: 349018 - DNA, 20 bp, Artificial
  CRISPR gRNA sequence
tcccatcaacgaagccctcc

SEQ ID NO: 349019 - DNA, 20 bp, Artificial
  CRISPR gRNA sequence
ccatcaacgaagccctccca

SEQ ID NO: 349020 - DNA, 20 bp, Artificial
  CRISPR gRNA sequence
ccaggaccttcctgcaagcc

SEQ ID NO: 349021 - DNA, 20 bp, Artificial
  CRISPR gRNA sequence
cctgcaagccctcgtcccac

SEQ ID NO: 349022 - DNA, 20 bp, Artificial
  CRISPR gRNA sequence
ctgcaagccctcgtcccaca

SEQ ID NO: 349023 - DNA, 20 bp, Artificial
  CRISPR gRNA sequence
caagccctcgtcccacacgc

SEQ ID NO: 349024 - DNA, 20 bp, Artificial
  CRISPR gRNA sequence
gtcccacacgcagctctgcc

SEQ ID NO: 349025 - DNA, 20 bp, Artificial
  CRISPR gRNA sequence
tgccgtcccttggtgtccct

SEQ ID NO: 349026 - DNA, 20 bp, Artificial
  CRISPR gRNA sequence
ccgtcccttggtgtccctcc

SEQ ID NO: 349027 - DNA, 20 bp, Artificial
  CRISPR gRNA sequence
ggtgtccctcccggcctcag

SEQ ID NO: 349028 - DNA, 20 bp, Artificial
  CRISPR gRNA sequence
gtgtccctcccggcctcagg

SEQ ID NO: 349029 - DNA, 20 bp, Artificial
  CRISPR gRNA sequence
ccggcctcaggtcctccatg

SEQ ID NO: 349030 - DNA, 20 bp, Artificial
  CRISPR gRNA sequence
aggtcctccatgctgggtac

SEQ ID NO: 349031 - DNA, 20 bp, Artificial
  CRISPR gRNA sequence
catgctgggtacctctgggc

SEQ ID NO: 349032 - DNA, 20 bp, Artificial
  CRISPR gRNA sequence
ggtacctctgggcacctcgt

SEQ ID NO: 349033 - DNA, 20 bp, Artificial
  CRISPR gRNA sequence
tgggcacctcgtttggctga

SEQ ID NO: 349034 - DNA, 20 bp, Artificial
  CRISPR gRNA sequence
ggcacctcgtttggctgagc

SEQ ID NO: 349035 - DNA, 20 bp, Artificial
  CRISPR gRNA sequence
gtttggctgagccaggggtt

SEQ ID NO: 349036 - DNA, 20 bp, Artificial
  CRISPR gRNA sequence
ggctgagccaggggttcagc

SEQ ID NO: 349037 - DNA, 20 bp, Artificial
  CRISPR gRNA sequence
gctgagccaggggttcagcc

SEQ ID NO: 349038 - DNA, 20 bp, Artificial
  CRISPR gRNA sequence
agccaggggttcagcctggc

SEQ ID NO: 349039 - DNA, 20 bp, Artificial
  CRISPR gRNA sequence
agcctggcagggcgccctgg

SEQ ID NO: 349040 - DNA, 20 bp, Artificial
  CRISPR gRNA sequence
gcagggcgccctggcagcag

SEQ ID NO: 349041 - DNA, 20 bp, Artificial
  CRISPR gRNA sequence
gcagcagtccttggcctgtg

SEQ ID NO: 349042 - DNA, 20 bp, Artificial
  CRISPR gRNA sequence
ggcctgtggatgctgtcctg

SEQ ID NO: 349043 - DNA, 20 bp, Artificial
  CRISPR gRNA sequence
gcctgtggatgctgtcctgg

SEQ ID NO: 349044 - DNA, 20 bp, Artificial
  CRISPR gRNA sequence
tggatgctgtcctggcccgt

SEQ ID NO: 349045 - DNA, 20 bp, Artificial
  CRISPR gRNA sequence
tcctggcccgtggatggtgt

SEQ ID NO: 349046 - DNA, 20 bp, Artificial
  CRISPR gRNA sequence
gcccgtggatggtgtcccgg

SEQ ID NO: 349047 - DNA, 20 bp, Artificial
  CRISPR gRNA sequence
cacgtacccctctcagcccc

SEQ ID NO: 349048 - DNA, 20 bp, Artificial
  CRISPR gRNA sequence
tcagcccctcctcttggact

SEQ ID NO: 349049 - DNA, 20 bp, Artificial
  CRISPR gRNA sequence
agcccctcctcttggactcc

SEQ ID NO: 349050 - DNA, 20 bp, Artificial
  CRISPR gRNA sequence
ctcttggactccagccatgg

SEQ ID NO: 349051 - DNA, 20 bp, Artificial
  CRISPR gRNA sequence
ttggactccagccatgggcc

SEQ ID NO: 349052 - DNA, 20 bp, Artificial
  CRISPR gRNA sequence
ggactccagccatgggcctg

SEQ ID NO: 349053 - DNA, 20 bp, Artificial
  CRISPR gRNA sequence
gactccagccatgggcctgc

SEQ ID NO: 349054 - DNA, 20 bp, Artificial
  CRISPR gRNA sequence
cagccatgggcctgcgcgcg

SEQ ID NO: 349055 - DNA, 20 bp, Artificial
  CRISPR gRNA sequence
cgcgcgagccggaactgctc

SEQ ID NO: 349056 - DNA, 20 bp, Artificial
  CRISPR gRNA sequence
ctccaggacagagaacgccg

SEQ ID NO: 349057 - DNA, 20 bp, Artificial
  CRISPR gRNA sequence
caggacagagaacgccgtgt

SEQ ID NO: 349058 - DNA, 20 bp, Artificial
  CRISPR gRNA sequence
cagcccaggccacttctgca

SEQ ID NO: 349059 - DNA, 20 bp, Artificial
  CRISPR gRNA sequence
ctgcatcgtccaggacgggg

SEQ ID NO: 349060 - DNA, 20 bp, Artificial
  CRISPR gRNA sequence
tgcatcgtccaggacgggga

SEQ ID NO: 349061 - DNA, 20 bp, Artificial
  CRISPR gRNA sequence
catcgtccaggacggggacc

SEQ ID NO: 349062 - DNA, 20 bp, Artificial
  CRISPR gRNA sequence
cgccgcgtgccgcgcttacg

SEQ ID NO: 349063 - DNA, 20 bp, Artificial
  CRISPR gRNA sequence
acgccacctccagcccgggc

SEQ ID NO: 349064 - DNA, 20 bp, Artificial
  CRISPR gRNA sequence
cgccacctccagcccgggcc

SEQ ID NO: 349065 - DNA, 20 bp, Artificial
  CRISPR gRNA sequence
cagcccgggccagagggtgc

SEQ ID NO: 349066 - DNA, 20 bp, Artificial
  CRISPR gRNA sequence
ccatttccaccctggtcccc

SEQ ID NO: 349067 - DNA, 20 bp, Artificial
  CRISPR gRNA sequence
ccaccctggtccccagtgcc

SEQ ID NO: 349068 - DNA, 20 bp, Artificial
  CRISPR gRNA sequence
caccctggtccccagtgccc

SEQ ID NO: 349069 - DNA, 20 bp, Artificial
  CRISPR gRNA sequence
gtccccagtgccccgctgtc

SEQ ID NO: 349070 - DNA, 20 bp, Artificial
  CRISPR gRNA sequence
tctggagccccaggtttcct

SEQ ID NO: 349071 - DNA, 20 bp, Artificial
  CRISPR gRNA sequence
gagccccaggtttcctcgac

SEQ ID NO: 349072 - DNA, 20 bp, Artificial
  CRISPR gRNA sequence
cctcgacggcatggcctgcc

SEQ ID NO: 349073 - DNA, 20 bp, Artificial
  CRISPR gRNA sequence
ctcgacggcatggcctgccc

SEQ ID NO: 349074 - DNA, 20 bp, Artificial
  CRISPR gRNA sequence
gacggcatggcctgcccagg

SEQ ID NO: 349075 - DNA, 20 bp, Artificial
  CRISPR gRNA sequence
cccaggggccctggtgagac

SEQ ID NO: 349076 - DNA, 20 bp, Artificial
  CRISPR gRNA sequence
gtgagacagaaccttggcca

SEQ ID NO: 349077 - DNA, 20 bp, Artificial
  CRISPR gRNA sequence
ggccagccccaggcccaccc

SEQ ID NO: 349078 - DNA, 20 bp, Artificial
  CRISPR gRNA sequence
gccagccccaggcccaccca

SEQ ID NO: 349079 - DNA, 20 bp, Artificial
  CRISPR gRNA sequence
cagccctgtcctggaagcag

SEQ ID NO: 349080 - DNA, 20 bp, Artificial
  CRISPR gRNA sequence
agccctgtcctggaagcagc

SEQ ID NO: 349081 - DNA, 20 bp, Artificial
  CRISPR gRNA sequence
tcctggaagcagcccagtgg

SEQ ID NO: 349082 - DNA, 20 bp, Artificial
  CRISPR gRNA sequence
gaagcagcccagtggggaac

SEQ ID NO: 349083 - DNA, 20 bp, Artificial
  CRISPR gRNA sequence
ctccacctcggggttctggg

SEQ ID NO: 349084 - DNA, 20 bp, Artificial
  CRISPR gRNA sequence
cacctcggggttctgggact

SEQ ID NO: 349085 - DNA, 20 bp, Artificial
  CRISPR gRNA sequence
ggggttctgggacttcccag

SEQ ID NO: 349086 - DNA, 20 bp, Artificial
  CRISPR gRNA sequence
tgggacttcccagtccccag

SEQ ID NO: 349087 - DNA, 20 bp, Artificial
  CRISPR gRNA sequence
ggacttcccagtccccaggc

SEQ ID NO: 349088 - DNA, 20 bp, Artificial
  CRISPR gRNA sequence
cccagtccccaggcctcgct

SEQ ID NO: 349089 - DNA, 20 bp, Artificial
  CRISPR gRNA sequence
ccagtccccaggcctcgctc

SEQ ID NO: 349090 - DNA, 20 bp, Artificial
  CRISPR gRNA sequence
gctctcgggcccctggtctg

SEQ ID NO: 349091 - DNA, 20 bp, Artificial
  CRISPR gRNA sequence
tcgggcccctggtctggagc

SEQ ID NO: 349092 - DNA, 20 bp, Artificial
  CRISPR gRNA sequence
gggcccctggtctggagcct

SEQ ID NO: 349093 - DNA, 20 bp, Artificial
  CRISPR gRNA sequence
gtctggagcctgggtttatg

SEQ ID NO: 349094 - DNA, 20 bp, Artificial
  CRISPR gRNA sequence
gagcctgggtttatgggagt

SEQ ID NO: 349095 - DNA, 20 bp, Artificial
  CRISPR gRNA sequence
ggtttatgggagtgaccatg

SEQ ID NO: 349096 - DNA, 20 bp, Artificial
  CRISPR gRNA sequence
atgggagtgaccatggttaa

SEQ ID NO: 349097 - DNA, 20 bp, Artificial
  CRISPR gRNA sequence
tgggagtgaccatggttaat

SEQ ID NO: 349098 - DNA, 20 bp, Artificial
  CRISPR gRNA sequence
atgccactgttcaagctaag

SEQ ID NO: 349099 - DNA, 20 bp, Artificial
  CRISPR gRNA sequence
ttcaagctaagtctaggagg

SEQ ID NO: 349100 - DNA, 20 bp, Artificial
  CRISPR gRNA sequence
aagctaagtctaggaggagt

SEQ ID NO: 349101 - DNA, 20 bp, Artificial
  CRISPR gRNA sequence
agtctaggaggagtaagtgt

SEQ ID NO: 349102 - DNA, 20 bp, Artificial
  CRISPR gRNA sequence
ggaggagtaagtgtccagcc

SEQ ID NO: 349103 - DNA, 20 bp, Artificial
  CRISPR gRNA sequence
gcctgcatctggccgggcag

SEQ ID NO: 349104 - DNA, 20 bp, Artificial
  CRISPR gRNA sequence
catctggccgggcagccccc

SEQ ID NO: 349105 - DNA, 20 bp, Artificial
  CRISPR gRNA sequence
gccgggcagcccccgcagca

SEQ ID NO: 349106 - DNA, 20 bp, Artificial
  CRISPR gRNA sequence
caggatgtggacacagaggg

SEQ ID NO: 349107 - DNA, 20 bp, Artificial
  CRISPR gRNA sequence
ccggactcatgagatcccag

SEQ ID NO: 349108 - DNA, 20 bp, Artificial
  CRISPR gRNA sequence
atgagatcccagctactcaa

SEQ ID NO: 349109 - DNA, 20 bp, Artificial
  CRISPR gRNA sequence
ctcaaggccgggacagccag

SEQ ID NO: 349110 - DNA, 20 bp, Artificial
  CRISPR gRNA sequence
aaggccgggacagccagagc

SEQ ID NO: 349111 - DNA, 20 bp, Artificial
  CRISPR gRNA sequence
caagactctggacagggagc

SEQ ID NO: 349112 - DNA, 20 bp, Artificial
  CRISPR gRNA sequence
tggacagggagcctgcccct

SEQ ID NO: 349113 - DNA, 20 bp, Artificial
  CRISPR gRNA sequence
gacagggagcctgcccctcc

SEQ ID NO: 349114 - DNA, 20 bp, Artificial
  CRISPR gRNA sequence
cccctccccgctggtcctcc

SEQ ID NO: 349115 - DNA, 20 bp, Artificial
  CRISPR gRNA sequence
cccgctggtcctcccatcac

SEQ ID NO: 349116 - DNA, 20 bp, Artificial
  CRISPR gRNA sequence
gtcctcccatcacccgtaga

SEQ ID NO: 349117 - DNA, 20 bp, Artificial
  CRISPR gRNA sequence
ccatcacccgtagagcaccc

SEQ ID NO: 349118 - DNA, 20 bp, Artificial
  CRISPR gRNA sequence
gaagctcacagacaagcagt

SEQ ID NO: 349119 - DNA, 20 bp, Artificial
  CRISPR gRNA sequence
acagacaagcagtccctagc

SEQ ID NO: 349120 - DNA, 20 bp, Artificial
  CRISPR gRNA sequence
gccgccagccccctcctggc

SEQ ID NO: 349121 - DNA, 20 bp, Artificial
  CRISPR gRNA sequence
ctggcctggtgccctcagcc

SEQ ID NO: 349122 - DNA, 20 bp, Artificial
  CRISPR gRNA sequence
gcctggtgccctcagccccc

SEQ ID NO: 349123 - DNA, 20 bp, Artificial
  CRISPR gRNA sequence
gtgccctcagccccctctgt

SEQ ID NO: 349124 - DNA, 20 bp, Artificial
  CRISPR gRNA sequence
agccccctctgtccgtccct

SEQ ID NO: 349125 - DNA, 20 bp, Artificial
  CRISPR gRNA sequence
tgtccgtccctctcttctca

SEQ ID NO: 349126 - DNA, 20 bp, Artificial
  CRISPR gRNA sequence
tccgtccctctcttctcagg

SEQ ID NO: 349127 - DNA, 20 bp, Artificial
  CRISPR gRNA sequence
tcttctcaggcaccgagagt

SEQ ID NO: 349128 - DNA, 20 bp, Artificial
  CRISPR gRNA sequence
ttctcaggcaccgagagtca

SEQ ID NO: 349129 - DNA, 20 bp, Artificial
  CRISPR gRNA sequence
ctcaggcaccgagagtcagg

SEQ ID NO: 349130 - DNA, 20 bp, Artificial
  CRISPR gRNA sequence
tcaggcaccgagagtcagga

SEQ ID NO: 349131 - DNA, 20 bp, Artificial
  CRISPR gRNA sequence
aggcaccgagagtcaggaca

SEQ ID NO: 349132 - DNA, 20 bp, Artificial
  CRISPR gRNA sequence
tgtcagaactgccccccggg

SEQ ID NO: 349133 - DNA, 20 bp, Artificial
  CRISPR gRNA sequence
ccccccggggaccttctctc

SEQ ID NO: 349134 - DNA, 20 bp, Artificial
  CRISPR gRNA sequence
ctctcccaatgggaccctgg

SEQ ID NO: 349135 - DNA, 20 bp, Artificial
  CRISPR gRNA sequence
tctcccaatgggaccctgga

SEQ ID NO: 349136 - DNA, 20 bp, Artificial
  CRISPR gRNA sequence
tcccaatgggaccctggagg

SEQ ID NO: 349137 - DNA, 20 bp, Artificial
  CRISPR gRNA sequence
ccaatgggaccctggaggaa

SEQ ID NO: 349138 - DNA, 20 bp, Artificial
  CRISPR gRNA sequence
gaggaatgtcagcaccagac

SEQ ID NO: 349139 - DNA, 20 bp, Artificial
  CRISPR gRNA sequence
tgtgccctggggagggggct

SEQ ID NO: 349140 - DNA, 20 bp, Artificial
  CRISPR gRNA sequence
tgccctggggagggggctcc

SEQ ID NO: 349141 - DNA, 20 bp, Artificial
  CRISPR gRNA sequence
gggagggggctccacgttgc

SEQ ID NO: 349142 - DNA, 20 bp, Artificial
  CRISPR gRNA sequence
cacgttgcttccctgggaga

SEQ ID NO: 349143 - DNA, 20 bp, Artificial
  CRISPR gRNA sequence
cttccctgggagatgaccgt

SEQ ID NO: 349144 - DNA, 20 bp, Artificial
  CRISPR gRNA sequence
ccctgggagatgaccgtctt

SEQ ID NO: 349145 - DNA, 20 bp, Artificial
  CRISPR gRNA sequence
cctgggagatgaccgtcttc

SEQ ID NO: 349146 - DNA, 20 bp, Artificial
  CRISPR gRNA sequence
ggagatgaccgtcttctcca

SEQ ID NO: 349147 - DNA, 20 bp, Artificial
  CRISPR gRNA sequence
ctccagcagaaaggcttgaa

SEQ ID NO: 349148 - DNA, 20 bp, Artificial
  CRISPR gRNA sequence
tccagcagaaaggcttgaag

SEQ ID NO: 349149 - DNA, 20 bp, Artificial
  CRISPR gRNA sequence
cagcagaaaggcttgaaggt

SEQ ID NO: 349150 - DNA, 20 bp, Artificial
  CRISPR gRNA sequence
gaaggtcccaccctgagcgg

SEQ ID NO: 349151 - DNA, 20 bp, Artificial
  CRISPR gRNA sequence
aaggtcccaccctgagcggc

SEQ ID NO: 349152 - DNA, 20 bp, Artificial
  CRISPR gRNA sequence
agcggcaccctggtcacatg

SEQ ID NO: 349153 - DNA, 20 bp, Artificial
  CRISPR gRNA sequence
gtcacatgcctgcgtccagg

SEQ ID NO: 349154 - DNA, 20 bp, Artificial
  CRISPR gRNA sequence
cgtccaggagagctgcaggg

SEQ ID NO: 349155 - DNA, 20 bp, Artificial
  CRISPR gRNA sequence
cagggctgaagcctgtgtgc

SEQ ID NO: 349156 - DNA, 20 bp, Artificial
  CRISPR gRNA sequence
aagcctgtgtgccccagata

SEQ ID NO: 349157 - DNA, 20 bp, Artificial
  CRISPR gRNA sequence
tgtgccccagataacccctt

SEQ ID NO: 349158 - DNA, 20 bp, Artificial
  CRISPR gRNA sequence
ccatgggcccagacaaagcc

SEQ ID NO: 349159 - DNA, 20 bp, Artificial
  CRISPR gRNA sequence
catgggcccagacaaagcct

SEQ ID NO: 349160 - DNA, 20 bp, Artificial
  CRISPR gRNA sequence
atcagatctgagcttcctgg

SEQ ID NO: 349161 - DNA, 20 bp, Artificial
  CRISPR gRNA sequence
agcttcctggaggctcagga

SEQ ID NO: 349162 - DNA, 20 bp, Artificial
  CRISPR gRNA sequence
cctggaggctcaggatgggc

SEQ ID NO: 349163 - DNA, 20 bp, Artificial
  CRISPR gRNA sequence
ctggaggctcaggatgggcc

SEQ ID NO: 349164 - DNA, 20 bp, Artificial
  CRISPR gRNA sequence
gaggctcaggatgggccttc

SEQ ID NO: 349165 - DNA, 20 bp, Artificial
  CRISPR gRNA sequence
aggatgggccttcccagaag

SEQ ID NO: 349166 - DNA, 20 bp, Artificial
  CRISPR gRNA sequence
cccagaagcaggcccagagg

SEQ ID NO: 349167 - DNA, 20 bp, Artificial
  CRISPR gRNA sequence
ccagaagcaggcccagaggg

SEQ ID NO: 349168 - DNA, 20 bp, Artificial
  CRISPR gRNA sequence
cctccagatcccctgtcccc

SEQ ID NO: 349169 - DNA, 20 bp, Artificial
  CRISPR gRNA sequence
cagatcccctgtcccctggg

SEQ ID NO: 349170 - DNA, 20 bp, Artificial
  CRISPR gRNA sequence
tcccctggggctgtgggtgt

SEQ ID NO: 349171 - DNA, 20 bp, Artificial
  CRISPR gRNA sequence
gggctgtgggtgtccctgaa

SEQ ID NO: 349172 - DNA, 20 bp, Artificial
  CRISPR gRNA sequence
tgggtgtccctgaatgtcag

SEQ ID NO: 349173 - DNA, 20 bp, Artificial
  CRISPR gRNA sequence
aatgtcagggccatgggagg

SEQ ID NO: 349174 - DNA, 20 bp, Artificial
  CRISPR gRNA sequence
ggcttcaggggttggggaaa

SEQ ID NO: 349175 - DNA, 20 bp, Artificial
  CRISPR gRNA sequence
caggggttggggaaagtgaa

SEQ ID NO: 349176 - DNA, 20 bp, Artificial
  CRISPR gRNA sequence
aggggttggggaaagtgaac

SEQ ID NO: 349177 - DNA, 20 bp, Artificial
  CRISPR gRNA sequence
gggaaagtgaacactctgct

SEQ ID NO: 349178 - DNA, 20 bp, Artificial
  CRISPR gRNA sequence
tgctctttgtccaccttcgg

SEQ ID NO: 349179 - DNA, 20 bp, Artificial
  CRISPR gRNA sequence
ctctttgtccaccttcggga

SEQ ID NO: 349180 - DNA, 20 bp, Artificial
  CRISPR gRNA sequence
tttgtccaccttcgggagga

SEQ ID NO: 349181 - DNA, 20 bp, Artificial
  CRISPR gRNA sequence
tgtccaccttcgggaggaca

SEQ ID NO: 349182 - DNA, 20 bp, Artificial
  CRISPR gRNA sequence
gtccaccttcgggaggacac

SEQ ID NO: 349183 - DNA, 20 bp, Artificial
  CRISPR gRNA sequence
tccaccttcgggaggacacc

SEQ ID NO: 349184 - DNA, 20 bp, Artificial
  CRISPR gRNA sequence
cgggaggacaccttcaaatg

SEQ ID NO: 349185 - DNA, 20 bp, Artificial
  CRISPR gRNA sequence
gggaggacaccttcaaatgc

SEQ ID NO: 349186 - DNA, 20 bp, Artificial
  CRISPR gRNA sequence
caaatgctgaccctgggccc

SEQ ID NO: 349187 - DNA, 20 bp, Artificial
  CRISPR gRNA sequence
aaatgctgaccctgggcccc

SEQ ID NO: 349188 - DNA, 20 bp, Artificial
  CRISPR gRNA sequence
accctgggcccctaactgac

SEQ ID NO: 349189 - DNA, 20 bp, Artificial
  CRISPR gRNA sequence
ggcccctaactgacctgaga

SEQ ID NO: 349190 - DNA, 20 bp, Artificial
  CRISPR gRNA sequence
actgacctgagacttcagag

SEQ ID NO: 349191 - DNA, 20 bp, Artificial
  CRISPR gRNA sequence
acctgagacttcagagcttc

SEQ ID NO: 349192 - DNA, 20 bp, Artificial
  CRISPR gRNA sequence
agacttcagagcttcttggg

SEQ ID NO: 349193 - DNA, 20 bp, Artificial
  CRISPR gRNA sequence
cagagcttcttgggaggagc

SEQ ID NO: 349194 - DNA, 20 bp, Artificial
  CRISPR gRNA sequence
agagcttcttgggaggagct

SEQ ID NO: 349195 - DNA, 20 bp, Artificial
  CRISPR gRNA sequence
cttgggaggagctggggtcc

SEQ ID NO: 349196 - DNA, 20 bp, Artificial
  CRISPR gRNA sequence
ttgggaggagctggggtccc

SEQ ID NO: 349197 - DNA, 20 bp, Artificial
  CRISPR gRNA sequence
gggaggagctggggtccccc

SEQ ID NO: 349198 - DNA, 20 bp, Artificial
  CRISPR gRNA sequence
ggaggagctggggtccccca

SEQ ID NO: 349199 - DNA, 20 bp, Artificial
  CRISPR gRNA sequence
gggtcccccagcggagcctg

SEQ ID NO: 349200 - DNA, 20 bp, Artificial
  CRISPR gRNA sequence
ggatggagcagggatggctg

SEQ ID NO: 349201 - DNA, 20 bp, Artificial
  CRISPR gRNA sequence
ccccagggagggggcggtgg

SEQ ID NO: 349202 - DNA, 20 bp, Artificial
  CRISPR gRNA sequence
ccatcctgctctgccctcct

SEQ ID NO: 349203 - DNA, 20 bp, Artificial
  CRISPR gRNA sequence
catcctgctctgccctcctc

SEQ ID NO: 349204 - DNA, 20 bp, Artificial
  CRISPR gRNA sequence
ctctgccctcctcgtcctct

SEQ ID NO: 349205 - DNA, 20 bp, Artificial
  CRISPR gRNA sequence
tgccctcctcgtcctctggc

SEQ ID NO: 349206 - DNA, 20 bp, Artificial
  CRISPR gRNA sequence
ccctcctcgtcctctggccc

SEQ ID NO: 349207 - DNA, 20 bp, Artificial
  CRISPR gRNA sequence
ctcgtcctctggccccagct

SEQ ID NO: 349208 - DNA, 20 bp, Artificial
  CRISPR gRNA sequence
gtcctctggccccagctcag

SEQ ID NO: 349209 - DNA, 20 bp, Artificial
  CRISPR gRNA sequence
tggccccagctcagtcctgt

SEQ ID NO: 349210 - DNA, 20 bp, Artificial
  CRISPR gRNA sequence
gccccagctcagtcctgtcc

SEQ ID NO: 349211 - DNA, 20 bp, Artificial
  CRISPR gRNA sequence
agtcctgtccatctccagct

SEQ ID NO: 349212 - DNA, 20 bp, Artificial
  CRISPR gRNA sequence
tccatctccagctctaacca

SEQ ID NO: 349213 - DNA, 20 bp, Artificial
  CRISPR gRNA sequence
cagctctaaccatttttgtc

SEQ ID NO: 349214 - DNA, 20 bp, Artificial
  CRISPR gRNA sequence
taaccatttttgtcccgaca

SEQ ID NO: 349215 - DNA, 20 bp, Artificial
  CRISPR gRNA sequence
accatttttgtcccgacact

SEQ ID NO: 349216 - DNA, 20 bp, Artificial
  CRISPR gRNA sequence
ttgtcccgacactggctctc

SEQ ID NO: 349217 - DNA, 20 bp, Artificial
  CRISPR gRNA sequence
tgtcccgacactggctctcc

SEQ ID NO: 349218 - DNA, 20 bp, Artificial
  CRISPR gRNA sequence
gtcccgacactggctctccc

SEQ ID NO: 349219 - DNA, 20 bp, Artificial
  CRISPR gRNA sequence
tcccgacactggctctccct

SEQ ID NO: 349220 - DNA, 20 bp, Artificial
  CRISPR gRNA sequence
gctctccctctaccttctgt

SEQ ID NO: 349221 - DNA, 20 bp, Artificial
  CRISPR gRNA sequence
tccctctaccttctgtcctt

SEQ ID NO: 349222 - DNA, 20 bp, Artificial
  CRISPR gRNA sequence
cctctaccttctgtccttgt

SEQ ID NO: 349223 - DNA, 20 bp, Artificial
  CRISPR gRNA sequence
taccttctgtccttgtctgc

SEQ ID NO: 349224 - DNA, 20 bp, Artificial
  CRISPR gRNA sequence
ccttctgtccttgtctgcca

SEQ ID NO: 349225 - DNA, 20 bp, Artificial
  CRISPR gRNA sequence
ctgtccttgtctgccactgg

SEQ ID NO: 349226 - DNA, 20 bp, Artificial
  CRISPR gRNA sequence
tgtccttgtctgccactggt

SEQ ID NO: 349227 - DNA, 20 bp, Artificial
  CRISPR gRNA sequence
tccttgtctgccactggtct

SEQ ID NO: 349228 - DNA, 20 bp, Artificial
  CRISPR gRNA sequence
gtctgccactggtctcccgt

SEQ ID NO: 349229 - DNA, 20 bp, Artificial
  CRISPR gRNA sequence
tctgccactggtctcccgtg

SEQ ID NO: 349230 - DNA, 20 bp, Artificial
  CRISPR gRNA sequence
ccactggtctcccgtgctct

SEQ ID NO: 349231 - DNA, 20 bp, Artificial
  CRISPR gRNA sequence
gtctcccgtgctctggggtc

SEQ ID NO: 349232 - DNA, 20 bp, Artificial
  CRISPR gRNA sequence
ccgtgctctggggtctctgc

SEQ ID NO: 349233 - DNA, 20 bp, Artificial
  CRISPR gRNA sequence
tggggtctctgcactgctgg

SEQ ID NO: 349234 - DNA, 20 bp, Artificial
  CRISPR gRNA sequence
gggtctctgcactgctggct

SEQ ID NO: 349235 - DNA, 20 bp, Artificial
  CRISPR gRNA sequence
tgcactgctggctgcctccc

SEQ ID NO: 349236 - DNA, 20 bp, Artificial
  CRISPR gRNA sequence
cactgctggctgcctcccgc

SEQ ID NO: 349237 - DNA, 20 bp, Artificial
  CRISPR gRNA sequence
ctggctgcctcccgcttctc

SEQ ID NO: 349238 - DNA, 20 bp, Artificial
  CRISPR gRNA sequence
gctgcctcccgcttctctcc

SEQ ID NO: 349239 - DNA, 20 bp, Artificial
  CRISPR gRNA sequence
cctcccgcttctctcccctc

SEQ ID NO: 349240 - DNA, 20 bp, Artificial
  CRISPR gRNA sequence
ccgcttctctcccctctccc

SEQ ID NO: 349241 - DNA, 20 bp, Artificial
  CRISPR gRNA sequence
ctctcccctctccctctgcc

SEQ ID NO: 349242 - DNA, 20 bp, Artificial
  CRISPR gRNA sequence
tctcccctctccctctgccg

SEQ ID NO: 349243 - DNA, 20 bp, Artificial
  CRISPR gRNA sequence
tcccctctccctctgccgtc

SEQ ID NO: 349244 - DNA, 20 bp, Artificial
  CRISPR gRNA sequence
ccctctccctctgccgtcct

SEQ ID NO: 349245 - DNA, 20 bp, Artificial
  CRISPR gRNA sequence
tccctctgccgtcctgtctc

SEQ ID NO: 349246 - DNA, 20 bp, Artificial
  CRISPR gRNA sequence
cctctgccgtcctgtctcct

SEQ ID NO: 349247 - DNA, 20 bp, Artificial
  CRISPR gRNA sequence
tgccgtcctgtctcctttgc

SEQ ID NO: 349248 - DNA, 20 bp, Artificial
  CRISPR gRNA sequence
ccgtcctgtctcctttgccc

SEQ ID NO: 349249 - DNA, 20 bp, Artificial
  CRISPR gRNA sequence
tctcctttgcccagtctctc

SEQ ID NO: 349250 - DNA, 20 bp, Artificial
  CRISPR gRNA sequence
ctttgcccagtctctccttg

SEQ ID NO: 349251 - DNA, 20 bp, Artificial
  CRISPR gRNA sequence
tgcccagtctctccttgttt

SEQ ID NO: 349252 - DNA, 20 bp, Artificial
  CRISPR gRNA sequence
gcccagtctctccttgtttc

SEQ ID NO: 349253 - DNA, 20 bp, Artificial
  CRISPR gRNA sequence
cccagtctctccttgtttct

SEQ ID NO: 349254 - DNA, 20 bp, Artificial
  CRISPR gRNA sequence
tccttgtttctcttctcctc

SEQ ID NO: 349255 - DNA, 20 bp, Artificial
  CRISPR gRNA sequence
cttgtttctcttctcctcct

SEQ ID NO: 349256 - DNA, 20 bp, Artificial
  CRISPR gRNA sequence
gtttctcttctcctccttcc

SEQ ID NO: 349257 - DNA, 20 bp, Artificial
  CRISPR gRNA sequence
tttctcttctcctccttcct

SEQ ID NO: 349258 - DNA, 20 bp, Artificial
  CRISPR gRNA sequence
ctcttctcctccttccttct

SEQ ID NO: 349259 - DNA, 20 bp, Artificial
  CRISPR gRNA sequence
tcttctcctccttccttctc

SEQ ID NO: 349260 - DNA, 20 bp, Artificial
  CRISPR gRNA sequence
ttctcctccttccttctctc

SEQ ID NO: 349261 - DNA, 20 bp, Artificial
  CRISPR gRNA sequence
ctcctccttccttctctcca

SEQ ID NO: 349262 - DNA, 20 bp, Artificial
  CRISPR gRNA sequence
tcctccttccttctctccac

SEQ ID NO: 349263 - DNA, 20 bp, Artificial
  CRISPR gRNA sequence
ctccttccttctctccacct

SEQ ID NO: 349264 - DNA, 20 bp, Artificial
  CRISPR gRNA sequence
cttccttctctccacctccc

SEQ ID NO: 349265 - DNA, 20 bp, Artificial
  CRISPR gRNA sequence
ccttctctccacctccccat

SEQ ID NO: 349266 - DNA, 20 bp, Artificial
  CRISPR gRNA sequence
cttctctccacctccccata

SEQ ID NO: 349267 - DNA, 20 bp, Artificial
  CRISPR gRNA sequence
ctctccacctccccatagcc

SEQ ID NO: 349268 - DNA, 20 bp, Artificial
  CRISPR gRNA sequence
tctccacctccccatagccg

SEQ ID NO: 349269 - DNA, 20 bp, Artificial
  CRISPR gRNA sequence
tccacctccccatagccgag

SEQ ID NO: 349270 - DNA, 20 bp, Artificial
  CRISPR gRNA sequence
cacctccccatagccgagct

SEQ ID NO: 349271 - DNA, 20 bp, Artificial
  CRISPR gRNA sequence
cccatagccgagcttggaaa

SEQ ID NO: 349272 - DNA, 20 bp, Artificial
  CRISPR gRNA sequence
ggaaaagtcagacagacctc

SEQ ID NO: 349273 - DNA, 20 bp, Artificial
  CRISPR gRNA sequence
gaaaagtcagacagacctct

SEQ ID NO: 349274 - DNA, 20 bp, Artificial
  CRISPR gRNA sequence
tgaggtctcatcctggagct

SEQ ID NO: 349275 - DNA, 20 bp, Artificial
  CRISPR gRNA sequence
aggtctcatcctggagctgc

SEQ ID NO: 349276 - DNA, 20 bp, Artificial
  CRISPR gRNA sequence
atcctggagctgccaccagc

SEQ ID NO: 349277 - DNA, 20 bp, Artificial
  CRISPR gRNA sequence
gagctgccaccagcccagcc

SEQ ID NO: 349278 - DNA, 20 bp, Artificial
  CRISPR gRNA sequence
ccaccagcccagcctccctg

SEQ ID NO: 349279 - DNA, 20 bp, Artificial
  CRISPR gRNA sequence
cctgggacctgtcttcactg

SEQ ID NO: 349280 - DNA, 20 bp, Artificial
  CRISPR gRNA sequence
ggacctgtcttcactgcctg

SEQ ID NO: 349281 - DNA, 20 bp, Artificial
  CRISPR gRNA sequence
tcttcactgcctggggccct

SEQ ID NO: 349282 - DNA, 20 bp, Artificial
  CRISPR gRNA sequence
cactgcctggggccctggga

SEQ ID NO: 349283 - DNA, 20 bp, Artificial
  CRISPR gRNA sequence
actgcctggggccctgggag

SEQ ID NO: 349284 - DNA, 20 bp, Artificial
  CRISPR gRNA sequence
cctggggccctgggagccag

SEQ ID NO: 349285 - DNA, 20 bp, Artificial
  CRISPR gRNA sequence
gggccctgggagccagggag

SEQ ID NO: 349286 - DNA, 20 bp, Artificial
  CRISPR gRNA sequence
ggagccagggaggctccctg

SEQ ID NO: 349287 - DNA, 20 bp, Artificial
  CRISPR gRNA sequence
cctgaggctgagtgaacact

SEQ ID NO: 349288 - DNA, 20 bp, Artificial
  CRISPR gRNA sequence
aggctgagtgaacactgggc

SEQ ID NO: 349289 - DNA, 20 bp, Artificial
  CRISPR gRNA sequence
agtgaacactgggcgctgca

SEQ ID NO: 349290 - DNA, 20 bp, Artificial
  CRISPR gRNA sequence
ggcgctgcacctgcctctcc

SEQ ID NO: 349291 - DNA, 20 bp, Artificial
  CRISPR gRNA sequence
cacctgcctctcccacgtcc

SEQ ID NO: 349292 - DNA, 20 bp, Artificial
  CRISPR gRNA sequence
cctctcccacgtcctcggcc

SEQ ID NO: 349293 - DNA, 20 bp, Artificial
  CRISPR gRNA sequence
tcccacgtcctcggccccac

SEQ ID NO: 349294 - DNA, 20 bp, Artificial
  CRISPR gRNA sequence
ccacgtcctcggccccactc

SEQ ID NO: 349295 - DNA, 20 bp, Artificial
  CRISPR gRNA sequence
ggccccactcccgcaggtgc

SEQ ID NO: 349296 - DNA, 20 bp, Artificial
  CRISPR gRNA sequence
ccgcaggtgcagctggctgg

SEQ ID NO: 349297 - DNA, 20 bp, Artificial
  CRISPR gRNA sequence
gctggtgacgaaggccggag

SEQ ID NO: 349298 - DNA, 20 bp, Artificial
  CRISPR gRNA sequence
gtgacgaaggccggagctgg

SEQ ID NO: 349299 - DNA, 20 bp, Artificial
  CRISPR gRNA sequence
ggaccagcagctcccactgg

SEQ ID NO: 349300 - DNA, 20 bp, Artificial
  CRISPR gRNA sequence
ccactgggtatggtggtttc

SEQ ID NO: 349301 - DNA, 20 bp, Artificial
  CRISPR gRNA sequence
ggtatggtggtttctctcag

SEQ ID NO: 349302 - DNA, 20 bp, Artificial
  CRISPR gRNA sequence
ctctcagggagcctcgtcat

SEQ ID NO: 349303 - DNA, 20 bp, Artificial
  CRISPR gRNA sequence
tctcagggagcctcgtcatc

SEQ ID NO: 349304 - DNA, 20 bp, Artificial
  CRISPR gRNA sequence
tcagggagcctcgtcatcgt

SEQ ID NO: 349305 - DNA, 20 bp, Artificial
  CRISPR gRNA sequence
agggagcctcgtcatcgtca

SEQ ID NO: 349306 - DNA, 20 bp, Artificial
  CRISPR gRNA sequence
gtcatcgtcattgtttgctc

SEQ ID NO: 349307 - DNA, 20 bp, Artificial
  CRISPR gRNA sequence
tttgctccacagttggccta

SEQ ID NO: 349308 - DNA, 20 bp, Artificial
  CRISPR gRNA sequence
gctccacagttggcctaatc

SEQ ID NO: 349309 - DNA, 20 bp, Artificial
  CRISPR gRNA sequence
ctccacagttggcctaatca

SEQ ID NO: 349310 - DNA, 20 bp, Artificial
  CRISPR gRNA sequence
cacagttggcctaatcatat

SEQ ID NO: 349311 - DNA, 20 bp, Artificial
  CRISPR gRNA sequence
gcctaatcatatgtgtgaaa

SEQ ID NO: 349312 - DNA, 20 bp, Artificial
  CRISPR gRNA sequence
atcatatgtgtgaaaagaag

SEQ ID NO: 349313 - DNA, 20 bp, Artificial
  CRISPR gRNA sequence
atgtccccagccgtcacctc

SEQ ID NO: 349314 - DNA, 20 bp, Artificial
  CRISPR gRNA sequence
ttggagctctgtcaccccaa

SEQ ID NO: 349315 - DNA, 20 bp, Artificial
  CRISPR gRNA sequence
ggagctctgtcaccccaagc

SEQ ID NO: 349316 - DNA, 20 bp, Artificial
  CRISPR gRNA sequence
gagctctgtcaccccaagcc

SEQ ID NO: 349317 - DNA, 20 bp, Artificial
  CRISPR gRNA sequence
tgtcaccccaagcctgggag

SEQ ID NO: 349318 - DNA, 20 bp, Artificial
  CRISPR gRNA sequence
tcaccccaagcctgggaggt

SEQ ID NO: 349319 - DNA, 20 bp, Artificial
  CRISPR gRNA sequence
ggaggtggccccagagcttt

SEQ ID NO: 349320 - DNA, 20 bp, Artificial
  CRISPR gRNA sequence
ttccaggatccgcggctcct

SEQ ID NO: 349321 - DNA, 20 bp, Artificial
  CRISPR gRNA sequence
tccaggatccgcggctcctc

SEQ ID NO: 349322 - DNA, 20 bp, Artificial
  CRISPR gRNA sequence
ccaggatccgcggctcctcc

SEQ ID NO: 349323 - DNA, 20 bp, Artificial
  CRISPR gRNA sequence
caggatccgcggctcctccc

SEQ ID NO: 349324 - DNA, 20 bp, Artificial
  CRISPR gRNA sequence
ctcccagggcagccactgca

SEQ ID NO: 349325 - DNA, 20 bp, Artificial
  CRISPR gRNA sequence
ccagggcagccactgcaggc

SEQ ID NO: 349326 - DNA, 20 bp, Artificial
  CRISPR gRNA sequence
caggctggggcaggtgggct

SEQ ID NO: 349327 - DNA, 20 bp, Artificial
  CRISPR gRNA sequence
gggcaggtgggctttctgct

SEQ ID NO: 349328 - DNA, 20 bp, Artificial
  CRISPR gRNA sequence
tctgctgtggccagagccca

SEQ ID NO: 349329 - DNA, 20 bp, Artificial
  CRISPR gRNA sequence
ctgctgtggccagagcccag

SEQ ID NO: 349330 - DNA, 20 bp, Artificial
  CRISPR gRNA sequence
tgctgtggccagagcccagg

SEQ ID NO: 349331 - DNA, 20 bp, Artificial
  CRISPR gRNA sequence
ctgtggccagagcccaggtg

SEQ ID NO: 349332 - DNA, 20 bp, Artificial
  CRISPR gRNA sequence
tggccagagcccaggtgtca

SEQ ID NO: 349333 - DNA, 20 bp, Artificial
  CRISPR gRNA sequence
gcctccctgggggaagggaa

SEQ ID NO: 349334 - DNA, 20 bp, Artificial
  CRISPR gRNA sequence
cctgggggaagggaaggtgg

SEQ ID NO: 349335 - DNA, 20 bp, Artificial
  CRISPR gRNA sequence
ggggaagggaaggtgggacc

SEQ ID NO: 349336 - DNA, 20 bp, Artificial
  CRISPR gRNA sequence
accgtggagccctcagccac

SEQ ID NO: 349337 - DNA, 20 bp, Artificial
  CRISPR gRNA sequence
agccacccctgcccacgcac

SEQ ID NO: 349338 - DNA, 20 bp, Artificial
  CRISPR gRNA sequence
cccacgcactctatgaccct

SEQ ID NO: 349339 - DNA, 20 bp, Artificial
  CRISPR gRNA sequence
tatgaccctgtgctcctgcc

SEQ ID NO: 349340 - DNA, 20 bp, Artificial
  CRISPR gRNA sequence
tgaccctgtgctcctgcctg

SEQ ID NO: 349341 - DNA, 20 bp, Artificial
  CRISPR gRNA sequence
tgctcctgcctgccccctgt

SEQ ID NO: 349342 - DNA, 20 bp, Artificial
  CRISPR gRNA sequence
ctgcctgccccctgtgggat

SEQ ID NO: 349343 - DNA, 20 bp, Artificial
  CRISPR gRNA sequence
cctgccccctgtgggatgtg

SEQ ID NO: 349344 - DNA, 20 bp, Artificial
  CRISPR gRNA sequence
ccccctgtgggatgtgggga

SEQ ID NO: 349345 - DNA, 20 bp, Artificial
  CRISPR gRNA sequence
tgggatgtggggagcaggac

SEQ ID NO: 349346 - DNA, 20 bp, Artificial
  CRISPR gRNA sequence
ctcagctgggagaagctctg

SEQ ID NO: 349347 - DNA, 20 bp, Artificial
  CRISPR gRNA sequence
agctgggagaagctctgggc

SEQ ID NO: 349348 - DNA, 20 bp, Artificial
  CRISPR gRNA sequence
ggagaagctctgggctgagg

SEQ ID NO: 349349 - DNA, 20 bp, Artificial
  CRISPR gRNA sequence
tgggctgagggtcaacagcc

SEQ ID NO: 349350 - DNA, 20 bp, Artificial
  CRISPR gRNA sequence
ggctgagggtcaacagccgc

SEQ ID NO: 349351 - DNA, 20 bp, Artificial
  CRISPR gRNA sequence
agggtcaacagccgccctgc

SEQ ID NO: 349352 - DNA, 20 bp, Artificial
  CRISPR gRNA sequence
ctggggacaaggctttgtcc

SEQ ID NO: 349353 - DNA, 20 bp, Artificial
  CRISPR gRNA sequence
gggacaaggctttgtcctca

SEQ ID NO: 349354 - DNA, 20 bp, Artificial
  CRISPR gRNA sequence
tgtcctcattgaggagagta

SEQ ID NO: 349355 - DNA, 20 bp, Artificial
  CRISPR gRNA sequence
gtcctcattgaggagagtaa

SEQ ID NO: 349356 - DNA, 20 bp, Artificial
  CRISPR gRNA sequence
tcctcattgaggagagtaag

SEQ ID NO: 349357 - DNA, 20 bp, Artificial
  CRISPR gRNA sequence
attgaggagagtaaggccat

SEQ ID NO: 349358 - DNA, 20 bp, Artificial
  CRISPR gRNA sequence
aggagagtaaggccattcat

SEQ ID NO: 349359 - DNA, 20 bp, Artificial
  CRISPR gRNA sequence
attcattcattcattcatcc

SEQ ID NO: 349360 - DNA, 20 bp, Artificial
  CRISPR gRNA sequence
attcattcattcatccacct

SEQ ID NO: 349361 - DNA, 20 bp, Artificial
  CRISPR gRNA sequence
attcattcatccacctatcc

SEQ ID NO: 349362 - DNA, 20 bp, Artificial
  CRISPR gRNA sequence
attcatccacctatccgccc

SEQ ID NO: 349363 - DNA, 20 bp, Artificial
  CRISPR gRNA sequence
atccacctatccgccctggt

SEQ ID NO: 349364 - DNA, 20 bp, Artificial
  CRISPR gRNA sequence
tccgccctggtctgggcacc

SEQ ID NO: 349365 - DNA, 20 bp, Artificial
  CRISPR gRNA sequence
gtctgggcacctgtgctgtg

SEQ ID NO: 349366 - DNA, 20 bp, Artificial
  CRISPR gRNA sequence
ggcacctgtgctgtgcctgg

SEQ ID NO: 349367 - DNA, 20 bp, Artificial
  CRISPR gRNA sequence
tgctgtgcctggcctcctgt

SEQ ID NO: 349368 - DNA, 20 bp, Artificial
  CRISPR gRNA sequence
tgcctggcctcctgtgcctg

SEQ ID NO: 349369 - DNA, 20 bp, Artificial
  CRISPR gRNA sequence
gcctcctgtgcctggcctcc

SEQ ID NO: 349370 - DNA, 20 bp, Artificial
  CRISPR gRNA sequence
ctgtgcctggcctcctgggc

SEQ ID NO: 349371 - DNA, 20 bp, Artificial
  CRISPR gRNA sequence
tgcctggcctcctgggcact

SEQ ID NO: 349372 - DNA, 20 bp, Artificial
  CRISPR gRNA sequence
gcctcctgggcactgacccc

SEQ ID NO: 349373 - DNA, 20 bp, Artificial
  CRISPR gRNA sequence
ctgggcactgaccccgctgt

SEQ ID NO: 349374 - DNA, 20 bp, Artificial
  CRISPR gRNA sequence
ggcactgaccccgctgtgtg

SEQ ID NO: 349375 - DNA, 20 bp, Artificial
  CRISPR gRNA sequence
accccgctgtgtggacccgg

SEQ ID NO: 349376 - DNA, 20 bp, Artificial
  CRISPR gRNA sequence
tgtggacccggctgtggccc

SEQ ID NO: 349377 - DNA, 20 bp, Artificial
  CRISPR gRNA sequence
tggccctgggagccctgtgc

SEQ ID NO: 349378 - DNA, 20 bp, Artificial
  CRISPR gRNA sequence
ggagccctgtgcacagcccc

SEQ ID NO: 349379 - DNA, 20 bp, Artificial
  CRISPR gRNA sequence
tgcacagcccccggggacgc

SEQ ID NO: 349380 - DNA, 20 bp, Artificial
  CRISPR gRNA sequence
ctaagcattgaggtctgaag

SEQ ID NO: 349381 - DNA, 20 bp, Artificial
  CRISPR gRNA sequence
taagcattgaggtctgaagg

SEQ ID NO: 349382 - DNA, 20 bp, Artificial
  CRISPR gRNA sequence
agcattgaggtctgaaggga

SEQ ID NO: 349383 - DNA, 20 bp, Artificial
  CRISPR gRNA sequence
aggtctgaagggaaagtcag

SEQ ID NO: 349384 - DNA, 20 bp, Artificial
  CRISPR gRNA sequence
aagggaaagtcagccccatc

SEQ ID NO: 349385 - DNA, 20 bp, Artificial
  CRISPR gRNA sequence
cagccaggcggcagcaaagc

SEQ ID NO: 349386 - DNA, 20 bp, Artificial
  CRISPR gRNA sequence
atcctcacccggggcctcca

SEQ ID NO: 349387 - DNA, 20 bp, Artificial
  CRISPR gRNA sequence
acccggggcctccaatgcgg

SEQ ID NO: 349388 - DNA, 20 bp, Artificial
  CRISPR gRNA sequence
caatgcggggaggtctcggg

SEQ ID NO: 349389 - DNA, 20 bp, Artificial
  CRISPR gRNA sequence
ggggcctcaggctctagggt

SEQ ID NO: 349390 - DNA, 20 bp, Artificial
  CRISPR gRNA sequence
aggctctagggtaggccggg

SEQ ID NO: 349391 - DNA, 20 bp, Artificial
  CRISPR gRNA sequence
tagggtaggccgggcagcag

SEQ ID NO: 349392 - DNA, 20 bp, Artificial
  CRISPR gRNA sequence
gggtaggccgggcagcagct

SEQ ID NO: 349393 - DNA, 20 bp, Artificial
  CRISPR gRNA sequence
agtctcacccaactgggcac

SEQ ID NO: 349394 - DNA, 20 bp, Artificial
  CRISPR gRNA sequence
gtctcacccaactgggcacc

SEQ ID NO: 349395 - DNA, 20 bp, Artificial
  CRISPR gRNA sequence
acccaactgggcacctgctg

SEQ ID NO: 349396 - DNA, 20 bp, Artificial
  CRISPR gRNA sequence
ggcacctgctggtatggtgg

SEQ ID NO: 349397 - DNA, 20 bp, Artificial
  CRISPR gRNA sequence
ctggtatggtgggcagggcc

SEQ ID NO: 349398 - DNA, 20 bp, Artificial
  CRISPR gRNA sequence
gtatggtgggcagggcctct

SEQ ID NO: 349399 - DNA, 20 bp, Artificial
  CRISPR gRNA sequence
tccactgtgaagcgcttgtt

SEQ ID NO: 349400 - DNA, 20 bp, Artificial
  CRISPR gRNA sequence
cactgtgaagcgcttgttcc

SEQ ID NO: 349401 - DNA, 20 bp, Artificial
  CRISPR gRNA sequence
tgaagcgcttgttcccctcc

SEQ ID NO: 349402 - DNA, 20 bp, Artificial
  CRISPR gRNA sequence
gttcccctcccatagatgac

SEQ ID NO: 349403 - DNA, 20 bp, Artificial
  CRISPR gRNA sequence
ttcccctcccatagatgacg

SEQ ID NO: 349404 - DNA, 20 bp, Artificial
  CRISPR gRNA sequence
ccctcccatagatgacggtt

SEQ ID NO: 349405 - DNA, 20 bp, Artificial
  CRISPR gRNA sequence
ccatagatgacggttgaatt

SEQ ID NO: 349406 - DNA, 20 bp, Artificial
  CRISPR gRNA sequence
aattagggttagttatgcac

SEQ ID NO: 349407 - DNA, 20 bp, Artificial
  CRISPR gRNA sequence
gggttagttatgcacttggg

SEQ ID NO: 349408 - DNA, 20 bp, Artificial
  CRISPR gRNA sequence
gttatgcacttgggggcctc

SEQ ID NO: 349409 - DNA, 20 bp, Artificial
  CRISPR gRNA sequence
tgcacttgggggcctcagct

SEQ ID NO: 349410 - DNA, 20 bp, Artificial
  CRISPR gRNA sequence
gggggcctcagctggggagg

SEQ ID NO: 349411 - DNA, 20 bp, Artificial
  CRISPR gRNA sequence
ggggcctcagctggggaggt

SEQ ID NO: 349412 - DNA, 20 bp, Artificial
  CRISPR gRNA sequence
agctggggaggtgggccggg

SEQ ID NO: 349413 - DNA, 20 bp, Artificial
  CRISPR gRNA sequence
gggaggtgggccgggcgccc

SEQ ID NO: 349414 - DNA, 20 bp, Artificial
  CRISPR gRNA sequence
tcacccatgctgggcctcct

SEQ ID NO: 349415 - DNA, 20 bp, Artificial
  CRISPR gRNA sequence
ggcctcctggggacaggctg

SEQ ID NO: 349416 - DNA, 20 bp, Artificial
  CRISPR gRNA sequence
ctggggacaggctgggctag

SEQ ID NO: 349417 - DNA, 20 bp, Artificial
  CRISPR gRNA sequence
gggacaggctgggctagcag

SEQ ID NO: 349418 - DNA, 20 bp, Artificial
  CRISPR gRNA sequence
ggctagcagtcccaacacag

SEQ ID NO: 349419 - DNA, 20 bp, Artificial
  CRISPR gRNA sequence
gcagtcccaacacagttggc

SEQ ID NO: 349420 - DNA, 20 bp, Artificial
  CRISPR gRNA sequence
gcctcctctgctctcagaga

SEQ ID NO: 349421 - DNA, 20 bp, Artificial
  CRISPR gRNA sequence
ctctgctctcagagagggtc

SEQ ID NO: 349422 - DNA, 20 bp, Artificial
  CRISPR gRNA sequence
tgctctcagagagggtcagt

SEQ ID NO: 349423 - DNA, 20 bp, Artificial
  CRISPR gRNA sequence
ctctcagagagggtcagtcc

SEQ ID NO: 349424 - DNA, 20 bp, Artificial
  CRISPR gRNA sequence
tcagagagggtcagtccctt

SEQ ID NO: 349425 - DNA, 20 bp, Artificial
  CRISPR gRNA sequence
agagagggtcagtcccttgg

SEQ ID NO: 349426 - DNA, 20 bp, Artificial
  CRISPR gRNA sequence
ggggacggtctcccagggag

SEQ ID NO: 349427 - DNA, 20 bp, Artificial
  CRISPR gRNA sequence
gggacggtctcccagggaga

SEQ ID NO: 349428 - DNA, 20 bp, Artificial
  CRISPR gRNA sequence
ccagggagaagcaggagttg

SEQ ID NO: 349429 - DNA, 20 bp, Artificial
  CRISPR gRNA sequence
tgcctccgccaccgctgtga

SEQ ID NO: 349430 - DNA, 20 bp, Artificial
  CRISPR gRNA sequence
cgccaccgctgtgagaccat

SEQ ID NO: 349431 - DNA, 20 bp, Artificial
  CRISPR gRNA sequence
tgagaccattgccatgagcc

SEQ ID NO: 349432 - DNA, 20 bp, Artificial
  CRISPR gRNA sequence
ccatgagcctgtgtcccctg

SEQ ID NO: 349433 - DNA, 20 bp, Artificial
  CRISPR gRNA sequence
tgtcccctgatcagacactg

SEQ ID NO: 349434 - DNA, 20 bp, Artificial
  CRISPR gRNA sequence
atcagacactgcccctccct

SEQ ID NO: 349435 - DNA, 20 bp, Artificial
  CRISPR gRNA sequence
cccctccctgacctgtgtgt

SEQ ID NO: 349436 - DNA, 20 bp, Artificial
  CRISPR gRNA sequence
cctgacctgtgtgtctgtgt

SEQ ID NO: 349437 - DNA, 20 bp, Artificial
  CRISPR gRNA sequence
acctgtgtgtctgtgtattg

SEQ ID NO: 349438 - DNA, 20 bp, Artificial
  CRISPR gRNA sequence
tgtgtctgtgtattgcaggt

SEQ ID NO: 349439 - DNA, 20 bp, Artificial
  CRISPR gRNA sequence
tgtattgcaggtgatgtagt

SEQ ID NO: 349440 - DNA, 20 bp, Artificial
  CRISPR gRNA sequence
caggtgatgtagtcaaggtg

SEQ ID NO: 349441 - DNA, 20 bp, Artificial
  CRISPR gRNA sequence
cgtccaggtattgatcctcc

SEQ ID NO: 349442 - DNA, 20 bp, Artificial
  CRISPR gRNA sequence
atcctcctccccctctccct

SEQ ID NO: 349443 - DNA, 20 bp, Artificial
  CRISPR gRNA sequence
ctccccctctccctcccccc

SEQ ID NO: 349444 - DNA, 20 bp, Artificial
  CRISPR gRNA sequence
cccctctccctcccccctcc

SEQ ID NO: 349445 - DNA, 20 bp, Artificial
  CRISPR gRNA sequence
tccctcccccctccaccttc

SEQ ID NO: 349446 - DNA, 20 bp, Artificial
  CRISPR gRNA sequence
cctcccccctccaccttccc

SEQ ID NO: 349447 - DNA, 20 bp, Artificial
  CRISPR gRNA sequence
ccccctccaccttcccacct

SEQ ID NO: 349448 - DNA, 20 bp, Artificial
  CRISPR gRNA sequence
caccttcccacctcccctct

SEQ ID NO: 349449 - DNA, 20 bp, Artificial
  CRISPR gRNA sequence
cccacctcccctctccccgc

SEQ ID NO: 349450 - DNA, 20 bp, Artificial
  CRISPR gRNA sequence
ccacctcccctctccccgct

SEQ ID NO: 349451 - DNA, 20 bp, Artificial
  CRISPR gRNA sequence
ccctctccccgctggggctg

SEQ ID NO: 349452 - DNA, 20 bp, Artificial
  CRISPR gRNA sequence
tccccgctggggctggtgtt

SEQ ID NO: 349453 - DNA, 20 bp, Artificial
  CRISPR gRNA sequence
cccgctggggctggtgtttc

SEQ ID NO: 349454 - DNA, 20 bp, Artificial
  CRISPR gRNA sequence
gggctggtgtttctggtgta

SEQ ID NO: 349455 - DNA, 20 bp, Artificial
  CRISPR gRNA sequence
gtgtttctggtgtacatggt

SEQ ID NO: 349456 - DNA, 20 bp, Artificial
  CRISPR gRNA sequence
ctggtgtacatggtgggggc

SEQ ID NO: 349457 - DNA, 20 bp, Artificial
  CRISPR gRNA sequence
tggtgtacatggtgggggct

SEQ ID NO: 349458 - DNA, 20 bp, Artificial
  CRISPR gRNA sequence
gtgtacatggtgggggctcc

SEQ ID NO: 349459 - DNA, 20 bp, Artificial
  CRISPR gRNA sequence
ccagttctctgagggtcctg

SEQ ID NO: 349460 - DNA, 20 bp, Artificial
  CRISPR gRNA sequence
tctgagggtcctgagtcttt

SEQ ID NO: 349461 - DNA, 20 bp, Artificial
  CRISPR gRNA sequence
tgagggtcctgagtctttca

SEQ ID NO: 349462 - DNA, 20 bp, Artificial
  CRISPR gRNA sequence
agggtcctgagtctttcaag

SEQ ID NO: 349463 - DNA, 20 bp, Artificial
  CRISPR gRNA sequence
agtctttcaagtacagccac

SEQ ID NO: 349464 - DNA, 20 bp, Artificial
  CRISPR gRNA sequence
tcaagtacagccacggtagc

SEQ ID NO: 349465 - DNA, 20 bp, Artificial
  CRISPR gRNA sequence
caagtacagccacggtagct

SEQ ID NO: 349466 - DNA, 20 bp, Artificial
  CRISPR gRNA sequence
aagtacagccacggtagctc

SEQ ID NO: 349467 - DNA, 20 bp, Artificial
  CRISPR gRNA sequence
aggaaagaacccaccccctc

SEQ ID NO: 349468 - DNA, 20 bp, Artificial
  CRISPR gRNA sequence
aaactgaaagcagtaaaatg

SEQ ID NO: 349469 - DNA, 20 bp, Artificial
  CRISPR gRNA sequence
aaagcagtaaaatgaacccg

SEQ ID NO: 349470 - DNA, 20 bp, Artificial
  CRISPR gRNA sequence
gagtcccaggggggcctgag

SEQ ID NO: 349471 - DNA, 20 bp, Artificial
  CRISPR gRNA sequence
agcaggcagggtctccacga

SEQ ID NO: 349472 - DNA, 20 bp, Artificial
  CRISPR gRNA sequence
cacgattcgtgtgctcacag

SEQ ID NO: 349473 - DNA, 20 bp, Artificial
  CRISPR gRNA sequence
gtgtgctcacagcggaaaag

SEQ ID NO: 349474 - DNA, 20 bp, Artificial
  CRISPR gRNA sequence
acagcggaaaagacaggagg

SEQ ID NO: 349475 - DNA, 20 bp, Artificial
  CRISPR gRNA sequence
aggccctgcaggcccctccg

SEQ ID NO: 349476 - DNA, 20 bp, Artificial
  CRISPR gRNA sequence
caggcccctccggacgtcac

SEQ ID NO: 349477 - DNA, 20 bp, Artificial
  CRISPR gRNA sequence
cggacgtcaccacggtggcc

SEQ ID NO: 349478 - DNA, 20 bp, Artificial
  CRISPR gRNA sequence
attcacggggaggagcccaa

SEQ ID NO: 349479 - DNA, 20 bp, Artificial
  CRISPR gRNA sequence
acggggaggagcccaaacca

SEQ ID NO: 349480 - DNA, 20 bp, Artificial
  CRISPR gRNA sequence
acccacagactctgcacccc

SEQ ID NO: 349481 - DNA, 20 bp, Artificial
  CRISPR gRNA sequence
tgcaccccgacgccagagat

SEQ ID NO: 349482 - DNA, 20 bp, Artificial
  CRISPR gRNA sequence
caccccgacgccagagatac

SEQ ID NO: 349483 - DNA, 20 bp, Artificial
  CRISPR gRNA sequence
gagcgacggctgctgaaaga

SEQ ID NO: 349484 - DNA, 20 bp, Artificial
  CRISPR gRNA sequence
ctgaaagaggctgtccacct

SEQ ID NO: 349485 - DNA, 20 bp, Artificial
  CRISPR gRNA sequence
aaagaggctgtccacctggc

SEQ ID NO: 349486 - DNA, 20 bp, Artificial
  CRISPR gRNA sequence
tccacctggcggaaccaccg

SEQ ID NO: 349487 - DNA, 20 bp, Artificial
  CRISPR gRNA sequence
gcggaaccaccggagcccgg

SEQ ID NO: 349488 - DNA, 20 bp, Artificial
  CRISPR gRNA sequence
gggggctccgccctgggctg

SEQ ID NO: 349489 - DNA, 20 bp, Artificial
  CRISPR gRNA sequence
ggggctccgccctgggctgg

SEQ ID NO: 349490 - DNA, 20 bp, Artificial
  CRISPR gRNA sequence
cgccctgggctggcttccgt

SEQ ID NO: 349491 - DNA, 20 bp, Artificial
  CRISPR gRNA sequence
ggctggcttccgtctcctcc

SEQ ID NO: 349492 - DNA, 20 bp, Artificial
  CRISPR gRNA sequence
gcttccgtctcctccagtgg

SEQ ID NO: 349493 - DNA, 20 bp, Artificial
  CRISPR gRNA sequence
ccgtctcctccagtggaggg

SEQ ID NO: 349494 - DNA, 20 bp, Artificial
  CRISPR gRNA sequence
cgtctcctccagtggaggga

SEQ ID NO: 349495 - DNA, 20 bp, Artificial
  CRISPR gRNA sequence
ctccagtggagggagaggtg

SEQ ID NO: 349496 - DNA, 20 bp, Artificial
  CRISPR gRNA sequence
cagtggagggagaggtgggg

SEQ ID NO: 349497 - DNA, 20 bp, Artificial
  CRISPR gRNA sequence
ctggggtagagctggggacg

SEQ ID NO: 349498 - DNA, 20 bp, Artificial
  CRISPR gRNA sequence
gggtagagctggggacgcca

SEQ ID NO: 349499 - DNA, 20 bp, Artificial
  CRISPR gRNA sequence
gggacgccacgtgccattcc

SEQ ID NO: 349500 - DNA, 20 bp, Artificial
  CRISPR gRNA sequence
ccatgggccagtgagggcct

SEQ ID NO: 349501 - DNA, 20 bp, Artificial
  CRISPR gRNA sequence
gggcctctgttctgctgtgg

SEQ ID NO: 349502 - DNA, 20 bp, Artificial
  CRISPR gRNA sequence
tgttctgctgtggcctgagc

SEQ ID NO: 349503 - DNA, 20 bp, Artificial
  CRISPR gRNA sequence
ttctgctgtggcctgagctc

SEQ ID NO: 349504 - DNA, 20 bp, Artificial
  CRISPR gRNA sequence
tgctgtggcctgagctcccc

SEQ ID NO: 349505 - DNA, 20 bp, Artificial
  CRISPR gRNA sequence
ctgtggcctgagctccccag

SEQ ID NO: 349506 - DNA, 20 bp, Artificial
  CRISPR gRNA sequence
tggcctgagctccccagagt

SEQ ID NO: 349507 - DNA, 20 bp, Artificial
  CRISPR gRNA sequence
agctccccagagtcctgagg

SEQ ID NO: 349508 - DNA, 20 bp, Artificial
  CRISPR gRNA sequence
cccagagtcctgaggaggag

SEQ ID NO: 349509 - DNA, 20 bp, Artificial
  CRISPR gRNA sequence
aggaggagcgccagttgccc

SEQ ID NO: 349510 - DNA, 20 bp, Artificial
  CRISPR gRNA sequence
cccctcgctcacagaccaca

SEQ ID NO: 349511 - DNA, 20 bp, Artificial
  CRISPR gRNA sequence
gctcacagaccacacaccca

SEQ ID NO: 349512 - DNA, 20 bp, Artificial
  CRISPR gRNA sequence
acagaccacacacccagccc

SEQ ID NO: 349513 - DNA, 20 bp, Artificial
  CRISPR gRNA sequence
ctgggccagcccagagggcc

SEQ ID NO: 349514 - DNA, 20 bp, Artificial
  CRISPR gRNA sequence
ggccagcccagagggccctt

SEQ ID NO: 349515 - DNA, 20 bp, Artificial
  CRISPR gRNA sequence
cagaccccagctgtctgcgc

SEQ ID NO: 349516 - DNA, 20 bp, Artificial
  CRISPR gRNA sequence
agaccccagctgtctgcgcg

SEQ ID NO: 349517 - DNA, 20 bp, Artificial
  CRISPR gRNA sequence
tctgcgcgtctgactcttgt

SEQ ID NO: 349518 - DNA, 20 bp, Artificial
  CRISPR gRNA sequence
cgcgtctgactcttgtggcc

SEQ ID NO: 349519 - DNA, 20 bp, Artificial
  CRISPR gRNA sequence
actcttgtggcctcagcagg

SEQ ID NO: 349520 - DNA, 20 bp, Artificial
  CRISPR gRNA sequence
ttgtggcctcagcaggacag

SEQ ID NO: 349521 - DNA, 20 bp, Artificial
  CRISPR gRNA sequence
gtggcctcagcaggacaggc

SEQ ID NO: 349522 - DNA, 20 bp, Artificial
  CRISPR gRNA sequence
tggcctcagcaggacaggcc

SEQ ID NO: 349523 - DNA, 20 bp, Artificial
  CRISPR gRNA sequence
agcaggacaggccccgggca

SEQ ID NO: 349524 - DNA, 20 bp, Artificial
  CRISPR gRNA sequence
cctcacagccaaggctggac

SEQ ID NO: 349525 - DNA, 20 bp, Artificial
  CRISPR gRNA sequence
acagccaaggctggactggg

SEQ ID NO: 349526 - DNA, 20 bp, Artificial
  CRISPR gRNA sequence
gactgggttggctgcagtgt

SEQ ID NO: 349527 - DNA, 20 bp, Artificial
  CRISPR gRNA sequence
ggttggctgcagtgtggtgt

SEQ ID NO: 349528 - DNA, 20 bp, Artificial
  CRISPR gRNA sequence
gctgcagtgtggtgtttagt

SEQ ID NO: 349529 - DNA, 20 bp, Artificial
  CRISPR gRNA sequence
cagtgtggtgtttagtggat

SEQ ID NO: 349530 - DNA, 20 bp, Artificial
  CRISPR gRNA sequence
agtggataccacatcggaag

SEQ ID NO: 349531 - DNA, 20 bp, Artificial
  CRISPR gRNA sequence
gtggataccacatcggaagt

SEQ ID NO: 349532 - DNA, 20 bp, Artificial
  CRISPR gRNA sequence
tctaaattggatttgaattc

SEQ ID NO: 349533 - DNA, 20 bp, Artificial
  CRISPR gRNA sequence
ctaaattggatttgaattcg

SEQ ID NO: 349534 - DNA, 20 bp, Artificial
  CRISPR gRNA sequence
taaattggatttgaattcgg

SEQ ID NO: 349535 - DNA, 20 bp, Artificial
  CRISPR gRNA sequence
aattggatttgaattcggct

SEQ ID NO: 349536 - DNA, 20 bp, Artificial
  CRISPR gRNA sequence
gatttgaattcggctcctgt

SEQ ID NO: 349537 - DNA, 20 bp, Artificial
  CRISPR gRNA sequence
gaattcggctcctgttttct

SEQ ID NO: 349538 - DNA, 20 bp, Artificial
  CRISPR gRNA sequence
aattcggctcctgttttcta

SEQ ID NO: 349539 - DNA, 20 bp, Artificial
  CRISPR gRNA sequence
ggctcctgttttctatttgt

SEQ ID NO: 349540 - DNA, 20 bp, Artificial
  CRISPR gRNA sequence
ctgttttctatttgtcatga

SEQ ID NO: 349541 - DNA, 20 bp, Artificial
  CRISPR gRNA sequence
ttttctatttgtcatgaaac

SEQ ID NO: 349542 - DNA, 20 bp, Artificial
  CRISPR gRNA sequence
tctatttgtcatgaaacagt

SEQ ID NO: 349543 - DNA, 20 bp, Artificial
  CRISPR gRNA sequence
ctatttgtcatgaaacagtg

SEQ ID NO: 349544 - DNA, 20 bp, Artificial
  CRISPR gRNA sequence
tatttgtcatgaaacagtgt

SEQ ID NO: 349545 - DNA, 20 bp, Artificial
  CRISPR gRNA sequence
tttgtcatgaaacagtgtat

SEQ ID NO: 349546 - DNA, 20 bp, Artificial
  CRISPR gRNA sequence
gtcatgaaacagtgtatttg

SEQ ID NO: 349547 - DNA, 20 bp, Artificial
  CRISPR gRNA sequence
tcatgaaacagtgtatttgg

SEQ ID NO: 349548 - DNA, 20 bp, Artificial
  CRISPR gRNA sequence
ggggagatgctgtgggagga

SEQ ID NO: 349549 - DNA, 20 bp, Artificial
  CRISPR gRNA sequence
gggagatgctgtgggaggat

SEQ ID NO: 349550 - DNA, 20 bp, Artificial
  CRISPR gRNA sequence
tgggaggatgtaaatatctt

SEQ ID NO: 349551 - DNA, 20 bp, Artificial
  CRISPR gRNA sequence
gtttctcctcaaactgtcac

SEQ ID NO: 349552 - DNA, 20 bp, Artificial
  CRISPR gRNA sequence
tttctcctcaaactgtcacc

SEQ ID NO: 349553 - DNA, 20 bp, Artificial
  CRISPR gRNA sequence
ctcctcaaactgtcacctcc

SEQ ID NO: 349554 - DNA, 20 bp, Artificial
  CRISPR gRNA sequence
tcctcaaactgtcacctccc

SEQ ID NO: 349555 - DNA, 20 bp, Artificial
  CRISPR gRNA sequence
ctcaaactgtcacctcccgg

SEQ ID NO: 349556 - DNA, 20 bp, Artificial
  CRISPR gRNA sequence
aaactgtcacctcccggtgt

SEQ ID NO: 349557 - DNA, 20 bp, Artificial
  CRISPR gRNA sequence
tcacctcccggtgtttcttg

SEQ ID NO: 349558 - DNA, 20 bp, Artificial
  CRISPR gRNA sequence
ccggtgtttcttgctgaaca

SEQ ID NO: 349559 - DNA, 20 bp, Artificial
  CRISPR gRNA sequence
cttgctgaacaaggagttcc

SEQ ID NO: 349560 - DNA, 20 bp, Artificial
  CRISPR gRNA sequence
ttgctgaacaaggagttcca

SEQ ID NO: 349561 - DNA, 20 bp, Artificial
  CRISPR gRNA sequence
gctgaacaaggagttccagg

SEQ ID NO: 349562 - DNA, 20 bp, Artificial
  CRISPR gRNA sequence
ctgaacaaggagttccagga

SEQ ID NO: 349563 - DNA, 20 bp, Artificial
  CRISPR gRNA sequence
aacaaggagttccaggatgg

SEQ ID NO: 349564 - DNA, 20 bp, Artificial
  CRISPR gRNA sequence
caggatggctgctgggctgt

SEQ ID NO: 349565 - DNA, 20 bp, Artificial
  CRISPR gRNA sequence
ctgggctgttcgggggaccc

SEQ ID NO: 349566 - DNA, 20 bp, Artificial
  CRISPR gRNA sequence
ggctgttcgggggacccctg

SEQ ID NO: 349567 - DNA, 20 bp, Artificial
  CRISPR gRNA sequence
ttcgggggacccctgccctc

SEQ ID NO: 349568 - DNA, 20 bp, Artificial
  CRISPR gRNA sequence
gggggacccctgccctcctc

SEQ ID NO: 349569 - DNA, 20 bp, Artificial
  CRISPR gRNA sequence
ccctcctcccgtcatgcctg

SEQ ID NO: 349570 - DNA, 20 bp, Artificial
  CRISPR gRNA sequence
ctcccgtcatgcctgggggt

SEQ ID NO: 349571 - DNA, 20 bp, Artificial
  CRISPR gRNA sequence
ccgtcatgcctgggggttca

SEQ ID NO: 349572 - DNA, 20 bp, Artificial
  CRISPR gRNA sequence
ggggttcactccacccagag

SEQ ID NO: 349573 - DNA, 20 bp, Artificial
  CRISPR gRNA sequence
actccacccagagaggagcc

SEQ ID NO: 349574 - DNA, 20 bp, Artificial
  CRISPR gRNA sequence
cacccagagaggagccctgg

SEQ ID NO: 349575 - DNA, 20 bp, Artificial
  CRISPR gRNA sequence
gccgccccttcatatcccaa

SEQ ID NO: 349576 - DNA, 20 bp, Artificial
  CRISPR gRNA sequence
catatcccaacagctgagct

SEQ ID NO: 349577 - DNA, 20 bp, Artificial
  CRISPR gRNA sequence
atatcccaacagctgagctc

SEQ ID NO: 349578 - DNA, 20 bp, Artificial
  CRISPR gRNA sequence
agctctcagtgggctcttct

SEQ ID NO: 349579 - DNA, 20 bp, Artificial
  CRISPR gRNA sequence
tcagtgggctcttctgacct

SEQ ID NO: 349580 - DNA, 20 bp, Artificial
  CRISPR gRNA sequence
agtgggctcttctgacctct

SEQ ID NO: 349581 - DNA, 20 bp, Artificial
  CRISPR gRNA sequence
ttctgacctctgtggctccg

SEQ ID NO: 349582 - DNA, 20 bp, Artificial
  CRISPR gRNA sequence
ctgacctctgtggctccgtc

SEQ ID NO: 349583 - DNA, 20 bp, Artificial
  CRISPR gRNA sequence
tgacctctgtggctccgtcc

SEQ ID NO: 349584 - DNA, 20 bp, Artificial
  CRISPR gRNA sequence
acctctgtggctccgtccga

SEQ ID NO: 349585 - DNA, 20 bp, Artificial
  CRISPR gRNA sequence
tgtggctccgtccgaggcta

SEQ ID NO: 349586 - DNA, 20 bp, Artificial
  CRISPR gRNA sequence
tggctccgtccgaggctatt

SEQ ID NO: 349587 - DNA, 20 bp, Artificial
  CRISPR gRNA sequence
cgtccgaggctattgctgtg

SEQ ID NO: 349588 - DNA, 20 bp, Artificial
  CRISPR gRNA sequence
ttgctgtggattctgatgct

SEQ ID NO: 349589 - DNA, 20 bp, Artificial
  CRISPR gRNA sequence
ctgtggattctgatgctcaa

SEQ ID NO: 349590 - DNA, 20 bp, Artificial
  CRISPR gRNA sequence
tggattctgatgctcaaatg

SEQ ID NO: 349591 - DNA, 20 bp, Artificial
  CRISPR gRNA sequence
tgatgctcaaatggtgtcag

SEQ ID NO: 349592 - DNA, 20 bp, Artificial
  CRISPR gRNA sequence
atgctcaaatggtgtcagat

SEQ ID NO: 349593 - DNA, 20 bp, Artificial
  CRISPR gRNA sequence
aaatggtgtcagatttgccc

SEQ ID NO: 349594 - DNA, 20 bp, Artificial
  CRISPR gRNA sequence
gcccagtaaaaaccccagat

SEQ ID NO: 349595 - DNA, 20 bp, Artificial
  CRISPR gRNA sequence
cccagtaaaaaccccagatc

SEQ ID NO: 349596 - DNA, 20 bp, Artificial
  CRISPR gRNA sequence
catctgacctacacttccca

SEQ ID NO: 349597 - DNA, 20 bp, Artificial
  CRISPR gRNA sequence
acctacacttcccagctgtg

SEQ ID NO: 349598 - DNA, 20 bp, Artificial
  CRISPR gRNA sequence
cacttcccagctgtgtccac

SEQ ID NO: 349599 - DNA, 20 bp, Artificial
  CRISPR gRNA sequence
cccagctgtgtccaccgaga

SEQ ID NO: 349600 - DNA, 20 bp, Artificial
  CRISPR gRNA sequence
ccagctgtgtccaccgagaa

SEQ ID NO: 349601 - DNA, 20 bp, Artificial
  CRISPR gRNA sequence
tgtccaccgagaaaccccag

SEQ ID NO: 349602 - DNA, 20 bp, Artificial
  CRISPR gRNA sequence
ctgtgcccagccctctccac

SEQ ID NO: 349603 - DNA, 20 bp, Artificial
  CRISPR gRNA sequence
tgcccagccctctccacctg

SEQ ID NO: 349604 - DNA, 20 bp, Artificial
  CRISPR gRNA sequence
tccacctgctccgggaaccc

SEQ ID NO: 349605 - DNA, 20 bp, Artificial
  CRISPR gRNA sequence
cacctgctccgggaacccgc

SEQ ID NO: 349606 - DNA, 20 bp, Artificial
  CRISPR gRNA sequence
ctccgggaacccgccaggcc

SEQ ID NO: 349607 - DNA, 20 bp, Artificial
  CRISPR gRNA sequence
cgggaacccgccaggcccag

SEQ ID NO: 349608 - DNA, 20 bp, Artificial
  CRISPR gRNA sequence
gcaggggcttcaccaggcct

SEQ ID NO: 349609 - DNA, 20 bp, Artificial
  CRISPR gRNA sequence
caccaggcctctgagccaca

SEQ ID NO: 349610 - DNA, 20 bp, Artificial
  CRISPR gRNA sequence
accaggcctctgagccacac

SEQ ID NO: 349611 - DNA, 20 bp, Artificial
  CRISPR gRNA sequence
tgagccacacattcatttaa

SEQ ID NO: 349612 - DNA, 20 bp, Artificial
  CRISPR gRNA sequence
agccacacattcatttaatg

SEQ ID NO: 349613 - DNA, 20 bp, Artificial
  CRISPR gRNA sequence
atttaatggtcgggatgagg

SEQ ID NO: 349614 - DNA, 20 bp, Artificial
  CRISPR gRNA sequence
aatggtcgggatgaggcccc

SEQ ID NO: 349615 - DNA, 20 bp, Artificial
  CRISPR gRNA sequence
atggtcgggatgaggcccct

SEQ ID NO: 349616 - DNA, 20 bp, Artificial
  CRISPR gRNA sequence
tccccacatctgaagttaga

SEQ ID NO: 349617 - DNA, 20 bp, Artificial
  CRISPR gRNA sequence
ccccacatctgaagttagaa

SEQ ID NO: 349618 - DNA, 20 bp, Artificial
  CRISPR gRNA sequence
cccacatctgaagttagaag

SEQ ID NO: 349619 - DNA, 20 bp, Artificial
  CRISPR gRNA sequence
aagttagaagcggtgagggg

SEQ ID NO: 349620 - DNA, 20 bp, Artificial
  CRISPR gRNA sequence
gaagcggtgaggggaatgac

SEQ ID NO: 349621 - DNA, 20 bp, Artificial
  CRISPR gRNA sequence
cagccatgccatgaggatgg

SEQ ID NO: 349622 - DNA, 20 bp, Artificial
  CRISPR gRNA sequence
cgagcatgcccgctccaccc

SEQ ID NO: 349623 - DNA, 20 bp, Artificial
  CRISPR gRNA sequence
caccccgccctaccccctct

SEQ ID NO: 349624 - DNA, 20 bp, Artificial
  CRISPR gRNA sequence
ccccctctcctttccttgtc

SEQ ID NO: 349625 - DNA, 20 bp, Artificial
  CRISPR gRNA sequence
tcctttccttgtcacctgcc

SEQ ID NO: 349626 - DNA, 20 bp, Artificial
  CRISPR gRNA sequence
ctttccttgtcacctgcctc

SEQ ID NO: 349627 - DNA, 20 bp, Artificial
  CRISPR gRNA sequence
tccttgtcacctgcctccag

SEQ ID NO: 349628 - DNA, 20 bp, Artificial
  CRISPR gRNA sequence
ccttgtcacctgcctccagc

SEQ ID NO: 349629 - DNA, 20 bp, Artificial
  CRISPR gRNA sequence
cttgtcacctgcctccagca

SEQ ID NO: 349630 - DNA, 20 bp, Artificial
  CRISPR gRNA sequence
gtcacctgcctccagcagag

SEQ ID NO: 349631 - DNA, 20 bp, Artificial
  CRISPR gRNA sequence
tcacctgcctccagcagagc

SEQ ID NO: 349632 - DNA, 20 bp, Artificial
  CRISPR gRNA sequence
cctccagcagagcccccagg

SEQ ID NO: 349633 - DNA, 20 bp, Artificial
  CRISPR gRNA sequence
cagcagagcccccaggctga

SEQ ID NO: 349634 - DNA, 20 bp, Artificial
  CRISPR gRNA sequence
agccacccaccccaactcct

SEQ ID NO: 349635 - DNA, 20 bp, Artificial
  CRISPR gRNA sequence
ctctcctgccaccccttgtc

SEQ ID NO: 349636 - DNA, 20 bp, Artificial
  CRISPR gRNA sequence
tcctgccaccccttgtcctg

SEQ ID NO: 349637 - DNA, 20 bp, Artificial
  CRISPR gRNA sequence
ctgccaccccttgtcctgtg

SEQ ID NO: 349638 - DNA, 20 bp, Artificial
  CRISPR gRNA sequence
ccaccccttgtcctgtggaa

SEQ ID NO: 349639 - DNA, 20 bp, Artificial
  CRISPR gRNA sequence
gtcctgtggaagctttggct

SEQ ID NO: 349640 - DNA, 20 bp, Artificial
  CRISPR gRNA sequence
tcctgtggaagctttggctt

SEQ ID NO: 349641 - DNA, 20 bp, Artificial
  CRISPR gRNA sequence
tggaagctttggcttagcgt

SEQ ID NO: 349642 - DNA, 20 bp, Artificial
  CRISPR gRNA sequence
tggcttagcgtcctggggtg

SEQ ID NO: 349643 - DNA, 20 bp, Artificial
  CRISPR gRNA sequence
ggcttagcgtcctggggtgt

SEQ ID NO: 349644 - DNA, 20 bp, Artificial
  CRISPR gRNA sequence
gcttagcgtcctggggtgtg

SEQ ID NO: 349645 - DNA, 20 bp, Artificial
  CRISPR gRNA sequence
agcgtcctggggtgtggaga

SEQ ID NO: 349646 - DNA, 20 bp, Artificial
  CRISPR gRNA sequence
gcgtcctggggtgtggagag

SEQ ID NO: 349647 - DNA, 20 bp, Artificial
  CRISPR gRNA sequence
gggtgtggagaggcccatgc

SEQ ID NO: 349648 - DNA, 20 bp, Artificial
  CRISPR gRNA sequence
ggcccctagaaagcagcact

SEQ ID NO: 349649 - DNA, 20 bp, Artificial
  CRISPR gRNA sequence
gaaagcagcacttctggctg

SEQ ID NO: 349650 - DNA, 20 bp, Artificial
  CRISPR gRNA sequence
ctggctgccccaccccgtgt

SEQ ID NO: 349651 - DNA, 20 bp, Artificial
  CRISPR gRNA sequence
tggctgccccaccccgtgtc

SEQ ID NO: 349652 - DNA, 20 bp, Artificial
  CRISPR gRNA sequence
gctgccccaccccgtgtcac

SEQ ID NO: 349653 - DNA, 20 bp, Artificial
  CRISPR gRNA sequence
ccccaccccgtgtcaccctc

SEQ ID NO: 349654 - DNA, 20 bp, Artificial
  CRISPR gRNA sequence
tccccaactggaggcgtggt

SEQ ID NO: 349655 - DNA, 20 bp, Artificial
  CRISPR gRNA sequence
cccaactggaggcgtggtct

SEQ ID NO: 349656 - DNA, 20 bp, Artificial
  CRISPR gRNA sequence
gaggcgtggtctccagggac

SEQ ID NO: 349657 - DNA, 20 bp, Artificial
  CRISPR gRNA sequence
cagggaccacgggcctccct

SEQ ID NO: 349658 - DNA, 20 bp, Artificial
  CRISPR gRNA sequence
cctgtgcatggaccggctcc

SEQ ID NO: 349659 - DNA, 20 bp, Artificial
  CRISPR gRNA sequence
tgcatggaccggctcctgac

SEQ ID NO: 349660 - DNA, 20 bp, Artificial
  CRISPR gRNA sequence
ctgaccaccgtccagggtca

SEQ ID NO: 349661 - DNA, 20 bp, Artificial
  CRISPR gRNA sequence
accaccgtccagggtcattg

SEQ ID NO: 349662 - DNA, 20 bp, Artificial
  CRISPR gRNA sequence
ccagggtaccttttcagagg

SEQ ID NO: 349663 - DNA, 20 bp, Artificial
  CRISPR gRNA sequence
ttcagaggctgaccccatag

SEQ ID NO: 349664 - DNA, 20 bp, Artificial
  CRISPR gRNA sequence
tcagaggctgaccccataga

SEQ ID NO: 349665 - DNA, 20 bp, Artificial
  CRISPR gRNA sequence
cagaggctgaccccatagac

SEQ ID NO: 349666 - DNA, 20 bp, Artificial
  CRISPR gRNA sequence
agaggctgaccccatagacc

SEQ ID NO: 349667 - DNA, 20 bp, Artificial
  CRISPR gRNA sequence
accccatagacctggctgcc

SEQ ID NO: 349668 - DNA, 20 bp, Artificial
  CRISPR gRNA sequence
gctgccccccagtgctagat

SEQ ID NO: 349669 - DNA, 20 bp, Artificial
  CRISPR gRNA sequence
ccccccagtgctagatggga

SEQ ID NO: 349670 - DNA, 20 bp, Artificial
  CRISPR gRNA sequence
gatgggagccaagcacagcc

SEQ ID NO: 349671 - DNA, 20 bp, Artificial
  CRISPR gRNA sequence
cccttctgcccacagtcccg

SEQ ID NO: 349672 - DNA, 20 bp, Artificial
  CRISPR gRNA sequence
ctgcccacagtcccgggggc

SEQ ID NO: 349673 - DNA, 20 bp, Artificial
  CRISPR gRNA sequence
tgcccacagtcccgggggca

SEQ ID NO: 349674 - DNA, 20 bp, Artificial
  CRISPR gRNA sequence
cccacagtcccgggggcagg

SEQ ID NO: 349675 - DNA, 20 bp, Artificial
  CRISPR gRNA sequence
cctggtcaggggccccaact

SEQ ID NO: 349676 - DNA, 20 bp, Artificial
  CRISPR gRNA sequence
gtcaggggccccaacttccc

SEQ ID NO: 349677 - DNA, 20 bp, Artificial
  CRISPR gRNA sequence
cccttcccccagggaggcca

SEQ ID NO: 349678 - DNA, 20 bp, Artificial
  CRISPR gRNA sequence
ccttcccccagggaggccac

SEQ ID NO: 349679 - DNA, 20 bp, Artificial
  CRISPR gRNA sequence
cccccagggaggccacctga

SEQ ID NO: 349680 - DNA, 20 bp, Artificial
  CRISPR gRNA sequence
ccccagggaggccacctgac

SEQ ID NO: 349681 - DNA, 20 bp, Artificial
  CRISPR gRNA sequence
acatctgggctccaggcaca

SEQ ID NO: 349682 - DNA, 20 bp, Artificial
  CRISPR gRNA sequence
ggctccaggcacagcaggaa

SEQ ID NO: 349683 - DNA, 20 bp, Artificial
  CRISPR gRNA sequence
caggcacagcaggaagccca

SEQ ID NO: 349684 - DNA, 20 bp, Artificial
  CRISPR gRNA sequence
ccccaacctgtagctcctcc

SEQ ID NO: 349685 - DNA, 20 bp, Artificial
  CRISPR gRNA sequence
tagctcctcctcctgggagg

SEQ ID NO: 349686 - DNA, 20 bp, Artificial
  CRISPR gRNA sequence
ctcctcctgggaggagccat

SEQ ID NO: 349687 - DNA, 20 bp, Artificial
  CRISPR gRNA sequence
ctcctgggaggagccatgga

SEQ ID NO: 349688 - DNA, 20 bp, Artificial
  CRISPR gRNA sequence
ctgggaggagccatggatcc

SEQ ID NO: 349689 - DNA, 20 bp, Artificial
  CRISPR gRNA sequence
ggaggagccatggatcctgg

SEQ ID NO: 349690 - DNA, 20 bp, Artificial
  CRISPR gRNA sequence
gaaaagctctggggccacct

SEQ ID NO: 349691 - DNA, 20 bp, Artificial
  CRISPR gRNA sequence
tggggccacctcccaggttt

SEQ ID NO: 349692 - DNA, 20 bp, Artificial
  CRISPR gRNA sequence
gggccacctcccaggtttgg

SEQ ID NO: 349693 - DNA, 20 bp, Artificial
  CRISPR gRNA sequence
ccaggtttggggggacagag

SEQ ID NO: 349694 - DNA, 20 bp, Artificial
  CRISPR gRNA sequence
ggggggacagagctccaaga

SEQ ID NO: 349695 - DNA, 20 bp, Artificial
  CRISPR gRNA sequence
gggggacagagctccaagag

SEQ ID NO: 349696 - DNA, 20 bp, Artificial
  CRISPR gRNA sequence
caagagacgacggctgggga

SEQ ID NO: 349697 - DNA, 20 bp, Artificial
  CRISPR gRNA sequence
gggacacgagccctcatggg

SEQ ID NO: 349698 - DNA, 20 bp, Artificial
  CRISPR gRNA sequence
atggggccgctgtgtgctca

SEQ ID NO: 349699 - DNA, 20 bp, Artificial
  CRISPR gRNA sequence
tgtgctcaccccttgatttt

SEQ ID NO: 349700 - DNA, 20 bp, Artificial
  CRISPR gRNA sequence
accccttgattttcttcttt

SEQ ID NO: 349701 - DNA, 20 bp, Artificial
  CRISPR gRNA sequence
gattttcttcttttcatgca

SEQ ID NO: 349702 - DNA, 20 bp, Artificial
  CRISPR gRNA sequence
attttcttcttttcatgcat

SEQ ID NO: 349703 - DNA, 20 bp, Artificial
  CRISPR gRNA sequence
tcttcttttcatgcatgaga

SEQ ID NO: 349704 - DNA, 20 bp, Artificial
  CRISPR gRNA sequence
cttcttttcatgcatgagat

SEQ ID NO: 349705 - DNA, 20 bp, Artificial
  CRISPR gRNA sequence
ttcttttcatgcatgagatt

SEQ ID NO: 349706 - DNA, 20 bp, Artificial
  CRISPR gRNA sequence
cttttcatgcatgagattag

SEQ ID NO: 349707 - DNA, 20 bp, Artificial
  CRISPR gRNA sequence
ttttcatgcatgagattagg

SEQ ID NO: 349708 - DNA, 20 bp, Artificial
  CRISPR gRNA sequence
ttcatgcatgagattaggcc

SEQ ID NO: 349709 - DNA, 20 bp, Artificial
  CRISPR gRNA sequence
tcatgcatgagattaggcca

SEQ ID NO: 349710 - DNA, 20 bp, Artificial
  CRISPR gRNA sequence
catgcatgagattaggccaa

SEQ ID NO: 349711 - DNA, 20 bp, Artificial
  CRISPR gRNA sequence
atgcatgagattaggccaag

SEQ ID NO: 349712 - DNA, 20 bp, Artificial
  CRISPR gRNA sequence
ggccaagtgtggagaaatca

SEQ ID NO: 349713 - DNA, 20 bp, Artificial
  CRISPR gRNA sequence
acgatgaggctccctgagag

SEQ ID NO: 349714 - DNA, 20 bp, Artificial
  CRISPR gRNA sequence
cctgagagaaatcacaccca

SEQ ID NO: 349715 - DNA, 20 bp, Artificial
  CRISPR gRNA sequence
agagaaatcacacccagcgg

SEQ ID NO: 349716 - DNA, 20 bp, Artificial
  CRISPR gRNA sequence
ctgctcccaggtctggcctc

SEQ ID NO: 349717 - DNA, 20 bp, Artificial
  CRISPR gRNA sequence
ctcccaggtctggcctcggt

SEQ ID NO: 349718 - DNA, 20 bp, Artificial
  CRISPR gRNA sequence
ccaggtctggcctcggtcac

SEQ ID NO: 349719 - DNA, 20 bp, Artificial
  CRISPR gRNA sequence
gcctcggtcaccagccacct

SEQ ID NO: 349720 - DNA, 20 bp, Artificial
  CRISPR gRNA sequence
ggtcaccagccacctgctgc

SEQ ID NO: 349721 - DNA, 20 bp, Artificial
  CRISPR gRNA sequence
ctgcatccgcgggagtgggg

SEQ ID NO: 349722 - DNA, 20 bp, Artificial
  CRISPR gRNA sequence
catccgcgggagtggggccg

SEQ ID NO: 349723 - DNA, 20 bp, Artificial
  CRISPR gRNA sequence
actcagccccagggagtgtc

SEQ ID NO: 349724 - DNA, 20 bp, Artificial
  CRISPR gRNA sequence
agccccagggagtgtccctg

SEQ ID NO: 349725 - DNA, 20 bp, Artificial
  CRISPR gRNA sequence
gctcccagggctctgggagg

SEQ ID NO: 349726 - DNA, 20 bp, Artificial
  CRISPR gRNA sequence
ccagggctctgggaggtgag

SEQ ID NO: 349727 - DNA, 20 bp, Artificial
  CRISPR gRNA sequence
tgggaggtgagggcaggtcc

SEQ ID NO: 349728 - DNA, 20 bp, Artificial
  CRISPR gRNA sequence
ggaggtgagggcaggtcccg

SEQ ID NO: 349729 - DNA, 20 bp, Artificial
  CRISPR gRNA sequence
ggttagtggcagctccggga

SEQ ID NO: 349730 - DNA, 20 bp, Artificial
  CRISPR gRNA sequence
gtggcagctccgggatgaga

SEQ ID NO: 349731 - DNA, 20 bp, Artificial
  CRISPR gRNA sequence
cgggatgagacctcagaggt

SEQ ID NO: 349732 - DNA, 20 bp, Artificial
  CRISPR gRNA sequence
agaggtctgtctgacttgtc

SEQ ID NO: 349733 - DNA, 20 bp, Artificial
  CRISPR gRNA sequence
tctgacttgtccaagcccgg

SEQ ID NO: 349734 - DNA, 20 bp, Artificial
  CRISPR gRNA sequence
acttgtccaagcccggctat

SEQ ID NO: 349735 - DNA, 20 bp, Artificial
  CRISPR gRNA sequence
gtccaagcccggctatgggg

SEQ ID NO: 349736 - DNA, 20 bp, Artificial
  CRISPR gRNA sequence
tccaagcccggctatgggga

SEQ ID NO: 349737 - DNA, 20 bp, Artificial
  CRISPR gRNA sequence
tggggaggtggggggaagga

SEQ ID NO: 349738 - DNA, 20 bp, Artificial
  CRISPR gRNA sequence
ggcaaagaagacaggacggc

SEQ ID NO: 349739 - DNA, 20 bp, Artificial
  CRISPR gRNA sequence
agagtatttcagcggcaccg

SEQ ID NO: 349740 - DNA, 20 bp, Artificial
  CRISPR gRNA sequence
cagcggcaccgctgtcctgg

SEQ ID NO: 349741 - DNA, 20 bp, Artificial
  CRISPR gRNA sequence
agcggcaccgctgtcctggg

SEQ ID NO: 349742 - DNA, 20 bp, Artificial
  CRISPR gRNA sequence
tcctgggccgcccggtgcca

SEQ ID NO: 349743 - DNA, 20 bp, Artificial
  CRISPR gRNA sequence
ggccgcccggtgccacatct

SEQ ID NO: 349744 - DNA, 20 bp, Artificial
  CRISPR gRNA sequence
tgaaaacagttgtttaattt

SEQ ID NO: 349745 - DNA, 20 bp, Artificial
  CRISPR gRNA sequence
gaaaacagttgtttaattta

SEQ ID NO: 349746 - DNA, 20 bp, Artificial
  CRISPR gRNA sequence
aaaacagttgtttaatttaa

SEQ ID NO: 349747 - DNA, 20 bp, Artificial
  CRISPR gRNA sequence
tttaatttaagcttgtccac

SEQ ID NO: 349748 - DNA, 20 bp, Artificial
  CRISPR gRNA sequence
aatttaagcttgtccactca

SEQ ID NO: 349749 - DNA, 20 bp, Artificial
  CRISPR gRNA sequence
atttaagcttgtccactcag

SEQ ID NO: 349750 - DNA, 20 bp, Artificial
  CRISPR gRNA sequence
aagcttgtccactcagtagc

SEQ ID NO: 349751 - DNA, 20 bp, Artificial
  CRISPR gRNA sequence
agcttgtccactcagtagct

SEQ ID NO: 349752 - DNA, 20 bp, Artificial
  CRISPR gRNA sequence
gtccactcagtagctgttga

SEQ ID NO: 349753 - DNA, 20 bp, Artificial
  CRISPR gRNA sequence
tccactcagtagctgttgaa

SEQ ID NO: 349754 - DNA, 20 bp, Artificial
  CRISPR gRNA sequence
agtagctgttgaatgtggga

SEQ ID NO: 349755 - DNA, 20 bp, Artificial
  CRISPR gRNA sequence
ttgaatgtgggaggttatct

SEQ ID NO: 349756 - DNA, 20 bp, Artificial
  CRISPR gRNA sequence
aatgtgggaggttatcttgt

SEQ ID NO: 349757 - DNA, 20 bp, Artificial
  CRISPR gRNA sequence
tcttgttctattcaagttgc

SEQ ID NO: 349758 - DNA, 20 bp, Artificial
  CRISPR gRNA sequence
gttctattcaagttgctata

SEQ ID NO: 349759 - DNA, 20 bp, Artificial
  CRISPR gRNA sequence
ttctattcaagttgctataa

SEQ ID NO: 349760 - DNA, 20 bp, Artificial
  CRISPR gRNA sequence
tattcaagttgctataaaaa

SEQ ID NO: 349761 - DNA, 20 bp, Artificial
  CRISPR gRNA sequence
ttcaagttgctataaaaata

SEQ ID NO: 349762 - DNA, 20 bp, Artificial
  CRISPR gRNA sequence
aagttgctataaaaataaaa

SEQ ID NO: 349763 - DNA, 20 bp, Artificial
  CRISPR gRNA sequence
ctataaaaataaaaactacc

SEQ ID NO: 349764 - DNA, 20 bp, Artificial
  CRISPR gRNA sequence
taaaaataaaaactaccata

SEQ ID NO: 349765 - DNA, 20 bp, Artificial
  CRISPR gRNA sequence
ccatagactgggtggcttaa

SEQ ID NO: 349766 - DNA, 20 bp, Artificial
  CRISPR gRNA sequence
ggtggcttaacaagaacaga

SEQ ID NO: 349767 - DNA, 20 bp, Artificial
  CRISPR gRNA sequence
aacaagaacagaaattcggc

SEQ ID NO: 349768 - DNA, 20 bp, Artificial
  CRISPR gRNA sequence
acaagaacagaaattcggca

SEQ ID NO: 349769 - DNA, 20 bp, Artificial
  CRISPR gRNA sequence
ggcagggcgaggtggctcac

SEQ ID NO: 349770 - DNA, 20 bp, Artificial
  CRISPR gRNA sequence
acgcctgtaatccccacact

SEQ ID NO: 349771 - DNA, 20 bp, Artificial
  CRISPR gRNA sequence
taatccccacactttgggag

SEQ ID NO: 349772 - DNA, 20 bp, Artificial
  CRISPR gRNA sequence
tgggaggccgaagcgggcag

SEQ ID NO: 349773 - DNA, 20 bp, Artificial
  CRISPR gRNA sequence
gggaggccgaagcgggcaga

SEQ ID NO: 349774 - DNA, 20 bp, Artificial
  CRISPR gRNA sequence
ggaggccgaagcgggcagat

SEQ ID NO: 349775 - DNA, 20 bp, Artificial
  CRISPR gRNA sequence
ctgacttcaaatgatctgcc

SEQ ID NO: 349776 - DNA, 20 bp, Artificial
  CRISPR gRNA sequence
tgacttcaaatgatctgccc

SEQ ID NO: 349777 - DNA, 20 bp, Artificial
  CRISPR gRNA sequence
acttcaaatgatctgcccgc

SEQ ID NO: 349778 - DNA, 20 bp, Artificial
  CRISPR gRNA sequence
caaatgatctgcccgcttcg

SEQ ID NO: 349779 - DNA, 20 bp, Artificial
  CRISPR gRNA sequence
aaatgatctgcccgcttcgg

SEQ ID NO: 349780 - DNA, 20 bp, Artificial
  CRISPR gRNA sequence
cccgcttcggcctcccaaag

SEQ ID NO: 349781 - DNA, 20 bp, Artificial
  CRISPR gRNA sequence
cggcctcccaaagtgtgggg

SEQ ID NO: 349782 - DNA, 20 bp, Artificial
  CRISPR gRNA sequence
ggcctcccaaagtgtgggga

SEQ ID NO: 349783 - DNA, 20 bp, Artificial
  CRISPR gRNA sequence
ccaaagtgtggggattacag

SEQ ID NO: 349784 - DNA, 20 bp, Artificial
  CRISPR gRNA sequence
caggcgtgagccacctcgcc

SEQ ID NO: 349785 - DNA, 20 bp, Artificial
  CRISPR gRNA sequence
gccctgccgaatttctgttc

SEQ ID NO: 349786 - DNA, 20 bp, Artificial
  CRISPR gRNA sequence
ccgaatttctgttcttgtta

SEQ ID NO: 349787 - DNA, 20 bp, Artificial
  CRISPR gRNA sequence
ctgttcttgttaagccaccc

SEQ ID NO: 349788 - DNA, 20 bp, Artificial
  CRISPR gRNA sequence
tgttcttgttaagccaccca

SEQ ID NO: 349789 - DNA, 20 bp, Artificial
  CRISPR gRNA sequence
ttcttgttaagccacccagt

SEQ ID NO: 349790 - DNA, 20 bp, Artificial
  CRISPR gRNA sequence
ttgttaagccacccagtcta

SEQ ID NO: 349791 - DNA, 20 bp, Artificial
  CRISPR gRNA sequence
gttaagccacccagtctatg

SEQ ID NO: 349792 - DNA, 20 bp, Artificial
  CRISPR gRNA sequence
ttaagccacccagtctatgg

SEQ ID NO: 349793 - DNA, 20 bp, Artificial
  CRISPR gRNA sequence
agccacccagtctatggtag

SEQ ID NO: 349794 - DNA, 20 bp, Artificial
  CRISPR gRNA sequence
tggtagtttttatttttata

SEQ ID NO: 349795 - DNA, 20 bp, Artificial
  CRISPR gRNA sequence
ttatttttatagcaacttga

SEQ ID NO: 349796 - DNA, 20 bp, Artificial
  CRISPR gRNA sequence
tatttttatagcaacttgaa

SEQ ID NO: 349797 - DNA, 20 bp, Artificial
  CRISPR gRNA sequence
atttttatagcaacttgaat

SEQ ID NO: 349798 - DNA, 20 bp, Artificial
  CRISPR gRNA sequence
tttttatagcaacttgaata

SEQ ID NO: 349799 - DNA, 20 bp, Artificial
  CRISPR gRNA sequence
ttatagcaacttgaatagaa

SEQ ID NO: 349800 - DNA, 20 bp, Artificial
  CRISPR gRNA sequence
tatagcaacttgaatagaac

SEQ ID NO: 349801 - DNA, 20 bp, Artificial
  CRISPR gRNA sequence
atagcaacttgaatagaaca

SEQ ID NO: 349802 - DNA, 20 bp, Artificial
  CRISPR gRNA sequence
tagcaacttgaatagaacaa

SEQ ID NO: 349803 - DNA, 20 bp, Artificial
  CRISPR gRNA sequence
gaatagaacaagataacctc

SEQ ID NO: 349804 - DNA, 20 bp, Artificial
  CRISPR gRNA sequence
aatagaacaagataacctcc

SEQ ID NO: 349805 - DNA, 20 bp, Artificial
  CRISPR gRNA sequence
ccacattcaacagctactga

SEQ ID NO: 349806 - DNA, 20 bp, Artificial
  CRISPR gRNA sequence
aacagctactgagtggacaa

SEQ ID NO: 349807 - DNA, 20 bp, Artificial
  CRISPR gRNA sequence
ctgagtggacaagcttaaat

SEQ ID NO: 349808 - DNA, 20 bp, Artificial
  CRISPR gRNA sequence
agtggacaagcttaaattaa

SEQ ID NO: 349809 - DNA, 20 bp, Artificial
  CRISPR gRNA sequence
aaattaaacaactgttttca

SEQ ID NO: 349810 - DNA, 20 bp, Artificial
  CRISPR gRNA sequence
aattaaacaactgttttcaa

SEQ ID NO: 349811 - DNA, 20 bp, Artificial
  CRISPR gRNA sequence
aacaactgttttcaaagatg

SEQ ID NO: 349812 - DNA, 20 bp, Artificial
  CRISPR gRNA sequence
ttttcaaagatgtggcaccg

SEQ ID NO: 349813 - DNA, 20 bp, Artificial
  CRISPR gRNA sequence
tcaaagatgtggcaccgggc

SEQ ID NO: 349814 - DNA, 20 bp, Artificial
  CRISPR gRNA sequence
caaagatgtggcaccgggcg

SEQ ID NO: 349815 - DNA, 20 bp, Artificial
  CRISPR gRNA sequence
aaagatgtggcaccgggcgg

SEQ ID NO: 349816 - DNA, 20 bp, Artificial
  CRISPR gRNA sequence
aaatactctcagggccctgc

SEQ ID NO: 349817 - DNA, 20 bp, Artificial
  CRISPR gRNA sequence
tcagggccctgcgctgctgg

SEQ ID NO: 349818 - DNA, 20 bp, Artificial
  CRISPR gRNA sequence
agggccctgcgctgctggct

SEQ ID NO: 349819 - DNA, 20 bp, Artificial
  CRISPR gRNA sequence
cgctgctggctgcctcccac

SEQ ID NO: 349820 - DNA, 20 bp, Artificial
  CRISPR gRNA sequence
ctggctgcctcccacttctc

SEQ ID NO: 349821 - DNA, 20 bp, Artificial
  CRISPR gRNA sequence
gctgcctcccacttctctcc

SEQ ID NO: 349822 - DNA, 20 bp, Artificial
  CRISPR gRNA sequence
cctcccacttctctcccctc

SEQ ID NO: 349823 - DNA, 20 bp, Artificial
  CRISPR gRNA sequence
ccacttctctcccctctccc

SEQ ID NO: 349824 - DNA, 20 bp, Artificial
  CRISPR gRNA sequence
ctctcccctctccctctgcc

SEQ ID NO: 349825 - DNA, 20 bp, Artificial
  CRISPR gRNA sequence
tctcccctctccctctgccg

SEQ ID NO: 349826 - DNA, 20 bp, Artificial
  CRISPR gRNA sequence
tcccctctccctctgccgtc

SEQ ID NO: 349827 - DNA, 20 bp, Artificial
  CRISPR gRNA sequence
ccctctccctctgccgtcct

SEQ ID NO: 349828 - DNA, 20 bp, Artificial
  CRISPR gRNA sequence
tccctctgccgtcctgtctt

SEQ ID NO: 349829 - DNA, 20 bp, Artificial
  CRISPR gRNA sequence
cctctgccgtcctgtcttct

SEQ ID NO: 349830 - DNA, 20 bp, Artificial
  CRISPR gRNA sequence
tgccgtcctgtcttctttgc

SEQ ID NO: 349831 - DNA, 20 bp, Artificial
  CRISPR gRNA sequence
ccgtcctgtcttctttgccc

SEQ ID NO: 349832 - DNA, 20 bp, Artificial
  CRISPR gRNA sequence
tcttctttgcccagcctctc

SEQ ID NO: 349833 - DNA, 20 bp, Artificial
  CRISPR gRNA sequence
ctttgcccagcctctcctta

SEQ ID NO: 349834 - DNA, 20 bp, Artificial
  CRISPR gRNA sequence
tttgcccagcctctccttat

SEQ ID NO: 349835 - DNA, 20 bp, Artificial
  CRISPR gRNA sequence
tgcccagcctctccttattt

SEQ ID NO: 349836 - DNA, 20 bp, Artificial
  CRISPR gRNA sequence
gcccagcctctccttatttc

SEQ ID NO: 349837 - DNA, 20 bp, Artificial
  CRISPR gRNA sequence
cccagcctctccttatttct

SEQ ID NO: 349838 - DNA, 20 bp, Artificial
  CRISPR gRNA sequence
tccttatttctctcctcttc

SEQ ID NO: 349839 - DNA, 20 bp, Artificial
  CRISPR gRNA sequence
cttatttctctcctcttcct

SEQ ID NO: 349840 - DNA, 20 bp, Artificial
  CRISPR gRNA sequence
atttctctcctcttccttcc

SEQ ID NO: 349841 - DNA, 20 bp, Artificial
  CRISPR gRNA sequence
tttctctcctcttccttcct

SEQ ID NO: 349842 - DNA, 20 bp, Artificial
  CRISPR gRNA sequence
ctctcctcttccttccttcc

SEQ ID NO: 349843 - DNA, 20 bp, Artificial
  CRISPR gRNA sequence
tctcctcttccttccttccc

SEQ ID NO: 349844 - DNA, 20 bp, Artificial
  CRISPR gRNA sequence
tcctcttccttccttccccc

SEQ ID NO: 349845 - DNA, 20 bp, Artificial
  CRISPR gRNA sequence
ctcttccttccttcccccca

SEQ ID NO: 349846 - DNA, 20 bp, Artificial
  CRISPR gRNA sequence
ttccttccttccccccacct

SEQ ID NO: 349847 - DNA, 20 bp, Artificial
  CRISPR gRNA sequence
ccttccttccccccacctcc

SEQ ID NO: 349848 - DNA, 20 bp, Artificial
  CRISPR gRNA sequence
cttccttccccccacctccc

SEQ ID NO: 349849 - DNA, 20 bp, Artificial
  CRISPR gRNA sequence
ccttccccccacctccccat

SEQ ID NO: 349850 - DNA, 20 bp, Artificial
  CRISPR gRNA sequence
cttccccccacctccccata

SEQ ID NO: 349851 - DNA, 20 bp, Artificial
  CRISPR gRNA sequence
ccccccacctccccatagcc

SEQ ID NO: 349852 - DNA, 20 bp, Artificial
  CRISPR gRNA sequence
cccccacctccccatagccg

SEQ ID NO: 349853 - DNA, 20 bp, Artificial
  CRISPR gRNA sequence
cccatagccgggcttggaca

SEQ ID NO: 349854 - DNA, 20 bp, Artificial
  CRISPR gRNA sequence
ggacaagtcagacagacctc

SEQ ID NO: 349855 - DNA, 20 bp, Artificial
  CRISPR gRNA sequence
gacaagtcagacagacctct

SEQ ID NO: 349856 - DNA, 20 bp, Artificial
  CRISPR gRNA sequence
tgaggtctcatcccggagct

SEQ ID NO: 349857 - DNA, 20 bp, Artificial
  CRISPR gRNA sequence
aggtctcatcccggagctgc

SEQ ID NO: 349858 - DNA, 20 bp, Artificial
  CRISPR gRNA sequence
atcccggagctgccactaac

SEQ ID NO: 349859 - DNA, 20 bp, Artificial
  CRISPR gRNA sequence
ccactaacccagcctccccc

SEQ ID NO: 349860 - DNA, 20 bp, Artificial
  CRISPR gRNA sequence
acccagcctcccccgggacc

SEQ ID NO: 349861 - DNA, 20 bp, Artificial
  CRISPR gRNA sequence
ccccgggacctgccctcacc

SEQ ID NO: 349862 - DNA, 20 bp, Artificial
  CRISPR gRNA sequence
ccctcacctcccagagccct

SEQ ID NO: 349863 - DNA, 20 bp, Artificial
  CRISPR gRNA sequence
acctcccagagccctgggag

SEQ ID NO: 349864 - DNA, 20 bp, Artificial
  CRISPR gRNA sequence
ccagagccctgggagccagg

SEQ ID NO: 349865 - DNA, 20 bp, Artificial
  CRISPR gRNA sequence
ggagccagggacactccctg

SEQ ID NO: 349866 - DNA, 20 bp, Artificial
  CRISPR gRNA sequence
cctggggctgagtgagtacc

SEQ ID NO: 349867 - DNA, 20 bp, Artificial
  CRISPR gRNA sequence
gggctgagtgagtaccgggg

SEQ ID NO: 349868 - DNA, 20 bp, Artificial
  CRISPR gRNA sequence
agtgagtaccgggggctgca

SEQ ID NO: 349869 - DNA, 20 bp, Artificial
  CRISPR gRNA sequence
cacctgccactcccatgtcc

SEQ ID NO: 349870 - DNA, 20 bp, Artificial
  CRISPR gRNA sequence
ccactcccatgtcctcggcc

SEQ ID NO: 349871 - DNA, 20 bp, Artificial
  CRISPR gRNA sequence
ccatgtcctcggccccactc

SEQ ID NO: 349872 - DNA, 20 bp, Artificial
  CRISPR gRNA sequence
ggccccactcccgcggatgc

SEQ ID NO: 349873 - DNA, 20 bp, Artificial
  CRISPR gRNA sequence
ccgcggatgcagcaggtggc

SEQ ID NO: 349874 - DNA, 20 bp, Artificial
  CRISPR gRNA sequence
gtgaccgaggccagacctgg

SEQ ID NO: 349875 - DNA, 20 bp, Artificial
  CRISPR gRNA sequence
ggagcagcagctcccgctgg

SEQ ID NO: 349876 - DNA, 20 bp, Artificial
  CRISPR gRNA sequence
ccgctgggtgtgatttctct

SEQ ID NO: 349877 - DNA, 20 bp, Artificial
  CRISPR gRNA sequence
ggtgtgatttctctcaggga

SEQ ID NO: 349878 - DNA, 20 bp, Artificial
  CRISPR gRNA sequence
ctctcagggagcctcatcgt

SEQ ID NO: 349879 - DNA, 20 bp, Artificial
  CRISPR gRNA sequence
tctcagggagcctcatcgtc

SEQ ID NO: 349880 - DNA, 20 bp, Artificial
  CRISPR gRNA sequence
tcagggagcctcatcgtcaa

SEQ ID NO: 349881 - DNA, 20 bp, Artificial
  CRISPR gRNA sequence
agggagcctcatcgtcaaca

SEQ ID NO: 349882 - DNA, 20 bp, Artificial
  CRISPR gRNA sequence
atcgtcaacatcattgattt

SEQ ID NO: 349883 - DNA, 20 bp, Artificial
  CRISPR gRNA sequence
atttctccacacttggccta

SEQ ID NO: 349884 - DNA, 20 bp, Artificial
  CRISPR gRNA sequence
ctccacacttggcctaatct

SEQ ID NO: 349885 - DNA, 20 bp, Artificial
  CRISPR gRNA sequence
tccacacttggcctaatctc

SEQ ID NO: 349886 - DNA, 20 bp, Artificial
  CRISPR gRNA sequence
cacacttggcctaatctcat

SEQ ID NO: 349887 - DNA, 20 bp, Artificial
  CRISPR gRNA sequence
ggcctaatctcatgcatgaa

SEQ ID NO: 349888 - DNA, 20 bp, Artificial
  CRISPR gRNA sequence
gcctaatctcatgcatgaaa

SEQ ID NO: 349889 - DNA, 20 bp, Artificial
  CRISPR gRNA sequence
atctcatgcatgaaaagaag

SEQ ID NO: 349890 - DNA, 20 bp, Artificial
  CRISPR gRNA sequence
atgcatgaaaagaagaaaat

SEQ ID NO: 349891 - DNA, 20 bp, Artificial
  CRISPR gRNA sequence
gtgtccccagccgtcgtctc

SEQ ID NO: 349892 - DNA, 20 bp, Artificial
  CRISPR gRNA sequence
ttggagctctgtccccccaa

SEQ ID NO: 349893 - DNA, 20 bp, Artificial
  CRISPR gRNA sequence
ggagctctgtccccccaaac

SEQ ID NO: 349894 - DNA, 20 bp, Artificial
  CRISPR gRNA sequence
gagctctgtccccccaaacc

SEQ ID NO: 349895 - DNA, 20 bp, Artificial
  CRISPR gRNA sequence
tgtccccccaaacctgggag

SEQ ID NO: 349896 - DNA, 20 bp, Artificial
  CRISPR gRNA sequence
tccccccaaacctgggaggt

SEQ ID NO: 349897 - DNA, 20 bp, Artificial
  CRISPR gRNA sequence
ggaggtggccccagagcttt

SEQ ID NO: 349898 - DNA, 20 bp, Artificial
  CRISPR gRNA sequence
ttccaggatccatggctcct

SEQ ID NO: 349899 - DNA, 20 bp, Artificial
  CRISPR gRNA sequence
tccaggatccatggctcctc

SEQ ID NO: 349900 - DNA, 20 bp, Artificial
  CRISPR gRNA sequence
ccaggatccatggctcctcc

SEQ ID NO: 349901 - DNA, 20 bp, Artificial
  CRISPR gRNA sequence
caggatccatggctcctccc

SEQ ID NO: 349902 - DNA, 20 bp, Artificial
  CRISPR gRNA sequence
ctcccaggaggaggagctac

SEQ ID NO: 349903 - DNA, 20 bp, Artificial
  CRISPR gRNA sequence
ccaggaggaggagctacagg

SEQ ID NO: 349904 - DNA, 20 bp, Artificial
  CRISPR gRNA sequence
caggttggggcaggtgggct

SEQ ID NO: 349905 - DNA, 20 bp, Artificial
  CRISPR gRNA sequence
gggcaggtgggcttcctgct

SEQ ID NO: 349906 - DNA, 20 bp, Artificial
  CRISPR gRNA sequence
cctgctgtgcctggagccca

SEQ ID NO: 349907 - DNA, 20 bp, Artificial
  CRISPR gRNA sequence
ctgctgtgcctggagcccag

SEQ ID NO: 349908 - DNA, 20 bp, Artificial
  CRISPR gRNA sequence
ctgtgcctggagcccagatg

SEQ ID NO: 349909 - DNA, 20 bp, Artificial
  CRISPR gRNA sequence
tgcctggagcccagatgtca

SEQ ID NO: 349910 - DNA, 20 bp, Artificial
  CRISPR gRNA sequence
gagcccagatgtcaggtggc

SEQ ID NO: 349911 - DNA, 20 bp, Artificial
  CRISPR gRNA sequence
cctgggggaagggaagttgg

SEQ ID NO: 349912 - DNA, 20 bp, Artificial
  CRISPR gRNA sequence
ggggaagggaagttggggcc

SEQ ID NO: 349913 - DNA, 20 bp, Artificial
  CRISPR gRNA sequence
gggcccctgaccagggagcc

SEQ ID NO: 349914 - DNA, 20 bp, Artificial
  CRISPR gRNA sequence
accagggagccctctgccac

SEQ ID NO: 349915 - DNA, 20 bp, Artificial
  CRISPR gRNA sequence
tgccacccctgcccgctcac

SEQ ID NO: 349916 - DNA, 20 bp, Artificial
  CRISPR gRNA sequence
ccacccctgcccgctcactc

SEQ ID NO: 349917 - DNA, 20 bp, Artificial
  CRISPR gRNA sequence
cccgctcactccatggcccc

SEQ ID NO: 349918 - DNA, 20 bp, Artificial
  CRISPR gRNA sequence
actccatggccccatgctcc

SEQ ID NO: 349919 - DNA, 20 bp, Artificial
  CRISPR gRNA sequence
catggccccatgctcccacc

SEQ ID NO: 349920 - DNA, 20 bp, Artificial
  CRISPR gRNA sequence
ccacctgcccccgggactgt

SEQ ID NO: 349921 - DNA, 20 bp, Artificial
  CRISPR gRNA sequence
cccccgggactgtgggcaga

SEQ ID NO: 349922 - DNA, 20 bp, Artificial
  CRISPR gRNA sequence
tgggcagaagggcaggctgt

SEQ ID NO: 349923 - DNA, 20 bp, Artificial
  CRISPR gRNA sequence
tgcttggctcccatctagca

SEQ ID NO: 349924 - DNA, 20 bp, Artificial
  CRISPR gRNA sequence
ggctcccatctagcactggg

SEQ ID NO: 349925 - DNA, 20 bp, Artificial
  CRISPR gRNA sequence
gctcccatctagcactgggg

SEQ ID NO: 349926 - DNA, 20 bp, Artificial
  CRISPR gRNA sequence
ccatctagcactggggggca

SEQ ID NO: 349927 - DNA, 20 bp, Artificial
  CRISPR gRNA sequence
gcactggggggcagccaggt

SEQ ID NO: 349928 - DNA, 20 bp, Artificial
  CRISPR gRNA sequence
gggggcagccaggtctatgg

SEQ ID NO: 349929 - DNA, 20 bp, Artificial
  CRISPR gRNA sequence
tggggtcagcctctgaaaag

SEQ ID NO: 349930 - DNA, 20 bp, Artificial
  CRISPR gRNA sequence
tgaaaaggtaccctggcaat

SEQ ID NO: 349931 - DNA, 20 bp, Artificial
  CRISPR gRNA sequence
aaaaggtaccctggcaatga

SEQ ID NO: 349932 - DNA, 20 bp, Artificial
  CRISPR gRNA sequence
gcaatgaccctggacggtgg

SEQ ID NO: 349933 - DNA, 20 bp, Artificial
  CRISPR gRNA sequence
gacggtggtcaggagccggt

SEQ ID NO: 349934 - DNA, 20 bp, Artificial
  CRISPR gRNA sequence
gagaccacgcctccagttgg

SEQ ID NO: 349935 - DNA, 20 bp, Artificial
  CRISPR gRNA sequence
cagttggggagagggtgaca

SEQ ID NO: 349936 - DNA, 20 bp, Artificial
  CRISPR gRNA sequence
gggagagggtgacacggggt

SEQ ID NO: 349937 - DNA, 20 bp, Artificial
  CRISPR gRNA sequence
ctttctaggggcccagggct

SEQ ID NO: 349938 - DNA, 20 bp, Artificial
  CRISPR gRNA sequence
tctaggggcccagggctcca

SEQ ID NO: 349939 - DNA, 20 bp, Artificial
  CRISPR gRNA sequence
ctaggggcccagggctccac

SEQ ID NO: 349940 - DNA, 20 bp, Artificial
  CRISPR gRNA sequence
taggggcccagggctccacc

SEQ ID NO: 349941 - DNA, 20 bp, Artificial
  CRISPR gRNA sequence
ggggcccagggctccacctg

SEQ ID NO: 349942 - DNA, 20 bp, Artificial
  CRISPR gRNA sequence
cacctggcctgcatgggcct

SEQ ID NO: 349943 - DNA, 20 bp, Artificial
  CRISPR gRNA sequence
gcctgcatgggcctctccac

SEQ ID NO: 349944 - DNA, 20 bp, Artificial
  CRISPR gRNA sequence
catgggcctctccacacccc

SEQ ID NO: 349945 - DNA, 20 bp, Artificial
  CRISPR gRNA sequence
tccacaccccaggacgctaa

SEQ ID NO: 349946 - DNA, 20 bp, Artificial
  CRISPR gRNA sequence
cacaccccaggacgctaagc

SEQ ID NO: 349947 - DNA, 20 bp, Artificial
  CRISPR gRNA sequence
agccaaagcttccacaggac

SEQ ID NO: 349948 - DNA, 20 bp, Artificial
  CRISPR gRNA sequence
ccacaggacaaggggtggca

SEQ ID NO: 349949 - DNA, 20 bp, Artificial
  CRISPR gRNA sequence
cacaggacaaggggtggcag

SEQ ID NO: 349950 - DNA, 20 bp, Artificial
  CRISPR gRNA sequence
gggtgggtggctcagcctgg

SEQ ID NO: 349951 - DNA, 20 bp, Artificial
  CRISPR gRNA sequence
agcctgggggctctgctgga

SEQ ID NO: 349952 - DNA, 20 bp, Artificial
  CRISPR gRNA sequence
ggggctctgctggaggcagg

SEQ ID NO: 349953 - DNA, 20 bp, Artificial
  CRISPR gRNA sequence
tgctggaggcaggtgacaag

SEQ ID NO: 349954 - DNA, 20 bp, Artificial
  CRISPR gRNA sequence
ctggaggcaggtgacaagga

SEQ ID NO: 349955 - DNA, 20 bp, Artificial
  CRISPR gRNA sequence
gaggcaggtgacaaggaaag

SEQ ID NO: 349956 - DNA, 20 bp, Artificial
  CRISPR gRNA sequence
ggaggggctatgtggcctcc

SEQ ID NO: 349957 - DNA, 20 bp, Artificial
  CRISPR gRNA sequence
tgtggcctccatcctcatgg

SEQ ID NO: 349958 - DNA, 20 bp, Artificial
  CRISPR gRNA sequence
catcctcatggcatggctgc

SEQ ID NO: 349959 - DNA, 20 bp, Artificial
  CRISPR gRNA sequence
atggcatggctgcagggtca

SEQ ID NO: 349960 - DNA, 20 bp, Artificial
  CRISPR gRNA sequence
cagggtcattcccctcaccg

SEQ ID NO: 349961 - DNA, 20 bp, Artificial
  CRISPR gRNA sequence
ccctcaccgcttctaacttc

SEQ ID NO: 349962 - DNA, 20 bp, Artificial
  CRISPR gRNA sequence
accgcttctaacttcagatg

SEQ ID NO: 349963 - DNA, 20 bp, Artificial
  CRISPR gRNA sequence
ctaacttcagatgtggggaa

SEQ ID NO: 349964 - DNA, 20 bp, Artificial
  CRISPR gRNA sequence
taacttcagatgtggggaaa

SEQ ID NO: 349965 - DNA, 20 bp, Artificial
  CRISPR gRNA sequence
acttcagatgtggggaaagg

SEQ ID NO: 349966 - DNA, 20 bp, Artificial
  CRISPR gRNA sequence
cagatgtggggaaaggggcc

SEQ ID NO: 349967 - DNA, 20 bp, Artificial
  CRISPR gRNA sequence
agatgtggggaaaggggcct

SEQ ID NO: 349968 - DNA, 20 bp, Artificial
  CRISPR gRNA sequence
atcccgaccattaaatgaat

SEQ ID NO: 349969 - DNA, 20 bp, Artificial
  CRISPR gRNA sequence
aatgaatgtgtggctcagag

SEQ ID NO: 349970 - DNA, 20 bp, Artificial
  CRISPR gRNA sequence
agaggcctggtgaagcccct

SEQ ID NO: 349971 - DNA, 20 bp, Artificial
  CRISPR gRNA sequence
gtgaagcccctgccagcggg

SEQ ID NO: 349972 - DNA, 20 bp, Artificial
  CRISPR gRNA sequence
ccagcgggacctgggcctgg

SEQ ID NO: 349973 - DNA, 20 bp, Artificial
  CRISPR gRNA sequence
ggcctggcgggttcccggag

SEQ ID NO: 349974 - DNA, 20 bp, Artificial
  CRISPR gRNA sequence
gcgggttcccggagcaggtg

SEQ ID NO: 349975 - DNA, 20 bp, Artificial
  CRISPR gRNA sequence
ccggagcaggtggagagggc

SEQ ID NO: 349976 - DNA, 20 bp, Artificial
  CRISPR gRNA sequence
ggcacagcaggcgtcactga

SEQ ID NO: 349977 - DNA, 20 bp, Artificial
  CRISPR gRNA sequence
atactggggtttctcggtgg

SEQ ID NO: 349978 - DNA, 20 bp, Artificial
  CRISPR gRNA sequence
gggtttctcggtggacacag

SEQ ID NO: 349979 - DNA, 20 bp, Artificial
  CRISPR gRNA sequence
ctcggtggacacagctggga

SEQ ID NO: 349980 - DNA, 20 bp, Artificial
  CRISPR gRNA sequence
tcggtggacacagctgggaa

SEQ ID NO: 349981 - DNA, 20 bp, Artificial
  CRISPR gRNA sequence
ggtggacacagctgggaagt

SEQ ID NO: 349982 - DNA, 20 bp, Artificial
  CRISPR gRNA sequence
ggaagtgtaggtcagatgta

SEQ ID NO: 349983 - DNA, 20 bp, Artificial
  CRISPR gRNA sequence
gggtttttactgggcaaatc

SEQ ID NO: 349984 - DNA, 20 bp, Artificial
  CRISPR gRNA sequence
ttactgggcaaatctgacac

SEQ ID NO: 349985 - DNA, 20 bp, Artificial
  CRISPR gRNA sequence
tactgggcaaatctgacacc

SEQ ID NO: 349986 - DNA, 20 bp, Artificial
  CRISPR gRNA sequence
actgggcaaatctgacacca

SEQ ID NO: 349987 - DNA, 20 bp, Artificial
  CRISPR gRNA sequence
ctgggcaaatctgacaccat

SEQ ID NO: 349988 - DNA, 20 bp, Artificial
  CRISPR gRNA sequence
ggcaaatctgacaccatttg

SEQ ID NO: 349989 - DNA, 20 bp, Artificial
  CRISPR gRNA sequence
acaccatttgagcatcagaa

SEQ ID NO: 349990 - DNA, 20 bp, Artificial
  CRISPR gRNA sequence
gagcatcagaatccacagca

SEQ ID NO: 349991 - DNA, 20 bp, Artificial
  CRISPR gRNA sequence
agcatcagaatccacagcaa

SEQ ID NO: 349992 - DNA, 20 bp, Artificial
  CRISPR gRNA sequence
ggacggagccacagaggtca

SEQ ID NO: 349993 - DNA, 20 bp, Artificial
  CRISPR gRNA sequence
agagctcagctgttgggata

SEQ ID NO: 349994 - DNA, 20 bp, Artificial
  CRISPR gRNA sequence
agctgttgggatatgaaggg

SEQ ID NO: 349995 - DNA, 20 bp, Artificial
  CRISPR gRNA sequence
ttgggatatgaaggggcggc

SEQ ID NO: 349996 - DNA, 20 bp, Artificial
  CRISPR gRNA sequence
ggatatgaaggggcggccag

SEQ ID NO: 349997 - DNA, 20 bp, Artificial
  CRISPR gRNA sequence
ctctctgggtggagtgaacc

SEQ ID NO: 349998 - DNA, 20 bp, Artificial
  CRISPR gRNA sequence
tctgggtggagtgaaccccc

SEQ ID NO: 349999 - DNA, 20 bp, Artificial
  CRISPR gRNA sequence
tgggtggagtgaacccccag

SEQ ID NO: 350000 - DNA, 20 bp, Artificial
  CRISPR gRNA sequence
ggtggagtgaacccccaggc

SEQ ID NO: 350001 - DNA, 20 bp, Artificial
  CRISPR gRNA sequence
gaactccttgttcagcaaga

SEQ ID NO: 350002 - DNA, 20 bp, Artificial
  CRISPR gRNA sequence
cttgttcagcaagaaacacc

SEQ ID NO: 350003 - DNA, 20 bp, Artificial
  CRISPR gRNA sequence
gttcagcaagaaacaccggg

SEQ ID NO: 350004 - DNA, 20 bp, Artificial
  CRISPR gRNA sequence
ttcagcaagaaacaccggga

SEQ ID NO: 350005 - DNA, 20 bp, Artificial
  CRISPR gRNA sequence
agcaagaaacaccgggaggt

SEQ ID NO: 350006 - DNA, 20 bp, Artificial
  CRISPR gRNA sequence
gaggagaaacaagatattta

SEQ ID NO: 350007 - DNA, 20 bp, Artificial
  CRISPR gRNA sequence
aggagaaacaagatatttac

SEQ ID NO: 350008 - DNA, 20 bp, Artificial
  CRISPR gRNA sequence
acatcctcccacagcatctc

SEQ ID NO: 350009 - DNA, 20 bp, Artificial
  CRISPR gRNA sequence
catcctcccacagcatctcc

SEQ ID NO: 350010 - DNA, 20 bp, Artificial
  CRISPR gRNA sequence
ccacagcatctccccaaata

SEQ ID NO: 350011 - DNA, 20 bp, Artificial
  CRISPR gRNA sequence
cccaaatacactgtttcatg

SEQ ID NO: 350012 - DNA, 20 bp, Artificial
  CRISPR gRNA sequence
tttcatgacaaatagaaaac

SEQ ID NO: 350013 - DNA, 20 bp, Artificial
  CRISPR gRNA sequence
catgacaaatagaaaacagg

SEQ ID NO: 350014 - DNA, 20 bp, Artificial
  CRISPR gRNA sequence
atgacaaatagaaaacagga

SEQ ID NO: 350015 - DNA, 20 bp, Artificial
  CRISPR gRNA sequence
aaatccaatttagaaaatca

SEQ ID NO: 350016 - DNA, 20 bp, Artificial
  CRISPR gRNA sequence
agaaaatcacttccgatgtg

SEQ ID NO: 350017 - DNA, 20 bp, Artificial
  CRISPR gRNA sequence
gaaaatcacttccgatgtgg

SEQ ID NO: 350018 - DNA, 20 bp, Artificial
  CRISPR gRNA sequence
ccgatgtggtatccactaaa

SEQ ID NO: 350019 - DNA, 20 bp, Artificial
  CRISPR gRNA sequence
cgatgtggtatccactaaac

SEQ ID NO: 350020 - DNA, 20 bp, Artificial
  CRISPR gRNA sequence
aacaccacactgcagccaac

SEQ ID NO: 350021 - DNA, 20 bp, Artificial
  CRISPR gRNA sequence
cagccaacccagtccagcct

SEQ ID NO: 350022 - DNA, 20 bp, Artificial
  CRISPR gRNA sequence
ggctgtgaggcagtgcccgg

SEQ ID NO: 350023 - DNA, 20 bp, Artificial
  CRISPR gRNA sequence
gctgtgaggcagtgcccggg

SEQ ID NO: 350024 - DNA, 20 bp, Artificial
  CRISPR gRNA sequence
tgaggcagtgcccggggcct

SEQ ID NO: 350025 - DNA, 20 bp, Artificial
  CRISPR gRNA sequence
tcctgctgaggccacaagag

SEQ ID NO: 350026 - DNA, 20 bp, Artificial
  CRISPR gRNA sequence
ctgaggccacaagagtcaga

SEQ ID NO: 350027 - DNA, 20 bp, Artificial
  CRISPR gRNA sequence
aggccacaagagtcagacgc

SEQ ID NO: 350028 - DNA, 20 bp, Artificial
  CRISPR gRNA sequence
gggtctgaagggccctctgg

SEQ ID NO: 350029 - DNA, 20 bp, Artificial
  CRISPR gRNA sequence
aagggccctctgggctggcc

SEQ ID NO: 350030 - DNA, 20 bp, Artificial
  CRISPR gRNA sequence
tgggctggcccaggagggct

SEQ ID NO: 350031 - DNA, 20 bp, Artificial
  CRISPR gRNA sequence
ggctggcccaggagggctgg

SEQ ID NO: 350032 - DNA, 20 bp, Artificial
  CRISPR gRNA sequence
gcccaggagggctgggtgtg

SEQ ID NO: 350033 - DNA, 20 bp, Artificial
  CRISPR gRNA sequence
ggtgtgtggtctgtgagcga

SEQ ID NO: 350034 - DNA, 20 bp, Artificial
  CRISPR gRNA sequence
tgagcgaggggcaactggcg

SEQ ID NO: 350035 - DNA, 20 bp, Artificial
  CRISPR gRNA sequence
gcgctcctcctcaggactct

SEQ ID NO: 350036 - DNA, 20 bp, Artificial
  CRISPR gRNA sequence
ctcctcaggactctggggag

SEQ ID NO: 350037 - DNA, 20 bp, Artificial
  CRISPR gRNA sequence
ctcaggactctggggagctc

SEQ ID NO: 350038 - DNA, 20 bp, Artificial
  CRISPR gRNA sequence
aggactctggggagctcagg

SEQ ID NO: 350039 - DNA, 20 bp, Artificial
  CRISPR gRNA sequence
tggggagctcaggccacagc

SEQ ID NO: 350040 - DNA, 20 bp, Artificial
  CRISPR gRNA sequence
gggagctcaggccacagcag

SEQ ID NO: 350041 - DNA, 20 bp, Artificial
  CRISPR gRNA sequence
aggccacagcagaacagagg

SEQ ID NO: 350042 - DNA, 20 bp, Artificial
  CRISPR gRNA sequence
actggcccatgggaatggca

SEQ ID NO: 350043 - DNA, 20 bp, Artificial
  CRISPR gRNA sequence
gcccatgggaatggcacgtg

SEQ ID NO: 350044 - DNA, 20 bp, Artificial
  CRISPR gRNA sequence
taccccagcaggggccccac

SEQ ID NO: 350045 - DNA, 20 bp, Artificial
  CRISPR gRNA sequence
ccccagcaggggccccacct

SEQ ID NO: 350046 - DNA, 20 bp, Artificial
  CRISPR gRNA sequence
tccctccactggaggagacg

SEQ ID NO: 350047 - DNA, 20 bp, Artificial
  CRISPR gRNA sequence
cctccactggaggagacgga

SEQ ID NO: 350048 - DNA, 20 bp, Artificial
  CRISPR gRNA sequence
cactggaggagacggaagcc

SEQ ID NO: 350049 - DNA, 20 bp, Artificial
  CRISPR gRNA sequence
gaggagacggaagccagccc

SEQ ID NO: 350050 - DNA, 20 bp, Artificial
  CRISPR gRNA sequence
cgggctccggtggttccgcc

SEQ ID NO: 350051 - DNA, 20 bp, Artificial
  CRISPR gRNA sequence
cggtggttccgccaggtgga

SEQ ID NO: 350052 - DNA, 20 bp, Artificial
  CRISPR gRNA sequence
cgccaggtggacagcctctt

SEQ ID NO: 350053 - DNA, 20 bp, Artificial
  CRISPR gRNA sequence
tttcagcagccgtcgctcca

SEQ ID NO: 350054 - DNA, 20 bp, Artificial
  CRISPR gRNA sequence
tcagcagccgtcgctccagg

SEQ ID NO: 350055 - DNA, 20 bp, Artificial
  CRISPR gRNA sequence
cagcagccgtcgctccaggt

SEQ ID NO: 350056 - DNA, 20 bp, Artificial
  CRISPR gRNA sequence
agcagccgtcgctccaggta

SEQ ID NO: 350057 - DNA, 20 bp, Artificial
  CRISPR gRNA sequence
caggtatctctggcgtcggg

SEQ ID NO: 350058 - DNA, 20 bp, Artificial
  CRISPR gRNA sequence
tggcgtcggggtgcagagtc

SEQ ID NO: 350059 - DNA, 20 bp, Artificial
  CRISPR gRNA sequence
gcgtcggggtgcagagtctg

SEQ ID NO: 350060 - DNA, 20 bp, Artificial
  CRISPR gRNA sequence
tgggtcagtggtttgggctc

SEQ ID NO: 350061 - DNA, 20 bp, Artificial
  CRISPR gRNA sequence
gggctcctccccgtgaatga

SEQ ID NO: 350062 - DNA, 20 bp, Artificial
  CRISPR gRNA sequence
ggctcctccccgtgaatgag

SEQ ID NO: 350063 - DNA, 20 bp, Artificial
  CRISPR gRNA sequence
ctccccgtgaatgagggtat

SEQ ID NO: 350064 - DNA, 20 bp, Artificial
  CRISPR gRNA sequence
cccgtgaatgagggtattgt

SEQ ID NO: 350065 - DNA, 20 bp, Artificial
  CRISPR gRNA sequence
tctcctccacggccaccgtg

SEQ ID NO: 350066 - DNA, 20 bp, Artificial
  CRISPR gRNA sequence
ctccacggccaccgtggtga

SEQ ID NO: 350067 - DNA, 20 bp, Artificial
  CRISPR gRNA sequence
cacggccaccgtggtgacgt

SEQ ID NO: 350068 - DNA, 20 bp, Artificial
  CRISPR gRNA sequence
cagggcctcaatgactgtgg

SEQ ID NO: 350069 - DNA, 20 bp, Artificial
  CRISPR gRNA sequence
aatgactgtggcctcacctt

SEQ ID NO: 350070 - DNA, 20 bp, Artificial
  CRISPR gRNA sequence
tggcctcaccttctgcctcc

SEQ ID NO: 350071 - DNA, 20 bp, Artificial
  CRISPR gRNA sequence
accttctgcctcctgtcttt

SEQ ID NO: 350072 - DNA, 20 bp, Artificial
  CRISPR gRNA sequence
ctgcctcctgtcttttccgc

SEQ ID NO: 350073 - DNA, 20 bp, Artificial
  CRISPR gRNA sequence
tgcctcctgtcttttccgct

SEQ ID NO: 350074 - DNA, 20 bp, Artificial
  CRISPR gRNA sequence
cctcctgtcttttccgctgt

SEQ ID NO: 350075 - DNA, 20 bp, Artificial
  CRISPR gRNA sequence
ctgtcttttccgctgtgagc

SEQ ID NO: 350076 - DNA, 20 bp, Artificial
  CRISPR gRNA sequence
tcttttccgctgtgagcaca

SEQ ID NO: 350077 - DNA, 20 bp, Artificial
  CRISPR gRNA sequence
ttccgctgtgagcacacgaa

SEQ ID NO: 350078 - DNA, 20 bp, Artificial
  CRISPR gRNA sequence
tccgctgtgagcacacgaat

SEQ ID NO: 350079 - DNA, 20 bp, Artificial
  CRISPR gRNA sequence
ccgctgtgagcacacgaatc

SEQ ID NO: 350080 - DNA, 20 bp, Artificial
  CRISPR gRNA sequence
cgctgtgagcacacgaatcg

SEQ ID NO: 350081 - DNA, 20 bp, Artificial
  CRISPR gRNA sequence
tgagcacacgaatcgtggag

SEQ ID NO: 350082 - DNA, 20 bp, Artificial
  CRISPR gRNA sequence
cctgctcaggcccccctggg

SEQ ID NO: 350083 - DNA, 20 bp, Artificial
  CRISPR gRNA sequence
ctcaggcccccctgggactc

SEQ ID NO: 350084 - DNA, 20 bp, Artificial
  CRISPR gRNA sequence
aggcccccctgggactccag

SEQ ID NO: 350085 - DNA, 20 bp, Artificial
  CRISPR gRNA sequence
ggactccaggttctcgggtt

SEQ ID NO: 350086 - DNA, 20 bp, Artificial
  CRISPR gRNA sequence
caggttctcgggttcatttt

SEQ ID NO: 350087 - DNA, 20 bp, Artificial
  CRISPR gRNA sequence
tcgggttcattttactgctt

SEQ ID NO: 350088 - DNA, 20 bp, Artificial
  CRISPR gRNA sequence
gggttcattttactgctttc

SEQ ID NO: 350089 - DNA, 20 bp, Artificial
  CRISPR gRNA sequence
attttactgctttcagtttg

SEQ ID NO: 350090 - DNA, 20 bp, Artificial
  CRISPR gRNA sequence
tactgctttcagtttgaggg

SEQ ID NO: 350091 - DNA, 20 bp, Artificial
  CRISPR gRNA sequence
actgctttcagtttgagggg

SEQ ID NO: 350092 - DNA, 20 bp, Artificial
  CRISPR gRNA sequence
ctgctttcagtttgaggggg

SEQ ID NO: 350093 - DNA, 20 bp, Artificial
  CRISPR gRNA sequence
ctttcagtttgagggggtgg

SEQ ID NO: 350094 - DNA, 20 bp, Artificial
  CRISPR gRNA sequence
tcagtttgagggggtgggtt

SEQ ID NO: 350095 - DNA, 20 bp, Artificial
  CRISPR gRNA sequence
cagtttgagggggtgggttc

SEQ ID NO: 350096 - DNA, 20 bp, Artificial
  CRISPR gRNA sequence
agtttgagggggtgggttct

SEQ ID NO: 350097 - DNA, 20 bp, Artificial
  CRISPR gRNA sequence
gagggggtgggttctttcct

SEQ ID NO: 350098 - DNA, 20 bp, Artificial
  CRISPR gRNA sequence
agggggtgggttctttcctg

SEQ ID NO: 350099 - DNA, 20 bp, Artificial
  CRISPR gRNA sequence
tttcctgagctaccgtggct

SEQ ID NO: 350100 - DNA, 20 bp, Artificial
  CRISPR gRNA sequence
tcctgagctaccgtggctgt

SEQ ID NO: 350101 - DNA, 20 bp, Artificial
  CRISPR gRNA sequence
cctgagctaccgtggctgta

SEQ ID NO: 350102 - DNA, 20 bp, Artificial
  CRISPR gRNA sequence
ctgagctaccgtggctgtac

SEQ ID NO: 350103 - DNA, 20 bp, Artificial
  CRISPR gRNA sequence
agctaccgtggctgtacttg

SEQ ID NO: 350104 - DNA, 20 bp, Artificial
  CRISPR gRNA sequence
ccgtggctgtacttgaaaga

SEQ ID NO: 350105 - DNA, 20 bp, Artificial
  CRISPR gRNA sequence
tacttgaaagactcaggacc

SEQ ID NO: 350106 - DNA, 20 bp, Artificial
  CRISPR gRNA sequence
gaaagactcaggaccctcag

SEQ ID NO: 350107 - DNA, 20 bp, Artificial
  CRISPR gRNA sequence
aaagactcaggaccctcaga

SEQ ID NO: 350108 - DNA, 20 bp, Artificial
  CRISPR gRNA sequence
aggaccctcagagaactggg

SEQ ID NO: 350109 - DNA, 20 bp, Artificial
  CRISPR gRNA sequence
agagaactgggagcccccac

SEQ ID NO: 350110 - DNA, 20 bp, Artificial
  CRISPR gRNA sequence
ggagcccccaccatgtacac

SEQ ID NO: 350111 - DNA, 20 bp, Artificial
  CRISPR gRNA sequence
gacggagacgatcaccttga

SEQ ID NO: 350112 - DNA, 20 bp, Artificial
  CRISPR gRNA sequence
gactacatcacctgcaatac

SEQ ID NO: 350113 - DNA, 20 bp, Artificial
  CRISPR gRNA sequence
actacatcacctgcaataca

SEQ ID NO: 350114 - DNA, 20 bp, Artificial
  CRISPR gRNA sequence
catcacctgcaatacacaga

SEQ ID NO: 350115 - DNA, 20 bp, Artificial
  CRISPR gRNA sequence
caatacacagacacacaggt

SEQ ID NO: 350116 - DNA, 20 bp, Artificial
  CRISPR gRNA sequence
atcaggggacacaggctcat

SEQ ID NO: 350117 - DNA, 20 bp, Artificial
  CRISPR gRNA sequence
atggcaatggtctcacagcg

SEQ ID NO: 350118 - DNA, 20 bp, Artificial
  CRISPR gRNA sequence
acagcggtggcggaggcaca

SEQ ID NO: 350119 - DNA, 20 bp, Artificial
  CRISPR gRNA sequence
ctgcttctccctgggagacc

SEQ ID NO: 350120 - DNA, 20 bp, Artificial
  CRISPR gRNA sequence
cttctccctgggagaccgtc

SEQ ID NO: 350121 - DNA, 20 bp, Artificial
  CRISPR gRNA sequence
ctccctgggagaccgtcccc

SEQ ID NO: 350122 - DNA, 20 bp, Artificial
  CRISPR gRNA sequence
tccctgggagaccgtcccca

SEQ ID NO: 350123 - DNA, 20 bp, Artificial
  CRISPR gRNA sequence
cctgggagaccgtccccaag

SEQ ID NO: 350124 - DNA, 20 bp, Artificial
  CRISPR gRNA sequence
ggagaccgtccccaagggac

SEQ ID NO: 350125 - DNA, 20 bp, Artificial
  CRISPR gRNA sequence
accctctctgagagcagagg

SEQ ID NO: 350126 - DNA, 20 bp, Artificial
  CRISPR gRNA sequence
tctgagagcagaggaggcca

SEQ ID NO: 350127 - DNA, 20 bp, Artificial
  CRISPR gRNA sequence
tgagagcagaggaggccaac

SEQ ID NO: 350128 - DNA, 20 bp, Artificial
  CRISPR gRNA sequence
agagcagaggaggccaactg

SEQ ID NO: 350129 - DNA, 20 bp, Artificial
  CRISPR gRNA sequence
tgttgggactgctagcccag

SEQ ID NO: 350130 - DNA, 20 bp, Artificial
  CRISPR gRNA sequence
ggactgctagcccagcctgt

SEQ ID NO: 350131 - DNA, 20 bp, Artificial
  CRISPR gRNA sequence
ctagcccagcctgtccccag

SEQ ID NO: 350132 - DNA, 20 bp, Artificial
  CRISPR gRNA sequence
gcccagcctgtccccaggag

SEQ ID NO: 350133 - DNA, 20 bp, Artificial
  CRISPR gRNA sequence
tccccaggaggcccagcatg

SEQ ID NO: 350134 - DNA, 20 bp, Artificial
  CRISPR gRNA sequence
ggggcgcccggcccacctcc

SEQ ID NO: 350135 - DNA, 20 bp, Artificial
  CRISPR gRNA sequence
cccagctgaggcccccaagt

SEQ ID NO: 350136 - DNA, 20 bp, Artificial
  CRISPR gRNA sequence
aggcccccaagtgcataact

SEQ ID NO: 350137 - DNA, 20 bp, Artificial
  CRISPR gRNA sequence
accctaattcaaccgtcatc

SEQ ID NO: 350138 - DNA, 20 bp, Artificial
  CRISPR gRNA sequence
attcaaccgtcatctatggg

SEQ ID NO: 350139 - DNA, 20 bp, Artificial
  CRISPR gRNA sequence
aaccgtcatctatgggaggg

SEQ ID NO: 350140 - DNA, 20 bp, Artificial
  CRISPR gRNA sequence
tgggaggggaacaagcgctt

SEQ ID NO: 350141 - DNA, 20 bp, Artificial
  CRISPR gRNA sequence
cacagtggagaggccctgcc

SEQ ID NO: 350142 - DNA, 20 bp, Artificial
  CRISPR gRNA sequence
acagtggagaggccctgccc

SEQ ID NO: 350143 - DNA, 20 bp, Artificial
  CRISPR gRNA sequence
cccaccataccagcaggtgc

SEQ ID NO: 350144 - DNA, 20 bp, Artificial
  CRISPR gRNA sequence
ggtgagactaagctgctgcc

SEQ ID NO: 350145 - DNA, 20 bp, Artificial
  CRISPR gRNA sequence
agctgctgcccggcctaccc

SEQ ID NO: 350146 - DNA, 20 bp, Artificial
  CRISPR gRNA sequence
ctgcccggcctaccctagag

SEQ ID NO: 350147 - DNA, 20 bp, Artificial
  CRISPR gRNA sequence
cccggcctaccctagagcct

SEQ ID NO: 350148 - DNA, 20 bp, Artificial
  CRISPR gRNA sequence
ccctagagcctgaggccccg

SEQ ID NO: 350149 - DNA, 20 bp, Artificial
  CRISPR gRNA sequence
gagcctgaggccccgagacc

SEQ ID NO: 350150 - DNA, 20 bp, Artificial
  CRISPR gRNA sequence
aggccccgagacctccccgc

SEQ ID NO: 350151 - DNA, 20 bp, Artificial
  CRISPR gRNA sequence
cccgcattggaggccccggg

SEQ ID NO: 350152 - DNA, 20 bp, Artificial
  CRISPR gRNA sequence
gaggccccgggtgaggatca

SEQ ID NO: 350153 - DNA, 20 bp, Artificial
  CRISPR gRNA sequence
tgctgccgcctggctggagg

SEQ ID NO: 350154 - DNA, 20 bp, Artificial
  CRISPR gRNA sequence
gctgccgcctggctggagga

SEQ ID NO: 350155 - DNA, 20 bp, Artificial
  CRISPR gRNA sequence
ctgccgcctggctggaggat

SEQ ID NO: 350156 - DNA, 20 bp, Artificial
  CRISPR gRNA sequence
ccgcctggctggaggatggg

SEQ ID NO: 350157 - DNA, 20 bp, Artificial
  CRISPR gRNA sequence
gctggaggatggggctgact

SEQ ID NO: 350158 - DNA, 20 bp, Artificial
  CRISPR gRNA sequence
gaggatggggctgactttcc

SEQ ID NO: 350159 - DNA, 20 bp, Artificial
  CRISPR gRNA sequence
actttcccttcagacctcaa

SEQ ID NO: 350160 - DNA, 20 bp, Artificial
  CRISPR gRNA sequence
tcccttcagacctcaatgct

SEQ ID NO: 350161 - DNA, 20 bp, Artificial
  CRISPR gRNA sequence
cccttcagacctcaatgctt

SEQ ID NO: 350162 - DNA, 20 bp, Artificial
  CRISPR gRNA sequence
ccttcagacctcaatgctta

SEQ ID NO: 350163 - DNA, 20 bp, Artificial
  CRISPR gRNA sequence
cagacctcaatgcttagaag

SEQ ID NO: 350164 - DNA, 20 bp, Artificial
  CRISPR gRNA sequence
agacctcaatgcttagaagc

SEQ ID NO: 350165 - DNA, 20 bp, Artificial
  CRISPR gRNA sequence
aatgcttagaagctgcgtcc

SEQ ID NO: 350166 - DNA, 20 bp, Artificial
  CRISPR gRNA sequence
agaagctgcgtccccggggg

SEQ ID NO: 350167 - DNA, 20 bp, Artificial
  CRISPR gRNA sequence
gaagctgcgtccccgggggc

SEQ ID NO: 350168 - DNA, 20 bp, Artificial
  CRISPR gRNA sequence
cgtccccgggggctgtgcac

SEQ ID NO: 350169 - DNA, 20 bp, Artificial
  CRISPR gRNA sequence
tgcacagggctcccagggcc

SEQ ID NO: 350170 - DNA, 20 bp, Artificial
  CRISPR gRNA sequence
ccagggccacagccgggtcc

SEQ ID NO: 350171 - DNA, 20 bp, Artificial
  CRISPR gRNA sequence
actctcctcaatgaggacaa

SEQ ID NO: 350172 - DNA, 20 bp, Artificial
  CRISPR gRNA sequence
ctctcctcaatgaggacaaa

SEQ ID NO: 350173 - DNA, 20 bp, Artificial
  CRISPR gRNA sequence
tcctcaatgaggacaaagcc

SEQ ID NO: 350174 - DNA, 20 bp, Artificial
  CRISPR gRNA sequence
ctcaatgaggacaaagcctt

SEQ ID NO: 350175 - DNA, 20 bp, Artificial
  CRISPR gRNA sequence
aatgaggacaaagccttgtc

SEQ ID NO: 350176 - DNA, 20 bp, Artificial
  CRISPR gRNA sequence
gtccccagcagggcggctgt

SEQ ID NO: 350177 - DNA, 20 bp, Artificial
  CRISPR gRNA sequence
tccccagcagggcggctgtt

SEQ ID NO: 350178 - DNA, 20 bp, Artificial
  CRISPR gRNA sequence
ttgaccctcagcccagagct

SEQ ID NO: 350179 - DNA, 20 bp, Artificial
  CRISPR gRNA sequence
accctcagcccagagcttct

SEQ ID NO: 350180 - DNA, 20 bp, Artificial
  CRISPR gRNA sequence
agcccagagcttctcccagc

SEQ ID NO: 350181 - DNA, 20 bp, Artificial
  CRISPR gRNA sequence
ctcccagctgagcagggcct

SEQ ID NO: 350182 - DNA, 20 bp, Artificial
  CRISPR gRNA sequence
tcccagctgagcagggcctg

SEQ ID NO: 350183 - DNA, 20 bp, Artificial
  CRISPR gRNA sequence
ccagctgagcagggcctgtc

SEQ ID NO: 350184 - DNA, 20 bp, Artificial
  CRISPR gRNA sequence
agcagggcctgtcctgctcc

SEQ ID NO: 350185 - DNA, 20 bp, Artificial
  CRISPR gRNA sequence
tcctgctccccacatcccac

SEQ ID NO: 350186 - DNA, 20 bp, Artificial
  CRISPR gRNA sequence
ctccccacatcccacagggg

SEQ ID NO: 350187 - DNA, 20 bp, Artificial
  CRISPR gRNA sequence
cccacatcccacagggggca

SEQ ID NO: 350188 - DNA, 20 bp, Artificial
  CRISPR gRNA sequence
agggctccacggtcaggggt

SEQ ID NO: 350189 - DNA, 20 bp, Artificial
  CRISPR gRNA sequence
cacggtcaggggtcccacct

SEQ ID NO: 350190 - DNA, 20 bp, Artificial
  CRISPR gRNA sequence
cccttcccccagggaggcca

SEQ ID NO: 350191 - DNA, 20 bp, Artificial
  CRISPR gRNA sequence
ccttcccccagggaggccag

SEQ ID NO: 350192 - DNA, 20 bp, Artificial
  CRISPR gRNA sequence
cccccagggaggccagctga

SEQ ID NO: 350193 - DNA, 20 bp, Artificial
  CRISPR gRNA sequence
ccccagggaggccagctgac

SEQ ID NO: 350194 - DNA, 20 bp, Artificial
  CRISPR gRNA sequence
acacctgggctctggccaca

SEQ ID NO: 350195 - DNA, 20 bp, Artificial
  CRISPR gRNA sequence
ggctctggccacagcagaaa

SEQ ID NO: 350196 - DNA, 20 bp, Artificial
  CRISPR gRNA sequence
tggccacagcagaaagccca

SEQ ID NO: 350197 - DNA, 20 bp, Artificial
  CRISPR gRNA sequence
gccacagcagaaagcccacc

SEQ ID NO: 350198 - DNA, 20 bp, Artificial
  CRISPR gRNA sequence
ccccagcctgcagtggctgc

SEQ ID NO: 350199 - DNA, 20 bp, Artificial
  CRISPR gRNA sequence
cagtggctgccctgggagga

SEQ ID NO: 350200 - DNA, 20 bp, Artificial
  CRISPR gRNA sequence
ccctgggaggagccgcggat

SEQ ID NO: 350201 - DNA, 20 bp, Artificial
  CRISPR gRNA sequence
ggaggagccgcggatcctgg

SEQ ID NO: 350202 - DNA, 20 bp, Artificial
  CRISPR gRNA sequence
gaaaagctctggggccacct

SEQ ID NO: 350203 - DNA, 20 bp, Artificial
  CRISPR gRNA sequence
tggggccacctcccaggctt

SEQ ID NO: 350204 - DNA, 20 bp, Artificial
  CRISPR gRNA sequence
gggccacctcccaggcttgg

SEQ ID NO: 350205 - DNA, 20 bp, Artificial
  CRISPR gRNA sequence
ccaggcttggggtgacagag

SEQ ID NO: 350206 - DNA, 20 bp, Artificial
  CRISPR gRNA sequence
ggggtgacagagctccaaga

SEQ ID NO: 350207 - DNA, 20 bp, Artificial
  CRISPR gRNA sequence
gggtgacagagctccaagag

SEQ ID NO: 350208 - DNA, 20 bp, Artificial
  CRISPR gRNA sequence
caagaggtgacggctgggga

SEQ ID NO: 350209 - DNA, 20 bp, Artificial
  CRISPR gRNA sequence
gggacatgagccctgatggg

SEQ ID NO: 350210 - DNA, 20 bp, Artificial
  CRISPR gRNA sequence
atggggccgccgtgtgctca

SEQ ID NO: 350211 - DNA, 20 bp, Artificial
  CRISPR gRNA sequence
accccttggctttcttcttt

SEQ ID NO: 350212 - DNA, 20 bp, Artificial
  CRISPR gRNA sequence
ggctttcttcttttcacaca

SEQ ID NO: 350213 - DNA, 20 bp, Artificial
  CRISPR gRNA sequence
gctttcttcttttcacacat

SEQ ID NO: 350214 - DNA, 20 bp, Artificial
  CRISPR gRNA sequence
tcttcttttcacacatatga

SEQ ID NO: 350215 - DNA, 20 bp, Artificial
  CRISPR gRNA sequence
cttcttttcacacatatgat

SEQ ID NO: 350216 - DNA, 20 bp, Artificial
  CRISPR gRNA sequence
ttcttttcacacatatgatt

SEQ ID NO: 350217 - DNA, 20 bp, Artificial
  CRISPR gRNA sequence
cttttcacacatatgattag

SEQ ID NO: 350218 - DNA, 20 bp, Artificial
  CRISPR gRNA sequence
ttttcacacatatgattagg

SEQ ID NO: 350219 - DNA, 20 bp, Artificial
  CRISPR gRNA sequence
ttcacacatatgattaggcc

SEQ ID NO: 350220 - DNA, 20 bp, Artificial
  CRISPR gRNA sequence
tcacacatatgattaggcca

SEQ ID NO: 350221 - DNA, 20 bp, Artificial
  CRISPR gRNA sequence
cacacatatgattaggccaa

SEQ ID NO: 350222 - DNA, 20 bp, Artificial
  CRISPR gRNA sequence
acacatatgattaggccaac

SEQ ID NO: 350223 - DNA, 20 bp, Artificial
  CRISPR gRNA sequence
ggccaactgtggagcaaaca

SEQ ID NO: 350224 - DNA, 20 bp, Artificial
  CRISPR gRNA sequence
tggagcaaacaatgacgatg

SEQ ID NO: 350225 - DNA, 20 bp, Artificial
  CRISPR gRNA sequence
cctgagagaaaccaccatac

SEQ ID NO: 350226 - DNA, 20 bp, Artificial
  CRISPR gRNA sequence
agagaaaccaccatacccag

SEQ ID NO: 350227 - DNA, 20 bp, Artificial
  CRISPR gRNA sequence
ctggtcccagctccggcctt

SEQ ID NO: 350228 - DNA, 20 bp, Artificial
  CRISPR gRNA sequence
gtcccagctccggccttcgt

SEQ ID NO: 350229 - DNA, 20 bp, Artificial
  CRISPR gRNA sequence
cggccttcgtcaccagccag

SEQ ID NO: 350230 - DNA, 20 bp, Artificial
  CRISPR gRNA sequence
cgtcaccagccagctgcacc

SEQ ID NO: 350231 - DNA, 20 bp, Artificial
  CRISPR gRNA sequence
gtcaccagccagctgcacct

SEQ ID NO: 350232 - DNA, 20 bp, Artificial
  CRISPR gRNA sequence
cacctgcgggagtggggccg

SEQ ID NO: 350233 - DNA, 20 bp, Artificial
  CRISPR gRNA sequence
cgggagtggggccgaggacg

SEQ ID NO: 350234 - DNA, 20 bp, Artificial
  CRISPR gRNA sequence
actcagcctcagggagcctc

SEQ ID NO: 350235 - DNA, 20 bp, Artificial
  CRISPR gRNA sequence
agcctcagggagcctccctg

SEQ ID NO: 350236 - DNA, 20 bp, Artificial
  CRISPR gRNA sequence
agggagcctccctggctccc

SEQ ID NO: 350237 - DNA, 20 bp, Artificial
  CRISPR gRNA sequence
cctggctcccagggccccag

SEQ ID NO: 350238 - DNA, 20 bp, Artificial
  CRISPR gRNA sequence
gctcccagggccccaggcag

SEQ ID NO: 350239 - DNA, 20 bp, Artificial
  CRISPR gRNA sequence
ccagggccccaggcagtgaa

SEQ ID NO: 350240 - DNA, 20 bp, Artificial
  CRISPR gRNA sequence
ggctggtggcagctccagga

SEQ ID NO: 350241 - DNA, 20 bp, Artificial
  CRISPR gRNA sequence
gtggcagctccaggatgaga

SEQ ID NO: 350242 - DNA, 20 bp, Artificial
  CRISPR gRNA sequence
caggatgagacctcagaggt

SEQ ID NO: 350243 - DNA, 20 bp, Artificial
  CRISPR gRNA sequence
agaggtctgtctgacttttc

SEQ ID NO: 350244 - DNA, 20 bp, Artificial
  CRISPR gRNA sequence
tctgacttttccaagctcgg

SEQ ID NO: 350245 - DNA, 20 bp, Artificial
  CRISPR gRNA sequence
acttttccaagctcggctat

SEQ ID NO: 350246 - DNA, 20 bp, Artificial
  CRISPR gRNA sequence
ttccaagctcggctatgggg

SEQ ID NO: 350247 - DNA, 20 bp, Artificial
  CRISPR gRNA sequence
tccaagctcggctatgggga

SEQ ID NO: 350248 - DNA, 20 bp, Artificial
  CRISPR gRNA sequence
ccaagctcggctatggggag

SEQ ID NO: 350249 - DNA, 20 bp, Artificial
  CRISPR gRNA sequence
caagctcggctatggggagg

SEQ ID NO: 350250 - DNA, 20 bp, Artificial
  CRISPR gRNA sequence
ggctatggggaggtggagag

SEQ ID NO: 350251 - DNA, 20 bp, Artificial
  CRISPR gRNA sequence
tggggaggtggagagaagga

SEQ ID NO: 350252 - DNA, 20 bp, Artificial
  CRISPR gRNA sequence
ggcaaaggagacaggacggc

SEQ ID NO: 350253 - DNA, 20 bp, Artificial
  CRISPR gRNA sequence
gagctggagatggacaggac

SEQ ID NO: 350254 - DNA, 20 bp, Artificial
  CRISPR gRNA sequence
gagatggacaggactgagct

SEQ ID NO: 350255 - DNA, 20 bp, Artificial
  CRISPR gRNA sequence
agctggggccagaggacgag

SEQ ID NO: 350256 - DNA, 20 bp, Artificial
  CRISPR gRNA sequence
gggccagaggacgaggaggg

SEQ ID NO: 350257 - DNA, 20 bp, Artificial
  CRISPR gRNA sequence
cctggggcagccatccctgc

SEQ ID NO: 350258 - DNA, 20 bp, Artificial
  CRISPR gRNA sequence
gggcagccatccctgctcca

SEQ ID NO: 350259 - DNA, 20 bp, Artificial
  CRISPR gRNA sequence
ctccatcccaggctccgctg

SEQ ID NO: 350260 - DNA, 20 bp, Artificial
  CRISPR gRNA sequence
catcccaggctccgctgggg

SEQ ID NO: 350261 - DNA, 20 bp, Artificial
  CRISPR gRNA sequence
cgctgggggaccccagctcc

SEQ ID NO: 350262 - DNA, 20 bp, Artificial
  CRISPR gRNA sequence
ggggaccccagctcctccca

SEQ ID NO: 350263 - DNA, 20 bp, Artificial
  CRISPR gRNA sequence
ctcccaagaagctctgaagt

SEQ ID NO: 350264 - DNA, 20 bp, Artificial
  CRISPR gRNA sequence
ccaagaagctctgaagtctc

SEQ ID NO: 350265 - DNA, 20 bp, Artificial
  CRISPR gRNA sequence
tgaagtctcaggtcagttag

SEQ ID NO: 350266 - DNA, 20 bp, Artificial
  CRISPR gRNA sequence
aagtctcaggtcagttaggg

SEQ ID NO: 350267 - DNA, 20 bp, Artificial
  CRISPR gRNA sequence
aggtcagttaggggcccagg

SEQ ID NO: 350268 - DNA, 20 bp, Artificial
  CRISPR gRNA sequence
ggggcccagggtcagcattt

SEQ ID NO: 350269 - DNA, 20 bp, Artificial
  CRISPR gRNA sequence
gaaggtgtcctcccgaaggt

SEQ ID NO: 350270 - DNA, 20 bp, Artificial
  CRISPR gRNA sequence
aaggtgtcctcccgaaggtg

SEQ ID NO: 350271 - DNA, 20 bp, Artificial
  CRISPR gRNA sequence
ccgaaggtggacaaagagca

SEQ ID NO: 350272 - DNA, 20 bp, Artificial
  CRISPR gRNA sequence
actttccccaacccctgaag

SEQ ID NO: 350273 - DNA, 20 bp, Artificial
  CRISPR gRNA sequence
tccccaacccctgaagccca

SEQ ID NO: 350274 - DNA, 20 bp, Artificial
  CRISPR gRNA sequence
ccccaacccctgaagcccag

SEQ ID NO: 350275 - DNA, 20 bp, Artificial
  CRISPR gRNA sequence
cccaacccctgaagcccagg

SEQ ID NO: 350276 - DNA, 20 bp, Artificial
  CRISPR gRNA sequence
aagcccaggggccctcccat

SEQ ID NO: 350277 - DNA, 20 bp, Artificial
  CRISPR gRNA sequence
ccatggccctgacattcagg

SEQ ID NO: 350278 - DNA, 20 bp, Artificial
  CRISPR gRNA sequence
acattcagggacacccacag

SEQ ID NO: 350279 - DNA, 20 bp, Artificial
  CRISPR gRNA sequence
agggacacccacagccccag

SEQ ID NO: 350280 - DNA, 20 bp, Artificial
  CRISPR gRNA sequence
gaggcagcctccctctgggc

SEQ ID NO: 350281 - DNA, 20 bp, Artificial
  CRISPR gRNA sequence
cctctgggcctgcttctggg

SEQ ID NO: 350282 - DNA, 20 bp, Artificial
  CRISPR gRNA sequence
tgggcctgcttctgggaagg

SEQ ID NO: 350283 - DNA, 20 bp, Artificial
  CRISPR gRNA sequence
ggcctgcttctgggaaggcc

SEQ ID NO: 350284 - DNA, 20 bp, Artificial
  CRISPR gRNA sequence
cttctgggaaggcccatcct

SEQ ID NO: 350285 - DNA, 20 bp, Artificial
  CRISPR gRNA sequence
ctgggaaggcccatcctgag

SEQ ID NO: 350286 - DNA, 20 bp, Artificial
  CRISPR gRNA sequence
tgggaaggcccatcctgagc

SEQ ID NO: 350287 - DNA, 20 bp, Artificial
  CRISPR gRNA sequence
ggaaggcccatcctgagcct

SEQ ID NO: 350288 - DNA, 20 bp, Artificial
  CRISPR gRNA sequence
agcctccaggaagctcagat

SEQ ID NO: 350289 - DNA, 20 bp, Artificial
  CRISPR gRNA sequence
caggaagctcagatctgatg

SEQ ID NO: 350290 - DNA, 20 bp, Artificial
  CRISPR gRNA sequence
agatctgatgaggctttgtc

SEQ ID NO: 350291 - DNA, 20 bp, Artificial
  CRISPR gRNA sequence
atgaggctttgtctgggccc

SEQ ID NO: 350292 - DNA, 20 bp, Artificial
  CRISPR gRNA sequence
tgtctgggcccatggaaggg

SEQ ID NO: 350293 - DNA, 20 bp, Artificial
  CRISPR gRNA sequence
gtctgggcccatggaagggg

SEQ ID NO: 350294 - DNA, 20 bp, Artificial
  CRISPR gRNA sequence
tctgggcccatggaaggggt

SEQ ID NO: 350295 - DNA, 20 bp, Artificial
  CRISPR gRNA sequence
ggcccatggaaggggttatc

SEQ ID NO: 350296 - DNA, 20 bp, Artificial
  CRISPR gRNA sequence
tctggggcacacaggcttca

SEQ ID NO: 350297 - DNA, 20 bp, Artificial
  CRISPR gRNA sequence
gggcacacaggcttcagccc

SEQ ID NO: 350298 - DNA, 20 bp, Artificial
  CRISPR gRNA sequence
cagccctgcagctctcctgg

SEQ ID NO: 350299 - DNA, 20 bp, Artificial
  CRISPR gRNA sequence
agccctgcagctctcctgga

SEQ ID NO: 350300 - DNA, 20 bp, Artificial
  CRISPR gRNA sequence
cagctctcctggacgcaggc

SEQ ID NO: 350301 - DNA, 20 bp, Artificial
  CRISPR gRNA sequence
tcctggacgcaggcatgtga

SEQ ID NO: 350302 - DNA, 20 bp, Artificial
  CRISPR gRNA sequence
ctggacgcaggcatgtgacc

SEQ ID NO: 350303 - DNA, 20 bp, Artificial
  CRISPR gRNA sequence
gacgcaggcatgtgaccagg

SEQ ID NO: 350304 - DNA, 20 bp, Artificial
  CRISPR gRNA sequence
agggtgggaccttcaagcct

SEQ ID NO: 350305 - DNA, 20 bp, Artificial
  CRISPR gRNA sequence
caagcctttctgctggagaa

SEQ ID NO: 350306 - DNA, 20 bp, Artificial
  CRISPR gRNA sequence
aagcctttctgctggagaag

SEQ ID NO: 350307 - DNA, 20 bp, Artificial
  CRISPR gRNA sequence
tctgctggagaagacggtca

SEQ ID NO: 350308 - DNA, 20 bp, Artificial
  CRISPR gRNA sequence
ctgctggagaagacggtcat

SEQ ID NO: 350309 - DNA, 20 bp, Artificial
  CRISPR gRNA sequence
tgctggagaagacggtcatc

SEQ ID NO: 350310 - DNA, 20 bp, Artificial
  CRISPR gRNA sequence
ctggagaagacggtcatctc

SEQ ID NO: 350311 - DNA, 20 bp, Artificial
  CRISPR gRNA sequence
gagaagacggtcatctccca

SEQ ID NO: 350312 - DNA, 20 bp, Artificial
  CRISPR gRNA sequence
ccagggaagcaacgtggagc

SEQ ID NO: 350313 - DNA, 20 bp, Artificial
  CRISPR gRNA sequence
cccagggcacagagctgggc

SEQ ID NO: 350314 - DNA, 20 bp, Artificial
  CRISPR gRNA sequence
ggcctcccccgggttcactt

SEQ ID NO: 350315 - DNA, 20 bp, Artificial
  CRISPR gRNA sequence
ccccgggttcacttacttgg

SEQ ID NO: 350316 - DNA, 20 bp, Artificial
  CRISPR gRNA sequence
acttacttggtctggtgctg

SEQ ID NO: 350317 - DNA, 20 bp, Artificial
  CRISPR gRNA sequence
acttggtctggtgctgacat

SEQ ID NO: 350318 - DNA, 20 bp, Artificial
  CRISPR gRNA sequence
cttggtctggtgctgacatt

SEQ ID NO: 350319 - DNA, 20 bp, Artificial
  CRISPR gRNA sequence
ggtctggtgctgacattcct

SEQ ID NO: 350320 - DNA, 20 bp, Artificial
  CRISPR gRNA sequence
gtctggtgctgacattcctc

SEQ ID NO: 350321 - DNA, 20 bp, Artificial
  CRISPR gRNA sequence
gtgctgacattcctccaggg

SEQ ID NO: 350322 - DNA, 20 bp, Artificial
  CRISPR gRNA sequence
acattcctccagggtcccat

SEQ ID NO: 350323 - DNA, 20 bp, Artificial
  CRISPR gRNA sequence
ctccagggtcccattgggag

SEQ ID NO: 350324 - DNA, 20 bp, Artificial
  CRISPR gRNA sequence
cagggtcccattgggagaga

SEQ ID NO: 350325 - DNA, 20 bp, Artificial
  CRISPR gRNA sequence
ggagagaaggtccccggggg

SEQ ID NO: 350326 - DNA, 20 bp, Artificial
  CRISPR gRNA sequence
tgacacagggtgtcctgact

SEQ ID NO: 350327 - DNA, 20 bp, Artificial
  CRISPR gRNA sequence
acacagggtgtcctgactct

SEQ ID NO: 350328 - DNA, 20 bp, Artificial
  CRISPR gRNA sequence
actctcggtgcctgagaaga

SEQ ID NO: 350329 - DNA, 20 bp, Artificial
  CRISPR gRNA sequence
tcggtgcctgagaagagagg

SEQ ID NO: 350330 - DNA, 20 bp, Artificial
  CRISPR gRNA sequence
ggtgcctgagaagagaggga

SEQ ID NO: 350331 - DNA, 20 bp, Artificial
  CRISPR gRNA sequence
agaagagagggacggacaga

SEQ ID NO: 350332 - DNA, 20 bp, Artificial
  CRISPR gRNA sequence
agggcaccaggccaggaggg

SEQ ID NO: 350333 - DNA, 20 bp, Artificial
  CRISPR gRNA sequence
gcggctagggactgcttgtc

SEQ ID NO: 350334 - DNA, 20 bp, Artificial
  CRISPR gRNA sequence
gggactgcttgtctgtgagc

SEQ ID NO: 350335 - DNA, 20 bp, Artificial
  CRISPR gRNA sequence
cttgtctgtgagcttctaga

SEQ ID NO: 350336 - DNA, 20 bp, Artificial
  CRISPR gRNA sequence
gtctgtgagcttctagacct

SEQ ID NO: 350337 - DNA, 20 bp, Artificial
  CRISPR gRNA sequence
tctgtgagcttctagacctg

SEQ ID NO: 350338 - DNA, 20 bp, Artificial
  CRISPR gRNA sequence
tgagcttctagacctgggtg

SEQ ID NO: 350339 - DNA, 20 bp, Artificial
  CRISPR gRNA sequence
ctagacctgggtgctctacg

SEQ ID NO: 350340 - DNA, 20 bp, Artificial
  CRISPR gRNA sequence
tagacctgggtgctctacgg

SEQ ID NO: 350341 - DNA, 20 bp, Artificial
  CRISPR gRNA sequence
gacctgggtgctctacgggt

SEQ ID NO: 350342 - DNA, 20 bp, Artificial
  CRISPR gRNA sequence
ggtgctctacgggtgatggg

SEQ ID NO: 350343 - DNA, 20 bp, Artificial
  CRISPR gRNA sequence
tacgggtgatgggaggacca

SEQ ID NO: 350344 - DNA, 20 bp, Artificial
  CRISPR gRNA sequence
cgggtgatgggaggaccagc

SEQ ID NO: 350345 - DNA, 20 bp, Artificial
  CRISPR gRNA sequence
cctgtccagagtcttggagg

SEQ ID NO: 350346 - DNA, 20 bp, Artificial
  CRISPR gRNA sequence
tccagagtcttggaggtggg

SEQ ID NO: 350347 - DNA, 20 bp, Artificial
  CRISPR gRNA sequence
ggaggtggggcctggggtgg

SEQ ID NO: 350348 - DNA, 20 bp, Artificial
  CRISPR gRNA sequence
gaggtggggcctggggtggt

SEQ ID NO: 350349 - DNA, 20 bp, Artificial
  CRISPR gRNA sequence
gggtggtggctctggctgtc

SEQ ID NO: 350350 - DNA, 20 bp, Artificial
  CRISPR gRNA sequence
tggctgtcccggccttgagt

SEQ ID NO: 350351 - DNA, 20 bp, Artificial
  CRISPR gRNA sequence
gctgtcccggccttgagtag

SEQ ID NO: 350352 - DNA, 20 bp, Artificial
  CRISPR gRNA sequence
tcccggccttgagtagctgg

SEQ ID NO: 350353 - DNA, 20 bp, Artificial
  CRISPR gRNA sequence
gagtagctgggatctcatga

SEQ ID NO: 350354 - DNA, 20 bp, Artificial
  CRISPR gRNA sequence
agtagctgggatctcatgag

SEQ ID NO: 350355 - DNA, 20 bp, Artificial
  CRISPR gRNA sequence
ggatctcatgagtccgggag

SEQ ID NO: 350356 - DNA, 20 bp, Artificial
  CRISPR gRNA sequence
atgagtccgggagtccctct

SEQ ID NO: 350357 - DNA, 20 bp, Artificial
  CRISPR gRNA sequence
tgtgtccacatcctgcagtg

SEQ ID NO: 350358 - DNA, 20 bp, Artificial
  CRISPR gRNA sequence
tgtccacatcctgcagtgct

SEQ ID NO: 350359 - DNA, 20 bp, Artificial
  CRISPR gRNA sequence
cagtgctgcgggggctgccc

SEQ ID NO: 350360 - DNA, 20 bp, Artificial
  CRISPR gRNA sequence
cgggggctgcccggccagat

SEQ ID NO: 350361 - DNA, 20 bp, Artificial
  CRISPR gRNA sequence
cccggccagatgcaggccag

SEQ ID NO: 350362 - DNA, 20 bp, Artificial
  CRISPR gRNA sequence
gacacttactcctcctagac

SEQ ID NO: 350363 - DNA, 20 bp, Artificial
  CRISPR gRNA sequence
actcctcctagacttagctt

SEQ ID NO: 350364 - DNA, 20 bp, Artificial
  CRISPR gRNA sequence
ctcctcctagacttagcttg

SEQ ID NO: 350365 - DNA, 20 bp, Artificial
  CRISPR gRNA sequence
ctcctagacttagcttgaac

SEQ ID NO: 350366 - DNA, 20 bp, Artificial
  CRISPR gRNA sequence
ctagacttagcttgaacagt

SEQ ID NO: 350367 - DNA, 20 bp, Artificial
  CRISPR gRNA sequence
gacttagcttgaacagtggc

SEQ ID NO: 350368 - DNA, 20 bp, Artificial
  CRISPR gRNA sequence
agcttgaacagtggcattaa

SEQ ID NO: 350369 - DNA, 20 bp, Artificial
  CRISPR gRNA sequence
gcttgaacagtggcattaac

SEQ ID NO: 350370 - DNA, 20 bp, Artificial
  CRISPR gRNA sequence
gaacagtggcattaaccatg

SEQ ID NO: 350371 - DNA, 20 bp, Artificial
  CRISPR gRNA sequence
aacagtggcattaaccatgg

SEQ ID NO: 350372 - DNA, 20 bp, Artificial
  CRISPR gRNA sequence
accatggtcactcccataaa

SEQ ID NO: 350373 - DNA, 20 bp, Artificial
  CRISPR gRNA sequence
ccataaacccaggctccaga

SEQ ID NO: 350374 - DNA, 20 bp, Artificial
  CRISPR gRNA sequence
cagaccaggggcccgagagc

SEQ ID NO: 350375 - DNA, 20 bp, Artificial
  CRISPR gRNA sequence
gggactgggaagtcccagaa

SEQ ID NO: 350376 - DNA, 20 bp, Artificial
  CRISPR gRNA sequence
ggaagtcccagaaccccgag

SEQ ID NO: 350377 - DNA, 20 bp, Artificial
  CRISPR gRNA sequence
gggtggcccttccttgcccc

SEQ ID NO: 350378 - DNA, 20 bp, Artificial
  CRISPR gRNA sequence
ccttgccccttcccctgcct

SEQ ID NO: 350379 - DNA, 20 bp, Artificial
  CRISPR gRNA sequence
cttgccccttcccctgcctc

SEQ ID NO: 350380 - DNA, 20 bp, Artificial
  CRISPR gRNA sequence
gccccttcccctgcctccat

SEQ ID NO: 350381 - DNA, 20 bp, Artificial
  CRISPR gRNA sequence
ccccttcccctgcctccatc

SEQ ID NO: 350382 - DNA, 20 bp, Artificial
  CRISPR gRNA sequence
cccctgcctccatcacctgt

SEQ ID NO: 350383 - DNA, 20 bp, Artificial
  CRISPR gRNA sequence
ccctgcctccatcacctgtt

SEQ ID NO: 350384 - DNA, 20 bp, Artificial
  CRISPR gRNA sequence
cctccatcacctgttcccca

SEQ ID NO: 350385 - DNA, 20 bp, Artificial
  CRISPR gRNA sequence
catcacctgttccccactgg

SEQ ID NO: 350386 - DNA, 20 bp, Artificial
  CRISPR gRNA sequence
ttccccactgggctgcttcc

SEQ ID NO: 350387 - DNA, 20 bp, Artificial
  CRISPR gRNA sequence
cccactgggctgcttccagg

SEQ ID NO: 350388 - DNA, 20 bp, Artificial
  CRISPR gRNA sequence
ggctgcttccaggacagggc

SEQ ID NO: 350389 - DNA, 20 bp, Artificial
  CRISPR gRNA sequence
cttccaggacagggctgaag

SEQ ID NO: 350390 - DNA, 20 bp, Artificial
  CRISPR gRNA sequence
ccaggacagggctgaagtgg

SEQ ID NO: 350391 - DNA, 20 bp, Artificial
  CRISPR gRNA sequence
caggacagggctgaagtggg

SEQ ID NO: 350392 - DNA, 20 bp, Artificial
  CRISPR gRNA sequence
aagtgggtgggcctggggct

SEQ ID NO: 350393 - DNA, 20 bp, Artificial
  CRISPR gRNA sequence
gggctggccaaggttctgtc

SEQ ID NO: 350394 - DNA, 20 bp, Artificial
  CRISPR gRNA sequence
gccaaggttctgtctcacca

SEQ ID NO: 350395 - DNA, 20 bp, Artificial
  CRISPR gRNA sequence
tgtctcaccagggcccctgg

SEQ ID NO: 350396 - DNA, 20 bp, Artificial
  CRISPR gRNA sequence
tctcaccagggcccctgggc

SEQ ID NO: 350397 - DNA, 20 bp, Artificial
  CRISPR gRNA sequence
accagggcccctgggcaggc

SEQ ID NO: 350398 - DNA, 20 bp, Artificial
  CRISPR gRNA sequence
ggcaggccatgccgtcgagg

SEQ ID NO: 350399 - DNA, 20 bp, Artificial
  CRISPR gRNA sequence
gggctccagacagcggggca

SEQ ID NO: 350400 - DNA, 20 bp, Artificial
  CRISPR gRNA sequence
cagacagcggggcactgggg

SEQ ID NO: 350401 - DNA, 20 bp, Artificial
  CRISPR gRNA sequence
gggaccagggtggaaatggg

SEQ ID NO: 350402 - DNA, 20 bp, Artificial
  CRISPR gRNA sequence
acctcccttctgcaccctct

SEQ ID NO: 350403 - DNA, 20 bp, Artificial
  CRISPR gRNA sequence
cctcccttctgcaccctctg

SEQ ID NO: 350404 - DNA, 20 bp, Artificial
  CRISPR gRNA sequence
ccttctgcaccctctggccc

SEQ ID NO: 350405 - DNA, 20 bp, Artificial
  CRISPR gRNA sequence
ctgcaccctctggcccgggc

SEQ ID NO: 350406 - DNA, 20 bp, Artificial
  CRISPR gRNA sequence
tgcaccctctggcccgggct

SEQ ID NO: 350407 - DNA, 20 bp, Artificial
  CRISPR gRNA sequence
caccctctggcccgggctgg

SEQ ID NO: 350408 - DNA, 20 bp, Artificial
  CRISPR gRNA sequence
tggcccgggctggaggtggc

SEQ ID NO: 350409 - DNA, 20 bp, Artificial
  CRISPR gRNA sequence
gcccgggctggaggtggcgt

SEQ ID NO: 350410 - DNA, 20 bp, Artificial
  CRISPR gRNA sequence
gaggtggcgtaagcgcggca

SEQ ID NO: 350411 - DNA, 20 bp, Artificial
  CRISPR gRNA sequence
gacgatgcagaagtggcctg

SEQ ID NO: 350412 - DNA, 20 bp, Artificial
  CRISPR gRNA sequence
ggctgcagccacacacggcg

SEQ ID NO: 350413 - DNA, 20 bp, Artificial
  CRISPR gRNA sequence
cagccacacacggcgttctc

SEQ ID NO: 350414 - DNA, 20 bp, Artificial
  CRISPR gRNA sequence
tctgtcctggagcagttccg

SEQ ID NO: 350415 - DNA, 20 bp, Artificial
  CRISPR gRNA sequence
tgtcctggagcagttccggc

SEQ ID NO: 350416 - DNA, 20 bp, Artificial
  CRISPR gRNA sequence
tcctggagcagttccggctc

SEQ ID NO: 350417 - DNA, 20 bp, Artificial
  CRISPR gRNA sequence
gagcagttccggctcgcgcg

SEQ ID NO: 350418 - DNA, 20 bp, Artificial
  CRISPR gRNA sequence
cggctcgcgcgcaggcccat

SEQ ID NO: 350419 - DNA, 20 bp, Artificial
  CRISPR gRNA sequence
gcgcgcaggcccatggctgg

SEQ ID NO: 350420 - DNA, 20 bp, Artificial
  CRISPR gRNA sequence
gagtccaagaggaggggctg

SEQ ID NO: 350421 - DNA, 20 bp, Artificial
  CRISPR gRNA sequence
agaggggtacgtggaggccg

SEQ ID NO: 350422 - DNA, 20 bp, Artificial
  CRISPR gRNA sequence
ctgccagggcgccctgccag

SEQ ID NO: 350423 - DNA, 20 bp, Artificial
  CRISPR gRNA sequence
ccagggcgccctgccaggct

SEQ ID NO: 350424 - DNA, 20 bp, Artificial
  CRISPR gRNA sequence
ccaggctgaacccctggctc

SEQ ID NO: 350425 - DNA, 20 bp, Artificial
  CRISPR gRNA sequence
aacccctggctcagccaaac

SEQ ID NO: 350426 - DNA, 20 bp, Artificial
  CRISPR gRNA sequence
gctcagccaaacgaggtgcc

SEQ ID NO: 350427 - DNA, 20 bp, Artificial
  CRISPR gRNA sequence
agccaaacgaggtgcccaga

SEQ ID NO: 350428 - DNA, 20 bp, Artificial
  CRISPR gRNA sequence
aggccgggagggacaccaag

SEQ ID NO: 350429 - DNA, 20 bp, Artificial
  CRISPR gRNA sequence
cgtgtgggacgagggcttgc

SEQ ID NO: 350430 - DNA, 20 bp, Artificial
  CRISPR gRNA sequence
gcaggaaggtcctgggaggg

SEQ ID NO: 350431 - DNA, 20 bp, Artificial
  CRISPR gRNA sequence
caggaaggtcctgggagggc

SEQ ID NO: 350432 - DNA, 20 bp, Artificial
  CRISPR gRNA sequence
ggagggcttcgttgatggga

SEQ ID NO: 350433 - DNA, 20 bp, Artificial
  CRISPR gRNA sequence
cgttgatgggagaaaccagc

SEQ ID NO: 350434 - DNA, 20 bp, Artificial
  CRISPR gRNA sequence
gttgatgggagaaaccagcc

SEQ ID NO: 350435 - DNA, 20 bp, Artificial
  CRISPR gRNA sequence
atgggagaaaccagccttct

SEQ ID NO: 350436 - DNA, 20 bp, Artificial
  CRISPR gRNA sequence
ctgcccagatgggcaggacg

SEQ ID NO: 350437 - DNA, 20 bp, Artificial
  CRISPR gRNA sequence
tgcccagatgggcaggacgc

SEQ ID NO: 350438 - DNA, 20 bp, Artificial
  CRISPR gRNA sequence
cccagatgggcaggacgccg

SEQ ID NO: 350439 - DNA, 20 bp, Artificial
  CRISPR gRNA sequence
gcactgtcagttccagggca

SEQ ID NO: 350440 - DNA, 20 bp, Artificial
  CRISPR gRNA sequence
cactgtcagttccagggcag

SEQ ID NO: 350441 - DNA, 20 bp, Artificial
  CRISPR gRNA sequence
tcagttccagggcagggtcc

SEQ ID NO: 350442 - DNA, 20 bp, Artificial
  CRISPR gRNA sequence
cagggcagggtcccgcaggc

SEQ ID NO: 350443 - DNA, 20 bp, Artificial
  CRISPR gRNA sequence
gccccacgtgcccacccaga

SEQ ID NO: 350444 - DNA, 20 bp, Artificial
  CRISPR gRNA sequence
cccatctgtgcaaaccaggc

SEQ ID NO: 350445 - DNA, 20 bp, Artificial
  CRISPR gRNA sequence
ccatctgtgcaaaccaggcc

SEQ ID NO: 350446 - DNA, 20 bp, Artificial
  CRISPR gRNA sequence
tgcaaaccaggccattccaa

SEQ ID NO: 350447 - DNA, 20 bp, Artificial
  CRISPR gRNA sequence
caatggcagaggcaggtagg

SEQ ID NO: 350448 - DNA, 20 bp, Artificial
  CRISPR gRNA sequence
cttcaggtactggtggaggt

SEQ ID NO: 350449 - DNA, 20 bp, Artificial
  CRISPR gRNA sequence
ttcaggtactggtggaggtg

SEQ ID NO: 350450 - DNA, 20 bp, Artificial
  CRISPR gRNA sequence
caggtactggtggaggtggg

SEQ ID NO: 350451 - DNA, 20 bp, Artificial
  CRISPR gRNA sequence
aggtactggtggaggtgggg

SEQ ID NO: 350452 - DNA, 20 bp, Artificial
  CRISPR gRNA sequence
gtggaggtggggtacaagct

SEQ ID NO: 350453 - DNA, 20 bp, Artificial
  CRISPR gRNA sequence
ggcctgggcccctcctgagg

SEQ ID NO: 350454 - DNA, 20 bp, Artificial
  CRISPR gRNA sequence
ggcccctcctgagggcagcc

SEQ ID NO: 350455 - DNA, 20 bp, Artificial
  CRISPR gRNA sequence
ctgagggcagcctcacctgc

SEQ ID NO: 350456 - DNA, 20 bp, Artificial
  CRISPR gRNA sequence
agggcagcctcacctgccac

SEQ ID NO: 350457 - DNA, 20 bp, Artificial
  CRISPR gRNA sequence
acctgccacctgtgccccca

SEQ ID NO: 350458 - DNA, 20 bp, Artificial
  CRISPR gRNA sequence
ccacctgtgcccccacatcc

SEQ ID NO: 350459 - DNA, 20 bp, Artificial
  CRISPR gRNA sequence
tgcccccacatcctcagccc

SEQ ID NO: 350460 - DNA, 20 bp, Artificial
  CRISPR gRNA sequence
agcccaagtagacaggtgct

SEQ ID NO: 350461 - DNA, 20 bp, Artificial
  CRISPR gRNA sequence
tcacaagaggggaggggcat

SEQ ID NO: 350462 - DNA, 20 bp, Artificial
  CRISPR gRNA sequence
cacaagaggggaggggcatg

SEQ ID NO: 350463 - DNA, 20 bp, Artificial
  CRISPR gRNA sequence
acaagaggggaggggcatgg

SEQ ID NO: 350464 - DNA, 20 bp, Artificial
  CRISPR gRNA sequence
ggcatgcaggttgaggtgtg

SEQ ID NO: 350465 - DNA, 20 bp, Artificial
  CRISPR gRNA sequence
aggtgtgagccccaaatccc

SEQ ID NO: 350466 - DNA, 20 bp, Artificial
  CRISPR gRNA sequence
catgcatgaacccccaaagc

SEQ ID NO: 350467 - DNA, 20 bp, Artificial
  CRISPR gRNA sequence
cagcttcctcttctgttcat

SEQ ID NO: 350468 - DNA, 20 bp, Artificial
  CRISPR gRNA sequence
cctcttctgttcatggctag

SEQ ID NO: 350469 - DNA, 20 bp, Artificial
  CRISPR gRNA sequence
ctcttctgttcatggctagc

SEQ ID NO: 350470 - DNA, 20 bp, Artificial
  CRISPR gRNA sequence
ttctgttcatggctagccca

SEQ ID NO: 350471 - DNA, 20 bp, Artificial
  CRISPR gRNA sequence
ctgttcatggctagcccacc

SEQ ID NO: 350472 - DNA, 20 bp, Artificial
  CRISPR gRNA sequence
tgttcatggctagcccacct

SEQ ID NO: 350473 - DNA, 20 bp, Artificial
  CRISPR gRNA sequence
ttcatggctagcccacctgc

SEQ ID NO: 350474 - DNA, 20 bp, Artificial
  CRISPR gRNA sequence
atggctagcccacctgccct

SEQ ID NO: 350475 - DNA, 20 bp, Artificial
  CRISPR gRNA sequence
gcccacctgccctgtgcctc

SEQ ID NO: 350476 - DNA, 20 bp, Artificial
  CRISPR gRNA sequence
ccctgtgcctccctgtaggc

SEQ ID NO: 350477 - DNA, 20 bp, Artificial
  CRISPR gRNA sequence
tgcctccctgtaggctcagg

SEQ ID NO: 350478 - DNA, 20 bp, Artificial
  CRISPR gRNA sequence
cctgtaggctcaggccctgc

SEQ ID NO: 350479 - DNA, 20 bp, Artificial
  CRISPR gRNA sequence
taggctcaggccctgccccc

SEQ ID NO: 350480 - DNA, 20 bp, Artificial
  CRISPR gRNA sequence
aggccctgcccccaggtgtg

SEQ ID NO: 350481 - DNA, 20 bp, Artificial
  CRISPR gRNA sequence
cccccaggtgtgccgtcagc

SEQ ID NO: 350482 - DNA, 20 bp, Artificial
  CRISPR gRNA sequence
tcccgcaggtgcagtcctgc

SEQ ID NO: 350483 - DNA, 20 bp, Artificial
  CRISPR gRNA sequence
cctggccgcagggagcactg

SEQ ID NO: 350484 - DNA, 20 bp, Artificial
  CRISPR gRNA sequence
gccgcagggagcactggcca

SEQ ID NO: 350485 - DNA, 20 bp, Artificial
  CRISPR gRNA sequence
gccatgctgagcctggcatg

SEQ ID NO: 350486 - DNA, 20 bp, Artificial
  CRISPR gRNA sequence
agcctggcatgaggctccaa

SEQ ID NO: 350487 - DNA, 20 bp, Artificial
  CRISPR gRNA sequence
gcatgaggctccaaggggac

SEQ ID NO: 350488 - DNA, 20 bp, Artificial
  CRISPR gRNA sequence
caaggggacagagccgttgg

SEQ ID NO: 350489 - DNA, 20 bp, Artificial
  CRISPR gRNA sequence
gccgcatggacaggctctgc

SEQ ID NO: 350490 - DNA, 20 bp, Artificial
  CRISPR gRNA sequence
tgcgctcagtgactcaaagg

SEQ ID NO: 350491 - DNA, 20 bp, Artificial
  CRISPR gRNA sequence
cgctcagtgactcaaaggcc

SEQ ID NO: 350492 - DNA, 20 bp, Artificial
  CRISPR gRNA sequence
agtgactcaaaggccacctc

SEQ ID NO: 350493 - DNA, 20 bp, Artificial
  CRISPR gRNA sequence
aaaggccacctctgggtctg

SEQ ID NO: 350494 - DNA, 20 bp, Artificial
  CRISPR gRNA sequence
tgggtctggttcccctttct

SEQ ID NO: 350495 - DNA, 20 bp, Artificial
  CRISPR gRNA sequence
ggtctggttcccctttctgt

SEQ ID NO: 350496 - DNA, 20 bp, Artificial
  CRISPR gRNA sequence
gttcccctttctgtctgcct

SEQ ID NO: 350497 - DNA, 20 bp, Artificial
  CRISPR gRNA sequence
ccctttctgtctgcctggac

SEQ ID NO: 350498 - DNA, 20 bp, Artificial
  CRISPR gRNA sequence
tctgtctgcctggactcagg

SEQ ID NO: 350499 - DNA, 20 bp, Artificial
  CRISPR gRNA sequence
ctgtctgcctggactcaggt

SEQ ID NO: 350500 - DNA, 20 bp, Artificial
  CRISPR gRNA sequence
tgtctgcctggactcaggtg

SEQ ID NO: 350501 - DNA, 20 bp, Artificial
  CRISPR gRNA sequence
tctgcctggactcaggtggg

SEQ ID NO: 350502 - DNA, 20 bp, Artificial
  CRISPR gRNA sequence
cctggactcaggtgggcacc

SEQ ID NO: 350503 - DNA, 20 bp, Artificial
  CRISPR gRNA sequence
gactcaggtgggcaccagcc

SEQ ID NO: 350504 - DNA, 20 bp, Artificial
  CRISPR gRNA sequence
aggtgggcaccagcctccag

SEQ ID NO: 350505 - DNA, 20 bp, Artificial
  CRISPR gRNA sequence
caggtgacctcttcccctga

SEQ ID NO: 350506 - DNA, 20 bp, Artificial
  CRISPR gRNA sequence
ttcccctgaggtcacagggg

SEQ ID NO: 350507 - DNA, 20 bp, Artificial
  CRISPR gRNA sequence
cccctgaggtcacaggggga

SEQ ID NO: 350508 - DNA, 20 bp, Artificial
  CRISPR gRNA sequence
ccctgaggtcacagggggaa

SEQ ID NO: 350509 - DNA, 20 bp, Artificial
  CRISPR gRNA sequence
aggtcacagggggaaccaat

SEQ ID NO: 350510 - DNA, 20 bp, Artificial
  CRISPR gRNA sequence
gaggagaaagggacaagaag

SEQ ID NO: 350511 - DNA, 20 bp, Artificial
  CRISPR gRNA sequence
tggggaagcagcaggcccga

SEQ ID NO: 350512 - DNA, 20 bp, Artificial
  CRISPR gRNA sequence
cactttgcagctagggacgt

SEQ ID NO: 350513 - DNA, 20 bp, Artificial
  CRISPR gRNA sequence
tgcagctagggacgtgggca

SEQ ID NO: 350514 - DNA, 20 bp, Artificial
  CRISPR gRNA sequence
gcagctagggacgtgggcac

SEQ ID NO: 350515 - DNA, 20 bp, Artificial
  CRISPR gRNA sequence
cagctagggacgtgggcaca

SEQ ID NO: 350516 - DNA, 20 bp, Artificial
  CRISPR gRNA sequence
gggacgtgggcacaggagag

SEQ ID NO: 350517 - DNA, 20 bp, Artificial
  CRISPR gRNA sequence
ggcacccaccccgggcacca

SEQ ID NO: 350518 - DNA, 20 bp, Artificial
  CRISPR gRNA sequence
aggatggcccacctggcggt

SEQ ID NO: 350519 - DNA, 20 bp, Artificial
  CRISPR gRNA sequence
gcggtgacaaagtgagaggt

SEQ ID NO: 350520 - DNA, 20 bp, Artificial
  CRISPR gRNA sequence
acctcaaggcgtcccctgca

SEQ ID NO: 350521 - DNA, 20 bp, Artificial
  CRISPR gRNA sequence
aaggcgtcccctgcagggtg

SEQ ID NO: 350522 - DNA, 20 bp, Artificial
  CRISPR gRNA sequence
cagggtgcatccatggagat

SEQ ID NO: 350523 - DNA, 20 bp, Artificial
  CRISPR gRNA sequence
ggacctggcctggggcagcc

SEQ ID NO: 350524 - DNA, 20 bp, Artificial
  CRISPR gRNA sequence
gcctggggcagccggggcct

SEQ ID NO: 350525 - DNA, 20 bp, Artificial
  CRISPR gRNA sequence
gggcagccggggccttcctg

SEQ ID NO: 350526 - DNA, 20 bp, Artificial
  CRISPR gRNA sequence
cctggggcactgtggccatg

SEQ ID NO: 350527 - DNA, 20 bp, Artificial
  CRISPR gRNA sequence
ctggggcactgtggccatgg

SEQ ID NO: 350528 - DNA, 20 bp, Artificial
  CRISPR gRNA sequence
gggcactgtggccatggaga

SEQ ID NO: 350529 - DNA, 20 bp, Artificial
  CRISPR gRNA sequence
tggccatggagagagggtgc

SEQ ID NO: 350530 - DNA, 20 bp, Artificial
  CRISPR gRNA sequence
cccaagcggaggctgggccg

SEQ ID NO: 350531 - DNA, 20 bp, Artificial
  CRISPR gRNA sequence
ggccggctgtgctggcctct

SEQ ID NO: 350532 - DNA, 20 bp, Artificial
  CRISPR gRNA sequence
tgctggcctcttacctgggt

SEQ ID NO: 350533 - DNA, 20 bp, Artificial
  CRISPR gRNA sequence
gcctcttacctgggtcacac

SEQ ID NO: 350534 - DNA, 20 bp, Artificial
  CRISPR gRNA sequence
ttacctgggtcacacatttg

SEQ ID NO: 350535 - DNA, 20 bp, Artificial
  CRISPR gRNA sequence
acctgggtcacacatttggc

SEQ ID NO: 350536 - DNA, 20 bp, Artificial
  CRISPR gRNA sequence
cctgggtcacacatttggca

SEQ ID NO: 350537 - DNA, 20 bp, Artificial
  CRISPR gRNA sequence
ggtcacacatttggcactgc

SEQ ID NO: 350538 - DNA, 20 bp, Artificial
  CRISPR gRNA sequence
ggcactgcagacacttgctt

SEQ ID NO: 350539 - DNA, 20 bp, Artificial
  CRISPR gRNA sequence
gcactgcagacacttgctta

SEQ ID NO: 350540 - DNA, 20 bp, Artificial
  CRISPR gRNA sequence
cagacacttgcttaggccat

SEQ ID NO: 350541 - DNA, 20 bp, Artificial
  CRISPR gRNA sequence
gcttaggccattgaggtggg

SEQ ID NO: 350542 - DNA, 20 bp, Artificial
  CRISPR gRNA sequence
cttaggccattgaggtgggc

SEQ ID NO: 350543 - DNA, 20 bp, Artificial
  CRISPR gRNA sequence
aggccattgaggtgggcaat

SEQ ID NO: 350544 - DNA, 20 bp, Artificial
  CRISPR gRNA sequence
ggccattgaggtgggcaatg

SEQ ID NO: 350545 - DNA, 20 bp, Artificial
  CRISPR gRNA sequence
aggtgggcaatgtaggtgcc

SEQ ID NO: 350546 - DNA, 20 bp, Artificial
  CRISPR gRNA sequence
gagggcagggttcacacact

SEQ ID NO: 350547 - DNA, 20 bp, Artificial
  CRISPR gRNA sequence
acacactgtgcccgtcagct

SEQ ID NO: 350548 - DNA, 20 bp, Artificial
  CRISPR gRNA sequence
tgcccgtcagctccccgcag

SEQ ID NO: 350549 - DNA, 20 bp, Artificial
  CRISPR gRNA sequence
cccgcaggcctccttcacac

SEQ ID NO: 350550 - DNA, 20 bp, Artificial
  CRISPR gRNA sequence
cttcacacgataacctgccg

SEQ ID NO: 350551 - DNA, 20 bp, Artificial
  CRISPR gRNA sequence
cacacgataacctgccgccc

SEQ ID NO: 350552 - DNA, 20 bp, Artificial
  CRISPR gRNA sequence
acacgataacctgccgccca

SEQ ID NO: 350553 - DNA, 20 bp, Artificial
  CRISPR gRNA sequence
ccgcccagagagtgggaact

SEQ ID NO: 350554 - DNA, 20 bp, Artificial
  CRISPR gRNA sequence
cgcaagtctgcgggaggccc

SEQ ID NO: 350555 - DNA, 20 bp, Artificial
  CRISPR gRNA sequence
gcaagtctgcgggaggcccc

SEQ ID NO: 350556 - DNA, 20 bp, Artificial
  CRISPR gRNA sequence
cgggaggccccttcgggagc

SEQ ID NO: 350557 - DNA, 20 bp, Artificial
  CRISPR gRNA sequence
cgggagcccacccatcactc

SEQ ID NO: 350558 - DNA, 20 bp, Artificial
  CRISPR gRNA sequence
gggagcccacccatcactcc

SEQ ID NO: 350559 - DNA, 20 bp, Artificial
  CRISPR gRNA sequence
cacccgcgcccagagcccaa

SEQ ID NO: 350560 - DNA, 20 bp, Artificial
  CRISPR gRNA sequence
aggggactcaaatggcccat

SEQ ID NO: 350561 - DNA, 20 bp, Artificial
  CRISPR gRNA sequence
aaatggcccatgagccccac

SEQ ID NO: 350562 - DNA, 20 bp, Artificial
  CRISPR gRNA sequence
ctctggggaaaatcggaaag

SEQ ID NO: 350563 - DNA, 20 bp, Artificial
  CRISPR gRNA sequence
tggggaaaatcggaaagttc

SEQ ID NO: 350564 - DNA, 20 bp, Artificial
  CRISPR gRNA sequence
gggaaaatcggaaagttctg

SEQ ID NO: 350565 - DNA, 20 bp, Artificial
  CRISPR gRNA sequence
tggaagcacatggggcctcc

SEQ ID NO: 350566 - DNA, 20 bp, Artificial
  CRISPR gRNA sequence
gaagcacatggggcctcctg

SEQ ID NO: 350567 - DNA, 20 bp, Artificial
  CRISPR gRNA sequence
ctgggacacctggcccggct

SEQ ID NO: 350568 - DNA, 20 bp, Artificial
  CRISPR gRNA sequence
ggacacctggcccggctctg

SEQ ID NO: 350569 - DNA, 20 bp, Artificial
  CRISPR gRNA sequence
gcccggctctggtatgtgcc

SEQ ID NO: 350570 - DNA, 20 bp, Artificial
  CRISPR gRNA sequence
tggtatgtgcccccgagccc

SEQ ID NO: 350571 - DNA, 20 bp, Artificial
  CRISPR gRNA sequence
gtatgtgcccccgagcccat

SEQ ID NO: 350572 - DNA, 20 bp, Artificial
  CRISPR gRNA sequence
tggccacggtgggccagcca

SEQ ID NO: 350573 - DNA, 20 bp, Artificial
  CRISPR gRNA sequence
gccacggtgggccagccacg

SEQ ID NO: 350574 - DNA, 20 bp, Artificial
  CRISPR gRNA sequence
tcagacccaccccctgtgca

SEQ ID NO: 350575 - DNA, 20 bp, Artificial
  CRISPR gRNA sequence
agacccaccccctgtgcagt

SEQ ID NO: 350576 - DNA, 20 bp, Artificial
  CRISPR gRNA sequence
tgcagtgtgactgtgagggt

SEQ ID NO: 350577 - DNA, 20 bp, Artificial
  CRISPR gRNA sequence
tgagggtcccccagggtgaa

SEQ ID NO: 350578 - DNA, 20 bp, Artificial
  CRISPR gRNA sequence
ctggcctgggggttctgccc

SEQ ID NO: 350579 - DNA, 20 bp, Artificial
  CRISPR gRNA sequence
gcctgggggttctgccctca

SEQ ID NO: 350580 - DNA, 20 bp, Artificial
  CRISPR gRNA sequence
ggggttctgccctcactgtc

SEQ ID NO: 350581 - DNA, 20 bp, Artificial
  CRISPR gRNA sequence
tgccctcactgtctgcacac

SEQ ID NO: 350582 - DNA, 20 bp, Artificial
  CRISPR gRNA sequence
ccctcactgtctgcacacct

SEQ ID NO: 350583 - DNA, 20 bp, Artificial
  CRISPR gRNA sequence
actgtctgcacacctagccc

SEQ ID NO: 350584 - DNA, 20 bp, Artificial
  CRISPR gRNA sequence
tctgcacacctagccccagg

SEQ ID NO: 350585 - DNA, 20 bp, Artificial
  CRISPR gRNA sequence
cacacctagccccagggctt

SEQ ID NO: 350586 - DNA, 20 bp, Artificial
  CRISPR gRNA sequence
gccccagggcttcatcacac

SEQ ID NO: 350587 - DNA, 20 bp, Artificial
  CRISPR gRNA sequence
catcacacccatggctgtgg

SEQ ID NO: 350588 - DNA, 20 bp, Artificial
  CRISPR gRNA sequence
atcacacccatggctgtggg

SEQ ID NO: 350589 - DNA, 20 bp, Artificial
  CRISPR gRNA sequence
tgggggcagagaacacaggg

SEQ ID NO: 350590 - DNA, 20 bp, Artificial
  CRISPR gRNA sequence
gggcagaagggggcaagagt

SEQ ID NO: 350591 - DNA, 20 bp, Artificial
  CRISPR gRNA sequence
ccctcggcccacagagctgg

SEQ ID NO: 350592 - DNA, 20 bp, Artificial
  CRISPR gRNA sequence
ggcccacagagctggcccgc

SEQ ID NO: 350593 - DNA, 20 bp, Artificial
  CRISPR gRNA sequence
gcccgccaaagggctgcacc

SEQ ID NO: 350594 - DNA, 20 bp, Artificial
  CRISPR gRNA sequence
cacctacctggactgcactt

SEQ ID NO: 350595 - DNA, 20 bp, Artificial
  CRISPR gRNA sequence
cctggactgcacttggggca

SEQ ID NO: 350596 - DNA, 20 bp, Artificial
  CRISPR gRNA sequence
gactgcacttggggcagcac

SEQ ID NO: 350597 - DNA, 20 bp, Artificial
  CRISPR gRNA sequence
cacttggggcagcactcgga

SEQ ID NO: 350598 - DNA, 20 bp, Artificial
  CRISPR gRNA sequence
ggggcagcactcggagccca

SEQ ID NO: 350599 - DNA, 20 bp, Artificial
  CRISPR gRNA sequence
gggcagcactcggagcccac

SEQ ID NO: 350600 - DNA, 20 bp, Artificial
  CRISPR gRNA sequence
ggagcccactgggtactcgt

SEQ ID NO: 350601 - DNA, 20 bp, Artificial
  CRISPR gRNA sequence
ggtactcgtcctccttgcag

SEQ ID NO: 350602 - DNA, 20 bp, Artificial
  CRISPR gRNA sequence
gtcctccttgcaggacggca

SEQ ID NO: 350603 - DNA, 20 bp, Artificial
  CRISPR gRNA sequence
cttgcaggacggcagagctg

SEQ ID NO: 350604 - DNA, 20 bp, Artificial
  CRISPR gRNA sequence
gcaggacggcagagctgggg

SEQ ID NO: 350605 - DNA, 20 bp, Artificial
  CRISPR gRNA sequence
caggacggcagagctggggc

SEQ ID NO: 350606 - DNA, 20 bp, Artificial
  CRISPR gRNA sequence
gggcgtagcagggggctccc

SEQ ID NO: 350607 - DNA, 20 bp, Artificial
  CRISPR gRNA sequence
ccaggaaggtgagatacagc

SEQ ID NO: 350608 - DNA, 20 bp, Artificial
  CRISPR gRNA sequence
agggggtcaggacaggcatt

SEQ ID NO: 350609 - DNA, 20 bp, Artificial
  CRISPR gRNA sequence
ggagatgccctggctgccct

SEQ ID NO: 350610 - DNA, 20 bp, Artificial
  CRISPR gRNA sequence
gctgccctgtgggctctgcc

SEQ ID NO: 350611 - DNA, 20 bp, Artificial
  CRISPR gRNA sequence
ccctgtgggctctgccaggc

SEQ ID NO: 350612 - DNA, 20 bp, Artificial
  CRISPR gRNA sequence
tgggctctgccaggcttggc

SEQ ID NO: 350613 - DNA, 20 bp, Artificial
  CRISPR gRNA sequence
tgccaggcttggccccacag

SEQ ID NO: 350614 - DNA, 20 bp, Artificial
  CRISPR gRNA sequence
ccaggcttggccccacagcc

SEQ ID NO: 350615 - DNA, 20 bp, Artificial
  CRISPR gRNA sequence
ggccccacagcctgaatctc

SEQ ID NO: 350616 - DNA, 20 bp, Artificial
  CRISPR gRNA sequence
gccccacagcctgaatctcc

SEQ ID NO: 350617 - DNA, 20 bp, Artificial
  CRISPR gRNA sequence
aatctccctctgtgcaatgg

SEQ ID NO: 350618 - DNA, 20 bp, Artificial
  CRISPR gRNA sequence
cctctgtgcaatggggagga

SEQ ID NO: 350619 - DNA, 20 bp, Artificial
  CRISPR gRNA sequence
tgtgcaatggggaggagcgg

SEQ ID NO: 350620 - DNA, 20 bp, Artificial
  CRISPR gRNA sequence
tgcaatggggaggagcggca

SEQ ID NO: 350621 - DNA, 20 bp, Artificial
  CRISPR gRNA sequence
gtagagaggacagaagcggg

SEQ ID NO: 350622 - DNA, 20 bp, Artificial
  CRISPR gRNA sequence
atggaacaaccttgccgacc

SEQ ID NO: 350623 - DNA, 20 bp, Artificial
  CRISPR gRNA sequence
gccgaccgctggagcccggg

SEQ ID NO: 350624 - DNA, 20 bp, Artificial
  CRISPR gRNA sequence
ccgaccgctggagcccggga

SEQ ID NO: 350625 - DNA, 20 bp, Artificial
  CRISPR gRNA sequence
gagcccgggatagggtgggg

SEQ ID NO: 350626 - DNA, 20 bp, Artificial
  CRISPR gRNA sequence
ctccagccctgatgacgctg

SEQ ID NO: 350627 - DNA, 20 bp, Artificial
  CRISPR gRNA sequence
cagccctgatgacgctgcct

SEQ ID NO: 350628 - DNA, 20 bp, Artificial
  CRISPR gRNA sequence
atgacgctgcctggcagcgc

SEQ ID NO: 350629 - DNA, 20 bp, Artificial
  CRISPR gRNA sequence
cctggcagcgcggagccctg

SEQ ID NO: 350630 - DNA, 20 bp, Artificial
  CRISPR gRNA sequence
gcagcgcggagccctgggaa

SEQ ID NO: 350631 - DNA, 20 bp, Artificial
  CRISPR gRNA sequence
ggaactggaactctgccctc

SEQ ID NO: 350632 - DNA, 20 bp, Artificial
  CRISPR gRNA sequence
gaactctgccctcgccaggg

SEQ ID NO: 350633 - DNA, 20 bp, Artificial
  CRISPR gRNA sequence
tgccctcgccagggacccca

SEQ ID NO: 350634 - DNA, 20 bp, Artificial
  CRISPR gRNA sequence
ccctcgccagggaccccaca

SEQ ID NO: 350635 - DNA, 20 bp, Artificial
  CRISPR gRNA sequence
gccagggaccccacacccca

SEQ ID NO: 350636 - DNA, 20 bp, Artificial
  CRISPR gRNA sequence
ggagcattgagcccactggg

SEQ ID NO: 350637 - DNA, 20 bp, Artificial
  CRISPR gRNA sequence
agcccactgggcagacaacc

SEQ ID NO: 350638 - DNA, 20 bp, Artificial
  CRISPR gRNA sequence
ggcagacaacctgccggccc

SEQ ID NO: 350639 - DNA, 20 bp, Artificial
  CRISPR gRNA sequence
ccggcccccctgctggccta

SEQ ID NO: 350640 - DNA, 20 bp, Artificial
  CRISPR gRNA sequence
ctggcctaggttggacctgc

SEQ ID NO: 350641 - DNA, 20 bp, Artificial
  CRISPR gRNA sequence
gcctaggttggacctgctga

SEQ ID NO: 350642 - DNA, 20 bp, Artificial
  CRISPR gRNA sequence
ggttggacctgctgacccct

SEQ ID NO: 350643 - DNA, 20 bp, Artificial
  CRISPR gRNA sequence
gacctgctgacccctgaaga

SEQ ID NO: 350644 - DNA, 20 bp, Artificial
  CRISPR gRNA sequence
ctgacccctgaagagccagc

SEQ ID NO: 350645 - DNA, 20 bp, Artificial
  CRISPR gRNA sequence
acccctgaagagccagcagg

SEQ ID NO: 350646 - DNA, 20 bp, Artificial
  CRISPR gRNA sequence
aagagccagcaggggcagcc

SEQ ID NO: 350647 - DNA, 20 bp, Artificial
  CRISPR gRNA sequence
acaagccagacagtgggtga

SEQ ID NO: 350648 - DNA, 20 bp, Artificial
  CRISPR gRNA sequence
atcagggccacatcggggag

SEQ ID NO: 350649 - DNA, 20 bp, Artificial
  CRISPR gRNA sequence
tgccgtggcctcgttcctgg

SEQ ID NO: 350650 - DNA, 20 bp, Artificial
  CRISPR gRNA sequence
ccgtggcctcgttcctgggc

SEQ ID NO: 350651 - DNA, 20 bp, Artificial
  CRISPR gRNA sequence
gttcctgggctggctgatgg

SEQ ID NO: 350652 - DNA, 20 bp, Artificial
  CRISPR gRNA sequence
ctgggctggctgatgggcag

SEQ ID NO: 350653 - DNA, 20 bp, Artificial
  CRISPR gRNA sequence
ggctggctgatgggcagtcg

SEQ ID NO: 350654 - DNA, 20 bp, Artificial
  CRISPR gRNA sequence
gctgatgggcagtcgggggc

SEQ ID NO: 350655 - DNA, 20 bp, Artificial
  CRISPR gRNA sequence
atgggcagtcgggggcccct

SEQ ID NO: 350656 - DNA, 20 bp, Artificial
  CRISPR gRNA sequence
atggggatagtggctggaca

SEQ ID NO: 350657 - DNA, 20 bp, Artificial
  CRISPR gRNA sequence
gacaggcaggagtgccacat

SEQ ID NO: 350658 - DNA, 20 bp, Artificial
  CRISPR gRNA sequence
ggtccagccccctgctgcac

SEQ ID NO: 350659 - DNA, 20 bp, Artificial
  CRISPR gRNA sequence
ctgcacactgatcttatcac

SEQ ID NO: 350660 - DNA, 20 bp, Artificial
  CRISPR gRNA sequence
cacactgatcttatcacctg

SEQ ID NO: 350661 - DNA, 20 bp, Artificial
  CRISPR gRNA sequence
atcttatcacctgtcaccaa

SEQ ID NO: 350662 - DNA, 20 bp, Artificial
  CRISPR gRNA sequence
atcacctgtcaccaaggtca

SEQ ID NO: 350663 - DNA, 20 bp, Artificial
  CRISPR gRNA sequence
tcacctgtcaccaaggtcag

SEQ ID NO: 350664 - DNA, 20 bp, Artificial
  CRISPR gRNA sequence
tcaccaaggtcagggctgcc

SEQ ID NO: 350665 - DNA, 20 bp, Artificial
  CRISPR gRNA sequence
ccggggagttgggtcacctg

SEQ ID NO: 350666 - DNA, 20 bp, Artificial
  CRISPR gRNA sequence
ggtcacctgctcgagggccc

SEQ ID NO: 350667 - DNA, 20 bp, Artificial
  CRISPR gRNA sequence
ctcgagggccccgcccagag

SEQ ID NO: 350668 - DNA, 20 bp, Artificial
  CRISPR gRNA sequence
gagggccccgcccagagacg

SEQ ID NO: 350669 - DNA, 20 bp, Artificial
  CRISPR gRNA sequence
accagctgcccgtggacgga

SEQ ID NO: 350670 - DNA, 20 bp, Artificial
  CRISPR gRNA sequence
cccgtggacggagtggtgag

SEQ ID NO: 350671 - DNA, 20 bp, Artificial
  CRISPR gRNA sequence
ctgggtagggctgtggctct

SEQ ID NO: 350672 - DNA, 20 bp, Artificial
  CRISPR gRNA sequence
ggtagggctgtggctctgct

SEQ ID NO: 350673 - DNA, 20 bp, Artificial
  CRISPR gRNA sequence
tggctctgctgctcacccca

SEQ ID NO: 350674 - DNA, 20 bp, Artificial
  CRISPR gRNA sequence
tgctgctcaccccactgtgg

SEQ ID NO: 350675 - DNA, 20 bp, Artificial
  CRISPR gRNA sequence
ctgctcaccccactgtggtg

SEQ ID NO: 350676 - DNA, 20 bp, Artificial
  CRISPR gRNA sequence
ctcaccccactgtggtgagc

SEQ ID NO: 350677 - DNA, 20 bp, Artificial
  CRISPR gRNA sequence
accccactgtggtgagccca

SEQ ID NO: 350678 - DNA, 20 bp, Artificial
  CRISPR gRNA sequence
tggtgagcccagtgctgggg

SEQ ID NO: 350679 - DNA, 20 bp, Artificial
  CRISPR gRNA sequence
ggggtctgggttgacccgag

SEQ ID NO: 350680 - DNA, 20 bp, Artificial
  CRISPR gRNA sequence
ggttgacccgagagccccag

SEQ ID NO: 350681 - DNA, 20 bp, Artificial
  CRISPR gRNA sequence
acccgagagccccaggcagc

SEQ ID NO: 350682 - DNA, 20 bp, Artificial
  CRISPR gRNA sequence
gacgccggagccagcaacgg

SEQ ID NO: 350683 - DNA, 20 bp, Artificial
  CRISPR gRNA sequence
tgggaggccctggggtcaga

SEQ ID NO: 350684 - DNA, 20 bp, Artificial
  CRISPR gRNA sequence
gggtcagaactgggatctgc

SEQ ID NO: 350685 - DNA, 20 bp, Artificial
  CRISPR gRNA sequence
ggatctgcgagcagacggag

SEQ ID NO: 350686 - DNA, 20 bp, Artificial
  CRISPR gRNA sequence
cgagcagacggagaggaggc

SEQ ID NO: 350687 - DNA, 20 bp, Artificial
  CRISPR gRNA sequence
gggggctcaccagcctcaag

SEQ ID NO: 350688 - DNA, 20 bp, Artificial
  CRISPR gRNA sequence
accagcctcaagacgtcggt

SEQ ID NO: 350689 - DNA, 20 bp, Artificial
  CRISPR gRNA sequence
aagacgtcggttttgggggt

SEQ ID NO: 350690 - DNA, 20 bp, Artificial
  CRISPR gRNA sequence
tgggggtggatctccaggga

SEQ ID NO: 350691 - DNA, 20 bp, Artificial
  CRISPR gRNA sequence
gggggtggatctccagggag

SEQ ID NO: 350692 - DNA, 20 bp, Artificial
  CRISPR gRNA sequence
ggggtggatctccagggagg

SEQ ID NO: 350693 - DNA, 20 bp, Artificial
  CRISPR gRNA sequence
cagggaggaggcccccagtc

SEQ ID NO: 350694 - DNA, 20 bp, Artificial
  CRISPR gRNA sequence
caggaggctcatggcctcag

SEQ ID NO: 350695 - DNA, 20 bp, Artificial
  CRISPR gRNA sequence
atggcctcaggctcagaccg

SEQ ID NO: 350696 - DNA, 20 bp, Artificial
  CRISPR gRNA sequence
aggctcagaccggcagctcg

SEQ ID NO: 350697 - DNA, 20 bp, Artificial
  CRISPR gRNA sequence
agaccggcagctcgggaacc

SEQ ID NO: 350698 - DNA, 20 bp, Artificial
  CRISPR gRNA sequence
gggaacccagctagcaggat

SEQ ID NO: 350699 - DNA, 20 bp, Artificial
  CRISPR gRNA sequence
gcaggatgaactccagcaga

SEQ ID NO: 350700 - DNA, 20 bp, Artificial
  CRISPR gRNA sequence
cagcagaggaactcagcgcc

SEQ ID NO: 350701 - DNA, 20 bp, Artificial
  CRISPR gRNA sequence
agcgccattgctgcggctgt

SEQ ID NO: 350702 - DNA, 20 bp, Artificial
  CRISPR gRNA sequence
ctgcggctgtgggccagaag

SEQ ID NO: 350703 - DNA, 20 bp, Artificial
  CRISPR gRNA sequence
cggctgtgggccagaagaga

SEQ ID NO: 350704 - DNA, 20 bp, Artificial
  CRISPR gRNA sequence
tgggccagaagagaaagaga

SEQ ID NO: 350705 - DNA, 20 bp, Artificial
  CRISPR gRNA sequence
ggtgtgacaagctgtgcctc

SEQ ID NO: 350706 - DNA, 20 bp, Artificial
  CRISPR gRNA sequence
tgcctcagaacccgagcagc

SEQ ID NO: 350707 - DNA, 20 bp, Artificial
  CRISPR gRNA sequence
agaacccgagcagcaggaga

SEQ ID NO: 350708 - DNA, 20 bp, Artificial
  CRISPR gRNA sequence
gcagcagagaggggctcagg

SEQ ID NO: 350709 - DNA, 20 bp, Artificial
  CRISPR gRNA sequence
aggcctgctgggtggagcgg

SEQ ID NO: 350710 - DNA, 20 bp, Artificial
  CRISPR gRNA sequence
ctgggtggagcggcgctggg

SEQ ID NO: 350711 - DNA, 20 bp, Artificial
  CRISPR gRNA sequence
ggtggagcggcgctggggga

SEQ ID NO: 350712 - DNA, 20 bp, Artificial
  CRISPR gRNA sequence
ggggacacaggtgggccctg

SEQ ID NO: 350713 - DNA, 20 bp, Artificial
  CRISPR gRNA sequence
cgggaggcaggagctgtcca

SEQ ID NO: 350714 - DNA, 20 bp, Artificial
  CRISPR gRNA sequence
tccaggcaaagccgagggga

SEQ ID NO: 350715 - DNA, 20 bp, Artificial
  CRISPR gRNA sequence
tccccctgcaccattccagt

SEQ ID NO: 350716 - DNA, 20 bp, Artificial
  CRISPR gRNA sequence
cccctgcaccattccagtcc

SEQ ID NO: 350717 - DNA, 20 bp, Artificial
  CRISPR gRNA sequence
caccattccagtccactccg

SEQ ID NO: 350718 - DNA, 20 bp, Artificial
  CRISPR gRNA sequence
cagtccactccgggtttcct

SEQ ID NO: 350719 - DNA, 20 bp, Artificial
  CRISPR gRNA sequence
cgggtttcctgtagaagggg

SEQ ID NO: 350720 - DNA, 20 bp, Artificial
  CRISPR gRNA sequence
cctgtagaagggggagcccc

SEQ ID NO: 350721 - DNA, 20 bp, Artificial
  CRISPR gRNA sequence
ctgtagaagggggagccccc

SEQ ID NO: 350722 - DNA, 20 bp, Artificial
  CRISPR gRNA sequence
tagaagggggagccccccaa

SEQ ID NO: 350723 - DNA, 20 bp, Artificial
  CRISPR gRNA sequence
cccttcccatctctgtgtga

SEQ ID NO: 350724 - DNA, 20 bp, Artificial
  CRISPR gRNA sequence
ttcccatctctgtgtgacag

SEQ ID NO: 350725 - DNA, 20 bp, Artificial
  CRISPR gRNA sequence
tgtgacagtggcacctgcac

SEQ ID NO: 350726 - DNA, 20 bp, Artificial
  CRISPR gRNA sequence
cctgcaccagactgcatgtt

SEQ ID NO: 350727 - DNA, 20 bp, Artificial
  CRISPR gRNA sequence
ctgcaccagactgcatgttg

SEQ ID NO: 350728 - DNA, 20 bp, Artificial
  CRISPR gRNA sequence
tctgaaattatgaaataaaa

SEQ ID NO: 350729 - DNA, 20 bp, Artificial
  CRISPR gRNA sequence
gaaattatgaaataaaacag

SEQ ID NO: 350730 - DNA, 20 bp, Artificial
  CRISPR gRNA sequence
ttatgaaataaaacagaagt

SEQ ID NO: 350731 - DNA, 20 bp, Artificial
  CRISPR gRNA sequence
atgaaataaaacagaagtaa

SEQ ID NO: 350732 - DNA, 20 bp, Artificial
  CRISPR gRNA sequence
tgaaataaaacagaagtaag

SEQ ID NO: 350733 - DNA, 20 bp, Artificial
  CRISPR gRNA sequence
aacagaagtaagaggtctat

SEQ ID NO: 350734 - DNA, 20 bp, Artificial
  CRISPR gRNA sequence
tctattagctcatcaaaatg

SEQ ID NO: 350735 - DNA, 20 bp, Artificial
  CRISPR gRNA sequence
tcatcaaaatgcagttatct

SEQ ID NO: 350736 - DNA, 20 bp, Artificial
  CRISPR gRNA sequence
aaaatgcagttatctaagtt

SEQ ID NO: 350737 - DNA, 20 bp, Artificial
  CRISPR gRNA sequence
agctgtgaactgccaaattt

SEQ ID NO: 350738 - DNA, 20 bp, Artificial
  CRISPR gRNA sequence
gctgtgaactgccaaatttg

SEQ ID NO: 350739 - DNA, 20 bp, Artificial
  CRISPR gRNA sequence
tgtgaactgccaaatttgag

SEQ ID NO: 350740 - DNA, 20 bp, Artificial
  CRISPR gRNA sequence
acatcttttctttgcaatcc

SEQ ID NO: 350741 - DNA, 20 bp, Artificial
  CRISPR gRNA sequence
tcttttctttgcaatccaag

SEQ ID NO: 350742 - DNA, 20 bp, Artificial
  CRISPR gRNA sequence
tgcaatccaagaagacttac

SEQ ID NO: 350743 - DNA, 20 bp, Artificial
  CRISPR gRNA sequence
caatccaagaagacttaccg

SEQ ID NO: 350744 - DNA, 20 bp, Artificial
  CRISPR gRNA sequence
atccaagaagacttaccgga

SEQ ID NO: 350745 - DNA, 20 bp, Artificial
  CRISPR gRNA sequence
acttaccggagagaactgct

SEQ ID NO: 350746 - DNA, 20 bp, Artificial
  CRISPR gRNA sequence
ttaccggagagaactgctca

SEQ ID NO: 350747 - DNA, 20 bp, Artificial
  CRISPR gRNA sequence
ctcagagaatctgcaacatc

SEQ ID NO: 350748 - DNA, 20 bp, Artificial
  CRISPR gRNA sequence
aatctgcaacatccggttcc

SEQ ID NO: 350749 - DNA, 20 bp, Artificial
  CRISPR gRNA sequence
tctgcaacatccggttcctg

SEQ ID NO: 350750 - DNA, 20 bp, Artificial
  CRISPR gRNA sequence
caacatccggttcctggaga

SEQ ID NO: 350751 - DNA, 20 bp, Artificial
  CRISPR gRNA sequence
tccggttcctggagacagct

SEQ ID NO: 350752 - DNA, 20 bp, Artificial
  CRISPR gRNA sequence
ccggttcctggagacagcta

SEQ ID NO: 350753 - DNA, 20 bp, Artificial
  CRISPR gRNA sequence
ttcctggagacagctaagga

SEQ ID NO: 350754 - DNA, 20 bp, Artificial
  CRISPR gRNA sequence
ctggagacagctaaggaaag

SEQ ID NO: 350755 - DNA, 20 bp, Artificial
  CRISPR gRNA sequence
agacagctaaggaaagaagc

SEQ ID NO: 350756 - DNA, 20 bp, Artificial
  CRISPR gRNA sequence
gacagctaaggaaagaagct

SEQ ID NO: 350757 - DNA, 20 bp, Artificial
  CRISPR gRNA sequence
acagctaaggaaagaagctg

SEQ ID NO: 350758 - DNA, 20 bp, Artificial
  CRISPR gRNA sequence
ggggcgcatgtttctgccca

SEQ ID NO: 350759 - DNA, 20 bp, Artificial
  CRISPR gRNA sequence
cgcatgtttctgcccaaagc

SEQ ID NO: 350760 - DNA, 20 bp, Artificial
  CRISPR gRNA sequence
gcatgtttctgcccaaagcc

SEQ ID NO: 350761 - DNA, 20 bp, Artificial
  CRISPR gRNA sequence
ttctgcccaaagccgggttt

SEQ ID NO: 350762 - DNA, 20 bp, Artificial
  CRISPR gRNA sequence
cccaaagccgggttttggcc

SEQ ID NO: 350763 - DNA, 20 bp, Artificial
  CRISPR gRNA sequence
ccaaagccgggttttggccg

SEQ ID NO: 350764 - DNA, 20 bp, Artificial
  CRISPR gRNA sequence
tgactacacaccccctttcc

SEQ ID NO: 350765 - DNA, 20 bp, Artificial
  CRISPR gRNA sequence
accccctttcctggctccca

SEQ ID NO: 350766 - DNA, 20 bp, Artificial
  CRISPR gRNA sequence
ccccctttcctggctcccat

SEQ ID NO: 350767 - DNA, 20 bp, Artificial
  CRISPR gRNA sequence
tttcctggctcccataggct

SEQ ID NO: 350768 - DNA, 20 bp, Artificial
  CRISPR gRNA sequence
gctcccataggctaagtgcc

SEQ ID NO: 350769 - DNA, 20 bp, Artificial
  CRISPR gRNA sequence
ggctaagtgcctggcttctt

SEQ ID NO: 350770 - DNA, 20 bp, Artificial
  CRISPR gRNA sequence
taagtgcctggcttcttgag

SEQ ID NO: 350771 - DNA, 20 bp, Artificial
  CRISPR gRNA sequence
tcttgagaagcctgcttctt

SEQ ID NO: 350772 - DNA, 20 bp, Artificial
  CRISPR gRNA sequence
cctgcttcttgagaacaaaa

SEQ ID NO: 350773 - DNA, 20 bp, Artificial
  CRISPR gRNA sequence
gagaacaaaaaagtgattta

SEQ ID NO: 350774 - DNA, 20 bp, Artificial
  CRISPR gRNA sequence
aaaagtgatttaaagcctca

SEQ ID NO: 350775 - DNA, 20 bp, Artificial
  CRISPR gRNA sequence
aaagtgatttaaagcctcat

SEQ ID NO: 350776 - DNA, 20 bp, Artificial
  CRISPR gRNA sequence
agtgatttaaagcctcatgg

SEQ ID NO: 350777 - DNA, 20 bp, Artificial
  CRISPR gRNA sequence
tttaaagcctcatgggagat

SEQ ID NO: 350778 - DNA, 20 bp, Artificial
  CRISPR gRNA sequence
atgggagatgagcaatcctc

SEQ ID NO: 350779 - DNA, 20 bp, Artificial
  CRISPR gRNA sequence
atgagcaatcctcaagacac

SEQ ID NO: 350780 - DNA, 20 bp, Artificial
  CRISPR gRNA sequence
agcaatcctcaagacacaag

SEQ ID NO: 350781 - DNA, 20 bp, Artificial
  CRISPR gRNA sequence
cctcaagacacaagcagaaa

SEQ ID NO: 350782 - DNA, 20 bp, Artificial
  CRISPR gRNA sequence
gacacaagcagaaaaagtcc

SEQ ID NO: 350783 - DNA, 20 bp, Artificial
  CRISPR gRNA sequence
cagaaaaagtcccagtgata

SEQ ID NO: 350784 - DNA, 20 bp, Artificial
  CRISPR gRNA sequence
agaaaaagtcccagtgatac

SEQ ID NO: 350785 - DNA, 20 bp, Artificial
  CRISPR gRNA sequence
aaaagtcccagtgatacagg

SEQ ID NO: 350786 - DNA, 20 bp, Artificial
  CRISPR gRNA sequence
agtcccagtgatacaggaag

SEQ ID NO: 350787 - DNA, 20 bp, Artificial
  CRISPR gRNA sequence
gtcccagtgatacaggaagc

SEQ ID NO: 350788 - DNA, 20 bp, Artificial
  CRISPR gRNA sequence
agtgatacaggaagcgggtt

SEQ ID NO: 350789 - DNA, 20 bp, Artificial
  CRISPR gRNA sequence
gtgatacaggaagcgggttc

SEQ ID NO: 350790 - DNA, 20 bp, Artificial
  CRISPR gRNA sequence
aagcgggttcaggaacctgc

SEQ ID NO: 350791 - DNA, 20 bp, Artificial
  CRISPR gRNA sequence
ctggttcctgatacataaat

SEQ ID NO: 350792 - DNA, 20 bp, Artificial
  CRISPR gRNA sequence
ttcctgatacataaatcaga

SEQ ID NO: 350793 - DNA, 20 bp, Artificial
  CRISPR gRNA sequence
agcctctgctgcatgacacg

SEQ ID NO: 350794 - DNA, 20 bp, Artificial
  CRISPR gRNA sequence
acacgaagcttgcttctgcc

SEQ ID NO: 350795 - DNA, 20 bp, Artificial
  CRISPR gRNA sequence
tgcttctgcctggcatctgt

SEQ ID NO: 350796 - DNA, 20 bp, Artificial
  CRISPR gRNA sequence
ttctgcctggcatctgtgag

SEQ ID NO: 350797 - DNA, 20 bp, Artificial
  CRISPR gRNA sequence
tggcatctgtgagcagctgc

SEQ ID NO: 350798 - DNA, 20 bp, Artificial
  CRISPR gRNA sequence
ggcatctgtgagcagctgcc

SEQ ID NO: 350799 - DNA, 20 bp, Artificial
  CRISPR gRNA sequence
tgtgagcagctgccaggctc

SEQ ID NO: 350800 - DNA, 20 bp, Artificial
  CRISPR gRNA sequence
agcagctgccaggctccggc

SEQ ID NO: 350801 - DNA, 20 bp, Artificial
  CRISPR gRNA sequence
gcagctgccaggctccggcc

SEQ ID NO: 350802 - DNA, 20 bp, Artificial
  CRISPR gRNA sequence
gatcccttccttctcctcat

SEQ ID NO: 350803 - DNA, 20 bp, Artificial
  CRISPR gRNA sequence
tccttctcctcattggctga

SEQ ID NO: 350804 - DNA, 20 bp, Artificial
  CRISPR gRNA sequence
ctcattggctgatggatccc

SEQ ID NO: 350805 - DNA, 20 bp, Artificial
  CRISPR gRNA sequence
tcattggctgatggatccca

SEQ ID NO: 350806 - DNA, 20 bp, Artificial
  CRISPR gRNA sequence
cattggctgatggatcccaa

SEQ ID NO: 350807 - DNA, 20 bp, Artificial
  CRISPR gRNA sequence
attggctgatggatcccaag

SEQ ID NO: 350808 - DNA, 20 bp, Artificial
  CRISPR gRNA sequence
cttcgtgctgtttctctccc

SEQ ID NO: 350809 - DNA, 20 bp, Artificial
  CRISPR gRNA sequence
ctgtttctctccctggcttt

SEQ ID NO: 350810 - DNA, 20 bp, Artificial
  CRISPR gRNA sequence
tgtttctctccctggctttt

SEQ ID NO: 350811 - DNA, 20 bp, Artificial
  CRISPR gRNA sequence
gtttctctccctggcttttg

SEQ ID NO: 350812 - DNA, 20 bp, Artificial
  CRISPR gRNA sequence
ctctccctggcttttggggc

SEQ ID NO: 350813 - DNA, 20 bp, Artificial
  CRISPR gRNA sequence
ctggcttttggggcaagcta

SEQ ID NO: 350814 - DNA, 20 bp, Artificial
  CRISPR gRNA sequence
ttttggggcaagctacggaa

SEQ ID NO: 350815 - DNA, 20 bp, Artificial
  CRISPR gRNA sequence
tttggggcaagctacggaac

SEQ ID NO: 350816 - DNA, 20 bp, Artificial
  CRISPR gRNA sequence
ggggcaagctacggaacagg

SEQ ID NO: 350817 - DNA, 20 bp, Artificial
  CRISPR gRNA sequence
gggcaagctacggaacaggt

SEQ ID NO: 350818 - DNA, 20 bp, Artificial
  CRISPR gRNA sequence
ggcgcatgatgaactgccca

SEQ ID NO: 350819 - DNA, 20 bp, Artificial
  CRISPR gRNA sequence
tgaactgcccaaagattctc

SEQ ID NO: 350820 - DNA, 20 bp, Artificial
  CRISPR gRNA sequence
actgcccaaagattctccgg

SEQ ID NO: 350821 - DNA, 20 bp, Artificial
  CRISPR gRNA sequence
cccaaagattctccggcagt

SEQ ID NO: 350822 - DNA, 20 bp, Artificial
  CRISPR gRNA sequence
ccaaagattctccggcagtt

SEQ ID NO: 350823 - DNA, 20 bp, Artificial
  CRISPR gRNA sequence
aagattctccggcagttggg

SEQ ID NO: 350824 - DNA, 20 bp, Artificial
  CRISPR gRNA sequence
tctccggcagttgggaagca

SEQ ID NO: 350825 - DNA, 20 bp, Artificial
  CRISPR gRNA sequence
ctgctgcccctgacatatga

SEQ ID NO: 350826 - DNA, 20 bp, Artificial
  CRISPR gRNA sequence
tgctgcccctgacatatgaa

SEQ ID NO: 350827 - DNA, 20 bp, Artificial
  CRISPR gRNA sequence
tgacatatgaaaggataaat

SEQ ID NO: 350828 - DNA, 20 bp, Artificial
  CRISPR gRNA sequence
acatatgaaaggataaataa

SEQ ID NO: 350829 - DNA, 20 bp, Artificial
  CRISPR gRNA sequence
ataaataagagcatgaacaa

SEQ ID NO: 350830 - DNA, 20 bp, Artificial
  CRISPR gRNA sequence
catccacattgtcgtcacaa

SEQ ID NO: 350831 - DNA, 20 bp, Artificial
  CRISPR gRNA sequence
cgtcacaatggcaaaatcac

SEQ ID NO: 350832 - DNA, 20 bp, Artificial
  CRISPR gRNA sequence
tcacaatggcaaaatcactg

SEQ ID NO: 350833 - DNA, 20 bp, Artificial
  CRISPR gRNA sequence
atggcaaaatcactggagaa

SEQ ID NO: 350834 - DNA, 20 bp, Artificial
  CRISPR gRNA sequence
aatcactggagaacagtgtc

SEQ ID NO: 350835 - DNA, 20 bp, Artificial
  CRISPR gRNA sequence
gaacagtgtcgagaacaaaa

SEQ ID NO: 350836 - DNA, 20 bp, Artificial
  CRISPR gRNA sequence
agtgtctcttgatccatccg

SEQ ID NO: 350837 - DNA, 20 bp, Artificial
  CRISPR gRNA sequence
gtctcttgatccatccgaag

SEQ ID NO: 350838 - DNA, 20 bp, Artificial
  CRISPR gRNA sequence
tctcttgatccatccgaagc

SEQ ID NO: 350839 - DNA, 20 bp, Artificial
  CRISPR gRNA sequence
agcaggccctccacgttatc

SEQ ID NO: 350840 - DNA, 20 bp, Artificial
  CRISPR gRNA sequence
gcaggccctccacgttatct

SEQ ID NO: 350841 - DNA, 20 bp, Artificial
  CRISPR gRNA sequence
aggccctccacgttatctag

SEQ ID NO: 350842 - DNA, 20 bp, Artificial
  CRISPR gRNA sequence
gttatctaggagatcgctac

SEQ ID NO: 350843 - DNA, 20 bp, Artificial
  CRISPR gRNA sequence
agatcgctacaagttttatc

SEQ ID NO: 350844 - DNA, 20 bp, Artificial
  CRISPR gRNA sequence
atcgctacaagttttatctg

SEQ ID NO: 350845 - DNA, 20 bp, Artificial
  CRISPR gRNA sequence
ttatctggagaatctcaccc

SEQ ID NO: 350846 - DNA, 20 bp, Artificial
  CRISPR gRNA sequence
tatctggagaatctcaccct

SEQ ID NO: 350847 - DNA, 20 bp, Artificial
  CRISPR gRNA sequence
atctggagaatctcaccctg

SEQ ID NO: 350848 - DNA, 20 bp, Artificial
  CRISPR gRNA sequence
agaatctcaccctggggata

SEQ ID NO: 350849 - DNA, 20 bp, Artificial
  CRISPR gRNA sequence
gaatctcaccctggggatac

SEQ ID NO: 350850 - DNA, 20 bp, Artificial
  CRISPR gRNA sequence
ctcaccctggggatacggga

SEQ ID NO: 350851 - DNA, 20 bp, Artificial
  CRISPR gRNA sequence
accctggggatacgggaaag

SEQ ID NO: 350852 - DNA, 20 bp, Artificial
  CRISPR gRNA sequence
ccctggggatacgggaaagc

SEQ ID NO: 350853 - DNA, 20 bp, Artificial
  CRISPR gRNA sequence
tggggatacgggaaagcagg

SEQ ID NO: 350854 - DNA, 20 bp, Artificial
  CRISPR gRNA sequence
ggggatacgggaaagcagga

SEQ ID NO: 350855 - DNA, 20 bp, Artificial
  CRISPR gRNA sequence
ggatacgggaaagcaggaag

SEQ ID NO: 350856 - DNA, 20 bp, Artificial
  CRISPR gRNA sequence
gatacgggaaagcaggaagg

SEQ ID NO: 350857 - DNA, 20 bp, Artificial
  CRISPR gRNA sequence
gggaaagcaggaaggaggat

SEQ ID NO: 350858 - DNA, 20 bp, Artificial
  CRISPR gRNA sequence
ggaaagcaggaaggaggatg

SEQ ID NO: 350859 - DNA, 20 bp, Artificial
  CRISPR gRNA sequence
gaaagcaggaaggaggatga

SEQ ID NO: 350860 - DNA, 20 bp, Artificial
  CRISPR gRNA sequence
gcaggaaggaggatgaggga

SEQ ID NO: 350861 - DNA, 20 bp, Artificial
  CRISPR gRNA sequence
gggatggtaccttatgaccc

SEQ ID NO: 350862 - DNA, 20 bp, Artificial
  CRISPR gRNA sequence
gatggtaccttatgaccctg

SEQ ID NO: 350863 - DNA, 20 bp, Artificial
  CRISPR gRNA sequence
gaccctggagaaaaatgttt

SEQ ID NO: 350864 - DNA, 20 bp, Artificial
  CRISPR gRNA sequence
tggagaaaaatgtttcagtt

SEQ ID NO: 350865 - DNA, 20 bp, Artificial
  CRISPR gRNA sequence
cagttcagcgcttttgcctg

SEQ ID NO: 350866 - DNA, 20 bp, Artificial
  CRISPR gRNA sequence
cagcgcttttgcctgcagtt

SEQ ID NO: 350867 - DNA, 20 bp, Artificial
  CRISPR gRNA sequence
agcgcttttgcctgcagttg

SEQ ID NO: 350868 - DNA, 20 bp, Artificial
  CRISPR gRNA sequence
tgcctgcagttgaggcttta

SEQ ID NO: 350869 - DNA, 20 bp, Artificial
  CRISPR gRNA sequence
aggctttatggtctccactc

SEQ ID NO: 350870 - DNA, 20 bp, Artificial
  CRISPR gRNA sequence
ggtctccactccagaaatta

SEQ ID NO: 350871 - DNA, 20 bp, Artificial
  CRISPR gRNA sequence
cagaaattaaagttttaaac

SEQ ID NO: 350872 - DNA, 20 bp, Artificial
  CRISPR gRNA sequence
ttaaagttttaaacaagacc

SEQ ID NO: 350873 - DNA, 20 bp, Artificial
  CRISPR gRNA sequence
taaagttttaaacaagaccc

SEQ ID NO: 350874 - DNA, 20 bp, Artificial
  CRISPR gRNA sequence
aagttttaaacaagacccag

SEQ ID NO: 350875 - DNA, 20 bp, Artificial
  CRISPR gRNA sequence
ttaaacaagacccaggagaa

SEQ ID NO: 350876 - DNA, 20 bp, Artificial
  CRISPR gRNA sequence
taaacaagacccaggagaac

SEQ ID NO: 350877 - DNA, 20 bp, Artificial
  CRISPR gRNA sequence
cgggacctgcaccttgatac

SEQ ID NO: 350878 - DNA, 20 bp, Artificial
  CRISPR gRNA sequence
gggacctgcaccttgatact

SEQ ID NO: 350879 - DNA, 20 bp, Artificial
  CRISPR gRNA sequence
caccttgatactgggctgca

SEQ ID NO: 350880 - DNA, 20 bp, Artificial
  CRISPR gRNA sequence
cttgatactgggctgcacag

SEQ ID NO: 350881 - DNA, 20 bp, Artificial
  CRISPR gRNA sequence
tgatactgggctgcacagtg

SEQ ID NO: 350882 - DNA, 20 bp, Artificial
  CRISPR gRNA sequence
tactgggctgcacagtggag

SEQ ID NO: 350883 - DNA, 20 bp, Artificial
  CRISPR gRNA sequence
actgggctgcacagtggaga

SEQ ID NO: 350884 - DNA, 20 bp, Artificial
  CRISPR gRNA sequence
ctgggctgcacagtggagaa

SEQ ID NO: 350885 - DNA, 20 bp, Artificial
  CRISPR gRNA sequence
tgggctgcacagtggagaag

SEQ ID NO: 350886 - DNA, 20 bp, Artificial
  CRISPR gRNA sequence
gggctgcacagtggagaagg

SEQ ID NO: 350887 - DNA, 20 bp, Artificial
  CRISPR gRNA sequence
agtggagaagggggaccatg

SEQ ID NO: 350888 - DNA, 20 bp, Artificial
  CRISPR gRNA sequence
aagggggaccatgtggctta

SEQ ID NO: 350889 - DNA, 20 bp, Artificial
  CRISPR gRNA sequence
gggaccatgtggcttacagc

SEQ ID NO: 350890 - DNA, 20 bp, Artificial
  CRISPR gRNA sequence
gaccatgtggcttacagctg

SEQ ID NO: 350891 - DNA, 20 bp, Artificial
  CRISPR gRNA sequence
tggcttacagctggagtgaa

SEQ ID NO: 350892 - DNA, 20 bp, Artificial
  CRISPR gRNA sequence
ggcttacagctggagtgaaa

SEQ ID NO: 350893 - DNA, 20 bp, Artificial
  CRISPR gRNA sequence
ttacagctggagtgaaaagg

SEQ ID NO: 350894 - DNA, 20 bp, Artificial
  CRISPR gRNA sequence
tacagctggagtgaaaaggc

SEQ ID NO: 350895 - DNA, 20 bp, Artificial
  CRISPR gRNA sequence
gggcacccacccactgaacc

SEQ ID NO: 350896 - DNA, 20 bp, Artificial
  CRISPR gRNA sequence
cacccactgaacccagccaa

SEQ ID NO: 350897 - DNA, 20 bp, Artificial
  CRISPR gRNA sequence
cacctcctgtccctcaccct

SEQ ID NO: 350898 - DNA, 20 bp, Artificial
  CRISPR gRNA sequence
tgtccctcaccctcggcccc

SEQ ID NO: 350899 - DNA, 20 bp, Artificial
  CRISPR gRNA sequence
aatatctacatctgcaccgt

SEQ ID NO: 350900 - DNA, 20 bp, Artificial
  CRISPR gRNA sequence
tgcaccgtgagcaaccctat

SEQ ID NO: 350901 - DNA, 20 bp, Artificial
  CRISPR gRNA sequence
accctatcagcaacaattcc

SEQ ID NO: 350902 - DNA, 20 bp, Artificial
  CRISPR gRNA sequence
agcaacaattcccagacctt

SEQ ID NO: 350903 - DNA, 20 bp, Artificial
  CRISPR gRNA sequence
attcccagaccttcagcccg

SEQ ID NO: 350904 - DNA, 20 bp, Artificial
  CRISPR gRNA sequence
cagaccttcagcccgtggcc

SEQ ID NO: 350905 - DNA, 20 bp, Artificial
  CRISPR gRNA sequence
ttcagcccgtggcccggatg

SEQ ID NO: 350906 - DNA, 20 bp, Artificial
  CRISPR gRNA sequence
tcagcccgtggcccggatgc

SEQ ID NO: 350907 - DNA, 20 bp, Artificial
  CRISPR gRNA sequence
cccgtggcccggatgcagga

SEQ ID NO: 350908 - DNA, 20 bp, Artificial
  CRISPR gRNA sequence
cggatgcaggacagacccct

SEQ ID NO: 350909 - DNA, 20 bp, Artificial
  CRISPR gRNA sequence
acccctcagaaacaaaacca

SEQ ID NO: 350910 - DNA, 20 bp, Artificial
  CRISPR gRNA sequence
cccctcagaaacaaaaccat

SEQ ID NO: 350911 - DNA, 20 bp, Artificial
  CRISPR gRNA sequence
ctcagaaacaaaaccatggg

SEQ ID NO: 350912 - DNA, 20 bp, Artificial
  CRISPR gRNA sequence
aaaccatgggcagtgtatgc

SEQ ID NO: 350913 - DNA, 20 bp, Artificial
  CRISPR gRNA sequence
aaccatgggcagtgtatgct

SEQ ID NO: 350914 - DNA, 20 bp, Artificial
  CRISPR gRNA sequence
ggcagtgtatgctgggctgt

SEQ ID NO: 350915 - DNA, 20 bp, Artificial
  CRISPR gRNA sequence
gcagtgtatgctgggctgtt

SEQ ID NO: 350916 - DNA, 20 bp, Artificial
  CRISPR gRNA sequence
cagtgtatgctgggctgtta

SEQ ID NO: 350917 - DNA, 20 bp, Artificial
  CRISPR gRNA sequence
agtgtatgctgggctgttag

SEQ ID NO: 350918 - DNA, 20 bp, Artificial
  CRISPR gRNA sequence
gtgtatgctgggctgttagg

SEQ ID NO: 350919 - DNA, 20 bp, Artificial
  CRISPR gRNA sequence
tgtcatcatgattctcatca

SEQ ID NO: 350920 - DNA, 20 bp, Artificial
  CRISPR gRNA sequence
catcatgattctcatcatgg

SEQ ID NO: 350921 - DNA, 20 bp, Artificial
  CRISPR gRNA sequence
tcatcatggtggtaatacta

SEQ ID NO: 350922 - DNA, 20 bp, Artificial
  CRISPR gRNA sequence
atggtggtaatactacagtt

SEQ ID NO: 350923 - DNA, 20 bp, Artificial
  CRISPR gRNA sequence
gtggtaatactacagttgag

SEQ ID NO: 350924 - DNA, 20 bp, Artificial
  CRISPR gRNA sequence
gtaatactacagttgagaag

SEQ ID NO: 350925 - DNA, 20 bp, Artificial
  CRISPR gRNA sequence
aatactacagttgagaagaa

SEQ ID NO: 350926 - DNA, 20 bp, Artificial
  CRISPR gRNA sequence
atactacagttgagaagaag

SEQ ID NO: 350927 - DNA, 20 bp, Artificial
  CRISPR gRNA sequence
gaggtaaaacgaaccattac

SEQ ID NO: 350928 - DNA, 20 bp, Artificial
  CRISPR gRNA sequence
aacgaaccattaccagacaa

SEQ ID NO: 350929 - DNA, 20 bp, Artificial
  CRISPR gRNA sequence
gaaccattaccagacaacag

SEQ ID NO: 350930 - DNA, 20 bp, Artificial
  CRISPR gRNA sequence
cagacaacagtggaaaaaaa

SEQ ID NO: 350931 - DNA, 20 bp, Artificial
  CRISPR gRNA sequence
aagccttacgatctatgccc

SEQ ID NO: 350932 - DNA, 20 bp, Artificial
  CRISPR gRNA sequence
ttacgatctatgcccaagtc

SEQ ID NO: 350933 - DNA, 20 bp, Artificial
  CRISPR gRNA sequence
ctatgcccaagtccagaaac

SEQ ID NO: 350934 - DNA, 20 bp, Artificial
  CRISPR gRNA sequence
tatgcccaagtccagaaacc

SEQ ID NO: 350935 - DNA, 20 bp, Artificial
  CRISPR gRNA sequence
tccagaaaccaggtcctctt

SEQ ID NO: 350936 - DNA, 20 bp, Artificial
  CRISPR gRNA sequence
agaaaccaggtcctcttcag

SEQ ID NO: 350937 - DNA, 20 bp, Artificial
  CRISPR gRNA sequence
gaagaaacttgactccttcc

SEQ ID NO: 350938 - DNA, 20 bp, Artificial
  CRISPR gRNA sequence
aacttgactccttcccagct

SEQ ID NO: 350939 - DNA, 20 bp, Artificial
  CRISPR gRNA sequence
acttgactccttcccagctc

SEQ ID NO: 350940 - DNA, 20 bp, Artificial
  CRISPR gRNA sequence
caccatatatgttgctgcca

SEQ ID NO: 350941 - DNA, 20 bp, Artificial
  CRISPR gRNA sequence
ccatatatgttgctgccaca

SEQ ID NO: 350942 - DNA, 20 bp, Artificial
  CRISPR gRNA sequence
tgctgccacagagcctgtcc

SEQ ID NO: 350943 - DNA, 20 bp, Artificial
  CRISPR gRNA sequence
ctgccacagagcctgtccca

SEQ ID NO: 350944 - DNA, 20 bp, Artificial
  CRISPR gRNA sequence
agcctgtcccagagtctgtc

SEQ ID NO: 350945 - DNA, 20 bp, Artificial
  CRISPR gRNA sequence
gcctgtcccagagtctgtcc

SEQ ID NO: 350946 - DNA, 20 bp, Artificial
  CRISPR gRNA sequence
ccaggaaacaaattccatca

SEQ ID NO: 350947 - DNA, 20 bp, Artificial
  CRISPR gRNA sequence
aattccatcacagtctatgc

SEQ ID NO: 350948 - DNA, 20 bp, Artificial
  CRISPR gRNA sequence
ctatgctagtgtgacacttc

SEQ ID NO: 350949 - DNA, 20 bp, Artificial
  CRISPR gRNA sequence
atgctagtgtgacacttcca

SEQ ID NO: 350950 - DNA, 20 bp, Artificial
  CRISPR gRNA sequence
gctagtgtgacacttccaga

SEQ ID NO: 350951 - DNA, 20 bp, Artificial
  CRISPR gRNA sequence
cacttccagagagctgacac

SEQ ID NO: 350952 - DNA, 20 bp, Artificial
  CRISPR gRNA sequence
cttccagagagctgacacca

SEQ ID NO: 350953 - DNA, 20 bp, Artificial
  CRISPR gRNA sequence
gctgacaccagagaccaaca

SEQ ID NO: 350954 - DNA, 20 bp, Artificial
  CRISPR gRNA sequence
ctgacaccagagaccaacaa

SEQ ID NO: 350955 - DNA, 20 bp, Artificial
  CRISPR gRNA sequence
tgacaccagagaccaacaaa

SEQ ID NO: 350956 - DNA, 20 bp, Artificial
  CRISPR gRNA sequence
accaacaaagggactttctg

SEQ ID NO: 350957 - DNA, 20 bp, Artificial
  CRISPR gRNA sequence
ccaacaaagggactttctga

SEQ ID NO: 350958 - DNA, 20 bp, Artificial
  CRISPR gRNA sequence
agggactttctgaaggaaaa

SEQ ID NO: 350959 - DNA, 20 bp, Artificial
  CRISPR gRNA sequence
accaaaatgaacactgaact

SEQ ID NO: 350960 - DNA, 20 bp, Artificial
  CRISPR gRNA sequence
atgaacactgaacttggcca

SEQ ID NO: 350961 - DNA, 20 bp, Artificial
  CRISPR gRNA sequence
tgaacactgaacttggccac

SEQ ID NO: 350962 - DNA, 20 bp, Artificial
  CRISPR gRNA sequence
tgaacttggccacaggcccc

SEQ ID NO: 350963 - DNA, 20 bp, Artificial
  CRISPR gRNA sequence
cacaggccccaagtttcctc

SEQ ID NO: 350964 - DNA, 20 bp, Artificial
  CRISPR gRNA sequence
aggccccaagtttcctctgg

SEQ ID NO: 350965 - DNA, 20 bp, Artificial
  CRISPR gRNA sequence
ctgcacgtctgtacccttct

SEQ ID NO: 350966 - DNA, 20 bp, Artificial
  CRISPR gRNA sequence
cccttctcagatcaactccc

SEQ ID NO: 350967 - DNA, 20 bp, Artificial
  CRISPR gRNA sequence
catacatctgtgaaatgaac

SEQ ID NO: 350968 - DNA, 20 bp, Artificial
  CRISPR gRNA sequence
atacatctgtgaaatgaaca

SEQ ID NO: 350969 - DNA, 20 bp, Artificial
  CRISPR gRNA sequence
catctgtgaaatgaacaagg

SEQ ID NO: 350970 - DNA, 20 bp, Artificial
  CRISPR gRNA sequence
tgtgaaatgaacaaggaagt

SEQ ID NO: 350971 - DNA, 20 bp, Artificial
  CRISPR gRNA sequence
gtgaaatgaacaaggaagtg

SEQ ID NO: 350972 - DNA, 20 bp, Artificial
  CRISPR gRNA sequence
acaaggaagtgaggcttccc

SEQ ID NO: 350973 - DNA, 20 bp, Artificial
  CRISPR gRNA sequence
agtgaggcttcccaagaatt

SEQ ID NO: 350974 - DNA, 20 bp, Artificial
  CRISPR gRNA sequence
caagaatttagcttgctgtg

SEQ ID NO: 350975 - DNA, 20 bp, Artificial
  CRISPR gRNA sequence
gaatttagcttgctgtgcag

SEQ ID NO: 350976 - DNA, 20 bp, Artificial
  CRISPR gRNA sequence
agcttgctgtgcagtggctg

SEQ ID NO: 350977 - DNA, 20 bp, Artificial
  CRISPR gRNA sequence
gcttgctgtgcagtggctgc

SEQ ID NO: 350978 - DNA, 20 bp, Artificial
  CRISPR gRNA sequence
ctgtgcagtggctgcaggcg

SEQ ID NO: 350979 - DNA, 20 bp, Artificial
  CRISPR gRNA sequence
cagtggctgcaggcgcagaa

SEQ ID NO: 350980 - DNA, 20 bp, Artificial
  CRISPR gRNA sequence
gtggctgcaggcgcagaaca

SEQ ID NO: 350981 - DNA, 20 bp, Artificial
  CRISPR gRNA sequence
aacagagcgttacttgataa

SEQ ID NO: 350982 - DNA, 20 bp, Artificial
  CRISPR gRNA sequence
agcgttccatctttgtgttg

SEQ ID NO: 350983 - DNA, 20 bp, Artificial
  CRISPR gRNA sequence
gttccatctttgtgttgtag

SEQ ID NO: 350984 - DNA, 20 bp, Artificial
  CRISPR gRNA sequence
ttgtgttgtagcagatgaaa

SEQ ID NO: 350985 - DNA, 20 bp, Artificial
  CRISPR gRNA sequence
gttgtagcagatgaaatgga

SEQ ID NO: 350986 - DNA, 20 bp, Artificial
  CRISPR gRNA sequence
gatgaaatggacagtaatgt

SEQ ID NO: 350987 - DNA, 20 bp, Artificial
  CRISPR gRNA sequence
aatggacagtaatgtgagtt

SEQ ID NO: 350988 - DNA, 20 bp, Artificial
  CRISPR gRNA sequence
agtaatgtgagttcagactt

SEQ ID NO: 350989 - DNA, 20 bp, Artificial
  CRISPR gRNA sequence
gtaatgtgagttcagacttt

SEQ ID NO: 350990 - DNA, 20 bp, Artificial
  CRISPR gRNA sequence
gactttgggcatcttgctct

SEQ ID NO: 350991 - DNA, 20 bp, Artificial
  CRISPR gRNA sequence
ttgggcatcttgctcttggc

SEQ ID NO: 350992 - DNA, 20 bp, Artificial
  CRISPR gRNA sequence
atcttgctcttggctggaac

SEQ ID NO: 350993 - DNA, 20 bp, Artificial
  CRISPR gRNA sequence
tggaactggataataaaaat

SEQ ID NO: 350994 - DNA, 20 bp, Artificial
  CRISPR gRNA sequence
gataataaaaatcagactga

SEQ ID NO: 350995 - DNA, 20 bp, Artificial
  CRISPR gRNA sequence
ataaaaatcagactgaaagc

SEQ ID NO: 350996 - DNA, 20 bp, Artificial
  CRISPR gRNA sequence
taaaaatcagactgaaagcc

SEQ ID NO: 350997 - DNA, 20 bp, Artificial
  CRISPR gRNA sequence
gactgaaagccaggacatct

SEQ ID NO: 350998 - DNA, 20 bp, Artificial
  CRISPR gRNA sequence
tgagtacctatctcacacac

SEQ ID NO: 350999 - DNA, 20 bp, Artificial
  CRISPR gRNA sequence
tatctcacacactggaccac

SEQ ID NO: 351000 - DNA, 20 bp, Artificial
  CRISPR gRNA sequence
acactggaccaccagtcaca

SEQ ID NO: 351001 - DNA, 20 bp, Artificial
  CRISPR gRNA sequence
ggaccaccagtcacaaagtc

SEQ ID NO: 351002 - DNA, 20 bp, Artificial
  CRISPR gRNA sequence
accagtcacaaagtctggaa

SEQ ID NO: 351003 - DNA, 20 bp, Artificial
  CRISPR gRNA sequence
gtctggaaaagtttacattt

SEQ ID NO: 351004 - DNA, 20 bp, Artificial
  CRISPR gRNA sequence
tggctatctttactttgttc

SEQ ID NO: 351005 - DNA, 20 bp, Artificial
  CRISPR gRNA sequence
ggctatctttactttgttct

SEQ ID NO: 351006 - DNA, 20 bp, Artificial
  CRISPR gRNA sequence
ctatctttactttgttctgg

SEQ ID NO: 351007 - DNA, 20 bp, Artificial
  CRISPR gRNA sequence
gagctgatcatgataacctg

SEQ ID NO: 351008 - DNA, 20 bp, Artificial
  CRISPR gRNA sequence
gataacctgcagacctgatc

SEQ ID NO: 351009 - DNA, 20 bp, Artificial
  CRISPR gRNA sequence
ctgatcaagcctctgtgcct

SEQ ID NO: 351010 - DNA, 20 bp, Artificial
  CRISPR gRNA sequence
ctgtgcctcagtttctctct

SEQ ID NO: 351011 - DNA, 20 bp, Artificial
  CRISPR gRNA sequence
tgtgcctcagtttctctctc

SEQ ID NO: 351012 - DNA, 20 bp, Artificial
  CRISPR gRNA sequence
tcagtttctctctcaggata

SEQ ID NO: 351013 - DNA, 20 bp, Artificial
  CRISPR gRNA sequence
agtttctctctcaggataaa

SEQ ID NO: 351014 - DNA, 20 bp, Artificial
  CRISPR gRNA sequence
ctctcaggataaagagtgaa

SEQ ID NO: 351015 - DNA, 20 bp, Artificial
  CRISPR gRNA sequence
ctcaggataaagagtgaata

SEQ ID NO: 351016 - DNA, 20 bp, Artificial
  CRISPR gRNA sequence
tcaggataaagagtgaatag

SEQ ID NO: 351017 - DNA, 20 bp, Artificial
  CRISPR gRNA sequence
taaagagtgaatagaggctg

SEQ ID NO: 351018 - DNA, 20 bp, Artificial
  CRISPR gRNA sequence
aaagagtgaatagaggctga

SEQ ID NO: 351019 - DNA, 20 bp, Artificial
  CRISPR gRNA sequence
aagagtgaatagaggctgaa

SEQ ID NO: 351020 - DNA, 20 bp, Artificial
  CRISPR gRNA sequence
cactctgatattattgtata

SEQ ID NO: 351021 - DNA, 20 bp, Artificial
  CRISPR gRNA sequence
actctgatattattgtataa

SEQ ID NO: 351022 - DNA, 20 bp, Artificial
  CRISPR gRNA sequence
ctgatattattgtataaagg

SEQ ID NO: 351023 - DNA, 20 bp, Artificial
  CRISPR gRNA sequence
attattgtataaaggaagct

SEQ ID NO: 351024 - DNA, 20 bp, Artificial
  CRISPR gRNA sequence
attattttatttgcaaaacc

SEQ ID NO: 351025 - DNA, 20 bp, Artificial
  CRISPR gRNA sequence
attttatttgcaaaacccag

SEQ ID NO: 351026 - DNA, 20 bp, Artificial
  CRISPR gRNA sequence
tgcaaaacccagaagctaaa

SEQ ID NO: 351027 - DNA, 20 bp, Artificial
  CRISPR gRNA sequence
gaagctaaaaagtcaataaa

SEQ ID NO: 351028 - DNA, 20 bp, Artificial
  CRISPR gRNA sequence
ctaaaaagtcaataaacaga

SEQ ID NO: 351029 - DNA, 20 bp, Artificial
  CRISPR gRNA sequence
taaacagaaagaatgatttt

SEQ ID NO: 351030 - DNA, 20 bp, Artificial
  CRISPR gRNA sequence
agaatgattttgagatctct

SEQ ID NO: 351031 - DNA, 20 bp, Artificial
  CRISPR gRNA sequence
tgagatctctgagttttgaa

SEQ ID NO: 351032 - DNA, 20 bp, Artificial
  CRISPR gRNA sequence
gatctctgagttttgaacag

SEQ ID NO: 351033 - DNA, 20 bp, Artificial
  CRISPR gRNA sequence
ctgagttttgaacagtggac

SEQ ID NO: 351034 - DNA, 20 bp, Artificial
  CRISPR gRNA sequence
cagtggactggaaaccatgt

SEQ ID NO: 351035 - DNA, 20 bp, Artificial
  CRISPR gRNA sequence
gtggactggaaaccatgtaa

SEQ ID NO: 351036 - DNA, 20 bp, Artificial
  CRISPR gRNA sequence
aaaccatgtaagagccttaa

SEQ ID NO: 351037 - DNA, 20 bp, Artificial
  CRISPR gRNA sequence
atgtaagagccttaaaagta

SEQ ID NO: 351038 - DNA, 20 bp, Artificial
  CRISPR gRNA sequence
aaagtacagttctgtgcaaa

SEQ ID NO: 351039 - DNA, 20 bp, Artificial
  CRISPR gRNA sequence
agttctgtgcaaatggcatt

SEQ ID NO: 351040 - DNA, 20 bp, Artificial
  CRISPR gRNA sequence
gcaaatggcattcagtttta

SEQ ID NO: 351041 - DNA, 20 bp, Artificial
  CRISPR gRNA sequence
ttcagttttaaagaaaaacg

SEQ ID NO: 351042 - DNA, 20 bp, Artificial
  CRISPR gRNA sequence
aaaacgtagcaaatgtttga

SEQ ID NO: 351043 - DNA, 20 bp, Artificial
  CRISPR gRNA sequence
tgtttgatggtgctgttaca

SEQ ID NO: 351044 - DNA, 20 bp, Artificial
  CRISPR gRNA sequence
gtttgatggtgctgttacaa

SEQ ID NO: 351045 - DNA, 20 bp, Artificial
  CRISPR gRNA sequence
ttgatggtgctgttacaaag

SEQ ID NO: 351046 - DNA, 20 bp, Artificial
  CRISPR gRNA sequence
ggtgctgttacaaaggagct

SEQ ID NO: 351047 - DNA, 20 bp, Artificial
  CRISPR gRNA sequence
acaaaggagcttggaatact

SEQ ID NO: 351048 - DNA, 20 bp, Artificial
  CRISPR gRNA sequence
aaaggagcttggaatactca

SEQ ID NO: 351049 - DNA, 20 bp, Artificial
  CRISPR gRNA sequence
aaggagcttggaatactcag

SEQ ID NO: 351050 - DNA, 20 bp, Artificial
  CRISPR gRNA sequence
actcagaggaacttgtccca

SEQ ID NO: 351051 - DNA, 20 bp, Artificial
  CRISPR gRNA sequence
tcaaaatgatgtttaaatcc

SEQ ID NO: 351052 - DNA, 20 bp, Artificial
  CRISPR gRNA sequence
attcccttgaacaacaaacc

SEQ ID NO: 351053 - DNA, 20 bp, Artificial
  CRISPR gRNA sequence
gaacaacaaacctggaacct

SEQ ID NO: 351054 - DNA, 20 bp, Artificial
  CRISPR gRNA sequence
acaaacctggaacctcagct

SEQ ID NO: 351055 - DNA, 20 bp, Artificial
  CRISPR gRNA sequence
cagctaagactctctgtgac

SEQ ID NO: 351056 - DNA, 20 bp, Artificial
  CRISPR gRNA sequence
gattctgaacctcttatatc

SEQ ID NO: 351057 - DNA, 20 bp, Artificial
  CRISPR gRNA sequence
attctgaacctcttatatcc

SEQ ID NO: 351058 - DNA, 20 bp, Artificial
  CRISPR gRNA sequence
ttctgaacctcttatatcca

SEQ ID NO: 351059 - DNA, 20 bp, Artificial
  CRISPR gRNA sequence
cctcttatatccagggcttc

SEQ ID NO: 351060 - DNA, 20 bp, Artificial
  CRISPR gRNA sequence
ctcttatatccagggcttca

SEQ ID NO: 351061 - DNA, 20 bp, Artificial
  CRISPR gRNA sequence
tcttatatccagggcttcaa

SEQ ID NO: 351062 - DNA, 20 bp, Artificial
  CRISPR gRNA sequence
cttatatccagggcttcaag

SEQ ID NO: 351063 - DNA, 20 bp, Artificial
  CRISPR gRNA sequence
cagggcttcaaggggtattg

SEQ ID NO: 351064 - DNA, 20 bp, Artificial
  CRISPR gRNA sequence
agggcttcaaggggtattgc

SEQ ID NO: 351065 - DNA, 20 bp, Artificial
  CRISPR gRNA sequence
ttcaaggggtattgcaggtc

SEQ ID NO: 351066 - DNA, 20 bp, Artificial
  CRISPR gRNA sequence
tcaaggggtattgcaggtca

SEQ ID NO: 351067 - DNA, 20 bp, Artificial
  CRISPR gRNA sequence
ttgcaggtcaaggtctttcc

SEQ ID NO: 351068 - DNA, 20 bp, Artificial
  CRISPR gRNA sequence
tgcaggtcaaggtctttcct

SEQ ID NO: 351069 - DNA, 20 bp, Artificial
  CRISPR gRNA sequence
ctcacactaaatttatcctc

SEQ ID NO: 351070 - DNA, 20 bp, Artificial
  CRISPR gRNA sequence
acactaaatttatcctctag

SEQ ID NO: 351071 - DNA, 20 bp, Artificial
  CRISPR gRNA sequence
ttatcctctagtagaaaatt

SEQ ID NO: 351072 - DNA, 20 bp, Artificial
  CRISPR gRNA sequence
agtagaaaattaagttattt

SEQ ID NO: 351073 - DNA, 20 bp, Artificial
  CRISPR gRNA sequence
attaagttattttggtctaa

SEQ ID NO: 351074 - DNA, 20 bp, Artificial
  CRISPR gRNA sequence
tgctcaataacttattttgc

SEQ ID NO: 351075 - DNA, 20 bp, Artificial
  CRISPR gRNA sequence
ataacttattttgcaagctg

SEQ ID NO: 351076 - DNA, 20 bp, Artificial
  CRISPR gRNA sequence
taacttattttgcaagctgc

SEQ ID NO: 351077 - DNA, 20 bp, Artificial
  CRISPR gRNA sequence
cttattttgcaagctgcagg

SEQ ID NO: 351078 - DNA, 20 bp, Artificial
  CRISPR gRNA sequence
ttttgcaagctgcaggcaga

SEQ ID NO: 351079 - DNA, 20 bp, Artificial
  CRISPR gRNA sequence
ttgcaagctgcaggcagaaa

SEQ ID NO: 351080 - DNA, 20 bp, Artificial
  CRISPR gRNA sequence
caggcagaaagagacttttt

SEQ ID NO: 351081 - DNA, 20 bp, Artificial
  CRISPR gRNA sequence
agaaagagactttttaagta

SEQ ID NO: 351082 - DNA, 20 bp, Artificial
  CRISPR gRNA sequence
tttttcctattctctgcttt

SEQ ID NO: 351083 - DNA, 20 bp, Artificial
  CRISPR gRNA sequence
tcctattctctgcttttaga

SEQ ID NO: 351084 - DNA, 20 bp, Artificial
  CRISPR gRNA sequence
cctattctctgcttttagac

SEQ ID NO: 351085 - DNA, 20 bp, Artificial
  CRISPR gRNA sequence
agacaggctgtcctcaattt

SEQ ID NO: 351086 - DNA, 20 bp, Artificial
  CRISPR gRNA sequence
tattgtttcttatataaact

SEQ ID NO: 351087 - DNA, 20 bp, Artificial
  CRISPR gRNA sequence
gtttcttatataaacttggt

SEQ ID NO: 351088 - DNA, 20 bp, Artificial
  CRISPR gRNA sequence
ataaacttggtaagtactgt

SEQ ID NO: 351089 - DNA, 20 bp, Artificial
  CRISPR gRNA sequence
ttggtaagtactgtaagaaa

SEQ ID NO: 351090 - DNA, 20 bp, Artificial
  CRISPR gRNA sequence
ctatcataccattgcataat

SEQ ID NO: 351091 - DNA, 20 bp, Artificial
  CRISPR gRNA sequence
tatcataccattgcataata

SEQ ID NO: 351092 - DNA, 20 bp, Artificial
  CRISPR gRNA sequence
tcataccattgcataataag

SEQ ID NO: 351093 - DNA, 20 bp, Artificial
  CRISPR gRNA sequence
aataaggagcaccaacttcc

SEQ ID NO: 351094 - DNA, 20 bp, Artificial
  CRISPR gRNA sequence
caacttcccagctcaaaact

SEQ ID NO: 351095 - DNA, 20 bp, Artificial
  CRISPR gRNA sequence
aacttcccagctcaaaactc

SEQ ID NO: 351096 - DNA, 20 bp, Artificial
  CRISPR gRNA sequence
ttgtatcttacctcctctat

SEQ ID NO: 351097 - DNA, 20 bp, Artificial
  CRISPR gRNA sequence
tgtatcttacctcctctatg

SEQ ID NO: 351098 - DNA, 20 bp, Artificial
  CRISPR gRNA sequence
atgaggtcaattcacattgt

SEQ ID NO: 351099 - DNA, 20 bp, Artificial
  CRISPR gRNA sequence
cacattgtaagcctgttgct

SEQ ID NO: 351100 - DNA, 20 bp, Artificial
  CRISPR gRNA sequence
gcttagtgcatctcgtttcc

SEQ ID NO: 351101 - DNA, 20 bp, Artificial
  CRISPR gRNA sequence
tgcatctcgtttcctggtac

SEQ ID NO: 351102 - DNA, 20 bp, Artificial
  CRISPR gRNA sequence
cctggtaccagcttctttaa

SEQ ID NO: 351103 - DNA, 20 bp, Artificial
  CRISPR gRNA sequence
tggtaccagcttctttaata

SEQ ID NO: 351104 - DNA, 20 bp, Artificial
  CRISPR gRNA sequence
agcttctttaatagagttct

SEQ ID NO: 351105 - DNA, 20 bp, Artificial
  CRISPR gRNA sequence
gagttcttagttgcaatcaa

SEQ ID NO: 351106 - DNA, 20 bp, Artificial
  CRISPR gRNA sequence
ttcttagttgcaatcaacag

SEQ ID NO: 351107 - DNA, 20 bp, Artificial
  CRISPR gRNA sequence
tagttgcaatcaacagaagc

SEQ ID NO: 351108 - DNA, 20 bp, Artificial
  CRISPR gRNA sequence
caatcaacagaagctggctt

SEQ ID NO: 351109 - DNA, 20 bp, Artificial
  CRISPR gRNA sequence
ctggctttggcttttttatg

SEQ ID NO: 351110 - DNA, 20 bp, Artificial
  CRISPR gRNA sequence
tttggcttttttatgtagaa

SEQ ID NO: 351111 - DNA, 20 bp, Artificial
  CRISPR gRNA sequence
ttggcttttttatgtagaaa

SEQ ID NO: 351112 - DNA, 20 bp, Artificial
  CRISPR gRNA sequence
tagaaaaggaacctattgaa

SEQ ID NO: 351113 - DNA, 20 bp, Artificial
  CRISPR gRNA sequence
cctattgaaaagatactgat

SEQ ID NO: 351114 - DNA, 20 bp, Artificial
  CRISPR gRNA sequence
tgattggttccaataactgc

SEQ ID NO: 351115 - DNA, 20 bp, Artificial
  CRISPR gRNA sequence
ttggttccaataactgctag

SEQ ID NO: 351116 - DNA, 20 bp, Artificial
  CRISPR gRNA sequence
tctgcaaaaccatgctttga

SEQ ID NO: 351117 - DNA, 20 bp, Artificial
  CRISPR gRNA sequence
caaaaccatgctttgaaagt

SEQ ID NO: 351118 - DNA, 20 bp, Artificial
  CRISPR gRNA sequence
aaccatgctttgaaagtgag

SEQ ID NO: 351119 - DNA, 20 bp, Artificial
  CRISPR gRNA sequence
accatgctttgaaagtgagc

SEQ ID NO: 351120 - DNA, 20 bp, Artificial
  CRISPR gRNA sequence
gctttgaaagtgagcaggaa

SEQ ID NO: 351121 - DNA, 20 bp, Artificial
  CRISPR gRNA sequence
ttgaaagtgagcaggaaaag

SEQ ID NO: 351122 - DNA, 20 bp, Artificial
  CRISPR gRNA sequence
gaaagtgagcaggaaaagaa

SEQ ID NO: 351123 - DNA, 20 bp, Artificial
  CRISPR gRNA sequence
tgagcaggaaaagaagagac

SEQ ID NO: 351124 - DNA, 20 bp, Artificial
  CRISPR gRNA sequence
gagcaggaaaagaagagact

SEQ ID NO: 351125 - DNA, 20 bp, Artificial
  CRISPR gRNA sequence
gaaaagaagagactaggctg

SEQ ID NO: 351126 - DNA, 20 bp, Artificial
  CRISPR gRNA sequence
agaagagactaggctgtggc

SEQ ID NO: 351127 - DNA, 20 bp, Artificial
  CRISPR gRNA sequence
gaagagactaggctgtggct

SEQ ID NO: 351128 - DNA, 20 bp, Artificial
  CRISPR gRNA sequence
agagactaggctgtggctgg

SEQ ID NO: 351129 - DNA, 20 bp, Artificial
  CRISPR gRNA sequence
ctaggctgtggctgggagca

SEQ ID NO: 351130 - DNA, 20 bp, Artificial
  CRISPR gRNA sequence
cacagccaaaattacaaaac

SEQ ID NO: 351131 - DNA, 20 bp, Artificial
  CRISPR gRNA sequence
ccaaaattacaaaaccagcc

SEQ ID NO: 351132 - DNA, 20 bp, Artificial
  CRISPR gRNA sequence
caaaattacaaaaccagccc

SEQ ID NO: 351133 - DNA, 20 bp, Artificial
  CRISPR gRNA sequence
aaaattacaaaaccagccca

SEQ ID NO: 351134 - DNA, 20 bp, Artificial
  CRISPR gRNA sequence
atgatgatcctgttcatgca

SEQ ID NO: 351135 - DNA, 20 bp, Artificial
  CRISPR gRNA sequence
tcatgcacagccactgtccc

SEQ ID NO: 351136 - DNA, 20 bp, Artificial
  CRISPR gRNA sequence
acagccactgtccccagcac

SEQ ID NO: 351137 - DNA, 20 bp, Artificial
  CRISPR gRNA sequence
cagccactgtccccagcact

SEQ ID NO: 351138 - DNA, 20 bp, Artificial
  CRISPR gRNA sequence
actgtccccagcactaggca

SEQ ID NO: 351139 - DNA, 20 bp, Artificial
  CRISPR gRNA sequence
cactgcctcactgtctctgc

SEQ ID NO: 351140 - DNA, 20 bp, Artificial
  CRISPR gRNA sequence
ctcactgtctctgctggact

SEQ ID NO: 351141 - DNA, 20 bp, Artificial
  CRISPR gRNA sequence
tgccatgaaaatgaattctc

SEQ ID NO: 351142 - DNA, 20 bp, Artificial
  CRISPR gRNA sequence
gccatgaaaatgaattctcc

SEQ ID NO: 351143 - DNA, 20 bp, Artificial
  CRISPR gRNA sequence
ccatgaaaatgaattctcca

SEQ ID NO: 351144 - DNA, 20 bp, Artificial
  CRISPR gRNA sequence
cttcttcatcctttcatctc

SEQ ID NO: 351145 - DNA, 20 bp, Artificial
  CRISPR gRNA sequence
catctctagcttataattca

SEQ ID NO: 351146 - DNA, 20 bp, Artificial
  CRISPR gRNA sequence
ctagcttataattcaaagtc

SEQ ID NO: 351147 - DNA, 20 bp, Artificial
  CRISPR gRNA sequence
tagcttataattcaaagtct

SEQ ID NO: 351148 - DNA, 20 bp, Artificial
  CRISPR gRNA sequence
ataattcaaagtctgggatt

SEQ ID NO: 351149 - DNA, 20 bp, Artificial
  CRISPR gRNA sequence
attcaaagtctgggattgag

SEQ ID NO: 351150 - DNA, 20 bp, Artificial
  CRISPR gRNA sequence
tgggattgagtggccaatcc

SEQ ID NO: 351151 - DNA, 20 bp, Artificial
  CRISPR gRNA sequence
gggattgagtggccaatcct

SEQ ID NO: 351152 - DNA, 20 bp, Artificial
  CRISPR gRNA sequence
catgtccatgtcctatctcc

SEQ ID NO: 351153 - DNA, 20 bp, Artificial
  CRISPR gRNA sequence
atgtccatgtcctatctcca

SEQ ID NO: 351154 - DNA, 20 bp, Artificial
  CRISPR gRNA sequence
tgtccatgtcctatctccaa

SEQ ID NO: 351155 - DNA, 20 bp, Artificial
  CRISPR gRNA sequence
gtccatgtcctatctccaag

SEQ ID NO: 351156 - DNA, 20 bp, Artificial
  CRISPR gRNA sequence
tccatgtcctatctccaagg

SEQ ID NO: 351157 - DNA, 20 bp, Artificial
  CRISPR gRNA sequence
ccatgtcctatctccaaggg

SEQ ID NO: 351158 - DNA, 20 bp, Artificial
  CRISPR gRNA sequence
gtcctatctccaaggggggc

SEQ ID NO: 351159 - DNA, 20 bp, Artificial
  CRISPR gRNA sequence
tcctatctccaaggggggct

SEQ ID NO: 351160 - DNA, 20 bp, Artificial
  CRISPR gRNA sequence
ggggctgggaattgaatatc

SEQ ID NO: 351161 - DNA, 20 bp, Artificial
  CRISPR gRNA sequence
actttcacttcttatgaatt

SEQ ID NO: 351162 - DNA, 20 bp, Artificial
  CRISPR gRNA sequence
ctttcacttcttatgaatta

SEQ ID NO: 351163 - DNA, 20 bp, Artificial
  CRISPR gRNA sequence
ttaaggaattctacaaataa

SEQ ID NO: 351164 - DNA, 20 bp, Artificial
  CRISPR gRNA sequence
aggaattctacaaataatag

SEQ ID NO: 351165 - DNA, 20 bp, Artificial
  CRISPR gRNA sequence
aattctacaaataatagaag

SEQ ID NO: 351166 - DNA, 20 bp, Artificial
  CRISPR gRNA sequence
attctacaaataatagaagt

SEQ ID NO: 351167 - DNA, 20 bp, Artificial
  CRISPR gRNA sequence
caaataatagaagtgggatt

SEQ ID NO: 351168 - DNA, 20 bp, Artificial
  CRISPR gRNA sequence
aaataatagaagtgggattc

SEQ ID NO: 351169 - DNA, 20 bp, Artificial
  CRISPR gRNA sequence
taatagaagtgggattcagg

SEQ ID NO: 351170 - DNA, 20 bp, Artificial
  CRISPR gRNA sequence
tagaagtgggattcaggtgg

SEQ ID NO: 351171 - DNA, 20 bp, Artificial
  CRISPR gRNA sequence
agaagtgggattcaggtggt

SEQ ID NO: 351172 - DNA, 20 bp, Artificial
  CRISPR gRNA sequence
agtgggattcaggtggtagg

SEQ ID NO: 351173 - DNA, 20 bp, Artificial
  CRISPR gRNA sequence
caggtggtaggcagacaaaa

SEQ ID NO: 351174 - DNA, 20 bp, Artificial
  CRISPR gRNA sequence
actgtctactctcaaaactg

SEQ ID NO: 351175 - DNA, 20 bp, Artificial
  CRISPR gRNA sequence
tgtctactctcaaaactgtg

SEQ ID NO: 351176 - DNA, 20 bp, Artificial
  CRISPR gRNA sequence
aaactgtggagctactaatg

SEQ ID NO: 351177 - DNA, 20 bp, Artificial
  CRISPR gRNA sequence
ctaatgaagatttgtaaacc

SEQ ID NO: 351178 - DNA, 20 bp, Artificial
  CRISPR gRNA sequence
taatgaagatttgtaaaccc

SEQ ID NO: 351179 - DNA, 20 bp, Artificial
  CRISPR gRNA sequence
atttgtaaacccgggcttat

SEQ ID NO: 351180 - DNA, 20 bp, Artificial
  CRISPR gRNA sequence
cccattcctttactacaact

SEQ ID NO: 351181 - DNA, 20 bp, Artificial
  CRISPR gRNA sequence
tactacaactcagattgctc

SEQ ID NO: 351182 - DNA, 20 bp, Artificial
  CRISPR gRNA sequence
tacaactcagattgctctag

SEQ ID NO: 351183 - DNA, 20 bp, Artificial
  CRISPR gRNA sequence
ctcagattgctctagaagct

SEQ ID NO: 351184 - DNA, 20 bp, Artificial
  CRISPR gRNA sequence
tgctctagaagctcagttcc

SEQ ID NO: 351185 - DNA, 20 bp, Artificial
  CRISPR gRNA sequence
gaagctcagttcccagcact

SEQ ID NO: 351186 - DNA, 20 bp, Artificial
  CRISPR gRNA sequence
tcccagcacttggatttttc

SEQ ID NO: 351187 - DNA, 20 bp, Artificial
  CRISPR gRNA sequence
cagcacttggatttttccag

SEQ ID NO: 351188 - DNA, 20 bp, Artificial
  CRISPR gRNA sequence
cagtagctgaattctacctg

SEQ ID NO: 351189 - DNA, 20 bp, Artificial
  CRISPR gRNA sequence
agtagctgaattctacctga

SEQ ID NO: 351190 - DNA, 20 bp, Artificial
  CRISPR gRNA sequence
agctgaattctacctgaagg

SEQ ID NO: 351191 - DNA, 20 bp, Artificial
  CRISPR gRNA sequence
gctgaattctacctgaagga

SEQ ID NO: 351192 - DNA, 20 bp, Artificial
  CRISPR gRNA sequence
ctgaattctacctgaaggaa

SEQ ID NO: 351193 - DNA, 20 bp, Artificial
  CRISPR gRNA sequence
aattctacctgaaggaaggg

SEQ ID NO: 351194 - DNA, 20 bp, Artificial
  CRISPR gRNA sequence
ctgaaggaagggcagaaaca

SEQ ID NO: 351195 - DNA, 20 bp, Artificial
  CRISPR gRNA sequence
tgaaggaagggcagaaacaa

SEQ ID NO: 351196 - DNA, 20 bp, Artificial
  CRISPR gRNA sequence
gaaggaagggcagaaacaaa

SEQ ID NO: 351197 - DNA, 20 bp, Artificial
  CRISPR gRNA sequence
aagggcagaaacaaagggtg

SEQ ID NO: 351198 - DNA, 20 bp, Artificial
  CRISPR gRNA sequence
ggcagaaacaaagggtgaag

SEQ ID NO: 351199 - DNA, 20 bp, Artificial
  CRISPR gRNA sequence
cagaaacaaagggtgaagaa

SEQ ID NO: 351200 - DNA, 20 bp, Artificial
  CRISPR gRNA sequence
agaaacaaagggtgaagaag

SEQ ID NO: 351201 - DNA, 20 bp, Artificial
  CRISPR gRNA sequence
aagaagaggctatcacttcc

SEQ ID NO: 351202 - DNA, 20 bp, Artificial
  CRISPR gRNA sequence
ttccaagtatcctgcacccc

SEQ ID NO: 351203 - DNA, 20 bp, Artificial
  CRISPR gRNA sequence
tccaagtatcctgcacccct

SEQ ID NO: 351204 - DNA, 20 bp, Artificial
  CRISPR gRNA sequence
tatcctgcacccctgggctc

SEQ ID NO: 351205 - DNA, 20 bp, Artificial
  CRISPR gRNA sequence
ccctgggctcaagacctcac

SEQ ID NO: 351206 - DNA, 20 bp, Artificial
  CRISPR gRNA sequence
cctgggctcaagacctcact

SEQ ID NO: 351207 - DNA, 20 bp, Artificial
  CRISPR gRNA sequence
ctgggctcaagacctcactg

SEQ ID NO: 351208 - DNA, 20 bp, Artificial
  CRISPR gRNA sequence
gggctcaagacctcactggg

SEQ ID NO: 351209 - DNA, 20 bp, Artificial
  CRISPR gRNA sequence
ggctcaagacctcactgggg

SEQ ID NO: 351210 - DNA, 20 bp, Artificial
  CRISPR gRNA sequence
gctcaagacctcactgggga

SEQ ID NO: 351211 - DNA, 20 bp, Artificial
  CRISPR gRNA sequence
tcaagacctcactggggagg

SEQ ID NO: 351212 - DNA, 20 bp, Artificial
  CRISPR gRNA sequence
tcactggggagggagtcttt

SEQ ID NO: 351213 - DNA, 20 bp, Artificial
  CRISPR gRNA sequence
cactggggagggagtctttt

SEQ ID NO: 351214 - DNA, 20 bp, Artificial
  CRISPR gRNA sequence
cttttgggccacccaccaaa

SEQ ID NO: 351215 - DNA, 20 bp, Artificial
  CRISPR gRNA sequence
ggccacccaccaaacagcac

SEQ ID NO: 351216 - DNA, 20 bp, Artificial
  CRISPR gRNA sequence
tggcattatgcctctcaccc

SEQ ID NO: 351217 - DNA, 20 bp, Artificial
  CRISPR gRNA sequence
atgcctctcaccctagacca

SEQ ID NO: 351218 - DNA, 20 bp, Artificial
  CRISPR gRNA sequence
ccctagaccatggttacacg

SEQ ID NO: 351219 - DNA, 20 bp, Artificial
  CRISPR gRNA sequence
cgtggtaaaacaaccccttc

SEQ ID NO: 351220 - DNA, 20 bp, Artificial
  CRISPR gRNA sequence
gtgatacattcacaactctc

SEQ ID NO: 351221 - DNA, 20 bp, Artificial
  CRISPR gRNA sequence
actctctagtttcccccaaa

SEQ ID NO: 351222 - DNA, 20 bp, Artificial
  CRISPR gRNA sequence
gtttcccccaaatggcacta

SEQ ID NO: 351223 - DNA, 20 bp, Artificial
  CRISPR gRNA sequence
tttcccccaaatggcactat

SEQ ID NO: 351224 - DNA, 20 bp, Artificial
  CRISPR gRNA sequence
ttcccccaaatggcactatg

SEQ ID NO: 351225 - DNA, 20 bp, Artificial
  CRISPR gRNA sequence
cccccaaatggcactatggg

SEQ ID NO: 351226 - DNA, 20 bp, Artificial
  CRISPR gRNA sequence
ccaaatggcactatggggag

SEQ ID NO: 351227 - DNA, 20 bp, Artificial
  CRISPR gRNA sequence
caaatggcactatggggagc

SEQ ID NO: 351228 - DNA, 20 bp, Artificial
  CRISPR gRNA sequence
aatggcactatggggagcgg

SEQ ID NO: 351229 - DNA, 20 bp, Artificial
  CRISPR gRNA sequence
gcgggagcttgccttttcct

SEQ ID NO: 351230 - DNA, 20 bp, Artificial
  CRISPR gRNA sequence
ttcctcagacttaaaacaat

SEQ ID NO: 351231 - DNA, 20 bp, Artificial
  CRISPR gRNA sequence
aatgctgttttcttttgacc

SEQ ID NO: 351232 - DNA, 20 bp, Artificial
  CRISPR gRNA sequence
gaccaagcatgtctgaattc

SEQ ID NO: 351233 - DNA, 20 bp, Artificial
  CRISPR gRNA sequence
ccaagcatgtctgaattcta

SEQ ID NO: 351234 - DNA, 20 bp, Artificial
  CRISPR gRNA sequence
agcatgtctgaattctagag

SEQ ID NO: 351235 - DNA, 20 bp, Artificial
  CRISPR gRNA sequence
tgtctgaattctagagaagt

SEQ ID NO: 351236 - DNA, 20 bp, Artificial
  CRISPR gRNA sequence
gtctgaattctagagaagtc

SEQ ID NO: 351237 - DNA, 20 bp, Artificial
  CRISPR gRNA sequence
ctgaattctagagaagtcag

SEQ ID NO: 351238 - DNA, 20 bp, Artificial
  CRISPR gRNA sequence
tgaattctagagaagtcagg

SEQ ID NO: 351239 - DNA, 20 bp, Artificial
  CRISPR gRNA sequence
aggaggaacacacccattct

SEQ ID NO: 351240 - DNA, 20 bp, Artificial
  CRISPR gRNA sequence
acacacccattctcggtttg

SEQ ID NO: 351241 - DNA, 20 bp, Artificial
  CRISPR gRNA sequence
cacacccattctcggtttga

SEQ ID NO: 351242 - DNA, 20 bp, Artificial
  CRISPR gRNA sequence
acacccattctcggtttgaa

SEQ ID NO: 351243 - DNA, 20 bp, Artificial
  CRISPR gRNA sequence
ttgaagggactgatgttctg

SEQ ID NO: 351244 - DNA, 20 bp, Artificial
  CRISPR gRNA sequence
ctgatgttctgaagtacaac

SEQ ID NO: 351245 - DNA, 20 bp, Artificial
  CRISPR gRNA sequence
tgatgttctgaagtacaact

SEQ ID NO: 351246 - DNA, 20 bp, Artificial
  CRISPR gRNA sequence
ttctgaagtacaactgggca

SEQ ID NO: 351247 - DNA, 20 bp, Artificial
  CRISPR gRNA sequence
agtacaactgggcacagtcc

SEQ ID NO: 351248 - DNA, 20 bp, Artificial
  CRISPR gRNA sequence
gtacaactgggcacagtccc

SEQ ID NO: 351249 - DNA, 20 bp, Artificial
  CRISPR gRNA sequence
gggcacagtcccaggctctt

SEQ ID NO: 351250 - DNA, 20 bp, Artificial
  CRISPR gRNA sequence
ggcacagtcccaggctcttc

SEQ ID NO: 351251 - DNA, 20 bp, Artificial
  CRISPR gRNA sequence
ggacgcttcctccattcaca

SEQ ID NO: 351252 - DNA, 20 bp, Artificial
  CRISPR gRNA sequence
cgcttcctccattcacacag

SEQ ID NO: 351253 - DNA, 20 bp, Artificial
  CRISPR gRNA sequence
gcttcctccattcacacagc

SEQ ID NO: 351254 - DNA, 20 bp, Artificial
  CRISPR gRNA sequence
cttcctccattcacacagcg

SEQ ID NO: 351255 - DNA, 20 bp, Artificial
  CRISPR gRNA sequence
cagcggggatgtgattgtta

SEQ ID NO: 351256 - DNA, 20 bp, Artificial
  CRISPR gRNA sequence
cggggatgtgattgttacag

SEQ ID NO: 351257 - DNA, 20 bp, Artificial
  CRISPR gRNA sequence
ggggatgtgattgttacagc

SEQ ID NO: 351258 - DNA, 20 bp, Artificial
  CRISPR gRNA sequence
gatgtgattgttacagcggg

SEQ ID NO: 351259 - DNA, 20 bp, Artificial
  CRISPR gRNA sequence
ttacagcgggtggtgtgtgc

SEQ ID NO: 351260 - DNA, 20 bp, Artificial
  CRISPR gRNA sequence
gcgggtggtgtgtgctggct

SEQ ID NO: 351261 - DNA, 20 bp, Artificial
  CRISPR gRNA sequence
ggtggtgtgtgctggctgag

SEQ ID NO: 351262 - DNA, 20 bp, Artificial
  CRISPR gRNA sequence
gtgaattgattcttcttctg

SEQ ID NO: 351263 - DNA, 20 bp, Artificial
  CRISPR gRNA sequence
aagtttatgtttctactttt

SEQ ID NO: 351264 - DNA, 20 bp, Artificial
  CRISPR gRNA sequence
ttttggaaatgaataaatta

SEQ ID NO: 351265 - DNA, 20 bp, Artificial
  CRISPR gRNA sequence
ggaaatgaataaattacagc

SEQ ID NO: 351266 - DNA, 20 bp, Artificial
  CRISPR gRNA sequence
gtaatttattcatttccaaa

SEQ ID NO: 351267 - DNA, 20 bp, Artificial
  CRISPR gRNA sequence
atttattcatttccaaaaag

SEQ ID NO: 351268 - DNA, 20 bp, Artificial
  CRISPR gRNA sequence
aaaagtagaaacataaactt

SEQ ID NO: 351269 - DNA, 20 bp, Artificial
  CRISPR gRNA sequence
agtagaaacataaacttcag

SEQ ID NO: 351270 - DNA, 20 bp, Artificial
  CRISPR gRNA sequence
agaaacataaacttcagaag

SEQ ID NO: 351271 - DNA, 20 bp, Artificial
  CRISPR gRNA sequence
tcagaagaagaatcaattca

SEQ ID NO: 351272 - DNA, 20 bp, Artificial
  CRISPR gRNA sequence
gaagaagaatcaattcacag

SEQ ID NO: 351273 - DNA, 20 bp, Artificial
  CRISPR gRNA sequence
atcaattcacagtggcttct

SEQ ID NO: 351274 - DNA, 20 bp, Artificial
  CRISPR gRNA sequence
attcacagtggcttctcagc

SEQ ID NO: 351275 - DNA, 20 bp, Artificial
  CRISPR gRNA sequence
tcacatccccgctgtgtgaa

SEQ ID NO: 351276 - DNA, 20 bp, Artificial
  CRISPR gRNA sequence
acatccccgctgtgtgaatg

SEQ ID NO: 351277 - DNA, 20 bp, Artificial
  CRISPR gRNA sequence
catccccgctgtgtgaatgg

SEQ ID NO: 351278 - DNA, 20 bp, Artificial
  CRISPR gRNA sequence
ccccgctgtgtgaatggagg

SEQ ID NO: 351279 - DNA, 20 bp, Artificial
  CRISPR gRNA sequence
tgaatggaggaagcgtcctg

SEQ ID NO: 351280 - DNA, 20 bp, Artificial
  CRISPR gRNA sequence
aatggaggaagcgtcctgaa

SEQ ID NO: 351281 - DNA, 20 bp, Artificial
  CRISPR gRNA sequence
aggaagcgtcctgaagagcc

SEQ ID NO: 351282 - DNA, 20 bp, Artificial
  CRISPR gRNA sequence
ggaagcgtcctgaagagcct

SEQ ID NO: 351283 - DNA, 20 bp, Artificial
  CRISPR gRNA sequence
gaagagcctgggactgtgcc

SEQ ID NO: 351284 - DNA, 20 bp, Artificial
  CRISPR gRNA sequence
gactgtgcccagttgtactt

SEQ ID NO: 351285 - DNA, 20 bp, Artificial
  CRISPR gRNA sequence
ccagttgtacttcagaacat

SEQ ID NO: 351286 - DNA, 20 bp, Artificial
  CRISPR gRNA sequence
aacatcagtcccttcaaacc

SEQ ID NO: 351287 - DNA, 20 bp, Artificial
  CRISPR gRNA sequence
cagtcccttcaaaccgagaa

SEQ ID NO: 351288 - DNA, 20 bp, Artificial
  CRISPR gRNA sequence
agtcccttcaaaccgagaat

SEQ ID NO: 351289 - DNA, 20 bp, Artificial
  CRISPR gRNA sequence
tgtgttcctcctgacttctc

SEQ ID NO: 351290 - DNA, 20 bp, Artificial
  CRISPR gRNA sequence
ctcctgacttctctagaatt

SEQ ID NO: 351291 - DNA, 20 bp, Artificial
  CRISPR gRNA sequence
ctctagaattcagacatgct

SEQ ID NO: 351292 - DNA, 20 bp, Artificial
  CRISPR gRNA sequence
attcagacatgcttggtcaa

SEQ ID NO: 351293 - DNA, 20 bp, Artificial
  CRISPR gRNA sequence
catgcttggtcaaaagaaaa

SEQ ID NO: 351294 - DNA, 20 bp, Artificial
  CRISPR gRNA sequence
tggtcaaaagaaaacagcat

SEQ ID NO: 351295 - DNA, 20 bp, Artificial
  CRISPR gRNA sequence
gtcaaaagaaaacagcatta

SEQ ID NO: 351296 - DNA, 20 bp, Artificial
  CRISPR gRNA sequence
tcaaaagaaaacagcattag

SEQ ID NO: 351297 - DNA, 20 bp, Artificial
  CRISPR gRNA sequence
caaaagaaaacagcattaga

SEQ ID NO: 351298 - DNA, 20 bp, Artificial
  CRISPR gRNA sequence
aaaagaaaacagcattagag

SEQ ID NO: 351299 - DNA, 20 bp, Artificial
  CRISPR gRNA sequence
acagcattagaggggaaaca

SEQ ID NO: 351300 - DNA, 20 bp, Artificial
  CRISPR gRNA sequence
cagcattagaggggaaacac

SEQ ID NO: 351301 - DNA, 20 bp, Artificial
  CRISPR gRNA sequence
agcattagaggggaaacacg

SEQ ID NO: 351302 - DNA, 20 bp, Artificial
  CRISPR gRNA sequence
cggggaaaacttattgtttt

SEQ ID NO: 351303 - DNA, 20 bp, Artificial
  CRISPR gRNA sequence
aaacttattgttttaagtct

SEQ ID NO: 351304 - DNA, 20 bp, Artificial
  CRISPR gRNA sequence
aacttattgttttaagtctg

SEQ ID NO: 351305 - DNA, 20 bp, Artificial
  CRISPR gRNA sequence
attgttttaagtctgaggaa

SEQ ID NO: 351306 - DNA, 20 bp, Artificial
  CRISPR gRNA sequence
ttgttttaagtctgaggaaa

SEQ ID NO: 351307 - DNA, 20 bp, Artificial
  CRISPR gRNA sequence
tttaagtctgaggaaaaggc

SEQ ID NO: 351308 - DNA, 20 bp, Artificial
  CRISPR gRNA sequence
aggcaagctcccgctcccca

SEQ ID NO: 351309 - DNA, 20 bp, Artificial
  CRISPR gRNA sequence
ccgctccccatagtgccatt

SEQ ID NO: 351310 - DNA, 20 bp, Artificial
  CRISPR gRNA sequence
cgctccccatagtgccattt

SEQ ID NO: 351311 - DNA, 20 bp, Artificial
  CRISPR gRNA sequence
gctccccatagtgccatttg

SEQ ID NO: 351312 - DNA, 20 bp, Artificial
  CRISPR gRNA sequence
ctccccatagtgccatttgg

SEQ ID NO: 351313 - DNA, 20 bp, Artificial
  CRISPR gRNA sequence
tagtgccatttgggggaaac

SEQ ID NO: 351314 - DNA, 20 bp, Artificial
  CRISPR gRNA sequence
gtgccatttgggggaaacta

SEQ ID NO: 351315 - DNA, 20 bp, Artificial
  CRISPR gRNA sequence
gccatttgggggaaactaga

SEQ ID NO: 351316 - DNA, 20 bp, Artificial
  CRISPR gRNA sequence
gagagttgtgaatgtatcac

SEQ ID NO: 351317 - DNA, 20 bp, Artificial
  CRISPR gRNA sequence
agttgtgaatgtatcaccag

SEQ ID NO: 351318 - DNA, 20 bp, Artificial
  CRISPR gRNA sequence
gttgtgaatgtatcaccaga

SEQ ID NO: 351319 - DNA, 20 bp, Artificial
  CRISPR gRNA sequence
ttgtgaatgtatcaccagaa

SEQ ID NO: 351320 - DNA, 20 bp, Artificial
  CRISPR gRNA sequence
tgtgaatgtatcaccagaag

SEQ ID NO: 351321 - DNA, 20 bp, Artificial
  CRISPR gRNA sequence
tgttttaccacgtgtaacca

SEQ ID NO: 351322 - DNA, 20 bp, Artificial
  CRISPR gRNA sequence
taccacgtgtaaccatggtc

SEQ ID NO: 351323 - DNA, 20 bp, Artificial
  CRISPR gRNA sequence
accacgtgtaaccatggtct

SEQ ID NO: 351324 - DNA, 20 bp, Artificial
  CRISPR gRNA sequence
ccacgtgtaaccatggtcta

SEQ ID NO: 351325 - DNA, 20 bp, Artificial
  CRISPR gRNA sequence
gtgtaaccatggtctagggt

SEQ ID NO: 351326 - DNA, 20 bp, Artificial
  CRISPR gRNA sequence
gtaaccatggtctagggtga

SEQ ID NO: 351327 - DNA, 20 bp, Artificial
  CRISPR gRNA sequence
taaccatggtctagggtgag

SEQ ID NO: 351328 - DNA, 20 bp, Artificial
  CRISPR gRNA sequence
tagggtgagaggcataatgc

SEQ ID NO: 351329 - DNA, 20 bp, Artificial
  CRISPR gRNA sequence
ggcataatgccagtgctgtt

SEQ ID NO: 351330 - DNA, 20 bp, Artificial
  CRISPR gRNA sequence
ataatgccagtgctgtttgg

SEQ ID NO: 351331 - DNA, 20 bp, Artificial
  CRISPR gRNA sequence
taatgccagtgctgtttggt

SEQ ID NO: 351332 - DNA, 20 bp, Artificial
  CRISPR gRNA sequence
tgccagtgctgtttggtggg

SEQ ID NO: 351333 - DNA, 20 bp, Artificial
  CRISPR gRNA sequence
ctgtttggtgggtggcccaa

SEQ ID NO: 351334 - DNA, 20 bp, Artificial
  CRISPR gRNA sequence
ggcccaaaagactccctccc

SEQ ID NO: 351335 - DNA, 20 bp, Artificial
  CRISPR gRNA sequence
caaaagactccctccccagt

SEQ ID NO: 351336 - DNA, 20 bp, Artificial
  CRISPR gRNA sequence
aaaagactccctccccagtg

SEQ ID NO: 351337 - DNA, 20 bp, Artificial
  CRISPR gRNA sequence
tccctccccagtgaggtctt

SEQ ID NO: 351338 - DNA, 20 bp, Artificial
  CRISPR gRNA sequence
ccccagtgaggtcttgagcc

SEQ ID NO: 351339 - DNA, 20 bp, Artificial
  CRISPR gRNA sequence
cccagtgaggtcttgagccc

SEQ ID NO: 351340 - DNA, 20 bp, Artificial
  CRISPR gRNA sequence
ccagtgaggtcttgagccca

SEQ ID NO: 351341 - DNA, 20 bp, Artificial
  CRISPR gRNA sequence
cagtgaggtcttgagcccag

SEQ ID NO: 351342 - DNA, 20 bp, Artificial
  CRISPR gRNA sequence
aggtcttgagcccaggggtg

SEQ ID NO: 351343 - DNA, 20 bp, Artificial
  CRISPR gRNA sequence
ggtcttgagcccaggggtgc

SEQ ID NO: 351344 - DNA, 20 bp, Artificial
  CRISPR gRNA sequence
gcccaggggtgcaggatact

SEQ ID NO: 351345 - DNA, 20 bp, Artificial
  CRISPR gRNA sequence
caggggtgcaggatacttgg

SEQ ID NO: 351346 - DNA, 20 bp, Artificial
  CRISPR gRNA sequence
tgcaggatacttggaagtga

SEQ ID NO: 351347 - DNA, 20 bp, Artificial
  CRISPR gRNA sequence
ctttgtttctgcccttcctt

SEQ ID NO: 351348 - DNA, 20 bp, Artificial
  CRISPR gRNA sequence
tttgtttctgcccttccttc

SEQ ID NO: 351349 - DNA, 20 bp, Artificial
  CRISPR gRNA sequence
gtttctgcccttccttcagg

SEQ ID NO: 351350 - DNA, 20 bp, Artificial
  CRISPR gRNA sequence
cccttccttcaggtagaatt

SEQ ID NO: 351351 - DNA, 20 bp, Artificial
  CRISPR gRNA sequence
ttcaggtagaattcagctac

SEQ ID NO: 351352 - DNA, 20 bp, Artificial
  CRISPR gRNA sequence
ttcagctactggaaaaatcc

SEQ ID NO: 351353 - DNA, 20 bp, Artificial
  CRISPR gRNA sequence
tactggaaaaatccaagtgc

SEQ ID NO: 351354 - DNA, 20 bp, Artificial
  CRISPR gRNA sequence
actggaaaaatccaagtgct

SEQ ID NO: 351355 - DNA, 20 bp, Artificial
  CRISPR gRNA sequence
aaatccaagtgctgggaact

SEQ ID NO: 351356 - DNA, 20 bp, Artificial
  CRISPR gRNA sequence
agtgctgggaactgagcttc

SEQ ID NO: 351357 - DNA, 20 bp, Artificial
  CRISPR gRNA sequence
tgctgggaactgagcttcta

SEQ ID NO: 351358 - DNA, 20 bp, Artificial
  CRISPR gRNA sequence
ctgagcttctagagcaatct

SEQ ID NO: 351359 - DNA, 20 bp, Artificial
  CRISPR gRNA sequence
ttctagagcaatctgagttg

SEQ ID NO: 351360 - DNA, 20 bp, Artificial
  CRISPR gRNA sequence
gagcaatctgagttgtagta

SEQ ID NO: 351361 - DNA, 20 bp, Artificial
  CRISPR gRNA sequence
agcaatctgagttgtagtaa

SEQ ID NO: 351362 - DNA, 20 bp, Artificial
  CRISPR gRNA sequence
tctgagttgtagtaaaggaa

SEQ ID NO: 351363 - DNA, 20 bp, Artificial
  CRISPR gRNA sequence
ctgagttgtagtaaaggaat

SEQ ID NO: 351364 - DNA, 20 bp, Artificial
  CRISPR gRNA sequence
gtaaaggaatgggtgctcat

SEQ ID NO: 351365 - DNA, 20 bp, Artificial
  CRISPR gRNA sequence
ggaatgggtgctcataagcc

SEQ ID NO: 351366 - DNA, 20 bp, Artificial
  CRISPR gRNA sequence
gaatgggtgctcataagccc

SEQ ID NO: 351367 - DNA, 20 bp, Artificial
  CRISPR gRNA sequence
ccgggtttacaaatcttcat

SEQ ID NO: 351368 - DNA, 20 bp, Artificial
  CRISPR gRNA sequence
ggtttacaaatcttcattag

SEQ ID NO: 351369 - DNA, 20 bp, Artificial
  CRISPR gRNA sequence
aatcttcattagtagctcca

SEQ ID NO: 351370 - DNA, 20 bp, Artificial
  CRISPR gRNA sequence
attagtagctccacagtttt

SEQ ID NO: 351371 - DNA, 20 bp, Artificial
  CRISPR gRNA sequence
tagtagctccacagttttga

SEQ ID NO: 351372 - DNA, 20 bp, Artificial
  CRISPR gRNA sequence
tagctccacagttttgagag

SEQ ID NO: 351373 - DNA, 20 bp, Artificial
  CRISPR gRNA sequence
tccacagttttgagagtaga

SEQ ID NO: 351374 - DNA, 20 bp, Artificial
  CRISPR gRNA sequence
tttgagagtagacagtgaat

SEQ ID NO: 351375 - DNA, 20 bp, Artificial
  CRISPR gRNA sequence
ttgagagtagacagtgaatg

SEQ ID NO: 351376 - DNA, 20 bp, Artificial
  CRISPR gRNA sequence
tgagagtagacagtgaatga

SEQ ID NO: 351377 - DNA, 20 bp, Artificial
  CRISPR gRNA sequence
agtagacagtgaatgagggt

SEQ ID NO: 351378 - DNA, 20 bp, Artificial
  CRISPR gRNA sequence
gtagacagtgaatgagggta

SEQ ID NO: 351379 - DNA, 20 bp, Artificial
  CRISPR gRNA sequence
gaatgagggtaaggttatac

SEQ ID NO: 351380 - DNA, 20 bp, Artificial
  CRISPR gRNA sequence
aatgagggtaaggttataca

SEQ ID NO: 351381 - DNA, 20 bp, Artificial
  CRISPR gRNA sequence
atgagggtaaggttatacaa

SEQ ID NO: 351382 - DNA, 20 bp, Artificial
  CRISPR gRNA sequence
agggtaaggttatacaaggg

SEQ ID NO: 351383 - DNA, 20 bp, Artificial
  CRISPR gRNA sequence
aaggttatacaagggtggcg

SEQ ID NO: 351384 - DNA, 20 bp, Artificial
  CRISPR gRNA sequence
gttatacaagggtggcgtag

SEQ ID NO: 351385 - DNA, 20 bp, Artificial
  CRISPR gRNA sequence
gtggcgtagtggataattgt

SEQ ID NO: 351386 - DNA, 20 bp, Artificial
  CRISPR gRNA sequence
tggcgtagtggataattgtg

SEQ ID NO: 351387 - DNA, 20 bp, Artificial
  CRISPR gRNA sequence
aatcccacttctattatttg

SEQ ID NO: 351388 - DNA, 20 bp, Artificial
  CRISPR gRNA sequence
tgtagaattccttaattcat

SEQ ID NO: 351389 - DNA, 20 bp, Artificial
  CRISPR gRNA sequence
agaattccttaattcataag

SEQ ID NO: 351390 - DNA, 20 bp, Artificial
  CRISPR gRNA sequence
ccttaattcataagaagtga

SEQ ID NO: 351391 - DNA, 20 bp, Artificial
  CRISPR gRNA sequence
taattcataagaagtgaaag

SEQ ID NO: 351392 - DNA, 20 bp, Artificial
  CRISPR gRNA sequence
gaagtgaaagtggaaaatgc

SEQ ID NO: 351393 - DNA, 20 bp, Artificial
  CRISPR gRNA sequence
aatgccagatattcaattcc

SEQ ID NO: 351394 - DNA, 20 bp, Artificial
  CRISPR gRNA sequence
attcaattcccagcccccct

SEQ ID NO: 351395 - DNA, 20 bp, Artificial
  CRISPR gRNA sequence
tcaattcccagccccccttg

SEQ ID NO: 351396 - DNA, 20 bp, Artificial
  CRISPR gRNA sequence
ttcccagccccccttggaga

SEQ ID NO: 351397 - DNA, 20 bp, Artificial
  CRISPR gRNA sequence
tcccagccccccttggagat

SEQ ID NO: 351398 - DNA, 20 bp, Artificial
  CRISPR gRNA sequence
ccccccttggagataggaca

SEQ ID NO: 351399 - DNA, 20 bp, Artificial
  CRISPR gRNA sequence
taggacatggacatgtgacc

SEQ ID NO: 351400 - DNA, 20 bp, Artificial
  CRISPR gRNA sequence
aggacatggacatgtgacct

SEQ ID NO: 351401 - DNA, 20 bp, Artificial
  CRISPR gRNA sequence
atggacatgtgacctaggat

SEQ ID NO: 351402 - DNA, 20 bp, Artificial
  CRISPR gRNA sequence
taggattggccactcaatcc

SEQ ID NO: 351403 - DNA, 20 bp, Artificial
  CRISPR gRNA sequence
aatcccagactttgaattat

SEQ ID NO: 351404 - DNA, 20 bp, Artificial
  CRISPR gRNA sequence
ccagactttgaattataagc

SEQ ID NO: 351405 - DNA, 20 bp, Artificial
  CRISPR gRNA sequence
agactttgaattataagcta

SEQ ID NO: 351406 - DNA, 20 bp, Artificial
  CRISPR gRNA sequence
gaattataagctagagatga

SEQ ID NO: 351407 - DNA, 20 bp, Artificial
  CRISPR gRNA sequence
aattataagctagagatgaa

SEQ ID NO: 351408 - DNA, 20 bp, Artificial
  CRISPR gRNA sequence
aagctagagatgaaaggatg

SEQ ID NO: 351409 - DNA, 20 bp, Artificial
  CRISPR gRNA sequence
ctagagatgaaaggatgaag

SEQ ID NO: 351410 - DNA, 20 bp, Artificial
  CRISPR gRNA sequence
tagagatgaaaggatgaaga

SEQ ID NO: 351411 - DNA, 20 bp, Artificial
  CRISPR gRNA sequence
agagatgaaaggatgaagaa

SEQ ID NO: 351412 - DNA, 20 bp, Artificial
  CRISPR gRNA sequence
aaaggatgaagaagggaccc

SEQ ID NO: 351413 - DNA, 20 bp, Artificial
  CRISPR gRNA sequence
aggatgaagaagggaccctg

SEQ ID NO: 351414 - DNA, 20 bp, Artificial
  CRISPR gRNA sequence
ccctggagaattcattttca

SEQ ID NO: 351415 - DNA, 20 bp, Artificial
  CRISPR gRNA sequence
tggagaattcattttcatgg

SEQ ID NO: 351416 - DNA, 20 bp, Artificial
  CRISPR gRNA sequence
gaattcattttcatggcaga

SEQ ID NO: 351417 - DNA, 20 bp, Artificial
  CRISPR gRNA sequence
cattttcatggcagacagtg

SEQ ID NO: 351418 - DNA, 20 bp, Artificial
  CRISPR gRNA sequence
tttcatggcagacagtgcag

SEQ ID NO: 351419 - DNA, 20 bp, Artificial
  CRISPR gRNA sequence
ggcagacagtgcagcagtaa

SEQ ID NO: 351420 - DNA, 20 bp, Artificial
  CRISPR gRNA sequence
gcagcagtaacagtaatatc

SEQ ID NO: 351421 - DNA, 20 bp, Artificial
  CRISPR gRNA sequence
aacagtaatatcaagtttcc

SEQ ID NO: 351422 - DNA, 20 bp, Artificial
  CRISPR gRNA sequence
taatatcaagtttccaagtc

SEQ ID NO: 351423 - DNA, 20 bp, Artificial
  CRISPR gRNA sequence
tatcaagtttccaagtccag

SEQ ID NO: 351424 - DNA, 20 bp, Artificial
  CRISPR gRNA sequence
tcaagtttccaagtccagca

SEQ ID NO: 351425 - DNA, 20 bp, Artificial
  CRISPR gRNA sequence
gtttccaagtccagcagaga

SEQ ID NO: 351426 - DNA, 20 bp, Artificial
  CRISPR gRNA sequence
ccaagtccagcagagacagt

SEQ ID NO: 351427 - DNA, 20 bp, Artificial
  CRISPR gRNA sequence
caagtccagcagagacagtg

SEQ ID NO: 351428 - DNA, 20 bp, Artificial
  CRISPR gRNA sequence
gtccagcagagacagtgagg

SEQ ID NO: 351429 - DNA, 20 bp, Artificial
  CRISPR gRNA sequence
cagcagagacagtgaggcag

SEQ ID NO: 351430 - DNA, 20 bp, Artificial
  CRISPR gRNA sequence
cagagacagtgaggcagtgg

SEQ ID NO: 351431 - DNA, 20 bp, Artificial
  CRISPR gRNA sequence
gagacagtgaggcagtggta

SEQ ID NO: 351432 - DNA, 20 bp, Artificial
  CRISPR gRNA sequence
gcagtggtagagtctgtgcc

SEQ ID NO: 351433 - DNA, 20 bp, Artificial
  CRISPR gRNA sequence
gtagagtctgtgcctagtgc

SEQ ID NO: 351434 - DNA, 20 bp, Artificial
  CRISPR gRNA sequence
tagagtctgtgcctagtgct

SEQ ID NO: 351435 - DNA, 20 bp, Artificial
  CRISPR gRNA sequence
agagtctgtgcctagtgctg

SEQ ID NO: 351436 - DNA, 20 bp, Artificial
  CRISPR gRNA sequence
tctgtgcctagtgctgggga

SEQ ID NO: 351437 - DNA, 20 bp, Artificial
  CRISPR gRNA sequence
gtgcctagtgctggggacag

SEQ ID NO: 351438 - DNA, 20 bp, Artificial
  CRISPR gRNA sequence
ggacagtggctgtgcatgaa

SEQ ID NO: 351439 - DNA, 20 bp, Artificial
  CRISPR gRNA sequence
gacagtggctgtgcatgaac

SEQ ID NO: 351440 - DNA, 20 bp, Artificial
  CRISPR gRNA sequence
atgaacaggatcatcatccc

SEQ ID NO: 351441 - DNA, 20 bp, Artificial
  CRISPR gRNA sequence
tgaacaggatcatcatccct

SEQ ID NO: 351442 - DNA, 20 bp, Artificial
  CRISPR gRNA sequence
caggatcatcatccctgggc

SEQ ID NO: 351443 - DNA, 20 bp, Artificial
  CRISPR gRNA sequence
ctgggctggttttgtaattt

SEQ ID NO: 351444 - DNA, 20 bp, Artificial
  CRISPR gRNA sequence
tgtaattttggctgtgctcc

SEQ ID NO: 351445 - DNA, 20 bp, Artificial
  CRISPR gRNA sequence
tttggctgtgctcccagcca

SEQ ID NO: 351446 - DNA, 20 bp, Artificial
  CRISPR gRNA sequence
ctgtgctcccagccacagcc

SEQ ID NO: 351447 - DNA, 20 bp, Artificial
  CRISPR gRNA sequence
tcttttcctgctcactttca

SEQ ID NO: 351448 - DNA, 20 bp, Artificial
  CRISPR gRNA sequence
tcctgctcactttcaaagca

SEQ ID NO: 351449 - DNA, 20 bp, Artificial
  CRISPR gRNA sequence
actttcaaagcatggttttg

SEQ ID NO: 351450 - DNA, 20 bp, Artificial
  CRISPR gRNA sequence
catggttttgcagaaacttc

SEQ ID NO: 351451 - DNA, 20 bp, Artificial
  CRISPR gRNA sequence
ggttttgcagaaacttctag

SEQ ID NO: 351452 - DNA, 20 bp, Artificial
  CRISPR gRNA sequence
cagaaacttctagcagttat

SEQ ID NO: 351453 - DNA, 20 bp, Artificial
  CRISPR gRNA sequence
tagcagttattggaaccaat

SEQ ID NO: 351454 - DNA, 20 bp, Artificial
  CRISPR gRNA sequence
accaatcagtatcttttcaa

SEQ ID NO: 351455 - DNA, 20 bp, Artificial
  CRISPR gRNA sequence
ccaatcagtatcttttcaat

SEQ ID NO: 351456 - DNA, 20 bp, Artificial
  CRISPR gRNA sequence
ggttccttttctacataaaa

SEQ ID NO: 351457 - DNA, 20 bp, Artificial
  CRISPR gRNA sequence
ttttctacataaaaaagcca

SEQ ID NO: 351458 - DNA, 20 bp, Artificial
  CRISPR gRNA sequence
ctacataaaaaagccaaagc

SEQ ID NO: 351459 - DNA, 20 bp, Artificial
  CRISPR gRNA sequence
agcttctgttgattgcaact

SEQ ID NO: 351460 - DNA, 20 bp, Artificial
  CRISPR gRNA sequence
tgcaactaagaactctatta

SEQ ID NO: 351461 - DNA, 20 bp, Artificial
  CRISPR gRNA sequence
aactaagaactctattaaag

SEQ ID NO: 351462 - DNA, 20 bp, Artificial
  CRISPR gRNA sequence
aagaactctattaaagaagc

SEQ ID NO: 351463 - DNA, 20 bp, Artificial
  CRISPR gRNA sequence
tctattaaagaagctggtac

SEQ ID NO: 351464 - DNA, 20 bp, Artificial
  CRISPR gRNA sequence
ctattaaagaagctggtacc

SEQ ID NO: 351465 - DNA, 20 bp, Artificial
  CRISPR gRNA sequence
agaagctggtaccaggaaac

SEQ ID NO: 351466 - DNA, 20 bp, Artificial
  CRISPR gRNA sequence
accaggaaacgagatgcact

SEQ ID NO: 351467 - DNA, 20 bp, Artificial
  CRISPR gRNA sequence
aaacgagatgcactaagcaa

SEQ ID NO: 351468 - DNA, 20 bp, Artificial
  CRISPR gRNA sequence
aacgagatgcactaagcaac

SEQ ID NO: 351469 - DNA, 20 bp, Artificial
  CRISPR gRNA sequence
tacaatgtgaattgacctca

SEQ ID NO: 351470 - DNA, 20 bp, Artificial
  CRISPR gRNA sequence
caatgtgaattgacctcata

SEQ ID NO: 351471 - DNA, 20 bp, Artificial
  CRISPR gRNA sequence
aatgtgaattgacctcatag

SEQ ID NO: 351472 - DNA, 20 bp, Artificial
  CRISPR gRNA sequence
tgtgaattgacctcatagag

SEQ ID NO: 351473 - DNA, 20 bp, Artificial
  CRISPR gRNA sequence
gtgaattgacctcatagagg

SEQ ID NO: 351474 - DNA, 20 bp, Artificial
  CRISPR gRNA sequence
attgacctcatagaggaggt

SEQ ID NO: 351475 - DNA, 20 bp, Artificial
  CRISPR gRNA sequence
tcatagaggaggtaagatac

SEQ ID NO: 351476 - DNA, 20 bp, Artificial
  CRISPR gRNA sequence
catagaggaggtaagataca

SEQ ID NO: 351477 - DNA, 20 bp, Artificial
  CRISPR gRNA sequence
gaggtaagatacaaggcaat

SEQ ID NO: 351478 - DNA, 20 bp, Artificial
  CRISPR gRNA sequence
aggtaagatacaaggcaata

SEQ ID NO: 351479 - DNA, 20 bp, Artificial
  CRISPR gRNA sequence
atacaaggcaataaggacct

SEQ ID NO: 351480 - DNA, 20 bp, Artificial
  CRISPR gRNA sequence
gcaataaggacctgagtttt

SEQ ID NO: 351481 - DNA, 20 bp, Artificial
  CRISPR gRNA sequence
taaggacctgagttttgagc

SEQ ID NO: 351482 - DNA, 20 bp, Artificial
  CRISPR gRNA sequence
aaggacctgagttttgagct

SEQ ID NO: 351483 - DNA, 20 bp, Artificial
  CRISPR gRNA sequence
gacctgagttttgagctggg

SEQ ID NO: 351484 - DNA, 20 bp, Artificial
  CRISPR gRNA sequence
tgagttttgagctgggaagt

SEQ ID NO: 351485 - DNA, 20 bp, Artificial
  CRISPR gRNA sequence
tggtgctccttattatgcaa

SEQ ID NO: 351486 - DNA, 20 bp, Artificial
  CRISPR gRNA sequence
cttattatgcaatggtatga

SEQ ID NO: 351487 - DNA, 20 bp, Artificial
  CRISPR gRNA sequence
attatgcaatggtatgatag

SEQ ID NO: 351488 - DNA, 20 bp, Artificial
  CRISPR gRNA sequence
atgatagtggctgtttctta

SEQ ID NO: 351489 - DNA, 20 bp, Artificial
  CRISPR gRNA sequence
tgtttcttacagtacttacc

SEQ ID NO: 351490 - DNA, 20 bp, Artificial
  CRISPR gRNA sequence
agtacttaccaagtttatat

SEQ ID NO: 351491 - DNA, 20 bp, Artificial
  CRISPR gRNA sequence
aagtttatataagaaacaat

SEQ ID NO: 351492 - DNA, 20 bp, Artificial
  CRISPR gRNA sequence
atataagaaacaataagaaa

SEQ ID NO: 351493 - DNA, 20 bp, Artificial
  CRISPR gRNA sequence
taagaaacaataagaaaaag

SEQ ID NO: 351494 - DNA, 20 bp, Artificial
  CRISPR gRNA sequence
aagaaacaataagaaaaagc

SEQ ID NO: 351495 - DNA, 20 bp, Artificial
  CRISPR gRNA sequence
agaaacaataagaaaaagca

SEQ ID NO: 351496 - DNA, 20 bp, Artificial
  CRISPR gRNA sequence
gaaaaagcagggcttaaatt

SEQ ID NO: 351497 - DNA, 20 bp, Artificial
  CRISPR gRNA sequence
aaaaagcagggcttaaattg

SEQ ID NO: 351498 - DNA, 20 bp, Artificial
  CRISPR gRNA sequence
agcagggcttaaattgagga

SEQ ID NO: 351499 - DNA, 20 bp, Artificial
  CRISPR gRNA sequence
attgaggacagcctgtctaa

SEQ ID NO: 351500 - DNA, 20 bp, Artificial
  CRISPR gRNA sequence
gaggacagcctgtctaaaag

SEQ ID NO: 351501 - DNA, 20 bp, Artificial
  CRISPR gRNA sequence
ggacagcctgtctaaaagca

SEQ ID NO: 351502 - DNA, 20 bp, Artificial
  CRISPR gRNA sequence
gcctgtctaaaagcagagaa

SEQ ID NO: 351503 - DNA, 20 bp, Artificial
  CRISPR gRNA sequence
cctgtctaaaagcagagaat

SEQ ID NO: 351504 - DNA, 20 bp, Artificial
  CRISPR gRNA sequence
gcagagaataggaaaaaaca

SEQ ID NO: 351505 - DNA, 20 bp, Artificial
  CRISPR gRNA sequence
cagagaataggaaaaaacaa

SEQ ID NO: 351506 - DNA, 20 bp, Artificial
  CRISPR gRNA sequence
aacaaaggactttacttaaa

SEQ ID NO: 351507 - DNA, 20 bp, Artificial
  CRISPR gRNA sequence
aaaaagtctctttctgcctg

SEQ ID NO: 351508 - DNA, 20 bp, Artificial
  CRISPR gRNA sequence
ctgcctgcagcttgcaaaat

SEQ ID NO: 351509 - DNA, 20 bp, Artificial
  CRISPR gRNA sequence
agcttgcaaaataagttatt

SEQ ID NO: 351510 - DNA, 20 bp, Artificial
  CRISPR gRNA sequence
aataagttattgagcattca

SEQ ID NO: 351511 - DNA, 20 bp, Artificial
  CRISPR gRNA sequence
attgagcattcaaagatttg

SEQ ID NO: 351512 - DNA, 20 bp, Artificial
  CRISPR gRNA sequence
attcaaagatttgaagctgt

SEQ ID NO: 351513 - DNA, 20 bp, Artificial
  CRISPR gRNA sequence
aaaataacttaattttctac

SEQ ID NO: 351514 - DNA, 20 bp, Artificial
  CRISPR gRNA sequence
aataacttaattttctacta

SEQ ID NO: 351515 - DNA, 20 bp, Artificial
  CRISPR gRNA sequence
ataacttaattttctactag

SEQ ID NO: 351516 - DNA, 20 bp, Artificial
  CRISPR gRNA sequence
tttctactagaggataaatt

SEQ ID NO: 351517 - DNA, 20 bp, Artificial
  CRISPR gRNA sequence
ctagaggataaatttagtgt

SEQ ID NO: 351518 - DNA, 20 bp, Artificial
  CRISPR gRNA sequence
tagaggataaatttagtgtg

SEQ ID NO: 351519 - DNA, 20 bp, Artificial
  CRISPR gRNA sequence
gaggataaatttagtgtgag

SEQ ID NO: 351520 - DNA, 20 bp, Artificial
  CRISPR gRNA sequence
ggataaatttagtgtgagga

SEQ ID NO: 351521 - DNA, 20 bp, Artificial
  CRISPR gRNA sequence
gataaatttagtgtgaggag

SEQ ID NO: 351522 - DNA, 20 bp, Artificial
  CRISPR gRNA sequence
ttagtgtgaggagaggtatg

SEQ ID NO: 351523 - DNA, 20 bp, Artificial
  CRISPR gRNA sequence
tagtgtgaggagaggtatgc

SEQ ID NO: 351524 - DNA, 20 bp, Artificial
  CRISPR gRNA sequence
agtgtgaggagaggtatgca

SEQ ID NO: 351525 - DNA, 20 bp, Artificial
  CRISPR gRNA sequence
tgtgaggagaggtatgcagg

SEQ ID NO: 351526 - DNA, 20 bp, Artificial
  CRISPR gRNA sequence
gaggagaggtatgcagggag

SEQ ID NO: 351527 - DNA, 20 bp, Artificial
  CRISPR gRNA sequence
agaggtatgcagggagtaga

SEQ ID NO: 351528 - DNA, 20 bp, Artificial
  CRISPR gRNA sequence
tgcagggagtagaaagtgcc

SEQ ID NO: 351529 - DNA, 20 bp, Artificial
  CRISPR gRNA sequence
gcagggagtagaaagtgcct

SEQ ID NO: 351530 - DNA, 20 bp, Artificial
  CRISPR gRNA sequence
ggagtagaaagtgcctagga

SEQ ID NO: 351531 - DNA, 20 bp, Artificial
  CRISPR gRNA sequence
ttgacctgcaataccccttg

SEQ ID NO: 351532 - DNA, 20 bp, Artificial
  CRISPR gRNA sequence
tgcaataccccttgaagccc

SEQ ID NO: 351533 - DNA, 20 bp, Artificial
  CRISPR gRNA sequence
ccccttgaagccctggatat

SEQ ID NO: 351534 - DNA, 20 bp, Artificial
  CRISPR gRNA sequence
ccttgaagccctggatataa

SEQ ID NO: 351535 - DNA, 20 bp, Artificial
  CRISPR gRNA sequence
cttgaagccctggatataag

SEQ ID NO: 351536 - DNA, 20 bp, Artificial
  CRISPR gRNA sequence
agccctggatataagaggtt

SEQ ID NO: 351537 - DNA, 20 bp, Artificial
  CRISPR gRNA sequence
gatataagaggttcagaatc

SEQ ID NO: 351538 - DNA, 20 bp, Artificial
  CRISPR gRNA sequence
agaggttcagaatctggtca

SEQ ID NO: 351539 - DNA, 20 bp, Artificial
  CRISPR gRNA sequence
aggttcagaatctggtcaca

SEQ ID NO: 351540 - DNA, 20 bp, Artificial
  CRISPR gRNA sequence
gttcagaatctggtcacaga

SEQ ID NO: 351541 - DNA, 20 bp, Artificial
  CRISPR gRNA sequence
aatctggtcacagagagtct

SEQ ID NO: 351542 - DNA, 20 bp, Artificial
  CRISPR gRNA sequence
ggtcacagagagtcttagct

SEQ ID NO: 351543 - DNA, 20 bp, Artificial
  CRISPR gRNA sequence
gtcacagagagtcttagctg

SEQ ID NO: 351544 - DNA, 20 bp, Artificial
  CRISPR gRNA sequence
gagagtcttagctgaggttc

SEQ ID NO: 351545 - DNA, 20 bp, Artificial
  CRISPR gRNA sequence
agagtcttagctgaggttcc

SEQ ID NO: 351546 - DNA, 20 bp, Artificial
  CRISPR gRNA sequence
aggttccaggtttgttgttc

SEQ ID NO: 351547 - DNA, 20 bp, Artificial
  CRISPR gRNA sequence
ggttccaggtttgttgttca

SEQ ID NO: 351548 - DNA, 20 bp, Artificial
  CRISPR gRNA sequence
gttccaggtttgttgttcaa

SEQ ID NO: 351549 - DNA, 20 bp, Artificial
  CRISPR gRNA sequence
ttgttgttcaagggaatcaa

SEQ ID NO: 351550 - DNA, 20 bp, Artificial
  CRISPR gRNA sequence
gttgttcaagggaatcaaca

SEQ ID NO: 351551 - DNA, 20 bp, Artificial
  CRISPR gRNA sequence
caagggaatcaacagagaac

SEQ ID NO: 351552 - DNA, 20 bp, Artificial
  CRISPR gRNA sequence
aagggaatcaacagagaact

SEQ ID NO: 351553 - DNA, 20 bp, Artificial
  CRISPR gRNA sequence
tgggatttaaacatcatttt

SEQ ID NO: 351554 - DNA, 20 bp, Artificial
  CRISPR gRNA sequence
gatttaaacatcattttgag

SEQ ID NO: 351555 - DNA, 20 bp, Artificial
  CRISPR gRNA sequence
tgagaagtgaaaaatcacca

SEQ ID NO: 351556 - DNA, 20 bp, Artificial
  CRISPR gRNA sequence
gagaagtgaaaaatcaccat

SEQ ID NO: 351557 - DNA, 20 bp, Artificial
  CRISPR gRNA sequence
gtgaaaaatcaccatgggac

SEQ ID NO: 351558 - DNA, 20 bp, Artificial
  CRISPR gRNA sequence
accatgggacaagttcctct

SEQ ID NO: 351559 - DNA, 20 bp, Artificial
  CRISPR gRNA sequence
caagttcctctgagtattcc

SEQ ID NO: 351560 - DNA, 20 bp, Artificial
  CRISPR gRNA sequence
tattccaagctcctttgtaa

SEQ ID NO: 351561 - DNA, 20 bp, Artificial
  CRISPR gRNA sequence
aaaactgaatgccatttgca

SEQ ID NO: 351562 - DNA, 20 bp, Artificial
  CRISPR gRNA sequence
ttgcacagaactgtactttt

SEQ ID NO: 351563 - DNA, 20 bp, Artificial
  CRISPR gRNA sequence
tgcacagaactgtactttta

SEQ ID NO: 351564 - DNA, 20 bp, Artificial
  CRISPR gRNA sequence
gtacttttaaggctcttaca

SEQ ID NO: 351565 - DNA, 20 bp, Artificial
  CRISPR gRNA sequence
taaggctcttacatggtttc

SEQ ID NO: 351566 - DNA, 20 bp, Artificial
  CRISPR gRNA sequence
ccagtccactgttcaaaact

SEQ ID NO: 351567 - DNA, 20 bp, Artificial
  CRISPR gRNA sequence
agtccactgttcaaaactca

SEQ ID NO: 351568 - DNA, 20 bp, Artificial
  CRISPR gRNA sequence
ctttctgtttattgactttt

SEQ ID NO: 351569 - DNA, 20 bp, Artificial
  CRISPR gRNA sequence
tttattgactttttagcttc

SEQ ID NO: 351570 - DNA, 20 bp, Artificial
  CRISPR gRNA sequence
ttattgactttttagcttct

SEQ ID NO: 351571 - DNA, 20 bp, Artificial
  CRISPR gRNA sequence
tgcaaataaaataatattct

SEQ ID NO: 351572 - DNA, 20 bp, Artificial
  CRISPR gRNA sequence
cttcctttatacaataatat

SEQ ID NO: 351573 - DNA, 20 bp, Artificial
  CRISPR gRNA sequence
tcctttatacaataatatca

SEQ ID NO: 351574 - DNA, 20 bp, Artificial
  CRISPR gRNA sequence
cagagtgttttatgtataat

SEQ ID NO: 351575 - DNA, 20 bp, Artificial
  CRISPR gRNA sequence
ataataagaaattcaccctt

SEQ ID NO: 351576 - DNA, 20 bp, Artificial
  CRISPR gRNA sequence
ctctattcactctttatcct

SEQ ID NO: 351577 - DNA, 20 bp, Artificial
  CRISPR gRNA sequence
ctattcactctttatcctga

SEQ ID NO: 351578 - DNA, 20 bp, Artificial
  CRISPR gRNA sequence
attcactctttatcctgaga

SEQ ID NO: 351579 - DNA, 20 bp, Artificial
  CRISPR gRNA sequence
tttatcctgagagagaaact

SEQ ID NO: 351580 - DNA, 20 bp, Artificial
  CRISPR gRNA sequence
ttatcctgagagagaaactg

SEQ ID NO: 351581 - DNA, 20 bp, Artificial
  CRISPR gRNA sequence
ctgagagagaaactgaggca

SEQ ID NO: 351582 - DNA, 20 bp, Artificial
  CRISPR gRNA sequence
gagagagaaactgaggcaca

SEQ ID NO: 351583 - DNA, 20 bp, Artificial
  CRISPR gRNA sequence
agagagaaactgaggcacag

SEQ ID NO: 351584 - DNA, 20 bp, Artificial
  CRISPR gRNA sequence
ctgaggcacagaggcttgat

SEQ ID NO: 351585 - DNA, 20 bp, Artificial
  CRISPR gRNA sequence
tgaggcacagaggcttgatc

SEQ ID NO: 351586 - DNA, 20 bp, Artificial
  CRISPR gRNA sequence
cagaggcttgatcaggtctg

SEQ ID NO: 351587 - DNA, 20 bp, Artificial
  CRISPR gRNA sequence
agaggcttgatcaggtctgc

SEQ ID NO: 351588 - DNA, 20 bp, Artificial
  CRISPR gRNA sequence
ggtctgcaggttatcatgat

SEQ ID NO: 351589 - DNA, 20 bp, Artificial
  CRISPR gRNA sequence
aggttatcatgatcagctcc

SEQ ID NO: 351590 - DNA, 20 bp, Artificial
  CRISPR gRNA sequence
catgatcagctcccagaaca

SEQ ID NO: 351591 - DNA, 20 bp, Artificial
  CRISPR gRNA sequence
tcagctcccagaacaaagta

SEQ ID NO: 351592 - DNA, 20 bp, Artificial
  CRISPR gRNA sequence
ctcccagaacaaagtaaaga

SEQ ID NO: 351593 - DNA, 20 bp, Artificial
  CRISPR gRNA sequence
agccaaaatgtaaacttttc

SEQ ID NO: 351594 - DNA, 20 bp, Artificial
  CRISPR gRNA sequence
acttttccagactttgtgac

SEQ ID NO: 351595 - DNA, 20 bp, Artificial
  CRISPR gRNA sequence
tttccagactttgtgactgg

SEQ ID NO: 351596 - DNA, 20 bp, Artificial
  CRISPR gRNA sequence
agactttgtgactggtggtc

SEQ ID NO: 351597 - DNA, 20 bp, Artificial
  CRISPR gRNA sequence
tgactggtggtccagtgtgt

SEQ ID NO: 351598 - DNA, 20 bp, Artificial
  CRISPR gRNA sequence
tggtggtccagtgtgtgaga

SEQ ID NO: 351599 - DNA, 20 bp, Artificial
  CRISPR gRNA sequence
ggtggtccagtgtgtgagat

SEQ ID NO: 351600 - DNA, 20 bp, Artificial
  CRISPR gRNA sequence
cagtgtgtgagataggtact

SEQ ID NO: 351601 - DNA, 20 bp, Artificial
  CRISPR gRNA sequence
agataggtactcagatgtcc

SEQ ID NO: 351602 - DNA, 20 bp, Artificial
  CRISPR gRNA sequence
tactcagatgtcctggcttt

SEQ ID NO: 351603 - DNA, 20 bp, Artificial
  CRISPR gRNA sequence
tcagtctgatttttattatc

SEQ ID NO: 351604 - DNA, 20 bp, Artificial
  CRISPR gRNA sequence
tgatttttattatccagttc

SEQ ID NO: 351605 - DNA, 20 bp, Artificial
  CRISPR gRNA sequence
tttattatccagttccagcc

SEQ ID NO: 351606 - DNA, 20 bp, Artificial
  CRISPR gRNA sequence
tattatccagttccagccaa

SEQ ID NO: 351607 - DNA, 20 bp, Artificial
  CRISPR gRNA sequence
atccagttccagccaagagc

SEQ ID NO: 351608 - DNA, 20 bp, Artificial
  CRISPR gRNA sequence
agccaagagcaagatgccca

SEQ ID NO: 351609 - DNA, 20 bp, Artificial
  CRISPR gRNA sequence
atttcatctgctacaacaca

SEQ ID NO: 351610 - DNA, 20 bp, Artificial
  CRISPR gRNA sequence
catctgctacaacacaaaga

SEQ ID NO: 351611 - DNA, 20 bp, Artificial
  CRISPR gRNA sequence
aaagatggaacgctgttatc

SEQ ID NO: 351612 - DNA, 20 bp, Artificial
  CRISPR gRNA sequence
aacgctctgttctgcgcctg

SEQ ID NO: 351613 - DNA, 20 bp, Artificial
  CRISPR gRNA sequence
ctgcgcctgcagccactgca

SEQ ID NO: 351614 - DNA, 20 bp, Artificial
  CRISPR gRNA sequence
gcctgcagccactgcacagc

SEQ ID NO: 351615 - DNA, 20 bp, Artificial
  CRISPR gRNA sequence
tgcacagcaagctaaattct

SEQ ID NO: 351616 - DNA, 20 bp, Artificial
  CRISPR gRNA sequence
gcacagcaagctaaattctt

SEQ ID NO: 351617 - DNA, 20 bp, Artificial
  CRISPR gRNA sequence
cagcaagctaaattcttggg

SEQ ID NO: 351618 - DNA, 20 bp, Artificial
  CRISPR gRNA sequence
tcacttccttgttcatttca

SEQ ID NO: 351619 - DNA, 20 bp, Artificial
  CRISPR gRNA sequence
gttcatttcacagatgtatg

SEQ ID NO: 351620 - DNA, 20 bp, Artificial
  CRISPR gRNA sequence
catttcacagatgtatgtgg

SEQ ID NO: 351621 - DNA, 20 bp, Artificial
  CRISPR gRNA sequence
gtatgtggaagaaacatcac

SEQ ID NO: 351622 - DNA, 20 bp, Artificial
  CRISPR gRNA sequence
tatgtggaagaaacatcacc

SEQ ID NO: 351623 - DNA, 20 bp, Artificial
  CRISPR gRNA sequence
atgtggaagaaacatcacca

SEQ ID NO: 351624 - DNA, 20 bp, Artificial
  CRISPR gRNA sequence
gtggaagaaacatcaccagg

SEQ ID NO: 351625 - DNA, 20 bp, Artificial
  CRISPR gRNA sequence
catcaccagggagttgatct

SEQ ID NO: 351626 - DNA, 20 bp, Artificial
  CRISPR gRNA sequence
caccagggagttgatctgag

SEQ ID NO: 351627 - DNA, 20 bp, Artificial
  CRISPR gRNA sequence
accagggagttgatctgaga

SEQ ID NO: 351628 - DNA, 20 bp, Artificial
  CRISPR gRNA sequence
ccagggagttgatctgagaa

SEQ ID NO: 351629 - DNA, 20 bp, Artificial
  CRISPR gRNA sequence
gagttgatctgagaagggta

SEQ ID NO: 351630 - DNA, 20 bp, Artificial
  CRISPR gRNA sequence
ctgagaagggtacagacgtg

SEQ ID NO: 351631 - DNA, 20 bp, Artificial
  CRISPR gRNA sequence
cagacgtgcagcatgtctgc

SEQ ID NO: 351632 - DNA, 20 bp, Artificial
  CRISPR gRNA sequence
gacgtgcagcatgtctgcca

SEQ ID NO: 351633 - DNA, 20 bp, Artificial
  CRISPR gRNA sequence
acgtgcagcatgtctgccag

SEQ ID NO: 351634 - DNA, 20 bp, Artificial
  CRISPR gRNA sequence
catgtctgccagaggaaact

SEQ ID NO: 351635 - DNA, 20 bp, Artificial
  CRISPR gRNA sequence
atgtctgccagaggaaactt

SEQ ID NO: 351636 - DNA, 20 bp, Artificial
  CRISPR gRNA sequence
tgtctgccagaggaaacttg

SEQ ID NO: 351637 - DNA, 20 bp, Artificial
  CRISPR gRNA sequence
cagaggaaacttggggcctg

SEQ ID NO: 351638 - DNA, 20 bp, Artificial
  CRISPR gRNA sequence
gaaacttggggcctgtggcc

SEQ ID NO: 351639 - DNA, 20 bp, Artificial
  CRISPR gRNA sequence
ttggggcctgtggccaagtt

SEQ ID NO: 351640 - DNA, 20 bp, Artificial
  CRISPR gRNA sequence
gccaagttcagtgttcattt

SEQ ID NO: 351641 - DNA, 20 bp, Artificial
  CRISPR gRNA sequence
ttggtttttccattttcctt

SEQ ID NO: 351642 - DNA, 20 bp, Artificial
  CRISPR gRNA sequence
tttttccattttccttcaga

SEQ ID NO: 351643 - DNA, 20 bp, Artificial
  CRISPR gRNA sequence
ccttcagaaagtccctttgt

SEQ ID NO: 351644 - DNA, 20 bp, Artificial
  CRISPR gRNA sequence
aaagtccctttgttggtctc

SEQ ID NO: 351645 - DNA, 20 bp, Artificial
  CRISPR gRNA sequence
cctttgttggtctctggtgt

SEQ ID NO: 351646 - DNA, 20 bp, Artificial
  CRISPR gRNA sequence
ggtctctggtgtcagctctc

SEQ ID NO: 351647 - DNA, 20 bp, Artificial
  CRISPR gRNA sequence
ctctggtgtcagctctctgg

SEQ ID NO: 351648 - DNA, 20 bp, Artificial
  CRISPR gRNA sequence
gctctctggaagtgtcacac

SEQ ID NO: 351649 - DNA, 20 bp, Artificial
  CRISPR gRNA sequence
ctggaagtgtcacactagca

SEQ ID NO: 351650 - DNA, 20 bp, Artificial
  CRISPR gRNA sequence
cacactagcatagactgtga

SEQ ID NO: 351651 - DNA, 20 bp, Artificial
  CRISPR gRNA sequence
ctgtgatggaatttgtttcc

SEQ ID NO: 351652 - DNA, 20 bp, Artificial
  CRISPR gRNA sequence
gatggaatttgtttcctgga

SEQ ID NO: 351653 - DNA, 20 bp, Artificial
  CRISPR gRNA sequence
tttgtttcctggacagactc

SEQ ID NO: 351654 - DNA, 20 bp, Artificial
  CRISPR gRNA sequence
ttgtttcctggacagactct

SEQ ID NO: 351655 - DNA, 20 bp, Artificial
  CRISPR gRNA sequence
ttcctggacagactctggga

SEQ ID NO: 351656 - DNA, 20 bp, Artificial
  CRISPR gRNA sequence
tcctggacagactctgggac

SEQ ID NO: 351657 - DNA, 20 bp, Artificial
  CRISPR gRNA sequence
agactctgggacaggctctg

SEQ ID NO: 351658 - DNA, 20 bp, Artificial
  CRISPR gRNA sequence
ctctgggacaggctctgtgg

SEQ ID NO: 351659 - DNA, 20 bp, Artificial
  CRISPR gRNA sequence
ctctgtggcagcaacatata

SEQ ID NO: 351660 - DNA, 20 bp, Artificial
  CRISPR gRNA sequence
tgtggcagcaacatatatgg

SEQ ID NO: 351661 - DNA, 20 bp, Artificial
  CRISPR gRNA sequence
agcaacatatatggtggtgc

SEQ ID NO: 351662 - DNA, 20 bp, Artificial
  CRISPR gRNA sequence
gcaacatatatggtggtgca

SEQ ID NO: 351663 - DNA, 20 bp, Artificial
  CRISPR gRNA sequence
caacatatatggtggtgcaa

SEQ ID NO: 351664 - DNA, 20 bp, Artificial
  CRISPR gRNA sequence
tatggtggtgcaagggtcct

SEQ ID NO: 351665 - DNA, 20 bp, Artificial
  CRISPR gRNA sequence
gtggtgcaagggtcctgagc

SEQ ID NO: 351666 - DNA, 20 bp, Artificial
  CRISPR gRNA sequence
tggtgcaagggtcctgagct

SEQ ID NO: 351667 - DNA, 20 bp, Artificial
  CRISPR gRNA sequence
tgcaagggtcctgagctggg

SEQ ID NO: 351668 - DNA, 20 bp, Artificial
  CRISPR gRNA sequence
gcaagggtcctgagctggga

SEQ ID NO: 351669 - DNA, 20 bp, Artificial
  CRISPR gRNA sequence
aagggtcctgagctgggaag

SEQ ID NO: 351670 - DNA, 20 bp, Artificial
  CRISPR gRNA sequence
tcctgagctgggaaggagtc

SEQ ID NO: 351671 - DNA, 20 bp, Artificial
  CRISPR gRNA sequence
aaggagtcaagtttcttctg

SEQ ID NO: 351672 - DNA, 20 bp, Artificial
  CRISPR gRNA sequence
ggagtcaagtttcttctgaa

SEQ ID NO: 351673 - DNA, 20 bp, Artificial
  CRISPR gRNA sequence
gagtcaagtttcttctgaag

SEQ ID NO: 351674 - DNA, 20 bp, Artificial
  CRISPR gRNA sequence
agtttcttctgaagaggacc

SEQ ID NO: 351675 - DNA, 20 bp, Artificial
  CRISPR gRNA sequence
tctgaagaggacctggtttc

SEQ ID NO: 351676 - DNA, 20 bp, Artificial
  CRISPR gRNA sequence
gaggacctggtttctggact

SEQ ID NO: 351677 - DNA, 20 bp, Artificial
  CRISPR gRNA sequence
aggacctggtttctggactt

SEQ ID NO: 351678 - DNA, 20 bp, Artificial
  CRISPR gRNA sequence
ctggtttctggacttgggca

SEQ ID NO: 351679 - DNA, 20 bp, Artificial
  CRISPR gRNA sequence
tggacttgggcatagatcgt

SEQ ID NO: 351680 - DNA, 20 bp, Artificial
  CRISPR gRNA sequence
ggacttgggcatagatcgta

SEQ ID NO: 351681 - DNA, 20 bp, Artificial
  CRISPR gRNA sequence
tttttttttccactgttgtc

SEQ ID NO: 351682 - DNA, 20 bp, Artificial
  CRISPR gRNA sequence
tttccactgttgtctggtaa

SEQ ID NO: 351683 - DNA, 20 bp, Artificial
  CRISPR gRNA sequence
ttacctcttcttctcaactg

SEQ ID NO: 351684 - DNA, 20 bp, Artificial
  CRISPR gRNA sequence
tgtagtattaccaccatgat

SEQ ID NO: 351685 - DNA, 20 bp, Artificial
  CRISPR gRNA sequence
atcatgatgacaccccctaa

SEQ ID NO: 351686 - DNA, 20 bp, Artificial
  CRISPR gRNA sequence
gatgacaccccctaacagcc

SEQ ID NO: 351687 - DNA, 20 bp, Artificial
  CRISPR gRNA sequence
agcccagcatacactgccca

SEQ ID NO: 351688 - DNA, 20 bp, Artificial
  CRISPR gRNA sequence
ctgcccatggttttgtttct

SEQ ID NO: 351689 - DNA, 20 bp, Artificial
  CRISPR gRNA sequence
tgcccatggttttgtttctg

SEQ ID NO: 351690 - DNA, 20 bp, Artificial
  CRISPR gRNA sequence
gcccatggttttgtttctga

SEQ ID NO: 351691 - DNA, 20 bp, Artificial
  CRISPR gRNA sequence
cccatggttttgtttctgag

SEQ ID NO: 351692 - DNA, 20 bp, Artificial
  CRISPR gRNA sequence
tgaggggtctgtcctgcatc

SEQ ID NO: 351693 - DNA, 20 bp, Artificial
  CRISPR gRNA sequence
gaggggtctgtcctgcatcc

SEQ ID NO: 351694 - DNA, 20 bp, Artificial
  CRISPR gRNA sequence
tctgtcctgcatccgggcca

SEQ ID NO: 351695 - DNA, 20 bp, Artificial
  CRISPR gRNA sequence
ctgtcctgcatccgggccac

SEQ ID NO: 351696 - DNA, 20 bp, Artificial
  CRISPR gRNA sequence
tgcatccgggccacgggctg

SEQ ID NO: 351697 - DNA, 20 bp, Artificial
  CRISPR gRNA sequence
gcatccgggccacgggctga

SEQ ID NO: 351698 - DNA, 20 bp, Artificial
  CRISPR gRNA sequence
cgggccacgggctgaaggtc

SEQ ID NO: 351699 - DNA, 20 bp, Artificial
  CRISPR gRNA sequence
gggccacgggctgaaggtct

SEQ ID NO: 351700 - DNA, 20 bp, Artificial
  CRISPR gRNA sequence
ggtctgggaattgttgctga

SEQ ID NO: 351701 - DNA, 20 bp, Artificial
  CRISPR gRNA sequence
gtctgggaattgttgctgat

SEQ ID NO: 351702 - DNA, 20 bp, Artificial
  CRISPR gRNA sequence
tctgggaattgttgctgata

SEQ ID NO: 351703 - DNA, 20 bp, Artificial
  CRISPR gRNA sequence
gttgctgatagggttgctca

SEQ ID NO: 351704 - DNA, 20 bp, Artificial
  CRISPR gRNA sequence
tgatagggttgctcacggtg

SEQ ID NO: 351705 - DNA, 20 bp, Artificial
  CRISPR gRNA sequence
ggttgctcacggtgcagatg

SEQ ID NO: 351706 - DNA, 20 bp, Artificial
  CRISPR gRNA sequence
ggtgcagatgtagatattgt

SEQ ID NO: 351707 - DNA, 20 bp, Artificial
  CRISPR gRNA sequence
tgtagatattgtcagcatgc

SEQ ID NO: 351708 - DNA, 20 bp, Artificial
  CRISPR gRNA sequence
gtagatattgtcagcatgct

SEQ ID NO: 351709 - DNA, 20 bp, Artificial
  CRISPR gRNA sequence
tagatattgtcagcatgctg

SEQ ID NO: 351710 - DNA, 20 bp, Artificial
  CRISPR gRNA sequence
agatattgtcagcatgctgg

SEQ ID NO: 351711 - DNA, 20 bp, Artificial
  CRISPR gRNA sequence
ttgtcagcatgctgggggcc

SEQ ID NO: 351712 - DNA, 20 bp, Artificial
  CRISPR gRNA sequence
tgtcagcatgctgggggccg

SEQ ID NO: 351713 - DNA, 20 bp, Artificial
  CRISPR gRNA sequence
gtcagcatgctgggggccga

SEQ ID NO: 351714 - DNA, 20 bp, Artificial
  CRISPR gRNA sequence
gcatgctgggggccgagggt

SEQ ID NO: 351715 - DNA, 20 bp, Artificial
  CRISPR gRNA sequence
catgctgggggccgagggtg

SEQ ID NO: 351716 - DNA, 20 bp, Artificial
  CRISPR gRNA sequence
atgctgggggccgagggtga

SEQ ID NO: 351717 - DNA, 20 bp, Artificial
  CRISPR gRNA sequence
tgggggccgagggtgaggga

SEQ ID NO: 351718 - DNA, 20 bp, Artificial
  CRISPR gRNA sequence
gggggccgagggtgagggac

SEQ ID NO: 351719 - DNA, 20 bp, Artificial
  CRISPR gRNA sequence
gggccgagggtgagggacag

SEQ ID NO: 351720 - DNA, 20 bp, Artificial
  CRISPR gRNA sequence
ggccgagggtgagggacagg

SEQ ID NO: 351721 - DNA, 20 bp, Artificial
  CRISPR gRNA sequence
cgagggtgagggacaggagg

SEQ ID NO: 351722 - DNA, 20 bp, Artificial
  CRISPR gRNA sequence
gagggtgagggacaggaggt

SEQ ID NO: 351723 - DNA, 20 bp, Artificial
  CRISPR gRNA sequence
gggtgagggacaggaggtgg

SEQ ID NO: 351724 - DNA, 20 bp, Artificial
  CRISPR gRNA sequence
ggacaggaggtgggagctgt

SEQ ID NO: 351725 - DNA, 20 bp, Artificial
  CRISPR gRNA sequence
aggaggtgggagctgttggc

SEQ ID NO: 351726 - DNA, 20 bp, Artificial
  CRISPR gRNA sequence
ggaggtgggagctgttggct

SEQ ID NO: 351727 - DNA, 20 bp, Artificial
  CRISPR gRNA sequence
tgggagctgttggctgggtt

SEQ ID NO: 351728 - DNA, 20 bp, Artificial
  CRISPR gRNA sequence
gagctgttggctgggttcag

SEQ ID NO: 351729 - DNA, 20 bp, Artificial
  CRISPR gRNA sequence
agctgttggctgggttcagt

SEQ ID NO: 351730 - DNA, 20 bp, Artificial
  CRISPR gRNA sequence
tgttggctgggttcagtggg

SEQ ID NO: 351731 - DNA, 20 bp, Artificial
  CRISPR gRNA sequence
gttggctgggttcagtgggt

SEQ ID NO: 351732 - DNA, 20 bp, Artificial
  CRISPR gRNA sequence
gggtgcccgccttttcactc

SEQ ID NO: 351733 - DNA, 20 bp, Artificial
  CRISPR gRNA sequence
cgccttttcactccagctgt

SEQ ID NO: 351734 - DNA, 20 bp, Artificial
  CRISPR gRNA sequence
cactccagctgtaagccaca

SEQ ID NO: 351735 - DNA, 20 bp, Artificial
  CRISPR gRNA sequence
ggtcccccttctccactgtg

SEQ ID NO: 351736 - DNA, 20 bp, Artificial
  CRISPR gRNA sequence
cccttctccactgtgcagcc

SEQ ID NO: 351737 - DNA, 20 bp, Artificial
  CRISPR gRNA sequence
ccactgtgcagcccagtatc

SEQ ID NO: 351738 - DNA, 20 bp, Artificial
  CRISPR gRNA sequence
cactgtgcagcccagtatca

SEQ ID NO: 351739 - DNA, 20 bp, Artificial
  CRISPR gRNA sequence
tgcagcccagtatcaaggtg

SEQ ID NO: 351740 - DNA, 20 bp, Artificial
  CRISPR gRNA sequence
gcagcccagtatcaaggtgc

SEQ ID NO: 351741 - DNA, 20 bp, Artificial
  CRISPR gRNA sequence
aggtgcaggtcccgttctcc

SEQ ID NO: 351742 - DNA, 20 bp, Artificial
  CRISPR gRNA sequence
ggtgcaggtcccgttctcct

SEQ ID NO: 351743 - DNA, 20 bp, Artificial
  CRISPR gRNA sequence
ttgtttaaaactttaatttc

SEQ ID NO: 351744 - DNA, 20 bp, Artificial
  CRISPR gRNA sequence
gtttaaaactttaatttctg

SEQ ID NO: 351745 - DNA, 20 bp, Artificial
  CRISPR gRNA sequence
taaaactttaatttctggag

SEQ ID NO: 351746 - DNA, 20 bp, Artificial
  CRISPR gRNA sequence
aaactttaatttctggagtg

SEQ ID NO: 351747 - DNA, 20 bp, Artificial
  CRISPR gRNA sequence
tttctggagtggagaccata

SEQ ID NO: 351748 - DNA, 20 bp, Artificial
  CRISPR gRNA sequence
agaccataaagcctcaactg

SEQ ID NO: 351749 - DNA, 20 bp, Artificial
  CRISPR gRNA sequence
gaccataaagcctcaactgc

SEQ ID NO: 351750 - DNA, 20 bp, Artificial
  CRISPR gRNA sequence
aaagcctcaactgcaggcaa

SEQ ID NO: 351751 - DNA, 20 bp, Artificial
  CRISPR gRNA sequence
tgaactgaaacatttttctc

SEQ ID NO: 351752 - DNA, 20 bp, Artificial
  CRISPR gRNA sequence
gaactgaaacatttttctcc

SEQ ID NO: 351753 - DNA, 20 bp, Artificial
  CRISPR gRNA sequence
aactgaaacatttttctcca

SEQ ID NO: 351754 - DNA, 20 bp, Artificial
  CRISPR gRNA sequence
acatttttctccagggtcat

SEQ ID NO: 351755 - DNA, 20 bp, Artificial
  CRISPR gRNA sequence
catttttctccagggtcata

SEQ ID NO: 351756 - DNA, 20 bp, Artificial
  CRISPR gRNA sequence
ttcctgctttcccgtatccc

SEQ ID NO: 351757 - DNA, 20 bp, Artificial
  CRISPR gRNA sequence
tcctgctttcccgtatcccc

SEQ ID NO: 351758 - DNA, 20 bp, Artificial
  CRISPR gRNA sequence
cctgctttcccgtatcccca

SEQ ID NO: 351759 - DNA, 20 bp, Artificial
  CRISPR gRNA sequence
ctttcccgtatccccagggt

SEQ ID NO: 351760 - DNA, 20 bp, Artificial
  CRISPR gRNA sequence
atccccagggtgagattctc

SEQ ID NO: 351761 - DNA, 20 bp, Artificial
  CRISPR gRNA sequence
gattctccagataaaacttg

SEQ ID NO: 351762 - DNA, 20 bp, Artificial
  CRISPR gRNA sequence
taaaacttgtagcgatctcc

SEQ ID NO: 351763 - DNA, 20 bp, Artificial
  CRISPR gRNA sequence
tagcgatctcctagataacg

SEQ ID NO: 351764 - DNA, 20 bp, Artificial
  CRISPR gRNA sequence
gcgatctcctagataacgtg

SEQ ID NO: 351765 - DNA, 20 bp, Artificial
  CRISPR gRNA sequence
cgatctcctagataacgtgg

SEQ ID NO: 351766 - DNA, 20 bp, Artificial
  CRISPR gRNA sequence
gatctcctagataacgtgga

SEQ ID NO: 351767 - DNA, 20 bp, Artificial
  CRISPR gRNA sequence
ataacgtggagggcctgctt

SEQ ID NO: 351768 - DNA, 20 bp, Artificial
  CRISPR gRNA sequence
cgtggagggcctgcttcgga

SEQ ID NO: 351769 - DNA, 20 bp, Artificial
  CRISPR gRNA sequence
gggcctgcttcggatggatc

SEQ ID NO: 351770 - DNA, 20 bp, Artificial
  CRISPR gRNA sequence
gcctgcttcggatggatcaa

SEQ ID NO: 351771 - DNA, 20 bp, Artificial
  CRISPR gRNA sequence
ttgttctcgacactgttctc

SEQ ID NO: 351772 - DNA, 20 bp, Artificial
  CRISPR gRNA sequence
ttgccattgtgacgacaatg

SEQ ID NO: 351773 - DNA, 20 bp, Artificial
  CRISPR gRNA sequence
ttatttatcctttcatatgt

SEQ ID NO: 351774 - DNA, 20 bp, Artificial
  CRISPR gRNA sequence
tatttatcctttcatatgtc

SEQ ID NO: 351775 - DNA, 20 bp, Artificial
  CRISPR gRNA sequence
atttatcctttcatatgtca

SEQ ID NO: 351776 - DNA, 20 bp, Artificial
  CRISPR gRNA sequence
tttatcctttcatatgtcag

SEQ ID NO: 351777 - DNA, 20 bp, Artificial
  CRISPR gRNA sequence
atcctttcatatgtcagggg

SEQ ID NO: 351778 - DNA, 20 bp, Artificial
  CRISPR gRNA sequence
ctttcatatgtcaggggcag

SEQ ID NO: 351779 - DNA, 20 bp, Artificial
  CRISPR gRNA sequence
gcactttgcttcccaactgc

SEQ ID NO: 351780 - DNA, 20 bp, Artificial
  CRISPR gRNA sequence
actttgcttcccaactgccg

SEQ ID NO: 351781 - DNA, 20 bp, Artificial
  CRISPR gRNA sequence
cccaactgccggagaatctt

SEQ ID NO: 351782 - DNA, 20 bp, Artificial
  CRISPR gRNA sequence
ccaactgccggagaatcttt

SEQ ID NO: 351783 - DNA, 20 bp, Artificial
  CRISPR gRNA sequence
actgccggagaatctttggg

SEQ ID NO: 351784 - DNA, 20 bp, Artificial
  CRISPR gRNA sequence
tcatgcgcccacctgttccg

SEQ ID NO: 351785 - DNA, 20 bp, Artificial
  CRISPR gRNA sequence
tgttccgtagcttgccccaa

SEQ ID NO: 351786 - DNA, 20 bp, Artificial
  CRISPR gRNA sequence
ccgtagcttgccccaaaagc

SEQ ID NO: 351787 - DNA, 20 bp, Artificial
  CRISPR gRNA sequence
cgtagcttgccccaaaagcc

SEQ ID NO: 351788 - DNA, 20 bp, Artificial
  CRISPR gRNA sequence
gtagcttgccccaaaagcca

SEQ ID NO: 351789 - DNA, 20 bp, Artificial
  CRISPR gRNA sequence
agcttgccccaaaagccagg

SEQ ID NO: 351790 - DNA, 20 bp, Artificial
  CRISPR gRNA sequence
cttgccccaaaagccaggga

SEQ ID NO: 351791 - DNA, 20 bp, Artificial
  CRISPR gRNA sequence
ccaaaagccagggagagaaa

SEQ ID NO: 351792 - DNA, 20 bp, Artificial
  CRISPR gRNA sequence
ccagggagagaaacagcacg

SEQ ID NO: 351793 - DNA, 20 bp, Artificial
  CRISPR gRNA sequence
cagggagagaaacagcacga

SEQ ID NO: 351794 - DNA, 20 bp, Artificial
  CRISPR gRNA sequence
agagaaacagcacgaaggtc

SEQ ID NO: 351795 - DNA, 20 bp, Artificial
  CRISPR gRNA sequence
gagaaacagcacgaaggtca

SEQ ID NO: 351796 - DNA, 20 bp, Artificial
  CRISPR gRNA sequence
gaaacagcacgaaggtcaag

SEQ ID NO: 351797 - DNA, 20 bp, Artificial
  CRISPR gRNA sequence
aacagcacgaaggtcaagga

SEQ ID NO: 351798 - DNA, 20 bp, Artificial
  CRISPR gRNA sequence
acagcacgaaggtcaaggag

SEQ ID NO: 351799 - DNA, 20 bp, Artificial
  CRISPR gRNA sequence
agcacgaaggtcaaggagag

SEQ ID NO: 351800 - DNA, 20 bp, Artificial
  CRISPR gRNA sequence
ggtcaaggagaggagcccct

SEQ ID NO: 351801 - DNA, 20 bp, Artificial
  CRISPR gRNA sequence
gtcaaggagaggagcccctt

SEQ ID NO: 351802 - DNA, 20 bp, Artificial
  CRISPR gRNA sequence
aggagccccttgggatccat

SEQ ID NO: 351803 - DNA, 20 bp, Artificial
  CRISPR gRNA sequence
cttgggatccatcagccaat

SEQ ID NO: 351804 - DNA, 20 bp, Artificial
  CRISPR gRNA sequence
ttgggatccatcagccaatg

SEQ ID NO: 351805 - DNA, 20 bp, Artificial
  CRISPR gRNA sequence
gggatccatcagccaatgag

SEQ ID NO: 351806 - DNA, 20 bp, Artificial
  CRISPR gRNA sequence
atccatcagccaatgaggag

SEQ ID NO: 351807 - DNA, 20 bp, Artificial
  CRISPR gRNA sequence
tccatcagccaatgaggaga

SEQ ID NO: 351808 - DNA, 20 bp, Artificial
  CRISPR gRNA sequence
atcagccaatgaggagaagg

SEQ ID NO: 351809 - DNA, 20 bp, Artificial
  CRISPR gRNA sequence
tcagccaatgaggagaagga

SEQ ID NO: 351810 - DNA, 20 bp, Artificial
  CRISPR gRNA sequence
cagccaatgaggagaaggaa

SEQ ID NO: 351811 - DNA, 20 bp, Artificial
  CRISPR gRNA sequence
tgaggagaaggaagggatcc

SEQ ID NO: 351812 - DNA, 20 bp, Artificial
  CRISPR gRNA sequence
gagaaggaagggatcctggc

SEQ ID NO: 351813 - DNA, 20 bp, Artificial
  CRISPR gRNA sequence
gaaggaagggatcctggccg

SEQ ID NO: 351814 - DNA, 20 bp, Artificial
  CRISPR gRNA sequence
aagggatcctggccggagcc

SEQ ID NO: 351815 - DNA, 20 bp, Artificial
  CRISPR gRNA sequence
ggatcctggccggagcctgg

SEQ ID NO: 351816 - DNA, 20 bp, Artificial
  CRISPR gRNA sequence
cggagcctggcagctgctca

SEQ ID NO: 351817 - DNA, 20 bp, Artificial
  CRISPR gRNA sequence
tggcagctgctcacagatgc

SEQ ID NO: 351818 - DNA, 20 bp, Artificial
  CRISPR gRNA sequence
ggcagctgctcacagatgcc

SEQ ID NO: 351819 - DNA, 20 bp, Artificial
  CRISPR gRNA sequence
agctgctcacagatgccagg

SEQ ID NO: 351820 - DNA, 20 bp, Artificial
  CRISPR gRNA sequence
tgctcacagatgccaggcag

SEQ ID NO: 351821 - DNA, 20 bp, Artificial
  CRISPR gRNA sequence
cacagatgccaggcagaagc

SEQ ID NO: 351822 - DNA, 20 bp, Artificial
  CRISPR gRNA sequence
gaagcaagcttcgtgtcatg

SEQ ID NO: 351823 - DNA, 20 bp, Artificial
  CRISPR gRNA sequence
gcaagcttcgtgtcatgcag

SEQ ID NO: 351824 - DNA, 20 bp, Artificial
  CRISPR gRNA sequence
aagcttcgtgtcatgcagca

SEQ ID NO: 351825 - DNA, 20 bp, Artificial
  CRISPR gRNA sequence
agcttcgtgtcatgcagcag

SEQ ID NO: 351826 - DNA, 20 bp, Artificial
  CRISPR gRNA sequence
aggctgtctgatttatgtat

SEQ ID NO: 351827 - DNA, 20 bp, Artificial
  CRISPR gRNA sequence
ggctgtctgatttatgtatc

SEQ ID NO: 351828 - DNA, 20 bp, Artificial
  CRISPR gRNA sequence
ctgatttatgtatcaggaac

SEQ ID NO: 351829 - DNA, 20 bp, Artificial
  CRISPR gRNA sequence
atttatgtatcaggaaccag

SEQ ID NO: 351830 - DNA, 20 bp, Artificial
  CRISPR gRNA sequence
tttatgtatcaggaaccagc

SEQ ID NO: 351831 - DNA, 20 bp, Artificial
  CRISPR gRNA sequence
gaacccgcttcctgtatcac

SEQ ID NO: 351832 - DNA, 20 bp, Artificial
  CRISPR gRNA sequence
aacccgcttcctgtatcact

SEQ ID NO: 351833 - DNA, 20 bp, Artificial
  CRISPR gRNA sequence
actttttctgcttgtgtctt

SEQ ID NO: 351834 - DNA, 20 bp, Artificial
  CRISPR gRNA sequence
ctttttctgcttgtgtcttg

SEQ ID NO: 351835 - DNA, 20 bp, Artificial
  CRISPR gRNA sequence
gaggattgctcatctcccat

SEQ ID NO: 351836 - DNA, 20 bp, Artificial
  CRISPR gRNA sequence
aggattgctcatctcccatg

SEQ ID NO: 351837 - DNA, 20 bp, Artificial
  CRISPR gRNA sequence
taaatcacttttttgttctc

SEQ ID NO: 351838 - DNA, 20 bp, Artificial
  CRISPR gRNA sequence
atcacttttttgttctcaag

SEQ ID NO: 351839 - DNA, 20 bp, Artificial
  CRISPR gRNA sequence
acttttttgttctcaagaag

SEQ ID NO: 351840 - DNA, 20 bp, Artificial
  CRISPR gRNA sequence
cttttttgttctcaagaagc

SEQ ID NO: 351841 - DNA, 20 bp, Artificial
  CRISPR gRNA sequence
tctcaagaagcaggcttctc

SEQ ID NO: 351842 - DNA, 20 bp, Artificial
  CRISPR gRNA sequence
caagaagcaggcttctcaag

SEQ ID NO: 351843 - DNA, 20 bp, Artificial
  CRISPR gRNA sequence
aagcaggcttctcaagaagc

SEQ ID NO: 351844 - DNA, 20 bp, Artificial
  CRISPR gRNA sequence
agcaggcttctcaagaagcc

SEQ ID NO: 351845 - DNA, 20 bp, Artificial
  CRISPR gRNA sequence
ttctcaagaagccaggcact

SEQ ID NO: 351846 - DNA, 20 bp, Artificial
  CRISPR gRNA sequence
gaagccaggcacttagccta

SEQ ID NO: 351847 - DNA, 20 bp, Artificial
  CRISPR gRNA sequence
aagccaggcacttagcctat

SEQ ID NO: 351848 - DNA, 20 bp, Artificial
  CRISPR gRNA sequence
gccaggcacttagcctatgg

SEQ ID NO: 351849 - DNA, 20 bp, Artificial
  CRISPR gRNA sequence
ggcacttagcctatgggagc

SEQ ID NO: 351850 - DNA, 20 bp, Artificial
  CRISPR gRNA sequence
gcacttagcctatgggagcc

SEQ ID NO: 351851 - DNA, 20 bp, Artificial
  CRISPR gRNA sequence
ttagcctatgggagccagga

SEQ ID NO: 351852 - DNA, 20 bp, Artificial
  CRISPR gRNA sequence
tagcctatgggagccaggaa

SEQ ID NO: 351853 - DNA, 20 bp, Artificial
  CRISPR gRNA sequence
agcctatgggagccaggaaa

SEQ ID NO: 351854 - DNA, 20 bp, Artificial
  CRISPR gRNA sequence
gcctatgggagccaggaaag

SEQ ID NO: 351855 - DNA, 20 bp, Artificial
  CRISPR gRNA sequence
cctatgggagccaggaaagg

SEQ ID NO: 351856 - DNA, 20 bp, Artificial
  CRISPR gRNA sequence
gagccaggaaagggggtgtg

SEQ ID NO: 351857 - DNA, 20 bp, Artificial
  CRISPR gRNA sequence
aagggggtgtgtagtcacct

SEQ ID NO: 351858 - DNA, 20 bp, Artificial
  CRISPR gRNA sequence
tagtcacctcggccaaaacc

SEQ ID NO: 351859 - DNA, 20 bp, Artificial
  CRISPR gRNA sequence
cctcggccaaaacccggctt

SEQ ID NO: 351860 - DNA, 20 bp, Artificial
  CRISPR gRNA sequence
ctcggccaaaacccggcttt

SEQ ID NO: 351861 - DNA, 20 bp, Artificial
  CRISPR gRNA sequence
ggccaaaacccggctttggg

SEQ ID NO: 351862 - DNA, 20 bp, Artificial
  CRISPR gRNA sequence
ttgggcagaaacatgcgccc

SEQ ID NO: 351863 - DNA, 20 bp, Artificial
  CRISPR gRNA sequence
tgcgccccagcttctttcct

SEQ ID NO: 351864 - DNA, 20 bp, Artificial
  CRISPR gRNA sequence
cttctttccttagctgtctc

SEQ ID NO: 351865 - DNA, 20 bp, Artificial
  CRISPR gRNA sequence
ttctttccttagctgtctcc

SEQ ID NO: 351866 - DNA, 20 bp, Artificial
  CRISPR gRNA sequence
ccttagctgtctccaggaac

SEQ ID NO: 351867 - DNA, 20 bp, Artificial
  CRISPR gRNA sequence
tctccaggaaccggatgttg

SEQ ID NO: 351868 - DNA, 20 bp, Artificial
  CRISPR gRNA sequence
ccggatgttgcagattctct

SEQ ID NO: 351869 - DNA, 20 bp, Artificial
  CRISPR gRNA sequence
gatgttgcagattctctgag

SEQ ID NO: 351870 - DNA, 20 bp, Artificial
  CRISPR gRNA sequence
attctctgagcagttctctc

SEQ ID NO: 351871 - DNA, 20 bp, Artificial
  CRISPR gRNA sequence
tctgagcagttctctccggt

SEQ ID NO: 351872 - DNA, 20 bp, Artificial
  CRISPR gRNA sequence
ttctctccggtaagtcttct

SEQ ID NO: 351873 - DNA, 20 bp, Artificial
  CRISPR gRNA sequence
gtaagtcttcttggattgca

SEQ ID NO: 351874 - DNA, 20 bp, Artificial
  CRISPR gRNA sequence
tcttcttggattgcaaagaa

SEQ ID NO: 351875 - DNA, 20 bp, Artificial
  CRISPR gRNA sequence
gcaaagaaaagatgtttcat

SEQ ID NO: 351876 - DNA, 20 bp, Artificial
  CRISPR gRNA sequence
attggatcactcctcaaatt

SEQ ID NO: 351877 - DNA, 20 bp, Artificial
  CRISPR gRNA sequence
ggatcactcctcaaatttgg

SEQ ID NO: 351878 - DNA, 20 bp, Artificial
  CRISPR gRNA sequence
tcctcaaatttggcagttca

SEQ ID NO: 351879 - DNA, 20 bp, Artificial
  CRISPR gRNA sequence
tggcagttcacagctgaact

SEQ ID NO: 351880 - DNA, 20 bp, Artificial
  CRISPR gRNA sequence
ttagataactgcattttgat

SEQ ID NO: 351881 - DNA, 20 bp, Artificial
  CRISPR gRNA sequence
actgcattttgatgagctaa

SEQ ID NO: 351882 - DNA, 20 bp, Artificial
  CRISPR gRNA sequence
tctgttttatttcataattt

SEQ ID NO: 351883 - DNA, 20 bp, Artificial
  CRISPR gRNA sequence
tcagatgacacctcaacatg

SEQ ID NO: 351884 - DNA, 20 bp, Artificial
  CRISPR gRNA sequence
tgacacctcaacatgcagtc

SEQ ID NO: 351885 - DNA, 20 bp, Artificial
  CRISPR gRNA sequence
cctcaacatgcagtctggtg

SEQ ID NO: 351886 - DNA, 20 bp, Artificial
  CRISPR gRNA sequence
ctcaacatgcagtctggtgc

SEQ ID NO: 351887 - DNA, 20 bp, Artificial
  CRISPR gRNA sequence
gtgcaggtgccactgtcaca

SEQ ID NO: 351888 - DNA, 20 bp, Artificial
  CRISPR gRNA sequence
gcaggtgccactgtcacaca

SEQ ID NO: 351889 - DNA, 20 bp, Artificial
  CRISPR gRNA sequence
gtgccactgtcacacagaga

SEQ ID NO: 351890 - DNA, 20 bp, Artificial
  CRISPR gRNA sequence
tgccactgtcacacagagat

SEQ ID NO: 351891 - DNA, 20 bp, Artificial
  CRISPR gRNA sequence
cactgtcacacagagatggg

SEQ ID NO: 351892 - DNA, 20 bp, Artificial
  CRISPR gRNA sequence
actgtcacacagagatggga

SEQ ID NO: 351893 - DNA, 20 bp, Artificial
  CRISPR gRNA sequence
ctgtcacacagagatgggaa

SEQ ID NO: 351894 - DNA, 20 bp, Artificial
  CRISPR gRNA sequence
gctgtgaactgccaaatttg

SEQ ID NO: 351895 - DNA, 20 bp, Artificial
  CRISPR gRNA sequence
ttaccggagagaactgctca

SEQ ID NO: 351896 - DNA, 20 bp, Artificial
  CRISPR gRNA sequence
gcgcatgtttctgcccaaag

SEQ ID NO: 351897 - DNA, 20 bp, Artificial
  CRISPR gRNA sequence
aagtcccagtgatacaggaa

SEQ ID NO: 351898 - DNA, 20 bp, Artificial
  CRISPR gRNA sequence
agcagctgccaggctccggc

SEQ ID NO: 351899 - DNA, 20 bp, Artificial
  CRISPR gRNA sequence
ttccttctcctcattggctg

SEQ ID NO: 351900 - DNA, 20 bp, Artificial
  CRISPR gRNA sequence
ctgctgcccctgacatatga

SEQ ID NO: 351901 - DNA, 20 bp, Artificial
  CRISPR gRNA sequence
atcgctacaagttttatctg

SEQ ID NO: 351902 - DNA, 20 bp, Artificial
  CRISPR gRNA sequence
tatctggagaatctcaccct

SEQ ID NO: 351903 - DNA, 20 bp, Artificial
  CRISPR gRNA sequence
ggatacgggaaagcaggaag

SEQ ID NO: 351904 - DNA, 20 bp, Artificial
  CRISPR gRNA sequence
ggaaagcaggaaggaggatg

SEQ ID NO: 351905 - DNA, 20 bp, Artificial
  CRISPR gRNA sequence
gggaccatgtggcttacagc

SEQ ID NO: 351906 - DNA, 20 bp, Artificial
  CRISPR gRNA sequence
ccagaccttcagcccgtggc

SEQ ID NO: 351907 - DNA, 20 bp, Artificial
  CRISPR gRNA sequence
cagtgtatgctgggctgtta

SEQ ID NO: 351908 - DNA, 20 bp, Artificial
  CRISPR gRNA sequence
tgctgccacagagcctgtcc

SEQ ID NO: 351909 - DNA, 20 bp, Artificial
  CRISPR gRNA sequence
acaaggaagtgaggcttccc

SEQ ID NO: 351910 - DNA, 20 bp, Artificial
  CRISPR gRNA sequence
cagatgaaatggacagtaat

SEQ ID NO: 351911 - DNA, 20 bp, Artificial
  CRISPR gRNA sequence
catcttgctcttggctggaa

SEQ ID NO: 351912 - DNA, 20 bp, Artificial
  CRISPR gRNA sequence
cagactgaaagccaggacat

SEQ ID NO: 351913 - DNA, 20 bp, Artificial
  CRISPR gRNA sequence
ctgtgcctcagtttctctct

SEQ ID NO: 351914 - DNA, 20 bp, Artificial
  CRISPR gRNA sequence
tcagtttctctctcaggata

SEQ ID NO: 351915 - DNA, 20 bp, Artificial
  CRISPR gRNA sequence
tttctctctcaggataaaga

SEQ ID NO: 351916 - DNA, 20 bp, Artificial
  CRISPR gRNA sequence
taaagagtgaatagaggctg

SEQ ID NO: 351917 - DNA, 20 bp, Artificial
  CRISPR gRNA sequence
gagtgaatagaggctgaagg

SEQ ID NO: 351918 - DNA, 20 bp, Artificial
  CRISPR gRNA sequence
attattgtataaaggaagct

SEQ ID NO: 351919 - DNA, 20 bp, Artificial
  CRISPR gRNA sequence
ctaaaaagtcaataaacaga

SEQ ID NO: 351920 - DNA, 20 bp, Artificial
  CRISPR gRNA sequence
aaagaatgattttgagatct

SEQ ID NO: 351921 - DNA, 20 bp, Artificial
  CRISPR gRNA sequence
ggtgctgttacaaaggagct

SEQ ID NO: 351922 - DNA, 20 bp, Artificial
  CRISPR gRNA sequence
ctcttatatccagggcttca

SEQ ID NO: 351923 - DNA, 20 bp, Artificial
  CRISPR gRNA sequence
ggtctaacagcttcaaatct

SEQ ID NO: 351924 - DNA, 20 bp, Artificial
  CRISPR gRNA sequence
cctggtaccagcttctttaa

SEQ ID NO: 351925 - DNA, 20 bp, Artificial
  CRISPR gRNA sequence
caaaattacaaaaccagccc

SEQ ID NO: 351926 - DNA, 20 bp, Artificial
  CRISPR gRNA sequence
ctgcactgtctgccatgaaa

SEQ ID NO: 351927 - DNA, 20 bp, Artificial
  CRISPR gRNA sequence
tgccatgaaaatgaattctc

SEQ ID NO: 351928 - DNA, 20 bp, Artificial
  CRISPR gRNA sequence
ctagcttataattcaaagtc

SEQ ID NO: 351929 - DNA, 20 bp, Artificial
  CRISPR gRNA sequence
ttataattcaaagtctggga

SEQ ID NO: 351930 - DNA, 20 bp, Artificial
  CRISPR gRNA sequence
tcctatctccaaggggggct

SEQ ID NO: 351931 - DNA, 20 bp, Artificial
  CRISPR gRNA sequence
tctccaaggggggctgggaa

SEQ ID NO: 351932 - DNA, 20 bp, Artificial
  CRISPR gRNA sequence
attttccactttcacttctt

SEQ ID NO: 351933 - DNA, 20 bp, Artificial
  CRISPR gRNA sequence
ctttcacttcttatgaatta

SEQ ID NO: 351934 - DNA, 20 bp, Artificial
  CRISPR gRNA sequence
aattctacaaataatagaag

SEQ ID NO: 351935 - DNA, 20 bp, Artificial
  CRISPR gRNA sequence
agaagctcagttcccagcac

SEQ ID NO: 351936 - DNA, 20 bp, Artificial
  CRISPR gRNA sequence
cacttggatttttccagtag

SEQ ID NO: 351937 - DNA, 20 bp, Artificial
  CRISPR gRNA sequence
ctgaaggaagggcagaaaca

SEQ ID NO: 351938 - DNA, 20 bp, Artificial
  CRISPR gRNA sequence
gctcaagacctcactgggga

SEQ ID NO: 351939 - DNA, 20 bp, Artificial
  CRISPR gRNA sequence
tttcttttgaccaagcatgt

SEQ ID NO: 351940 - DNA, 20 bp, Artificial
  CRISPR gRNA sequence
gcttcctccattcacacagc

SEQ ID NO: 351941 - DNA, 20 bp, Artificial
  CRISPR gRNA sequence
gcggggatgtgattgttaca

SEQ ID NO: 351942 - DNA, 20 bp, Artificial
  CRISPR gRNA sequence
gtgctggctgagaagccact

SEQ ID NO: 351943 - DNA, 20 bp, Artificial
  CRISPR gRNA sequence
tatgtttctactttttggaa

SEQ ID NO: 351944 - DNA, 20 bp, Artificial
  CRISPR gRNA sequence
agaaacataaacttcagaag

SEQ ID NO: 351945 - DNA, 20 bp, Artificial
  CRISPR gRNA sequence
aacaatcacatccccgctgt

SEQ ID NO: 351946 - DNA, 20 bp, Artificial
  CRISPR gRNA sequence
aacatcagtcccttcaaacc

SEQ ID NO: 351947 - DNA, 20 bp, Artificial
  CRISPR gRNA sequence
tcagtcccttcaaaccgaga

SEQ ID NO: 351948 - DNA, 20 bp, Artificial
  CRISPR gRNA sequence
tgtgttcctcctgacttctc

SEQ ID NO: 351949 - DNA, 20 bp, Artificial
  CRISPR gRNA sequence
gtgccatttgggggaaacta

SEQ ID NO: 351950 - DNA, 20 bp, Artificial
  CRISPR gRNA sequence
ttgggggaaactagagagtt

SEQ ID NO: 351951 - DNA, 20 bp, Artificial
  CRISPR gRNA sequence
gttgtgaatgtatcaccaga

SEQ ID NO: 351952 - DNA, 20 bp, Artificial
  CRISPR gRNA sequence
taccacgtgtaaccatggtc

SEQ ID NO: 351953 - DNA, 20 bp, Artificial
  CRISPR gRNA sequence
cataatgccagtgctgtttg

SEQ ID NO: 351954 - DNA, 20 bp, Artificial
  CRISPR gRNA sequence
cccagtgaggtcttgagccc

SEQ ID NO: 351955 - DNA, 20 bp, Artificial
  CRISPR gRNA sequence
aggtcttgagcccaggggtg

SEQ ID NO: 351956 - DNA, 20 bp, Artificial
  CRISPR gRNA sequence
gtttctgcccttccttcagg

SEQ ID NO: 351957 - DNA, 20 bp, Artificial
  CRISPR gRNA sequence
aactgagcttctagagcaat

SEQ ID NO: 351958 - DNA, 20 bp, Artificial
  CRISPR gRNA sequence
agcaatctgagttgtagtaa

SEQ ID NO: 351959 - DNA, 20 bp, Artificial
  CRISPR gRNA sequence
atctgagttgtagtaaagga

SEQ ID NO: 351960 - DNA, 20 bp, Artificial
  CRISPR gRNA sequence
aggaatgggtgctcataagc

SEQ ID NO: 351961 - DNA, 20 bp, Artificial
  CRISPR gRNA sequence
attagtagctccacagtttt

SEQ ID NO: 351962 - DNA, 20 bp, Artificial
  CRISPR gRNA sequence
cacagttttgagagtagaca

SEQ ID NO: 351963 - DNA, 20 bp, Artificial
  CRISPR gRNA sequence
tttgagagtagacagtgaat

SEQ ID NO: 351964 - DNA, 20 bp, Artificial
  CRISPR gRNA sequence
gaatgagggtaaggttatac

SEQ ID NO: 351965 - DNA, 20 bp, Artificial
  CRISPR gRNA sequence
ggttatacaagggtggcgta

SEQ ID NO: 351966 - DNA, 20 bp, Artificial
  CRISPR gRNA sequence
cttttttgtctgcctaccac

SEQ ID NO: 351967 - DNA, 20 bp, Artificial
  CRISPR gRNA sequence
aatcccacttctattatttg

SEQ ID NO: 351968 - DNA, 20 bp, Artificial
  CRISPR gRNA sequence
taggacatggacatgtgacc

SEQ ID NO: 351969 - DNA, 20 bp, Artificial
  CRISPR gRNA sequence
tggccactcaatcccagact

SEQ ID NO: 351970 - DNA, 20 bp, Artificial
  CRISPR gRNA sequence
gaattataagctagagatga

SEQ ID NO: 351971 - DNA, 20 bp, Artificial
  CRISPR gRNA sequence
aggatgaagaagggaccctg

SEQ ID NO: 351972 - DNA, 20 bp, Artificial
  CRISPR gRNA sequence
cagagacagtgaggcagtgg

SEQ ID NO: 351973 - DNA, 20 bp, Artificial
  CRISPR gRNA sequence
ggacagtggctgtgcatgaa

SEQ ID NO: 351974 - DNA, 20 bp, Artificial
  CRISPR gRNA sequence
ctaagcaacaggcttacaat

SEQ ID NO: 351975 - DNA, 20 bp, Artificial
  CRISPR gRNA sequence
agatacaaggcaataaggac

SEQ ID NO: 351976 - DNA, 20 bp, Artificial
  CRISPR gRNA sequence
ggacagcctgtctaaaagca

SEQ ID NO: 351977 - DNA, 20 bp, Artificial
  CRISPR gRNA sequence
aataacttaattttctacta

SEQ ID NO: 351978 - DNA, 20 bp, Artificial
  CRISPR gRNA sequence
agtgtgaggagaggtatgca

SEQ ID NO: 351979 - DNA, 20 bp, Artificial
  CRISPR gRNA sequence
ctgcaataccccttgaagcc

SEQ ID NO: 351980 - DNA, 20 bp, Artificial
  CRISPR gRNA sequence
agccctggatataagaggtt

SEQ ID NO: 351981 - DNA, 20 bp, Artificial
  CRISPR gRNA sequence
aggttcagaatctggtcaca

SEQ ID NO: 351982 - DNA, 20 bp, Artificial
  CRISPR gRNA sequence
gttccaggtttgttgttcaa

SEQ ID NO: 351983 - DNA, 20 bp, Artificial
  CRISPR gRNA sequence
caagggaatcaacagagaac

SEQ ID NO: 351984 - DNA, 20 bp, Artificial
  CRISPR gRNA sequence
tcaccatgggacaagttcct

SEQ ID NO: 351985 - DNA, 20 bp, Artificial
  CRISPR gRNA sequence
tgctacgtttttctttaaaa

SEQ ID NO: 351986 - DNA, 20 bp, Artificial
  CRISPR gRNA sequence
gtttattgactttttagctt

SEQ ID NO: 351987 - DNA, 20 bp, Artificial
  CRISPR gRNA sequence
cttcctttatacaataatat

SEQ ID NO: 351988 - DNA, 20 bp, Artificial
  CRISPR gRNA sequence
atgtggaagaaacatcacca

SEQ ID NO: 351989 - DNA, 20 bp, Artificial
  CRISPR gRNA sequence
caccagggagttgatctgag

SEQ ID NO: 351990 - DNA, 20 bp, Artificial
  CRISPR gRNA sequence
cacactagcatagactgtga

SEQ ID NO: 351991 - DNA, 20 bp, Artificial
  CRISPR gRNA sequence
agcaacatatatggtggtgc

SEQ ID NO: 351992 - DNA, 20 bp, Artificial
  CRISPR gRNA sequence
gcaagggtcctgagctggga

SEQ ID NO: 351993 - DNA, 20 bp, Artificial
  CRISPR gRNA sequence
tgtagtattaccaccatgat

SEQ ID NO: 351994 - DNA, 20 bp, Artificial
  CRISPR gRNA sequence
tgcccatggttttgtttctg

SEQ ID NO: 351995 - DNA, 20 bp, Artificial
  CRISPR gRNA sequence
gggccacgggctgaaggtct

SEQ ID NO: 351996 - DNA, 20 bp, Artificial
  CRISPR gRNA sequence
ggtctgggaattgttgctga

SEQ ID NO: 351997 - DNA, 20 bp, Artificial
  CRISPR gRNA sequence
ttgtcagcatgctgggggcc

SEQ ID NO: 351998 - DNA, 20 bp, Artificial
  CRISPR gRNA sequence
caggaggtgggagctgttgg

SEQ ID NO: 351999 - DNA, 20 bp, Artificial
  CRISPR gRNA sequence
ggagctgttggctgggttca

SEQ ID NO: 352000 - DNA, 20 bp, Artificial
  CRISPR gRNA sequence
ctgttggctgggttcagtgg

SEQ ID NO: 352001 - DNA, 20 bp, Artificial
  CRISPR gRNA sequence
aaggtgcaggtcccgttctc

SEQ ID NO: 352002 - DNA, 20 bp, Artificial
  CRISPR gRNA sequence
ttgtttaaaactttaatttc

SEQ ID NO: 352003 - DNA, 20 bp, Artificial
  CRISPR gRNA sequence
tgaactgaaacatttttctc

SEQ ID NO: 352004 - DNA, 20 bp, Artificial
  CRISPR gRNA sequence
ttcctgctttcccgtatccc

SEQ ID NO: 352005 - DNA, 20 bp, Artificial
  CRISPR gRNA sequence
gataacgtggagggcctgct

SEQ ID NO: 352006 - DNA, 20 bp, Artificial
  CRISPR gRNA sequence
acgtggagggcctgcttcgg

SEQ ID NO: 352007 - DNA, 20 bp, Artificial
  CRISPR gRNA sequence
tttgccattgtgacgacaat

SEQ ID NO: 352008 - DNA, 20 bp, Artificial
  CRISPR gRNA sequence
actttgcttcccaactgccg

SEQ ID NO: 352009 - DNA, 20 bp, Artificial
  CRISPR gRNA sequence
ggtcaaggagaggagcccct

SEQ ID NO: 352010 - DNA, 20 bp, Artificial
  CRISPR gRNA sequence
tcagccaatgaggagaagga

SEQ ID NO: 352011 - DNA, 20 bp, Artificial
  CRISPR gRNA sequence
actttttctgcttgtgtctt

SEQ ID NO: 352012 - DNA, 20 bp, Artificial
  CRISPR gRNA sequence
agcctatgggagccaggaaa

SEQ ID NO: 352013 - DNA, 20 bp, Artificial
  CRISPR gRNA sequence
tccttagctgtctccaggaa

SEQ ID NO: 352014 - DNA, 20 bp, Artificial
  CRISPR gRNA sequence
gttctctccggtaagtcttc

SEQ ID NO: 352015 - DNA, 20 bp, Artificial
  CRISPR gRNA sequence
tgcaaagaaaagatgtttca

SEQ ID NO: 352016 - DNA, 20 bp, Artificial
  CRISPR gRNA sequence
ctaaggaaagaagctggggc

SEQ ID NO: 352017 - DNA, 20 bp, Artificial
  CRISPR gRNA sequence
gcgcatgtttctgcccaaag

SEQ ID NO: 352018 - DNA, 20 bp, Artificial
  CRISPR gRNA sequence
tggctcccataggctaagtg

SEQ ID NO: 352019 - DNA, 20 bp, Artificial
  CRISPR gRNA sequence
agtgcctggcttcttgagaa

SEQ ID NO: 352020 - DNA, 20 bp, Artificial
  CRISPR gRNA sequence
cctgcttcttgagaacaaaa

SEQ ID NO: 352021 - DNA, 20 bp, Artificial
  CRISPR gRNA sequence
acagcctctgctgcatgaca

SEQ ID NO: 352022 - DNA, 20 bp, Artificial
  CRISPR gRNA sequence
cctctgctgcatgacacgaa

SEQ ID NO: 352023 - DNA, 20 bp, Artificial
  CRISPR gRNA sequence
gctcctctccttgaccttcg

SEQ ID NO: 352024 - DNA, 20 bp, Artificial
  CRISPR gRNA sequence
accttcgtgctgtttctctc

SEQ ID NO: 352025 - DNA, 20 bp, Artificial
  CRISPR gRNA sequence
tgggcgcatgatgaactgcc

SEQ ID NO: 352026 - DNA, 20 bp, Artificial
  CRISPR gRNA sequence
acgttatctaggagatcgct

SEQ ID NO: 352027 - DNA, 20 bp, Artificial
  CRISPR gRNA sequence
taccttatgaccctggagaa

SEQ ID NO: 352028 - DNA, 20 bp, Artificial
  CRISPR gRNA sequence
tggagaaaaatgtttcagtt

SEQ ID NO: 352029 - DNA, 20 bp, Artificial
  CRISPR gRNA sequence
tcagcgcttttgcctgcagt

SEQ ID NO: 352030 - DNA, 20 bp, Artificial
  CRISPR gRNA sequence
atggtctccactccagaaat

SEQ ID NO: 352031 - DNA, 20 bp, Artificial
  CRISPR gRNA sequence
acagtggagaagggggacca

SEQ ID NO: 352032 - DNA, 20 bp, Artificial
  CRISPR gRNA sequence
tgggctgttagggggtgtca

SEQ ID NO: 352033 - DNA, 20 bp, Artificial
  CRISPR gRNA sequence
actgaacttggccacaggcc

SEQ ID NO: 352034 - DNA, 20 bp, Artificial
  CRISPR gRNA sequence
ttctcagatcaactccctgg

SEQ ID NO: 352035 - DNA, 20 bp, Artificial
  CRISPR gRNA sequence
ctgtgaaatgaacaaggaag

SEQ ID NO: 352036 - DNA, 20 bp, Artificial
  CRISPR gRNA sequence
gaagtgaggcttcccaagaa

SEQ ID NO: 352037 - DNA, 20 bp, Artificial
  CRISPR gRNA sequence
ccaccagtcacaaagtctgg

SEQ ID NO: 352038 - DNA, 20 bp, Artificial
  CRISPR gRNA sequence
acctgatcaagcctctgtgc

SEQ ID NO: 352039 - DNA, 20 bp, Artificial
  CRISPR gRNA sequence
aaaaagtcaataaacagaaa

SEQ ID NO: 352040 - DNA, 20 bp, Artificial
  CRISPR gRNA sequence
aaagaatgattttgagatct

SEQ ID NO: 352041 - DNA, 20 bp, Artificial
  CRISPR gRNA sequence
acagttctgtgcaaatggca

SEQ ID NO: 352042 - DNA, 20 bp, Artificial
  CRISPR gRNA sequence
gttttaaagaaaaacgtagc

SEQ ID NO: 352043 - DNA, 20 bp, Artificial
  CRISPR gRNA sequence
gtttgatggtgctgttacaa

SEQ ID NO: 352044 - DNA, 20 bp, Artificial
  CRISPR gRNA sequence
actcagaggaacttgtccca

SEQ ID NO: 352045 - DNA, 20 bp, Artificial
  CRISPR gRNA sequence
tgatttttcacttctcaaaa

SEQ ID NO: 352046 - DNA, 20 bp, Artificial
  CRISPR gRNA sequence
atgtttaaatcccagttctc

SEQ ID NO: 352047 - DNA, 20 bp, Artificial
  CRISPR gRNA sequence
ctcagctaagactctctgtg

SEQ ID NO: 352048 - DNA, 20 bp, Artificial
  CRISPR gRNA sequence
gattctgaacctcttatatc

SEQ ID NO: 352049 - DNA, 20 bp, Artificial
  CRISPR gRNA sequence
aaattaagttattttggtct

SEQ ID NO: 352050 - DNA, 20 bp, Artificial
  CRISPR gRNA sequence
gagactttttaagtaaagtc

SEQ ID NO: 352051 - DNA, 20 bp, Artificial
  CRISPR gRNA sequence
gtcctttgttttttcctatt

SEQ ID NO: 352052 - DNA, 20 bp, Artificial
  CRISPR gRNA sequence
caggctgtcctcaatttaag

SEQ ID NO: 352053 - DNA, 20 bp, Artificial
  CRISPR gRNA sequence
atttaagccctgctttttct

SEQ ID NO: 352054 - DNA, 20 bp, Artificial
  CRISPR gRNA sequence
gtcaattcacattgtaagcc

SEQ ID NO: 352055 - DNA, 20 bp, Artificial
  CRISPR gRNA sequence
taagcctgttgcttagtgca

SEQ ID NO: 352056 - DNA, 20 bp, Artificial
  CRISPR gRNA sequence
agtgcatctcgtttcctggt

SEQ ID NO: 352057 - DNA, 20 bp, Artificial
  CRISPR gRNA sequence
cttagttgcaatcaacagaa

SEQ ID NO: 352058 - DNA, 20 bp, Artificial
  CRISPR gRNA sequence
tgcaatcaacagaagctggc

SEQ ID NO: 352059 - DNA, 20 bp, Artificial
  CRISPR gRNA sequence
aaaggaacctattgaaaaga

SEQ ID NO: 352060 - DNA, 20 bp, Artificial
  CRISPR gRNA sequence
gattggttccaataactgct

SEQ ID NO: 352061 - DNA, 20 bp, Artificial
  CRISPR gRNA sequence
tgctagaagtttctgcaaaa

SEQ ID NO: 352062 - DNA, 20 bp, Artificial
  CRISPR gRNA sequence
cccttcttcatcctttcatc

SEQ ID NO: 352063 - DNA, 20 bp, Artificial
  CRISPR gRNA sequence
tctagcttataattcaaagt

SEQ ID NO: 352064 - DNA, 20 bp, Artificial
  CRISPR gRNA sequence
gaattctacaaataatagaa

SEQ ID NO: 352065 - DNA, 20 bp, Artificial
  CRISPR gRNA sequence
caaaactgtggagctactaa

SEQ ID NO: 352066 - DNA, 20 bp, Artificial
  CRISPR gRNA sequence
actaatgaagatttgtaaac

SEQ ID NO: 352067 - DNA, 20 bp, Artificial
  CRISPR gRNA sequence
cacccattcctttactacaa

SEQ ID NO: 352068 - DNA, 20 bp, Artificial
  CRISPR gRNA sequence
tagaagctcagttcccagca

SEQ ID NO: 352069 - DNA, 20 bp, Artificial
  CRISPR gRNA sequence
tggtgatacattcacaactc

SEQ ID NO: 352070 - DNA, 20 bp, Artificial
  CRISPR gRNA sequence
caaatggcactatggggagc

SEQ ID NO: 352071 - DNA, 20 bp, Artificial
  CRISPR gRNA sequence
ttttcctcagacttaaaaca

SEQ ID NO: 352072 - DNA, 20 bp, Artificial
  CRISPR gRNA sequence
cttaaaacaataagttttcc

SEQ ID NO: 352073 - DNA, 20 bp, Artificial
  CRISPR gRNA sequence
tccccgtgtttcccctctaa

SEQ ID NO: 352074 - DNA, 20 bp, Artificial
  CRISPR gRNA sequence
tcaggaggaacacacccatt

SEQ ID NO: 352075 - DNA, 20 bp, Artificial
  CRISPR gRNA sequence
gcacagtcccaggctcttca

SEQ ID NO: 352076 - DNA, 20 bp, Artificial
  CRISPR gRNA sequence
cctccattcacacagcgggg

SEQ ID NO: 352077 - DNA, 20 bp, Artificial
  CRISPR gRNA sequence
ctggctgagaagccactgtg

SEQ ID NO: 352078 - DNA, 20 bp, Artificial
  CRISPR gRNA sequence
ctgtgaattgattcttcttc

SEQ ID NO: 352079 - DNA, 20 bp, Artificial
  CRISPR gRNA sequence
attgattcttcttctgaagt

SEQ ID NO: 352080 - DNA, 20 bp, Artificial
  CRISPR gRNA sequence
cagaagaagaatcaattcac

SEQ ID NO: 352081 - DNA, 20 bp, Artificial
  CRISPR gRNA sequence
ctgacttctctagaattcag

SEQ ID NO: 352082 - DNA, 20 bp, Artificial
  CRISPR gRNA sequence
ggggaaacacggggaaaact

SEQ ID NO: 352083 - DNA, 20 bp, Artificial
  CRISPR gRNA sequence
gtgaatgtatcaccagaagg

SEQ ID NO: 352084 - DNA, 20 bp, Artificial
  CRISPR gRNA sequence
ggtgagaggcataatgccag

SEQ ID NO: 352085 - DNA, 20 bp, Artificial
  CRISPR gRNA sequence
gtgatagcctcttcttcacc

SEQ ID NO: 352086 - DNA, 20 bp, Artificial
  CRISPR gRNA sequence
aaaaatccaagtgctgggaa

SEQ ID NO: 352087 - DNA, 20 bp, Artificial
  CRISPR gRNA sequence
aggaatgggtgctcataagc

SEQ ID NO: 352088 - DNA, 20 bp, Artificial
  CRISPR gRNA sequence
caaatcttcattagtagctc

SEQ ID NO: 352089 - DNA, 20 bp, Artificial
  CRISPR gRNA sequence
ggtggcgtagtggataattg

SEQ ID NO: 352090 - DNA, 20 bp, Artificial
  CRISPR gRNA sequence
ataggacatggacatgtgac

SEQ ID NO: 352091 - DNA, 20 bp, Artificial
  CRISPR gRNA sequence
gtgcagcagtaacagtaata

SEQ ID NO: 352092 - DNA, 20 bp, Artificial
  CRISPR gRNA sequence
aacaggatcatcatccctgg

SEQ ID NO: 352093 - DNA, 20 bp, Artificial
  CRISPR gRNA sequence
tttcctgctcactttcaaag

SEQ ID NO: 352094 - DNA, 20 bp, Artificial
  CRISPR gRNA sequence
ttctacataaaaaagccaaa

SEQ ID NO: 352095 - DNA, 20 bp, Artificial
  CRISPR gRNA sequence
aaaaagccaaagccagcttc

SEQ ID NO: 352096 - DNA, 20 bp, Artificial
  CRISPR gRNA sequence
gaaacgagatgcactaagca

SEQ ID NO: 352097 - DNA, 20 bp, Artificial
  CRISPR gRNA sequence
agatacaaggcaataaggac

SEQ ID NO: 352098 - DNA, 20 bp, Artificial
  CRISPR gRNA sequence
ttatgcaatggtatgatagt

SEQ ID NO: 352099 - DNA, 20 bp, Artificial
  CRISPR gRNA sequence
gctgtttcttacagtactta

SEQ ID NO: 352100 - DNA, 20 bp, Artificial
  CRISPR gRNA sequence
taagaaacaataagaaaaag

SEQ ID NO: 352101 - DNA, 20 bp, Artificial
  CRISPR gRNA sequence
ttaaaaagtctctttctgcc

SEQ ID NO: 352102 - DNA, 20 bp, Artificial
  CRISPR gRNA sequence
aaaataagttattgagcatt

SEQ ID NO: 352103 - DNA, 20 bp, Artificial
  CRISPR gRNA sequence
agagagtcttagctgaggtt

SEQ ID NO: 352104 - DNA, 20 bp, Artificial
  CRISPR gRNA sequence
tcaagggaatcaacagagaa

SEQ ID NO: 352105 - DNA, 20 bp, Artificial
  CRISPR gRNA sequence
acagcaccatcaaacatttg

SEQ ID NO: 352106 - DNA, 20 bp, Artificial
  CRISPR gRNA sequence
ctgtacttttaaggctctta

SEQ ID NO: 352107 - DNA, 20 bp, Artificial
  CRISPR gRNA sequence
agagatctcaaaatcattct

SEQ ID NO: 352108 - DNA, 20 bp, Artificial
  CRISPR gRNA sequence
ttctttctgtttattgactt

SEQ ID NO: 352109 - DNA, 20 bp, Artificial
  CRISPR gRNA sequence
gtttattgactttttagctt

SEQ ID NO: 352110 - DNA, 20 bp, Artificial
  CRISPR gRNA sequence
tttgcaaataaaataatatt

SEQ ID NO: 352111 - DNA, 20 bp, Artificial
  CRISPR gRNA sequence
tcctttatacaataatatca

SEQ ID NO: 352112 - DNA, 20 bp, Artificial
  CRISPR gRNA sequence
tgagagagaaactgaggcac

SEQ ID NO: 352113 - DNA, 20 bp, Artificial
  CRISPR gRNA sequence
tgagataggtactcagatgt

SEQ ID NO: 352114 - DNA, 20 bp, Artificial
  CRISPR gRNA sequence
ctcagatgtcctggctttca

SEQ ID NO: 352115 - DNA, 20 bp, Artificial
  CRISPR gRNA sequence
tggccaagttcagtgttcat

SEQ ID NO: 352116 - DNA, 20 bp, Artificial
  CRISPR gRNA sequence
ctagcatagactgtgatgga

SEQ ID NO: 352117 - DNA, 20 bp, Artificial
  CRISPR gRNA sequence
ggtcctgagctgggaaggag

SEQ ID NO: 352118 - DNA, 20 bp, Artificial
  CRISPR gRNA sequence
caagtttcttctgaagagga

SEQ ID NO: 352119 - DNA, 20 bp, Artificial
  CRISPR gRNA sequence
ctggacttgggcatagatcg

SEQ ID NO: 352120 - DNA, 20 bp, Artificial
  CRISPR gRNA sequence
tccactgttgtctggtaatg

SEQ ID NO: 352121 - DNA, 20 bp, Artificial
  CRISPR gRNA sequence
acagcccagcatacactgcc

SEQ ID NO: 352122 - DNA, 20 bp, Artificial
  CRISPR gRNA sequence
ccagcatacactgcccatgg

SEQ ID NO: 352123 - DNA, 20 bp, Artificial
  CRISPR gRNA sequence
gcaggtcccgttctcctggg

SEQ ID NO: 352124 - DNA, 20 bp, Artificial
  CRISPR gRNA sequence
gtaccatccctcatcctcct

SEQ ID NO: 352125 - DNA, 20 bp, Artificial
  CRISPR gRNA sequence
tgctttcccgtatccccagg

SEQ ID NO: 352126 - DNA, 20 bp, Artificial
  CRISPR gRNA sequence
tctcctagataacgtggagg

SEQ ID NO: 352127 - DNA, 20 bp, Artificial
  CRISPR gRNA sequence
ttgttctcgacactgttctc

SEQ ID NO: 352128 - DNA, 20 bp, Artificial
  CRISPR gRNA sequence
tgccattgtgacgacaatgt

SEQ ID NO: 352129 - DNA, 20 bp, Artificial
  CRISPR gRNA sequence
atatgtcaggggcagcagca

SEQ ID NO: 352130 - DNA, 20 bp, Artificial
  CRISPR gRNA sequence
catcatgcgcccacctgttc

SEQ ID NO: 352131 - DNA, 20 bp, Artificial
  CRISPR gRNA sequence
ctcacagatgccaggcagaa

SEQ ID NO: 352132 - DNA, 20 bp, Artificial
  CRISPR gRNA sequence
cgtgtcatgcagcagaggct

SEQ ID NO: 352133 - DNA, 20 bp, Artificial
  CRISPR gRNA sequence
aggaaccagcaggttcctga

SEQ ID NO: 352134 - DNA, 20 bp, Artificial
  CRISPR gRNA sequence
tcctgtatcactgggacttt

SEQ ID NO: 352135 - DNA, 20 bp, Artificial
  CRISPR gRNA sequence
gactttttctgcttgtgtct

SEQ ID NO: 352136 - DNA, 20 bp, Artificial
  CRISPR gRNA sequence
tgaggattgctcatctccca

SEQ ID NO: 352137 - DNA, 20 bp, Artificial
  CRISPR gRNA sequence
cacttttttgttctcaagaa

SEQ ID NO: 352138 - DNA, 20 bp, Artificial
  CRISPR gRNA sequence
tgtagtcacctcggccaaaa

SEQ ID NO: 352139 - DNA, 20 bp, Artificial
  CRISPR gRNA sequence
ctttgggcagaaacatgcgc

SEQ ID NO: 352140 - DNA, 20 bp, Artificial
  CRISPR gRNA sequence
tgtctccaggaaccggatgt

SEQ ID NO: 352141 - DNA, 20 bp, Artificial
  CRISPR gRNA sequence
agttctctccggtaagtctt

SEQ ID NO: 352142 - DNA, 20 bp, Artificial
  CRISPR gRNA sequence
cttcttggattgcaaagaaa

SEQ ID NO: 352143 - DNA, 20 bp, Artificial
  CRISPR gRNA sequence
tgagctaatagacctcttac

SEQ ID NO: 352144 - DNA, 20 bp, Artificial
  CRISPR gRNA sequence
cttaccggagagaactgctc

SEQ ID NO: 352145 - DNA, 20 bp, Artificial
  CRISPR gRNA sequence
gagcaatcctcaagacacaa

SEQ ID NO: 352146 - DNA, 20 bp, Artificial
  CRISPR gRNA sequence
gatcgctacaagttttatct

SEQ ID NO: 352147 - DNA, 20 bp, Artificial
  CRISPR gRNA sequence
ggatggtaccttatgaccct

SEQ ID NO: 352148 - DNA, 20 bp, Artificial
  CRISPR gRNA sequence
gaggctttatggtctccact

SEQ ID NO: 352149 - DNA, 20 bp, Artificial
  CRISPR gRNA sequence
ccggatgcaggacagacccc

SEQ ID NO: 352150 - DNA, 20 bp, Artificial
  CRISPR gRNA sequence
cttacgatctatgcccaagt

SEQ ID NO: 352151 - DNA, 20 bp, Artificial
  CRISPR gRNA sequence
cagaaaccaggtcctcttca

SEQ ID NO: 352152 - DNA, 20 bp, Artificial
  CRISPR gRNA sequence
aacaaggaagtgaggcttcc

SEQ ID NO: 352153 - DNA, 20 bp, Artificial
  CRISPR gRNA sequence
tattattgtataaaggaagc

SEQ ID NO: 352154 - DNA, 20 bp, Artificial
  CRISPR gRNA sequence
agaagctaaaaagtcaataa

SEQ ID NO: 352155 - DNA, 20 bp, Artificial
  CRISPR gRNA sequence
gctaaaaagtcaataaacag

SEQ ID NO: 352156 - DNA, 20 bp, Artificial
  CRISPR gRNA sequence
tgcaaatggcattcagtttt

SEQ ID NO: 352157 - DNA, 20 bp, Artificial
  CRISPR gRNA sequence
cacactaaatttatcctcta

SEQ ID NO: 352158 - DNA, 20 bp, Artificial
  CRISPR gRNA sequence
acttattttgcaagctgcag

SEQ ID NO: 352159 - DNA, 20 bp, Artificial
  CRISPR gRNA sequence
tataaacttggtaagtactg

SEQ ID NO: 352160 - DNA, 20 bp, Artificial
  CRISPR gRNA sequence
gctggctttggcttttttat

SEQ ID NO: 352161 - DNA, 20 bp, Artificial
  CRISPR gRNA sequence
gaattctacctgaaggaagg

SEQ ID NO: 352162 - DNA, 20 bp, Artificial
  CRISPR gRNA sequence
aatttattcatttccaaaaa

SEQ ID NO: 352163 - DNA, 20 bp, Artificial
  CRISPR gRNA sequence
tagaaacataaacttcagaa

SEQ ID NO: 352164 - DNA, 20 bp, Artificial
  CRISPR gRNA sequence
gaacatcagtcccttcaaac

SEQ ID NO: 352165 - DNA, 20 bp, Artificial
  CRISPR gRNA sequence
gtgtgttcctcctgacttct

SEQ ID NO: 352166 - DNA, 20 bp, Artificial
  CRISPR gRNA sequence
aattcagacatgcttggtca

SEQ ID NO: 352167 - DNA, 20 bp, Artificial
  CRISPR gRNA sequence
tgtttctgcccttccttcag

SEQ ID NO: 352168 - DNA, 20 bp, Artificial
  CRISPR gRNA sequence
gaatcccacttctattattt

SEQ ID NO: 352169 - DNA, 20 bp, Artificial
  CRISPR gRNA sequence
aaggatgaagaagggaccct

SEQ ID NO: 352170 - DNA, 20 bp, Artificial
  CRISPR gRNA sequence
cactttcaaagcatggtttt

SEQ ID NO: 352171 - DNA, 20 bp, Artificial
  CRISPR gRNA sequence
cagtacttaccaagtttata

SEQ ID NO: 352172 - DNA, 20 bp, Artificial
  CRISPR gRNA sequence
caagtttatataagaaacaa

SEQ ID NO: 352173 - DNA, 20 bp, Artificial
  CRISPR gRNA sequence
aggacagcctgtctaaaagc

SEQ ID NO: 352174 - DNA, 20 bp, Artificial
  CRISPR gRNA sequence
tgaggagaggtatgcaggga

SEQ ID NO: 352175 - DNA, 20 bp, Artificial
  CRISPR gRNA sequence
aagccctggatataagaggt

SEQ ID NO: 352176 - DNA, 20 bp, Artificial
  CRISPR gRNA sequence
tcagagtgttttatgtataa

SEQ ID NO: 352177 - DNA, 20 bp, Artificial
  CRISPR gRNA sequence
tattcactctttatcctgag

SEQ ID NO: 352178 - DNA, 20 bp, Artificial
  CRISPR gRNA sequence
tcatttcacagatgtatgtg

SEQ ID NO: 352179 - DNA, 20 bp, Artificial
  CRISPR gRNA sequence
tttggtttttccattttcct

SEQ ID NO: 352180 - DNA, 20 bp, Artificial
  CRISPR gRNA sequence
ctgtagtattaccaccatga

SEQ ID NO: 352181 - DNA, 20 bp, Artificial
  CRISPR gRNA sequence
cactttgcttcccaactgcc

SEQ ID NO: 352182 - DNA, 20 bp, Artificial
  CRISPR gRNA sequence
gcttgccccaaaagccaggg

SEQ ID NO: 352183 - DNA, 20 bp, Artificial
  CRISPR gRNA sequence
cggccaaaacccggctttgg

SEQ ID NO: 352184 - DNA, 20 bp, Artificial
  CRISPR gRNA sequence
ggtaagtcttcttggattgc

SEQ ID NO: 352185 - DNA, 20 bp, Artificial
  CRISPR gRNA sequence
tgtcatctgaaattatgaaa

SEQ ID NO: 352186 - DNA, 20 bp, Artificial
  CRISPR gRNA sequence
caggacagacccctcagaaa

SEQ ID NO: 352187 - DNA, 20 bp, Artificial
  CRISPR gRNA sequence
ctacagttgagaagaagagg

SEQ ID NO: 352188 - DNA, 20 bp, Artificial
  CRISPR gRNA sequence
gactttctgaaggaaaatgg

SEQ ID NO: 352189 - DNA, 20 bp, Artificial
  CRISPR gRNA sequence
ggtgaatttcttattataca

SEQ ID NO: 352190 - DNA, 20 bp, Artificial
  CRISPR gRNA sequence
taagaatattattttatttg

SEQ ID NO: 352191 - DNA, 20 bp, Artificial
  CRISPR gRNA sequence
aatggcattcagttttaaag

SEQ ID NO: 352192 - DNA, 20 bp, Artificial
  CRISPR gRNA sequence
ggagcaccaacttcccagct

SEQ ID NO: 352193 - DNA, 20 bp, Artificial
  CRISPR gRNA sequence
ataactgctagaagtttctg

SEQ ID NO: 352194 - DNA, 20 bp, Artificial
  CRISPR gRNA sequence
tgggagcacagccaaaatta

SEQ ID NO: 352195 - DNA, 20 bp, Artificial
  CRISPR gRNA sequence
cctcattcactgtctactct

SEQ ID NO: 352196 - DNA, 20 bp, Artificial
  CRISPR gRNA sequence
tagaccatggttacacgtgg

SEQ ID NO: 352197 - DNA, 20 bp, Artificial
  CRISPR gRNA sequence
gcttgccttttcctcagact

SEQ ID NO: 352198 - DNA, 20 bp, Artificial
  CRISPR gRNA sequence
tcagacatgcttggtcaaaa

SEQ ID NO: 352199 - DNA, 20 bp, Artificial
  CRISPR gRNA sequence
cattagaggggaaacacggg

SEQ ID NO: 352200 - DNA, 20 bp, Artificial
  CRISPR gRNA sequence
tctaaaagcagagaatagga

SEQ ID NO: 352201 - DNA, 20 bp, Artificial
  CRISPR gRNA sequence
acatttgctacgtttttctt

SEQ ID NO: 352202 - DNA, 20 bp, Artificial
  CRISPR gRNA sequence
atggtttccagtccactgtt

SEQ ID NO: 352203 - DNA, 20 bp, Artificial
  CRISPR gRNA sequence
ccgttctcctgggtcttgtt

SEQ ID NO: 352204 - DNA, 20 bp, Artificial
  CRISPR gRNA sequence
ccagggtgagattctccaga

SEQ ID NO: 352205 - DNA, 20 bp, Artificial
  CRISPR gRNA sequence
gggtgtgtagtcacctcggc

SEQ ID NO: 352206 - DNA, 20 bp, Artificial
  CRISPR gRNA sequence
cccatctctgtgtgacagtg

SEQ ID NO: 352207 - DNA, 20 bp, Artificial
  CRISPR gRNA sequence
ccatctctgtgtgacagtgg

SEQ ID NO: 352208 - DNA, 20 bp, Artificial
  CRISPR gRNA sequence
tgtgtgacagtggcacctgc

SEQ ID NO: 352209 - DNA, 20 bp, Artificial
  CRISPR gRNA sequence
tgtgacagtggcacctgcac

SEQ ID NO: 352210 - DNA, 20 bp, Artificial
  CRISPR gRNA sequence
caccagactgcatgttgagg

SEQ ID NO: 352211 - DNA, 20 bp, Artificial
  CRISPR gRNA sequence
catgttgaggtgtcatctga

SEQ ID NO: 352212 - DNA, 20 bp, Artificial
  CRISPR gRNA sequence
aggtgtcatctgaaattatg

SEQ ID NO: 352213 - DNA, 20 bp, Artificial
  CRISPR gRNA sequence
aaattatgaaataaaacaga

SEQ ID NO: 352214 - DNA, 20 bp, Artificial
  CRISPR gRNA sequence
tgaaataaaacagaagtaag

SEQ ID NO: 352215 - DNA, 20 bp, Artificial
  CRISPR gRNA sequence
ttagctcatcaaaatgcagt

SEQ ID NO: 352216 - DNA, 20 bp, Artificial
  CRISPR gRNA sequence
gctcatcaaaatgcagttat

SEQ ID NO: 352217 - DNA, 20 bp, Artificial
  CRISPR gRNA sequence
atcaaaatgcagttatctaa

SEQ ID NO: 352218 - DNA, 20 bp, Artificial
  CRISPR gRNA sequence
tctaagttcagctgtgaact

SEQ ID NO: 352219 - DNA, 20 bp, Artificial
  CRISPR gRNA sequence
agttcagctgtgaactgcca

SEQ ID NO: 352220 - DNA, 20 bp, Artificial
  CRISPR gRNA sequence
agctgtgaactgccaaattt

SEQ ID NO: 352221 - DNA, 20 bp, Artificial
  CRISPR gRNA sequence
tgaactgccaaatttgagga

SEQ ID NO: 352222 - DNA, 20 bp, Artificial
  CRISPR gRNA sequence
ccaaatttgaggagtgatcc

SEQ ID NO: 352223 - DNA, 20 bp, Artificial
  CRISPR gRNA sequence
gaggagtgatccaatgaaac

SEQ ID NO: 352224 - DNA, 20 bp, Artificial
  CRISPR gRNA sequence
aggagtgatccaatgaaaca

SEQ ID NO: 352225 - DNA, 20 bp, Artificial
  CRISPR gRNA sequence
ttctttgcaatccaagaaga

SEQ ID NO: 352226 - DNA, 20 bp, Artificial
  CRISPR gRNA sequence
tctttgcaatccaagaagac

SEQ ID NO: 352227 - DNA, 20 bp, Artificial
  CRISPR gRNA sequence
ctttgcaatccaagaagact

SEQ ID NO: 352228 - DNA, 20 bp, Artificial
  CRISPR gRNA sequence
tttgcaatccaagaagactt

SEQ ID NO: 352229 - DNA, 20 bp, Artificial
  CRISPR gRNA sequence
tgcaatccaagaagacttac

SEQ ID NO: 352230 - DNA, 20 bp, Artificial
  CRISPR gRNA sequence
gcaatccaagaagacttacc

SEQ ID NO: 352231 - DNA, 20 bp, Artificial
  CRISPR gRNA sequence
caatccaagaagacttaccg

SEQ ID NO: 352232 - DNA, 20 bp, Artificial
  CRISPR gRNA sequence
accggagagaactgctcaga

SEQ ID NO: 352233 - DNA, 20 bp, Artificial
  CRISPR gRNA sequence
ccggagagaactgctcagag

SEQ ID NO: 352234 - DNA, 20 bp, Artificial
  CRISPR gRNA sequence
ctcagagaatctgcaacatc

SEQ ID NO: 352235 - DNA, 20 bp, Artificial
  CRISPR gRNA sequence
agagaatctgcaacatccgg

SEQ ID NO: 352236 - DNA, 20 bp, Artificial
  CRISPR gRNA sequence
caacatccggttcctggaga

SEQ ID NO: 352237 - DNA, 20 bp, Artificial
  CRISPR gRNA sequence
ctggagacagctaaggaaag

SEQ ID NO: 352238 - DNA, 20 bp, Artificial
  CRISPR gRNA sequence
gagacagctaaggaaagaag

SEQ ID NO: 352239 - DNA, 20 bp, Artificial
  CRISPR gRNA sequence
aggaaagaagctggggcgca

SEQ ID NO: 352240 - DNA, 20 bp, Artificial
  CRISPR gRNA sequence
gggcgcatgtttctgcccaa

SEQ ID NO: 352241 - DNA, 20 bp, Artificial
  CRISPR gRNA sequence
ctgcccaaagccgggttttg

SEQ ID NO: 352242 - DNA, 20 bp, Artificial
  CRISPR gRNA sequence
tgcccaaagccgggttttgg

SEQ ID NO: 352243 - DNA, 20 bp, Artificial
  CRISPR gRNA sequence
cccaaagccgggttttggcc

SEQ ID NO: 352244 - DNA, 20 bp, Artificial
  CRISPR gRNA sequence
tggccgaggtgactacacac

SEQ ID NO: 352245 - DNA, 20 bp, Artificial
  CRISPR gRNA sequence
ggccgaggtgactacacacc

SEQ ID NO: 352246 - DNA, 20 bp, Artificial
  CRISPR gRNA sequence
gccgaggtgactacacaccc

SEQ ID NO: 352247 - DNA, 20 bp, Artificial
  CRISPR gRNA sequence
cacaccccctttcctggctc

SEQ ID NO: 352248 - DNA, 20 bp, Artificial
  CRISPR gRNA sequence
tcctggctcccataggctaa

SEQ ID NO: 352249 - DNA, 20 bp, Artificial
  CRISPR gRNA sequence
cctggctcccataggctaag

SEQ ID NO: 352250 - DNA, 20 bp, Artificial
  CRISPR gRNA sequence
ctggctcccataggctaagt

SEQ ID NO: 352251 - DNA, 20 bp, Artificial
  CRISPR gRNA sequence
gctcccataggctaagtgcc

SEQ ID NO: 352252 - DNA, 20 bp, Artificial
  CRISPR gRNA sequence
ccataggctaagtgcctggc

SEQ ID NO: 352253 - DNA, 20 bp, Artificial
  CRISPR gRNA sequence
agtgcctggcttcttgagaa

SEQ ID NO: 352254 - DNA, 20 bp, Artificial
  CRISPR gRNA sequence
gcttcttgagaagcctgctt

SEQ ID NO: 352255 - DNA, 20 bp, Artificial
  CRISPR gRNA sequence
cttgagaagcctgcttcttg

SEQ ID NO: 352256 - DNA, 20 bp, Artificial
  CRISPR gRNA sequence
ttgagaagcctgcttcttga

SEQ ID NO: 352257 - DNA, 20 bp, Artificial
  CRISPR gRNA sequence
gagaagcctgcttcttgaga

SEQ ID NO: 352258 - DNA, 20 bp, Artificial
  CRISPR gRNA sequence
agaagcctgcttcttgagaa

SEQ ID NO: 352259 - DNA, 20 bp, Artificial
  CRISPR gRNA sequence
cttcttgagaacaaaaaagt

SEQ ID NO: 352260 - DNA, 20 bp, Artificial
  CRISPR gRNA sequence
cttgagaacaaaaaagtgat

SEQ ID NO: 352261 - DNA, 20 bp, Artificial
  CRISPR gRNA sequence
ttgagaacaaaaaagtgatt

SEQ ID NO: 352262 - DNA, 20 bp, Artificial
  CRISPR gRNA sequence
gagaacaaaaaagtgattta

SEQ ID NO: 352263 - DNA, 20 bp, Artificial
  CRISPR gRNA sequence
agaacaaaaaagtgatttaa

SEQ ID NO: 352264 - DNA, 20 bp, Artificial
  CRISPR gRNA sequence
aaagcctcatgggagatgag

SEQ ID NO: 352265 - DNA, 20 bp, Artificial
  CRISPR gRNA sequence
aagcctcatgggagatgagc

SEQ ID NO: 352266 - DNA, 20 bp, Artificial
  CRISPR gRNA sequence
atgggagatgagcaatcctc

SEQ ID NO: 352267 - DNA, 20 bp, Artificial
  CRISPR gRNA sequence
aagacacaagcagaaaaagt

SEQ ID NO: 352268 - DNA, 20 bp, Artificial
  CRISPR gRNA sequence
aggaacctgctggttcctga

SEQ ID NO: 352269 - DNA, 20 bp, Artificial
  CRISPR gRNA sequence
ctggttcctgatacataaat

SEQ ID NO: 352270 - DNA, 20 bp, Artificial
  CRISPR gRNA sequence
gttcctgatacataaatcag

SEQ ID NO: 352271 - DNA, 20 bp, Artificial
  CRISPR gRNA sequence
ctgatacataaatcagacag

SEQ ID NO: 352272 - DNA, 20 bp, Artificial
  CRISPR gRNA sequence
atacataaatcagacagcct

SEQ ID NO: 352273 - DNA, 20 bp, Artificial
  CRISPR gRNA sequence
tgctgcatgacacgaagctt

SEQ ID NO: 352274 - DNA, 20 bp, Artificial
  CRISPR gRNA sequence
ctgcatgacacgaagcttgc

SEQ ID NO: 352275 - DNA, 20 bp, Artificial
  CRISPR gRNA sequence
catgacacgaagcttgcttc

SEQ ID NO: 352276 - DNA, 20 bp, Artificial
  CRISPR gRNA sequence
gcttctgcctggcatctgtg

SEQ ID NO: 352277 - DNA, 20 bp, Artificial
  CRISPR gRNA sequence
cttctgcctggcatctgtga

SEQ ID NO: 352278 - DNA, 20 bp, Artificial
  CRISPR gRNA sequence
ctgcctggcatctgtgagca

SEQ ID NO: 352279 - DNA, 20 bp, Artificial
  CRISPR gRNA sequence
tgcctggcatctgtgagcag

SEQ ID NO: 352280 - DNA, 20 bp, Artificial
  CRISPR gRNA sequence
cctggcatctgtgagcagct

SEQ ID NO: 352281 - DNA, 20 bp, Artificial
  CRISPR gRNA sequence
gcatctgtgagcagctgcca

SEQ ID NO: 352282 - DNA, 20 bp, Artificial
  CRISPR gRNA sequence
tgagcagctgccaggctccg

SEQ ID NO: 352283 - DNA, 20 bp, Artificial
  CRISPR gRNA sequence
ccaggctccggccaggatcc

SEQ ID NO: 352284 - DNA, 20 bp, Artificial
  CRISPR gRNA sequence
cggccaggatcccttccttc

SEQ ID NO: 352285 - DNA, 20 bp, Artificial
  CRISPR gRNA sequence
ccttctcctcattggctgat

SEQ ID NO: 352286 - DNA, 20 bp, Artificial
  CRISPR gRNA sequence
cttctcctcattggctgatg

SEQ ID NO: 352287 - DNA, 20 bp, Artificial
  CRISPR gRNA sequence
ctcctcattggctgatggat

SEQ ID NO: 352288 - DNA, 20 bp, Artificial
  CRISPR gRNA sequence
tcctcattggctgatggatc

SEQ ID NO: 352289 - DNA, 20 bp, Artificial
  CRISPR gRNA sequence
ctcattggctgatggatccc

SEQ ID NO: 352290 - DNA, 20 bp, Artificial
  CRISPR gRNA sequence
attggctgatggatcccaag

SEQ ID NO: 352291 - DNA, 20 bp, Artificial
  CRISPR gRNA sequence
gctgatggatcccaaggggc

SEQ ID NO: 352292 - DNA, 20 bp, Artificial
  CRISPR gRNA sequence
atggatcccaaggggctcct

SEQ ID NO: 352293 - DNA, 20 bp, Artificial
  CRISPR gRNA sequence
ctctccttgaccttcgtgct

SEQ ID NO: 352294 - DNA, 20 bp, Artificial
  CRISPR gRNA sequence
tccttgaccttcgtgctgtt

SEQ ID NO: 352295 - DNA, 20 bp, Artificial
  CRISPR gRNA sequence
cttgaccttcgtgctgtttc

SEQ ID NO: 352296 - DNA, 20 bp, Artificial
  CRISPR gRNA sequence
gaccttcgtgctgtttctct

SEQ ID NO: 352297 - DNA, 20 bp, Artificial
  CRISPR gRNA sequence
accttcgtgctgtttctctc

SEQ ID NO: 352298 - DNA, 20 bp, Artificial
  CRISPR gRNA sequence
cgtgctgtttctctccctgg

SEQ ID NO: 352299 - DNA, 20 bp, Artificial
  CRISPR gRNA sequence
gtgctgtttctctccctggc

SEQ ID NO: 352300 - DNA, 20 bp, Artificial
  CRISPR gRNA sequence
tttctctccctggcttttgg

SEQ ID NO: 352301 - DNA, 20 bp, Artificial
  CRISPR gRNA sequence
ctctccctggcttttggggc

SEQ ID NO: 352302 - DNA, 20 bp, Artificial
  CRISPR gRNA sequence
tctccctggcttttggggca

SEQ ID NO: 352303 - DNA, 20 bp, Artificial
  CRISPR gRNA sequence
tccctggcttttggggcaag

SEQ ID NO: 352304 - DNA, 20 bp, Artificial
  CRISPR gRNA sequence
cctggcttttggggcaagct

SEQ ID NO: 352305 - DNA, 20 bp, Artificial
  CRISPR gRNA sequence
gcttttggggcaagctacgg

SEQ ID NO: 352306 - DNA, 20 bp, Artificial
  CRISPR gRNA sequence
ttggggcaagctacggaaca

SEQ ID NO: 352307 - DNA, 20 bp, Artificial
  CRISPR gRNA sequence
tggggcaagctacggaacag

SEQ ID NO: 352308 - DNA, 20 bp, Artificial
  CRISPR gRNA sequence
ggggcaagctacggaacagg

SEQ ID NO: 352309 - DNA, 20 bp, Artificial
  CRISPR gRNA sequence
gggcaagctacggaacaggt

SEQ ID NO: 352310 - DNA, 20 bp, Artificial
  CRISPR gRNA sequence
cggaacaggtgggcgcatga

SEQ ID NO: 352311 - DNA, 20 bp, Artificial
  CRISPR gRNA sequence
cccaaagattctccggcagt

SEQ ID NO: 352312 - DNA, 20 bp, Artificial
  CRISPR gRNA sequence
tccggcagttgggaagcaaa

SEQ ID NO: 352313 - DNA, 20 bp, Artificial
  CRISPR gRNA sequence
cggcagttgggaagcaaagt

SEQ ID NO: 352314 - DNA, 20 bp, Artificial
  CRISPR gRNA sequence
ggaagcaaagtgctgctgcc

SEQ ID NO: 352315 - DNA, 20 bp, Artificial
  CRISPR gRNA sequence
ctgcccctgacatatgaaag

SEQ ID NO: 352316 - DNA, 20 bp, Artificial
  CRISPR gRNA sequence
cccctgacatatgaaaggat

SEQ ID NO: 352317 - DNA, 20 bp, Artificial
  CRISPR gRNA sequence
acatatgaaaggataaataa

SEQ ID NO: 352318 - DNA, 20 bp, Artificial
  CRISPR gRNA sequence
tcgtcacaatggcaaaatca

SEQ ID NO: 352319 - DNA, 20 bp, Artificial
  CRISPR gRNA sequence
gagaacagtgtcgagaacaa

SEQ ID NO: 352320 - DNA, 20 bp, Artificial
  CRISPR gRNA sequence
ttgatccatccgaagcaggc

SEQ ID NO: 352321 - DNA, 20 bp, Artificial
  CRISPR gRNA sequence
gatccatccgaagcaggccc

SEQ ID NO: 352322 - DNA, 20 bp, Artificial
  CRISPR gRNA sequence
atccatccgaagcaggccct

SEQ ID NO: 352323 - DNA, 20 bp, Artificial
  CRISPR gRNA sequence
cacgttatctaggagatcgc

SEQ ID NO: 352324 - DNA, 20 bp, Artificial
  CRISPR gRNA sequence
tctaggagatcgctacaagt

SEQ ID NO: 352325 - DNA, 20 bp, Artificial
  CRISPR gRNA sequence
ggagatcgctacaagtttta

SEQ ID NO: 352326 - DNA, 20 bp, Artificial
  CRISPR gRNA sequence
caagttttatctggagaatc

SEQ ID NO: 352327 - DNA, 20 bp, Artificial
  CRISPR gRNA sequence
tatctggagaatctcaccct

SEQ ID NO: 352328 - DNA, 20 bp, Artificial
  CRISPR gRNA sequence
atctggagaatctcaccctg

SEQ ID NO: 352329 - DNA, 20 bp, Artificial
  CRISPR gRNA sequence
tctggagaatctcaccctgg

SEQ ID NO: 352330 - DNA, 20 bp, Artificial
  CRISPR gRNA sequence
gagaatctcaccctggggat

SEQ ID NO: 352331 - DNA, 20 bp, Artificial
  CRISPR gRNA sequence
accctggggatacgggaaag

SEQ ID NO: 352332 - DNA, 20 bp, Artificial
  CRISPR gRNA sequence
gggatacgggaaagcaggaa

SEQ ID NO: 352333 - DNA, 20 bp, Artificial
  CRISPR gRNA sequence
atgaccctggagaaaaatgt

SEQ ID NO: 352334 - DNA, 20 bp, Artificial
  CRISPR gRNA sequence
tgaccctggagaaaaatgtt

SEQ ID NO: 352335 - DNA, 20 bp, Artificial
  CRISPR gRNA sequence
gagaaaaatgtttcagttca

SEQ ID NO: 352336 - DNA, 20 bp, Artificial
  CRISPR gRNA sequence
cagttcagcgcttttgcctg

SEQ ID NO: 352337 - DNA, 20 bp, Artificial
  CRISPR gRNA sequence
agttcagcgcttttgcctgc

SEQ ID NO: 352338 - DNA, 20 bp, Artificial
  CRISPR gRNA sequence
agcgcttttgcctgcagttg

SEQ ID NO: 352339 - DNA, 20 bp, Artificial
  CRISPR gRNA sequence
ttgcctgcagttgaggcttt

SEQ ID NO: 352340 - DNA, 20 bp, Artificial
  CRISPR gRNA sequence
tgcctgcagttgaggcttta

SEQ ID NO: 352341 - DNA, 20 bp, Artificial
  CRISPR gRNA sequence
gcctgcagttgaggctttat

SEQ ID NO: 352342 - DNA, 20 bp, Artificial
  CRISPR gRNA sequence
cctgcagttgaggctttatg

SEQ ID NO: 352343 - DNA, 20 bp, Artificial
  CRISPR gRNA sequence
cagttgaggctttatggtct

SEQ ID NO: 352344 - DNA, 20 bp, Artificial
  CRISPR gRNA sequence
aggctttatggtctccactc

SEQ ID NO: 352345 - DNA, 20 bp, Artificial
  CRISPR gRNA sequence
tatggtctccactccagaaa

SEQ ID NO: 352346 - DNA, 20 bp, Artificial
  CRISPR gRNA sequence
atggtctccactccagaaat

SEQ ID NO: 352347 - DNA, 20 bp, Artificial
  CRISPR gRNA sequence
tggtctccactccagaaatt

SEQ ID NO: 352348 - DNA, 20 bp, Artificial
  CRISPR gRNA sequence
cactccagaaattaaagttt

SEQ ID NO: 352349 - DNA, 20 bp, Artificial
  CRISPR gRNA sequence
cagaaattaaagttttaaac

SEQ ID NO: 352350 - DNA, 20 bp, Artificial
  CRISPR gRNA sequence
aagttttaaacaagacccag

SEQ ID NO: 352351 - DNA, 20 bp, Artificial
  CRISPR gRNA sequence
taaacaagacccaggagaac

SEQ ID NO: 352352 - DNA, 20 bp, Artificial
  CRISPR gRNA sequence
aaacaagacccaggagaacg

SEQ ID NO: 352353 - DNA, 20 bp, Artificial
  CRISPR gRNA sequence
aacaagacccaggagaacgg

SEQ ID NO: 352354 - DNA, 20 bp, Artificial
  CRISPR gRNA sequence
caccttgatactgggctgca

SEQ ID NO: 352355 - DNA, 20 bp, Artificial
  CRISPR gRNA sequence
gatactgggctgcacagtgg

SEQ ID NO: 352356 - DNA, 20 bp, Artificial
  CRISPR gRNA sequence
atactgggctgcacagtgga

SEQ ID NO: 352357 - DNA, 20 bp, Artificial
  CRISPR gRNA sequence
ggctgcacagtggagaaggg

SEQ ID NO: 352358 - DNA, 20 bp, Artificial
  CRISPR gRNA sequence
cacagtggagaagggggacc

SEQ ID NO: 352359 - DNA, 20 bp, Artificial
  CRISPR gRNA sequence
acagctggagtgaaaaggcg

SEQ ID NO: 352360 - DNA, 20 bp, Artificial
  CRISPR gRNA sequence
cagctggagtgaaaaggcgg

SEQ ID NO: 352361 - DNA, 20 bp, Artificial
  CRISPR gRNA sequence
gagtgaaaaggcgggcaccc

SEQ ID NO: 352362 - DNA, 20 bp, Artificial
  CRISPR gRNA sequence
aacccagccaacagctccca

SEQ ID NO: 352363 - DNA, 20 bp, Artificial
  CRISPR gRNA sequence
ccacctcctgtccctcaccc

SEQ ID NO: 352364 - DNA, 20 bp, Artificial
  CRISPR gRNA sequence
ctgtccctcaccctcggccc

SEQ ID NO: 352365 - DNA, 20 bp, Artificial
  CRISPR gRNA sequence
tccctcaccctcggccccca

SEQ ID NO: 352366 - DNA, 20 bp, Artificial
  CRISPR gRNA sequence
accctcggcccccagcatgc

SEQ ID NO: 352367 - DNA, 20 bp, Artificial
  CRISPR gRNA sequence
ggcccccagcatgctgacaa

SEQ ID NO: 352368 - DNA, 20 bp, Artificial
  CRISPR gRNA sequence
acaatatctacatctgcacc

SEQ ID NO: 352369 - DNA, 20 bp, Artificial
  CRISPR gRNA sequence
catctgcaccgtgagcaacc

SEQ ID NO: 352370 - DNA, 20 bp, Artificial
  CRISPR gRNA sequence
caccgtgagcaaccctatca

SEQ ID NO: 352371 - DNA, 20 bp, Artificial
  CRISPR gRNA sequence
tcagcaacaattcccagacc

SEQ ID NO: 352372 - DNA, 20 bp, Artificial
  CRISPR gRNA sequence
ccagaccttcagcccgtggc

SEQ ID NO: 352373 - DNA, 20 bp, Artificial
  CRISPR gRNA sequence
cagcccgtggcccggatgca

SEQ ID NO: 352374 - DNA, 20 bp, Artificial
  CRISPR gRNA sequence
agcccgtggcccggatgcag

SEQ ID NO: 352375 - DNA, 20 bp, Artificial
  CRISPR gRNA sequence
agaaacaaaaccatgggcag

SEQ ID NO: 352376 - DNA, 20 bp, Artificial
  CRISPR gRNA sequence
ggctgttagggggtgtcatc

SEQ ID NO: 352377 - DNA, 20 bp, Artificial
  CRISPR gRNA sequence
ttagggggtgtcatcatgat

SEQ ID NO: 352378 - DNA, 20 bp, Artificial
  CRISPR gRNA sequence
gggggtgtcatcatgattct

SEQ ID NO: 352379 - DNA, 20 bp, Artificial
  CRISPR gRNA sequence
tcatcatggtggtaatacta

SEQ ID NO: 352380 - DNA, 20 bp, Artificial
  CRISPR gRNA sequence
atcatggtggtaatactaca

SEQ ID NO: 352381 - DNA, 20 bp, Artificial
  CRISPR gRNA sequence
cagttgagaagaagaggtaa

SEQ ID NO: 352382 - DNA, 20 bp, Artificial
  CRISPR gRNA sequence
agaagaagaggtaaaacgaa

SEQ ID NO: 352383 - DNA, 20 bp, Artificial
  CRISPR gRNA sequence
ccagacaacagtggaaaaaa

SEQ ID NO: 352384 - DNA, 20 bp, Artificial
  CRISPR gRNA sequence
acgatctatgcccaagtcca

SEQ ID NO: 352385 - DNA, 20 bp, Artificial
  CRISPR gRNA sequence
cgatctatgcccaagtccag

SEQ ID NO: 352386 - DNA, 20 bp, Artificial
  CRISPR gRNA sequence
tgcccaagtccagaaaccag

SEQ ID NO: 352387 - DNA, 20 bp, Artificial
  CRISPR gRNA sequence
ttcagaagaaacttgactcc

SEQ ID NO: 352388 - DNA, 20 bp, Artificial
  CRISPR gRNA sequence
cagaagaaacttgactcctt

SEQ ID NO: 352389 - DNA, 20 bp, Artificial
  CRISPR gRNA sequence
agaagaaacttgactccttc

SEQ ID NO: 352390 - DNA, 20 bp, Artificial
  CRISPR gRNA sequence
gactccttcccagctcagga

SEQ ID NO: 352391 - DNA, 20 bp, Artificial
  CRISPR gRNA sequence
actccttcccagctcaggac

SEQ ID NO: 352392 - DNA, 20 bp, Artificial
  CRISPR gRNA sequence
cttcccagctcaggaccctt

SEQ ID NO: 352393 - DNA, 20 bp, Artificial
  CRISPR gRNA sequence
cccagctcaggacccttgca

SEQ ID NO: 352394 - DNA, 20 bp, Artificial
  CRISPR gRNA sequence
ccagctcaggacccttgcac

SEQ ID NO: 352395 - DNA, 20 bp, Artificial
  CRISPR gRNA sequence
aggacccttgcaccaccata

SEQ ID NO: 352396 - DNA, 20 bp, Artificial
  CRISPR gRNA sequence
gcaccaccatatatgttgct

SEQ ID NO: 352397 - DNA, 20 bp, Artificial
  CRISPR gRNA sequence
caccaccatatatgttgctg

SEQ ID NO: 352398 - DNA, 20 bp, Artificial
  CRISPR gRNA sequence
ctgccacagagcctgtccca

SEQ ID NO: 352399 - DNA, 20 bp, Artificial
  CRISPR gRNA sequence
ccacagagcctgtcccagag

SEQ ID NO: 352400 - DNA, 20 bp, Artificial
  CRISPR gRNA sequence
tcccagagtctgtccaggaa

SEQ ID NO: 352401 - DNA, 20 bp, Artificial
  CRISPR gRNA sequence
tccaggaaacaaattccatc

SEQ ID NO: 352402 - DNA, 20 bp, Artificial
  CRISPR gRNA sequence
catcacagtctatgctagtg

SEQ ID NO: 352403 - DNA, 20 bp, Artificial
  CRISPR gRNA sequence
tgctagtgtgacacttccag

SEQ ID NO: 352404 - DNA, 20 bp, Artificial
  CRISPR gRNA sequence
gtgtgacacttccagagagc

SEQ ID NO: 352405 - DNA, 20 bp, Artificial
  CRISPR gRNA sequence
ccagagagctgacaccagag

SEQ ID NO: 352406 - DNA, 20 bp, Artificial
  CRISPR gRNA sequence
cagagagctgacaccagaga

SEQ ID NO: 352407 - DNA, 20 bp, Artificial
  CRISPR gRNA sequence
acaccagagaccaacaaagg

SEQ ID NO: 352408 - DNA, 20 bp, Artificial
  CRISPR gRNA sequence
tctgaaggaaaatggaaaaa

SEQ ID NO: 352409 - DNA, 20 bp, Artificial
  CRISPR gRNA sequence
ctgaaggaaaatggaaaaac

SEQ ID NO: 352410 - DNA, 20 bp, Artificial
  CRISPR gRNA sequence
tgaaggaaaatggaaaaacc

SEQ ID NO: 352411 - DNA, 20 bp, Artificial
  CRISPR gRNA sequence
aaggaaaatggaaaaaccaa

SEQ ID NO: 352412 - DNA, 20 bp, Artificial
  CRISPR gRNA sequence
aacttggccacaggccccaa

SEQ ID NO: 352413 - DNA, 20 bp, Artificial
  CRISPR gRNA sequence
ggccacaggccccaagtttc

SEQ ID NO: 352414 - DNA, 20 bp, Artificial
  CRISPR gRNA sequence
gccacaggccccaagtttcc

SEQ ID NO: 352415 - DNA, 20 bp, Artificial
  CRISPR gRNA sequence
cctctggcagacatgctgca

SEQ ID NO: 352416 - DNA, 20 bp, Artificial
  CRISPR gRNA sequence
ctctggcagacatgctgcac

SEQ ID NO: 352417 - DNA, 20 bp, Artificial
  CRISPR gRNA sequence
tggcagacatgctgcacgtc

SEQ ID NO: 352418 - DNA, 20 bp, Artificial
  CRISPR gRNA sequence
gcagacatgctgcacgtctg

SEQ ID NO: 352419 - DNA, 20 bp, Artificial
  CRISPR gRNA sequence
cacgtctgtacccttctcag

SEQ ID NO: 352420 - DNA, 20 bp, Artificial
  CRISPR gRNA sequence
tacccttctcagatcaactc

SEQ ID NO: 352421 - DNA, 20 bp, Artificial
  CRISPR gRNA sequence
ctcagatcaactccctggtg

SEQ ID NO: 352422 - DNA, 20 bp, Artificial
  CRISPR gRNA sequence
tcagatcaactccctggtga

SEQ ID NO: 352423 - DNA, 20 bp, Artificial
  CRISPR gRNA sequence
agatcaactccctggtgatg

SEQ ID NO: 352424 - DNA, 20 bp, Artificial
  CRISPR gRNA sequence
cctggtgatgtttcttccac

SEQ ID NO: 352425 - DNA, 20 bp, Artificial
  CRISPR gRNA sequence
gtgatgtttcttccacatac

SEQ ID NO: 352426 - DNA, 20 bp, Artificial
  CRISPR gRNA sequence
cttccacatacatctgtgaa

SEQ ID NO: 352427 - DNA, 20 bp, Artificial
  CRISPR gRNA sequence
ttccacatacatctgtgaaa

SEQ ID NO: 352428 - DNA, 20 bp, Artificial
  CRISPR gRNA sequence
ccacatacatctgtgaaatg

SEQ ID NO: 352429 - DNA, 20 bp, Artificial
  CRISPR gRNA sequence
cacatacatctgtgaaatga

SEQ ID NO: 352430 - DNA, 20 bp, Artificial
  CRISPR gRNA sequence
tgaaatgaacaaggaagtga

SEQ ID NO: 352431 - DNA, 20 bp, Artificial
  CRISPR gRNA sequence
cccaagaatttagcttgctg

SEQ ID NO: 352432 - DNA, 20 bp, Artificial
  CRISPR gRNA sequence
ccaagaatttagcttgctgt

SEQ ID NO: 352433 - DNA, 20 bp, Artificial
  CRISPR gRNA sequence
agcttgctgtgcagtggctg

SEQ ID NO: 352434 - DNA, 20 bp, Artificial
  CRISPR gRNA sequence
gcttgctgtgcagtggctgc

SEQ ID NO: 352435 - DNA, 20 bp, Artificial
  CRISPR gRNA sequence
gctgtgcagtggctgcaggc

SEQ ID NO: 352436 - DNA, 20 bp, Artificial
  CRISPR gRNA sequence
ctgtgcagtggctgcaggcg

SEQ ID NO: 352437 - DNA, 20 bp, Artificial
  CRISPR gRNA sequence
tgcagtggctgcaggcgcag

SEQ ID NO: 352438 - DNA, 20 bp, Artificial
  CRISPR gRNA sequence
caggcgcagaacagagcgtt

SEQ ID NO: 352439 - DNA, 20 bp, Artificial
  CRISPR gRNA sequence
cttgataacagcgttccatc

SEQ ID NO: 352440 - DNA, 20 bp, Artificial
  CRISPR gRNA sequence
gataacagcgttccatcttt

SEQ ID NO: 352441 - DNA, 20 bp, Artificial
  CRISPR gRNA sequence
ataacagcgttccatctttg

SEQ ID NO: 352442 - DNA, 20 bp, Artificial
  CRISPR gRNA sequence
catctttgtgttgtagcaga

SEQ ID NO: 352443 - DNA, 20 bp, Artificial
  CRISPR gRNA sequence
tgtgttgtagcagatgaaat

SEQ ID NO: 352444 - DNA, 20 bp, Artificial
  CRISPR gRNA sequence
gtgttgtagcagatgaaatg

SEQ ID NO: 352445 - DNA, 20 bp, Artificial
  CRISPR gRNA sequence
tgttgtagcagatgaaatgg

SEQ ID NO: 352446 - DNA, 20 bp, Artificial
  CRISPR gRNA sequence
tagcagatgaaatggacagt

SEQ ID NO: 352447 - DNA, 20 bp, Artificial
  CRISPR gRNA sequence
agactttgggcatcttgctc

SEQ ID NO: 352448 - DNA, 20 bp, Artificial
  CRISPR gRNA sequence
tgggcatcttgctcttggct

SEQ ID NO: 352449 - DNA, 20 bp, Artificial
  CRISPR gRNA sequence
gggcatcttgctcttggctg

SEQ ID NO: 352450 - DNA, 20 bp, Artificial
  CRISPR gRNA sequence
ggcatcttgctcttggctgg

SEQ ID NO: 352451 - DNA, 20 bp, Artificial
  CRISPR gRNA sequence
gctcttggctggaactggat

SEQ ID NO: 352452 - DNA, 20 bp, Artificial
  CRISPR gRNA sequence
ctcttggctggaactggata

SEQ ID NO: 352453 - DNA, 20 bp, Artificial
  CRISPR gRNA sequence
ttggctggaactggataata

SEQ ID NO: 352454 - DNA, 20 bp, Artificial
  CRISPR gRNA sequence
ggctggaactggataataaa

SEQ ID NO: 352455 - DNA, 20 bp, Artificial
  CRISPR gRNA sequence
gctggaactggataataaaa

SEQ ID NO: 352456 - DNA, 20 bp, Artificial
  CRISPR gRNA sequence
gaactggataataaaaatca

SEQ ID NO: 352457 - DNA, 20 bp, Artificial
  CRISPR gRNA sequence
gataataaaaatcagactga

SEQ ID NO: 352458 - DNA, 20 bp, Artificial
  CRISPR gRNA sequence
aaagccaggacatctgagta

SEQ ID NO: 352459 - DNA, 20 bp, Artificial
  CRISPR gRNA sequence
agtacctatctcacacactg

SEQ ID NO: 352460 - DNA, 20 bp, Artificial
  CRISPR gRNA sequence
tctcacacactggaccacca

SEQ ID NO: 352461 - DNA, 20 bp, Artificial
  CRISPR gRNA sequence
acacactggaccaccagtca

SEQ ID NO: 352462 - DNA, 20 bp, Artificial
  CRISPR gRNA sequence
gaccaccagtcacaaagtct

SEQ ID NO: 352463 - DNA, 20 bp, Artificial
  CRISPR gRNA sequence
gaaaagtttacattttggct

SEQ ID NO: 352464 - DNA, 20 bp, Artificial
  CRISPR gRNA sequence
acattttggctatctttact

SEQ ID NO: 352465 - DNA, 20 bp, Artificial
  CRISPR gRNA sequence
cattttggctatctttactt

SEQ ID NO: 352466 - DNA, 20 bp, Artificial
  CRISPR gRNA sequence
tggctatctttactttgttc

SEQ ID NO: 352467 - DNA, 20 bp, Artificial
  CRISPR gRNA sequence
ggctatctttactttgttct

SEQ ID NO: 352468 - DNA, 20 bp, Artificial
  CRISPR gRNA sequence
gctatctttactttgttctg

SEQ ID NO: 352469 - DNA, 20 bp, Artificial
  CRISPR gRNA sequence
tctttactttgttctgggag

SEQ ID NO: 352470 - DNA, 20 bp, Artificial
  CRISPR gRNA sequence
tactttgttctgggagctga

SEQ ID NO: 352471 - DNA, 20 bp, Artificial
  CRISPR gRNA sequence
actttgttctgggagctgat

SEQ ID NO: 352472 - DNA, 20 bp, Artificial
  CRISPR gRNA sequence
ctttgttctgggagctgatc

SEQ ID NO: 352473 - DNA, 20 bp, Artificial
  CRISPR gRNA sequence
tgttctgggagctgatcatg

SEQ ID NO: 352474 - DNA, 20 bp, Artificial
  CRISPR gRNA sequence
gttctgggagctgatcatga

SEQ ID NO: 352475 - DNA, 20 bp, Artificial
  CRISPR gRNA sequence
ttctgggagctgatcatgat

SEQ ID NO: 352476 - DNA, 20 bp, Artificial
  CRISPR gRNA sequence
tgggagctgatcatgataac

SEQ ID NO: 352477 - DNA, 20 bp, Artificial
  CRISPR gRNA sequence
ggagctgatcatgataacct

SEQ ID NO: 352478 - DNA, 20 bp, Artificial
  CRISPR gRNA sequence
atcatgataacctgcagacc

SEQ ID NO: 352479 - DNA, 20 bp, Artificial
  CRISPR gRNA sequence
cagacctgatcaagcctctg

SEQ ID NO: 352480 - DNA, 20 bp, Artificial
  CRISPR gRNA sequence
atcaagcctctgtgcctcag

SEQ ID NO: 352481 - DNA, 20 bp, Artificial
  CRISPR gRNA sequence
tgtgcctcagtttctctctc

SEQ ID NO: 352482 - DNA, 20 bp, Artificial
  CRISPR gRNA sequence
tgcctcagtttctctctcag

SEQ ID NO: 352483 - DNA, 20 bp, Artificial
  CRISPR gRNA sequence
agtttctctctcaggataaa

SEQ ID NO: 352484 - DNA, 20 bp, Artificial
  CRISPR gRNA sequence
ctctctcaggataaagagtg

SEQ ID NO: 352485 - DNA, 20 bp, Artificial
  CRISPR gRNA sequence
tctctcaggataaagagtga

SEQ ID NO: 352486 - DNA, 20 bp, Artificial
  CRISPR gRNA sequence
tctcaggataaagagtgaat

SEQ ID NO: 352487 - DNA, 20 bp, Artificial
  CRISPR gRNA sequence
tcaggataaagagtgaatag

SEQ ID NO: 352488 - DNA, 20 bp, Artificial
  CRISPR gRNA sequence
aggataaagagtgaatagag

SEQ ID NO: 352489 - DNA, 20 bp, Artificial
  CRISPR gRNA sequence
aagggtgaatttcttattat

SEQ ID NO: 352490 - DNA, 20 bp, Artificial
  CRISPR gRNA sequence
cttattatacataaaacact

SEQ ID NO: 352491 - DNA, 20 bp, Artificial
  CRISPR gRNA sequence
ttattatacataaaacactc

SEQ ID NO: 352492 - DNA, 20 bp, Artificial
  CRISPR gRNA sequence
attatacataaaacactctg

SEQ ID NO: 352493 - DNA, 20 bp, Artificial
  CRISPR gRNA sequence
ttatacataaaacactctga

SEQ ID NO: 352494 - DNA, 20 bp, Artificial
  CRISPR gRNA sequence
tacataaaacactctgatat

SEQ ID NO: 352495 - DNA, 20 bp, Artificial
  CRISPR gRNA sequence
tgatattattgtataaagga

SEQ ID NO: 352496 - DNA, 20 bp, Artificial
  CRISPR gRNA sequence
atattattgtataaaggaag

SEQ ID NO: 352497 - DNA, 20 bp, Artificial
  CRISPR gRNA sequence
ttgtataaaggaagctaaga

SEQ ID NO: 352498 - DNA, 20 bp, Artificial
  CRISPR gRNA sequence
tataaaggaagctaagaata

SEQ ID NO: 352499 - DNA, 20 bp, Artificial
  CRISPR gRNA sequence
agaatattattttatttgca

SEQ ID NO: 352500 - DNA, 20 bp, Artificial
  CRISPR gRNA sequence
ttttatttgcaaaacccaga

SEQ ID NO: 352501 - DNA, 20 bp, Artificial
  CRISPR gRNA sequence
tatttgcaaaacccagaagc

SEQ ID NO: 352502 - DNA, 20 bp, Artificial
  CRISPR gRNA sequence
atttgcaaaacccagaagct

SEQ ID NO: 352503 - DNA, 20 bp, Artificial
  CRISPR gRNA sequence
tttgcaaaacccagaagcta

SEQ ID NO: 352504 - DNA, 20 bp, Artificial
  CRISPR gRNA sequence
gcaaaacccagaagctaaaa

SEQ ID NO: 352505 - DNA, 20 bp, Artificial
  CRISPR gRNA sequence
caaaacccagaagctaaaaa

SEQ ID NO: 352506 - DNA, 20 bp, Artificial
  CRISPR gRNA sequence
aaaagtcaataaacagaaag

SEQ ID NO: 352507 - DNA, 20 bp, Artificial
  CRISPR gRNA sequence
tgagatctctgagttttgaa

SEQ ID NO: 352508 - DNA, 20 bp, Artificial
  CRISPR gRNA sequence
gagatctctgagttttgaac

SEQ ID NO: 352509 - DNA, 20 bp, Artificial
  CRISPR gRNA sequence
agatctctgagttttgaaca

SEQ ID NO: 352510 - DNA, 20 bp, Artificial
  CRISPR gRNA sequence
tgagttttgaacagtggact

SEQ ID NO: 352511 - DNA, 20 bp, Artificial
  CRISPR gRNA sequence
agttttgaacagtggactgg

SEQ ID NO: 352512 - DNA, 20 bp, Artificial
  CRISPR gRNA sequence
tgaacagtggactggaaacc

SEQ ID NO: 352513 - DNA, 20 bp, Artificial
  CRISPR gRNA sequence
gaacagtggactggaaacca

SEQ ID NO: 352514 - DNA, 20 bp, Artificial
  CRISPR gRNA sequence
aacagtggactggaaaccat

SEQ ID NO: 352515 - DNA, 20 bp, Artificial
  CRISPR gRNA sequence
gaaaccatgtaagagcctta

SEQ ID NO: 352516 - DNA, 20 bp, Artificial
  CRISPR gRNA sequence
aaaagtacagttctgtgcaa

SEQ ID NO: 352517 - DNA, 20 bp, Artificial
  CRISPR gRNA sequence
aaagtacagttctgtgcaaa

SEQ ID NO: 352518 - DNA, 20 bp, Artificial
  CRISPR gRNA sequence
tgtgcaaatggcattcagtt

SEQ ID NO: 352519 - DNA, 20 bp, Artificial
  CRISPR gRNA sequence
tgcaaatggcattcagtttt

SEQ ID NO: 352520 - DNA, 20 bp, Artificial
  CRISPR gRNA sequence
agttttaaagaaaaacgtag

SEQ ID NO: 352521 - DNA, 20 bp, Artificial
  CRISPR gRNA sequence
taaagaaaaacgtagcaaat

SEQ ID NO: 352522 - DNA, 20 bp, Artificial
  CRISPR gRNA sequence
aaagaaaaacgtagcaaatg

SEQ ID NO: 352523 - DNA, 20 bp, Artificial
  CRISPR gRNA sequence
aagaaaaacgtagcaaatgt

SEQ ID NO: 352524 - DNA, 20 bp, Artificial
  CRISPR gRNA sequence
gatggtgctgttacaaagga

SEQ ID NO: 352525 - DNA, 20 bp, Artificial
  CRISPR gRNA sequence
atggtgctgttacaaaggag

SEQ ID NO: 352526 - DNA, 20 bp, Artificial
  CRISPR gRNA sequence
ttacaaaggagcttggaata

SEQ ID NO: 352527 - DNA, 20 bp, Artificial
  CRISPR gRNA sequence
caaaggagcttggaatactc

SEQ ID NO: 352528 - DNA, 20 bp, Artificial
  CRISPR gRNA sequence
ggaatactcagaggaacttg

SEQ ID NO: 352529 - DNA, 20 bp, Artificial
  CRISPR gRNA sequence
gaatactcagaggaacttgt

SEQ ID NO: 352530 - DNA, 20 bp, Artificial
  CRISPR gRNA sequence
agaggaacttgtcccatggt

SEQ ID NO: 352531 - DNA, 20 bp, Artificial
  CRISPR gRNA sequence
gtcccatggtgatttttcac

SEQ ID NO: 352532 - DNA, 20 bp, Artificial
  CRISPR gRNA sequence
tcccatggtgatttttcact

SEQ ID NO: 352533 - DNA, 20 bp, Artificial
  CRISPR gRNA sequence
ttcacttctcaaaatgatgt

SEQ ID NO: 352534 - DNA, 20 bp, Artificial
  CRISPR gRNA sequence
tcacttctcaaaatgatgtt

SEQ ID NO: 352535 - DNA, 20 bp, Artificial
  CRISPR gRNA sequence
cacttctcaaaatgatgttt

SEQ ID NO: 352536 - DNA, 20 bp, Artificial
  CRISPR gRNA sequence
acttctcaaaatgatgttta

SEQ ID NO: 352537 - DNA, 20 bp, Artificial
  CRISPR gRNA sequence
ctcaaaatgatgtttaaatc

SEQ ID NO: 352538 - DNA, 20 bp, Artificial
  CRISPR gRNA sequence
tcaaaatgatgtttaaatcc

SEQ ID NO: 352539 - DNA, 20 bp, Artificial
  CRISPR gRNA sequence
aaaatgatgtttaaatccca

SEQ ID NO: 352540 - DNA, 20 bp, Artificial
  CRISPR gRNA sequence
aaatcccagttctctgttga

SEQ ID NO: 352541 - DNA, 20 bp, Artificial
  CRISPR gRNA sequence
aatcccagttctctgttgat

SEQ ID NO: 352542 - DNA, 20 bp, Artificial
  CRISPR gRNA sequence
tctgttgattcccttgaaca

SEQ ID NO: 352543 - DNA, 20 bp, Artificial
  CRISPR gRNA sequence
tgttgattcccttgaacaac

SEQ ID NO: 352544 - DNA, 20 bp, Artificial
  CRISPR gRNA sequence
ttgattcccttgaacaacaa

SEQ ID NO: 352545 - DNA, 20 bp, Artificial
  CRISPR gRNA sequence
attcccttgaacaacaaacc

SEQ ID NO: 352546 - DNA, 20 bp, Artificial
  CRISPR gRNA sequence
ccttgaacaacaaacctgga

SEQ ID NO: 352547 - DNA, 20 bp, Artificial
  CRISPR gRNA sequence
gaacaacaaacctggaacct

SEQ ID NO: 352548 - DNA, 20 bp, Artificial
  CRISPR gRNA sequence
aacaacaaacctggaacctc

SEQ ID NO: 352549 - DNA, 20 bp, Artificial
  CRISPR gRNA sequence
gaacctcagctaagactctc

SEQ ID NO: 352550 - DNA, 20 bp, Artificial
  CRISPR gRNA sequence
agctaagactctctgtgacc

SEQ ID NO: 352551 - DNA, 20 bp, Artificial
  CRISPR gRNA sequence
agactctctgtgaccagatt

SEQ ID NO: 352552 - DNA, 20 bp, Artificial
  CRISPR gRNA sequence
tctgtgaccagattctgaac

SEQ ID NO: 352553 - DNA, 20 bp, Artificial
  CRISPR gRNA sequence
tgtgaccagattctgaacct

SEQ ID NO: 352554 - DNA, 20 bp, Artificial
  CRISPR gRNA sequence
tgaccagattctgaacctct

SEQ ID NO: 352555 - DNA, 20 bp, Artificial
  CRISPR gRNA sequence
tgaacctcttatatccaggg

SEQ ID NO: 352556 - DNA, 20 bp, Artificial
  CRISPR gRNA sequence
aacctcttatatccagggct

SEQ ID NO: 352557 - DNA, 20 bp, Artificial
  CRISPR gRNA sequence
ttatatccagggcttcaagg

SEQ ID NO: 352558 - DNA, 20 bp, Artificial
  CRISPR gRNA sequence
atatccagggcttcaagggg

SEQ ID NO: 352559 - DNA, 20 bp, Artificial
  CRISPR gRNA sequence
tatccagggcttcaaggggt

SEQ ID NO: 352560 - DNA, 20 bp, Artificial
  CRISPR gRNA sequence
caaggggtattgcaggtcaa

SEQ ID NO: 352561 - DNA, 20 bp, Artificial
  CRISPR gRNA sequence
aaggggtattgcaggtcaag

SEQ ID NO: 352562 - DNA, 20 bp, Artificial
  CRISPR gRNA sequence
caggtcaaggtctttcctag

SEQ ID NO: 352563 - DNA, 20 bp, Artificial
  CRISPR gRNA sequence
tcctaggcactttctactcc

SEQ ID NO: 352564 - DNA, 20 bp, Artificial
  CRISPR gRNA sequence
cctaggcactttctactccc

SEQ ID NO: 352565 - DNA, 20 bp, Artificial
  CRISPR gRNA sequence
ctaggcactttctactccct

SEQ ID NO: 352566 - DNA, 20 bp, Artificial
  CRISPR gRNA sequence
ggcactttctactccctgca

SEQ ID NO: 352567 - DNA, 20 bp, Artificial
  CRISPR gRNA sequence
tctactccctgcatacctct

SEQ ID NO: 352568 - DNA, 20 bp, Artificial
  CRISPR gRNA sequence
ctactccctgcatacctctc

SEQ ID NO: 352569 - DNA, 20 bp, Artificial
  CRISPR gRNA sequence
tactccctgcatacctctcc

SEQ ID NO: 352570 - DNA, 20 bp, Artificial
  CRISPR gRNA sequence
ctccctgcatacctctcctc

SEQ ID NO: 352571 - DNA, 20 bp, Artificial
  CRISPR gRNA sequence
cctgcatacctctcctcaca

SEQ ID NO: 352572 - DNA, 20 bp, Artificial
  CRISPR gRNA sequence
catacctctcctcacactaa

SEQ ID NO: 352573 - DNA, 20 bp, Artificial
  CRISPR gRNA sequence
tcctcacactaaatttatcc

SEQ ID NO: 352574 - DNA, 20 bp, Artificial
  CRISPR gRNA sequence
ctcacactaaatttatcctc

SEQ ID NO: 352575 - DNA, 20 bp, Artificial
  CRISPR gRNA sequence
acactaaatttatcctctag

SEQ ID NO: 352576 - DNA, 20 bp, Artificial
  CRISPR gRNA sequence
aatttatcctctagtagaaa

SEQ ID NO: 352577 - DNA, 20 bp, Artificial
  CRISPR gRNA sequence
atcctctagtagaaaattaa

SEQ ID NO: 352578 - DNA, 20 bp, Artificial
  CRISPR gRNA sequence
tcctctagtagaaaattaag

SEQ ID NO: 352579 - DNA, 20 bp, Artificial
  CRISPR gRNA sequence
tagtagaaaattaagttatt

SEQ ID NO: 352580 - DNA, 20 bp, Artificial
  CRISPR gRNA sequence
gtagaaaattaagttatttt

SEQ ID NO: 352581 - DNA, 20 bp, Artificial
  CRISPR gRNA sequence
agttattttggtctaacagc

SEQ ID NO: 352582 - DNA, 20 bp, Artificial
  CRISPR gRNA sequence
ttttggtctaacagcttcaa

SEQ ID NO: 352583 - DNA, 20 bp, Artificial
  CRISPR gRNA sequence
tggtctaacagcttcaaatc

SEQ ID NO: 352584 - DNA, 20 bp, Artificial
  CRISPR gRNA sequence
ggtctaacagcttcaaatct

SEQ ID NO: 352585 - DNA, 20 bp, Artificial
  CRISPR gRNA sequence
gtctaacagcttcaaatctt

SEQ ID NO: 352586 - DNA, 20 bp, Artificial
  CRISPR gRNA sequence
acagcttcaaatctttgaat

SEQ ID NO: 352587 - DNA, 20 bp, Artificial
  CRISPR gRNA sequence
caaatctttgaatgctcaat

SEQ ID NO: 352588 - DNA, 20 bp, Artificial
  CRISPR gRNA sequence
aaatctttgaatgctcaata

SEQ ID NO: 352589 - DNA, 20 bp, Artificial
  CRISPR gRNA sequence
tgaatgctcaataacttatt

SEQ ID NO: 352590 - DNA, 20 bp, Artificial
  CRISPR gRNA sequence
gaatgctcaataacttattt

SEQ ID NO: 352591 - DNA, 20 bp, Artificial
  CRISPR gRNA sequence
aatgctcaataacttatttt

SEQ ID NO: 352592 - DNA, 20 bp, Artificial
  CRISPR gRNA sequence
aataacttattttgcaagct

SEQ ID NO: 352593 - DNA, 20 bp, Artificial
  CRISPR gRNA sequence
attttgcaagctgcaggcag

SEQ ID NO: 352594 - DNA, 20 bp, Artificial
  CRISPR gRNA sequence
ttttgcaagctgcaggcaga

SEQ ID NO: 352595 - DNA, 20 bp, Artificial
  CRISPR gRNA sequence
tgcaagctgcaggcagaaag

SEQ ID NO: 352596 - DNA, 20 bp, Artificial
  CRISPR gRNA sequence
gcaagctgcaggcagaaaga

SEQ ID NO: 352597 - DNA, 20 bp, Artificial
  CRISPR gRNA sequence
caagctgcaggcagaaagag

SEQ ID NO: 352598 - DNA, 20 bp, Artificial
  CRISPR gRNA sequence
caggcagaaagagacttttt

SEQ ID NO: 352599 - DNA, 20 bp, Artificial
  CRISPR gRNA sequence
tttaagtaaagtcctttgtt

SEQ ID NO: 352600 - DNA, 20 bp, Artificial
  CRISPR gRNA sequence
ttaagtaaagtcctttgttt

SEQ ID NO: 352601 - DNA, 20 bp, Artificial
  CRISPR gRNA sequence
taagtaaagtcctttgtttt

SEQ ID NO: 352602 - DNA, 20 bp, Artificial
  CRISPR gRNA sequence
aagtaaagtcctttgttttt

SEQ ID NO: 352603 - DNA, 20 bp, Artificial
  CRISPR gRNA sequence
agtaaagtcctttgtttttt

SEQ ID NO: 352604 - DNA, 20 bp, Artificial
  CRISPR gRNA sequence
tgttttttcctattctctgc

SEQ ID NO: 352605 - DNA, 20 bp, Artificial
  CRISPR gRNA sequence
gttttttcctattctctgct

SEQ ID NO: 352606 - DNA, 20 bp, Artificial
  CRISPR gRNA sequence
ttttttcctattctctgctt

SEQ ID NO: 352607 - DNA, 20 bp, Artificial
  CRISPR gRNA sequence
tttcctattctctgctttta

SEQ ID NO: 352608 - DNA, 20 bp, Artificial
  CRISPR gRNA sequence
ttcctattctctgcttttag

SEQ ID NO: 352609 - DNA, 20 bp, Artificial
  CRISPR gRNA sequence
tcctattctctgcttttaga

SEQ ID NO: 352610 - DNA, 20 bp, Artificial
  CRISPR gRNA sequence
cctattctctgcttttagac

SEQ ID NO: 352611 - DNA, 20 bp, Artificial
  CRISPR gRNA sequence
ctattctctgcttttagaca

SEQ ID NO: 352612 - DNA, 20 bp, Artificial
  CRISPR gRNA sequence
ttctctgcttttagacaggc

SEQ ID NO: 352613 - DNA, 20 bp, Artificial
  CRISPR gRNA sequence
tctgcttttagacaggctgt

SEQ ID NO: 352614 - DNA, 20 bp, Artificial
  CRISPR gRNA sequence
tgcttttagacaggctgtcc

SEQ ID NO: 352615 - DNA, 20 bp, Artificial
  CRISPR gRNA sequence
cttttagacaggctgtcctc

SEQ ID NO: 352616 - DNA, 20 bp, Artificial
  CRISPR gRNA sequence
ttagacaggctgtcctcaat

SEQ ID NO: 352617 - DNA, 20 bp, Artificial
  CRISPR gRNA sequence
tagacaggctgtcctcaatt

SEQ ID NO: 352618 - DNA, 20 bp, Artificial
  CRISPR gRNA sequence
agacaggctgtcctcaattt

SEQ ID NO: 352619 - DNA, 20 bp, Artificial
  CRISPR gRNA sequence
gacaggctgtcctcaattta

SEQ ID NO: 352620 - DNA, 20 bp, Artificial
  CRISPR gRNA sequence
tcctcaatttaagccctgct

SEQ ID NO: 352621 - DNA, 20 bp, Artificial
  CRISPR gRNA sequence
aatttaagccctgctttttc

SEQ ID NO: 352622 - DNA, 20 bp, Artificial
  CRISPR gRNA sequence
aagccctgctttttcttatt

SEQ ID NO: 352623 - DNA, 20 bp, Artificial
  CRISPR gRNA sequence
agccctgctttttcttattg

SEQ ID NO: 352624 - DNA, 20 bp, Artificial
  CRISPR gRNA sequence
ctttttcttattgtttctta

SEQ ID NO: 352625 - DNA, 20 bp, Artificial
  CRISPR gRNA sequence
tttcttattgtttcttatat

SEQ ID NO: 352626 - DNA, 20 bp, Artificial
  CRISPR gRNA sequence
ttcttattgtttcttatata

SEQ ID NO: 352627 - DNA, 20 bp, Artificial
  CRISPR gRNA sequence
tcttattgtttcttatataa

SEQ ID NO: 352628 - DNA, 20 bp, Artificial
  CRISPR gRNA sequence
cttattgtttcttatataaa

SEQ ID NO: 352629 - DNA, 20 bp, Artificial
  CRISPR gRNA sequence
ttattgtttcttatataaac

SEQ ID NO: 352630 - DNA, 20 bp, Artificial
  CRISPR gRNA sequence
attgtttcttatataaactt

SEQ ID NO: 352631 - DNA, 20 bp, Artificial
  CRISPR gRNA sequence
ttgtttcttatataaacttg

SEQ ID NO: 352632 - DNA, 20 bp, Artificial
  CRISPR gRNA sequence
tttcttatataaacttggta

SEQ ID NO: 352633 - DNA, 20 bp, Artificial
  CRISPR gRNA sequence
cttatataaacttggtaagt

SEQ ID NO: 352634 - DNA, 20 bp, Artificial
  CRISPR gRNA sequence
ttatataaacttggtaagta

SEQ ID NO: 352635 - DNA, 20 bp, Artificial
  CRISPR gRNA sequence
atataaacttggtaagtact

SEQ ID NO: 352636 - DNA, 20 bp, Artificial
  CRISPR gRNA sequence
tataaacttggtaagtactg

SEQ ID NO: 352637 - DNA, 20 bp, Artificial
  CRISPR gRNA sequence
ggtaagtactgtaagaaaca

SEQ ID NO: 352638 - DNA, 20 bp, Artificial
  CRISPR gRNA sequence
gtaagtactgtaagaaacag

SEQ ID NO: 352639 - DNA, 20 bp, Artificial
  CRISPR gRNA sequence
taagaaacagccactatcat

SEQ ID NO: 352640 - DNA, 20 bp, Artificial
  CRISPR gRNA sequence
tcataccattgcataataag

SEQ ID NO: 352641 - DNA, 20 bp, Artificial
  CRISPR gRNA sequence
cataataaggagcaccaact

SEQ ID NO: 352642 - DNA, 20 bp, Artificial
  CRISPR gRNA sequence
cccagctcaaaactcaggtc

SEQ ID NO: 352643 - DNA, 20 bp, Artificial
  CRISPR gRNA sequence
ccagctcaaaactcaggtcc

SEQ ID NO: 352644 - DNA, 20 bp, Artificial
  CRISPR gRNA sequence
aaaactcaggtccttattgc

SEQ ID NO: 352645 - DNA, 20 bp, Artificial
  CRISPR gRNA sequence
aggtccttattgccttgtat

SEQ ID NO: 352646 - DNA, 20 bp, Artificial
  CRISPR gRNA sequence
attgccttgtatcttacctc

SEQ ID NO: 352647 - DNA, 20 bp, Artificial
  CRISPR gRNA sequence
ttgccttgtatcttacctcc

SEQ ID NO: 352648 - DNA, 20 bp, Artificial
  CRISPR gRNA sequence
ccttgtatcttacctcctct

SEQ ID NO: 352649 - DNA, 20 bp, Artificial
  CRISPR gRNA sequence
gtatcttacctcctctatga

SEQ ID NO: 352650 - DNA, 20 bp, Artificial
  CRISPR gRNA sequence
tatcttacctcctctatgag

SEQ ID NO: 352651 - DNA, 20 bp, Artificial
  CRISPR gRNA sequence
acctcctctatgaggtcaat

SEQ ID NO: 352652 - DNA, 20 bp, Artificial
  CRISPR gRNA sequence
cctcctctatgaggtcaatt

SEQ ID NO: 352653 - DNA, 20 bp, Artificial
  CRISPR gRNA sequence
ctctatgaggtcaattcaca

SEQ ID NO: 352654 - DNA, 20 bp, Artificial
  CRISPR gRNA sequence
tatgaggtcaattcacattg

SEQ ID NO: 352655 - DNA, 20 bp, Artificial
  CRISPR gRNA sequence
tgaggtcaattcacattgta

SEQ ID NO: 352656 - DNA, 20 bp, Artificial
  CRISPR gRNA sequence
acattgtaagcctgttgctt

SEQ ID NO: 352657 - DNA, 20 bp, Artificial
  CRISPR gRNA sequence
taagcctgttgcttagtgca

SEQ ID NO: 352658 - DNA, 20 bp, Artificial
  CRISPR gRNA sequence
ttgcttagtgcatctcgttt

SEQ ID NO: 352659 - DNA, 20 bp, Artificial
  CRISPR gRNA sequence
cttagtgcatctcgtttcct

SEQ ID NO: 352660 - DNA, 20 bp, Artificial
  CRISPR gRNA sequence
agtgcatctcgtttcctggt

SEQ ID NO: 352661 - DNA, 20 bp, Artificial
  CRISPR gRNA sequence
gtgcatctcgtttcctggta

SEQ ID NO: 352662 - DNA, 20 bp, Artificial
  CRISPR gRNA sequence
gtttcctggtaccagcttct

SEQ ID NO: 352663 - DNA, 20 bp, Artificial
  CRISPR gRNA sequence
cctggtaccagcttctttaa

SEQ ID NO: 352664 - DNA, 20 bp, Artificial
  CRISPR gRNA sequence
ctggtaccagcttctttaat

SEQ ID NO: 352665 - DNA, 20 bp, Artificial
  CRISPR gRNA sequence
gtaccagcttctttaataga

SEQ ID NO: 352666 - DNA, 20 bp, Artificial
  CRISPR gRNA sequence
ctttaatagagttcttagtt

SEQ ID NO: 352667 - DNA, 20 bp, Artificial
  CRISPR gRNA sequence
tttaatagagttcttagttg

SEQ ID NO: 352668 - DNA, 20 bp, Artificial
  CRISPR gRNA sequence
taatagagttcttagttgca

SEQ ID NO: 352669 - DNA, 20 bp, Artificial
  CRISPR gRNA sequence
aatagagttcttagttgcaa

SEQ ID NO: 352670 - DNA, 20 bp, Artificial
  CRISPR gRNA sequence
atagagttcttagttgcaat

SEQ ID NO: 352671 - DNA, 20 bp, Artificial
  CRISPR gRNA sequence
ttagttgcaatcaacagaag

SEQ ID NO: 352672 - DNA, 20 bp, Artificial
  CRISPR gRNA sequence
agttgcaatcaacagaagct

SEQ ID NO: 352673 - DNA, 20 bp, Artificial
  CRISPR gRNA sequence
gttgcaatcaacagaagctg

SEQ ID NO: 352674 - DNA, 20 bp, Artificial
  CRISPR gRNA sequence
caatcaacagaagctggctt

SEQ ID NO: 352675 - DNA, 20 bp, Artificial
  CRISPR gRNA sequence
gctttggcttttttatgtag

SEQ ID NO: 352676 - DNA, 20 bp, Artificial
  CRISPR gRNA sequence
tggcttttttatgtagaaaa

SEQ ID NO: 352677 - DNA, 20 bp, Artificial
  CRISPR gRNA sequence
ggcttttttatgtagaaaag

SEQ ID NO: 352678 - DNA, 20 bp, Artificial
  CRISPR gRNA sequence
gcttttttatgtagaaaagg

SEQ ID NO: 352679 - DNA, 20 bp, Artificial
  CRISPR gRNA sequence
ttttatgtagaaaaggaacc

SEQ ID NO: 352680 - DNA, 20 bp, Artificial
  CRISPR gRNA sequence
tttatgtagaaaaggaacct

SEQ ID NO: 352681 - DNA, 20 bp, Artificial
  CRISPR gRNA sequence
ttatgtagaaaaggaaccta

SEQ ID NO: 352682 - DNA, 20 bp, Artificial
  CRISPR gRNA sequence
tatgtagaaaaggaacctat

SEQ ID NO: 352683 - DNA, 20 bp, Artificial
  CRISPR gRNA sequence
atgtagaaaaggaacctatt

SEQ ID NO: 352684 - DNA, 20 bp, Artificial
  CRISPR gRNA sequence
tgtagaaaaggaacctattg

SEQ ID NO: 352685 - DNA, 20 bp, Artificial
  CRISPR gRNA sequence
ttgaaaagatactgattggt

SEQ ID NO: 352686 - DNA, 20 bp, Artificial
  CRISPR gRNA sequence
aaaagatactgattggttcc

SEQ ID NO: 352687 - DNA, 20 bp, Artificial
  CRISPR gRNA sequence
attggttccaataactgcta

SEQ ID NO: 352688 - DNA, 20 bp, Artificial
  CRISPR gRNA sequence
gttccaataactgctagaag

SEQ ID NO: 352689 - DNA, 20 bp, Artificial
  CRISPR gRNA sequence
caataactgctagaagtttc

SEQ ID NO: 352690 - DNA, 20 bp, Artificial
  CRISPR gRNA sequence
ctagaagtttctgcaaaacc

SEQ ID NO: 352691 - DNA, 20 bp, Artificial
  CRISPR gRNA sequence
gaagtttctgcaaaaccatg

SEQ ID NO: 352692 - DNA, 20 bp, Artificial
  CRISPR gRNA sequence
ctgcaaaaccatgctttgaa

SEQ ID NO: 352693 - DNA, 20 bp, Artificial
  CRISPR gRNA sequence
tgcaaaaccatgctttgaaa

SEQ ID NO: 352694 - DNA, 20 bp, Artificial
  CRISPR gRNA sequence
caaaaccatgctttgaaagt

SEQ ID NO: 352695 - DNA, 20 bp, Artificial
  CRISPR gRNA sequence
tgaaagtgagcaggaaaaga

SEQ ID NO: 352696 - DNA, 20 bp, Artificial
  CRISPR gRNA sequence
gaaagtgagcaggaaaagaa

SEQ ID NO: 352697 - DNA, 20 bp, Artificial
  CRISPR gRNA sequence
aaagtgagcaggaaaagaag

SEQ ID NO: 352698 - DNA, 20 bp, Artificial
  CRISPR gRNA sequence
ggctgtggctgggagcacag

SEQ ID NO: 352699 - DNA, 20 bp, Artificial
  CRISPR gRNA sequence
tggctgggagcacagccaaa

SEQ ID NO: 352700 - DNA, 20 bp, Artificial
  CRISPR gRNA sequence
ggagcacagccaaaattaca

SEQ ID NO: 352701 - DNA, 20 bp, Artificial
  CRISPR gRNA sequence
caaaaccagcccagggatga

SEQ ID NO: 352702 - DNA, 20 bp, Artificial
  CRISPR gRNA sequence
ttcatgcacagccactgtcc

SEQ ID NO: 352703 - DNA, 20 bp, Artificial
  CRISPR gRNA sequence
atgcacagccactgtcccca

SEQ ID NO: 352704 - DNA, 20 bp, Artificial
  CRISPR gRNA sequence
tccccagcactaggcacaga

SEQ ID NO: 352705 - DNA, 20 bp, Artificial
  CRISPR gRNA sequence
ggcacagactctaccactgc

SEQ ID NO: 352706 - DNA, 20 bp, Artificial
  CRISPR gRNA sequence
taccactgcctcactgtctc

SEQ ID NO: 352707 - DNA, 20 bp, Artificial
  CRISPR gRNA sequence
ccactgcctcactgtctctg

SEQ ID NO: 352708 - DNA, 20 bp, Artificial
  CRISPR gRNA sequence
cctcactgtctctgctggac

SEQ ID NO: 352709 - DNA, 20 bp, Artificial
  CRISPR gRNA sequence
actgtctctgctggacttgg

SEQ ID NO: 352710 - DNA, 20 bp, Artificial
  CRISPR gRNA sequence
tctctgctggacttggaaac

SEQ ID NO: 352711 - DNA, 20 bp, Artificial
  CRISPR gRNA sequence
tgctggacttggaaacttga

SEQ ID NO: 352712 - DNA, 20 bp, Artificial
  CRISPR gRNA sequence
ctggacttggaaacttgata

SEQ ID NO: 352713 - DNA, 20 bp, Artificial
  CRISPR gRNA sequence
gacttggaaacttgatatta

SEQ ID NO: 352714 - DNA, 20 bp, Artificial
  CRISPR gRNA sequence
ggaaacttgatattactgtt

SEQ ID NO: 352715 - DNA, 20 bp, Artificial
  CRISPR gRNA sequence
gaaacttgatattactgtta

SEQ ID NO: 352716 - DNA, 20 bp, Artificial
  CRISPR gRNA sequence
gatattactgttactgctgc

SEQ ID NO: 352717 - DNA, 20 bp, Artificial
  CRISPR gRNA sequence
atattactgttactgctgca

SEQ ID NO: 352718 - DNA, 20 bp, Artificial
  CRISPR gRNA sequence
ctgttactgctgcactgtct

SEQ ID NO: 352719 - DNA, 20 bp, Artificial
  CRISPR gRNA sequence
ttactgctgcactgtctgcc

SEQ ID NO: 352720 - DNA, 20 bp, Artificial
  CRISPR gRNA sequence
ctgctgcactgtctgccatg

SEQ ID NO: 352721 - DNA, 20 bp, Artificial
  CRISPR gRNA sequence
ctgcactgtctgccatgaaa

SEQ ID NO: 352722 - DNA, 20 bp, Artificial
  CRISPR gRNA sequence
cactgtctgccatgaaaatg

SEQ ID NO: 352723 - DNA, 20 bp, Artificial
  CRISPR gRNA sequence
tctgccatgaaaatgaattc

SEQ ID NO: 352724 - DNA, 20 bp, Artificial
  CRISPR gRNA sequence
ccatgaaaatgaattctcca

SEQ ID NO: 352725 - DNA, 20 bp, Artificial
  CRISPR gRNA sequence
tccagggtcccttcttcatc

SEQ ID NO: 352726 - DNA, 20 bp, Artificial
  CRISPR gRNA sequence
cagggtcccttcttcatcct

SEQ ID NO: 352727 - DNA, 20 bp, Artificial
  CRISPR gRNA sequence
cttcatcctttcatctctag

SEQ ID NO: 352728 - DNA, 20 bp, Artificial
  CRISPR gRNA sequence
ttcatcctttcatctctagc

SEQ ID NO: 352729 - DNA, 20 bp, Artificial
  CRISPR gRNA sequence
catcctttcatctctagctt

SEQ ID NO: 352730 - DNA, 20 bp, Artificial
  CRISPR gRNA sequence
atcctttcatctctagctta

SEQ ID NO: 352731 - DNA, 20 bp, Artificial
  CRISPR gRNA sequence
tcatctctagcttataattc

SEQ ID NO: 352732 - DNA, 20 bp, Artificial
  CRISPR gRNA sequence
catctctagcttataattca

SEQ ID NO: 352733 - DNA, 20 bp, Artificial
  CRISPR gRNA sequence
atctctagcttataattcaa

SEQ ID NO: 352734 - DNA, 20 bp, Artificial
  CRISPR gRNA sequence
tagcttataattcaaagtct

SEQ ID NO: 352735 - DNA, 20 bp, Artificial
  CRISPR gRNA sequence
gcttataattcaaagtctgg

SEQ ID NO: 352736 - DNA, 20 bp, Artificial
  CRISPR gRNA sequence
ataattcaaagtctgggatt

SEQ ID NO: 352737 - DNA, 20 bp, Artificial
  CRISPR gRNA sequence
taattcaaagtctgggattg

SEQ ID NO: 352738 - DNA, 20 bp, Artificial
  CRISPR gRNA sequence
aaagtctgggattgagtggc

SEQ ID NO: 352739 - DNA, 20 bp, Artificial
  CRISPR gRNA sequence
ggattgagtggccaatccta

SEQ ID NO: 352740 - DNA, 20 bp, Artificial
  CRISPR gRNA sequence
agtggccaatcctaggtcac

SEQ ID NO: 352741 - DNA, 20 bp, Artificial
  CRISPR gRNA sequence
ggtcacatgtccatgtccta

SEQ ID NO: 352742 - DNA, 20 bp, Artificial
  CRISPR gRNA sequence
tctccaaggggggctgggaa

SEQ ID NO: 352743 - DNA, 20 bp, Artificial
  CRISPR gRNA sequence
caaggggggctgggaattga

SEQ ID NO: 352744 - DNA, 20 bp, Artificial
  CRISPR gRNA sequence
ggaattgaatatctggcatt

SEQ ID NO: 352745 - DNA, 20 bp, Artificial
  CRISPR gRNA sequence
aatatctggcattttccact

SEQ ID NO: 352746 - DNA, 20 bp, Artificial
  CRISPR gRNA sequence
gcattttccactttcacttc

SEQ ID NO: 352747 - DNA, 20 bp, Artificial
  CRISPR gRNA sequence
tccactttcacttcttatga

SEQ ID NO: 352748 - DNA, 20 bp, Artificial
  CRISPR gRNA sequence
ccactttcacttcttatgaa

SEQ ID NO: 352749 - DNA, 20 bp, Artificial
  CRISPR gRNA sequence
cactttcacttcttatgaat

SEQ ID NO: 352750 - DNA, 20 bp, Artificial
  CRISPR gRNA sequence
tcacttcttatgaattaagg

SEQ ID NO: 352751 - DNA, 20 bp, Artificial
  CRISPR gRNA sequence
cacttcttatgaattaagga

SEQ ID NO: 352752 - DNA, 20 bp, Artificial
  CRISPR gRNA sequence
acttcttatgaattaaggaa

SEQ ID NO: 352753 - DNA, 20 bp, Artificial
  CRISPR gRNA sequence
cttatgaattaaggaattct

SEQ ID NO: 352754 - DNA, 20 bp, Artificial
  CRISPR gRNA sequence
ttatgaattaaggaattcta

SEQ ID NO: 352755 - DNA, 20 bp, Artificial
  CRISPR gRNA sequence
atgaattaaggaattctaca

SEQ ID NO: 352756 - DNA, 20 bp, Artificial
  CRISPR gRNA sequence
tgaattaaggaattctacaa

SEQ ID NO: 352757 - DNA, 20 bp, Artificial
  CRISPR gRNA sequence
aggaattctacaaataatag

SEQ ID NO: 352758 - DNA, 20 bp, Artificial
  CRISPR gRNA sequence
tacaaataatagaagtggga

SEQ ID NO: 352759 - DNA, 20 bp, Artificial
  CRISPR gRNA sequence
caaataatagaagtgggatt

SEQ ID NO: 352760 - DNA, 20 bp, Artificial
  CRISPR gRNA sequence
aggtggtaggcagacaaaaa

SEQ ID NO: 352761 - DNA, 20 bp, Artificial
  CRISPR gRNA sequence
acaattatccactacgccac

SEQ ID NO: 352762 - DNA, 20 bp, Artificial
  CRISPR gRNA sequence
tccactacgccacccttgta

SEQ ID NO: 352763 - DNA, 20 bp, Artificial
  CRISPR gRNA sequence
cgccacccttgtataacctt

SEQ ID NO: 352764 - DNA, 20 bp, Artificial
  CRISPR gRNA sequence
gtataaccttaccctcattc

SEQ ID NO: 352765 - DNA, 20 bp, Artificial
  CRISPR gRNA sequence
tataaccttaccctcattca

SEQ ID NO: 352766 - DNA, 20 bp, Artificial
  CRISPR gRNA sequence
accctcattcactgtctact

SEQ ID NO: 352767 - DNA, 20 bp, Artificial
  CRISPR gRNA sequence
ccctcattcactgtctactc

SEQ ID NO: 352768 - DNA, 20 bp, Artificial
  CRISPR gRNA sequence
attcactgtctactctcaaa

SEQ ID NO: 352769 - DNA, 20 bp, Artificial
  CRISPR gRNA sequence
actgtctactctcaaaactg

SEQ ID NO: 352770 - DNA, 20 bp, Artificial
  CRISPR gRNA sequence
tctactctcaaaactgtgga

SEQ ID NO: 352771 - DNA, 20 bp, Artificial
  CRISPR gRNA sequence
ctctcaaaactgtggagcta

SEQ ID NO: 352772 - DNA, 20 bp, Artificial
  CRISPR gRNA sequence
tcaaaactgtggagctacta

SEQ ID NO: 352773 - DNA, 20 bp, Artificial
  CRISPR gRNA sequence
aaaactgtggagctactaat

SEQ ID NO: 352774 - DNA, 20 bp, Artificial
  CRISPR gRNA sequence
tggagctactaatgaagatt

SEQ ID NO: 352775 - DNA, 20 bp, Artificial
  CRISPR gRNA sequence
ctaatgaagatttgtaaacc

SEQ ID NO: 352776 - DNA, 20 bp, Artificial
  CRISPR gRNA sequence
atgaagatttgtaaacccgg

SEQ ID NO: 352777 - DNA, 20 bp, Artificial
  CRISPR gRNA sequence
gtaaacccgggcttatgagc

SEQ ID NO: 352778 - DNA, 20 bp, Artificial
  CRISPR gRNA sequence
taaacccgggcttatgagca

SEQ ID NO: 352779 - DNA, 20 bp, Artificial
  CRISPR gRNA sequence
atgagcacccattcctttac

SEQ ID NO: 352780 - DNA, 20 bp, Artificial
  CRISPR gRNA sequence
tgagcacccattcctttact

SEQ ID NO: 352781 - DNA, 20 bp, Artificial
  CRISPR gRNA sequence
ctttactacaactcagattg

SEQ ID NO: 352782 - DNA, 20 bp, Artificial
  CRISPR gRNA sequence
tactacaactcagattgctc

SEQ ID NO: 352783 - DNA, 20 bp, Artificial
  CRISPR gRNA sequence
actacaactcagattgctct

SEQ ID NO: 352784 - DNA, 20 bp, Artificial
  CRISPR gRNA sequence
ctacaactcagattgctcta

SEQ ID NO: 352785 - DNA, 20 bp, Artificial
  CRISPR gRNA sequence
caactcagattgctctagaa

SEQ ID NO: 352786 - DNA, 20 bp, Artificial
  CRISPR gRNA sequence
agattgctctagaagctcag

SEQ ID NO: 352787 - DNA, 20 bp, Artificial
  CRISPR gRNA sequence
ctctagaagctcagttccca

SEQ ID NO: 352788 - DNA, 20 bp, Artificial
  CRISPR gRNA sequence
tagaagctcagttcccagca

SEQ ID NO: 352789 - DNA, 20 bp, Artificial
  CRISPR gRNA sequence
gaagctcagttcccagcact

SEQ ID NO: 352790 - DNA, 20 bp, Artificial
  CRISPR gRNA sequence
agttcccagcacttggattt

SEQ ID NO: 352791 - DNA, 20 bp, Artificial
  CRISPR gRNA sequence
ccagcacttggatttttcca

SEQ ID NO: 352792 - DNA, 20 bp, Artificial
  CRISPR gRNA sequence
ggatttttccagtagctgaa

SEQ ID NO: 352793 - DNA, 20 bp, Artificial
  CRISPR gRNA sequence
gatttttccagtagctgaat

SEQ ID NO: 352794 - DNA, 20 bp, Artificial
  CRISPR gRNA sequence
ttccagtagctgaattctac

SEQ ID NO: 352795 - DNA, 20 bp, Artificial
  CRISPR gRNA sequence
tccagtagctgaattctacc

SEQ ID NO: 352796 - DNA, 20 bp, Artificial
  CRISPR gRNA sequence
ccagtagctgaattctacct

SEQ ID NO: 352797 - DNA, 20 bp, Artificial
  CRISPR gRNA sequence
cagtagctgaattctacctg

SEQ ID NO: 352798 - DNA, 20 bp, Artificial
  CRISPR gRNA sequence
aattctacctgaaggaaggg

SEQ ID NO: 352799 - DNA, 20 bp, Artificial
  CRISPR gRNA sequence
tacctgaaggaagggcagaa

SEQ ID NO: 352800 - DNA, 20 bp, Artificial
  CRISPR gRNA sequence
cctgaaggaagggcagaaac

SEQ ID NO: 352801 - DNA, 20 bp, Artificial
  CRISPR gRNA sequence
aaggaagggcagaaacaaag

SEQ ID NO: 352802 - DNA, 20 bp, Artificial
  CRISPR gRNA sequence
tcacttccaagtatcctgca

SEQ ID NO: 352803 - DNA, 20 bp, Artificial
  CRISPR gRNA sequence
ccaagtatcctgcacccctg

SEQ ID NO: 352804 - DNA, 20 bp, Artificial
  CRISPR gRNA sequence
caagtatcctgcacccctgg

SEQ ID NO: 352805 - DNA, 20 bp, Artificial
  CRISPR gRNA sequence
cacccctgggctcaagacct

SEQ ID NO: 352806 - DNA, 20 bp, Artificial
  CRISPR gRNA sequence
ggctcaagacctcactgggg

SEQ ID NO: 352807 - DNA, 20 bp, Artificial
  CRISPR gRNA sequence
aagacctcactggggaggga

SEQ ID NO: 352808 - DNA, 20 bp, Artificial
  CRISPR gRNA sequence
actggggagggagtcttttg

SEQ ID NO: 352809 - DNA, 20 bp, Artificial
  CRISPR gRNA sequence
gggagggagtcttttgggcc

SEQ ID NO: 352810 - DNA, 20 bp, Artificial
  CRISPR gRNA sequence
ttgggccacccaccaaacag

SEQ ID NO: 352811 - DNA, 20 bp, Artificial
  CRISPR gRNA sequence
tgggccacccaccaaacagc

SEQ ID NO: 352812 - DNA, 20 bp, Artificial
  CRISPR gRNA sequence
gggccacccaccaaacagca

SEQ ID NO: 352813 - DNA, 20 bp, Artificial
  CRISPR gRNA sequence
ggccacccaccaaacagcac

SEQ ID NO: 352814 - DNA, 20 bp, Artificial
  CRISPR gRNA sequence
gcattatgcctctcacccta

SEQ ID NO: 352815 - DNA, 20 bp, Artificial
  CRISPR gRNA sequence
tgcctctcaccctagaccat

SEQ ID NO: 352816 - DNA, 20 bp, Artificial
  CRISPR gRNA sequence
tcaccctagaccatggttac

SEQ ID NO: 352817 - DNA, 20 bp, Artificial
  CRISPR gRNA sequence
accctagaccatggttacac

SEQ ID NO: 352818 - DNA, 20 bp, Artificial
  CRISPR gRNA sequence
gaccatggttacacgtggta

SEQ ID NO: 352819 - DNA, 20 bp, Artificial
  CRISPR gRNA sequence
cacgtggtaaaacaacccct

SEQ ID NO: 352820 - DNA, 20 bp, Artificial
  CRISPR gRNA sequence
ctggtgatacattcacaact

SEQ ID NO: 352821 - DNA, 20 bp, Artificial
  CRISPR gRNA sequence
tggtgatacattcacaactc

SEQ ID NO: 352822 - DNA, 20 bp, Artificial
  CRISPR gRNA sequence
gtgatacattcacaactctc

SEQ ID NO: 352823 - DNA, 20 bp, Artificial
  CRISPR gRNA sequence
acaactctctagtttccccc

SEQ ID NO: 352824 - DNA, 20 bp, Artificial
  CRISPR gRNA sequence
tctagtttcccccaaatggc

SEQ ID NO: 352825 - DNA, 20 bp, Artificial
  CRISPR gRNA sequence
tagtttcccccaaatggcac

SEQ ID NO: 352826 - DNA, 20 bp, Artificial
  CRISPR gRNA sequence
gtttcccccaaatggcacta

SEQ ID NO: 352827 - DNA, 20 bp, Artificial
  CRISPR gRNA sequence
cccccaaatggcactatggg

SEQ ID NO: 352828 - DNA, 20 bp, Artificial
  CRISPR gRNA sequence
ccccaaatggcactatgggg

SEQ ID NO: 352829 - DNA, 20 bp, Artificial
  CRISPR gRNA sequence
tggggagcgggagcttgcct

SEQ ID NO: 352830 - DNA, 20 bp, Artificial
  CRISPR gRNA sequence
gccttttcctcagacttaaa

SEQ ID NO: 352831 - DNA, 20 bp, Artificial
  CRISPR gRNA sequence
ccttttcctcagacttaaaa

SEQ ID NO: 352832 - DNA, 20 bp, Artificial
  CRISPR gRNA sequence
ttcctcagacttaaaacaat

SEQ ID NO: 352833 - DNA, 20 bp, Artificial
  CRISPR gRNA sequence
tcctcagacttaaaacaata

SEQ ID NO: 352834 - DNA, 20 bp, Artificial
  CRISPR gRNA sequence
cctcagacttaaaacaataa

SEQ ID NO: 352835 - DNA, 20 bp, Artificial
  CRISPR gRNA sequence
ctcagacttaaaacaataag

SEQ ID NO: 352836 - DNA, 20 bp, Artificial
  CRISPR gRNA sequence
agacttaaaacaataagttt

SEQ ID NO: 352837 - DNA, 20 bp, Artificial
  CRISPR gRNA sequence
aaaacaataagttttccccg

SEQ ID NO: 352838 - DNA, 20 bp, Artificial
  CRISPR gRNA sequence
aaacaataagttttccccgt

SEQ ID NO: 352839 - DNA, 20 bp, Artificial
  CRISPR gRNA sequence
tccccgtgtttcccctctaa

SEQ ID NO: 352840 - DNA, 20 bp, Artificial
  CRISPR gRNA sequence
ccccgtgtttcccctctaat

SEQ ID NO: 352841 - DNA, 20 bp, Artificial
  CRISPR gRNA sequence
cccgtgtttcccctctaatg

SEQ ID NO: 352842 - DNA, 20 bp, Artificial
  CRISPR gRNA sequence
cccctctaatgctgttttct

SEQ ID NO: 352843 - DNA, 20 bp, Artificial
  CRISPR gRNA sequence
ccctctaatgctgttttctt

SEQ ID NO: 352844 - DNA, 20 bp, Artificial
  CRISPR gRNA sequence
taatgctgttttcttttgac

SEQ ID NO: 352845 - DNA, 20 bp, Artificial
  CRISPR gRNA sequence
atgctgttttcttttgacca

SEQ ID NO: 352846 - DNA, 20 bp, Artificial
  CRISPR gRNA sequence
ttttcttttgaccaagcatg

SEQ ID NO: 352847 - DNA, 20 bp, Artificial
  CRISPR gRNA sequence
tcttttgaccaagcatgtct

SEQ ID NO: 352848 - DNA, 20 bp, Artificial
  CRISPR gRNA sequence
cttttgaccaagcatgtctg

SEQ ID NO: 352849 - DNA, 20 bp, Artificial
  CRISPR gRNA sequence
ttttgaccaagcatgtctga

SEQ ID NO: 352850 - DNA, 20 bp, Artificial
  CRISPR gRNA sequence
ttgaccaagcatgtctgaat

SEQ ID NO: 352851 - DNA, 20 bp, Artificial
  CRISPR gRNA sequence
tgaccaagcatgtctgaatt

SEQ ID NO: 352852 - DNA, 20 bp, Artificial
  CRISPR gRNA sequence
gaccaagcatgtctgaattc

SEQ ID NO: 352853 - DNA, 20 bp, Artificial
  CRISPR gRNA sequence
accaagcatgtctgaattct

SEQ ID NO: 352854 - DNA, 20 bp, Artificial
  CRISPR gRNA sequence
aattctagagaagtcaggag

SEQ ID NO: 352855 - DNA, 20 bp, Artificial
  CRISPR gRNA sequence
tagagaagtcaggaggaaca

SEQ ID NO: 352856 - DNA, 20 bp, Artificial
  CRISPR gRNA sequence
gagaagtcaggaggaacaca

SEQ ID NO: 352857 - DNA, 20 bp, Artificial
  CRISPR gRNA sequence
tcggtttgaagggactgatg

SEQ ID NO: 352858 - DNA, 20 bp, Artificial
  CRISPR gRNA sequence
ggtttgaagggactgatgtt

SEQ ID NO: 352859 - DNA, 20 bp, Artificial
  CRISPR gRNA sequence
gaagggactgatgttctgaa

SEQ ID NO: 352860 - DNA, 20 bp, Artificial
  CRISPR gRNA sequence
aagggactgatgttctgaag

SEQ ID NO: 352861 - DNA, 20 bp, Artificial
  CRISPR gRNA sequence
atgttctgaagtacaactgg

SEQ ID NO: 352862 - DNA, 20 bp, Artificial
  CRISPR gRNA sequence
tgaagtacaactgggcacag

SEQ ID NO: 352863 - DNA, 20 bp, Artificial
  CRISPR gRNA sequence
aagtacaactgggcacagtc

SEQ ID NO: 352864 - DNA, 20 bp, Artificial
  CRISPR gRNA sequence
ggcacagtcccaggctcttc

SEQ ID NO: 352865 - DNA, 20 bp, Artificial
  CRISPR gRNA sequence
ttcaggacgcttcctccatt

SEQ ID NO: 352866 - DNA, 20 bp, Artificial
  CRISPR gRNA sequence
caggacgcttcctccattca

SEQ ID NO: 352867 - DNA, 20 bp, Artificial
  CRISPR gRNA sequence
aggacgcttcctccattcac

SEQ ID NO: 352868 - DNA, 20 bp, Artificial
  CRISPR gRNA sequence
cctccattcacacagcgggg

SEQ ID NO: 352869 - DNA, 20 bp, Artificial
  CRISPR gRNA sequence
ctccattcacacagcgggga

SEQ ID NO: 352870 - DNA, 20 bp, Artificial
  CRISPR gRNA sequence
cattcacacagcggggatgt

SEQ ID NO: 352871 - DNA, 20 bp, Artificial
  CRISPR gRNA sequence
acacagcggggatgtgattg

SEQ ID NO: 352872 - DNA, 20 bp, Artificial
  CRISPR gRNA sequence
ttacagcgggtggtgtgtgc

SEQ ID NO: 352873 - DNA, 20 bp, Artificial
  CRISPR gRNA sequence
cagcgggtggtgtgtgctgg

SEQ ID NO: 352874 - DNA, 20 bp, Artificial
  CRISPR gRNA sequence
gctgagaagccactgtgaat

SEQ ID NO: 352875 - DNA, 20 bp, Artificial
  CRISPR gRNA sequence
agaagccactgtgaattgat

SEQ ID NO: 352876 - DNA, 20 bp, Artificial
  CRISPR gRNA sequence
tgaattgattcttcttctga

SEQ ID NO: 352877 - DNA, 20 bp, Artificial
  CRISPR gRNA sequence
attcttcttctgaagtttat

SEQ ID NO: 352878 - DNA, 20 bp, Artificial
  CRISPR gRNA sequence
ttcttctgaagtttatgttt

SEQ ID NO: 352879 - DNA, 20 bp, Artificial
  CRISPR gRNA sequence
cttctgaagtttatgtttct

SEQ ID NO: 352880 - DNA, 20 bp, Artificial
  CRISPR gRNA sequence
ttctgaagtttatgtttcta

SEQ ID NO: 352881 - DNA, 20 bp, Artificial
  CRISPR gRNA sequence
ctgaagtttatgtttctact

SEQ ID NO: 352882 - DNA, 20 bp, Artificial
  CRISPR gRNA sequence
tgaagtttatgtttctactt

SEQ ID NO: 352883 - DNA, 20 bp, Artificial
  CRISPR gRNA sequence
aagtttatgtttctactttt

SEQ ID NO: 352884 - DNA, 20 bp, Artificial
  CRISPR gRNA sequence
atgtttctactttttggaaa

SEQ ID NO: 352885 - DNA, 20 bp, Artificial
  CRISPR gRNA sequence
tgtttctactttttggaaat

SEQ ID NO: 352886 - DNA, 20 bp, Artificial
  CRISPR gRNA sequence
ctactttttggaaatgaata

SEQ ID NO: 352887 - DNA, 20 bp, Artificial
  CRISPR gRNA sequence
tactttttggaaatgaataa

SEQ ID NO: 352888 - DNA, 20 bp, Artificial
  CRISPR gRNA sequence
ctttttggaaatgaataaat

SEQ ID NO: 352889 - DNA, 20 bp, Artificial
  CRISPR gRNA sequence
tttggaaatgaataaattac

SEQ ID NO: 352890 - DNA, 20 bp, Artificial
  CRISPR gRNA sequence
ttggaaatgaataaattaca

SEQ ID NO: 352891 - DNA, 20 bp, Artificial
  CRISPR gRNA sequence
tggaaatgaataaattacag

SEQ ID NO: 352892 - DNA, 20 bp, Artificial
  CRISPR gRNA sequence
ggaaatgaataaattacagc

SEQ ID NO: 352893 - DNA, 20 bp, Artificial
  CRISPR gRNA sequence
gaaatgaataaattacagcc

SEQ ID NO: 352894 - DNA, 20 bp, Artificial
  CRISPR gRNA sequence
atggactggctgtaatttat

SEQ ID NO: 352895 - DNA, 20 bp, Artificial
  CRISPR gRNA sequence
gctgtaatttattcatttcc

SEQ ID NO: 352896 - DNA, 20 bp, Artificial
  CRISPR gRNA sequence
taatttattcatttccaaaa

SEQ ID NO: 352897 - DNA, 20 bp, Artificial
  CRISPR gRNA sequence
attcatttccaaaaagtaga

SEQ ID NO: 352898 - DNA, 20 bp, Artificial
  CRISPR gRNA sequence
ttcatttccaaaaagtagaa

SEQ ID NO: 352899 - DNA, 20 bp, Artificial
  CRISPR gRNA sequence
atttccaaaaagtagaaaca

SEQ ID NO: 352900 - DNA, 20 bp, Artificial
  CRISPR gRNA sequence
ccaaaaagtagaaacataaa

SEQ ID NO: 352901 - DNA, 20 bp, Artificial
  CRISPR gRNA sequence
caaaaagtagaaacataaac

SEQ ID NO: 352902 - DNA, 20 bp, Artificial
  CRISPR gRNA sequence
cagaagaagaatcaattcac

SEQ ID NO: 352903 - DNA, 20 bp, Artificial
  CRISPR gRNA sequence
agaagaagaatcaattcaca

SEQ ID NO: 352904 - DNA, 20 bp, Artificial
  CRISPR gRNA sequence
acagtggcttctcagccagc

SEQ ID NO: 352905 - DNA, 20 bp, Artificial
  CRISPR gRNA sequence
ctcagccagcacacaccacc

SEQ ID NO: 352906 - DNA, 20 bp, Artificial
  CRISPR gRNA sequence
tcagccagcacacaccaccc

SEQ ID NO: 352907 - DNA, 20 bp, Artificial
  CRISPR gRNA sequence
agccagcacacaccacccgc

SEQ ID NO: 352908 - DNA, 20 bp, Artificial
  CRISPR gRNA sequence
taacaatcacatccccgctg

SEQ ID NO: 352909 - DNA, 20 bp, Artificial
  CRISPR gRNA sequence
tgtgaatggaggaagcgtcc

SEQ ID NO: 352910 - DNA, 20 bp, Artificial
  CRISPR gRNA sequence
aagagcctgggactgtgccc

SEQ ID NO: 352911 - DNA, 20 bp, Artificial
  CRISPR gRNA sequence
ggactgtgcccagttgtact

SEQ ID NO: 352912 - DNA, 20 bp, Artificial
  CRISPR gRNA sequence
tgcccagttgtacttcagaa

SEQ ID NO: 352913 - DNA, 20 bp, Artificial
  CRISPR gRNA sequence
tacttcagaacatcagtccc

SEQ ID NO: 352914 - DNA, 20 bp, Artificial
  CRISPR gRNA sequence
cagaacatcagtcccttcaa

SEQ ID NO: 352915 - DNA, 20 bp, Artificial
  CRISPR gRNA sequence
agaacatcagtcccttcaaa

SEQ ID NO: 352916 - DNA, 20 bp, Artificial
  CRISPR gRNA sequence
caaaccgagaatgggtgtgt

SEQ ID NO: 352917 - DNA, 20 bp, Artificial
  CRISPR gRNA sequence
aaaccgagaatgggtgtgtt

SEQ ID NO: 352918 - DNA, 20 bp, Artificial
  CRISPR gRNA sequence
ctcctgacttctctagaatt

SEQ ID NO: 352919 - DNA, 20 bp, Artificial
  CRISPR gRNA sequence
ctgacttctctagaattcag

SEQ ID NO: 352920 - DNA, 20 bp, Artificial
  CRISPR gRNA sequence
acttctctagaattcagaca

SEQ ID NO: 352921 - DNA, 20 bp, Artificial
  CRISPR gRNA sequence
ctctagaattcagacatgct

SEQ ID NO: 352922 - DNA, 20 bp, Artificial
  CRISPR gRNA sequence
tctagaattcagacatgctt

SEQ ID NO: 352923 - DNA, 20 bp, Artificial
  CRISPR gRNA sequence
tagaattcagacatgcttgg

SEQ ID NO: 352924 - DNA, 20 bp, Artificial
  CRISPR gRNA sequence
gaattcagacatgcttggtc

SEQ ID NO: 352925 - DNA, 20 bp, Artificial
  CRISPR gRNA sequence
agacatgcttggtcaaaaga

SEQ ID NO: 352926 - DNA, 20 bp, Artificial
  CRISPR gRNA sequence
ggtcaaaagaaaacagcatt

SEQ ID NO: 352927 - DNA, 20 bp, Artificial
  CRISPR gRNA sequence
gtcaaaagaaaacagcatta

SEQ ID NO: 352928 - DNA, 20 bp, Artificial
  CRISPR gRNA sequence
gaggggaaacacggggaaaa

SEQ ID NO: 352929 - DNA, 20 bp, Artificial
  CRISPR gRNA sequence
attgttttaagtctgaggaa

SEQ ID NO: 352930 - DNA, 20 bp, Artificial
  CRISPR gRNA sequence
ttgttttaagtctgaggaaa

SEQ ID NO: 352931 - DNA, 20 bp, Artificial
  CRISPR gRNA sequence
ttttaagtctgaggaaaagg

SEQ ID NO: 352932 - DNA, 20 bp, Artificial
  CRISPR gRNA sequence
taagtctgaggaaaaggcaa

SEQ ID NO: 352933 - DNA, 20 bp, Artificial
  CRISPR gRNA sequence
aagtctgaggaaaaggcaag

SEQ ID NO: 352934 - DNA, 20 bp, Artificial
  CRISPR gRNA sequence
agtctgaggaaaaggcaagc

SEQ ID NO: 352935 - DNA, 20 bp, Artificial
  CRISPR gRNA sequence
aggaaaaggcaagctcccgc

SEQ ID NO: 352936 - DNA, 20 bp, Artificial
  CRISPR gRNA sequence
ccgctccccatagtgccatt

SEQ ID NO: 352937 - DNA, 20 bp, Artificial
  CRISPR gRNA sequence
cccatagtgccatttggggg

SEQ ID NO: 352938 - DNA, 20 bp, Artificial
  CRISPR gRNA sequence
gggggaaactagagagttgt

SEQ ID NO: 352939 - DNA, 20 bp, Artificial
  CRISPR gRNA sequence
ggggaaactagagagttgtg

SEQ ID NO: 352940 - DNA, 20 bp, Artificial
  CRISPR gRNA sequence
gagagttgtgaatgtatcac

SEQ ID NO: 352941 - DNA, 20 bp, Artificial
  CRISPR gRNA sequence
tgaatgtatcaccagaaggg

SEQ ID NO: 352942 - DNA, 20 bp, Artificial
  CRISPR gRNA sequence
ttttaccacgtgtaaccatg

SEQ ID NO: 352943 - DNA, 20 bp, Artificial
  CRISPR gRNA sequence
taccacgtgtaaccatggtc

SEQ ID NO: 352944 - DNA, 20 bp, Artificial
  CRISPR gRNA sequence
accacgtgtaaccatggtct

SEQ ID NO: 352945 - DNA, 20 bp, Artificial
  CRISPR gRNA sequence
ccacgtgtaaccatggtcta

SEQ ID NO: 352946 - DNA, 20 bp, Artificial
  CRISPR gRNA sequence
gggtgagaggcataatgcca

SEQ ID NO: 352947 - DNA, 20 bp, Artificial
  CRISPR gRNA sequence
tttggtgggtggcccaaaag

SEQ ID NO: 352948 - DNA, 20 bp, Artificial
  CRISPR gRNA sequence
ggtgggtggcccaaaagact

SEQ ID NO: 352949 - DNA, 20 bp, Artificial
  CRISPR gRNA sequence
gtgggtggcccaaaagactc

SEQ ID NO: 352950 - DNA, 20 bp, Artificial
  CRISPR gRNA sequence
cctccccagtgaggtcttga

SEQ ID NO: 352951 - DNA, 20 bp, Artificial
  CRISPR gRNA sequence
cccagtgaggtcttgagccc

SEQ ID NO: 352952 - DNA, 20 bp, Artificial
  CRISPR gRNA sequence
gagcccaggggtgcaggata

SEQ ID NO: 352953 - DNA, 20 bp, Artificial
  CRISPR gRNA sequence
agcccaggggtgcaggatac

SEQ ID NO: 352954 - DNA, 20 bp, Artificial
  CRISPR gRNA sequence
ggaagtgatagcctcttctt

SEQ ID NO: 352955 - DNA, 20 bp, Artificial
  CRISPR gRNA sequence
gaagtgatagcctcttcttc

SEQ ID NO: 352956 - DNA, 20 bp, Artificial
  CRISPR gRNA sequence
ttcttcaccctttgtttctg

SEQ ID NO: 352957 - DNA, 20 bp, Artificial
  CRISPR gRNA sequence
cttcaccctttgtttctgcc

SEQ ID NO: 352958 - DNA, 20 bp, Artificial
  CRISPR gRNA sequence
ttcaccctttgtttctgccc

SEQ ID NO: 352959 - DNA, 20 bp, Artificial
  CRISPR gRNA sequence
caccctttgtttctgccctt

SEQ ID NO: 352960 - DNA, 20 bp, Artificial
  CRISPR gRNA sequence
accctttgtttctgcccttc

SEQ ID NO: 352961 - DNA, 20 bp, Artificial
  CRISPR gRNA sequence
tgtttctgcccttccttcag

SEQ ID NO: 352962 - DNA, 20 bp, Artificial
  CRISPR gRNA sequence
gtttctgcccttccttcagg

SEQ ID NO: 352963 - DNA, 20 bp, Artificial
  CRISPR gRNA sequence
tttctgcccttccttcaggt

SEQ ID NO: 352964 - DNA, 20 bp, Artificial
  CRISPR gRNA sequence
ctgcccttccttcaggtaga

SEQ ID NO: 352965 - DNA, 20 bp, Artificial
  CRISPR gRNA sequence
tgcccttccttcaggtagaa

SEQ ID NO: 352966 - DNA, 20 bp, Artificial
  CRISPR gRNA sequence
cccttccttcaggtagaatt

SEQ ID NO: 352967 - DNA, 20 bp, Artificial
  CRISPR gRNA sequence
ccttcaggtagaattcagct

SEQ ID NO: 352968 - DNA, 20 bp, Artificial
  CRISPR gRNA sequence
cttcaggtagaattcagcta

SEQ ID NO: 352969 - DNA, 20 bp, Artificial
  CRISPR gRNA sequence
caggtagaattcagctactg

SEQ ID NO: 352970 - DNA, 20 bp, Artificial
  CRISPR gRNA sequence
aggtagaattcagctactgg

SEQ ID NO: 352971 - DNA, 20 bp, Artificial
  CRISPR gRNA sequence
agctactggaaaaatccaag

SEQ ID NO: 352972 - DNA, 20 bp, Artificial
  CRISPR gRNA sequence
ctggaaaaatccaagtgctg

SEQ ID NO: 352973 - DNA, 20 bp, Artificial
  CRISPR gRNA sequence
gaaaaatccaagtgctggga

SEQ ID NO: 352974 - DNA, 20 bp, Artificial
  CRISPR gRNA sequence
ggaactgagcttctagagca

SEQ ID NO: 352975 - DNA, 20 bp, Artificial
  CRISPR gRNA sequence
agcttctagagcaatctgag

SEQ ID NO: 352976 - DNA, 20 bp, Artificial
  CRISPR gRNA sequence
ctagagcaatctgagttgta

SEQ ID NO: 352977 - DNA, 20 bp, Artificial
  CRISPR gRNA sequence
tagagcaatctgagttgtag

SEQ ID NO: 352978 - DNA, 20 bp, Artificial
  CRISPR gRNA sequence
gagcaatctgagttgtagta

SEQ ID NO: 352979 - DNA, 20 bp, Artificial
  CRISPR gRNA sequence
agttgtagtaaaggaatggg

SEQ ID NO: 352980 - DNA, 20 bp, Artificial
  CRISPR gRNA sequence
tagtaaaggaatgggtgctc

SEQ ID NO: 352981 - DNA, 20 bp, Artificial
  CRISPR gRNA sequence
ataagcccgggtttacaaat

SEQ ID NO: 352982 - DNA, 20 bp, Artificial
  CRISPR gRNA sequence
acaaatcttcattagtagct

SEQ ID NO: 352983 - DNA, 20 bp, Artificial
  CRISPR gRNA sequence
caaatcttcattagtagctc

SEQ ID NO: 352984 - DNA, 20 bp, Artificial
  CRISPR gRNA sequence
cattagtagctccacagttt

SEQ ID NO: 352985 - DNA, 20 bp, Artificial
  CRISPR gRNA sequence
attagtagctccacagtttt

SEQ ID NO: 352986 - DNA, 20 bp, Artificial
  CRISPR gRNA sequence
gtagctccacagttttgaga

SEQ ID NO: 352987 - DNA, 20 bp, Artificial
  CRISPR gRNA sequence
cacagttttgagagtagaca

SEQ ID NO: 352988 - DNA, 20 bp, Artificial
  CRISPR gRNA sequence
tgagagtagacagtgaatga

SEQ ID NO: 352989 - DNA, 20 bp, Artificial
  CRISPR gRNA sequence
gagagtagacagtgaatgag

SEQ ID NO: 352990 - DNA, 20 bp, Artificial
  CRISPR gRNA sequence
agagtagacagtgaatgagg

SEQ ID NO: 352991 - DNA, 20 bp, Artificial
  CRISPR gRNA sequence
tacaagggtggcgtagtgga

SEQ ID NO: 352992 - DNA, 20 bp, Artificial
  CRISPR gRNA sequence
tgaggcttttttgtctgcct

SEQ ID NO: 352993 - DNA, 20 bp, Artificial
  CRISPR gRNA sequence
ttttgtctgcctaccacctg

SEQ ID NO: 352994 - DNA, 20 bp, Artificial
  CRISPR gRNA sequence
tttgtctgcctaccacctga

SEQ ID NO: 352995 - DNA, 20 bp, Artificial
  CRISPR gRNA sequence
ttgtctgcctaccacctgaa

SEQ ID NO: 352996 - DNA, 20 bp, Artificial
  CRISPR gRNA sequence
tgtctgcctaccacctgaat

SEQ ID NO: 352997 - DNA, 20 bp, Artificial
  CRISPR gRNA sequence
gtctgcctaccacctgaatc

SEQ ID NO: 352998 - DNA, 20 bp, Artificial
  CRISPR gRNA sequence
tctgcctaccacctgaatcc

SEQ ID NO: 352999 - DNA, 20 bp, Artificial
  CRISPR gRNA sequence
cctaccacctgaatcccact

SEQ ID NO: 353000 - DNA, 20 bp, Artificial
  CRISPR gRNA sequence
ccacctgaatcccacttcta

SEQ ID NO: 353001 - DNA, 20 bp, Artificial
  CRISPR gRNA sequence
aatcccacttctattatttg

SEQ ID NO: 353002 - DNA, 20 bp, Artificial
  CRISPR gRNA sequence
ctattatttgtagaattcct

SEQ ID NO: 353003 - DNA, 20 bp, Artificial
  CRISPR gRNA sequence
tattatttgtagaattcctt

SEQ ID NO: 353004 - DNA, 20 bp, Artificial
  CRISPR gRNA sequence
ttatttgtagaattccttaa

SEQ ID NO: 353005 - DNA, 20 bp, Artificial
  CRISPR gRNA sequence
tttgtagaattccttaattc

SEQ ID NO: 353006 - DNA, 20 bp, Artificial
  CRISPR gRNA sequence
gtagaattccttaattcata

SEQ ID NO: 353007 - DNA, 20 bp, Artificial
  CRISPR gRNA sequence
tagaattccttaattcataa

SEQ ID NO: 353008 - DNA, 20 bp, Artificial
  CRISPR gRNA sequence
cttaattcataagaagtgaa

SEQ ID NO: 353009 - DNA, 20 bp, Artificial
  CRISPR gRNA sequence
aattcataagaagtgaaagt

SEQ ID NO: 353010 - DNA, 20 bp, Artificial
  CRISPR gRNA sequence
attcataagaagtgaaagtg

SEQ ID NO: 353011 - DNA, 20 bp, Artificial
  CRISPR gRNA sequence
ataagaagtgaaagtggaaa

SEQ ID NO: 353012 - DNA, 20 bp, Artificial
  CRISPR gRNA sequence
aattcccagccccccttgga

SEQ ID NO: 353013 - DNA, 20 bp, Artificial
  CRISPR gRNA sequence
ccagccccccttggagatag

SEQ ID NO: 353014 - DNA, 20 bp, Artificial
  CRISPR gRNA sequence
ggagataggacatggacatg

SEQ ID NO: 353015 - DNA, 20 bp, Artificial
  CRISPR gRNA sequence
gagataggacatggacatgt

SEQ ID NO: 353016 - DNA, 20 bp, Artificial
  CRISPR gRNA sequence
ggattggccactcaatccca

SEQ ID NO: 353017 - DNA, 20 bp, Artificial
  CRISPR gRNA sequence
gccactcaatcccagacttt

SEQ ID NO: 353018 - DNA, 20 bp, Artificial
  CRISPR gRNA sequence
aatcccagactttgaattat

SEQ ID NO: 353019 - DNA, 20 bp, Artificial
  CRISPR gRNA sequence
tgaattataagctagagatg

SEQ ID NO: 353020 - DNA, 20 bp, Artificial
  CRISPR gRNA sequence
gaattataagctagagatga

SEQ ID NO: 353021 - DNA, 20 bp, Artificial
  CRISPR gRNA sequence
aattataagctagagatgaa

SEQ ID NO: 353022 - DNA, 20 bp, Artificial
  CRISPR gRNA sequence
taagctagagatgaaaggat

SEQ ID NO: 353023 - DNA, 20 bp, Artificial
  CRISPR gRNA sequence
gagatgaaaggatgaagaag

SEQ ID NO: 353024 - DNA, 20 bp, Artificial
  CRISPR gRNA sequence
gagaattcattttcatggca

SEQ ID NO: 353025 - DNA, 20 bp, Artificial
  CRISPR gRNA sequence
attttcatggcagacagtgc

SEQ ID NO: 353026 - DNA, 20 bp, Artificial
  CRISPR gRNA sequence
tcatggcagacagtgcagca

SEQ ID NO: 353027 - DNA, 20 bp, Artificial
  CRISPR gRNA sequence
catggcagacagtgcagcag

SEQ ID NO: 353028 - DNA, 20 bp, Artificial
  CRISPR gRNA sequence
atggcagacagtgcagcagt

SEQ ID NO: 353029 - DNA, 20 bp, Artificial
  CRISPR gRNA sequence
ccaagtccagcagagacagt

SEQ ID NO: 353030 - DNA, 20 bp, Artificial
  CRISPR gRNA sequence
caagtccagcagagacagtg

SEQ ID NO: 353031 - DNA, 20 bp, Artificial
  CRISPR gRNA sequence
tgcctagtgctggggacagt

SEQ ID NO: 353032 - DNA, 20 bp, Artificial
  CRISPR gRNA sequence
gtgctggggacagtggctgt

SEQ ID NO: 353033 - DNA, 20 bp, Artificial
  CRISPR gRNA sequence
gggacagtggctgtgcatga

SEQ ID NO: 353034 - DNA, 20 bp, Artificial
  CRISPR gRNA sequence
tgcatgaacaggatcatcat

SEQ ID NO: 353035 - DNA, 20 bp, Artificial
  CRISPR gRNA sequence
ggctggttttgtaattttgg

SEQ ID NO: 353036 - DNA, 20 bp, Artificial
  CRISPR gRNA sequence
gttttgtaattttggctgtg

SEQ ID NO: 353037 - DNA, 20 bp, Artificial
  CRISPR gRNA sequence
tgtaattttggctgtgctcc

SEQ ID NO: 353038 - DNA, 20 bp, Artificial
  CRISPR gRNA sequence
gtaattttggctgtgctccc

SEQ ID NO: 353039 - DNA, 20 bp, Artificial
  CRISPR gRNA sequence
taattttggctgtgctccca

SEQ ID NO: 353040 - DNA, 20 bp, Artificial
  CRISPR gRNA sequence
tggctgtgctcccagccaca

SEQ ID NO: 353041 - DNA, 20 bp, Artificial
  CRISPR gRNA sequence
ggctgtgctcccagccacag

SEQ ID NO: 353042 - DNA, 20 bp, Artificial
  CRISPR gRNA sequence
gctgtgctcccagccacagc

SEQ ID NO: 353043 - DNA, 20 bp, Artificial
  CRISPR gRNA sequence
tgctcccagccacagcctag

SEQ ID NO: 353044 - DNA, 20 bp, Artificial
  CRISPR gRNA sequence
ccagccacagcctagtctct

SEQ ID NO: 353045 - DNA, 20 bp, Artificial
  CRISPR gRNA sequence
gtctcttcttttcctgctca

SEQ ID NO: 353046 - DNA, 20 bp, Artificial
  CRISPR gRNA sequence
ttcttttcctgctcactttc

SEQ ID NO: 353047 - DNA, 20 bp, Artificial
  CRISPR gRNA sequence
cttttcctgctcactttcaa

SEQ ID NO: 353048 - DNA, 20 bp, Artificial
  CRISPR gRNA sequence
ttttcctgctcactttcaaa

SEQ ID NO: 353049 - DNA, 20 bp, Artificial
  CRISPR gRNA sequence
ttcctgctcactttcaaagc

SEQ ID NO: 353050 - DNA, 20 bp, Artificial
  CRISPR gRNA sequence
tcctgctcactttcaaagca

SEQ ID NO: 353051 - DNA, 20 bp, Artificial
  CRISPR gRNA sequence
cctgctcactttcaaagcat

SEQ ID NO: 353052 - DNA, 20 bp, Artificial
  CRISPR gRNA sequence
ctgctcactttcaaagcatg

SEQ ID NO: 353053 - DNA, 20 bp, Artificial
  CRISPR gRNA sequence
ctcactttcaaagcatggtt

SEQ ID NO: 353054 - DNA, 20 bp, Artificial
  CRISPR gRNA sequence
actttcaaagcatggttttg

SEQ ID NO: 353055 - DNA, 20 bp, Artificial
  CRISPR gRNA sequence
tcaaagcatggttttgcaga

SEQ ID NO: 353056 - DNA, 20 bp, Artificial
  CRISPR gRNA sequence
caaagcatggttttgcagaa

SEQ ID NO: 353057 - DNA, 20 bp, Artificial
  CRISPR gRNA sequence
aaagcatggttttgcagaaa

SEQ ID NO: 353058 - DNA, 20 bp, Artificial
  CRISPR gRNA sequence
tgcagaaacttctagcagtt

SEQ ID NO: 353059 - DNA, 20 bp, Artificial
  CRISPR gRNA sequence
gcagaaacttctagcagtta

SEQ ID NO: 353060 - DNA, 20 bp, Artificial
  CRISPR gRNA sequence
cagaaacttctagcagttat

SEQ ID NO: 353061 - DNA, 20 bp, Artificial
  CRISPR gRNA sequence
ctagcagttattggaaccaa

SEQ ID NO: 353062 - DNA, 20 bp, Artificial
  CRISPR gRNA sequence
tagcagttattggaaccaat

SEQ ID NO: 353063 - DNA, 20 bp, Artificial
  CRISPR gRNA sequence
gcagttattggaaccaatca

SEQ ID NO: 353064 - DNA, 20 bp, Artificial
  CRISPR gRNA sequence
ttggaaccaatcagtatctt

SEQ ID NO: 353065 - DNA, 20 bp, Artificial
  CRISPR gRNA sequence
gaaccaatcagtatcttttc

SEQ ID NO: 353066 - DNA, 20 bp, Artificial
  CRISPR gRNA sequence
ttcaataggttccttttcta

SEQ ID NO: 353067 - DNA, 20 bp, Artificial
  CRISPR gRNA sequence
tcaataggttccttttctac

SEQ ID NO: 353068 - DNA, 20 bp, Artificial
  CRISPR gRNA sequence
caataggttccttttctaca

SEQ ID NO: 353069 - DNA, 20 bp, Artificial
  CRISPR gRNA sequence
aataggttccttttctacat

SEQ ID NO: 353070 - DNA, 20 bp, Artificial
  CRISPR gRNA sequence
cttttctacataaaaaagcc

SEQ ID NO: 353071 - DNA, 20 bp, Artificial
  CRISPR gRNA sequence
ttctacataaaaaagccaaa

SEQ ID NO: 353072 - DNA, 20 bp, Artificial
  CRISPR gRNA sequence
tctacataaaaaagccaaag

SEQ ID NO: 353073 - DNA, 20 bp, Artificial
  CRISPR gRNA sequence
ctacataaaaaagccaaagc

SEQ ID NO: 353074 - DNA, 20 bp, Artificial
  CRISPR gRNA sequence
tacataaaaaagccaaagcc

SEQ ID NO: 353075 - DNA, 20 bp, Artificial
  CRISPR gRNA sequence
cataaaaaagccaaagccag

SEQ ID NO: 353076 - DNA, 20 bp, Artificial
  CRISPR gRNA sequence
ctgttgattgcaactaagaa

SEQ ID NO: 353077 - DNA, 20 bp, Artificial
  CRISPR gRNA sequence
tgttgattgcaactaagaac

SEQ ID NO: 353078 - DNA, 20 bp, Artificial
  CRISPR gRNA sequence
ttgattgcaactaagaactc

SEQ ID NO: 353079 - DNA, 20 bp, Artificial
  CRISPR gRNA sequence
attgcaactaagaactctat

SEQ ID NO: 353080 - DNA, 20 bp, Artificial
  CRISPR gRNA sequence
caactaagaactctattaaa

SEQ ID NO: 353081 - DNA, 20 bp, Artificial
  CRISPR gRNA sequence
agaactctattaaagaagct

SEQ ID NO: 353082 - DNA, 20 bp, Artificial
  CRISPR gRNA sequence
tattaaagaagctggtacca

SEQ ID NO: 353083 - DNA, 20 bp, Artificial
  CRISPR gRNA sequence
ttaaagaagctggtaccagg

SEQ ID NO: 353084 - DNA, 20 bp, Artificial
  CRISPR gRNA sequence
aagaagctggtaccaggaaa

SEQ ID NO: 353085 - DNA, 20 bp, Artificial
  CRISPR gRNA sequence
gtaccaggaaacgagatgca

SEQ ID NO: 353086 - DNA, 20 bp, Artificial
  CRISPR gRNA sequence
agcaacaggcttacaatgtg

SEQ ID NO: 353087 - DNA, 20 bp, Artificial
  CRISPR gRNA sequence
acaatgtgaattgacctcat

SEQ ID NO: 353088 - DNA, 20 bp, Artificial
  CRISPR gRNA sequence
caatgtgaattgacctcata

SEQ ID NO: 353089 - DNA, 20 bp, Artificial
  CRISPR gRNA sequence
acctcatagaggaggtaaga

SEQ ID NO: 353090 - DNA, 20 bp, Artificial
  CRISPR gRNA sequence
atagaggaggtaagatacaa

SEQ ID NO: 353091 - DNA, 20 bp, Artificial
  CRISPR gRNA sequence
agttttgagctgggaagttg

SEQ ID NO: 353092 - DNA, 20 bp, Artificial
  CRISPR gRNA sequence
tgagctgggaagttggtgct

SEQ ID NO: 353093 - DNA, 20 bp, Artificial
  CRISPR gRNA sequence
gagctgggaagttggtgctc

SEQ ID NO: 353094 - DNA, 20 bp, Artificial
  CRISPR gRNA sequence
agctgggaagttggtgctcc

SEQ ID NO: 353095 - DNA, 20 bp, Artificial
  CRISPR gRNA sequence
ggaagttggtgctccttatt

SEQ ID NO: 353096 - DNA, 20 bp, Artificial
  CRISPR gRNA sequence
gtgctccttattatgcaatg

SEQ ID NO: 353097 - DNA, 20 bp, Artificial
  CRISPR gRNA sequence
cttattatgcaatggtatga

SEQ ID NO: 353098 - DNA, 20 bp, Artificial
  CRISPR gRNA sequence
attatgcaatggtatgatag

SEQ ID NO: 353099 - DNA, 20 bp, Artificial
  CRISPR gRNA sequence
ttatgcaatggtatgatagt

SEQ ID NO: 353100 - DNA, 20 bp, Artificial
  CRISPR gRNA sequence
tgcaatggtatgatagtggc

SEQ ID NO: 353101 - DNA, 20 bp, Artificial
  CRISPR gRNA sequence
tttcttacagtacttaccaa

SEQ ID NO: 353102 - DNA, 20 bp, Artificial
  CRISPR gRNA sequence
cttacagtacttaccaagtt

SEQ ID NO: 353103 - DNA, 20 bp, Artificial
  CRISPR gRNA sequence
ttacagtacttaccaagttt

SEQ ID NO: 353104 - DNA, 20 bp, Artificial
  CRISPR gRNA sequence
acagtacttaccaagtttat

SEQ ID NO: 353105 - DNA, 20 bp, Artificial
  CRISPR gRNA sequence
cagtacttaccaagtttata

SEQ ID NO: 353106 - DNA, 20 bp, Artificial
  CRISPR gRNA sequence
accaagtttatataagaaac

SEQ ID NO: 353107 - DNA, 20 bp, Artificial
  CRISPR gRNA sequence
ccaagtttatataagaaaca

SEQ ID NO: 353108 - DNA, 20 bp, Artificial
  CRISPR gRNA sequence
atataagaaacaataagaaa

SEQ ID NO: 353109 - DNA, 20 bp, Artificial
  CRISPR gRNA sequence
tataagaaacaataagaaaa

SEQ ID NO: 353110 - DNA, 20 bp, Artificial
  CRISPR gRNA sequence
aaattgaggacagcctgtct

SEQ ID NO: 353111 - DNA, 20 bp, Artificial
  CRISPR gRNA sequence
aattgaggacagcctgtcta

SEQ ID NO: 353112 - DNA, 20 bp, Artificial
  CRISPR gRNA sequence
aggacagcctgtctaaaagc

SEQ ID NO: 353113 - DNA, 20 bp, Artificial
  CRISPR gRNA sequence
tctaaaagcagagaatagga

SEQ ID NO: 353114 - DNA, 20 bp, Artificial
  CRISPR gRNA sequence
aaagcagagaataggaaaaa

SEQ ID NO: 353115 - DNA, 20 bp, Artificial
  CRISPR gRNA sequence
tacttaaaaagtctctttct

SEQ ID NO: 353116 - DNA, 20 bp, Artificial
  CRISPR gRNA sequence
acttaaaaagtctctttctg

SEQ ID NO: 353117 - DNA, 20 bp, Artificial
  CRISPR gRNA sequence
cttaaaaagtctctttctgc

SEQ ID NO: 353118 - DNA, 20 bp, Artificial
  CRISPR gRNA sequence
aaaaagtctctttctgcctg

SEQ ID NO: 353119 - DNA, 20 bp, Artificial
  CRISPR gRNA sequence
aaaagtctctttctgcctgc

SEQ ID NO: 353120 - DNA, 20 bp, Artificial
  CRISPR gRNA sequence
tttctgcctgcagcttgcaa

SEQ ID NO: 353121 - DNA, 20 bp, Artificial
  CRISPR gRNA sequence
tctgcctgcagcttgcaaaa

SEQ ID NO: 353122 - DNA, 20 bp, Artificial
  CRISPR gRNA sequence
ctgcctgcagcttgcaaaat

SEQ ID NO: 353123 - DNA, 20 bp, Artificial
  CRISPR gRNA sequence
tgcctgcagcttgcaaaata

SEQ ID NO: 353124 - DNA, 20 bp, Artificial
  CRISPR gRNA sequence
cctgcagcttgcaaaataag

SEQ ID NO: 353125 - DNA, 20 bp, Artificial
  CRISPR gRNA sequence
cagcttgcaaaataagttat

SEQ ID NO: 353126 - DNA, 20 bp, Artificial
  CRISPR gRNA sequence
gcaaaataagttattgagca

SEQ ID NO: 353127 - DNA, 20 bp, Artificial
  CRISPR gRNA sequence
caaaataagttattgagcat

SEQ ID NO: 353128 - DNA, 20 bp, Artificial
  CRISPR gRNA sequence
ttgagcattcaaagatttga

SEQ ID NO: 353129 - DNA, 20 bp, Artificial
  CRISPR gRNA sequence
agcattcaaagatttgaagc

SEQ ID NO: 353130 - DNA, 20 bp, Artificial
  CRISPR gRNA sequence
aaagatttgaagctgttaga

SEQ ID NO: 353131 - DNA, 20 bp, Artificial
  CRISPR gRNA sequence
gaagctgttagaccaaaata

SEQ ID NO: 353132 - DNA, 20 bp, Artificial
  CRISPR gRNA sequence
aagctgttagaccaaaataa

SEQ ID NO: 353133 - DNA, 20 bp, Artificial
  CRISPR gRNA sequence
ttagaccaaaataacttaat

SEQ ID NO: 353134 - DNA, 20 bp, Artificial
  CRISPR gRNA sequence
gaccaaaataacttaatttt

SEQ ID NO: 353135 - DNA, 20 bp, Artificial
  CRISPR gRNA sequence
aattttctactagaggataa

SEQ ID NO: 353136 - DNA, 20 bp, Artificial
  CRISPR gRNA sequence
attttctactagaggataaa

SEQ ID NO: 353137 - DNA, 20 bp, Artificial
  CRISPR gRNA sequence
tctactagaggataaattta

SEQ ID NO: 353138 - DNA, 20 bp, Artificial
  CRISPR gRNA sequence
ctactagaggataaatttag

SEQ ID NO: 353139 - DNA, 20 bp, Artificial
  CRISPR gRNA sequence
tactagaggataaatttagt

SEQ ID NO: 353140 - DNA, 20 bp, Artificial
  CRISPR gRNA sequence
ctagaggataaatttagtgt

SEQ ID NO: 353141 - DNA, 20 bp, Artificial
  CRISPR gRNA sequence
gaggataaatttagtgtgag

SEQ ID NO: 353142 - DNA, 20 bp, Artificial
  CRISPR gRNA sequence
agtgtgaggagaggtatgca

SEQ ID NO: 353143 - DNA, 20 bp, Artificial
  CRISPR gRNA sequence
gtgtgaggagaggtatgcag

SEQ ID NO: 353144 - DNA, 20 bp, Artificial
  CRISPR gRNA sequence
ggaaagaccttgacctgcaa

SEQ ID NO: 353145 - DNA, 20 bp, Artificial
  CRISPR gRNA sequence
gacctgcaataccccttgaa

SEQ ID NO: 353146 - DNA, 20 bp, Artificial
  CRISPR gRNA sequence
acctgcaataccccttgaag

SEQ ID NO: 353147 - DNA, 20 bp, Artificial
  CRISPR gRNA sequence
caataccccttgaagccctg

SEQ ID NO: 353148 - DNA, 20 bp, Artificial
  CRISPR gRNA sequence
gaagccctggatataagagg

SEQ ID NO: 353149 - DNA, 20 bp, Artificial
  CRISPR gRNA sequence
aagccctggatataagaggt

SEQ ID NO: 353150 - DNA, 20 bp, Artificial
  CRISPR gRNA sequence
gatataagaggttcagaatc

SEQ ID NO: 353151 - DNA, 20 bp, Artificial
  CRISPR gRNA sequence
agaatctggtcacagagagt

SEQ ID NO: 353152 - DNA, 20 bp, Artificial
  CRISPR gRNA sequence
gtcacagagagtcttagctg

SEQ ID NO: 353153 - DNA, 20 bp, Artificial
  CRISPR gRNA sequence
agctgaggttccaggtttgt

SEQ ID NO: 353154 - DNA, 20 bp, Artificial
  CRISPR gRNA sequence
gctgaggttccaggtttgtt

SEQ ID NO: 353155 - DNA, 20 bp, Artificial
  CRISPR gRNA sequence
aggttccaggtttgttgttc

SEQ ID NO: 353156 - DNA, 20 bp, Artificial
  CRISPR gRNA sequence
caggtttgttgttcaaggga

SEQ ID NO: 353157 - DNA, 20 bp, Artificial
  CRISPR gRNA sequence
gttgttcaagggaatcaaca

SEQ ID NO: 353158 - DNA, 20 bp, Artificial
  CRISPR gRNA sequence
ttgttcaagggaatcaacag

SEQ ID NO: 353159 - DNA, 20 bp, Artificial
  CRISPR gRNA sequence
ttcaagggaatcaacagaga

SEQ ID NO: 353160 - DNA, 20 bp, Artificial
  CRISPR gRNA sequence
aagggaatcaacagagaact

SEQ ID NO: 353161 - DNA, 20 bp, Artificial
  CRISPR gRNA sequence
ggatttaaacatcattttga

SEQ ID NO: 353162 - DNA, 20 bp, Artificial
  CRISPR gRNA sequence
aaacatcattttgagaagtg

SEQ ID NO: 353163 - DNA, 20 bp, Artificial
  CRISPR gRNA sequence
aacatcattttgagaagtga

SEQ ID NO: 353164 - DNA, 20 bp, Artificial
  CRISPR gRNA sequence
tgagaagtgaaaaatcacca

SEQ ID NO: 353165 - DNA, 20 bp, Artificial
  CRISPR gRNA sequence
gagaagtgaaaaatcaccat

SEQ ID NO: 353166 - DNA, 20 bp, Artificial
  CRISPR gRNA sequence
agaagtgaaaaatcaccatg

SEQ ID NO: 353167 - DNA, 20 bp, Artificial
  CRISPR gRNA sequence
ctctgagtattccaagctcc

SEQ ID NO: 353168 - DNA, 20 bp, Artificial
  CRISPR gRNA sequence
tgagtattccaagctccttt

SEQ ID NO: 353169 - DNA, 20 bp, Artificial
  CRISPR gRNA sequence
agtattccaagctcctttgt

SEQ ID NO: 353170 - DNA, 20 bp, Artificial
  CRISPR gRNA sequence
caagctcctttgtaacagca

SEQ ID NO: 353171 - DNA, 20 bp, Artificial
  CRISPR gRNA sequence
ctttgtaacagcaccatcaa

SEQ ID NO: 353172 - DNA, 20 bp, Artificial
  CRISPR gRNA sequence
tgtaacagcaccatcaaaca

SEQ ID NO: 353173 - DNA, 20 bp, Artificial
  CRISPR gRNA sequence
gtaacagcaccatcaaacat

SEQ ID NO: 353174 - DNA, 20 bp, Artificial
  CRISPR gRNA sequence
taacagcaccatcaaacatt

SEQ ID NO: 353175 - DNA, 20 bp, Artificial
  CRISPR gRNA sequence
gctacgtttttctttaaaac

SEQ ID NO: 353176 - DNA, 20 bp, Artificial
  CRISPR gRNA sequence
ctacgtttttctttaaaact

SEQ ID NO: 353177 - DNA, 20 bp, Artificial
  CRISPR gRNA sequence
cgtttttctttaaaactgaa

SEQ ID NO: 353178 - DNA, 20 bp, Artificial
  CRISPR gRNA sequence
ttctttaaaactgaatgcca

SEQ ID NO: 353179 - DNA, 20 bp, Artificial
  CRISPR gRNA sequence
tctttaaaactgaatgccat

SEQ ID NO: 353180 - DNA, 20 bp, Artificial
  CRISPR gRNA sequence
ctttaaaactgaatgccatt

SEQ ID NO: 353181 - DNA, 20 bp, Artificial
  CRISPR gRNA sequence
tttaaaactgaatgccattt

SEQ ID NO: 353182 - DNA, 20 bp, Artificial
  CRISPR gRNA sequence
taaaactgaatgccatttgc

SEQ ID NO: 353183 - DNA, 20 bp, Artificial
  CRISPR gRNA sequence
aaaactgaatgccatttgca

SEQ ID NO: 353184 - DNA, 20 bp, Artificial
  CRISPR gRNA sequence
aaactgaatgccatttgcac

SEQ ID NO: 353185 - DNA, 20 bp, Artificial
  CRISPR gRNA sequence
aatgccatttgcacagaact

SEQ ID NO: 353186 - DNA, 20 bp, Artificial
  CRISPR gRNA sequence
gcacagaactgtacttttaa

SEQ ID NO: 353187 - DNA, 20 bp, Artificial
  CRISPR gRNA sequence
cacagaactgtacttttaag

SEQ ID NO: 353188 - DNA, 20 bp, Artificial
  CRISPR gRNA sequence
tacttttaaggctcttacat

SEQ ID NO: 353189 - DNA, 20 bp, Artificial
  CRISPR gRNA sequence
ttaaggctcttacatggttt

SEQ ID NO: 353190 - DNA, 20 bp, Artificial
  CRISPR gRNA sequence
taaggctcttacatggtttc

SEQ ID NO: 353191 - DNA, 20 bp, Artificial
  CRISPR gRNA sequence
aaggctcttacatggtttcc

SEQ ID NO: 353192 - DNA, 20 bp, Artificial
  CRISPR gRNA sequence
aggctcttacatggtttcca

SEQ ID NO: 353193 - DNA, 20 bp, Artificial
  CRISPR gRNA sequence
ttacatggtttccagtccac

SEQ ID NO: 353194 - DNA, 20 bp, Artificial
  CRISPR gRNA sequence
acatggtttccagtccactg

SEQ ID NO: 353195 - DNA, 20 bp, Artificial
  CRISPR gRNA sequence
catggtttccagtccactgt

SEQ ID NO: 353196 - DNA, 20 bp, Artificial
  CRISPR gRNA sequence
ccagtccactgttcaaaact

SEQ ID NO: 353197 - DNA, 20 bp, Artificial
  CRISPR gRNA sequence
cagtccactgttcaaaactc

SEQ ID NO: 353198 - DNA, 20 bp, Artificial
  CRISPR gRNA sequence
ttcaaaactcagagatctca

SEQ ID NO: 353199 - DNA, 20 bp, Artificial
  CRISPR gRNA sequence
aaaactcagagatctcaaaa

SEQ ID NO: 353200 - DNA, 20 bp, Artificial
  CRISPR gRNA sequence
agagatctcaaaatcattct

SEQ ID NO: 353201 - DNA, 20 bp, Artificial
  CRISPR gRNA sequence
aaaatcattctttctgttta

SEQ ID NO: 353202 - DNA, 20 bp, Artificial
  CRISPR gRNA sequence
tttctgtttattgacttttt

SEQ ID NO: 353203 - DNA, 20 bp, Artificial
  CRISPR gRNA sequence
tctgtttattgactttttag

SEQ ID NO: 353204 - DNA, 20 bp, Artificial
  CRISPR gRNA sequence
ctgtttattgactttttagc

SEQ ID NO: 353205 - DNA, 20 bp, Artificial
  CRISPR gRNA sequence
tgtttattgactttttagct

SEQ ID NO: 353206 - DNA, 20 bp, Artificial
  CRISPR gRNA sequence
tttattgactttttagcttc

SEQ ID NO: 353207 - DNA, 20 bp, Artificial
  CRISPR gRNA sequence
attgactttttagcttctgg

SEQ ID NO: 353208 - DNA, 20 bp, Artificial
  CRISPR gRNA sequence
ttgactttttagcttctggg

SEQ ID NO: 353209 - DNA, 20 bp, Artificial
  CRISPR gRNA sequence
actttttagcttctgggttt

SEQ ID NO: 353210 - DNA, 20 bp, Artificial
  CRISPR gRNA sequence
tttagcttctgggttttgca

SEQ ID NO: 353211 - DNA, 20 bp, Artificial
  CRISPR gRNA sequence
ttagcttctgggttttgcaa

SEQ ID NO: 353212 - DNA, 20 bp, Artificial
  CRISPR gRNA sequence
tagcttctgggttttgcaaa

SEQ ID NO: 353213 - DNA, 20 bp, Artificial
  CRISPR gRNA sequence
agcttctgggttttgcaaat

SEQ ID NO: 353214 - DNA, 20 bp, Artificial
  CRISPR gRNA sequence
gcttctgggttttgcaaata

SEQ ID NO: 353215 - DNA, 20 bp, Artificial
  CRISPR gRNA sequence
ctgggttttgcaaataaaat

SEQ ID NO: 353216 - DNA, 20 bp, Artificial
  CRISPR gRNA sequence
tgggttttgcaaataaaata

SEQ ID NO: 353217 - DNA, 20 bp, Artificial
  CRISPR gRNA sequence
ggttttgcaaataaaataat

SEQ ID NO: 353218 - DNA, 20 bp, Artificial
  CRISPR gRNA sequence
tgcaaataaaataatattct

SEQ ID NO: 353219 - DNA, 20 bp, Artificial
  CRISPR gRNA sequence
gcaaataaaataatattctt

SEQ ID NO: 353220 - DNA, 20 bp, Artificial
  CRISPR gRNA sequence
caaataaaataatattctta

SEQ ID NO: 353221 - DNA, 20 bp, Artificial
  CRISPR gRNA sequence
ttagcttcctttatacaata

SEQ ID NO: 353222 - DNA, 20 bp, Artificial
  CRISPR gRNA sequence
agcttcctttatacaataat

SEQ ID NO: 353223 - DNA, 20 bp, Artificial
  CRISPR gRNA sequence
gcttcctttatacaataata

SEQ ID NO: 353224 - DNA, 20 bp, Artificial
  CRISPR gRNA sequence
cctttatacaataatatcag

SEQ ID NO: 353225 - DNA, 20 bp, Artificial
  CRISPR gRNA sequence
ctttatacaataatatcaga

SEQ ID NO: 353226 - DNA, 20 bp, Artificial
  CRISPR gRNA sequence
tatacaataatatcagagtg

SEQ ID NO: 353227 - DNA, 20 bp, Artificial
  CRISPR gRNA sequence
atacaataatatcagagtgt

SEQ ID NO: 353228 - DNA, 20 bp, Artificial
  CRISPR gRNA sequence
tacaataatatcagagtgtt

SEQ ID NO: 353229 - DNA, 20 bp, Artificial
  CRISPR gRNA sequence
tatgtataataagaaattca

SEQ ID NO: 353230 - DNA, 20 bp, Artificial
  CRISPR gRNA sequence
atgtataataagaaattcac

SEQ ID NO: 353231 - DNA, 20 bp, Artificial
  CRISPR gRNA sequence
tgtataataagaaattcacc

SEQ ID NO: 353232 - DNA, 20 bp, Artificial
  CRISPR gRNA sequence
acccttcagcctctattcac

SEQ ID NO: 353233 - DNA, 20 bp, Artificial
  CRISPR gRNA sequence
cagcctctattcactcttta

SEQ ID NO: 353234 - DNA, 20 bp, Artificial
  CRISPR gRNA sequence
agcctctattcactctttat

SEQ ID NO: 353235 - DNA, 20 bp, Artificial
  CRISPR gRNA sequence
tattcactctttatcctgag

SEQ ID NO: 353236 - DNA, 20 bp, Artificial
  CRISPR gRNA sequence
ttcactctttatcctgagag

SEQ ID NO: 353237 - DNA, 20 bp, Artificial
  CRISPR gRNA sequence
actctttatcctgagagaga

SEQ ID NO: 353238 - DNA, 20 bp, Artificial
  CRISPR gRNA sequence
tttatcctgagagagaaact

SEQ ID NO: 353239 - DNA, 20 bp, Artificial
  CRISPR gRNA sequence
tatcctgagagagaaactga

SEQ ID NO: 353240 - DNA, 20 bp, Artificial
  CRISPR gRNA sequence
atcctgagagagaaactgag

SEQ ID NO: 353241 - DNA, 20 bp, Artificial
  CRISPR gRNA sequence
tcctgagagagaaactgagg

SEQ ID NO: 353242 - DNA, 20 bp, Artificial
  CRISPR gRNA sequence
agagagaaactgaggcacag

SEQ ID NO: 353243 - DNA, 20 bp, Artificial
  CRISPR gRNA sequence
aggcacagaggcttgatcag

SEQ ID NO: 353244 - DNA, 20 bp, Artificial
  CRISPR gRNA sequence
gatcaggtctgcaggttatc

SEQ ID NO: 353245 - DNA, 20 bp, Artificial
  CRISPR gRNA sequence
atcaggtctgcaggttatca

SEQ ID NO: 353246 - DNA, 20 bp, Artificial
  CRISPR gRNA sequence
caggttatcatgatcagctc

SEQ ID NO: 353247 - DNA, 20 bp, Artificial
  CRISPR gRNA sequence
tcatgatcagctcccagaac

SEQ ID NO: 353248 - DNA, 20 bp, Artificial
  CRISPR gRNA sequence
ccagaacaaagtaaagatag

SEQ ID NO: 353249 - DNA, 20 bp, Artificial
  CRISPR gRNA sequence
ttccagactttgtgactggt

SEQ ID NO: 353250 - DNA, 20 bp, Artificial
  CRISPR gRNA sequence
tccagactttgtgactggtg

SEQ ID NO: 353251 - DNA, 20 bp, Artificial
  CRISPR gRNA sequence
ccagactttgtgactggtgg

SEQ ID NO: 353252 - DNA, 20 bp, Artificial
  CRISPR gRNA sequence
cagactttgtgactggtggt

SEQ ID NO: 353253 - DNA, 20 bp, Artificial
  CRISPR gRNA sequence
tgtgactggtggtccagtgt

SEQ ID NO: 353254 - DNA, 20 bp, Artificial
  CRISPR gRNA sequence
gtgactggtggtccagtgtg

SEQ ID NO: 353255 - DNA, 20 bp, Artificial
  CRISPR gRNA sequence
tgactggtggtccagtgtgt

SEQ ID NO: 353256 - DNA, 20 bp, Artificial
  CRISPR gRNA sequence
gtggtccagtgtgtgagata

SEQ ID NO: 353257 - DNA, 20 bp, Artificial
  CRISPR gRNA sequence
agatgtcctggctttcagtc

SEQ ID NO: 353258 - DNA, 20 bp, Artificial
  CRISPR gRNA sequence
gctttcagtctgatttttat

SEQ ID NO: 353259 - DNA, 20 bp, Artificial
  CRISPR gRNA sequence
tcagtctgatttttattatc

SEQ ID NO: 353260 - DNA, 20 bp, Artificial
  CRISPR gRNA sequence
cagtctgatttttattatcc

SEQ ID NO: 353261 - DNA, 20 bp, Artificial
  CRISPR gRNA sequence
agtctgatttttattatcca

SEQ ID NO: 353262 - DNA, 20 bp, Artificial
  CRISPR gRNA sequence
atttttattatccagttcca

SEQ ID NO: 353263 - DNA, 20 bp, Artificial
  CRISPR gRNA sequence
ttattatccagttccagcca

SEQ ID NO: 353264 - DNA, 20 bp, Artificial
  CRISPR gRNA sequence
tattatccagttccagccaa

SEQ ID NO: 353265 - DNA, 20 bp, Artificial
  CRISPR gRNA sequence
attatccagttccagccaag

SEQ ID NO: 353266 - DNA, 20 bp, Artificial
  CRISPR gRNA sequence
ttatccagttccagccaaga

SEQ ID NO: 353267 - DNA, 20 bp, Artificial
  CRISPR gRNA sequence
tccagttccagccaagagca

SEQ ID NO: 353268 - DNA, 20 bp, Artificial
  CRISPR gRNA sequence
cagccaagagcaagatgccc

SEQ ID NO: 353269 - DNA, 20 bp, Artificial
  CRISPR gRNA sequence
aactcacattactgtccatt

SEQ ID NO: 353270 - DNA, 20 bp, Artificial
  CRISPR gRNA sequence
acattactgtccatttcatc

SEQ ID NO: 353271 - DNA, 20 bp, Artificial
  CRISPR gRNA sequence
ctgtccatttcatctgctac

SEQ ID NO: 353272 - DNA, 20 bp, Artificial
  CRISPR gRNA sequence
tccatttcatctgctacaac

SEQ ID NO: 353273 - DNA, 20 bp, Artificial
  CRISPR gRNA sequence
catctgctacaacacaaaga

SEQ ID NO: 353274 - DNA, 20 bp, Artificial
  CRISPR gRNA sequence
atctgctacaacacaaagat

SEQ ID NO: 353275 - DNA, 20 bp, Artificial
  CRISPR gRNA sequence
ctacaacacaaagatggaac

SEQ ID NO: 353276 - DNA, 20 bp, Artificial
  CRISPR gRNA sequence
caacacaaagatggaacgct

SEQ ID NO: 353277 - DNA, 20 bp, Artificial
  CRISPR gRNA sequence
ttatcaagtaacgctctgtt

SEQ ID NO: 353278 - DNA, 20 bp, Artificial
  CRISPR gRNA sequence
tcaagtaacgctctgttctg

SEQ ID NO: 353279 - DNA, 20 bp, Artificial
  CRISPR gRNA sequence
tgttctgcgcctgcagccac

SEQ ID NO: 353280 - DNA, 20 bp, Artificial
  CRISPR gRNA sequence
ttctgcgcctgcagccactg

SEQ ID NO: 353281 - DNA, 20 bp, Artificial
  CRISPR gRNA sequence
tgcgcctgcagccactgcac

SEQ ID NO: 353282 - DNA, 20 bp, Artificial
  CRISPR gRNA sequence
cgcctgcagccactgcacag

SEQ ID NO: 353283 - DNA, 20 bp, Artificial
  CRISPR gRNA sequence
cagccactgcacagcaagct

SEQ ID NO: 353284 - DNA, 20 bp, Artificial
  CRISPR gRNA sequence
cacagcaagctaaattcttg

SEQ ID NO: 353285 - DNA, 20 bp, Artificial
  CRISPR gRNA sequence
aattcttgggaagcctcact

SEQ ID NO: 353286 - DNA, 20 bp, Artificial
  CRISPR gRNA sequence
ttgggaagcctcacttcctt

SEQ ID NO: 353287 - DNA, 20 bp, Artificial
  CRISPR gRNA sequence
gggaagcctcacttccttgt

SEQ ID NO: 353288 - DNA, 20 bp, Artificial
  CRISPR gRNA sequence
ggaagcctcacttccttgtt

SEQ ID NO: 353289 - DNA, 20 bp, Artificial
  CRISPR gRNA sequence
acttccttgttcatttcaca

SEQ ID NO: 353290 - DNA, 20 bp, Artificial
  CRISPR gRNA sequence
ccttgttcatttcacagatg

SEQ ID NO: 353291 - DNA, 20 bp, Artificial
  CRISPR gRNA sequence
cttgttcatttcacagatgt

SEQ ID NO: 353292 - DNA, 20 bp, Artificial
  CRISPR gRNA sequence
gttcatttcacagatgtatg

SEQ ID NO: 353293 - DNA, 20 bp, Artificial
  CRISPR gRNA sequence
ttcatttcacagatgtatgt

SEQ ID NO: 353294 - DNA, 20 bp, Artificial
  CRISPR gRNA sequence
atttcacagatgtatgtgga

SEQ ID NO: 353295 - DNA, 20 bp, Artificial
  CRISPR gRNA sequence
cacagatgtatgtggaagaa

SEQ ID NO: 353296 - DNA, 20 bp, Artificial
  CRISPR gRNA sequence
acagatgtatgtggaagaaa

SEQ ID NO: 353297 - DNA, 20 bp, Artificial
  CRISPR gRNA sequence
atctgagaagggtacagacg

SEQ ID NO: 353298 - DNA, 20 bp, Artificial
  CRISPR gRNA sequence
agaagggtacagacgtgcag

SEQ ID NO: 353299 - DNA, 20 bp, Artificial
  CRISPR gRNA sequence
ccagaggaaacttggggcct

SEQ ID NO: 353300 - DNA, 20 bp, Artificial
  CRISPR gRNA sequence
ggggcctgtggccaagttca

SEQ ID NO: 353301 - DNA, 20 bp, Artificial
  CRISPR gRNA sequence
gggcctgtggccaagttcag

SEQ ID NO: 353302 - DNA, 20 bp, Artificial
  CRISPR gRNA sequence
tggccaagttcagtgttcat

SEQ ID NO: 353303 - DNA, 20 bp, Artificial
  CRISPR gRNA sequence
agtgttcattttggtttttc

SEQ ID NO: 353304 - DNA, 20 bp, Artificial
  CRISPR gRNA sequence
attttggtttttccattttc

SEQ ID NO: 353305 - DNA, 20 bp, Artificial
  CRISPR gRNA sequence
tggtttttccattttccttc

SEQ ID NO: 353306 - DNA, 20 bp, Artificial
  CRISPR gRNA sequence
ggtttttccattttccttca

SEQ ID NO: 353307 - DNA, 20 bp, Artificial
  CRISPR gRNA sequence
gtttttccattttccttcag

SEQ ID NO: 353308 - DNA, 20 bp, Artificial
  CRISPR gRNA sequence
ttccattttccttcagaaag

SEQ ID NO: 353309 - DNA, 20 bp, Artificial
  CRISPR gRNA sequence
tccattttccttcagaaagt

SEQ ID NO: 353310 - DNA, 20 bp, Artificial
  CRISPR gRNA sequence
ccattttccttcagaaagtc

SEQ ID NO: 353311 - DNA, 20 bp, Artificial
  CRISPR gRNA sequence
cattttccttcagaaagtcc

SEQ ID NO: 353312 - DNA, 20 bp, Artificial
  CRISPR gRNA sequence
tccttcagaaagtccctttg

SEQ ID NO: 353313 - DNA, 20 bp, Artificial
  CRISPR gRNA sequence
ccttcagaaagtccctttgt

SEQ ID NO: 353314 - DNA, 20 bp, Artificial
  CRISPR gRNA sequence
cttcagaaagtccctttgtt

SEQ ID NO: 353315 - DNA, 20 bp, Artificial
  CRISPR gRNA sequence
cagaaagtccctttgttggt

SEQ ID NO: 353316 - DNA, 20 bp, Artificial
  CRISPR gRNA sequence
agaaagtccctttgttggtc

SEQ ID NO: 353317 - DNA, 20 bp, Artificial
  CRISPR gRNA sequence
tgttggtctctggtgtcagc

SEQ ID NO: 353318 - DNA, 20 bp, Artificial
  CRISPR gRNA sequence
gttggtctctggtgtcagct

SEQ ID NO: 353319 - DNA, 20 bp, Artificial
  CRISPR gRNA sequence
ttggtctctggtgtcagctc

SEQ ID NO: 353320 - DNA, 20 bp, Artificial
  CRISPR gRNA sequence
gtctctggtgtcagctctct

SEQ ID NO: 353321 - DNA, 20 bp, Artificial
  CRISPR gRNA sequence
tggtgtcagctctctggaag

SEQ ID NO: 353322 - DNA, 20 bp, Artificial
  CRISPR gRNA sequence
gtgtcagctctctggaagtg

SEQ ID NO: 353323 - DNA, 20 bp, Artificial
  CRISPR gRNA sequence
tctggaagtgtcacactagc

SEQ ID NO: 353324 - DNA, 20 bp, Artificial
  CRISPR gRNA sequence
tggaagtgtcacactagcat

SEQ ID NO: 353325 - DNA, 20 bp, Artificial
  CRISPR gRNA sequence
gaagtgtcacactagcatag

SEQ ID NO: 353326 - DNA, 20 bp, Artificial
  CRISPR gRNA sequence
gcatagactgtgatggaatt

SEQ ID NO: 353327 - DNA, 20 bp, Artificial
  CRISPR gRNA sequence
tgatggaatttgtttcctgg

SEQ ID NO: 353328 - DNA, 20 bp, Artificial
  CRISPR gRNA sequence
gtttcctggacagactctgg

SEQ ID NO: 353329 - DNA, 20 bp, Artificial
  CRISPR gRNA sequence
tttcctggacagactctggg

SEQ ID NO: 353330 - DNA, 20 bp, Artificial
  CRISPR gRNA sequence
cctggacagactctgggaca

SEQ ID NO: 353331 - DNA, 20 bp, Artificial
  CRISPR gRNA sequence
ctggacagactctgggacag

SEQ ID NO: 353332 - DNA, 20 bp, Artificial
  CRISPR gRNA sequence
gacagactctgggacaggct

SEQ ID NO: 353333 - DNA, 20 bp, Artificial
  CRISPR gRNA sequence
tgggacaggctctgtggcag

SEQ ID NO: 353334 - DNA, 20 bp, Artificial
  CRISPR gRNA sequence
ggacaggctctgtggcagca

SEQ ID NO: 353335 - DNA, 20 bp, Artificial
  CRISPR gRNA sequence
tgtggcagcaacatatatgg

SEQ ID NO: 353336 - DNA, 20 bp, Artificial
  CRISPR gRNA sequence
tggcagcaacatatatggtg

SEQ ID NO: 353337 - DNA, 20 bp, Artificial
  CRISPR gRNA sequence
agctgggaaggagtcaagtt

SEQ ID NO: 353338 - DNA, 20 bp, Artificial
  CRISPR gRNA sequence
ggaaggagtcaagtttcttc

SEQ ID NO: 353339 - DNA, 20 bp, Artificial
  CRISPR gRNA sequence
cttctgaagaggacctggtt

SEQ ID NO: 353340 - DNA, 20 bp, Artificial
  CRISPR gRNA sequence
ttctgaagaggacctggttt

SEQ ID NO: 353341 - DNA, 20 bp, Artificial
  CRISPR gRNA sequence
ctgaagaggacctggtttct

SEQ ID NO: 353342 - DNA, 20 bp, Artificial
  CRISPR gRNA sequence
tgaagaggacctggtttctg

SEQ ID NO: 353343 - DNA, 20 bp, Artificial
  CRISPR gRNA sequence
aagaggacctggtttctgga

SEQ ID NO: 353344 - DNA, 20 bp, Artificial
  CRISPR gRNA sequence
gtttctggacttgggcatag

SEQ ID NO: 353345 - DNA, 20 bp, Artificial
  CRISPR gRNA sequence
ctggacttgggcatagatcg

SEQ ID NO: 353346 - DNA, 20 bp, Artificial
  CRISPR gRNA sequence
tggacttgggcatagatcgt

SEQ ID NO: 353347 - DNA, 20 bp, Artificial
  CRISPR gRNA sequence
gacttgggcatagatcgtaa

SEQ ID NO: 353348 - DNA, 20 bp, Artificial
  CRISPR gRNA sequence
gggcatagatcgtaaggctt

SEQ ID NO: 353349 - DNA, 20 bp, Artificial
  CRISPR gRNA sequence
ggcatagatcgtaaggcttt

SEQ ID NO: 353350 - DNA, 20 bp, Artificial
  CRISPR gRNA sequence
tttttttccactgttgtctg

SEQ ID NO: 353351 - DNA, 20 bp, Artificial
  CRISPR gRNA sequence
ttttttccactgttgtctgg

SEQ ID NO: 353352 - DNA, 20 bp, Artificial
  CRISPR gRNA sequence
tttttccactgttgtctggt

SEQ ID NO: 353353 - DNA, 20 bp, Artificial
  CRISPR gRNA sequence
ttttccactgttgtctggta

SEQ ID NO: 353354 - DNA, 20 bp, Artificial
  CRISPR gRNA sequence
tttccactgttgtctggtaa

SEQ ID NO: 353355 - DNA, 20 bp, Artificial
  CRISPR gRNA sequence
ttccactgttgtctggtaat

SEQ ID NO: 353356 - DNA, 20 bp, Artificial
  CRISPR gRNA sequence
tccactgttgtctggtaatg

SEQ ID NO: 353357 - DNA, 20 bp, Artificial
  CRISPR gRNA sequence
ccactgttgtctggtaatgg

SEQ ID NO: 353358 - DNA, 20 bp, Artificial
  CRISPR gRNA sequence
cactgttgtctggtaatggt

SEQ ID NO: 353359 - DNA, 20 bp, Artificial
  CRISPR gRNA sequence
ttgtctggtaatggttcgtt

SEQ ID NO: 353360 - DNA, 20 bp, Artificial
  CRISPR gRNA sequence
tctggtaatggttcgtttta

SEQ ID NO: 353361 - DNA, 20 bp, Artificial
  CRISPR gRNA sequence
gtaatggttcgttttacctc

SEQ ID NO: 353362 - DNA, 20 bp, Artificial
  CRISPR gRNA sequence
gttttacctcttcttctcaa

SEQ ID NO: 353363 - DNA, 20 bp, Artificial
  CRISPR gRNA sequence
tacctcttcttctcaactgt

SEQ ID NO: 353364 - DNA, 20 bp, Artificial
  CRISPR gRNA sequence
acctcttcttctcaactgta

SEQ ID NO: 353365 - DNA, 20 bp, Artificial
  CRISPR gRNA sequence
cctcttcttctcaactgtag

SEQ ID NO: 353366 - DNA, 20 bp, Artificial
  CRISPR gRNA sequence
ttcttctcaactgtagtatt

SEQ ID NO: 353367 - DNA, 20 bp, Artificial
  CRISPR gRNA sequence
cttctcaactgtagtattac

SEQ ID NO: 353368 - DNA, 20 bp, Artificial
  CRISPR gRNA sequence
ttctcaactgtagtattacc

SEQ ID NO: 353369 - DNA, 20 bp, Artificial
  CRISPR gRNA sequence
ctcaactgtagtattaccac

SEQ ID NO: 353370 - DNA, 20 bp, Artificial
  CRISPR gRNA sequence
tcaactgtagtattaccacc

SEQ ID NO: 353371 - DNA, 20 bp, Artificial
  CRISPR gRNA sequence
aactgtagtattaccaccat

SEQ ID NO: 353372 - DNA, 20 bp, Artificial
  CRISPR gRNA sequence
tagtattaccaccatgatga

SEQ ID NO: 353373 - DNA, 20 bp, Artificial
  CRISPR gRNA sequence
ccaccatgatgagaatcatg

SEQ ID NO: 353374 - DNA, 20 bp, Artificial
  CRISPR gRNA sequence
acagcccagcatacactgcc

SEQ ID NO: 353375 - DNA, 20 bp, Artificial
  CRISPR gRNA sequence
cccatggttttgtttctgag

SEQ ID NO: 353376 - DNA, 20 bp, Artificial
  CRISPR gRNA sequence
tgtttctgaggggtctgtcc

SEQ ID NO: 353377 - DNA, 20 bp, Artificial
  CRISPR gRNA sequence
gtttctgaggggtctgtcct

SEQ ID NO: 353378 - DNA, 20 bp, Artificial
  CRISPR gRNA sequence
tttctgaggggtctgtcctg

SEQ ID NO: 353379 - DNA, 20 bp, Artificial
  CRISPR gRNA sequence
ctgaggggtctgtcctgcat

SEQ ID NO: 353380 - DNA, 20 bp, Artificial
  CRISPR gRNA sequence
tgaggggtctgtcctgcatc

SEQ ID NO: 353381 - DNA, 20 bp, Artificial
  CRISPR gRNA sequence
aggggtctgtcctgcatccg

SEQ ID NO: 353382 - DNA, 20 bp, Artificial
  CRISPR gRNA sequence
tcctgcatccgggccacggg

SEQ ID NO: 353383 - DNA, 20 bp, Artificial
  CRISPR gRNA sequence
catccgggccacgggctgaa

SEQ ID NO: 353384 - DNA, 20 bp, Artificial
  CRISPR gRNA sequence
aaggtctgggaattgttgct

SEQ ID NO: 353385 - DNA, 20 bp, Artificial
  CRISPR gRNA sequence
ggaattgttgctgatagggt

SEQ ID NO: 353386 - DNA, 20 bp, Artificial
  CRISPR gRNA sequence
ttgctgatagggttgctcac

SEQ ID NO: 353387 - DNA, 20 bp, Artificial
  CRISPR gRNA sequence
ctgatagggttgctcacggt

SEQ ID NO: 353388 - DNA, 20 bp, Artificial
  CRISPR gRNA sequence
atagggttgctcacggtgca

SEQ ID NO: 353389 - DNA, 20 bp, Artificial
  CRISPR gRNA sequence
ctcacggtgcagatgtagat

SEQ ID NO: 353390 - DNA, 20 bp, Artificial
  CRISPR gRNA sequence
acggtgcagatgtagatatt

SEQ ID NO: 353391 - DNA, 20 bp, Artificial
  CRISPR gRNA sequence
tcagcatgctgggggccgag

SEQ ID NO: 353392 - DNA, 20 bp, Artificial
  CRISPR gRNA sequence
ggggccgagggtgagggaca

SEQ ID NO: 353393 - DNA, 20 bp, Artificial
  CRISPR gRNA sequence
ttggctgggttcagtgggtg

SEQ ID NO: 353394 - DNA, 20 bp, Artificial
  CRISPR gRNA sequence
gctgggttcagtgggtgggt

SEQ ID NO: 353395 - DNA, 20 bp, Artificial
  CRISPR gRNA sequence
ggttcagtgggtgggtgccc

SEQ ID NO: 353396 - DNA, 20 bp, Artificial
  CRISPR gRNA sequence
agtgggtgggtgcccgcctt

SEQ ID NO: 353397 - DNA, 20 bp, Artificial
  CRISPR gRNA sequence
ttcactccagctgtaagcca

SEQ ID NO: 353398 - DNA, 20 bp, Artificial
  CRISPR gRNA sequence
tcactccagctgtaagccac

SEQ ID NO: 353399 - DNA, 20 bp, Artificial
  CRISPR gRNA sequence
cactccagctgtaagccaca

SEQ ID NO: 353400 - DNA, 20 bp, Artificial
  CRISPR gRNA sequence
actccagctgtaagccacat

SEQ ID NO: 353401 - DNA, 20 bp, Artificial
  CRISPR gRNA sequence
cagctgtaagccacatggtc

SEQ ID NO: 353402 - DNA, 20 bp, Artificial
  CRISPR gRNA sequence
taagccacatggtccccctt

SEQ ID NO: 353403 - DNA, 20 bp, Artificial
  CRISPR gRNA sequence
ctccactgtgcagcccagta

SEQ ID NO: 353404 - DNA, 20 bp, Artificial
  CRISPR gRNA sequence
tccactgtgcagcccagtat

SEQ ID NO: 353405 - DNA, 20 bp, Artificial
  CRISPR gRNA sequence
cactgtgcagcccagtatca

SEQ ID NO: 353406 - DNA, 20 bp, Artificial
  CRISPR gRNA sequence
tgcagcccagtatcaaggtg

SEQ ID NO: 353407 - DNA, 20 bp, Artificial
  CRISPR gRNA sequence
tcctgggtcttgtttaaaac

SEQ ID NO: 353408 - DNA, 20 bp, Artificial
  CRISPR gRNA sequence
ctgggtcttgtttaaaactt

SEQ ID NO: 353409 - DNA, 20 bp, Artificial
  CRISPR gRNA sequence
ggtcttgtttaaaactttaa

SEQ ID NO: 353410 - DNA, 20 bp, Artificial
  CRISPR gRNA sequence
gtttaaaactttaatttctg

SEQ ID NO: 353411 - DNA, 20 bp, Artificial
  CRISPR gRNA sequence
tttaaaactttaatttctgg

SEQ ID NO: 353412 - DNA, 20 bp, Artificial
  CRISPR gRNA sequence
aaaactttaatttctggagt

SEQ ID NO: 353413 - DNA, 20 bp, Artificial
  CRISPR gRNA sequence
aaactttaatttctggagtg

SEQ ID NO: 353414 - DNA, 20 bp, Artificial
  CRISPR gRNA sequence
taatttctggagtggagacc

SEQ ID NO: 353415 - DNA, 20 bp, Artificial
  CRISPR gRNA sequence
aatttctggagtggagacca

SEQ ID NO: 353416 - DNA, 20 bp, Artificial
  CRISPR gRNA sequence
atttctggagtggagaccat

SEQ ID NO: 353417 - DNA, 20 bp, Artificial
  CRISPR gRNA sequence
ctggagtggagaccataaag

SEQ ID NO: 353418 - DNA, 20 bp, Artificial
  CRISPR gRNA sequence
tggagtggagaccataaagc

SEQ ID NO: 353419 - DNA, 20 bp, Artificial
  CRISPR gRNA sequence
gagtggagaccataaagcct

SEQ ID NO: 353420 - DNA, 20 bp, Artificial
  CRISPR gRNA sequence
aactgcaggcaaaagcgctg

SEQ ID NO: 353421 - DNA, 20 bp, Artificial
  CRISPR gRNA sequence
caggcaaaagcgctgaactg

SEQ ID NO: 353422 - DNA, 20 bp, Artificial
  CRISPR gRNA sequence
aactgaaacatttttctcca

SEQ ID NO: 353423 - DNA, 20 bp, Artificial
  CRISPR gRNA sequence
aaacatttttctccagggtc

SEQ ID NO: 353424 - DNA, 20 bp, Artificial
  CRISPR gRNA sequence
ttctccagggtcataaggta

SEQ ID NO: 353425 - DNA, 20 bp, Artificial
  CRISPR gRNA sequence
tctccagggtcataaggtac

SEQ ID NO: 353426 - DNA, 20 bp, Artificial
  CRISPR gRNA sequence
ctccagggtcataaggtacc

SEQ ID NO: 353427 - DNA, 20 bp, Artificial
  CRISPR gRNA sequence
tccagggtcataaggtacca

SEQ ID NO: 353428 - DNA, 20 bp, Artificial
  CRISPR gRNA sequence
cagggtcataaggtaccatc

SEQ ID NO: 353429 - DNA, 20 bp, Artificial
  CRISPR gRNA sequence
atcctccttcctgctttccc

SEQ ID NO: 353430 - DNA, 20 bp, Artificial
  CRISPR gRNA sequence
cttcctgctttcccgtatcc

SEQ ID NO: 353431 - DNA, 20 bp, Artificial
  CRISPR gRNA sequence
cctgctttcccgtatcccca

SEQ ID NO: 353432 - DNA, 20 bp, Artificial
  CRISPR gRNA sequence
ctgctttcccgtatccccag

SEQ ID NO: 353433 - DNA, 20 bp, Artificial
  CRISPR gRNA sequence
ctttcccgtatccccagggt

SEQ ID NO: 353434 - DNA, 20 bp, Artificial
  CRISPR gRNA sequence
tcccgtatccccagggtgag

SEQ ID NO: 353435 - DNA, 20 bp, Artificial
  CRISPR gRNA sequence
cccgtatccccagggtgaga

SEQ ID NO: 353436 - DNA, 20 bp, Artificial
  CRISPR gRNA sequence
ccgtatccccagggtgagat

SEQ ID NO: 353437 - DNA, 20 bp, Artificial
  CRISPR gRNA sequence
tccagataaaacttgtagcg

SEQ ID NO: 353438 - DNA, 20 bp, Artificial
  CRISPR gRNA sequence
cagataaaacttgtagcgat

SEQ ID NO: 353439 - DNA, 20 bp, Artificial
  CRISPR gRNA sequence
gtagcgatctcctagataac

SEQ ID NO: 353440 - DNA, 20 bp, Artificial
  CRISPR gRNA sequence
tagcgatctcctagataacg

SEQ ID NO: 353441 - DNA, 20 bp, Artificial
  CRISPR gRNA sequence
ctagataacgtggagggcct

SEQ ID NO: 353442 - DNA, 20 bp, Artificial
  CRISPR gRNA sequence
gataacgtggagggcctgct

SEQ ID NO: 353443 - DNA, 20 bp, Artificial
  CRISPR gRNA sequence
cttcggatggatcaagagac

SEQ ID NO: 353444 - DNA, 20 bp, Artificial
  CRISPR gRNA sequence
cggatggatcaagagacact

SEQ ID NO: 353445 - DNA, 20 bp, Artificial
  CRISPR gRNA sequence
ggatggatcaagagacacta

SEQ ID NO: 353446 - DNA, 20 bp, Artificial
  CRISPR gRNA sequence
ttttgttctcgacactgttc

SEQ ID NO: 353447 - DNA, 20 bp, Artificial
  CRISPR gRNA sequence
tgttctcgacactgttctcc

SEQ ID NO: 353448 - DNA, 20 bp, Artificial
  CRISPR gRNA sequence
gttctcgacactgttctcca

SEQ ID NO: 353449 - DNA, 20 bp, Artificial
  CRISPR gRNA sequence
ttctcgacactgttctccag

SEQ ID NO: 353450 - DNA, 20 bp, Artificial
  CRISPR gRNA sequence
tcgacactgttctccagtga

SEQ ID NO: 353451 - DNA, 20 bp, Artificial
  CRISPR gRNA sequence
gacactgttctccagtgatt

SEQ ID NO: 353452 - DNA, 20 bp, Artificial
  CRISPR gRNA sequence
ttctccagtgattttgccat

SEQ ID NO: 353453 - DNA, 20 bp, Artificial
  CRISPR gRNA sequence
tccagtgattttgccattgt

SEQ ID NO: 353454 - DNA, 20 bp, Artificial
  CRISPR gRNA sequence
cagtgattttgccattgtga

SEQ ID NO: 353455 - DNA, 20 bp, Artificial
  CRISPR gRNA sequence
tgccattgtgacgacaatgt

SEQ ID NO: 353456 - DNA, 20 bp, Artificial
  CRISPR gRNA sequence
gccattgtgacgacaatgtg

SEQ ID NO: 353457 - DNA, 20 bp, Artificial
  CRISPR gRNA sequence
ccattgtgacgacaatgtgg

SEQ ID NO: 353458 - DNA, 20 bp, Artificial
  CRISPR gRNA sequence
tgacgacaatgtggatgctt

SEQ ID NO: 353459 - DNA, 20 bp, Artificial
  CRISPR gRNA sequence
ttgttcatgctcttatttat

SEQ ID NO: 353460 - DNA, 20 bp, Artificial
  CRISPR gRNA sequence
tgttcatgctcttatttatc

SEQ ID NO: 353461 - DNA, 20 bp, Artificial
  CRISPR gRNA sequence
gttcatgctcttatttatcc

SEQ ID NO: 353462 - DNA, 20 bp, Artificial
  CRISPR gRNA sequence
ttcatgctcttatttatcct

SEQ ID NO: 353463 - DNA, 20 bp, Artificial
  CRISPR gRNA sequence
atgctcttatttatcctttc

SEQ ID NO: 353464 - DNA, 20 bp, Artificial
  CRISPR gRNA sequence
ttatttatcctttcatatgt

SEQ ID NO: 353465 - DNA, 20 bp, Artificial
  CRISPR gRNA sequence
atttatcctttcatatgtca

SEQ ID NO: 353466 - DNA, 20 bp, Artificial
  CRISPR gRNA sequence
tttatcctttcatatgtcag

SEQ ID NO: 353467 - DNA, 20 bp, Artificial
  CRISPR gRNA sequence
atcctttcatatgtcagggg

SEQ ID NO: 353468 - DNA, 20 bp, Artificial
  CRISPR gRNA sequence
tcctttcatatgtcaggggc

SEQ ID NO: 353469 - DNA, 20 bp, Artificial
  CRISPR gRNA sequence
tcatatgtcaggggcagcag

SEQ ID NO: 353470 - DNA, 20 bp, Artificial
  CRISPR gRNA sequence
catatgtcaggggcagcagc

SEQ ID NO: 353471 - DNA, 20 bp, Artificial
  CRISPR gRNA sequence
atatgtcaggggcagcagca

SEQ ID NO: 353472 - DNA, 20 bp, Artificial
  CRISPR gRNA sequence
tgcttcccaactgccggaga

SEQ ID NO: 353473 - DNA, 20 bp, Artificial
  CRISPR gRNA sequence
gcttcccaactgccggagaa

SEQ ID NO: 353474 - DNA, 20 bp, Artificial
  CRISPR gRNA sequence
cttcccaactgccggagaat

SEQ ID NO: 353475 - DNA, 20 bp, Artificial
  CRISPR gRNA sequence
cccaactgccggagaatctt

SEQ ID NO: 353476 - DNA, 20 bp, Artificial
  CRISPR gRNA sequence
ccaactgccggagaatcttt

SEQ ID NO: 353477 - DNA, 20 bp, Artificial
  CRISPR gRNA sequence
ccggagaatctttgggcagt

SEQ ID NO: 353478 - DNA, 20 bp, Artificial
  CRISPR gRNA sequence
tgggcagttcatcatgcgcc

SEQ ID NO: 353479 - DNA, 20 bp, Artificial
  CRISPR gRNA sequence
gggcagttcatcatgcgccc

SEQ ID NO: 353480 - DNA, 20 bp, Artificial
  CRISPR gRNA sequence
ggcagttcatcatgcgccca

SEQ ID NO: 353481 - DNA, 20 bp, Artificial
  CRISPR gRNA sequence
atcatgcgcccacctgttcc

SEQ ID NO: 353482 - DNA, 20 bp, Artificial
  CRISPR gRNA sequence
ttccgtagcttgccccaaaa

SEQ ID NO: 353483 - DNA, 20 bp, Artificial
  CRISPR gRNA sequence
cgtagcttgccccaaaagcc

SEQ ID NO: 353484 - DNA, 20 bp, Artificial
  CRISPR gRNA sequence
gccccaaaagccagggagag

SEQ ID NO: 353485 - DNA, 20 bp, Artificial
  CRISPR gRNA sequence
ccccaaaagccagggagaga

SEQ ID NO: 353486 - DNA, 20 bp, Artificial
  CRISPR gRNA sequence
gggatccatcagccaatgag

SEQ ID NO: 353487 - DNA, 20 bp, Artificial
  CRISPR gRNA sequence
ggatccatcagccaatgagg

SEQ ID NO: 353488 - DNA, 20 bp, Artificial
  CRISPR gRNA sequence
gccggagcctggcagctgct

SEQ ID NO: 353489 - DNA, 20 bp, Artificial
  CRISPR gRNA sequence
gcagctgctcacagatgcca

SEQ ID NO: 353490 - DNA, 20 bp, Artificial
  CRISPR gRNA sequence
ctcacagatgccaggcagaa

SEQ ID NO: 353491 - DNA, 20 bp, Artificial
  CRISPR gRNA sequence
acagatgccaggcagaagca

SEQ ID NO: 353492 - DNA, 20 bp, Artificial
  CRISPR gRNA sequence
cgtgtcatgcagcagaggct

SEQ ID NO: 353493 - DNA, 20 bp, Artificial
  CRISPR gRNA sequence
gtgtcatgcagcagaggctg

SEQ ID NO: 353494 - DNA, 20 bp, Artificial
  CRISPR gRNA sequence
tctgatttatgtatcaggaa

SEQ ID NO: 353495 - DNA, 20 bp, Artificial
  CRISPR gRNA sequence
atttatgtatcaggaaccag

SEQ ID NO: 353496 - DNA, 20 bp, Artificial
  CRISPR gRNA sequence
atgtatcaggaaccagcagg

SEQ ID NO: 353497 - DNA, 20 bp, Artificial
  CRISPR gRNA sequence
tgtatcaggaaccagcaggt

SEQ ID NO: 353498 - DNA, 20 bp, Artificial
  CRISPR gRNA sequence
ctgaacccgcttcctgtatc

SEQ ID NO: 353499 - DNA, 20 bp, Artificial
  CRISPR gRNA sequence
aacccgcttcctgtatcact

SEQ ID NO: 353500 - DNA, 20 bp, Artificial
  CRISPR gRNA sequence
cctgtatcactgggactttt

SEQ ID NO: 353501 - DNA, 20 bp, Artificial
  CRISPR gRNA sequence
ctgtatcactgggacttttt

SEQ ID NO: 353502 - DNA, 20 bp, Artificial
  CRISPR gRNA sequence
tatcactgggactttttctg

SEQ ID NO: 353503 - DNA, 20 bp, Artificial
  CRISPR gRNA sequence
ggactttttctgcttgtgtc

SEQ ID NO: 353504 - DNA, 20 bp, Artificial
  CRISPR gRNA sequence
tttctgcttgtgtcttgagg

SEQ ID NO: 353505 - DNA, 20 bp, Artificial
  CRISPR gRNA sequence
ttctgcttgtgtcttgagga

SEQ ID NO: 353506 - DNA, 20 bp, Artificial
  CRISPR gRNA sequence
tctgcttgtgtcttgaggat

SEQ ID NO: 353507 - DNA, 20 bp, Artificial
  CRISPR gRNA sequence
ctgcttgtgtcttgaggatt

SEQ ID NO: 353508 - DNA, 20 bp, Artificial
  CRISPR gRNA sequence
tgcttgtgtcttgaggattg

SEQ ID NO: 353509 - DNA, 20 bp, Artificial
  CRISPR gRNA sequence
cttgtgtcttgaggattgct

SEQ ID NO: 353510 - DNA, 20 bp, Artificial
  CRISPR gRNA sequence
gtgtcttgaggattgctcat

SEQ ID NO: 353511 - DNA, 20 bp, Artificial
  CRISPR gRNA sequence
tgtcttgaggattgctcatc

SEQ ID NO: 353512 - DNA, 20 bp, Artificial
  CRISPR gRNA sequence
gaggattgctcatctcccat

SEQ ID NO: 353513 - DNA, 20 bp, Artificial
  CRISPR gRNA sequence
aggattgctcatctcccatg

SEQ ID NO: 353514 - DNA, 20 bp, Artificial
  CRISPR gRNA sequence
ctcatctcccatgaggcttt

SEQ ID NO: 353515 - DNA, 20 bp, Artificial
  CRISPR gRNA sequence
atctcccatgaggctttaaa

SEQ ID NO: 353516 - DNA, 20 bp, Artificial
  CRISPR gRNA sequence
ccatgaggctttaaatcact

SEQ ID NO: 353517 - DNA, 20 bp, Artificial
  CRISPR gRNA sequence
taaatcacttttttgttctc

SEQ ID NO: 353518 - DNA, 20 bp, Artificial
  CRISPR gRNA sequence
aaatcacttttttgttctca

SEQ ID NO: 353519 - DNA, 20 bp, Artificial
  CRISPR gRNA sequence
aatcacttttttgttctcaa

SEQ ID NO: 353520 - DNA, 20 bp, Artificial
  CRISPR gRNA sequence
ttttgttctcaagaagcagg

SEQ ID NO: 353521 - DNA, 20 bp, Artificial
  CRISPR gRNA sequence
tttgttctcaagaagcaggc

SEQ ID NO: 353522 - DNA, 20 bp, Artificial
  CRISPR gRNA sequence
ttgttctcaagaagcaggct

SEQ ID NO: 353523 - DNA, 20 bp, Artificial
  CRISPR gRNA sequence
tgttctcaagaagcaggctt

SEQ ID NO: 353524 - DNA, 20 bp, Artificial
  CRISPR gRNA sequence
gttctcaagaagcaggcttc

SEQ ID NO: 353525 - DNA, 20 bp, Artificial
  CRISPR gRNA sequence
ttctcaagaagcaggcttct

SEQ ID NO: 353526 - DNA, 20 bp, Artificial
  CRISPR gRNA sequence
tcaagaagcaggcttctcaa

SEQ ID NO: 353527 - DNA, 20 bp, Artificial
  CRISPR gRNA sequence
aagaagcaggcttctcaaga

SEQ ID NO: 353528 - DNA, 20 bp, Artificial
  CRISPR gRNA sequence
ctcaagaagccaggcactta

SEQ ID NO: 353529 - DNA, 20 bp, Artificial
  CRISPR gRNA sequence
tcaagaagccaggcacttag

SEQ ID NO: 353530 - DNA, 20 bp, Artificial
  CRISPR gRNA sequence
aagaagccaggcacttagcc

SEQ ID NO: 353531 - DNA, 20 bp, Artificial
  CRISPR gRNA sequence
agcctatgggagccaggaaa

SEQ ID NO: 353532 - DNA, 20 bp, Artificial
  CRISPR gRNA sequence
gcctatgggagccaggaaag

SEQ ID NO: 353533 - DNA, 20 bp, Artificial
  CRISPR gRNA sequence
tgggagccaggaaagggggt

SEQ ID NO: 353534 - DNA, 20 bp, Artificial
  CRISPR gRNA sequence
ggccaaaacccggctttggg

SEQ ID NO: 353535 - DNA, 20 bp, Artificial
  CRISPR gRNA sequence
tgggcagaaacatgcgcccc

SEQ ID NO: 353536 - DNA, 20 bp, Artificial
  CRISPR gRNA sequence
gggcagaaacatgcgcccca

SEQ ID NO: 353537 - DNA, 20 bp, Artificial
  CRISPR gRNA sequence
ggcagaaacatgcgccccag

SEQ ID NO: 353538 - DNA, 20 bp, Artificial
  CRISPR gRNA sequence
ctttccttagctgtctccag

SEQ ID NO: 353539 - DNA, 20 bp, Artificial
  CRISPR gRNA sequence
tttccttagctgtctccagg

SEQ ID NO: 353540 - DNA, 20 bp, Artificial
  CRISPR gRNA sequence
tccttagctgtctccaggaa

SEQ ID NO: 353541 - DNA, 20 bp, Artificial
  CRISPR gRNA sequence
ccttagctgtctccaggaac

SEQ ID NO: 353542 - DNA, 20 bp, Artificial
  CRISPR gRNA sequence
cttagctgtctccaggaacc

SEQ ID NO: 353543 - DNA, 20 bp, Artificial
  CRISPR gRNA sequence
agctgtctccaggaaccgga

SEQ ID NO: 353544 - DNA, 20 bp, Artificial
  CRISPR gRNA sequence
gctgtctccaggaaccggat

SEQ ID NO: 353545 - DNA, 20 bp, Artificial
  CRISPR gRNA sequence
tctccaggaaccggatgttg

SEQ ID NO: 353546 - DNA, 20 bp, Artificial
  CRISPR gRNA sequence
caggaaccggatgttgcaga

SEQ ID NO: 353547 - DNA, 20 bp, Artificial
  CRISPR gRNA sequence
cagattctctgagcagttct

SEQ ID NO: 353548 - DNA, 20 bp, Artificial
  CRISPR gRNA sequence
tctgagcagttctctccggt

SEQ ID NO: 353549 - DNA, 20 bp, Artificial
  CRISPR gRNA sequence
tgagcagttctctccggtaa

SEQ ID NO: 353550 - DNA, 20 bp, Artificial
  CRISPR gRNA sequence
agcagttctctccggtaagt

SEQ ID NO: 353551 - DNA, 20 bp, Artificial
  CRISPR gRNA sequence
tctccggtaagtcttcttgg

SEQ ID NO: 353552 - DNA, 20 bp, Artificial
  CRISPR gRNA sequence
tccggtaagtcttcttggat

SEQ ID NO: 353553 - DNA, 20 bp, Artificial
  CRISPR gRNA sequence
cggtaagtcttcttggattg

SEQ ID NO: 353554 - DNA, 20 bp, Artificial
  CRISPR gRNA sequence
cttggattgcaaagaaaaga

SEQ ID NO: 353555 - DNA, 20 bp, Artificial
  CRISPR gRNA sequence
ttggattgcaaagaaaagat

SEQ ID NO: 353556 - DNA, 20 bp, Artificial
  CRISPR gRNA sequence
ggattgcaaagaaaagatgt

SEQ ID NO: 353557 - DNA, 20 bp, Artificial
  CRISPR gRNA sequence
gattgcaaagaaaagatgtt

SEQ ID NO: 353558 - DNA, 20 bp, Artificial
  CRISPR gRNA sequence
caaagaaaagatgtttcatt

SEQ ID NO: 353559 - DNA, 20 bp, Artificial
  CRISPR gRNA sequence
cattggatcactcctcaaat

SEQ ID NO: 353560 - DNA, 20 bp, Artificial
  CRISPR gRNA sequence
attggatcactcctcaaatt

SEQ ID NO: 353561 - DNA, 20 bp, Artificial
  CRISPR gRNA sequence
gatcactcctcaaatttggc

SEQ ID NO: 353562 - DNA, 20 bp, Artificial
  CRISPR gRNA sequence
ctcaaatttggcagttcaca

SEQ ID NO: 353563 - DNA, 20 bp, Artificial
  CRISPR gRNA sequence
aaatttggcagttcacagct

SEQ ID NO: 353564 - DNA, 20 bp, Artificial
  CRISPR gRNA sequence
ggcagttcacagctgaactt

SEQ ID NO: 353565 - DNA, 20 bp, Artificial
  CRISPR gRNA sequence
gcagttcacagctgaactta

SEQ ID NO: 353566 - DNA, 20 bp, Artificial
  CRISPR gRNA sequence
acagctgaacttagataact

SEQ ID NO: 353567 - DNA, 20 bp, Artificial
  CRISPR gRNA sequence
aacttagataactgcatttt

SEQ ID NO: 353568 - DNA, 20 bp, Artificial
  CRISPR gRNA sequence
agataactgcattttgatga

SEQ ID NO: 353569 - DNA, 20 bp, Artificial
  CRISPR gRNA sequence
gataactgcattttgatgag

SEQ ID NO: 353570 - DNA, 20 bp, Artificial
  CRISPR gRNA sequence
cattttgatgagctaataga

SEQ ID NO: 353571 - DNA, 20 bp, Artificial
  CRISPR gRNA sequence
tgatgagctaatagacctct

SEQ ID NO: 353572 - DNA, 20 bp, Artificial
  CRISPR gRNA sequence
gatgagctaatagacctctt

SEQ ID NO: 353573 - DNA, 20 bp, Artificial
  CRISPR gRNA sequence
atgagctaatagacctctta

SEQ ID NO: 353574 - DNA, 20 bp, Artificial
  CRISPR gRNA sequence
atagacctcttacttctgtt

SEQ ID NO: 353575 - DNA, 20 bp, Artificial
  CRISPR gRNA sequence
ttacttctgttttatttcat

SEQ ID NO: 353576 - DNA, 20 bp, Artificial
  CRISPR gRNA sequence
acttctgttttatttcataa

SEQ ID NO: 353577 - DNA, 20 bp, Artificial
  CRISPR gRNA sequence
cttctgttttatttcataat

SEQ ID NO: 353578 - DNA, 20 bp, Artificial
  CRISPR gRNA sequence
ctgttttatttcataatttc

SEQ ID NO: 353579 - DNA, 20 bp, Artificial
  CRISPR gRNA sequence
tgttttatttcataatttca

SEQ ID NO: 353580 - DNA, 20 bp, Artificial
  CRISPR gRNA sequence
ttttatttcataatttcaga

SEQ ID NO: 353581 - DNA, 20 bp, Artificial
  CRISPR gRNA sequence
tatttcataatttcagatga

SEQ ID NO: 353582 - DNA, 20 bp, Artificial
  CRISPR gRNA sequence
atttcataatttcagatgac

SEQ ID NO: 353583 - DNA, 20 bp, Artificial
  CRISPR gRNA sequence
tttcataatttcagatgaca

SEQ ID NO: 353584 - DNA, 20 bp, Artificial
  CRISPR gRNA sequence
cataatttcagatgacacct

SEQ ID NO: 353585 - DNA, 20 bp, Artificial
  CRISPR gRNA sequence
ataatttcagatgacacctc

SEQ ID NO: 353586 - DNA, 20 bp, Artificial
  CRISPR gRNA sequence
cagatgacacctcaacatgc

SEQ ID NO: 353587 - DNA, 20 bp, Artificial
  CRISPR gRNA sequence
agatgacacctcaacatgca

SEQ ID NO: 353588 - DNA, 20 bp, Artificial
  CRISPR gRNA sequence
aacatgcagtctggtgcagg

SEQ ID NO: 353589 - DNA, 20 bp, Artificial
  CRISPR gRNA sequence
gtgcaggtgccactgtcaca

SEQ ID NO: 353590 - DNA, 20 bp, Artificial
  CRISPR gRNA sequence
tcacacagagatgggaaggg

SEQ ID NO: 353591 - DNA, 20 bp, Artificial
  CRISPR gRNA sequence
taggtggaaaaaaagttatg

SEQ ID NO: 353592 - DNA, 20 bp, Artificial
  CRISPR gRNA sequence
aggtggaaaaaaagttatgt

SEQ ID NO: 353593 - DNA, 20 bp, Artificial
  CRISPR gRNA sequence
gtggaaaaaaagttatgtag

SEQ ID NO: 353594 - DNA, 20 bp, Artificial
  CRISPR gRNA sequence
tggaaaaaaagttatgtagg

SEQ ID NO: 353595 - DNA, 20 bp, Artificial
  CRISPR gRNA sequence
ggaaaaaaagttatgtagga

SEQ ID NO: 353596 - DNA, 20 bp, Artificial
  CRISPR gRNA sequence
aaaaagttatgtaggaggga

SEQ ID NO: 353597 - DNA, 20 bp, Artificial
  CRISPR gRNA sequence
gcaaaatcatttttaccatg

SEQ ID NO: 353598 - DNA, 20 bp, Artificial
  CRISPR gRNA sequence
ttttaccatgtagtttaact

SEQ ID NO: 353599 - DNA, 20 bp, Artificial
  CRISPR gRNA sequence
ttaccatgtagtttaactaa

SEQ ID NO: 353600 - DNA, 20 bp, Artificial
  CRISPR gRNA sequence
tgtagtttaactaagagtac

SEQ ID NO: 353601 - DNA, 20 bp, Artificial
  CRISPR gRNA sequence
gtttaactaagagtactggc

SEQ ID NO: 353602 - DNA, 20 bp, Artificial
  CRISPR gRNA sequence
tttaactaagagtactggca

SEQ ID NO: 353603 - DNA, 20 bp, Artificial
  CRISPR gRNA sequence
aagagtactggcaaggtcat

SEQ ID NO: 353604 - DNA, 20 bp, Artificial
  CRISPR gRNA sequence
tttaatacaaatatttctga

SEQ ID NO: 353605 - DNA, 20 bp, Artificial
  CRISPR gRNA sequence
taatacaaatatttctgaaa

SEQ ID NO: 353606 - DNA, 20 bp, Artificial
  CRISPR gRNA sequence
aatatttctgaaagagacat

SEQ ID NO: 353607 - DNA, 20 bp, Artificial
  CRISPR gRNA sequence
atttctgaaagagacatgag

SEQ ID NO: 353608 - DNA, 20 bp, Artificial
  CRISPR gRNA sequence
ttctgaaagagacatgagaa

SEQ ID NO: 353609 - DNA, 20 bp, Artificial
  CRISPR gRNA sequence
catgagaagagtattttatg

SEQ ID NO: 353610 - DNA, 20 bp, Artificial
  CRISPR gRNA sequence
agaagagtattttatgtggt

SEQ ID NO: 353611 - DNA, 20 bp, Artificial
  CRISPR gRNA sequence
agtattttatgtggtgagtt

SEQ ID NO: 353612 - DNA, 20 bp, Artificial
  CRISPR gRNA sequence
gtattttatgtggtgagttt

SEQ ID NO: 353613 - DNA, 20 bp, Artificial
  CRISPR gRNA sequence
tattttatgtggtgagtttg

SEQ ID NO: 353614 - DNA, 20 bp, Artificial
  CRISPR gRNA sequence
ttttatgtggtgagtttggg

SEQ ID NO: 353615 - DNA, 20 bp, Artificial
  CRISPR gRNA sequence
ttatgtggtgagtttgggga

SEQ ID NO: 353616 - DNA, 20 bp, Artificial
  CRISPR gRNA sequence
gtggtgagtttggggagaga

SEQ ID NO: 353617 - DNA, 20 bp, Artificial
  CRISPR gRNA sequence
atgtctaaaattgaaaaaaa

SEQ ID NO: 353618 - DNA, 20 bp, Artificial
  CRISPR gRNA sequence
aaaattgaaaaaaaaagtat

SEQ ID NO: 353619 - DNA, 20 bp, Artificial
  CRISPR gRNA sequence
aaaaaaagtattagtgtcat

SEQ ID NO: 353620 - DNA, 20 bp, Artificial
  CRISPR gRNA sequence
agtgtcataagcatgctatt

SEQ ID NO: 353621 - DNA, 20 bp, Artificial
  CRISPR gRNA sequence
cataagcatgctattcagaa

SEQ ID NO: 353622 - DNA, 20 bp, Artificial
  CRISPR gRNA sequence
gtgaacataaataaaataat

SEQ ID NO: 353623 - DNA, 20 bp, Artificial
  CRISPR gRNA sequence
acataaataaaataatgagt

SEQ ID NO: 353624 - DNA, 20 bp, Artificial
  CRISPR gRNA sequence
taaataaaataatgagttag

SEQ ID NO: 353625 - DNA, 20 bp, Artificial
  CRISPR gRNA sequence
ataaaataatgagttagaag

SEQ ID NO: 353626 - DNA, 20 bp, Artificial
  CRISPR gRNA sequence
gtagtaaaatttgttgtctc

SEQ ID NO: 353627 - DNA, 20 bp, Artificial
  CRISPR gRNA sequence
tagtaaaatttgttgtctca

SEQ ID NO: 353628 - DNA, 20 bp, Artificial
  CRISPR gRNA sequence
tgtctcaaggtaacaaaaat

SEQ ID NO: 353629 - DNA, 20 bp, Artificial
  CRISPR gRNA sequence
gtctcaaggtaacaaaaatg

SEQ ID NO: 353630 - DNA, 20 bp, Artificial
  CRISPR gRNA sequence
tcaaggtaacaaaaatgagg

SEQ ID NO: 353631 - DNA, 20 bp, Artificial
  CRISPR gRNA sequence
caaggtaacaaaaatgagga

SEQ ID NO: 353632 - DNA, 20 bp, Artificial
  CRISPR gRNA sequence
aaggtaacaaaaatgaggaa

SEQ ID NO: 353633 - DNA, 20 bp, Artificial
  CRISPR gRNA sequence
taacaaaaatgaggaagggc

SEQ ID NO: 353634 - DNA, 20 bp, Artificial
  CRISPR gRNA sequence
aacaaaaatgaggaagggca

SEQ ID NO: 353635 - DNA, 20 bp, Artificial
  CRISPR gRNA sequence
acaaaaatgaggaagggcaa

SEQ ID NO: 353636 - DNA, 20 bp, Artificial
  CRISPR gRNA sequence
ggcaagggactactatgttt

SEQ ID NO: 353637 - DNA, 20 bp, Artificial
  CRISPR gRNA sequence
gcaagggactactatgtttc

SEQ ID NO: 353638 - DNA, 20 bp, Artificial
  CRISPR gRNA sequence
aaacaaacaaaaaacctgta

SEQ ID NO: 353639 - DNA, 20 bp, Artificial
  CRISPR gRNA sequence
acatgcacttataaaataca

SEQ ID NO: 353640 - DNA, 20 bp, Artificial
  CRISPR gRNA sequence
acttataaaatacaaagaac

SEQ ID NO: 353641 - DNA, 20 bp, Artificial
  CRISPR gRNA sequence
cttataaaatacaaagaaca

SEQ ID NO: 353642 - DNA, 20 bp, Artificial
  CRISPR gRNA sequence
taaaatacaaagaacaaggc

SEQ ID NO: 353643 - DNA, 20 bp, Artificial
  CRISPR gRNA sequence
aaaatacaaagaacaaggcc

SEQ ID NO: 353644 - DNA, 20 bp, Artificial
  CRISPR gRNA sequence
aatacaaagaacaaggccag

SEQ ID NO: 353645 - DNA, 20 bp, Artificial
  CRISPR gRNA sequence
acaaagaacaaggccaggag

SEQ ID NO: 353646 - DNA, 20 bp, Artificial
  CRISPR gRNA sequence
gtcgctcatgcctgtaatcc

SEQ ID NO: 353647 - DNA, 20 bp, Artificial
  CRISPR gRNA sequence
tgcctgtaatcccagcaatt

SEQ ID NO: 353648 - DNA, 20 bp, Artificial
  CRISPR gRNA sequence
gcctgtaatcccagcaattt

SEQ ID NO: 353649 - DNA, 20 bp, Artificial
  CRISPR gRNA sequence
ctgtaatcccagcaatttag

SEQ ID NO: 353650 - DNA, 20 bp, Artificial
  CRISPR gRNA sequence
tgtaatcccagcaatttagg

SEQ ID NO: 353651 - DNA, 20 bp, Artificial
  CRISPR gRNA sequence
tcccagcaatttaggaggct

SEQ ID NO: 353652 - DNA, 20 bp, Artificial
  CRISPR gRNA sequence
cccagcaatttaggaggctg

SEQ ID NO: 353653 - DNA, 20 bp, Artificial
  CRISPR gRNA sequence
agcaatttaggaggctgagg

SEQ ID NO: 353654 - DNA, 20 bp, Artificial
  CRISPR gRNA sequence
gcaatttaggaggctgaggc

SEQ ID NO: 353655 - DNA, 20 bp, Artificial
  CRISPR gRNA sequence
atttaggaggctgaggcagg

SEQ ID NO: 353656 - DNA, 20 bp, Artificial
  CRISPR gRNA sequence
ctgaggcaggtggatcacct

SEQ ID NO: 353657 - DNA, 20 bp, Artificial
  CRISPR gRNA sequence
tgaggcaggtggatcacctg

SEQ ID NO: 353658 - DNA, 20 bp, Artificial
  CRISPR gRNA sequence
caggtggatcacctgaggtc

SEQ ID NO: 353659 - DNA, 20 bp, Artificial
  CRISPR gRNA sequence
ggtggatcacctgaggtcca

SEQ ID NO: 353660 - DNA, 20 bp, Artificial
  CRISPR gRNA sequence
tcacctgaggtccagagttc

SEQ ID NO: 353661 - DNA, 20 bp, Artificial
  CRISPR gRNA sequence
tgaggtccagagttcaagac

SEQ ID NO: 353662 - DNA, 20 bp, Artificial
  CRISPR gRNA sequence
caagacaagtctgaccaacg

SEQ ID NO: 353663 - DNA, 20 bp, Artificial
  CRISPR gRNA sequence
agacaagtctgaccaacgtg

SEQ ID NO: 353664 - DNA, 20 bp, Artificial
  CRISPR gRNA sequence
ctccactaaaaatacaaaat

SEQ ID NO: 353665 - DNA, 20 bp, Artificial
  CRISPR gRNA sequence
actaaaaatacaaaattagc

SEQ ID NO: 353666 - DNA, 20 bp, Artificial
  CRISPR gRNA sequence
ctaaaaatacaaaattagcc

SEQ ID NO: 353667 - DNA, 20 bp, Artificial
  CRISPR gRNA sequence
acaaaattagccaggcatgt

SEQ ID NO: 353668 - DNA, 20 bp, Artificial
  CRISPR gRNA sequence
ttggcatatgcctgtaatcc

SEQ ID NO: 353669 - DNA, 20 bp, Artificial
  CRISPR gRNA sequence
tgcctgtaatcccagctatt

SEQ ID NO: 353670 - DNA, 20 bp, Artificial
  CRISPR gRNA sequence
gcctgtaatcccagctattc

SEQ ID NO: 353671 - DNA, 20 bp, Artificial
  CRISPR gRNA sequence
ctgtaatcccagctattcag

SEQ ID NO: 353672 - DNA, 20 bp, Artificial
  CRISPR gRNA sequence
tgtaatcccagctattcagg

SEQ ID NO: 353673 - DNA, 20 bp, Artificial
  CRISPR gRNA sequence
tcccagctattcaggaggct

SEQ ID NO: 353674 - DNA, 20 bp, Artificial
  CRISPR gRNA sequence
cccagctattcaggaggctg

SEQ ID NO: 353675 - DNA, 20 bp, Artificial
  CRISPR gRNA sequence
agctattcaggaggctgagg

SEQ ID NO: 353676 - DNA, 20 bp, Artificial
  CRISPR gRNA sequence
gctattcaggaggctgaggc

SEQ ID NO: 353677 - DNA, 20 bp, Artificial
  CRISPR gRNA sequence
tattcaggaggctgaggcag

SEQ ID NO: 353678 - DNA, 20 bp, Artificial
  CRISPR gRNA sequence
gcaggagaatcacttgaatc

SEQ ID NO: 353679 - DNA, 20 bp, Artificial
  CRISPR gRNA sequence
caggagaatcacttgaatcc

SEQ ID NO: 353680 - DNA, 20 bp, Artificial
  CRISPR gRNA sequence
ggagaatcacttgaatccgg

SEQ ID NO: 353681 - DNA, 20 bp, Artificial
  CRISPR gRNA sequence
gagaatcacttgaatccggg

SEQ ID NO: 353682 - DNA, 20 bp, Artificial
  CRISPR gRNA sequence
aatcacttgaatccgggagg

SEQ ID NO: 353683 - DNA, 20 bp, Artificial
  CRISPR gRNA sequence
tcacttgaatccgggaggca

SEQ ID NO: 353684 - DNA, 20 bp, Artificial
  CRISPR gRNA sequence
cacttgaatccgggaggcag

SEQ ID NO: 353685 - DNA, 20 bp, Artificial
  CRISPR gRNA sequence
aatccgggaggcagaggttg

SEQ ID NO: 353686 - DNA, 20 bp, Artificial
  CRISPR gRNA sequence
cgggaggcagaggttgtggt

SEQ ID NO: 353687 - DNA, 20 bp, Artificial
  CRISPR gRNA sequence
ggcagaggttgtggtgagcc

SEQ ID NO: 353688 - DNA, 20 bp, Artificial
  CRISPR gRNA sequence
gagattgtgccattgcactc

SEQ ID NO: 353689 - DNA, 20 bp, Artificial
  CRISPR gRNA sequence
tgtgccattgcactccagcc

SEQ ID NO: 353690 - DNA, 20 bp, Artificial
  CRISPR gRNA sequence
gtgccattgcactccagccc

SEQ ID NO: 353691 - DNA, 20 bp, Artificial
  CRISPR gRNA sequence
cactccagcccgggcaacaa

SEQ ID NO: 353692 - DNA, 20 bp, Artificial
  CRISPR gRNA sequence
taataataaaataaaataca

SEQ ID NO: 353693 - DNA, 20 bp, Artificial
  CRISPR gRNA sequence
aatacaaagaacattgcatt

SEQ ID NO: 353694 - DNA, 20 bp, Artificial
  CRISPR gRNA sequence
tttttctgcatgtaattcat

SEQ ID NO: 353695 - DNA, 20 bp, Artificial
  CRISPR gRNA sequence
catcagttaattttattctg

SEQ ID NO: 353696 - DNA, 20 bp, Artificial
  CRISPR gRNA sequence
ttttccctgctatttctcca

SEQ ID NO: 353697 - DNA, 20 bp, Artificial
  CRISPR gRNA sequence
tatttctccatggcaaatga

SEQ ID NO: 353698 - DNA, 20 bp, Artificial
  CRISPR gRNA sequence
ttctccatggcaaatgaaag

SEQ ID NO: 353699 - DNA, 20 bp, Artificial
  CRISPR gRNA sequence
gttttattcattcaaaacaa

SEQ ID NO: 353700 - DNA, 20 bp, Artificial
  CRISPR gRNA sequence
cattcaaaacaacagaatac

SEQ ID NO: 353701 - DNA, 20 bp, Artificial
  CRISPR gRNA sequence
aaacaacagaatacaagaca

SEQ ID NO: 353702 - DNA, 20 bp, Artificial
  CRISPR gRNA sequence
aacaacagaatacaagacaa

SEQ ID NO: 353703 - DNA, 20 bp, Artificial
  CRISPR gRNA sequence
aaaatatttctataccctac

SEQ ID NO: 353704 - DNA, 20 bp, Artificial
  CRISPR gRNA sequence
tacaagaaccaaaaatccaa

SEQ ID NO: 353705 - DNA, 20 bp, Artificial
  CRISPR gRNA sequence
ccaaaagtacacactaacac

SEQ ID NO: 353706 - DNA, 20 bp, Artificial
  CRISPR gRNA sequence
gtacacactaacactagaaa

SEQ ID NO: 353707 - DNA, 20 bp, Artificial
  CRISPR gRNA sequence
actagaaaaagtgttctgaa

SEQ ID NO: 353708 - DNA, 20 bp, Artificial
  CRISPR gRNA sequence
ctagaaaaagtgttctgaac

SEQ ID NO: 353709 - DNA, 20 bp, Artificial
  CRISPR gRNA sequence
accatataacttattctaac

SEQ ID NO: 353710 - DNA, 20 bp, Artificial
  CRISPR gRNA sequence
ccatataacttattctaaca

SEQ ID NO: 353711 - DNA, 20 bp, Artificial
  CRISPR gRNA sequence
aaggataatacgaaataaac

SEQ ID NO: 353712 - DNA, 20 bp, Artificial
  CRISPR gRNA sequence
gaaataaaccagaattatcc

SEQ ID NO: 353713 - DNA, 20 bp, Artificial
  CRISPR gRNA sequence
ttattactcatacttccaaa

SEQ ID NO: 353714 - DNA, 20 bp, Artificial
  CRISPR gRNA sequence
gaccttttcttacatcttac

SEQ ID NO: 353715 - DNA, 20 bp, Artificial
  CRISPR gRNA sequence
ttttcttacatcttacaaga

SEQ ID NO: 353716 - DNA, 20 bp, Artificial
  CRISPR gRNA sequence
cttacatcttacaagatagt

SEQ ID NO: 353717 - DNA, 20 bp, Artificial
  CRISPR gRNA sequence
gatagttagtgctctgaatc

SEQ ID NO: 353718 - DNA, 20 bp, Artificial
  CRISPR gRNA sequence
aatatgtgtaaaccgacctt

SEQ ID NO: 353719 - DNA, 20 bp, Artificial
  CRISPR gRNA sequence
atatgtgtaaaccgaccttg

SEQ ID NO: 353720 - DNA, 20 bp, Artificial
  CRISPR gRNA sequence
gaggatttataaaatttcct

SEQ ID NO: 353721 - DNA, 20 bp, Artificial
  CRISPR gRNA sequence
atttataaaatttccttaga

SEQ ID NO: 353722 - DNA, 20 bp, Artificial
  CRISPR gRNA sequence
aatttccttagaaagcattg

SEQ ID NO: 353723 - DNA, 20 bp, Artificial
  CRISPR gRNA sequence
gaaagcattgcagttaattc

SEQ ID NO: 353724 - DNA, 20 bp, Artificial
  CRISPR gRNA sequence
agcattgcagttaattctag

SEQ ID NO: 353725 - DNA, 20 bp, Artificial
  CRISPR gRNA sequence
ttttctacctattgaatcac

SEQ ID NO: 353726 - DNA, 20 bp, Artificial
  CRISPR gRNA sequence
acctattgaatcactagaaa

SEQ ID NO: 353727 - DNA, 20 bp, Artificial
  CRISPR gRNA sequence
ctattgaatcactagaaata

SEQ ID NO: 353728 - DNA, 20 bp, Artificial
  CRISPR gRNA sequence
ttgaatcactagaaatagag

SEQ ID NO: 353729 - DNA, 20 bp, Artificial
  CRISPR gRNA sequence
taaaaaaattaacttgtttt

SEQ ID NO: 353730 - DNA, 20 bp, Artificial
  CRISPR gRNA sequence
attaacttgtttttagtttt

SEQ ID NO: 353731 - DNA, 20 bp, Artificial
  CRISPR gRNA sequence
agttttcagatacatgtttt

SEQ ID NO: 353732 - DNA, 20 bp, Artificial
  CRISPR gRNA sequence
ttttcagatacatgttttaa

SEQ ID NO: 353733 - DNA, 20 bp, Artificial
  CRISPR gRNA sequence
agatacatgttttaagagcc

SEQ ID NO: 353734 - DNA, 20 bp, Artificial
  CRISPR gRNA sequence
atacatgttttaagagccca

SEQ ID NO: 353735 - DNA, 20 bp, Artificial
  CRISPR gRNA sequence
gttttaagagcccagagtct

SEQ ID NO: 353736 - DNA, 20 bp, Artificial
  CRISPR gRNA sequence
taagagcccagagtcttggc

SEQ ID NO: 353737 - DNA, 20 bp, Artificial
  CRISPR gRNA sequence
gagcccagagtcttggctgg

SEQ ID NO: 353738 - DNA, 20 bp, Artificial
  CRISPR gRNA sequence
gctggaagaactctaatgaa

SEQ ID NO: 353739 - DNA, 20 bp, Artificial
  CRISPR gRNA sequence
aagaactctaatgaacagat

SEQ ID NO: 353740 - DNA, 20 bp, Artificial
  CRISPR gRNA sequence
agtgaaaaaatatacttata

SEQ ID NO: 353741 - DNA, 20 bp, Artificial
  CRISPR gRNA sequence
gaaaaaatatacttatacag

SEQ ID NO: 353742 - DNA, 20 bp, Artificial
  CRISPR gRNA sequence
tatacttatacagaagtctg

SEQ ID NO: 353743 - DNA, 20 bp, Artificial
  CRISPR gRNA sequence
atacttatacagaagtctga

SEQ ID NO: 353744 - DNA, 20 bp, Artificial
  CRISPR gRNA sequence
cttatacagaagtctgaagg

SEQ ID NO: 353745 - DNA, 20 bp, Artificial
  CRISPR gRNA sequence
tatacagaagtctgaaggtg

SEQ ID NO: 353746 - DNA, 20 bp, Artificial
  CRISPR gRNA sequence
agaagtctgaaggtggagat

SEQ ID NO: 353747 - DNA, 20 bp, Artificial
  CRISPR gRNA sequence
aggtggagatcagtactttc

SEQ ID NO: 353748 - DNA, 20 bp, Artificial
  CRISPR gRNA sequence
ttctagatgttacattttaa

SEQ ID NO: 353749 - DNA, 20 bp, Artificial
  CRISPR gRNA sequence
tagatgttacattttaatag

SEQ ID NO: 353750 - DNA, 20 bp, Artificial
  CRISPR gRNA sequence
atattgtcttatatttttta

SEQ ID NO: 353751 - DNA, 20 bp, Artificial
  CRISPR gRNA sequence
ttcttatcactgttgtgaaa

SEQ ID NO: 353752 - DNA, 20 bp, Artificial
  CRISPR gRNA sequence
gaaactttgtactcacaatt

SEQ ID NO: 353753 - DNA, 20 bp, Artificial
  CRISPR gRNA sequence
cgtctccacttacactttat

SEQ ID NO: 353754 - DNA, 20 bp, Artificial
  CRISPR gRNA sequence
atcttgctgaaatttcatat

SEQ ID NO: 353755 - DNA, 20 bp, Artificial
  CRISPR gRNA sequence
ttgctgaaatttcatataag

SEQ ID NO: 353756 - DNA, 20 bp, Artificial
  CRISPR gRNA sequence
catataagcagtacaaaata

SEQ ID NO: 353757 - DNA, 20 bp, Artificial
  CRISPR gRNA sequence
acagtacatcattataaatc

SEQ ID NO: 353758 - DNA, 20 bp, Artificial
  CRISPR gRNA sequence
cagtacatcattataaatca

SEQ ID NO: 353759 - DNA, 20 bp, Artificial
  CRISPR gRNA sequence
gtacatcattataaatcaag

SEQ ID NO: 353760 - DNA, 20 bp, Artificial
  CRISPR gRNA sequence
catcattataaatcaaggag

SEQ ID NO: 353761 - DNA, 20 bp, Artificial
  CRISPR gRNA sequence
taaatcaaggagaagcattt

SEQ ID NO: 353762 - DNA, 20 bp, Artificial
  CRISPR gRNA sequence
aaggagaagcattttggtca

SEQ ID NO: 353763 - DNA, 20 bp, Artificial
  CRISPR gRNA sequence
agtgatctctaattacaatg

SEQ ID NO: 353764 - DNA, 20 bp, Artificial
  CRISPR gRNA sequence
caatgtggactctctcaatt

SEQ ID NO: 353765 - DNA, 20 bp, Artificial
  CRISPR gRNA sequence
tttagaaaactactgttata

SEQ ID NO: 353766 - DNA, 20 bp, Artificial
  CRISPR gRNA sequence
ctatacaaaccaatataact

SEQ ID NO: 353767 - DNA, 20 bp, Artificial
  CRISPR gRNA sequence
aatccacgaatgcctactaa

SEQ ID NO: 353768 - DNA, 20 bp, Artificial
  CRISPR gRNA sequence
attgataacccatgtatttt

SEQ ID NO: 353769 - DNA, 20 bp, Artificial
  CRISPR gRNA sequence
gtattttaagtttatatata

SEQ ID NO: 353770 - DNA, 20 bp, Artificial
  CRISPR gRNA sequence
agtttatatatatagtattt

SEQ ID NO: 353771 - DNA, 20 bp, Artificial
  CRISPR gRNA sequence
gaattacttaaaacataaat

SEQ ID NO: 353772 - DNA, 20 bp, Artificial
  CRISPR gRNA sequence
attacttaaaacataaattg

SEQ ID NO: 353773 - DNA, 20 bp, Artificial
  CRISPR gRNA sequence
acctacctgcctcccatttt

SEQ ID NO: 353774 - DNA, 20 bp, Artificial
  CRISPR gRNA sequence
cccattttaagcatgattac

SEQ ID NO: 353775 - DNA, 20 bp, Artificial
  CRISPR gRNA sequence
ttctcaacatattataccta

SEQ ID NO: 353776 - DNA, 20 bp, Artificial
  CRISPR gRNA sequence
tacctaaagttctttaaata

SEQ ID NO: 353777 - DNA, 20 bp, Artificial
  CRISPR gRNA sequence
agttctttaaataaagtttg

SEQ ID NO: 353778 - DNA, 20 bp, Artificial
  CRISPR gRNA sequence
gttctttaaataaagtttga

SEQ ID NO: 353779 - DNA, 20 bp, Artificial
  CRISPR gRNA sequence
aggtatctcttataataata

SEQ ID NO: 353780 - DNA, 20 bp, Artificial
  CRISPR gRNA sequence
ataataatatagtcaatgca

SEQ ID NO: 353781 - DNA, 20 bp, Artificial
  CRISPR gRNA sequence
tagtcaatgcatagtcatca

SEQ ID NO: 353782 - DNA, 20 bp, Artificial
  CRISPR gRNA sequence
catagtcatcatagttcaat

SEQ ID NO: 353783 - DNA, 20 bp, Artificial
  CRISPR gRNA sequence
aaactgtgtactccattaac

SEQ ID NO: 353784 - DNA, 20 bp, Artificial
  CRISPR gRNA sequence
cttcctatcttattataaca

SEQ ID NO: 353785 - DNA, 20 bp, Artificial
  CRISPR gRNA sequence
acaaagtaatttcctttcat

SEQ ID NO: 353786 - DNA, 20 bp, Artificial
  CRISPR gRNA sequence
tactttaacataaatattaa

SEQ ID NO: 353787 - DNA, 20 bp, Artificial
  CRISPR gRNA sequence
ataaatattaatggcattca

SEQ ID NO: 353788 - DNA, 20 bp, Artificial
  CRISPR gRNA sequence
taaatattaatggcattcaa

SEQ ID NO: 353789 - DNA, 20 bp, Artificial
  CRISPR gRNA sequence
atattaatggcattcaaagg

SEQ ID NO: 353790 - DNA, 20 bp, Artificial
  CRISPR gRNA sequence
aatggcattcaaaggaagca

SEQ ID NO: 353791 - DNA, 20 bp, Artificial
  CRISPR gRNA sequence
tatatatatatgtaaaactt

SEQ ID NO: 353792 - DNA, 20 bp, Artificial
  CRISPR gRNA sequence
atatatatgtaaaacttaag

SEQ ID NO: 353793 - DNA, 20 bp, Artificial
  CRISPR gRNA sequence
taagaagcattttgcttcca

SEQ ID NO: 353794 - DNA, 20 bp, Artificial
  CRISPR gRNA sequence
gaagcattttgcttccaaag

SEQ ID NO: 353795 - DNA, 20 bp, Artificial
  CRISPR gRNA sequence
ccaaagcagcaacttgtaaa

SEQ ID NO: 353796 - DNA, 20 bp, Artificial
  CRISPR gRNA sequence
aaaagtatctgtatttaaaa

SEQ ID NO: 353797 - DNA, 20 bp, Artificial
  CRISPR gRNA sequence
gtatttaaaatagaatttac

SEQ ID NO: 353798 - DNA, 20 bp, Artificial
  CRISPR gRNA sequence
aattctgatcgtttattctg

SEQ ID NO: 353799 - DNA, 20 bp, Artificial
  CRISPR gRNA sequence
ctgtttttcatctgctttct

SEQ ID NO: 353800 - DNA, 20 bp, Artificial
  CRISPR gRNA sequence
tctgctttcttagtaacaat

SEQ ID NO: 353801 - DNA, 20 bp, Artificial
  CRISPR gRNA sequence
cttagtaacaatcagaatca

SEQ ID NO: 353802 - DNA, 20 bp, Artificial
  CRISPR gRNA sequence
ttagtaacaatcagaatcat

SEQ ID NO: 353803 - DNA, 20 bp, Artificial
  CRISPR gRNA sequence
aatcagaatcataggtgcaa

SEQ ID NO: 353804 - DNA, 20 bp, Artificial
  CRISPR gRNA sequence
tcagaatcataggtgcaaaa

SEQ ID NO: 353805 - DNA, 20 bp, Artificial
  CRISPR gRNA sequence
gaatcataggtgcaaaagag

SEQ ID NO: 353806 - DNA, 20 bp, Artificial
  CRISPR gRNA sequence
atcataggtgcaaaagagta

SEQ ID NO: 353807 - DNA, 20 bp, Artificial
  CRISPR gRNA sequence
tcataggtgcaaaagagtag

SEQ ID NO: 353808 - DNA, 20 bp, Artificial
  CRISPR gRNA sequence
cataggtgcaaaagagtaga

SEQ ID NO: 353809 - DNA, 20 bp, Artificial
  CRISPR gRNA sequence
ataggtgcaaaagagtagag

SEQ ID NO: 353810 - DNA, 20 bp, Artificial
  CRISPR gRNA sequence
taggtgcaaaagagtagagg

SEQ ID NO: 353811 - DNA, 20 bp, Artificial
  CRISPR gRNA sequence
ggtgcaaaagagtagagggg

SEQ ID NO: 353812 - DNA, 20 bp, Artificial
  CRISPR gRNA sequence
agagggggagaaacatacac

SEQ ID NO: 353813 - DNA, 20 bp, Artificial
  CRISPR gRNA sequence
gagggggagaaacatacact

SEQ ID NO: 353814 - DNA, 20 bp, Artificial
  CRISPR gRNA sequence
agggggagaaacatacacta

SEQ ID NO: 353815 - DNA, 20 bp, Artificial
  CRISPR gRNA sequence
ggggagaaacatacactagg

SEQ ID NO: 353816 - DNA, 20 bp, Artificial
  CRISPR gRNA sequence
ggagaaacatacactaggga

SEQ ID NO: 353817 - DNA, 20 bp, Artificial
  CRISPR gRNA sequence
tcccaaaactatcacgaatt

SEQ ID NO: 353818 - DNA, 20 bp, Artificial
  CRISPR gRNA sequence
gaattaagaatgatgttaaa

SEQ ID NO: 353819 - DNA, 20 bp, Artificial
  CRISPR gRNA sequence
tgttaaaaagatgacaatga

SEQ ID NO: 353820 - DNA, 20 bp, Artificial
  CRISPR gRNA sequence
agatgacaatgaaagtgctt

SEQ ID NO: 353821 - DNA, 20 bp, Artificial
  CRISPR gRNA sequence
gacaatgaaagtgctttggt

SEQ ID NO: 353822 - DNA, 20 bp, Artificial
  CRISPR gRNA sequence
tgaaagtgctttggtaagta

SEQ ID NO: 353823 - DNA, 20 bp, Artificial
  CRISPR gRNA sequence
ctttggtaagtaaagatgtc

SEQ ID NO: 353824 - DNA, 20 bp, Artificial
  CRISPR gRNA sequence
ttggtaagtaaagatgtcca

SEQ ID NO: 353825 - DNA, 20 bp, Artificial
  CRISPR gRNA sequence
taagtaaagatgtccagaga

SEQ ID NO: 353826 - DNA, 20 bp, Artificial
  CRISPR gRNA sequence
agagaaagaaaatgaatgaa

SEQ ID NO: 353827 - DNA, 20 bp, Artificial
  CRISPR gRNA sequence
atgaatgaatggaatttcac

SEQ ID NO: 353828 - DNA, 20 bp, Artificial
  CRISPR gRNA sequence
atttcacaagcattacccct

SEQ ID NO: 353829 - DNA, 20 bp, Artificial
  CRISPR gRNA sequence
tttcacaagcattacccctg

SEQ ID NO: 353830 - DNA, 20 bp, Artificial
  CRISPR gRNA sequence
ttcacaagcattacccctga

SEQ ID NO: 353831 - DNA, 20 bp, Artificial
  CRISPR gRNA sequence
cattacccctgagggtataa

SEQ ID NO: 353832 - DNA, 20 bp, Artificial
  CRISPR gRNA sequence
attacccctgagggtataac

SEQ ID NO: 353833 - DNA, 20 bp, Artificial
  CRISPR gRNA sequence
tacccctgagggtataacag

SEQ ID NO: 353834 - DNA, 20 bp, Artificial
  CRISPR gRNA sequence
tgagggtataacaggagcat

SEQ ID NO: 353835 - DNA, 20 bp, Artificial
  CRISPR gRNA sequence
gggtataacaggagcatcag

SEQ ID NO: 353836 - DNA, 20 bp, Artificial
  CRISPR gRNA sequence
acaggagcatcagaagacgt

SEQ ID NO: 353837 - DNA, 20 bp, Artificial
  CRISPR gRNA sequence
aggagcatcagaagacgtca

SEQ ID NO: 353838 - DNA, 20 bp, Artificial
  CRISPR gRNA sequence
agaagacgtcagagaatttt

SEQ ID NO: 353839 - DNA, 20 bp, Artificial
  CRISPR gRNA sequence
gaagacgtcagagaattttt

SEQ ID NO: 353840 - DNA, 20 bp, Artificial
  CRISPR gRNA sequence
agacgtcagagaatttttgg

SEQ ID NO: 353841 - DNA, 20 bp, Artificial
  CRISPR gRNA sequence
gacgtcagagaatttttggg

SEQ ID NO: 353842 - DNA, 20 bp, Artificial
  CRISPR gRNA sequence
gagaatttttgggaggactt

SEQ ID NO: 353843 - DNA, 20 bp, Artificial
  CRISPR gRNA sequence
atttttgggaggacttcaga

SEQ ID NO: 353844 - DNA, 20 bp, Artificial
  CRISPR gRNA sequence
tgaaaaaaccctacactctg

SEQ ID NO: 353845 - DNA, 20 bp, Artificial
  CRISPR gRNA sequence
aaaaaaccctacactctgta

SEQ ID NO: 353846 - DNA, 20 bp, Artificial
  CRISPR gRNA sequence
aaaaaccctacactctgtag

SEQ ID NO: 353847 - DNA, 20 bp, Artificial
  CRISPR gRNA sequence
aaccctacactctgtagagg

SEQ ID NO: 353848 - DNA, 20 bp, Artificial
  CRISPR gRNA sequence
ctctgtagaggaagaatata

SEQ ID NO: 353849 - DNA, 20 bp, Artificial
  CRISPR gRNA sequence
ctgtagaggaagaatatata

SEQ ID NO: 353850 - DNA, 20 bp, Artificial
  CRISPR gRNA sequence
tagaggaagaatatatagag

SEQ ID NO: 353851 - DNA, 20 bp, Artificial
  CRISPR gRNA sequence
ggaagaatatatagagaaga

SEQ ID NO: 353852 - DNA, 20 bp, Artificial
  CRISPR gRNA sequence
gaagaatatatagagaagaa

SEQ ID NO: 353853 - DNA, 20 bp, Artificial
  CRISPR gRNA sequence
aatatatagagaagaaagga

SEQ ID NO: 353854 - DNA, 20 bp, Artificial
  CRISPR gRNA sequence
tatatagagaagaaaggaca

SEQ ID NO: 353855 - DNA, 20 bp, Artificial
  CRISPR gRNA sequence
agaagaaaggacagagtaaa

SEQ ID NO: 353856 - DNA, 20 bp, Artificial
  CRISPR gRNA sequence
ttctcatcaatattttgaat

SEQ ID NO: 353857 - DNA, 20 bp, Artificial
  CRISPR gRNA sequence
ctcatcaatattttgaatga

SEQ ID NO: 353858 - DNA, 20 bp, Artificial
  CRISPR gRNA sequence
ccaaaaacacaaacacacac

SEQ ID NO: 353859 - DNA, 20 bp, Artificial
  CRISPR gRNA sequence
caaaaacacaaacacacaca

SEQ ID NO: 353860 - DNA, 20 bp, Artificial
  CRISPR gRNA sequence
cacaaacacacacaaggaaa

SEQ ID NO: 353861 - DNA, 20 bp, Artificial
  CRISPR gRNA sequence
caaacacacacaaggaaaaa

SEQ ID NO: 353862 - DNA, 20 bp, Artificial
  CRISPR gRNA sequence
acacacaaggaaaaagagac

SEQ ID NO: 353863 - DNA, 20 bp, Artificial
  CRISPR gRNA sequence
gagacaagttccaaatgttc

SEQ ID NO: 353864 - DNA, 20 bp, Artificial
  CRISPR gRNA sequence
gacaagttccaaatgttctg

SEQ ID NO: 353865 - DNA, 20 bp, Artificial
  CRISPR gRNA sequence
acaagttccaaatgttctgg

SEQ ID NO: 353866 - DNA, 20 bp, Artificial
  CRISPR gRNA sequence
ctggaggctttgcaatactg

SEQ ID NO: 353867 - DNA, 20 bp, Artificial
  CRISPR gRNA sequence
gaggctttgcaatactgcag

SEQ ID NO: 353868 - DNA, 20 bp, Artificial
  CRISPR gRNA sequence
actgcagtggtttgctacaa

SEQ ID NO: 353869 - DNA, 20 bp, Artificial
  CRISPR gRNA sequence
tgctacaaaagtctttcatg

SEQ ID NO: 353870 - DNA, 20 bp, Artificial
  CRISPR gRNA sequence
aaagtctttcatgaagttcc

SEQ ID NO: 353871 - DNA, 20 bp, Artificial
  CRISPR gRNA sequence
agtaaaaaccaccatgacaa

SEQ ID NO: 353872 - DNA, 20 bp, Artificial
  CRISPR gRNA sequence
tatactgtcccttccacacc

SEQ ID NO: 353873 - DNA, 20 bp, Artificial
  CRISPR gRNA sequence
ataattttctctcttaaaat

SEQ ID NO: 353874 - DNA, 20 bp, Artificial
  CRISPR gRNA sequence
gctcacatacactaatcatt

SEQ ID NO: 353875 - DNA, 20 bp, Artificial
  CRISPR gRNA sequence
tacactaatcattgagaatt

SEQ ID NO: 353876 - DNA, 20 bp, Artificial
  CRISPR gRNA sequence
atcattgagaatttggttat

SEQ ID NO: 353877 - DNA, 20 bp, Artificial
  CRISPR gRNA sequence
cattgagaatttggttattg

SEQ ID NO: 353878 - DNA, 20 bp, Artificial
  CRISPR gRNA sequence
atttggttattggagttttc

SEQ ID NO: 353879 - DNA, 20 bp, Artificial
  CRISPR gRNA sequence
ggttattggagttttccaga

SEQ ID NO: 353880 - DNA, 20 bp, Artificial
  CRISPR gRNA sequence
ttttgattgtctttaccatt

SEQ ID NO: 353881 - DNA, 20 bp, Artificial
  CRISPR gRNA sequence
attgtctttaccattcagaa

SEQ ID NO: 353882 - DNA, 20 bp, Artificial
  CRISPR gRNA sequence
tttaccttttaattgatgct

SEQ ID NO: 353883 - DNA, 20 bp, Artificial
  CRISPR gRNA sequence
caaaccaataaattcactca

SEQ ID NO: 353884 - DNA, 20 bp, Artificial
  CRISPR gRNA sequence
agaatctttgattgatctga

SEQ ID NO: 353885 - DNA, 20 bp, Artificial
  CRISPR gRNA sequence
atctttgattgatctgatag

SEQ ID NO: 353886 - DNA, 20 bp, Artificial
  CRISPR gRNA sequence
ctttgattgatctgatagta

SEQ ID NO: 353887 - DNA, 20 bp, Artificial
  CRISPR gRNA sequence
tttcttgtaaactgcctttc

SEQ ID NO: 353888 - DNA, 20 bp, Artificial
  CRISPR gRNA sequence
ttgttacactaatatatttg

SEQ ID NO: 353889 - DNA, 20 bp, Artificial
  CRISPR gRNA sequence
gtggaaacatttcatgaatc

SEQ ID NO: 353890 - DNA, 20 bp, Artificial
  CRISPR gRNA sequence
tggaaacatttcatgaatcc

SEQ ID NO: 353891 - DNA, 20 bp, Artificial
  CRISPR gRNA sequence
ttcatgaatccaggtataaa

SEQ ID NO: 353892 - DNA, 20 bp, Artificial
  CRISPR gRNA sequence
ccaggtataaaaagatcttt

SEQ ID NO: 353893 - DNA, 20 bp, Artificial
  CRISPR gRNA sequence
taagcaaacataataaaaat

SEQ ID NO: 353894 - DNA, 20 bp, Artificial
  CRISPR gRNA sequence
agcaaacataataaaaatga

SEQ ID NO: 353895 - DNA, 20 bp, Artificial
  CRISPR gRNA sequence
tacccttcttgcatatactt

SEQ ID NO: 353896 - DNA, 20 bp, Artificial
  CRISPR gRNA sequence
tgcatatacttaagcacaac

SEQ ID NO: 353897 - DNA, 20 bp, Artificial
  CRISPR gRNA sequence
gcatatacttaagcacaacc

SEQ ID NO: 353898 - DNA, 20 bp, Artificial
  CRISPR gRNA sequence
acttaagcacaaccaggaaa

SEQ ID NO: 353899 - DNA, 20 bp, Artificial
  CRISPR gRNA sequence
tttattttttcactcctgaa

SEQ ID NO: 353900 - DNA, 20 bp, Artificial
  CRISPR gRNA sequence
ttattttttcactcctgaaa

SEQ ID NO: 353901 - DNA, 20 bp, Artificial
  CRISPR gRNA sequence
tattttttcactcctgaaaa

SEQ ID NO: 353902 - DNA, 20 bp, Artificial
  CRISPR gRNA sequence
tcactcctgaaaagggttaa

SEQ ID NO: 353903 - DNA, 20 bp, Artificial
  CRISPR gRNA sequence
ctcacaaattttataattca

SEQ ID NO: 353904 - DNA, 20 bp, Artificial
  CRISPR gRNA sequence
ttttataattcacagaaatg

SEQ ID NO: 353905 - DNA, 20 bp, Artificial
  CRISPR gRNA sequence
tttataattcacagaaatgt

SEQ ID NO: 353906 - DNA, 20 bp, Artificial
  CRISPR gRNA sequence
atttctgtaattcacaaaac

SEQ ID NO: 353907 - DNA, 20 bp, Artificial
  CRISPR gRNA sequence
cacaaaacaagtgcattatt

SEQ ID NO: 353908 - DNA, 20 bp, Artificial
  CRISPR gRNA sequence
agtgcattatttggcataca

SEQ ID NO: 353909 - DNA, 20 bp, Artificial
  CRISPR gRNA sequence
atttggcatacatggtgttt

SEQ ID NO: 353910 - DNA, 20 bp, Artificial
  CRISPR gRNA sequence
tttggcatacatggtgttta

SEQ ID NO: 353911 - DNA, 20 bp, Artificial
  CRISPR gRNA sequence
atcataaaatactcactaat

SEQ ID NO: 353912 - DNA, 20 bp, Artificial
  CRISPR gRNA sequence
atactcactaattagcttaa

SEQ ID NO: 353913 - DNA, 20 bp, Artificial
  CRISPR gRNA sequence
taaaagtgtaaattacatct

SEQ ID NO: 353914 - DNA, 20 bp, Artificial
  CRISPR gRNA sequence
attacatcttagaatctgtc

SEQ ID NO: 353915 - DNA, 20 bp, Artificial
  CRISPR gRNA sequence
ttacatcttagaatctgtct

SEQ ID NO: 353916 - DNA, 20 bp, Artificial
  CRISPR gRNA sequence
cttagaatctgtctaggcaa

SEQ ID NO: 353917 - DNA, 20 bp, Artificial
  CRISPR gRNA sequence
ttagaatctgtctaggcaac

SEQ ID NO: 353918 - DNA, 20 bp, Artificial
  CRISPR gRNA sequence
agaatctgtctaggcaacag

SEQ ID NO: 353919 - DNA, 20 bp, Artificial
  CRISPR gRNA sequence
gtctaggcaacaggagaatt

SEQ ID NO: 353920 - DNA, 20 bp, Artificial
  CRISPR gRNA sequence
aatttggatttgctttattt

SEQ ID NO: 353921 - DNA, 20 bp, Artificial
  CRISPR gRNA sequence
ctttatttaagattatcatg

SEQ ID NO: 353922 - DNA, 20 bp, Artificial
  CRISPR gRNA sequence
acaactttgatatttaaata

SEQ ID NO: 353923 - DNA, 20 bp, Artificial
  CRISPR gRNA sequence
ccttcataatgaatcttttc

SEQ ID NO: 353924 - DNA, 20 bp, Artificial
  CRISPR gRNA sequence
cataatgaatcttttctaga

SEQ ID NO: 353925 - DNA, 20 bp, Artificial
  CRISPR gRNA sequence
aatgaatcttttctagatgg

SEQ ID NO: 353926 - DNA, 20 bp, Artificial
  CRISPR gRNA sequence
cttttctagatggtggtctt

SEQ ID NO: 353927 - DNA, 20 bp, Artificial
  CRISPR gRNA sequence
tggtggtctttagaaatctt

SEQ ID NO: 353928 - DNA, 20 bp, Artificial
  CRISPR gRNA sequence
gtggtctttagaaatcttta

SEQ ID NO: 353929 - DNA, 20 bp, Artificial
  CRISPR gRNA sequence
gagataaataatgaatcttt

SEQ ID NO: 353930 - DNA, 20 bp, Artificial
  CRISPR gRNA sequence
acaataaccattgtcctttc

SEQ ID NO: 353931 - DNA, 20 bp, Artificial
  CRISPR gRNA sequence
caataaccattgtcctttca

SEQ ID NO: 353932 - DNA, 20 bp, Artificial
  CRISPR gRNA sequence
tcctttcaaggtaaccatga

SEQ ID NO: 353933 - DNA, 20 bp, Artificial
  CRISPR gRNA sequence
gtaaccatgacagttttatt

SEQ ID NO: 353934 - DNA, 20 bp, Artificial
  CRISPR gRNA sequence
catgacagttttattcagtt

SEQ ID NO: 353935 - DNA, 20 bp, Artificial
  CRISPR gRNA sequence
tggcaaatacttttcattgt

SEQ ID NO: 353936 - DNA, 20 bp, Artificial
  CRISPR gRNA sequence
tttcattgttagcctacatc

SEQ ID NO: 353937 - DNA, 20 bp, Artificial
  CRISPR gRNA sequence
atctagaatttaaacaatat

SEQ ID NO: 353938 - DNA, 20 bp, Artificial
  CRISPR gRNA sequence
tctagaatttaaacaatatt

SEQ ID NO: 353939 - DNA, 20 bp, Artificial
  CRISPR gRNA sequence
aatttaaacaatattaggta

SEQ ID NO: 353940 - DNA, 20 bp, Artificial
  CRISPR gRNA sequence
tctctaattgctttgactgt

SEQ ID NO: 353941 - DNA, 20 bp, Artificial
  CRISPR gRNA sequence
ttgactgttggtgatgtcat

SEQ ID NO: 353942 - DNA, 20 bp, Artificial
  CRISPR gRNA sequence
tgactgttggtgatgtcatt

SEQ ID NO: 353943 - DNA, 20 bp, Artificial
  CRISPR gRNA sequence
gactgttggtgatgtcatta

SEQ ID NO: 353944 - DNA, 20 bp, Artificial
  CRISPR gRNA sequence
tagggctgtctttgtctgaa

SEQ ID NO: 353945 - DNA, 20 bp, Artificial
  CRISPR gRNA sequence
ctgtctttgtctgaatagtg

SEQ ID NO: 353946 - DNA, 20 bp, Artificial
  CRISPR gRNA sequence
tctttgtctgaatagtgaag

SEQ ID NO: 353947 - DNA, 20 bp, Artificial
  CRISPR gRNA sequence
ttgtctgaatagtgaagcag

SEQ ID NO: 353948 - DNA, 20 bp, Artificial
  CRISPR gRNA sequence
tttccctttgtatttttctg

SEQ ID NO: 353949 - DNA, 20 bp, Artificial
  CRISPR gRNA sequence
ccactttcaactgtcacttt

SEQ ID NO: 353950 - DNA, 20 bp, Artificial
  CRISPR gRNA sequence
ctttcaactgtcacttttag

SEQ ID NO: 353951 - DNA, 20 bp, Artificial
  CRISPR gRNA sequence
aatcattaaaaaataataac

SEQ ID NO: 353952 - DNA, 20 bp, Artificial
  CRISPR gRNA sequence
atcattaaaaaataataact

SEQ ID NO: 353953 - DNA, 20 bp, Artificial
  CRISPR gRNA sequence
actaggtgcctgaccctttt

SEQ ID NO: 353954 - DNA, 20 bp, Artificial
  CRISPR gRNA sequence
taggtgcctgacccttttga

SEQ ID NO: 353955 - DNA, 20 bp, Artificial
  CRISPR gRNA sequence
atattaaaaataattctcaa

SEQ ID NO: 353956 - DNA, 20 bp, Artificial
  CRISPR gRNA sequence
ttaaaaataattctcaaaag

SEQ ID NO: 353957 - DNA, 20 bp, Artificial
  CRISPR gRNA sequence
caaaatatgtccaaaacatt

SEQ ID NO: 353958 - DNA, 20 bp, Artificial
  CRISPR gRNA sequence
tatctactacatttgctcct

SEQ ID NO: 353959 - DNA, 20 bp, Artificial
  CRISPR gRNA sequence
atctactacatttgctccta

SEQ ID NO: 353960 - DNA, 20 bp, Artificial
  CRISPR gRNA sequence
actacatttgctcctaaggc

SEQ ID NO: 353961 - DNA, 20 bp, Artificial
  CRISPR gRNA sequence
tttgctcctaaggctagacc

SEQ ID NO: 353962 - DNA, 20 bp, Artificial
  CRISPR gRNA sequence
ttgctcctaaggctagacct

SEQ ID NO: 353963 - DNA, 20 bp, Artificial
  CRISPR gRNA sequence
tcctaaggctagacctggga

SEQ ID NO: 353964 - DNA, 20 bp, Artificial
  CRISPR gRNA sequence
taaggctagacctgggatgg

SEQ ID NO: 353965 - DNA, 20 bp, Artificial
  CRISPR gRNA sequence
gctagacctgggatggcggc

SEQ ID NO: 353966 - DNA, 20 bp, Artificial
  CRISPR gRNA sequence
atggcggcaagaattctata

SEQ ID NO: 353967 - DNA, 20 bp, Artificial
  CRISPR gRNA sequence
gcaagaattctatacagaat

SEQ ID NO: 353968 - DNA, 20 bp, Artificial
  CRISPR gRNA sequence
aagaattctatacagaatga

SEQ ID NO: 353969 - DNA, 20 bp, Artificial
  CRISPR gRNA sequence
aatgagagataaataaatat

SEQ ID NO: 353970 - DNA, 20 bp, Artificial
  CRISPR gRNA sequence
gagataaataaatatgagaa

SEQ ID NO: 353971 - DNA, 20 bp, Artificial
  CRISPR gRNA sequence
aaataaatatgagaatagta

SEQ ID NO: 353972 - DNA, 20 bp, Artificial
  CRISPR gRNA sequence
aataaatatgagaatagtaa

SEQ ID NO: 353973 - DNA, 20 bp, Artificial
  CRISPR gRNA sequence
atattcatttcttctactgc

SEQ ID NO: 353974 - DNA, 20 bp, Artificial
  CRISPR gRNA sequence
tattcatttcttctactgcc

SEQ ID NO: 353975 - DNA, 20 bp, Artificial
  CRISPR gRNA sequence
tctactgccaggtattcttc

SEQ ID NO: 353976 - DNA, 20 bp, Artificial
  CRISPR gRNA sequence
attcttctggactatgctga

SEQ ID NO: 353977 - DNA, 20 bp, Artificial
  CRISPR gRNA sequence
tcttctggactatgctgata

SEQ ID NO: 353978 - DNA, 20 bp, Artificial
  CRISPR gRNA sequence
tctggactatgctgatagag

SEQ ID NO: 353979 - DNA, 20 bp, Artificial
  CRISPR gRNA sequence
tatgctgatagagtggattc

SEQ ID NO: 353980 - DNA, 20 bp, Artificial
  CRISPR gRNA sequence
gctgatagagtggattctag

SEQ ID NO: 353981 - DNA, 20 bp, Artificial
  CRISPR gRNA sequence
tagagtggattctagaagta

SEQ ID NO: 353982 - DNA, 20 bp, Artificial
  CRISPR gRNA sequence
gtggattctagaagtatgga

SEQ ID NO: 353983 - DNA, 20 bp, Artificial
  CRISPR gRNA sequence
ggattctagaagtatggaca

SEQ ID NO: 353984 - DNA, 20 bp, Artificial
  CRISPR gRNA sequence
ggacagagataccccatttc

SEQ ID NO: 353985 - DNA, 20 bp, Artificial
  CRISPR gRNA sequence
ccatcccatatttcactttt

SEQ ID NO: 353986 - DNA, 20 bp, Artificial
  CRISPR gRNA sequence
tttagttaacaaaaatgtct

SEQ ID NO: 353987 - DNA, 20 bp, Artificial
  CRISPR gRNA sequence
aatgtcttggttaatcactg

SEQ ID NO: 353988 - DNA, 20 bp, Artificial
  CRISPR gRNA sequence
tcactgcagtcaatatttgt

SEQ ID NO: 353989 - DNA, 20 bp, Artificial
  CRISPR gRNA sequence
atatttgttggtaaactctc

SEQ ID NO: 353990 - DNA, 20 bp, Artificial
  CRISPR gRNA sequence
ttggtaaactctccagcttt

SEQ ID NO: 353991 - DNA, 20 bp, Artificial
  CRISPR gRNA sequence
taaccatgctctgaattgcc

SEQ ID NO: 353992 - DNA, 20 bp, Artificial
  CRISPR gRNA sequence
tgtgctttgaccctgcttct

SEQ ID NO: 353993 - DNA, 20 bp, Artificial
  CRISPR gRNA sequence
ttgaccctgcttctcagctc

SEQ ID NO: 353994 - DNA, 20 bp, Artificial
  CRISPR gRNA sequence
accctgcttctcagctctag

SEQ ID NO: 353995 - DNA, 20 bp, Artificial
  CRISPR gRNA sequence
cagctctagaagtgaaccct

SEQ ID NO: 353996 - DNA, 20 bp, Artificial
  CRISPR gRNA sequence
agtgaacccttagtttactt

SEQ ID NO: 353997 - DNA, 20 bp, Artificial
  CRISPR gRNA sequence
ttaagccattccatcctttc

SEQ ID NO: 353998 - DNA, 20 bp, Artificial
  CRISPR gRNA sequence
caaatttgtttgctccattt

SEQ ID NO: 353999 - DNA, 20 bp, Artificial
  CRISPR gRNA sequence
atttgtttgctccatttgag

SEQ ID NO: 354000 - DNA, 20 bp, Artificial
  CRISPR gRNA sequence
ttgagaagcaaactctctac

SEQ ID NO: 354001 - DNA, 20 bp, Artificial
  CRISPR gRNA sequence
gaagcaaactctctaccaga

SEQ ID NO: 354002 - DNA, 20 bp, Artificial
  CRISPR gRNA sequence
actctctaccagacagaaac

SEQ ID NO: 354003 - DNA, 20 bp, Artificial
  CRISPR gRNA sequence
ctctctaccagacagaaaca

SEQ ID NO: 354004 - DNA, 20 bp, Artificial
  CRISPR gRNA sequence
acaaggatgtatgaattgcc

SEQ ID NO: 354005 - DNA, 20 bp, Artificial
  CRISPR gRNA sequence
aaggatgtatgaattgccaa

SEQ ID NO: 354006 - DNA, 20 bp, Artificial
  CRISPR gRNA sequence
atgtatgaattgccaagagt

SEQ ID NO: 354007 - DNA, 20 bp, Artificial
  CRISPR gRNA sequence
tatgaattgccaagagttgg

SEQ ID NO: 354008 - DNA, 20 bp, Artificial
  CRISPR gRNA sequence
ggcagccatcttgccaacac

SEQ ID NO: 354009 - DNA, 20 bp, Artificial
  CRISPR gRNA sequence
cagccatcttgccaacacaa

SEQ ID NO: 354010 - DNA, 20 bp, Artificial
  CRISPR gRNA sequence
agccatcttgccaacacaag

SEQ ID NO: 354011 - DNA, 20 bp, Artificial
  CRISPR gRNA sequence
atcttgccaacacaagagga

SEQ ID NO: 354012 - DNA, 20 bp, Artificial
  CRISPR gRNA sequence
cacaagaggaaagcctgcat

SEQ ID NO: 354013 - DNA, 20 bp, Artificial
  CRISPR gRNA sequence
caagaggaaagcctgcatga

SEQ ID NO: 354014 - DNA, 20 bp, Artificial
  CRISPR gRNA sequence
aggaaagcctgcatgagagt

SEQ ID NO: 354015 - DNA, 20 bp, Artificial
  CRISPR gRNA sequence
ggaaagcctgcatgagagtg

SEQ ID NO: 354016 - DNA, 20 bp, Artificial
  CRISPR gRNA sequence
gcctgcatgagagtgaggcc

SEQ ID NO: 354017 - DNA, 20 bp, Artificial
  CRISPR gRNA sequence
catgagagtgaggccaagac

SEQ ID NO: 354018 - DNA, 20 bp, Artificial
  CRISPR gRNA sequence
atgagagtgaggccaagacc

SEQ ID NO: 354019 - DNA, 20 bp, Artificial
  CRISPR gRNA sequence
tgagagtgaggccaagacca

SEQ ID NO: 354020 - DNA, 20 bp, Artificial
  CRISPR gRNA sequence
tgaggccaagaccagggaaa

SEQ ID NO: 354021 - DNA, 20 bp, Artificial
  CRISPR gRNA sequence
gggaaatggatccaacactc

SEQ ID NO: 354022 - DNA, 20 bp, Artificial
  CRISPR gRNA sequence
aatggatccaacactctgga

SEQ ID NO: 354023 - DNA, 20 bp, Artificial
  CRISPR gRNA sequence
atggatccaacactctggaa

SEQ ID NO: 354024 - DNA, 20 bp, Artificial
  CRISPR gRNA sequence
tggatccaacactctggaaa

SEQ ID NO: 354025 - DNA, 20 bp, Artificial
  CRISPR gRNA sequence
caacactctggaaagggatt

SEQ ID NO: 354026 - DNA, 20 bp, Artificial
  CRISPR gRNA sequence
cactctggaaagggattcag

SEQ ID NO: 354027 - DNA, 20 bp, Artificial
  CRISPR gRNA sequence
ctggaaagggattcagaagc

SEQ ID NO: 354028 - DNA, 20 bp, Artificial
  CRISPR gRNA sequence
tttatgcccatacttaattc

SEQ ID NO: 354029 - DNA, 20 bp, Artificial
  CRISPR gRNA sequence
taattctagacacaacattt

SEQ ID NO: 354030 - DNA, 20 bp, Artificial
  CRISPR gRNA sequence
tagacacaacatttaagccc

SEQ ID NO: 354031 - DNA, 20 bp, Artificial
  CRISPR gRNA sequence
aacatttaagccctggtaaa

SEQ ID NO: 354032 - DNA, 20 bp, Artificial
  CRISPR gRNA sequence
tggtaaatagcccttgccca

SEQ ID NO: 354033 - DNA, 20 bp, Artificial
  CRISPR gRNA sequence
gcccaaagcttaatctcccc

SEQ ID NO: 354034 - DNA, 20 bp, Artificial
  CRISPR gRNA sequence
gatcattctgttatatgata

SEQ ID NO: 354035 - DNA, 20 bp, Artificial
  CRISPR gRNA sequence
attctgttatatgatacagt

SEQ ID NO: 354036 - DNA, 20 bp, Artificial
  CRISPR gRNA sequence
gttttcttttgtatataaac

SEQ ID NO: 354037 - DNA, 20 bp, Artificial
  CRISPR gRNA sequence
tcttttgtatataaaccagt

SEQ ID NO: 354038 - DNA, 20 bp, Artificial
  CRISPR gRNA sequence
ttttgtatataaaccagtta

SEQ ID NO: 354039 - DNA, 20 bp, Artificial
  CRISPR gRNA sequence
gtatataaaccagttagagt

SEQ ID NO: 354040 - DNA, 20 bp, Artificial
  CRISPR gRNA sequence
tatataaaccagttagagtc

SEQ ID NO: 354041 - DNA, 20 bp, Artificial
  CRISPR gRNA sequence
tagagtcaggttttctgaaa

SEQ ID NO: 354042 - DNA, 20 bp, Artificial
  CRISPR gRNA sequence
agttctatgaaaaatgattt

SEQ ID NO: 354043 - DNA, 20 bp, Artificial
  CRISPR gRNA sequence
gttctatgaaaaatgatttt

SEQ ID NO: 354044 - DNA, 20 bp, Artificial
  CRISPR gRNA sequence
aaaaatgattttaggtaatg

SEQ ID NO: 354045 - DNA, 20 bp, Artificial
  CRISPR gRNA sequence
atgaagtatttttcctatca

SEQ ID NO: 354046 - DNA, 20 bp, Artificial
  CRISPR gRNA sequence
cctatcaaagtaactcaatt

SEQ ID NO: 354047 - DNA, 20 bp, Artificial
  CRISPR gRNA sequence
agtaactcaattcagacaac

SEQ ID NO: 354048 - DNA, 20 bp, Artificial
  CRISPR gRNA sequence
aattcagacaactagtatct

SEQ ID NO: 354049 - DNA, 20 bp, Artificial
  CRISPR gRNA sequence
attcagacaactagtatcta

SEQ ID NO: 354050 - DNA, 20 bp, Artificial
  CRISPR gRNA sequence
cagacaactagtatctaagg

SEQ ID NO: 354051 - DNA, 20 bp, Artificial
  CRISPR gRNA sequence
ctagtatctaaggtagacct

SEQ ID NO: 354052 - DNA, 20 bp, Artificial
  CRISPR gRNA sequence
tagtatctaaggtagacctt

SEQ ID NO: 354053 - DNA, 20 bp, Artificial
  CRISPR gRNA sequence
tatctaaggtagaccttggg

SEQ ID NO: 354054 - DNA, 20 bp, Artificial
  CRISPR gRNA sequence
ctaaggtagaccttgggtag

SEQ ID NO: 354055 - DNA, 20 bp, Artificial
  CRISPR gRNA sequence
tagtggaaaaaaattgcata

SEQ ID NO: 354056 - DNA, 20 bp, Artificial
  CRISPR gRNA sequence
ttgcataaagatccatgcat

SEQ ID NO: 354057 - DNA, 20 bp, Artificial
  CRISPR gRNA sequence
agatccatgcatgagtacat

SEQ ID NO: 354058 - DNA, 20 bp, Artificial
  CRISPR gRNA sequence
atccatgcatgagtacataa

SEQ ID NO: 354059 - DNA, 20 bp, Artificial
  CRISPR gRNA sequence
attactaatgcactcatgtc

SEQ ID NO: 354060 - DNA, 20 bp, Artificial
  CRISPR gRNA sequence
aatgcactcatgtcaagaat

SEQ ID NO: 354061 - DNA, 20 bp, Artificial
  CRISPR gRNA sequence
tcaagaataagcttaaactc

SEQ ID NO: 354062 - DNA, 20 bp, Artificial
  CRISPR gRNA sequence
taagcttaaactctagtctt

SEQ ID NO: 354063 - DNA, 20 bp, Artificial
  CRISPR gRNA sequence
aactctagtctttggtctgc

SEQ ID NO: 354064 - DNA, 20 bp, Artificial
  CRISPR gRNA sequence
ctctagtctttggtctgcga

SEQ ID NO: 354065 - DNA, 20 bp, Artificial
  CRISPR gRNA sequence
tagtctttggtctgcgagag

SEQ ID NO: 354066 - DNA, 20 bp, Artificial
  CRISPR gRNA sequence
agtctttggtctgcgagaga

SEQ ID NO: 354067 - DNA, 20 bp, Artificial
  CRISPR gRNA sequence
tttggtctgcgagagaaggt

SEQ ID NO: 354068 - DNA, 20 bp, Artificial
  CRISPR gRNA sequence
gtctgcgagagaaggttgga

SEQ ID NO: 354069 - DNA, 20 bp, Artificial
  CRISPR gRNA sequence
atcctctcttgtatcatcca

SEQ ID NO: 354070 - DNA, 20 bp, Artificial
  CRISPR gRNA sequence
tgtatcatccatggattgat

SEQ ID NO: 354071 - DNA, 20 bp, Artificial
  CRISPR gRNA sequence
atcatccatggattgattgg

SEQ ID NO: 354072 - DNA, 20 bp, Artificial
  CRISPR gRNA sequence
tcatccatggattgattggt

SEQ ID NO: 354073 - DNA, 20 bp, Artificial
  CRISPR gRNA sequence
ggattgattggtaggttgac

SEQ ID NO: 354074 - DNA, 20 bp, Artificial
  CRISPR gRNA sequence
ttgattggtaggttgactgg

SEQ ID NO: 354075 - DNA, 20 bp, Artificial
  CRISPR gRNA sequence
gattggtaggttgactggta

SEQ ID NO: 354076 - DNA, 20 bp, Artificial
  CRISPR gRNA sequence
ggtaggttgactggtagaga

SEQ ID NO: 354077 - DNA, 20 bp, Artificial
  CRISPR gRNA sequence
gtaggttgactggtagagat

SEQ ID NO: 354078 - DNA, 20 bp, Artificial
  CRISPR gRNA sequence
tggtagagatgggacttcta

SEQ ID NO: 354079 - DNA, 20 bp, Artificial
  CRISPR gRNA sequence
gatgggacttctatagttat

SEQ ID NO: 354080 - DNA, 20 bp, Artificial
  CRISPR gRNA sequence
atgggacttctatagttatt

SEQ ID NO: 354081 - DNA, 20 bp, Artificial
  CRISPR gRNA sequence
ttctatagttattgggtgcc

SEQ ID NO: 354082 - DNA, 20 bp, Artificial
  CRISPR gRNA sequence
atagttattgggtgcctaga

SEQ ID NO: 354083 - DNA, 20 bp, Artificial
  CRISPR gRNA sequence
tgggtgcctagaaagacaaa

SEQ ID NO: 354084 - DNA, 20 bp, Artificial
  CRISPR gRNA sequence
gtgcctagaaagacaaacag

SEQ ID NO: 354085 - DNA, 20 bp, Artificial
  CRISPR gRNA sequence
gcctagaaagacaaacagca

SEQ ID NO: 354086 - DNA, 20 bp, Artificial
  CRISPR gRNA sequence
ctagaaagacaaacagcaga

SEQ ID NO: 354087 - DNA, 20 bp, Artificial
  CRISPR gRNA sequence
ctgcatttcaacaactaatg

SEQ ID NO: 354088 - DNA, 20 bp, Artificial
  CRISPR gRNA sequence
aaacatacctctcataaatg

SEQ ID NO: 354089 - DNA, 20 bp, Artificial
  CRISPR gRNA sequence
aacatacctctcataaatgc

SEQ ID NO: 354090 - DNA, 20 bp, Artificial
  CRISPR gRNA sequence
tcataaatgcaggcatgata

SEQ ID NO: 354091 - DNA, 20 bp, Artificial
  CRISPR gRNA sequence
cataaatgcaggcatgatat

SEQ ID NO: 354092 - DNA, 20 bp, Artificial
  CRISPR gRNA sequence
atgcaggcatgatatgggac

SEQ ID NO: 354093 - DNA, 20 bp, Artificial
  CRISPR gRNA sequence
tcattgtattgaacttctgt

SEQ ID NO: 354094 - DNA, 20 bp, Artificial
  CRISPR gRNA sequence
tggaaatcatattcttgact

SEQ ID NO: 354095 - DNA, 20 bp, Artificial
  CRISPR gRNA sequence
tattcttgactgagatgcaa

SEQ ID NO: 354096 - DNA, 20 bp, Artificial
  CRISPR gRNA sequence
actgagatgcaacagaaatc

SEQ ID NO: 354097 - DNA, 20 bp, Artificial
  CRISPR gRNA sequence
gatgcaacagaaatctagtc

SEQ ID NO: 354098 - DNA, 20 bp, Artificial
  CRISPR gRNA sequence
atgaattacctgtttcaatg

SEQ ID NO: 354099 - DNA, 20 bp, Artificial
  CRISPR gRNA sequence
gaactccctctcccaatgtt

SEQ ID NO: 354100 - DNA, 20 bp, Artificial
  CRISPR gRNA sequence
caatgttaagctattttgat

SEQ ID NO: 354101 - DNA, 20 bp, Artificial
  CRISPR gRNA sequence
caattactatcatttttata

SEQ ID NO: 354102 - DNA, 20 bp, Artificial
  CRISPR gRNA sequence
tttatatggaaattctaaca

SEQ ID NO: 354103 - DNA, 20 bp, Artificial
  CRISPR gRNA sequence
gtgtctgaactttaaaaaat

SEQ ID NO: 354104 - DNA, 20 bp, Artificial
  CRISPR gRNA sequence
taagcaacttaacatataaa

SEQ ID NO: 354105 - DNA, 20 bp, Artificial
  CRISPR gRNA sequence
aagttaacaaaactgacatc

SEQ ID NO: 354106 - DNA, 20 bp, Artificial
  CRISPR gRNA sequence
taatcttctctaccgtaatc

SEQ ID NO: 354107 - DNA, 20 bp, Artificial
  CRISPR gRNA sequence
ccacatatgtatgtatgtaa

SEQ ID NO: 354108 - DNA, 20 bp, Artificial
  CRISPR gRNA sequence
tgtatgtaacagaaaatatg

SEQ ID NO: 354109 - DNA, 20 bp, Artificial
  CRISPR gRNA sequence
gtatgtaacagaaaatatgc

SEQ ID NO: 354110 - DNA, 20 bp, Artificial
  CRISPR gRNA sequence
aaaatatgcaggtgtgaaaa

SEQ ID NO: 354111 - DNA, 20 bp, Artificial
  CRISPR gRNA sequence
tatgcaggtgtgaaaaaaga

SEQ ID NO: 354112 - DNA, 20 bp, Artificial
  CRISPR gRNA sequence
tgaaaaaagaaagacaaatt

SEQ ID NO: 354113 - DNA, 20 bp, Artificial
  CRISPR gRNA sequence
aaaaaagaaagacaaattaa

SEQ ID NO: 354114 - DNA, 20 bp, Artificial
  CRISPR gRNA sequence
aaagacaaattaagagacaa

SEQ ID NO: 354115 - DNA, 20 bp, Artificial
  CRISPR gRNA sequence
aattaagagacaaaagaaac

SEQ ID NO: 354116 - DNA, 20 bp, Artificial
  CRISPR gRNA sequence
ttaagagacaaaagaaacta

SEQ ID NO: 354117 - DNA, 20 bp, Artificial
  CRISPR gRNA sequence
gagacaaaagaaactagaga

SEQ ID NO: 354118 - DNA, 20 bp, Artificial
  CRISPR gRNA sequence
agacaaaagaaactagagaa

SEQ ID NO: 354119 - DNA, 20 bp, Artificial
  CRISPR gRNA sequence
ctagagaaaggtcttttgat

SEQ ID NO: 354120 - DNA, 20 bp, Artificial
  CRISPR gRNA sequence
tgatgagtaatttaaaaatt

SEQ ID NO: 354121 - DNA, 20 bp, Artificial
  CRISPR gRNA sequence
ttaaaaatttagattgacct

SEQ ID NO: 354122 - DNA, 20 bp, Artificial
  CRISPR gRNA sequence
tagattgaccttagtgttgt

SEQ ID NO: 354123 - DNA, 20 bp, Artificial
  CRISPR gRNA sequence
ttagtgttgttggttttttt

SEQ ID NO: 354124 - DNA, 20 bp, Artificial
  CRISPR gRNA sequence
tgttgttggtttttttgagt

SEQ ID NO: 354125 - DNA, 20 bp, Artificial
  CRISPR gRNA sequence
ttgttggtttttttgagtca

SEQ ID NO: 354126 - DNA, 20 bp, Artificial
  CRISPR gRNA sequence
agagtctcgctctgttgccc

SEQ ID NO: 354127 - DNA, 20 bp, Artificial
  CRISPR gRNA sequence
tctcgctctgttgcccaagc

SEQ ID NO: 354128 - DNA, 20 bp, Artificial
  CRISPR gRNA sequence
tcgctctgttgcccaagctg

SEQ ID NO: 354129 - DNA, 20 bp, Artificial
  CRISPR gRNA sequence
ctgttgcccaagctggagtg

SEQ ID NO: 354130 - DNA, 20 bp, Artificial
  CRISPR gRNA sequence
ttgcccaagctggagtgcag

SEQ ID NO: 354131 - DNA, 20 bp, Artificial
  CRISPR gRNA sequence
tggagtgcagtggcgcaatc

SEQ ID NO: 354132 - DNA, 20 bp, Artificial
  CRISPR gRNA sequence
ggagtgcagtggcgcaatct

SEQ ID NO: 354133 - DNA, 20 bp, Artificial
  CRISPR gRNA sequence
tcactgcaacccccacctcc

SEQ ID NO: 354134 - DNA, 20 bp, Artificial
  CRISPR gRNA sequence
cactgcaacccccacctccc

SEQ ID NO: 354135 - DNA, 20 bp, Artificial
  CRISPR gRNA sequence
aacccccacctcccaggttc

SEQ ID NO: 354136 - DNA, 20 bp, Artificial
  CRISPR gRNA sequence
aggttcaagcaattctgcct

SEQ ID NO: 354137 - DNA, 20 bp, Artificial
  CRISPR gRNA sequence
caattctgcctcagcctcac

SEQ ID NO: 354138 - DNA, 20 bp, Artificial
  CRISPR gRNA sequence
ttctgcctcagcctcacgag

SEQ ID NO: 354139 - DNA, 20 bp, Artificial
  CRISPR gRNA sequence
gcctcagcctcacgagtagc

SEQ ID NO: 354140 - DNA, 20 bp, Artificial
  CRISPR gRNA sequence
cctcagcctcacgagtagct

SEQ ID NO: 354141 - DNA, 20 bp, Artificial
  CRISPR gRNA sequence
ctcacgagtagctgggatta

SEQ ID NO: 354142 - DNA, 20 bp, Artificial
  CRISPR gRNA sequence
tcacgagtagctgggattac

SEQ ID NO: 354143 - DNA, 20 bp, Artificial
  CRISPR gRNA sequence
gagtagctgggattacaggc

SEQ ID NO: 354144 - DNA, 20 bp, Artificial
  CRISPR gRNA sequence
caggcaagcaccatcacgcc

SEQ ID NO: 354145 - DNA, 20 bp, Artificial
  CRISPR gRNA sequence
ccagctaatttttgtatttt

SEQ ID NO: 354146 - DNA, 20 bp, Artificial
  CRISPR gRNA sequence
gctaatttttgtatttttag

SEQ ID NO: 354147 - DNA, 20 bp, Artificial
  CRISPR gRNA sequence
taatttttgtatttttagta

SEQ ID NO: 354148 - DNA, 20 bp, Artificial
  CRISPR gRNA sequence
ttttgtatttttagtagaga

SEQ ID NO: 354149 - DNA, 20 bp, Artificial
  CRISPR gRNA sequence
ttgtatttttagtagagatg

SEQ ID NO: 354150 - DNA, 20 bp, Artificial
  CRISPR gRNA sequence
gagatggagtttcgccatgt

SEQ ID NO: 354151 - DNA, 20 bp, Artificial
  CRISPR gRNA sequence
tggagtttcgccatgttggc

SEQ ID NO: 354152 - DNA, 20 bp, Artificial
  CRISPR gRNA sequence
ggagtttcgccatgttggcc

SEQ ID NO: 354153 - DNA, 20 bp, Artificial
  CRISPR gRNA sequence
tttcgccatgttggccaggc

SEQ ID NO: 354154 - DNA, 20 bp, Artificial
  CRISPR gRNA sequence
tggtctcaaactcctgacct

SEQ ID NO: 354155 - DNA, 20 bp, Artificial
  CRISPR gRNA sequence
ctcagacgatccgcccacct

SEQ ID NO: 354156 - DNA, 20 bp, Artificial
  CRISPR gRNA sequence
ccgcccacctcagcctccca

SEQ ID NO: 354157 - DNA, 20 bp, Artificial
  CRISPR gRNA sequence
acctcagcctcccaaagtgt

SEQ ID NO: 354158 - DNA, 20 bp, Artificial
  CRISPR gRNA sequence
cctcagcctcccaaagtgtt

SEQ ID NO: 354159 - DNA, 20 bp, Artificial
  CRISPR gRNA sequence
tcccaaagtgttgggattac

SEQ ID NO: 354160 - DNA, 20 bp, Artificial
  CRISPR gRNA sequence
agtgttgggattacaagcgt

SEQ ID NO: 354161 - DNA, 20 bp, Artificial
  CRISPR gRNA sequence
caagcgtgagccaccatgac

SEQ ID NO: 354162 - DNA, 20 bp, Artificial
  CRISPR gRNA sequence
cgtgagccaccatgaccagc

SEQ ID NO: 354163 - DNA, 20 bp, Artificial
  CRISPR gRNA sequence
caccatgaccagccagatgt

SEQ ID NO: 354164 - DNA, 20 bp, Artificial
  CRISPR gRNA sequence
agccagatgttagtgttttt

SEQ ID NO: 354165 - DNA, 20 bp, Artificial
  CRISPR gRNA sequence
cagatgttagtgtttttaag

SEQ ID NO: 354166 - DNA, 20 bp, Artificial
  CRISPR gRNA sequence
tgttagtgtttttaagaaga

SEQ ID NO: 354167 - DNA, 20 bp, Artificial
  CRISPR gRNA sequence
agaaagcaaaatgaaaattc

SEQ ID NO: 354168 - DNA, 20 bp, Artificial
  CRISPR gRNA sequence
tcaagtgccatgattactta

SEQ ID NO: 354169 - DNA, 20 bp, Artificial
  CRISPR gRNA sequence
aagtgccatgattacttata

SEQ ID NO: 354170 - DNA, 20 bp, Artificial
  CRISPR gRNA sequence
agtgccatgattacttatag

SEQ ID NO: 354171 - DNA, 20 bp, Artificial
  CRISPR gRNA sequence
atagaggttatcttttaaaa

SEQ ID NO: 354172 - DNA, 20 bp, Artificial
  CRISPR gRNA sequence
agaggttatcttttaaaaaa

SEQ ID NO: 354173 - DNA, 20 bp, Artificial
  CRISPR gRNA sequence
atcttttaaaaaagagaatg

SEQ ID NO: 354174 - DNA, 20 bp, Artificial
  CRISPR gRNA sequence
ttttaaaaaagagaatgaag

SEQ ID NO: 354175 - DNA, 20 bp, Artificial
  CRISPR gRNA sequence
gttctaatgtctttttttga

SEQ ID NO: 354176 - DNA, 20 bp, Artificial
  CRISPR gRNA sequence
tattctacaaaaacctgaaa

SEQ ID NO: 354177 - DNA, 20 bp, Artificial
  CRISPR gRNA sequence
ctacaaaaacctgaaaaagt

SEQ ID NO: 354178 - DNA, 20 bp, Artificial
  CRISPR gRNA sequence
aaaaagttggatacctaata

SEQ ID NO: 354179 - DNA, 20 bp, Artificial
  CRISPR gRNA sequence
acctaatatagaccgttgca

SEQ ID NO: 354180 - DNA, 20 bp, Artificial
  CRISPR gRNA sequence
ttcacaacaataaatgtgac

SEQ ID NO: 354181 - DNA, 20 bp, Artificial
  CRISPR gRNA sequence
aacaataaatgtgactagac

SEQ ID NO: 354182 - DNA, 20 bp, Artificial
  CRISPR gRNA sequence
aaatgtgactagactggcat

SEQ ID NO: 354183 - DNA, 20 bp, Artificial
  CRISPR gRNA sequence
tgtgactagactggcatgag

SEQ ID NO: 354184 - DNA, 20 bp, Artificial
  CRISPR gRNA sequence
tagactggcatgagtagaca

SEQ ID NO: 354185 - DNA, 20 bp, Artificial
  CRISPR gRNA sequence
agactggcatgagtagacaa

SEQ ID NO: 354186 - DNA, 20 bp, Artificial
  CRISPR gRNA sequence
ggcatgagtagacaaaggct

SEQ ID NO: 354187 - DNA, 20 bp, Artificial
  CRISPR gRNA sequence
gcatgagtagacaaaggcta

SEQ ID NO: 354188 - DNA, 20 bp, Artificial
  CRISPR gRNA sequence
gtagacaaaggctaaggatg

SEQ ID NO: 354189 - DNA, 20 bp, Artificial
  CRISPR gRNA sequence
gacaaaggctaaggatgaag

SEQ ID NO: 354190 - DNA, 20 bp, Artificial
  CRISPR gRNA sequence
acaaaggctaaggatgaaga

SEQ ID NO: 354191 - DNA, 20 bp, Artificial
  CRISPR gRNA sequence
caaaggctaaggatgaagaa

SEQ ID NO: 354192 - DNA, 20 bp, Artificial
  CRISPR gRNA sequence
aatcccaaaattgtgtatga

SEQ ID NO: 354193 - DNA, 20 bp, Artificial
  CRISPR gRNA sequence
tcccaaaattgtgtatgaca

SEQ ID NO: 354194 - DNA, 20 bp, Artificial
  CRISPR gRNA sequence
caccaatttatttcttgctg

SEQ ID NO: 354195 - DNA, 20 bp, Artificial
  CRISPR gRNA sequence
caatttatttcttgctgaag

SEQ ID NO: 354196 - DNA, 20 bp, Artificial
  CRISPR gRNA sequence
ctgaagtggctgatgaaata

SEQ ID NO: 354197 - DNA, 20 bp, Artificial
  CRISPR gRNA sequence
agtggctgatgaaataaagc

SEQ ID NO: 354198 - DNA, 20 bp, Artificial
  CRISPR gRNA sequence
gtggctgatgaaataaagca

SEQ ID NO: 354199 - DNA, 20 bp, Artificial
  CRISPR gRNA sequence
agcaaggtttcttgattcta

SEQ ID NO: 354200 - DNA, 20 bp, Artificial
  CRISPR gRNA sequence
aggtttcttgattctacagt

SEQ ID NO: 354201 - DNA, 20 bp, Artificial
  CRISPR gRNA sequence
ttgattctacagttggcatc

SEQ ID NO: 354202 - DNA, 20 bp, Artificial
  CRISPR gRNA sequence
attctacagttggcatcaag

SEQ ID NO: 354203 - DNA, 20 bp, Artificial
  CRISPR gRNA sequence
aaaaaaaatattttttgcaa

SEQ ID NO: 354204 - DNA, 20 bp, Artificial
  CRISPR gRNA sequence
gtaactacttaataaataaa

SEQ ID NO: 354205 - DNA, 20 bp, Artificial
  CRISPR gRNA sequence
agttaaactgataaattatg

SEQ ID NO: 354206 - DNA, 20 bp, Artificial
  CRISPR gRNA sequence
gttaaactgataaattatga

SEQ ID NO: 354207 - DNA, 20 bp, Artificial
  CRISPR gRNA sequence
ggcatctgatgaacacatgt

SEQ ID NO: 354208 - DNA, 20 bp, Artificial
  CRISPR gRNA sequence
atgaacacatgttggattgt

SEQ ID NO: 354209 - DNA, 20 bp, Artificial
  CRISPR gRNA sequence
ttggattgtcagaacctttt

SEQ ID NO: 354210 - DNA, 20 bp, Artificial
  CRISPR gRNA sequence
gtcagaacctttttagtact

SEQ ID NO: 354211 - DNA, 20 bp, Artificial
  CRISPR gRNA sequence
cctttttagtacttggcttg

SEQ ID NO: 354212 - DNA, 20 bp, Artificial
  CRISPR gRNA sequence
gtacttggcttgtggccatg

SEQ ID NO: 354213 - DNA, 20 bp, Artificial
  CRISPR gRNA sequence
atgtagaattccactgcgaa

SEQ ID NO: 354214 - DNA, 20 bp, Artificial
  CRISPR gRNA sequence
ctgcgaatagttaaaatgaa

SEQ ID NO: 354215 - DNA, 20 bp, Artificial
  CRISPR gRNA sequence
aaaagaaatttatatacttt

SEQ ID NO: 354216 - DNA, 20 bp, Artificial
  CRISPR gRNA sequence
gaaatttatatacttttggc

SEQ ID NO: 354217 - DNA, 20 bp, Artificial
  CRISPR gRNA sequence
aaatttatatacttttggct

SEQ ID NO: 354218 - DNA, 20 bp, Artificial
  CRISPR gRNA sequence
atatacttttggctaggaat

SEQ ID NO: 354219 - DNA, 20 bp, Artificial
  CRISPR gRNA sequence
tatacttttggctaggaatt

SEQ ID NO: 354220 - DNA, 20 bp, Artificial
  CRISPR gRNA sequence
atacttttggctaggaattg

SEQ ID NO: 354221 - DNA, 20 bp, Artificial
  CRISPR gRNA sequence
aattggggaattttttgtct

SEQ ID NO: 354222 - DNA, 20 bp, Artificial
  CRISPR gRNA sequence
gggaattttttgtcttagtt

SEQ ID NO: 354223 - DNA, 20 bp, Artificial
  CRISPR gRNA sequence
ggaattttttgtcttagttt

SEQ ID NO: 354224 - DNA, 20 bp, Artificial
  CRISPR gRNA sequence
gctgctgtaacaaaatactg

SEQ ID NO: 354225 - DNA, 20 bp, Artificial
  CRISPR gRNA sequence
tgtaacaaaatactgtagac

SEQ ID NO: 354226 - DNA, 20 bp, Artificial
  CRISPR gRNA sequence
gtaacaaaatactgtagact

SEQ ID NO: 354227 - DNA, 20 bp, Artificial
  CRISPR gRNA sequence
ccacaaacacttattcctca

SEQ ID NO: 354228 - DNA, 20 bp, Artificial
  CRISPR gRNA sequence
acacttattcctcacagttc

SEQ ID NO: 354229 - DNA, 20 bp, Artificial
  CRISPR gRNA sequence
acttattcctcacagttctg

SEQ ID NO: 354230 - DNA, 20 bp, Artificial
  CRISPR gRNA sequence
cttattcctcacagttctgg

SEQ ID NO: 354231 - DNA, 20 bp, Artificial
  CRISPR gRNA sequence
ttcctcacagttctggaggc

SEQ ID NO: 354232 - DNA, 20 bp, Artificial
  CRISPR gRNA sequence
tcctcacagttctggaggct

SEQ ID NO: 354233 - DNA, 20 bp, Artificial
  CRISPR gRNA sequence
tcacagttctggaggctggg

SEQ ID NO: 354234 - DNA, 20 bp, Artificial
  CRISPR gRNA sequence
ttctggaggctgggaagtcc

SEQ ID NO: 354235 - DNA, 20 bp, Artificial
  CRISPR gRNA sequence
aggctgggaagtccaagatt

SEQ ID NO: 354236 - DNA, 20 bp, Artificial
  CRISPR gRNA sequence
agaaaatattttcctaactt

SEQ ID NO: 354237 - DNA, 20 bp, Artificial
  CRISPR gRNA sequence
tcctaacttgagaaaaaaaa

SEQ ID NO: 354238 - DNA, 20 bp, Artificial
  CRISPR gRNA sequence
ctaacttgagaaaaaaaaaa

SEQ ID NO: 354239 - DNA, 20 bp, Artificial
  CRISPR gRNA sequence
ttgagaaaaaaaaaagagtc

SEQ ID NO: 354240 - DNA, 20 bp, Artificial
  CRISPR gRNA sequence
gaaaaaaaaaagagtccagt

SEQ ID NO: 354241 - DNA, 20 bp, Artificial
  CRISPR gRNA sequence
aaaaaaaaaagagtccagtg

SEQ ID NO: 354242 - DNA, 20 bp, Artificial
  CRISPR gRNA sequence
aaaaaaaaagagtccagtga

SEQ ID NO: 354243 - DNA, 20 bp, Artificial
  CRISPR gRNA sequence
aagagtccagtgagggcctg

SEQ ID NO: 354244 - DNA, 20 bp, Artificial
  CRISPR gRNA sequence
agagtccagtgagggcctgc

SEQ ID NO: 354245 - DNA, 20 bp, Artificial
  CRISPR gRNA sequence
gggcctgcgggcctgtttct

SEQ ID NO: 354246 - DNA, 20 bp, Artificial
  CRISPR gRNA sequence
cgggcctgtttcttggtttg

SEQ ID NO: 354247 - DNA, 20 bp, Artificial
  CRISPR gRNA sequence
tttgcagacaactgtcttct

SEQ ID NO: 354248 - DNA, 20 bp, Artificial
  CRISPR gRNA sequence
ctcagtatcctcacattgca

SEQ ID NO: 354249 - DNA, 20 bp, Artificial
  CRISPR gRNA sequence
cagtatcctcacattgcaaa

SEQ ID NO: 354250 - DNA, 20 bp, Artificial
  CRISPR gRNA sequence
tatcctcacattgcaaagag

SEQ ID NO: 354251 - DNA, 20 bp, Artificial
  CRISPR gRNA sequence
ctcacattgcaaagagcaga

SEQ ID NO: 354252 - DNA, 20 bp, Artificial
  CRISPR gRNA sequence
cacattgcaaagagcagaaa

SEQ ID NO: 354253 - DNA, 20 bp, Artificial
  CRISPR gRNA sequence
acattgcaaagagcagaaag

SEQ ID NO: 354254 - DNA, 20 bp, Artificial
  CRISPR gRNA sequence
ttgcaaagagcagaaagagg

SEQ ID NO: 354255 - DNA, 20 bp, Artificial
  CRISPR gRNA sequence
aaagagcagaaagaggaagc

SEQ ID NO: 354256 - DNA, 20 bp, Artificial
  CRISPR gRNA sequence
caagctcttctgtccttaaa

SEQ ID NO: 354257 - DNA, 20 bp, Artificial
  CRISPR gRNA sequence
aagctcttctgtccttaaaa

SEQ ID NO: 354258 - DNA, 20 bp, Artificial
  CRISPR gRNA sequence
aggcactgatcccattcacg

SEQ ID NO: 354259 - DNA, 20 bp, Artificial
  CRISPR gRNA sequence
catgatctaattacatccca

SEQ ID NO: 354260 - DNA, 20 bp, Artificial
  CRISPR gRNA sequence
acctcctaatatcatcgcat

SEQ ID NO: 354261 - DNA, 20 bp, Artificial
  CRISPR gRNA sequence
cctcctaatatcatcgcatt

SEQ ID NO: 354262 - DNA, 20 bp, Artificial
  CRISPR gRNA sequence
aatatcatcgcattaggcat

SEQ ID NO: 354263 - DNA, 20 bp, Artificial
  CRISPR gRNA sequence
atatcatcgcattaggcatt

SEQ ID NO: 354264 - DNA, 20 bp, Artificial
  CRISPR gRNA sequence
ggatttcaacatatgaatgt

SEQ ID NO: 354265 - DNA, 20 bp, Artificial
  CRISPR gRNA sequence
gatttcaacatatgaatgtt

SEQ ID NO: 354266 - DNA, 20 bp, Artificial
  CRISPR gRNA sequence
ttcaacatatgaatgttggg

SEQ ID NO: 354267 - DNA, 20 bp, Artificial
  CRISPR gRNA sequence
agacataaatgttcaatcca

SEQ ID NO: 354268 - DNA, 20 bp, Artificial
  CRISPR gRNA sequence
tttttgtgaaatttcataaa

SEQ ID NO: 354269 - DNA, 20 bp, Artificial
  CRISPR gRNA sequence
ttttgtgaaatttcataaac

SEQ ID NO: 354270 - DNA, 20 bp, Artificial
  CRISPR gRNA sequence
aaacaggatgctatgcatta

SEQ ID NO: 354271 - DNA, 20 bp, Artificial
  CRISPR gRNA sequence
aacaggatgctatgcattaa

SEQ ID NO: 354272 - DNA, 20 bp, Artificial
  CRISPR gRNA sequence
aggatgctatgcattaaagg

SEQ ID NO: 354273 - DNA, 20 bp, Artificial
  CRISPR gRNA sequence
gatgctatgcattaaaggaa

SEQ ID NO: 354274 - DNA, 20 bp, Artificial
  CRISPR gRNA sequence
gcattaaaggaagagatttg

SEQ ID NO: 354275 - DNA, 20 bp, Artificial
  CRISPR gRNA sequence
aaaggaagagatttgaagta

SEQ ID NO: 354276 - DNA, 20 bp, Artificial
  CRISPR gRNA sequence
ggaagagatttgaagtatag

SEQ ID NO: 354277 - DNA, 20 bp, Artificial
  CRISPR gRNA sequence
gaagagatttgaagtatagt

SEQ ID NO: 354278 - DNA, 20 bp, Artificial
  CRISPR gRNA sequence
aagagatttgaagtatagtg

SEQ ID NO: 354279 - DNA, 20 bp, Artificial
  CRISPR gRNA sequence
tgaagtatagtggggataac

SEQ ID NO: 354280 - DNA, 20 bp, Artificial
  CRISPR gRNA sequence
atccctcttatctgcaaacc

SEQ ID NO: 354281 - DNA, 20 bp, Artificial
  CRISPR gRNA sequence
cctcttatctgcaaacccag

SEQ ID NO: 354282 - DNA, 20 bp, Artificial
  CRISPR gRNA sequence
ctcttatctgcaaacccaga

SEQ ID NO: 354283 - DNA, 20 bp, Artificial
  CRISPR gRNA sequence
ttatctgcaaacccagaagg

SEQ ID NO: 354284 - DNA, 20 bp, Artificial
  CRISPR gRNA sequence
caaacccagaaggaagtttc

SEQ ID NO: 354285 - DNA, 20 bp, Artificial
  CRISPR gRNA sequence
gaaggaagtttctagtcttt

SEQ ID NO: 354286 - DNA, 20 bp, Artificial
  CRISPR gRNA sequence
tagtcttttagttaaacact

SEQ ID NO: 354287 - DNA, 20 bp, Artificial
  CRISPR gRNA sequence
agtcttttagttaaacacta

SEQ ID NO: 354288 - DNA, 20 bp, Artificial
  CRISPR gRNA sequence
gtcttttagttaaacactaa

SEQ ID NO: 354289 - DNA, 20 bp, Artificial
  CRISPR gRNA sequence
tcttttagttaaacactaag

SEQ ID NO: 354290 - DNA, 20 bp, Artificial
  CRISPR gRNA sequence
tttagttaaacactaagggg

SEQ ID NO: 354291 - DNA, 20 bp, Artificial
  CRISPR gRNA sequence
agttaaacactaaggggcag

SEQ ID NO: 354292 - DNA, 20 bp, Artificial
  CRISPR gRNA sequence
aaacactaaggggcagcagc

SEQ ID NO: 354293 - DNA, 20 bp, Artificial
  CRISPR gRNA sequence
aacactaaggggcagcagca

SEQ ID NO: 354294 - DNA, 20 bp, Artificial
  CRISPR gRNA sequence
actaaggggcagcagcaagg

SEQ ID NO: 354295 - DNA, 20 bp, Artificial
  CRISPR gRNA sequence
gggcagcagcaaggcagaat

SEQ ID NO: 354296 - DNA, 20 bp, Artificial
  CRISPR gRNA sequence
ggcagcagcaaggcagaata

SEQ ID NO: 354297 - DNA, 20 bp, Artificial
  CRISPR gRNA sequence
agcagcaaggcagaataagg

SEQ ID NO: 354298 - DNA, 20 bp, Artificial
  CRISPR gRNA sequence
gaataaggaagaaactttta

SEQ ID NO: 354299 - DNA, 20 bp, Artificial
  CRISPR gRNA sequence
tacagctcatcaaactcctg

SEQ ID NO: 354300 - DNA, 20 bp, Artificial
  CRISPR gRNA sequence
atcaaactcctgcagcccat

SEQ ID NO: 354301 - DNA, 20 bp, Artificial
  CRISPR gRNA sequence
tcaaactcctgcagcccata

SEQ ID NO: 354302 - DNA, 20 bp, Artificial
  CRISPR gRNA sequence
cagcccataaggaaataaaa

SEQ ID NO: 354303 - DNA, 20 bp, Artificial
  CRISPR gRNA sequence
aaggaaataaaaaagttctt

SEQ ID NO: 354304 - DNA, 20 bp, Artificial
  CRISPR gRNA sequence
aaaaagttctttggttgtat

SEQ ID NO: 354305 - DNA, 20 bp, Artificial
  CRISPR gRNA sequence
acactaataacttacctcca

SEQ ID NO: 354306 - DNA, 20 bp, Artificial
  CRISPR gRNA sequence
ctatgtgcttgctacgcttc

SEQ ID NO: 354307 - DNA, 20 bp, Artificial
  CRISPR gRNA sequence
aaaaatattatgtcctctcc

SEQ ID NO: 354308 - DNA, 20 bp, Artificial
  CRISPR gRNA sequence
aaaatattatgtcctctcct

SEQ ID NO: 354309 - DNA, 20 bp, Artificial
  CRISPR gRNA sequence
tattatgtcctctcctgggt

SEQ ID NO: 354310 - DNA, 20 bp, Artificial
  CRISPR gRNA sequence
ctgcaaattcatgtcctcct

SEQ ID NO: 354311 - DNA, 20 bp, Artificial
  CRISPR gRNA sequence
aatgtgacctcatttgaaaa

SEQ ID NO: 354312 - DNA, 20 bp, Artificial
  CRISPR gRNA sequence
atgtgacctcatttgaaaat

SEQ ID NO: 354313 - DNA, 20 bp, Artificial
  CRISPR gRNA sequence
gaaaataggatccttgtaat

SEQ ID NO: 354314 - DNA, 20 bp, Artificial
  CRISPR gRNA sequence
taggatccttgtaattagct

SEQ ID NO: 354315 - DNA, 20 bp, Artificial
  CRISPR gRNA sequence
aagctcaaacaacgctgtgc

SEQ ID NO: 354316 - DNA, 20 bp, Artificial
  CRISPR gRNA sequence
gctcaaacaacgctgtgctg

SEQ ID NO: 354317 - DNA, 20 bp, Artificial
  CRISPR gRNA sequence
tcaaacaacgctgtgctgga

SEQ ID NO: 354318 - DNA, 20 bp, Artificial
  CRISPR gRNA sequence
caaacaacgctgtgctggag

SEQ ID NO: 354319 - DNA, 20 bp, Artificial
  CRISPR gRNA sequence
aaacaacgctgtgctggaga

SEQ ID NO: 354320 - DNA, 20 bp, Artificial
  CRISPR gRNA sequence
aacaacgctgtgctggagag

SEQ ID NO: 354321 - DNA, 20 bp, Artificial
  CRISPR gRNA sequence
aacgctgtgctggagagggg

SEQ ID NO: 354322 - DNA, 20 bp, Artificial
  CRISPR gRNA sequence
acgctgtgctggagaggggt

SEQ ID NO: 354323 - DNA, 20 bp, Artificial
  CRISPR gRNA sequence
ctggagaggggtgggccttt

SEQ ID NO: 354324 - DNA, 20 bp, Artificial
  CRISPR gRNA sequence
aggggtgggcctttaagtcc

SEQ ID NO: 354325 - DNA, 20 bp, Artificial
  CRISPR gRNA sequence
gcctttaagtccaagataac

SEQ ID NO: 354326 - DNA, 20 bp, Artificial
  CRISPR gRNA sequence
cctttaagtccaagataact

SEQ ID NO: 354327 - DNA, 20 bp, Artificial
  CRISPR gRNA sequence
ctttaagtccaagataactg

SEQ ID NO: 354328 - DNA, 20 bp, Artificial
  CRISPR gRNA sequence
aagataactggggtctccat

SEQ ID NO: 354329 - DNA, 20 bp, Artificial
  CRISPR gRNA sequence
aactggggtctccataagaa

SEQ ID NO: 354330 - DNA, 20 bp, Artificial
  CRISPR gRNA sequence
tggggtctccataagaaaag

SEQ ID NO: 354331 - DNA, 20 bp, Artificial
  CRISPR gRNA sequence
ggggtctccataagaaaaga

SEQ ID NO: 354332 - DNA, 20 bp, Artificial
  CRISPR gRNA sequence
gtctccataagaaaagaagg

SEQ ID NO: 354333 - DNA, 20 bp, Artificial
  CRISPR gRNA sequence
tctccataagaaaagaagga

SEQ ID NO: 354334 - DNA, 20 bp, Artificial
  CRISPR gRNA sequence
ccataagaaaagaaggaagg

SEQ ID NO: 354335 - DNA, 20 bp, Artificial
  CRISPR gRNA sequence
ggaaggcagacacacacaca

SEQ ID NO: 354336 - DNA, 20 bp, Artificial
  CRISPR gRNA sequence
gcagacacacacacacagct

SEQ ID NO: 354337 - DNA, 20 bp, Artificial
  CRISPR gRNA sequence
cacacacacacagctgagaa

SEQ ID NO: 354338 - DNA, 20 bp, Artificial
  CRISPR gRNA sequence
acacagctgagaacagtgat

SEQ ID NO: 354339 - DNA, 20 bp, Artificial
  CRISPR gRNA sequence
acagctgagaacagtgatga

SEQ ID NO: 354340 - DNA, 20 bp, Artificial
  CRISPR gRNA sequence
cagctgagaacagtgatgag

SEQ ID NO: 354341 - DNA, 20 bp, Artificial
  CRISPR gRNA sequence
agctgagaacagtgatgaga

SEQ ID NO: 354342 - DNA, 20 bp, Artificial
  CRISPR gRNA sequence
gctgagaacagtgatgagag

SEQ ID NO: 354343 - DNA, 20 bp, Artificial
  CRISPR gRNA sequence
gagaacagtgatgagagggg

SEQ ID NO: 354344 - DNA, 20 bp, Artificial
  CRISPR gRNA sequence
gaacagtgatgagaggggca

SEQ ID NO: 354345 - DNA, 20 bp, Artificial
  CRISPR gRNA sequence
gtgatgagaggggcagagat

SEQ ID NO: 354346 - DNA, 20 bp, Artificial
  CRISPR gRNA sequence
gatgagaggggcagagattg

SEQ ID NO: 354347 - DNA, 20 bp, Artificial
  CRISPR gRNA sequence
gattggagcgatgtgtctac

SEQ ID NO: 354348 - DNA, 20 bp, Artificial
  CRISPR gRNA sequence
gagcgatgtgtctaccagcc

SEQ ID NO: 354349 - DNA, 20 bp, Artificial
  CRISPR gRNA sequence
agcgatgtgtctaccagcca

SEQ ID NO: 354350 - DNA, 20 bp, Artificial
  CRISPR gRNA sequence
gtctaccagccaaggatcga

SEQ ID NO: 354351 - DNA, 20 bp, Artificial
  CRISPR gRNA sequence
ccaaggatcgacagctccac

SEQ ID NO: 354352 - DNA, 20 bp, Artificial
  CRISPR gRNA sequence
aggatcgacagctccactag

SEQ ID NO: 354353 - DNA, 20 bp, Artificial
  CRISPR gRNA sequence
tcgacagctccactagaagc

SEQ ID NO: 354354 - DNA, 20 bp, Artificial
  CRISPR gRNA sequence
cagctccactagaagctgga

SEQ ID NO: 354355 - DNA, 20 bp, Artificial
  CRISPR gRNA sequence
ctccactagaagctggatag

SEQ ID NO: 354356 - DNA, 20 bp, Artificial
  CRISPR gRNA sequence
ctagaagctggatagaagca

SEQ ID NO: 354357 - DNA, 20 bp, Artificial
  CRISPR gRNA sequence
tagaagctggatagaagcat

SEQ ID NO: 354358 - DNA, 20 bp, Artificial
  CRISPR gRNA sequence
agctggatagaagcatggga

SEQ ID NO: 354359 - DNA, 20 bp, Artificial
  CRISPR gRNA sequence
ggatggattctcatcccacg

SEQ ID NO: 354360 - DNA, 20 bp, Artificial
  CRISPR gRNA sequence
ttctcatcccacgaagaaac

SEQ ID NO: 354361 - DNA, 20 bp, Artificial
  CRISPR gRNA sequence
tttcttgtacttcaaccctc

SEQ ID NO: 354362 - DNA, 20 bp, Artificial
  CRISPR gRNA sequence
acttcaaccctccagaatta

SEQ ID NO: 354363 - DNA, 20 bp, Artificial
  CRISPR gRNA sequence
tcaaccctccagaattatgg

SEQ ID NO: 354364 - DNA, 20 bp, Artificial
  CRISPR gRNA sequence
cctccagaattatggaagaa

SEQ ID NO: 354365 - DNA, 20 bp, Artificial
  CRISPR gRNA sequence
gaatagatttctgttgtttt

SEQ ID NO: 354366 - DNA, 20 bp, Artificial
  CRISPR gRNA sequence
tgttttaagccaccccgttt

SEQ ID NO: 354367 - DNA, 20 bp, Artificial
  CRISPR gRNA sequence
cccgttttggtaatttgtca

SEQ ID NO: 354368 - DNA, 20 bp, Artificial
  CRISPR gRNA sequence
gttttggtaatttgtcacag

SEQ ID NO: 354369 - DNA, 20 bp, Artificial
  CRISPR gRNA sequence
gtaatttgtcacagcagccc

SEQ ID NO: 354370 - DNA, 20 bp, Artificial
  CRISPR gRNA sequence
ttgtcacagcagccctagaa

SEQ ID NO: 354371 - DNA, 20 bp, Artificial
  CRISPR gRNA sequence
tgtcacagcagccctagaaa

SEQ ID NO: 354372 - DNA, 20 bp, Artificial
  CRISPR gRNA sequence
gcagccctagaaaaggaaca

SEQ ID NO: 354373 - DNA, 20 bp, Artificial
  CRISPR gRNA sequence
ctagaaaaggaacaaagatt

SEQ ID NO: 354374 - DNA, 20 bp, Artificial
  CRISPR gRNA sequence
tagaaaaggaacaaagattt

SEQ ID NO: 354375 - DNA, 20 bp, Artificial
  CRISPR gRNA sequence
agaaaaggaacaaagattta

SEQ ID NO: 354376 - DNA, 20 bp, Artificial
  CRISPR gRNA sequence
aaaggaacaaagatttaggg

SEQ ID NO: 354377 - DNA, 20 bp, Artificial
  CRISPR gRNA sequence
aaggaacaaagatttaggga

SEQ ID NO: 354378 - DNA, 20 bp, Artificial
  CRISPR gRNA sequence
acaaagatttagggaaggca

SEQ ID NO: 354379 - DNA, 20 bp, Artificial
  CRISPR gRNA sequence
agtgttgattgttattacgc

SEQ ID NO: 354380 - DNA, 20 bp, Artificial
  CRISPR gRNA sequence
gtgttgattgttattacgcc

SEQ ID NO: 354381 - DNA, 20 bp, Artificial
  CRISPR gRNA sequence
tgttgattgttattacgcca

SEQ ID NO: 354382 - DNA, 20 bp, Artificial
  CRISPR gRNA sequence
ttatattcatataaaaaact

SEQ ID NO: 354383 - DNA, 20 bp, Artificial
  CRISPR gRNA sequence
atataaaaaacttagtttca

SEQ ID NO: 354384 - DNA, 20 bp, Artificial
  CRISPR gRNA sequence
tataaaaaacttagtttcaa

SEQ ID NO: 354385 - DNA, 20 bp, Artificial
  CRISPR gRNA sequence
ataaaaaacttagtttcaaa

SEQ ID NO: 354386 - DNA, 20 bp, Artificial
  CRISPR gRNA sequence
gtttcaaagggtattaaaaa

SEQ ID NO: 354387 - DNA, 20 bp, Artificial
  CRISPR gRNA sequence
aaagggtattaaaaatagaa

SEQ ID NO: 354388 - DNA, 20 bp, Artificial
  CRISPR gRNA sequence
gtattaaaaatagaatagtt

SEQ ID NO: 354389 - DNA, 20 bp, Artificial
  CRISPR gRNA sequence
agaaaataactttctccaaa

SEQ ID NO: 354390 - DNA, 20 bp, Artificial
  CRISPR gRNA sequence
aatagctgatatttaaatta

SEQ ID NO: 354391 - DNA, 20 bp, Artificial
  CRISPR gRNA sequence
atagctgatatttaaattac

SEQ ID NO: 354392 - DNA, 20 bp, Artificial
  CRISPR gRNA sequence
ttaaattacaggcaactgca

SEQ ID NO: 354393 - DNA, 20 bp, Artificial
  CRISPR gRNA sequence
attacaggcaactgcatggt

SEQ ID NO: 354394 - DNA, 20 bp, Artificial
  CRISPR gRNA sequence
ttacaggcaactgcatggtc

SEQ ID NO: 354395 - DNA, 20 bp, Artificial
  CRISPR gRNA sequence
ctgcatggtcaggttactga

SEQ ID NO: 354396 - DNA, 20 bp, Artificial
  CRISPR gRNA sequence
tgcatggtcaggttactgaa

SEQ ID NO: 354397 - DNA, 20 bp, Artificial
  CRISPR gRNA sequence
ctgaaaggacaataaaatat

SEQ ID NO: 354398 - DNA, 20 bp, Artificial
  CRISPR gRNA sequence
tataagattgctaactgcaa

SEQ ID NO: 354399 - DNA, 20 bp, Artificial
  CRISPR gRNA sequence
taagattgctaactgcaaaa

SEQ ID NO: 354400 - DNA, 20 bp, Artificial
  CRISPR gRNA sequence
tttgcatctgtaaattacaa

SEQ ID NO: 354401 - DNA, 20 bp, Artificial
  CRISPR gRNA sequence
attacaaaagaaaaaaatga

SEQ ID NO: 354402 - DNA, 20 bp, Artificial
  CRISPR gRNA sequence
aacttaccttctgtgtatcc

SEQ ID NO: 354403 - DNA, 20 bp, Artificial
  CRISPR gRNA sequence
acttaccttctgtgtatccc

SEQ ID NO: 354404 - DNA, 20 bp, Artificial
  CRISPR gRNA sequence
gtatcccaggactctgtaaa

SEQ ID NO: 354405 - DNA, 20 bp, Artificial
  CRISPR gRNA sequence
tctctctctccttctccttc

SEQ ID NO: 354406 - DNA, 20 bp, Artificial
  CRISPR gRNA sequence
tctggaatgcatattcaata

SEQ ID NO: 354407 - DNA, 20 bp, Artificial
  CRISPR gRNA sequence
ctggaatgcatattcaataa

SEQ ID NO: 354408 - DNA, 20 bp, Artificial
  CRISPR gRNA sequence
catattcaataaaggatata

SEQ ID NO: 354409 - DNA, 20 bp, Artificial
  CRISPR gRNA sequence
gatataaagatatgatattc

SEQ ID NO: 354410 - DNA, 20 bp, Artificial
  CRISPR gRNA sequence
ccagtactaatattatttcg

SEQ ID NO: 354411 - DNA, 20 bp, Artificial
  CRISPR gRNA sequence
tctatacctcactgtacccc

SEQ ID NO: 354412 - DNA, 20 bp, Artificial
  CRISPR gRNA sequence
atgcaccttctaatatgttg

SEQ ID NO: 354413 - DNA, 20 bp, Artificial
  CRISPR gRNA sequence
caccttctaatatgttgaag

SEQ ID NO: 354414 - DNA, 20 bp, Artificial
  CRISPR gRNA sequence
tccaaaattctgttacccta

SEQ ID NO: 354415 - DNA, 20 bp, Artificial
  CRISPR gRNA sequence
tgtcttctccaaattgctcc

SEQ ID NO: 354416 - DNA, 20 bp, Artificial
  CRISPR gRNA sequence
ttctccaaattgctcccaga

SEQ ID NO: 354417 - DNA, 20 bp, Artificial
  CRISPR gRNA sequence
ccaaattgctcccagatggt

SEQ ID NO: 354418 - DNA, 20 bp, Artificial
  CRISPR gRNA sequence
caaattgctcccagatggtg

SEQ ID NO: 354419 - DNA, 20 bp, Artificial
  CRISPR gRNA sequence
aaattgctcccagatggtga

SEQ ID NO: 354420 - DNA, 20 bp, Artificial
  CRISPR gRNA sequence
agatggtgagggcaactaaa

SEQ ID NO: 354421 - DNA, 20 bp, Artificial
  CRISPR gRNA sequence
gatatctaaccactgtgcat

SEQ ID NO: 354422 - DNA, 20 bp, Artificial
  CRISPR gRNA sequence
tgtgcattagtaattaatct

SEQ ID NO: 354423 - DNA, 20 bp, Artificial
  CRISPR gRNA sequence
taatctcagtgattttacta

SEQ ID NO: 354424 - DNA, 20 bp, Artificial
  CRISPR gRNA sequence
ttttactaaagaatgattta

SEQ ID NO: 354425 - DNA, 20 bp, Artificial
  CRISPR gRNA sequence
cttattacataaatgactta

SEQ ID NO: 354426 - DNA, 20 bp, Artificial
  CRISPR gRNA sequence
ctccaaataacctcacattt

SEQ ID NO: 354427 - DNA, 20 bp, Artificial
  CRISPR gRNA sequence
ttaaaatttattttaaatgc

SEQ ID NO: 354428 - DNA, 20 bp, Artificial
  CRISPR gRNA sequence
aaatttattttaaatgccag

SEQ ID NO: 354429 - DNA, 20 bp, Artificial
  CRISPR gRNA sequence
atgccagcagtgtaacttct

SEQ ID NO: 354430 - DNA, 20 bp, Artificial
  CRISPR gRNA sequence
tcttggatgacaatataatg

SEQ ID NO: 354431 - DNA, 20 bp, Artificial
  CRISPR gRNA sequence
tgaagctttataaaatcttt

SEQ ID NO: 354432 - DNA, 20 bp, Artificial
  CRISPR gRNA sequence
gaagctttataaaatctttt

SEQ ID NO: 354433 - DNA, 20 bp, Artificial
  CRISPR gRNA sequence
gttattctaaatcactcgta

SEQ ID NO: 354434 - DNA, 20 bp, Artificial
  CRISPR gRNA sequence
attttattaaatcacttatg

SEQ ID NO: 354435 - DNA, 20 bp, Artificial
  CRISPR gRNA sequence
cttatgtagattattttatt

SEQ ID NO: 354436 - DNA, 20 bp, Artificial
  CRISPR gRNA sequence
ttattaagatttcatataaa

SEQ ID NO: 354437 - DNA, 20 bp, Artificial
  CRISPR gRNA sequence
tattaagatttcatataaac

SEQ ID NO: 354438 - DNA, 20 bp, Artificial
  CRISPR gRNA sequence
agatttcatataaacaggtt

SEQ ID NO: 354439 - DNA, 20 bp, Artificial
  CRISPR gRNA sequence
tataaacaggtttagaaact

SEQ ID NO: 354440 - DNA, 20 bp, Artificial
  CRISPR gRNA sequence
ataaacaggtttagaaacta

SEQ ID NO: 354441 - DNA, 20 bp, Artificial
  CRISPR gRNA sequence
ggtttagaaactaaggtgtg

SEQ ID NO: 354442 - DNA, 20 bp, Artificial
  CRISPR gRNA sequence
tttagaaactaaggtgtgaa

SEQ ID NO: 354443 - DNA, 20 bp, Artificial
  CRISPR gRNA sequence
ttagaaactaaggtgtgaag

SEQ ID NO: 354444 - DNA, 20 bp, Artificial
  CRISPR gRNA sequence
gaaactaaggtgtgaagagg

SEQ ID NO: 354445 - DNA, 20 bp, Artificial
  CRISPR gRNA sequence
aactaaggtgtgaagaggaa

SEQ ID NO: 354446 - DNA, 20 bp, Artificial
  CRISPR gRNA sequence
cttgtcccaaatcacatgat

SEQ ID NO: 354447 - DNA, 20 bp, Artificial
  CRISPR gRNA sequence
tcccaaatcacatgatcggt

SEQ ID NO: 354448 - DNA, 20 bp, Artificial
  CRISPR gRNA sequence
aatcacatgatcggttggtg

SEQ ID NO: 354449 - DNA, 20 bp, Artificial
  CRISPR gRNA sequence
atgatcggttggtgtagtgc

SEQ ID NO: 354450 - DNA, 20 bp, Artificial
  CRISPR gRNA sequence
cgccctccctcttgactatt

SEQ ID NO: 354451 - DNA, 20 bp, Artificial
  CRISPR gRNA sequence
ctattaagctctccaacttc

SEQ ID NO: 354452 - DNA, 20 bp, Artificial
  CRISPR gRNA sequence
aatcacttcgccgtgactga

SEQ ID NO: 354453 - DNA, 20 bp, Artificial
  CRISPR gRNA sequence
atcacttcgccgtgactgaa

SEQ ID NO: 354454 - DNA, 20 bp, Artificial
  CRISPR gRNA sequence
gaaaggaccatctgcaacca

SEQ ID NO: 354455 - DNA, 20 bp, Artificial
  CRISPR gRNA sequence
agtattcaataaacgctcca

SEQ ID NO: 354456 - DNA, 20 bp, Artificial
  CRISPR gRNA sequence
gaaacccataaaaacctaac

SEQ ID NO: 354457 - DNA, 20 bp, Artificial
  CRISPR gRNA sequence
aaacccataaaaacctaacc

SEQ ID NO: 354458 - DNA, 20 bp, Artificial
  CRISPR gRNA sequence
aacccataaaaacctaacca

SEQ ID NO: 354459 - DNA, 20 bp, Artificial
  CRISPR gRNA sequence
acccataaaaacctaaccag

SEQ ID NO: 354460 - DNA, 20 bp, Artificial
  CRISPR gRNA sequence
aaacctaaccaggggaatca

SEQ ID NO: 354461 - DNA, 20 bp, Artificial
  CRISPR gRNA sequence
cctaaccaggggaatcatag

SEQ ID NO: 354462 - DNA, 20 bp, Artificial
  CRISPR gRNA sequence
taaccaggggaatcatagaa

SEQ ID NO: 354463 - DNA, 20 bp, Artificial
  CRISPR gRNA sequence
aatcatagaagagaaaatac

SEQ ID NO: 354464 - DNA, 20 bp, Artificial
  CRISPR gRNA sequence
tcatagaagagaaaatacca

SEQ ID NO: 354465 - DNA, 20 bp, Artificial
  CRISPR gRNA sequence
tagaagagaaaataccagag

SEQ ID NO: 354466 - DNA, 20 bp, Artificial
  CRISPR gRNA sequence
aagagaaaataccagagaag

SEQ ID NO: 354467 - DNA, 20 bp, Artificial
  CRISPR gRNA sequence
aaaataccagagaagaagaa

SEQ ID NO: 354468 - DNA, 20 bp, Artificial
  CRISPR gRNA sequence
aataccagagaagaagaaaa

SEQ ID NO: 354469 - DNA, 20 bp, Artificial
  CRISPR gRNA sequence
ataccagagaagaagaaaag

SEQ ID NO: 354470 - DNA, 20 bp, Artificial
  CRISPR gRNA sequence
aggctactgtaactgaatgc

SEQ ID NO: 354471 - DNA, 20 bp, Artificial
  CRISPR gRNA sequence
gctactgtaactgaatgcaa

SEQ ID NO: 354472 - DNA, 20 bp, Artificial
  CRISPR gRNA sequence
ctgtatccaactatataaaa

SEQ ID NO: 354473 - DNA, 20 bp, Artificial
  CRISPR gRNA sequence
actatataaaatagttatta

SEQ ID NO: 354474 - DNA, 20 bp, Artificial
  CRISPR gRNA sequence
ctatataaaatagttattat

SEQ ID NO: 354475 - DNA, 20 bp, Artificial
  CRISPR gRNA sequence
tatataaaatagttattata

SEQ ID NO: 354476 - DNA, 20 bp, Artificial
  CRISPR gRNA sequence
tataaaatagttattatagg

SEQ ID NO: 354477 - DNA, 20 bp, Artificial
  CRISPR gRNA sequence
aaatagttattatagggaga

SEQ ID NO: 354478 - DNA, 20 bp, Artificial
  CRISPR gRNA sequence
gtgactctttttatctccct

SEQ ID NO: 354479 - DNA, 20 bp, Artificial
  CRISPR gRNA sequence
tgactctttttatctcccta

SEQ ID NO: 354480 - DNA, 20 bp, Artificial
  CRISPR gRNA sequence
ctttttatctccctaaggaa

SEQ ID NO: 354481 - DNA, 20 bp, Artificial
  CRISPR gRNA sequence
aaaagattcttattgaacaa

SEQ ID NO: 354482 - DNA, 20 bp, Artificial
  CRISPR gRNA sequence
tgaacaacagactcctctgt

SEQ ID NO: 354483 - DNA, 20 bp, Artificial
  CRISPR gRNA sequence
acagactcctctgttagata

SEQ ID NO: 354484 - DNA, 20 bp, Artificial
  CRISPR gRNA sequence
gactcctctgttagatacag

SEQ ID NO: 354485 - DNA, 20 bp, Artificial
  CRISPR gRNA sequence
tctgttagatacagaagata

SEQ ID NO: 354486 - DNA, 20 bp, Artificial
  CRISPR gRNA sequence
gatacagaaatgtaatgttt

SEQ ID NO: 354487 - DNA, 20 bp, Artificial
  CRISPR gRNA sequence
atacagaaatgtaatgtttt

SEQ ID NO: 354488 - DNA, 20 bp, Artificial
  CRISPR gRNA sequence
acagaaatgtaatgttttgg

SEQ ID NO: 354489 - DNA, 20 bp, Artificial
  CRISPR gRNA sequence
atgttttgggagttctcttt

SEQ ID NO: 354490 - DNA, 20 bp, Artificial
  CRISPR gRNA sequence
tgttttgggagttctcttta

SEQ ID NO: 354491 - DNA, 20 bp, Artificial
  CRISPR gRNA sequence
ttgggagttctctttaaggt

SEQ ID NO: 354492 - DNA, 20 bp, Artificial
  CRISPR gRNA sequence
tgggagttctctttaaggtg

SEQ ID NO: 354493 - DNA, 20 bp, Artificial
  CRISPR gRNA sequence
tttgtgaatatcttgaaaat

SEQ ID NO: 354494 - DNA, 20 bp, Artificial
  CRISPR gRNA sequence
tgaatatcttgaaaataaga

SEQ ID NO: 354495 - DNA, 20 bp, Artificial
  CRISPR gRNA sequence
aaaataagatggtctttctc

SEQ ID NO: 354496 - DNA, 20 bp, Artificial
  CRISPR gRNA sequence
aaataagatggtctttctcc

SEQ ID NO: 354497 - DNA, 20 bp, Artificial
  CRISPR gRNA sequence
aataagatggtctttctcca

SEQ ID NO: 354498 - DNA, 20 bp, Artificial
  CRISPR gRNA sequence
agatggtctttctccaggga

SEQ ID NO: 354499 - DNA, 20 bp, Artificial
  CRISPR gRNA sequence
gatggtctttctccagggaa

SEQ ID NO: 354500 - DNA, 20 bp, Artificial
  CRISPR gRNA sequence
ttctccagggaaaggttatg

SEQ ID NO: 354501 - DNA, 20 bp, Artificial
  CRISPR gRNA sequence
tctccagggaaaggttatgc

SEQ ID NO: 354502 - DNA, 20 bp, Artificial
  CRISPR gRNA sequence
gggaaaggttatgcaggaaa

SEQ ID NO: 354503 - DNA, 20 bp, Artificial
  CRISPR gRNA sequence
ttgactccaattgtctcttc

SEQ ID NO: 354504 - DNA, 20 bp, Artificial
  CRISPR gRNA sequence
tgtgtaaatttactatacac

SEQ ID NO: 354505 - DNA, 20 bp, Artificial
  CRISPR gRNA sequence
gtgtaaatttactatacaca

SEQ ID NO: 354506 - DNA, 20 bp, Artificial
  CRISPR gRNA sequence
tttactatacacaaggcata

SEQ ID NO: 354507 - DNA, 20 bp, Artificial
  CRISPR gRNA sequence
ctatacacaaggcatatggc

SEQ ID NO: 354508 - DNA, 20 bp, Artificial
  CRISPR gRNA sequence
tatacacaaggcatatggct

SEQ ID NO: 354509 - DNA, 20 bp, Artificial
  CRISPR gRNA sequence
gctaggtgttttatataaat

SEQ ID NO: 354510 - DNA, 20 bp, Artificial
  CRISPR gRNA sequence
ctcaaaataaatctatgata

SEQ ID NO: 354511 - DNA, 20 bp, Artificial
  CRISPR gRNA sequence
ctattattatcctcatttta

SEQ ID NO: 354512 - DNA, 20 bp, Artificial
  CRISPR gRNA sequence
attatcctcattttaaagat

SEQ ID NO: 354513 - DNA, 20 bp, Artificial
  CRISPR gRNA sequence
ttatcctcattttaaagata

SEQ ID NO: 354514 - DNA, 20 bp, Artificial
  CRISPR gRNA sequence
ctcattttaaagataaggaa

SEQ ID NO: 354515 - DNA, 20 bp, Artificial
  CRISPR gRNA sequence
tttgaccttttattaaattg

SEQ ID NO: 354516 - DNA, 20 bp, Artificial
  CRISPR gRNA sequence
tttattaaattgtggttcac

SEQ ID NO: 354517 - DNA, 20 bp, Artificial
  CRISPR gRNA sequence
ttattaaattgtggttcaca

SEQ ID NO: 354518 - DNA, 20 bp, Artificial
  CRISPR gRNA sequence
gcttgctatctcacaacgtg

SEQ ID NO: 354519 - DNA, 20 bp, Artificial
  CRISPR gRNA sequence
gtgcagttaacgttcccaac

SEQ ID NO: 354520 - DNA, 20 bp, Artificial
  CRISPR gRNA sequence
tgcagttaacgttcccaacc

SEQ ID NO: 354521 - DNA, 20 bp, Artificial
  CRISPR gRNA sequence
cacacacacacacacacaca

SEQ ID NO: 354522 - DNA, 20 bp, Artificial
  CRISPR gRNA sequence
acacacatacacatttaaat

SEQ ID NO: 354523 - DNA, 20 bp, Artificial
  CRISPR gRNA sequence
catacacatttaaataagcc

SEQ ID NO: 354524 - DNA, 20 bp, Artificial
  CRISPR gRNA sequence
tacacatttaaataagcctg

SEQ ID NO: 354525 - DNA, 20 bp, Artificial
  CRISPR gRNA sequence
catacaatgtgatgaaacaa

SEQ ID NO: 354526 - DNA, 20 bp, Artificial
  CRISPR gRNA sequence
tacaatgtgatgaaacaaaa

SEQ ID NO: 354527 - DNA, 20 bp, Artificial
  CRISPR gRNA sequence
tgatgaaacaaaagagaaca

SEQ ID NO: 354528 - DNA, 20 bp, Artificial
  CRISPR gRNA sequence
acaaaagagaacatggaact

SEQ ID NO: 354529 - DNA, 20 bp, Artificial
  CRISPR gRNA sequence
aaaagagaacatggaactta

SEQ ID NO: 354530 - DNA, 20 bp, Artificial
  CRISPR gRNA sequence
acttgcactctgcaatttac

SEQ ID NO: 354531 - DNA, 20 bp, Artificial
  CRISPR gRNA sequence
cactctgcaatttactagct

SEQ ID NO: 354532 - DNA, 20 bp, Artificial
  CRISPR gRNA sequence
ctgagttatttatgtcttta

SEQ ID NO: 354533 - DNA, 20 bp, Artificial
  CRISPR gRNA sequence
ttatttatgtctttaaagtt

SEQ ID NO: 354534 - DNA, 20 bp, Artificial
  CRISPR gRNA sequence
ctctcatctgtattattaaa

SEQ ID NO: 354535 - DNA, 20 bp, Artificial
  CRISPR gRNA sequence
attaaaaagtcaaaaaatat

SEQ ID NO: 354536 - DNA, 20 bp, Artificial
  CRISPR gRNA sequence
agtcaaaaaatattagatgc

SEQ ID NO: 354537 - DNA, 20 bp, Artificial
  CRISPR gRNA sequence
aaaaaatattagatgctggc

SEQ ID NO: 354538 - DNA, 20 bp, Artificial
  CRISPR gRNA sequence
aaaaatattagatgctggca

SEQ ID NO: 354539 - DNA, 20 bp, Artificial
  CRISPR gRNA sequence
attagatgctggcaaggttg

SEQ ID NO: 354540 - DNA, 20 bp, Artificial
  CRISPR gRNA sequence
tagatgctggcaaggttgtg

SEQ ID NO: 354541 - DNA, 20 bp, Artificial
  CRISPR gRNA sequence
agatgctggcaaggttgtgg

SEQ ID NO: 354542 - DNA, 20 bp, Artificial
  CRISPR gRNA sequence
tggcaaggttgtggaggaaa

SEQ ID NO: 354543 - DNA, 20 bp, Artificial
  CRISPR gRNA sequence
aaagaacacttttacgctgt

SEQ ID NO: 354544 - DNA, 20 bp, Artificial
  CRISPR gRNA sequence
gaacacttttacgctgttgg

SEQ ID NO: 354545 - DNA, 20 bp, Artificial
  CRISPR gRNA sequence
aacacttttacgctgttggt

SEQ ID NO: 354546 - DNA, 20 bp, Artificial
  CRISPR gRNA sequence
ctgttggtgggaatgtaaat

SEQ ID NO: 354547 - DNA, 20 bp, Artificial
  CRISPR gRNA sequence
ggtgggaatgtaaattagtt

SEQ ID NO: 354548 - DNA, 20 bp, Artificial
  CRISPR gRNA sequence
gtgggaatgtaaattagttc

SEQ ID NO: 354549 - DNA, 20 bp, Artificial
  CRISPR gRNA sequence
gtaaattagttcaggcattg

SEQ ID NO: 354550 - DNA, 20 bp, Artificial
  CRISPR gRNA sequence
aattagttcaggcattgtgg

SEQ ID NO: 354551 - DNA, 20 bp, Artificial
  CRISPR gRNA sequence
agttcaggcattgtggaaga

SEQ ID NO: 354552 - DNA, 20 bp, Artificial
  CRISPR gRNA sequence
aggcattgtggaagacagtg

SEQ ID NO: 354553 - DNA, 20 bp, Artificial
  CRISPR gRNA sequence
ggtgattcctcaaaaactta

SEQ ID NO: 354554 - DNA, 20 bp, Artificial
  CRISPR gRNA sequence
attcctcaaaaacttacaga

SEQ ID NO: 354555 - DNA, 20 bp, Artificial
  CRISPR gRNA sequence
gacagaaataccatttgacc

SEQ ID NO: 354556 - DNA, 20 bp, Artificial
  CRISPR gRNA sequence
agaaataccatttgacccag

SEQ ID NO: 354557 - DNA, 20 bp, Artificial
  CRISPR gRNA sequence
tgacccagcagcgccattac

SEQ ID NO: 354558 - DNA, 20 bp, Artificial
  CRISPR gRNA sequence
gacccagcagcgccattact

SEQ ID NO: 354559 - DNA, 20 bp, Artificial
  CRISPR gRNA sequence
cattactgggtatatgccca

SEQ ID NO: 354560 - DNA, 20 bp, Artificial
  CRISPR gRNA sequence
attactgggtatatgcccaa

SEQ ID NO: 354561 - DNA, 20 bp, Artificial
  CRISPR gRNA sequence
aatataaatcattctactat

SEQ ID NO: 354562 - DNA, 20 bp, Artificial
  CRISPR gRNA sequence
ttctactataagacacatgc

SEQ ID NO: 354563 - DNA, 20 bp, Artificial
  CRISPR gRNA sequence
atgcaagcatgtgttcattg

SEQ ID NO: 354564 - DNA, 20 bp, Artificial
  CRISPR gRNA sequence
cattgcagcactattcatga

SEQ ID NO: 354565 - DNA, 20 bp, Artificial
  CRISPR gRNA sequence
cagcactattcatgatagca

SEQ ID NO: 354566 - DNA, 20 bp, Artificial
  CRISPR gRNA sequence
tattcatgatagcaaagaca

SEQ ID NO: 354567 - DNA, 20 bp, Artificial
  CRISPR gRNA sequence
acctcaatacccgtcaatga

SEQ ID NO: 354568 - DNA, 20 bp, Artificial
  CRISPR gRNA sequence
aatacccgtcaatgatagac

SEQ ID NO: 354569 - DNA, 20 bp, Artificial
  CRISPR gRNA sequence
cgtcaatgatagactggata

SEQ ID NO: 354570 - DNA, 20 bp, Artificial
  CRISPR gRNA sequence
tagactggataaagaaaatg

SEQ ID NO: 354571 - DNA, 20 bp, Artificial
  CRISPR gRNA sequence
aatgtggtacacatatacca

SEQ ID NO: 354572 - DNA, 20 bp, Artificial
  CRISPR gRNA sequence
atataccatagaacactata

SEQ ID NO: 354573 - DNA, 20 bp, Artificial
  CRISPR gRNA sequence
catagaacactatacagcca

SEQ ID NO: 354574 - DNA, 20 bp, Artificial
  CRISPR gRNA sequence
gaacactatacagccacaga

SEQ ID NO: 354575 - DNA, 20 bp, Artificial
  CRISPR gRNA sequence
atacagccacagaaagaaat

SEQ ID NO: 354576 - DNA, 20 bp, Artificial
  CRISPR gRNA sequence
aaatgagatcatgtcctttg

SEQ ID NO: 354577 - DNA, 20 bp, Artificial
  CRISPR gRNA sequence
aatgagatcatgtcctttgc

SEQ ID NO: 354578 - DNA, 20 bp, Artificial
  CRISPR gRNA sequence
atgagatcatgtcctttgca

SEQ ID NO: 354579 - DNA, 20 bp, Artificial
  CRISPR gRNA sequence
tcatgtcctttgcagggaca

SEQ ID NO: 354580 - DNA, 20 bp, Artificial
  CRISPR gRNA sequence
gtcctttgcagggacacgga

SEQ ID NO: 354581 - DNA, 20 bp, Artificial
  CRISPR gRNA sequence
cctttgcagggacacggata

SEQ ID NO: 354582 - DNA, 20 bp, Artificial
  CRISPR gRNA sequence
tgcagggacacggatagagc

SEQ ID NO: 354583 - DNA, 20 bp, Artificial
  CRISPR gRNA sequence
cagggacacggatagagctg

SEQ ID NO: 354584 - DNA, 20 bp, Artificial
  CRISPR gRNA sequence
agggacacggatagagctgg

SEQ ID NO: 354585 - DNA, 20 bp, Artificial
  CRISPR gRNA sequence
gagctggaggccattatcct

SEQ ID NO: 354586 - DNA, 20 bp, Artificial
  CRISPR gRNA sequence
ttatccttagcaaactcatg

SEQ ID NO: 354587 - DNA, 20 bp, Artificial
  CRISPR gRNA sequence
tatccttagcaaactcatgc

SEQ ID NO: 354588 - DNA, 20 bp, Artificial
  CRISPR gRNA sequence
ttagcaaactcatgcaggaa

SEQ ID NO: 354589 - DNA, 20 bp, Artificial
  CRISPR gRNA sequence
taccacatgttctcacctat

SEQ ID NO: 354590 - DNA, 20 bp, Artificial
  CRISPR gRNA sequence
cacatgttctcacctataag

SEQ ID NO: 354591 - DNA, 20 bp, Artificial
  CRISPR gRNA sequence
acatgttctcacctataagt

SEQ ID NO: 354592 - DNA, 20 bp, Artificial
  CRISPR gRNA sequence
atgttctcacctataagtgg

SEQ ID NO: 354593 - DNA, 20 bp, Artificial
  CRISPR gRNA sequence
ataagtgggagctaaatgat

SEQ ID NO: 354594 - DNA, 20 bp, Artificial
  CRISPR gRNA sequence
agctaaatgatgagaacaca

SEQ ID NO: 354595 - DNA, 20 bp, Artificial
  CRISPR gRNA sequence
gatgagaacacatggacaca

SEQ ID NO: 354596 - DNA, 20 bp, Artificial
  CRISPR gRNA sequence
agaacacatggacacataga

SEQ ID NO: 354597 - DNA, 20 bp, Artificial
  CRISPR gRNA sequence
gaacacatggacacatagac

SEQ ID NO: 354598 - DNA, 20 bp, Artificial
  CRISPR gRNA sequence
tagacgggaacaacacacac

SEQ ID NO: 354599 - DNA, 20 bp, Artificial
  CRISPR gRNA sequence
gacgggaacaacacacactg

SEQ ID NO: 354600 - DNA, 20 bp, Artificial
  CRISPR gRNA sequence
caacacacactggagcctac

SEQ ID NO: 354601 - DNA, 20 bp, Artificial
  CRISPR gRNA sequence
acacacactggagcctactg

SEQ ID NO: 354602 - DNA, 20 bp, Artificial
  CRISPR gRNA sequence
cacacactggagcctactgg

SEQ ID NO: 354603 - DNA, 20 bp, Artificial
  CRISPR gRNA sequence
acacactggagcctactgga

SEQ ID NO: 354604 - DNA, 20 bp, Artificial
  CRISPR gRNA sequence
cactggagcctactggaggg

SEQ ID NO: 354605 - DNA, 20 bp, Artificial
  CRISPR gRNA sequence
ctggagcctactggagggca

SEQ ID NO: 354606 - DNA, 20 bp, Artificial
  CRISPR gRNA sequence
tggagcctactggagggcag

SEQ ID NO: 354607 - DNA, 20 bp, Artificial
  CRISPR gRNA sequence
ggagcctactggagggcaga

SEQ ID NO: 354608 - DNA, 20 bp, Artificial
  CRISPR gRNA sequence
gcctactggagggcagaggg

SEQ ID NO: 354609 - DNA, 20 bp, Artificial
  CRISPR gRNA sequence
cctactggagggcagagggt

SEQ ID NO: 354610 - DNA, 20 bp, Artificial
  CRISPR gRNA sequence
tactggagggcagagggtgg

SEQ ID NO: 354611 - DNA, 20 bp, Artificial
  CRISPR gRNA sequence
tggagggcagagggtgggag

SEQ ID NO: 354612 - DNA, 20 bp, Artificial
  CRISPR gRNA sequence
ggagggcagagggtgggaga

SEQ ID NO: 354613 - DNA, 20 bp, Artificial
  CRISPR gRNA sequence
gagggcagagggtgggagaa

SEQ ID NO: 354614 - DNA, 20 bp, Artificial
  CRISPR gRNA sequence
gggcagagggtgggagaagg

SEQ ID NO: 354615 - DNA, 20 bp, Artificial
  CRISPR gRNA sequence
gcagagggtgggagaaggga

SEQ ID NO: 354616 - DNA, 20 bp, Artificial
  CRISPR gRNA sequence
cagagggtgggagaagggag

SEQ ID NO: 354617 - DNA, 20 bp, Artificial
  CRISPR gRNA sequence
ggtgggagaagggagaggat

SEQ ID NO: 354618 - DNA, 20 bp, Artificial
  CRISPR gRNA sequence
gtgggagaagggagaggatc

SEQ ID NO: 354619 - DNA, 20 bp, Artificial
  CRISPR gRNA sequence
ggatcaggaaaaataactat

SEQ ID NO: 354620 - DNA, 20 bp, Artificial
  CRISPR gRNA sequence
gatcaggaaaaataactatt

SEQ ID NO: 354621 - DNA, 20 bp, Artificial
  CRISPR gRNA sequence
gaaaaataactattgggtat

SEQ ID NO: 354622 - DNA, 20 bp, Artificial
  CRISPR gRNA sequence
aaaaataactattgggtata

SEQ ID NO: 354623 - DNA, 20 bp, Artificial
  CRISPR gRNA sequence
tgggtataaggcttaatacc

SEQ ID NO: 354624 - DNA, 20 bp, Artificial
  CRISPR gRNA sequence
gggtataaggcttaatacct

SEQ ID NO: 354625 - DNA, 20 bp, Artificial
  CRISPR gRNA sequence
ctgaacttaaaataaatgtt

SEQ ID NO: 354626 - DNA, 20 bp, Artificial
  CRISPR gRNA sequence
aaaatgaaaataaaaaaata

SEQ ID NO: 354627 - DNA, 20 bp, Artificial
  CRISPR gRNA sequence
aatgaaaataaaaaaataaa

SEQ ID NO: 354628 - DNA, 20 bp, Artificial
  CRISPR gRNA sequence
tgaaaataaaaaaataaaga

SEQ ID NO: 354629 - DNA, 20 bp, Artificial
  CRISPR gRNA sequence
gagagtaaacatatcacaat

SEQ ID NO: 354630 - DNA, 20 bp, Artificial
  CRISPR gRNA sequence
acaattggatttacgttgac

SEQ ID NO: 354631 - DNA, 20 bp, Artificial
  CRISPR gRNA sequence
tttacgttgaccagccattc

SEQ ID NO: 354632 - DNA, 20 bp, Artificial
  CRISPR gRNA sequence
accagccattctggtttgcc

SEQ ID NO: 354633 - DNA, 20 bp, Artificial
  CRISPR gRNA sequence
ccagccattctggtttgcct

SEQ ID NO: 354634 - DNA, 20 bp, Artificial
  CRISPR gRNA sequence
attctggtttgcctgggact

SEQ ID NO: 354635 - DNA, 20 bp, Artificial
  CRISPR gRNA sequence
ttctggtttgcctgggacta

SEQ ID NO: 354636 - DNA, 20 bp, Artificial
  CRISPR gRNA sequence
ctggtttgcctgggactaag

SEQ ID NO: 354637 - DNA, 20 bp, Artificial
  CRISPR gRNA sequence
cctgggactaaggagtttcc

SEQ ID NO: 354638 - DNA, 20 bp, Artificial
  CRISPR gRNA sequence
ctgggactaaggagtttccc

SEQ ID NO: 354639 - DNA, 20 bp, Artificial
  CRISPR gRNA sequence
actaaggagtttcccaggat

SEQ ID NO: 354640 - DNA, 20 bp, Artificial
  CRISPR gRNA sequence
taaggagtttcccaggatga

SEQ ID NO: 354641 - DNA, 20 bp, Artificial
  CRISPR gRNA sequence
cttttttttttttttttttt

SEQ ID NO: 354642 - DNA, 20 bp, Artificial
  CRISPR gRNA sequence
ttttttttttttttttgaga

SEQ ID NO: 354643 - DNA, 20 bp, Artificial
  CRISPR gRNA sequence
ttttttttttttttgagatg

SEQ ID NO: 354644 - DNA, 20 bp, Artificial
  CRISPR gRNA sequence
tggagtctcgctctgtcacc

SEQ ID NO: 354645 - DNA, 20 bp, Artificial
  CRISPR gRNA sequence
ggagtctcgctctgtcaccc

SEQ ID NO: 354646 - DNA, 20 bp, Artificial
  CRISPR gRNA sequence
tctcgctctgtcacccaggc

SEQ ID NO: 354647 - DNA, 20 bp, Artificial
  CRISPR gRNA sequence
ctcgctctgtcacccaggct

SEQ ID NO: 354648 - DNA, 20 bp, Artificial
  CRISPR gRNA sequence
gggatgcaatgctgcaatct

SEQ ID NO: 354649 - DNA, 20 bp, Artificial
  CRISPR gRNA sequence
tcactgcaacctccgcctcc

SEQ ID NO: 354650 - DNA, 20 bp, Artificial
  CRISPR gRNA sequence
cactgcaacctccgcctccc

SEQ ID NO: 354651 - DNA, 20 bp, Artificial
  CRISPR gRNA sequence
aacctccgcctcccgggttc

SEQ ID NO: 354652 - DNA, 20 bp, Artificial
  CRISPR gRNA sequence
ttcaagtgattctcctgcct

SEQ ID NO: 354653 - DNA, 20 bp, Artificial
  CRISPR gRNA sequence
ttctcctgcctcagcctcct

SEQ ID NO: 354654 - DNA, 20 bp, Artificial
  CRISPR gRNA sequence
tcctgcctcagcctcctgag

SEQ ID NO: 354655 - DNA, 20 bp, Artificial
  CRISPR gRNA sequence
gcctcagcctcctgagtagc

SEQ ID NO: 354656 - DNA, 20 bp, Artificial
  CRISPR gRNA sequence
cctcagcctcctgagtagct

SEQ ID NO: 354657 - DNA, 20 bp, Artificial
  CRISPR gRNA sequence
ctcctgagtagctgggatta

SEQ ID NO: 354658 - DNA, 20 bp, Artificial
  CRISPR gRNA sequence
tcctgagtagctgggattac

SEQ ID NO: 354659 - DNA, 20 bp, Artificial
  CRISPR gRNA sequence
caggcgcccgccaccatgcc

SEQ ID NO: 354660 - DNA, 20 bp, Artificial
  CRISPR gRNA sequence
gctaattttttttttatttt

SEQ ID NO: 354661 - DNA, 20 bp, Artificial
  CRISPR gRNA sequence
aattttttttttatttttag

SEQ ID NO: 354662 - DNA, 20 bp, Artificial
  CRISPR gRNA sequence
ttttttttttatttttagta

SEQ ID NO: 354663 - DNA, 20 bp, Artificial
  CRISPR gRNA sequence
ttttttatttttagtagaga

SEQ ID NO: 354664 - DNA, 20 bp, Artificial
  CRISPR gRNA sequence
tttttatttttagtagagat

SEQ ID NO: 354665 - DNA, 20 bp, Artificial
  CRISPR gRNA sequence
ttttatttttagtagagatg

SEQ ID NO: 354666 - DNA, 20 bp, Artificial
  CRISPR gRNA sequence
gagatggggtttcaccatgt

SEQ ID NO: 354667 - DNA, 20 bp, Artificial
  CRISPR gRNA sequence
tggggtttcaccatgttggt

SEQ ID NO: 354668 - DNA, 20 bp, Artificial
  CRISPR gRNA sequence
ggggtttcaccatgttggtc

SEQ ID NO: 354669 - DNA, 20 bp, Artificial
  CRISPR gRNA sequence
tttcaccatgttggtcaggc

SEQ ID NO: 354670 - DNA, 20 bp, Artificial
  CRISPR gRNA sequence
acctcatgatctgcccacct

SEQ ID NO: 354671 - DNA, 20 bp, Artificial
  CRISPR gRNA sequence
ctgcccacctcggcctccca

SEQ ID NO: 354672 - DNA, 20 bp, Artificial
  CRISPR gRNA sequence
acctcggcctcccaaagtgc

SEQ ID NO: 354673 - DNA, 20 bp, Artificial
  CRISPR gRNA sequence
cctcggcctcccaaagtgct

SEQ ID NO: 354674 - DNA, 20 bp, Artificial
  CRISPR gRNA sequence
ctcccaaagtgctgggatta

SEQ ID NO: 354675 - DNA, 20 bp, Artificial
  CRISPR gRNA sequence
tcccaaagtgctgggattac

SEQ ID NO: 354676 - DNA, 20 bp, Artificial
  CRISPR gRNA sequence
agtgctgggattacaggcgt

SEQ ID NO: 354677 - DNA, 20 bp, Artificial
  CRISPR gRNA sequence
caggcgtgagccatcgcacc

SEQ ID NO: 354678 - DNA, 20 bp, Artificial
  CRISPR gRNA sequence
gtgagccatcgcacccagcc

SEQ ID NO: 354679 - DNA, 20 bp, Artificial
  CRISPR gRNA sequence
gagccatcgcacccagccaa

SEQ ID NO: 354680 - DNA, 20 bp, Artificial
  CRISPR gRNA sequence
agattttcaatgccaaaacc

SEQ ID NO: 354681 - DNA, 20 bp, Artificial
  CRISPR gRNA sequence
attttcaatgccaaaaccca

SEQ ID NO: 354682 - DNA, 20 bp, Artificial
  CRISPR gRNA sequence
tttcaatgccaaaacccaga

SEQ ID NO: 354683 - DNA, 20 bp, Artificial
  CRISPR gRNA sequence
cccagagagccccgaaaacc

SEQ ID NO: 354684 - DNA, 20 bp, Artificial
  CRISPR gRNA sequence
ccagagagccccgaaaacca

SEQ ID NO: 354685 - DNA, 20 bp, Artificial
  CRISPR gRNA sequence
ggttccctatccattaatgc

SEQ ID NO: 354686 - DNA, 20 bp, Artificial
  CRISPR gRNA sequence
ccattaatgccagtgttcac

SEQ ID NO: 354687 - DNA, 20 bp, Artificial
  CRISPR gRNA sequence
cattaatgccagtgttcaca

SEQ ID NO: 354688 - DNA, 20 bp, Artificial
  CRISPR gRNA sequence
attaaatttcttcctacact

SEQ ID NO: 354689 - DNA, 20 bp, Artificial
  CRISPR gRNA sequence
ttaaatttcttcctacactc

SEQ ID NO: 354690 - DNA, 20 bp, Artificial
  CRISPR gRNA sequence
tacactcaggtgcacatcta

SEQ ID NO: 354691 - DNA, 20 bp, Artificial
  CRISPR gRNA sequence
aggtgcacatctatagaaca

SEQ ID NO: 354692 - DNA, 20 bp, Artificial
  CRISPR gRNA sequence
cacatctatagaacacagtt

SEQ ID NO: 354693 - DNA, 20 bp, Artificial
  CRISPR gRNA sequence
tttttttttttttttttttt

SEQ ID NO: 354694 - DNA, 20 bp, Artificial
  CRISPR gRNA sequence
ttttttttttttttttgaga

SEQ ID NO: 354695 - DNA, 20 bp, Artificial
  CRISPR gRNA sequence
ttttttttttttttgagaca

SEQ ID NO: 354696 - DNA, 20 bp, Artificial
  CRISPR gRNA sequence
cagagtcttactctgttacc

SEQ ID NO: 354697 - DNA, 20 bp, Artificial
  CRISPR gRNA sequence
agagtcttactctgttaccc

SEQ ID NO: 354698 - DNA, 20 bp, Artificial
  CRISPR gRNA sequence
tcttactctgttacccaggc

SEQ ID NO: 354699 - DNA, 20 bp, Artificial
  CRISPR gRNA sequence
ttactctgttacccaggctg

SEQ ID NO: 354700 - DNA, 20 bp, Artificial
  CRISPR gRNA sequence
ctgttacccaggctggagta

SEQ ID NO: 354701 - DNA, 20 bp, Artificial
  CRISPR gRNA sequence
ttacccaggctggagtacag

SEQ ID NO: 354702 - DNA, 20 bp, Artificial
  CRISPR gRNA sequence
ggagtacagtggtgcaatct

SEQ ID NO: 354703 - DNA, 20 bp, Artificial
  CRISPR gRNA sequence
tcactgcaacctccatctcc

SEQ ID NO: 354704 - DNA, 20 bp, Artificial
  CRISPR gRNA sequence
cactgcaacctccatctccc

SEQ ID NO: 354705 - DNA, 20 bp, Artificial
  CRISPR gRNA sequence
aacctccatctcccgggttc

SEQ ID NO: 354706 - DNA, 20 bp, Artificial
  CRISPR gRNA sequence
ttcaagtgattctcctgtct

SEQ ID NO: 354707 - DNA, 20 bp, Artificial
  CRISPR gRNA sequence
ttctcctgtctcagcctcct

SEQ ID NO: 354708 - DNA, 20 bp, Artificial
  CRISPR gRNA sequence
tcctgtctcagcctcctgag

SEQ ID NO: 354709 - DNA, 20 bp, Artificial
  CRISPR gRNA sequence
tctcagcctcctgagtagct

SEQ ID NO: 354710 - DNA, 20 bp, Artificial
  CRISPR gRNA sequence
ctcctgagtagctgagacta

SEQ ID NO: 354711 - DNA, 20 bp, Artificial
  CRISPR gRNA sequence
tcctgagtagctgagactac

SEQ ID NO: 354712 - DNA, 20 bp, Artificial
  CRISPR gRNA sequence
caggcacccaccaccacgcc

SEQ ID NO: 354713 - DNA, 20 bp, Artificial
  CRISPR gRNA sequence
ccacgcccagccaatttttg

SEQ ID NO: 354714 - DNA, 20 bp, Artificial
  CRISPR gRNA sequence
ccagccaatttttgcagttt

SEQ ID NO: 354715 - DNA, 20 bp, Artificial
  CRISPR gRNA sequence
gccaatttttgcagttttag

SEQ ID NO: 354716 - DNA, 20 bp, Artificial
  CRISPR gRNA sequence
caatttttgcagttttagta

SEQ ID NO: 354717 - DNA, 20 bp, Artificial
  CRISPR gRNA sequence
ttttgcagttttagtagaga

SEQ ID NO: 354718 - DNA, 20 bp, Artificial
  CRISPR gRNA sequence
tttgcagttttagtagagat

SEQ ID NO: 354719 - DNA, 20 bp, Artificial
  CRISPR gRNA sequence
ttgcagttttagtagagatg

SEQ ID NO: 354720 - DNA, 20 bp, Artificial
  CRISPR gRNA sequence
gagatggggtttcaccatgt

SEQ ID NO: 354721 - DNA, 20 bp, Artificial
  CRISPR gRNA sequence
tggggtttcaccatgttggc

SEQ ID NO: 354722 - DNA, 20 bp, Artificial
  CRISPR gRNA sequence
ggggtttcaccatgttggcc

SEQ ID NO: 354723 - DNA, 20 bp, Artificial
  CRISPR gRNA sequence
tttcaccatgttggccaggc

SEQ ID NO: 354724 - DNA, 20 bp, Artificial
  CRISPR gRNA sequence
ccacccacctcatcctccca

SEQ ID NO: 354725 - DNA, 20 bp, Artificial
  CRISPR gRNA sequence
acctcatcctcccaaagtgc

SEQ ID NO: 354726 - DNA, 20 bp, Artificial
  CRISPR gRNA sequence
cctcatcctcccaaagtgct

SEQ ID NO: 354727 - DNA, 20 bp, Artificial
  CRISPR gRNA sequence
ctcccaaagtgctgggatta

SEQ ID NO: 354728 - DNA, 20 bp, Artificial
  CRISPR gRNA sequence
tcccaaagtgctgggattac

SEQ ID NO: 354729 - DNA, 20 bp, Artificial
  CRISPR gRNA sequence
agtgctgggattacaggcgt

SEQ ID NO: 354730 - DNA, 20 bp, Artificial
  CRISPR gRNA sequence
caggcgtgagccaccatgcc

SEQ ID NO: 354731 - DNA, 20 bp, Artificial
  CRISPR gRNA sequence
caccatgcctggccatattt

SEQ ID NO: 354732 - DNA, 20 bp, Artificial
  CRISPR gRNA sequence
cctttcacacttgccaatgt

SEQ ID NO: 354733 - DNA, 20 bp, Artificial
  CRISPR gRNA sequence
ctttcacacttgccaatgtg

SEQ ID NO: 354734 - DNA, 20 bp, Artificial
  CRISPR gRNA sequence
ccaatgtgaggctgtttccc

SEQ ID NO: 354735 - DNA, 20 bp, Artificial
  CRISPR gRNA sequence
tgaggctgtttccctagcca

SEQ ID NO: 354736 - DNA, 20 bp, Artificial
  CRISPR gRNA sequence
tttccctagccatggtcact

SEQ ID NO: 354737 - DNA, 20 bp, Artificial
  CRISPR gRNA sequence
ttgctatctctgcatgaaaa

SEQ ID NO: 354738 - DNA, 20 bp, Artificial
  CRISPR gRNA sequence
tgcatgaaaacagcacaaac

SEQ ID NO: 354739 - DNA, 20 bp, Artificial
  CRISPR gRNA sequence
gcatgaaaacagcacaaacc

SEQ ID NO: 354740 - DNA, 20 bp, Artificial
  CRISPR gRNA sequence
atgaaaacagcacaaaccag

SEQ ID NO: 354741 - DNA, 20 bp, Artificial
  CRISPR gRNA sequence
aaaacagcacaaaccaggag

SEQ ID NO: 354742 - DNA, 20 bp, Artificial
  CRISPR gRNA sequence
aacagcacaaaccaggagca

SEQ ID NO: 354743 - DNA, 20 bp, Artificial
  CRISPR gRNA sequence
agcacaaaccaggagcagag

SEQ ID NO: 354744 - DNA, 20 bp, Artificial
  CRISPR gRNA sequence
ccgccaatccctccaacaca

SEQ ID NO: 354745 - DNA, 20 bp, Artificial
  CRISPR gRNA sequence
cgccaatccctccaacacac

SEQ ID NO: 354746 - DNA, 20 bp, Artificial
  CRISPR gRNA sequence
ccctccaacacacaggctac

SEQ ID NO: 354747 - DNA, 20 bp, Artificial
  CRISPR gRNA sequence
cctccaacacacaggctacc

SEQ ID NO: 354748 - DNA, 20 bp, Artificial
  CRISPR gRNA sequence
cacacaggctaccaggcact

SEQ ID NO: 354749 - DNA, 20 bp, Artificial
  CRISPR gRNA sequence
gctaccaggcactgagtgtg

SEQ ID NO: 354750 - DNA, 20 bp, Artificial
  CRISPR gRNA sequence
ggcactgagtgtgaagtatt

SEQ ID NO: 354751 - DNA, 20 bp, Artificial
  CRISPR gRNA sequence
gtgaagtattcagttttgtt

SEQ ID NO: 354752 - DNA, 20 bp, Artificial
  CRISPR gRNA sequence
tgaagtattcagttttgttc

SEQ ID NO: 354753 - DNA, 20 bp, Artificial
  CRISPR gRNA sequence
gaagtattcagttttgttca

SEQ ID NO: 354754 - DNA, 20 bp, Artificial
  CRISPR gRNA sequence
ggacactgtctgatttatgt

SEQ ID NO: 354755 - DNA, 20 bp, Artificial
  CRISPR gRNA sequence
atttatgttggcttctatcc

SEQ ID NO: 354756 - DNA, 20 bp, Artificial
  CRISPR gRNA sequence
tatccaagtcaatacatctg

SEQ ID NO: 354757 - DNA, 20 bp, Artificial
  CRISPR gRNA sequence
agtcaatacatctgaagctg

SEQ ID NO: 354758 - DNA, 20 bp, Artificial
  CRISPR gRNA sequence
gtcaatacatctgaagctgc

SEQ ID NO: 354759 - DNA, 20 bp, Artificial
  CRISPR gRNA sequence
agctgcaggattattttaaa

SEQ ID NO: 354760 - DNA, 20 bp, Artificial
  CRISPR gRNA sequence
gcaggattattttaaacagt

SEQ ID NO: 354761 - DNA, 20 bp, Artificial
  CRISPR gRNA sequence
attttaaacagtcagtaaaa

SEQ ID NO: 354762 - DNA, 20 bp, Artificial
  CRISPR gRNA sequence
tttaaacagtcagtaaaacg

SEQ ID NO: 354763 - DNA, 20 bp, Artificial
  CRISPR gRNA sequence
acagtcagtaaaacggagtt

SEQ ID NO: 354764 - DNA, 20 bp, Artificial
  CRISPR gRNA sequence
gtcagtaaaacggagttcag

SEQ ID NO: 354765 - DNA, 20 bp, Artificial
  CRISPR gRNA sequence
tcagtaaaacggagttcaga

SEQ ID NO: 354766 - DNA, 20 bp, Artificial
  CRISPR gRNA sequence
ggagttcagaaggtcattgt

SEQ ID NO: 354767 - DNA, 20 bp, Artificial
  CRISPR gRNA sequence
agttcagaaggtcattgttg

SEQ ID NO: 354768 - DNA, 20 bp, Artificial
  CRISPR gRNA sequence
aaggtcattgttggagccct

SEQ ID NO: 354769 - DNA, 20 bp, Artificial
  CRISPR gRNA sequence
aggtcattgttggagccctt

SEQ ID NO: 354770 - DNA, 20 bp, Artificial
  CRISPR gRNA sequence
agcccttgggtcatctttcg

SEQ ID NO: 354771 - DNA, 20 bp, Artificial
  CRISPR gRNA sequence
atctttcgaagcatttctat

SEQ ID NO: 354772 - DNA, 20 bp, Artificial
  CRISPR gRNA sequence
tttcgaagcatttctattgg

SEQ ID NO: 354773 - DNA, 20 bp, Artificial
  CRISPR gRNA sequence
taacaaccacaaactgatac

SEQ ID NO: 354774 - DNA, 20 bp, Artificial
  CRISPR gRNA sequence
cacaaactgatactagtgac

SEQ ID NO: 354775 - DNA, 20 bp, Artificial
  CRISPR gRNA sequence
acaaactgatactagtgacg

SEQ ID NO: 354776 - DNA, 20 bp, Artificial
  CRISPR gRNA sequence
aactgatactagtgacgagg

SEQ ID NO: 354777 - DNA, 20 bp, Artificial
  CRISPR gRNA sequence
tgatactagtgacgaggcag

SEQ ID NO: 354778 - DNA, 20 bp, Artificial
  CRISPR gRNA sequence
gatactagtgacgaggcaga

SEQ ID NO: 354779 - DNA, 20 bp, Artificial
  CRISPR gRNA sequence
agtgacgaggcagaaggaac

SEQ ID NO: 354780 - DNA, 20 bp, Artificial
  CRISPR gRNA sequence
gaacaagtgcttttcccttg

SEQ ID NO: 354781 - DNA, 20 bp, Artificial
  CRISPR gRNA sequence
gcatccatgattacaaattc

SEQ ID NO: 354782 - DNA, 20 bp, Artificial
  CRISPR gRNA sequence
tccttttatcacatttaacc

SEQ ID NO: 354783 - DNA, 20 bp, Artificial
  CRISPR gRNA sequence
ttttatcacatttaaccaag

SEQ ID NO: 354784 - DNA, 20 bp, Artificial
  CRISPR gRNA sequence
tttatcacatttaaccaagt

SEQ ID NO: 354785 - DNA, 20 bp, Artificial
  CRISPR gRNA sequence
atgtattctaccgttcaatt

SEQ ID NO: 354786 - DNA, 20 bp, Artificial
  CRISPR gRNA sequence
caatttagctattcatgtaa

SEQ ID NO: 354787 - DNA, 20 bp, Artificial
  CRISPR gRNA sequence
atgcataatgcattttcatg

SEQ ID NO: 354788 - DNA, 20 bp, Artificial
  CRISPR gRNA sequence
atgaagcaaaatttttcatg

SEQ ID NO: 354789 - DNA, 20 bp, Artificial
  CRISPR gRNA sequence
gtccaacatctgtgaccctg

SEQ ID NO: 354790 - DNA, 20 bp, Artificial
  CRISPR gRNA sequence
ccaacatctgtgaccctgtg

SEQ ID NO: 354791 - DNA, 20 bp, Artificial
  CRISPR gRNA sequence
caacatctgtgaccctgtgg

SEQ ID NO: 354792 - DNA, 20 bp, Artificial
  CRISPR gRNA sequence
tgtcaccactcgctgtctct

SEQ ID NO: 354793 - DNA, 20 bp, Artificial
  CRISPR gRNA sequence
gtctcttagtcacatttgcc

SEQ ID NO: 354794 - DNA, 20 bp, Artificial
  CRISPR gRNA sequence
ccctctgccatctctgcccc

SEQ ID NO: 354795 - DNA, 20 bp, Artificial
  CRISPR gRNA sequence
cctctgccatctctgccccc

SEQ ID NO: 354796 - DNA, 20 bp, Artificial
  CRISPR gRNA sequence
ccaggatgtttcccattgcc

SEQ ID NO: 354797 - DNA, 20 bp, Artificial
  CRISPR gRNA sequence
caggatgtttcccattgcca

SEQ ID NO: 354798 - DNA, 20 bp, Artificial
  CRISPR gRNA sequence
ttcccattgccaaggtgaaa

SEQ ID NO: 354799 - DNA, 20 bp, Artificial
  CRISPR gRNA sequence
ccattgccaaggtgaaaaag

SEQ ID NO: 354800 - DNA, 20 bp, Artificial
  CRISPR gRNA sequence
ttgccaaggtgaaaaagtgg

SEQ ID NO: 354801 - DNA, 20 bp, Artificial
  CRISPR gRNA sequence
gccaaggtgaaaaagtggaa

SEQ ID NO: 354802 - DNA, 20 bp, Artificial
  CRISPR gRNA sequence
tgaaaaagtggaagagtccg

SEQ ID NO: 354803 - DNA, 20 bp, Artificial
  CRISPR gRNA sequence
ccgtggtgctactaacacct

SEQ ID NO: 354804 - DNA, 20 bp, Artificial
  CRISPR gRNA sequence
tcaatttgctaatttctgtt

SEQ ID NO: 354805 - DNA, 20 bp, Artificial
  CRISPR gRNA sequence
caatttgctaatttctgttc

SEQ ID NO: 354806 - DNA, 20 bp, Artificial
  CRISPR gRNA sequence
aatttgctaatttctgttca

SEQ ID NO: 354807 - DNA, 20 bp, Artificial
  CRISPR gRNA sequence
tgctaatttctgttcaggga

SEQ ID NO: 354808 - DNA, 20 bp, Artificial
  CRISPR gRNA sequence
ttctgttcagggaaagactt

SEQ ID NO: 354809 - DNA, 20 bp, Artificial
  CRISPR gRNA sequence
tctgttcagggaaagactta

SEQ ID NO: 354810 - DNA, 20 bp, Artificial
  CRISPR gRNA sequence
ctgttcagggaaagacttaa

SEQ ID NO: 354811 - DNA, 20 bp, Artificial
  CRISPR gRNA sequence
ttcagggaaagacttaaggg

SEQ ID NO: 354812 - DNA, 20 bp, Artificial
  CRISPR gRNA sequence
gacttaagggcagtccgtga

SEQ ID NO: 354813 - DNA, 20 bp, Artificial
  CRISPR gRNA sequence
acttaagggcagtccgtgat

SEQ ID NO: 354814 - DNA, 20 bp, Artificial
  CRISPR gRNA sequence
cttaagggcagtccgtgatg

SEQ ID NO: 354815 - DNA, 20 bp, Artificial
  CRISPR gRNA sequence
ggcagtccgtgatggggaaa

SEQ ID NO: 354816 - DNA, 20 bp, Artificial
  CRISPR gRNA sequence
gcagtccgtgatggggaaaa

SEQ ID NO: 354817 - DNA, 20 bp, Artificial
  CRISPR gRNA sequence
aatgacctgacctcctgttt

SEQ ID NO: 354818 - DNA, 20 bp, Artificial
  CRISPR gRNA sequence
acctcctgttttagtttaat

SEQ ID NO: 354819 - DNA, 20 bp, Artificial
  CRISPR gRNA sequence
taattagacaaatgtttatt

SEQ ID NO: 354820 - DNA, 20 bp, Artificial
  CRISPR gRNA sequence
tttattgagcattcattatt

SEQ ID NO: 354821 - DNA, 20 bp, Artificial
  CRISPR gRNA sequence
ttgagcattcattatttgga

SEQ ID NO: 354822 - DNA, 20 bp, Artificial
  CRISPR gRNA sequence
cattcattatttggacagat

SEQ ID NO: 354823 - DNA, 20 bp, Artificial
  CRISPR gRNA sequence
acaaactctgccattatgaa

SEQ ID NO: 354824 - DNA, 20 bp, Artificial
  CRISPR gRNA sequence
aactctgccattatgaatag

SEQ ID NO: 354825 - DNA, 20 bp, Artificial
  CRISPR gRNA sequence
actctgccattatgaataga

SEQ ID NO: 354826 - DNA, 20 bp, Artificial
  CRISPR gRNA sequence
ctctgccattatgaatagaa

SEQ ID NO: 354827 - DNA, 20 bp, Artificial
  CRISPR gRNA sequence
gccattatgaatagaaggga

SEQ ID NO: 354828 - DNA, 20 bp, Artificial
  CRISPR gRNA sequence
ttatgaatagaagggatggc

SEQ ID NO: 354829 - DNA, 20 bp, Artificial
  CRISPR gRNA sequence
agaagggatggcaagcatga

SEQ ID NO: 354830 - DNA, 20 bp, Artificial
  CRISPR gRNA sequence
atgaaagtgattaaaataca

SEQ ID NO: 354831 - DNA, 20 bp, Artificial
  CRISPR gRNA sequence
aaagtgattaaaatacaaag

SEQ ID NO: 354832 - DNA, 20 bp, Artificial
  CRISPR gRNA sequence
aagtgattaaaatacaaagc

SEQ ID NO: 354833 - DNA, 20 bp, Artificial
  CRISPR gRNA sequence
taaaatacaaagcaggatgt

SEQ ID NO: 354834 - DNA, 20 bp, Artificial
  CRISPR gRNA sequence
aaaatacaaagcaggatgtg

SEQ ID NO: 354835 - DNA, 20 bp, Artificial
  CRISPR gRNA sequence
aatacaaagcaggatgtgag

SEQ ID NO: 354836 - DNA, 20 bp, Artificial
  CRISPR gRNA sequence
acaaagcaggatgtgaggag

SEQ ID NO: 354837 - DNA, 20 bp, Artificial
  CRISPR gRNA sequence
aagcaggatgtgaggagtag

SEQ ID NO: 354838 - DNA, 20 bp, Artificial
  CRISPR gRNA sequence
gcaggatgtgaggagtagca

SEQ ID NO: 354839 - DNA, 20 bp, Artificial
  CRISPR gRNA sequence
agagacgtacacaatgattc

SEQ ID NO: 354840 - DNA, 20 bp, Artificial
  CRISPR gRNA sequence
acgtacacaatgattccaga

SEQ ID NO: 354841 - DNA, 20 bp, Artificial
  CRISPR gRNA sequence
ggtgacatcatgtctatttg

SEQ ID NO: 354842 - DNA, 20 bp, Artificial
  CRISPR gRNA sequence
gtgacatcatgtctatttgc

SEQ ID NO: 354843 - DNA, 20 bp, Artificial
  CRISPR gRNA sequence
tgacatcatgtctatttgca

SEQ ID NO: 354844 - DNA, 20 bp, Artificial
  CRISPR gRNA sequence
atcatgtctatttgcaggga

SEQ ID NO: 354845 - DNA, 20 bp, Artificial
  CRISPR gRNA sequence
catgtctatttgcagggaca

SEQ ID NO: 354846 - DNA, 20 bp, Artificial
  CRISPR gRNA sequence
ctatttgcagggacagagaa

SEQ ID NO: 354847 - DNA, 20 bp, Artificial
  CRISPR gRNA sequence
tgcagggacagagaacagta

SEQ ID NO: 354848 - DNA, 20 bp, Artificial
  CRISPR gRNA sequence
cagggacagagaacagtaca

SEQ ID NO: 354849 - DNA, 20 bp, Artificial
  CRISPR gRNA sequence
agagaacagtacagagctca

SEQ ID NO: 354850 - DNA, 20 bp, Artificial
  CRISPR gRNA sequence
agaacagtacagagctcaca

SEQ ID NO: 354851 - DNA, 20 bp, Artificial
  CRISPR gRNA sequence
gaacagtacagagctcacag

SEQ ID NO: 354852 - DNA, 20 bp, Artificial
  CRISPR gRNA sequence
aacagtacagagctcacaga

SEQ ID NO: 354853 - DNA, 20 bp, Artificial
  CRISPR gRNA sequence
acagtacagagctcacagag

SEQ ID NO: 354854 - DNA, 20 bp, Artificial
  CRISPR gRNA sequence
tacagagctcacagagggga

SEQ ID NO: 354855 - DNA, 20 bp, Artificial
  CRISPR gRNA sequence
acagagctcacagaggggac

SEQ ID NO: 354856 - DNA, 20 bp, Artificial
  CRISPR gRNA sequence
ttcacaccttgaatgataca

SEQ ID NO: 354857 - DNA, 20 bp, Artificial
  CRISPR gRNA sequence
tcacaccttgaatgatacat

SEQ ID NO: 354858 - DNA, 20 bp, Artificial
  CRISPR gRNA sequence
ttgaatgatacataggaatg

SEQ ID NO: 354859 - DNA, 20 bp, Artificial
  CRISPR gRNA sequence
cataggaatgcagccaaatg

SEQ ID NO: 354860 - DNA, 20 bp, Artificial
  CRISPR gRNA sequence
ataggaatgcagccaaatgt

SEQ ID NO: 354861 - DNA, 20 bp, Artificial
  CRISPR gRNA sequence
taggaatgcagccaaatgtg

SEQ ID NO: 354862 - DNA, 20 bp, Artificial
  CRISPR gRNA sequence
tgcagccaaatgtggggaaa

SEQ ID NO: 354863 - DNA, 20 bp, Artificial
  CRISPR gRNA sequence
aatgtggggaaacagcactt

SEQ ID NO: 354864 - DNA, 20 bp, Artificial
  CRISPR gRNA sequence
gtggggaaacagcactttgg

SEQ ID NO: 354865 - DNA, 20 bp, Artificial
  CRISPR gRNA sequence
acagcactttggtagcaaac

SEQ ID NO: 354866 - DNA, 20 bp, Artificial
  CRISPR gRNA sequence
cactttggtagcaaaccaga

SEQ ID NO: 354867 - DNA, 20 bp, Artificial
  CRISPR gRNA sequence
actttggtagcaaaccagat

SEQ ID NO: 354868 - DNA, 20 bp, Artificial
  CRISPR gRNA sequence
ctttggtagcaaaccagatg

SEQ ID NO: 354869 - DNA, 20 bp, Artificial
  CRISPR gRNA sequence
ttggtagcaaaccagatggg

SEQ ID NO: 354870 - DNA, 20 bp, Artificial
  CRISPR gRNA sequence
ggtagcaaaccagatgggga

SEQ ID NO: 354871 - DNA, 20 bp, Artificial
  CRISPR gRNA sequence
aaaccagatggggagagcaa

SEQ ID NO: 354872 - DNA, 20 bp, Artificial
  CRISPR gRNA sequence
aaccagatggggagagcaat

SEQ ID NO: 354873 - DNA, 20 bp, Artificial
  CRISPR gRNA sequence
ggagagcaatgggtgtgctt

SEQ ID NO: 354874 - DNA, 20 bp, Artificial
  CRISPR gRNA sequence
ccacaaaatttatcaacatc

SEQ ID NO: 354875 - DNA, 20 bp, Artificial
  CRISPR gRNA sequence
cacaaaatttatcaacatcc

SEQ ID NO: 354876 - DNA, 20 bp, Artificial
  CRISPR gRNA sequence
caaaatttatcaacatccgg

SEQ ID NO: 354877 - DNA, 20 bp, Artificial
  CRISPR gRNA sequence
aacatccgggagattaaata

SEQ ID NO: 354878 - DNA, 20 bp, Artificial
  CRISPR gRNA sequence
atccgggagattaaataaag

SEQ ID NO: 354879 - DNA, 20 bp, Artificial
  CRISPR gRNA sequence
gggagattaaataaagtaga

SEQ ID NO: 354880 - DNA, 20 bp, Artificial
  CRISPR gRNA sequence
tagaaagtatgaataaaaat

SEQ ID NO: 354881 - DNA, 20 bp, Artificial
  CRISPR gRNA sequence
agaaagtatgaataaaaatt

SEQ ID NO: 354882 - DNA, 20 bp, Artificial
  CRISPR gRNA sequence
tatgaataaaaattaggctt

SEQ ID NO: 354883 - DNA, 20 bp, Artificial
  CRISPR gRNA sequence
aataaaaattaggcttcagt

SEQ ID NO: 354884 - DNA, 20 bp, Artificial
  CRISPR gRNA sequence
ataaaaattaggcttcagtc

SEQ ID NO: 354885 - DNA, 20 bp, Artificial
  CRISPR gRNA sequence
taaaaattaggcttcagtca

SEQ ID NO: 354886 - DNA, 20 bp, Artificial
  CRISPR gRNA sequence
gcttcagtcagggttaatga

SEQ ID NO: 354887 - DNA, 20 bp, Artificial
  CRISPR gRNA sequence
cttcagtcagggttaatgac

SEQ ID NO: 354888 - DNA, 20 bp, Artificial
  CRISPR gRNA sequence
ttcagtcagggttaatgaca

SEQ ID NO: 354889 - DNA, 20 bp, Artificial
  CRISPR gRNA sequence
gggttaatgacagggttaat

SEQ ID NO: 354890 - DNA, 20 bp, Artificial
  CRISPR gRNA sequence
aatgagttttaacattattc

SEQ ID NO: 354891 - DNA, 20 bp, Artificial
  CRISPR gRNA sequence
gagttttaacattattctgg

SEQ ID NO: 354892 - DNA, 20 bp, Artificial
  CRISPR gRNA sequence
agttttaacattattctggt

SEQ ID NO: 354893 - DNA, 20 bp, Artificial
  CRISPR gRNA sequence
ttttaacattattctggtag

SEQ ID NO: 354894 - DNA, 20 bp, Artificial
  CRISPR gRNA sequence
taacattattctggtaggag

SEQ ID NO: 354895 - DNA, 20 bp, Artificial
  CRISPR gRNA sequence
aacattattctggtaggagt

SEQ ID NO: 354896 - DNA, 20 bp, Artificial
  CRISPR gRNA sequence
attattctggtaggagtggg

SEQ ID NO: 354897 - DNA, 20 bp, Artificial
  CRISPR gRNA sequence
taggagtgggaagataacca

SEQ ID NO: 354898 - DNA, 20 bp, Artificial
  CRISPR gRNA sequence
agataaccaaagatattgaa

SEQ ID NO: 354899 - DNA, 20 bp, Artificial
  CRISPR gRNA sequence
gataaccaaagatattgaac

SEQ ID NO: 354900 - DNA, 20 bp, Artificial
  CRISPR gRNA sequence
aaccaaagatattgaacagg

SEQ ID NO: 354901 - DNA, 20 bp, Artificial
  CRISPR gRNA sequence
aggaagatgacatgccaacc

SEQ ID NO: 354902 - DNA, 20 bp, Artificial
  CRISPR gRNA sequence
tgacatgccaacccagcctt

SEQ ID NO: 354903 - DNA, 20 bp, Artificial
  CRISPR gRNA sequence
catgccaacccagccttcag

SEQ ID NO: 354904 - DNA, 20 bp, Artificial
  CRISPR gRNA sequence
gccaacccagccttcagaag

SEQ ID NO: 354905 - DNA, 20 bp, Artificial
  CRISPR gRNA sequence
ccagccttcagaagaagacc

SEQ ID NO: 354906 - DNA, 20 bp, Artificial
  CRISPR gRNA sequence
cagccttcagaagaagaccc

SEQ ID NO: 354907 - DNA, 20 bp, Artificial
  CRISPR gRNA sequence
agccttcagaagaagaccca

SEQ ID NO: 354908 - DNA, 20 bp, Artificial
  CRISPR gRNA sequence
agaagaagacccagggaaac

SEQ ID NO: 354909 - DNA, 20 bp, Artificial
  CRISPR gRNA sequence
gaagacccagggaaactgga

SEQ ID NO: 354910 - DNA, 20 bp, Artificial
  CRISPR gRNA sequence
aagacccagggaaactggat

SEQ ID NO: 354911 - DNA, 20 bp, Artificial
  CRISPR gRNA sequence
cccagggaaactggatgggt

SEQ ID NO: 354912 - DNA, 20 bp, Artificial
  CRISPR gRNA sequence
cagggaaactggatgggtta

SEQ ID NO: 354913 - DNA, 20 bp, Artificial
  CRISPR gRNA sequence
gaaactggatgggttagaga

SEQ ID NO: 354914 - DNA, 20 bp, Artificial
  CRISPR gRNA sequence
aactggatgggttagagaaa

SEQ ID NO: 354915 - DNA, 20 bp, Artificial
  CRISPR gRNA sequence
actggatgggttagagaaag

SEQ ID NO: 354916 - DNA, 20 bp, Artificial
  CRISPR gRNA sequence
tgggttagagaaagaggcta

SEQ ID NO: 354917 - DNA, 20 bp, Artificial
  CRISPR gRNA sequence
tagagaaagaggctacagct

SEQ ID NO: 354918 - DNA, 20 bp, Artificial
  CRISPR gRNA sequence
gagaaagaggctacagctga

SEQ ID NO: 354919 - DNA, 20 bp, Artificial
  CRISPR gRNA sequence
aaagaggctacagctgagag

SEQ ID NO: 354920 - DNA, 20 bp, Artificial
  CRISPR gRNA sequence
aagaggctacagctgagagc

SEQ ID NO: 354921 - DNA, 20 bp, Artificial
  CRISPR gRNA sequence
ggctacagctgagagcaggc

SEQ ID NO: 354922 - DNA, 20 bp, Artificial
  CRISPR gRNA sequence
ctacagctgagagcaggctg

SEQ ID NO: 354923 - DNA, 20 bp, Artificial
  CRISPR gRNA sequence
gctggagacgttaccaaaac

SEQ ID NO: 354924 - DNA, 20 bp, Artificial
  CRISPR gRNA sequence
ctggagacgttaccaaaacc

SEQ ID NO: 354925 - DNA, 20 bp, Artificial
  CRISPR gRNA sequence
tggagacgttaccaaaacca

SEQ ID NO: 354926 - DNA, 20 bp, Artificial
  CRISPR gRNA sequence
gagacgttaccaaaaccagg

SEQ ID NO: 354927 - DNA, 20 bp, Artificial
  CRISPR gRNA sequence
acgttaccaaaaccagggag

SEQ ID NO: 354928 - DNA, 20 bp, Artificial
  CRISPR gRNA sequence
aaaccagggagcagtgatga

SEQ ID NO: 354929 - DNA, 20 bp, Artificial
  CRISPR gRNA sequence
agcagtgatgacagctgcta

SEQ ID NO: 354930 - DNA, 20 bp, Artificial
  CRISPR gRNA sequence
cagtgatgacagctgctaaa

SEQ ID NO: 354931 - DNA, 20 bp, Artificial
  CRISPR gRNA sequence
gatgacagctgctaaagagc

SEQ ID NO: 354932 - DNA, 20 bp, Artificial
  CRISPR gRNA sequence
tgacagctgctaaagagcca

SEQ ID NO: 354933 - DNA, 20 bp, Artificial
  CRISPR gRNA sequence
gacagctgctaaagagccag

SEQ ID NO: 354934 - DNA, 20 bp, Artificial
  CRISPR gRNA sequence
ctgctaaagagccagaggtc

SEQ ID NO: 354935 - DNA, 20 bp, Artificial
  CRISPR gRNA sequence
tgctaaagagccagaggtca

SEQ ID NO: 354936 - DNA, 20 bp, Artificial
  CRISPR gRNA sequence
agagccagaggtcaaggatg

SEQ ID NO: 354937 - DNA, 20 bp, Artificial
  CRISPR gRNA sequence
agccagaggtcaaggatgaa

SEQ ID NO: 354938 - DNA, 20 bp, Artificial
  CRISPR gRNA sequence
gaggtcaaggatgaagagac

SEQ ID NO: 354939 - DNA, 20 bp, Artificial
  CRISPR gRNA sequence
tcaaggatgaagagacaaga

SEQ ID NO: 354940 - DNA, 20 bp, Artificial
  CRISPR gRNA sequence
aaggatgaagagacaagatg

SEQ ID NO: 354941 - DNA, 20 bp, Artificial
  CRISPR gRNA sequence
ggatgaagagacaagatgga

SEQ ID NO: 354942 - DNA, 20 bp, Artificial
  CRISPR gRNA sequence
gagacaagatggagagacac

SEQ ID NO: 354943 - DNA, 20 bp, Artificial
  CRISPR gRNA sequence
acactggaaatcctattaac

SEQ ID NO: 354944 - DNA, 20 bp, Artificial
  CRISPR gRNA sequence
cactggaaatcctattaaca

SEQ ID NO: 354945 - DNA, 20 bp, Artificial
  CRISPR gRNA sequence
actggaaatcctattaacaa

SEQ ID NO: 354946 - DNA, 20 bp, Artificial
  CRISPR gRNA sequence
ctggaaatcctattaacaag

SEQ ID NO: 354947 - DNA, 20 bp, Artificial
  CRISPR gRNA sequence
tgtgtgtgtgtgtgtgtgtg

SEQ ID NO: 354948 - DNA, 20 bp, Artificial
  CRISPR gRNA sequence
gtgtgtgtgtgtggtgcatt

SEQ ID NO: 354949 - DNA, 20 bp, Artificial
  CRISPR gRNA sequence
tgcatttggtaacattactg

SEQ ID NO: 354950 - DNA, 20 bp, Artificial
  CRISPR gRNA sequence
gcatttggtaacattactga

SEQ ID NO: 354951 - DNA, 20 bp, Artificial
  CRISPR gRNA sequence
atttggtaacattactgaag

SEQ ID NO: 354952 - DNA, 20 bp, Artificial
  CRISPR gRNA sequence
ttggtaacattactgaagga

SEQ ID NO: 354953 - DNA, 20 bp, Artificial
  CRISPR gRNA sequence
tggtaacattactgaaggag

SEQ ID NO: 354954 - DNA, 20 bp, Artificial
  CRISPR gRNA sequence
gtaacattactgaaggagag

SEQ ID NO: 354955 - DNA, 20 bp, Artificial
  CRISPR gRNA sequence
attactgaaggagaggagtg

SEQ ID NO: 354956 - DNA, 20 bp, Artificial
  CRISPR gRNA sequence
ctgaaggagaggagtgcaga

SEQ ID NO: 354957 - DNA, 20 bp, Artificial
  CRISPR gRNA sequence
gatggacatattcacctacc

SEQ ID NO: 354958 - DNA, 20 bp, Artificial
  CRISPR gRNA sequence
ctacccagcaaacatatatt

SEQ ID NO: 354959 - DNA, 20 bp, Artificial
  CRISPR gRNA sequence
attaagtatctatgatatgc

SEQ ID NO: 354960 - DNA, 20 bp, Artificial
  CRISPR gRNA sequence
tatgccagacatgaaaaata

SEQ ID NO: 354961 - DNA, 20 bp, Artificial
  CRISPR gRNA sequence
atgaaaaatatagacatcaa

SEQ ID NO: 354962 - DNA, 20 bp, Artificial
  CRISPR gRNA sequence
aaatatagacatcaaaagtg

SEQ ID NO: 354963 - DNA, 20 bp, Artificial
  CRISPR gRNA sequence
gtgtggtcccttcctcccct

SEQ ID NO: 354964 - DNA, 20 bp, Artificial
  CRISPR gRNA sequence
tggtcccttcctcccctaag

SEQ ID NO: 354965 - DNA, 20 bp, Artificial
  CRISPR gRNA sequence
cccctaagaagataacactt

SEQ ID NO: 354966 - DNA, 20 bp, Artificial
  CRISPR gRNA sequence
ctttagctgtaatacattat

SEQ ID NO: 354967 - DNA, 20 bp, Artificial
  CRISPR gRNA sequence
tttagctgtaatacattata

SEQ ID NO: 354968 - DNA, 20 bp, Artificial
  CRISPR gRNA sequence
atttcaacctgctatgatta

SEQ ID NO: 354969 - DNA, 20 bp, Artificial
  CRISPR gRNA sequence
tcaacctgctatgattacag

SEQ ID NO: 354970 - DNA, 20 bp, Artificial
  CRISPR gRNA sequence
tatgtaacaaatacctacac

SEQ ID NO: 354971 - DNA, 20 bp, Artificial
  CRISPR gRNA sequence
taacaaatacctacacaagt

SEQ ID NO: 354972 - DNA, 20 bp, Artificial
  CRISPR gRNA sequence
acctacacaagtgagctgat

SEQ ID NO: 354973 - DNA, 20 bp, Artificial
  CRISPR gRNA sequence
cacaagtgagctgataagca

SEQ ID NO: 354974 - DNA, 20 bp, Artificial
  CRISPR gRNA sequence
acaagtgagctgataagcac

SEQ ID NO: 354975 - DNA, 20 bp, Artificial
  CRISPR gRNA sequence
aagtgagctgataagcacag

SEQ ID NO: 354976 - DNA, 20 bp, Artificial
  CRISPR gRNA sequence
gctgataagcacaggagaac

SEQ ID NO: 354977 - DNA, 20 bp, Artificial
  CRISPR gRNA sequence
gataagcacaggagaactag

SEQ ID NO: 354978 - DNA, 20 bp, Artificial
  CRISPR gRNA sequence
ataagcacaggagaactaga

SEQ ID NO: 354979 - DNA, 20 bp, Artificial
  CRISPR gRNA sequence
taagcacaggagaactagaa

SEQ ID NO: 354980 - DNA, 20 bp, Artificial
  CRISPR gRNA sequence
aagcacaggagaactagaag

SEQ ID NO: 354981 - DNA, 20 bp, Artificial
  CRISPR gRNA sequence
cacaggagaactagaagggg

SEQ ID NO: 354982 - DNA, 20 bp, Artificial
  CRISPR gRNA sequence
ctagaaggggaagaaaaact

SEQ ID NO: 354983 - DNA, 20 bp, Artificial
  CRISPR gRNA sequence
aggggaagaaaaactcagcc

SEQ ID NO: 354984 - DNA, 20 bp, Artificial
  CRISPR gRNA sequence
aaactcagccaagaatatcc

SEQ ID NO: 354985 - DNA, 20 bp, Artificial
  CRISPR gRNA sequence
ttcccaactgtgctacaata

SEQ ID NO: 354986 - DNA, 20 bp, Artificial
  CRISPR gRNA sequence
actgtgctacaatacagtaa

SEQ ID NO: 354987 - DNA, 20 bp, Artificial
  CRISPR gRNA sequence
ctgtgctacaatacagtaaa

SEQ ID NO: 354988 - DNA, 20 bp, Artificial
  CRISPR gRNA sequence
tttttaatttttgttattga

SEQ ID NO: 354989 - DNA, 20 bp, Artificial
  CRISPR gRNA sequence
ttttaatttttgttattgac

SEQ ID NO: 354990 - DNA, 20 bp, Artificial
  CRISPR gRNA sequence
tttaatttttgttattgaca

SEQ ID NO: 354991 - DNA, 20 bp, Artificial
  CRISPR gRNA sequence
cagggtcttgctatgttgcc

SEQ ID NO: 354992 - DNA, 20 bp, Artificial
  CRISPR gRNA sequence
agggtcttgctatgttgccc

SEQ ID NO: 354993 - DNA, 20 bp, Artificial
  CRISPR gRNA sequence
tcttgctatgttgcccaggc

SEQ ID NO: 354994 - DNA, 20 bp, Artificial
  CRISPR gRNA sequence
ccaggctggactcgaactct

SEQ ID NO: 354995 - DNA, 20 bp, Artificial
  CRISPR gRNA sequence
ggactcgaactcttggactc

SEQ ID NO: 354996 - DNA, 20 bp, Artificial
  CRISPR gRNA sequence
cttggactcaagcaatcctc

SEQ ID NO: 354997 - DNA, 20 bp, Artificial
  CRISPR gRNA sequence
ctcaagcaatcctccagcct

SEQ ID NO: 354998 - DNA, 20 bp, Artificial
  CRISPR gRNA sequence
tcctccagcctcagcctcct

SEQ ID NO: 354999 - DNA, 20 bp, Artificial
  CRISPR gRNA sequence
tccagcctcagcctcctgag

SEQ ID NO: 355000 - DNA, 20 bp, Artificial
  CRISPR gRNA sequence
gcctcagcctcctgagtagc

SEQ ID NO: 355001 - DNA, 20 bp, Artificial
  CRISPR gRNA sequence
ctcctgagtagctggaactt

SEQ ID NO: 355002 - DNA, 20 bp, Artificial
  CRISPR gRNA sequence
tcctgagtagctggaacttc

SEQ ID NO: 355003 - DNA, 20 bp, Artificial
  CRISPR gRNA sequence
caggcacatatcactgtgac

SEQ ID NO: 355004 - DNA, 20 bp, Artificial
  CRISPR gRNA sequence
tcactgtgaccagccaataa

SEQ ID NO: 355005 - DNA, 20 bp, Artificial
  CRISPR gRNA sequence
ataaaagattaaaaaaaatt

SEQ ID NO: 355006 - DNA, 20 bp, Artificial
  CRISPR gRNA sequence
agattaaaaaaaatttagta

SEQ ID NO: 355007 - DNA, 20 bp, Artificial
  CRISPR gRNA sequence
gattaaaaaaaatttagtat

SEQ ID NO: 355008 - DNA, 20 bp, Artificial
  CRISPR gRNA sequence
aaaatttagtataggccaaa

SEQ ID NO: 355009 - DNA, 20 bp, Artificial
  CRISPR gRNA sequence
aatggctccctgctgtctct

SEQ ID NO: 355010 - DNA, 20 bp, Artificial
  CRISPR gRNA sequence
atggctccctgctgtctcta

SEQ ID NO: 355011 - DNA, 20 bp, Artificial
  CRISPR gRNA sequence
gctccctgctgtctctaagg

SEQ ID NO: 355012 - DNA, 20 bp, Artificial
  CRISPR gRNA sequence
accctccaattccttcttct

SEQ ID NO: 355013 - DNA, 20 bp, Artificial
  CRISPR gRNA sequence
tccttcttctcagtaatttt

SEQ ID NO: 355014 - DNA, 20 bp, Artificial
  CRISPR gRNA sequence
tctcagtaattttaagcacc

SEQ ID NO: 355015 - DNA, 20 bp, Artificial
  CRISPR gRNA sequence
ttttaagcacctagatttct

SEQ ID NO: 355016 - DNA, 20 bp, Artificial
  CRISPR gRNA sequence
cacctagatttcttggttct

SEQ ID NO: 355017 - DNA, 20 bp, Artificial
  CRISPR gRNA sequence
aaattatgctgtttgcttat

SEQ ID NO: 355018 - DNA, 20 bp, Artificial
  CRISPR gRNA sequence
aattatgctgtttgcttatt

SEQ ID NO: 355019 - DNA, 20 bp, Artificial
  CRISPR gRNA sequence
ctgtttgcttattgggatgt

SEQ ID NO: 355020 - DNA, 20 bp, Artificial
  CRISPR gRNA sequence
atttgatgaatgaataaatg

SEQ ID NO: 355021 - DNA, 20 bp, Artificial
  CRISPR gRNA sequence
tttgatgaatgaataaatga

SEQ ID NO: 355022 - DNA, 20 bp, Artificial
  CRISPR gRNA sequence
aaccttgttcttccccttct

SEQ ID NO: 355023 - DNA, 20 bp, Artificial
  CRISPR gRNA sequence
acacaccaccccctcgctgt

SEQ ID NO: 355024 - DNA, 20 bp, Artificial
  CRISPR gRNA sequence
ctcgctgtcagctttttcct

SEQ ID NO: 355025 - DNA, 20 bp, Artificial
  CRISPR gRNA sequence
cgctgtcagctttttccttg

SEQ ID NO: 355026 - DNA, 20 bp, Artificial
  CRISPR gRNA sequence
gctgtcagctttttccttgg

SEQ ID NO: 355027 - DNA, 20 bp, Artificial
  CRISPR gRNA sequence
tgtcagctttttccttggag

SEQ ID NO: 355028 - DNA, 20 bp, Artificial
  CRISPR gRNA sequence
gtcagctttttccttggagg

SEQ ID NO: 355029 - DNA, 20 bp, Artificial
  CRISPR gRNA sequence
agctttttccttggaggagg

SEQ ID NO: 355030 - DNA, 20 bp, Artificial
  CRISPR gRNA sequence
ttttccttggaggaggaaga

SEQ ID NO: 355031 - DNA, 20 bp, Artificial
  CRISPR gRNA sequence
tttccttggaggaggaagac

SEQ ID NO: 355032 - DNA, 20 bp, Artificial
  CRISPR gRNA sequence
ttccttggaggaggaagaca

SEQ ID NO: 355033 - DNA, 20 bp, Artificial
  CRISPR gRNA sequence
cttggaggaggaagacaggg

SEQ ID NO: 355034 - DNA, 20 bp, Artificial
  CRISPR gRNA sequence
ttggaggaggaagacagggc

SEQ ID NO: 355035 - DNA, 20 bp, Artificial
  CRISPR gRNA sequence
gaggaagacagggcaggata

SEQ ID NO: 355036 - DNA, 20 bp, Artificial
  CRISPR gRNA sequence
ggaagacagggcaggataaa

SEQ ID NO: 355037 - DNA, 20 bp, Artificial
  CRISPR gRNA sequence
agacagggcaggataaagag

SEQ ID NO: 355038 - DNA, 20 bp, Artificial
  CRISPR gRNA sequence
acagggcaggataaagagca

SEQ ID NO: 355039 - DNA, 20 bp, Artificial
  CRISPR gRNA sequence
cagggcaggataaagagcag

SEQ ID NO: 355040 - DNA, 20 bp, Artificial
  CRISPR gRNA sequence
aggataaagagcagaggcat

SEQ ID NO: 355041 - DNA, 20 bp, Artificial
  CRISPR gRNA sequence
ggataaagagcagaggcatc

SEQ ID NO: 355042 - DNA, 20 bp, Artificial
  CRISPR gRNA sequence
taaagagcagaggcatcagg

SEQ ID NO: 355043 - DNA, 20 bp, Artificial
  CRISPR gRNA sequence
aggcatcaggcagaatataa

SEQ ID NO: 355044 - DNA, 20 bp, Artificial
  CRISPR gRNA sequence
ggcatcaggcagaatataaa

SEQ ID NO: 355045 - DNA, 20 bp, Artificial
  CRISPR gRNA sequence
gcatcaggcagaatataaaa

SEQ ID NO: 355046 - DNA, 20 bp, Artificial
  CRISPR gRNA sequence
catcaggcagaatataaaag

SEQ ID NO: 355047 - DNA, 20 bp, Artificial
  CRISPR gRNA sequence
caggcagaatataaaagggg

SEQ ID NO: 355048 - DNA, 20 bp, Artificial
  CRISPR gRNA sequence
atataaaaggggcagaccac

SEQ ID NO: 355049 - DNA, 20 bp, Artificial
  CRISPR gRNA sequence
aattcttaaatgaactattc

SEQ ID NO: 355050 - DNA, 20 bp, Artificial
  CRISPR gRNA sequence
ctctccctgtaacattacca

SEQ ID NO: 355051 - DNA, 20 bp, Artificial
  CRISPR gRNA sequence
ctacttctcctcctttgtgt

SEQ ID NO: 355052 - DNA, 20 bp, Artificial
  CRISPR gRNA sequence
tctcctcctttgtgttagaa

SEQ ID NO: 355053 - DNA, 20 bp, Artificial
  CRISPR gRNA sequence
aaaatatatatgtgaatgct

SEQ ID NO: 355054 - DNA, 20 bp, Artificial
  CRISPR gRNA sequence
tatatatgtgaatgctgaga

SEQ ID NO: 355055 - DNA, 20 bp, Artificial
  CRISPR gRNA sequence
gagacagcttgacaaattac

SEQ ID NO: 355056 - DNA, 20 bp, Artificial
  CRISPR gRNA sequence
agacagcttgacaaattact

SEQ ID NO: 355057 - DNA, 20 bp, Artificial
  CRISPR gRNA sequence
acaaattactgggttattaa

SEQ ID NO: 355058 - DNA, 20 bp, Artificial
  CRISPR gRNA sequence
aaattactgggttattaata

SEQ ID NO: 355059 - DNA, 20 bp, Artificial
  CRISPR gRNA sequence
ttaatagagaacctctaaca

SEQ ID NO: 355060 - DNA, 20 bp, Artificial
  CRISPR gRNA sequence
gaacctctaacatggtgaat

SEQ ID NO: 355061 - DNA, 20 bp, Artificial
  CRISPR gRNA sequence
ctaacatggtgaataagatt

SEQ ID NO: 355062 - DNA, 20 bp, Artificial
  CRISPR gRNA sequence
tggtgaataagattcagcat

SEQ ID NO: 355063 - DNA, 20 bp, Artificial
  CRISPR gRNA sequence
agttgcactactcacctgtt

SEQ ID NO: 355064 - DNA, 20 bp, Artificial
  CRISPR gRNA sequence
gttgcactactcacctgtta

SEQ ID NO: 355065 - DNA, 20 bp, Artificial
  CRISPR gRNA sequence
gttaaggaaaatgacaatga

SEQ ID NO: 355066 - DNA, 20 bp, Artificial
  CRISPR gRNA sequence
aaggaaaatgacaatgatgg

SEQ ID NO: 355067 - DNA, 20 bp, Artificial
  CRISPR gRNA sequence
tgacaatgatggtggtaatt

SEQ ID NO: 355068 - DNA, 20 bp, Artificial
  CRISPR gRNA sequence
caacaataaaactgtccctc

SEQ ID NO: 355069 - DNA, 20 bp, Artificial
  CRISPR gRNA sequence
aaactgtccctccagccaca

SEQ ID NO: 355070 - DNA, 20 bp, Artificial
  CRISPR gRNA sequence
actgtccctccagccacaaa

SEQ ID NO: 355071 - DNA, 20 bp, Artificial
  CRISPR gRNA sequence
ctgtccctccagccacaaag

SEQ ID NO: 355072 - DNA, 20 bp, Artificial
  CRISPR gRNA sequence
tgtccctccagccacaaaga

SEQ ID NO: 355073 - DNA, 20 bp, Artificial
  CRISPR gRNA sequence
cagccacaaagagggtatat

SEQ ID NO: 355074 - DNA, 20 bp, Artificial
  CRISPR gRNA sequence
aaagagggtatattggttat

SEQ ID NO: 355075 - DNA, 20 bp, Artificial
  CRISPR gRNA sequence
tattggttatcggttttacc

SEQ ID NO: 355076 - DNA, 20 bp, Artificial
  CRISPR gRNA sequence
attggttatcggttttacct

SEQ ID NO: 355077 - DNA, 20 bp, Artificial
  CRISPR gRNA sequence
tggttatcggttttacctag

SEQ ID NO: 355078 - DNA, 20 bp, Artificial
  CRISPR gRNA sequence
gttatcggttttacctagga

SEQ ID NO: 355079 - DNA, 20 bp, Artificial
  CRISPR gRNA sequence
aggagagaaaaaaaatattg

SEQ ID NO: 355080 - DNA, 20 bp, Artificial
  CRISPR gRNA sequence
ggagagaaaaaaaatattgt

SEQ ID NO: 355081 - DNA, 20 bp, Artificial
  CRISPR gRNA sequence
aaaaaaaatattgtaggaat

SEQ ID NO: 355082 - DNA, 20 bp, Artificial
  CRISPR gRNA sequence
aaaaaaatattgtaggaatt

SEQ ID NO: 355083 - DNA, 20 bp, Artificial
  CRISPR gRNA sequence
tattgtaggaattaggaatt

SEQ ID NO: 355084 - DNA, 20 bp, Artificial
  CRISPR gRNA sequence
aggaattaggaattcagcca

SEQ ID NO: 355085 - DNA, 20 bp, Artificial
  CRISPR gRNA sequence
ggaattaggaattcagccaa

SEQ ID NO: 355086 - DNA, 20 bp, Artificial
  CRISPR gRNA sequence
attaggaattcagccaaagg

SEQ ID NO: 355087 - DNA, 20 bp, Artificial
  CRISPR gRNA sequence
attcagccaaaggcagtaaa

SEQ ID NO: 355088 - DNA, 20 bp, Artificial
  CRISPR gRNA sequence
agccaaaggcagtaaaaagt

SEQ ID NO: 355089 - DNA, 20 bp, Artificial
  CRISPR gRNA sequence
gccaaaggcagtaaaaagta

SEQ ID NO: 355090 - DNA, 20 bp, Artificial
  CRISPR gRNA sequence
aaaggcagtaaaaagtaagg

SEQ ID NO: 355091 - DNA, 20 bp, Artificial
  CRISPR gRNA sequence
aaggcagtaaaaagtaaggc

SEQ ID NO: 355092 - DNA, 20 bp, Artificial
  CRISPR gRNA sequence
aaaagtaaggcaggaaaata

SEQ ID NO: 355093 - DNA, 20 bp, Artificial
  CRISPR gRNA sequence
taaggcaggaaaataaagaa

SEQ ID NO: 355094 - DNA, 20 bp, Artificial
  CRISPR gRNA sequence
gaaaagatacattaattatt

SEQ ID NO: 355095 - DNA, 20 bp, Artificial
  CRISPR gRNA sequence
attattgagtaacaaaaaca

SEQ ID NO: 355096 - DNA, 20 bp, Artificial
  CRISPR gRNA sequence
aaagaatccaacaaaaaaaa

SEQ ID NO: 355097 - DNA, 20 bp, Artificial
  CRISPR gRNA sequence
tccaacaaaaaaaatagaat

SEQ ID NO: 355098 - DNA, 20 bp, Artificial
  CRISPR gRNA sequence
aaaaaaaatagaatgagtta

SEQ ID NO: 355099 - DNA, 20 bp, Artificial
  CRISPR gRNA sequence
aaaaaaatagaatgagttac

SEQ ID NO: 355100 - DNA, 20 bp, Artificial
  CRISPR gRNA sequence
atagaatgagttacaggaaa

SEQ ID NO: 355101 - DNA, 20 bp, Artificial
  CRISPR gRNA sequence
agaatgagttacaggaaaaa

SEQ ID NO: 355102 - DNA, 20 bp, Artificial
  CRISPR gRNA sequence
gaaaaagagaatttttcttt

SEQ ID NO: 355103 - DNA, 20 bp, Artificial
  CRISPR gRNA sequence
aaaagagaatttttctttta

SEQ ID NO: 355104 - DNA, 20 bp, Artificial
  CRISPR gRNA sequence
taaatatttctaactcctaa

SEQ ID NO: 355105 - DNA, 20 bp, Artificial
  CRISPR gRNA sequence
tttttatttgttttttgatt

SEQ ID NO: 355106 - DNA, 20 bp, Artificial
  CRISPR gRNA sequence
atttgttttttgattaagct

SEQ ID NO: 355107 - DNA, 20 bp, Artificial
  CRISPR gRNA sequence
ttacaaaaaaaaaaaatata

SEQ ID NO: 355108 - DNA, 20 bp, Artificial
  CRISPR gRNA sequence
acaaaaaaaaaaaatataaa

SEQ ID NO: 355109 - DNA, 20 bp, Artificial
  CRISPR gRNA sequence
taaagagcatgcgtttgcca

SEQ ID NO: 355110 - DNA, 20 bp, Artificial
  CRISPR gRNA sequence
gccaaagacctcattcaaat

SEQ ID NO: 355111 - DNA, 20 bp, Artificial
  CRISPR gRNA sequence
catatacacaaaaccttttg

SEQ ID NO: 355112 - DNA, 20 bp, Artificial
  CRISPR gRNA sequence
aaaaaaaaaaactattaaaa

SEQ ID NO: 355113 - DNA, 20 bp, Artificial
  CRISPR gRNA sequence
aaaaaaaaaactattaaaat

SEQ ID NO: 355114 - DNA, 20 bp, Artificial
  CRISPR gRNA sequence
aaaactattaaaataggaaa

SEQ ID NO: 355115 - DNA, 20 bp, Artificial
  CRISPR gRNA sequence
aaactattaaaataggaaat

SEQ ID NO: 355116 - DNA, 20 bp, Artificial
  CRISPR gRNA sequence
tattaaaataggaaataggc

SEQ ID NO: 355117 - DNA, 20 bp, Artificial
  CRISPR gRNA sequence
attaaaataggaaataggcc

SEQ ID NO: 355118 - DNA, 20 bp, Artificial
  CRISPR gRNA sequence
aataggaaataggccaggtg

SEQ ID NO: 355119 - DNA, 20 bp, Artificial
  CRISPR gRNA sequence
aggaaataggccaggtgtag

SEQ ID NO: 355120 - DNA, 20 bp, Artificial
  CRISPR gRNA sequence
ataggccaggtgtagtggct

SEQ ID NO: 355121 - DNA, 20 bp, Artificial
  CRISPR gRNA sequence
taggccaggtgtagtggctc

SEQ ID NO: 355122 - DNA, 20 bp, Artificial
  CRISPR gRNA sequence
gtggctcaggcctgtaatca

SEQ ID NO: 355123 - DNA, 20 bp, Artificial
  CRISPR gRNA sequence
ggctcaggcctgtaatcaca

SEQ ID NO: 355124 - DNA, 20 bp, Artificial
  CRISPR gRNA sequence
gctcaggcctgtaatcacag

SEQ ID NO: 355125 - DNA, 20 bp, Artificial
  CRISPR gRNA sequence
ggcctgtaatcacagaggtt

SEQ ID NO: 355126 - DNA, 20 bp, Artificial
  CRISPR gRNA sequence
gcctgtaatcacagaggttt

SEQ ID NO: 355127 - DNA, 20 bp, Artificial
  CRISPR gRNA sequence
ctgtaatcacagaggtttag

SEQ ID NO: 355128 - DNA, 20 bp, Artificial
  CRISPR gRNA sequence
gtaatcacagaggtttagga

SEQ ID NO: 355129 - DNA, 20 bp, Artificial
  CRISPR gRNA sequence
taatcacagaggtttaggag

SEQ ID NO: 355130 - DNA, 20 bp, Artificial
  CRISPR gRNA sequence
aatcacagaggtttaggaga

SEQ ID NO: 355131 - DNA, 20 bp, Artificial
  CRISPR gRNA sequence
atcacagaggtttaggagag

SEQ ID NO: 355132 - DNA, 20 bp, Artificial
  CRISPR gRNA sequence
tttaggagaggggatcactt

SEQ ID NO: 355133 - DNA, 20 bp, Artificial
  CRISPR gRNA sequence
ttaggagaggggatcacttg

SEQ ID NO: 355134 - DNA, 20 bp, Artificial
  CRISPR gRNA sequence
gagaggggatcacttgaggc

SEQ ID NO: 355135 - DNA, 20 bp, Artificial
  CRISPR gRNA sequence
agaggggatcacttgaggcc

SEQ ID NO: 355136 - DNA, 20 bp, Artificial
  CRISPR gRNA sequence
aggggatcacttgaggccag

SEQ ID NO: 355137 - DNA, 20 bp, Artificial
  CRISPR gRNA sequence
tcacttgaggccaggagttc

SEQ ID NO: 355138 - DNA, 20 bp, Artificial
  CRISPR gRNA sequence
tgaggccaggagttcaagac

SEQ ID NO: 355139 - DNA, 20 bp, Artificial
  CRISPR gRNA sequence
ccaggagttcaagaccagca

SEQ ID NO: 355140 - DNA, 20 bp, Artificial
  CRISPR gRNA sequence
caggagttcaagaccagcat

SEQ ID NO: 355141 - DNA, 20 bp, Artificial
  CRISPR gRNA sequence
caagaccagcatgggcaaca

SEQ ID NO: 355142 - DNA, 20 bp, Artificial
  CRISPR gRNA sequence
gtctctactaaaaacacaaa

SEQ ID NO: 355143 - DNA, 20 bp, Artificial
  CRISPR gRNA sequence
aaaaacacaaaaagtgatcc

SEQ ID NO: 355144 - DNA, 20 bp, Artificial
  CRISPR gRNA sequence
cacaaaaagtgatcccagtg

SEQ ID NO: 355145 - DNA, 20 bp, Artificial
  CRISPR gRNA sequence
aaaaagtgatcccagtgtgg

SEQ ID NO: 355146 - DNA, 20 bp, Artificial
  CRISPR gRNA sequence
gtggtgcatgcctataatcc

SEQ ID NO: 355147 - DNA, 20 bp, Artificial
  CRISPR gRNA sequence
ctataatcccagctactcat

SEQ ID NO: 355148 - DNA, 20 bp, Artificial
  CRISPR gRNA sequence
tataatcccagctactcatt

SEQ ID NO: 355149 - DNA, 20 bp, Artificial
  CRISPR gRNA sequence
tcccagctactcattaggct

SEQ ID NO: 355150 - DNA, 20 bp, Artificial
  CRISPR gRNA sequence
cccagctactcattaggctg

SEQ ID NO: 355151 - DNA, 20 bp, Artificial
  CRISPR gRNA sequence
tactcattaggctgaggcac

SEQ ID NO: 355152 - DNA, 20 bp, Artificial
  CRISPR gRNA sequence
cacgagactcatttgaaccc

SEQ ID NO: 355153 - DNA, 20 bp, Artificial
  CRISPR gRNA sequence
cgagactcatttgaacccca

SEQ ID NO: 355154 - DNA, 20 bp, Artificial
  CRISPR gRNA sequence
gagactcatttgaaccccag

SEQ ID NO: 355155 - DNA, 20 bp, Artificial
  CRISPR gRNA sequence
actcatttgaaccccagagg

SEQ ID NO: 355156 - DNA, 20 bp, Artificial
  CRISPR gRNA sequence
tcatttgaaccccagaggcg

SEQ ID NO: 355157 - DNA, 20 bp, Artificial
  CRISPR gRNA sequence
aaccccagaggcggagcttg

SEQ ID NO: 355158 - DNA, 20 bp, Artificial
  CRISPR gRNA sequence
ccagaggcggagcttgcagt

SEQ ID NO: 355159 - DNA, 20 bp, Artificial
  CRISPR gRNA sequence
ggcggagcttgcagtgagcc

SEQ ID NO: 355160 - DNA, 20 bp, Artificial
  CRISPR gRNA sequence
cggatcttgccactgcactc

SEQ ID NO: 355161 - DNA, 20 bp, Artificial
  CRISPR gRNA sequence
cttgccactgcactccagcc

SEQ ID NO: 355162 - DNA, 20 bp, Artificial
  CRISPR gRNA sequence
ttgccactgcactccagcct

SEQ ID NO: 355163 - DNA, 20 bp, Artificial
  CRISPR gRNA sequence
ctgcactccagcctgggcaa

SEQ ID NO: 355164 - DNA, 20 bp, Artificial
  CRISPR gRNA sequence
gcactccagcctgggcaaca

SEQ ID NO: 355165 - DNA, 20 bp, Artificial
  CRISPR gRNA sequence
actccagcctgggcaacaga

SEQ ID NO: 355166 - DNA, 20 bp, Artificial
  CRISPR gRNA sequence
tccagcctgggcaacagaga

SEQ ID NO: 355167 - DNA, 20 bp, Artificial
  CRISPR gRNA sequence
ctatgtaaaaataaataaaa

SEQ ID NO: 355168 - DNA, 20 bp, Artificial
  CRISPR gRNA sequence
aataaaatagtaaataaaca

SEQ ID NO: 355169 - DNA, 20 bp, Artificial
  CRISPR gRNA sequence
tcttttatgcctgatatatt

SEQ ID NO: 355170 - DNA, 20 bp, Artificial
  CRISPR gRNA sequence
taagtacattcaacatacaa

SEQ ID NO: 355171 - DNA, 20 bp, Artificial
  CRISPR gRNA sequence
aatataactctgatgtttat

SEQ ID NO: 355172 - DNA, 20 bp, Artificial
  CRISPR gRNA sequence
gatgtttataagtataattt

SEQ ID NO: 355173 - DNA, 20 bp, Artificial
  CRISPR gRNA sequence
taagtataatttaagaaaaa

SEQ ID NO: 355174 - DNA, 20 bp, Artificial
  CRISPR gRNA sequence
tagatattttctattcaatt

SEQ ID NO: 355175 - DNA, 20 bp, Artificial
  CRISPR gRNA sequence
ttggtaatgatacaaaaaat

SEQ ID NO: 355176 - DNA, 20 bp, Artificial
  CRISPR gRNA sequence
tactccaactcaatgtctga

SEQ ID NO: 355177 - DNA, 20 bp, Artificial
  CRISPR gRNA sequence
caatgtctgaaagtttacca

SEQ ID NO: 355178 - DNA, 20 bp, Artificial
  CRISPR gRNA sequence
tctgaaagtttaccatggtc

SEQ ID NO: 355179 - DNA, 20 bp, Artificial
  CRISPR gRNA sequence
acaattcaactgaccgactc

SEQ ID NO: 355180 - DNA, 20 bp, Artificial
  CRISPR gRNA sequence
ctccagcaaattccttactg

SEQ ID NO: 355181 - DNA, 20 bp, Artificial
  CRISPR gRNA sequence
tctcttcatttgtcaactga

SEQ ID NO: 355182 - DNA, 20 bp, Artificial
  CRISPR gRNA sequence
catttgtcaactgatggcaa

SEQ ID NO: 355183 - DNA, 20 bp, Artificial
  CRISPR gRNA sequence
ttgtcaactgatggcaatgg

SEQ ID NO: 355184 - DNA, 20 bp, Artificial
  CRISPR gRNA sequence
tcaactgatggcaatggcag

SEQ ID NO: 355185 - DNA, 20 bp, Artificial
  CRISPR gRNA sequence
cagcagccctaattacatca

SEQ ID NO: 355186 - DNA, 20 bp, Artificial
  CRISPR gRNA sequence
ttacatcacagaattgtgat

SEQ ID NO: 355187 - DNA, 20 bp, Artificial
  CRISPR gRNA sequence
aattgtgatgagactctcat

SEQ ID NO: 355188 - DNA, 20 bp, Artificial
  CRISPR gRNA sequence
tctcatgagtcaatattcac

SEQ ID NO: 355189 - DNA, 20 bp, Artificial
  CRISPR gRNA sequence
caagaacaatcaactgcgat

SEQ ID NO: 355190 - DNA, 20 bp, Artificial
  CRISPR gRNA sequence
agaacaatcaactgcgatta

SEQ ID NO: 355191 - DNA, 20 bp, Artificial
  CRISPR gRNA sequence
gattagagaaatgtcccctc

SEQ ID NO: 355192 - DNA, 20 bp, Artificial
  CRISPR gRNA sequence
ttagagaaatgtcccctctg

SEQ ID NO: 355193 - DNA, 20 bp, Artificial
  CRISPR gRNA sequence
aaatgtcccctctggagtgt

SEQ ID NO: 355194 - DNA, 20 bp, Artificial
  CRISPR gRNA sequence
tcccctctggagtgtgagcc

SEQ ID NO: 355195 - DNA, 20 bp, Artificial
  CRISPR gRNA sequence
ctctggagtgtgagcccagt

SEQ ID NO: 355196 - DNA, 20 bp, Artificial
  CRISPR gRNA sequence
tctggagtgtgagcccagtg

SEQ ID NO: 355197 - DNA, 20 bp, Artificial
  CRISPR gRNA sequence
gagtgtgagcccagtgaggt

SEQ ID NO: 355198 - DNA, 20 bp, Artificial
  CRISPR gRNA sequence
gtgtgagcccagtgaggtca

SEQ ID NO: 355199 - DNA, 20 bp, Artificial
  CRISPR gRNA sequence
acctctcacccttcaaccca

SEQ ID NO: 355200 - DNA, 20 bp, Artificial
  CRISPR gRNA sequence
ctctcacccttcaacccaca

SEQ ID NO: 355201 - DNA, 20 bp, Artificial
  CRISPR gRNA sequence
caacccacagagcatgttgt

SEQ ID NO: 355202 - DNA, 20 bp, Artificial
  CRISPR gRNA sequence
catgttgtgagtgcctccca

SEQ ID NO: 355203 - DNA, 20 bp, Artificial
  CRISPR gRNA sequence
atgttgtgagtgcctcccac

SEQ ID NO: 355204 - DNA, 20 bp, Artificial
  CRISPR gRNA sequence
tgttgtgagtgcctcccaca

SEQ ID NO: 355205 - DNA, 20 bp, Artificial
  CRISPR gRNA sequence
tgtgagtgcctcccacaggg

SEQ ID NO: 355206 - DNA, 20 bp, Artificial
  CRISPR gRNA sequence
atcccatcaacatctgctgc

SEQ ID NO: 355207 - DNA, 20 bp, Artificial
  CRISPR gRNA sequence
tcccatcaacatctgctgct

SEQ ID NO: 355208 - DNA, 20 bp, Artificial
  CRISPR gRNA sequence
tcaacatctgctgctgggaa

SEQ ID NO: 355209 - DNA, 20 bp, Artificial
  CRISPR gRNA sequence
caacatctgctgctgggaat

SEQ ID NO: 355210 - DNA, 20 bp, Artificial
  CRISPR gRNA sequence
aggactgaaatgaaacccaa

SEQ ID NO: 355211 - DNA, 20 bp, Artificial
  CRISPR gRNA sequence
tcttcattgctgtctctctt

SEQ ID NO: 355212 - DNA, 20 bp, Artificial
  CRISPR gRNA sequence
cttcattgctgtctctcttc

SEQ ID NO: 355213 - DNA, 20 bp, Artificial
  CRISPR gRNA sequence
attgctgtctctcttcggga

SEQ ID NO: 355214 - DNA, 20 bp, Artificial
  CRISPR gRNA sequence
cctgtcaatcaccccaccat

SEQ ID NO: 355215 - DNA, 20 bp, Artificial
  CRISPR gRNA sequence
ctgtcaatcaccccaccatt

SEQ ID NO: 355216 - DNA, 20 bp, Artificial
  CRISPR gRNA sequence
ccccaccattaggatgatgc

SEQ ID NO: 355217 - DNA, 20 bp, Artificial
  CRISPR gRNA sequence
cccaccattaggatgatgcc

SEQ ID NO: 355218 - DNA, 20 bp, Artificial
  CRISPR gRNA sequence
ttaggatgatgccaggctct

SEQ ID NO: 355219 - DNA, 20 bp, Artificial
  CRISPR gRNA sequence
aggatgatgccaggctctga

SEQ ID NO: 355220 - DNA, 20 bp, Artificial
  CRISPR gRNA sequence
ggatgatgccaggctctgag

SEQ ID NO: 355221 - DNA, 20 bp, Artificial
  CRISPR gRNA sequence
gatgatgccaggctctgaga

SEQ ID NO: 355222 - DNA, 20 bp, Artificial
  CRISPR gRNA sequence
gatgccaggctctgagaggg

SEQ ID NO: 355223 - DNA, 20 bp, Artificial
  CRISPR gRNA sequence
ttcccttcctcctgaaatca

SEQ ID NO: 355224 - DNA, 20 bp, Artificial
  CRISPR gRNA sequence
atgtttgtactgtgacaccc

SEQ ID NO: 355225 - DNA, 20 bp, Artificial
  CRISPR gRNA sequence
actgtgacaccccggctgtc

SEQ ID NO: 355226 - DNA, 20 bp, Artificial
  CRISPR gRNA sequence
ggctgtctggaatcctattg

SEQ ID NO: 355227 - DNA, 20 bp, Artificial
  CRISPR gRNA sequence
attcttccccatcttttcct

SEQ ID NO: 355228 - DNA, 20 bp, Artificial
  CRISPR gRNA sequence
ttctcactttatccactatg

SEQ ID NO: 355229 - DNA, 20 bp, Artificial
  CRISPR gRNA sequence
tgtagctgcatttttttcat

SEQ ID NO: 355230 - DNA, 20 bp, Artificial
  CRISPR gRNA sequence
atttttttcataagaactca

SEQ ID NO: 355231 - DNA, 20 bp, Artificial
  CRISPR gRNA sequence
tttcataagaactcaaagta

SEQ ID NO: 355232 - DNA, 20 bp, Artificial
  CRISPR gRNA sequence
ctttcacaaactttactgca

SEQ ID NO: 355233 - DNA, 20 bp, Artificial
  CRISPR gRNA sequence
ttcacaaactttactgcaaa

SEQ ID NO: 355234 - DNA, 20 bp, Artificial
  CRISPR gRNA sequence
ctttactgcaaagagaaact

SEQ ID NO: 355235 - DNA, 20 bp, Artificial
  CRISPR gRNA sequence
aaagagaaactaagacaaat

SEQ ID NO: 355236 - DNA, 20 bp, Artificial
  CRISPR gRNA sequence
cattttatttttaaacgttt

SEQ ID NO: 355237 - DNA, 20 bp, Artificial
  CRISPR gRNA sequence
atttttaaacgttttagacc

SEQ ID NO: 355238 - DNA, 20 bp, Artificial
  CRISPR gRNA sequence
tagacctagattccacaaat

SEQ ID NO: 355239 - DNA, 20 bp, Artificial
  CRISPR gRNA sequence
ctagattccacaaataagtg

SEQ ID NO: 355240 - DNA, 20 bp, Artificial
  CRISPR gRNA sequence
aaattttttctttttgtgtc

SEQ ID NO: 355241 - DNA, 20 bp, Artificial
  CRISPR gRNA sequence
tcacttttcataatgtcctc

SEQ ID NO: 355242 - DNA, 20 bp, Artificial
  CRISPR gRNA sequence
cacttttcataatgtcctca

SEQ ID NO: 355243 - DNA, 20 bp, Artificial
  CRISPR gRNA sequence
tatgatttccttctttttta

SEQ ID NO: 355244 - DNA, 20 bp, Artificial
  CRISPR gRNA sequence
atgatttccttcttttttaa

SEQ ID NO: 355245 - DNA, 20 bp, Artificial
  CRISPR gRNA sequence
tgatttccttcttttttaaa

SEQ ID NO: 355246 - DNA, 20 bp, Artificial
  CRISPR gRNA sequence
cttcttttttaaagggttaa

SEQ ID NO: 355247 - DNA, 20 bp, Artificial
  CRISPR gRNA sequence
tttatctattcatctgttga

SEQ ID NO: 355248 - DNA, 20 bp, Artificial
  CRISPR gRNA sequence
ttcatctgttgatggacacc

SEQ ID NO: 355249 - DNA, 20 bp, Artificial
  CRISPR gRNA sequence
tcatctgttgatggacacct

SEQ ID NO: 355250 - DNA, 20 bp, Artificial
  CRISPR gRNA sequence
catccacatcttgactactg

SEQ ID NO: 355251 - DNA, 20 bp, Artificial
  CRISPR gRNA sequence
acaatgatgcaatacataca

SEQ ID NO: 355252 - DNA, 20 bp, Artificial
  CRISPR gRNA sequence
gatgcaatacatacacggtg

SEQ ID NO: 355253 - DNA, 20 bp, Artificial
  CRISPR gRNA sequence
atgcaatacatacacggtgc

SEQ ID NO: 355254 - DNA, 20 bp, Artificial
  CRISPR gRNA sequence
cacggtgcaggtatttcttc

SEQ ID NO: 355255 - DNA, 20 bp, Artificial
  CRISPR gRNA sequence
cctttgtatataatacccat

SEQ ID NO: 355256 - DNA, 20 bp, Artificial
  CRISPR gRNA sequence
tataatacccatcagattgc

SEQ ID NO: 355257 - DNA, 20 bp, Artificial
  CRISPR gRNA sequence
cagattgctggttcatatga

SEQ ID NO: 355258 - DNA, 20 bp, Artificial
  CRISPR gRNA sequence
ttttaattttattttatttt

SEQ ID NO: 355259 - DNA, 20 bp, Artificial
  CRISPR gRNA sequence
tttaattttattttattttt

SEQ ID NO: 355260 - DNA, 20 bp, Artificial
  CRISPR gRNA sequence
attttattttatttttggga

SEQ ID NO: 355261 - DNA, 20 bp, Artificial
  CRISPR gRNA sequence
tttattttatttttgggaca

SEQ ID NO: 355262 - DNA, 20 bp, Artificial
  CRISPR gRNA sequence
agagtttcactcttgtcacc

SEQ ID NO: 355263 - DNA, 20 bp, Artificial
  CRISPR gRNA sequence
gagtttcactcttgtcaccc

SEQ ID NO: 355264 - DNA, 20 bp, Artificial
  CRISPR gRNA sequence
ttcactcttgtcacccaggc

SEQ ID NO: 355265 - DNA, 20 bp, Artificial
  CRISPR gRNA sequence
cactcttgtcacccaggctg

SEQ ID NO: 355266 - DNA, 20 bp, Artificial
  CRISPR gRNA sequence
ttgtcacccaggctggagtg

SEQ ID NO: 355267 - DNA, 20 bp, Artificial
  CRISPR gRNA sequence
tcacccaggctggagtgcag

SEQ ID NO: 355268 - DNA, 20 bp, Artificial
  CRISPR gRNA sequence
ggagtgcagtggcacaatct

SEQ ID NO: 355269 - DNA, 20 bp, Artificial
  CRISPR gRNA sequence
gcacaatctcagctcgctgc

SEQ ID NO: 355270 - DNA, 20 bp, Artificial
  CRISPR gRNA sequence
tcgctgcaagctccacttcc

SEQ ID NO: 355271 - DNA, 20 bp, Artificial
  CRISPR gRNA sequence
cgctgcaagctccacttccc

SEQ ID NO: 355272 - DNA, 20 bp, Artificial
  CRISPR gRNA sequence
aagctccacttcccaggttc

SEQ ID NO: 355273 - DNA, 20 bp, Artificial
  CRISPR gRNA sequence
ttcaagcaattctcctgcct

SEQ ID NO: 355274 - DNA, 20 bp, Artificial
  CRISPR gRNA sequence
attctcctgcctcagcctcc

SEQ ID NO: 355275 - DNA, 20 bp, Artificial
  CRISPR gRNA sequence
ctcctgcctcagcctccaag

SEQ ID NO: 355276 - DNA, 20 bp, Artificial
  CRISPR gRNA sequence
tgcctcagcctccaagtagc

SEQ ID NO: 355277 - DNA, 20 bp, Artificial
  CRISPR gRNA sequence
gcctcagcctccaagtagct

SEQ ID NO: 355278 - DNA, 20 bp, Artificial
  CRISPR gRNA sequence
cctccaagtagctgggatta

SEQ ID NO: 355279 - DNA, 20 bp, Artificial
  CRISPR gRNA sequence
ctccaagtagctgggattac

SEQ ID NO: 355280 - DNA, 20 bp, Artificial
  CRISPR gRNA sequence
caggcacctgccaccacacc

SEQ ID NO: 355281 - DNA, 20 bp, Artificial
  CRISPR gRNA sequence
ccagctaatttttgtatttt

SEQ ID NO: 355282 - DNA, 20 bp, Artificial
  CRISPR gRNA sequence
gctaatttttgtatttttag

SEQ ID NO: 355283 - DNA, 20 bp, Artificial
  CRISPR gRNA sequence
taatttttgtatttttagta

SEQ ID NO: 355284 - DNA, 20 bp, Artificial
  CRISPR gRNA sequence
ttttgtatttttagtagaga

SEQ ID NO: 355285 - DNA, 20 bp, Artificial
  CRISPR gRNA sequence
tttgtatttttagtagagat

SEQ ID NO: 355286 - DNA, 20 bp, Artificial
  CRISPR gRNA sequence
ttgtatttttagtagagatg

SEQ ID NO: 355287 - DNA, 20 bp, Artificial
  CRISPR gRNA sequence
gagatggggtttcaccctgt

SEQ ID NO: 355288 - DNA, 20 bp, Artificial
  CRISPR gRNA sequence
tggggtttcaccctgttggc

SEQ ID NO: 355289 - DNA, 20 bp, Artificial
  CRISPR gRNA sequence
ggggtttcaccctgttggcc

SEQ ID NO: 355290 - DNA, 20 bp, Artificial
  CRISPR gRNA sequence
tttcaccctgttggccaggc

SEQ ID NO: 355291 - DNA, 20 bp, Artificial
  CRISPR gRNA sequence
tggtctcgaactcctgacct

SEQ ID NO: 355292 - DNA, 20 bp, Artificial
  CRISPR gRNA sequence
ggtctcgaactcctgacctc

SEQ ID NO: 355293 - DNA, 20 bp, Artificial
  CRISPR gRNA sequence
ctcaggtgatccatctgcct

SEQ ID NO: 355294 - DNA, 20 bp, Artificial
  CRISPR gRNA sequence
ccatctgccttggcctccca

SEQ ID NO: 355295 - DNA, 20 bp, Artificial
  CRISPR gRNA sequence
gccttggcctcccaaagtgc

SEQ ID NO: 355296 - DNA, 20 bp, Artificial
  CRISPR gRNA sequence
ccttggcctcccaaagtgct

SEQ ID NO: 355297 - DNA, 20 bp, Artificial
  CRISPR gRNA sequence
ctcccaaagtgctgggatta

SEQ ID NO: 355298 - DNA, 20 bp, Artificial
  CRISPR gRNA sequence
tcccaaagtgctgggattac

SEQ ID NO: 355299 - DNA, 20 bp, Artificial
  CRISPR gRNA sequence
agtgctgggattacaggcat

SEQ ID NO: 355300 - DNA, 20 bp, Artificial
  CRISPR gRNA sequence
caggcatgagccaccgcacc

SEQ ID NO: 355301 - DNA, 20 bp, Artificial
  CRISPR gRNA sequence
tggcctatttttaatttctt

SEQ ID NO: 355302 - DNA, 20 bp, Artificial
  CRISPR gRNA sequence
ggcctatttttaatttcttg

SEQ ID NO: 355303 - DNA, 20 bp, Artificial
  CRISPR gRNA sequence
ctactacctgtaccaataac

SEQ ID NO: 355304 - DNA, 20 bp, Artificial
  CRISPR gRNA sequence
cccatttacattcccgccaa

SEQ ID NO: 355305 - DNA, 20 bp, Artificial
  CRISPR gRNA sequence
cattcccgccaacagtgtac

SEQ ID NO: 355306 - DNA, 20 bp, Artificial
  CRISPR gRNA sequence
attcccgccaacagtgtaca

SEQ ID NO: 355307 - DNA, 20 bp, Artificial
  CRISPR gRNA sequence
ttcccgccaacagtgtacaa

SEQ ID NO: 355308 - DNA, 20 bp, Artificial
  CRISPR gRNA sequence
atctcttgcctttttgataa

SEQ ID NO: 355309 - DNA, 20 bp, Artificial
  CRISPR gRNA sequence
tttgataacagccattctaa

SEQ ID NO: 355310 - DNA, 20 bp, Artificial
  CRISPR gRNA sequence
ttgataacagccattctaat

SEQ ID NO: 355311 - DNA, 20 bp, Artificial
  CRISPR gRNA sequence
acagccattctaataggtgt

SEQ ID NO: 355312 - DNA, 20 bp, Artificial
  CRISPR gRNA sequence
cagccattctaataggtgtg

SEQ ID NO: 355313 - DNA, 20 bp, Artificial
  CRISPR gRNA sequence
cattctaataggtgtgaggt

SEQ ID NO: 355314 - DNA, 20 bp, Artificial
  CRISPR gRNA sequence
ttctaataggtgtgaggtga

SEQ ID NO: 355315 - DNA, 20 bp, Artificial
  CRISPR gRNA sequence
ggtgtgaggtgagagctcac

SEQ ID NO: 355316 - DNA, 20 bp, Artificial
  CRISPR gRNA sequence
gtgtgaggtgagagctcact

SEQ ID NO: 355317 - DNA, 20 bp, Artificial
  CRISPR gRNA sequence
tgtgaggtgagagctcactg

SEQ ID NO: 355318 - DNA, 20 bp, Artificial
  CRISPR gRNA sequence
atttgcatttccctgatgac

SEQ ID NO: 355319 - DNA, 20 bp, Artificial
  CRISPR gRNA sequence
ccctgatgaccagtaatgtt

SEQ ID NO: 355320 - DNA, 20 bp, Artificial
  CRISPR gRNA sequence
tgatgaccagtaatgttgag

SEQ ID NO: 355321 - DNA, 20 bp, Artificial
  CRISPR gRNA sequence
gcagctttccatatacctat

SEQ ID NO: 355322 - DNA, 20 bp, Artificial
  CRISPR gRNA sequence
ctttccatatacctattggc

SEQ ID NO: 355323 - DNA, 20 bp, Artificial
  CRISPR gRNA sequence
ggccagtgttatgtcttctt

SEQ ID NO: 355324 - DNA, 20 bp, Artificial
  CRISPR gRNA sequence
agtgttatgtcttctttgga

SEQ ID NO: 355325 - DNA, 20 bp, Artificial
  CRISPR gRNA sequence
gtttttgcccactttttaat

SEQ ID NO: 355326 - DNA, 20 bp, Artificial
  CRISPR gRNA sequence
tttttgcccactttttaatt

SEQ ID NO: 355327 - DNA, 20 bp, Artificial
  CRISPR gRNA sequence
tgaaatcctgccatttgcga

SEQ ID NO: 355328 - DNA, 20 bp, Artificial
  CRISPR gRNA sequence
tcctgccatttgcgacagca

SEQ ID NO: 355329 - DNA, 20 bp, Artificial
  CRISPR gRNA sequence
tgcgacagcatggatgaatt

SEQ ID NO: 355330 - DNA, 20 bp, Artificial
  CRISPR gRNA sequence
cgacagcatggatgaatttg

SEQ ID NO: 355331 - DNA, 20 bp, Artificial
  CRISPR gRNA sequence
gacagcatggatgaatttgg

SEQ ID NO: 355332 - DNA, 20 bp, Artificial
  CRISPR gRNA sequence
gaatttggaggacattatgt

SEQ ID NO: 355333 - DNA, 20 bp, Artificial
  CRISPR gRNA sequence
ggacattatgtaagtgaaat

SEQ ID NO: 355334 - DNA, 20 bp, Artificial
  CRISPR gRNA sequence
attatgtaagtgaaataagc

SEQ ID NO: 355335 - DNA, 20 bp, Artificial
  CRISPR gRNA sequence
taagtgaaataagccagaca

SEQ ID NO: 355336 - DNA, 20 bp, Artificial
  CRISPR gRNA sequence
tgaaataagccagacataga

SEQ ID NO: 355337 - DNA, 20 bp, Artificial
  CRISPR gRNA sequence
tgtataatctcacctgtatg

SEQ ID NO: 355338 - DNA, 20 bp, Artificial
  CRISPR gRNA sequence
cctgtatgtggaatctaaaa

SEQ ID NO: 355339 - DNA, 20 bp, Artificial
  CRISPR gRNA sequence
atctaaaaaagtcaaactta

SEQ ID NO: 355340 - DNA, 20 bp, Artificial
  CRISPR gRNA sequence
taaaaaagtcaaacttatag

SEQ ID NO: 355341 - DNA, 20 bp, Artificial
  CRISPR gRNA sequence
aaaagtcaaacttatagaag

SEQ ID NO: 355342 - DNA, 20 bp, Artificial
  CRISPR gRNA sequence
aaagtcaaacttatagaagc

SEQ ID NO: 355343 - DNA, 20 bp, Artificial
  CRISPR gRNA sequence
aagtcaaacttatagaagca

SEQ ID NO: 355344 - DNA, 20 bp, Artificial
  CRISPR gRNA sequence
aaacttatagaagcagggaa

SEQ ID NO: 355345 - DNA, 20 bp, Artificial
  CRISPR gRNA sequence
tatagaagcagggaatagaa

SEQ ID NO: 355346 - DNA, 20 bp, Artificial
  CRISPR gRNA sequence
agaagcagggaatagaacag

SEQ ID NO: 355347 - DNA, 20 bp, Artificial
  CRISPR gRNA sequence
gggaatagaacagtggttgc

SEQ ID NO: 355348 - DNA, 20 bp, Artificial
  CRISPR gRNA sequence
ggaatagaacagtggttgcc

SEQ ID NO: 355349 - DNA, 20 bp, Artificial
  CRISPR gRNA sequence
aatagaacagtggttgccag

SEQ ID NO: 355350 - DNA, 20 bp, Artificial
  CRISPR gRNA sequence
atagaacagtggttgccagg

SEQ ID NO: 355351 - DNA, 20 bp, Artificial
  CRISPR gRNA sequence
gaacagtggttgccaggagg

SEQ ID NO: 355352 - DNA, 20 bp, Artificial
  CRISPR gRNA sequence
aacagtggttgccaggaggt

SEQ ID NO: 355353 - DNA, 20 bp, Artificial
  CRISPR gRNA sequence
cagtggttgccaggaggtgg

SEQ ID NO: 355354 - DNA, 20 bp, Artificial
  CRISPR gRNA sequence
agtggttgccaggaggtggg

SEQ ID NO: 355355 - DNA, 20 bp, Artificial
  CRISPR gRNA sequence
gtggttgccaggaggtggga

SEQ ID NO: 355356 - DNA, 20 bp, Artificial
  CRISPR gRNA sequence
gttgccaggaggtgggaggg

SEQ ID NO: 355357 - DNA, 20 bp, Artificial
  CRISPR gRNA sequence
gccaggaggtgggagggcag

SEQ ID NO: 355358 - DNA, 20 bp, Artificial
  CRISPR gRNA sequence
ggaggtgggagggcagaaga

SEQ ID NO: 355359 - DNA, 20 bp, Artificial
  CRISPR gRNA sequence
gaggtgggagggcagaagat

SEQ ID NO: 355360 - DNA, 20 bp, Artificial
  CRISPR gRNA sequence
aggtgggagggcagaagata

SEQ ID NO: 355361 - DNA, 20 bp, Artificial
  CRISPR gRNA sequence
gtgggagggcagaagatagg

SEQ ID NO: 355362 - DNA, 20 bp, Artificial
  CRISPR gRNA sequence
ggcagaagatagggagacgc

SEQ ID NO: 355363 - DNA, 20 bp, Artificial
  CRISPR gRNA sequence
agatagggagacgctggcta

SEQ ID NO: 355364 - DNA, 20 bp, Artificial
  CRISPR gRNA sequence
gatagggagacgctggctaa

SEQ ID NO: 355365 - DNA, 20 bp, Artificial
  CRISPR gRNA sequence
atagggagacgctggctaaa

SEQ ID NO: 355366 - DNA, 20 bp, Artificial
  CRISPR gRNA sequence
ggctaaagggtaccaacttt

SEQ ID NO: 355367 - DNA, 20 bp, Artificial
  CRISPR gRNA sequence
gtaccaacttttggttataa

SEQ ID NO: 355368 - DNA, 20 bp, Artificial
  CRISPR gRNA sequence
taccaacttttggttataat

SEQ ID NO: 355369 - DNA, 20 bp, Artificial
  CRISPR gRNA sequence
accaacttttggttataatg

SEQ ID NO: 355370 - DNA, 20 bp, Artificial
  CRISPR gRNA sequence
tataatggggacctactata

SEQ ID NO: 355371 - DNA, 20 bp, Artificial
  CRISPR gRNA sequence
tggggacctactatacagta

SEQ ID NO: 355372 - DNA, 20 bp, Artificial
  CRISPR gRNA sequence
gacctactatacagtatgga

SEQ ID NO: 355373 - DNA, 20 bp, Artificial
  CRISPR gRNA sequence
cagtatggatggtgatacat

SEQ ID NO: 355374 - DNA, 20 bp, Artificial
  CRISPR gRNA sequence
atacatgagttaattaattg

SEQ ID NO: 355375 - DNA, 20 bp, Artificial
  CRISPR gRNA sequence
tatattcaatctttatttga

SEQ ID NO: 355376 - DNA, 20 bp, Artificial
  CRISPR gRNA sequence
attatttaaaaaaaaattta

SEQ ID NO: 355377 - DNA, 20 bp, Artificial
  CRISPR gRNA sequence
tttaaagcaattgttttctt

SEQ ID NO: 355378 - DNA, 20 bp, Artificial
  CRISPR gRNA sequence
ttaaagcaattgttttcttt

SEQ ID NO: 355379 - DNA, 20 bp, Artificial
  CRISPR gRNA sequence
tttatattttccaaattttc

SEQ ID NO: 355380 - DNA, 20 bp, Artificial
  CRISPR gRNA sequence
cgatgtgttcattttgtgat

SEQ ID NO: 355381 - DNA, 20 bp, Artificial
  CRISPR gRNA sequence
gatgtgttcattttgtgatc

SEQ ID NO: 355382 - DNA, 20 bp, Artificial
  CRISPR gRNA sequence
attttgtgatcaggcaaata

SEQ ID NO: 355383 - DNA, 20 bp, Artificial
  CRISPR gRNA sequence
aatacagtaccaaaaaaata

SEQ ID NO: 355384 - DNA, 20 bp, Artificial
  CRISPR gRNA sequence
accaaaaaaataaagatctg

SEQ ID NO: 355385 - DNA, 20 bp, Artificial
  CRISPR gRNA sequence
ccaaaaaaataaagatctgc

SEQ ID NO: 355386 - DNA, 20 bp, Artificial
  CRISPR gRNA sequence
aaagatctgcaggcttaaaa

SEQ ID NO: 355387 - DNA, 20 bp, Artificial
  CRISPR gRNA sequence
aagaatattttatcaaatct

SEQ ID NO: 355388 - DNA, 20 bp, Artificial
  CRISPR gRNA sequence
aatattttatcaaatcttag

SEQ ID NO: 355389 - DNA, 20 bp, Artificial
  CRISPR gRNA sequence
ttatcaaatcttagtggtta

SEQ ID NO: 355390 - DNA, 20 bp, Artificial
  CRISPR gRNA sequence
aaatcttagtggttaaagta

SEQ ID NO: 355391 - DNA, 20 bp, Artificial
  CRISPR gRNA sequence
aatcttagtggttaaagtac

SEQ ID NO: 355392 - DNA, 20 bp, Artificial
  CRISPR gRNA sequence
agtggttaaagtacaggatg

SEQ ID NO: 355393 - DNA, 20 bp, Artificial
  CRISPR gRNA sequence
ggatgtagaaatcttttctt

SEQ ID NO: 355394 - DNA, 20 bp, Artificial
  CRISPR gRNA sequence
agaaatcttttctttagaaa

SEQ ID NO: 355395 - DNA, 20 bp, Artificial
  CRISPR gRNA sequence
aaatagaatacttaacaatt

SEQ ID NO: 355396 - DNA, 20 bp, Artificial
  CRISPR gRNA sequence
agaatacttaacaattaaga

SEQ ID NO: 355397 - DNA, 20 bp, Artificial
  CRISPR gRNA sequence
ttaagatggctttctttatg

SEQ ID NO: 355398 - DNA, 20 bp, Artificial
  CRISPR gRNA sequence
taagatggctttctttatga

SEQ ID NO: 355399 - DNA, 20 bp, Artificial
  CRISPR gRNA sequence
tctaatttatatgaatttaa

SEQ ID NO: 355400 - DNA, 20 bp, Artificial
  CRISPR gRNA sequence
taacagtataacctgcttga

SEQ ID NO: 355401 - DNA, 20 bp, Artificial
  CRISPR gRNA sequence
tcaattataaatccaaattt

SEQ ID NO: 355402 - DNA, 20 bp, Artificial
  CRISPR gRNA sequence
atttcagatgcattgtttca

SEQ ID NO: 355403 - DNA, 20 bp, Artificial
  CRISPR gRNA sequence
tttcagatgcattgtttcat

SEQ ID NO: 355404 - DNA, 20 bp, Artificial
  CRISPR gRNA sequence
acctatttgtaacccgtttt

SEQ ID NO: 355405 - DNA, 20 bp, Artificial
  CRISPR gRNA sequence
aacccgtttttagtaatgtt

SEQ ID NO: 355406 - DNA, 20 bp, Artificial
  CRISPR gRNA sequence
tttagtaatgtttggcctct

SEQ ID NO: 355407 - DNA, 20 bp, Artificial
  CRISPR gRNA sequence
taatgtttggcctcttggat

SEQ ID NO: 355408 - DNA, 20 bp, Artificial
  CRISPR gRNA sequence
atcagatccatttattcact

SEQ ID NO: 355409 - DNA, 20 bp, Artificial
  CRISPR gRNA sequence
tcactcagtctttaaacaca

SEQ ID NO: 355410 - DNA, 20 bp, Artificial
  CRISPR gRNA sequence
ctttaaacacaaagtatttc

SEQ ID NO: 355411 - DNA, 20 bp, Artificial
  CRISPR gRNA sequence
tttaaacacaaagtatttca

SEQ ID NO: 355412 - DNA, 20 bp, Artificial
  CRISPR gRNA sequence
ttcaaggtgtactgtatgcc

SEQ ID NO: 355413 - DNA, 20 bp, Artificial
  CRISPR gRNA sequence
gtactgtatgcctggtacta

SEQ ID NO: 355414 - DNA, 20 bp, Artificial
  CRISPR gRNA sequence
tatgcctggtactacagaca

SEQ ID NO: 355415 - DNA, 20 bp, Artificial
  CRISPR gRNA sequence
gcctggtactacagacaaag

SEQ ID NO: 355416 - DNA, 20 bp, Artificial
  CRISPR gRNA sequence
tggtactacagacaaagtgg

SEQ ID NO: 355417 - DNA, 20 bp, Artificial
  CRISPR gRNA sequence
ggtactacagacaaagtggt

SEQ ID NO: 355418 - DNA, 20 bp, Artificial
  CRISPR gRNA sequence
acaaagtggtaggtaaaaac

SEQ ID NO: 355419 - DNA, 20 bp, Artificial
  CRISPR gRNA sequence
aaacaagtttgacacctgtg

SEQ ID NO: 355420 - DNA, 20 bp, Artificial
  CRISPR gRNA sequence
tctctgctctcacactacca

SEQ ID NO: 355421 - DNA, 20 bp, Artificial
  CRISPR gRNA sequence
actaccacagcaatcgtcaa

SEQ ID NO: 355422 - DNA, 20 bp, Artificial
  CRISPR gRNA sequence
tcaacagacttctgtgacca

SEQ ID NO: 355423 - DNA, 20 bp, Artificial
  CRISPR gRNA sequence
caacagacttctgtgaccaa

SEQ ID NO: 355424 - DNA, 20 bp, Artificial
  CRISPR gRNA sequence
gacttctgtgaccaaaggtg

SEQ ID NO: 355425 - DNA, 20 bp, Artificial
  CRISPR gRNA sequence
acttctgtgaccaaaggtgt

SEQ ID NO: 355426 - DNA, 20 bp, Artificial
  CRISPR gRNA sequence
tctgtgaccaaaggtgtggg

SEQ ID NO: 355427 - DNA, 20 bp, Artificial
  CRISPR gRNA sequence
gtgtgggtggttttccccca

SEQ ID NO: 355428 - DNA, 20 bp, Artificial
  CRISPR gRNA sequence
gtggttttcccccacagtaa

SEQ ID NO: 355429 - DNA, 20 bp, Artificial
  CRISPR gRNA sequence
tggttttcccccacagtaac

SEQ ID NO: 355430 - DNA, 20 bp, Artificial
  CRISPR gRNA sequence
tcccccacagtaacaggcac

SEQ ID NO: 355431 - DNA, 20 bp, Artificial
  CRISPR gRNA sequence
cacagtaacaggcaccagct

SEQ ID NO: 355432 - DNA, 20 bp, Artificial
  CRISPR gRNA sequence
aattctgacatgatctaccc

SEQ ID NO: 355433 - DNA, 20 bp, Artificial
  CRISPR gRNA sequence
attctgacatgatctaccca

SEQ ID NO: 355434 - DNA, 20 bp, Artificial
  CRISPR gRNA sequence
tgacatgatctacccaagga

SEQ ID NO: 355435 - DNA, 20 bp, Artificial
  CRISPR gRNA sequence
gatctacccaaggacagtat

SEQ ID NO: 355436 - DNA, 20 bp, Artificial
  CRISPR gRNA sequence
aaggacagtatcagatccca

SEQ ID NO: 355437 - DNA, 20 bp, Artificial
  CRISPR gRNA sequence
aggacagtatcagatcccac

SEQ ID NO: 355438 - DNA, 20 bp, Artificial
  CRISPR gRNA sequence
cagtatcagatcccacaggc

SEQ ID NO: 355439 - DNA, 20 bp, Artificial
  CRISPR gRNA sequence
agtatcagatcccacaggct

SEQ ID NO: 355440 - DNA, 20 bp, Artificial
  CRISPR gRNA sequence
gtatcagatcccacaggctg

SEQ ID NO: 355441 - DNA, 20 bp, Artificial
  CRISPR gRNA sequence
tatcagatcccacaggctgg

SEQ ID NO: 355442 - DNA, 20 bp, Artificial
  CRISPR gRNA sequence
gatcccacaggctgggggct

SEQ ID NO: 355443 - DNA, 20 bp, Artificial
  CRISPR gRNA sequence
aggctgggggctcagtccca

SEQ ID NO: 355444 - DNA, 20 bp, Artificial
  CRISPR gRNA sequence
ccattgctaaccctgccctt

SEQ ID NO: 355445 - DNA, 20 bp, Artificial
  CRISPR gRNA sequence
gcccttcagacaccaattgc

SEQ ID NO: 355446 - DNA, 20 bp, Artificial
  CRISPR gRNA sequence
tcagacaccaattgcaagtc

SEQ ID NO: 355447 - DNA, 20 bp, Artificial
  CRISPR gRNA sequence
cagacaccaattgcaagtcc

SEQ ID NO: 355448 - DNA, 20 bp, Artificial
  CRISPR gRNA sequence
caattgcaagtccaggcctc

SEQ ID NO: 355449 - DNA, 20 bp, Artificial
  CRISPR gRNA sequence
tttttttttttttttttttt

SEQ ID NO: 355450 - DNA, 20 bp, Artificial
  CRISPR gRNA sequence
ttttttttttttttttgaga

SEQ ID NO: 355451 - DNA, 20 bp, Artificial
  CRISPR gRNA sequence
ttttttttttttttgagacg

SEQ ID NO: 355452 - DNA, 20 bp, Artificial
  CRISPR gRNA sequence
cggagtctcgctctgtcacc

SEQ ID NO: 355453 - DNA, 20 bp, Artificial
  CRISPR gRNA sequence
ggagtctcgctctgtcaccc

SEQ ID NO: 355454 - DNA, 20 bp, Artificial
  CRISPR gRNA sequence
tctcgctctgtcacccaggc

SEQ ID NO: 355455 - DNA, 20 bp, Artificial
  CRISPR gRNA sequence
tcgctctgtcacccaggctg

SEQ ID NO: 355456 - DNA, 20 bp, Artificial
  CRISPR gRNA sequence
tcacccaggctggagtacaa

SEQ ID NO: 355457 - DNA, 20 bp, Artificial
  CRISPR gRNA sequence
cccaggctggagtacaatgg

SEQ ID NO: 355458 - DNA, 20 bp, Artificial
  CRISPR gRNA sequence
ccaggctggagtacaatggc

SEQ ID NO: 355459 - DNA, 20 bp, Artificial
  CRISPR gRNA sequence
ggagtacaatggcaggatct

SEQ ID NO: 355460 - DNA, 20 bp, Artificial
  CRISPR gRNA sequence
tcgctgcaatctccgcctcc

SEQ ID NO: 355461 - DNA, 20 bp, Artificial
  CRISPR gRNA sequence
cgctgcaatctccgcctccc

SEQ ID NO: 355462 - DNA, 20 bp, Artificial
  CRISPR gRNA sequence
aatctccgcctcccaggttc

SEQ ID NO: 355463 - DNA, 20 bp, Artificial
  CRISPR gRNA sequence
ttcaagtgattctcctgcct

SEQ ID NO: 355464 - DNA, 20 bp, Artificial
  CRISPR gRNA sequence
ttctcctgcctcagcctcct

SEQ ID NO: 355465 - DNA, 20 bp, Artificial
  CRISPR gRNA sequence
tcctgcctcagcctcctgag

SEQ ID NO: 355466 - DNA, 20 bp, Artificial
  CRISPR gRNA sequence
gcctcagcctcctgagtagc

SEQ ID NO: 355467 - DNA, 20 bp, Artificial
  CRISPR gRNA sequence
cctcagcctcctgagtagct

SEQ ID NO: 355468 - DNA, 20 bp, Artificial
  CRISPR gRNA sequence
ctcctgagtagctgggatta

SEQ ID NO: 355469 - DNA, 20 bp, Artificial
  CRISPR gRNA sequence
tcctgagtagctgggattac

SEQ ID NO: 355470 - DNA, 20 bp, Artificial
  CRISPR gRNA sequence
caggcacccgccactacgtc

SEQ ID NO: 355471 - DNA, 20 bp, Artificial
  CRISPR gRNA sequence
ccagctaatttttgtatttt

SEQ ID NO: 355472 - DNA, 20 bp, Artificial
  CRISPR gRNA sequence
gctaatttttgtatttttag

SEQ ID NO: 355473 - DNA, 20 bp, Artificial
  CRISPR gRNA sequence
taatttttgtatttttagta

SEQ ID NO: 355474 - DNA, 20 bp, Artificial
  CRISPR gRNA sequence
ttttgtatttttagtagaga

SEQ ID NO: 355475 - DNA, 20 bp, Artificial
  CRISPR gRNA sequence
tttgtatttttagtagagac

SEQ ID NO: 355476 - DNA, 20 bp, Artificial
  CRISPR gRNA sequence
ttgtatttttagtagagacg

SEQ ID NO: 355477 - DNA, 20 bp, Artificial
  CRISPR gRNA sequence
gagacggggtttcaccatgt

SEQ ID NO: 355478 - DNA, 20 bp, Artificial
  CRISPR gRNA sequence
cggggtttcaccatgttagt

SEQ ID NO: 355479 - DNA, 20 bp, Artificial
  CRISPR gRNA sequence
ggggtttcaccatgttagtc

SEQ ID NO: 355480 - DNA, 20 bp, Artificial
  CRISPR gRNA sequence
tttcaccatgttagtcaggc

SEQ ID NO: 355481 - DNA, 20 bp, Artificial
  CRISPR gRNA sequence
tggtctcgaactcctcacct

SEQ ID NO: 355482 - DNA, 20 bp, Artificial
  CRISPR gRNA sequence
ggtctcgaactcctcaccta

SEQ ID NO: 355483 - DNA, 20 bp, Artificial
  CRISPR gRNA sequence
ctaaggtgatccgccctcct

SEQ ID NO: 355484 - DNA, 20 bp, Artificial
  CRISPR gRNA sequence
ccgccctcctcggcctccca

SEQ ID NO: 355485 - DNA, 20 bp, Artificial
  CRISPR gRNA sequence
tcctcggcctcccaaagtgc

SEQ ID NO: 355486 - DNA, 20 bp, Artificial
  CRISPR gRNA sequence
cctcggcctcccaaagtgct

SEQ ID NO: 355487 - DNA, 20 bp, Artificial
  CRISPR gRNA sequence
ctcccaaagtgctgggattg

SEQ ID NO: 355488 - DNA, 20 bp, Artificial
  CRISPR gRNA sequence
tcccaaagtgctgggattgc

SEQ ID NO: 355489 - DNA, 20 bp, Artificial
  CRISPR gRNA sequence
agtgctgggattgcaggcgt

SEQ ID NO: 355490 - DNA, 20 bp, Artificial
  CRISPR gRNA sequence
caggcgtgagccaccgtgcc

SEQ ID NO: 355491 - DNA, 20 bp, Artificial
  CRISPR gRNA sequence
tgagccaccgtgcccagtcc

SEQ ID NO: 355492 - DNA, 20 bp, Artificial
  CRISPR gRNA sequence
gagccaccgtgcccagtccc

SEQ ID NO: 355493 - DNA, 20 bp, Artificial
  CRISPR gRNA sequence
cgtgcccagtcccaggcctc

SEQ ID NO: 355494 - DNA, 20 bp, Artificial
  CRISPR gRNA sequence
gtcccaggcctctagaactt

SEQ ID NO: 355495 - DNA, 20 bp, Artificial
  CRISPR gRNA sequence
cctctagaacttcggaccaa

SEQ ID NO: 355496 - DNA, 20 bp, Artificial
  CRISPR gRNA sequence
ctctagaacttcggaccaat

SEQ ID NO: 355497 - DNA, 20 bp, Artificial
  CRISPR gRNA sequence
acttcggaccaatgggcctc

SEQ ID NO: 355498 - DNA, 20 bp, Artificial
  CRISPR gRNA sequence
cggaccaatgggcctcaagc

SEQ ID NO: 355499 - DNA, 20 bp, Artificial
  CRISPR gRNA sequence
ggaccaatgggcctcaagct

SEQ ID NO: 355500 - DNA, 20 bp, Artificial
  CRISPR gRNA sequence
gaccaatgggcctcaagctg

SEQ ID NO: 355501 - DNA, 20 bp, Artificial
  CRISPR gRNA sequence
ggcctcaagctggggttccc

SEQ ID NO: 355502 - DNA, 20 bp, Artificial
  CRISPR gRNA sequence
ggttcccaagaccccttttt

SEQ ID NO: 355503 - DNA, 20 bp, Artificial
  CRISPR gRNA sequence
gttcccaagacccctttttc

SEQ ID NO: 355504 - DNA, 20 bp, Artificial
  CRISPR gRNA sequence
caagacccctttttcaggtt

SEQ ID NO: 355505 - DNA, 20 bp, Artificial
  CRISPR gRNA sequence
tttttcaggtttggttaatc

SEQ ID NO: 355506 - DNA, 20 bp, Artificial
  CRISPR gRNA sequence
ttcaggtttggttaatctgg

SEQ ID NO: 355507 - DNA, 20 bp, Artificial
  CRISPR gRNA sequence
caggtttggttaatctggtg

SEQ ID NO: 355508 - DNA, 20 bp, Artificial
  CRISPR gRNA sequence
tttggttaatctggtggagc

SEQ ID NO: 355509 - DNA, 20 bp, Artificial
  CRISPR gRNA sequence
taatctggtggagccagtta

SEQ ID NO: 355510 - DNA, 20 bp, Artificial
  CRISPR gRNA sequence
atctggtggagccagttata

SEQ ID NO: 355511 - DNA, 20 bp, Artificial
  CRISPR gRNA sequence
tggagccagttatagagctc

SEQ ID NO: 355512 - DNA, 20 bp, Artificial
  CRISPR gRNA sequence
gctcaagaaaacacatttgt

SEQ ID NO: 355513 - DNA, 20 bp, Artificial
  CRISPR gRNA sequence
acatttgtcagtttaatatc

SEQ ID NO: 355514 - DNA, 20 bp, Artificial
  CRISPR gRNA sequence
catttgtcagtttaatatca

SEQ ID NO: 355515 - DNA, 20 bp, Artificial
  CRISPR gRNA sequence
tttaatatcaaggatattgc

SEQ ID NO: 355516 - DNA, 20 bp, Artificial
  CRISPR gRNA sequence
ttaatatcaaggatattgca

SEQ ID NO: 355517 - DNA, 20 bp, Artificial
  CRISPR gRNA sequence
taatatcaaggatattgcaa

SEQ ID NO: 355518 - DNA, 20 bp, Artificial
  CRISPR gRNA sequence
caaggatattgcaagggata

SEQ ID NO: 355519 - DNA, 20 bp, Artificial
  CRISPR gRNA sequence
tattgcaagggatacagatg

SEQ ID NO: 355520 - DNA, 20 bp, Artificial
  CRISPR gRNA sequence
ttgcaagggatacagatgaa

SEQ ID NO: 355521 - DNA, 20 bp, Artificial
  CRISPR gRNA sequence
agggatacagatgaagagat

SEQ ID NO: 355522 - DNA, 20 bp, Artificial
  CRISPR gRNA sequence
gatacagatgaagagattgg

SEQ ID NO: 355523 - DNA, 20 bp, Artificial
  CRISPR gRNA sequence
atacagatgaagagattggt

SEQ ID NO: 355524 - DNA, 20 bp, Artificial
  CRISPR gRNA sequence
tacagatgaagagattggta

SEQ ID NO: 355525 - DNA, 20 bp, Artificial
  CRISPR gRNA sequence
gatgaagagattggtagggt

SEQ ID NO: 355526 - DNA, 20 bp, Artificial
  CRISPR gRNA sequence
atgaagagattggtagggtg

SEQ ID NO: 355527 - DNA, 20 bp, Artificial
  CRISPR gRNA sequence
ggtagggtgaggcatgtgta

SEQ ID NO: 355528 - DNA, 20 bp, Artificial
  CRISPR gRNA sequence
gtagggtgaggcatgtgtaa

SEQ ID NO: 355529 - DNA, 20 bp, Artificial
  CRISPR gRNA sequence
tagggtgaggcatgtgtaaa

SEQ ID NO: 355530 - DNA, 20 bp, Artificial
  CRISPR gRNA sequence
agggtgaggcatgtgtaaag

SEQ ID NO: 355531 - DNA, 20 bp, Artificial
  CRISPR gRNA sequence
gaggcatgtgtaaaggggca

SEQ ID NO: 355532 - DNA, 20 bp, Artificial
  CRISPR gRNA sequence
ggcatgtgtaaaggggcaca

SEQ ID NO: 355533 - DNA, 20 bp, Artificial
  CRISPR gRNA sequence
tccctgtccacatcaccctc

SEQ ID NO: 355534 - DNA, 20 bp, Artificial
  CRISPR gRNA sequence
ccctgtccacatcaccctcc

SEQ ID NO: 355535 - DNA, 20 bp, Artificial
  CRISPR gRNA sequence
ctgtccacatcaccctccag

SEQ ID NO: 355536 - DNA, 20 bp, Artificial
  CRISPR gRNA sequence
tgtccacatcaccctccagg

SEQ ID NO: 355537 - DNA, 20 bp, Artificial
  CRISPR gRNA sequence
tccaggaggctccacatgtt

SEQ ID NO: 355538 - DNA, 20 bp, Artificial
  CRISPR gRNA sequence
gctccacatgttcagctgtc

SEQ ID NO: 355539 - DNA, 20 bp, Artificial
  CRISPR gRNA sequence
ctctccaaaccccatcctct

SEQ ID NO: 355540 - DNA, 20 bp, Artificial
  CRISPR gRNA sequence
cccatcctcttggattttta

SEQ ID NO: 355541 - DNA, 20 bp, Artificial
  CRISPR gRNA sequence
catcctcttggatttttatg

SEQ ID NO: 355542 - DNA, 20 bp, Artificial
  CRISPR gRNA sequence
atcctcttggatttttatgg

SEQ ID NO: 355543 - DNA, 20 bp, Artificial
  CRISPR gRNA sequence
tttatggaggcttcattacg

SEQ ID NO: 355544 - DNA, 20 bp, Artificial
  CRISPR gRNA sequence
ttatggaggcttcattacgt

SEQ ID NO: 355545 - DNA, 20 bp, Artificial
  CRISPR gRNA sequence
aggtatgactgacaaccttg

SEQ ID NO: 355546 - DNA, 20 bp, Artificial
  CRISPR gRNA sequence
gactgacaaccttgtagaaa

SEQ ID NO: 355547 - DNA, 20 bp, Artificial
  CRISPR gRNA sequence
actgacaaccttgtagaaat

SEQ ID NO: 355548 - DNA, 20 bp, Artificial
  CRISPR gRNA sequence
caaccttgtagaaatgggac

SEQ ID NO: 355549 - DNA, 20 bp, Artificial
  CRISPR gRNA sequence
aaccttgtagaaatgggact

SEQ ID NO: 355550 - DNA, 20 bp, Artificial
  CRISPR gRNA sequence
tagaaatgggactgggcaaa

SEQ ID NO: 355551 - DNA, 20 bp, Artificial
  CRISPR gRNA sequence
aaaagcatatcatctaaacc

SEQ ID NO: 355552 - DNA, 20 bp, Artificial
  CRISPR gRNA sequence
gcatatcatctaaacccagc

SEQ ID NO: 355553 - DNA, 20 bp, Artificial
  CRISPR gRNA sequence
taaacccagcaagtcctgtc

SEQ ID NO: 355554 - DNA, 20 bp, Artificial
  CRISPR gRNA sequence
agcaagtcctgtccagactt

SEQ ID NO: 355555 - DNA, 20 bp, Artificial
  CRISPR gRNA sequence
tcctgtccagactttagata

SEQ ID NO: 355556 - DNA, 20 bp, Artificial
  CRISPR gRNA sequence
cctgtccagactttagatat

SEQ ID NO: 355557 - DNA, 20 bp, Artificial
  CRISPR gRNA sequence
ctgtccagactttagatatg

SEQ ID NO: 355558 - DNA, 20 bp, Artificial
  CRISPR gRNA sequence
tccagactttagatatgggg

SEQ ID NO: 355559 - DNA, 20 bp, Artificial
  CRISPR gRNA sequence
ccagactttagatatggggt

SEQ ID NO: 355560 - DNA, 20 bp, Artificial
  CRISPR gRNA sequence
atatggggtgggatcctctc

SEQ ID NO: 355561 - DNA, 20 bp, Artificial
  CRISPR gRNA sequence
ggtgggatcctctctggaat

SEQ ID NO: 355562 - DNA, 20 bp, Artificial
  CRISPR gRNA sequence
gtgggatcctctctggaatg

SEQ ID NO: 355563 - DNA, 20 bp, Artificial
  CRISPR gRNA sequence
tgggatcctctctggaatga

SEQ ID NO: 355564 - DNA, 20 bp, Artificial
  CRISPR gRNA sequence
agggtcttttgacccacatt

SEQ ID NO: 355565 - DNA, 20 bp, Artificial
  CRISPR gRNA sequence
cttttgacccacattcagat

SEQ ID NO: 355566 - DNA, 20 bp, Artificial
  CRISPR gRNA sequence
tttgacccacattcagatta

SEQ ID NO: 355567 - DNA, 20 bp, Artificial
  CRISPR gRNA sequence
ttcagattagagtcttacct

SEQ ID NO: 355568 - DNA, 20 bp, Artificial
  CRISPR gRNA sequence
gattagagtcttaccttggt

SEQ ID NO: 355569 - DNA, 20 bp, Artificial
  CRISPR gRNA sequence
attagagtcttaccttggtc

SEQ ID NO: 355570 - DNA, 20 bp, Artificial
  CRISPR gRNA sequence
tagagtcttaccttggtcag

SEQ ID NO: 355571 - DNA, 20 bp, Artificial
  CRISPR gRNA sequence
gtcttaccttggtcaggaga

SEQ ID NO: 355572 - DNA, 20 bp, Artificial
  CRISPR gRNA sequence
tcttaccttggtcaggagaa

SEQ ID NO: 355573 - DNA, 20 bp, Artificial
  CRISPR gRNA sequence
accttggtcaggagaaagga

SEQ ID NO: 355574 - DNA, 20 bp, Artificial
  CRISPR gRNA sequence
ccttggtcaggagaaaggac

SEQ ID NO: 355575 - DNA, 20 bp, Artificial
  CRISPR gRNA sequence
ttggtcaggagaaaggacag

SEQ ID NO: 355576 - DNA, 20 bp, Artificial
  CRISPR gRNA sequence
gtcaggagaaaggacaggag

SEQ ID NO: 355577 - DNA, 20 bp, Artificial
  CRISPR gRNA sequence
tcaggagaaaggacaggaga

SEQ ID NO: 355578 - DNA, 20 bp, Artificial
  CRISPR gRNA sequence
gagaaaggacaggagaaggt

SEQ ID NO: 355579 - DNA, 20 bp, Artificial
  CRISPR gRNA sequence
gaaaggacaggagaaggtca

SEQ ID NO: 355580 - DNA, 20 bp, Artificial
  CRISPR gRNA sequence
aaggacaggagaaggtcaga

SEQ ID NO: 355581 - DNA, 20 bp, Artificial
  CRISPR gRNA sequence
agagagaacttctgtttcct

SEQ ID NO: 355582 - DNA, 20 bp, Artificial
  CRISPR gRNA sequence
gagagaacttctgtttcctg

SEQ ID NO: 355583 - DNA, 20 bp, Artificial
  CRISPR gRNA sequence
cttctgtttcctgaggcctg

SEQ ID NO: 355584 - DNA, 20 bp, Artificial
  CRISPR gRNA sequence
aagtgccccaacattataac

SEQ ID NO: 355585 - DNA, 20 bp, Artificial
  CRISPR gRNA sequence
agtgccccaacattataaca

SEQ ID NO: 355586 - DNA, 20 bp, Artificial
  CRISPR gRNA sequence
acaaggaccatgtgaatttt

SEQ ID NO: 355587 - DNA, 20 bp, Artificial
  CRISPR gRNA sequence
ggaccatgtgaattttgagc

SEQ ID NO: 355588 - DNA, 20 bp, Artificial
  CRISPR gRNA sequence
gaccatgtgaattttgagcc

SEQ ID NO: 355589 - DNA, 20 bp, Artificial
  CRISPR gRNA sequence
gaattttgagccaggacccg

SEQ ID NO: 355590 - DNA, 20 bp, Artificial
  CRISPR gRNA sequence
gacccgtggatgaaaaccta

SEQ ID NO: 355591 - DNA, 20 bp, Artificial
  CRISPR gRNA sequence
taataccacaatacctgatt

SEQ ID NO: 355592 - DNA, 20 bp, Artificial
  CRISPR gRNA sequence
taccacaatacctgatttag

SEQ ID NO: 355593 - DNA, 20 bp, Artificial
  CRISPR gRNA sequence
ggaacatatattgttttgaa

SEQ ID NO: 355594 - DNA, 20 bp, Artificial
  CRISPR gRNA sequence
tatattgttttgaaaagtcc

SEQ ID NO: 355595 - DNA, 20 bp, Artificial
  CRISPR gRNA sequence
agtcctagacaatttaaaaa

SEQ ID NO: 355596 - DNA, 20 bp, Artificial
  CRISPR gRNA sequence
ctagacaatttaaaaatagt

SEQ ID NO: 355597 - DNA, 20 bp, Artificial
  CRISPR gRNA sequence
tagacaatttaaaaatagtt

SEQ ID NO: 355598 - DNA, 20 bp, Artificial
  CRISPR gRNA sequence
agacaatttaaaaatagtta

SEQ ID NO: 355599 - DNA, 20 bp, Artificial
  CRISPR gRNA sequence
tttaaaaatagttagggaaa

SEQ ID NO: 355600 - DNA, 20 bp, Artificial
  CRISPR gRNA sequence
ttaaaaatagttagggaaaa

SEQ ID NO: 355601 - DNA, 20 bp, Artificial
  CRISPR gRNA sequence
gggaaaaaggattttttctt

SEQ ID NO: 355602 - DNA, 20 bp, Artificial
  CRISPR gRNA sequence
ggattttttcttaagaaata

SEQ ID NO: 355603 - DNA, 20 bp, Artificial
  CRISPR gRNA sequence
gattttttcttaagaaataa

SEQ ID NO: 355604 - DNA, 20 bp, Artificial
  CRISPR gRNA sequence
taagaaataaaggtgaaata

SEQ ID NO: 355605 - DNA, 20 bp, Artificial
  CRISPR gRNA sequence
aataaaggtgaaataaagca

SEQ ID NO: 355606 - DNA, 20 bp, Artificial
  CRISPR gRNA sequence
taaaggtgaaataaagcatg

SEQ ID NO: 355607 - DNA, 20 bp, Artificial
  CRISPR gRNA sequence
ggtgaaataaagcatggagt

SEQ ID NO: 355608 - DNA, 20 bp, Artificial
  CRISPR gRNA sequence
gtgaaataaagcatggagtc

SEQ ID NO: 355609 - DNA, 20 bp, Artificial
  CRISPR gRNA sequence
aaataaagcatggagtcagg

SEQ ID NO: 355610 - DNA, 20 bp, Artificial
  CRISPR gRNA sequence
ataaagcatggagtcaggta

SEQ ID NO: 355611 - DNA, 20 bp, Artificial
  CRISPR gRNA sequence
agtcaggtagagattcaatc

SEQ ID NO: 355612 - DNA, 20 bp, Artificial
  CRISPR gRNA sequence
tcaggtagagattcaatcca

SEQ ID NO: 355613 - DNA, 20 bp, Artificial
  CRISPR gRNA sequence
aatccagagacatttcaatc

SEQ ID NO: 355614 - DNA, 20 bp, Artificial
  CRISPR gRNA sequence
tccagagacatttcaatcta

SEQ ID NO: 355615 - DNA, 20 bp, Artificial
  CRISPR gRNA sequence
agagacatttcaatctagag

SEQ ID NO: 355616 - DNA, 20 bp, Artificial
  CRISPR gRNA sequence
catttcaatctagagtggcc

SEQ ID NO: 355617 - DNA, 20 bp, Artificial
  CRISPR gRNA sequence
atctagagtggcccagcctg

SEQ ID NO: 355618 - DNA, 20 bp, Artificial
  CRISPR gRNA sequence
ggcccagcctgtagctgaca

SEQ ID NO: 355619 - DNA, 20 bp, Artificial
  CRISPR gRNA sequence
ctgtagctgacatggcttct

SEQ ID NO: 355620 - DNA, 20 bp, Artificial
  CRISPR gRNA sequence
tccattccctgccttgcctg

SEQ ID NO: 355621 - DNA, 20 bp, Artificial
  CRISPR gRNA sequence
gcttccacatgaatgaccac

SEQ ID NO: 355622 - DNA, 20 bp, Artificial
  CRISPR gRNA sequence
tgaatgaccactggcctata

SEQ ID NO: 355623 - DNA, 20 bp, Artificial
  CRISPR gRNA sequence
gaatgaccactggcctatac

SEQ ID NO: 355624 - DNA, 20 bp, Artificial
  CRISPR gRNA sequence
aatgaccactggcctataca

SEQ ID NO: 355625 - DNA, 20 bp, Artificial
  CRISPR gRNA sequence
atacagggcttgcaccttgc

SEQ ID NO: 355626 - DNA, 20 bp, Artificial
  CRISPR gRNA sequence
tacagggcttgcaccttgct

SEQ ID NO: 355627 - DNA, 20 bp, Artificial
  CRISPR gRNA sequence
gcaccttgctgggccctgta

SEQ ID NO: 355628 - DNA, 20 bp, Artificial
  CRISPR gRNA sequence
cttgctgggccctgtatggc

SEQ ID NO: 355629 - DNA, 20 bp, Artificial
  CRISPR gRNA sequence
ttgctgggccctgtatggct

SEQ ID NO: 355630 - DNA, 20 bp, Artificial
  CRISPR gRNA sequence
tgctgggccctgtatggctg

SEQ ID NO: 355631 - DNA, 20 bp, Artificial
  CRISPR gRNA sequence
gtatggctggggaaaataaa

SEQ ID NO: 355632 - DNA, 20 bp, Artificial
  CRISPR gRNA sequence
tatggctggggaaaataaaa

SEQ ID NO: 355633 - DNA, 20 bp, Artificial
  CRISPR gRNA sequence
ctggggaaaataaaaaggaa

SEQ ID NO: 355634 - DNA, 20 bp, Artificial
  CRISPR gRNA sequence
aaataaaaaggaaaagcaaa

SEQ ID NO: 355635 - DNA, 20 bp, Artificial
  CRISPR gRNA sequence
aataaaaaggaaaagcaaat

SEQ ID NO: 355636 - DNA, 20 bp, Artificial
  CRISPR gRNA sequence
aaaggaaaagcaaatgggta

SEQ ID NO: 355637 - DNA, 20 bp, Artificial
  CRISPR gRNA sequence
gcaaatgggtacggatgctt

SEQ ID NO: 355638 - DNA, 20 bp, Artificial
  CRISPR gRNA sequence
caaatgggtacggatgcttt

SEQ ID NO: 355639 - DNA, 20 bp, Artificial
  CRISPR gRNA sequence
aatgggtacggatgctttgg

SEQ ID NO: 355640 - DNA, 20 bp, Artificial
  CRISPR gRNA sequence
atgctttgggagttaatcaa

SEQ ID NO: 355641 - DNA, 20 bp, Artificial
  CRISPR gRNA sequence
aatcaacagttcataacatt

SEQ ID NO: 355642 - DNA, 20 bp, Artificial
  CRISPR gRNA sequence
ttcataacatttagtttttt

SEQ ID NO: 355643 - DNA, 20 bp, Artificial
  CRISPR gRNA sequence
agttttttaagttttgctaa

SEQ ID NO: 355644 - DNA, 20 bp, Artificial
  CRISPR gRNA sequence
taagttttgctaatagatgt

SEQ ID NO: 355645 - DNA, 20 bp, Artificial
  CRISPR gRNA sequence
ttgctaatagatgtcagatt

SEQ ID NO: 355646 - DNA, 20 bp, Artificial
  CRISPR gRNA sequence
gatgtcagattgagtaatgt

SEQ ID NO: 355647 - DNA, 20 bp, Artificial
  CRISPR gRNA sequence
attgagtaatgtcagccctg

SEQ ID NO: 355648 - DNA, 20 bp, Artificial
  CRISPR gRNA sequence
ctgaagcccttttctttaaa

SEQ ID NO: 355649 - DNA, 20 bp, Artificial
  CRISPR gRNA sequence
tgaagcccttttctttaaaa

SEQ ID NO: 355650 - DNA, 20 bp, Artificial
  CRISPR gRNA sequence
agcccttttctttaaaaagg

SEQ ID NO: 355651 - DNA, 20 bp, Artificial
  CRISPR gRNA sequence
ggaagcccttttctttaaaa

SEQ ID NO: 355652 - DNA, 20 bp, Artificial
  CRISPR gRNA sequence
agcccttttctttaaaaaag

SEQ ID NO: 355653 - DNA, 20 bp, Artificial
  CRISPR gRNA sequence
taaaaaagaagaattgtttc

SEQ ID NO: 355654 - DNA, 20 bp, Artificial
  CRISPR gRNA sequence
aaaagaagaattgtttccag

SEQ ID NO: 355655 - DNA, 20 bp, Artificial
  CRISPR gRNA sequence
cccaatgctgtgttgattca

SEQ ID NO: 355656 - DNA, 20 bp, Artificial
  CRISPR gRNA sequence
ccaatgctgtgttgattcat

SEQ ID NO: 355657 - DNA, 20 bp, Artificial
  CRISPR gRNA sequence
aatgctgtgttgattcatag

SEQ ID NO: 355658 - DNA, 20 bp, Artificial
  CRISPR gRNA sequence
atgctgtgttgattcatagg

SEQ ID NO: 355659 - DNA, 20 bp, Artificial
  CRISPR gRNA sequence
gctgtgttgattcataggag

SEQ ID NO: 355660 - DNA, 20 bp, Artificial
  CRISPR gRNA sequence
gtgttgattcataggaggag

SEQ ID NO: 355661 - DNA, 20 bp, Artificial
  CRISPR gRNA sequence
aaaaccattaccttacatca

SEQ ID NO: 355662 - DNA, 20 bp, Artificial
  CRISPR gRNA sequence
accattaccttacatcacag

SEQ ID NO: 355663 - DNA, 20 bp, Artificial
  CRISPR gRNA sequence
tacatcacagaagataaata

SEQ ID NO: 355664 - DNA, 20 bp, Artificial
  CRISPR gRNA sequence
aatacagttaaaacaattta

SEQ ID NO: 355665 - DNA, 20 bp, Artificial
  CRISPR gRNA sequence
cagttaaaacaatttaaagc

SEQ ID NO: 355666 - DNA, 20 bp, Artificial
  CRISPR gRNA sequence
taaaacaatttaaagcaagt

SEQ ID NO: 355667 - DNA, 20 bp, Artificial
  CRISPR gRNA sequence
caagtcagtgaaatatataa

SEQ ID NO: 355668 - DNA, 20 bp, Artificial
  CRISPR gRNA sequence
tataaaagaataatttactc

SEQ ID NO: 355669 - DNA, 20 bp, Artificial
  CRISPR gRNA sequence
ataaaagaataatttactcc

SEQ ID NO: 355670 - DNA, 20 bp, Artificial
  CRISPR gRNA sequence
actccaggattgtgaccctc

SEQ ID NO: 355671 - DNA, 20 bp, Artificial
  CRISPR gRNA sequence
ctccaggattgtgaccctct

SEQ ID NO: 355672 - DNA, 20 bp, Artificial
  CRISPR gRNA sequence
ggattgtgaccctctaggct

SEQ ID NO: 355673 - DNA, 20 bp, Artificial
  CRISPR gRNA sequence
gaccctctaggctaagtttc

SEQ ID NO: 355674 - DNA, 20 bp, Artificial
  CRISPR gRNA sequence
gctaagtttctggcaatgac

SEQ ID NO: 355675 - DNA, 20 bp, Artificial
  CRISPR gRNA sequence
ctggcaatgacaagtattta

SEQ ID NO: 355676 - DNA, 20 bp, Artificial
  CRISPR gRNA sequence
aatgacaagtatttatggct

SEQ ID NO: 355677 - DNA, 20 bp, Artificial
  CRISPR gRNA sequence
atggctgagttatacactct

SEQ ID NO: 355678 - DNA, 20 bp, Artificial
  CRISPR gRNA sequence
tgagttatacactcttagaa

SEQ ID NO: 355679 - DNA, 20 bp, Artificial
  CRISPR gRNA sequence
gagttatacactcttagaaa

SEQ ID NO: 355680 - DNA, 20 bp, Artificial
  CRISPR gRNA sequence
ctcttagaaaaggctcatga

SEQ ID NO: 355681 - DNA, 20 bp, Artificial
  CRISPR gRNA sequence
gctcatgatagaaatattgc

SEQ ID NO: 355682 - DNA, 20 bp, Artificial
  CRISPR gRNA sequence
ttgccagtcccttcttccct

SEQ ID NO: 355683 - DNA, 20 bp, Artificial
  CRISPR gRNA sequence
gccagtcccttcttccctca

SEQ ID NO: 355684 - DNA, 20 bp, Artificial
  CRISPR gRNA sequence
tcccttcttccctcagagtt

SEQ ID NO: 355685 - DNA, 20 bp, Artificial
  CRISPR gRNA sequence
cttcttccctcagagttcgg

SEQ ID NO: 355686 - DNA, 20 bp, Artificial
  CRISPR gRNA sequence
ttcttccctcagagttcggc

SEQ ID NO: 355687 - DNA, 20 bp, Artificial
  CRISPR gRNA sequence
tccctcagagttcggcaggc

SEQ ID NO: 355688 - DNA, 20 bp, Artificial
  CRISPR gRNA sequence
cctcagagttcggcaggcaa

SEQ ID NO: 355689 - DNA, 20 bp, Artificial
  CRISPR gRNA sequence
cagagttcggcaggcaagag

SEQ ID NO: 355690 - DNA, 20 bp, Artificial
  CRISPR gRNA sequence
agagtggccattaatgtcta

SEQ ID NO: 355691 - DNA, 20 bp, Artificial
  CRISPR gRNA sequence
gtctatagtttatcctctat

SEQ ID NO: 355692 - DNA, 20 bp, Artificial
  CRISPR gRNA sequence
tctatagtttatcctctatt

SEQ ID NO: 355693 - DNA, 20 bp, Artificial
  CRISPR gRNA sequence
ctatagtttatcctctatta

SEQ ID NO: 355694 - DNA, 20 bp, Artificial
  CRISPR gRNA sequence
tagtttatcctctattaggg

SEQ ID NO: 355695 - DNA, 20 bp, Artificial
  CRISPR gRNA sequence
agtttatcctctattagggt

SEQ ID NO: 355696 - DNA, 20 bp, Artificial
  CRISPR gRNA sequence
gtttatcctctattagggtg

SEQ ID NO: 355697 - DNA, 20 bp, Artificial
  CRISPR gRNA sequence
tttatcctctattagggtgg

SEQ ID NO: 355698 - DNA, 20 bp, Artificial
  CRISPR gRNA sequence
atcctctattagggtggggg

SEQ ID NO: 355699 - DNA, 20 bp, Artificial
  CRISPR gRNA sequence
cctctattagggtgggggtg

SEQ ID NO: 355700 - DNA, 20 bp, Artificial
  CRISPR gRNA sequence
tattagggtgggggtggagt

SEQ ID NO: 355701 - DNA, 20 bp, Artificial
  CRISPR gRNA sequence
attagggtgggggtggagtt

SEQ ID NO: 355702 - DNA, 20 bp, Artificial
  CRISPR gRNA sequence
ttagggtgggggtggagtta

SEQ ID NO: 355703 - DNA, 20 bp, Artificial
  CRISPR gRNA sequence
agggtgggggtggagttagg

SEQ ID NO: 355704 - DNA, 20 bp, Artificial
  CRISPR gRNA sequence
gggggtggagttagggagtg

SEQ ID NO: 355705 - DNA, 20 bp, Artificial
  CRISPR gRNA sequence
gtggagttagggagtgaaga

SEQ ID NO: 355706 - DNA, 20 bp, Artificial
  CRISPR gRNA sequence
agttagggagtgaagaaagc

SEQ ID NO: 355707 - DNA, 20 bp, Artificial
  CRISPR gRNA sequence
agtgaagaaagcaagtcact

SEQ ID NO: 355708 - DNA, 20 bp, Artificial
  CRISPR gRNA sequence
tcacttagaacctaaataac

SEQ ID NO: 355709 - DNA, 20 bp, Artificial
  CRISPR gRNA sequence
cacttagaacctaaataact

SEQ ID NO: 355710 - DNA, 20 bp, Artificial
  CRISPR gRNA sequence
gaacctaaataactgggcca

SEQ ID NO: 355711 - DNA, 20 bp, Artificial
  CRISPR gRNA sequence
aactgggccaaagaatatgc

SEQ ID NO: 355712 - DNA, 20 bp, Artificial
  CRISPR gRNA sequence
actgggccaaagaatatgcc

SEQ ID NO: 355713 - DNA, 20 bp, Artificial
  CRISPR gRNA sequence
ctgggccaaagaatatgcca

SEQ ID NO: 355714 - DNA, 20 bp, Artificial
  CRISPR gRNA sequence
aatatgccagggaaaacccg

SEQ ID NO: 355715 - DNA, 20 bp, Artificial
  CRISPR gRNA sequence
atatgccagggaaaacccgc

SEQ ID NO: 355716 - DNA, 20 bp, Artificial
  CRISPR gRNA sequence
ggtcctgactctctaacatc

SEQ ID NO: 355717 - DNA, 20 bp, Artificial
  CRISPR gRNA sequence
gactctctaacatcaagcgt

SEQ ID NO: 355718 - DNA, 20 bp, Artificial
  CRISPR gRNA sequence
actctctaacatcaagcgtt

SEQ ID NO: 355719 - DNA, 20 bp, Artificial
  CRISPR gRNA sequence
tctaacatcaagcgttaggc

SEQ ID NO: 355720 - DNA, 20 bp, Artificial
  CRISPR gRNA sequence
ctgcaaattaaaaccacaat

SEQ ID NO: 355721 - DNA, 20 bp, Artificial
  CRISPR gRNA sequence
gcaaattaaaaccacaatga

SEQ ID NO: 355722 - DNA, 20 bp, Artificial
  CRISPR gRNA sequence
ccacctcacacctttttgaa

SEQ ID NO: 355723 - DNA, 20 bp, Artificial
  CRISPR gRNA sequence
tttgaatggcttttctcaaa

SEQ ID NO: 355724 - DNA, 20 bp, Artificial
  CRISPR gRNA sequence
ggcttttctcaaaaagatga

SEQ ID NO: 355725 - DNA, 20 bp, Artificial
  CRISPR gRNA sequence
aaaagatgaaagaaaacatg

SEQ ID NO: 355726 - DNA, 20 bp, Artificial
  CRISPR gRNA sequence
tgtggttttcgccgccatca

SEQ ID NO: 355727 - DNA, 20 bp, Artificial
  CRISPR gRNA sequence
cgccgccatcatggtgtgtg

SEQ ID NO: 355728 - DNA, 20 bp, Artificial
  CRISPR gRNA sequence
tcctcaccatgtcttctccc

SEQ ID NO: 355729 - DNA, 20 bp, Artificial
  CRISPR gRNA sequence
atgtcttctcccaagacttt

SEQ ID NO: 355730 - DNA, 20 bp, Artificial
  CRISPR gRNA sequence
tgtcttctcccaagactttc

SEQ ID NO: 355731 - DNA, 20 bp, Artificial
  CRISPR gRNA sequence
gtcttctcccaagactttca

SEQ ID NO: 355732 - DNA, 20 bp, Artificial
  CRISPR gRNA sequence
ctcccaagactttcagggtc

SEQ ID NO: 355733 - DNA, 20 bp, Artificial
  CRISPR gRNA sequence
tttcagggtcaagcaattcc

SEQ ID NO: 355734 - DNA, 20 bp, Artificial
  CRISPR gRNA sequence
gggtcaagcaattcctggtc

SEQ ID NO: 355735 - DNA, 20 bp, Artificial
  CRISPR gRNA sequence
aattcctggtcaagaaacaa

SEQ ID NO: 355736 - DNA, 20 bp, Artificial
  CRISPR gRNA sequence
gcaaaatcatcccattttat

SEQ ID NO: 355737 - DNA, 20 bp, Artificial
  CRISPR gRNA sequence
caaaatcatcccattttatc

SEQ ID NO: 355738 - DNA, 20 bp, Artificial
  CRISPR gRNA sequence
aaaatcatcccattttatcg

SEQ ID NO: 355739 - DNA, 20 bp, Artificial
  CRISPR gRNA sequence
aaatcatcccattttatcgg

SEQ ID NO: 355740 - DNA, 20 bp, Artificial
  CRISPR gRNA sequence
ctgcccctgataattcaatg

SEQ ID NO: 355741 - DNA, 20 bp, Artificial
  CRISPR gRNA sequence
tgcccctgataattcaatgt

SEQ ID NO: 355742 - DNA, 20 bp, Artificial
  CRISPR gRNA sequence
ggttcttttctattttccct

SEQ ID NO: 355743 - DNA, 20 bp, Artificial
  CRISPR gRNA sequence
tttctattttccctaagtgt

SEQ ID NO: 355744 - DNA, 20 bp, Artificial
  CRISPR gRNA sequence
tattttccctaagtgttggc

SEQ ID NO: 355745 - DNA, 20 bp, Artificial
  CRISPR gRNA sequence
ccctaagtgttggccagtct

SEQ ID NO: 355746 - DNA, 20 bp, Artificial
  CRISPR gRNA sequence
gttggccagtctgagaaata

SEQ ID NO: 355747 - DNA, 20 bp, Artificial
  CRISPR gRNA sequence
ttggccagtctgagaaataa

SEQ ID NO: 355748 - DNA, 20 bp, Artificial
  CRISPR gRNA sequence
tggccagtctgagaaataaa

SEQ ID NO: 355749 - DNA, 20 bp, Artificial
  CRISPR gRNA sequence
cagtctgagaaataaaggga

SEQ ID NO: 355750 - DNA, 20 bp, Artificial
  CRISPR gRNA sequence
gtctgagaaataaagggaaa

SEQ ID NO: 355751 - DNA, 20 bp, Artificial
  CRISPR gRNA sequence
aataaagggaaagagtacaa

SEQ ID NO: 355752 - DNA, 20 bp, Artificial
  CRISPR gRNA sequence
aagggaaagagtacaaaaga

SEQ ID NO: 355753 - DNA, 20 bp, Artificial
  CRISPR gRNA sequence
tacaaaagacagaaatttta

SEQ ID NO: 355754 - DNA, 20 bp, Artificial
  CRISPR gRNA sequence
aaagacagaaattttaaagc

SEQ ID NO: 355755 - DNA, 20 bp, Artificial
  CRISPR gRNA sequence
aagacagaaattttaaagct

SEQ ID NO: 355756 - DNA, 20 bp, Artificial
  CRISPR gRNA sequence
aaattttaaagctgggtgtc

SEQ ID NO: 355757 - DNA, 20 bp, Artificial
  CRISPR gRNA sequence
aattttaaagctgggtgtct

SEQ ID NO: 355758 - DNA, 20 bp, Artificial
  CRISPR gRNA sequence
attttaaagctgggtgtcta

SEQ ID NO: 355759 - DNA, 20 bp, Artificial
  CRISPR gRNA sequence
ttttaaagctgggtgtctag

SEQ ID NO: 355760 - DNA, 20 bp, Artificial
  CRISPR gRNA sequence
ttaaagctgggtgtctaggg

SEQ ID NO: 355761 - DNA, 20 bp, Artificial
  CRISPR gRNA sequence
ctaggggagacatcacatgt

SEQ ID NO: 355762 - DNA, 20 bp, Artificial
  CRISPR gRNA sequence
ggggagacatcacatgttgg

SEQ ID NO: 355763 - DNA, 20 bp, Artificial
  CRISPR gRNA sequence
gggagacatcacatgttggc

SEQ ID NO: 355764 - DNA, 20 bp, Artificial
  CRISPR gRNA sequence
caggttccgtgatgcctcct

SEQ ID NO: 355765 - DNA, 20 bp, Artificial
  CRISPR gRNA sequence
tgcctcctgagccgtaaaac

SEQ ID NO: 355766 - DNA, 20 bp, Artificial
  CRISPR gRNA sequence
tcctgagccgtaaaaccagc

SEQ ID NO: 355767 - DNA, 20 bp, Artificial
  CRISPR gRNA sequence
taaaaccagcaagtttttat

SEQ ID NO: 355768 - DNA, 20 bp, Artificial
  CRISPR gRNA sequence
gtttttattagcaattttca

SEQ ID NO: 355769 - DNA, 20 bp, Artificial
  CRISPR gRNA sequence
tttttattagcaattttcaa

SEQ ID NO: 355770 - DNA, 20 bp, Artificial
  CRISPR gRNA sequence
ttttattagcaattttcaaa

SEQ ID NO: 355771 - DNA, 20 bp, Artificial
  CRISPR gRNA sequence
tttattagcaattttcaaag

SEQ ID NO: 355772 - DNA, 20 bp, Artificial
  CRISPR gRNA sequence
tattagcaattttcaaaggg

SEQ ID NO: 355773 - DNA, 20 bp, Artificial
  CRISPR gRNA sequence
attagcaattttcaaagggg

SEQ ID NO: 355774 - DNA, 20 bp, Artificial
  CRISPR gRNA sequence
ttagcaattttcaaagggga

SEQ ID NO: 355775 - DNA, 20 bp, Artificial
  CRISPR gRNA sequence
agcaattttcaaaggggagg

SEQ ID NO: 355776 - DNA, 20 bp, Artificial
  CRISPR gRNA sequence
aaggggagggagtgtatgaa

SEQ ID NO: 355777 - DNA, 20 bp, Artificial
  CRISPR gRNA sequence
aggggagggagtgtatgaat

SEQ ID NO: 355778 - DNA, 20 bp, Artificial
  CRISPR gRNA sequence
ggggagggagtgtatgaata

SEQ ID NO: 355779 - DNA, 20 bp, Artificial
  CRISPR gRNA sequence
gggagtgtatgaatagggtg

SEQ ID NO: 355780 - DNA, 20 bp, Artificial
  CRISPR gRNA sequence
ggagtgtatgaatagggtgt

SEQ ID NO: 355781 - DNA, 20 bp, Artificial
  CRISPR gRNA sequence
tatgaatagggtgtgggtca

SEQ ID NO: 355782 - DNA, 20 bp, Artificial
  CRISPR gRNA sequence
tgaatagggtgtgggtcaca

SEQ ID NO: 355783 - DNA, 20 bp, Artificial
  CRISPR gRNA sequence
tcacagagatcacatgcttc

SEQ ID NO: 355784 - DNA, 20 bp, Artificial
  CRISPR gRNA sequence
cacagagatcacatgcttca

SEQ ID NO: 355785 - DNA, 20 bp, Artificial
  CRISPR gRNA sequence
acagagatcacatgcttcaa

SEQ ID NO: 355786 - DNA, 20 bp, Artificial
  CRISPR gRNA sequence
acatgcttcaagggcaacaa

SEQ ID NO: 355787 - DNA, 20 bp, Artificial
  CRISPR gRNA sequence
caagggcaacaaaagatcac

SEQ ID NO: 355788 - DNA, 20 bp, Artificial
  CRISPR gRNA sequence
aagggcaacaaaagatcaca

SEQ ID NO: 355789 - DNA, 20 bp, Artificial
  CRISPR gRNA sequence
acaaaagatcacaaggcaaa

SEQ ID NO: 355790 - DNA, 20 bp, Artificial
  CRISPR gRNA sequence
aaaagatcacaaggcaaatg

SEQ ID NO: 355791 - DNA, 20 bp, Artificial
  CRISPR gRNA sequence
aaagatcacaaggcaaatgg

SEQ ID NO: 355792 - DNA, 20 bp, Artificial
  CRISPR gRNA sequence
gatcacaaggcaaatggagg

SEQ ID NO: 355793 - DNA, 20 bp, Artificial
  CRISPR gRNA sequence
tcacaaggcaaatggaggca

SEQ ID NO: 355794 - DNA, 20 bp, Artificial
  CRISPR gRNA sequence
aaggcaaatggaggcagagc

SEQ ID NO: 355795 - DNA, 20 bp, Artificial
  CRISPR gRNA sequence
atggaggcagagcgagatca

SEQ ID NO: 355796 - DNA, 20 bp, Artificial
  CRISPR gRNA sequence
tggaggcagagcgagatcac

SEQ ID NO: 355797 - DNA, 20 bp, Artificial
  CRISPR gRNA sequence
ggcagagcgagatcacagga

SEQ ID NO: 355798 - DNA, 20 bp, Artificial
  CRISPR gRNA sequence
gcagagcgagatcacaggat

SEQ ID NO: 355799 - DNA, 20 bp, Artificial
  CRISPR gRNA sequence
cagagcgagatcacaggatg

SEQ ID NO: 355800 - DNA, 20 bp, Artificial
  CRISPR gRNA sequence
tgaaattaaaattgctaatg

SEQ ID NO: 355801 - DNA, 20 bp, Artificial
  CRISPR gRNA sequence
taaaattgctaatgaagttt

SEQ ID NO: 355802 - DNA, 20 bp, Artificial
  CRISPR gRNA sequence
aaaattgctaatgaagtttc

SEQ ID NO: 355803 - DNA, 20 bp, Artificial
  CRISPR gRNA sequence
gtcactgataaacatcttaa

SEQ ID NO: 355804 - DNA, 20 bp, Artificial
  CRISPR gRNA sequence
tcactgataaacatcttaac

SEQ ID NO: 355805 - DNA, 20 bp, Artificial
  CRISPR gRNA sequence
cactgataaacatcttaaca

SEQ ID NO: 355806 - DNA, 20 bp, Artificial
  CRISPR gRNA sequence
taaacatcttaacagggttc

SEQ ID NO: 355807 - DNA, 20 bp, Artificial
  CRISPR gRNA sequence
aacatcttaacagggttcaa

SEQ ID NO: 355808 - DNA, 20 bp, Artificial
  CRISPR gRNA sequence
atcttaacagggttcaagag

SEQ ID NO: 355809 - DNA, 20 bp, Artificial
  CRISPR gRNA sequence
cttaacagggttcaagagca

SEQ ID NO: 355810 - DNA, 20 bp, Artificial
  CRISPR gRNA sequence
agggttcaagagcagagaac

SEQ ID NO: 355811 - DNA, 20 bp, Artificial
  CRISPR gRNA sequence
gagcagagaaccagtctgac

SEQ ID NO: 355812 - DNA, 20 bp, Artificial
  CRISPR gRNA sequence
ccagtctgactagaattcgc

SEQ ID NO: 355813 - DNA, 20 bp, Artificial
  CRISPR gRNA sequence
cagtctgactagaattcgcc

SEQ ID NO: 355814 - DNA, 20 bp, Artificial
  CRISPR gRNA sequence
ctgactagaattcgccaggc

SEQ ID NO: 355815 - DNA, 20 bp, Artificial
  CRISPR gRNA sequence
aggctggaatttcctaatcc

SEQ ID NO: 355816 - DNA, 20 bp, Artificial
  CRISPR gRNA sequence
tggaatttcctaatcctagc

SEQ ID NO: 355817 - DNA, 20 bp, Artificial
  CRISPR gRNA sequence
tttcctaatcctagcaagcc

SEQ ID NO: 355818 - DNA, 20 bp, Artificial
  CRISPR gRNA sequence
ttcctaatcctagcaagcct

SEQ ID NO: 355819 - DNA, 20 bp, Artificial
  CRISPR gRNA sequence
tcctaatcctagcaagcctg

SEQ ID NO: 355820 - DNA, 20 bp, Artificial
  CRISPR gRNA sequence
cctaatcctagcaagcctgg

SEQ ID NO: 355821 - DNA, 20 bp, Artificial
  CRISPR gRNA sequence
tagcaagcctgggggtgctg

SEQ ID NO: 355822 - DNA, 20 bp, Artificial
  CRISPR gRNA sequence
agcaagcctgggggtgctgc

SEQ ID NO: 355823 - DNA, 20 bp, Artificial
  CRISPR gRNA sequence
caagcctgggggtgctgcag

SEQ ID NO: 355824 - DNA, 20 bp, Artificial
  CRISPR gRNA sequence
aagcctgggggtgctgcagg

SEQ ID NO: 355825 - DNA, 20 bp, Artificial
  CRISPR gRNA sequence
ctgggggtgctgcaggaggc

SEQ ID NO: 355826 - DNA, 20 bp, Artificial
  CRISPR gRNA sequence
tgggggtgctgcaggaggcc

SEQ ID NO: 355827 - DNA, 20 bp, Artificial
  CRISPR gRNA sequence
gggggtgctgcaggaggcca

SEQ ID NO: 355828 - DNA, 20 bp, Artificial
  CRISPR gRNA sequence
tcccttatctgcaactgcat

SEQ ID NO: 355829 - DNA, 20 bp, Artificial
  CRISPR gRNA sequence
cccttatctgcaactgcata

SEQ ID NO: 355830 - DNA, 20 bp, Artificial
  CRISPR gRNA sequence
ttatctgcaactgcataagg

SEQ ID NO: 355831 - DNA, 20 bp, Artificial
  CRISPR gRNA sequence
taaggcagacaccccccgct

SEQ ID NO: 355832 - DNA, 20 bp, Artificial
  CRISPR gRNA sequence
aggcagacaccccccgctga

SEQ ID NO: 355833 - DNA, 20 bp, Artificial
  CRISPR gRNA sequence
ggcagacaccccccgctgag

SEQ ID NO: 355834 - DNA, 20 bp, Artificial
  CRISPR gRNA sequence
cccccgctgagaggccatta

SEQ ID NO: 355835 - DNA, 20 bp, Artificial
  CRISPR gRNA sequence
cccgctgagaggccattata

SEQ ID NO: 355836 - DNA, 20 bp, Artificial
  CRISPR gRNA sequence
ccgctgagaggccattatag

SEQ ID NO: 355837 - DNA, 20 bp, Artificial
  CRISPR gRNA sequence
cgctgagaggccattataga

SEQ ID NO: 355838 - DNA, 20 bp, Artificial
  CRISPR gRNA sequence
atagagggctctcctccccc

SEQ ID NO: 355839 - DNA, 20 bp, Artificial
  CRISPR gRNA sequence
tagagggctctcctcccccc

SEQ ID NO: 355840 - DNA, 20 bp, Artificial
  CRISPR gRNA sequence
gggctctcctccccccagga

SEQ ID NO: 355841 - DNA, 20 bp, Artificial
  CRISPR gRNA sequence
ccaggaaagcattcttttcc

SEQ ID NO: 355842 - DNA, 20 bp, Artificial
  CRISPR gRNA sequence
caggaaagcattcttttccc

SEQ ID NO: 355843 - DNA, 20 bp, Artificial
  CRISPR gRNA sequence
aggaaagcattcttttccca

SEQ ID NO: 355844 - DNA, 20 bp, Artificial
  CRISPR gRNA sequence
gaattattaatattccttac

SEQ ID NO: 355845 - DNA, 20 bp, Artificial
  CRISPR gRNA sequence
aattattaatattccttact

SEQ ID NO: 355846 - DNA, 20 bp, Artificial
  CRISPR gRNA sequence
attattaatattccttactg

SEQ ID NO: 355847 - DNA, 20 bp, Artificial
  CRISPR gRNA sequence
attaatattccttactgggg

SEQ ID NO: 355848 - DNA, 20 bp, Artificial
  CRISPR gRNA sequence
ttaatattccttactgggga

SEQ ID NO: 355849 - DNA, 20 bp, Artificial
  CRISPR gRNA sequence
tccttactggggaaggaatt

SEQ ID NO: 355850 - DNA, 20 bp, Artificial
  CRISPR gRNA sequence
tcttacccattttcgataat

SEQ ID NO: 355851 - DNA, 20 bp, Artificial
  CRISPR gRNA sequence
ttacccattttcgataataa

SEQ ID NO: 355852 - DNA, 20 bp, Artificial
  CRISPR gRNA sequence
tttcgataataagagaaata

SEQ ID NO: 355853 - DNA, 20 bp, Artificial
  CRISPR gRNA sequence
aaatatggctctgtcctgac

SEQ ID NO: 355854 - DNA, 20 bp, Artificial
  CRISPR gRNA sequence
gctctgtcctgactggccta

SEQ ID NO: 355855 - DNA, 20 bp, Artificial
  CRISPR gRNA sequence
ctctgtcctgactggcctac

SEQ ID NO: 355856 - DNA, 20 bp, Artificial
  CRISPR gRNA sequence
tgtcctgactggcctacagg

SEQ ID NO: 355857 - DNA, 20 bp, Artificial
  CRISPR gRNA sequence
ctgactggcctacaggcagc

SEQ ID NO: 355858 - DNA, 20 bp, Artificial
  CRISPR gRNA sequence
cctacaggcagccagacttt

SEQ ID NO: 355859 - DNA, 20 bp, Artificial
  CRISPR gRNA sequence
ctacaggcagccagacttta

SEQ ID NO: 355860 - DNA, 20 bp, Artificial
  CRISPR gRNA sequence
cccttgttctctgaaaatca

SEQ ID NO: 355861 - DNA, 20 bp, Artificial
  CRISPR gRNA sequence
atcacagttatcctgttctt

SEQ ID NO: 355862 - DNA, 20 bp, Artificial
  CRISPR gRNA sequence
tcacagttatcctgttctta

SEQ ID NO: 355863 - DNA, 20 bp, Artificial
  CRISPR gRNA sequence
tatcctgttcttaaggtgcc

SEQ ID NO: 355864 - DNA, 20 bp, Artificial
  CRISPR gRNA sequence
tgctttacaaacaatttgtg

SEQ ID NO: 355865 - DNA, 20 bp, Artificial
  CRISPR gRNA sequence
tgcagttaacacaaccatca

SEQ ID NO: 355866 - DNA, 20 bp, Artificial
  CRISPR gRNA sequence
gcagttaacacaaccatcac

SEQ ID NO: 355867 - DNA, 20 bp, Artificial
  CRISPR gRNA sequence
cagttaacacaaccatcaca

SEQ ID NO: 355868 - DNA, 20 bp, Artificial
  CRISPR gRNA sequence
cacaaccatcacagggtcct

SEQ ID NO: 355869 - DNA, 20 bp, Artificial
  CRISPR gRNA sequence
acaaccatcacagggtcctg

SEQ ID NO: 355870 - DNA, 20 bp, Artificial
  CRISPR gRNA sequence
cctgaggtgacatacatcct

SEQ ID NO: 355871 - DNA, 20 bp, Artificial
  CRISPR gRNA sequence
acatacatcctcagcttacg

SEQ ID NO: 355872 - DNA, 20 bp, Artificial
  CRISPR gRNA sequence
tcctcagcttacgaagatga

SEQ ID NO: 355873 - DNA, 20 bp, Artificial
  CRISPR gRNA sequence
cctcagcttacgaagatgac

SEQ ID NO: 355874 - DNA, 20 bp, Artificial
  CRISPR gRNA sequence
cttacgaagatgacgggatt

SEQ ID NO: 355875 - DNA, 20 bp, Artificial
  CRISPR gRNA sequence
tacgaagatgacgggattaa

SEQ ID NO: 355876 - DNA, 20 bp, Artificial
  CRISPR gRNA sequence
atgacgggattaagagatta

SEQ ID NO: 355877 - DNA, 20 bp, Artificial
  CRISPR gRNA sequence
gggattaagagattaaagta

SEQ ID NO: 355878 - DNA, 20 bp, Artificial
  CRISPR gRNA sequence
taagagattaaagtaaagac

SEQ ID NO: 355879 - DNA, 20 bp, Artificial
  CRISPR gRNA sequence
gattaaagtaaagacaagca

SEQ ID NO: 355880 - DNA, 20 bp, Artificial
  CRISPR gRNA sequence
attaaagtaaagacaagcat

SEQ ID NO: 355881 - DNA, 20 bp, Artificial
  CRISPR gRNA sequence
agacaagcataggaaatcac

SEQ ID NO: 355882 - DNA, 20 bp, Artificial
  CRISPR gRNA sequence
acaagcataggaaatcacaa

SEQ ID NO: 355883 - DNA, 20 bp, Artificial
  CRISPR gRNA sequence
gaaatcacaagagtattgac

SEQ ID NO: 355884 - DNA, 20 bp, Artificial
  CRISPR gRNA sequence
aaatcacaagagtattgact

SEQ ID NO: 355885 - DNA, 20 bp, Artificial
  CRISPR gRNA sequence
aatcacaagagtattgactg

SEQ ID NO: 355886 - DNA, 20 bp, Artificial
  CRISPR gRNA sequence
cacaagagtattgactgggg

SEQ ID NO: 355887 - DNA, 20 bp, Artificial
  CRISPR gRNA sequence
caatttaaattcttctgcca

SEQ ID NO: 355888 - DNA, 20 bp, Artificial
  CRISPR gRNA sequence
aaattcttctgccatggctt

SEQ ID NO: 355889 - DNA, 20 bp, Artificial
  CRISPR gRNA sequence
tcttctgccatggcttcagc

SEQ ID NO: 355890 - DNA, 20 bp, Artificial
  CRISPR gRNA sequence
cttcagccagtccctccgtt

SEQ ID NO: 355891 - DNA, 20 bp, Artificial
  CRISPR gRNA sequence
ttcagccagtccctccgttc

SEQ ID NO: 355892 - DNA, 20 bp, Artificial
  CRISPR gRNA sequence
tcaggttccctgacttccca

SEQ ID NO: 355893 - DNA, 20 bp, Artificial
  CRISPR gRNA sequence
cttcccacagcaccatttcc

SEQ ID NO: 355894 - DNA, 20 bp, Artificial
  CRISPR gRNA sequence
cccacagcaccatttcccag

SEQ ID NO: 355895 - DNA, 20 bp, Artificial
  CRISPR gRNA sequence
gcaccatttcccagtggatt

SEQ ID NO: 355896 - DNA, 20 bp, Artificial
  CRISPR gRNA sequence
ttcccagtggattcagatga

SEQ ID NO: 355897 - DNA, 20 bp, Artificial
  CRISPR gRNA sequence
cagtggattcagatgacagc

SEQ ID NO: 355898 - DNA, 20 bp, Artificial
  CRISPR gRNA sequence
atgacagctggtaatacaac

SEQ ID NO: 355899 - DNA, 20 bp, Artificial
  CRISPR gRNA sequence
gctggtaatacaaccagtta

SEQ ID NO: 355900 - DNA, 20 bp, Artificial
  CRISPR gRNA sequence
aaccagttacagctccaaaa

SEQ ID NO: 355901 - DNA, 20 bp, Artificial
  CRISPR gRNA sequence
ccagttacagctccaaaacg

SEQ ID NO: 355902 - DNA, 20 bp, Artificial
  CRISPR gRNA sequence
gctccaaaacggagccactg

SEQ ID NO: 355903 - DNA, 20 bp, Artificial
  CRISPR gRNA sequence
ccaaaacggagccactgaag

SEQ ID NO: 355904 - DNA, 20 bp, Artificial
  CRISPR gRNA sequence
ggagccactgaagaagaacc

SEQ ID NO: 355905 - DNA, 20 bp, Artificial
  CRISPR gRNA sequence
ccactgaagaagaaccaagc

SEQ ID NO: 355906 - DNA, 20 bp, Artificial
  CRISPR gRNA sequence
cactgaagaagaaccaagct

SEQ ID NO: 355907 - DNA, 20 bp, Artificial
  CRISPR gRNA sequence
agaaccaagctgggtttata

SEQ ID NO: 355908 - DNA, 20 bp, Artificial
  CRISPR gRNA sequence
gtttatacggaattgtacgt

SEQ ID NO: 355909 - DNA, 20 bp, Artificial
  CRISPR gRNA sequence
atacggaattgtacgtgaga

SEQ ID NO: 355910 - DNA, 20 bp, Artificial
  CRISPR gRNA sequence
attgtacgtgagatggcaca

SEQ ID NO: 355911 - DNA, 20 bp, Artificial
  CRISPR gRNA sequence
ttgtacgtgagatggcacac

SEQ ID NO: 355912 - DNA, 20 bp, Artificial
  CRISPR gRNA sequence
cacaggtttacgctgtgtca

SEQ ID NO: 355913 - DNA, 20 bp, Artificial
  CRISPR gRNA sequence
ctgtgaatgtcaccactatc

SEQ ID NO: 355914 - DNA, 20 bp, Artificial
  CRISPR gRNA sequence
gaatgtcaccactatctgga

SEQ ID NO: 355915 - DNA, 20 bp, Artificial
  CRISPR gRNA sequence
gacagtcgaacatgttttat

SEQ ID NO: 355916 - DNA, 20 bp, Artificial
  CRISPR gRNA sequence
acagtcgaacatgttttatt

SEQ ID NO: 355917 - DNA, 20 bp, Artificial
  CRISPR gRNA sequence
tttgtttatatgctctgcac

SEQ ID NO: 355918 - DNA, 20 bp, Artificial
  CRISPR gRNA sequence
gtttatatgctctgcactag

SEQ ID NO: 355919 - DNA, 20 bp, Artificial
  CRISPR gRNA sequence
tttatatgctctgcactagt

SEQ ID NO: 355920 - DNA, 20 bp, Artificial
  CRISPR gRNA sequence
atatgctctgcactagtagg

SEQ ID NO: 355921 - DNA, 20 bp, Artificial
  CRISPR gRNA sequence
tatgctctgcactagtaggt

SEQ ID NO: 355922 - DNA, 20 bp, Artificial
  CRISPR gRNA sequence
tctgcactagtaggtaggtt

SEQ ID NO: 355923 - DNA, 20 bp, Artificial
  CRISPR gRNA sequence
aggttcagtaataaatatgt

SEQ ID NO: 355924 - DNA, 20 bp, Artificial
  CRISPR gRNA sequence
atatgtgagaacttttgttt

SEQ ID NO: 355925 - DNA, 20 bp, Artificial
  CRISPR gRNA sequence
gagaacttttgtttcagtaa

SEQ ID NO: 355926 - DNA, 20 bp, Artificial
  CRISPR gRNA sequence
aacttttgtttcagtaaaag

SEQ ID NO: 355927 - DNA, 20 bp, Artificial
  CRISPR gRNA sequence
tttgtttcagtaaaagaaga

SEQ ID NO: 355928 - DNA, 20 bp, Artificial
  CRISPR gRNA sequence
tttcagtaaaagaagaaaga

SEQ ID NO: 355929 - DNA, 20 bp, Artificial
  CRISPR gRNA sequence
agtaaaagaagaaagaaaga

SEQ ID NO: 355930 - DNA, 20 bp, Artificial
  CRISPR gRNA sequence
gtaaaagaagaaagaaagaa

SEQ ID NO: 355931 - DNA, 20 bp, Artificial
  CRISPR gRNA sequence
aaaagaagaaagaaagaaag

SEQ ID NO: 355932 - DNA, 20 bp, Artificial
  CRISPR gRNA sequence
aagaagaaagaaagaaagga

SEQ ID NO: 355933 - DNA, 20 bp, Artificial
  CRISPR gRNA sequence
gaagaaagaaagaaaggaga

SEQ ID NO: 355934 - DNA, 20 bp, Artificial
  CRISPR gRNA sequence
agaaagaaagaaaggagaga

SEQ ID NO: 355935 - DNA, 20 bp, Artificial
  CRISPR gRNA sequence
aaagaaagaaaggagagaga

SEQ ID NO: 355936 - DNA, 20 bp, Artificial
  CRISPR gRNA sequence
agaaagaaaggagagagaga

SEQ ID NO: 355937 - DNA, 20 bp, Artificial
  CRISPR gRNA sequence
agaaaggagagagagagaga

SEQ ID NO: 355938 - DNA, 20 bp, Artificial
  CRISPR gRNA sequence
aaaggagagagagagagaaa

SEQ ID NO: 355939 - DNA, 20 bp, Artificial
  CRISPR gRNA sequence
aaggagagagagagagaaag

SEQ ID NO: 355940 - DNA, 20 bp, Artificial
  CRISPR gRNA sequence
agagagagagagaaagagga

SEQ ID NO: 355941 - DNA, 20 bp, Artificial
  CRISPR gRNA sequence
gagagagagagaaagaggaa

SEQ ID NO: 355942 - DNA, 20 bp, Artificial
  CRISPR gRNA sequence
agagagaaagaggaaaggaa

SEQ ID NO: 355943 - DNA, 20 bp, Artificial
  CRISPR gRNA sequence
gagaaagaggaaaggaatgg

SEQ ID NO: 355944 - DNA, 20 bp, Artificial
  CRISPR gRNA sequence
agaaagaggaaaggaatgga

SEQ ID NO: 355945 - DNA, 20 bp, Artificial
  CRISPR gRNA sequence
gaaagaggaaaggaatggaa

SEQ ID NO: 355946 - DNA, 20 bp, Artificial
  CRISPR gRNA sequence
agaggaaaggaatggaaggg

SEQ ID NO: 355947 - DNA, 20 bp, Artificial
  CRISPR gRNA sequence
gaggaaaggaatggaaggga

SEQ ID NO: 355948 - DNA, 20 bp, Artificial
  CRISPR gRNA sequence
aaaggaatggaagggaagga

SEQ ID NO: 355949 - DNA, 20 bp, Artificial
  CRISPR gRNA sequence
ggaatggaagggaaggaaag

SEQ ID NO: 355950 - DNA, 20 bp, Artificial
  CRISPR gRNA sequence
gaatggaagggaaggaaagc

SEQ ID NO: 355951 - DNA, 20 bp, Artificial
  CRISPR gRNA sequence
aatggaagggaaggaaagcg

SEQ ID NO: 355952 - DNA, 20 bp, Artificial
  CRISPR gRNA sequence
atggaagggaaggaaagcgg

SEQ ID NO: 355953 - DNA, 20 bp, Artificial
  CRISPR gRNA sequence
ggaagggaaggaaagcgggg

SEQ ID NO: 355954 - DNA, 20 bp, Artificial
  CRISPR gRNA sequence
gaagggaaggaaagcggggg

SEQ ID NO: 355955 - DNA, 20 bp, Artificial
  CRISPR gRNA sequence
gggaaggaaagcgggggagg

SEQ ID NO: 355956 - DNA, 20 bp, Artificial
  CRISPR gRNA sequence
ggaaggaaagcgggggagga

SEQ ID NO: 355957 - DNA, 20 bp, Artificial
  CRISPR gRNA sequence
aggaaagcgggggaggaagg

SEQ ID NO: 355958 - DNA, 20 bp, Artificial
  CRISPR gRNA sequence
ggaaagcgggggaggaaggc

SEQ ID NO: 355959 - DNA, 20 bp, Artificial
  CRISPR gRNA sequence
aagcgggggaggaaggcagg

SEQ ID NO: 355960 - DNA, 20 bp, Artificial
  CRISPR gRNA sequence
agcgggggaggaaggcaggc

SEQ ID NO: 355961 - DNA, 20 bp, Artificial
  CRISPR gRNA sequence
gggggaggaaggcaggcagg

SEQ ID NO: 355962 - DNA, 20 bp, Artificial
  CRISPR gRNA sequence
ggggaggaaggcaggcaggc

SEQ ID NO: 355963 - DNA, 20 bp, Artificial
  CRISPR gRNA sequence
gaggaaggcaggcaggcagg

SEQ ID NO: 355964 - DNA, 20 bp, Artificial
  CRISPR gRNA sequence
aggaaggcaggcaggcaggc

SEQ ID NO: 355965 - DNA, 20 bp, Artificial
  CRISPR gRNA sequence
ggaaggcaggcaggcaggca

SEQ ID NO: 355966 - DNA, 20 bp, Artificial
  CRISPR gRNA sequence
aaggcaggcaggcaggcagg

SEQ ID NO: 355967 - DNA, 20 bp, Artificial
  CRISPR gRNA sequence
aggcaggcaggcaggcaggg

SEQ ID NO: 355968 - DNA, 20 bp, Artificial
  CRISPR gRNA sequence
gcaggcaggcaggcagggag

SEQ ID NO: 355969 - DNA, 20 bp, Artificial
  CRISPR gRNA sequence
gcaggcaggcagggaggaga

SEQ ID NO: 355970 - DNA, 20 bp, Artificial
  CRISPR gRNA sequence
gcaggcagggaggagaaaga

SEQ ID NO: 355971 - DNA, 20 bp, Artificial
  CRISPR gRNA sequence
aggcagggaggagaaagaaa

SEQ ID NO: 355972 - DNA, 20 bp, Artificial
  CRISPR gRNA sequence
agggaggagaaagaaagaga

SEQ ID NO: 355973 - DNA, 20 bp, Artificial
  CRISPR gRNA sequence
gggaggagaaagaaagagaa

SEQ ID NO: 355974 - DNA, 20 bp, Artificial
  CRISPR gRNA sequence
aggagaaagaaagagaaagg

SEQ ID NO: 355975 - DNA, 20 bp, Artificial
  CRISPR gRNA sequence
gaaagaaagagaaaggaagt

SEQ ID NO: 355976 - DNA, 20 bp, Artificial
  CRISPR gRNA sequence
aaagaaagagaaaggaagta

SEQ ID NO: 355977 - DNA, 20 bp, Artificial
  CRISPR gRNA sequence
gaaagagaaaggaagtaagg

SEQ ID NO: 355978 - DNA, 20 bp, Artificial
  CRISPR gRNA sequence
aaagagaaaggaagtaagga

SEQ ID NO: 355979 - DNA, 20 bp, Artificial
  CRISPR gRNA sequence
gagaaaggaagtaaggaagg

SEQ ID NO: 355980 - DNA, 20 bp, Artificial
  CRISPR gRNA sequence
aaggaagtaaggaaggcgga

SEQ ID NO: 355981 - DNA, 20 bp, Artificial
  CRISPR gRNA sequence
gaagtaaggaaggcggaaag

SEQ ID NO: 355982 - DNA, 20 bp, Artificial
  CRISPR gRNA sequence
aagtaaggaaggcggaaaga

SEQ ID NO: 355983 - DNA, 20 bp, Artificial
  CRISPR gRNA sequence
taaggaaggcggaaagaagg

SEQ ID NO: 355984 - DNA, 20 bp, Artificial
  CRISPR gRNA sequence
aaggaaggcggaaagaagga

SEQ ID NO: 355985 - DNA, 20 bp, Artificial
  CRISPR gRNA sequence
aggaaggcggaaagaaggaa

SEQ ID NO: 355986 - DNA, 20 bp, Artificial
  CRISPR gRNA sequence
ggaaggcggaaagaaggaag

SEQ ID NO: 355987 - DNA, 20 bp, Artificial
  CRISPR gRNA sequence
aaggcggaaagaaggaaggg

SEQ ID NO: 355988 - DNA, 20 bp, Artificial
  CRISPR gRNA sequence
aggcggaaagaaggaagggg

SEQ ID NO: 355989 - DNA, 20 bp, Artificial
  CRISPR gRNA sequence
ggcggaaagaaggaagggga

SEQ ID NO: 355990 - DNA, 20 bp, Artificial
  CRISPR gRNA sequence
ggaaagaaggaaggggaggg

SEQ ID NO: 355991 - DNA, 20 bp, Artificial
  CRISPR gRNA sequence
gaaagaaggaaggggaggga

SEQ ID NO: 355992 - DNA, 20 bp, Artificial
  CRISPR gRNA sequence
aaagaaggaaggggagggaa

SEQ ID NO: 355993 - DNA, 20 bp, Artificial
  CRISPR gRNA sequence
gaaggaaggggagggaaggg

SEQ ID NO: 355994 - DNA, 20 bp, Artificial
  CRISPR gRNA sequence
aaggaaggggagggaaggga

SEQ ID NO: 355995 - DNA, 20 bp, Artificial
  CRISPR gRNA sequence
aggaaggggagggaagggaa

SEQ ID NO: 355996 - DNA, 20 bp, Artificial
  CRISPR gRNA sequence
aaggggagggaagggaaggg

SEQ ID NO: 355997 - DNA, 20 bp, Artificial
  CRISPR gRNA sequence
aggggagggaagggaaggga

SEQ ID NO: 355998 - DNA, 20 bp, Artificial
  CRISPR gRNA sequence
ggggagggaagggaagggaa

SEQ ID NO: 355999 - DNA, 20 bp, Artificial
  CRISPR gRNA sequence
agggaagggaagggaaggga

SEQ ID NO: 356000 - DNA, 20 bp, Artificial
  CRISPR gRNA sequence
gggaagggaagggaagggaa

SEQ ID NO: 356001 - DNA, 20 bp, Artificial
  CRISPR gRNA sequence
aagggaagggaagggaaagg

SEQ ID NO: 356002 - DNA, 20 bp, Artificial
  CRISPR gRNA sequence
gggaagggaagggaaaggaa

SEQ ID NO: 356003 - DNA, 20 bp, Artificial
  CRISPR gRNA sequence
aagggaagggaaaggaagag

SEQ ID NO: 356004 - DNA, 20 bp, Artificial
  CRISPR gRNA sequence
gggaagggaaaggaagagaa

SEQ ID NO: 356005 - DNA, 20 bp, Artificial
  CRISPR gRNA sequence
agggaaaggaagagaagaga

SEQ ID NO: 356006 - DNA, 20 bp, Artificial
  CRISPR gRNA sequence
aaaggaagagaagagaaaga

SEQ ID NO: 356007 - DNA, 20 bp, Artificial
  CRISPR gRNA sequence
gaagagaagagaaagaaaga

SEQ ID NO: 356008 - DNA, 20 bp, Artificial
  CRISPR gRNA sequence
aagagaaagaaagaaagaaa

SEQ ID NO: 356009 - DNA, 20 bp, Artificial
  CRISPR gRNA sequence
gaaagaaagaaagaaaaaga

SEQ ID NO: 356010 - DNA, 20 bp, Artificial
  CRISPR gRNA sequence
aagaaagaaagaaaaagaaa

SEQ ID NO: 356011 - DNA, 20 bp, Artificial
  CRISPR gRNA sequence
gaaagaaagaaaaagaaaga

SEQ ID NO: 356012 - DNA, 20 bp, Artificial
  CRISPR gRNA sequence
gaaagaaaaagaaagagaga

SEQ ID NO: 356013 - DNA, 20 bp, Artificial
  CRISPR gRNA sequence
gaaaaagaaagagagaaaga

SEQ ID NO: 356014 - DNA, 20 bp, Artificial
  CRISPR gRNA sequence
aagaaagagagaaagaaaga

SEQ ID NO: 356015 - DNA, 20 bp, Artificial
  CRISPR gRNA sequence
aagagagaaagaaagaaaga

SEQ ID NO: 356016 - DNA, 20 bp, Artificial
  CRISPR gRNA sequence
gagaaagaaagaaagaaaga

SEQ ID NO: 356017 - DNA, 20 bp, Artificial
  CRISPR gRNA sequence
aagaaagaaagaaagaaaga

SEQ ID NO: 356018 - DNA, 20 bp, Artificial
  CRISPR gRNA sequence
aagaaagaaagaaagaaaga

SEQ ID NO: 356019 - DNA, 20 bp, Artificial
  CRISPR gRNA sequence
agaaagaaagaaagaaagaa

SEQ ID NO: 356020 - DNA, 20 bp, Artificial
  CRISPR gRNA sequence
aagaaagaaagaaagaaagg

SEQ ID NO: 356021 - DNA, 20 bp, Artificial
  CRISPR gRNA sequence
agaaagaaagaaagaaagga

SEQ ID NO: 356022 - DNA, 20 bp, Artificial
  CRISPR gRNA sequence
aagaaagaaagaaaggaagg

SEQ ID NO: 356023 - DNA, 20 bp, Artificial
  CRISPR gRNA sequence
agaaagaaagaaaggaagga

SEQ ID NO: 356024 - DNA, 20 bp, Artificial
  CRISPR gRNA sequence
aagaaagaaaggaaggaagg

SEQ ID NO: 356025 - DNA, 20 bp, Artificial
  CRISPR gRNA sequence
agaaagaaaggaaggaagga

SEQ ID NO: 356026 - DNA, 20 bp, Artificial
  CRISPR gRNA sequence
aagaaaggaaggaaggaagg

SEQ ID NO: 356027 - DNA, 20 bp, Artificial
  CRISPR gRNA sequence
agaaaggaaggaaggaagga

SEQ ID NO: 356028 - DNA, 20 bp, Artificial
  CRISPR gRNA sequence
aaggaaggaaggaaggaagg

SEQ ID NO: 356029 - DNA, 20 bp, Artificial
  CRISPR gRNA sequence
aggaaggaaggaaggaagga

SEQ ID NO: 356030 - DNA, 20 bp, Artificial
  CRISPR gRNA sequence
ggaaggaaggaaggaaggaa

SEQ ID NO: 356031 - DNA, 20 bp, Artificial
  CRISPR gRNA sequence
gaaggaaggaaggaaggaag

SEQ ID NO: 356032 - DNA, 20 bp, Artificial
  CRISPR gRNA sequence
gaaggaaggaaggaagggga

SEQ ID NO: 356033 - DNA, 20 bp, Artificial
  CRISPR gRNA sequence
gaaggaaggaaggggaaaga

SEQ ID NO: 356034 - DNA, 20 bp, Artificial
  CRISPR gRNA sequence
gaaggaaggggaaagaaaga

SEQ ID NO: 356035 - DNA, 20 bp, Artificial
  CRISPR gRNA sequence
ggaaggggaaagaaagaaag

SEQ ID NO: 356036 - DNA, 20 bp, Artificial
  CRISPR gRNA sequence
gaaggggaaagaaagaaaga

SEQ ID NO: 356037 - DNA, 20 bp, Artificial
  CRISPR gRNA sequence
aggggaaagaaagaaagaag

SEQ ID NO: 356038 - DNA, 20 bp, Artificial
  CRISPR gRNA sequence
ggggaaagaaagaaagaagg

SEQ ID NO: 356039 - DNA, 20 bp, Artificial
  CRISPR gRNA sequence
gggaaagaaagaaagaagga

SEQ ID NO: 356040 - DNA, 20 bp, Artificial
  CRISPR gRNA sequence
aaagaaagaaagaaggaggg

SEQ ID NO: 356041 - DNA, 20 bp, Artificial
  CRISPR gRNA sequence
aagaaagaaagaaggaggga

SEQ ID NO: 356042 - DNA, 20 bp, Artificial
  CRISPR gRNA sequence
aagaaagaaggagggaagga

SEQ ID NO: 356043 - DNA, 20 bp, Artificial
  CRISPR gRNA sequence
agaaagaaggagggaaggaa

SEQ ID NO: 356044 - DNA, 20 bp, Artificial
  CRISPR gRNA sequence
gaaagaaggagggaaggaaa

SEQ ID NO: 356045 - DNA, 20 bp, Artificial
  CRISPR gRNA sequence
aaagaaggagggaaggaaag

SEQ ID NO: 356046 - DNA, 20 bp, Artificial
  CRISPR gRNA sequence
agaaggagggaaggaaaggg

SEQ ID NO: 356047 - DNA, 20 bp, Artificial
  CRISPR gRNA sequence
ggagggaaggaaaggggaga

SEQ ID NO: 356048 - DNA, 20 bp, Artificial
  CRISPR gRNA sequence
gggaaggaaaggggagaaag

SEQ ID NO: 356049 - DNA, 20 bp, Artificial
  CRISPR gRNA sequence
aggaaaggggagaaagaaga

SEQ ID NO: 356050 - DNA, 20 bp, Artificial
  CRISPR gRNA sequence
gaaaggggagaaagaagaaa

SEQ ID NO: 356051 - DNA, 20 bp, Artificial
  CRISPR gRNA sequence
ggggagaaagaagaaagagt

SEQ ID NO: 356052 - DNA, 20 bp, Artificial
  CRISPR gRNA sequence
agaaagaagaaagagttggc

SEQ ID NO: 356053 - DNA, 20 bp, Artificial
  CRISPR gRNA sequence
gaaagaagaaagagttggca

SEQ ID NO: 356054 - DNA, 20 bp, Artificial
  CRISPR gRNA sequence
aaagaagaaagagttggcaa

SEQ ID NO: 356055 - DNA, 20 bp, Artificial
  CRISPR gRNA sequence
agaaagagttggcaagggta

SEQ ID NO: 356056 - DNA, 20 bp, Artificial
  CRISPR gRNA sequence
aaagagttggcaagggtatg

SEQ ID NO: 356057 - DNA, 20 bp, Artificial
  CRISPR gRNA sequence
gagttggcaagggtatggag

SEQ ID NO: 356058 - DNA, 20 bp, Artificial
  CRISPR gRNA sequence
gttggcaagggtatggagaa

SEQ ID NO: 356059 - DNA, 20 bp, Artificial
  CRISPR gRNA sequence
tggcaagggtatggagaaga

SEQ ID NO: 356060 - DNA, 20 bp, Artificial
  CRISPR gRNA sequence
gaaccctcgcacactgttga

SEQ ID NO: 356061 - DNA, 20 bp, Artificial
  CRISPR gRNA sequence
cacataatctcacttaaata

SEQ ID NO: 356062 - DNA, 20 bp, Artificial
  CRISPR gRNA sequence
acctaaaaaaattaatgtct

SEQ ID NO: 356063 - DNA, 20 bp, Artificial
  CRISPR gRNA sequence
taaaaaaattaatgtcttag

SEQ ID NO: 356064 - DNA, 20 bp, Artificial
  CRISPR gRNA sequence
aaaaattaatgtcttagaag

SEQ ID NO: 356065 - DNA, 20 bp, Artificial
  CRISPR gRNA sequence
attaatgtcttagaagtaga

SEQ ID NO: 356066 - DNA, 20 bp, Artificial
  CRISPR gRNA sequence
aatgtcttagaagtagaaag

SEQ ID NO: 356067 - DNA, 20 bp, Artificial
  CRISPR gRNA sequence
agaagtagaaagtagaatga

SEQ ID NO: 356068 - DNA, 20 bp, Artificial
  CRISPR gRNA sequence
gaaagtagaatgatggttac

SEQ ID NO: 356069 - DNA, 20 bp, Artificial
  CRISPR gRNA sequence
aagtagaatgatggttacca

SEQ ID NO: 356070 - DNA, 20 bp, Artificial
  CRISPR gRNA sequence
agtagaatgatggttaccag

SEQ ID NO: 356071 - DNA, 20 bp, Artificial
  CRISPR gRNA sequence
atggttaccagaggctgtgc

SEQ ID NO: 356072 - DNA, 20 bp, Artificial
  CRISPR gRNA sequence
ggttaccagaggctgtgcaa

SEQ ID NO: 356073 - DNA, 20 bp, Artificial
  CRISPR gRNA sequence
ccagaggctgtgcaagagaa

SEQ ID NO: 356074 - DNA, 20 bp, Artificial
  CRISPR gRNA sequence
cagaggctgtgcaagagaat

SEQ ID NO: 356075 - DNA, 20 bp, Artificial
  CRISPR gRNA sequence
agaggctgtgcaagagaatg

SEQ ID NO: 356076 - DNA, 20 bp, Artificial
  CRISPR gRNA sequence
aggctgtgcaagagaatggg

SEQ ID NO: 356077 - DNA, 20 bp, Artificial
  CRISPR gRNA sequence
ggctgtgcaagagaatgggg

SEQ ID NO: 356078 - DNA, 20 bp, Artificial
  CRISPR gRNA sequence
gctgtgcaagagaatgggga

SEQ ID NO: 356079 - DNA, 20 bp, Artificial
  CRISPR gRNA sequence
tgtgcaagagaatggggagg

SEQ ID NO: 356080 - DNA, 20 bp, Artificial
  CRISPR gRNA sequence
gagaatggggagggagataa

SEQ ID NO: 356081 - DNA, 20 bp, Artificial
  CRISPR gRNA sequence
agaatggggagggagataat

SEQ ID NO: 356082 - DNA, 20 bp, Artificial
  CRISPR gRNA sequence
aatggggagggagataatgg

SEQ ID NO: 356083 - DNA, 20 bp, Artificial
  CRISPR gRNA sequence
agggagataatgggagttgt

SEQ ID NO: 356084 - DNA, 20 bp, Artificial
  CRISPR gRNA sequence
ataatgggagttgttggtca

SEQ ID NO: 356085 - DNA, 20 bp, Artificial
  CRISPR gRNA sequence
aatgggagttgttggtcaaa

SEQ ID NO: 356086 - DNA, 20 bp, Artificial
  CRISPR gRNA sequence
ggtcaaagagtacaaaattt

SEQ ID NO: 356087 - DNA, 20 bp, Artificial
  CRISPR gRNA sequence
gtacaaaatttcagatacac

SEQ ID NO: 356088 - DNA, 20 bp, Artificial
  CRISPR gRNA sequence
tacaaaatttcagatacacg

SEQ ID NO: 356089 - DNA, 20 bp, Artificial
  CRISPR gRNA sequence
acaaaatttcagatacacga

SEQ ID NO: 356090 - DNA, 20 bp, Artificial
  CRISPR gRNA sequence
caaaatttcagatacacgag

SEQ ID NO: 356091 - DNA, 20 bp, Artificial
  CRISPR gRNA sequence
ttcagatacacgaggggaat

SEQ ID NO: 356092 - DNA, 20 bp, Artificial
  CRISPR gRNA sequence
acacgaggggaataagtctt

SEQ ID NO: 356093 - DNA, 20 bp, Artificial
  CRISPR gRNA sequence
tttctttttttttttttttt

SEQ ID NO: 356094 - DNA, 20 bp, Artificial
  CRISPR gRNA sequence
ttttttttttttttttgaga

SEQ ID NO: 356095 - DNA, 20 bp, Artificial
  CRISPR gRNA sequence
ttttttttttttttgagaca

SEQ ID NO: 356096 - DNA, 20 bp, Artificial
  CRISPR gRNA sequence
cagagtctcgttttgtcacc

SEQ ID NO: 356097 - DNA, 20 bp, Artificial
  CRISPR gRNA sequence
agagtctcgttttgtcaccc

SEQ ID NO: 356098 - DNA, 20 bp, Artificial
  CRISPR gRNA sequence
tctcgttttgtcacccaggc

SEQ ID NO: 356099 - DNA, 20 bp, Artificial
  CRISPR gRNA sequence
tcgttttgtcacccaggctg

SEQ ID NO: 356100 - DNA, 20 bp, Artificial
  CRISPR gRNA sequence
ttgtcacccaggctggagtg

SEQ ID NO: 356101 - DNA, 20 bp, Artificial
  CRISPR gRNA sequence
tcacccaggctggagtgcag

SEQ ID NO: 356102 - DNA, 20 bp, Artificial
  CRISPR gRNA sequence
ggagtgcagtggcacgatct

SEQ ID NO: 356103 - DNA, 20 bp, Artificial
  CRISPR gRNA sequence
tcactgcaacctccgcctcc

SEQ ID NO: 356104 - DNA, 20 bp, Artificial
  CRISPR gRNA sequence
cactgcaacctccgcctcct

SEQ ID NO: 356105 - DNA, 20 bp, Artificial
  CRISPR gRNA sequence
aacctccgcctcctgggttc

SEQ ID NO: 356106 - DNA, 20 bp, Artificial
  CRISPR gRNA sequence
ttcaagcgattctcctgcct

SEQ ID NO: 356107 - DNA, 20 bp, Artificial
  CRISPR gRNA sequence
ttctcctgcctcagccccct

SEQ ID NO: 356108 - DNA, 20 bp, Artificial
  CRISPR gRNA sequence
tcctgcctcagccccctgag

SEQ ID NO: 356109 - DNA, 20 bp, Artificial
  CRISPR gRNA sequence
gcctcagccccctgagtagc

SEQ ID NO: 356110 - DNA, 20 bp, Artificial
  CRISPR gRNA sequence
cctcagccccctgagtagct

SEQ ID NO: 356111 - DNA, 20 bp, Artificial
  CRISPR gRNA sequence
cccctgagtagctgggacta

SEQ ID NO: 356112 - DNA, 20 bp, Artificial
  CRISPR gRNA sequence
ccctgagtagctgggactac

SEQ ID NO: 356113 - DNA, 20 bp, Artificial
  CRISPR gRNA sequence
caggcgcccgccacaatgcc

SEQ ID NO: 356114 - DNA, 20 bp, Artificial
  CRISPR gRNA sequence
cccagctaatttttatattt

SEQ ID NO: 356115 - DNA, 20 bp, Artificial
  CRISPR gRNA sequence
agctaatttttatattttag

SEQ ID NO: 356116 - DNA, 20 bp, Artificial
  CRISPR gRNA sequence
ctaatttttatattttagta

SEQ ID NO: 356117 - DNA, 20 bp, Artificial
  CRISPR gRNA sequence
tttttatattttagtagaga

SEQ ID NO: 356118 - DNA, 20 bp, Artificial
  CRISPR gRNA sequence
ttttatattttagtagagat

SEQ ID NO: 356119 - DNA, 20 bp, Artificial
  CRISPR gRNA sequence
tttatattttagtagagatg

SEQ ID NO: 356120 - DNA, 20 bp, Artificial
  CRISPR gRNA sequence
gagatggggtttcaccatgt

SEQ ID NO: 356121 - DNA, 20 bp, Artificial
  CRISPR gRNA sequence
tttcaccatgttggccatgc

SEQ ID NO: 356122 - DNA, 20 bp, Artificial
  CRISPR gRNA sequence
ggtctcgaactcctgacctc

SEQ ID NO: 356123 - DNA, 20 bp, Artificial
  CRISPR gRNA sequence
gtctcgaactcctgacctcg

SEQ ID NO: 356124 - DNA, 20 bp, Artificial
  CRISPR gRNA sequence
tctcgaactcctgacctcga

SEQ ID NO: 356125 - DNA, 20 bp, Artificial
  CRISPR gRNA sequence
ctcgagggatccacctgcct

SEQ ID NO: 356126 - DNA, 20 bp, Artificial
  CRISPR gRNA sequence
ccacctgcctcggtctccta

SEQ ID NO: 356127 - DNA, 20 bp, Artificial
  CRISPR gRNA sequence
gcctcggtctcctaaagtgc

SEQ ID NO: 356128 - DNA, 20 bp, Artificial
  CRISPR gRNA sequence
ctcctaaagtgctggaatta

SEQ ID NO: 356129 - DNA, 20 bp, Artificial
  CRISPR gRNA sequence
tcctaaagtgctggaattac

SEQ ID NO: 356130 - DNA, 20 bp, Artificial
  CRISPR gRNA sequence
agtgctggaattacaggcgt

SEQ ID NO: 356131 - DNA, 20 bp, Artificial
  CRISPR gRNA sequence
ggaattacaggcgtgagcca

SEQ ID NO: 356132 - DNA, 20 bp, Artificial
  CRISPR gRNA sequence
caggcgtgagccacagcacc

SEQ ID NO: 356133 - DNA, 20 bp, Artificial
  CRISPR gRNA sequence
gtgagccacagcacccagcc

SEQ ID NO: 356134 - DNA, 20 bp, Artificial
  CRISPR gRNA sequence
acagcacccagccaagtttt

SEQ ID NO: 356135 - DNA, 20 bp, Artificial
  CRISPR gRNA sequence
aagttttaagatttatcata

SEQ ID NO: 356136 - DNA, 20 bp, Artificial
  CRISPR gRNA sequence
ttttaagatttatcatacag

SEQ ID NO: 356137 - DNA, 20 bp, Artificial
  CRISPR gRNA sequence
ttaagatttatcatacagca

SEQ ID NO: 356138 - DNA, 20 bp, Artificial
  CRISPR gRNA sequence
atcatacagcagagtctcta

SEQ ID NO: 356139 - DNA, 20 bp, Artificial
  CRISPR gRNA sequence
caataataatgtatacttca

SEQ ID NO: 356140 - DNA, 20 bp, Artificial
  CRISPR gRNA sequence
atgtatacttcaaagtgact

SEQ ID NO: 356141 - DNA, 20 bp, Artificial
  CRISPR gRNA sequence
agtaaatttcaaatatctca

SEQ ID NO: 356142 - DNA, 20 bp, Artificial
  CRISPR gRNA sequence
aaatttcaaatatctcacag

SEQ ID NO: 356143 - DNA, 20 bp, Artificial
  CRISPR gRNA sequence
atatctcacagtagaaatca

SEQ ID NO: 356144 - DNA, 20 bp, Artificial
  CRISPR gRNA sequence
tatctcacagtagaaatcat

SEQ ID NO: 356145 - DNA, 20 bp, Artificial
  CRISPR gRNA sequence
gtagaaatcataggtaaatg

SEQ ID NO: 356146 - DNA, 20 bp, Artificial
  CRISPR gRNA sequence
gaaatcataggtaaatgaag

SEQ ID NO: 356147 - DNA, 20 bp, Artificial
  CRISPR gRNA sequence
atcataggtaaatgaagtgg

SEQ ID NO: 356148 - DNA, 20 bp, Artificial
  CRISPR gRNA sequence
gaagtggtggatatgttaat

SEQ ID NO: 356149 - DNA, 20 bp, Artificial
  CRISPR gRNA sequence
atacatatgtcaaaatatca

SEQ ID NO: 356150 - DNA, 20 bp, Artificial
  CRISPR gRNA sequence
aaaataaaattaactttttt

SEQ ID NO: 356151 - DNA, 20 bp, Artificial
  CRISPR gRNA sequence
attaactttttttagatttt

SEQ ID NO: 356152 - DNA, 20 bp, Artificial
  CRISPR gRNA sequence
aagaaaataaactgaaatat

SEQ ID NO: 356153 - DNA, 20 bp, Artificial
  CRISPR gRNA sequence
attagaccttgttttgtgta

SEQ ID NO: 356154 - DNA, 20 bp, Artificial
  CRISPR gRNA sequence
gaccttgttttgtgtacaga

SEQ ID NO: 356155 - DNA, 20 bp, Artificial
  CRISPR gRNA sequence
gtgtacagatggaccataat

SEQ ID NO: 356156 - DNA, 20 bp, Artificial
  CRISPR gRNA sequence
acagatggaccataatgagt

SEQ ID NO: 356157 - DNA, 20 bp, Artificial
  CRISPR gRNA sequence
ccataatgagtgagttcaca

SEQ ID NO: 356158 - DNA, 20 bp, Artificial
  CRISPR gRNA sequence
ataatgagtgagttcacaca

SEQ ID NO: 356159 - DNA, 20 bp, Artificial
  CRISPR gRNA sequence
atgagtgagttcacacagag

SEQ ID NO: 356160 - DNA, 20 bp, Artificial
  CRISPR gRNA sequence
gagttcacacagagcagatg

SEQ ID NO: 356161 - DNA, 20 bp, Artificial
  CRISPR gRNA sequence
agttcacacagagcagatgt

SEQ ID NO: 356162 - DNA, 20 bp, Artificial
  CRISPR gRNA sequence
cacacagagcagatgtgggt

SEQ ID NO: 356163 - DNA, 20 bp, Artificial
  CRISPR gRNA sequence
agcagatgtgggtgagctga

SEQ ID NO: 356164 - DNA, 20 bp, Artificial
  CRISPR gRNA sequence
gctgacagattctgcattat

SEQ ID NO: 356165 - DNA, 20 bp, Artificial
  CRISPR gRNA sequence
ctgacagattctgcattatc

SEQ ID NO: 356166 - DNA, 20 bp, Artificial
  CRISPR gRNA sequence
ctgcattatcaggtcataca

SEQ ID NO: 356167 - DNA, 20 bp, Artificial
  CRISPR gRNA sequence
attcaacctttgtcccactt

SEQ ID NO: 356168 - DNA, 20 bp, Artificial
  CRISPR gRNA sequence
ctttgtcccactttagacat

SEQ ID NO: 356169 - DNA, 20 bp, Artificial
  CRISPR gRNA sequence
agacattggtttattgaaaa

SEQ ID NO: 356170 - DNA, 20 bp, Artificial
  CRISPR gRNA sequence
acattggtttattgaaaaca

SEQ ID NO: 356171 - DNA, 20 bp, Artificial
  CRISPR gRNA sequence
gtttattgaaaacagagact

SEQ ID NO: 356172 - DNA, 20 bp, Artificial
  CRISPR gRNA sequence
tttattgaaaacagagactg

SEQ ID NO: 356173 - DNA, 20 bp, Artificial
  CRISPR gRNA sequence
tattgaaaacagagactgag

SEQ ID NO: 356174 - DNA, 20 bp, Artificial
  CRISPR gRNA sequence
aaaacagagactgaggagaa

SEQ ID NO: 356175 - DNA, 20 bp, Artificial
  CRISPR gRNA sequence
gagactgaggagaaaagcct

SEQ ID NO: 356176 - DNA, 20 bp, Artificial
  CRISPR gRNA sequence
agactgaggagaaaagcctt

SEQ ID NO: 356177 - DNA, 20 bp, Artificial
  CRISPR gRNA sequence
gactgaggagaaaagccttg

SEQ ID NO: 356178 - DNA, 20 bp, Artificial
  CRISPR gRNA sequence
aggagaaaagccttggggcc

SEQ ID NO: 356179 - DNA, 20 bp, Artificial
  CRISPR gRNA sequence
tgtcttctaattctttcccc

SEQ ID NO: 356180 - DNA, 20 bp, Artificial
  CRISPR gRNA sequence
cttctaattctttcccctgg

SEQ ID NO: 356181 - DNA, 20 bp, Artificial
  CRISPR gRNA sequence
ttcccctggaagacttcaca

SEQ ID NO: 356182 - DNA, 20 bp, Artificial
  CRISPR gRNA sequence
tcccctggaagacttcacat

SEQ ID NO: 356183 - DNA, 20 bp, Artificial
  CRISPR gRNA sequence
aggacacttaatgttttaaa

SEQ ID NO: 356184 - DNA, 20 bp, Artificial
  CRISPR gRNA sequence
atgttttaaacagttttttt

SEQ ID NO: 356185 - DNA, 20 bp, Artificial
  CRISPR gRNA sequence
atgatgataaaattaaccac

SEQ ID NO: 356186 - DNA, 20 bp, Artificial
  CRISPR gRNA sequence
tgatgataaaattaaccaca

SEQ ID NO: 356187 - DNA, 20 bp, Artificial
  CRISPR gRNA sequence
gatgataaaattaaccacaa

SEQ ID NO: 356188 - DNA, 20 bp, Artificial
  CRISPR gRNA sequence
gataaaattaaccacaaggg

SEQ ID NO: 356189 - DNA, 20 bp, Artificial
  CRISPR gRNA sequence
ttaaccacaagggtagctat

SEQ ID NO: 356190 - DNA, 20 bp, Artificial
  CRISPR gRNA sequence
gtagctatgagatttaaatc

SEQ ID NO: 356191 - DNA, 20 bp, Artificial
  CRISPR gRNA sequence
tgagatttaaatcaagcatg

SEQ ID NO: 356192 - DNA, 20 bp, Artificial
  CRISPR gRNA sequence
agatttaaatcaagcatgca

SEQ ID NO: 356193 - DNA, 20 bp, Artificial
  CRISPR gRNA sequence
gatttaaatcaagcatgcag

SEQ ID NO: 356194 - DNA, 20 bp, Artificial
  CRISPR gRNA sequence
ttaaatcaagcatgcagagg

SEQ ID NO: 356195 - DNA, 20 bp, Artificial
  CRISPR gRNA sequence
agaggtggtttcaacatttt

SEQ ID NO: 356196 - DNA, 20 bp, Artificial
  CRISPR gRNA sequence
attttaagcgccaaacgatt

SEQ ID NO: 356197 - DNA, 20 bp, Artificial
  CRISPR gRNA sequence
ttttaagcgccaaacgattt

SEQ ID NO: 356198 - DNA, 20 bp, Artificial
  CRISPR gRNA sequence
atatgcatttatattttacg

SEQ ID NO: 356199 - DNA, 20 bp, Artificial
  CRISPR gRNA sequence
tacgtagacacattccaaat

SEQ ID NO: 356200 - DNA, 20 bp, Artificial
  CRISPR gRNA sequence
acgtagacacattccaaatg

SEQ ID NO: 356201 - DNA, 20 bp, Artificial
  CRISPR gRNA sequence
cgtagacacattccaaatga

SEQ ID NO: 356202 - DNA, 20 bp, Artificial
  CRISPR gRNA sequence
cattccaaatgagggttaat

SEQ ID NO: 356203 - DNA, 20 bp, Artificial
  CRISPR gRNA sequence
gtttctatttttttcatgtt

SEQ ID NO: 356204 - DNA, 20 bp, Artificial
  CRISPR gRNA sequence
catgttgagatgtcacattg

SEQ ID NO: 356205 - DNA, 20 bp, Artificial
  CRISPR gRNA sequence
gttgagatgtcacattgaag

SEQ ID NO: 356206 - DNA, 20 bp, Artificial
  CRISPR gRNA sequence
cacattgaagtagtcgtgta

SEQ ID NO: 356207 - DNA, 20 bp, Artificial
  CRISPR gRNA sequence
attgaagtagtcgtgtacag

SEQ ID NO: 356208 - DNA, 20 bp, Artificial
  CRISPR gRNA sequence
tgaagtagtcgtgtacagca

SEQ ID NO: 356209 - DNA, 20 bp, Artificial
  CRISPR gRNA sequence
gcagagcatgcttgctcctg

SEQ ID NO: 356210 - DNA, 20 bp, Artificial
  CRISPR gRNA sequence
agcatgcttgctcctgcagc

SEQ ID NO: 356211 - DNA, 20 bp, Artificial
  CRISPR gRNA sequence
tgcagctagactcgccttcc

SEQ ID NO: 356212 - DNA, 20 bp, Artificial
  CRISPR gRNA sequence
gcagctagactcgccttcct

SEQ ID NO: 356213 - DNA, 20 bp, Artificial
  CRISPR gRNA sequence
cagctagactcgccttcctg

SEQ ID NO: 356214 - DNA, 20 bp, Artificial
  CRISPR gRNA sequence
tagactcgccttcctgggga

SEQ ID NO: 356215 - DNA, 20 bp, Artificial
  CRISPR gRNA sequence
agactcgccttcctggggaa

SEQ ID NO: 356216 - DNA, 20 bp, Artificial
  CRISPR gRNA sequence
cgccttcctggggaaaggca

SEQ ID NO: 356217 - DNA, 20 bp, Artificial
  CRISPR gRNA sequence
gccttcctggggaaaggcac

SEQ ID NO: 356218 - DNA, 20 bp, Artificial
  CRISPR gRNA sequence
gggaaaggcacaggtactgt

SEQ ID NO: 356219 - DNA, 20 bp, Artificial
  CRISPR gRNA sequence
ctatacaataactgttgcct

SEQ ID NO: 356220 - DNA, 20 bp, Artificial
  CRISPR gRNA sequence
tacaataactgttgccttgg

SEQ ID NO: 356221 - DNA, 20 bp, Artificial
  CRISPR gRNA sequence
ctgttgccttggcagaccac

SEQ ID NO: 356222 - DNA, 20 bp, Artificial
  CRISPR gRNA sequence
tggcagaccaccggaaataa

SEQ ID NO: 356223 - DNA, 20 bp, Artificial
  CRISPR gRNA sequence
cagaccaccggaaataatag

SEQ ID NO: 356224 - DNA, 20 bp, Artificial
  CRISPR gRNA sequence
ccggaaataatagtagcaca

SEQ ID NO: 356225 - DNA, 20 bp, Artificial
  CRISPR gRNA sequence
tgcctgaaatacgcatcacg

SEQ ID NO: 356226 - DNA, 20 bp, Artificial
  CRISPR gRNA sequence
aatacgcatcacgtggatat

SEQ ID NO: 356227 - DNA, 20 bp, Artificial
  CRISPR gRNA sequence
gcatcacgtggatattggta

SEQ ID NO: 356228 - DNA, 20 bp, Artificial
  CRISPR gRNA sequence
tggtatggtaatattattcc

SEQ ID NO: 356229 - DNA, 20 bp, Artificial
  CRISPR gRNA sequence
aatattattccaagttttca

SEQ ID NO: 356230 - DNA, 20 bp, Artificial
  CRISPR gRNA sequence
atattattccaagttttcaa

SEQ ID NO: 356231 - DNA, 20 bp, Artificial
  CRISPR gRNA sequence
aaaggtcaactttctttgtc

SEQ ID NO: 356232 - DNA, 20 bp, Artificial
  CRISPR gRNA sequence
ctttctttgtccagataaat

SEQ ID NO: 356233 - DNA, 20 bp, Artificial
  CRISPR gRNA sequence
cagttttatactctgtattt

SEQ ID NO: 356234 - DNA, 20 bp, Artificial
  CRISPR gRNA sequence
agaaacctttctgtgtttta

SEQ ID NO: 356235 - DNA, 20 bp, Artificial
  CRISPR gRNA sequence
acctttctgtgttttatagc

SEQ ID NO: 356236 - DNA, 20 bp, Artificial
  CRISPR gRNA sequence
tttctgtgttttatagctag

SEQ ID NO: 356237 - DNA, 20 bp, Artificial
  CRISPR gRNA sequence
ttctgtgttttatagctaga

SEQ ID NO: 356238 - DNA, 20 bp, Artificial
  CRISPR gRNA sequence
gttttatagctagaaggtcc

SEQ ID NO: 356239 - DNA, 20 bp, Artificial
  CRISPR gRNA sequence
tttatagctagaaggtccta

SEQ ID NO: 356240 - DNA, 20 bp, Artificial
  CRISPR gRNA sequence
cctagagtgtaaattatttt

SEQ ID NO: 356241 - DNA, 20 bp, Artificial
  CRISPR gRNA sequence
tagagtgtaaattattttca

SEQ ID NO: 356242 - DNA, 20 bp, Artificial
  CRISPR gRNA sequence
aaattattttcagagaatta

SEQ ID NO: 356243 - DNA, 20 bp, Artificial
  CRISPR gRNA sequence
aattattttcagagaattaa

SEQ ID NO: 356244 - DNA, 20 bp, Artificial
  CRISPR gRNA sequence
attattttcagagaattaaa

SEQ ID NO: 356245 - DNA, 20 bp, Artificial
  CRISPR gRNA sequence
ttcagagaattaaagggcca

SEQ ID NO: 356246 - DNA, 20 bp, Artificial
  CRISPR gRNA sequence
caacctctaatccttcttct

SEQ ID NO: 356247 - DNA, 20 bp, Artificial
  CRISPR gRNA sequence
taatccttcttctgagtaaa

SEQ ID NO: 356248 - DNA, 20 bp, Artificial
  CRISPR gRNA sequence
actacttttcctcaaaataa

SEQ ID NO: 356249 - DNA, 20 bp, Artificial
  CRISPR gRNA sequence
cctcaaaataaaagtattat

SEQ ID NO: 356250 - DNA, 20 bp, Artificial
  CRISPR gRNA sequence
ctcaaaataaaagtattatc

SEQ ID NO: 356251 - DNA, 20 bp, Artificial
  CRISPR gRNA sequence
agtattatcaggttttaact

SEQ ID NO: 356252 - DNA, 20 bp, Artificial
  CRISPR gRNA sequence
aggttttaactaagaaacat

SEQ ID NO: 356253 - DNA, 20 bp, Artificial
  CRISPR gRNA sequence
ggttttaactaagaaacata

SEQ ID NO: 356254 - DNA, 20 bp, Artificial
  CRISPR gRNA sequence
taactaagaaacataaggcc

SEQ ID NO: 356255 - DNA, 20 bp, Artificial
  CRISPR gRNA sequence
actaagaaacataaggccca

SEQ ID NO: 356256 - DNA, 20 bp, Artificial
  CRISPR gRNA sequence
aaataatttttctgtcatta

SEQ ID NO: 356257 - DNA, 20 bp, Artificial
  CRISPR gRNA sequence
ataatttttctgtcattata

SEQ ID NO: 356258 - DNA, 20 bp, Artificial
  CRISPR gRNA sequence
tctgtcattatagagcaaac

SEQ ID NO: 356259 - DNA, 20 bp, Artificial
  CRISPR gRNA sequence
tcattatagagcaaaccagt

SEQ ID NO: 356260 - DNA, 20 bp, Artificial
  CRISPR gRNA sequence
cattatagagcaaaccagtg

SEQ ID NO: 356261 - DNA, 20 bp, Artificial
  CRISPR gRNA sequence
attatagagcaaaccagtga

SEQ ID NO: 356262 - DNA, 20 bp, Artificial
  CRISPR gRNA sequence
atagagcaaaccagtgaggg

SEQ ID NO: 356263 - DNA, 20 bp, Artificial
  CRISPR gRNA sequence
agcaaaccagtgagggaagc

SEQ ID NO: 356264 - DNA, 20 bp, Artificial
  CRISPR gRNA sequence
agtgagggaagcaagcttcc

SEQ ID NO: 356265 - DNA, 20 bp, Artificial
  CRISPR gRNA sequence
agcaagcttcctagctgatg

SEQ ID NO: 356266 - DNA, 20 bp, Artificial
  CRISPR gRNA sequence
ctacaatttgcctctcttga

SEQ ID NO: 356267 - DNA, 20 bp, Artificial
  CRISPR gRNA sequence
cctctcttgatggcaaatta

SEQ ID NO: 356268 - DNA, 20 bp, Artificial
  CRISPR gRNA sequence
atggcaaattatagcaaaat

SEQ ID NO: 356269 - DNA, 20 bp, Artificial
  CRISPR gRNA sequence
ttatagcaaaattagtatat

SEQ ID NO: 356270 - DNA, 20 bp, Artificial
  CRISPR gRNA sequence
tatagcaaaattagtatatc

SEQ ID NO: 356271 - DNA, 20 bp, Artificial
  CRISPR gRNA sequence
agcaaaattagtatatcagg

SEQ ID NO: 356272 - DNA, 20 bp, Artificial
  CRISPR gRNA sequence
gcaaaattagtatatcaggt

SEQ ID NO: 356273 - DNA, 20 bp, Artificial
  CRISPR gRNA sequence
ttgaaaatacttgtcccaaa

SEQ ID NO: 356274 - DNA, 20 bp, Artificial
  CRISPR gRNA sequence
caaatagtttaaacacttta

SEQ ID NO: 356275 - DNA, 20 bp, Artificial
  CRISPR gRNA sequence
aaatagtttaaacactttaa

SEQ ID NO: 356276 - DNA, 20 bp, Artificial
  CRISPR gRNA sequence
aacactttaaaggtttatgt

SEQ ID NO: 356277 - DNA, 20 bp, Artificial
  CRISPR gRNA sequence
tttaaaggtttatgtcagtt

SEQ ID NO: 356278 - DNA, 20 bp, Artificial
  CRISPR gRNA sequence
agttgagaaacatataccct

SEQ ID NO: 356279 - DNA, 20 bp, Artificial
  CRISPR gRNA sequence
gagaaacatataccctaaga

SEQ ID NO: 356280 - DNA, 20 bp, Artificial
  CRISPR gRNA sequence
tacgttttacctacacaata

SEQ ID NO: 356281 - DNA, 20 bp, Artificial
  CRISPR gRNA sequence
acaatatagaatgactgtat

SEQ ID NO: 356282 - DNA, 20 bp, Artificial
  CRISPR gRNA sequence
actgtattagctacttcttc

SEQ ID NO: 356283 - DNA, 20 bp, Artificial
  CRISPR gRNA sequence
cttcttctggtgcgataatg

SEQ ID NO: 356284 - DNA, 20 bp, Artificial
  CRISPR gRNA sequence
tgcgataatgtagcatcatt

SEQ ID NO: 356285 - DNA, 20 bp, Artificial
  CRISPR gRNA sequence
tgtagcatcattcagtactg

SEQ ID NO: 356286 - DNA, 20 bp, Artificial
  CRISPR gRNA sequence
gtagcatcattcagtactgt

SEQ ID NO: 356287 - DNA, 20 bp, Artificial
  CRISPR gRNA sequence
cattcagtactgtgggccat

SEQ ID NO: 356288 - DNA, 20 bp, Artificial
  CRISPR gRNA sequence
tgtgggccataagttctcca

SEQ ID NO: 356289 - DNA, 20 bp, Artificial
  CRISPR gRNA sequence
cataagttctccacagtgat

SEQ ID NO: 356290 - DNA, 20 bp, Artificial
  CRISPR gRNA sequence
tctccacagtgattggtgta

SEQ ID NO: 356291 - DNA, 20 bp, Artificial
  CRISPR gRNA sequence
cacagtgattggtgtatggc

SEQ ID NO: 356292 - DNA, 20 bp, Artificial
  CRISPR gRNA sequence
acagtgattggtgtatggca

SEQ ID NO: 356293 - DNA, 20 bp, Artificial
  CRISPR gRNA sequence
ggtgtatggcaaggatattt

SEQ ID NO: 356294 - DNA, 20 bp, Artificial
  CRISPR gRNA sequence
tatggcaaggatatttaagt

SEQ ID NO: 356295 - DNA, 20 bp, Artificial
  CRISPR gRNA sequence
ggatatttaagtgagcacat

SEQ ID NO: 356296 - DNA, 20 bp, Artificial
  CRISPR gRNA sequence
gatatttaagtgagcacatg

SEQ ID NO: 356297 - DNA, 20 bp, Artificial
  CRISPR gRNA sequence
taagtgagcacatgaggaca

SEQ ID NO: 356298 - DNA, 20 bp, Artificial
  CRISPR gRNA sequence
agtgagcacatgaggacaaa

SEQ ID NO: 356299 - DNA, 20 bp, Artificial
  CRISPR gRNA sequence
agcacatgaggacaaagaga

SEQ ID NO: 356300 - DNA, 20 bp, Artificial
  CRISPR gRNA sequence
gcacatgaggacaaagagat

SEQ ID NO: 356301 - DNA, 20 bp, Artificial
  CRISPR gRNA sequence
ttcaaattgacacatttatt

SEQ ID NO: 356302 - DNA, 20 bp, Artificial
  CRISPR gRNA sequence
atttattgagaaaaatgtta

SEQ ID NO: 356303 - DNA, 20 bp, Artificial
  CRISPR gRNA sequence
tacggctgactcctttgtat

SEQ ID NO: 356304 - DNA, 20 bp, Artificial
  CRISPR gRNA sequence
atttttacccaaatatttct

SEQ ID NO: 356305 - DNA, 20 bp, Artificial
  CRISPR gRNA sequence
ttttatgaacatattattta

SEQ ID NO: 356306 - DNA, 20 bp, Artificial
  CRISPR gRNA sequence
ttatgaacatattatttaaa

SEQ ID NO: 356307 - DNA, 20 bp, Artificial
  CRISPR gRNA sequence
tattatttaaagagactata

SEQ ID NO: 356308 - DNA, 20 bp, Artificial
  CRISPR gRNA sequence
agactatatagatgcttcaa

SEQ ID NO: 356309 - DNA, 20 bp, Artificial
  CRISPR gRNA sequence
tatatagatgcttcaaaagt

SEQ ID NO: 356310 - DNA, 20 bp, Artificial
  CRISPR gRNA sequence
gcttcaaaagtcagaatgtc

SEQ ID NO: 356311 - DNA, 20 bp, Artificial
  CRISPR gRNA sequence
ttcaaaagtcagaatgtcaa

SEQ ID NO: 356312 - DNA, 20 bp, Artificial
  CRISPR gRNA sequence
acatacctttctcactgtct

SEQ ID NO: 356313 - DNA, 20 bp, Artificial
  CRISPR gRNA sequence
ttctcactgtcttagtgaat

SEQ ID NO: 356314 - DNA, 20 bp, Artificial
  CRISPR gRNA sequence
tgtcttagtgaattagtgtg

SEQ ID NO: 356315 - DNA, 20 bp, Artificial
  CRISPR gRNA sequence
tagtgaattagtgtgcagaa

SEQ ID NO: 356316 - DNA, 20 bp, Artificial
  CRISPR gRNA sequence
gtgaattagtgtgcagaaaa

SEQ ID NO: 356317 - DNA, 20 bp, Artificial
  CRISPR gRNA sequence
tgtgcagaaaagagttcatg

SEQ ID NO: 356318 - DNA, 20 bp, Artificial
  CRISPR gRNA sequence
gcagaaaagagttcatgtag

SEQ ID NO: 356319 - DNA, 20 bp, Artificial
  CRISPR gRNA sequence
cagaaaagagttcatgtagc

SEQ ID NO: 356320 - DNA, 20 bp, Artificial
  CRISPR gRNA sequence
aagagttcatgtagcaggct

SEQ ID NO: 356321 - DNA, 20 bp, Artificial
  CRISPR gRNA sequence
catgtagcaggcttggattc

SEQ ID NO: 356322 - DNA, 20 bp, Artificial
  CRISPR gRNA sequence
atgtagcaggcttggattct

SEQ ID NO: 356323 - DNA, 20 bp, Artificial
  CRISPR gRNA sequence
tctgggtgatcctcctgcct

SEQ ID NO: 356324 - DNA, 20 bp, Artificial
  CRISPR gRNA sequence
tcctcctgcctcagcctccc

SEQ ID NO: 356325 - DNA, 20 bp, Artificial
  CRISPR gRNA sequence
tcctgcctcagcctcccaag

SEQ ID NO: 356326 - DNA, 20 bp, Artificial
  CRISPR gRNA sequence
gcctcagcctcccaagtagc

SEQ ID NO: 356327 - DNA, 20 bp, Artificial
  CRISPR gRNA sequence
cctcagcctcccaagtagct

SEQ ID NO: 356328 - DNA, 20 bp, Artificial
  CRISPR gRNA sequence
ctcccaagtagctgggacca

SEQ ID NO: 356329 - DNA, 20 bp, Artificial
  CRISPR gRNA sequence
tcccaagtagctgggaccac

SEQ ID NO: 356330 - DNA, 20 bp, Artificial
  CRISPR gRNA sequence
ggaccacaggcacatgccac

SEQ ID NO: 356331 - DNA, 20 bp, Artificial
  CRISPR gRNA sequence
gaccacaggcacatgccacc

SEQ ID NO: 356332 - DNA, 20 bp, Artificial
  CRISPR gRNA sequence
caggcacatgccaccaggcc

SEQ ID NO: 356333 - DNA, 20 bp, Artificial
  CRISPR gRNA sequence
acatttttttaaattgtttg

SEQ ID NO: 356334 - DNA, 20 bp, Artificial
  CRISPR gRNA sequence
atttttttaaattgtttgta

SEQ ID NO: 356335 - DNA, 20 bp, Artificial
  CRISPR gRNA sequence
tttaaattgtttgtagagac

SEQ ID NO: 356336 - DNA, 20 bp, Artificial
  CRISPR gRNA sequence
caagatctcgctatgttgct

SEQ ID NO: 356337 - DNA, 20 bp, Artificial
  CRISPR gRNA sequence
aagatctcgctatgttgctc

SEQ ID NO: 356338 - DNA, 20 bp, Artificial
  CRISPR gRNA sequence
tctcgctatgttgctcaggc

SEQ ID NO: 356339 - DNA, 20 bp, Artificial
  CRISPR gRNA sequence
ctcgctatgttgctcaggct

SEQ ID NO: 356340 - DNA, 20 bp, Artificial
  CRISPR gRNA sequence
tcgctatgttgctcaggctg

SEQ ID NO: 356341 - DNA, 20 bp, Artificial
  CRISPR gRNA sequence
ctcaggctggggttgaactc

SEQ ID NO: 356342 - DNA, 20 bp, Artificial
  CRISPR gRNA sequence
ggggttgaactctagacctc

SEQ ID NO: 356343 - DNA, 20 bp, Artificial
  CRISPR gRNA sequence
gttgaactctagacctcaag

SEQ ID NO: 356344 - DNA, 20 bp, Artificial
  CRISPR gRNA sequence
ctcaagcagtcctactgaaa

SEQ ID NO: 356345 - DNA, 20 bp, Artificial
  CRISPR gRNA sequence
cctactgaaatggcctccca

SEQ ID NO: 356346 - DNA, 20 bp, Artificial
  CRISPR gRNA sequence
gaaatggcctcccaaagcat

SEQ ID NO: 356347 - DNA, 20 bp, Artificial
  CRISPR gRNA sequence
aaatggcctcccaaagcatt

SEQ ID NO: 356348 - DNA, 20 bp, Artificial
  CRISPR gRNA sequence
ctcccaaagcattgggatta

SEQ ID NO: 356349 - DNA, 20 bp, Artificial
  CRISPR gRNA sequence
tcccaaagcattgggattac

SEQ ID NO: 356350 - DNA, 20 bp, Artificial
  CRISPR gRNA sequence
caaagcattgggattacagg

SEQ ID NO: 356351 - DNA, 20 bp, Artificial
  CRISPR gRNA sequence
aaagcattgggattacaggc

SEQ ID NO: 356352 - DNA, 20 bp, Artificial
  CRISPR gRNA sequence
agcattgggattacaggcag

SEQ ID NO: 356353 - DNA, 20 bp, Artificial
  CRISPR gRNA sequence
caggcaggagccaccacgcc

SEQ ID NO: 356354 - DNA, 20 bp, Artificial
  CRISPR gRNA sequence
gagccaccacgcctggctcc

SEQ ID NO: 356355 - DNA, 20 bp, Artificial
  CRISPR gRNA sequence
agccaccacgcctggctcca

SEQ ID NO: 356356 - DNA, 20 bp, Artificial
  CRISPR gRNA sequence
gccaccacgcctggctccaa

SEQ ID NO: 356357 - DNA, 20 bp, Artificial
  CRISPR gRNA sequence
ctggctccaagggattatta

SEQ ID NO: 356358 - DNA, 20 bp, Artificial
  CRISPR gRNA sequence
tattatggacacttgactct

SEQ ID NO: 356359 - DNA, 20 bp, Artificial
  CRISPR gRNA sequence
ggacacttgactctgagtca

SEQ ID NO: 356360 - DNA, 20 bp, Artificial
  CRISPR gRNA sequence
cttgactctgagtcaaagcc

SEQ ID NO: 356361 - DNA, 20 bp, Artificial
  CRISPR gRNA sequence
ctctgagtcaaagcctagcc

SEQ ID NO: 356362 - DNA, 20 bp, Artificial
  CRISPR gRNA sequence
tagccaagactgtttctgtt

SEQ ID NO: 356363 - DNA, 20 bp, Artificial
  CRISPR gRNA sequence
tttctgtttagctttatttc

SEQ ID NO: 356364 - DNA, 20 bp, Artificial
  CRISPR gRNA sequence
tgcttttgtgttcatgtctg

SEQ ID NO: 356365 - DNA, 20 bp, Artificial
  CRISPR gRNA sequence
agacatgtcttgattgaaat

SEQ ID NO: 356366 - DNA, 20 bp, Artificial
  CRISPR gRNA sequence
gacatgtcttgattgaaatc

SEQ ID NO: 356367 - DNA, 20 bp, Artificial
  CRISPR gRNA sequence
tcttgattgaaatcaggaat

SEQ ID NO: 356368 - DNA, 20 bp, Artificial
  CRISPR gRNA sequence
ggaattagaaattaaatgcc

SEQ ID NO: 356369 - DNA, 20 bp, Artificial
  CRISPR gRNA sequence
taaatgccaagtccataaaa

SEQ ID NO: 356370 - DNA, 20 bp, Artificial
  CRISPR gRNA sequence
atgccaagtccataaaaaag

SEQ ID NO: 356371 - DNA, 20 bp, Artificial
  CRISPR gRNA sequence
agtccataaaaaagaagatg

SEQ ID NO: 356372 - DNA, 20 bp, Artificial
  CRISPR gRNA sequence
ccataaaaaagaagatgaag

SEQ ID NO: 356373 - DNA, 20 bp, Artificial
  CRISPR gRNA sequence
gaagatgaagtagatgcaac

SEQ ID NO: 356374 - DNA, 20 bp, Artificial
  CRISPR gRNA sequence
gatgcaacaagttctctgct

SEQ ID NO: 356375 - DNA, 20 bp, Artificial
  CRISPR gRNA sequence
aacaagttctctgcttggat

SEQ ID NO: 356376 - DNA, 20 bp, Artificial
  CRISPR gRNA sequence
gttctctgcttggataagca

SEQ ID NO: 356377 - DNA, 20 bp, Artificial
  CRISPR gRNA sequence
ctctgcttggataagcatag

SEQ ID NO: 356378 - DNA, 20 bp, Artificial
  CRISPR gRNA sequence
gcttggataagcatagcagt

SEQ ID NO: 356379 - DNA, 20 bp, Artificial
  CRISPR gRNA sequence
gcatagcagtgagactgtca

SEQ ID NO: 356380 - DNA, 20 bp, Artificial
  CRISPR gRNA sequence
actgtcacctttgactcata

SEQ ID NO: 356381 - DNA, 20 bp, Artificial
  CRISPR gRNA sequence
ttgactcataaagtgtctct

SEQ ID NO: 356382 - DNA, 20 bp, Artificial
  CRISPR gRNA sequence
tgactcataaagtgtctctt

SEQ ID NO: 356383 - DNA, 20 bp, Artificial
  CRISPR gRNA sequence
taaagtgtctcttgggaatc

SEQ ID NO: 356384 - DNA, 20 bp, Artificial
  CRISPR gRNA sequence
aatctggcttcctgtcataa

SEQ ID NO: 356385 - DNA, 20 bp, Artificial
  CRISPR gRNA sequence
ctggcttcctgtcataacag

SEQ ID NO: 356386 - DNA, 20 bp, Artificial
  CRISPR gRNA sequence
ttataacaataaaaaaaacc

SEQ ID NO: 356387 - DNA, 20 bp, Artificial
  CRISPR gRNA sequence
ataaaaaaaacctagaaaaa

SEQ ID NO: 356388 - DNA, 20 bp, Artificial
  CRISPR gRNA sequence
cctagaaaaatggcaaaaaa

SEQ ID NO: 356389 - DNA, 20 bp, Artificial
  CRISPR gRNA sequence
aaatggcaaaaaatagacta

SEQ ID NO: 356390 - DNA, 20 bp, Artificial
  CRISPR gRNA sequence
aaaatagactatggaatatt

SEQ ID NO: 356391 - DNA, 20 bp, Artificial
  CRISPR gRNA sequence
aaatagactatggaatattg

SEQ ID NO: 356392 - DNA, 20 bp, Artificial
  CRISPR gRNA sequence
gaatattgaggaaaacaaac

SEQ ID NO: 356393 - DNA, 20 bp, Artificial
  CRISPR gRNA sequence
aatattgaggaaaacaaacg

SEQ ID NO: 356394 - DNA, 20 bp, Artificial
  CRISPR gRNA sequence
attgaggaaaacaaacgagg

SEQ ID NO: 356395 - DNA, 20 bp, Artificial
  CRISPR gRNA sequence
ttgaggaaaacaaacgaggt

SEQ ID NO: 356396 - DNA, 20 bp, Artificial
  CRISPR gRNA sequence
acgaggtaggtgatgctttg

SEQ ID NO: 356397 - DNA, 20 bp, Artificial
  CRISPR gRNA sequence
ggtaggtgatgctttgtagt

SEQ ID NO: 356398 - DNA, 20 bp, Artificial
  CRISPR gRNA sequence
ggtgatgctttgtagtgagc

SEQ ID NO: 356399 - DNA, 20 bp, Artificial
  CRISPR gRNA sequence
gtgatgctttgtagtgagcg

SEQ ID NO: 356400 - DNA, 20 bp, Artificial
  CRISPR gRNA sequence
tgatgctttgtagtgagcga

SEQ ID NO: 356401 - DNA, 20 bp, Artificial
  CRISPR gRNA sequence
gatgctttgtagtgagcgag

SEQ ID NO: 356402 - DNA, 20 bp, Artificial
  CRISPR gRNA sequence
attcaaacaaacaaacatac

SEQ ID NO: 356403 - DNA, 20 bp, Artificial
  CRISPR gRNA sequence
tcaaacaaacaaacatacaa

SEQ ID NO: 356404 - DNA, 20 bp, Artificial
  CRISPR gRNA sequence
acaaacatacaagagtataa

SEQ ID NO: 356405 - DNA, 20 bp, Artificial
  CRISPR gRNA sequence
atacaagagtataatggcac

SEQ ID NO: 356406 - DNA, 20 bp, Artificial
  CRISPR gRNA sequence
tacaagagtataatggcaca

SEQ ID NO: 356407 - DNA, 20 bp, Artificial
  CRISPR gRNA sequence
taatggcacaaggtaattta

SEQ ID NO: 356408 - DNA, 20 bp, Artificial
  CRISPR gRNA sequence
tggcacaaggtaatttaaag

SEQ ID NO: 356409 - DNA, 20 bp, Artificial
  CRISPR gRNA sequence
ggcacaaggtaatttaaagc

SEQ ID NO: 356410 - DNA, 20 bp, Artificial
  CRISPR gRNA sequence
gcacaaggtaatttaaagcg

SEQ ID NO: 356411 - DNA, 20 bp, Artificial
  CRISPR gRNA sequence
tctcattatatcccaccaca

SEQ ID NO: 356412 - DNA, 20 bp, Artificial
  CRISPR gRNA sequence
tcattatatcccaccacata

SEQ ID NO: 356413 - DNA, 20 bp, Artificial
  CRISPR gRNA sequence
atatcccaccacatagagca

SEQ ID NO: 356414 - DNA, 20 bp, Artificial
  CRISPR gRNA sequence
caccacatagagcaaagcgc

SEQ ID NO: 356415 - DNA, 20 bp, Artificial
  CRISPR gRNA sequence
atagagcaaagcgcaagact

SEQ ID NO: 356416 - DNA, 20 bp, Artificial
  CRISPR gRNA sequence
aaagcgcaagacttggtgct

SEQ ID NO: 356417 - DNA, 20 bp, Artificial
  CRISPR gRNA sequence
agcgcaagacttggtgctca

SEQ ID NO: 356418 - DNA, 20 bp, Artificial
  CRISPR gRNA sequence
gcgcaagacttggtgctcag

SEQ ID NO: 356419 - DNA, 20 bp, Artificial
  CRISPR gRNA sequence
acttggtgctcagaggacac

SEQ ID NO: 356420 - DNA, 20 bp, Artificial
  CRISPR gRNA sequence
cttggtgctcagaggacacc

SEQ ID NO: 356421 - DNA, 20 bp, Artificial
  CRISPR gRNA sequence
gtgctcagaggacaccagga

SEQ ID NO: 356422 - DNA, 20 bp, Artificial
  CRISPR gRNA sequence
agaggacaccaggacagcca

SEQ ID NO: 356423 - DNA, 20 bp, Artificial
  CRISPR gRNA sequence
gaggacaccaggacagccac

SEQ ID NO: 356424 - DNA, 20 bp, Artificial
  CRISPR gRNA sequence
acaccaggacagccacagga

SEQ ID NO: 356425 - DNA, 20 bp, Artificial
  CRISPR gRNA sequence
tatatctattgtcctctgtt

SEQ ID NO: 356426 - DNA, 20 bp, Artificial
  CRISPR gRNA sequence
tctattgtcctctgtttagt

SEQ ID NO: 356427 - DNA, 20 bp, Artificial
  CRISPR gRNA sequence
ctattgtcctctgtttagta

SEQ ID NO: 356428 - DNA, 20 bp, Artificial
  CRISPR gRNA sequence
gtcctctgtttagtaaggca

SEQ ID NO: 356429 - DNA, 20 bp, Artificial
  CRISPR gRNA sequence
aggcaaagaaacatgctatc

SEQ ID NO: 356430 - DNA, 20 bp, Artificial
  CRISPR gRNA sequence
aaaatgataatttaaaaact

SEQ ID NO: 356431 - DNA, 20 bp, Artificial
  CRISPR gRNA sequence
tttaaaaacttggtacataa

SEQ ID NO: 356432 - DNA, 20 bp, Artificial
  CRISPR gRNA sequence
ttaaaaacttggtacataaa

SEQ ID NO: 356433 - DNA, 20 bp, Artificial
  CRISPR gRNA sequence
acttggtacataaaaggaat

SEQ ID NO: 356434 - DNA, 20 bp, Artificial
  CRISPR gRNA sequence
ggaataagctttactaaact

SEQ ID NO: 356435 - DNA, 20 bp, Artificial
  CRISPR gRNA sequence
ataagctttactaaacttag

SEQ ID NO: 356436 - DNA, 20 bp, Artificial
  CRISPR gRNA sequence
cttagaagatgtatgtatat

SEQ ID NO: 356437 - DNA, 20 bp, Artificial
  CRISPR gRNA sequence
atgtcattacttattgccta

SEQ ID NO: 356438 - DNA, 20 bp, Artificial
  CRISPR gRNA sequence
tacttattgcctacagaaat

SEQ ID NO: 356439 - DNA, 20 bp, Artificial
  CRISPR gRNA sequence
acttattgcctacagaaata

SEQ ID NO: 356440 - DNA, 20 bp, Artificial
  CRISPR gRNA sequence
aactgtgtttcaaataaaac

SEQ ID NO: 356441 - DNA, 20 bp, Artificial
  CRISPR gRNA sequence
gtttcaaataaaactagtat

SEQ ID NO: 356442 - DNA, 20 bp, Artificial
  CRISPR gRNA sequence
tgtatatgttcttataacaa

SEQ ID NO: 356443 - DNA, 20 bp, Artificial
  CRISPR gRNA sequence
tagaaatatcatcttaaaat

SEQ ID NO: 356444 - DNA, 20 bp, Artificial
  CRISPR gRNA sequence
atcatcttaaaatgagccat

SEQ ID NO: 356445 - DNA, 20 bp, Artificial
  CRISPR gRNA sequence
aaatgagccatcagtattaa

SEQ ID NO: 356446 - DNA, 20 bp, Artificial
  CRISPR gRNA sequence
aatgagccatcagtattaaa

SEQ ID NO: 356447 - DNA, 20 bp, Artificial
  CRISPR gRNA sequence
gcaaccaacacactatttca

SEQ ID NO: 356448 - DNA, 20 bp, Artificial
  CRISPR gRNA sequence
cactatttcacggttgtgtt

SEQ ID NO: 356449 - DNA, 20 bp, Artificial
  CRISPR gRNA sequence
actatttcacggttgtgttc

SEQ ID NO: 356450 - DNA, 20 bp, Artificial
  CRISPR gRNA sequence
ctatttcacggttgtgttca

SEQ ID NO: 356451 - DNA, 20 bp, Artificial
  CRISPR gRNA sequence
tgttcagggtgccccctccc

SEQ ID NO: 356452 - DNA, 20 bp, Artificial
  CRISPR gRNA sequence
gttcagggtgccccctcccc

SEQ ID NO: 356453 - DNA, 20 bp, Artificial
  CRISPR gRNA sequence
ggtgccccctccccaggatc

SEQ ID NO: 356454 - DNA, 20 bp, Artificial
  CRISPR gRNA sequence
gtgccccctccccaggatct

SEQ ID NO: 356455 - DNA, 20 bp, Artificial
  CRISPR gRNA sequence
ccccaggatctgggatttgc

SEQ ID NO: 356456 - DNA, 20 bp, Artificial
  CRISPR gRNA sequence
caggatctgggatttgctgg

SEQ ID NO: 356457 - DNA, 20 bp, Artificial
  CRISPR gRNA sequence
aggatctgggatttgctgga

SEQ ID NO: 356458 - DNA, 20 bp, Artificial
  CRISPR gRNA sequence
ggatttgctggaaggacaca

SEQ ID NO: 356459 - DNA, 20 bp, Artificial
  CRISPR gRNA sequence
ctggaaggacacacagcttt

SEQ ID NO: 356460 - DNA, 20 bp, Artificial
  CRISPR gRNA sequence
ttcagcctgtacccacgtca

SEQ ID NO: 356461 - DNA, 20 bp, Artificial
  CRISPR gRNA sequence
cctgtacccacgtcacagct

SEQ ID NO: 356462 - DNA, 20 bp, Artificial
  CRISPR gRNA sequence
ctgtacccacgtcacagctc

SEQ ID NO: 356463 - DNA, 20 bp, Artificial
  CRISPR gRNA sequence
gtcacagctcaggtttatga

SEQ ID NO: 356464 - DNA, 20 bp, Artificial
  CRISPR gRNA sequence
acagctcaggtttatgacag

SEQ ID NO: 356465 - DNA, 20 bp, Artificial
  CRISPR gRNA sequence
gctcaggtttatgacagcag

SEQ ID NO: 356466 - DNA, 20 bp, Artificial
  CRISPR gRNA sequence
ctcaggtttatgacagcaga

SEQ ID NO: 356467 - DNA, 20 bp, Artificial
  CRISPR gRNA sequence
tatgacagcagaaggatcca

SEQ ID NO: 356468 - DNA, 20 bp, Artificial
  CRISPR gRNA sequence
cagaaggatccaaagcaaat

SEQ ID NO: 356469 - DNA, 20 bp, Artificial
  CRISPR gRNA sequence
ggatccaaagcaaatcagca

SEQ ID NO: 356470 - DNA, 20 bp, Artificial
  CRISPR gRNA sequence
gatccaaagcaaatcagcaa

SEQ ID NO: 356471 - DNA, 20 bp, Artificial
  CRISPR gRNA sequence
atccaaagcaaatcagcaaa

SEQ ID NO: 356472 - DNA, 20 bp, Artificial
  CRISPR gRNA sequence
cagcaaagggataaactgcc

SEQ ID NO: 356473 - DNA, 20 bp, Artificial
  CRISPR gRNA sequence
agcaaagggataaactgcct

SEQ ID NO: 356474 - DNA, 20 bp, Artificial
  CRISPR gRNA sequence
agggataaactgcctgggca

SEQ ID NO: 356475 - DNA, 20 bp, Artificial
  CRISPR gRNA sequence
ataaactgcctgggcaaagt

SEQ ID NO: 356476 - DNA, 20 bp, Artificial
  CRISPR gRNA sequence
aactgcctgggcaaagtcag

SEQ ID NO: 356477 - DNA, 20 bp, Artificial
  CRISPR gRNA sequence
actgcctgggcaaagtcaga

SEQ ID NO: 356478 - DNA, 20 bp, Artificial
  CRISPR gRNA sequence
ctgggcaaagtcagaaggac

SEQ ID NO: 356479 - DNA, 20 bp, Artificial
  CRISPR gRNA sequence
aggactggctgatgtccctg

SEQ ID NO: 356480 - DNA, 20 bp, Artificial
  CRISPR gRNA sequence
tggctgatgtccctgaagaa

SEQ ID NO: 356481 - DNA, 20 bp, Artificial
  CRISPR gRNA sequence
ctgatgtccctgaagaaaag

SEQ ID NO: 356482 - DNA, 20 bp, Artificial
  CRISPR gRNA sequence
tgatgtccctgaagaaaagc

SEQ ID NO: 356483 - DNA, 20 bp, Artificial
  CRISPR gRNA sequence
cctgaagaaaagcaggtgtt

SEQ ID NO: 356484 - DNA, 20 bp, Artificial
  CRISPR gRNA sequence
ggtgtttagcataaaccaca

SEQ ID NO: 356485 - DNA, 20 bp, Artificial
  CRISPR gRNA sequence
gtgtttagcataaaccacat

SEQ ID NO: 356486 - DNA, 20 bp, Artificial
  CRISPR gRNA sequence
acatgggttgtataaacatt

SEQ ID NO: 356487 - DNA, 20 bp, Artificial
  CRISPR gRNA sequence
gggttgtataaacatttaga

SEQ ID NO: 356488 - DNA, 20 bp, Artificial
  CRISPR gRNA sequence
tataaacatttagacagaat

SEQ ID NO: 356489 - DNA, 20 bp, Artificial
  CRISPR gRNA sequence
ttagacagaataagccaccc

SEQ ID NO: 356490 - DNA, 20 bp, Artificial
  CRISPR gRNA sequence
gacagaataagccaccccag

SEQ ID NO: 356491 - DNA, 20 bp, Artificial
  CRISPR gRNA sequence
gaataagccaccccagcagt

SEQ ID NO: 356492 - DNA, 20 bp, Artificial
  CRISPR gRNA sequence
ataagccaccccagcagtca

SEQ ID NO: 356493 - DNA, 20 bp, Artificial
  CRISPR gRNA sequence
agcagtcagagaattgttga

SEQ ID NO: 356494 - DNA, 20 bp, Artificial
  CRISPR gRNA sequence
ttgaaagcctccaaaaatcc

SEQ ID NO: 356495 - DNA, 20 bp, Artificial
  CRISPR gRNA sequence
tccaagttctcacatgccca

SEQ ID NO: 356496 - DNA, 20 bp, Artificial
  CRISPR gRNA sequence
caagttctcacatgcccaca

SEQ ID NO: 356497 - DNA, 20 bp, Artificial
  CRISPR gRNA sequence
agttctcacatgcccacaga

SEQ ID NO: 356498 - DNA, 20 bp, Artificial
  CRISPR gRNA sequence
cccacagagagccaaccttg

SEQ ID NO: 356499 - DNA, 20 bp, Artificial
  CRISPR gRNA sequence
ccacagagagccaaccttgc

SEQ ID NO: 356500 - DNA, 20 bp, Artificial
  CRISPR gRNA sequence
cagagagccaaccttgcagg

SEQ ID NO: 356501 - DNA, 20 bp, Artificial
  CRISPR gRNA sequence
agagagccaaccttgcaggc

SEQ ID NO: 356502 - DNA, 20 bp, Artificial
  CRISPR gRNA sequence
ccttgcaggcaggccgtcct

SEQ ID NO: 356503 - DNA, 20 bp, Artificial
  CRISPR gRNA sequence
cttgcaggcaggccgtccta

SEQ ID NO: 356504 - DNA, 20 bp, Artificial
  CRISPR gRNA sequence
gcaggccgtcctaaggactg

SEQ ID NO: 356505 - DNA, 20 bp, Artificial
  CRISPR gRNA sequence
cgtcctaaggactgtagtcc

SEQ ID NO: 356506 - DNA, 20 bp, Artificial
  CRISPR gRNA sequence
gtcctaaggactgtagtccc

SEQ ID NO: 356507 - DNA, 20 bp, Artificial
  CRISPR gRNA sequence
aaggactgtagtcccaggcc

SEQ ID NO: 356508 - DNA, 20 bp, Artificial
  CRISPR gRNA sequence
gtagtcccaggcctggatga

SEQ ID NO: 356509 - DNA, 20 bp, Artificial
  CRISPR gRNA sequence
agtcccaggcctggatgaca

SEQ ID NO: 356510 - DNA, 20 bp, Artificial
  CRISPR gRNA sequence
ccaggcctggatgacagagc

SEQ ID NO: 356511 - DNA, 20 bp, Artificial
  CRISPR gRNA sequence
aaacaatacaaatgaccaca

SEQ ID NO: 356512 - DNA, 20 bp, Artificial
  CRISPR gRNA sequence
acaatacaaatgaccacatg

SEQ ID NO: 356513 - DNA, 20 bp, Artificial
  CRISPR gRNA sequence
aatgaccacatggagccttg

SEQ ID NO: 356514 - DNA, 20 bp, Artificial
  CRISPR gRNA sequence
tggaatatcaccctgattcc

SEQ ID NO: 356515 - DNA, 20 bp, Artificial
  CRISPR gRNA sequence
ggaatatcaccctgattcct

SEQ ID NO: 356516 - DNA, 20 bp, Artificial
  CRISPR gRNA sequence
atcaccctgattcctaggcc

SEQ ID NO: 356517 - DNA, 20 bp, Artificial
  CRISPR gRNA sequence
tcaccctgattcctaggcct

SEQ ID NO: 356518 - DNA, 20 bp, Artificial
  CRISPR gRNA sequence
tgattcctaggcctgggaac

SEQ ID NO: 356519 - DNA, 20 bp, Artificial
  CRISPR gRNA sequence
ctaggcctgggaacaagtcc

SEQ ID NO: 356520 - DNA, 20 bp, Artificial
  CRISPR gRNA sequence
taggcctgggaacaagtccc

SEQ ID NO: 356521 - DNA, 20 bp, Artificial
  CRISPR gRNA sequence
tcccaggaatccatgtcttt

SEQ ID NO: 356522 - DNA, 20 bp, Artificial
  CRISPR gRNA sequence
aggaatccatgtctttcagc

SEQ ID NO: 356523 - DNA, 20 bp, Artificial
  CRISPR gRNA sequence
atgtctttcagcaagcatac

SEQ ID NO: 356524 - DNA, 20 bp, Artificial
  CRISPR gRNA sequence
ataccagatgatcctgatgt

SEQ ID NO: 356525 - DNA, 20 bp, Artificial
  CRISPR gRNA sequence
atcctgatgttggtgttcca

SEQ ID NO: 356526 - DNA, 20 bp, Artificial
  CRISPR gRNA sequence
gatgttggtgttccacagaa

SEQ ID NO: 356527 - DNA, 20 bp, Artificial
  CRISPR gRNA sequence
gtgttccacagaatggcatt

SEQ ID NO: 356528 - DNA, 20 bp, Artificial
  CRISPR gRNA sequence
tgagaaacactgctctactc

SEQ ID NO: 356529 - DNA, 20 bp, Artificial
  CRISPR gRNA sequence
aaacactgctctactctaga

SEQ ID NO: 356530 - DNA, 20 bp, Artificial
  CRISPR gRNA sequence
ctactctagaaagcaccttc

SEQ ID NO: 356531 - DNA, 20 bp, Artificial
  CRISPR gRNA sequence
tactctagaaagcaccttcc

SEQ ID NO: 356532 - DNA, 20 bp, Artificial
  CRISPR gRNA sequence
actctagaaagcaccttcca

SEQ ID NO: 356533 - DNA, 20 bp, Artificial
  CRISPR gRNA sequence
ctctagaaagcaccttccag

SEQ ID NO: 356534 - DNA, 20 bp, Artificial
  CRISPR gRNA sequence
ctagaaagcaccttccaggg

SEQ ID NO: 356535 - DNA, 20 bp, Artificial
  CRISPR gRNA sequence
agcaccttccaggggagctc

SEQ ID NO: 356536 - DNA, 20 bp, Artificial
  CRISPR gRNA sequence
ccaggggagctccagctgct

SEQ ID NO: 356537 - DNA, 20 bp, Artificial
  CRISPR gRNA sequence
gagctccagctgctgagccc

SEQ ID NO: 356538 - DNA, 20 bp, Artificial
  CRISPR gRNA sequence
gctgctgagccccagtctgc

SEQ ID NO: 356539 - DNA, 20 bp, Artificial
  CRISPR gRNA sequence
gctgagccccagtctgccag

SEQ ID NO: 356540 - DNA, 20 bp, Artificial
  CRISPR gRNA sequence
atttctcctccctcctttct

SEQ ID NO: 356541 - DNA, 20 bp, Artificial
  CRISPR gRNA sequence
tttctcctccctcctttctt

SEQ ID NO: 356542 - DNA, 20 bp, Artificial
  CRISPR gRNA sequence
ttctcctccctcctttctta

SEQ ID NO: 356543 - DNA, 20 bp, Artificial
  CRISPR gRNA sequence
ctttcttagggtattgactt

SEQ ID NO: 356544 - DNA, 20 bp, Artificial
  CRISPR gRNA sequence
gactttagaaaacttgtaat

SEQ ID NO: 356545 - DNA, 20 bp, Artificial
  CRISPR gRNA sequence
tttagaaaacttgtaattgg

SEQ ID NO: 356546 - DNA, 20 bp, Artificial
  CRISPR gRNA sequence
ttctgtctctgtctctttga

SEQ ID NO: 356547 - DNA, 20 bp, Artificial
  CRISPR gRNA sequence
agacatgcacatctttttaa

SEQ ID NO: 356548 - DNA, 20 bp, Artificial
  CRISPR gRNA sequence
atgcacatctttttaacggc

SEQ ID NO: 356549 - DNA, 20 bp, Artificial
  CRISPR gRNA sequence
catctttttaacggccagat

SEQ ID NO: 356550 - DNA, 20 bp, Artificial
  CRISPR gRNA sequence
cggccagataagtcttttgt

SEQ ID NO: 356551 - DNA, 20 bp, Artificial
  CRISPR gRNA sequence
agtcttttgtcagcttttga

SEQ ID NO: 356552 - DNA, 20 bp, Artificial
  CRISPR gRNA sequence
tcttttgtcagcttttgatg

SEQ ID NO: 356553 - DNA, 20 bp, Artificial
  CRISPR gRNA sequence
gatggagaaatgtctttctc

SEQ ID NO: 356554 - DNA, 20 bp, Artificial
  CRISPR gRNA sequence
atggagaaatgtctttctcg

SEQ ID NO: 356555 - DNA, 20 bp, Artificial
  CRISPR gRNA sequence
aaatgtctttctcgaggacc

SEQ ID NO: 356556 - DNA, 20 bp, Artificial
  CRISPR gRNA sequence
aatgtctttctcgaggacct

SEQ ID NO: 356557 - DNA, 20 bp, Artificial
  CRISPR gRNA sequence
tgtctttctcgaggacctgg

SEQ ID NO: 356558 - DNA, 20 bp, Artificial
  CRISPR gRNA sequence
ccctttgaaatgtaaccatc

SEQ ID NO: 356559 - DNA, 20 bp, Artificial
  CRISPR gRNA sequence
cctttgaaatgtaaccatca

SEQ ID NO: 356560 - DNA, 20 bp, Artificial
  CRISPR gRNA sequence
ttgaaatgtaaccatcaagg

SEQ ID NO: 356561 - DNA, 20 bp, Artificial
  CRISPR gRNA sequence
aatgtaaccatcaaggaaga

SEQ ID NO: 356562 - DNA, 20 bp, Artificial
  CRISPR gRNA sequence
acccttacctcccaatttct

SEQ ID NO: 356563 - DNA, 20 bp, Artificial
  CRISPR gRNA sequence
ccttacctcccaatttctga

SEQ ID NO: 356564 - DNA, 20 bp, Artificial
  CRISPR gRNA sequence
cttacctcccaatttctgag

SEQ ID NO: 356565 - DNA, 20 bp, Artificial
  CRISPR gRNA sequence
ttacctcccaatttctgaga

SEQ ID NO: 356566 - DNA, 20 bp, Artificial
  CRISPR gRNA sequence
cctcccaatttctgagaggg

SEQ ID NO: 356567 - DNA, 20 bp, Artificial
  CRISPR gRNA sequence
agagggtagaaaactaccac

SEQ ID NO: 356568 - DNA, 20 bp, Artificial
  CRISPR gRNA sequence
ctaccacaagcacctcactc

SEQ ID NO: 356569 - DNA, 20 bp, Artificial
  CRISPR gRNA sequence
taccacaagcacctcactca

SEQ ID NO: 356570 - DNA, 20 bp, Artificial
  CRISPR gRNA sequence
gcacctcactcaaggtgcaa

SEQ ID NO: 356571 - DNA, 20 bp, Artificial
  CRISPR gRNA sequence
caaaagtacctcctgtcata

SEQ ID NO: 356572 - DNA, 20 bp, Artificial
  CRISPR gRNA sequence
acctcctgtcataaagatgt

SEQ ID NO: 356573 - DNA, 20 bp, Artificial
  CRISPR gRNA sequence
tcctgtcataaagatgtgag

SEQ ID NO: 356574 - DNA, 20 bp, Artificial
  CRISPR gRNA sequence
tgagaagtttgtttttcctt

SEQ ID NO: 356575 - DNA, 20 bp, Artificial
  CRISPR gRNA sequence
gtttgtttttcctttggata

SEQ ID NO: 356576 - DNA, 20 bp, Artificial
  CRISPR gRNA sequence
ctttggataaagccaattat

SEQ ID NO: 356577 - DNA, 20 bp, Artificial
  CRISPR gRNA sequence
caattattagctaacacaca

SEQ ID NO: 356578 - DNA, 20 bp, Artificial
  CRISPR gRNA sequence
acacagtcatccccaattac

SEQ ID NO: 356579 - DNA, 20 bp, Artificial
  CRISPR gRNA sequence
ccccaattaccagttgaatc

SEQ ID NO: 356580 - DNA, 20 bp, Artificial
  CRISPR gRNA sequence
cccaattaccagttgaatct

SEQ ID NO: 356581 - DNA, 20 bp, Artificial
  CRISPR gRNA sequence
taccagttgaatctaggatg

SEQ ID NO: 356582 - DNA, 20 bp, Artificial
  CRISPR gRNA sequence
atgtgtgacaaatgtctgac

SEQ ID NO: 356583 - DNA, 20 bp, Artificial
  CRISPR gRNA sequence
ctgacaagccctcttacttg

SEQ ID NO: 356584 - DNA, 20 bp, Artificial
  CRISPR gRNA sequence
aagccctcttacttgaagac

SEQ ID NO: 356585 - DNA, 20 bp, Artificial
  CRISPR gRNA sequence
gactagttatcattcatctt

SEQ ID NO: 356586 - DNA, 20 bp, Artificial
  CRISPR gRNA sequence
ctagttatcattcatcttta

SEQ ID NO: 356587 - DNA, 20 bp, Artificial
  CRISPR gRNA sequence
tctttagagcatgtatgtaa

SEQ ID NO: 356588 - DNA, 20 bp, Artificial
  CRISPR gRNA sequence
ctttagagcatgtatgtaat

SEQ ID NO: 356589 - DNA, 20 bp, Artificial
  CRISPR gRNA sequence
tgtaatgggttgtatctact

SEQ ID NO: 356590 - DNA, 20 bp, Artificial
  CRISPR gRNA sequence
ttgtatctacttggctgtat

SEQ ID NO: 356591 - DNA, 20 bp, Artificial
  CRISPR gRNA sequence
gtatctacttggctgtatga

SEQ ID NO: 356592 - DNA, 20 bp, Artificial
  CRISPR gRNA sequence
atctacttggctgtatgaga

SEQ ID NO: 356593 - DNA, 20 bp, Artificial
  CRISPR gRNA sequence
acttggctgtatgagagagt

SEQ ID NO: 356594 - DNA, 20 bp, Artificial
  CRISPR gRNA sequence
gtgagatttctttgtctttg

SEQ ID NO: 356595 - DNA, 20 bp, Artificial
  CRISPR gRNA sequence
tctttgtctttgcagtctct

SEQ ID NO: 356596 - DNA, 20 bp, Artificial
  CRISPR gRNA sequence
ctttgtctttgcagtctctt

SEQ ID NO: 356597 - DNA, 20 bp, Artificial
  CRISPR gRNA sequence
ttgtctttgcagtctcttag

SEQ ID NO: 356598 - DNA, 20 bp, Artificial
  CRISPR gRNA sequence
tgtctttgcagtctcttagg

SEQ ID NO: 356599 - DNA, 20 bp, Artificial
  CRISPR gRNA sequence
acatgcattacattctgatt

SEQ ID NO: 356600 - DNA, 20 bp, Artificial
  CRISPR gRNA sequence
tattttgttttctacctttg

SEQ ID NO: 356601 - DNA, 20 bp, Artificial
  CRISPR gRNA sequence
ttttgttttctacctttgtg

SEQ ID NO: 356602 - DNA, 20 bp, Artificial
  CRISPR gRNA sequence
tgttttctacctttgtggag

SEQ ID NO: 356603 - DNA, 20 bp, Artificial
  CRISPR gRNA sequence
acctttgtggagcagttttc

SEQ ID NO: 356604 - DNA, 20 bp, Artificial
  CRISPR gRNA sequence
cctttgtggagcagttttct

SEQ ID NO: 356605 - DNA, 20 bp, Artificial
  CRISPR gRNA sequence
ttgtggagcagttttctggg

SEQ ID NO: 356606 - DNA, 20 bp, Artificial
  CRISPR gRNA sequence
tgtggagcagttttctgggt

SEQ ID NO: 356607 - DNA, 20 bp, Artificial
  CRISPR gRNA sequence
gtggagcagttttctgggta

SEQ ID NO: 356608 - DNA, 20 bp, Artificial
  CRISPR gRNA sequence
ggagcagttttctgggtagg

SEQ ID NO: 356609 - DNA, 20 bp, Artificial
  CRISPR gRNA sequence
gagcagttttctgggtaggg

SEQ ID NO: 356610 - DNA, 20 bp, Artificial
  CRISPR gRNA sequence
gcagttttctgggtagggag

SEQ ID NO: 356611 - DNA, 20 bp, Artificial
  CRISPR gRNA sequence
tgtttctaattatatttctc

SEQ ID NO: 356612 - DNA, 20 bp, Artificial
  CRISPR gRNA sequence
tattattactgttgtttaat

SEQ ID NO: 356613 - DNA, 20 bp, Artificial
  CRISPR gRNA sequence
attattactgttgtttaatc

SEQ ID NO: 356614 - DNA, 20 bp, Artificial
  CRISPR gRNA sequence
tcaggtataactctacatta

SEQ ID NO: 356615 - DNA, 20 bp, Artificial
  CRISPR gRNA sequence
gctaccattatgcttatcct

SEQ ID NO: 356616 - DNA, 20 bp, Artificial
  CRISPR gRNA sequence
ctaccattatgcttatcctc

SEQ ID NO: 356617 - DNA, 20 bp, Artificial
  CRISPR gRNA sequence
ttatgcttatcctcaggaaa

SEQ ID NO: 356618 - DNA, 20 bp, Artificial
  CRISPR gRNA sequence
tatgcttatcctcaggaaat

SEQ ID NO: 356619 - DNA, 20 bp, Artificial
  CRISPR gRNA sequence
aggaaatttttcaaatgttg

SEQ ID NO: 356620 - DNA, 20 bp, Artificial
  CRISPR gRNA sequence
tcaaatgttgtagtgaaatc

SEQ ID NO: 356621 - DNA, 20 bp, Artificial
  CRISPR gRNA sequence
tgaaatcaagataaacaacc

SEQ ID NO: 356622 - DNA, 20 bp, Artificial
  CRISPR gRNA sequence
gataaacaacctggtgtctg

SEQ ID NO: 356623 - DNA, 20 bp, Artificial
  CRISPR gRNA sequence
ataaacaacctggtgtctgc

SEQ ID NO: 356624 - DNA, 20 bp, Artificial
  CRISPR gRNA sequence
ctggtgtctgcaggttgcaa

SEQ ID NO: 356625 - DNA, 20 bp, Artificial
  CRISPR gRNA sequence
tggtgtctgcaggttgcaac

SEQ ID NO: 356626 - DNA, 20 bp, Artificial
  CRISPR gRNA sequence
ggttgcaacaggacacacaa

SEQ ID NO: 356627 - DNA, 20 bp, Artificial
  CRISPR gRNA sequence
gttgcaacaggacacacaat

SEQ ID NO: 356628 - DNA, 20 bp, Artificial
  CRISPR gRNA sequence
atttaaatatattatgtatt

SEQ ID NO: 356629 - DNA, 20 bp, Artificial
  CRISPR gRNA sequence
aatataaactacataaacat

SEQ ID NO: 356630 - DNA, 20 bp, Artificial
  CRISPR gRNA sequence
tataaactacataaacatga

SEQ ID NO: 356631 - DNA, 20 bp, Artificial
  CRISPR gRNA sequence
acataaacatgagagaacat

SEQ ID NO: 356632 - DNA, 20 bp, Artificial
  CRISPR gRNA sequence
catgagagaacataagtgtt

SEQ ID NO: 356633 - DNA, 20 bp, Artificial
  CRISPR gRNA sequence
gtgttcagaatgttttaata

SEQ ID NO: 356634 - DNA, 20 bp, Artificial
  CRISPR gRNA sequence
ggaaaataaacttttgtttt

SEQ ID NO: 356635 - DNA, 20 bp, Artificial
  CRISPR gRNA sequence
aaataaacttttgtttttgg

SEQ ID NO: 356636 - DNA, 20 bp, Artificial
  CRISPR gRNA sequence
aataaacttttgtttttgga

SEQ ID NO: 356637 - DNA, 20 bp, Artificial
  CRISPR gRNA sequence
ataaacttttgtttttggaa

SEQ ID NO: 356638 - DNA, 20 bp, Artificial
  CRISPR gRNA sequence
aaacttttgtttttggaagg

SEQ ID NO: 356639 - DNA, 20 bp, Artificial
  CRISPR gRNA sequence
tgtttttggaagggagattt

SEQ ID NO: 356640 - DNA, 20 bp, Artificial
  CRISPR gRNA sequence
tttttggaagggagatttta

SEQ ID NO: 356641 - DNA, 20 bp, Artificial
  CRISPR gRNA sequence
ttttggaagggagattttag

SEQ ID NO: 356642 - DNA, 20 bp, Artificial
  CRISPR gRNA sequence
gaagggagattttagaggtg

SEQ ID NO: 356643 - DNA, 20 bp, Artificial
  CRISPR gRNA sequence
gtgaagccctcactgtccct

SEQ ID NO: 356644 - DNA, 20 bp, Artificial
  CRISPR gRNA sequence
tgaagccctcactgtcccta

SEQ ID NO: 356645 - DNA, 20 bp, Artificial
  CRISPR gRNA sequence
agccctcactgtccctaagg

SEQ ID NO: 356646 - DNA, 20 bp, Artificial
  CRISPR gRNA sequence
gccctcactgtccctaagga

SEQ ID NO: 356647 - DNA, 20 bp, Artificial
  CRISPR gRNA sequence
cctcactgtccctaaggaag

SEQ ID NO: 356648 - DNA, 20 bp, Artificial
  CRISPR gRNA sequence
ctcactgtccctaaggaagg

SEQ ID NO: 356649 - DNA, 20 bp, Artificial
  CRISPR gRNA sequence
tcactgtccctaaggaagga

SEQ ID NO: 356650 - DNA, 20 bp, Artificial
  CRISPR gRNA sequence
gtccctaaggaaggagggac

SEQ ID NO: 356651 - DNA, 20 bp, Artificial
  CRISPR gRNA sequence
gactagtattctgattactc

SEQ ID NO: 356652 - DNA, 20 bp, Artificial
  CRISPR gRNA sequence
tattctgattactccagctc

SEQ ID NO: 356653 - DNA, 20 bp, Artificial
  CRISPR gRNA sequence
attactccagctctggtttc

SEQ ID NO: 356654 - DNA, 20 bp, Artificial
  CRISPR gRNA sequence
actccagctctggtttcaag

SEQ ID NO: 356655 - DNA, 20 bp, Artificial
  CRISPR gRNA sequence
ctggtttcaagaagccatta

SEQ ID NO: 356656 - DNA, 20 bp, Artificial
  CRISPR gRNA sequence
ttcaagaagccattacggtc

SEQ ID NO: 356657 - DNA, 20 bp, Artificial
  CRISPR gRNA sequence
tcaagaagccattacggtct

SEQ ID NO: 356658 - DNA, 20 bp, Artificial
  CRISPR gRNA sequence
agccattacggtctgggcac

SEQ ID NO: 356659 - DNA, 20 bp, Artificial
  CRISPR gRNA sequence
ccattacggtctgggcacaa

SEQ ID NO: 356660 - DNA, 20 bp, Artificial
  CRISPR gRNA sequence
tacggtctgggcacaagagc

SEQ ID NO: 356661 - DNA, 20 bp, Artificial
  CRISPR gRNA sequence
cggtctgggcacaagagcaa

SEQ ID NO: 356662 - DNA, 20 bp, Artificial
  CRISPR gRNA sequence
gtctgggcacaagagcaaga

SEQ ID NO: 356663 - DNA, 20 bp, Artificial
  CRISPR gRNA sequence
tgggcacaagagcaagagag

SEQ ID NO: 356664 - DNA, 20 bp, Artificial
  CRISPR gRNA sequence
gggcacaagagcaagagagc

SEQ ID NO: 356665 - DNA, 20 bp, Artificial
  CRISPR gRNA sequence
agcaagagagcaggatttga

SEQ ID NO: 356666 - DNA, 20 bp, Artificial
  CRISPR gRNA sequence
gcaagagagcaggatttgac

SEQ ID NO: 356667 - DNA, 20 bp, Artificial
  CRISPR gRNA sequence
agagagcaggatttgacagg

SEQ ID NO: 356668 - DNA, 20 bp, Artificial
  CRISPR gRNA sequence
agagcaggatttgacaggaa

SEQ ID NO: 356669 - DNA, 20 bp, Artificial
  CRISPR gRNA sequence
gcaggatttgacaggaagag

SEQ ID NO: 356670 - DNA, 20 bp, Artificial
  CRISPR gRNA sequence
ggatttgacaggaagagaag

SEQ ID NO: 356671 - DNA, 20 bp, Artificial
  CRISPR gRNA sequence
gatttgacaggaagagaaga

SEQ ID NO: 356672 - DNA, 20 bp, Artificial
  CRISPR gRNA sequence
atttgacaggaagagaagaa

SEQ ID NO: 356673 - DNA, 20 bp, Artificial
  CRISPR gRNA sequence
ttgacaggaagagaagaagg

SEQ ID NO: 356674 - DNA, 20 bp, Artificial
  CRISPR gRNA sequence
acaggaagagaagaagggag

SEQ ID NO: 356675 - DNA, 20 bp, Artificial
  CRISPR gRNA sequence
agagaagaagggagaagcct

SEQ ID NO: 356676 - DNA, 20 bp, Artificial
  CRISPR gRNA sequence
gaagaagggagaagcctcag

SEQ ID NO: 356677 - DNA, 20 bp, Artificial
  CRISPR gRNA sequence
aagaagggagaagcctcaga

SEQ ID NO: 356678 - DNA, 20 bp, Artificial
  CRISPR gRNA sequence
gaagggagaagcctcagaag

SEQ ID NO: 356679 - DNA, 20 bp, Artificial
  CRISPR gRNA sequence
aagggagaagcctcagaagg

SEQ ID NO: 356680 - DNA, 20 bp, Artificial
  CRISPR gRNA sequence
ggagaagcctcagaaggagg

SEQ ID NO: 356681 - DNA, 20 bp, Artificial
  CRISPR gRNA sequence
gagaagcctcagaaggagga

SEQ ID NO: 356682 - DNA, 20 bp, Artificial
  CRISPR gRNA sequence
aagcctcagaaggaggaagg

SEQ ID NO: 356683 - DNA, 20 bp, Artificial
  CRISPR gRNA sequence
agcctcagaaggaggaagga

SEQ ID NO: 356684 - DNA, 20 bp, Artificial
  CRISPR gRNA sequence
gcctcagaaggaggaaggaa

SEQ ID NO: 356685 - DNA, 20 bp, Artificial
  CRISPR gRNA sequence
ggaggaaggaagggcgtgct

SEQ ID NO: 356686 - DNA, 20 bp, Artificial
  CRISPR gRNA sequence
gaggaaggaagggcgtgctt

SEQ ID NO: 356687 - DNA, 20 bp, Artificial
  CRISPR gRNA sequence
agggcgtgcttgggaacttt

SEQ ID NO: 356688 - DNA, 20 bp, Artificial
  CRISPR gRNA sequence
gcgtgcttgggaacttttag

SEQ ID NO: 356689 - DNA, 20 bp, Artificial
  CRISPR gRNA sequence
gggaacttttagcagattcc

SEQ ID NO: 356690 - DNA, 20 bp, Artificial
  CRISPR gRNA sequence
acttttagcagattcctgga

SEQ ID NO: 356691 - DNA, 20 bp, Artificial
  CRISPR gRNA sequence
agattcctggaaagctgttc

SEQ ID NO: 356692 - DNA, 20 bp, Artificial
  CRISPR gRNA sequence
gattcctggaaagctgttca

SEQ ID NO: 356693 - DNA, 20 bp, Artificial
  CRISPR gRNA sequence
attcctggaaagctgttcaa

SEQ ID NO: 356694 - DNA, 20 bp, Artificial
  CRISPR gRNA sequence
tcctggaaagctgttcaagg

SEQ ID NO: 356695 - DNA, 20 bp, Artificial
  CRISPR gRNA sequence
tggaaagctgttcaagggag

SEQ ID NO: 356696 - DNA, 20 bp, Artificial
  CRISPR gRNA sequence
agggagtggactttcccaca

SEQ ID NO: 356697 - DNA, 20 bp, Artificial
  CRISPR gRNA sequence
gggagtggactttcccacac

SEQ ID NO: 356698 - DNA, 20 bp, Artificial
  CRISPR gRNA sequence
agtggactttcccacacagg

SEQ ID NO: 356699 - DNA, 20 bp, Artificial
  CRISPR gRNA sequence
tttcccacacaggaagcgtc

SEQ ID NO: 356700 - DNA, 20 bp, Artificial
  CRISPR gRNA sequence
cccacacaggaagcgtccag

SEQ ID NO: 356701 - DNA, 20 bp, Artificial
  CRISPR gRNA sequence
ccacacaggaagcgtccagt

SEQ ID NO: 356702 - DNA, 20 bp, Artificial
  CRISPR gRNA sequence
cacaggaagcgtccagtggg

SEQ ID NO: 356703 - DNA, 20 bp, Artificial
  CRISPR gRNA sequence
aagcgtccagtgggtggatc

SEQ ID NO: 356704 - DNA, 20 bp, Artificial
  CRISPR gRNA sequence
gtccagtgggtggatctggt

SEQ ID NO: 356705 - DNA, 20 bp, Artificial
  CRISPR gRNA sequence
tccagtgggtggatctggtg

SEQ ID NO: 356706 - DNA, 20 bp, Artificial
  CRISPR gRNA sequence
ggtggatctggtgaggccat

SEQ ID NO: 356707 - DNA, 20 bp, Artificial
  CRISPR gRNA sequence
atctggtgaggccatgagaa

SEQ ID NO: 356708 - DNA, 20 bp, Artificial
  CRISPR gRNA sequence
tctggtgaggccatgagaac

SEQ ID NO: 356709 - DNA, 20 bp, Artificial
  CRISPR gRNA sequence
ccatgagaacaggtgctttg

SEQ ID NO: 356710 - DNA, 20 bp, Artificial
  CRISPR gRNA sequence
tgagaacaggtgctttgtag

SEQ ID NO: 356711 - DNA, 20 bp, Artificial
  CRISPR gRNA sequence
aacaggtgctttgtagtggc

SEQ ID NO: 356712 - DNA, 20 bp, Artificial
  CRISPR gRNA sequence
aggtgctttgtagtggccag

SEQ ID NO: 356713 - DNA, 20 bp, Artificial
  CRISPR gRNA sequence
tggccagaagctgtgcctat

SEQ ID NO: 356714 - DNA, 20 bp, Artificial
  CRISPR gRNA sequence
aagctgtgcctatgagacct

SEQ ID NO: 356715 - DNA, 20 bp, Artificial
  CRISPR gRNA sequence
tatgagacctgagccatcac

SEQ ID NO: 356716 - DNA, 20 bp, Artificial
  CRISPR gRNA sequence
atgagacctgagccatcacc

SEQ ID NO: 356717 - DNA, 20 bp, Artificial
  CRISPR gRNA sequence
atcaccaggtctcctttgcg

SEQ ID NO: 356718 - DNA, 20 bp, Artificial
  CRISPR gRNA sequence
caccaggtctcctttgcgca

SEQ ID NO: 356719 - DNA, 20 bp, Artificial
  CRISPR gRNA sequence
accaggtctcctttgcgcag

SEQ ID NO: 356720 - DNA, 20 bp, Artificial
  CRISPR gRNA sequence
ttgcgcagaggctactccta

SEQ ID NO: 356721 - DNA, 20 bp, Artificial
  CRISPR gRNA sequence
aagttcccctaatctgttcc

SEQ ID NO: 356722 - DNA, 20 bp, Artificial
  CRISPR gRNA sequence
cccctaatctgttcctggtg

SEQ ID NO: 356723 - DNA, 20 bp, Artificial
  CRISPR gRNA sequence
tggtgtggatttgacttcac

SEQ ID NO: 356724 - DNA, 20 bp, Artificial
  CRISPR gRNA sequence
gatttgacttcaccagcaac

SEQ ID NO: 356725 - DNA, 20 bp, Artificial
  CRISPR gRNA sequence
agcaaccagcacctcccctc

SEQ ID NO: 356726 - DNA, 20 bp, Artificial
  CRISPR gRNA sequence
gcaaccagcacctcccctcc

SEQ ID NO: 356727 - DNA, 20 bp, Artificial
  CRISPR gRNA sequence
ctgattgtgcctgtccctca

SEQ ID NO: 356728 - DNA, 20 bp, Artificial
  CRISPR gRNA sequence
ctgtccctcatggcactgtg

SEQ ID NO: 356729 - DNA, 20 bp, Artificial
  CRISPR gRNA sequence
ccctcatggcactgtgtgga

SEQ ID NO: 356730 - DNA, 20 bp, Artificial
  CRISPR gRNA sequence
cgtgactccatgatgtgcac

SEQ ID NO: 356731 - DNA, 20 bp, Artificial
  CRISPR gRNA sequence
ccatgatgtgcacaagcccc

SEQ ID NO: 356732 - DNA, 20 bp, Artificial
  CRISPR gRNA sequence
tgatgtgcacaagcccctag

SEQ ID NO: 356733 - DNA, 20 bp, Artificial
  CRISPR gRNA sequence
gatgtgcacaagcccctaga

SEQ ID NO: 356734 - DNA, 20 bp, Artificial
  CRISPR gRNA sequence
gtgcacaagcccctagaagg

SEQ ID NO: 356735 - DNA, 20 bp, Artificial
  CRISPR gRNA sequence
acaagcccctagaaggaaga

SEQ ID NO: 356736 - DNA, 20 bp, Artificial
  CRISPR gRNA sequence
caagcccctagaaggaagac

SEQ ID NO: 356737 - DNA, 20 bp, Artificial
  CRISPR gRNA sequence
gcccctagaaggaagacagg

SEQ ID NO: 356738 - DNA, 20 bp, Artificial
  CRISPR gRNA sequence
cccctagaaggaagacagga

SEQ ID NO: 356739 - DNA, 20 bp, Artificial
  CRISPR gRNA sequence
ctagaaggaagacaggaagg

SEQ ID NO: 356740 - DNA, 20 bp, Artificial
  CRISPR gRNA sequence
tagaaggaagacaggaagga

SEQ ID NO: 356741 - DNA, 20 bp, Artificial
  CRISPR gRNA sequence
agaaggaagacaggaaggaa

SEQ ID NO: 356742 - DNA, 20 bp, Artificial
  CRISPR gRNA sequence
gaaggaagacaggaaggaag

SEQ ID NO: 356743 - DNA, 20 bp, Artificial
  CRISPR gRNA sequence
aggaagacaggaaggaaggg

SEQ ID NO: 356744 - DNA, 20 bp, Artificial
  CRISPR gRNA sequence
aagacaggaaggaaggggag

SEQ ID NO: 356745 - DNA, 20 bp, Artificial
  CRISPR gRNA sequence
agacaggaaggaaggggaga

SEQ ID NO: 356746 - DNA, 20 bp, Artificial
  CRISPR gRNA sequence
aaggggagaaggtcccctca

SEQ ID NO: 356747 - DNA, 20 bp, Artificial
  CRISPR gRNA sequence
agaaggtcccctcatagcat

SEQ ID NO: 356748 - DNA, 20 bp, Artificial
  CRISPR gRNA sequence
tcccctcatagcattggcgt

SEQ ID NO: 356749 - DNA, 20 bp, Artificial
  CRISPR gRNA sequence
tcatagcattggcgtcagcg

SEQ ID NO: 356750 - DNA, 20 bp, Artificial
  CRISPR gRNA sequence
catagcattggcgtcagcga

SEQ ID NO: 356751 - DNA, 20 bp, Artificial
  CRISPR gRNA sequence
tggcgtcagcgaaggatccc

SEQ ID NO: 356752 - DNA, 20 bp, Artificial
  CRISPR gRNA sequence
aaggatcccgagctgaaata

SEQ ID NO: 356753 - DNA, 20 bp, Artificial
  CRISPR gRNA sequence
gatcccgagctgaaataaag

SEQ ID NO: 356754 - DNA, 20 bp, Artificial
  CRISPR gRNA sequence
cccgagctgaaataaagtag

SEQ ID NO: 356755 - DNA, 20 bp, Artificial
  CRISPR gRNA sequence
ccgagctgaaataaagtagc

SEQ ID NO: 356756 - DNA, 20 bp, Artificial
  CRISPR gRNA sequence
gagctgaaataaagtagcgg

SEQ ID NO: 356757 - DNA, 20 bp, Artificial
  CRISPR gRNA sequence
tcctttgcctaaacttgctc

SEQ ID NO: 356758 - DNA, 20 bp, Artificial
  CRISPR gRNA sequence
cctaaacttgctctagacat

SEQ ID NO: 356759 - DNA, 20 bp, Artificial
  CRISPR gRNA sequence
acttgctctagacattggtt

SEQ ID NO: 356760 - DNA, 20 bp, Artificial
  CRISPR gRNA sequence
tcacttgtataaacctcttg

SEQ ID NO: 356761 - DNA, 20 bp, Artificial
  CRISPR gRNA sequence
cttgtataaacctcttgaag

SEQ ID NO: 356762 - DNA, 20 bp, Artificial
  CRISPR gRNA sequence
ttgtataaacctcttgaaga

SEQ ID NO: 356763 - DNA, 20 bp, Artificial
  CRISPR gRNA sequence
tcttgaagaaggacgctctg

SEQ ID NO: 356764 - DNA, 20 bp, Artificial
  CRISPR gRNA sequence
ctctgtagctccaccgtcac

SEQ ID NO: 356765 - DNA, 20 bp, Artificial
  CRISPR gRNA sequence
tcaccagcttctgttgtgat

SEQ ID NO: 356766 - DNA, 20 bp, Artificial
  CRISPR gRNA sequence
gttgtgatgagtctcctgat

SEQ ID NO: 356767 - DNA, 20 bp, Artificial
  CRISPR gRNA sequence
tgtgatgagtctcctgatga

SEQ ID NO: 356768 - DNA, 20 bp, Artificial
  CRISPR gRNA sequence
gatgagtctcctgatgagag

SEQ ID NO: 356769 - DNA, 20 bp, Artificial
  CRISPR gRNA sequence
tagtttttctcttccacttt

SEQ ID NO: 356770 - DNA, 20 bp, Artificial
  CRISPR gRNA sequence
tttttctcttccactttgag

SEQ ID NO: 356771 - DNA, 20 bp, Artificial
  CRISPR gRNA sequence
ctcttccactttgagcagaa

SEQ ID NO: 356772 - DNA, 20 bp, Artificial
  CRISPR gRNA sequence
ttccactttgagcagaaaag

SEQ ID NO: 356773 - DNA, 20 bp, Artificial
  CRISPR gRNA sequence
tttgagcagaaaagtagtgc

SEQ ID NO: 356774 - DNA, 20 bp, Artificial
  CRISPR gRNA sequence
ttgagcagaaaagtagtgct

SEQ ID NO: 356775 - DNA, 20 bp, Artificial
  CRISPR gRNA sequence
tgagcagaaaagtagtgctg

SEQ ID NO: 356776 - DNA, 20 bp, Artificial
  CRISPR gRNA sequence
agaaaagtagtgctggggcc

SEQ ID NO: 356777 - DNA, 20 bp, Artificial
  CRISPR gRNA sequence
agtagtgctggggccaagaa

SEQ ID NO: 356778 - DNA, 20 bp, Artificial
  CRISPR gRNA sequence
gtagtgctggggccaagaat

SEQ ID NO: 356779 - DNA, 20 bp, Artificial
  CRISPR gRNA sequence
ggccaagaataggaactctg

SEQ ID NO: 356780 - DNA, 20 bp, Artificial
  CRISPR gRNA sequence
aagaataggaactctgaagc

SEQ ID NO: 356781 - DNA, 20 bp, Artificial
  CRISPR gRNA sequence
ataggaactctgaagccagt

SEQ ID NO: 356782 - DNA, 20 bp, Artificial
  CRISPR gRNA sequence
atccctgcccctctatttat

SEQ ID NO: 356783 - DNA, 20 bp, Artificial
  CRISPR gRNA sequence
ccctctatttattagttacc

SEQ ID NO: 356784 - DNA, 20 bp, Artificial
  CRISPR gRNA sequence
atttattagttaccaagcct

SEQ ID NO: 356785 - DNA, 20 bp, Artificial
  CRISPR gRNA sequence
ttagttaccaagcctgagat

SEQ ID NO: 356786 - DNA, 20 bp, Artificial
  CRISPR gRNA sequence
tctccatacctcactttcca

SEQ ID NO: 356787 - DNA, 20 bp, Artificial
  CRISPR gRNA sequence
ctttccacagacgtcaaacg

SEQ ID NO: 356788 - DNA, 20 bp, Artificial
  CRISPR gRNA sequence
tttccacagacgtcaaacgt

SEQ ID NO: 356789 - DNA, 20 bp, Artificial
  CRISPR gRNA sequence
ccacagacgtcaaacgtggg

SEQ ID NO: 356790 - DNA, 20 bp, Artificial
  CRISPR gRNA sequence
agacgtcaaacgtgggcagt

SEQ ID NO: 356791 - DNA, 20 bp, Artificial
  CRISPR gRNA sequence
gacgtcaaacgtgggcagtc

SEQ ID NO: 356792 - DNA, 20 bp, Artificial
  CRISPR gRNA sequence
ggcagtcaggctgctgtgac

SEQ ID NO: 356793 - DNA, 20 bp, Artificial
  CRISPR gRNA sequence
ggctgctgtgacaagtaaat

SEQ ID NO: 356794 - DNA, 20 bp, Artificial
  CRISPR gRNA sequence
acaagtaaatcagtaactac

SEQ ID NO: 356795 - DNA, 20 bp, Artificial
  CRISPR gRNA sequence
agtaactacgagtaaattct

SEQ ID NO: 356796 - DNA, 20 bp, Artificial
  CRISPR gRNA sequence
ctacgagtaaattctcagaa

SEQ ID NO: 356797 - DNA, 20 bp, Artificial
  CRISPR gRNA sequence
taaattctcagaacagccac

SEQ ID NO: 356798 - DNA, 20 bp, Artificial
  CRISPR gRNA sequence
agaacagccactggcacaca

SEQ ID NO: 356799 - DNA, 20 bp, Artificial
  CRISPR gRNA sequence
cactggcacacatagaaaca

SEQ ID NO: 356800 - DNA, 20 bp, Artificial
  CRISPR gRNA sequence
tggtatgtgtgtttatcata

SEQ ID NO: 356801 - DNA, 20 bp, Artificial
  CRISPR gRNA sequence
gtgtttatcatatagcgacc

SEQ ID NO: 356802 - DNA, 20 bp, Artificial
  CRISPR gRNA sequence
atcatatagcgaccaagaca

SEQ ID NO: 356803 - DNA, 20 bp, Artificial
  CRISPR gRNA sequence
gccctgtgacacgtaattct

SEQ ID NO: 356804 - DNA, 20 bp, Artificial
  CRISPR gRNA sequence
gtgacacgtaattcttagaa

SEQ ID NO: 356805 - DNA, 20 bp, Artificial
  CRISPR gRNA sequence
gctacttataactctttcct

SEQ ID NO: 356806 - DNA, 20 bp, Artificial
  CRISPR gRNA sequence
ctacttataactctttcctt

SEQ ID NO: 356807 - DNA, 20 bp, Artificial
  CRISPR gRNA sequence
taactctttccttgggtcct

SEQ ID NO: 356808 - DNA, 20 bp, Artificial
  CRISPR gRNA sequence
agaaaacttcaaaatgtgac

SEQ ID NO: 356809 - DNA, 20 bp, Artificial
  CRISPR gRNA sequence
gaaaacttcaaaatgtgacc

SEQ ID NO: 356810 - DNA, 20 bp, Artificial
  CRISPR gRNA sequence
cttcaaaatgtgaccaggtg

SEQ ID NO: 356811 - DNA, 20 bp, Artificial
  CRISPR gRNA sequence
caaaatgtgaccaggtgcag

SEQ ID NO: 356812 - DNA, 20 bp, Artificial
  CRISPR gRNA sequence
gtggctcacgtctgcaatcc

SEQ ID NO: 356813 - DNA, 20 bp, Artificial
  CRISPR gRNA sequence
cgtctgcaatcccggcactt

SEQ ID NO: 356814 - DNA, 20 bp, Artificial
  CRISPR gRNA sequence
ctgcaatcccggcactttgg

SEQ ID NO: 356815 - DNA, 20 bp, Artificial
  CRISPR gRNA sequence
tgcaatcccggcactttgga

SEQ ID NO: 356816 - DNA, 20 bp, Artificial
  CRISPR gRNA sequence
tcccggcactttggaaggcc

SEQ ID NO: 356817 - DNA, 20 bp, Artificial
  CRISPR gRNA sequence
cccggcactttggaaggccg

SEQ ID NO: 356818 - DNA, 20 bp, Artificial
  CRISPR gRNA sequence
ggcactttggaaggccgagg

SEQ ID NO: 356819 - DNA, 20 bp, Artificial
  CRISPR gRNA sequence
gcactttggaaggccgaggt

SEQ ID NO: 356820 - DNA, 20 bp, Artificial
  CRISPR gRNA sequence
ctttggaaggccgaggtggg

SEQ ID NO: 356821 - DNA, 20 bp, Artificial
  CRISPR gRNA sequence
ccgaggtgggtggatcacct

SEQ ID NO: 356822 - DNA, 20 bp, Artificial
  CRISPR gRNA sequence
cgaggtgggtggatcacctg

SEQ ID NO: 356823 - DNA, 20 bp, Artificial
  CRISPR gRNA sequence
gtgggtggatcacctgaggt

SEQ ID NO: 356824 - DNA, 20 bp, Artificial
  CRISPR gRNA sequence
tgggtggatcacctgaggtc

SEQ ID NO: 356825 - DNA, 20 bp, Artificial
  CRISPR gRNA sequence
tcacctgaggtcaggacttc

SEQ ID NO: 356826 - DNA, 20 bp, Artificial
  CRISPR gRNA sequence
tgaggtcaggacttcgagac

SEQ ID NO: 356827 - DNA, 20 bp, Artificial
  CRISPR gRNA sequence
cgagaccagcttgaccaatg

SEQ ID NO: 356828 - DNA, 20 bp, Artificial
  CRISPR gRNA sequence
tcttctaaaaatacaaaaat

SEQ ID NO: 356829 - DNA, 20 bp, Artificial
  CRISPR gRNA sequence
ctaaaaatacaaaaattagc

SEQ ID NO: 356830 - DNA, 20 bp, Artificial
  CRISPR gRNA sequence
taaaaatacaaaaattagct

SEQ ID NO: 356831 - DNA, 20 bp, Artificial
  CRISPR gRNA sequence
atacaaaaattagctgggca

SEQ ID NO: 356832 - DNA, 20 bp, Artificial
  CRISPR gRNA sequence
caaaaattagctgggcatgg

SEQ ID NO: 356833 - DNA, 20 bp, Artificial
  CRISPR gRNA sequence
aaattagctgggcatggtgg

SEQ ID NO: 356834 - DNA, 20 bp, Artificial
  CRISPR gRNA sequence
aattagctgggcatggtggc

SEQ ID NO: 356835 - DNA, 20 bp, Artificial
  CRISPR gRNA sequence
gtggcaggtgcctgtaatcc

SEQ ID NO: 356836 - DNA, 20 bp, Artificial
  CRISPR gRNA sequence
tgcctgtaatcccagctgct

SEQ ID NO: 356837 - DNA, 20 bp, Artificial
  CRISPR gRNA sequence
gcctgtaatcccagctgctt

SEQ ID NO: 356838 - DNA, 20 bp, Artificial
  CRISPR gRNA sequence
ctgtaatcccagctgcttgg

SEQ ID NO: 356839 - DNA, 20 bp, Artificial
  CRISPR gRNA sequence
tgtaatcccagctgcttggg

SEQ ID NO: 356840 - DNA, 20 bp, Artificial
  CRISPR gRNA sequence
tcccagctgcttgggaggct

SEQ ID NO: 356841 - DNA, 20 bp, Artificial
  CRISPR gRNA sequence
cccagctgcttgggaggctg

SEQ ID NO: 356842 - DNA, 20 bp, Artificial
  CRISPR gRNA sequence
agctgcttgggaggctgagg

SEQ ID NO: 356843 - DNA, 20 bp, Artificial
  CRISPR gRNA sequence
tgcttgggaggctgaggcag

SEQ ID NO: 356844 - DNA, 20 bp, Artificial
  CRISPR gRNA sequence
gcagaagaatcgcttgaacc

SEQ ID NO: 356845 - DNA, 20 bp, Artificial
  CRISPR gRNA sequence
cagaagaatcgcttgaaccc

SEQ ID NO: 356846 - DNA, 20 bp, Artificial
  CRISPR gRNA sequence
gaagaatcgcttgaacccag

SEQ ID NO: 356847 - DNA, 20 bp, Artificial
  CRISPR gRNA sequence
aagaatcgcttgaacccagg

SEQ ID NO: 356848 - DNA, 20 bp, Artificial
  CRISPR gRNA sequence
gaatcgcttgaacccaggag

SEQ ID NO: 356849 - DNA, 20 bp, Artificial
  CRISPR gRNA sequence
aatcgcttgaacccaggagg

SEQ ID NO: 356850 - DNA, 20 bp, Artificial
  CRISPR gRNA sequence
tcgcttgaacccaggaggag

SEQ ID NO: 356851 - DNA, 20 bp, Artificial
  CRISPR gRNA sequence
cgcttgaacccaggaggagg

SEQ ID NO: 356852 - DNA, 20 bp, Artificial
  CRISPR gRNA sequence
aacccaggaggaggaggttg

SEQ ID NO: 356853 - DNA, 20 bp, Artificial
  CRISPR gRNA sequence
caggaggaggaggttgcagt

SEQ ID NO: 356854 - DNA, 20 bp, Artificial
  CRISPR gRNA sequence
ggaggaggttgcagtgagcc

SEQ ID NO: 356855 - DNA, 20 bp, Artificial
  CRISPR gRNA sequence
gagatcgtgccattgcactc

SEQ ID NO: 356856 - DNA, 20 bp, Artificial
  CRISPR gRNA sequence
cgtgccattgcactccagcc

SEQ ID NO: 356857 - DNA, 20 bp, Artificial
  CRISPR gRNA sequence
gtgccattgcactccagcct

SEQ ID NO: 356858 - DNA, 20 bp, Artificial
  CRISPR gRNA sequence
ttgcactccagcctgggcaa

SEQ ID NO: 356859 - DNA, 20 bp, Artificial
  CRISPR gRNA sequence
gcactccagcctgggcaaca

SEQ ID NO: 356860 - DNA, 20 bp, Artificial
  CRISPR gRNA sequence
tccagcctgggcaacagagt

SEQ ID NO: 356861 - DNA, 20 bp, Artificial
  CRISPR gRNA sequence
aaaaataaaaataaaaataa

SEQ ID NO: 356862 - DNA, 20 bp, Artificial
  CRISPR gRNA sequence
taaaaataattttttaaaaa

SEQ ID NO: 356863 - DNA, 20 bp, Artificial
  CRISPR gRNA sequence
aaaaataattttttaaaaaa

SEQ ID NO: 356864 - DNA, 20 bp, Artificial
  CRISPR gRNA sequence
acttgaaaatgcaaaccata

SEQ ID NO: 356865 - DNA, 20 bp, Artificial
  CRISPR gRNA sequence
caaaccatatagcatttaca

SEQ ID NO: 356866 - DNA, 20 bp, Artificial
  CRISPR gRNA sequence
tttacaaagacttatatcta

SEQ ID NO: 356867 - DNA, 20 bp, Artificial
  CRISPR gRNA sequence
ttacaaagacttatatctaa

SEQ ID NO: 356868 - DNA, 20 bp, Artificial
  CRISPR gRNA sequence
aaggtgttataaatgttgta

SEQ ID NO: 356869 - DNA, 20 bp, Artificial
  CRISPR gRNA sequence
aaatgttgtacagatctttt

SEQ ID NO: 356870 - DNA, 20 bp, Artificial
  CRISPR gRNA sequence
tcttttcagaatatgaaatt

SEQ ID NO: 356871 - DNA, 20 bp, Artificial
  CRISPR gRNA sequence
ttcagaatatgaaattcagc

SEQ ID NO: 356872 - DNA, 20 bp, Artificial
  CRISPR gRNA sequence
atatgaaattcagcaagcct

SEQ ID NO: 356873 - DNA, 20 bp, Artificial
  CRISPR gRNA sequence
tatgaaattcagcaagcctt

SEQ ID NO: 356874 - DNA, 20 bp, Artificial
  CRISPR gRNA sequence
ttaggctgaatacctccaaa

SEQ ID NO: 356875 - DNA, 20 bp, Artificial
  CRISPR gRNA sequence
ttttatgaaaaaaattccct

SEQ ID NO: 356876 - DNA, 20 bp, Artificial
  CRISPR gRNA sequence
aagtgctctacaaaacatga

SEQ ID NO: 356877 - DNA, 20 bp, Artificial
  CRISPR gRNA sequence
aaaacatgaaagcctatgcc

SEQ ID NO: 356878 - DNA, 20 bp, Artificial
  CRISPR gRNA sequence
gaaagcctatgcctggctat

SEQ ID NO: 356879 - DNA, 20 bp, Artificial
  CRISPR gRNA sequence
tggctataagaaataataac

SEQ ID NO: 356880 - DNA, 20 bp, Artificial
  CRISPR gRNA sequence
ggctataagaaataataact

SEQ ID NO: 356881 - DNA, 20 bp, Artificial
  CRISPR gRNA sequence
aaatctgctgctttatgctc

SEQ ID NO: 356882 - DNA, 20 bp, Artificial
  CRISPR gRNA sequence
atctgctgctttatgctcta

SEQ ID NO: 356883 - DNA, 20 bp, Artificial
  CRISPR gRNA sequence
tctcatctctcttttttaaa

SEQ ID NO: 356884 - DNA, 20 bp, Artificial
  CRISPR gRNA sequence
tcatctctcttttttaaaaa

SEQ ID NO: 356885 - DNA, 20 bp, Artificial
  CRISPR gRNA sequence
ttaaaaatgaattatatgat

SEQ ID NO: 356886 - DNA, 20 bp, Artificial
  CRISPR gRNA sequence
aaactgatacctttatctgc

SEQ ID NO: 356887 - DNA, 20 bp, Artificial
  CRISPR gRNA sequence
gatacctttatctgctggat

SEQ ID NO: 356888 - DNA, 20 bp, Artificial
  CRISPR gRNA sequence
atacctttatctgctggatc

SEQ ID NO: 356889 - DNA, 20 bp, Artificial
  CRISPR gRNA sequence
cctttatctgctggatcagg

SEQ ID NO: 356890 - DNA, 20 bp, Artificial
  CRISPR gRNA sequence
tttatctgctggatcaggaa

SEQ ID NO: 356891 - DNA, 20 bp, Artificial
  CRISPR gRNA sequence
gctggatcaggaagagaaaa

SEQ ID NO: 356892 - DNA, 20 bp, Artificial
  CRISPR gRNA sequence
agagaaaatagtcaatataa

SEQ ID NO: 356893 - DNA, 20 bp, Artificial
  CRISPR gRNA sequence
taaaagcaaaatgacttgtt

SEQ ID NO: 356894 - DNA, 20 bp, Artificial
  CRISPR gRNA sequence
cttgtttggattaaaatatt

SEQ ID NO: 356895 - DNA, 20 bp, Artificial
  CRISPR gRNA sequence
ttgtttggattaaaatattt

SEQ ID NO: 356896 - DNA, 20 bp, Artificial
  CRISPR gRNA sequence
ggattaaaatatttgggatt

SEQ ID NO: 356897 - DNA, 20 bp, Artificial
  CRISPR gRNA sequence
ggatttggcatgtgtgcata

SEQ ID NO: 356898 - DNA, 20 bp, Artificial
  CRISPR gRNA sequence
ttggcatgtgtgcatatggt

SEQ ID NO: 356899 - DNA, 20 bp, Artificial
  CRISPR gRNA sequence
atgtgtgcatatggtaagtg

SEQ ID NO: 356900 - DNA, 20 bp, Artificial
  CRISPR gRNA sequence
atatggtaagtgtggttata

SEQ ID NO: 356901 - DNA, 20 bp, Artificial
  CRISPR gRNA sequence
cacaatcgtgtgtatttgtt

SEQ ID NO: 356902 - DNA, 20 bp, Artificial
  CRISPR gRNA sequence
tttgttgagtgtttaccata

SEQ ID NO: 356903 - DNA, 20 bp, Artificial
  CRISPR gRNA sequence
gttgagtgtttaccatacgg

SEQ ID NO: 356904 - DNA, 20 bp, Artificial
  CRISPR gRNA sequence
ttgagtgtttaccatacggc

SEQ ID NO: 356905 - DNA, 20 bp, Artificial
  CRISPR gRNA sequence
ctcctcctaacaaatattca

SEQ ID NO: 356906 - DNA, 20 bp, Artificial
  CRISPR gRNA sequence
acaaatattcatagatatct

SEQ ID NO: 356907 - DNA, 20 bp, Artificial
  CRISPR gRNA sequence
cacacacacacacaaattaa

SEQ ID NO: 356908 - DNA, 20 bp, Artificial
  CRISPR gRNA sequence
cacacacacacaaattaaaa

SEQ ID NO: 356909 - DNA, 20 bp, Artificial
  CRISPR gRNA sequence
tcaatcctaatgctccacat

SEQ ID NO: 356910 - DNA, 20 bp, Artificial
  CRISPR gRNA sequence
acataagatgtgaaaaactg

SEQ ID NO: 356911 - DNA, 20 bp, Artificial
  CRISPR gRNA sequence
gatgtgaaaaactgaagaca

SEQ ID NO: 356912 - DNA, 20 bp, Artificial
  CRISPR gRNA sequence
aactgaagacacagtgacat

SEQ ID NO: 356913 - DNA, 20 bp, Artificial
  CRISPR gRNA sequence
actgaagacacagtgacatc

SEQ ID NO: 356914 - DNA, 20 bp, Artificial
  CRISPR gRNA sequence
gacatcaggataactatact

SEQ ID NO: 356915 - DNA, 20 bp, Artificial
  CRISPR gRNA sequence
tcaggataactatacttggt

SEQ ID NO: 356916 - DNA, 20 bp, Artificial
  CRISPR gRNA sequence
ctgtataaacttccctccca

SEQ ID NO: 356917 - DNA, 20 bp, Artificial
  CRISPR gRNA sequence
tgtataaacttccctcccat

SEQ ID NO: 356918 - DNA, 20 bp, Artificial
  CRISPR gRNA sequence
catttacacattgcgtccca

SEQ ID NO: 356919 - DNA, 20 bp, Artificial
  CRISPR gRNA sequence
ttaatgaaatcttctcaact

SEQ ID NO: 356920 - DNA, 20 bp, Artificial
  CRISPR gRNA sequence
gtgtccatcatcatcacaat

SEQ ID NO: 356921 - DNA, 20 bp, Artificial
  CRISPR gRNA sequence
tgtccatcatcatcacaata

SEQ ID NO: 356922 - DNA, 20 bp, Artificial
  CRISPR gRNA sequence
gtttcactcactgtccaaca

SEQ ID NO: 356923 - DNA, 20 bp, Artificial
  CRISPR gRNA sequence
ctcactgtccaacatagcta

SEQ ID NO: 356924 - DNA, 20 bp, Artificial
  CRISPR gRNA sequence
cactttccaccaatccaact

SEQ ID NO: 356925 - DNA, 20 bp, Artificial
  CRISPR gRNA sequence
ctttccaccaatccaactga

SEQ ID NO: 356926 - DNA, 20 bp, Artificial
  CRISPR gRNA sequence
tttcaacttgatacttgtga

SEQ ID NO: 356927 - DNA, 20 bp, Artificial
  CRISPR gRNA sequence
gtgaaagactctctccctgt

SEQ ID NO: 356928 - DNA, 20 bp, Artificial
  CRISPR gRNA sequence
taaaatgccactcatatcta

SEQ ID NO: 356929 - DNA, 20 bp, Artificial
  CRISPR gRNA sequence
aaaatgccactcatatctaa

SEQ ID NO: 356930 - DNA, 20 bp, Artificial
  CRISPR gRNA sequence
ctaaaggattgtgaacacca

SEQ ID NO: 356931 - DNA, 20 bp, Artificial
  CRISPR gRNA sequence
gaacaccatggcctaccttt

SEQ ID NO: 356932 - DNA, 20 bp, Artificial
  CRISPR gRNA sequence
cctacctttgagttctacca

SEQ ID NO: 356933 - DNA, 20 bp, Artificial
  CRISPR gRNA sequence
taaaaacattgaattaatcc

SEQ ID NO: 356934 - DNA, 20 bp, Artificial
  CRISPR gRNA sequence
ttaatcctggaaatgaattt

SEQ ID NO: 356935 - DNA, 20 bp, Artificial
  CRISPR gRNA sequence
aatcctggaaatgaatttta

SEQ ID NO: 356936 - DNA, 20 bp, Artificial
  CRISPR gRNA sequence
gaattttagagtgctcaatg

SEQ ID NO: 356937 - DNA, 20 bp, Artificial
  CRISPR gRNA sequence
gcaaaatatttattttataa

SEQ ID NO: 356938 - DNA, 20 bp, Artificial
  CRISPR gRNA sequence
ttaaaatccctgaatcattt

SEQ ID NO: 356939 - DNA, 20 bp, Artificial
  CRISPR gRNA sequence
aatcattttagtataaataa

SEQ ID NO: 356940 - DNA, 20 bp, Artificial
  CRISPR gRNA sequence
ttagtataaataatagctta

SEQ ID NO: 356941 - DNA, 20 bp, Artificial
  CRISPR gRNA sequence
tataaataatagcttaaaga

SEQ ID NO: 356942 - DNA, 20 bp, Artificial
  CRISPR gRNA sequence
aatagcttaaagatagaaat

SEQ ID NO: 356943 - DNA, 20 bp, Artificial
  CRISPR gRNA sequence
atagcttaaagatagaaatt

SEQ ID NO: 356944 - DNA, 20 bp, Artificial
  CRISPR gRNA sequence
tagcttaaagatagaaattg

SEQ ID NO: 356945 - DNA, 20 bp, Artificial
  CRISPR gRNA sequence
aagatagaaattggggttca

SEQ ID NO: 356946 - DNA, 20 bp, Artificial
  CRISPR gRNA sequence
agatatacttctacttatga

SEQ ID NO: 356947 - DNA, 20 bp, Artificial
  CRISPR gRNA sequence
ttccgtcctcttaaacaaca

SEQ ID NO: 356948 - DNA, 20 bp, Artificial
  CRISPR gRNA sequence
tcttaaacaacatagtcctc

SEQ ID NO: 356949 - DNA, 20 bp, Artificial
  CRISPR gRNA sequence
aacatagtcctccagaaacc

SEQ ID NO: 356950 - DNA, 20 bp, Artificial
  CRISPR gRNA sequence
catcgcctttgaatatttat

SEQ ID NO: 356951 - DNA, 20 bp, Artificial
  CRISPR gRNA sequence
atcgcctttgaatatttatc

SEQ ID NO: 356952 - DNA, 20 bp, Artificial
  CRISPR gRNA sequence
caataatgtttgaaatactt

SEQ ID NO: 356953 - DNA, 20 bp, Artificial
  CRISPR gRNA sequence
tgtttgaaatacttcagatg

SEQ ID NO: 356954 - DNA, 20 bp, Artificial
  CRISPR gRNA sequence
aatacttcagatgaagttca

SEQ ID NO: 356955 - DNA, 20 bp, Artificial
  CRISPR gRNA sequence
ttcaaagtaatcgactgatt

SEQ ID NO: 356956 - DNA, 20 bp, Artificial
  CRISPR gRNA sequence
ttgagttgtaatacttaaat

SEQ ID NO: 356957 - DNA, 20 bp, Artificial
  CRISPR gRNA sequence
cttaaattagaatttctatt

SEQ ID NO: 356958 - DNA, 20 bp, Artificial
  CRISPR gRNA sequence
tgaaatgctattaatcttat

SEQ ID NO: 356959 - DNA, 20 bp, Artificial
  CRISPR gRNA sequence
aataacttattttacatttt

SEQ ID NO: 356960 - DNA, 20 bp, Artificial
  CRISPR gRNA sequence
agtaattttctacttgcttt

SEQ ID NO: 356961 - DNA, 20 bp, Artificial
  CRISPR gRNA sequence
taattttctacttgcttttg

SEQ ID NO: 356962 - DNA, 20 bp, Artificial
  CRISPR gRNA sequence
tttgatcaatcatttatgtt

SEQ ID NO: 356963 - DNA, 20 bp, Artificial
  CRISPR gRNA sequence
atttatgttcagtttttaat

SEQ ID NO: 356964 - DNA, 20 bp, Artificial
  CRISPR gRNA sequence
tttatgttcagtttttaata

SEQ ID NO: 356965 - DNA, 20 bp, Artificial
  CRISPR gRNA sequence
tcagtttttaataaggctct

SEQ ID NO: 356966 - DNA, 20 bp, Artificial
  CRISPR gRNA sequence
agtttttaataaggctctaa

SEQ ID NO: 356967 - DNA, 20 bp, Artificial
  CRISPR gRNA sequence
aggctctaagagacaacctc

SEQ ID NO: 356968 - DNA, 20 bp, Artificial
  CRISPR gRNA sequence
ctcaagctgttaacaattcc

SEQ ID NO: 356969 - DNA, 20 bp, Artificial
  CRISPR gRNA sequence
tcaagctgttaacaattccc

SEQ ID NO: 356970 - DNA, 20 bp, Artificial
  CRISPR gRNA sequence
taacaattcccaggtgcttt

SEQ ID NO: 356971 - DNA, 20 bp, Artificial
  CRISPR gRNA sequence
aaattccatatacgacaata

SEQ ID NO: 356972 - DNA, 20 bp, Artificial
  CRISPR gRNA sequence
atacgacaataaagtataaa

SEQ ID NO: 356973 - DNA, 20 bp, Artificial
  CRISPR gRNA sequence
aagtataaatggttatttca

SEQ ID NO: 356974 - DNA, 20 bp, Artificial
  CRISPR gRNA sequence
ataaatggttatttcacagt

SEQ ID NO: 356975 - DNA, 20 bp, Artificial
  CRISPR gRNA sequence
aaatggttatttcacagtca

SEQ ID NO: 356976 - DNA, 20 bp, Artificial
  CRISPR gRNA sequence
tcacagtcagagtcatttga

SEQ ID NO: 356977 - DNA, 20 bp, Artificial
  CRISPR gRNA sequence
cacagtcagagtcatttgaa

SEQ ID NO: 356978 - DNA, 20 bp, Artificial
  CRISPR gRNA sequence
tgaaaggtctcaaataaatg

SEQ ID NO: 356979 - DNA, 20 bp, Artificial
  CRISPR gRNA sequence
tctttttttttttttttttt

SEQ ID NO: 356980 - DNA, 20 bp, Artificial
  CRISPR gRNA sequence
tttttttttttttttttttg

SEQ ID NO: 356981 - DNA, 20 bp, Artificial
  CRISPR gRNA sequence
tttttttttttttttggaga

SEQ ID NO: 356982 - DNA, 20 bp, Artificial
  CRISPR gRNA sequence
ttttttttttttttggagac

SEQ ID NO: 356983 - DNA, 20 bp, Artificial
  CRISPR gRNA sequence
ttttttttggagacaggttc

SEQ ID NO: 356984 - DNA, 20 bp, Artificial
  CRISPR gRNA sequence
caggttctggctctgttgcc

SEQ ID NO: 356985 - DNA, 20 bp, Artificial
  CRISPR gRNA sequence
aggttctggctctgttgccc

SEQ ID NO: 356986 - DNA, 20 bp, Artificial
  CRISPR gRNA sequence
tggctctgttgcccaggctg

SEQ ID NO: 356987 - DNA, 20 bp, Artificial
  CRISPR gRNA sequence
ttgcccaggctgcagtgcaa

SEQ ID NO: 356988 - DNA, 20 bp, Artificial
  CRISPR gRNA sequence
caggctgcagtgcaatggtg

SEQ ID NO: 356989 - DNA, 20 bp, Artificial
  CRISPR gRNA sequence
gcagtgcaatggtgcagtca

SEQ ID NO: 356990 - DNA, 20 bp, Artificial
  CRISPR gRNA sequence
ggtgcagtcatagctcactg

SEQ ID NO: 356991 - DNA, 20 bp, Artificial
  CRISPR gRNA sequence
tcactgcagccactaattct

SEQ ID NO: 356992 - DNA, 20 bp, Artificial
  CRISPR gRNA sequence
cactgcagccactaattctt

SEQ ID NO: 356993 - DNA, 20 bp, Artificial
  CRISPR gRNA sequence
agccactaattcttgggctc

SEQ ID NO: 356994 - DNA, 20 bp, Artificial
  CRISPR gRNA sequence
gccactaattcttgggctca

SEQ ID NO: 356995 - DNA, 20 bp, Artificial
  CRISPR gRNA sequence
ctcaaggactcctaccgcct

SEQ ID NO: 356996 - DNA, 20 bp, Artificial
  CRISPR gRNA sequence
cctaccgcctcagcctccca

SEQ ID NO: 356997 - DNA, 20 bp, Artificial
  CRISPR gRNA sequence
aagcaccatgtgtgaatttt

SEQ ID NO: 356998 - DNA, 20 bp, Artificial
  CRISPR gRNA sequence
caccatgtgtgaattttaag

SEQ ID NO: 356999 - DNA, 20 bp, Artificial
  CRISPR gRNA sequence
accatgtgtgaattttaagt

SEQ ID NO: 357000 - DNA, 20 bp, Artificial
  CRISPR gRNA sequence
atgtgtgaattttaagtagg

SEQ ID NO: 357001 - DNA, 20 bp, Artificial
  CRISPR gRNA sequence
attttaagtaggaagaaaat

SEQ ID NO: 357002 - DNA, 20 bp, Artificial
  CRISPR gRNA sequence
tgaatgtgaatcctgacttg

SEQ ID NO: 357003 - DNA, 20 bp, Artificial
  CRISPR gRNA sequence
tgaatcctgacttgtagtct

SEQ ID NO: 357004 - DNA, 20 bp, Artificial
  CRISPR gRNA sequence
tgacttgtagtctaagttcc

SEQ ID NO: 357005 - DNA, 20 bp, Artificial
  CRISPR gRNA sequence
gacttgtagtctaagttccc

SEQ ID NO: 357006 - DNA, 20 bp, Artificial
  CRISPR gRNA sequence
acttgtagtctaagttccca

SEQ ID NO: 357007 - DNA, 20 bp, Artificial
  CRISPR gRNA sequence
ttgtagtctaagttcccagg

SEQ ID NO: 357008 - DNA, 20 bp, Artificial
  CRISPR gRNA sequence
gtagtctaagttcccaggga

SEQ ID NO: 357009 - DNA, 20 bp, Artificial
  CRISPR gRNA sequence
ggagagaaaaactttatgaa

SEQ ID NO: 357010 - DNA, 20 bp, Artificial
  CRISPR gRNA sequence
agagaaaaactttatgaaaa

SEQ ID NO: 357011 - DNA, 20 bp, Artificial
  CRISPR gRNA sequence
aaaagagttgaaaattcaat

SEQ ID NO: 357012 - DNA, 20 bp, Artificial
  CRISPR gRNA sequence
agagttgaaaattcaatcag

SEQ ID NO: 357013 - DNA, 20 bp, Artificial
  CRISPR gRNA sequence
gaaaattcaatcagaagata

SEQ ID NO: 357014 - DNA, 20 bp, Artificial
  CRISPR gRNA sequence
aaaattcaatcagaagataa

SEQ ID NO: 357015 - DNA, 20 bp, Artificial
  CRISPR gRNA sequence
agaagataaaggtccacctg

SEQ ID NO: 357016 - DNA, 20 bp, Artificial
  CRISPR gRNA sequence
ataaaggtccacctgtagaa

SEQ ID NO: 357017 - DNA, 20 bp, Artificial
  CRISPR gRNA sequence
aaggtccacctgtagaacag

SEQ ID NO: 357018 - DNA, 20 bp, Artificial
  CRISPR gRNA sequence
acctgtagaacagcagttcc

SEQ ID NO: 357019 - DNA, 20 bp, Artificial
  CRISPR gRNA sequence
cctgtagaacagcagttcct

SEQ ID NO: 357020 - DNA, 20 bp, Artificial
  CRISPR gRNA sequence
ctacaaacttgcattgttta

SEQ ID NO: 357021 - DNA, 20 bp, Artificial
  CRISPR gRNA sequence
caaacttgcattgtttatag

SEQ ID NO: 357022 - DNA, 20 bp, Artificial
  CRISPR gRNA sequence
tgtttatagtggtgttctgt

SEQ ID NO: 357023 - DNA, 20 bp, Artificial
  CRISPR gRNA sequence
agaacttgctttatgtacat

SEQ ID NO: 357024 - DNA, 20 bp, Artificial
  CRISPR gRNA sequence
gaacttgctttatgtacatg

SEQ ID NO: 357025 - DNA, 20 bp, Artificial
  CRISPR gRNA sequence
cttgctttatgtacatgagg

SEQ ID NO: 357026 - DNA, 20 bp, Artificial
  CRISPR gRNA sequence
gtacatgaggtagcaatgta

SEQ ID NO: 357027 - DNA, 20 bp, Artificial
  CRISPR gRNA sequence
aacaatgttcttcaatataa

SEQ ID NO: 357028 - DNA, 20 bp, Artificial
  CRISPR gRNA sequence
cttcaatataatagtgtcat

SEQ ID NO: 357029 - DNA, 20 bp, Artificial
  CRISPR gRNA sequence
atagtgtcatcagataaatt

SEQ ID NO: 357030 - DNA, 20 bp, Artificial
  CRISPR gRNA sequence
aaattcagcatgtaaccttt

SEQ ID NO: 357031 - DNA, 20 bp, Artificial
  CRISPR gRNA sequence
attcagcatgtaacctttta

SEQ ID NO: 357032 - DNA, 20 bp, Artificial
  CRISPR gRNA sequence
cttacttatctatacaataa

SEQ ID NO: 357033 - DNA, 20 bp, Artificial
  CRISPR gRNA sequence
gtatgtataaaaaatgactg

SEQ ID NO: 357034 - DNA, 20 bp, Artificial
  CRISPR gRNA sequence
tatgtataaaaaatgactgc

SEQ ID NO: 357035 - DNA, 20 bp, Artificial
  CRISPR gRNA sequence
atgactgcaggcaaacattc

SEQ ID NO: 357036 - DNA, 20 bp, Artificial
  CRISPR gRNA sequence
tgactgcaggcaaacattct

SEQ ID NO: 357037 - DNA, 20 bp, Artificial
  CRISPR gRNA sequence
ttgtgtgttcaaaaaatgaa

SEQ ID NO: 357038 - DNA, 20 bp, Artificial
  CRISPR gRNA sequence
aaaaatgaatagatcaatac

SEQ ID NO: 357039 - DNA, 20 bp, Artificial
  CRISPR gRNA sequence
aaaatgaatagatcaatact

SEQ ID NO: 357040 - DNA, 20 bp, Artificial
  CRISPR gRNA sequence
aaatgaatagatcaatacta

SEQ ID NO: 357041 - DNA, 20 bp, Artificial
  CRISPR gRNA sequence
tacaaaacaaattaactgac

SEQ ID NO: 357042 - DNA, 20 bp, Artificial
  CRISPR gRNA sequence
ttgcatttttttgaatgcaa

SEQ ID NO: 357043 - DNA, 20 bp, Artificial
  CRISPR gRNA sequence
gatcattaaaaaaaatgatc

SEQ ID NO: 357044 - DNA, 20 bp, Artificial
  CRISPR gRNA sequence
atcattaaaaaaaatgatct

SEQ ID NO: 357045 - DNA, 20 bp, Artificial
  CRISPR gRNA sequence
attaaaaaaaatgatctggg

SEQ ID NO: 357046 - DNA, 20 bp, Artificial
  CRISPR gRNA sequence
taaaaaaaatgatctgggca

SEQ ID NO: 357047 - DNA, 20 bp, Artificial
  CRISPR gRNA sequence
aaaaaaaatgatctgggcag

SEQ ID NO: 357048 - DNA, 20 bp, Artificial
  CRISPR gRNA sequence
aatgatctgggcagaggcaa

SEQ ID NO: 357049 - DNA, 20 bp, Artificial
  CRISPR gRNA sequence
tctgggcagaggcaacagta

SEQ ID NO: 357050 - DNA, 20 bp, Artificial
  CRISPR gRNA sequence
gcagaggcaacagtaaagta

SEQ ID NO: 357051 - DNA, 20 bp, Artificial
  CRISPR gRNA sequence
gtaaagattcaaccacataa

SEQ ID NO: 357052 - DNA, 20 bp, Artificial
  CRISPR gRNA sequence
accacataatagccatgatt

SEQ ID NO: 357053 - DNA, 20 bp, Artificial
  CRISPR gRNA sequence
aatcaactcacttgtgatgc

SEQ ID NO: 357054 - DNA, 20 bp, Artificial
  CRISPR gRNA sequence
gctggaaactatgtttcatc

SEQ ID NO: 357055 - DNA, 20 bp, Artificial
  CRISPR gRNA sequence
ctatgtttcatctggatacc

SEQ ID NO: 357056 - DNA, 20 bp, Artificial
  CRISPR gRNA sequence
tctggatacccagtttcacc

SEQ ID NO: 357057 - DNA, 20 bp, Artificial
  CRISPR gRNA sequence
tttcaccgagaaaactaaat

SEQ ID NO: 357058 - DNA, 20 bp, Artificial
  CRISPR gRNA sequence
ttcaccgagaaaactaaatt

SEQ ID NO: 357059 - DNA, 20 bp, Artificial
  CRISPR gRNA sequence
ctaaattgggctgaaaattg

SEQ ID NO: 357060 - DNA, 20 bp, Artificial
  CRISPR gRNA sequence
aaattgtggttgatctgttt

SEQ ID NO: 357061 - DNA, 20 bp, Artificial
  CRISPR gRNA sequence
ttgtggttgatctgtttgag

SEQ ID NO: 357062 - DNA, 20 bp, Artificial
  CRISPR gRNA sequence
gtggttgatctgtttgagta

SEQ ID NO: 357063 - DNA, 20 bp, Artificial
  CRISPR gRNA sequence
tggttgatctgtttgagtag

SEQ ID NO: 357064 - DNA, 20 bp, Artificial
  CRISPR gRNA sequence
tgtttgagtagaggttattt

SEQ ID NO: 357065 - DNA, 20 bp, Artificial
  CRISPR gRNA sequence
tagaggttattttagcttgt

SEQ ID NO: 357066 - DNA, 20 bp, Artificial
  CRISPR gRNA sequence
aggttattttagcttgtgag

SEQ ID NO: 357067 - DNA, 20 bp, Artificial
  CRISPR gRNA sequence
ttagcttgtgagcagtgaca

SEQ ID NO: 357068 - DNA, 20 bp, Artificial
  CRISPR gRNA sequence
tgagcagtgacacggtgctc

SEQ ID NO: 357069 - DNA, 20 bp, Artificial
  CRISPR gRNA sequence
gagcagtgacacggtgctct

SEQ ID NO: 357070 - DNA, 20 bp, Artificial
  CRISPR gRNA sequence
gacacggtgctctgggattc

SEQ ID NO: 357071 - DNA, 20 bp, Artificial
  CRISPR gRNA sequence
atcatataaattaactgtca

SEQ ID NO: 357072 - DNA, 20 bp, Artificial
  CRISPR gRNA sequence
tggacattttactttccatg

SEQ ID NO: 357073 - DNA, 20 bp, Artificial
  CRISPR gRNA sequence
ggacattttactttccatgt

SEQ ID NO: 357074 - DNA, 20 bp, Artificial
  CRISPR gRNA sequence
ttttactttccatgtaggta

SEQ ID NO: 357075 - DNA, 20 bp, Artificial
  CRISPR gRNA sequence
catgtaggtaaagataataa

SEQ ID NO: 357076 - DNA, 20 bp, Artificial
  CRISPR gRNA sequence
atgtaggtaaagataataaa

SEQ ID NO: 357077 - DNA, 20 bp, Artificial
  CRISPR gRNA sequence
ggtaaagataataaaaggct

SEQ ID NO: 357078 - DNA, 20 bp, Artificial
  CRISPR gRNA sequence
gtaaagataataaaaggctg

SEQ ID NO: 357079 - DNA, 20 bp, Artificial
  CRISPR gRNA sequence
aggttcaccacacaatgtca

SEQ ID NO: 357080 - DNA, 20 bp, Artificial
  CRISPR gRNA sequence
tcaccacacaatgtcatgga

SEQ ID NO: 357081 - DNA, 20 bp, Artificial
  CRISPR gRNA sequence
caccacacaatgtcatggaa

SEQ ID NO: 357082 - DNA, 20 bp, Artificial
  CRISPR gRNA sequence
accacacaatgtcatggaaa

SEQ ID NO: 357083 - DNA, 20 bp, Artificial
  CRISPR gRNA sequence
atggaaagggacatatctgt

SEQ ID NO: 357084 - DNA, 20 bp, Artificial
  CRISPR gRNA sequence
aagggacatatctgtcagcc

SEQ ID NO: 357085 - DNA, 20 bp, Artificial
  CRISPR gRNA sequence
tctgtcagcccagtgcacac

SEQ ID NO: 357086 - DNA, 20 bp, Artificial
  CRISPR gRNA sequence
cagcccagtgcacaccagtt

SEQ ID NO: 357087 - DNA, 20 bp, Artificial
  CRISPR gRNA sequence
cagacaatcctcatgtccac

SEQ ID NO: 357088 - DNA, 20 bp, Artificial
  CRISPR gRNA sequence
ttatatctattctaaattca

SEQ ID NO: 357089 - DNA, 20 bp, Artificial
  CRISPR gRNA sequence
tatatctattctaaattcat

SEQ ID NO: 357090 - DNA, 20 bp, Artificial
  CRISPR gRNA sequence
tatctattctaaattcatag

SEQ ID NO: 357091 - DNA, 20 bp, Artificial
  CRISPR gRNA sequence
ctattctaaattcataggag

SEQ ID NO: 357092 - DNA, 20 bp, Artificial
  CRISPR gRNA sequence
tattctaaattcataggagt

SEQ ID NO: 357093 - DNA, 20 bp, Artificial
  CRISPR gRNA sequence
ctaaattcataggagtggga

SEQ ID NO: 357094 - DNA, 20 bp, Artificial
  CRISPR gRNA sequence
aattcataggagtgggacag

SEQ ID NO: 357095 - DNA, 20 bp, Artificial
  CRISPR gRNA sequence
attcataggagtgggacaga

SEQ ID NO: 357096 - DNA, 20 bp, Artificial
  CRISPR gRNA sequence
aggagtgggacagaaggttc

SEQ ID NO: 357097 - DNA, 20 bp, Artificial
  CRISPR gRNA sequence
gacagaaggttctggattaa

SEQ ID NO: 357098 - DNA, 20 bp, Artificial
  CRISPR gRNA sequence
tctacaacctgaaactcttc

SEQ ID NO: 357099 - DNA, 20 bp, Artificial
  CRISPR gRNA sequence
aaactcttctggaatccaaa

SEQ ID NO: 357100 - DNA, 20 bp, Artificial
  CRISPR gRNA sequence
cttctggaatccaaatggac

SEQ ID NO: 357101 - DNA, 20 bp, Artificial
  CRISPR gRNA sequence
ttctggaatccaaatggact

SEQ ID NO: 357102 - DNA, 20 bp, Artificial
  CRISPR gRNA sequence
ctggaatccaaatggactgg

SEQ ID NO: 357103 - DNA, 20 bp, Artificial
  CRISPR gRNA sequence
caaatggactgggagcaaac

SEQ ID NO: 357104 - DNA, 20 bp, Artificial
  CRISPR gRNA sequence
tggactgggagcaaactggt

SEQ ID NO: 357105 - DNA, 20 bp, Artificial
  CRISPR gRNA sequence
gcaaactggttggtttttga

SEQ ID NO: 357106 - DNA, 20 bp, Artificial
  CRISPR gRNA sequence
ttggtttttgacagaaataa

SEQ ID NO: 357107 - DNA, 20 bp, Artificial
  CRISPR gRNA sequence
tggtttttgacagaaataaa

SEQ ID NO: 357108 - DNA, 20 bp, Artificial
  CRISPR gRNA sequence
tttgacagaaataaaaggcc

SEQ ID NO: 357109 - DNA, 20 bp, Artificial
  CRISPR gRNA sequence
ttgacagaaataaaaggcca

SEQ ID NO: 357110 - DNA, 20 bp, Artificial
  CRISPR gRNA sequence
aaataaaaggccaaggaaat

SEQ ID NO: 357111 - DNA, 20 bp, Artificial
  CRISPR gRNA sequence
aataattttataatccaact

SEQ ID NO: 357112 - DNA, 20 bp, Artificial
  CRISPR gRNA sequence
ataattttataatccaactc

SEQ ID NO: 357113 - DNA, 20 bp, Artificial
  CRISPR gRNA sequence
aattttataatccaactcag

SEQ ID NO: 357114 - DNA, 20 bp, Artificial
  CRISPR gRNA sequence
tataatccaactcaggagca

SEQ ID NO: 357115 - DNA, 20 bp, Artificial
  CRISPR gRNA sequence
taatccaactcaggagcaca

SEQ ID NO: 357116 - DNA, 20 bp, Artificial
  CRISPR gRNA sequence
ctcaggagcacagagtctca

SEQ ID NO: 357117 - DNA, 20 bp, Artificial
  CRISPR gRNA sequence
ggagcacagagtctcaaagt

SEQ ID NO: 357118 - DNA, 20 bp, Artificial
  CRISPR gRNA sequence
caaagtcagtaacctcccac

SEQ ID NO: 357119 - DNA, 20 bp, Artificial
  CRISPR gRNA sequence
aacctcccacaagccatcta

SEQ ID NO: 357120 - DNA, 20 bp, Artificial
  CRISPR gRNA sequence
acctcccacaagccatctac

SEQ ID NO: 357121 - DNA, 20 bp, Artificial
  CRISPR gRNA sequence
cccacaagccatctacaggc

SEQ ID NO: 357122 - DNA, 20 bp, Artificial
  CRISPR gRNA sequence
gatttataatctgtataaat

SEQ ID NO: 357123 - DNA, 20 bp, Artificial
  CRISPR gRNA sequence
taagatgtatcatctatata

SEQ ID NO: 357124 - DNA, 20 bp, Artificial
  CRISPR gRNA sequence
acggatgtatttataactta

SEQ ID NO: 357125 - DNA, 20 bp, Artificial
  CRISPR gRNA sequence
tcctatacctcacatcgtcc

SEQ ID NO: 357126 - DNA, 20 bp, Artificial
  CRISPR gRNA sequence
ctatacctcacatcgtccca

SEQ ID NO: 357127 - DNA, 20 bp, Artificial
  CRISPR gRNA sequence
tatacctcacatcgtcccag

SEQ ID NO: 357128 - DNA, 20 bp, Artificial
  CRISPR gRNA sequence
atcgtcccagaggaaatatc

SEQ ID NO: 357129 - DNA, 20 bp, Artificial
  CRISPR gRNA sequence
tcgtcccagaggaaatatct

SEQ ID NO: 357130 - DNA, 20 bp, Artificial
  CRISPR gRNA sequence
tcccagaggaaatatctggg

SEQ ID NO: 357131 - DNA, 20 bp, Artificial
  CRISPR gRNA sequence
aatatctgggaagattctct

SEQ ID NO: 357132 - DNA, 20 bp, Artificial
  CRISPR gRNA sequence
tgggaagattctcttagctg

SEQ ID NO: 357133 - DNA, 20 bp, Artificial
  CRISPR gRNA sequence
gctgtggcactatgatttcc

SEQ ID NO: 357134 - DNA, 20 bp, Artificial
  CRISPR gRNA sequence
cactatgatttcctagtgaa

SEQ ID NO: 357135 - DNA, 20 bp, Artificial
  CRISPR gRNA sequence
actaatcccatccttctatt

SEQ ID NO: 357136 - DNA, 20 bp, Artificial
  CRISPR gRNA sequence
catccttctattcagatgac

SEQ ID NO: 357137 - DNA, 20 bp, Artificial
  CRISPR gRNA sequence
ttatattaaaaattcaaaat

SEQ ID NO: 357138 - DNA, 20 bp, Artificial
  CRISPR gRNA sequence
aattcaaaataagaaaatga

SEQ ID NO: 357139 - DNA, 20 bp, Artificial
  CRISPR gRNA sequence
taagaaaatgaaagttaaaa

SEQ ID NO: 357140 - DNA, 20 bp, Artificial
  CRISPR gRNA sequence
atgaaagttaaaaaagtaaa

SEQ ID NO: 357141 - DNA, 20 bp, Artificial
  CRISPR gRNA sequence
aagtaaatagccctatctga

SEQ ID NO: 357142 - DNA, 20 bp, Artificial
  CRISPR gRNA sequence
tgaaagttatatatgtaaac

SEQ ID NO: 357143 - DNA, 20 bp, Artificial
  CRISPR gRNA sequence
aaagttatatatgtaaacaa

SEQ ID NO: 357144 - DNA, 20 bp, Artificial
  CRISPR gRNA sequence
atgtaaacaagagttcatga

SEQ ID NO: 357145 - DNA, 20 bp, Artificial
  CRISPR gRNA sequence
agttttttctccaatcactg

SEQ ID NO: 357146 - DNA, 20 bp, Artificial
  CRISPR gRNA sequence
cactgtagttgatcttttga

SEQ ID NO: 357147 - DNA, 20 bp, Artificial
  CRISPR gRNA sequence
tagttgatcttttgaaagtt

SEQ ID NO: 357148 - DNA, 20 bp, Artificial
  CRISPR gRNA sequence
cagtttctttgatcaacaat

SEQ ID NO: 357149 - DNA, 20 bp, Artificial
  CRISPR gRNA sequence
tcaacaatcagtaaacctca

SEQ ID NO: 357150 - DNA, 20 bp, Artificial
  CRISPR gRNA sequence
caacaatcagtaaacctcaa

SEQ ID NO: 357151 - DNA, 20 bp, Artificial
  CRISPR gRNA sequence
acctcaaaggttaaacgttg

SEQ ID NO: 357152 - DNA, 20 bp, Artificial
  CRISPR gRNA sequence
aacgttgaagaaaaaaaatc

SEQ ID NO: 357153 - DNA, 20 bp, Artificial
  CRISPR gRNA sequence
ttgaagaaaaaaaatctgga

SEQ ID NO: 357154 - DNA, 20 bp, Artificial
  CRISPR gRNA sequence
gaaaaaaaatctggaaagaa

SEQ ID NO: 357155 - DNA, 20 bp, Artificial
  CRISPR gRNA sequence
aaaaaaatctggaaagaaaa

SEQ ID NO: 357156 - DNA, 20 bp, Artificial
  CRISPR gRNA sequence
aaaaaatctggaaagaaaag

SEQ ID NO: 357157 - DNA, 20 bp, Artificial
  CRISPR gRNA sequence
aaatctggaaagaaaagagg

SEQ ID NO: 357158 - DNA, 20 bp, Artificial
  CRISPR gRNA sequence
tagaaaacttaaaattaaaa

SEQ ID NO: 357159 - DNA, 20 bp, Artificial
  CRISPR gRNA sequence
acttaaaattaaaatggaca

SEQ ID NO: 357160 - DNA, 20 bp, Artificial
  CRISPR gRNA sequence
aaaatggacacagcccctac

SEQ ID NO: 357161 - DNA, 20 bp, Artificial
  CRISPR gRNA sequence
acagcccctactagaatgaa

SEQ ID NO: 357162 - DNA, 20 bp, Artificial
  CRISPR gRNA sequence
aatagaaacattaacataat

SEQ ID NO: 357163 - DNA, 20 bp, Artificial
  CRISPR gRNA sequence
aaacattaacataatcggtc

SEQ ID NO: 357164 - DNA, 20 bp, Artificial
  CRISPR gRNA sequence
aatcggtcaagaacacttac

SEQ ID NO: 357165 - DNA, 20 bp, Artificial
  CRISPR gRNA sequence
atcggtcaagaacacttact

SEQ ID NO: 357166 - DNA, 20 bp, Artificial
  CRISPR gRNA sequence
cttactgggcatattctgaa

SEQ ID NO: 357167 - DNA, 20 bp, Artificial
  CRISPR gRNA sequence
aaagatgctttgacaacttt

SEQ ID NO: 357168 - DNA, 20 bp, Artificial
  CRISPR gRNA sequence
gatgctttgacaactttaag

SEQ ID NO: 357169 - DNA, 20 bp, Artificial
  CRISPR gRNA sequence
ctcaattaatttctgataac

SEQ ID NO: 357170 - DNA, 20 bp, Artificial
  CRISPR gRNA sequence
caattaatttctgataacca

SEQ ID NO: 357171 - DNA, 20 bp, Artificial
  CRISPR gRNA sequence
aatttctgataaccagagtt

SEQ ID NO: 357172 - DNA, 20 bp, Artificial
  CRISPR gRNA sequence
agagtttggaacattacaaa

SEQ ID NO: 357173 - DNA, 20 bp, Artificial
  CRISPR gRNA sequence
tggaacattacaaatagatg

SEQ ID NO: 357174 - DNA, 20 bp, Artificial
  CRISPR gRNA sequence
ggaacattacaaatagatgc

SEQ ID NO: 357175 - DNA, 20 bp, Artificial
  CRISPR gRNA sequence
cattacaaatagatgcaggc

SEQ ID NO: 357176 - DNA, 20 bp, Artificial
  CRISPR gRNA sequence
attacaaatagatgcaggcc

SEQ ID NO: 357177 - DNA, 20 bp, Artificial
  CRISPR gRNA sequence
aaatagatgcaggccaggtg

SEQ ID NO: 357178 - DNA, 20 bp, Artificial
  CRISPR gRNA sequence
tagatgcaggccaggtgtgg

SEQ ID NO: 357179 - DNA, 20 bp, Artificial
  CRISPR gRNA sequence
gtggttcacactaccaatcc

SEQ ID NO: 357180 - DNA, 20 bp, Artificial
  CRISPR gRNA sequence
cactaccaatcccagcactt

SEQ ID NO: 357181 - DNA, 20 bp, Artificial
  CRISPR gRNA sequence
actaccaatcccagcacttt

SEQ ID NO: 357182 - DNA, 20 bp, Artificial
  CRISPR gRNA sequence
taccaatcccagcactttag

SEQ ID NO: 357183 - DNA, 20 bp, Artificial
  CRISPR gRNA sequence
accaatcccagcactttagg

SEQ ID NO: 357184 - DNA, 20 bp, Artificial
  CRISPR gRNA sequence
tcccagcactttaggaggct

SEQ ID NO: 357185 - DNA, 20 bp, Artificial
  CRISPR gRNA sequence
cccagcactttaggaggctg

SEQ ID NO: 357186 - DNA, 20 bp, Artificial
  CRISPR gRNA sequence
agcactttaggaggctgagg

SEQ ID NO: 357187 - DNA, 20 bp, Artificial
  CRISPR gRNA sequence
gcactttaggaggctgaggc

SEQ ID NO: 357188 - DNA, 20 bp, Artificial
  CRISPR gRNA sequence
cactttaggaggctgaggca

SEQ ID NO: 357189 - DNA, 20 bp, Artificial
  CRISPR gRNA sequence
actttaggaggctgaggcag

SEQ ID NO: 357190 - DNA, 20 bp, Artificial
  CRISPR gRNA sequence
gctgaggcaggggattgctt

SEQ ID NO: 357191 - DNA, 20 bp, Artificial
  CRISPR gRNA sequence
ggcaggggattgcttgagcc

SEQ ID NO: 357192 - DNA, 20 bp, Artificial
  CRISPR gRNA sequence
gcaggggattgcttgagccc

SEQ ID NO: 357193 - DNA, 20 bp, Artificial
  CRISPR gRNA sequence
tctaccaaaaatacaaaaat

SEQ ID NO: 357194 - DNA, 20 bp, Artificial
  CRISPR gRNA sequence
ccaaaaatacaaaaattagc

SEQ ID NO: 357195 - DNA, 20 bp, Artificial
  CRISPR gRNA sequence
aattagccagtctcataacc

SEQ ID NO: 357196 - DNA, 20 bp, Artificial
  CRISPR gRNA sequence
aataaataaataaatacaaa

SEQ ID NO: 357197 - DNA, 20 bp, Artificial
  CRISPR gRNA sequence
aataaataaatacaaataga

SEQ ID NO: 357198 - DNA, 20 bp, Artificial
  CRISPR gRNA sequence
aaataaatacaaatagatgg

SEQ ID NO: 357199 - DNA, 20 bp, Artificial
  CRISPR gRNA sequence
acaaatagatggaagttaat

SEQ ID NO: 357200 - DNA, 20 bp, Artificial
  CRISPR gRNA sequence
tggaagttaataagtcactc

SEQ ID NO: 357201 - DNA, 20 bp, Artificial
  CRISPR gRNA sequence
ggaagttaataagtcactcg

SEQ ID NO: 357202 - DNA, 20 bp, Artificial
  CRISPR gRNA sequence
gaagttaataagtcactcga

SEQ ID NO: 357203 - DNA, 20 bp, Artificial
  CRISPR gRNA sequence
gttaataagtcactcgaggg

SEQ ID NO: 357204 - DNA, 20 bp, Artificial
  CRISPR gRNA sequence
cactcgagggtagcaatttt

SEQ ID NO: 357205 - DNA, 20 bp, Artificial
  CRISPR gRNA sequence
tagcaattttcagactataa

SEQ ID NO: 357206 - DNA, 20 bp, Artificial
  CRISPR gRNA sequence
ttttcagactataaaagttt

SEQ ID NO: 357207 - DNA, 20 bp, Artificial
  CRISPR gRNA sequence
tataaaagtttgagaaatcc

SEQ ID NO: 357208 - DNA, 20 bp, Artificial
  CRISPR gRNA sequence
gatgcttaatatttcaatga

SEQ ID NO: 357209 - DNA, 20 bp, Artificial
  CRISPR gRNA sequence
atgcttaatatttcaatgat

SEQ ID NO: 357210 - DNA, 20 bp, Artificial
  CRISPR gRNA sequence
tgcttaatatttcaatgatg

SEQ ID NO: 357211 - DNA, 20 bp, Artificial
  CRISPR gRNA sequence
ttaatatttcaatgatgggg

SEQ ID NO: 357212 - DNA, 20 bp, Artificial
  CRISPR gRNA sequence
atatttcaatgatggggaag

SEQ ID NO: 357213 - DNA, 20 bp, Artificial
  CRISPR gRNA sequence
tcaatgatggggaagcagtt

SEQ ID NO: 357214 - DNA, 20 bp, Artificial
  CRISPR gRNA sequence
ggaagcagtttggtctgatg

SEQ ID NO: 357215 - DNA, 20 bp, Artificial
  CRISPR gRNA sequence
gtctgatgtggaaaaaaaca

SEQ ID NO: 357216 - DNA, 20 bp, Artificial
  CRISPR gRNA sequence
tggaaaaaaacatagacatt

SEQ ID NO: 357217 - DNA, 20 bp, Artificial
  CRISPR gRNA sequence
aaaaaacatagacattgaga

SEQ ID NO: 357218 - DNA, 20 bp, Artificial
  CRISPR gRNA sequence
ttgagacggctgaaactcta

SEQ ID NO: 357219 - DNA, 20 bp, Artificial
  CRISPR gRNA sequence
tgagacggctgaaactctat

SEQ ID NO: 357220 - DNA, 20 bp, Artificial
  CRISPR gRNA sequence
acggctgaaactctatagga

SEQ ID NO: 357221 - DNA, 20 bp, Artificial
  CRISPR gRNA sequence
ctgaaactctataggaaaga

SEQ ID NO: 357222 - DNA, 20 bp, Artificial
  CRISPR gRNA sequence
aggaaagaaagcaaatgtga

SEQ ID NO: 357223 - DNA, 20 bp, Artificial
  CRISPR gRNA sequence
aagcaaatgtgatggaaact

SEQ ID NO: 357224 - DNA, 20 bp, Artificial
  CRISPR gRNA sequence
aaatgtgatggaaacttagt

SEQ ID NO: 357225 - DNA, 20 bp, Artificial
  CRISPR gRNA sequence
gtgatggaaacttagtcagt

SEQ ID NO: 357226 - DNA, 20 bp, Artificial
  CRISPR gRNA sequence
gaaacttagtcagttagaaa

SEQ ID NO: 357227 - DNA, 20 bp, Artificial
  CRISPR gRNA sequence
aaacttagtcagttagaaaa

SEQ ID NO: 357228 - DNA, 20 bp, Artificial
  CRISPR gRNA sequence
acttagtcagttagaaaaag

SEQ ID NO: 357229 - DNA, 20 bp, Artificial
  CRISPR gRNA sequence
agtcagttagaaaaaggaga

SEQ ID NO: 357230 - DNA, 20 bp, Artificial
  CRISPR gRNA sequence
cagttagaaaaaggagaaag

SEQ ID NO: 357231 - DNA, 20 bp, Artificial
  CRISPR gRNA sequence
agttagaaaaaggagaaagt

SEQ ID NO: 357232 - DNA, 20 bp, Artificial
  CRISPR gRNA sequence
agaaaaaggagaaagtagga

SEQ ID NO: 357233 - DNA, 20 bp, Artificial
  CRISPR gRNA sequence
aggagaaagtaggaaagtgt

SEQ ID NO: 357234 - DNA, 20 bp, Artificial
  CRISPR gRNA sequence
taggaaagtgtgagtgtttt

SEQ ID NO: 357235 - DNA, 20 bp, Artificial
  CRISPR gRNA sequence
aggaaagtgtgagtgttttg

SEQ ID NO: 357236 - DNA, 20 bp, Artificial
  CRISPR gRNA sequence
aaagtgtgagtgttttgagg

SEQ ID NO: 357237 - DNA, 20 bp, Artificial
  CRISPR gRNA sequence
gtgtgagtgttttgaggcag

SEQ ID NO: 357238 - DNA, 20 bp, Artificial
  CRISPR gRNA sequence
gagtgttttgaggcagtgga

SEQ ID NO: 357239 - DNA, 20 bp, Artificial
  CRISPR gRNA sequence
ggcagtggaaagcacaaact

SEQ ID NO: 357240 - DNA, 20 bp, Artificial
  CRISPR gRNA sequence
tgagattcaaatcatgctga

SEQ ID NO: 357241 - DNA, 20 bp, Artificial
  CRISPR gRNA sequence
cagtatctctctaccctgtg

SEQ ID NO: 357242 - DNA, 20 bp, Artificial
  CRISPR gRNA sequence
agtatctctctaccctgtgt

SEQ ID NO: 357243 - DNA, 20 bp, Artificial
  CRISPR gRNA sequence
aggacacctttgtgcctaca

SEQ ID NO: 357244 - DNA, 20 bp, Artificial
  CRISPR gRNA sequence
ggacacctttgtgcctacaa

SEQ ID NO: 357245 - DNA, 20 bp, Artificial
  CRISPR gRNA sequence
cacctttgtgcctacaaagg

SEQ ID NO: 357246 - DNA, 20 bp, Artificial
  CRISPR gRNA sequence
acctttgtgcctacaaaggt

SEQ ID NO: 357247 - DNA, 20 bp, Artificial
  CRISPR gRNA sequence
tttgtgcctacaaaggtagg

SEQ ID NO: 357248 - DNA, 20 bp, Artificial
  CRISPR gRNA sequence
gcctacaaaggtaggtggat

SEQ ID NO: 357249 - DNA, 20 bp, Artificial
  CRISPR gRNA sequence
tacaaaggtaggtggatcag

SEQ ID NO: 357250 - DNA, 20 bp, Artificial
  CRISPR gRNA sequence
ctatgacccatcactgatcc

SEQ ID NO: 357251 - DNA, 20 bp, Artificial
  CRISPR gRNA sequence
tatgacccatcactgatccc

SEQ ID NO: 357252 - DNA, 20 bp, Artificial
  CRISPR gRNA sequence
cccatcactgatcccaggac

SEQ ID NO: 357253 - DNA, 20 bp, Artificial
  CRISPR gRNA sequence
ccatcactgatcccaggacc

SEQ ID NO: 357254 - DNA, 20 bp, Artificial
  CRISPR gRNA sequence
tcactgatcccaggaccagg

SEQ ID NO: 357255 - DNA, 20 bp, Artificial
  CRISPR gRNA sequence
cccaggaccaggtggcttca

SEQ ID NO: 357256 - DNA, 20 bp, Artificial
  CRISPR gRNA sequence
atgaattctatcaaacattc

SEQ ID NO: 357257 - DNA, 20 bp, Artificial
  CRISPR gRNA sequence
tgaattctatcaaacattct

SEQ ID NO: 357258 - DNA, 20 bp, Artificial
  CRISPR gRNA sequence
taggaattaatgccaatcct

SEQ ID NO: 357259 - DNA, 20 bp, Artificial
  CRISPR gRNA sequence
attaatgccaatcctgagtt

SEQ ID NO: 357260 - DNA, 20 bp, Artificial
  CRISPR gRNA sequence
gccaatcctgagtttagaaa

SEQ ID NO: 357261 - DNA, 20 bp, Artificial
  CRISPR gRNA sequence
atttaattcttttttaaaaa

SEQ ID NO: 357262 - DNA, 20 bp, Artificial
  CRISPR gRNA sequence
taattcttttttaaaaaaag

SEQ ID NO: 357263 - DNA, 20 bp, Artificial
  CRISPR gRNA sequence
ttcttttttaaaaaaagaag

SEQ ID NO: 357264 - DNA, 20 bp, Artificial
  CRISPR gRNA sequence
aaaagaagcagttctaaact

SEQ ID NO: 357265 - DNA, 20 bp, Artificial
  CRISPR gRNA sequence
cagttctaaactcagtttat

SEQ ID NO: 357266 - DNA, 20 bp, Artificial
  CRISPR gRNA sequence
ctaaactcagtttatgagac

SEQ ID NO: 357267 - DNA, 20 bp, Artificial
  CRISPR gRNA sequence
catcaccctgataccaaaac

SEQ ID NO: 357268 - DNA, 20 bp, Artificial
  CRISPR gRNA sequence
cctgataccaaaaccagaca

SEQ ID NO: 357269 - DNA, 20 bp, Artificial
  CRISPR gRNA sequence
aaaaaaaaaaaaaaaaccta

SEQ ID NO: 357270 - DNA, 20 bp, Artificial
  CRISPR gRNA sequence
aaaaaaaaaaaaaaacctac

SEQ ID NO: 357271 - DNA, 20 bp, Artificial
  CRISPR gRNA sequence
gctgacatccctaatgaaca

SEQ ID NO: 357272 - DNA, 20 bp, Artificial
  CRISPR gRNA sequence
aaaaatcctcaacaaaatac

SEQ ID NO: 357273 - DNA, 20 bp, Artificial
  CRISPR gRNA sequence
aaattcaccatcacattaaa

SEQ ID NO: 357274 - DNA, 20 bp, Artificial
  CRISPR gRNA sequence
aatcaattctgatttatccc

SEQ ID NO: 357275 - DNA, 20 bp, Artificial
  CRISPR gRNA sequence
tgatttatccctggcatgca

SEQ ID NO: 357276 - DNA, 20 bp, Artificial
  CRISPR gRNA sequence
ttatccctggcatgcaaaga

SEQ ID NO: 357277 - DNA, 20 bp, Artificial
  CRISPR gRNA sequence
tgtaatacaccacattaaca

SEQ ID NO: 357278 - DNA, 20 bp, Artificial
  CRISPR gRNA sequence
cattaacaaagtgatataaa

SEQ ID NO: 357279 - DNA, 20 bp, Artificial
  CRISPR gRNA sequence
attaacaaagtgatataaaa

SEQ ID NO: 357280 - DNA, 20 bp, Artificial
  CRISPR gRNA sequence
aggccacatgatcatcaaaa

SEQ ID NO: 357281 - DNA, 20 bp, Artificial
  CRISPR gRNA sequence
gccacatgatcatcaaaata

SEQ ID NO: 357282 - DNA, 20 bp, Artificial
  CRISPR gRNA sequence
tcatcaaaatagagcataaa

SEQ ID NO: 357283 - DNA, 20 bp, Artificial
  CRISPR gRNA sequence
aaaaaaaactctcaacaaat

SEQ ID NO: 357284 - DNA, 20 bp, Artificial
  CRISPR gRNA sequence
aaaaaaactctcaacaaatt

SEQ ID NO: 357285 - DNA, 20 bp, Artificial
  CRISPR gRNA sequence
aactctcaacaaattaggta

SEQ ID NO: 357286 - DNA, 20 bp, Artificial
  CRISPR gRNA sequence
ctcaacaaattaggtacaga

SEQ ID NO: 357287 - DNA, 20 bp, Artificial
  CRISPR gRNA sequence
gaatttaccccaacacaata

SEQ ID NO: 357288 - DNA, 20 bp, Artificial
  CRISPR gRNA sequence
aatttaccccaacacaataa

SEQ ID NO: 357289 - DNA, 20 bp, Artificial
  CRISPR gRNA sequence
caataaaggccatctatgaa

SEQ ID NO: 357290 - DNA, 20 bp, Artificial
  CRISPR gRNA sequence
ggccatctatgaaaagccca

SEQ ID NO: 357291 - DNA, 20 bp, Artificial
  CRISPR gRNA sequence
cccacagctaacatcatacc

SEQ ID NO: 357292 - DNA, 20 bp, Artificial
  CRISPR gRNA sequence
aacatcataccaagtcatgt

SEQ ID NO: 357293 - DNA, 20 bp, Artificial
  CRISPR gRNA sequence
ataccaagtcatgtaagact

SEQ ID NO: 357294 - DNA, 20 bp, Artificial
  CRISPR gRNA sequence
agactgagaacttttgctct

SEQ ID NO: 357295 - DNA, 20 bp, Artificial
  CRISPR gRNA sequence
gagaacttttgctctaagat

SEQ ID NO: 357296 - DNA, 20 bp, Artificial
  CRISPR gRNA sequence
agaacttttgctctaagatc

SEQ ID NO: 357297 - DNA, 20 bp, Artificial
  CRISPR gRNA sequence
tttgctctaagatcaggaaa

SEQ ID NO: 357298 - DNA, 20 bp, Artificial
  CRISPR gRNA sequence
ctaagatcaggaaaaagaca

SEQ ID NO: 357299 - DNA, 20 bp, Artificial
  CRISPR gRNA sequence
taagatcaggaaaaagacaa

SEQ ID NO: 357300 - DNA, 20 bp, Artificial
  CRISPR gRNA sequence
gatcaggaaaaagacaaagg

SEQ ID NO: 357301 - DNA, 20 bp, Artificial
  CRISPR gRNA sequence
ttcaacacctctgcttaaca

SEQ ID NO: 357302 - DNA, 20 bp, Artificial
  CRISPR gRNA sequence
acctctgcttaacatagtac

SEQ ID NO: 357303 - DNA, 20 bp, Artificial
  CRISPR gRNA sequence
tctgcttaacatagtacaag

SEQ ID NO: 357304 - DNA, 20 bp, Artificial
  CRISPR gRNA sequence
atagtacaagaagtcttaat

SEQ ID NO: 357305 - DNA, 20 bp, Artificial
  CRISPR gRNA sequence
agtacaagaagtcttaatca

SEQ ID NO: 357306 - DNA, 20 bp, Artificial
  CRISPR gRNA sequence
cttaatcagagccattaaac

SEQ ID NO: 357307 - DNA, 20 bp, Artificial
  CRISPR gRNA sequence
cagagccattaaacaagaaa

SEQ ID NO: 357308 - DNA, 20 bp, Artificial
  CRISPR gRNA sequence
aaacaagaaaaagaaaacaa

SEQ ID NO: 357309 - DNA, 20 bp, Artificial
  CRISPR gRNA sequence
aacaagaaaaagaaaacaaa

SEQ ID NO: 357310 - DNA, 20 bp, Artificial
  CRISPR gRNA sequence
aaaacaaaaggcattcaaat

SEQ ID NO: 357311 - DNA, 20 bp, Artificial
  CRISPR gRNA sequence
caaaaggcattcaaatcaga

SEQ ID NO: 357312 - DNA, 20 bp, Artificial
  CRISPR gRNA sequence
aaaaggcattcaaatcagaa

SEQ ID NO: 357313 - DNA, 20 bp, Artificial
  CRISPR gRNA sequence
aggcattcaaatcagaaagg

SEQ ID NO: 357314 - DNA, 20 bp, Artificial
  CRISPR gRNA sequence
cattcaaatcagaaaggaag

SEQ ID NO: 357315 - DNA, 20 bp, Artificial
  CRISPR gRNA sequence
atatatgtataaaaccctaa

SEQ ID NO: 357316 - DNA, 20 bp, Artificial
  CRISPR gRNA sequence
ttcaaactaataaatgaatt

SEQ ID NO: 357317 - DNA, 20 bp, Artificial
  CRISPR gRNA sequence
actaataaatgaattcagtt

SEQ ID NO: 357318 - DNA, 20 bp, Artificial
  CRISPR gRNA sequence
taataaatgaattcagttaa

SEQ ID NO: 357319 - DNA, 20 bp, Artificial
  CRISPR gRNA sequence
aataaatgaattcagttaag

SEQ ID NO: 357320 - DNA, 20 bp, Artificial
  CRISPR gRNA sequence
aaatgaattcagttaagagg

SEQ ID NO: 357321 - DNA, 20 bp, Artificial
  CRISPR gRNA sequence
aatgaattcagttaagaggc

SEQ ID NO: 357322 - DNA, 20 bp, Artificial
  CRISPR gRNA sequence
aaaatcaacatataaaatat

SEQ ID NO: 357323 - DNA, 20 bp, Artificial
  CRISPR gRNA sequence
tcaacatataaaatatcagt

SEQ ID NO: 357324 - DNA, 20 bp, Artificial
  CRISPR gRNA sequence
caacatataaaatatcagtc

SEQ ID NO: 357325 - DNA, 20 bp, Artificial
  CRISPR gRNA sequence
gtcaggtttctgtacacaaa

SEQ ID NO: 357326 - DNA, 20 bp, Artificial
  CRISPR gRNA sequence
aaacagcaaactatccaaaa

SEQ ID NO: 357327 - DNA, 20 bp, Artificial
  CRISPR gRNA sequence
aacagcaaactatccaaaaa

SEQ ID NO: 357328 - DNA, 20 bp, Artificial
  CRISPR gRNA sequence
cccatccccaataacaataa

SEQ ID NO: 357329 - DNA, 20 bp, Artificial
  CRISPR gRNA sequence
ccatccccaataacaataaa

SEQ ID NO: 357330 - DNA, 20 bp, Artificial
  CRISPR gRNA sequence
caataacaataaaaggaata

SEQ ID NO: 357331 - DNA, 20 bp, Artificial
  CRISPR gRNA sequence
ataaaaggaataaagtattt

SEQ ID NO: 357332 - DNA, 20 bp, Artificial
  CRISPR gRNA sequence
aaacttaaccaaaaatgtta

SEQ ID NO: 357333 - DNA, 20 bp, Artificial
  CRISPR gRNA sequence
cttgcacactgaaaatcata

SEQ ID NO: 357334 - DNA, 20 bp, Artificial
  CRISPR gRNA sequence
ttgttttgccatctttgctc

SEQ ID NO: 357335 - DNA, 20 bp, Artificial
  CRISPR gRNA sequence
catctttgctcaagaactaa

SEQ ID NO: 357336 - DNA, 20 bp, Artificial
  CRISPR gRNA sequence
ctttgctcaagaactaatgg

SEQ ID NO: 357337 - DNA, 20 bp, Artificial
  CRISPR gRNA sequence
gctttgcttgacaattatat

SEQ ID NO: 357338 - DNA, 20 bp, Artificial
  CRISPR gRNA sequence
cttgacaattatatgagatg

SEQ ID NO: 357339 - DNA, 20 bp, Artificial
  CRISPR gRNA sequence
ttgacaattatatgagatgc

SEQ ID NO: 357340 - DNA, 20 bp, Artificial
  CRISPR gRNA sequence
tcccatattaatacataact

SEQ ID NO: 357341 - DNA, 20 bp, Artificial
  CRISPR gRNA sequence
ttagactctccataccaacc

SEQ ID NO: 357342 - DNA, 20 bp, Artificial
  CRISPR gRNA sequence
ccaacctagtcatttgacta

SEQ ID NO: 357343 - DNA, 20 bp, Artificial
  CRISPR gRNA sequence
ccccattcctcctgcatatt

SEQ ID NO: 357344 - DNA, 20 bp, Artificial
  CRISPR gRNA sequence
cccattcctcctgcatattt

SEQ ID NO: 357345 - DNA, 20 bp, Artificial
  CRISPR gRNA sequence
ccattcctcctgcatatttg

SEQ ID NO: 357346 - DNA, 20 bp, Artificial
  CRISPR gRNA sequence
acctgtttcatgtcattcct

SEQ ID NO: 357347 - DNA, 20 bp, Artificial
  CRISPR gRNA sequence
atgcctcatttgaaccttga

SEQ ID NO: 357348 - DNA, 20 bp, Artificial
  CRISPR gRNA sequence
gaaccttgatggtcccgcct

SEQ ID NO: 357349 - DNA, 20 bp, Artificial
  CRISPR gRNA sequence
ccttgatggtcccgcctgag

SEQ ID NO: 357350 - DNA, 20 bp, Artificial
  CRISPR gRNA sequence
tcccgcctgagtggtctcac

SEQ ID NO: 357351 - DNA, 20 bp, Artificial
  CRISPR gRNA sequence
cgcctgagtggtctcactgg

SEQ ID NO: 357352 - DNA, 20 bp, Artificial
  CRISPR gRNA sequence
ctgagtggtctcactggtgg

SEQ ID NO: 357353 - DNA, 20 bp, Artificial
  CRISPR gRNA sequence
ctggtggaagacgattatac

SEQ ID NO: 357354 - DNA, 20 bp, Artificial
  CRISPR gRNA sequence
tggtggaagacgattataca

SEQ ID NO: 357355 - DNA, 20 bp, Artificial
  CRISPR gRNA sequence
agacgattatacaaggacat

SEQ ID NO: 357356 - DNA, 20 bp, Artificial
  CRISPR gRNA sequence
tgagtaattatacttatcaa

SEQ ID NO: 357357 - DNA, 20 bp, Artificial
  CRISPR gRNA sequence
ttatacttatcaatagcaaa

SEQ ID NO: 357358 - DNA, 20 bp, Artificial
  CRISPR gRNA sequence
tacttatcaatagcaaacag

SEQ ID NO: 357359 - DNA, 20 bp, Artificial
  CRISPR gRNA sequence
aacagaagttttttcaatat

SEQ ID NO: 357360 - DNA, 20 bp, Artificial
  CRISPR gRNA sequence
ttttcaatattagcctcctc

SEQ ID NO: 357361 - DNA, 20 bp, Artificial
  CRISPR gRNA sequence
ctcctccagaaactttctgc

SEQ ID NO: 357362 - DNA, 20 bp, Artificial
  CRISPR gRNA sequence
cctccagaaactttctgcaa

SEQ ID NO: 357363 - DNA, 20 bp, Artificial
  CRISPR gRNA sequence
ttttgccttcattcttttta

SEQ ID NO: 357364 - DNA, 20 bp, Artificial
  CRISPR gRNA sequence
tcattctttttatagccaat

SEQ ID NO: 357365 - DNA, 20 bp, Artificial
  CRISPR gRNA sequence
cattctttttatagccaata

SEQ ID NO: 357366 - DNA, 20 bp, Artificial
  CRISPR gRNA sequence
ctttttatagccaataaggt

SEQ ID NO: 357367 - DNA, 20 bp, Artificial
  CRISPR gRNA sequence
aataaggtcagtttaaacaa

SEQ ID NO: 357368 - DNA, 20 bp, Artificial
  CRISPR gRNA sequence
aaggtcagtttaaacaatag

SEQ ID NO: 357369 - DNA, 20 bp, Artificial
  CRISPR gRNA sequence
atagtagtctgcaaatcatt

SEQ ID NO: 357370 - DNA, 20 bp, Artificial
  CRISPR gRNA sequence
aaatatttgacaaattattt

SEQ ID NO: 357371 - DNA, 20 bp, Artificial
  CRISPR gRNA sequence
tatttgacaaattattttag

SEQ ID NO: 357372 - DNA, 20 bp, Artificial
  CRISPR gRNA sequence
tcttatgacaaatgaaaatc

SEQ ID NO: 357373 - DNA, 20 bp, Artificial
  CRISPR gRNA sequence
ttatgacaaatgaaaatcca

SEQ ID NO: 357374 - DNA, 20 bp, Artificial
  CRISPR gRNA sequence
tatgacaaatgaaaatccag

SEQ ID NO: 357375 - DNA, 20 bp, Artificial
  CRISPR gRNA sequence
atgaaaatccagaggatgtt

SEQ ID NO: 357376 - DNA, 20 bp, Artificial
  CRISPR gRNA sequence
tgaaaatccagaggatgtta

SEQ ID NO: 357377 - DNA, 20 bp, Artificial
  CRISPR gRNA sequence
gaaaatccagaggatgttaa

SEQ ID NO: 357378 - DNA, 20 bp, Artificial
  CRISPR gRNA sequence
ttaagggccaaaaataactg

SEQ ID NO: 357379 - DNA, 20 bp, Artificial
  CRISPR gRNA sequence
ctgtagtcactgtcaataaa

SEQ ID NO: 357380 - DNA, 20 bp, Artificial
  CRISPR gRNA sequence
tccccactttccttgccctt

SEQ ID NO: 357381 - DNA, 20 bp, Artificial
  CRISPR gRNA sequence
actttccttgcccttcggtc

SEQ ID NO: 357382 - DNA, 20 bp, Artificial
  CRISPR gRNA sequence
ctttccttgcccttcggtcc

SEQ ID NO: 357383 - DNA, 20 bp, Artificial
  CRISPR gRNA sequence
ccttgcccttcggtccaggc

SEQ ID NO: 357384 - DNA, 20 bp, Artificial
  CRISPR gRNA sequence
gtccaggcaagtttcaaatt

SEQ ID NO: 357385 - DNA, 20 bp, Artificial
  CRISPR gRNA sequence
ggcaagtttcaaattcagaa

SEQ ID NO: 357386 - DNA, 20 bp, Artificial
  CRISPR gRNA sequence
agtttcaaattcagaaaagt

SEQ ID NO: 357387 - DNA, 20 bp, Artificial
  CRISPR gRNA sequence
caaattcagaaaagtcagtc

SEQ ID NO: 357388 - DNA, 20 bp, Artificial
  CRISPR gRNA sequence
aattatttcattctacattt

SEQ ID NO: 357389 - DNA, 20 bp, Artificial
  CRISPR gRNA sequence
attatttcattctacatttc

SEQ ID NO: 357390 - DNA, 20 bp, Artificial
  CRISPR gRNA sequence
cattctacatttcaggacat

SEQ ID NO: 357391 - DNA, 20 bp, Artificial
  CRISPR gRNA sequence
catttcaggacataagtgca

SEQ ID NO: 357392 - DNA, 20 bp, Artificial
  CRISPR gRNA sequence
atttcaggacataagtgcaa

SEQ ID NO: 357393 - DNA, 20 bp, Artificial
  CRISPR gRNA sequence
aggacataagtgcaaaggac

SEQ ID NO: 357394 - DNA, 20 bp, Artificial
  CRISPR gRNA sequence
gacataagtgcaaaggacaa

SEQ ID NO: 357395 - DNA, 20 bp, Artificial
  CRISPR gRNA sequence
gaaatgtatttcttttcact

SEQ ID NO: 357396 - DNA, 20 bp, Artificial
  CRISPR gRNA sequence
gtatttcttttcactcagca

SEQ ID NO: 357397 - DNA, 20 bp, Artificial
  CRISPR gRNA sequence
ttcttttcactcagcaaaga

SEQ ID NO: 357398 - DNA, 20 bp, Artificial
  CRISPR gRNA sequence
tttcactcagcaaagaaagt

SEQ ID NO: 357399 - DNA, 20 bp, Artificial
  CRISPR gRNA sequence
cactcagcaaagaaagtcag

SEQ ID NO: 357400 - DNA, 20 bp, Artificial
  CRISPR gRNA sequence
agaaagtcagtggtaaatgt

SEQ ID NO: 357401 - DNA, 20 bp, Artificial
  CRISPR gRNA sequence
gtcagtggtaaatgtgagtt

SEQ ID NO: 357402 - DNA, 20 bp, Artificial
  CRISPR gRNA sequence
tcctctgttcaaaaccaatc

SEQ ID NO: 357403 - DNA, 20 bp, Artificial
  CRISPR gRNA sequence
cctctgttcaaaaccaatca

SEQ ID NO: 357404 - DNA, 20 bp, Artificial
  CRISPR gRNA sequence
gttcaaaaccaatcaaggcc

SEQ ID NO: 357405 - DNA, 20 bp, Artificial
  CRISPR gRNA sequence
ggcctggatacttgacctgc

SEQ ID NO: 357406 - DNA, 20 bp, Artificial
  CRISPR gRNA sequence
tggatacttgacctgctggt

SEQ ID NO: 357407 - DNA, 20 bp, Artificial
  CRISPR gRNA sequence
atacttgacctgctggttgg

SEQ ID NO: 357408 - DNA, 20 bp, Artificial
  CRISPR gRNA sequence
tacttgacctgctggttggc

SEQ ID NO: 357409 - DNA, 20 bp, Artificial
  CRISPR gRNA sequence
acttgacctgctggttggca

SEQ ID NO: 357410 - DNA, 20 bp, Artificial
  CRISPR gRNA sequence
cttgacctgctggttggcag

SEQ ID NO: 357411 - DNA, 20 bp, Artificial
  CRISPR gRNA sequence
gttggcaggggtcctctgtt

SEQ ID NO: 357412 - DNA, 20 bp, Artificial
  CRISPR gRNA sequence
gggtcctctgttgagtgacc

SEQ ID NO: 357413 - DNA, 20 bp, Artificial
  CRISPR gRNA sequence
agtgacctggtacttgtctg

SEQ ID NO: 357414 - DNA, 20 bp, Artificial
  CRISPR gRNA sequence
tacttgtctgaagatgaatg

SEQ ID NO: 357415 - DNA, 20 bp, Artificial
  CRISPR gRNA sequence
acttgtctgaagatgaatgc

SEQ ID NO: 357416 - DNA, 20 bp, Artificial
  CRISPR gRNA sequence
tgtctgaagatgaatgcagg

SEQ ID NO: 357417 - DNA, 20 bp, Artificial
  CRISPR gRNA sequence
gtctgaagatgaatgcaggc

SEQ ID NO: 357418 - DNA, 20 bp, Artificial
  CRISPR gRNA sequence
tgaagatgaatgcaggcagg

SEQ ID NO: 357419 - DNA, 20 bp, Artificial
  CRISPR gRNA sequence
gaagatgaatgcaggcaggt

SEQ ID NO: 357420 - DNA, 20 bp, Artificial
  CRISPR gRNA sequence
agatgaatgcaggcaggtag

SEQ ID NO: 357421 - DNA, 20 bp, Artificial
  CRISPR gRNA sequence
gaatgcaggcaggtaggagt

SEQ ID NO: 357422 - DNA, 20 bp, Artificial
  CRISPR gRNA sequence
aatgcaggcaggtaggagtc

SEQ ID NO: 357423 - DNA, 20 bp, Artificial
  CRISPR gRNA sequence
atgcaggcaggtaggagtca

SEQ ID NO: 357424 - DNA, 20 bp, Artificial
  CRISPR gRNA sequence
tgcaggcaggtaggagtcag

SEQ ID NO: 357425 - DNA, 20 bp, Artificial
  CRISPR gRNA sequence
aggcaggtaggagtcagggg

SEQ ID NO: 357426 - DNA, 20 bp, Artificial
  CRISPR gRNA sequence
gcaggtaggagtcaggggaa

SEQ ID NO: 357427 - DNA, 20 bp, Artificial
  CRISPR gRNA sequence
gtgtgtgtgtgtatgaatat

SEQ ID NO: 357428 - DNA, 20 bp, Artificial
  CRISPR gRNA sequence
gtgtgtgtgtatgaatatga

SEQ ID NO: 357429 - DNA, 20 bp, Artificial
  CRISPR gRNA sequence
agtcctaaaaatctctcttt

SEQ ID NO: 357430 - DNA, 20 bp, Artificial
  CRISPR gRNA sequence
tccaatactatgtgctataa

SEQ ID NO: 357431 - DNA, 20 bp, Artificial
  CRISPR gRNA sequence
aatactatgtgctataaaag

SEQ ID NO: 357432 - DNA, 20 bp, Artificial
  CRISPR gRNA sequence
gtgctataaaagaagtcatt

SEQ ID NO: 357433 - DNA, 20 bp, Artificial
  CRISPR gRNA sequence
aagtcattgagaactaacaa

SEQ ID NO: 357434 - DNA, 20 bp, Artificial
  CRISPR gRNA sequence
agaactaacaaaagtatgta

SEQ ID NO: 357435 - DNA, 20 bp, Artificial
  CRISPR gRNA sequence
tgccacaatcacctttccct

SEQ ID NO: 357436 - DNA, 20 bp, Artificial
  CRISPR gRNA sequence
cacaatcacctttcccttgg

SEQ ID NO: 357437 - DNA, 20 bp, Artificial
  CRISPR gRNA sequence
tccacattgatttttgacca

SEQ ID NO: 357438 - DNA, 20 bp, Artificial
  CRISPR gRNA sequence
cacattgatttttgaccaaa

SEQ ID NO: 357439 - DNA, 20 bp, Artificial
  CRISPR gRNA sequence
atttttgaccaaagagcctc

SEQ ID NO: 357440 - DNA, 20 bp, Artificial
  CRISPR gRNA sequence
gtgaaataatcaaattgcac

SEQ ID NO: 357441 - DNA, 20 bp, Artificial
  CRISPR gRNA sequence
gaaataatcaaattgcacca

SEQ ID NO: 357442 - DNA, 20 bp, Artificial
  CRISPR gRNA sequence
atctgttttgctttgcatct

SEQ ID NO: 357443 - DNA, 20 bp, Artificial
  CRISPR gRNA sequence
tcacttataaaaattgaaaa

SEQ ID NO: 357444 - DNA, 20 bp, Artificial
  CRISPR gRNA sequence
cacttataaaaattgaaaaa

SEQ ID NO: 357445 - DNA, 20 bp, Artificial
  CRISPR gRNA sequence
aggaattaaactgaaacata

SEQ ID NO: 357446 - DNA, 20 bp, Artificial
  CRISPR gRNA sequence
aaactgaaacatacagtcaa

SEQ ID NO: 357447 - DNA, 20 bp, Artificial
  CRISPR gRNA sequence
caatgataactttttactaa

SEQ ID NO: 357448 - DNA, 20 bp, Artificial
  CRISPR gRNA sequence
aactttttactaatggatac

SEQ ID NO: 357449 - DNA, 20 bp, Artificial
  CRISPR gRNA sequence
actttttactaatggataca

SEQ ID NO: 357450 - DNA, 20 bp, Artificial
  CRISPR gRNA sequence
ttactaatggatacaaggtc

SEQ ID NO: 357451 - DNA, 20 bp, Artificial
  CRISPR gRNA sequence
tctgtcaactgaatgtcaaa

SEQ ID NO: 357452 - DNA, 20 bp, Artificial
  CRISPR gRNA sequence
ttgcaactgttcaaaacaca

SEQ ID NO: 357453 - DNA, 20 bp, Artificial
  CRISPR gRNA sequence
acactactgaccattacatt

SEQ ID NO: 357454 - DNA, 20 bp, Artificial
  CRISPR gRNA sequence
tttagtcatcttcatttcat

SEQ ID NO: 357455 - DNA, 20 bp, Artificial
  CRISPR gRNA sequence
agtcatcttcatttcattgg

SEQ ID NO: 357456 - DNA, 20 bp, Artificial
  CRISPR gRNA sequence
tcatcttcatttcattggca

SEQ ID NO: 357457 - DNA, 20 bp, Artificial
  CRISPR gRNA sequence
ctgtttataatttacataca

SEQ ID NO: 357458 - DNA, 20 bp, Artificial
  CRISPR gRNA sequence
ataatttacatacaaagaaa

SEQ ID NO: 357459 - DNA, 20 bp, Artificial
  CRISPR gRNA sequence
acaaagaaatagttttgtgc

SEQ ID NO: 357460 - DNA, 20 bp, Artificial
  CRISPR gRNA sequence
atagttttgtgcaagaaact

SEQ ID NO: 357461 - DNA, 20 bp, Artificial
  CRISPR gRNA sequence
gcaagaaacttagtcatctt

SEQ ID NO: 357462 - DNA, 20 bp, Artificial
  CRISPR gRNA sequence
gaaacttagtcatctttgga

SEQ ID NO: 357463 - DNA, 20 bp, Artificial
  CRISPR gRNA sequence
tgacatttttattaattaat

SEQ ID NO: 357464 - DNA, 20 bp, Artificial
  CRISPR gRNA sequence
acatttttattaattaataa

SEQ ID NO: 357465 - DNA, 20 bp, Artificial
  CRISPR gRNA sequence
cttcattttctctataattt

SEQ ID NO: 357466 - DNA, 20 bp, Artificial
  CRISPR gRNA sequence
gatgtttacaattacttttt

SEQ ID NO: 357467 - DNA, 20 bp, Artificial
  CRISPR gRNA sequence
attactttttcagcatataa

SEQ ID NO: 357468 - DNA, 20 bp, Artificial
  CRISPR gRNA sequence
ttactttttcagcatataat

SEQ ID NO: 357469 - DNA, 20 bp, Artificial
  CRISPR gRNA sequence
ctttatgacacttttctgaa

SEQ ID NO: 357470 - DNA, 20 bp, Artificial
  CRISPR gRNA sequence
agaacatttttttcttgcct

SEQ ID NO: 357471 - DNA, 20 bp, Artificial
  CRISPR gRNA sequence
cactgtttctttttcctgac

SEQ ID NO: 357472 - DNA, 20 bp, Artificial
  CRISPR gRNA sequence
aaaaaatacttccataatgc

SEQ ID NO: 357473 - DNA, 20 bp, Artificial
  CRISPR gRNA sequence
aaaaatacttccataatgca

SEQ ID NO: 357474 - DNA, 20 bp, Artificial
  CRISPR gRNA sequence
aaaatacttccataatgcaa

SEQ ID NO: 357475 - DNA, 20 bp, Artificial
  CRISPR gRNA sequence
tccataatgcaagggatttt

SEQ ID NO: 357476 - DNA, 20 bp, Artificial
  CRISPR gRNA sequence
ccataatgcaagggattttt

SEQ ID NO: 357477 - DNA, 20 bp, Artificial
  CRISPR gRNA sequence
aatgcaagggatttttaggt

SEQ ID NO: 357478 - DNA, 20 bp, Artificial
  CRISPR gRNA sequence
gcaagggatttttaggtaag

SEQ ID NO: 357479 - DNA, 20 bp, Artificial
  CRISPR gRNA sequence
gttctttttgtctgtgtctg

SEQ ID NO: 357480 - DNA, 20 bp, Artificial
  CRISPR gRNA sequence
ttctttttgtctgtgtctga

SEQ ID NO: 357481 - DNA, 20 bp, Artificial
  CRISPR gRNA sequence
tttgtctgtgtctgaaggaa

SEQ ID NO: 357482 - DNA, 20 bp, Artificial
  CRISPR gRNA sequence
tgtctgtgtctgaaggaaca

SEQ ID NO: 357483 - DNA, 20 bp, Artificial
  CRISPR gRNA sequence
acagagtcaacatttaaaat

SEQ ID NO: 357484 - DNA, 20 bp, Artificial
  CRISPR gRNA sequence
cagagtcaacatttaaaatg

SEQ ID NO: 357485 - DNA, 20 bp, Artificial
  CRISPR gRNA sequence
gagtcaacatttaaaatgag

SEQ ID NO: 357486 - DNA, 20 bp, Artificial
  CRISPR gRNA sequence
catcattttcattaaattct

SEQ ID NO: 357487 - DNA, 20 bp, Artificial
  CRISPR gRNA sequence
gtccaatgtatgtctcacca

SEQ ID NO: 357488 - DNA, 20 bp, Artificial
  CRISPR gRNA sequence
gtatgtctcaccacagttcc

SEQ ID NO: 357489 - DNA, 20 bp, Artificial
  CRISPR gRNA sequence
atgtctcaccacagttccta

SEQ ID NO: 357490 - DNA, 20 bp, Artificial
  CRISPR gRNA sequence
tgtctcaccacagttcctag

SEQ ID NO: 357491 - DNA, 20 bp, Artificial
  CRISPR gRNA sequence
accacagttcctagaggaac

SEQ ID NO: 357492 - DNA, 20 bp, Artificial
  CRISPR gRNA sequence
ccacagttcctagaggaaca

SEQ ID NO: 357493 - DNA, 20 bp, Artificial
  CRISPR gRNA sequence
cacagttcctagaggaacaa

SEQ ID NO: 357494 - DNA, 20 bp, Artificial
  CRISPR gRNA sequence
cagttcctagaggaacaagg

SEQ ID NO: 357495 - DNA, 20 bp, Artificial
  CRISPR gRNA sequence
agttcctagaggaacaaggg

SEQ ID NO: 357496 - DNA, 20 bp, Artificial
  CRISPR gRNA sequence
ggaacaagggaggcttgatg

SEQ ID NO: 357497 - DNA, 20 bp, Artificial
  CRISPR gRNA sequence
agggaggcttgatgtggtcc

SEQ ID NO: 357498 - DNA, 20 bp, Artificial
  CRISPR gRNA sequence
gggaggcttgatgtggtcca

SEQ ID NO: 357499 - DNA, 20 bp, Artificial
  CRISPR gRNA sequence
ccaaggtgattgtgtatgaa

SEQ ID NO: 357500 - DNA, 20 bp, Artificial
  CRISPR gRNA sequence
aatgctctccttattataca

SEQ ID NO: 357501 - DNA, 20 bp, Artificial
  CRISPR gRNA sequence
tgctctccttattatacaca

SEQ ID NO: 357502 - DNA, 20 bp, Artificial
  CRISPR gRNA sequence
ccttattatacacagagcta

SEQ ID NO: 357503 - DNA, 20 bp, Artificial
  CRISPR gRNA sequence
tattatacacagagctatag

SEQ ID NO: 357504 - DNA, 20 bp, Artificial
  CRISPR gRNA sequence
tatacacagagctatagtgg

SEQ ID NO: 357505 - DNA, 20 bp, Artificial
  CRISPR gRNA sequence
gtggaagcttctgtttatac

SEQ ID NO: 357506 - DNA, 20 bp, Artificial
  CRISPR gRNA sequence
tttcttcttcattttcaaca

SEQ ID NO: 357507 - DNA, 20 bp, Artificial
  CRISPR gRNA sequence
ttcttcttcattttcaacac

SEQ ID NO: 357508 - DNA, 20 bp, Artificial
  CRISPR gRNA sequence
ttcttcattttcaacacagg

SEQ ID NO: 357509 - DNA, 20 bp, Artificial
  CRISPR gRNA sequence
ttcaacacaggaagaaatat

SEQ ID NO: 357510 - DNA, 20 bp, Artificial
  CRISPR gRNA sequence
gaaatatcagtttgcaatat

SEQ ID NO: 357511 - DNA, 20 bp, Artificial
  CRISPR gRNA sequence
atcagtttgcaatatgagca

SEQ ID NO: 357512 - DNA, 20 bp, Artificial
  CRISPR gRNA sequence
caatatgagcaaagtctata

SEQ ID NO: 357513 - DNA, 20 bp, Artificial
  CRISPR gRNA sequence
aatatgagcaaagtctataa

SEQ ID NO: 357514 - DNA, 20 bp, Artificial
  CRISPR gRNA sequence
atatgagcaaagtctataaa

SEQ ID NO: 357515 - DNA, 20 bp, Artificial
  CRISPR gRNA sequence
gagcaaagtctataaaggga

SEQ ID NO: 357516 - DNA, 20 bp, Artificial
  CRISPR gRNA sequence
agtctataaagggacagcca

SEQ ID NO: 357517 - DNA, 20 bp, Artificial
  CRISPR gRNA sequence
ataaagggacagccaaagcc

SEQ ID NO: 357518 - DNA, 20 bp, Artificial
  CRISPR gRNA sequence
agggacagccaaagcctagc

SEQ ID NO: 357519 - DNA, 20 bp, Artificial
  CRISPR gRNA sequence
agccaaagcctagcaagcgt

SEQ ID NO: 357520 - DNA, 20 bp, Artificial
  CRISPR gRNA sequence
ctagcaagcgttggctctac

SEQ ID NO: 357521 - DNA, 20 bp, Artificial
  CRISPR gRNA sequence
tggctctacaagtctaacat

SEQ ID NO: 357522 - DNA, 20 bp, Artificial
  CRISPR gRNA sequence
tacaagtctaacataagtca

SEQ ID NO: 357523 - DNA, 20 bp, Artificial
  CRISPR gRNA sequence
acaagtctaacataagtcaa

SEQ ID NO: 357524 - DNA, 20 bp, Artificial
  CRISPR gRNA sequence
aacataagtcaaaggtaaat

SEQ ID NO: 357525 - DNA, 20 bp, Artificial
  CRISPR gRNA sequence
taagtcaaaggtaaattagc

SEQ ID NO: 357526 - DNA, 20 bp, Artificial
  CRISPR gRNA sequence
aaggtaaattagctggctga

SEQ ID NO: 357527 - DNA, 20 bp, Artificial
  CRISPR gRNA sequence
attagctggctgaaagcatg

SEQ ID NO: 357528 - DNA, 20 bp, Artificial
  CRISPR gRNA sequence
agctggctgaaagcatgtgg

SEQ ID NO: 357529 - DNA, 20 bp, Artificial
  CRISPR gRNA sequence
gctggctgaaagcatgtgga

SEQ ID NO: 357530 - DNA, 20 bp, Artificial
  CRISPR gRNA sequence
ctggctgaaagcatgtggaa

SEQ ID NO: 357531 - DNA, 20 bp, Artificial
  CRISPR gRNA sequence
ggctgaaagcatgtggaagg

SEQ ID NO: 357532 - DNA, 20 bp, Artificial
  CRISPR gRNA sequence
tgaaagcatgtggaagggag

SEQ ID NO: 357533 - DNA, 20 bp, Artificial
  CRISPR gRNA sequence
gaaagcatgtggaagggaga

SEQ ID NO: 357534 - DNA, 20 bp, Artificial
  CRISPR gRNA sequence
aaagcatgtggaagggagaa

SEQ ID NO: 357535 - DNA, 20 bp, Artificial
  CRISPR gRNA sequence
gcatgtggaagggagaaggg

SEQ ID NO: 357536 - DNA, 20 bp, Artificial
  CRISPR gRNA sequence
catgtggaagggagaaggga

SEQ ID NO: 357537 - DNA, 20 bp, Artificial
  CRISPR gRNA sequence
gtggaagggagaagggaagg

SEQ ID NO: 357538 - DNA, 20 bp, Artificial
  CRISPR gRNA sequence
agggagaagggaaggaagaa

SEQ ID NO: 357539 - DNA, 20 bp, Artificial
  CRISPR gRNA sequence
gaagggaaggaagaaaagaa

SEQ ID NO: 357540 - DNA, 20 bp, Artificial
  CRISPR gRNA sequence
aagggaaggaagaaaagaaa

SEQ ID NO: 357541 - DNA, 20 bp, Artificial
  CRISPR gRNA sequence
agggaaggaagaaaagaaaa

SEQ ID NO: 357542 - DNA, 20 bp, Artificial
  CRISPR gRNA sequence
aggaagaaaagaaaagggaa

SEQ ID NO: 357543 - DNA, 20 bp, Artificial
  CRISPR gRNA sequence
gaaaagaaaagggaatggaa

SEQ ID NO: 357544 - DNA, 20 bp, Artificial
  CRISPR gRNA sequence
aaagaaaagggaatggaaca

SEQ ID NO: 357545 - DNA, 20 bp, Artificial
  CRISPR gRNA sequence
aagggaatggaacagagtga

SEQ ID NO: 357546 - DNA, 20 bp, Artificial
  CRISPR gRNA sequence
ggaatggaacagagtgaaag

SEQ ID NO: 357547 - DNA, 20 bp, Artificial
  CRISPR gRNA sequence
gaatggaacagagtgaaaga

SEQ ID NO: 357548 - DNA, 20 bp, Artificial
  CRISPR gRNA sequence
tggaacagagtgaaagaagg

SEQ ID NO: 357549 - DNA, 20 bp, Artificial
  CRISPR gRNA sequence
ggaacagagtgaaagaagga

SEQ ID NO: 357550 - DNA, 20 bp, Artificial
  CRISPR gRNA sequence
acagagtgaaagaaggaagg

SEQ ID NO: 357551 - DNA, 20 bp, Artificial
  CRISPR gRNA sequence
cagagtgaaagaaggaagga

SEQ ID NO: 357552 - DNA, 20 bp, Artificial
  CRISPR gRNA sequence
agagtgaaagaaggaaggaa

SEQ ID NO: 357553 - DNA, 20 bp, Artificial
  CRISPR gRNA sequence
gtgaaagaaggaaggaaggg

SEQ ID NO: 357554 - DNA, 20 bp, Artificial
  CRISPR gRNA sequence
tgaaagaaggaaggaaggga

SEQ ID NO: 357555 - DNA, 20 bp, Artificial
  CRISPR gRNA sequence
agaaggaaggaagggaagga

SEQ ID NO: 357556 - DNA, 20 bp, Artificial
  CRISPR gRNA sequence
ggaaggaagggaaggaaaga

SEQ ID NO: 357557 - DNA, 20 bp, Artificial
  CRISPR gRNA sequence
aggaagggaaggaaagatgg

SEQ ID NO: 357558 - DNA, 20 bp, Artificial
  CRISPR gRNA sequence
gaagggaaggaaagatggaa

SEQ ID NO: 357559 - DNA, 20 bp, Artificial
  CRISPR gRNA sequence
agggaaggaaagatggaaga

SEQ ID NO: 357560 - DNA, 20 bp, Artificial
  CRISPR gRNA sequence
aaggaaagatggaagagagt

SEQ ID NO: 357561 - DNA, 20 bp, Artificial
  CRISPR gRNA sequence
aggaaagatggaagagagtg

SEQ ID NO: 357562 - DNA, 20 bp, Artificial
  CRISPR gRNA sequence
ggaaagatggaagagagtga

SEQ ID NO: 357563 - DNA, 20 bp, Artificial
  CRISPR gRNA sequence
aaagatggaagagagtgagg

SEQ ID NO: 357564 - DNA, 20 bp, Artificial
  CRISPR gRNA sequence
atggaagagagtgagggaga

SEQ ID NO: 357565 - DNA, 20 bp, Artificial
  CRISPR gRNA sequence
tggaagagagtgagggagaa

SEQ ID NO: 357566 - DNA, 20 bp, Artificial
  CRISPR gRNA sequence
ggaagagagtgagggagaaa

SEQ ID NO: 357567 - DNA, 20 bp, Artificial
  CRISPR gRNA sequence
aagagagtgagggagaaagg

SEQ ID NO: 357568 - DNA, 20 bp, Artificial
  CRISPR gRNA sequence
agagagtgagggagaaaggg

SEQ ID NO: 357569 - DNA, 20 bp, Artificial
  CRISPR gRNA sequence
gagagtgagggagaaaggga

SEQ ID NO: 357570 - DNA, 20 bp, Artificial
  CRISPR gRNA sequence
gagtgagggagaaagggagg

SEQ ID NO: 357571 - DNA, 20 bp, Artificial
  CRISPR gRNA sequence
agtgagggagaaagggaggg

SEQ ID NO: 357572 - DNA, 20 bp, Artificial
  CRISPR gRNA sequence
gtgagggagaaagggaggga

SEQ ID NO: 357573 - DNA, 20 bp, Artificial
  CRISPR gRNA sequence
ggagggagggaactgtaata

SEQ ID NO: 357574 - DNA, 20 bp, Artificial
  CRISPR gRNA sequence
gagggagggaactgtaatac

SEQ ID NO: 357575 - DNA, 20 bp, Artificial
  CRISPR gRNA sequence
ctgtaatacaggcctctaca

SEQ ID NO: 357576 - DNA, 20 bp, Artificial
  CRISPR gRNA sequence
cctctacacagaactctata

SEQ ID NO: 357577 - DNA, 20 bp, Artificial
  CRISPR gRNA sequence
ctttttctcacaatcataca

SEQ ID NO: 357578 - DNA, 20 bp, Artificial
  CRISPR gRNA sequence
tttctcacaatcatacaaag

SEQ ID NO: 357579 - DNA, 20 bp, Artificial
  CRISPR gRNA sequence
acaatcatacaaagtggatc

SEQ ID NO: 357580 - DNA, 20 bp, Artificial
  CRISPR gRNA sequence
caatcatacaaagtggatct

SEQ ID NO: 357581 - DNA, 20 bp, Artificial
  CRISPR gRNA sequence
caaagtggatctaggttttg

SEQ ID NO: 357582 - DNA, 20 bp, Artificial
  CRISPR gRNA sequence
aaagtggatctaggttttgt

SEQ ID NO: 357583 - DNA, 20 bp, Artificial
  CRISPR gRNA sequence
aagtggatctaggttttgtg

SEQ ID NO: 357584 - DNA, 20 bp, Artificial
  CRISPR gRNA sequence
agtggatctaggttttgtgg

SEQ ID NO: 357585 - DNA, 20 bp, Artificial
  CRISPR gRNA sequence
gatctaggttttgtgggggc

SEQ ID NO: 357586 - DNA, 20 bp, Artificial
  CRISPR gRNA sequence
gctggaatcttacacaattt

SEQ ID NO: 357587 - DNA, 20 bp, Artificial
  CRISPR gRNA sequence
ctggaatcttacacaattta

SEQ ID NO: 357588 - DNA, 20 bp, Artificial
  CRISPR gRNA sequence
ttaaggattcattgtgacaa

SEQ ID NO: 357589 - DNA, 20 bp, Artificial
  CRISPR gRNA sequence
aaggattcattgtgacaaaa

SEQ ID NO: 357590 - DNA, 20 bp, Artificial
  CRISPR gRNA sequence
acaaatgcctaatacacaaa

SEQ ID NO: 357591 - DNA, 20 bp, Artificial
  CRISPR gRNA sequence
tgcctaatacacaaatagtg

SEQ ID NO: 357592 - DNA, 20 bp, Artificial
  CRISPR gRNA sequence
acacaaatagtgcagtgctt

SEQ ID NO: 357593 - DNA, 20 bp, Artificial
  CRISPR gRNA sequence
caaatagtgcagtgctttgg

SEQ ID NO: 357594 - DNA, 20 bp, Artificial
  CRISPR gRNA sequence
aaatagtgcagtgctttgga

SEQ ID NO: 357595 - DNA, 20 bp, Artificial
  CRISPR gRNA sequence
aatagtgcagtgctttggaa

SEQ ID NO: 357596 - DNA, 20 bp, Artificial
  CRISPR gRNA sequence
atagtgcagtgctttggaag

SEQ ID NO: 357597 - DNA, 20 bp, Artificial
  CRISPR gRNA sequence
gctttggaaggggcctgctc

SEQ ID NO: 357598 - DNA, 20 bp, Artificial
  CRISPR gRNA sequence
ttggaaggggcctgctcaag

SEQ ID NO: 357599 - DNA, 20 bp, Artificial
  CRISPR gRNA sequence
tggaaggggcctgctcaagt

SEQ ID NO: 357600 - DNA, 20 bp, Artificial
  CRISPR gRNA sequence
gaaggggcctgctcaagtgg

SEQ ID NO: 357601 - DNA, 20 bp, Artificial
  CRISPR gRNA sequence
aaggggcctgctcaagtggg

SEQ ID NO: 357602 - DNA, 20 bp, Artificial
  CRISPR gRNA sequence
gggcctgctcaagtgggagg

SEQ ID NO: 357603 - DNA, 20 bp, Artificial
  CRISPR gRNA sequence
ggcctgctcaagtgggagga

SEQ ID NO: 357604 - DNA, 20 bp, Artificial
  CRISPR gRNA sequence
ctgctcaagtgggaggaagg

SEQ ID NO: 357605 - DNA, 20 bp, Artificial
  CRISPR gRNA sequence
tgctcaagtgggaggaagga

SEQ ID NO: 357606 - DNA, 20 bp, Artificial
  CRISPR gRNA sequence
tcaagtgggaggaaggaagg

SEQ ID NO: 357607 - DNA, 20 bp, Artificial
  CRISPR gRNA sequence
caagtgggaggaaggaagga

SEQ ID NO: 357608 - DNA, 20 bp, Artificial
  CRISPR gRNA sequence
gtgggaggaaggaaggaagg

SEQ ID NO: 357609 - DNA, 20 bp, Artificial
  CRISPR gRNA sequence
tgggaggaaggaaggaagga

SEQ ID NO: 357610 - DNA, 20 bp, Artificial
  CRISPR gRNA sequence
gaggaaggaaggaaggaagg

SEQ ID NO: 357611 - DNA, 20 bp, Artificial
  CRISPR gRNA sequence
aggaaggaaggaaggaagga

SEQ ID NO: 357612 - DNA, 20 bp, Artificial
  CRISPR gRNA sequence
aaggaaggaaggaaggaagg

SEQ ID NO: 357613 - DNA, 20 bp, Artificial
  CRISPR gRNA sequence
aggaaggaaggaaggaagga

SEQ ID NO: 357614 - DNA, 20 bp, Artificial
  CRISPR gRNA sequence
aaggaaggaaggaaggaagg

SEQ ID NO: 357615 - DNA, 20 bp, Artificial
  CRISPR gRNA sequence
aggaaggaaggaaggaagga

SEQ ID NO: 357616 - DNA, 20 bp, Artificial
  CRISPR gRNA sequence
aaggaaggaaggaaggaagg

SEQ ID NO: 357617 - DNA, 20 bp, Artificial
  CRISPR gRNA sequence
aggaaggaaggaaggaagga

SEQ ID NO: 357618 - DNA, 20 bp, Artificial
  CRISPR gRNA sequence
aaggaaggaaggaaggaagg

SEQ ID NO: 357619 - DNA, 20 bp, Artificial
  CRISPR gRNA sequence
aggaaggaaggaaggaagga

SEQ ID NO: 357620 - DNA, 20 bp, Artificial
  CRISPR gRNA sequence
aaggaaggaaggaaggaagg

SEQ ID NO: 357621 - DNA, 20 bp, Artificial
  CRISPR gRNA sequence
aggaaggaaggaaggaagga

SEQ ID NO: 357622 - DNA, 20 bp, Artificial
  CRISPR gRNA sequence
aaggaaggaaggaaggaagg

SEQ ID NO: 357623 - DNA, 20 bp, Artificial
  CRISPR gRNA sequence
aggaaggaaggaaggaagga

SEQ ID NO: 357624 - DNA, 20 bp, Artificial
  CRISPR gRNA sequence
ggaaggaaggaaggaaggaa

SEQ ID NO: 357625 - DNA, 20 bp, Artificial
  CRISPR gRNA sequence
aaggaaggaaggaaggaagg

SEQ ID NO: 357626 - DNA, 20 bp, Artificial
  CRISPR gRNA sequence
aggaaggaaggaaggaaggg

SEQ ID NO: 357627 - DNA, 20 bp, Artificial
  CRISPR gRNA sequence
ggaaggaaggaaggaaggga

SEQ ID NO: 357628 - DNA, 20 bp, Artificial
  CRISPR gRNA sequence
aaggaaggaaggaagggagg

SEQ ID NO: 357629 - DNA, 20 bp, Artificial
  CRISPR gRNA sequence
aggaaggaaggaagggaggg

SEQ ID NO: 357630 - DNA, 20 bp, Artificial
  CRISPR gRNA sequence
ggaaggaaggaagggaggga

SEQ ID NO: 357631 - DNA, 20 bp, Artificial
  CRISPR gRNA sequence
aaggaaggaagggagggagg

SEQ ID NO: 357632 - DNA, 20 bp, Artificial
  CRISPR gRNA sequence
aggaaggaagggagggaggg

SEQ ID NO: 357633 - DNA, 20 bp, Artificial
  CRISPR gRNA sequence
ggaaggaagggagggaggga

SEQ ID NO: 357634 - DNA, 20 bp, Artificial
  CRISPR gRNA sequence
aaggaagggagggagggagg

SEQ ID NO: 357635 - DNA, 20 bp, Artificial
  CRISPR gRNA sequence
aggaagggagggagggaggg

SEQ ID NO: 357636 - DNA, 20 bp, Artificial
  CRISPR gRNA sequence
ggaagggagggagggaggga

SEQ ID NO: 357637 - DNA, 20 bp, Artificial
  CRISPR gRNA sequence
agggagggagggagggaggg

SEQ ID NO: 357638 - DNA, 20 bp, Artificial
  CRISPR gRNA sequence
gggagggagggagggaggga

SEQ ID NO: 357639 - DNA, 20 bp, Artificial
  CRISPR gRNA sequence
ggagggagggagggagggaa

SEQ ID NO: 357640 - DNA, 20 bp, Artificial
  CRISPR gRNA sequence
agggagggagggagggaagg

SEQ ID NO: 357641 - DNA, 20 bp, Artificial
  CRISPR gRNA sequence
gggagggagggagggaaggg

SEQ ID NO: 357642 - DNA, 20 bp, Artificial
  CRISPR gRNA sequence
ggagggagggagggaaggga

SEQ ID NO: 357643 - DNA, 20 bp, Artificial
  CRISPR gRNA sequence
gagggagggagggaagggag

SEQ ID NO: 357644 - DNA, 20 bp, Artificial
  CRISPR gRNA sequence
gggagggagggaagggaggg

SEQ ID NO: 357645 - DNA, 20 bp, Artificial
  CRISPR gRNA sequence
ggagggagggaagggagggg

SEQ ID NO: 357646 - DNA, 20 bp, Artificial
  CRISPR gRNA sequence
gagggagggaagggagggga

SEQ ID NO: 357647 - DNA, 20 bp, Artificial
  CRISPR gRNA sequence
agggagggaagggaggggag

SEQ ID NO: 357648 - DNA, 20 bp, Artificial
  CRISPR gRNA sequence
ggagggaagggaggggaggg

SEQ ID NO: 357649 - DNA, 20 bp, Artificial
  CRISPR gRNA sequence
gagggaagggaggggagggg

SEQ ID NO: 357650 - DNA, 20 bp, Artificial
  CRISPR gRNA sequence
agggaagggaggggagggga

SEQ ID NO: 357651 - DNA, 20 bp, Artificial
  CRISPR gRNA sequence
gggaagggaggggaggggag

SEQ ID NO: 357652 - DNA, 20 bp, Artificial
  CRISPR gRNA sequence
gaagggaggggaggggaggg

SEQ ID NO: 357653 - DNA, 20 bp, Artificial
  CRISPR gRNA sequence
aagggaggggaggggagggg

SEQ ID NO: 357654 - DNA, 20 bp, Artificial
  CRISPR gRNA sequence
agggaggggaggggagggga

SEQ ID NO: 357655 - DNA, 20 bp, Artificial
  CRISPR gRNA sequence
gaggggaggggaggggaggg

SEQ ID NO: 357656 - DNA, 20 bp, Artificial
  CRISPR gRNA sequence
aggggaggggaggggaggga

SEQ ID NO: 357657 - DNA, 20 bp, Artificial
  CRISPR gRNA sequence
ggggaggggaggggagggaa

SEQ ID NO: 357658 - DNA, 20 bp, Artificial
  CRISPR gRNA sequence
gaggggaggggagggaaggg

SEQ ID NO: 357659 - DNA, 20 bp, Artificial
  CRISPR gRNA sequence
aggggaggggagggaaggga

SEQ ID NO: 357660 - DNA, 20 bp, Artificial
  CRISPR gRNA sequence
ggggaggggagggaagggaa

SEQ ID NO: 357661 - DNA, 20 bp, Artificial
  CRISPR gRNA sequence
ggaggggagggaagggaagg

SEQ ID NO: 357662 - DNA, 20 bp, Artificial
  CRISPR gRNA sequence
gaggggagggaagggaaggg

SEQ ID NO: 357663 - DNA, 20 bp, Artificial
  CRISPR gRNA sequence
aggggagggaagggaaggga

SEQ ID NO: 357664 - DNA, 20 bp, Artificial
  CRISPR gRNA sequence
ggggagggaagggaagggag

SEQ ID NO: 357665 - DNA, 20 bp, Artificial
  CRISPR gRNA sequence
ggagggaagggaagggaggg

SEQ ID NO: 357666 - DNA, 20 bp, Artificial
  CRISPR gRNA sequence
agggaagggaagggagggga

SEQ ID NO: 357667 - DNA, 20 bp, Artificial
  CRISPR gRNA sequence
gaagggaagggaggggagag

SEQ ID NO: 357668 - DNA, 20 bp, Artificial
  CRISPR gRNA sequence
aagggaagggaggggagaga

SEQ ID NO: 357669 - DNA, 20 bp, Artificial
  CRISPR gRNA sequence
agggaagggaggggagagaa

SEQ ID NO: 357670 - DNA, 20 bp, Artificial
  CRISPR gRNA sequence
gaagggaggggagagaaggg

SEQ ID NO: 357671 - DNA, 20 bp, Artificial
  CRISPR gRNA sequence
aagggaggggagagaaggga

SEQ ID NO: 357672 - DNA, 20 bp, Artificial
  CRISPR gRNA sequence
agggaggggagagaagggaa

SEQ ID NO: 357673 - DNA, 20 bp, Artificial
  CRISPR gRNA sequence
ggaggggagagaagggaagg

SEQ ID NO: 357674 - DNA, 20 bp, Artificial
  CRISPR gRNA sequence
gaggggagagaagggaaggg

SEQ ID NO: 357675 - DNA, 20 bp, Artificial
  CRISPR gRNA sequence
aggggagagaagggaaggga

SEQ ID NO: 357676 - DNA, 20 bp, Artificial
  CRISPR gRNA sequence
ggggagagaagggaagggag

SEQ ID NO: 357677 - DNA, 20 bp, Artificial
  CRISPR gRNA sequence
ggagagaagggaagggaggg

SEQ ID NO: 357678 - DNA, 20 bp, Artificial
  CRISPR gRNA sequence
gagagaagggaagggagggg

SEQ ID NO: 357679 - DNA, 20 bp, Artificial
  CRISPR gRNA sequence
agagaagggaagggagggga

SEQ ID NO: 357680 - DNA, 20 bp, Artificial
  CRISPR gRNA sequence
gagaagggaagggaggggag

SEQ ID NO: 357681 - DNA, 20 bp, Artificial
  CRISPR gRNA sequence
gaagggaagggaggggaggg

SEQ ID NO: 357682 - DNA, 20 bp, Artificial
  CRISPR gRNA sequence
agggaagggaggggagggga

SEQ ID NO: 357683 - DNA, 20 bp, Artificial
  CRISPR gRNA sequence
aagggaggggaggggagaga

SEQ ID NO: 357684 - DNA, 20 bp, Artificial
  CRISPR gRNA sequence
agggaggggaggggagagaa

SEQ ID NO: 357685 - DNA, 20 bp, Artificial
  CRISPR gRNA sequence
ggaggggaggggagagaaag

SEQ ID NO: 357686 - DNA, 20 bp, Artificial
  CRISPR gRNA sequence
gaggggaggggagagaaagg

SEQ ID NO: 357687 - DNA, 20 bp, Artificial
  CRISPR gRNA sequence
aggggaggggagagaaagga

SEQ ID NO: 357688 - DNA, 20 bp, Artificial
  CRISPR gRNA sequence
ggggaggggagagaaaggag

SEQ ID NO: 357689 - DNA, 20 bp, Artificial
  CRISPR gRNA sequence
ggaggggagagaaaggaggg

SEQ ID NO: 357690 - DNA, 20 bp, Artificial
  CRISPR gRNA sequence
gaggggagagaaaggagggg

SEQ ID NO: 357691 - DNA, 20 bp, Artificial
  CRISPR gRNA sequence
aggggagagaaaggagggga

SEQ ID NO: 357692 - DNA, 20 bp, Artificial
  CRISPR gRNA sequence
ggggagagaaaggaggggag

SEQ ID NO: 357693 - DNA, 20 bp, Artificial
  CRISPR gRNA sequence
ggagagaaaggaggggaggg

SEQ ID NO: 357694 - DNA, 20 bp, Artificial
  CRISPR gRNA sequence
gagagaaaggaggggagggg

SEQ ID NO: 357695 - DNA, 20 bp, Artificial
  CRISPR gRNA sequence
agagaaaggaggggagggga

SEQ ID NO: 357696 - DNA, 20 bp, Artificial
  CRISPR gRNA sequence
gagaaaggaggggaggggag

SEQ ID NO: 357697 - DNA, 20 bp, Artificial
  CRISPR gRNA sequence
gaaaggaggggaggggaggg

SEQ ID NO: 357698 - DNA, 20 bp, Artificial
  CRISPR gRNA sequence
aaggaggggaggggagggga

SEQ ID NO: 357699 - DNA, 20 bp, Artificial
  CRISPR gRNA sequence
aggggaggggaggggagaga

SEQ ID NO: 357700 - DNA, 20 bp, Artificial
  CRISPR gRNA sequence
ggggaggggaggggagagac

SEQ ID NO: 357701 - DNA, 20 bp, Artificial
  CRISPR gRNA sequence
ggaggggaggggagagacag

SEQ ID NO: 357702 - DNA, 20 bp, Artificial
  CRISPR gRNA sequence
gaggggaggggagagacagg

SEQ ID NO: 357703 - DNA, 20 bp, Artificial
  CRISPR gRNA sequence
aggggaggggagagacagga

SEQ ID NO: 357704 - DNA, 20 bp, Artificial
  CRISPR gRNA sequence
ggggaggggagagacaggag

SEQ ID NO: 357705 - DNA, 20 bp, Artificial
  CRISPR gRNA sequence
ggaggggagagacaggaggg

SEQ ID NO: 357706 - DNA, 20 bp, Artificial
  CRISPR gRNA sequence
gaggggagagacaggagggg

SEQ ID NO: 357707 - DNA, 20 bp, Artificial
  CRISPR gRNA sequence
aggggagagacaggagggga

SEQ ID NO: 357708 - DNA, 20 bp, Artificial
  CRISPR gRNA sequence
ggggagagacaggaggggag

SEQ ID NO: 357709 - DNA, 20 bp, Artificial
  CRISPR gRNA sequence
ggagagacaggaggggaggg

SEQ ID NO: 357710 - DNA, 20 bp, Artificial
  CRISPR gRNA sequence
gagagacaggaggggagggg

SEQ ID NO: 357711 - DNA, 20 bp, Artificial
  CRISPR gRNA sequence
agagacaggaggggagggga

SEQ ID NO: 357712 - DNA, 20 bp, Artificial
  CRISPR gRNA sequence
gagacaggaggggaggggag

SEQ ID NO: 357713 - DNA, 20 bp, Artificial
  CRISPR gRNA sequence
gacaggaggggaggggaggg

SEQ ID NO: 357714 - DNA, 20 bp, Artificial
  CRISPR gRNA sequence
acaggaggggaggggagggg

SEQ ID NO: 357715 - DNA, 20 bp, Artificial
  CRISPR gRNA sequence
caggaggggaggggagggga

SEQ ID NO: 357716 - DNA, 20 bp, Artificial
  CRISPR gRNA sequence
aggaggggaggggaggggag

SEQ ID NO: 357717 - DNA, 20 bp, Artificial
  CRISPR gRNA sequence
ggaggggaggggaggggagg

SEQ ID NO: 357718 - DNA, 20 bp, Artificial
  CRISPR gRNA sequence
gaggggaggggaggggaggg

SEQ ID NO: 357719 - DNA, 20 bp, Artificial
  CRISPR gRNA sequence
aggggaggggaggggagggg

SEQ ID NO: 357720 - DNA, 20 bp, Artificial
  CRISPR gRNA sequence
ggggaggggaggggaggggg

SEQ ID NO: 357721 - DNA, 20 bp, Artificial
  CRISPR gRNA sequence
ggaggggaggggaggggggg

SEQ ID NO: 357722 - DNA, 20 bp, Artificial
  CRISPR gRNA sequence
gaggggaggggagggggggg

SEQ ID NO: 357723 - DNA, 20 bp, Artificial
  CRISPR gRNA sequence
aggggaggggagggggggga

SEQ ID NO: 357724 - DNA, 20 bp, Artificial
  CRISPR gRNA sequence
ggaggggaggggggggaggg

SEQ ID NO: 357725 - DNA, 20 bp, Artificial
  CRISPR gRNA sequence
gaggggaggggggggaggga

SEQ ID NO: 357726 - DNA, 20 bp, Artificial
  CRISPR gRNA sequence
aggggaggggggggagggaa

SEQ ID NO: 357727 - DNA, 20 bp, Artificial
  CRISPR gRNA sequence
ggggaggggggggagggaag

SEQ ID NO: 357728 - DNA, 20 bp, Artificial
  CRISPR gRNA sequence
ggaggggggggagggaaggg

SEQ ID NO: 357729 - DNA, 20 bp, Artificial
  CRISPR gRNA sequence
gaggggggggagggaagggg

SEQ ID NO: 357730 - DNA, 20 bp, Artificial
  CRISPR gRNA sequence
aggggggggagggaagggga

SEQ ID NO: 357731 - DNA, 20 bp, Artificial
  CRISPR gRNA sequence
gggggggagggaaggggagg

SEQ ID NO: 357732 - DNA, 20 bp, Artificial
  CRISPR gRNA sequence
gggagggaaggggagggaga

SEQ ID NO: 357733 - DNA, 20 bp, Artificial
  CRISPR gRNA sequence
ggagggaaggggagggagat

SEQ ID NO: 357734 - DNA, 20 bp, Artificial
  CRISPR gRNA sequence
gagggaaggggagggagatg

SEQ ID NO: 357735 - DNA, 20 bp, Artificial
  CRISPR gRNA sequence
gggaaggggagggagatggg

SEQ ID NO: 357736 - DNA, 20 bp, Artificial
  CRISPR gRNA sequence
ggaaggggagggagatgggg

SEQ ID NO: 357737 - DNA, 20 bp, Artificial
  CRISPR gRNA sequence
gaaggggagggagatgggga

SEQ ID NO: 357738 - DNA, 20 bp, Artificial
  CRISPR gRNA sequence
aaggggagggagatggggag

SEQ ID NO: 357739 - DNA, 20 bp, Artificial
  CRISPR gRNA sequence
aggggagggagatggggagg

SEQ ID NO: 357740 - DNA, 20 bp, Artificial
  CRISPR gRNA sequence
gggagggagatggggagggg

SEQ ID NO: 357741 - DNA, 20 bp, Artificial
  CRISPR gRNA sequence
ggagggagatggggaggggg

SEQ ID NO: 357742 - DNA, 20 bp, Artificial
  CRISPR gRNA sequence
gagggagatggggaggggga

SEQ ID NO: 357743 - DNA, 20 bp, Artificial
  CRISPR gRNA sequence
ggagatggggagggggaggg

SEQ ID NO: 357744 - DNA, 20 bp, Artificial
  CRISPR gRNA sequence
gagatggggagggggagggc

SEQ ID NO: 357745 - DNA, 20 bp, Artificial
  CRISPR gRNA sequence
agatggggagggggagggca

SEQ ID NO: 357746 - DNA, 20 bp, Artificial
  CRISPR gRNA sequence
gatggggagggggagggcag

SEQ ID NO: 357747 - DNA, 20 bp, Artificial
  CRISPR gRNA sequence
tggggagggggagggcaggg

SEQ ID NO: 357748 - DNA, 20 bp, Artificial
  CRISPR gRNA sequence
ggggagggggagggcagggg

SEQ ID NO: 357749 - DNA, 20 bp, Artificial
  CRISPR gRNA sequence
gggagggggagggcagggga

SEQ ID NO: 357750 - DNA, 20 bp, Artificial
  CRISPR gRNA sequence
ggagggggagggcaggggag

SEQ ID NO: 357751 - DNA, 20 bp, Artificial
  CRISPR gRNA sequence
gagggggagggcaggggagg

SEQ ID NO: 357752 - DNA, 20 bp, Artificial
  CRISPR gRNA sequence
ggggagggcaggggaggggg

SEQ ID NO: 357753 - DNA, 20 bp, Artificial
  CRISPR gRNA sequence
gggagggcaggggaggggga

SEQ ID NO: 357754 - DNA, 20 bp, Artificial
  CRISPR gRNA sequence
agggcaggggagggggaagg

SEQ ID NO: 357755 - DNA, 20 bp, Artificial
  CRISPR gRNA sequence
gggcaggggagggggaaggt

SEQ ID NO: 357756 - DNA, 20 bp, Artificial
  CRISPR gRNA sequence
ggcaggggagggggaaggta

SEQ ID NO: 357757 - DNA, 20 bp, Artificial
  CRISPR gRNA sequence
gcaggggagggggaaggtag

SEQ ID NO: 357758 - DNA, 20 bp, Artificial
  CRISPR gRNA sequence
aggggagggggaaggtaggg

SEQ ID NO: 357759 - DNA, 20 bp, Artificial
  CRISPR gRNA sequence
ggggagggggaaggtagggg

SEQ ID NO: 357760 - DNA, 20 bp, Artificial
  CRISPR gRNA sequence
gggagggggaaggtagggga

SEQ ID NO: 357761 - DNA, 20 bp, Artificial
  CRISPR gRNA sequence
agggggaaggtaggggaggg

SEQ ID NO: 357762 - DNA, 20 bp, Artificial
  CRISPR gRNA sequence
gggggaaggtaggggaggga

SEQ ID NO: 357763 - DNA, 20 bp, Artificial
  CRISPR gRNA sequence
ggaaggtaggggagggaagg

SEQ ID NO: 357764 - DNA, 20 bp, Artificial
  CRISPR gRNA sequence
gaaggtaggggagggaagga

SEQ ID NO: 357765 - DNA, 20 bp, Artificial
  CRISPR gRNA sequence
aaggtaggggagggaaggaa

SEQ ID NO: 357766 - DNA, 20 bp, Artificial
  CRISPR gRNA sequence
aggtaggggagggaaggaag

SEQ ID NO: 357767 - DNA, 20 bp, Artificial
  CRISPR gRNA sequence
gtaggggagggaaggaaggg

SEQ ID NO: 357768 - DNA, 20 bp, Artificial
  CRISPR gRNA sequence
taggggagggaaggaagggg

SEQ ID NO: 357769 - DNA, 20 bp, Artificial
  CRISPR gRNA sequence
aggggagggaaggaagggga

SEQ ID NO: 357770 - DNA, 20 bp, Artificial
  CRISPR gRNA sequence
ggggagggaaggaaggggag

SEQ ID NO: 357771 - DNA, 20 bp, Artificial
  CRISPR gRNA sequence
ggagggaaggaaggggaggg

SEQ ID NO: 357772 - DNA, 20 bp, Artificial
  CRISPR gRNA sequence
gagggaaggaaggggagggg

SEQ ID NO: 357773 - DNA, 20 bp, Artificial
  CRISPR gRNA sequence
gggaaggaaggggaggggag

SEQ ID NO: 357774 - DNA, 20 bp, Artificial
  CRISPR gRNA sequence
ggaaggaaggggaggggagg

SEQ ID NO: 357775 - DNA, 20 bp, Artificial
  CRISPR gRNA sequence
gaaggaaggggaggggagga

SEQ ID NO: 357776 - DNA, 20 bp, Artificial
  CRISPR gRNA sequence
aaggaaggggaggggaggag

SEQ ID NO: 357777 - DNA, 20 bp, Artificial
  CRISPR gRNA sequence
ggaaggggaggggaggaggg

SEQ ID NO: 357778 - DNA, 20 bp, Artificial
  CRISPR gRNA sequence
gaaggggaggggaggagggg

SEQ ID NO: 357779 - DNA, 20 bp, Artificial
  CRISPR gRNA sequence
aaggggaggggaggagggga

SEQ ID NO: 357780 - DNA, 20 bp, Artificial
  CRISPR gRNA sequence
aggggaggggaggaggggag

SEQ ID NO: 357781 - DNA, 20 bp, Artificial
  CRISPR gRNA sequence
gggaggggaggaggggaggg

SEQ ID NO: 357782 - DNA, 20 bp, Artificial
  CRISPR gRNA sequence
ggaggggaggaggggagggg

SEQ ID NO: 357783 - DNA, 20 bp, Artificial
  CRISPR gRNA sequence
gaggggaggaggggagggga

SEQ ID NO: 357784 - DNA, 20 bp, Artificial
  CRISPR gRNA sequence
ggggaggaggggaggggagg

SEQ ID NO: 357785 - DNA, 20 bp, Artificial
  CRISPR gRNA sequence
gggaggaggggaggggaggg

SEQ ID NO: 357786 - DNA, 20 bp, Artificial
  CRISPR gRNA sequence
aggaggggaggggagggagg

SEQ ID NO: 357787 - DNA, 20 bp, Artificial
  CRISPR gRNA sequence
ggaggggaggggagggagga

SEQ ID NO: 357788 - DNA, 20 bp, Artificial
  CRISPR gRNA sequence
gggaggggagggaggaagga

SEQ ID NO: 357789 - DNA, 20 bp, Artificial
  CRISPR gRNA sequence
ggaggggagggaggaaggaa

SEQ ID NO: 357790 - DNA, 20 bp, Artificial
  CRISPR gRNA sequence
ggggagggaggaaggaaagg

SEQ ID NO: 357791 - DNA, 20 bp, Artificial
  CRISPR gRNA sequence
gagggaggaaggaaaggaag

SEQ ID NO: 357792 - DNA, 20 bp, Artificial
  CRISPR gRNA sequence
agggaggaaggaaaggaaga

SEQ ID NO: 357793 - DNA, 20 bp, Artificial
  CRISPR gRNA sequence
gggaggaaggaaaggaagaa

SEQ ID NO: 357794 - DNA, 20 bp, Artificial
  CRISPR gRNA sequence
gaggaaggaaaggaagaagg

SEQ ID NO: 357795 - DNA, 20 bp, Artificial
  CRISPR gRNA sequence
gaaaggaagaagggagaaca

SEQ ID NO: 357796 - DNA, 20 bp, Artificial
  CRISPR gRNA sequence
aagaagggagaacaaagtga

SEQ ID NO: 357797 - DNA, 20 bp, Artificial
  CRISPR gRNA sequence
agaagggagaacaaagtgaa

SEQ ID NO: 357798 - DNA, 20 bp, Artificial
  CRISPR gRNA sequence
ttttctcttccgtgtcccga

SEQ ID NO: 357799 - DNA, 20 bp, Artificial
  CRISPR gRNA sequence
ctcttccgtgtcccgacagt

SEQ ID NO: 357800 - DNA, 20 bp, Artificial
  CRISPR gRNA sequence
tcttccgtgtcccgacagtg

SEQ ID NO: 357801 - DNA, 20 bp, Artificial
  CRISPR gRNA sequence
tccgtgtcccgacagtgagg

SEQ ID NO: 357802 - DNA, 20 bp, Artificial
  CRISPR gRNA sequence
tgtcccgacagtgaggaagc

SEQ ID NO: 357803 - DNA, 20 bp, Artificial
  CRISPR gRNA sequence
cgacagtgaggaagctggcc

SEQ ID NO: 357804 - DNA, 20 bp, Artificial
  CRISPR gRNA sequence
acagtgaggaagctggccca

SEQ ID NO: 357805 - DNA, 20 bp, Artificial
  CRISPR gRNA sequence
cagtgaggaagctggcccag

SEQ ID NO: 357806 - DNA, 20 bp, Artificial
  CRISPR gRNA sequence
tgaggaagctggcccagagg

SEQ ID NO: 357807 - DNA, 20 bp, Artificial
  CRISPR gRNA sequence
aggaagctggcccagaggca

SEQ ID NO: 357808 - DNA, 20 bp, Artificial
  CRISPR gRNA sequence
agctggcccagaggcagagc

SEQ ID NO: 357809 - DNA, 20 bp, Artificial
  CRISPR gRNA sequence
gctggcccagaggcagagct

SEQ ID NO: 357810 - DNA, 20 bp, Artificial
  CRISPR gRNA sequence
tggcccagaggcagagctgg

SEQ ID NO: 357811 - DNA, 20 bp, Artificial
  CRISPR gRNA sequence
gcccagaggcagagctggga

SEQ ID NO: 357812 - DNA, 20 bp, Artificial
  CRISPR gRNA sequence
gaggcagagctgggagagcc

SEQ ID NO: 357813 - DNA, 20 bp, Artificial
  CRISPR gRNA sequence
aggcagagctgggagagcct

SEQ ID NO: 357814 - DNA, 20 bp, Artificial
  CRISPR gRNA sequence
agagctgggagagcctggga

SEQ ID NO: 357815 - DNA, 20 bp, Artificial
  CRISPR gRNA sequence
cctctctctcaactgtaatg

SEQ ID NO: 357816 - DNA, 20 bp, Artificial
  CRISPR gRNA sequence
ctctctctcaactgtaatgc

SEQ ID NO: 357817 - DNA, 20 bp, Artificial
  CRISPR gRNA sequence
ctgtaatgcaggcctctaca

SEQ ID NO: 357818 - DNA, 20 bp, Artificial
  CRISPR gRNA sequence
cctctacacagacctctata

SEQ ID NO: 357819 - DNA, 20 bp, Artificial
  CRISPR gRNA sequence
ctctacacagacctctatat

SEQ ID NO: 357820 - DNA, 20 bp, Artificial
  CRISPR gRNA sequence
ctatatgggcctctctatat

SEQ ID NO: 357821 - DNA, 20 bp, Artificial
  CRISPR gRNA sequence
ctctatattagcacttctgt

SEQ ID NO: 357822 - DNA, 20 bp, Artificial
  CRISPR gRNA sequence
attagcacttctgtaagtga

SEQ ID NO: 357823 - DNA, 20 bp, Artificial
  CRISPR gRNA sequence
ctttttctcatactcatgca

SEQ ID NO: 357824 - DNA, 20 bp, Artificial
  CRISPR gRNA sequence
tttctcatactcatgcaaag

SEQ ID NO: 357825 - DNA, 20 bp, Artificial
  CRISPR gRNA sequence
atactcatgcaaagtggatc

SEQ ID NO: 357826 - DNA, 20 bp, Artificial
  CRISPR gRNA sequence
tactcatgcaaagtggatct

SEQ ID NO: 357827 - DNA, 20 bp, Artificial
  CRISPR gRNA sequence
caaagtggatctaggttttg

SEQ ID NO: 357828 - DNA, 20 bp, Artificial
  CRISPR gRNA sequence
aaagtggatctaggttttgc

SEQ ID NO: 357829 - DNA, 20 bp, Artificial
  CRISPR gRNA sequence
caggtcctgaaacacaatga

SEQ ID NO: 357830 - DNA, 20 bp, Artificial
  CRISPR gRNA sequence
aggtcctgaaacacaatgaa

SEQ ID NO: 357831 - DNA, 20 bp, Artificial
  CRISPR gRNA sequence
ggcttcattgtgacaaaaaa

SEQ ID NO: 357832 - DNA, 20 bp, Artificial
  CRISPR gRNA sequence
acaaatgcctaatatacaaa

SEQ ID NO: 357833 - DNA, 20 bp, Artificial
  CRISPR gRNA sequence
tgcctaatatacaaatagtg

SEQ ID NO: 357834 - DNA, 20 bp, Artificial
  CRISPR gRNA sequence
atacaaatagtgtggtgcct

SEQ ID NO: 357835 - DNA, 20 bp, Artificial
  CRISPR gRNA sequence
acaaatagtgtggtgccttg

SEQ ID NO: 357836 - DNA, 20 bp, Artificial
  CRISPR gRNA sequence
caaatagtgtggtgccttgg

SEQ ID NO: 357837 - DNA, 20 bp, Artificial
  CRISPR gRNA sequence
aatagtgtggtgccttggag

SEQ ID NO: 357838 - DNA, 20 bp, Artificial
  CRISPR gRNA sequence
atagtgtggtgccttggagg

SEQ ID NO: 357839 - DNA, 20 bp, Artificial
  CRISPR gRNA sequence
tggtgccttggaggaggcct

SEQ ID NO: 357840 - DNA, 20 bp, Artificial
  CRISPR gRNA sequence
gtgccttggaggaggccttg

SEQ ID NO: 357841 - DNA, 20 bp, Artificial
  CRISPR gRNA sequence
tgccttggaggaggccttgg

SEQ ID NO: 357842 - DNA, 20 bp, Artificial
  CRISPR gRNA sequence
ccttggaggaggccttggag

SEQ ID NO: 357843 - DNA, 20 bp, Artificial
  CRISPR gRNA sequence
cttggaggaggccttggagg

SEQ ID NO: 357844 - DNA, 20 bp, Artificial
  CRISPR gRNA sequence
ggaggaggccttggaggagg

SEQ ID NO: 357845 - DNA, 20 bp, Artificial
  CRISPR gRNA sequence
ggaggccttggaggaggtgg

SEQ ID NO: 357846 - DNA, 20 bp, Artificial
  CRISPR gRNA sequence
tggaggaggtggaagcccca

SEQ ID NO: 357847 - DNA, 20 bp, Artificial
  CRISPR gRNA sequence
ggaggaggtggaagccccaa

SEQ ID NO: 357848 - DNA, 20 bp, Artificial
  CRISPR gRNA sequence
gccccaaaggccaatttcac

SEQ ID NO: 357849 - DNA, 20 bp, Artificial
  CRISPR gRNA sequence
aggccaatttcaccagcaca

SEQ ID NO: 357850 - DNA, 20 bp, Artificial
  CRISPR gRNA sequence
accagcacaaagattatact

SEQ ID NO: 357851 - DNA, 20 bp, Artificial
  CRISPR gRNA sequence
acaaagattatactcagtaa

SEQ ID NO: 357852 - DNA, 20 bp, Artificial
  CRISPR gRNA sequence
atactcagtaatggtcacca

SEQ ID NO: 357853 - DNA, 20 bp, Artificial
  CRISPR gRNA sequence
gtaatggtcaccaaagatct

SEQ ID NO: 357854 - DNA, 20 bp, Artificial
  CRISPR gRNA sequence
tggtcaccaaagatctaagt

SEQ ID NO: 357855 - DNA, 20 bp, Artificial
  CRISPR gRNA sequence
tcaccaaagatctaagtcag

SEQ ID NO: 357856 - DNA, 20 bp, Artificial
  CRISPR gRNA sequence
atctaagtcagtggttctta

SEQ ID NO: 357857 - DNA, 20 bp, Artificial
  CRISPR gRNA sequence
agtggttcttatagtatgtt

SEQ ID NO: 357858 - DNA, 20 bp, Artificial
  CRISPR gRNA sequence
gtggttcttatagtatgttt

SEQ ID NO: 357859 - DNA, 20 bp, Artificial
  CRISPR gRNA sequence
tggttcttatagtatgtttg

SEQ ID NO: 357860 - DNA, 20 bp, Artificial
  CRISPR gRNA sequence
ggttcttatagtatgtttgg

SEQ ID NO: 357861 - DNA, 20 bp, Artificial
  CRISPR gRNA sequence
tagtatgtttgggggtccct

SEQ ID NO: 357862 - DNA, 20 bp, Artificial
  CRISPR gRNA sequence
agtatgtttgggggtccctg

SEQ ID NO: 357863 - DNA, 20 bp, Artificial
  CRISPR gRNA sequence
gaggatccctgtgtcccttt

SEQ ID NO: 357864 - DNA, 20 bp, Artificial
  CRISPR gRNA sequence
aggatccctgtgtccctttt

SEQ ID NO: 357865 - DNA, 20 bp, Artificial
  CRISPR gRNA sequence
ggatccctgtgtcccttttg

SEQ ID NO: 357866 - DNA, 20 bp, Artificial
  CRISPR gRNA sequence
tgtcccttttggggatctgc

SEQ ID NO: 357867 - DNA, 20 bp, Artificial
  CRISPR gRNA sequence
gtcccttttggggatctgca

SEQ ID NO: 357868 - DNA, 20 bp, Artificial
  CRISPR gRNA sequence
caaggtcaaacctattttcc

SEQ ID NO: 357869 - DNA, 20 bp, Artificial
  CRISPR gRNA sequence
cctattttcctagtaatatt

SEQ ID NO: 357870 - DNA, 20 bp, Artificial
  CRISPR gRNA sequence
gtaatattaagatgcaacat

SEQ ID NO: 357871 - DNA, 20 bp, Artificial
  CRISPR gRNA sequence
ttctgcatccacatctgaaa

SEQ ID NO: 357872 - DNA, 20 bp, Artificial
  CRISPR gRNA sequence
atccacatctgaaaaagact

SEQ ID NO: 357873 - DNA, 20 bp, Artificial
  CRISPR gRNA sequence
ccacatctgaaaaagactga

SEQ ID NO: 357874 - DNA, 20 bp, Artificial
  CRISPR gRNA sequence
gaaaaagactgagagaaaaa

SEQ ID NO: 357875 - DNA, 20 bp, Artificial
  CRISPR gRNA sequence
aaaaagactgagagaaaaaa

SEQ ID NO: 357876 - DNA, 20 bp, Artificial
  CRISPR gRNA sequence
gagaaaaaaaggctcctgtc

SEQ ID NO: 357877 - DNA, 20 bp, Artificial
  CRISPR gRNA sequence
aaggctcctgtctggcaaac

SEQ ID NO: 357878 - DNA, 20 bp, Artificial
  CRISPR gRNA sequence
ctgctgaaatgcactcaacg

SEQ ID NO: 357879 - DNA, 20 bp, Artificial
  CRISPR gRNA sequence
cactcaacgcagccctgctt

SEQ ID NO: 357880 - DNA, 20 bp, Artificial
  CRISPR gRNA sequence
ctgcttcagccatatcaacc

SEQ ID NO: 357881 - DNA, 20 bp, Artificial
  CRISPR gRNA sequence
ctagcactgtcttgtattgc

SEQ ID NO: 357882 - DNA, 20 bp, Artificial
  CRISPR gRNA sequence
tagcactgtcttgtattgct

SEQ ID NO: 357883 - DNA, 20 bp, Artificial
  CRISPR gRNA sequence
agcactgtcttgtattgctg

SEQ ID NO: 357884 - DNA, 20 bp, Artificial
  CRISPR gRNA sequence
tcttgtattgctggggtatg

SEQ ID NO: 357885 - DNA, 20 bp, Artificial
  CRISPR gRNA sequence
cttgtattgctggggtatgt

SEQ ID NO: 357886 - DNA, 20 bp, Artificial
  CRISPR gRNA sequence
ttgtattgctggggtatgtg

SEQ ID NO: 357887 - DNA, 20 bp, Artificial
  CRISPR gRNA sequence
atcaaaaatattcatgtaat

SEQ ID NO: 357888 - DNA, 20 bp, Artificial
  CRISPR gRNA sequence
tcaaaaatattcatgtaatt

SEQ ID NO: 357889 - DNA, 20 bp, Artificial
  CRISPR gRNA sequence
aaaatattcatgtaattggg

SEQ ID NO: 357890 - DNA, 20 bp, Artificial
  CRISPR gRNA sequence
tattcatgtaattgggaaga

SEQ ID NO: 357891 - DNA, 20 bp, Artificial
  CRISPR gRNA sequence
attcatgtaattgggaagat

SEQ ID NO: 357892 - DNA, 20 bp, Artificial
  CRISPR gRNA sequence
tcatgtaattgggaagatag

SEQ ID NO: 357893 - DNA, 20 bp, Artificial
  CRISPR gRNA sequence
ttgggaagataggagttcta

SEQ ID NO: 357894 - DNA, 20 bp, Artificial
  CRISPR gRNA sequence
agttctacagctgaaacctg

SEQ ID NO: 357895 - DNA, 20 bp, Artificial
  CRISPR gRNA sequence
gttctacagctgaaacctga

SEQ ID NO: 357896 - DNA, 20 bp, Artificial
  CRISPR gRNA sequence
tacagctgaaacctgaaggc

SEQ ID NO: 357897 - DNA, 20 bp, Artificial
  CRISPR gRNA sequence
tggtaataccatatgttttt

SEQ ID NO: 357898 - DNA, 20 bp, Artificial
  CRISPR gRNA sequence
cctttacgaatttctttttt

SEQ ID NO: 357899 - DNA, 20 bp, Artificial
  CRISPR gRNA sequence
cgaatttcttttttaagctt

SEQ ID NO: 357900 - DNA, 20 bp, Artificial
  CRISPR gRNA sequence
gaatttcttttttaagcttc

SEQ ID NO: 357901 - DNA, 20 bp, Artificial
  CRISPR gRNA sequence
ttcttttttaagcttcagga

SEQ ID NO: 357902 - DNA, 20 bp, Artificial
  CRISPR gRNA sequence
ttttttaagcttcaggatgg

SEQ ID NO: 357903 - DNA, 20 bp, Artificial
  CRISPR gRNA sequence
tttaagcttcaggatggtgg

SEQ ID NO: 357904 - DNA, 20 bp, Artificial
  CRISPR gRNA sequence
gcttcaggatggtggcagat

SEQ ID NO: 357905 - DNA, 20 bp, Artificial
  CRISPR gRNA sequence
atggtggcagataagaaaat

SEQ ID NO: 357906 - DNA, 20 bp, Artificial
  CRISPR gRNA sequence
tggcagataagaaaattgga

SEQ ID NO: 357907 - DNA, 20 bp, Artificial
  CRISPR gRNA sequence
ttattgctgtatctgattga

SEQ ID NO: 357908 - DNA, 20 bp, Artificial
  CRISPR gRNA sequence
tatctgattgatggattcac

SEQ ID NO: 357909 - DNA, 20 bp, Artificial
  CRISPR gRNA sequence
attgatggattcacaagata

SEQ ID NO: 357910 - DNA, 20 bp, Artificial
  CRISPR gRNA sequence
gataaagaaaccctcaatac

SEQ ID NO: 357911 - DNA, 20 bp, Artificial
  CRISPR gRNA sequence
aaccctcaatactagaataa

SEQ ID NO: 357912 - DNA, 20 bp, Artificial
  CRISPR gRNA sequence
atggccaactcacctaaatt

SEQ ID NO: 357913 - DNA, 20 bp, Artificial
  CRISPR gRNA sequence
atgtttaccataaataaaaa

SEQ ID NO: 357914 - DNA, 20 bp, Artificial
  CRISPR gRNA sequence
gtttaccataaataaaaaca

SEQ ID NO: 357915 - DNA, 20 bp, Artificial
  CRISPR gRNA sequence
ccataaataaaaacagagac

SEQ ID NO: 357916 - DNA, 20 bp, Artificial
  CRISPR gRNA sequence
taaaaacagagaccagccca

SEQ ID NO: 357917 - DNA, 20 bp, Artificial
  CRISPR gRNA sequence
aaaaacagagaccagcccac

SEQ ID NO: 357918 - DNA, 20 bp, Artificial
  CRISPR gRNA sequence
aaaacagagaccagcccacg

SEQ ID NO: 357919 - DNA, 20 bp, Artificial
  CRISPR gRNA sequence
cagagaccagcccacggggc

SEQ ID NO: 357920 - DNA, 20 bp, Artificial
  CRISPR gRNA sequence
gctttttccatgtttgatac

SEQ ID NO: 357921 - DNA, 20 bp, Artificial
  CRISPR gRNA sequence
ttttccatgtttgataccag

SEQ ID NO: 357922 - DNA, 20 bp, Artificial
  CRISPR gRNA sequence
gtttgataccagaagatgtc

SEQ ID NO: 357923 - DNA, 20 bp, Artificial
  CRISPR gRNA sequence
gtctggtgctcactcaccct

SEQ ID NO: 357924 - DNA, 20 bp, Artificial
  CRISPR gRNA sequence
tgctcactcaccctcggcta

SEQ ID NO: 357925 - DNA, 20 bp, Artificial
  CRISPR gRNA sequence
ctacagtcaatctcatcacg

SEQ ID NO: 357926 - DNA, 20 bp, Artificial
  CRISPR gRNA sequence
tacagtcaatctcatcacga

SEQ ID NO: 357927 - DNA, 20 bp, Artificial
  CRISPR gRNA sequence
ggtttcgttttctcctgcgc

SEQ ID NO: 357928 - DNA, 20 bp, Artificial
  CRISPR gRNA sequence
tttctcctgcgctggcctgc

SEQ ID NO: 357929 - DNA, 20 bp, Artificial
  CRISPR gRNA sequence
ctcctgcgctggcctgcaag

SEQ ID NO: 357930 - DNA, 20 bp, Artificial
  CRISPR gRNA sequence
ctgcgctggcctgcaagtag

SEQ ID NO: 357931 - DNA, 20 bp, Artificial
  CRISPR gRNA sequence
cgctggcctgcaagtagcag

SEQ ID NO: 357932 - DNA, 20 bp, Artificial
  CRISPR gRNA sequence
gcctgcaagtagcagcggta

SEQ ID NO: 357933 - DNA, 20 bp, Artificial
  CRISPR gRNA sequence
agtagcagcggtaaagcccc

SEQ ID NO: 357934 - DNA, 20 bp, Artificial
  CRISPR gRNA sequence
agcggtaaagccccgagtct

SEQ ID NO: 357935 - DNA, 20 bp, Artificial
  CRISPR gRNA sequence
cgagtctgagactgtgacat

SEQ ID NO: 357936 - DNA, 20 bp, Artificial
  CRISPR gRNA sequence
gagtctgagactgtgacatc

SEQ ID NO: 357937 - DNA, 20 bp, Artificial
  CRISPR gRNA sequence
agtctgagactgtgacatcg

SEQ ID NO: 357938 - DNA, 20 bp, Artificial
  CRISPR gRNA sequence
cgatgacgctccaccttccg

SEQ ID NO: 357939 - DNA, 20 bp, Artificial
  CRISPR gRNA sequence
cgctccaccttccgtggctg

SEQ ID NO: 357940 - DNA, 20 bp, Artificial
  CRISPR gRNA sequence
cagttgctcactatttgtct

SEQ ID NO: 357941 - DNA, 20 bp, Artificial
  CRISPR gRNA sequence
agttgctcactatttgtctt

SEQ ID NO: 357942 - DNA, 20 bp, Artificial
  CRISPR gRNA sequence
cactatttgtcttgggaact

SEQ ID NO: 357943 - DNA, 20 bp, Artificial
  CRISPR gRNA sequence
ctatttgtcttgggaacttg

SEQ ID NO: 357944 - DNA, 20 bp, Artificial
  CRISPR gRNA sequence
tatttgtcttgggaacttgg

SEQ ID NO: 357945 - DNA, 20 bp, Artificial
  CRISPR gRNA sequence
tggaggtgaaatttctgcca

SEQ ID NO: 357946 - DNA, 20 bp, Artificial
  CRISPR gRNA sequence
tgaaatttctgccatggacc

SEQ ID NO: 357947 - DNA, 20 bp, Artificial
  CRISPR gRNA sequence
ttctgccatggaccaagttg

SEQ ID NO: 357948 - DNA, 20 bp, Artificial
  CRISPR gRNA sequence
gccatggaccaagttgcagt

SEQ ID NO: 357949 - DNA, 20 bp, Artificial
  CRISPR gRNA sequence
ggaccaagttgcagtaagtt

SEQ ID NO: 357950 - DNA, 20 bp, Artificial
  CRISPR gRNA sequence
accaagttgcagtaagttaa

SEQ ID NO: 357951 - DNA, 20 bp, Artificial
  CRISPR gRNA sequence
ccaagttgcagtaagttaag

SEQ ID NO: 357952 - DNA, 20 bp, Artificial
  CRISPR gRNA sequence
aagttaagaggtcgatctga

SEQ ID NO: 357953 - DNA, 20 bp, Artificial
  CRISPR gRNA sequence
agttaagaggtcgatctgac

SEQ ID NO: 357954 - DNA, 20 bp, Artificial
  CRISPR gRNA sequence
gttaagaggtcgatctgacg

SEQ ID NO: 357955 - DNA, 20 bp, Artificial
  CRISPR gRNA sequence
agaggtcgatctgacggggc

SEQ ID NO: 357956 - DNA, 20 bp, Artificial
  CRISPR gRNA sequence
ttcccacctcactgcctgca

SEQ ID NO: 357957 - DNA, 20 bp, Artificial
  CRISPR gRNA sequence
tcccacctcactgcctgcac

SEQ ID NO: 357958 - DNA, 20 bp, Artificial
  CRISPR gRNA sequence
ctgcacaggccacgtcatct

SEQ ID NO: 357959 - DNA, 20 bp, Artificial
  CRISPR gRNA sequence
tgcacaggccacgtcatctg

SEQ ID NO: 357960 - DNA, 20 bp, Artificial
  CRISPR gRNA sequence
ccacgtcatctgaggctgac

SEQ ID NO: 357961 - DNA, 20 bp, Artificial
  CRISPR gRNA sequence
gtcatctgaggctgacaagt

SEQ ID NO: 357962 - DNA, 20 bp, Artificial
  CRISPR gRNA sequence
agtgagtgtgacattctttc

SEQ ID NO: 357963 - DNA, 20 bp, Artificial
  CRISPR gRNA sequence
gtgagtgtgacattctttcc

SEQ ID NO: 357964 - DNA, 20 bp, Artificial
  CRISPR gRNA sequence
ttccaggttccgaaacaatg

SEQ ID NO: 357965 - DNA, 20 bp, Artificial
  CRISPR gRNA sequence
gaaacaatgtggctatttga

SEQ ID NO: 357966 - DNA, 20 bp, Artificial
  CRISPR gRNA sequence
aatgtggctatttgatggca

SEQ ID NO: 357967 - DNA, 20 bp, Artificial
  CRISPR gRNA sequence
ctgcctcaaaactatctgaa

SEQ ID NO: 357968 - DNA, 20 bp, Artificial
  CRISPR gRNA sequence
cctcaaaactatctgaaaag

SEQ ID NO: 357969 - DNA, 20 bp, Artificial
  CRISPR gRNA sequence
caaaactatctgaaaagaag

SEQ ID NO: 357970 - DNA, 20 bp, Artificial
  CRISPR gRNA sequence
gaaaagaagaagcaaatgat

SEQ ID NO: 357971 - DNA, 20 bp, Artificial
  CRISPR gRNA sequence
aagaagcaaatgattagata

SEQ ID NO: 357972 - DNA, 20 bp, Artificial
  CRISPR gRNA sequence
agaagcaaatgattagatac

SEQ ID NO: 357973 - DNA, 20 bp, Artificial
  CRISPR gRNA sequence
agatacaggttgtcaaattt

SEQ ID NO: 357974 - DNA, 20 bp, Artificial
  CRISPR gRNA sequence
gatacaggttgtcaaatttt

SEQ ID NO: 357975 - DNA, 20 bp, Artificial
  CRISPR gRNA sequence
caaattttgggacacccaac

SEQ ID NO: 357976 - DNA, 20 bp, Artificial
  CRISPR gRNA sequence
attttgggacacccaactgg

SEQ ID NO: 357977 - DNA, 20 bp, Artificial
  CRISPR gRNA sequence
tacttaatcataaaaataat

SEQ ID NO: 357978 - DNA, 20 bp, Artificial
  CRISPR gRNA sequence
attggtgatgttacctaaca

SEQ ID NO: 357979 - DNA, 20 bp, Artificial
  CRISPR gRNA sequence
actttttttttttttttcct

SEQ ID NO: 357980 - DNA, 20 bp, Artificial
  CRISPR gRNA sequence
tttttttttttttcctgaga

SEQ ID NO: 357981 - DNA, 20 bp, Artificial
  CRISPR gRNA sequence
tttttttttttcctgagacg

SEQ ID NO: 357982 - DNA, 20 bp, Artificial
  CRISPR gRNA sequence
cggagtcttgctctgtcacc

SEQ ID NO: 357983 - DNA, 20 bp, Artificial
  CRISPR gRNA sequence
tcttgctctgtcacccagac

SEQ ID NO: 357984 - DNA, 20 bp, Artificial
  CRISPR gRNA sequence
ttgctctgtcacccagacta

SEQ ID NO: 357985 - DNA, 20 bp, Artificial
  CRISPR gRNA sequence
ctgtcacccagactagagtg

SEQ ID NO: 357986 - DNA, 20 bp, Artificial
  CRISPR gRNA sequence
tcacccagactagagtgcag

SEQ ID NO: 357987 - DNA, 20 bp, Artificial
  CRISPR gRNA sequence
agagtgcagtggtgtgatct

SEQ ID NO: 357988 - DNA, 20 bp, Artificial
  CRISPR gRNA sequence
tcaatgcaacctccacctcc

SEQ ID NO: 357989 - DNA, 20 bp, Artificial
  CRISPR gRNA sequence
caatgcaacctccacctccc

SEQ ID NO: 357990 - DNA, 20 bp, Artificial
  CRISPR gRNA sequence
ttcacgccattctcctgcct

SEQ ID NO: 357991 - DNA, 20 bp, Artificial
  CRISPR gRNA sequence
ttctcctgcctcagcctcct

SEQ ID NO: 357992 - DNA, 20 bp, Artificial
  CRISPR gRNA sequence
tcctgcctcagcctcctgag

SEQ ID NO: 357993 - DNA, 20 bp, Artificial
  CRISPR gRNA sequence
gcctcagcctcctgagtagc

SEQ ID NO: 357994 - DNA, 20 bp, Artificial
  CRISPR gRNA sequence
cctcagcctcctgagtagct

SEQ ID NO: 357995 - DNA, 20 bp, Artificial
  CRISPR gRNA sequence
ctcctgagtagctgggacta

SEQ ID NO: 357996 - DNA, 20 bp, Artificial
  CRISPR gRNA sequence
tcctgagtagctgggactat

SEQ ID NO: 357997 - DNA, 20 bp, Artificial
  CRISPR gRNA sequence
taggcgcccgccaccgcgcc

SEQ ID NO: 357998 - DNA, 20 bp, Artificial
  CRISPR gRNA sequence
cggctaattttttgtatttt

SEQ ID NO: 357999 - DNA, 20 bp, Artificial
  CRISPR gRNA sequence
ctaattttttgtatttttag

SEQ ID NO: 358000 - DNA, 20 bp, Artificial
  CRISPR gRNA sequence
aattttttgtatttttagta

SEQ ID NO: 358001 - DNA, 20 bp, Artificial
  CRISPR gRNA sequence
ttttgtatttttagtagaga

SEQ ID NO: 358002 - DNA, 20 bp, Artificial
  CRISPR gRNA sequence
tttgtatttttagtagagac

SEQ ID NO: 358003 - DNA, 20 bp, Artificial
  CRISPR gRNA sequence
gagacgggctttcaccgtgt

SEQ ID NO: 358004 - DNA, 20 bp, Artificial
  CRISPR gRNA sequence
cgggctttcaccgtgttagc

SEQ ID NO: 358005 - DNA, 20 bp, Artificial
  CRISPR gRNA sequence
gggctttcaccgtgttagcc

SEQ ID NO: 358006 - DNA, 20 bp, Artificial
  CRISPR gRNA sequence
tttcaccgtgttagccagga

SEQ ID NO: 358007 - DNA, 20 bp, Artificial
  CRISPR gRNA sequence
accttgtgatccgcccacct

SEQ ID NO: 358008 - DNA, 20 bp, Artificial
  CRISPR gRNA sequence
ccgcccacctcggcctccca

SEQ ID NO: 358009 - DNA, 20 bp, Artificial
  CRISPR gRNA sequence
acctcggcctcccaaagtgc

SEQ ID NO: 358010 - DNA, 20 bp, Artificial
  CRISPR gRNA sequence
cctcggcctcccaaagtgct

SEQ ID NO: 358011 - DNA, 20 bp, Artificial
  CRISPR gRNA sequence
ctcccaaagtgctgggatta

SEQ ID NO: 358012 - DNA, 20 bp, Artificial
  CRISPR gRNA sequence
tcccaaagtgctgggattac

SEQ ID NO: 358013 - DNA, 20 bp, Artificial
  CRISPR gRNA sequence
agtgctgggattacaggcat

SEQ ID NO: 358014 - DNA, 20 bp, Artificial
  CRISPR gRNA sequence
caggcatgagccaccgcacc

SEQ ID NO: 358015 - DNA, 20 bp, Artificial
  CRISPR gRNA sequence
tgtgaatgacacattcttgt

SEQ ID NO: 358016 - DNA, 20 bp, Artificial
  CRISPR gRNA sequence
tgaatgacacattcttgtaa

SEQ ID NO: 358017 - DNA, 20 bp, Artificial
  CRISPR gRNA sequence
tgacacattcttgtaagaga

SEQ ID NO: 358018 - DNA, 20 bp, Artificial
  CRISPR gRNA sequence
gacacattcttgtaagagaa

SEQ ID NO: 358019 - DNA, 20 bp, Artificial
  CRISPR gRNA sequence
acacattcttgtaagagaaa

SEQ ID NO: 358020 - DNA, 20 bp, Artificial
  CRISPR gRNA sequence
gttttttgttttttgttttt

SEQ ID NO: 358021 - DNA, 20 bp, Artificial
  CRISPR gRNA sequence
ttgttttttgtttttaagtc

SEQ ID NO: 358022 - DNA, 20 bp, Artificial
  CRISPR gRNA sequence
tgttttttgtttttaagtcc

SEQ ID NO: 358023 - DNA, 20 bp, Artificial
  CRISPR gRNA sequence
ttttttgtttttaagtccgg

SEQ ID NO: 358024 - DNA, 20 bp, Artificial
  CRISPR gRNA sequence
ttttaagtccgggagataaa

SEQ ID NO: 358025 - DNA, 20 bp, Artificial
  CRISPR gRNA sequence
agtccgggagataaatagaa

SEQ ID NO: 358026 - DNA, 20 bp, Artificial
  CRISPR gRNA sequence
tccgggagataaatagaaaa

SEQ ID NO: 358027 - DNA, 20 bp, Artificial
  CRISPR gRNA sequence
ccgggagataaatagaaaag

SEQ ID NO: 358028 - DNA, 20 bp, Artificial
  CRISPR gRNA sequence
aggatatgattgttcacaca

SEQ ID NO: 358029 - DNA, 20 bp, Artificial
  CRISPR gRNA sequence
ttgttcacacatagttccat

SEQ ID NO: 358030 - DNA, 20 bp, Artificial
  CRISPR gRNA sequence
atagttccataagtgttact

SEQ ID NO: 358031 - DNA, 20 bp, Artificial
  CRISPR gRNA sequence
gtgttacttggttaaccatg

SEQ ID NO: 358032 - DNA, 20 bp, Artificial
  CRISPR gRNA sequence
tacttggttaaccatgtagt

SEQ ID NO: 358033 - DNA, 20 bp, Artificial
  CRISPR gRNA sequence
taaccatgtagtgagaaaca

SEQ ID NO: 358034 - DNA, 20 bp, Artificial
  CRISPR gRNA sequence
agaaacacagccaaaacccc

SEQ ID NO: 358035 - DNA, 20 bp, Artificial
  CRISPR gRNA sequence
aaaacccctggtgcttttct

SEQ ID NO: 358036 - DNA, 20 bp, Artificial
  CRISPR gRNA sequence
gcttttcttggtatcatatc

SEQ ID NO: 358037 - DNA, 20 bp, Artificial
  CRISPR gRNA sequence
ttttcttggtatcatatcaa

SEQ ID NO: 358038 - DNA, 20 bp, Artificial
  CRISPR gRNA sequence
tttcttggtatcatatcaag

SEQ ID NO: 358039 - DNA, 20 bp, Artificial
  CRISPR gRNA sequence
tcaagaggctgaattttaca

SEQ ID NO: 358040 - DNA, 20 bp, Artificial
  CRISPR gRNA sequence
aagaggctgaattttacaaa

SEQ ID NO: 358041 - DNA, 20 bp, Artificial
  CRISPR gRNA sequence
gaattttacaaagagactgt

SEQ ID NO: 358042 - DNA, 20 bp, Artificial
  CRISPR gRNA sequence
aattttacaaagagactgtt

SEQ ID NO: 358043 - DNA, 20 bp, Artificial
  CRISPR gRNA sequence
agactgttaggcaataatgc

SEQ ID NO: 358044 - DNA, 20 bp, Artificial
  CRISPR gRNA sequence
gactgttaggcaataatgct

SEQ ID NO: 358045 - DNA, 20 bp, Artificial
  CRISPR gRNA sequence
gttaggcaataatgctgggc

SEQ ID NO: 358046 - DNA, 20 bp, Artificial
  CRISPR gRNA sequence
gtgtctctgacactgaccta

SEQ ID NO: 358047 - DNA, 20 bp, Artificial
  CRISPR gRNA sequence
gacctacagtatcaaatgtt

SEQ ID NO: 358048 - DNA, 20 bp, Artificial
  CRISPR gRNA sequence
acctacagtatcaaatgttc

SEQ ID NO: 358049 - DNA, 20 bp, Artificial
  CRISPR gRNA sequence
tgttcaggttataatcattc

SEQ ID NO: 358050 - DNA, 20 bp, Artificial
  CRISPR gRNA sequence
aggttataatcattctggct

SEQ ID NO: 358051 - DNA, 20 bp, Artificial
  CRISPR gRNA sequence
cattctggctaagattctga

SEQ ID NO: 358052 - DNA, 20 bp, Artificial
  CRISPR gRNA sequence
agattctgacagttatgaaa

SEQ ID NO: 358053 - DNA, 20 bp, Artificial
  CRISPR gRNA sequence
atacacatgatctcattctt

SEQ ID NO: 358054 - DNA, 20 bp, Artificial
  CRISPR gRNA sequence
gatctcattcttcagatata

SEQ ID NO: 358055 - DNA, 20 bp, Artificial
  CRISPR gRNA sequence
atctcattcttcagatatac

SEQ ID NO: 358056 - DNA, 20 bp, Artificial
  CRISPR gRNA sequence
tctcattcttcagatataca

SEQ ID NO: 358057 - DNA, 20 bp, Artificial
  CRISPR gRNA sequence
atacagggttgtcttacaca

SEQ ID NO: 358058 - DNA, 20 bp, Artificial
  CRISPR gRNA sequence
tacagggttgtcttacacat

SEQ ID NO: 358059 - DNA, 20 bp, Artificial
  CRISPR gRNA sequence
agggttgtcttacacatggg

SEQ ID NO: 358060 - DNA, 20 bp, Artificial
  CRISPR gRNA sequence
ggttgtcttacacatgggta

SEQ ID NO: 358061 - DNA, 20 bp, Artificial
  CRISPR gRNA sequence
tgtcttacacatgggtagag

SEQ ID NO: 358062 - DNA, 20 bp, Artificial
  CRISPR gRNA sequence
gtcttacacatgggtagagt

SEQ ID NO: 358063 - DNA, 20 bp, Artificial
  CRISPR gRNA sequence
tcttacacatgggtagagta

SEQ ID NO: 358064 - DNA, 20 bp, Artificial
  CRISPR gRNA sequence
gtagagtagggccccacatg

SEQ ID NO: 358065 - DNA, 20 bp, Artificial
  CRISPR gRNA sequence
atcaattcttgataccatga

SEQ ID NO: 358066 - DNA, 20 bp, Artificial
  CRISPR gRNA sequence
ttcttgataccatgaaagtc

SEQ ID NO: 358067 - DNA, 20 bp, Artificial
  CRISPR gRNA sequence
caccttcctcacaccatttc

SEQ ID NO: 358068 - DNA, 20 bp, Artificial
  CRISPR gRNA sequence
tttctggaattcctaccata

SEQ ID NO: 358069 - DNA, 20 bp, Artificial
  CRISPR gRNA sequence
aattcctaccataaagtact

SEQ ID NO: 358070 - DNA, 20 bp, Artificial
  CRISPR gRNA sequence
gtaattgtcactaaatatct

SEQ ID NO: 358071 - DNA, 20 bp, Artificial
  CRISPR gRNA sequence
tcactaaatatctaagtcca

SEQ ID NO: 358072 - DNA, 20 bp, Artificial
  CRISPR gRNA sequence
atatctaagtccatggtcct

SEQ ID NO: 358073 - DNA, 20 bp, Artificial
  CRISPR gRNA sequence
atctaagtccatggtcctta

SEQ ID NO: 358074 - DNA, 20 bp, Artificial
  CRISPR gRNA sequence
catggtccttagagtgtgtt

SEQ ID NO: 358075 - DNA, 20 bp, Artificial
  CRISPR gRNA sequence
atggtccttagagtgtgttt

SEQ ID NO: 358076 - DNA, 20 bp, Artificial
  CRISPR gRNA sequence
tggtccttagagtgtgtttg

SEQ ID NO: 358077 - DNA, 20 bp, Artificial
  CRISPR gRNA sequence
ggtccttagagtgtgtttgg

SEQ ID NO: 358078 - DNA, 20 bp, Artificial
  CRISPR gRNA sequence
tagagtgtgtttgggggccc

SEQ ID NO: 358079 - DNA, 20 bp, Artificial
  CRISPR gRNA sequence
agagtgtgtttgggggccct

SEQ ID NO: 358080 - DNA, 20 bp, Artificial
  CRISPR gRNA sequence
tgggcatctctgtgtccctt

SEQ ID NO: 358081 - DNA, 20 bp, Artificial
  CRISPR gRNA sequence
gggcatctctgtgtcccttt

SEQ ID NO: 358082 - DNA, 20 bp, Artificial
  CRISPR gRNA sequence
ggcatctctgtgtcccttta

SEQ ID NO: 358083 - DNA, 20 bp, Artificial
  CRISPR gRNA sequence
gcatctctgtgtccctttag

SEQ ID NO: 358084 - DNA, 20 bp, Artificial
  CRISPR gRNA sequence
tgtccctttaggggatatgc

SEQ ID NO: 358085 - DNA, 20 bp, Artificial
  CRISPR gRNA sequence
ccagttcaaatctattttcc

SEQ ID NO: 358086 - DNA, 20 bp, Artificial
  CRISPR gRNA sequence
tctattttcctagtgatatt

SEQ ID NO: 358087 - DNA, 20 bp, Artificial
  CRISPR gRNA sequence
tattttcctagtgatattga

SEQ ID NO: 358088 - DNA, 20 bp, Artificial
  CRISPR gRNA sequence
attttcctagtgatattgag

SEQ ID NO: 358089 - DNA, 20 bp, Artificial
  CRISPR gRNA sequence
gaaattccccctcttcactc

SEQ ID NO: 358090 - DNA, 20 bp, Artificial
  CRISPR gRNA sequence
tcttcactccagttctctca

SEQ ID NO: 358091 - DNA, 20 bp, Artificial
  CRISPR gRNA sequence
cttcactccagttctctcac

SEQ ID NO: 358092 - DNA, 20 bp, Artificial
  CRISPR gRNA sequence
ccagttctctcacaggtata

SEQ ID NO: 358093 - DNA, 20 bp, Artificial
  CRISPR gRNA sequence
gttctctcacaggtatacag

SEQ ID NO: 358094 - DNA, 20 bp, Artificial
  CRISPR gRNA sequence
aggtatacagtagatatttc

SEQ ID NO: 358095 - DNA, 20 bp, Artificial
  CRISPR gRNA sequence
gtatacagtagatatttcca

SEQ ID NO: 358096 - DNA, 20 bp, Artificial
  CRISPR gRNA sequence
tatacagtagatatttccag

SEQ ID NO: 358097 - DNA, 20 bp, Artificial
  CRISPR gRNA sequence
gatatttccagaggctctgc

SEQ ID NO: 358098 - DNA, 20 bp, Artificial
  CRISPR gRNA sequence
tttccagaggctctgccagc

SEQ ID NO: 358099 - DNA, 20 bp, Artificial
  CRISPR gRNA sequence
ccagaggctctgccagctag

SEQ ID NO: 358100 - DNA, 20 bp, Artificial
  CRISPR gRNA sequence
ctcaatattgatttctaata

SEQ ID NO: 358101 - DNA, 20 bp, Artificial
  CRISPR gRNA sequence
ttctaatacagtaaacatga

SEQ ID NO: 358102 - DNA, 20 bp, Artificial
  CRISPR gRNA sequence
tacagtaaacatgacagata

SEQ ID NO: 358103 - DNA, 20 bp, Artificial
  CRISPR gRNA sequence
tacataaacaaacactccct

SEQ ID NO: 358104 - DNA, 20 bp, Artificial
  CRISPR gRNA sequence
acataaacaaacactccctg

SEQ ID NO: 358105 - DNA, 20 bp, Artificial
  CRISPR gRNA sequence
cataaacaaacactccctga

SEQ ID NO: 358106 - DNA, 20 bp, Artificial
  CRISPR gRNA sequence
aaacactccctgagggcctt

SEQ ID NO: 358107 - DNA, 20 bp, Artificial
  CRISPR gRNA sequence
gccttcagtaatttttaaaa

SEQ ID NO: 358108 - DNA, 20 bp, Artificial
  CRISPR gRNA sequence
gtaatttttaaaatagcata

SEQ ID NO: 358109 - DNA, 20 bp, Artificial
  CRISPR gRNA sequence
taatttttaaaatagcataa

SEQ ID NO: 358110 - DNA, 20 bp, Artificial
  CRISPR gRNA sequence
aatttttaaaatagcataaa

SEQ ID NO: 358111 - DNA, 20 bp, Artificial
  CRISPR gRNA sequence
atttttaaaatagcataaag

SEQ ID NO: 358112 - DNA, 20 bp, Artificial
  CRISPR gRNA sequence
aaatagcataaaggggtctt

SEQ ID NO: 358113 - DNA, 20 bp, Artificial
  CRISPR gRNA sequence
aaaggggtcttgagaccaaa

SEQ ID NO: 358114 - DNA, 20 bp, Artificial
  CRISPR gRNA sequence
ggtcttgagaccaaaaagtt

SEQ ID NO: 358115 - DNA, 20 bp, Artificial
  CRISPR gRNA sequence
gtcttgagaccaaaaagttt

SEQ ID NO: 358116 - DNA, 20 bp, Artificial
  CRISPR gRNA sequence
aagtttgggaacccgatcta

SEQ ID NO: 358117 - DNA, 20 bp, Artificial
  CRISPR gRNA sequence
ccgatctaaagaataaactg

SEQ ID NO: 358118 - DNA, 20 bp, Artificial
  CRISPR gRNA sequence
ggtaactctttcttaaaatt

SEQ ID NO: 358119 - DNA, 20 bp, Artificial
  CRISPR gRNA sequence
ttcttaaaattaagataacc

SEQ ID NO: 358120 - DNA, 20 bp, Artificial
  CRISPR gRNA sequence
taaaattaagataacccagc

SEQ ID NO: 358121 - DNA, 20 bp, Artificial
  CRISPR gRNA sequence
aaaattaagataacccagca

SEQ ID NO: 358122 - DNA, 20 bp, Artificial
  CRISPR gRNA sequence
agataacccagcaaggtaac

SEQ ID NO: 358123 - DNA, 20 bp, Artificial
  CRISPR gRNA sequence
taacccagcaaggtaacaag

SEQ ID NO: 358124 - DNA, 20 bp, Artificial
  CRISPR gRNA sequence
taacaagtggatctatttat

SEQ ID NO: 358125 - DNA, 20 bp, Artificial
  CRISPR gRNA sequence
gaacaccttctttcttctga

SEQ ID NO: 358126 - DNA, 20 bp, Artificial
  CRISPR gRNA sequence
caaatcctgacctgctattt

SEQ ID NO: 358127 - DNA, 20 bp, Artificial
  CRISPR gRNA sequence
atcctgacctgctatttcag

SEQ ID NO: 358128 - DNA, 20 bp, Artificial
  CRISPR gRNA sequence
cctgacctgctatttcagta

SEQ ID NO: 358129 - DNA, 20 bp, Artificial
  CRISPR gRNA sequence
acctgctatttcagtagagt

SEQ ID NO: 358130 - DNA, 20 bp, Artificial
  CRISPR gRNA sequence
cctgctatttcagtagagtg

SEQ ID NO: 358131 - DNA, 20 bp, Artificial
  CRISPR gRNA sequence
tatttcagtagagtgaggcc

SEQ ID NO: 358132 - DNA, 20 bp, Artificial
  CRISPR gRNA sequence
atttcagtagagtgaggcct

SEQ ID NO: 358133 - DNA, 20 bp, Artificial
  CRISPR gRNA sequence
tcagtagagtgaggcctggg

SEQ ID NO: 358134 - DNA, 20 bp, Artificial
  CRISPR gRNA sequence
aatgatgtcacaaaactctc

SEQ ID NO: 358135 - DNA, 20 bp, Artificial
  CRISPR gRNA sequence
tcacaaaactctctggcact

SEQ ID NO: 358136 - DNA, 20 bp, Artificial
  CRISPR gRNA sequence
cacaaaactctctggcacta

SEQ ID NO: 358137 - DNA, 20 bp, Artificial
  CRISPR gRNA sequence
acaaaactctctggcactaa

SEQ ID NO: 358138 - DNA, 20 bp, Artificial
  CRISPR gRNA sequence
aaaactctctggcactaagg

SEQ ID NO: 358139 - DNA, 20 bp, Artificial
  CRISPR gRNA sequence
cactaagggagaaatgcaaa

SEQ ID NO: 358140 - DNA, 20 bp, Artificial
  CRISPR gRNA sequence
taagggagaaatgcaaaaag

SEQ ID NO: 358141 - DNA, 20 bp, Artificial
  CRISPR gRNA sequence
aagggagaaatgcaaaaagt

SEQ ID NO: 358142 - DNA, 20 bp, Artificial
  CRISPR gRNA sequence
ggagaaatgcaaaaagtggg

SEQ ID NO: 358143 - DNA, 20 bp, Artificial
  CRISPR gRNA sequence
ctgtcacttcaactatgtga

SEQ ID NO: 358144 - DNA, 20 bp, Artificial
  CRISPR gRNA sequence
aactatgtgacagtttcact

SEQ ID NO: 358145 - DNA, 20 bp, Artificial
  CRISPR gRNA sequence
actatgtgacagtttcactc

SEQ ID NO: 358146 - DNA, 20 bp, Artificial
  CRISPR gRNA sequence
gtgacagtttcactcaggac

SEQ ID NO: 358147 - DNA, 20 bp, Artificial
  CRISPR gRNA sequence
agtttcactcaggactggcc

SEQ ID NO: 358148 - DNA, 20 bp, Artificial
  CRISPR gRNA sequence
gtttcactcaggactggccc

SEQ ID NO: 358149 - DNA, 20 bp, Artificial
  CRISPR gRNA sequence
ttcactcaggactggcccag

SEQ ID NO: 358150 - DNA, 20 bp, Artificial
  CRISPR gRNA sequence
tggcccaggagccattgtct

SEQ ID NO: 358151 - DNA, 20 bp, Artificial
  CRISPR gRNA sequence
ttgtcttggcatacaaacaa

SEQ ID NO: 358152 - DNA, 20 bp, Artificial
  CRISPR gRNA sequence
ggcatacaaacaaaagaaaa

SEQ ID NO: 358153 - DNA, 20 bp, Artificial
  CRISPR gRNA sequence
caaacaaaagaaaaaagaaa

SEQ ID NO: 358154 - DNA, 20 bp, Artificial
  CRISPR gRNA sequence
aacaaaagaaaaaagaaata

SEQ ID NO: 358155 - DNA, 20 bp, Artificial
  CRISPR gRNA sequence
aaagaaaaaagaaatagaga

SEQ ID NO: 358156 - DNA, 20 bp, Artificial
  CRISPR gRNA sequence
agaaaaaagaaatagagaaa

SEQ ID NO: 358157 - DNA, 20 bp, Artificial
  CRISPR gRNA sequence
aaaaaagaaatagagaaaga

SEQ ID NO: 358158 - DNA, 20 bp, Artificial
  CRISPR gRNA sequence
aagaaatagagaaagagaga

SEQ ID NO: 358159 - DNA, 20 bp, Artificial
  CRISPR gRNA sequence
agaaatagagaaagagagaa

SEQ ID NO: 358160 - DNA, 20 bp, Artificial
  CRISPR gRNA sequence
aatagagaaagagagaaagg

SEQ ID NO: 358161 - DNA, 20 bp, Artificial
  CRISPR gRNA sequence
atagagaaagagagaaagga

SEQ ID NO: 358162 - DNA, 20 bp, Artificial
  CRISPR gRNA sequence
agagaaagagagaaaggaag

SEQ ID NO: 358163 - DNA, 20 bp, Artificial
  CRISPR gRNA sequence
gagaaagagagaaaggaagg

SEQ ID NO: 358164 - DNA, 20 bp, Artificial
  CRISPR gRNA sequence
agaaagagagaaaggaagga

SEQ ID NO: 358165 - DNA, 20 bp, Artificial
  CRISPR gRNA sequence
aagagagaaaggaaggaggg

SEQ ID NO: 358166 - DNA, 20 bp, Artificial
  CRISPR gRNA sequence
agagagaaaggaaggaggga

SEQ ID NO: 358167 - DNA, 20 bp, Artificial
  CRISPR gRNA sequence
agagaaaggaaggagggaag

SEQ ID NO: 358168 - DNA, 20 bp, Artificial
  CRISPR gRNA sequence
aggaaggagggaaggagaaa

SEQ ID NO: 358169 - DNA, 20 bp, Artificial
  CRISPR gRNA sequence
aaggagggaaggagaaaaag

SEQ ID NO: 358170 - DNA, 20 bp, Artificial
  CRISPR gRNA sequence
ggagggaaggagaaaaagaa

SEQ ID NO: 358171 - DNA, 20 bp, Artificial
  CRISPR gRNA sequence
agggaaggagaaaaagaaga

SEQ ID NO: 358172 - DNA, 20 bp, Artificial
  CRISPR gRNA sequence
ggagaaaaagaagagagaaa

SEQ ID NO: 358173 - DNA, 20 bp, Artificial
  CRISPR gRNA sequence
aagaagagagaaaaagaaaa

SEQ ID NO: 358174 - DNA, 20 bp, Artificial
  CRISPR gRNA sequence
agaagagagaaaaagaaaaa

SEQ ID NO: 358175 - DNA, 20 bp, Artificial
  CRISPR gRNA sequence
aagagagaaaaagaaaaaag

SEQ ID NO: 358176 - DNA, 20 bp, Artificial
  CRISPR gRNA sequence
agagagaaaaagaaaaaagg

SEQ ID NO: 358177 - DNA, 20 bp, Artificial
  CRISPR gRNA sequence
gagagaaaaagaaaaaagga

SEQ ID NO: 358178 - DNA, 20 bp, Artificial
  CRISPR gRNA sequence
gagaaaaagaaaaaaggagg

SEQ ID NO: 358179 - DNA, 20 bp, Artificial
  CRISPR gRNA sequence
agaaaaagaaaaaaggaggg

SEQ ID NO: 358180 - DNA, 20 bp, Artificial
  CRISPR gRNA sequence
aaaagaaaaaaggagggagg

SEQ ID NO: 358181 - DNA, 20 bp, Artificial
  CRISPR gRNA sequence
aaaaggagggaggaagaaaa

SEQ ID NO: 358182 - DNA, 20 bp, Artificial
  CRISPR gRNA sequence
aaaggagggaggaagaaaaa

SEQ ID NO: 358183 - DNA, 20 bp, Artificial
  CRISPR gRNA sequence
ggagggaggaagaaaaaagg

SEQ ID NO: 358184 - DNA, 20 bp, Artificial
  CRISPR gRNA sequence
gagggaggaagaaaaaagga

SEQ ID NO: 358185 - DNA, 20 bp, Artificial
  CRISPR gRNA sequence
gaggaagaaaaaaggaagga

SEQ ID NO: 358186 - DNA, 20 bp, Artificial
  CRISPR gRNA sequence
aggaagaaaaaaggaaggaa

SEQ ID NO: 358187 - DNA, 20 bp, Artificial
  CRISPR gRNA sequence
gaagaaaaaaggaaggaaag

SEQ ID NO: 358188 - DNA, 20 bp, Artificial
  CRISPR gRNA sequence
aaaaaaggaaggaaaggaga

SEQ ID NO: 358189 - DNA, 20 bp, Artificial
  CRISPR gRNA sequence
aaaaggaaggaaaggagaca

SEQ ID NO: 358190 - DNA, 20 bp, Artificial
  CRISPR gRNA sequence
gaaaggagacagagaaacaa

SEQ ID NO: 358191 - DNA, 20 bp, Artificial
  CRISPR gRNA sequence
aaggagacagagaaacaaaa

SEQ ID NO: 358192 - DNA, 20 bp, Artificial
  CRISPR gRNA sequence
aaagagatgtcacatttcga

SEQ ID NO: 358193 - DNA, 20 bp, Artificial
  CRISPR gRNA sequence
agagatgtcacatttcgaaa

SEQ ID NO: 358194 - DNA, 20 bp, Artificial
  CRISPR gRNA sequence
agatgtcacatttcgaaaga

SEQ ID NO: 358195 - DNA, 20 bp, Artificial
  CRISPR gRNA sequence
catttcgaaagagagaatga

SEQ ID NO: 358196 - DNA, 20 bp, Artificial
  CRISPR gRNA sequence
tcgaaagagagaatgaaagc

SEQ ID NO: 358197 - DNA, 20 bp, Artificial
  CRISPR gRNA sequence
agagaatgaaagcaagtcta

SEQ ID NO: 358198 - DNA, 20 bp, Artificial
  CRISPR gRNA sequence
atgaaagcaagtctaaagtg

SEQ ID NO: 358199 - DNA, 20 bp, Artificial
  CRISPR gRNA sequence
aagcaagtctaaagtgcagt

SEQ ID NO: 358200 - DNA, 20 bp, Artificial
  CRISPR gRNA sequence
agatttgccatctattgaac

SEQ ID NO: 358201 - DNA, 20 bp, Artificial
  CRISPR gRNA sequence
tctattgaactagaatatca

SEQ ID NO: 358202 - DNA, 20 bp, Artificial
  CRISPR gRNA sequence
ctagaatatcatggctacga

SEQ ID NO: 358203 - DNA, 20 bp, Artificial
  CRISPR gRNA sequence
tatcatggctacgatagttt

SEQ ID NO: 358204 - DNA, 20 bp, Artificial
  CRISPR gRNA sequence
gtttcagccgcaccaaaaac

SEQ ID NO: 358205 - DNA, 20 bp, Artificial
  CRISPR gRNA sequence
aaaaactagcttctcatctt

SEQ ID NO: 358206 - DNA, 20 bp, Artificial
  CRISPR gRNA sequence
agcttctcatcttcagcatg

SEQ ID NO: 358207 - DNA, 20 bp, Artificial
  CRISPR gRNA sequence
atgtgtcaaaatgttgtaaa

SEQ ID NO: 358208 - DNA, 20 bp, Artificial
  CRISPR gRNA sequence
atgttgtaaaaagaaaacca

SEQ ID NO: 358209 - DNA, 20 bp, Artificial
  CRISPR gRNA sequence
aaaagaaaaccacagcactc

SEQ ID NO: 358210 - DNA, 20 bp, Artificial
  CRISPR gRNA sequence
ctctgtacaaccgtttacca

SEQ ID NO: 358211 - DNA, 20 bp, Artificial
  CRISPR gRNA sequence
tctgtacaaccgtttaccaa

SEQ ID NO: 358212 - DNA, 20 bp, Artificial
  CRISPR gRNA sequence
gtacaaccgtttaccaaagg

SEQ ID NO: 358213 - DNA, 20 bp, Artificial
  CRISPR gRNA sequence
ttacccacataacacacacc

SEQ ID NO: 358214 - DNA, 20 bp, Artificial
  CRISPR gRNA sequence
ccggaaaacatttcgtctct

SEQ ID NO: 358215 - DNA, 20 bp, Artificial
  CRISPR gRNA sequence
catttcgtctctaagtaata

SEQ ID NO: 358216 - DNA, 20 bp, Artificial
  CRISPR gRNA sequence
tctaagtaataaagcaacac

SEQ ID NO: 358217 - DNA, 20 bp, Artificial
  CRISPR gRNA sequence
gtaataaagcaacacaagaa

SEQ ID NO: 358218 - DNA, 20 bp, Artificial
  CRISPR gRNA sequence
taataaagcaacacaagaaa

SEQ ID NO: 358219 - DNA, 20 bp, Artificial
  CRISPR gRNA sequence
aataaagcaacacaagaaaa

SEQ ID NO: 358220 - DNA, 20 bp, Artificial
  CRISPR gRNA sequence
ataaagcaacacaagaaaag

SEQ ID NO: 358221 - DNA, 20 bp, Artificial
  CRISPR gRNA sequence
aagcaacacaagaaaagggg

SEQ ID NO: 358222 - DNA, 20 bp, Artificial
  CRISPR gRNA sequence
aacacaagaaaaggggaaga

SEQ ID NO: 358223 - DNA, 20 bp, Artificial
  CRISPR gRNA sequence
aagaaaaggggaagaaagaa

SEQ ID NO: 358224 - DNA, 20 bp, Artificial
  CRISPR gRNA sequence
aaggggaagaaagaaaagca

SEQ ID NO: 358225 - DNA, 20 bp, Artificial
  CRISPR gRNA sequence
aggggaagaaagaaaagcaa

SEQ ID NO: 358226 - DNA, 20 bp, Artificial
  CRISPR gRNA sequence
ggaagaaagaaaagcaaagg

SEQ ID NO: 358227 - DNA, 20 bp, Artificial
  CRISPR gRNA sequence
aggaagaaaattcattaaaa

SEQ ID NO: 358228 - DNA, 20 bp, Artificial
  CRISPR gRNA sequence
ggaagaaaattcattaaaaa

SEQ ID NO: 358229 - DNA, 20 bp, Artificial
  CRISPR gRNA sequence
gaagaaaattcattaaaaaa

SEQ ID NO: 358230 - DNA, 20 bp, Artificial
  CRISPR gRNA sequence
attcattaaaaaagggaaaa

SEQ ID NO: 358231 - DNA, 20 bp, Artificial
  CRISPR gRNA sequence
ttcattaaaaaagggaaaaa

SEQ ID NO: 358232 - DNA, 20 bp, Artificial
  CRISPR gRNA sequence
aaagggaaaaaaggaaataa

SEQ ID NO: 358233 - DNA, 20 bp, Artificial
  CRISPR gRNA sequence
aaaaggaaataaaagcttaa

SEQ ID NO: 358234 - DNA, 20 bp, Artificial
  CRISPR gRNA sequence
taaaagcttaaaagaaacaa

SEQ ID NO: 358235 - DNA, 20 bp, Artificial
  CRISPR gRNA sequence
aaaagcttaaaagaaacaaa

SEQ ID NO: 358236 - DNA, 20 bp, Artificial
  CRISPR gRNA sequence
aattaaaataaaaattaaaa

SEQ ID NO: 358237 - DNA, 20 bp, Artificial
  CRISPR gRNA sequence
attaaaataaaaattaaaac

SEQ ID NO: 358238 - DNA, 20 bp, Artificial
  CRISPR gRNA sequence
ttaaaataaaaattaaaaca

SEQ ID NO: 358239 - DNA, 20 bp, Artificial
  CRISPR gRNA sequence
aataaaaattaaaacaggga

SEQ ID NO: 358240 - DNA, 20 bp, Artificial
  CRISPR gRNA sequence
ataaaaattaaaacagggaa

SEQ ID NO: 358241 - DNA, 20 bp, Artificial
  CRISPR gRNA sequence
aaaattaaaacagggaaagg

SEQ ID NO: 358242 - DNA, 20 bp, Artificial
  CRISPR gRNA sequence
aaacagggaaaggaagacgt

SEQ ID NO: 358243 - DNA, 20 bp, Artificial
  CRISPR gRNA sequence
gggaaaggaagacgtgagaa

SEQ ID NO: 358244 - DNA, 20 bp, Artificial
  CRISPR gRNA sequence
aaaggaagacgtgagaaaag

SEQ ID NO: 358245 - DNA, 20 bp, Artificial
  CRISPR gRNA sequence
aaggaagacgtgagaaaaga

SEQ ID NO: 358246 - DNA, 20 bp, Artificial
  CRISPR gRNA sequence
aatgcgtgacaacataaaat

SEQ ID NO: 358247 - DNA, 20 bp, Artificial
  CRISPR gRNA sequence
gacaacataaaatcagatgc

SEQ ID NO: 358248 - DNA, 20 bp, Artificial
  CRISPR gRNA sequence
tcagatgctagcacaccatg

SEQ ID NO: 358249 - DNA, 20 bp, Artificial
  CRISPR gRNA sequence
agatgctagcacaccatgtg

SEQ ID NO: 358250 - DNA, 20 bp, Artificial
  CRISPR gRNA sequence
cacaccatgtggagaaatga

SEQ ID NO: 358251 - DNA, 20 bp, Artificial
  CRISPR gRNA sequence
ggagaaatgaaagaacataa

SEQ ID NO: 358252 - DNA, 20 bp, Artificial
  CRISPR gRNA sequence
aacataaaagaaatgaaaaa

SEQ ID NO: 358253 - DNA, 20 bp, Artificial
  CRISPR gRNA sequence
acataaaagaaatgaaaaaa

SEQ ID NO: 358254 - DNA, 20 bp, Artificial
  CRISPR gRNA sequence
ataaaagaaatgaaaaaaag

SEQ ID NO: 358255 - DNA, 20 bp, Artificial
  CRISPR gRNA sequence
taaaagaaatgaaaaaaagg

SEQ ID NO: 358256 - DNA, 20 bp, Artificial
  CRISPR gRNA sequence
aaagaaatgaaaaaaaggag

SEQ ID NO: 358257 - DNA, 20 bp, Artificial
  CRISPR gRNA sequence
ggagaaatcgactttcatgt

SEQ ID NO: 358258 - DNA, 20 bp, Artificial
  CRISPR gRNA sequence
gactttcatgtgagcccttc

SEQ ID NO: 358259 - DNA, 20 bp, Artificial
  CRISPR gRNA sequence
atgtgagcccttctggtccc

SEQ ID NO: 358260 - DNA, 20 bp, Artificial
  CRISPR gRNA sequence
tgtgagcccttctggtccct

SEQ ID NO: 358261 - DNA, 20 bp, Artificial
  CRISPR gRNA sequence
gagcccttctggtccctggg

SEQ ID NO: 358262 - DNA, 20 bp, Artificial
  CRISPR gRNA sequence
ccttctggtccctgggaagt

SEQ ID NO: 358263 - DNA, 20 bp, Artificial
  CRISPR gRNA sequence
ttctggtccctgggaagtaa

SEQ ID NO: 358264 - DNA, 20 bp, Artificial
  CRISPR gRNA sequence
tctggtccctgggaagtaag

SEQ ID NO: 358265 - DNA, 20 bp, Artificial
  CRISPR gRNA sequence
ggtccctgggaagtaagagg

SEQ ID NO: 358266 - DNA, 20 bp, Artificial
  CRISPR gRNA sequence
gcagcgtgaatgcgtgtcct

SEQ ID NO: 358267 - DNA, 20 bp, Artificial
  CRISPR gRNA sequence
gtttttcttcttcttctctc

SEQ ID NO: 358268 - DNA, 20 bp, Artificial
  CRISPR gRNA sequence
gatgccgccccgtccaatct

SEQ ID NO: 358269 - DNA, 20 bp, Artificial
  CRISPR gRNA sequence
atgccgccccgtccaatctc

SEQ ID NO: 358270 - DNA, 20 bp, Artificial
  CRISPR gRNA sequence
gccgccccgtccaatctcag

SEQ ID NO: 358271 - DNA, 20 bp, Artificial
  CRISPR gRNA sequence
tctaaccaaaaccatgctgt

SEQ ID NO: 358272 - DNA, 20 bp, Artificial
  CRISPR gRNA sequence
ctaaccaaaaccatgctgtc

SEQ ID NO: 358273 - DNA, 20 bp, Artificial
  CRISPR gRNA sequence
cccccgtgaacctgccgact

SEQ ID NO: 358274 - DNA, 20 bp, Artificial
  CRISPR gRNA sequence
ccccgtgaacctgccgactc

SEQ ID NO: 358275 - DNA, 20 bp, Artificial
  CRISPR gRNA sequence
cgtgaacctgccgactcagg

SEQ ID NO: 358276 - DNA, 20 bp, Artificial
  CRISPR gRNA sequence
cctgccgactcaggtagaaa

SEQ ID NO: 358277 - DNA, 20 bp, Artificial
  CRISPR gRNA sequence
ctgccgactcaggtagaaac

SEQ ID NO: 358278 - DNA, 20 bp, Artificial
  CRISPR gRNA sequence
tgccgactcaggtagaaaca

SEQ ID NO: 358279 - DNA, 20 bp, Artificial
  CRISPR gRNA sequence
gccgactcaggtagaaacag

SEQ ID NO: 358280 - DNA, 20 bp, Artificial
  CRISPR gRNA sequence
tagaaacaggggtctactca

SEQ ID NO: 358281 - DNA, 20 bp, Artificial
  CRISPR gRNA sequence
gccgtgtctgcattttcaca

SEQ ID NO: 358282 - DNA, 20 bp, Artificial
  CRISPR gRNA sequence
ccgtgtctgcattttcacaa

SEQ ID NO: 358283 - DNA, 20 bp, Artificial
  CRISPR gRNA sequence
cattttcacaaaggacaatg

SEQ ID NO: 358284 - DNA, 20 bp, Artificial
  CRISPR gRNA sequence
attttcacaaaggacaatgc

SEQ ID NO: 358285 - DNA, 20 bp, Artificial
  CRISPR gRNA sequence
ttcacaaaggacaatgcagg

SEQ ID NO: 358286 - DNA, 20 bp, Artificial
  CRISPR gRNA sequence
aaggacaatgcaggaagcaa

SEQ ID NO: 358287 - DNA, 20 bp, Artificial
  CRISPR gRNA sequence
aggacaatgcaggaagcaat

SEQ ID NO: 358288 - DNA, 20 bp, Artificial
  CRISPR gRNA sequence
ggacaatgcaggaagcaatg

SEQ ID NO: 358289 - DNA, 20 bp, Artificial
  CRISPR gRNA sequence
ggaagcaatggggaaaatcc

SEQ ID NO: 358290 - DNA, 20 bp, Artificial
  CRISPR gRNA sequence
aagcaatggggaaaatccta

SEQ ID NO: 358291 - DNA, 20 bp, Artificial
  CRISPR gRNA sequence
agcaatggggaaaatcctag

SEQ ID NO: 358292 - DNA, 20 bp, Artificial
  CRISPR gRNA sequence
gcaatggggaaaatcctaga

SEQ ID NO: 358293 - DNA, 20 bp, Artificial
  CRISPR gRNA sequence
caatggggaaaatcctagag

SEQ ID NO: 358294 - DNA, 20 bp, Artificial
  CRISPR gRNA sequence
ggaaaatcctagaggggatg

SEQ ID NO: 358295 - DNA, 20 bp, Artificial
  CRISPR gRNA sequence
agaggggatgcagctgtctt

SEQ ID NO: 358296 - DNA, 20 bp, Artificial
  CRISPR gRNA sequence
gaggggatgcagctgtcttt

SEQ ID NO: 358297 - DNA, 20 bp, Artificial
  CRISPR gRNA sequence
aggggatgcagctgtctttg

SEQ ID NO: 358298 - DNA, 20 bp, Artificial
  CRISPR gRNA sequence
gggatgcagctgtctttggg

SEQ ID NO: 358299 - DNA, 20 bp, Artificial
  CRISPR gRNA sequence
gcagctgtctttggggagca

SEQ ID NO: 358300 - DNA, 20 bp, Artificial
  CRISPR gRNA sequence
tgtctttggggagcaaagtg

SEQ ID NO: 358301 - DNA, 20 bp, Artificial
  CRISPR gRNA sequence
gtctttggggagcaaagtgc

SEQ ID NO: 358302 - DNA, 20 bp, Artificial
  CRISPR gRNA sequence
tctttggggagcaaagtgca

SEQ ID NO: 358303 - DNA, 20 bp, Artificial
  CRISPR gRNA sequence
tttggggagcaaagtgcagg

SEQ ID NO: 358304 - DNA, 20 bp, Artificial
  CRISPR gRNA sequence
ttggggagcaaagtgcaggg

SEQ ID NO: 358305 - DNA, 20 bp, Artificial
  CRISPR gRNA sequence
agcaaagtgcagggaggtta

SEQ ID NO: 358306 - DNA, 20 bp, Artificial
  CRISPR gRNA sequence
aaagtgcagggaggttacag

SEQ ID NO: 358307 - DNA, 20 bp, Artificial
  CRISPR gRNA sequence
agtgcagggaggttacagca

SEQ ID NO: 358308 - DNA, 20 bp, Artificial
  CRISPR gRNA sequence
gtgcagggaggttacagcag

SEQ ID NO: 358309 - DNA, 20 bp, Artificial
  CRISPR gRNA sequence
ttacagcagaggctccatgt

SEQ ID NO: 358310 - DNA, 20 bp, Artificial
  CRISPR gRNA sequence
tacagcagaggctccatgtg

SEQ ID NO: 358311 - DNA, 20 bp, Artificial
  CRISPR gRNA sequence
agaggctccatgtgaggacc

SEQ ID NO: 358312 - DNA, 20 bp, Artificial
  CRISPR gRNA sequence
gacctagacccgcctctcaa

SEQ ID NO: 358313 - DNA, 20 bp, Artificial
  CRISPR gRNA sequence
gacccgcctctcaatagact

SEQ ID NO: 358314 - DNA, 20 bp, Artificial
  CRISPR gRNA sequence
gcctctcaatagactcagcc

SEQ ID NO: 358315 - DNA, 20 bp, Artificial
  CRISPR gRNA sequence
ctctcaatagactcagcctg

SEQ ID NO: 358316 - DNA, 20 bp, Artificial
  CRISPR gRNA sequence
tctcaatagactcagcctgg

SEQ ID NO: 358317 - DNA, 20 bp, Artificial
  CRISPR gRNA sequence
tagactcagcctggaggtga

SEQ ID NO: 358318 - DNA, 20 bp, Artificial
  CRISPR gRNA sequence
actcagcctggaggtgaaag

SEQ ID NO: 358319 - DNA, 20 bp, Artificial
  CRISPR gRNA sequence
cagcctggaggtgaaagaag

SEQ ID NO: 358320 - DNA, 20 bp, Artificial
  CRISPR gRNA sequence
aaagaagtggttcccaaccc

SEQ ID NO: 358321 - DNA, 20 bp, Artificial
  CRISPR gRNA sequence
agaagtggttcccaacccta

SEQ ID NO: 358322 - DNA, 20 bp, Artificial
  CRISPR gRNA sequence
gtggttcccaaccctagagc

SEQ ID NO: 358323 - DNA, 20 bp, Artificial
  CRISPR gRNA sequence
tggttcccaaccctagagcc

SEQ ID NO: 358324 - DNA, 20 bp, Artificial
  CRISPR gRNA sequence
ttcccaaccctagagccagg

SEQ ID NO: 358325 - DNA, 20 bp, Artificial
  CRISPR gRNA sequence
aaccctagagccaggtggtt

SEQ ID NO: 358326 - DNA, 20 bp, Artificial
  CRISPR gRNA sequence
cctagagccaggtggttcag

SEQ ID NO: 358327 - DNA, 20 bp, Artificial
  CRISPR gRNA sequence
agccaggtggttcagaagct

SEQ ID NO: 358328 - DNA, 20 bp, Artificial
  CRISPR gRNA sequence
ccaggtggttcagaagctca

SEQ ID NO: 358329 - DNA, 20 bp, Artificial
  CRISPR gRNA sequence
ggtggttcagaagctcagag

SEQ ID NO: 358330 - DNA, 20 bp, Artificial
  CRISPR gRNA sequence
gattaacctttcctgacaaa

SEQ ID NO: 358331 - DNA, 20 bp, Artificial
  CRISPR gRNA sequence
ttaacctttcctgacaaaca

SEQ ID NO: 358332 - DNA, 20 bp, Artificial
  CRISPR gRNA sequence
tgacaaacagagtaactgat

SEQ ID NO: 358333 - DNA, 20 bp, Artificial
  CRISPR gRNA sequence
acagagtaactgattggtgt

SEQ ID NO: 358334 - DNA, 20 bp, Artificial
  CRISPR gRNA sequence
attggtgttagatgaaaatc

SEQ ID NO: 358335 - DNA, 20 bp, Artificial
  CRISPR gRNA sequence
tgaaaatcaagacctattac

SEQ ID NO: 358336 - DNA, 20 bp, Artificial
  CRISPR gRNA sequence
gaaaatcaagacctattacg

SEQ ID NO: 358337 - DNA, 20 bp, Artificial
  CRISPR gRNA sequence
atcaagacctattacgaggt

SEQ ID NO: 358338 - DNA, 20 bp, Artificial
  CRISPR gRNA sequence
cggccaaacctgccttgcct

SEQ ID NO: 358339 - DNA, 20 bp, Artificial
  CRISPR gRNA sequence
cttgcctcagatattgcttg

SEQ ID NO: 358340 - DNA, 20 bp, Artificial
  CRISPR gRNA sequence
agatattgcttgtggcttct

SEQ ID NO: 358341 - DNA, 20 bp, Artificial
  CRISPR gRNA sequence
gcttgtggcttctcagacca

SEQ ID NO: 358342 - DNA, 20 bp, Artificial
  CRISPR gRNA sequence
cttgtggcttctcagaccac

SEQ ID NO: 358343 - DNA, 20 bp, Artificial
  CRISPR gRNA sequence
gaccacaggctcttcctgca

SEQ ID NO: 358344 - DNA, 20 bp, Artificial
  CRISPR gRNA sequence
caggctcttcctgcaaagct

SEQ ID NO: 358345 - DNA, 20 bp, Artificial
  CRISPR gRNA sequence
gctcttcctgcaaagctcag

SEQ ID NO: 358346 - DNA, 20 bp, Artificial
  CRISPR gRNA sequence
cttcctgcaaagctcagtgg

SEQ ID NO: 358347 - DNA, 20 bp, Artificial
  CRISPR gRNA sequence
ttcctgcaaagctcagtgga

SEQ ID NO: 358348 - DNA, 20 bp, Artificial
  CRISPR gRNA sequence
ctgcaaagctcagtggaagg

SEQ ID NO: 358349 - DNA, 20 bp, Artificial
  CRISPR gRNA sequence
cagctcaaaatgaccttgaa

SEQ ID NO: 358350 - DNA, 20 bp, Artificial
  CRISPR gRNA sequence
atgaccttgaaaagaactgc

SEQ ID NO: 358351 - DNA, 20 bp, Artificial
  CRISPR gRNA sequence
ccttgaaaagaactgccaga

SEQ ID NO: 358352 - DNA, 20 bp, Artificial
  CRISPR gRNA sequence
ttgaaaagaactgccagaaa

SEQ ID NO: 358353 - DNA, 20 bp, Artificial
  CRISPR gRNA sequence
cagaaagagcccacacaaac

SEQ ID NO: 358354 - DNA, 20 bp, Artificial
  CRISPR gRNA sequence
gaaagagcccacacaaacaa

SEQ ID NO: 358355 - DNA, 20 bp, Artificial
  CRISPR gRNA sequence
ccacacaaacaagagaaccg

SEQ ID NO: 358356 - DNA, 20 bp, Artificial
  CRISPR gRNA sequence
cacacaaacaagagaaccgt

SEQ ID NO: 358357 - DNA, 20 bp, Artificial
  CRISPR gRNA sequence
ccgtgggatcctgatgaact

SEQ ID NO: 358358 - DNA, 20 bp, Artificial
  CRISPR gRNA sequence
gatcctgatgaacttggaat

SEQ ID NO: 358359 - DNA, 20 bp, Artificial
  CRISPR gRNA sequence
ctgatgaacttggaattgga

SEQ ID NO: 358360 - DNA, 20 bp, Artificial
  CRISPR gRNA sequence
atgaacttggaattggaaag

SEQ ID NO: 358361 - DNA, 20 bp, Artificial
  CRISPR gRNA sequence
gaaagtggattcacgtgaaa

SEQ ID NO: 358362 - DNA, 20 bp, Artificial
  CRISPR gRNA sequence
tgaaacagaccaaaatgtcg

SEQ ID NO: 358363 - DNA, 20 bp, Artificial
  CRISPR gRNA sequence
accaaaatgtcgtagttaat

SEQ ID NO: 358364 - DNA, 20 bp, Artificial
  CRISPR gRNA sequence
ccaaaatgtcgtagttaatt

SEQ ID NO: 358365 - DNA, 20 bp, Artificial
  CRISPR gRNA sequence
aaatgtcgtagttaattggg

SEQ ID NO: 358366 - DNA, 20 bp, Artificial
  CRISPR gRNA sequence
caaatacaaataatgaaaac

SEQ ID NO: 358367 - DNA, 20 bp, Artificial
  CRISPR gRNA sequence
aaccagcttatacttatatg

SEQ ID NO: 358368 - DNA, 20 bp, Artificial
  CRISPR gRNA sequence
tgtagctacgtattaatact

SEQ ID NO: 358369 - DNA, 20 bp, Artificial
  CRISPR gRNA sequence
tacttagaataaacattgaa

SEQ ID NO: 358370 - DNA, 20 bp, Artificial
  CRISPR gRNA sequence
ttttcccatgatttttattg

SEQ ID NO: 358371 - DNA, 20 bp, Artificial
  CRISPR gRNA sequence
tttcccatgatttttattgc

SEQ ID NO: 358372 - DNA, 20 bp, Artificial
  CRISPR gRNA sequence
aatattctctattttgtatg

SEQ ID NO: 358373 - DNA, 20 bp, Artificial
  CRISPR gRNA sequence
tattttgtatgtggcttctc

SEQ ID NO: 358374 - DNA, 20 bp, Artificial
  CRISPR gRNA sequence
gcttgaccacaaatcatcct

SEQ ID NO: 358375 - DNA, 20 bp, Artificial
  CRISPR gRNA sequence
atcatccttggaaattattt

SEQ ID NO: 358376 - DNA, 20 bp, Artificial
  CRISPR gRNA sequence
tccaaccactgctcatgtcc

SEQ ID NO: 358377 - DNA, 20 bp, Artificial
  CRISPR gRNA sequence
ccaaccactgctcatgtcct

SEQ ID NO: 358378 - DNA, 20 bp, Artificial
  CRISPR gRNA sequence
ctgggtaccccaaacattgc

SEQ ID NO: 358379 - DNA, 20 bp, Artificial
  CRISPR gRNA sequence
tgggtaccccaaacattgct

SEQ ID NO: 358380 - DNA, 20 bp, Artificial
  CRISPR gRNA sequence
atgccactgcccctgcccac

SEQ ID NO: 358381 - DNA, 20 bp, Artificial
  CRISPR gRNA sequence
cctgcccactagcgcctccc

SEQ ID NO: 358382 - DNA, 20 bp, Artificial
  CRISPR gRNA sequence
gtcctcctcaccatcctcac

SEQ ID NO: 358383 - DNA, 20 bp, Artificial
  CRISPR gRNA sequence
tcaccatcctcactggtcaa

SEQ ID NO: 358384 - DNA, 20 bp, Artificial
  CRISPR gRNA sequence
ggtcaacagttctgcatatg

SEQ ID NO: 358385 - DNA, 20 bp, Artificial
  CRISPR gRNA sequence
cagttctgcatatgcagttt

SEQ ID NO: 358386 - DNA, 20 bp, Artificial
  CRISPR gRNA sequence
ttctgcatatgcagtttgag

SEQ ID NO: 358387 - DNA, 20 bp, Artificial
  CRISPR gRNA sequence
cacccacttcacaaaaccct

SEQ ID NO: 358388 - DNA, 20 bp, Artificial
  CRISPR gRNA sequence
accctgagtcattttactgt

SEQ ID NO: 358389 - DNA, 20 bp, Artificial
  CRISPR gRNA sequence
actgtcagcttcgtaaaccc

SEQ ID NO: 358390 - DNA, 20 bp, Artificial
  CRISPR gRNA sequence
cgtaaacccaagcctctgta

SEQ ID NO: 358391 - DNA, 20 bp, Artificial
  CRISPR gRNA sequence
aacccaagcctctgtatagc

SEQ ID NO: 358392 - DNA, 20 bp, Artificial
  CRISPR gRNA sequence
attttacactgctctgtact

SEQ ID NO: 358393 - DNA, 20 bp, Artificial
  CRISPR gRNA sequence
actgctctgtacttagcacc

SEQ ID NO: 358394 - DNA, 20 bp, Artificial
  CRISPR gRNA sequence
ttagcacctagaaccatgct

SEQ ID NO: 358395 - DNA, 20 bp, Artificial
  CRISPR gRNA sequence
ctagaaccatgcttggcata

SEQ ID NO: 358396 - DNA, 20 bp, Artificial
  CRISPR gRNA sequence
gaaccatgcttggcataaag

SEQ ID NO: 358397 - DNA, 20 bp, Artificial
  CRISPR gRNA sequence
accatgcttggcataaagta

SEQ ID NO: 358398 - DNA, 20 bp, Artificial
  CRISPR gRNA sequence
atgcttggcataaagtagag

SEQ ID NO: 358399 - DNA, 20 bp, Artificial
  CRISPR gRNA sequence
agaagtcaatcaatattttt

SEQ ID NO: 358400 - DNA, 20 bp, Artificial
  CRISPR gRNA sequence
ataaaaaatttgccaaccta

SEQ ID NO: 358401 - DNA, 20 bp, Artificial
  CRISPR gRNA sequence
aaatttgccaacctaaagaa

SEQ ID NO: 358402 - DNA, 20 bp, Artificial
  CRISPR gRNA sequence
aatttgccaacctaaagaat

SEQ ID NO: 358403 - DNA, 20 bp, Artificial
  CRISPR gRNA sequence
tttgccaacctaaagaatgg

SEQ ID NO: 358404 - DNA, 20 bp, Artificial
  CRISPR gRNA sequence
ttgccaacctaaagaatggg

SEQ ID NO: 358405 - DNA, 20 bp, Artificial
  CRISPR gRNA sequence
tgcaaactatgcatctgaca

SEQ ID NO: 358406 - DNA, 20 bp, Artificial
  CRISPR gRNA sequence
gcaaactatgcatctgacaa

SEQ ID NO: 358407 - DNA, 20 bp, Artificial
  CRISPR gRNA sequence
tctgacaaaggtctaatatc

SEQ ID NO: 358408 - DNA, 20 bp, Artificial
  CRISPR gRNA sequence
gtctaatatccagcatctat

SEQ ID NO: 358409 - DNA, 20 bp, Artificial
  CRISPR gRNA sequence
tctaatatccagcatctata

SEQ ID NO: 358410 - DNA, 20 bp, Artificial
  CRISPR gRNA sequence
aatatccagcatctataagg

SEQ ID NO: 358411 - DNA, 20 bp, Artificial
  CRISPR gRNA sequence
ccagcatctataaggaagtt

SEQ ID NO: 358412 - DNA, 20 bp, Artificial
  CRISPR gRNA sequence
aggaagttaagcaaatttac

SEQ ID NO: 358413 - DNA, 20 bp, Artificial
  CRISPR gRNA sequence
gaagttaagcaaatttacaa

SEQ ID NO: 358414 - DNA, 20 bp, Artificial
  CRISPR gRNA sequence
aagttaagcaaatttacaag

SEQ ID NO: 358415 - DNA, 20 bp, Artificial
  CRISPR gRNA sequence
aggaaaacgaccccattaaa

SEQ ID NO: 358416 - DNA, 20 bp, Artificial
  CRISPR gRNA sequence
aaaacgaccccattaaaaag

SEQ ID NO: 358417 - DNA, 20 bp, Artificial
  CRISPR gRNA sequence
aaacgaccccattaaaaagt

SEQ ID NO: 358418 - DNA, 20 bp, Artificial
  CRISPR gRNA sequence
accccattaaaaagtgggta

SEQ ID NO: 358419 - DNA, 20 bp, Artificial
  CRISPR gRNA sequence
ccccattaaaaagtgggtaa

SEQ ID NO: 358420 - DNA, 20 bp, Artificial
  CRISPR gRNA sequence
aagtgggtaaaggacacaaa

SEQ ID NO: 358421 - DNA, 20 bp, Artificial
  CRISPR gRNA sequence
cacaaacagacacttctcaa

SEQ ID NO: 358422 - DNA, 20 bp, Artificial
  CRISPR gRNA sequence
aaacagacacttctcaaaag

SEQ ID NO: 358423 - DNA, 20 bp, Artificial
  CRISPR gRNA sequence
ctcaaaagaagacatatacg

SEQ ID NO: 358424 - DNA, 20 bp, Artificial
  CRISPR gRNA sequence
aagacatatacgtggccaac

SEQ ID NO: 358425 - DNA, 20 bp, Artificial
  CRISPR gRNA sequence
gccaacaagcatatgacaaa

SEQ ID NO: 358426 - DNA, 20 bp, Artificial
  CRISPR gRNA sequence
ctcaatatcactcatcatta

SEQ ID NO: 358427 - DNA, 20 bp, Artificial
  CRISPR gRNA sequence
atatcactcatcattacaga

SEQ ID NO: 358428 - DNA, 20 bp, Artificial
  CRISPR gRNA sequence
tatcactcatcattacagaa

SEQ ID NO: 358429 - DNA, 20 bp, Artificial
  CRISPR gRNA sequence
aggcaaaccaaaatgacaat

SEQ ID NO: 358430 - DNA, 20 bp, Artificial
  CRISPR gRNA sequence
aatgagacaccatctcatac

SEQ ID NO: 358431 - DNA, 20 bp, Artificial
  CRISPR gRNA sequence
agacaccatctcataccagt

SEQ ID NO: 358432 - DNA, 20 bp, Artificial
  CRISPR gRNA sequence
ccatctcataccagtcagaa

SEQ ID NO: 358433 - DNA, 20 bp, Artificial
  CRISPR gRNA sequence
tcagaatggctattactaaa

SEQ ID NO: 358434 - DNA, 20 bp, Artificial
  CRISPR gRNA sequence
cagaatggctattactaaaa

SEQ ID NO: 358435 - DNA, 20 bp, Artificial
  CRISPR gRNA sequence
actaaaaaggcaaaacatta

SEQ ID NO: 358436 - DNA, 20 bp, Artificial
  CRISPR gRNA sequence
aggcaaaacattacagatgc

SEQ ID NO: 358437 - DNA, 20 bp, Artificial
  CRISPR gRNA sequence
aaaacattacagatgctggt

SEQ ID NO: 358438 - DNA, 20 bp, Artificial
  CRISPR gRNA sequence
aaacattacagatgctggtg

SEQ ID NO: 358439 - DNA, 20 bp, Artificial
  CRISPR gRNA sequence
tacagatgctggtgaggttg

SEQ ID NO: 358440 - DNA, 20 bp, Artificial
  CRISPR gRNA sequence
cagatgctggtgaggttgca

SEQ ID NO: 358441 - DNA, 20 bp, Artificial
  CRISPR gRNA sequence
gctggtgaggttgcagagaa

SEQ ID NO: 358442 - DNA, 20 bp, Artificial
  CRISPR gRNA sequence
ctggtgaggttgcagagaaa

SEQ ID NO: 358443 - DNA, 20 bp, Artificial
  CRISPR gRNA sequence
tggtgaggttgcagagaaaa

SEQ ID NO: 358444 - DNA, 20 bp, Artificial
  CRISPR gRNA sequence
agggaacacttatacactgt

SEQ ID NO: 358445 - DNA, 20 bp, Artificial
  CRISPR gRNA sequence
gaacacttatacactgttgg

SEQ ID NO: 358446 - DNA, 20 bp, Artificial
  CRISPR gRNA sequence
aacacttatacactgttggt

SEQ ID NO: 358447 - DNA, 20 bp, Artificial
  CRISPR gRNA sequence
cacttatacactgttggtgg

SEQ ID NO: 358448 - DNA, 20 bp, Artificial
  CRISPR gRNA sequence
gtaaattaattcaaccattg

SEQ ID NO: 358449 - DNA, 20 bp, Artificial
  CRISPR gRNA sequence
attaattcaaccattgtgga

SEQ ID NO: 358450 - DNA, 20 bp, Artificial
  CRISPR gRNA sequence
aattcaaccattgtggaaag

SEQ ID NO: 358451 - DNA, 20 bp, Artificial
  CRISPR gRNA sequence
aaccattgtggaaagcagta

SEQ ID NO: 358452 - DNA, 20 bp, Artificial
  CRISPR gRNA sequence
agcagtatggcaattcctca

SEQ ID NO: 358453 - DNA, 20 bp, Artificial
  CRISPR gRNA sequence
cagtatggcaattcctcaaa

SEQ ID NO: 358454 - DNA, 20 bp, Artificial
  CRISPR gRNA sequence
gcaattcctcaaagagataa

SEQ ID NO: 358455 - DNA, 20 bp, Artificial
  CRISPR gRNA sequence
attcctcaaagagataaaag

SEQ ID NO: 358456 - DNA, 20 bp, Artificial
  CRISPR gRNA sequence
agcagaactaccatttgacc

SEQ ID NO: 358457 - DNA, 20 bp, Artificial
  CRISPR gRNA sequence
tgacccagcaatcccattcc

SEQ ID NO: 358458 - DNA, 20 bp, Artificial
  CRISPR gRNA sequence
gacccagcaatcccattcct

SEQ ID NO: 358459 - DNA, 20 bp, Artificial
  CRISPR gRNA sequence
cccattcctgggcatatacc

SEQ ID NO: 358460 - DNA, 20 bp, Artificial
  CRISPR gRNA sequence
cattcctgggcatataccca

SEQ ID NO: 358461 - DNA, 20 bp, Artificial
  CRISPR gRNA sequence
attcctgggcatatacccag

SEQ ID NO: 358462 - DNA, 20 bp, Artificial
  CRISPR gRNA sequence
atataaatcatcccactata

SEQ ID NO: 358463 - DNA, 20 bp, Artificial
  CRISPR gRNA sequence
atgtacatgaatgttcactg

SEQ ID NO: 358464 - DNA, 20 bp, Artificial
  CRISPR gRNA sequence
cactgcagcactaatcacaa

SEQ ID NO: 358465 - DNA, 20 bp, Artificial
  CRISPR gRNA sequence
cagcactaatcacaatagca

SEQ ID NO: 358466 - DNA, 20 bp, Artificial
  CRISPR gRNA sequence
aaatcaacctaaacgtccat

SEQ ID NO: 358467 - DNA, 20 bp, Artificial
  CRISPR gRNA sequence
acctaaacgtccatcagtga

SEQ ID NO: 358468 - DNA, 20 bp, Artificial
  CRISPR gRNA sequence
aaacgtccatcagtgacaga

SEQ ID NO: 358469 - DNA, 20 bp, Artificial
  CRISPR gRNA sequence
aacgtccatcagtgacagat

SEQ ID NO: 358470 - DNA, 20 bp, Artificial
  CRISPR gRNA sequence
catcagtgacagatgggata

SEQ ID NO: 358471 - DNA, 20 bp, Artificial
  CRISPR gRNA sequence
aatgtgttacatattcatca

SEQ ID NO: 358472 - DNA, 20 bp, Artificial
  CRISPR gRNA sequence
attcatcatggaatactatg

SEQ ID NO: 358473 - DNA, 20 bp, Artificial
  CRISPR gRNA sequence
aatactatgcagccataaaa

SEQ ID NO: 358474 - DNA, 20 bp, Artificial
  CRISPR gRNA sequence
atgcagccataaaaaagaat

SEQ ID NO: 358475 - DNA, 20 bp, Artificial
  CRISPR gRNA sequence
gaatgagatcatatgttttg

SEQ ID NO: 358476 - DNA, 20 bp, Artificial
  CRISPR gRNA sequence
aatgagatcatatgttttgt

SEQ ID NO: 358477 - DNA, 20 bp, Artificial
  CRISPR gRNA sequence
tcatatgttttgtgggaaca

SEQ ID NO: 358478 - DNA, 20 bp, Artificial
  CRISPR gRNA sequence
gttttgtgggaacatggatg

SEQ ID NO: 358479 - DNA, 20 bp, Artificial
  CRISPR gRNA sequence
tgtgggaacatggatgcagc

SEQ ID NO: 358480 - DNA, 20 bp, Artificial
  CRISPR gRNA sequence
tgggaacatggatgcagctg

SEQ ID NO: 358481 - DNA, 20 bp, Artificial
  CRISPR gRNA sequence
gggaacatggatgcagctgg

SEQ ID NO: 358482 - DNA, 20 bp, Artificial
  CRISPR gRNA sequence
cagctggaggctattatcct

SEQ ID NO: 358483 - DNA, 20 bp, Artificial
  CRISPR gRNA sequence
ttatcctcagtaaactaatg

SEQ ID NO: 358484 - DNA, 20 bp, Artificial
  CRISPR gRNA sequence
tatcctcagtaaactaatgc

SEQ ID NO: 358485 - DNA, 20 bp, Artificial
  CRISPR gRNA sequence
cacatgttctcactttcaaa

SEQ ID NO: 358486 - DNA, 20 bp, Artificial
  CRISPR gRNA sequence
acatgttctcactttcaaat

SEQ ID NO: 358487 - DNA, 20 bp, Artificial
  CRISPR gRNA sequence
atgttctcactttcaaatgg

SEQ ID NO: 358488 - DNA, 20 bp, Artificial
  CRISPR gRNA sequence
tcactttcaaatgggagcta

SEQ ID NO: 358489 - DNA, 20 bp, Artificial
  CRISPR gRNA sequence
cactttcaaatgggagctaa

SEQ ID NO: 358490 - DNA, 20 bp, Artificial
  CRISPR gRNA sequence
tcaaatgggagctaaaggat

SEQ ID NO: 358491 - DNA, 20 bp, Artificial
  CRISPR gRNA sequence
aatgggagctaaaggataag

SEQ ID NO: 358492 - DNA, 20 bp, Artificial
  CRISPR gRNA sequence
ggagctaaaggataagaagt

SEQ ID NO: 358493 - DNA, 20 bp, Artificial
  CRISPR gRNA sequence
gagctaaaggataagaagtt

SEQ ID NO: 358494 - DNA, 20 bp, Artificial
  CRISPR gRNA sequence
gataagaagttaggaacata

SEQ ID NO: 358495 - DNA, 20 bp, Artificial
  CRISPR gRNA sequence
aagaagttaggaacataaag

SEQ ID NO: 358496 - DNA, 20 bp, Artificial
  CRISPR gRNA sequence
agaagttaggaacataaaga

SEQ ID NO: 358497 - DNA, 20 bp, Artificial
  CRISPR gRNA sequence
gaacataaagaaggaaacaa

SEQ ID NO: 358498 - DNA, 20 bp, Artificial
  CRISPR gRNA sequence
aagaaggaaacaacagacac

SEQ ID NO: 358499 - DNA, 20 bp, Artificial
  CRISPR gRNA sequence
agaaggaaacaacagacact

SEQ ID NO: 358500 - DNA, 20 bp, Artificial
  CRISPR gRNA sequence
gaaacaacagacactgggtc

SEQ ID NO: 358501 - DNA, 20 bp, Artificial
  CRISPR gRNA sequence
aacagacactgggtctagtt

SEQ ID NO: 358502 - DNA, 20 bp, Artificial
  CRISPR gRNA sequence
cagacactgggtctagttga

SEQ ID NO: 358503 - DNA, 20 bp, Artificial
  CRISPR gRNA sequence
acactgggtctagttgagag

SEQ ID NO: 358504 - DNA, 20 bp, Artificial
  CRISPR gRNA sequence
actgggtctagttgagagcg

SEQ ID NO: 358505 - DNA, 20 bp, Artificial
  CRISPR gRNA sequence
ctgggtctagttgagagcgg

SEQ ID NO: 358506 - DNA, 20 bp, Artificial
  CRISPR gRNA sequence
tgggtctagttgagagcgga

SEQ ID NO: 358507 - DNA, 20 bp, Artificial
  CRISPR gRNA sequence
gtctagttgagagcggaggg

SEQ ID NO: 358508 - DNA, 20 bp, Artificial
  CRISPR gRNA sequence
tctagttgagagcggagggt

SEQ ID NO: 358509 - DNA, 20 bp, Artificial
  CRISPR gRNA sequence
tagttgagagcggagggtgg

SEQ ID NO: 358510 - DNA, 20 bp, Artificial
  CRISPR gRNA sequence
agttgagagcggagggtggg

SEQ ID NO: 358511 - DNA, 20 bp, Artificial
  CRISPR gRNA sequence
ttgagagcggagggtgggag

SEQ ID NO: 358512 - DNA, 20 bp, Artificial
  CRISPR gRNA sequence
tgagagcggagggtgggagg

SEQ ID NO: 358513 - DNA, 20 bp, Artificial
  CRISPR gRNA sequence
gagagcggagggtgggagga

SEQ ID NO: 358514 - DNA, 20 bp, Artificial
  CRISPR gRNA sequence
gagcggagggtgggaggagg

SEQ ID NO: 358515 - DNA, 20 bp, Artificial
  CRISPR gRNA sequence
gcggagggtgggaggaggga

SEQ ID NO: 358516 - DNA, 20 bp, Artificial
  CRISPR gRNA sequence
gagggtgggaggagggagag

SEQ ID NO: 358517 - DNA, 20 bp, Artificial
  CRISPR gRNA sequence
ggtgggaggagggagagaag

SEQ ID NO: 358518 - DNA, 20 bp, Artificial
  CRISPR gRNA sequence
gaggagggagagaagcagaa

SEQ ID NO: 358519 - DNA, 20 bp, Artificial
  CRISPR gRNA sequence
ggagggagagaagcagaaaa

SEQ ID NO: 358520 - DNA, 20 bp, Artificial
  CRISPR gRNA sequence
gaagcagaaaagagaactct

SEQ ID NO: 358521 - DNA, 20 bp, Artificial
  CRISPR gRNA sequence
aaagagaactcttagttact

SEQ ID NO: 358522 - DNA, 20 bp, Artificial
  CRISPR gRNA sequence
tagttactgagcttaataac

SEQ ID NO: 358523 - DNA, 20 bp, Artificial
  CRISPR gRNA sequence
acatgtacccacaaacctaa

SEQ ID NO: 358524 - DNA, 20 bp, Artificial
  CRISPR gRNA sequence
agtttttttaaaaatttttc

SEQ ID NO: 358525 - DNA, 20 bp, Artificial
  CRISPR gRNA sequence
tttttaaaaatttttctggc

SEQ ID NO: 358526 - DNA, 20 bp, Artificial
  CRISPR gRNA sequence
ttttaaaaatttttctggcc

SEQ ID NO: 358527 - DNA, 20 bp, Artificial
  CRISPR gRNA sequence
aaaatttttctggccgggcg

SEQ ID NO: 358528 - DNA, 20 bp, Artificial
  CRISPR gRNA sequence
atttttctggccgggcgcgg

SEQ ID NO: 358529 - DNA, 20 bp, Artificial
  CRISPR gRNA sequence
gtggctcacgcctgtaatcc

SEQ ID NO: 358530 - DNA, 20 bp, Artificial
  CRISPR gRNA sequence
ctgtaatcccagcactttgc

SEQ ID NO: 358531 - DNA, 20 bp, Artificial
  CRISPR gRNA sequence
tgtaatcccagcactttgcg

SEQ ID NO: 358532 - DNA, 20 bp, Artificial
  CRISPR gRNA sequence
tcccagcactttgcgaggcc

SEQ ID NO: 358533 - DNA, 20 bp, Artificial
  CRISPR gRNA sequence
cccagcactttgcgaggccg

SEQ ID NO: 358534 - DNA, 20 bp, Artificial
  CRISPR gRNA sequence
agcactttgcgaggccgagg

SEQ ID NO: 358535 - DNA, 20 bp, Artificial
  CRISPR gRNA sequence
gcactttgcgaggccgaggc

SEQ ID NO: 358536 - DNA, 20 bp, Artificial
  CRISPR gRNA sequence
ctttgcgaggccgaggcggg

SEQ ID NO: 358537 - DNA, 20 bp, Artificial
  CRISPR gRNA sequence
ggccgaggcgggcggatcac

SEQ ID NO: 358538 - DNA, 20 bp, Artificial
  CRISPR gRNA sequence
gccgaggcgggcggatcacg

SEQ ID NO: 358539 - DNA, 20 bp, Artificial
  CRISPR gRNA sequence
aggcgggcggatcacgaggt

SEQ ID NO: 358540 - DNA, 20 bp, Artificial
  CRISPR gRNA sequence
ggcgggcggatcacgaggtc

SEQ ID NO: 358541 - DNA, 20 bp, Artificial
  CRISPR gRNA sequence
cgggcggatcacgaggtcag

SEQ ID NO: 358542 - DNA, 20 bp, Artificial
  CRISPR gRNA sequence
gatcacgaggtcaggagatc

SEQ ID NO: 358543 - DNA, 20 bp, Artificial
  CRISPR gRNA sequence
tcaggagatcgagaccatcc

SEQ ID NO: 358544 - DNA, 20 bp, Artificial
  CRISPR gRNA sequence
tcgagaccatcctggctaac

SEQ ID NO: 358545 - DNA, 20 bp, Artificial
  CRISPR gRNA sequence
cgagaccatcctggctaaca

SEQ ID NO: 358546 - DNA, 20 bp, Artificial
  CRISPR gRNA sequence
ctactaaaaatacaaaaaat

SEQ ID NO: 358547 - DNA, 20 bp, Artificial
  CRISPR gRNA sequence
taaaaatacaaaaaattagc

SEQ ID NO: 358548 - DNA, 20 bp, Artificial
  CRISPR gRNA sequence
aaaaatacaaaaaattagcc

SEQ ID NO: 358549 - DNA, 20 bp, Artificial
  CRISPR gRNA sequence
tacaaaaaattagccgggcg

SEQ ID NO: 358550 - DNA, 20 bp, Artificial
  CRISPR gRNA sequence
aaaaaattagccgggcgcgg

SEQ ID NO: 358551 - DNA, 20 bp, Artificial
  CRISPR gRNA sequence
aaattagccgggcgcggtgg

SEQ ID NO: 358552 - DNA, 20 bp, Artificial
  CRISPR gRNA sequence
aattagccgggcgcggtggc

SEQ ID NO: 358553 - DNA, 20 bp, Artificial
  CRISPR gRNA sequence
ggcgcggtggcgggcgcctg

SEQ ID NO: 358554 - DNA, 20 bp, Artificial
  CRISPR gRNA sequence
gtggcgggcgcctgtagtcc

SEQ ID NO: 358555 - DNA, 20 bp, Artificial
  CRISPR gRNA sequence
cgcctgtagtcccagctact

SEQ ID NO: 358556 - DNA, 20 bp, Artificial
  CRISPR gRNA sequence
gcctgtagtcccagctactc

SEQ ID NO: 358557 - DNA, 20 bp, Artificial
  CRISPR gRNA sequence
ctgtagtcccagctactcgg

SEQ ID NO: 358558 - DNA, 20 bp, Artificial
  CRISPR gRNA sequence
tgtagtcccagctactcggg

SEQ ID NO: 358559 - DNA, 20 bp, Artificial
  CRISPR gRNA sequence
tcccagctactcgggaggct

SEQ ID NO: 358560 - DNA, 20 bp, Artificial
  CRISPR gRNA sequence
cccagctactcgggaggctg

SEQ ID NO: 358561 - DNA, 20 bp, Artificial
  CRISPR gRNA sequence
agctactcgggaggctgagg

SEQ ID NO: 358562 - DNA, 20 bp, Artificial
  CRISPR gRNA sequence
gctactcgggaggctgaggc

SEQ ID NO: 358563 - DNA, 20 bp, Artificial
  CRISPR gRNA sequence
tactcgggaggctgaggcag

SEQ ID NO: 358564 - DNA, 20 bp, Artificial
  CRISPR gRNA sequence
gggaggctgaggcaggagaa

SEQ ID NO: 358565 - DNA, 20 bp, Artificial
  CRISPR gRNA sequence
gcaggagaatggcgtgaacc

SEQ ID NO: 358566 - DNA, 20 bp, Artificial
  CRISPR gRNA sequence
caggagaatggcgtgaaccc

SEQ ID NO: 358567 - DNA, 20 bp, Artificial
  CRISPR gRNA sequence
ggagaatggcgtgaacccgg

SEQ ID NO: 358568 - DNA, 20 bp, Artificial
  CRISPR gRNA sequence
gagaatggcgtgaacccggg

SEQ ID NO: 358569 - DNA, 20 bp, Artificial
  CRISPR gRNA sequence
aatggcgtgaacccgggagg

SEQ ID NO: 358570 - DNA, 20 bp, Artificial
  CRISPR gRNA sequence
tggcgtgaacccgggaggcg

SEQ ID NO: 358571 - DNA, 20 bp, Artificial
  CRISPR gRNA sequence
aacccgggaggcggagcttg

SEQ ID NO: 358572 - DNA, 20 bp, Artificial
  CRISPR gRNA sequence
cgggaggcggagcttgcagt

SEQ ID NO: 358573 - DNA, 20 bp, Artificial
  CRISPR gRNA sequence
ggcggagcttgcagtgagcc

SEQ ID NO: 358574 - DNA, 20 bp, Artificial
  CRISPR gRNA sequence
gagccgagattgcgccactg

SEQ ID NO: 358575 - DNA, 20 bp, Artificial
  CRISPR gRNA sequence
gattgcgccactgcagtccg

SEQ ID NO: 358576 - DNA, 20 bp, Artificial
  CRISPR gRNA sequence
cgccactgcagtccgcagtc

SEQ ID NO: 358577 - DNA, 20 bp, Artificial
  CRISPR gRNA sequence
ctgcagtccgcagtccggcc

SEQ ID NO: 358578 - DNA, 20 bp, Artificial
  CRISPR gRNA sequence
tgcagtccgcagtccggcct

SEQ ID NO: 358579 - DNA, 20 bp, Artificial
  CRISPR gRNA sequence
ccgcagtccggcctgggcga

SEQ ID NO: 358580 - DNA, 20 bp, Artificial
  CRISPR gRNA sequence
gcagtccggcctgggcgaca

SEQ ID NO: 358581 - DNA, 20 bp, Artificial
  CRISPR gRNA sequence
tccggcctgggcgacagagc

SEQ ID NO: 358582 - DNA, 20 bp, Artificial
  CRISPR gRNA sequence
gcatgtatttttattgattt

SEQ ID NO: 358583 - DNA, 20 bp, Artificial
  CRISPR gRNA sequence
catgtatttttattgatttt

SEQ ID NO: 358584 - DNA, 20 bp, Artificial
  CRISPR gRNA sequence
atgtatttttattgattttg

SEQ ID NO: 358585 - DNA, 20 bp, Artificial
  CRISPR gRNA sequence
tgtatttttattgattttgg

SEQ ID NO: 358586 - DNA, 20 bp, Artificial
  CRISPR gRNA sequence
tatttttattgattttgggg

SEQ ID NO: 358587 - DNA, 20 bp, Artificial
  CRISPR gRNA sequence
tctataataaccctaatatt

SEQ ID NO: 358588 - DNA, 20 bp, Artificial
  CRISPR gRNA sequence
attaagaaatatatttaaaa

SEQ ID NO: 358589 - DNA, 20 bp, Artificial
  CRISPR gRNA sequence
aaatatatttaaaatagtat

SEQ ID NO: 358590 - DNA, 20 bp, Artificial
  CRISPR gRNA sequence
tagtcatgcctaaacgaatt

SEQ ID NO: 358591 - DNA, 20 bp, Artificial
  CRISPR gRNA sequence
gtcatgcctaaacgaattga

SEQ ID NO: 358592 - DNA, 20 bp, Artificial
  CRISPR gRNA sequence
cctaaacgaattgagagttc

SEQ ID NO: 358593 - DNA, 20 bp, Artificial
  CRISPR gRNA sequence
ctaaacgaattgagagttct

SEQ ID NO: 358594 - DNA, 20 bp, Artificial
  CRISPR gRNA sequence
gagttctaggcaacaatcct

SEQ ID NO: 358595 - DNA, 20 bp, Artificial
  CRISPR gRNA sequence
aaatgccatttatgtttcca

SEQ ID NO: 358596 - DNA, 20 bp, Artificial
  CRISPR gRNA sequence
atgtttccacagtaccacct

SEQ ID NO: 358597 - DNA, 20 bp, Artificial
  CRISPR gRNA sequence
tttccacagtaccaccttgg

SEQ ID NO: 358598 - DNA, 20 bp, Artificial
  CRISPR gRNA sequence
cagtaccaccttggaagtca

SEQ ID NO: 358599 - DNA, 20 bp, Artificial
  CRISPR gRNA sequence
aatcaaacctgatgctaatc

SEQ ID NO: 358600 - DNA, 20 bp, Artificial
  CRISPR gRNA sequence
caaatctaaccaccaactta

SEQ ID NO: 358601 - DNA, 20 bp, Artificial
  CRISPR gRNA sequence
caccaacttacagaactgca

SEQ ID NO: 358602 - DNA, 20 bp, Artificial
  CRISPR gRNA sequence
ccaacttacagaactgcaaa

SEQ ID NO: 358603 - DNA, 20 bp, Artificial
  CRISPR gRNA sequence
acttacagaactgcaaagag

SEQ ID NO: 358604 - DNA, 20 bp, Artificial
  CRISPR gRNA sequence
ttacagaactgcaaagagca

SEQ ID NO: 358605 - DNA, 20 bp, Artificial
  CRISPR gRNA sequence
aaacgtatcaaatgccacca

SEQ ID NO: 358606 - DNA, 20 bp, Artificial
  CRISPR gRNA sequence
aacgtatcaaatgccaccat

SEQ ID NO: 358607 - DNA, 20 bp, Artificial
  CRISPR gRNA sequence
tatcaaatgccaccatggga

SEQ ID NO: 358608 - DNA, 20 bp, Artificial
  CRISPR gRNA sequence
caaatgccaccatgggaaag

SEQ ID NO: 358609 - DNA, 20 bp, Artificial
  CRISPR gRNA sequence
caccatgggaaagcagccca

SEQ ID NO: 358610 - DNA, 20 bp, Artificial
  CRISPR gRNA sequence
accatgggaaagcagcccac

SEQ ID NO: 358611 - DNA, 20 bp, Artificial
  CRISPR gRNA sequence
cacgggaatatgaaaaactc

SEQ ID NO: 358612 - DNA, 20 bp, Artificial
  CRISPR gRNA sequence
acgggaatatgaaaaactca

SEQ ID NO: 358613 - DNA, 20 bp, Artificial
  CRISPR gRNA sequence
caacaacaacaaaaaaatga

SEQ ID NO: 358614 - DNA, 20 bp, Artificial
  CRISPR gRNA sequence
aacaacaacaaaaaaatgaa

SEQ ID NO: 358615 - DNA, 20 bp, Artificial
  CRISPR gRNA sequence
aacaacaaaaaaatgaaagg

SEQ ID NO: 358616 - DNA, 20 bp, Artificial
  CRISPR gRNA sequence
caacaaaaaaatgaaaggtg

SEQ ID NO: 358617 - DNA, 20 bp, Artificial
  CRISPR gRNA sequence
acaaaaaaatgaaaggtgga

SEQ ID NO: 358618 - DNA, 20 bp, Artificial
  CRISPR gRNA sequence
caaaaaaatgaaaggtggag

SEQ ID NO: 358619 - DNA, 20 bp, Artificial
  CRISPR gRNA sequence
ggtggagaggaatcaaccta

SEQ ID NO: 358620 - DNA, 20 bp, Artificial
  CRISPR gRNA sequence
gtggagaggaatcaacctac

SEQ ID NO: 358621 - DNA, 20 bp, Artificial
  CRISPR gRNA sequence
aggaatcaacctacaggtta

SEQ ID NO: 358622 - DNA, 20 bp, Artificial
  CRISPR gRNA sequence
ggaatcaacctacaggttaa

SEQ ID NO: 358623 - DNA, 20 bp, Artificial
  CRISPR gRNA sequence
gaatcaacctacaggttaaa

SEQ ID NO: 358624 - DNA, 20 bp, Artificial
  CRISPR gRNA sequence
atcaacctacaggttaaagg

SEQ ID NO: 358625 - DNA, 20 bp, Artificial
  CRISPR gRNA sequence
tcaacctacaggttaaaggg

SEQ ID NO: 358626 - DNA, 20 bp, Artificial
  CRISPR gRNA sequence
ggttaaagggaggtattaca

SEQ ID NO: 358627 - DNA, 20 bp, Artificial
  CRISPR gRNA sequence
tattacacagtaacaatgtg

SEQ ID NO: 358628 - DNA, 20 bp, Artificial
  CRISPR gRNA sequence
aacaatgtgtggaacttaaa

SEQ ID NO: 358629 - DNA, 20 bp, Artificial
  CRISPR gRNA sequence
acaatgtgtggaacttaaaa

SEQ ID NO: 358630 - DNA, 20 bp, Artificial
  CRISPR gRNA sequence
acttaaaaaggaaaaattca

SEQ ID NO: 358631 - DNA, 20 bp, Artificial
  CRISPR gRNA sequence
aaaggaaaaattcatagaac

SEQ ID NO: 358632 - DNA, 20 bp, Artificial
  CRISPR gRNA sequence
aggaaaaattcatagaactg

SEQ ID NO: 358633 - DNA, 20 bp, Artificial
  CRISPR gRNA sequence
catagaactggagaaatgca

SEQ ID NO: 358634 - DNA, 20 bp, Artificial
  CRISPR gRNA sequence
agaactggagaaatgcaaag

SEQ ID NO: 358635 - DNA, 20 bp, Artificial
  CRISPR gRNA sequence
agtagacacttaataatttt

SEQ ID NO: 358636 - DNA, 20 bp, Artificial
  CRISPR gRNA sequence
agaaattattgctgttttgt

SEQ ID NO: 358637 - DNA, 20 bp, Artificial
  CRISPR gRNA sequence
gaaattattgctgttttgtg

SEQ ID NO: 358638 - DNA, 20 bp, Artificial
  CRISPR gRNA sequence
aaattattgctgttttgtga

SEQ ID NO: 358639 - DNA, 20 bp, Artificial
  CRISPR gRNA sequence
aattattgctgttttgtgag

SEQ ID NO: 358640 - DNA, 20 bp, Artificial
  CRISPR gRNA sequence
ttgctgttttgtgaggggtg

SEQ ID NO: 358641 - DNA, 20 bp, Artificial
  CRISPR gRNA sequence
tgctgttttgtgaggggtga

SEQ ID NO: 358642 - DNA, 20 bp, Artificial
  CRISPR gRNA sequence
gtgaggggtgaaggtaatga

SEQ ID NO: 358643 - DNA, 20 bp, Artificial
  CRISPR gRNA sequence
ggtatcatgtttatgttaaa

SEQ ID NO: 358644 - DNA, 20 bp, Artificial
  CRISPR gRNA sequence
aaaaagaaaactcatctttt

SEQ ID NO: 358645 - DNA, 20 bp, Artificial
  CRISPR gRNA sequence
aaaactcatcttttgagatt

SEQ ID NO: 358646 - DNA, 20 bp, Artificial
  CRISPR gRNA sequence
aaactcatcttttgagattc

SEQ ID NO: 358647 - DNA, 20 bp, Artificial
  CRISPR gRNA sequence
aggctaaaatatttattgat

SEQ ID NO: 358648 - DNA, 20 bp, Artificial
  CRISPR gRNA sequence
ttattgatgagatgacttaa

SEQ ID NO: 358649 - DNA, 20 bp, Artificial
  CRISPR gRNA sequence
tgatgagatgacttaatggc

SEQ ID NO: 358650 - DNA, 20 bp, Artificial
  CRISPR gRNA sequence
gaatttgcttcaaattaatc

SEQ ID NO: 358651 - DNA, 20 bp, Artificial
  CRISPR gRNA sequence
aatttgcttcaaattaatca

SEQ ID NO: 358652 - DNA, 20 bp, Artificial
  CRISPR gRNA sequence
atttgcttcaaattaatcaa

SEQ ID NO: 358653 - DNA, 20 bp, Artificial
  CRISPR gRNA sequence
gcttcaaattaatcaaggga

SEQ ID NO: 358654 - DNA, 20 bp, Artificial
  CRISPR gRNA sequence
ttcaaattaatcaagggaaa

SEQ ID NO: 358655 - DNA, 20 bp, Artificial
  CRISPR gRNA sequence
caaattaatcaagggaaaga

SEQ ID NO: 358656 - DNA, 20 bp, Artificial
  CRISPR gRNA sequence
aattaatcaagggaaagaga

SEQ ID NO: 358657 - DNA, 20 bp, Artificial
  CRISPR gRNA sequence
tcaagggaaagagagagtgt

SEQ ID NO: 358658 - DNA, 20 bp, Artificial
  CRISPR gRNA sequence
gaaagagagagtgtgagaaa

SEQ ID NO: 358659 - DNA, 20 bp, Artificial
  CRISPR gRNA sequence
aagagagagtgtgagaaata

SEQ ID NO: 358660 - DNA, 20 bp, Artificial
  CRISPR gRNA sequence
taacactgacccaaacttga

SEQ ID NO: 358661 - DNA, 20 bp, Artificial
  CRISPR gRNA sequence
actgacccaaacttgatagt

SEQ ID NO: 358662 - DNA, 20 bp, Artificial
  CRISPR gRNA sequence
cccaaacttgatagtcggcg

SEQ ID NO: 358663 - DNA, 20 bp, Artificial
  CRISPR gRNA sequence
tagtcggcgaagctatatac

SEQ ID NO: 358664 - DNA, 20 bp, Artificial
  CRISPR gRNA sequence
gcgaagctatatactggtca

SEQ ID NO: 358665 - DNA, 20 bp, Artificial
  CRISPR gRNA sequence
cgaagctatatactggtcac

SEQ ID NO: 358666 - DNA, 20 bp, Artificial
  CRISPR gRNA sequence
gaagctatatactggtcaca

SEQ ID NO: 358667 - DNA, 20 bp, Artificial
  CRISPR gRNA sequence
aagctatatactggtcacag

SEQ ID NO: 358668 - DNA, 20 bp, Artificial
  CRISPR gRNA sequence
gtttgaaacttccattaaaa

SEQ ID NO: 358669 - DNA, 20 bp, Artificial
  CRISPR gRNA sequence
ttccattaaaaaagctttaa

SEQ ID NO: 358670 - DNA, 20 bp, Artificial
  CRISPR gRNA sequence
taaaagtatttatttgtgcc

SEQ ID NO: 358671 - DNA, 20 bp, Artificial
  CRISPR gRNA sequence
aaaagtatttatttgtgccc

SEQ ID NO: 358672 - DNA, 20 bp, Artificial
  CRISPR gRNA sequence
tatttatttgtgcccgggca

SEQ ID NO: 358673 - DNA, 20 bp, Artificial
  CRISPR gRNA sequence
ttatttgtgcccgggcacag

SEQ ID NO: 358674 - DNA, 20 bp, Artificial
  CRISPR gRNA sequence
agtggctcacacctgtaatc

SEQ ID NO: 358675 - DNA, 20 bp, Artificial
  CRISPR gRNA sequence
acacctgtaatccagcactt

SEQ ID NO: 358676 - DNA, 20 bp, Artificial
  CRISPR gRNA sequence
cacctgtaatccagcacttt

SEQ ID NO: 358677 - DNA, 20 bp, Artificial
  CRISPR gRNA sequence
cctgtaatccagcactttgg

SEQ ID NO: 358678 - DNA, 20 bp, Artificial
  CRISPR gRNA sequence
ctgtaatccagcactttggg

SEQ ID NO: 358679 - DNA, 20 bp, Artificial
  CRISPR gRNA sequence
atccagcactttgggaggcc

SEQ ID NO: 358680 - DNA, 20 bp, Artificial
  CRISPR gRNA sequence
tccagcactttgggaggccg

SEQ ID NO: 358681 - DNA, 20 bp, Artificial
  CRISPR gRNA sequence
agcactttgggaggccgagg

SEQ ID NO: 358682 - DNA, 20 bp, Artificial
  CRISPR gRNA sequence
gcactttgggaggccgaggc

SEQ ID NO: 358683 - DNA, 20 bp, Artificial
  CRISPR gRNA sequence
ctttgggaggccgaggcagg

SEQ ID NO: 358684 - DNA, 20 bp, Artificial
  CRISPR gRNA sequence
ggccgaggcaggcagatcac

SEQ ID NO: 358685 - DNA, 20 bp, Artificial
  CRISPR gRNA sequence
gccgaggcaggcagatcacg

SEQ ID NO: 358686 - DNA, 20 bp, Artificial
  CRISPR gRNA sequence
aggcaggcagatcacgaggt

SEQ ID NO: 358687 - DNA, 20 bp, Artificial
  CRISPR gRNA sequence
ggcaggcagatcacgaggtc

SEQ ID NO: 358688 - DNA, 20 bp, Artificial
  CRISPR gRNA sequence
caggcagatcacgaggtcag

SEQ ID NO: 358689 - DNA, 20 bp, Artificial
  CRISPR gRNA sequence
gatcacgaggtcaggagatc

SEQ ID NO: 358690 - DNA, 20 bp, Artificial
  CRISPR gRNA sequence
tcaggagatcaagaccatcc

SEQ ID NO: 358691 - DNA, 20 bp, Artificial
  CRISPR gRNA sequence
caagaccatcctggctaaca

SEQ ID NO: 358692 - DNA, 20 bp, Artificial
  CRISPR gRNA sequence
ctactaaaaatacaaaaaat

SEQ ID NO: 358693 - DNA, 20 bp, Artificial
  CRISPR gRNA sequence
taaaaatacaaaaaattagc

SEQ ID NO: 358694 - DNA, 20 bp, Artificial
  CRISPR gRNA sequence
aaaaatacaaaaaattagcc

SEQ ID NO: 358695 - DNA, 20 bp, Artificial
  CRISPR gRNA sequence
tacaaaaaattagccgggcg

SEQ ID NO: 358696 - DNA, 20 bp, Artificial
  CRISPR gRNA sequence
aaaaaattagccgggcgtgg

SEQ ID NO: 358697 - DNA, 20 bp, Artificial
  CRISPR gRNA sequence
aaattagccgggcgtggtgg

SEQ ID NO: 358698 - DNA, 20 bp, Artificial
  CRISPR gRNA sequence
aattagccgggcgtggtggc

SEQ ID NO: 358699 - DNA, 20 bp, Artificial
  CRISPR gRNA sequence
ggcgtggtggcaggtgcctg

SEQ ID NO: 358700 - DNA, 20 bp, Artificial
  CRISPR gRNA sequence
gtggcaggtgcctgtagtcc

SEQ ID NO: 358701 - DNA, 20 bp, Artificial
  CRISPR gRNA sequence
tgcctgtagtcccagctact

SEQ ID NO: 358702 - DNA, 20 bp, Artificial
  CRISPR gRNA sequence
gcctgtagtcccagctactc

SEQ ID NO: 358703 - DNA, 20 bp, Artificial
  CRISPR gRNA sequence
ctgtagtcccagctactcag

SEQ ID NO: 358704 - DNA, 20 bp, Artificial
  CRISPR gRNA sequence
tgtagtcccagctactcagg

SEQ ID NO: 358705 - DNA, 20 bp, Artificial
  CRISPR gRNA sequence
tcccagctactcaggaggct

SEQ ID NO: 358706 - DNA, 20 bp, Artificial
  CRISPR gRNA sequence
cccagctactcaggaggctg

SEQ ID NO: 358707 - DNA, 20 bp, Artificial
  CRISPR gRNA sequence
agctactcaggaggctgagg

SEQ ID NO: 358708 - DNA, 20 bp, Artificial
  CRISPR gRNA sequence
tactcaggaggctgaggcag

SEQ ID NO: 358709 - DNA, 20 bp, Artificial
  CRISPR gRNA sequence
aggaggctgaggcagaagaa

SEQ ID NO: 358710 - DNA, 20 bp, Artificial
  CRISPR gRNA sequence
gcagaagaatggcgtgaacc

SEQ ID NO: 358711 - DNA, 20 bp, Artificial
  CRISPR gRNA sequence
cagaagaatggcgtgaaccc

SEQ ID NO: 358712 - DNA, 20 bp, Artificial
  CRISPR gRNA sequence
gaagaatggcgtgaacccgg

SEQ ID NO: 358713 - DNA, 20 bp, Artificial
  CRISPR gRNA sequence
aagaatggcgtgaacccggg

SEQ ID NO: 358714 - DNA, 20 bp, Artificial
  CRISPR gRNA sequence
aatggcgtgaacccgggagg

SEQ ID NO: 358715 - DNA, 20 bp, Artificial
  CRISPR gRNA sequence
tggcgtgaacccgggaggca

SEQ ID NO: 358716 - DNA, 20 bp, Artificial
  CRISPR gRNA sequence
aacccgggaggcagagcttg

SEQ ID NO: 358717 - DNA, 20 bp, Artificial
  CRISPR gRNA sequence
cgggaggcagagcttgcagt

SEQ ID NO: 358718 - DNA, 20 bp, Artificial
  CRISPR gRNA sequence
ggcagagcttgcagtgagcc

SEQ ID NO: 358719 - DNA, 20 bp, Artificial
  CRISPR gRNA sequence
gagatcgcaccactgcactc

SEQ ID NO: 358720 - DNA, 20 bp, Artificial
  CRISPR gRNA sequence
cgcaccactgcactccagcc

SEQ ID NO: 358721 - DNA, 20 bp, Artificial
  CRISPR gRNA sequence
gcaccactgcactccagcct

SEQ ID NO: 358722 - DNA, 20 bp, Artificial
  CRISPR gRNA sequence
ctgcactccagcctgggcga

SEQ ID NO: 358723 - DNA, 20 bp, Artificial
  CRISPR gRNA sequence
gcactccagcctgggcgaca

SEQ ID NO: 358724 - DNA, 20 bp, Artificial
  CRISPR gRNA sequence
tccagcctgggcgacagagc

SEQ ID NO: 358725 - DNA, 20 bp, Artificial
  CRISPR gRNA sequence
tgactcaaaaaaaaaaaaaa

SEQ ID NO: 358726 - DNA, 20 bp, Artificial
  CRISPR gRNA sequence
aaaaaaaaaaaagtatttgt

SEQ ID NO: 358727 - DNA, 20 bp, Artificial
  CRISPR gRNA sequence
aaaaaagtatttgttagtac

SEQ ID NO: 358728 - DNA, 20 bp, Artificial
  CRISPR gRNA sequence
tatttgttagtacaagattt

SEQ ID NO: 358729 - DNA, 20 bp, Artificial
  CRISPR gRNA sequence
ttgttagtacaagatttgag

SEQ ID NO: 358730 - DNA, 20 bp, Artificial
  CRISPR gRNA sequence
tagtacaagatttgagaagc

SEQ ID NO: 358731 - DNA, 20 bp, Artificial
  CRISPR gRNA sequence
gtacaagatttgagaagcaa

SEQ ID NO: 358732 - DNA, 20 bp, Artificial
  CRISPR gRNA sequence
caagatttgagaagcaagag

SEQ ID NO: 358733 - DNA, 20 bp, Artificial
  CRISPR gRNA sequence
aagatttgagaagcaagaga

SEQ ID NO: 358734 - DNA, 20 bp, Artificial
  CRISPR gRNA sequence
gcaagagaaggaacctaaat

SEQ ID NO: 358735 - DNA, 20 bp, Artificial
  CRISPR gRNA sequence
aagagaaggaacctaaattg

SEQ ID NO: 358736 - DNA, 20 bp, Artificial
  CRISPR gRNA sequence
attggagtccctgcttgtga

SEQ ID NO: 358737 - DNA, 20 bp, Artificial
  CRISPR gRNA sequence
ttggagtccctgcttgtgaa

SEQ ID NO: 358738 - DNA, 20 bp, Artificial
  CRISPR gRNA sequence
tcctaacaataacatccaat

SEQ ID NO: 358739 - DNA, 20 bp, Artificial
  CRISPR gRNA sequence
gtattaatgtgcctgtttca

SEQ ID NO: 358740 - DNA, 20 bp, Artificial
  CRISPR gRNA sequence
ttgaaaaaataaatatactg

SEQ ID NO: 358741 - DNA, 20 bp, Artificial
  CRISPR gRNA sequence
aaaaaataaatatactgaag

SEQ ID NO: 358742 - DNA, 20 bp, Artificial
  CRISPR gRNA sequence
atactgaagtagctttccca

SEQ ID NO: 358743 - DNA, 20 bp, Artificial
  CRISPR gRNA sequence
actgaagtagctttcccaaa

SEQ ID NO: 358744 - DNA, 20 bp, Artificial
  CRISPR gRNA sequence
agtagctttcccaaagagct

SEQ ID NO: 358745 - DNA, 20 bp, Artificial
  CRISPR gRNA sequence
gctttcccaaagagctgagc

SEQ ID NO: 358746 - DNA, 20 bp, Artificial
  CRISPR gRNA sequence
cccaaagagctgagctggca

SEQ ID NO: 358747 - DNA, 20 bp, Artificial
  CRISPR gRNA sequence
agagctgagctggcaaagaa

SEQ ID NO: 358748 - DNA, 20 bp, Artificial
  CRISPR gRNA sequence
gagctggcaaagaacagaat

SEQ ID NO: 358749 - DNA, 20 bp, Artificial
  CRISPR gRNA sequence
aagaacagaatcagaaacgc

SEQ ID NO: 358750 - DNA, 20 bp, Artificial
  CRISPR gRNA sequence
agaaacgcaagaaactaatt

SEQ ID NO: 358751 - DNA, 20 bp, Artificial
  CRISPR gRNA sequence
aagaaactaatttggtttta

SEQ ID NO: 358752 - DNA, 20 bp, Artificial
  CRISPR gRNA sequence
agctcatacatttttcatgc

SEQ ID NO: 358753 - DNA, 20 bp, Artificial
  CRISPR gRNA sequence
tatctttaacctccaattct

SEQ ID NO: 358754 - DNA, 20 bp, Artificial
  CRISPR gRNA sequence
ctttaacctccaattctaag

SEQ ID NO: 358755 - DNA, 20 bp, Artificial
  CRISPR gRNA sequence
ttctctctctcacctctaaa

SEQ ID NO: 358756 - DNA, 20 bp, Artificial
  CRISPR gRNA sequence
tctctctctcacctctaaac

SEQ ID NO: 358757 - DNA, 20 bp, Artificial
  CRISPR gRNA sequence
ccattcctgaaaaccaactt

SEQ ID NO: 358758 - DNA, 20 bp, Artificial
  CRISPR gRNA sequence
aaaaccaactttggaccttt

SEQ ID NO: 358759 - DNA, 20 bp, Artificial
  CRISPR gRNA sequence
ttggaccttttggcgccatc

SEQ ID NO: 358760 - DNA, 20 bp, Artificial
  CRISPR gRNA sequence
tccctattcattcaaaattc

SEQ ID NO: 358761 - DNA, 20 bp, Artificial
  CRISPR gRNA sequence
ccctattcattcaaaattcc

SEQ ID NO: 358762 - DNA, 20 bp, Artificial
  CRISPR gRNA sequence
ctattcattcaaaattccag

SEQ ID NO: 358763 - DNA, 20 bp, Artificial
  CRISPR gRNA sequence
ttcattcaaaattccaggag

SEQ ID NO: 358764 - DNA, 20 bp, Artificial
  CRISPR gRNA sequence
tcattcaaaattccaggagt

SEQ ID NO: 358765 - DNA, 20 bp, Artificial
  CRISPR gRNA sequence
gagtgggttcccatcctgct

SEQ ID NO: 358766 - DNA, 20 bp, Artificial
  CRISPR gRNA sequence
atgtgtgcttcgacacaatc

SEQ ID NO: 358767 - DNA, 20 bp, Artificial
  CRISPR gRNA sequence
tccatttccacccttctacc

SEQ ID NO: 358768 - DNA, 20 bp, Artificial
  CRISPR gRNA sequence
accaagactgcaaatgtcat

SEQ ID NO: 358769 - DNA, 20 bp, Artificial
  CRISPR gRNA sequence
agtgttcttgacctgaatgc

SEQ ID NO: 358770 - DNA, 20 bp, Artificial
  CRISPR gRNA sequence
tgacctgaatgctggatgtc

SEQ ID NO: 358771 - DNA, 20 bp, Artificial
  CRISPR gRNA sequence
tgctggatgtccagccctcc

SEQ ID NO: 358772 - DNA, 20 bp, Artificial
  CRISPR gRNA sequence
cctggaaatactctacccct

SEQ ID NO: 358773 - DNA, 20 bp, Artificial
  CRISPR gRNA sequence
aaaaatgtgtgttgtgcccc

SEQ ID NO: 358774 - DNA, 20 bp, Artificial
  CRISPR gRNA sequence
aaaatgtgtgttgtgccccc

SEQ ID NO: 358775 - DNA, 20 bp, Artificial
  CRISPR gRNA sequence
aatgtgtgttgtgcccccag

SEQ ID NO: 358776 - DNA, 20 bp, Artificial
  CRISPR gRNA sequence
cctgtctactcaccatcgct

SEQ ID NO: 358777 - DNA, 20 bp, Artificial
  CRISPR gRNA sequence
tctactcaccatcgctgagt

SEQ ID NO: 358778 - DNA, 20 bp, Artificial
  CRISPR gRNA sequence
ctccttgttcaaccatctct

SEQ ID NO: 358779 - DNA, 20 bp, Artificial
  CRISPR gRNA sequence
tccttgttcaaccatctctt

SEQ ID NO: 358780 - DNA, 20 bp, Artificial
  CRISPR gRNA sequence
gttcaaccatctcttaggtg

SEQ ID NO: 358781 - DNA, 20 bp, Artificial
  CRISPR gRNA sequence
ccatctcttaggtgcagatc

SEQ ID NO: 358782 - DNA, 20 bp, Artificial
  CRISPR gRNA sequence
gcagatcaagtgcaaatcaa

SEQ ID NO: 358783 - DNA, 20 bp, Artificial
  CRISPR gRNA sequence
gcaaatcaatagcgcctgct

SEQ ID NO: 358784 - DNA, 20 bp, Artificial
  CRISPR gRNA sequence
atcaatagcgcctgctcagt

SEQ ID NO: 358785 - DNA, 20 bp, Artificial
  CRISPR gRNA sequence
tgctcagtcagacctctccc

SEQ ID NO: 358786 - DNA, 20 bp, Artificial
  CRISPR gRNA sequence
gctcagtcagacctctcccc

SEQ ID NO: 358787 - DNA, 20 bp, Artificial
  CRISPR gRNA sequence
ctcagtcagacctctcccca

SEQ ID NO: 358788 - DNA, 20 bp, Artificial
  CRISPR gRNA sequence
acctctccccagggtttcta

SEQ ID NO: 358789 - DNA, 20 bp, Artificial
  CRISPR gRNA sequence
ccccagggtttctaaagcac

SEQ ID NO: 358790 - DNA, 20 bp, Artificial
  CRISPR gRNA sequence
tgttcttacgatgcttcaaa

SEQ ID NO: 358791 - DNA, 20 bp, Artificial
  CRISPR gRNA sequence
caaatagactaaaaattaaa

SEQ ID NO: 358792 - DNA, 20 bp, Artificial
  CRISPR gRNA sequence
agactaaaaattaaacagcc

SEQ ID NO: 358793 - DNA, 20 bp, Artificial
  CRISPR gRNA sequence
aaacagcccagcattgccct

SEQ ID NO: 358794 - DNA, 20 bp, Artificial
  CRISPR gRNA sequence
gcattgccctaagccatctg

SEQ ID NO: 358795 - DNA, 20 bp, Artificial
  CRISPR gRNA sequence
cattgccctaagccatctgc

SEQ ID NO: 358796 - DNA, 20 bp, Artificial
  CRISPR gRNA sequence
ttgccctaagccatctgcag

SEQ ID NO: 358797 - DNA, 20 bp, Artificial
  CRISPR gRNA sequence
caggagcactattattacac

SEQ ID NO: 358798 - DNA, 20 bp, Artificial
  CRISPR gRNA sequence
ctattattacactagctaat

SEQ ID NO: 358799 - DNA, 20 bp, Artificial
  CRISPR gRNA sequence
tagctaattagaaatgatga

SEQ ID NO: 358800 - DNA, 20 bp, Artificial
  CRISPR gRNA sequence
ctaattagaaatgatgatag

SEQ ID NO: 358801 - DNA, 20 bp, Artificial
  CRISPR gRNA sequence
attagaaatgatgatagtag

SEQ ID NO: 358802 - DNA, 20 bp, Artificial
  CRISPR gRNA sequence
aatgatgatagtagtagctc

SEQ ID NO: 358803 - DNA, 20 bp, Artificial
  CRISPR gRNA sequence
gatgatagtagtagctccag

SEQ ID NO: 358804 - DNA, 20 bp, Artificial
  CRISPR gRNA sequence
cacgtattcccaactgtgcc

SEQ ID NO: 358805 - DNA, 20 bp, Artificial
  CRISPR gRNA sequence
gactatgaatatgctcaatt

SEQ ID NO: 358806 - DNA, 20 bp, Artificial
  CRISPR gRNA sequence
acttttctacaaactcttac

SEQ ID NO: 358807 - DNA, 20 bp, Artificial
  CRISPR gRNA sequence
atgttgactgcatgatgact

SEQ ID NO: 358808 - DNA, 20 bp, Artificial
  CRISPR gRNA sequence
tgttgactgcatgatgacta

SEQ ID NO: 358809 - DNA, 20 bp, Artificial
  CRISPR gRNA sequence
ttgactgcatgatgactaag

SEQ ID NO: 358810 - DNA, 20 bp, Artificial
  CRISPR gRNA sequence
tgactgcatgatgactaagg

SEQ ID NO: 358811 - DNA, 20 bp, Artificial
  CRISPR gRNA sequence
atgactaaggaggtctccta

SEQ ID NO: 358812 - DNA, 20 bp, Artificial
  CRISPR gRNA sequence
ggaggtctcctaaagtgcct

SEQ ID NO: 358813 - DNA, 20 bp, Artificial
  CRISPR gRNA sequence
ctcctaaagtgcctgagata

SEQ ID NO: 358814 - DNA, 20 bp, Artificial
  CRISPR gRNA sequence
gagataaagttctcaaaaat

SEQ ID NO: 358815 - DNA, 20 bp, Artificial
  CRISPR gRNA sequence
taaagttctcaaaaataagc

SEQ ID NO: 358816 - DNA, 20 bp, Artificial
  CRISPR gRNA sequence
tctcaaaaataagcaagcaa

SEQ ID NO: 358817 - DNA, 20 bp, Artificial
  CRISPR gRNA sequence
aaataagcaagcaaaagaaa

SEQ ID NO: 358818 - DNA, 20 bp, Artificial
  CRISPR gRNA sequence
aagcaagcaaaagaaataga

SEQ ID NO: 358819 - DNA, 20 bp, Artificial
  CRISPR gRNA sequence
agcaagcaaaagaaatagaa

SEQ ID NO: 358820 - DNA, 20 bp, Artificial
  CRISPR gRNA sequence
agcaaaagaaatagaaaggc

SEQ ID NO: 358821 - DNA, 20 bp, Artificial
  CRISPR gRNA sequence
gaaatagaaaggcaagttcc

SEQ ID NO: 358822 - DNA, 20 bp, Artificial
  CRISPR gRNA sequence
aaaggcaagttcccagttac

SEQ ID NO: 358823 - DNA, 20 bp, Artificial
  CRISPR gRNA sequence
gcaagttcccagttacaagc

SEQ ID NO: 358824 - DNA, 20 bp, Artificial
  CRISPR gRNA sequence
ccagttacaagcaagcaaca

SEQ ID NO: 358825 - DNA, 20 bp, Artificial
  CRISPR gRNA sequence
tacaagcaagcaacaaagtc

SEQ ID NO: 358826 - DNA, 20 bp, Artificial
  CRISPR gRNA sequence
agcaagcaacaaagtccaga

SEQ ID NO: 358827 - DNA, 20 bp, Artificial
  CRISPR gRNA sequence
aagcaacaaagtccagaaag

SEQ ID NO: 358828 - DNA, 20 bp, Artificial
  CRISPR gRNA sequence
aagtccagaaagtggaaaaa

SEQ ID NO: 358829 - DNA, 20 bp, Artificial
  CRISPR gRNA sequence
gtggaaaaatggcacttttg

SEQ ID NO: 358830 - DNA, 20 bp, Artificial
  CRISPR gRNA sequence
aatggcacttttgaagctca

SEQ ID NO: 358831 - DNA, 20 bp, Artificial
  CRISPR gRNA sequence
atggcacttttgaagctcat

SEQ ID NO: 358832 - DNA, 20 bp, Artificial
  CRISPR gRNA sequence
tggcacttttgaagctcata

SEQ ID NO: 358833 - DNA, 20 bp, Artificial
  CRISPR gRNA sequence
tttgaagctcatagggcatg

SEQ ID NO: 358834 - DNA, 20 bp, Artificial
  CRISPR gRNA sequence
agctcatagggcatgcagtg

SEQ ID NO: 358835 - DNA, 20 bp, Artificial
  CRISPR gRNA sequence
gctcatagggcatgcagtgt

SEQ ID NO: 358836 - DNA, 20 bp, Artificial
  CRISPR gRNA sequence
tcatagggcatgcagtgtgg

SEQ ID NO: 358837 - DNA, 20 bp, Artificial
  CRISPR gRNA sequence
catagggcatgcagtgtggg

SEQ ID NO: 358838 - DNA, 20 bp, Artificial
  CRISPR gRNA sequence
gcagtgtgggaggacatact

SEQ ID NO: 358839 - DNA, 20 bp, Artificial
  CRISPR gRNA sequence
cagtgtgggaggacatactg

SEQ ID NO: 358840 - DNA, 20 bp, Artificial
  CRISPR gRNA sequence
gtgggaggacatactgagga

SEQ ID NO: 358841 - DNA, 20 bp, Artificial
  CRISPR gRNA sequence
ggaggacatactgaggacag

SEQ ID NO: 358842 - DNA, 20 bp, Artificial
  CRISPR gRNA sequence
gaggacatactgaggacaga

SEQ ID NO: 358843 - DNA, 20 bp, Artificial
  CRISPR gRNA sequence
ggacatactgaggacagaag

SEQ ID NO: 358844 - DNA, 20 bp, Artificial
  CRISPR gRNA sequence
tgaggacagaaggagaaaca

SEQ ID NO: 358845 - DNA, 20 bp, Artificial
  CRISPR gRNA sequence
aaggagaaacacagacacaa

SEQ ID NO: 358846 - DNA, 20 bp, Artificial
  CRISPR gRNA sequence
aggagaaacacagacacaaa

SEQ ID NO: 358847 - DNA, 20 bp, Artificial
  CRISPR gRNA sequence
agaaacacagacacaaaagg

SEQ ID NO: 358848 - DNA, 20 bp, Artificial
  CRISPR gRNA sequence
cacaaaaggcagaattttcc

SEQ ID NO: 358849 - DNA, 20 bp, Artificial
  CRISPR gRNA sequence
acaaaaggcagaattttcca

SEQ ID NO: 358850 - DNA, 20 bp, Artificial
  CRISPR gRNA sequence
ggatgcctttgcctgcctca

SEQ ID NO: 358851 - DNA, 20 bp, Artificial
  CRISPR gRNA sequence
ctttgcctgcctcatagttc

SEQ ID NO: 358852 - DNA, 20 bp, Artificial
  CRISPR gRNA sequence
cctcatagttctggctgtga

SEQ ID NO: 358853 - DNA, 20 bp, Artificial
  CRISPR gRNA sequence
ttctggctgtgacagccaaa

SEQ ID NO: 358854 - DNA, 20 bp, Artificial
  CRISPR gRNA sequence
gtgacagccaaaaagtgaaa

SEQ ID NO: 358855 - DNA, 20 bp, Artificial
  CRISPR gRNA sequence
cagccaaaaagtgaaaaaga

SEQ ID NO: 358856 - DNA, 20 bp, Artificial
  CRISPR gRNA sequence
aaaagtgaaaaagacagtcg

SEQ ID NO: 358857 - DNA, 20 bp, Artificial
  CRISPR gRNA sequence
agtgaaaaagacagtcgtgg

SEQ ID NO: 358858 - DNA, 20 bp, Artificial
  CRISPR gRNA sequence
gtcgtggtggacactgaact

SEQ ID NO: 358859 - DNA, 20 bp, Artificial
  CRISPR gRNA sequence
tggacactgaactgagctgt

SEQ ID NO: 358860 - DNA, 20 bp, Artificial
  CRISPR gRNA sequence
ggacactgaactgagctgtc

SEQ ID NO: 358861 - DNA, 20 bp, Artificial
  CRISPR gRNA sequence
cactgaactgagctgtcagg

SEQ ID NO: 358862 - DNA, 20 bp, Artificial
  CRISPR gRNA sequence
ctgagctgtcaggcagcttc

SEQ ID NO: 358863 - DNA, 20 bp, Artificial
  CRISPR gRNA sequence
agctgtcaggcagcttcaag

SEQ ID NO: 358864 - DNA, 20 bp, Artificial
  CRISPR gRNA sequence
tcaggcagcttcaagcagaa

SEQ ID NO: 358865 - DNA, 20 bp, Artificial
  CRISPR gRNA sequence
agcttcaagcagaatagaaa

SEQ ID NO: 358866 - DNA, 20 bp, Artificial
  CRISPR gRNA sequence
ttcaagcagaatagaaacag

SEQ ID NO: 358867 - DNA, 20 bp, Artificial
  CRISPR gRNA sequence
agaaacagaagcctcttccc

SEQ ID NO: 358868 - DNA, 20 bp, Artificial
  CRISPR gRNA sequence
gcctcttccctagaacgcat

SEQ ID NO: 358869 - DNA, 20 bp, Artificial
  CRISPR gRNA sequence
ctagaacgcatcagcattcc

SEQ ID NO: 358870 - DNA, 20 bp, Artificial
  CRISPR gRNA sequence
aacgcatcagcattcccaga

SEQ ID NO: 358871 - DNA, 20 bp, Artificial
  CRISPR gRNA sequence
cgcatcagcattcccagaaa

SEQ ID NO: 358872 - DNA, 20 bp, Artificial
  CRISPR gRNA sequence
cattcccagaaagagaatgc

SEQ ID NO: 358873 - DNA, 20 bp, Artificial
  CRISPR gRNA sequence
gcaagctcctgcctacactg

SEQ ID NO: 358874 - DNA, 20 bp, Artificial
  CRISPR gRNA sequence
gtgtgcattcatttcaaaca

SEQ ID NO: 358875 - DNA, 20 bp, Artificial
  CRISPR gRNA sequence
gcattcatttcaaacataga

SEQ ID NO: 358876 - DNA, 20 bp, Artificial
  CRISPR gRNA sequence
tcaaacatagacagcaatga

SEQ ID NO: 358877 - DNA, 20 bp, Artificial
  CRISPR gRNA sequence
atagacagcaatgacagtat

SEQ ID NO: 358878 - DNA, 20 bp, Artificial
  CRISPR gRNA sequence
acagcaatgacagtattgga

SEQ ID NO: 358879 - DNA, 20 bp, Artificial
  CRISPR gRNA sequence
ttggatggcatttctctaaa

SEQ ID NO: 358880 - DNA, 20 bp, Artificial
  CRISPR gRNA sequence
ctaaaaagctgcaatgttcc

SEQ ID NO: 358881 - DNA, 20 bp, Artificial
  CRISPR gRNA sequence
aaagctgcaatgttcccaga

SEQ ID NO: 358882 - DNA, 20 bp, Artificial
  CRISPR gRNA sequence
tgcaatgttcccagatggcc

SEQ ID NO: 358883 - DNA, 20 bp, Artificial
  CRISPR gRNA sequence
tgttcccagatggccaagtt

SEQ ID NO: 358884 - DNA, 20 bp, Artificial
  CRISPR gRNA sequence
gttcccagatggccaagttt

SEQ ID NO: 358885 - DNA, 20 bp, Artificial
  CRISPR gRNA sequence
ttcccagatggccaagtttg

SEQ ID NO: 358886 - DNA, 20 bp, Artificial
  CRISPR gRNA sequence
ggccaagtttggggatgtta

SEQ ID NO: 358887 - DNA, 20 bp, Artificial
  CRISPR gRNA sequence
gccaagtttggggatgttac

SEQ ID NO: 358888 - DNA, 20 bp, Artificial
  CRISPR gRNA sequence
aagtttggggatgttacagg

SEQ ID NO: 358889 - DNA, 20 bp, Artificial
  CRISPR gRNA sequence
tgtgtcccccaacattccta

SEQ ID NO: 358890 - DNA, 20 bp, Artificial
  CRISPR gRNA sequence
cccccaacattcctatggtg

SEQ ID NO: 358891 - DNA, 20 bp, Artificial
  CRISPR gRNA sequence
acattcctatggtgaagtcc

SEQ ID NO: 358892 - DNA, 20 bp, Artificial
  CRISPR gRNA sequence
tatggtgaagtcctagcctc

SEQ ID NO: 358893 - DNA, 20 bp, Artificial
  CRISPR gRNA sequence
cttcacaacctgatctgatt

SEQ ID NO: 358894 - DNA, 20 bp, Artificial
  CRISPR gRNA sequence
aacctgatctgatttggaaa

SEQ ID NO: 358895 - DNA, 20 bp, Artificial
  CRISPR gRNA sequence
acctgatctgatttggaaat

SEQ ID NO: 358896 - DNA, 20 bp, Artificial
  CRISPR gRNA sequence
cctgatctgatttggaaata

SEQ ID NO: 358897 - DNA, 20 bp, Artificial
  CRISPR gRNA sequence
atttggaaatagggctgttg

SEQ ID NO: 358898 - DNA, 20 bp, Artificial
  CRISPR gRNA sequence
agggctgttgcagatacaat

SEQ ID NO: 358899 - DNA, 20 bp, Artificial
  CRISPR gRNA sequence
agatacaattagttaacatg

SEQ ID NO: 358900 - DNA, 20 bp, Artificial
  CRISPR gRNA sequence
tagttaacatgaagtcatcc

SEQ ID NO: 358901 - DNA, 20 bp, Artificial
  CRISPR gRNA sequence
aacatgaagtcatcctggaa

SEQ ID NO: 358902 - DNA, 20 bp, Artificial
  CRISPR gRNA sequence
acatgaagtcatcctggaat

SEQ ID NO: 358903 - DNA, 20 bp, Artificial
  CRISPR gRNA sequence
catgaagtcatcctggaata

SEQ ID NO: 358904 - DNA, 20 bp, Artificial
  CRISPR gRNA sequence
gaagtcatcctggaataggg

SEQ ID NO: 358905 - DNA, 20 bp, Artificial
  CRISPR gRNA sequence
tatgaccgtgtccttataaa

SEQ ID NO: 358906 - DNA, 20 bp, Artificial
  CRISPR gRNA sequence
atgaccgtgtccttataaaa

SEQ ID NO: 358907 - DNA, 20 bp, Artificial
  CRISPR gRNA sequence
tgaccgtgtccttataaaaa

SEQ ID NO: 358908 - DNA, 20 bp, Artificial
  CRISPR gRNA sequence
gaccgtgtccttataaaaag

SEQ ID NO: 358909 - DNA, 20 bp, Artificial
  CRISPR gRNA sequence
aaaaaggggaaattctgaca

SEQ ID NO: 358910 - DNA, 20 bp, Artificial
  CRISPR gRNA sequence
aaaaggggaaattctgacac

SEQ ID NO: 358911 - DNA, 20 bp, Artificial
  CRISPR gRNA sequence
tctgacacaggcatgaatac

SEQ ID NO: 358912 - DNA, 20 bp, Artificial
  CRISPR gRNA sequence
gacacaggcatgaatacaag

SEQ ID NO: 358913 - DNA, 20 bp, Artificial
  CRISPR gRNA sequence
tacaagcagaacgccatgtg

SEQ ID NO: 358914 - DNA, 20 bp, Artificial
  CRISPR gRNA sequence
acgccatgtgaagatgaatg

SEQ ID NO: 358915 - DNA, 20 bp, Artificial
  CRISPR gRNA sequence
gccatgtgaagatgaatgca

SEQ ID NO: 358916 - DNA, 20 bp, Artificial
  CRISPR gRNA sequence
gtgaagatgaatgcagagat

SEQ ID NO: 358917 - DNA, 20 bp, Artificial
  CRISPR gRNA sequence
tgaagatgaatgcagagatt

SEQ ID NO: 358918 - DNA, 20 bp, Artificial
  CRISPR gRNA sequence
gattgggttgatgcttccac

SEQ ID NO: 358919 - DNA, 20 bp, Artificial
  CRISPR gRNA sequence
ggttgatgcttccacgagcc

SEQ ID NO: 358920 - DNA, 20 bp, Artificial
  CRISPR gRNA sequence
gttgatgcttccacgagcca

SEQ ID NO: 358921 - DNA, 20 bp, Artificial
  CRISPR gRNA sequence
gatgcttccacgagccaagg

SEQ ID NO: 358922 - DNA, 20 bp, Artificial
  CRISPR gRNA sequence
atgcttccacgagccaagga

SEQ ID NO: 358923 - DNA, 20 bp, Artificial
  CRISPR gRNA sequence
ccacgagccaaggaaggcca

SEQ ID NO: 358924 - DNA, 20 bp, Artificial
  CRISPR gRNA sequence
caaggaaggccaaagattgc

SEQ ID NO: 358925 - DNA, 20 bp, Artificial
  CRISPR gRNA sequence
caaagattgccagaaattgc

SEQ ID NO: 358926 - DNA, 20 bp, Artificial
  CRISPR gRNA sequence
agattgccagaaattgccag

SEQ ID NO: 358927 - DNA, 20 bp, Artificial
  CRISPR gRNA sequence
tgccagaaattgccagaagc

SEQ ID NO: 358928 - DNA, 20 bp, Artificial
  CRISPR gRNA sequence
gccagaaattgccagaagct

SEQ ID NO: 358929 - DNA, 20 bp, Artificial
  CRISPR gRNA sequence
gaaattgccagaagctaggt

SEQ ID NO: 358930 - DNA, 20 bp, Artificial
  CRISPR gRNA sequence
agacctctccttgcaacccc

SEQ ID NO: 358931 - DNA, 20 bp, Artificial
  CRISPR gRNA sequence
acctctccttgcaaccccca

SEQ ID NO: 358932 - DNA, 20 bp, Artificial
  CRISPR gRNA sequence
cctctccttgcaacccccag

SEQ ID NO: 358933 - DNA, 20 bp, Artificial
  CRISPR gRNA sequence
ctctccttgcaacccccaga

SEQ ID NO: 358934 - DNA, 20 bp, Artificial
  CRISPR gRNA sequence
ccctgctgataccttcactt

SEQ ID NO: 358935 - DNA, 20 bp, Artificial
  CRISPR gRNA sequence
cactttggacttcaaactgc

SEQ ID NO: 358936 - DNA, 20 bp, Artificial
  CRISPR gRNA sequence
caagacaacacatttctgtt

SEQ ID NO: 358937 - DNA, 20 bp, Artificial
  CRISPR gRNA sequence
cacatttctgttaagttacc

SEQ ID NO: 358938 - DNA, 20 bp, Artificial
  CRISPR gRNA sequence
ctgttaagttacccagcttt

SEQ ID NO: 358939 - DNA, 20 bp, Artificial
  CRISPR gRNA sequence
cagcttttggtatcatgtgc

SEQ ID NO: 358940 - DNA, 20 bp, Artificial
  CRISPR gRNA sequence
cttttggtatcatgtgccag

SEQ ID NO: 358941 - DNA, 20 bp, Artificial
  CRISPR gRNA sequence
gtatcatgtgccagcagctc

SEQ ID NO: 358942 - DNA, 20 bp, Artificial
  CRISPR gRNA sequence
tatcatgtgccagcagctct

SEQ ID NO: 358943 - DNA, 20 bp, Artificial
  CRISPR gRNA sequence
cagcagctctaggacactaa

SEQ ID NO: 358944 - DNA, 20 bp, Artificial
  CRISPR gRNA sequence
agcagctctaggacactaat

SEQ ID NO: 358945 - DNA, 20 bp, Artificial
  CRISPR gRNA sequence
gcagctctaggacactaata

SEQ ID NO: 358946 - DNA, 20 bp, Artificial
  CRISPR gRNA sequence
agctctaggacactaatagg

SEQ ID NO: 358947 - DNA, 20 bp, Artificial
  CRISPR gRNA sequence
ctaggacactaatagggagt

SEQ ID NO: 358948 - DNA, 20 bp, Artificial
  CRISPR gRNA sequence
taggacactaatagggagta

SEQ ID NO: 358949 - DNA, 20 bp, Artificial
  CRISPR gRNA sequence
taatagggagtaaggaccat

SEQ ID NO: 358950 - DNA, 20 bp, Artificial
  CRISPR gRNA sequence
aatagggagtaaggaccatc

SEQ ID NO: 358951 - DNA, 20 bp, Artificial
  CRISPR gRNA sequence
ggaccatcaggacgacatct

SEQ ID NO: 358952 - DNA, 20 bp, Artificial
  CRISPR gRNA sequence
gaccatcaggacgacatctt

SEQ ID NO: 358953 - DNA, 20 bp, Artificial
  CRISPR gRNA sequence
tcaggacgacatcttgggta

SEQ ID NO: 358954 - DNA, 20 bp, Artificial
  CRISPR gRNA sequence
acgacatcttgggtacagtc

SEQ ID NO: 358955 - DNA, 20 bp, Artificial
  CRISPR gRNA sequence
cgacatcttgggtacagtct

SEQ ID NO: 358956 - DNA, 20 bp, Artificial
  CRISPR gRNA sequence
gggtacagtctgggcctcgc

SEQ ID NO: 358957 - DNA, 20 bp, Artificial
  CRISPR gRNA sequence
tgggcctcgccagcacccat

SEQ ID NO: 358958 - DNA, 20 bp, Artificial
  CRISPR gRNA sequence
gcctcgccagcacccatcag

SEQ ID NO: 358959 - DNA, 20 bp, Artificial
  CRISPR gRNA sequence
tcgccagcacccatcagaag

SEQ ID NO: 358960 - DNA, 20 bp, Artificial
  CRISPR gRNA sequence
cagcacccatcagaagcagc

SEQ ID NO: 358961 - DNA, 20 bp, Artificial
  CRISPR gRNA sequence
agcagcaagtccatcctgct

SEQ ID NO: 358962 - DNA, 20 bp, Artificial
  CRISPR gRNA sequence
gtccatcctgctgagaaaat

SEQ ID NO: 358963 - DNA, 20 bp, Artificial
  CRISPR gRNA sequence
cattttctgtctttcatcta

SEQ ID NO: 358964 - DNA, 20 bp, Artificial
  CRISPR gRNA sequence
tctgtctttcatctaaagtg

SEQ ID NO: 358965 - DNA, 20 bp, Artificial
  CRISPR gRNA sequence
ttcatctaaagtgcagataa

SEQ ID NO: 358966 - DNA, 20 bp, Artificial
  CRISPR gRNA sequence
tcatctaaagtgcagataaa

SEQ ID NO: 358967 - DNA, 20 bp, Artificial
  CRISPR gRNA sequence
taaagtgcagataaaaggta

SEQ ID NO: 358968 - DNA, 20 bp, Artificial
  CRISPR gRNA sequence
aaagtgcagataaaaggtaa

SEQ ID NO: 358969 - DNA, 20 bp, Artificial
  CRISPR gRNA sequence
taaaaggtaaaggaccaaac

SEQ ID NO: 358970 - DNA, 20 bp, Artificial
  CRISPR gRNA sequence
gaccaaacaagataaaaaat

SEQ ID NO: 358971 - DNA, 20 bp, Artificial
  CRISPR gRNA sequence
caagataaaaaataagctaa

SEQ ID NO: 358972 - DNA, 20 bp, Artificial
  CRISPR gRNA sequence
ctaaaagaccgcttaactga

SEQ ID NO: 358973 - DNA, 20 bp, Artificial
  CRISPR gRNA sequence
taaaagaccgcttaactgaa

SEQ ID NO: 358974 - DNA, 20 bp, Artificial
  CRISPR gRNA sequence
gaccgcttaactgaaaggca

SEQ ID NO: 358975 - DNA, 20 bp, Artificial
  CRISPR gRNA sequence
ttaactgaaaggcacagata

SEQ ID NO: 358976 - DNA, 20 bp, Artificial
  CRISPR gRNA sequence
actgaaaggcacagataaag

SEQ ID NO: 358977 - DNA, 20 bp, Artificial
  CRISPR gRNA sequence
ctgaaaggcacagataaagt

SEQ ID NO: 358978 - DNA, 20 bp, Artificial
  CRISPR gRNA sequence
aaaggcacagataaagtggg

SEQ ID NO: 358979 - DNA, 20 bp, Artificial
  CRISPR gRNA sequence
aggcacagataaagtgggaa

SEQ ID NO: 358980 - DNA, 20 bp, Artificial
  CRISPR gRNA sequence
acagataaagtgggaagagt

SEQ ID NO: 358981 - DNA, 20 bp, Artificial
  CRISPR gRNA sequence
gggaagagtgagttacaata

SEQ ID NO: 358982 - DNA, 20 bp, Artificial
  CRISPR gRNA sequence
gaagagtgagttacaataaa

SEQ ID NO: 358983 - DNA, 20 bp, Artificial
  CRISPR gRNA sequence
gataaaaacacaacccgaca

SEQ ID NO: 358984 - DNA, 20 bp, Artificial
  CRISPR gRNA sequence
aacccgacaaagccatcatg

SEQ ID NO: 358985 - DNA, 20 bp, Artificial
  CRISPR gRNA sequence
acccgacaaagccatcatga

SEQ ID NO: 358986 - DNA, 20 bp, Artificial
  CRISPR gRNA sequence
gacaaagccatcatgaagga

SEQ ID NO: 358987 - DNA, 20 bp, Artificial
  CRISPR gRNA sequence
aagccatcatgaaggaaagc

SEQ ID NO: 358988 - DNA, 20 bp, Artificial
  CRISPR gRNA sequence
agccatcatgaaggaaagcc

SEQ ID NO: 358989 - DNA, 20 bp, Artificial
  CRISPR gRNA sequence
atcatgaaggaaagccaggc

SEQ ID NO: 358990 - DNA, 20 bp, Artificial
  CRISPR gRNA sequence
tcatgaaggaaagccaggca

SEQ ID NO: 358991 - DNA, 20 bp, Artificial
  CRISPR gRNA sequence
aagccaggcaaggccatttg

SEQ ID NO: 358992 - DNA, 20 bp, Artificial
  CRISPR gRNA sequence
tttgtggaaataaaaaaatg

SEQ ID NO: 358993 - DNA, 20 bp, Artificial
  CRISPR gRNA sequence
ttgtggaaataaaaaaatga

SEQ ID NO: 358994 - DNA, 20 bp, Artificial
  CRISPR gRNA sequence
tgtggaaataaaaaaatgaa

SEQ ID NO: 358995 - DNA, 20 bp, Artificial
  CRISPR gRNA sequence
aaataaaaaaatgaagggac

SEQ ID NO: 358996 - DNA, 20 bp, Artificial
  CRISPR gRNA sequence
aaaaatgaagggactagatt

SEQ ID NO: 358997 - DNA, 20 bp, Artificial
  CRISPR gRNA sequence
aaaatgaagggactagattc

SEQ ID NO: 358998 - DNA, 20 bp, Artificial
  CRISPR gRNA sequence
ttcaggctgcgtgtcctgca

SEQ ID NO: 358999 - DNA, 20 bp, Artificial
  CRISPR gRNA sequence
gcgtgtcctgcatggcaaat

SEQ ID NO: 359000 - DNA, 20 bp, Artificial
  CRISPR gRNA sequence
cgtgtcctgcatggcaaatc

SEQ ID NO: 359001 - DNA, 20 bp, Artificial
  CRISPR gRNA sequence
ctgcatggcaaatcaggatt

SEQ ID NO: 359002 - DNA, 20 bp, Artificial
  CRISPR gRNA sequence
tggcaaatcaggattcagcc

SEQ ID NO: 359003 - DNA, 20 bp, Artificial
  CRISPR gRNA sequence
cagcccagaaaatccatatt

SEQ ID NO: 359004 - DNA, 20 bp, Artificial
  CRISPR gRNA sequence
gcccagaaaatccatattaa

SEQ ID NO: 359005 - DNA, 20 bp, Artificial
  CRISPR gRNA sequence
ccatattaagagatgatttg

SEQ ID NO: 359006 - DNA, 20 bp, Artificial
  CRISPR gRNA sequence
gatgatttgcagtatgtcca

SEQ ID NO: 359007 - DNA, 20 bp, Artificial
  CRISPR gRNA sequence
tgatttgcagtatgtccaaa

SEQ ID NO: 359008 - DNA, 20 bp, Artificial
  CRISPR gRNA sequence
aaagagcgattcccctgtct

SEQ ID NO: 359009 - DNA, 20 bp, Artificial
  CRISPR gRNA sequence
tcccctgtctaagcactgaa

SEQ ID NO: 359010 - DNA, 20 bp, Artificial
  CRISPR gRNA sequence
tgtctaagcactgaacagca

SEQ ID NO: 359011 - DNA, 20 bp, Artificial
  CRISPR gRNA sequence
gtctaagcactgaacagcaa

SEQ ID NO: 359012 - DNA, 20 bp, Artificial
  CRISPR gRNA sequence
acagcaaaggacttgcaatg

SEQ ID NO: 359013 - DNA, 20 bp, Artificial
  CRISPR gRNA sequence
cagcaaaggacttgcaatgc

SEQ ID NO: 359014 - DNA, 20 bp, Artificial
  CRISPR gRNA sequence
aggacttgcaatgcaggccc

SEQ ID NO: 359015 - DNA, 20 bp, Artificial
  CRISPR gRNA sequence
acttgcaatgcaggccccgg

SEQ ID NO: 359016 - DNA, 20 bp, Artificial
  CRISPR gRNA sequence
gccccggcagctttgtgatt

SEQ ID NO: 359017 - DNA, 20 bp, Artificial
  CRISPR gRNA sequence
gctttgtgattcagattacc

SEQ ID NO: 359018 - DNA, 20 bp, Artificial
  CRISPR gRNA sequence
ctttgtgattcagattaccc

SEQ ID NO: 359019 - DNA, 20 bp, Artificial
  CRISPR gRNA sequence
ttgtgattcagattacccag

SEQ ID NO: 359020 - DNA, 20 bp, Artificial
  CRISPR gRNA sequence
ttcagattacccaggagtca

SEQ ID NO: 359021 - DNA, 20 bp, Artificial
  CRISPR gRNA sequence
caggagtcaaagcaactgct

SEQ ID NO: 359022 - DNA, 20 bp, Artificial
  CRISPR gRNA sequence
aaagcaactgctgagaccac

SEQ ID NO: 359023 - DNA, 20 bp, Artificial
  CRISPR gRNA sequence
gctgagaccaccggcctccc

SEQ ID NO: 359024 - DNA, 20 bp, Artificial
  CRISPR gRNA sequence
accaccggcctccccagctt

SEQ ID NO: 359025 - DNA, 20 bp, Artificial
  CRISPR gRNA sequence
caccggcctccccagcttca

SEQ ID NO: 359026 - DNA, 20 bp, Artificial
  CRISPR gRNA sequence
gcctccccagcttcagagcc

SEQ ID NO: 359027 - DNA, 20 bp, Artificial
  CRISPR gRNA sequence
cctccccagcttcagagccc

SEQ ID NO: 359028 - DNA, 20 bp, Artificial
  CRISPR gRNA sequence
ttcagagcccaggctgcctc

SEQ ID NO: 359029 - DNA, 20 bp, Artificial
  CRISPR gRNA sequence
tcagagcccaggctgcctcc

SEQ ID NO: 359030 - DNA, 20 bp, Artificial
  CRISPR gRNA sequence
cagagcccaggctgcctcca

SEQ ID NO: 359031 - DNA, 20 bp, Artificial
  CRISPR gRNA sequence
agagcccaggctgcctccag

SEQ ID NO: 359032 - DNA, 20 bp, Artificial
  CRISPR gRNA sequence
gcccaggctgcctccagggg

SEQ ID NO: 359033 - DNA, 20 bp, Artificial
  CRISPR gRNA sequence
tgcctccaggggcagctccg

SEQ ID NO: 359034 - DNA, 20 bp, Artificial
  CRISPR gRNA sequence
cctccaggggcagctccgtg

SEQ ID NO: 359035 - DNA, 20 bp, Artificial
  CRISPR gRNA sequence
ggggcagctccgtggagctc

SEQ ID NO: 359036 - DNA, 20 bp, Artificial
  CRISPR gRNA sequence
ccgtggagctccagaatctt

SEQ ID NO: 359037 - DNA, 20 bp, Artificial
  CRISPR gRNA sequence
gagctccagaatcttgagat

SEQ ID NO: 359038 - DNA, 20 bp, Artificial
  CRISPR gRNA sequence
atcttgagattggctcctga

SEQ ID NO: 359039 - DNA, 20 bp, Artificial
  CRISPR gRNA sequence
tcttgagattggctcctgaa

SEQ ID NO: 359040 - DNA, 20 bp, Artificial
  CRISPR gRNA sequence
tggctcctgaaaggtaaccg

SEQ ID NO: 359041 - DNA, 20 bp, Artificial
  CRISPR gRNA sequence
ggctcctgaaaggtaaccgt

SEQ ID NO: 359042 - DNA, 20 bp, Artificial
  CRISPR gRNA sequence
aaggtaaccgtgggtcccct

SEQ ID NO: 359043 - DNA, 20 bp, Artificial
  CRISPR gRNA sequence
cccttggtgtaatgtttgtt

SEQ ID NO: 359044 - DNA, 20 bp, Artificial
  CRISPR gRNA sequence
ccttggtgtaatgtttgttc

SEQ ID NO: 359045 - DNA, 20 bp, Artificial
  CRISPR gRNA sequence
aactttcaatctctccacca

SEQ ID NO: 359046 - DNA, 20 bp, Artificial
  CRISPR gRNA sequence
tctctccaccatggtacaat

SEQ ID NO: 359047 - DNA, 20 bp, Artificial
  CRISPR gRNA sequence
tgagaatgatgtttttatta

SEQ ID NO: 359048 - DNA, 20 bp, Artificial
  CRISPR gRNA sequence
aatgatgtttttattatagt

SEQ ID NO: 359049 - DNA, 20 bp, Artificial
  CRISPR gRNA sequence
tttattatagtcagtatcat

SEQ ID NO: 359050 - DNA, 20 bp, Artificial
  CRISPR gRNA sequence
ataagatttgctgaatcaca

SEQ ID NO: 359051 - DNA, 20 bp, Artificial
  CRISPR gRNA sequence
atttgctgaatcacatggaa

SEQ ID NO: 359052 - DNA, 20 bp, Artificial
  CRISPR gRNA sequence
catggaaaagtcaaactttt

SEQ ID NO: 359053 - DNA, 20 bp, Artificial
  CRISPR gRNA sequence
caaacttttgagccattctg

SEQ ID NO: 359054 - DNA, 20 bp, Artificial
  CRISPR gRNA sequence
attctgcagtttctctcaac

SEQ ID NO: 359055 - DNA, 20 bp, Artificial
  CRISPR gRNA sequence
ccagaaaaattactgactaa

SEQ ID NO: 359056 - DNA, 20 bp, Artificial
  CRISPR gRNA sequence
cagaaaaattactgactaat

SEQ ID NO: 359057 - DNA, 20 bp, Artificial
  CRISPR gRNA sequence
attactgactaatgggatat

SEQ ID NO: 359058 - DNA, 20 bp, Artificial
  CRISPR gRNA sequence
ggatataagaattttaaata

SEQ ID NO: 359059 - DNA, 20 bp, Artificial
  CRISPR gRNA sequence
gatataagaattttaaatat

SEQ ID NO: 359060 - DNA, 20 bp, Artificial
  CRISPR gRNA sequence
ataagaattttaaatatagg

SEQ ID NO: 359061 - DNA, 20 bp, Artificial
  CRISPR gRNA sequence
aatataggtagtacatctct

SEQ ID NO: 359062 - DNA, 20 bp, Artificial
  CRISPR gRNA sequence
atataggtagtacatctctg

SEQ ID NO: 359063 - DNA, 20 bp, Artificial
  CRISPR gRNA sequence
aaccaaaaaataaaatgccc

SEQ ID NO: 359064 - DNA, 20 bp, Artificial
  CRISPR gRNA sequence
ccaaaaaataaaatgcccaa

SEQ ID NO: 359065 - DNA, 20 bp, Artificial
  CRISPR gRNA sequence
aataaaatgcccaagagcat

SEQ ID NO: 359066 - DNA, 20 bp, Artificial
  CRISPR gRNA sequence
tctactaaaatgttaccaat

SEQ ID NO: 359067 - DNA, 20 bp, Artificial
  CRISPR gRNA sequence
aatgttaccaattggccccc

SEQ ID NO: 359068 - DNA, 20 bp, Artificial
  CRISPR gRNA sequence
atgttaccaattggcccccc

SEQ ID NO: 359069 - DNA, 20 bp, Artificial
  CRISPR gRNA sequence
taccaattggccccccaggt

SEQ ID NO: 359070 - DNA, 20 bp, Artificial
  CRISPR gRNA sequence
ccaggttagacaatttaatg

SEQ ID NO: 359071 - DNA, 20 bp, Artificial
  CRISPR gRNA sequence
tttaatgtagactttctgca

SEQ ID NO: 359072 - DNA, 20 bp, Artificial
  CRISPR gRNA sequence
aatgtagactttctgcatgg

SEQ ID NO: 359073 - DNA, 20 bp, Artificial
  CRISPR gRNA sequence
atgtagactttctgcatggc

SEQ ID NO: 359074 - DNA, 20 bp, Artificial
  CRISPR gRNA sequence
tctgcatggcaggtttttaa

SEQ ID NO: 359075 - DNA, 20 bp, Artificial
  CRISPR gRNA sequence
tggcaggtttttaacagaaa

SEQ ID NO: 359076 - DNA, 20 bp, Artificial
  CRISPR gRNA sequence
ttttaacagaaaaagacatc

SEQ ID NO: 359077 - DNA, 20 bp, Artificial
  CRISPR gRNA sequence
ttaacagaaaaagacatcaa

SEQ ID NO: 359078 - DNA, 20 bp, Artificial
  CRISPR gRNA sequence
catctctaatgattctgtac

SEQ ID NO: 359079 - DNA, 20 bp, Artificial
  CRISPR gRNA sequence
tctctaatgattctgtacta

SEQ ID NO: 359080 - DNA, 20 bp, Artificial
  CRISPR gRNA sequence
aatgattctgtactagagaa

SEQ ID NO: 359081 - DNA, 20 bp, Artificial
  CRISPR gRNA sequence
tgtactagagaatagattgt

SEQ ID NO: 359082 - DNA, 20 bp, Artificial
  CRISPR gRNA sequence
agagaatagattgttagtga

SEQ ID NO: 359083 - DNA, 20 bp, Artificial
  CRISPR gRNA sequence
agattgttagtgatggtccc

SEQ ID NO: 359084 - DNA, 20 bp, Artificial
  CRISPR gRNA sequence
attgttagtgatggtccctg

SEQ ID NO: 359085 - DNA, 20 bp, Artificial
  CRISPR gRNA sequence
tggtccctggagactacatt

SEQ ID NO: 359086 - DNA, 20 bp, Artificial
  CRISPR gRNA sequence
catatacttaaaaatatttt

SEQ ID NO: 359087 - DNA, 20 bp, Artificial
  CRISPR gRNA sequence
atattttcagtatattttta

SEQ ID NO: 359088 - DNA, 20 bp, Artificial
  CRISPR gRNA sequence
tatttttaaagtaaaataat

SEQ ID NO: 359089 - DNA, 20 bp, Artificial
  CRISPR gRNA sequence
taaaataataagccttgaac

SEQ ID NO: 359090 - DNA, 20 bp, Artificial
  CRISPR gRNA sequence
gccttgaacgagtccttact

SEQ ID NO: 359091 - DNA, 20 bp, Artificial
  CRISPR gRNA sequence
aacgagtccttactaagtgc

SEQ ID NO: 359092 - DNA, 20 bp, Artificial
  CRISPR gRNA sequence
cagcattaaatgcattacct

SEQ ID NO: 359093 - DNA, 20 bp, Artificial
  CRISPR gRNA sequence
attaaatgcattacctaagc

SEQ ID NO: 359094 - DNA, 20 bp, Artificial
  CRISPR gRNA sequence
attacctaagctagtgcatt

SEQ ID NO: 359095 - DNA, 20 bp, Artificial
  CRISPR gRNA sequence
tgcatttagtccccacaaat

SEQ ID NO: 359096 - DNA, 20 bp, Artificial
  CRISPR gRNA sequence
gtccccacaaataagtcacc

SEQ ID NO: 359097 - DNA, 20 bp, Artificial
  CRISPR gRNA sequence
ataagtcacccagctgtgaa

SEQ ID NO: 359098 - DNA, 20 bp, Artificial
  CRISPR gRNA sequence
agtcacccagctgtgaatgg

SEQ ID NO: 359099 - DNA, 20 bp, Artificial
  CRISPR gRNA sequence
gtcacccagctgtgaatggc

SEQ ID NO: 359100 - DNA, 20 bp, Artificial
  CRISPR gRNA sequence
aatggcaggacattcttacc

SEQ ID NO: 359101 - DNA, 20 bp, Artificial
  CRISPR gRNA sequence
atggcaggacattcttacct

SEQ ID NO: 359102 - DNA, 20 bp, Artificial
  CRISPR gRNA sequence
gcaggacattcttacctagg

SEQ ID NO: 359103 - DNA, 20 bp, Artificial
  CRISPR gRNA sequence
caggacattcttacctaggc

SEQ ID NO: 359104 - DNA, 20 bp, Artificial
  CRISPR gRNA sequence
aggacattcttacctaggca

SEQ ID NO: 359105 - DNA, 20 bp, Artificial
  CRISPR gRNA sequence
tcttacctaggcagggcgtc

SEQ ID NO: 359106 - DNA, 20 bp, Artificial
  CRISPR gRNA sequence
cttacctaggcagggcgtct

SEQ ID NO: 359107 - DNA, 20 bp, Artificial
  CRISPR gRNA sequence
ttacctaggcagggcgtcta

SEQ ID NO: 359108 - DNA, 20 bp, Artificial
  CRISPR gRNA sequence
acctaggcagggcgtctagg

SEQ ID NO: 359109 - DNA, 20 bp, Artificial
  CRISPR gRNA sequence
aggcagggcgtctagggagc

SEQ ID NO: 359110 - DNA, 20 bp, Artificial
  CRISPR gRNA sequence
ctagggagccagtctcaaac

SEQ ID NO: 359111 - DNA, 20 bp, Artificial
  CRISPR gRNA sequence
gccagtctcaaaccagccct

SEQ ID NO: 359112 - DNA, 20 bp, Artificial
  CRISPR gRNA sequence
agtctcaaaccagccctgag

SEQ ID NO: 359113 - DNA, 20 bp, Artificial
  CRISPR gRNA sequence
gtctcaaaccagccctgaga

SEQ ID NO: 359114 - DNA, 20 bp, Artificial
  CRISPR gRNA sequence
tctcaaaccagccctgagaa

SEQ ID NO: 359115 - DNA, 20 bp, Artificial
  CRISPR gRNA sequence
ccagccctgagaagggactc

SEQ ID NO: 359116 - DNA, 20 bp, Artificial
  CRISPR gRNA sequence
ctgagaagggactccggtga

SEQ ID NO: 359117 - DNA, 20 bp, Artificial
  CRISPR gRNA sequence
gaagggactccggtgacagc

SEQ ID NO: 359118 - DNA, 20 bp, Artificial
  CRISPR gRNA sequence
agggactccggtgacagcca

SEQ ID NO: 359119 - DNA, 20 bp, Artificial
  CRISPR gRNA sequence
gagttttcttttccaccctg

SEQ ID NO: 359120 - DNA, 20 bp, Artificial
  CRISPR gRNA sequence
ttttcttttccaccctgcag

SEQ ID NO: 359121 - DNA, 20 bp, Artificial
  CRISPR gRNA sequence
tttcttttccaccctgcagc

SEQ ID NO: 359122 - DNA, 20 bp, Artificial
  CRISPR gRNA sequence
ttcttttccaccctgcagca

SEQ ID NO: 359123 - DNA, 20 bp, Artificial
  CRISPR gRNA sequence
ttttccaccctgcagcaggg

SEQ ID NO: 359124 - DNA, 20 bp, Artificial
  CRISPR gRNA sequence
tttccaccctgcagcagggc

SEQ ID NO: 359125 - DNA, 20 bp, Artificial
  CRISPR gRNA sequence
cctgcagcagggcaggatct

SEQ ID NO: 359126 - DNA, 20 bp, Artificial
  CRISPR gRNA sequence
tgcagcagggcaggatctca

SEQ ID NO: 359127 - DNA, 20 bp, Artificial
  CRISPR gRNA sequence
gcagcagggcaggatctcag

SEQ ID NO: 359128 - DNA, 20 bp, Artificial
  CRISPR gRNA sequence
caggatctcagaggcaacat

SEQ ID NO: 359129 - DNA, 20 bp, Artificial
  CRISPR gRNA sequence
tcagaggcaacatcagctcc

SEQ ID NO: 359130 - DNA, 20 bp, Artificial
  CRISPR gRNA sequence
cagaggcaacatcagctcca

SEQ ID NO: 359131 - DNA, 20 bp, Artificial
  CRISPR gRNA sequence
tccaaggatgcctctgctcc

SEQ ID NO: 359132 - DNA, 20 bp, Artificial
  CRISPR gRNA sequence
aggatgcctctgctcctaga

SEQ ID NO: 359133 - DNA, 20 bp, Artificial
  CRISPR gRNA sequence
gatgccttaactcttataat

SEQ ID NO: 359134 - DNA, 20 bp, Artificial
  CRISPR gRNA sequence
catataaaattttcaattcc

SEQ ID NO: 359135 - DNA, 20 bp, Artificial
  CRISPR gRNA sequence
ataaaattttcaattcccgg

SEQ ID NO: 359136 - DNA, 20 bp, Artificial
  CRISPR gRNA sequence
taaaattttcaattcccggc

SEQ ID NO: 359137 - DNA, 20 bp, Artificial
  CRISPR gRNA sequence
cccggcaggcaccaacacat

SEQ ID NO: 359138 - DNA, 20 bp, Artificial
  CRISPR gRNA sequence
attagtgtgaaattgtccat

SEQ ID NO: 359139 - DNA, 20 bp, Artificial
  CRISPR gRNA sequence
tgtccattagattgttttcc

SEQ ID NO: 359140 - DNA, 20 bp, Artificial
  CRISPR gRNA sequence
ccattagattgttttccaag

SEQ ID NO: 359141 - DNA, 20 bp, Artificial
  CRISPR gRNA sequence
tagattgttttccaagtaga

SEQ ID NO: 359142 - DNA, 20 bp, Artificial
  CRISPR gRNA sequence
ttgttttccaagtagaaagc

SEQ ID NO: 359143 - DNA, 20 bp, Artificial
  CRISPR gRNA sequence
tgttttccaagtagaaagca

SEQ ID NO: 359144 - DNA, 20 bp, Artificial
  CRISPR gRNA sequence
tttccaagtagaaagcaagg

SEQ ID NO: 359145 - DNA, 20 bp, Artificial
  CRISPR gRNA sequence
agcaaggaagatgtttccca

SEQ ID NO: 359146 - DNA, 20 bp, Artificial
  CRISPR gRNA sequence
gcaaggaagatgtttcccac

SEQ ID NO: 359147 - DNA, 20 bp, Artificial
  CRISPR gRNA sequence
aaggaagatgtttcccacag

SEQ ID NO: 359148 - DNA, 20 bp, Artificial
  CRISPR gRNA sequence
ggaagatgtttcccacagga

SEQ ID NO: 359149 - DNA, 20 bp, Artificial
  CRISPR gRNA sequence
agatgtttcccacaggagag

SEQ ID NO: 359150 - DNA, 20 bp, Artificial
  CRISPR gRNA sequence
gtttcccacaggagagtggc

SEQ ID NO: 359151 - DNA, 20 bp, Artificial
  CRISPR gRNA sequence
cacaggagagtggccagcaa

SEQ ID NO: 359152 - DNA, 20 bp, Artificial
  CRISPR gRNA sequence
ggccagcaatagacttgctg

SEQ ID NO: 359153 - DNA, 20 bp, Artificial
  CRISPR gRNA sequence
gcaatagacttgctgtggca

SEQ ID NO: 359154 - DNA, 20 bp, Artificial
  CRISPR gRNA sequence
caatagacttgctgtggcaa

SEQ ID NO: 359155 - DNA, 20 bp, Artificial
  CRISPR gRNA sequence
atagacttgctgtggcaaag

SEQ ID NO: 359156 - DNA, 20 bp, Artificial
  CRISPR gRNA sequence
agacttgctgtggcaaagga

SEQ ID NO: 359157 - DNA, 20 bp, Artificial
  CRISPR gRNA sequence
acttgctgtggcaaaggaga

SEQ ID NO: 359158 - DNA, 20 bp, Artificial
  CRISPR gRNA sequence
ttgctgtggcaaaggagaga

SEQ ID NO: 359159 - DNA, 20 bp, Artificial
  CRISPR gRNA sequence
tgctgtggcaaaggagagag

SEQ ID NO: 359160 - DNA, 20 bp, Artificial
  CRISPR gRNA sequence
ctgtggcaaaggagagagag

SEQ ID NO: 359161 - DNA, 20 bp, Artificial
  CRISPR gRNA sequence
gtggcaaaggagagagagga

SEQ ID NO: 359162 - DNA, 20 bp, Artificial
  CRISPR gRNA sequence
aaaggagagagaggagagcc

SEQ ID NO: 359163 - DNA, 20 bp, Artificial
  CRISPR gRNA sequence
gagagaggagagcccagaac

SEQ ID NO: 359164 - DNA, 20 bp, Artificial
  CRISPR gRNA sequence
gaactagccttgtccctgcc

SEQ ID NO: 359165 - DNA, 20 bp, Artificial
  CRISPR gRNA sequence
aactagccttgtccctgcca

SEQ ID NO: 359166 - DNA, 20 bp, Artificial
  CRISPR gRNA sequence
agccttgtccctgccaaggt

SEQ ID NO: 359167 - DNA, 20 bp, Artificial
  CRISPR gRNA sequence
ctgccaaggtgagtgcaccg

SEQ ID NO: 359168 - DNA, 20 bp, Artificial
  CRISPR gRNA sequence
tgccaaggtgagtgcaccgc

SEQ ID NO: 359169 - DNA, 20 bp, Artificial
  CRISPR gRNA sequence
gccaaggtgagtgcaccgcg

SEQ ID NO: 359170 - DNA, 20 bp, Artificial
  CRISPR gRNA sequence
aaggtgagtgcaccgcgggg

SEQ ID NO: 359171 - DNA, 20 bp, Artificial
  CRISPR gRNA sequence
ggtgagtgcaccgcggggca

SEQ ID NO: 359172 - DNA, 20 bp, Artificial
  CRISPR gRNA sequence
gtgagtgcaccgcggggcag

SEQ ID NO: 359173 - DNA, 20 bp, Artificial
  CRISPR gRNA sequence
tgagtgcaccgcggggcaga

SEQ ID NO: 359174 - DNA, 20 bp, Artificial
  CRISPR gRNA sequence
gtgcaccgcggggcagaggg

SEQ ID NO: 359175 - DNA, 20 bp, Artificial
  CRISPR gRNA sequence
gcaccgcggggcagagggca

SEQ ID NO: 359176 - DNA, 20 bp, Artificial
  CRISPR gRNA sequence
ccgcggggcagagggcagag

SEQ ID NO: 359177 - DNA, 20 bp, Artificial
  CRISPR gRNA sequence
cgcggggcagagggcagaga

SEQ ID NO: 359178 - DNA, 20 bp, Artificial
  CRISPR gRNA sequence
cggggcagagggcagagaag

SEQ ID NO: 359179 - DNA, 20 bp, Artificial
  CRISPR gRNA sequence
gggcagagggcagagaagga

SEQ ID NO: 359180 - DNA, 20 bp, Artificial
  CRISPR gRNA sequence
agagggcagagaaggagagt

SEQ ID NO: 359181 - DNA, 20 bp, Artificial
  CRISPR gRNA sequence
gggcagagaaggagagtgag

SEQ ID NO: 359182 - DNA, 20 bp, Artificial
  CRISPR gRNA sequence
cagagaaggagagtgagtgg

SEQ ID NO: 359183 - DNA, 20 bp, Artificial
  CRISPR gRNA sequence
aaggagagtgagtggaagtg

SEQ ID NO: 359184 - DNA, 20 bp, Artificial
  CRISPR gRNA sequence
aggagagtgagtggaagtgc

SEQ ID NO: 359185 - DNA, 20 bp, Artificial
  CRISPR gRNA sequence
agtgagtggaagtgcgggat

SEQ ID NO: 359186 - DNA, 20 bp, Artificial
  CRISPR gRNA sequence
gagtggaagtgcgggattgg

SEQ ID NO: 359187 - DNA, 20 bp, Artificial
  CRISPR gRNA sequence
agtggaagtgcgggattggt

SEQ ID NO: 359188 - DNA, 20 bp, Artificial
  CRISPR gRNA sequence
tggaagtgcgggattggtgg

SEQ ID NO: 359189 - DNA, 20 bp, Artificial
  CRISPR gRNA sequence
ggattggtgggagactcatg

SEQ ID NO: 359190 - DNA, 20 bp, Artificial
  CRISPR gRNA sequence
tggtgggagactcatgcaga

SEQ ID NO: 359191 - DNA, 20 bp, Artificial
  CRISPR gRNA sequence
gggagactcatgcagaaaga

SEQ ID NO: 359192 - DNA, 20 bp, Artificial
  CRISPR gRNA sequence
cagaaagatggactgcaaac

SEQ ID NO: 359193 - DNA, 20 bp, Artificial
  CRISPR gRNA sequence
gaaagatggactgcaaacca

SEQ ID NO: 359194 - DNA, 20 bp, Artificial
  CRISPR gRNA sequence
aaagatggactgcaaaccag

SEQ ID NO: 359195 - DNA, 20 bp, Artificial
  CRISPR gRNA sequence
gatggactgcaaaccagagg

SEQ ID NO: 359196 - DNA, 20 bp, Artificial
  CRISPR gRNA sequence
cattcattccttcatccaca

SEQ ID NO: 359197 - DNA, 20 bp, Artificial
  CRISPR gRNA sequence
ccttcatccacaaagattac

SEQ ID NO: 359198 - DNA, 20 bp, Artificial
  CRISPR gRNA sequence
cttcatccacaaagattact

SEQ ID NO: 359199 - DNA, 20 bp, Artificial
  CRISPR gRNA sequence
tactgggtgtaaataaaaca

SEQ ID NO: 359200 - DNA, 20 bp, Artificial
  CRISPR gRNA sequence
ggtgtaaataaaacacagac

SEQ ID NO: 359201 - DNA, 20 bp, Artificial
  CRISPR gRNA sequence
gtgtaaataaaacacagact

SEQ ID NO: 359202 - DNA, 20 bp, Artificial
  CRISPR gRNA sequence
aaataaaacacagactgggt

SEQ ID NO: 359203 - DNA, 20 bp, Artificial
  CRISPR gRNA sequence
aataaaacacagactgggtt

SEQ ID NO: 359204 - DNA, 20 bp, Artificial
  CRISPR gRNA sequence
ataaaacacagactgggtta

SEQ ID NO: 359205 - DNA, 20 bp, Artificial
  CRISPR gRNA sequence
taaaacacagactgggttag

SEQ ID NO: 359206 - DNA, 20 bp, Artificial
  CRISPR gRNA sequence
aaacacagactgggttaggg

SEQ ID NO: 359207 - DNA, 20 bp, Artificial
  CRISPR gRNA sequence
acacagactgggttagggga

SEQ ID NO: 359208 - DNA, 20 bp, Artificial
  CRISPR gRNA sequence
gggttaggggagagacacac

SEQ ID NO: 359209 - DNA, 20 bp, Artificial
  CRISPR gRNA sequence
ttaggggagagacacacaag

SEQ ID NO: 359210 - DNA, 20 bp, Artificial
  CRISPR gRNA sequence
aagcagataattgctgtaaa

SEQ ID NO: 359211 - DNA, 20 bp, Artificial
  CRISPR gRNA sequence
aattgctgtaaaaagacgat

SEQ ID NO: 359212 - DNA, 20 bp, Artificial
  CRISPR gRNA sequence
aaaagacgataagtcctcca

SEQ ID NO: 359213 - DNA, 20 bp, Artificial
  CRISPR gRNA sequence
gataagtcctccaaagaaca

SEQ ID NO: 359214 - DNA, 20 bp, Artificial
  CRISPR gRNA sequence
tccaaagaacaaagtgatga

SEQ ID NO: 359215 - DNA, 20 bp, Artificial
  CRISPR gRNA sequence
aacaaagtgatgaaagcaca

SEQ ID NO: 359216 - DNA, 20 bp, Artificial
  CRISPR gRNA sequence
caaagtgatgaaagcacaaa

SEQ ID NO: 359217 - DNA, 20 bp, Artificial
  CRISPR gRNA sequence
aagtgatgaaagcacaaaga

SEQ ID NO: 359218 - DNA, 20 bp, Artificial
  CRISPR gRNA sequence
gaaagcacaaagagagcctg

SEQ ID NO: 359219 - DNA, 20 bp, Artificial
  CRISPR gRNA sequence
gcctgtagaaattccccact

SEQ ID NO: 359220 - DNA, 20 bp, Artificial
  CRISPR gRNA sequence
cctgtagaaattccccactg

SEQ ID NO: 359221 - DNA, 20 bp, Artificial
  CRISPR gRNA sequence
attccccactgaggccctga

SEQ ID NO: 359222 - DNA, 20 bp, Artificial
  CRISPR gRNA sequence
tgaggccctgatggcatctg

SEQ ID NO: 359223 - DNA, 20 bp, Artificial
  CRISPR gRNA sequence
aggccctgatggcatctgca

SEQ ID NO: 359224 - DNA, 20 bp, Artificial
  CRISPR gRNA sequence
atggcatctgcagagaccca

SEQ ID NO: 359225 - DNA, 20 bp, Artificial
  CRISPR gRNA sequence
ggcatctgcagagacccaaa

SEQ ID NO: 359226 - DNA, 20 bp, Artificial
  CRISPR gRNA sequence
tctgcagagacccaaagaga

SEQ ID NO: 359227 - DNA, 20 bp, Artificial
  CRISPR gRNA sequence
tgcagagacccaaagagaca

SEQ ID NO: 359228 - DNA, 20 bp, Artificial
  CRISPR gRNA sequence
acccaaagagacagagctgt

SEQ ID NO: 359229 - DNA, 20 bp, Artificial
  CRISPR gRNA sequence
agagacagagctgtgagttt

SEQ ID NO: 359230 - DNA, 20 bp, Artificial
  CRISPR gRNA sequence
gacagagctgtgagtttcag

SEQ ID NO: 359231 - DNA, 20 bp, Artificial
  CRISPR gRNA sequence
agagctgtgagtttcagaag

SEQ ID NO: 359232 - DNA, 20 bp, Artificial
  CRISPR gRNA sequence
cagaagcagctattgcccga

SEQ ID NO: 359233 - DNA, 20 bp, Artificial
  CRISPR gRNA sequence
attgcccgacggtgctcacc

SEQ ID NO: 359234 - DNA, 20 bp, Artificial
  CRISPR gRNA sequence
ttgcccgacggtgctcacca

SEQ ID NO: 359235 - DNA, 20 bp, Artificial
  CRISPR gRNA sequence
gtgctcaccaaggtctgtca

SEQ ID NO: 359236 - DNA, 20 bp, Artificial
  CRISPR gRNA sequence
aagattctctcaccaaacac

SEQ ID NO: 359237 - DNA, 20 bp, Artificial
  CRISPR gRNA sequence
agattctctcaccaaacaca

SEQ ID NO: 359238 - DNA, 20 bp, Artificial
  CRISPR gRNA sequence
gattctctcaccaaacacaa

SEQ ID NO: 359239 - DNA, 20 bp, Artificial
  CRISPR gRNA sequence
ccaaacacaagggtatttgc

SEQ ID NO: 359240 - DNA, 20 bp, Artificial
  CRISPR gRNA sequence
aacacaagggtatttgccag

SEQ ID NO: 359241 - DNA, 20 bp, Artificial
  CRISPR gRNA sequence
ttgccagaagaaaatctatt

SEQ ID NO: 359242 - DNA, 20 bp, Artificial
  CRISPR gRNA sequence
tgccagaagaaaatctattt

SEQ ID NO: 359243 - DNA, 20 bp, Artificial
  CRISPR gRNA sequence
ctatttaggactccaaactt

SEQ ID NO: 359244 - DNA, 20 bp, Artificial
  CRISPR gRNA sequence
cttaagctgttcgattgcat

SEQ ID NO: 359245 - DNA, 20 bp, Artificial
  CRISPR gRNA sequence
ttgcataagtttgatgcctt

SEQ ID NO: 359246 - DNA, 20 bp, Artificial
  CRISPR gRNA sequence
gcataagtttgatgccttta

SEQ ID NO: 359247 - DNA, 20 bp, Artificial
  CRISPR gRNA sequence
tgcctttagagcatctactc

SEQ ID NO: 359248 - DNA, 20 bp, Artificial
  CRISPR gRNA sequence
gcctttagagcatctactcc

SEQ ID NO: 359249 - DNA, 20 bp, Artificial
  CRISPR gRNA sequence
ttctgaccatgtcactattt

SEQ ID NO: 359250 - DNA, 20 bp, Artificial
  CRISPR gRNA sequence
tctacttcattacatttctt

SEQ ID NO: 359251 - DNA, 20 bp, Artificial
  CRISPR gRNA sequence
ttacatttctttggtatttc

SEQ ID NO: 359252 - DNA, 20 bp, Artificial
  CRISPR gRNA sequence
atttctttggtatttccaga

SEQ ID NO: 359253 - DNA, 20 bp, Artificial
  CRISPR gRNA sequence
ggtatttccagatggctttg

SEQ ID NO: 359254 - DNA, 20 bp, Artificial
  CRISPR gRNA sequence
tatttccagatggctttgtg

SEQ ID NO: 359255 - DNA, 20 bp, Artificial
  CRISPR gRNA sequence
tggctttgtggagaacaaat

SEQ ID NO: 359256 - DNA, 20 bp, Artificial
  CRISPR gRNA sequence
atgacatatgaaaaatgact

SEQ ID NO: 359257 - DNA, 20 bp, Artificial
  CRISPR gRNA sequence
agaaccaactgatataatgt

SEQ ID NO: 359258 - DNA, 20 bp, Artificial
  CRISPR gRNA sequence
aactgatataatgttagaaa

SEQ ID NO: 359259 - DNA, 20 bp, Artificial
  CRISPR gRNA sequence
actgatataatgttagaaat

SEQ ID NO: 359260 - DNA, 20 bp, Artificial
  CRISPR gRNA sequence
aatgttagaaatgggaaacc

SEQ ID NO: 359261 - DNA, 20 bp, Artificial
  CRISPR gRNA sequence
agaaatgggaaaccaagaaa

SEQ ID NO: 359262 - DNA, 20 bp, Artificial
  CRISPR gRNA sequence
ctacacatactatatacgcc

SEQ ID NO: 359263 - DNA, 20 bp, Artificial
  CRISPR gRNA sequence
tttgacttccattgaaaaaa

SEQ ID NO: 359264 - DNA, 20 bp, Artificial
  CRISPR gRNA sequence
aaaaaagatgtaataaaatt

SEQ ID NO: 359265 - DNA, 20 bp, Artificial
  CRISPR gRNA sequence
attaagttaattctaaaact

SEQ ID NO: 359266 - DNA, 20 bp, Artificial
  CRISPR gRNA sequence
aagttttaaaacacactgct

SEQ ID NO: 359267 - DNA, 20 bp, Artificial
  CRISPR gRNA sequence
agttttaaaacacactgctc

SEQ ID NO: 359268 - DNA, 20 bp, Artificial
  CRISPR gRNA sequence
aaacacactgctcaggaaat

SEQ ID NO: 359269 - DNA, 20 bp, Artificial
  CRISPR gRNA sequence
acacactgctcaggaaatca

SEQ ID NO: 359270 - DNA, 20 bp, Artificial
  CRISPR gRNA sequence
cacactgctcaggaaatcag

SEQ ID NO: 359271 - DNA, 20 bp, Artificial
  CRISPR gRNA sequence
cagaggttcaccattgctaa

SEQ ID NO: 359272 - DNA, 20 bp, Artificial
  CRISPR gRNA sequence
attaaaattgctctgaaaat

SEQ ID NO: 359273 - DNA, 20 bp, Artificial
  CRISPR gRNA sequence
aaaattgctctgaaaattgg

SEQ ID NO: 359274 - DNA, 20 bp, Artificial
  CRISPR gRNA sequence
ataatttctgcaaatttctg

SEQ ID NO: 359275 - DNA, 20 bp, Artificial
  CRISPR gRNA sequence
taatttctgcaaatttctgc

SEQ ID NO: 359276 - DNA, 20 bp, Artificial
  CRISPR gRNA sequence
ctgcaaatttctgcaggcaa

SEQ ID NO: 359277 - DNA, 20 bp, Artificial
  CRISPR gRNA sequence
aaaagacatgacctatgaaa

SEQ ID NO: 359278 - DNA, 20 bp, Artificial
  CRISPR gRNA sequence
agacatgacctatgaaatag

SEQ ID NO: 359279 - DNA, 20 bp, Artificial
  CRISPR gRNA sequence
gaaatagaagccattttctg

SEQ ID NO: 359280 - DNA, 20 bp, Artificial
  CRISPR gRNA sequence
aaatagaagccattttctgt

SEQ ID NO: 359281 - DNA, 20 bp, Artificial
  CRISPR gRNA sequence
aatagaagccattttctgta

SEQ ID NO: 359282 - DNA, 20 bp, Artificial
  CRISPR gRNA sequence
gaagccattttctgtaggga

SEQ ID NO: 359283 - DNA, 20 bp, Artificial
  CRISPR gRNA sequence
aagccattttctgtagggaa

SEQ ID NO: 359284 - DNA, 20 bp, Artificial
  CRISPR gRNA sequence
gccattttctgtagggaaag

SEQ ID NO: 359285 - DNA, 20 bp, Artificial
  CRISPR gRNA sequence
ctgtagggaaaggagaacac

SEQ ID NO: 359286 - DNA, 20 bp, Artificial
  CRISPR gRNA sequence
tgtagggaaaggagaacaca

SEQ ID NO: 359287 - DNA, 20 bp, Artificial
  CRISPR gRNA sequence
aaggagaacacaaggtcctc

SEQ ID NO: 359288 - DNA, 20 bp, Artificial
  CRISPR gRNA sequence
caaggtcctctggtcttgct

SEQ ID NO: 359289 - DNA, 20 bp, Artificial
  CRISPR gRNA sequence
cagcgctgcaaaaatctcgt

SEQ ID NO: 359290 - DNA, 20 bp, Artificial
  CRISPR gRNA sequence
agcgctgcaaaaatctcgtc

SEQ ID NO: 359291 - DNA, 20 bp, Artificial
  CRISPR gRNA sequence
tgcaaaaatctcgtcaggaa

SEQ ID NO: 359292 - DNA, 20 bp, Artificial
  CRISPR gRNA sequence
aatctcgtcaggaatagcaa

SEQ ID NO: 359293 - DNA, 20 bp, Artificial
  CRISPR gRNA sequence
atctcgtcaggaatagcaac

SEQ ID NO: 359294 - DNA, 20 bp, Artificial
  CRISPR gRNA sequence
aggaatagcaacaggactca

SEQ ID NO: 359295 - DNA, 20 bp, Artificial
  CRISPR gRNA sequence
tagcaacaggactcaaagaa

SEQ ID NO: 359296 - DNA, 20 bp, Artificial
  CRISPR gRNA sequence
aaactaaaaattcaccctta

SEQ ID NO: 359297 - DNA, 20 bp, Artificial
  CRISPR gRNA sequence
tctcctgaaaatgtgaatat

SEQ ID NO: 359298 - DNA, 20 bp, Artificial
  CRISPR gRNA sequence
aatatgagccctattttgcc

SEQ ID NO: 359299 - DNA, 20 bp, Artificial
  CRISPR gRNA sequence
aaaatatttcacgctttaac

SEQ ID NO: 359300 - DNA, 20 bp, Artificial
  CRISPR gRNA sequence
tttcacgctttaactggccg

SEQ ID NO: 359301 - DNA, 20 bp, Artificial
  CRISPR gRNA sequence
ttcacgctttaactggccgc

SEQ ID NO: 359302 - DNA, 20 bp, Artificial
  CRISPR gRNA sequence
cgctttaactggccgcaggc

SEQ ID NO: 359303 - DNA, 20 bp, Artificial
  CRISPR gRNA sequence
ttaactggccgcaggcaaga

SEQ ID NO: 359304 - DNA, 20 bp, Artificial
  CRISPR gRNA sequence
taactggccgcaggcaagaa

SEQ ID NO: 359305 - DNA, 20 bp, Artificial
  CRISPR gRNA sequence
tggccgcaggcaagaaaggt

SEQ ID NO: 359306 - DNA, 20 bp, Artificial
  CRISPR gRNA sequence
ggccgcaggcaagaaaggtg

SEQ ID NO: 359307 - DNA, 20 bp, Artificial
  CRISPR gRNA sequence
caagaaaggtgaggatttct

SEQ ID NO: 359308 - DNA, 20 bp, Artificial
  CRISPR gRNA sequence
agaaaggtgaggatttcttg

SEQ ID NO: 359309 - DNA, 20 bp, Artificial
  CRISPR gRNA sequence
gaaaggtgaggatttcttgg

SEQ ID NO: 359310 - DNA, 20 bp, Artificial
  CRISPR gRNA sequence
aggatttcttggaggacttc

SEQ ID NO: 359311 - DNA, 20 bp, Artificial
  CRISPR gRNA sequence
tcttggaggacttcgagttt

SEQ ID NO: 359312 - DNA, 20 bp, Artificial
  CRISPR gRNA sequence
acaatattcacgttcgttgt

SEQ ID NO: 359313 - DNA, 20 bp, Artificial
  CRISPR gRNA sequence
caatattcacgttcgttgta

SEQ ID NO: 359314 - DNA, 20 bp, Artificial
  CRISPR gRNA sequence
aatattcacgttcgttgtaa

SEQ ID NO: 359315 - DNA, 20 bp, Artificial
  CRISPR gRNA sequence
acgttcgttgtaagggaaaa

SEQ ID NO: 359316 - DNA, 20 bp, Artificial
  CRISPR gRNA sequence
ggaaaatggcaaatgacgaa

SEQ ID NO: 359317 - DNA, 20 bp, Artificial
  CRISPR gRNA sequence
gaaaatggcaaatgacgaat

SEQ ID NO: 359318 - DNA, 20 bp, Artificial
  CRISPR gRNA sequence
aatggcaaatgacgaatggg

SEQ ID NO: 359319 - DNA, 20 bp, Artificial
  CRISPR gRNA sequence
tgacgaatgggaagaactga

SEQ ID NO: 359320 - DNA, 20 bp, Artificial
  CRISPR gRNA sequence
tgaaagatgaaatctttgct

SEQ ID NO: 359321 - DNA, 20 bp, Artificial
  CRISPR gRNA sequence
gaaagatgaaatctttgctt

SEQ ID NO: 359322 - DNA, 20 bp, Artificial
  CRISPR gRNA sequence
atctttgcttgggtttcgct

SEQ ID NO: 359323 - DNA, 20 bp, Artificial
  CRISPR gRNA sequence
cttgggtttcgctaagcaat

SEQ ID NO: 359324 - DNA, 20 bp, Artificial
  CRISPR gRNA sequence
gttccaaacaccctgcaatg

SEQ ID NO: 359325 - DNA, 20 bp, Artificial
  CRISPR gRNA sequence
ttccaaacaccctgcaatgc

SEQ ID NO: 359326 - DNA, 20 bp, Artificial
  CRISPR gRNA sequence
tccaaacaccctgcaatgca

SEQ ID NO: 359327 - DNA, 20 bp, Artificial
  CRISPR gRNA sequence
tgcagggaactccataaaaa

SEQ ID NO: 359328 - DNA, 20 bp, Artificial
  CRISPR gRNA sequence
cagggaactccataaaaatg

SEQ ID NO: 359329 - DNA, 20 bp, Artificial
  CRISPR gRNA sequence
ggaactccataaaaatggag

SEQ ID NO: 359330 - DNA, 20 bp, Artificial
  CRISPR gRNA sequence
gaactccataaaaatggagc

SEQ ID NO: 359331 - DNA, 20 bp, Artificial
  CRISPR gRNA sequence
actccataaaaatggagcag

SEQ ID NO: 359332 - DNA, 20 bp, Artificial
  CRISPR gRNA sequence
cataaaaatggagcaggagc

SEQ ID NO: 359333 - DNA, 20 bp, Artificial
  CRISPR gRNA sequence
ataaaaatggagcaggagcc

SEQ ID NO: 359334 - DNA, 20 bp, Artificial
  CRISPR gRNA sequence
agcaggagccgggcttgact

SEQ ID NO: 359335 - DNA, 20 bp, Artificial
  CRISPR gRNA sequence
ggagccgggcttgactcgga

SEQ ID NO: 359336 - DNA, 20 bp, Artificial
  CRISPR gRNA sequence
ccgggcttgactcggacagt

SEQ ID NO: 359337 - DNA, 20 bp, Artificial
  CRISPR gRNA sequence
ggcttgactcggacagtgag

SEQ ID NO: 359338 - DNA, 20 bp, Artificial
  CRISPR gRNA sequence
ggacagtgagcagatgctgt

SEQ ID NO: 359339 - DNA, 20 bp, Artificial
  CRISPR gRNA sequence
gacagtgagcagatgctgtc

SEQ ID NO: 359340 - DNA, 20 bp, Artificial
  CRISPR gRNA sequence
gcagatgctgtcaggctcta

SEQ ID NO: 359341 - DNA, 20 bp, Artificial
  CRISPR gRNA sequence
caggctctacggacacctcc

SEQ ID NO: 359342 - DNA, 20 bp, Artificial
  CRISPR gRNA sequence
aggctctacggacacctcct

SEQ ID NO: 359343 - DNA, 20 bp, Artificial
  CRISPR gRNA sequence
gggacctttctgccttcttg

SEQ ID NO: 359344 - DNA, 20 bp, Artificial
  CRISPR gRNA sequence
tctgccttcttgaagcaccc

SEQ ID NO: 359345 - DNA, 20 bp, Artificial
  CRISPR gRNA sequence
tgtgctctcttctcccctaa

SEQ ID NO: 359346 - DNA, 20 bp, Artificial
  CRISPR gRNA sequence
ctctcttctcccctaacagc

SEQ ID NO: 359347 - DNA, 20 bp, Artificial
  CRISPR gRNA sequence
acagccagcacctgccccgc

SEQ ID NO: 359348 - DNA, 20 bp, Artificial
  CRISPR gRNA sequence
cagccagcacctgccccgct

SEQ ID NO: 359349 - DNA, 20 bp, Artificial
  CRISPR gRNA sequence
cagcacctgccccgctaggt

SEQ ID NO: 359350 - DNA, 20 bp, Artificial
  CRISPR gRNA sequence
gcacctgccccgctaggttg

SEQ ID NO: 359351 - DNA, 20 bp, Artificial
  CRISPR gRNA sequence
cgctaggttggagcactgcc

SEQ ID NO: 359352 - DNA, 20 bp, Artificial
  CRISPR gRNA sequence
gctaggttggagcactgccc

SEQ ID NO: 359353 - DNA, 20 bp, Artificial
  CRISPR gRNA sequence
ctaggttggagcactgccca

SEQ ID NO: 359354 - DNA, 20 bp, Artificial
  CRISPR gRNA sequence
ggttggagcactgcccaggg

SEQ ID NO: 359355 - DNA, 20 bp, Artificial
  CRISPR gRNA sequence
ggagcactgcccagggtggc

SEQ ID NO: 359356 - DNA, 20 bp, Artificial
  CRISPR gRNA sequence
agcactgcccagggtggctg

SEQ ID NO: 359357 - DNA, 20 bp, Artificial
  CRISPR gRNA sequence
agggtggctggagcctgcct

SEQ ID NO: 359358 - DNA, 20 bp, Artificial
  CRISPR gRNA sequence
tgagaatgcacacactgatc

SEQ ID NO: 359359 - DNA, 20 bp, Artificial
  CRISPR gRNA sequence
gagaatgcacacactgatca

SEQ ID NO: 359360 - DNA, 20 bp, Artificial
  CRISPR gRNA sequence
agaatgcacacactgatcaa

SEQ ID NO: 359361 - DNA, 20 bp, Artificial
  CRISPR gRNA sequence
ctgatcaagggaccctgatc

SEQ ID NO: 359362 - DNA, 20 bp, Artificial
  CRISPR gRNA sequence
cctgatccagtgactgaccc

SEQ ID NO: 359363 - DNA, 20 bp, Artificial
  CRISPR gRNA sequence
gatccagtgactgaccctgg

SEQ ID NO: 359364 - DNA, 20 bp, Artificial
  CRISPR gRNA sequence
tccagtgactgaccctggta

SEQ ID NO: 359365 - DNA, 20 bp, Artificial
  CRISPR gRNA sequence
tagagtttgcttttcctgac

SEQ ID NO: 359366 - DNA, 20 bp, Artificial
  CRISPR gRNA sequence
agagtttgcttttcctgacc

SEQ ID NO: 359367 - DNA, 20 bp, Artificial
  CRISPR gRNA sequence
gtttgcttttcctgaccagg

SEQ ID NO: 359368 - DNA, 20 bp, Artificial
  CRISPR gRNA sequence
tcctgaccaggcagcttccc

SEQ ID NO: 359369 - DNA, 20 bp, Artificial
  CRISPR gRNA sequence
gcagcttccctagacttcgc

SEQ ID NO: 359370 - DNA, 20 bp, Artificial
  CRISPR gRNA sequence
gctggatcctgtgcccttgc

SEQ ID NO: 359371 - DNA, 20 bp, Artificial
  CRISPR gRNA sequence
ctctccttccctttccaatc

SEQ ID NO: 359372 - DNA, 20 bp, Artificial
  CRISPR gRNA sequence
ttccaatccagatcccctga

SEQ ID NO: 359373 - DNA, 20 bp, Artificial
  CRISPR gRNA sequence
tccaatccagatcccctgat

SEQ ID NO: 359374 - DNA, 20 bp, Artificial
  CRISPR gRNA sequence
tccctgcgaacacttcctaa

SEQ ID NO: 359375 - DNA, 20 bp, Artificial
  CRISPR gRNA sequence
ccctgcgaacacttcctaat

SEQ ID NO: 359376 - DNA, 20 bp, Artificial
  CRISPR gRNA sequence
tttcacatttatcctcttct

SEQ ID NO: 359377 - DNA, 20 bp, Artificial
  CRISPR gRNA sequence
ttcacatttatcctcttctc

SEQ ID NO: 359378 - DNA, 20 bp, Artificial
  CRISPR gRNA sequence
tcacatttatcctcttctca

SEQ ID NO: 359379 - DNA, 20 bp, Artificial
  CRISPR gRNA sequence
ctcttctcagggactgcttc

SEQ ID NO: 359380 - DNA, 20 bp, Artificial
  CRISPR gRNA sequence
cttctggtgaatgcaatcta

SEQ ID NO: 359381 - DNA, 20 bp, Artificial
  CRISPR gRNA sequence
tggtgaatgcaatctaaagc

SEQ ID NO: 359382 - DNA, 20 bp, Artificial
  CRISPR gRNA sequence
atctaaagcaagcacaattg

SEQ ID NO: 359383 - DNA, 20 bp, Artificial
  CRISPR gRNA sequence
gaactttactaaattgtact

SEQ ID NO: 359384 - DNA, 20 bp, Artificial
  CRISPR gRNA sequence
actttactaaattgtacttg

SEQ ID NO: 359385 - DNA, 20 bp, Artificial
  CRISPR gRNA sequence
actaaattgtacttggagcc

SEQ ID NO: 359386 - DNA, 20 bp, Artificial
  CRISPR gRNA sequence
cctagaatctaaatttccat

SEQ ID NO: 359387 - DNA, 20 bp, Artificial
  CRISPR gRNA sequence
taaatttccatcagtgtgcc

SEQ ID NO: 359388 - DNA, 20 bp, Artificial
  CRISPR gRNA sequence
tccatcagtgtgcctggaac

SEQ ID NO: 359389 - DNA, 20 bp, Artificial
  CRISPR gRNA sequence
tgtcttttttgtttgttttt

SEQ ID NO: 359390 - DNA, 20 bp, Artificial
  CRISPR gRNA sequence
ttttttgtttgtttttcaga

SEQ ID NO: 359391 - DNA, 20 bp, Artificial
  CRISPR gRNA sequence
ttttgtttgtttttcagatg

SEQ ID NO: 359392 - DNA, 20 bp, Artificial
  CRISPR gRNA sequence
tggagtcccactctgttgcc

SEQ ID NO: 359393 - DNA, 20 bp, Artificial
  CRISPR gRNA sequence
ggagtcccactctgttgccc

SEQ ID NO: 359394 - DNA, 20 bp, Artificial
  CRISPR gRNA sequence
tcccactctgttgcccaggc

SEQ ID NO: 359395 - DNA, 20 bp, Artificial
  CRISPR gRNA sequence
ccactctgttgcccaggctg

SEQ ID NO: 359396 - DNA, 20 bp, Artificial
  CRISPR gRNA sequence
ctgttgcccaggctggagtg

SEQ ID NO: 359397 - DNA, 20 bp, Artificial
  CRISPR gRNA sequence
cccaggctggagtgcagtga

SEQ ID NO: 359398 - DNA, 20 bp, Artificial
  CRISPR gRNA sequence
gcagtgatggtatcttgact

SEQ ID NO: 359399 - DNA, 20 bp, Artificial
  CRISPR gRNA sequence
tatcttgactcagcacctcc

SEQ ID NO: 359400 - DNA, 20 bp, Artificial
  CRISPR gRNA sequence
atcttgactcagcacctcct

SEQ ID NO: 359401 - DNA, 20 bp, Artificial
  CRISPR gRNA sequence
actcagcacctcctgggttc

SEQ ID NO: 359402 - DNA, 20 bp, Artificial
  CRISPR gRNA sequence
ttcaagcaattctgctgcct

SEQ ID NO: 359403 - DNA, 20 bp, Artificial
  CRISPR gRNA sequence
ttctgctgcctcagcctccc

SEQ ID NO: 359404 - DNA, 20 bp, Artificial
  CRISPR gRNA sequence
gcctcagcctcccgagtaac

SEQ ID NO: 359405 - DNA, 20 bp, Artificial
  CRISPR gRNA sequence
cctcagcctcccgagtaact

SEQ ID NO: 359406 - DNA, 20 bp, Artificial
  CRISPR gRNA sequence
ctcccgagtaactgggatta

SEQ ID NO: 359407 - DNA, 20 bp, Artificial
  CRISPR gRNA sequence
tcccgagtaactgggattac

SEQ ID NO: 359408 - DNA, 20 bp, Artificial
  CRISPR gRNA sequence
caggcacacaccaccatgcc

SEQ ID NO: 359409 - DNA, 20 bp, Artificial
  CRISPR gRNA sequence
agctaaattttttgtatttt

SEQ ID NO: 359410 - DNA, 20 bp, Artificial
  CRISPR gRNA sequence
taaattttttgtatttttag

SEQ ID NO: 359411 - DNA, 20 bp, Artificial
  CRISPR gRNA sequence
aattttttgtatttttagta

SEQ ID NO: 359412 - DNA, 20 bp, Artificial
  CRISPR gRNA sequence
ttttgtatttttagtagaga

SEQ ID NO: 359413 - DNA, 20 bp, Artificial
  CRISPR gRNA sequence
tttgtatttttagtagagat

SEQ ID NO: 359414 - DNA, 20 bp, Artificial
  CRISPR gRNA sequence
ttgtatttttagtagagatg

SEQ ID NO: 359415 - DNA, 20 bp, Artificial
  CRISPR gRNA sequence
gagatggggttttgccatgt

SEQ ID NO: 359416 - DNA, 20 bp, Artificial
  CRISPR gRNA sequence
tggggttttgccatgttggc

SEQ ID NO: 359417 - DNA, 20 bp, Artificial
  CRISPR gRNA sequence
ggggttttgccatgttggcc

SEQ ID NO: 359418 - DNA, 20 bp, Artificial
  CRISPR gRNA sequence
ttttgccatgttggccaggc

SEQ ID NO: 359419 - DNA, 20 bp, Artificial
  CRISPR gRNA sequence
ggtctcgaactcctgatctc

SEQ ID NO: 359420 - DNA, 20 bp, Artificial
  CRISPR gRNA sequence
ctcgaactcctgatctcaag

SEQ ID NO: 359421 - DNA, 20 bp, Artificial
  CRISPR gRNA sequence
ctcaagtggtccgcccacct

SEQ ID NO: 359422 - DNA, 20 bp, Artificial
  CRISPR gRNA sequence
ccgcccacctcggcctccca

SEQ ID NO: 359423 - DNA, 20 bp, Artificial
  CRISPR gRNA sequence
acctcggcctcccaaagtgc

SEQ ID NO: 359424 - DNA, 20 bp, Artificial
  CRISPR gRNA sequence
cctcggcctcccaaagtgct

SEQ ID NO: 359425 - DNA, 20 bp, Artificial
  CRISPR gRNA sequence
ctcccaaagtgctgggatta

SEQ ID NO: 359426 - DNA, 20 bp, Artificial
  CRISPR gRNA sequence
tcccaaagtgctgggattac

SEQ ID NO: 359427 - DNA, 20 bp, Artificial
  CRISPR gRNA sequence
caggtgtgtgccaccacacc

SEQ ID NO: 359428 - DNA, 20 bp, Artificial
  CRISPR gRNA sequence
tcttcttgataacatgacct

SEQ ID NO: 359429 - DNA, 20 bp, Artificial
  CRISPR gRNA sequence
agtcaatgaaatctctctca

SEQ ID NO: 359430 - DNA, 20 bp, Artificial
  CRISPR gRNA sequence
caatgaaatctctctcatag

SEQ ID NO: 359431 - DNA, 20 bp, Artificial
  CRISPR gRNA sequence
tgaaatctctctcatagaag

SEQ ID NO: 359432 - DNA, 20 bp, Artificial
  CRISPR gRNA sequence
aaatctctctcatagaagca

SEQ ID NO: 359433 - DNA, 20 bp, Artificial
  CRISPR gRNA sequence
aatctctctcatagaagcag

SEQ ID NO: 359434 - DNA, 20 bp, Artificial
  CRISPR gRNA sequence
atctctctcatagaagcaga

SEQ ID NO: 359435 - DNA, 20 bp, Artificial
  CRISPR gRNA sequence
tctctcatagaagcagaggg

SEQ ID NO: 359436 - DNA, 20 bp, Artificial
  CRISPR gRNA sequence
ctctcatagaagcagagggt

SEQ ID NO: 359437 - DNA, 20 bp, Artificial
  CRISPR gRNA sequence
catagaagcagagggtagga

SEQ ID NO: 359438 - DNA, 20 bp, Artificial
  CRISPR gRNA sequence
agagggtaggatggtgctta

SEQ ID NO: 359439 - DNA, 20 bp, Artificial
  CRISPR gRNA sequence
gggtaggatggtgcttacag

SEQ ID NO: 359440 - DNA, 20 bp, Artificial
  CRISPR gRNA sequence
aggatggtgcttacagtggc

SEQ ID NO: 359441 - DNA, 20 bp, Artificial
  CRISPR gRNA sequence
ggatggtgcttacagtggct

SEQ ID NO: 359442 - DNA, 20 bp, Artificial
  CRISPR gRNA sequence
gatggtgcttacagtggctg

SEQ ID NO: 359443 - DNA, 20 bp, Artificial
  CRISPR gRNA sequence
tgcttacagtggctggggat

SEQ ID NO: 359444 - DNA, 20 bp, Artificial
  CRISPR gRNA sequence
gcttacagtggctggggatt

SEQ ID NO: 359445 - DNA, 20 bp, Artificial
  CRISPR gRNA sequence
ttacagtggctggggattgg

SEQ ID NO: 359446 - DNA, 20 bp, Artificial
  CRISPR gRNA sequence
tggctggggattgggagaat

SEQ ID NO: 359447 - DNA, 20 bp, Artificial
  CRISPR gRNA sequence
ggctggggattgggagaatg

SEQ ID NO: 359448 - DNA, 20 bp, Artificial
  CRISPR gRNA sequence
gctggggattgggagaatga

SEQ ID NO: 359449 - DNA, 20 bp, Artificial
  CRISPR gRNA sequence
ctggggattgggagaatgag

SEQ ID NO: 359450 - DNA, 20 bp, Artificial
  CRISPR gRNA sequence
ttgggagaatgaggggataa

SEQ ID NO: 359451 - DNA, 20 bp, Artificial
  CRISPR gRNA sequence
agaatgaggggataacggtt

SEQ ID NO: 359452 - DNA, 20 bp, Artificial
  CRISPR gRNA sequence
aatgaggggataacggttaa

SEQ ID NO: 359453 - DNA, 20 bp, Artificial
  CRISPR gRNA sequence
atgaggggataacggttaag

SEQ ID NO: 359454 - DNA, 20 bp, Artificial
  CRISPR gRNA sequence
tgaggggataacggttaaga

SEQ ID NO: 359455 - DNA, 20 bp, Artificial
  CRISPR gRNA sequence
gttaagagggtacaaaacct

SEQ ID NO: 359456 - DNA, 20 bp, Artificial
  CRISPR gRNA sequence
agagggtacaaaacctcagt

SEQ ID NO: 359457 - DNA, 20 bp, Artificial
  CRISPR gRNA sequence
ggtacaaaacctcagtcaga

SEQ ID NO: 359458 - DNA, 20 bp, Artificial
  CRISPR gRNA sequence
acaaaacctcagtcagacag

SEQ ID NO: 359459 - DNA, 20 bp, Artificial
  CRISPR gRNA sequence
cctcagtcagacagaagaca

SEQ ID NO: 359460 - DNA, 20 bp, Artificial
  CRISPR gRNA sequence
ctcagtcagacagaagacat

SEQ ID NO: 359461 - DNA, 20 bp, Artificial
  CRISPR gRNA sequence
cataggattcttcctttttt

SEQ ID NO: 359462 - DNA, 20 bp, Artificial
  CRISPR gRNA sequence
cttttttgagctccgtcaca

SEQ ID NO: 359463 - DNA, 20 bp, Artificial
  CRISPR gRNA sequence
acagcttgatgcatataaat

SEQ ID NO: 359464 - DNA, 20 bp, Artificial
  CRISPR gRNA sequence
agcttgatgcatataaataa

SEQ ID NO: 359465 - DNA, 20 bp, Artificial
  CRISPR gRNA sequence
cttgatgcatataaataaga

SEQ ID NO: 359466 - DNA, 20 bp, Artificial
  CRISPR gRNA sequence
attgcccatttcaaaatttc

SEQ ID NO: 359467 - DNA, 20 bp, Artificial
  CRISPR gRNA sequence
tgcccatttcaaaatttcta

SEQ ID NO: 359468 - DNA, 20 bp, Artificial
  CRISPR gRNA sequence
cccatttcaaaatttctaga

SEQ ID NO: 359469 - DNA, 20 bp, Artificial
  CRISPR gRNA sequence
aaatattctcaccacaaaaa

SEQ ID NO: 359470 - DNA, 20 bp, Artificial
  CRISPR gRNA sequence
ttctcaccacaaaaaaagtt

SEQ ID NO: 359471 - DNA, 20 bp, Artificial
  CRISPR gRNA sequence
acaaaaaaagttaagtattt

SEQ ID NO: 359472 - DNA, 20 bp, Artificial
  CRISPR gRNA sequence
aaaaaaagttaagtatttga

SEQ ID NO: 359473 - DNA, 20 bp, Artificial
  CRISPR gRNA sequence
aaaaaagttaagtatttgag

SEQ ID NO: 359474 - DNA, 20 bp, Artificial
  CRISPR gRNA sequence
aagttaagtatttgagagga

SEQ ID NO: 359475 - DNA, 20 bp, Artificial
  CRISPR gRNA sequence
gagaggatggatacatgaac

SEQ ID NO: 359476 - DNA, 20 bp, Artificial
  CRISPR gRNA sequence
ttattacacattatatttat

SEQ ID NO: 359477 - DNA, 20 bp, Artificial
  CRISPR gRNA sequence
gtttgtaccctataaattta

SEQ ID NO: 359478 - DNA, 20 bp, Artificial
  CRISPR gRNA sequence
tctgtctttgactctctgtt

SEQ ID NO: 359479 - DNA, 20 bp, Artificial
  CRISPR gRNA sequence
tttggctctatcactctctc

SEQ ID NO: 359480 - DNA, 20 bp, Artificial
  CRISPR gRNA sequence
tctatcactctctcaagtcc

SEQ ID NO: 359481 - DNA, 20 bp, Artificial
  CRISPR gRNA sequence
agcttgacctatctctctcc

SEQ ID NO: 359482 - DNA, 20 bp, Artificial
  CRISPR gRNA sequence
gcttgacctatctctctccc

SEQ ID NO: 359483 - DNA, 20 bp, Artificial
  CRISPR gRNA sequence
tctctcccaggacttaccca

SEQ ID NO: 359484 - DNA, 20 bp, Artificial
  CRISPR gRNA sequence
acttacccacagtaatctct

SEQ ID NO: 359485 - DNA, 20 bp, Artificial
  CRISPR gRNA sequence
ctctcagccactgaatccta

SEQ ID NO: 359486 - DNA, 20 bp, Artificial
  CRISPR gRNA sequence
tttccacatttttgtgtaat

SEQ ID NO: 359487 - DNA, 20 bp, Artificial
  CRISPR gRNA sequence
ttgtgtaattggatataaca

SEQ ID NO: 359488 - DNA, 20 bp, Artificial
  CRISPR gRNA sequence
tgtcgtgttttctatttctg

SEQ ID NO: 359489 - DNA, 20 bp, Artificial
  CRISPR gRNA sequence
tggctatgtcttgcttttct

SEQ ID NO: 359490 - DNA, 20 bp, Artificial
  CRISPR gRNA sequence
ttgcttttctcagttatgcc

SEQ ID NO: 359491 - DNA, 20 bp, Artificial
  CRISPR gRNA sequence
ctcagttatgccaagctcct

SEQ ID NO: 359492 - DNA, 20 bp, Artificial
  CRISPR gRNA sequence
cagttatgccaagctccttg

SEQ ID NO: 359493 - DNA, 20 bp, Artificial
  CRISPR gRNA sequence
agttatgccaagctccttgg

SEQ ID NO: 359494 - DNA, 20 bp, Artificial
  CRISPR gRNA sequence
gttactccaccatgtttcaa

SEQ ID NO: 359495 - DNA, 20 bp, Artificial
  CRISPR gRNA sequence
accatgtttcaaaagcttgc

SEQ ID NO: 359496 - DNA, 20 bp, Artificial
  CRISPR gRNA sequence
aaaagcttgccagttaattg

SEQ ID NO: 359497 - DNA, 20 bp, Artificial
  CRISPR gRNA sequence
aaagcttgccagttaattgt

SEQ ID NO: 359498 - DNA, 20 bp, Artificial
  CRISPR gRNA sequence
aagcttgccagttaattgta

SEQ ID NO: 359499 - DNA, 20 bp, Artificial
  CRISPR gRNA sequence
aattgtactccttctaatct

SEQ ID NO: 359500 - DNA, 20 bp, Artificial
  CRISPR gRNA sequence
attgtactccttctaatctc

SEQ ID NO: 359501 - DNA, 20 bp, Artificial
  CRISPR gRNA sequence
tcaggaaaaaccttatataa

SEQ ID NO: 359502 - DNA, 20 bp, Artificial
  CRISPR gRNA sequence
atataatagcttgtacatat

SEQ ID NO: 359503 - DNA, 20 bp, Artificial
  CRISPR gRNA sequence
tggatgattaataaatactt

SEQ ID NO: 359504 - DNA, 20 bp, Artificial
  CRISPR gRNA sequence
gaattcatttactacatctg

SEQ ID NO: 359505 - DNA, 20 bp, Artificial
  CRISPR gRNA sequence
aattcatttactacatctgt

SEQ ID NO: 359506 - DNA, 20 bp, Artificial
  CRISPR gRNA sequence
ttcatttactacatctgtag

SEQ ID NO: 359507 - DNA, 20 bp, Artificial
  CRISPR gRNA sequence
ttactacatctgtaggagtt

SEQ ID NO: 359508 - DNA, 20 bp, Artificial
  CRISPR gRNA sequence
aggagttaagcacaatctca

SEQ ID NO: 359509 - DNA, 20 bp, Artificial
  CRISPR gRNA sequence
tctcaaagaaatctgcacaa

SEQ ID NO: 359510 - DNA, 20 bp, Artificial
  CRISPR gRNA sequence
aaagaaatctgcacaacagc

SEQ ID NO: 359511 - DNA, 20 bp, Artificial
  CRISPR gRNA sequence
cagcaagaatgactaacaca

SEQ ID NO: 359512 - DNA, 20 bp, Artificial
  CRISPR gRNA sequence
actaacacaaagatgatgaa

SEQ ID NO: 359513 - DNA, 20 bp, Artificial
  CRISPR gRNA sequence
gaacagtgttcttaaccaaa

SEQ ID NO: 359514 - DNA, 20 bp, Artificial
  CRISPR gRNA sequence
accaaacagaatgaaaattt

SEQ ID NO: 359515 - DNA, 20 bp, Artificial
  CRISPR gRNA sequence
cagaatgaaaatttgagata

SEQ ID NO: 359516 - DNA, 20 bp, Artificial
  CRISPR gRNA sequence
aaaatttgagatatggttat

SEQ ID NO: 359517 - DNA, 20 bp, Artificial
  CRISPR gRNA sequence
aatttgagatatggttatta

SEQ ID NO: 359518 - DNA, 20 bp, Artificial
  CRISPR gRNA sequence
atttgagatatggttattag

SEQ ID NO: 359519 - DNA, 20 bp, Artificial
  CRISPR gRNA sequence
cttccctacattttttcaac

SEQ ID NO: 359520 - DNA, 20 bp, Artificial
  CRISPR gRNA sequence
tttcaactggactattaaaa

SEQ ID NO: 359521 - DNA, 20 bp, Artificial
  CRISPR gRNA sequence
gtcaaaatgaactctaattg

SEQ ID NO: 359522 - DNA, 20 bp, Artificial
  CRISPR gRNA sequence
ctccaattcatattgcatca

SEQ ID NO: 359523 - DNA, 20 bp, Artificial
  CRISPR gRNA sequence
aactaacatataaatcttat

SEQ ID NO: 359524 - DNA, 20 bp, Artificial
  CRISPR gRNA sequence
actaacatataaatcttatc

SEQ ID NO: 359525 - DNA, 20 bp, Artificial
  CRISPR gRNA sequence
atataaatcttatcaggcta

SEQ ID NO: 359526 - DNA, 20 bp, Artificial
  CRISPR gRNA sequence
aggctacagctgtactttga

SEQ ID NO: 359527 - DNA, 20 bp, Artificial
  CRISPR gRNA sequence
ggctacagctgtactttgaa

SEQ ID NO: 359528 - DNA, 20 bp, Artificial
  CRISPR gRNA sequence
cagctgtactttgaaaggtt

SEQ ID NO: 359529 - DNA, 20 bp, Artificial
  CRISPR gRNA sequence
gacgtttcctattcctacta

SEQ ID NO: 359530 - DNA, 20 bp, Artificial
  CRISPR gRNA sequence
acgtttcctattcctactac

SEQ ID NO: 359531 - DNA, 20 bp, Artificial
  CRISPR gRNA sequence
cctattcctactacaggaca

SEQ ID NO: 359532 - DNA, 20 bp, Artificial
  CRISPR gRNA sequence
aggacaaagcacatgttctt

SEQ ID NO: 359533 - DNA, 20 bp, Artificial
  CRISPR gRNA sequence
tctccattctcatctcctac

SEQ ID NO: 359534 - DNA, 20 bp, Artificial
  CRISPR gRNA sequence
ctagaatctgccatatactc

SEQ ID NO: 359535 - DNA, 20 bp, Artificial
  CRISPR gRNA sequence
ccatatactccagtttcccc

SEQ ID NO: 359536 - DNA, 20 bp, Artificial
  CRISPR gRNA sequence
tcacctttatgatcttgcat

SEQ ID NO: 359537 - DNA, 20 bp, Artificial
  CRISPR gRNA sequence
gcatcagctatctcttcttc

SEQ ID NO: 359538 - DNA, 20 bp, Artificial
  CRISPR gRNA sequence
taatccttccacttcattcc

SEQ ID NO: 359539 - DNA, 20 bp, Artificial
  CRISPR gRNA sequence
tctgtgacatcacctatttc

SEQ ID NO: 359540 - DNA, 20 bp, Artificial
  CRISPR gRNA sequence
ctgtgacatcacctatttca

SEQ ID NO: 359541 - DNA, 20 bp, Artificial
  CRISPR gRNA sequence
tgacatcacctatttcaagg

SEQ ID NO: 359542 - DNA, 20 bp, Artificial
  CRISPR gRNA sequence
ttttcttactcatttcaaaa

SEQ ID NO: 359543 - DNA, 20 bp, Artificial
  CRISPR gRNA sequence
tttcttactcatttcaaaat

SEQ ID NO: 359544 - DNA, 20 bp, Artificial
  CRISPR gRNA sequence
tgtcatttacttcctgccct

SEQ ID NO: 359545 - DNA, 20 bp, Artificial
  CRISPR gRNA sequence
aagaaactatccactcctta

SEQ ID NO: 359546 - DNA, 20 bp, Artificial
  CRISPR gRNA sequence
ccttaaagacattgtacctt

SEQ ID NO: 359547 - DNA, 20 bp, Artificial
  CRISPR gRNA sequence
accttcagtatgtctaatct

SEQ ID NO: 359548 - DNA, 20 bp, Artificial
  CRISPR gRNA sequence
gtctaatcttagcaaaatgc

SEQ ID NO: 359549 - DNA, 20 bp, Artificial
  CRISPR gRNA sequence
tctaatcttagcaaaatgcc

SEQ ID NO: 359550 - DNA, 20 bp, Artificial
  CRISPR gRNA sequence
agcaaaatgccaggcacatt

SEQ ID NO: 359551 - DNA, 20 bp, Artificial
  CRISPR gRNA sequence
attaagtttcccaataattt

SEQ ID NO: 359552 - DNA, 20 bp, Artificial
  CRISPR gRNA sequence
ttaagtttcccaataatttt

SEQ ID NO: 359553 - DNA, 20 bp, Artificial
  CRISPR gRNA sequence
taagtttcccaataattttg

SEQ ID NO: 359554 - DNA, 20 bp, Artificial
  CRISPR gRNA sequence
aagtttcccaataattttgg

SEQ ID NO: 359555 - DNA, 20 bp, Artificial
  CRISPR gRNA sequence
agtttcccaataattttggg

SEQ ID NO: 359556 - DNA, 20 bp, Artificial
  CRISPR gRNA sequence
ataattttggggggactaca

SEQ ID NO: 359557 - DNA, 20 bp, Artificial
  CRISPR gRNA sequence
tttggggggactacatggat

SEQ ID NO: 359558 - DNA, 20 bp, Artificial
  CRISPR gRNA sequence
tggatgagaaaacatctcca

SEQ ID NO: 359559 - DNA, 20 bp, Artificial
  CRISPR gRNA sequence
aagatgatgtgttgtaaatt

SEQ ID NO: 359560 - DNA, 20 bp, Artificial
  CRISPR gRNA sequence
gtaaatttagtgaatgatac

SEQ ID NO: 359561 - DNA, 20 bp, Artificial
  CRISPR gRNA sequence
taaatttagtgaatgatacc

SEQ ID NO: 359562 - DNA, 20 bp, Artificial
  CRISPR gRNA sequence
agtgaatgataccaggaact

SEQ ID NO: 359563 - DNA, 20 bp, Artificial
  CRISPR gRNA sequence
tgaatgataccaggaactca

SEQ ID NO: 359564 - DNA, 20 bp, Artificial
  CRISPR gRNA sequence
gaactcagagcaatattttc

SEQ ID NO: 359565 - DNA, 20 bp, Artificial
  CRISPR gRNA sequence
cagagcaatattttccagtc

SEQ ID NO: 359566 - DNA, 20 bp, Artificial
  CRISPR gRNA sequence
agagcaatattttccagtcc

SEQ ID NO: 359567 - DNA, 20 bp, Artificial
  CRISPR gRNA sequence
ttccagtccaggccctacat

SEQ ID NO: 359568 - DNA, 20 bp, Artificial
  CRISPR gRNA sequence
gtccaggccctacatgagtt

SEQ ID NO: 359569 - DNA, 20 bp, Artificial
  CRISPR gRNA sequence
tccaggccctacatgagttt

SEQ ID NO: 359570 - DNA, 20 bp, Artificial
  CRISPR gRNA sequence
ccattcccacttctgccaaa

SEQ ID NO: 359571 - DNA, 20 bp, Artificial
  CRISPR gRNA sequence
ctgccaaatggaaacccaca

SEQ ID NO: 359572 - DNA, 20 bp, Artificial
  CRISPR gRNA sequence
ccaaatggaaacccacacag

SEQ ID NO: 359573 - DNA, 20 bp, Artificial
  CRISPR gRNA sequence
cacacagcagctttccctcc

SEQ ID NO: 359574 - DNA, 20 bp, Artificial
  CRISPR gRNA sequence
tcctggcaccactcacccct

SEQ ID NO: 359575 - DNA, 20 bp, Artificial
  CRISPR gRNA sequence
caccactcacccctgagcat

SEQ ID NO: 359576 - DNA, 20 bp, Artificial
  CRISPR gRNA sequence
actcacccctgagcatcagc

SEQ ID NO: 359577 - DNA, 20 bp, Artificial
  CRISPR gRNA sequence
cagccagcactgcaaattta

SEQ ID NO: 359578 - DNA, 20 bp, Artificial
  CRISPR gRNA sequence
gttttaataccaactctcca

SEQ ID NO: 359579 - DNA, 20 bp, Artificial
  CRISPR gRNA sequence
tttaataccaactctccaaa

SEQ ID NO: 359580 - DNA, 20 bp, Artificial
  CRISPR gRNA sequence
accaactctccaaagagctc

SEQ ID NO: 359581 - DNA, 20 bp, Artificial
  CRISPR gRNA sequence
ccaactctccaaagagctcc

SEQ ID NO: 359582 - DNA, 20 bp, Artificial
  CRISPR gRNA sequence
tccaggtgcttttcaaacca

SEQ ID NO: 359583 - DNA, 20 bp, Artificial
  CRISPR gRNA sequence
ggtgcttttcaaaccacaga

SEQ ID NO: 359584 - DNA, 20 bp, Artificial
  CRISPR gRNA sequence
tcaaaccacagaaagatcaa

SEQ ID NO: 359585 - DNA, 20 bp, Artificial
  CRISPR gRNA sequence
agtatttctcacaactccct

SEQ ID NO: 359586 - DNA, 20 bp, Artificial
  CRISPR gRNA sequence
gtatttctcacaactccctg

SEQ ID NO: 359587 - DNA, 20 bp, Artificial
  CRISPR gRNA sequence
tttctcacaactccctgagg

SEQ ID NO: 359588 - DNA, 20 bp, Artificial
  CRISPR gRNA sequence
ctcacaactccctgaggtag

SEQ ID NO: 359589 - DNA, 20 bp, Artificial
  CRISPR gRNA sequence
cacaactccctgaggtagaa

SEQ ID NO: 359590 - DNA, 20 bp, Artificial
  CRISPR gRNA sequence
acaactccctgaggtagaag

SEQ ID NO: 359591 - DNA, 20 bp, Artificial
  CRISPR gRNA sequence
tagaagaggctgaaattatt

SEQ ID NO: 359592 - DNA, 20 bp, Artificial
  CRISPR gRNA sequence
atttagttcaaaccataatg

SEQ ID NO: 359593 - DNA, 20 bp, Artificial
  CRISPR gRNA sequence
atataacaatattaaaaaac

SEQ ID NO: 359594 - DNA, 20 bp, Artificial
  CRISPR gRNA sequence
caatattaaaaaaccagtgt

SEQ ID NO: 359595 - DNA, 20 bp, Artificial
  CRISPR gRNA sequence
ttaaaaaaccagtgtgagta

SEQ ID NO: 359596 - DNA, 20 bp, Artificial
  CRISPR gRNA sequence
accagtgtgagtacagctat

SEQ ID NO: 359597 - DNA, 20 bp, Artificial
  CRISPR gRNA sequence
agtgtgagtacagctattag

SEQ ID NO: 359598 - DNA, 20 bp, Artificial
  CRISPR gRNA sequence
gtgtgagtacagctattagc

SEQ ID NO: 359599 - DNA, 20 bp, Artificial
  CRISPR gRNA sequence
tgtgagtacagctattagca

SEQ ID NO: 359600 - DNA, 20 bp, Artificial
  CRISPR gRNA sequence
agtacagctattagcaggga

SEQ ID NO: 359601 - DNA, 20 bp, Artificial
  CRISPR gRNA sequence
ttgtaatcatcacatcgatt

SEQ ID NO: 359602 - DNA, 20 bp, Artificial
  CRISPR gRNA sequence
atcatcacatcgattcagaa

SEQ ID NO: 359603 - DNA, 20 bp, Artificial
  CRISPR gRNA sequence
tcacatcgattcagaaaagc

SEQ ID NO: 359604 - DNA, 20 bp, Artificial
  CRISPR gRNA sequence
catcgattcagaaaagcaag

SEQ ID NO: 359605 - DNA, 20 bp, Artificial
  CRISPR gRNA sequence
attcagaaaagcaagtagcc

SEQ ID NO: 359606 - DNA, 20 bp, Artificial
  CRISPR gRNA sequence
agtagcccagaaaaaactaa

SEQ ID NO: 359607 - DNA, 20 bp, Artificial
  CRISPR gRNA sequence
gcccagaaaaaactaacagc

SEQ ID NO: 359608 - DNA, 20 bp, Artificial
  CRISPR gRNA sequence
ccagaaaaaactaacagcaa

SEQ ID NO: 359609 - DNA, 20 bp, Artificial
  CRISPR gRNA sequence
cagaaaaaactaacagcaag

SEQ ID NO: 359610 - DNA, 20 bp, Artificial
  CRISPR gRNA sequence
agaaaaaactaacagcaaga

SEQ ID NO: 359611 - DNA, 20 bp, Artificial
  CRISPR gRNA sequence
actaacagcaagagggaaac

SEQ ID NO: 359612 - DNA, 20 bp, Artificial
  CRISPR gRNA sequence
taacagcaagagggaaacaa

SEQ ID NO: 359613 - DNA, 20 bp, Artificial
  CRISPR gRNA sequence
gagggaaacaagagtgtcca

SEQ ID NO: 359614 - DNA, 20 bp, Artificial
  CRISPR gRNA sequence
agtgtccatggtatttattt

SEQ ID NO: 359615 - DNA, 20 bp, Artificial
  CRISPR gRNA sequence
tttggatttgcaatgaaatt

SEQ ID NO: 359616 - DNA, 20 bp, Artificial
  CRISPR gRNA sequence
ttggatttgcaatgaaattt

SEQ ID NO: 359617 - DNA, 20 bp, Artificial
  CRISPR gRNA sequence
gcaatgaaatttgggaatta

SEQ ID NO: 359618 - DNA, 20 bp, Artificial
  CRISPR gRNA sequence
caatgaaatttgggaattaa

SEQ ID NO: 359619 - DNA, 20 bp, Artificial
  CRISPR gRNA sequence
atgaaatttgggaattaaag

SEQ ID NO: 359620 - DNA, 20 bp, Artificial
  CRISPR gRNA sequence
gagataataatacatgtatt

SEQ ID NO: 359621 - DNA, 20 bp, Artificial
  CRISPR gRNA sequence
aatttgtgttctttatacgt

SEQ ID NO: 359622 - DNA, 20 bp, Artificial
  CRISPR gRNA sequence
tttgtgttctttatacgtca

SEQ ID NO: 359623 - DNA, 20 bp, Artificial
  CRISPR gRNA sequence
ttgtgttctttatacgtcag

SEQ ID NO: 359624 - DNA, 20 bp, Artificial
  CRISPR gRNA sequence
tacgcaacaataattctgta

SEQ ID NO: 359625 - DNA, 20 bp, Artificial
  CRISPR gRNA sequence
tgtaaagcattacatatgtg

SEQ ID NO: 359626 - DNA, 20 bp, Artificial
  CRISPR gRNA sequence
tatgtgaagatgactacacc

SEQ ID NO: 359627 - DNA, 20 bp, Artificial
  CRISPR gRNA sequence
aagatgactacaccaagcat

SEQ ID NO: 359628 - DNA, 20 bp, Artificial
  CRISPR gRNA sequence
acaccaagcattagttgaaa

SEQ ID NO: 359629 - DNA, 20 bp, Artificial
  CRISPR gRNA sequence
accaagcattagttgaaata

SEQ ID NO: 359630 - DNA, 20 bp, Artificial
  CRISPR gRNA sequence
ttagttgaaatagagaatat

SEQ ID NO: 359631 - DNA, 20 bp, Artificial
  CRISPR gRNA sequence
ttgaaatagagaatattgga

SEQ ID NO: 359632 - DNA, 20 bp, Artificial
  CRISPR gRNA sequence
ttggaaagaatctaaatgtc

SEQ ID NO: 359633 - DNA, 20 bp, Artificial
  CRISPR gRNA sequence
taaatgtccagaaacttaac

SEQ ID NO: 359634 - DNA, 20 bp, Artificial
  CRISPR gRNA sequence
aaatgtccagaaacttaaca

SEQ ID NO: 359635 - DNA, 20 bp, Artificial
  CRISPR gRNA sequence
tccagaaacttaacaaggtg

SEQ ID NO: 359636 - DNA, 20 bp, Artificial
  CRISPR gRNA sequence
aaggtgaagcaaatcatgaa

SEQ ID NO: 359637 - DNA, 20 bp, Artificial
  CRISPR gRNA sequence
gaagcaaatcatgaaaagta

SEQ ID NO: 359638 - DNA, 20 bp, Artificial
  CRISPR gRNA sequence
aaatcatgaaaagtaaagat

SEQ ID NO: 359639 - DNA, 20 bp, Artificial
  CRISPR gRNA sequence
aaaagtaaagatcagtctat

SEQ ID NO: 359640 - DNA, 20 bp, Artificial
  CRISPR gRNA sequence
aaagatcagtctatcagtat

SEQ ID NO: 359641 - DNA, 20 bp, Artificial
  CRISPR gRNA sequence
aatgcttatgacataatgta

SEQ ID NO: 359642 - DNA, 20 bp, Artificial
  CRISPR gRNA sequence
atgtatgtacactttgctaa

SEQ ID NO: 359643 - DNA, 20 bp, Artificial
  CRISPR gRNA sequence
atgtacactttgctaacagt

SEQ ID NO: 359644 - DNA, 20 bp, Artificial
  CRISPR gRNA sequence
aacatgtgtgtgctctgaat

SEQ ID NO: 359645 - DNA, 20 bp, Artificial
  CRISPR gRNA sequence
catgtgtgtgctctgaatga

SEQ ID NO: 359646 - DNA, 20 bp, Artificial
  CRISPR gRNA sequence
tgctctgaatgagagttgaa

SEQ ID NO: 359647 - DNA, 20 bp, Artificial
  CRISPR gRNA sequence
gctctgaatgagagttgaac

SEQ ID NO: 359648 - DNA, 20 bp, Artificial
  CRISPR gRNA sequence
aatgagagttgaacaggaaa

SEQ ID NO: 359649 - DNA, 20 bp, Artificial
  CRISPR gRNA sequence
atgagagttgaacaggaaac

SEQ ID NO: 359650 - DNA, 20 bp, Artificial
  CRISPR gRNA sequence
agagttgaacaggaaacggg

SEQ ID NO: 359651 - DNA, 20 bp, Artificial
  CRISPR gRNA sequence
agttgaacaggaaacgggaa

SEQ ID NO: 359652 - DNA, 20 bp, Artificial
  CRISPR gRNA sequence
gttgaacaggaaacgggaag

SEQ ID NO: 359653 - DNA, 20 bp, Artificial
  CRISPR gRNA sequence
gaaacgggaagaggaaacac

SEQ ID NO: 359654 - DNA, 20 bp, Artificial
  CRISPR gRNA sequence
gggaagaggaaacacaagaa

SEQ ID NO: 359655 - DNA, 20 bp, Artificial
  CRISPR gRNA sequence
aagaggaaacacaagaacgg

SEQ ID NO: 359656 - DNA, 20 bp, Artificial
  CRISPR gRNA sequence
aaatgttgttttgatactct

SEQ ID NO: 359657 - DNA, 20 bp, Artificial
  CRISPR gRNA sequence
atactcttggtgcactgtgt

SEQ ID NO: 359658 - DNA, 20 bp, Artificial
  CRISPR gRNA sequence
ctcttggtgcactgtgttag

SEQ ID NO: 359659 - DNA, 20 bp, Artificial
  CRISPR gRNA sequence
actgtgttagtagttttcta

SEQ ID NO: 359660 - DNA, 20 bp, Artificial
  CRISPR gRNA sequence
gtgttagtagttttctaaag

SEQ ID NO: 359661 - DNA, 20 bp, Artificial
  CRISPR gRNA sequence
tgttagtagttttctaaaga

SEQ ID NO: 359662 - DNA, 20 bp, Artificial
  CRISPR gRNA sequence
ttagtagttttctaaagaag

SEQ ID NO: 359663 - DNA, 20 bp, Artificial
  CRISPR gRNA sequence
tagtagttttctaaagaagg

SEQ ID NO: 359664 - DNA, 20 bp, Artificial
  CRISPR gRNA sequence
tagttttctaaagaaggagg

SEQ ID NO: 359665 - DNA, 20 bp, Artificial
  CRISPR gRNA sequence
aaagaaggaggcagccctgt

SEQ ID NO: 359666 - DNA, 20 bp, Artificial
  CRISPR gRNA sequence
aagaaggaggcagccctgtg

SEQ ID NO: 359667 - DNA, 20 bp, Artificial
  CRISPR gRNA sequence
aggaggcagccctgtgagga

SEQ ID NO: 359668 - DNA, 20 bp, Artificial
  CRISPR gRNA sequence
ggaggcagccctgtgaggat

SEQ ID NO: 359669 - DNA, 20 bp, Artificial
  CRISPR gRNA sequence
ctgtgaggatgggcacacct

SEQ ID NO: 359670 - DNA, 20 bp, Artificial
  CRISPR gRNA sequence
gtgaggatgggcacaccttg

SEQ ID NO: 359671 - DNA, 20 bp, Artificial
  CRISPR gRNA sequence
accttggagacttgcgtcca

SEQ ID NO: 359672 - DNA, 20 bp, Artificial
  CRISPR gRNA sequence
ggagacttgcgtccaaagac

SEQ ID NO: 359673 - DNA, 20 bp, Artificial
  CRISPR gRNA sequence
tgcgtccaaagactagaaca

SEQ ID NO: 359674 - DNA, 20 bp, Artificial
  CRISPR gRNA sequence
tccaaagactagaacacaga

SEQ ID NO: 359675 - DNA, 20 bp, Artificial
  CRISPR gRNA sequence
ccaaagactagaacacagaa

SEQ ID NO: 359676 - DNA, 20 bp, Artificial
  CRISPR gRNA sequence
aaagactagaacacagaaag

SEQ ID NO: 359677 - DNA, 20 bp, Artificial
  CRISPR gRNA sequence
tagaacacagaaaggagaaa

SEQ ID NO: 359678 - DNA, 20 bp, Artificial
  CRISPR gRNA sequence
agaacacagaaaggagaaat

SEQ ID NO: 359679 - DNA, 20 bp, Artificial
  CRISPR gRNA sequence
gaaataggaacttgacttca

SEQ ID NO: 359680 - DNA, 20 bp, Artificial
  CRISPR gRNA sequence
ataggaacttgacttcacag

SEQ ID NO: 359681 - DNA, 20 bp, Artificial
  CRISPR gRNA sequence
taggaacttgacttcacagt

SEQ ID NO: 359682 - DNA, 20 bp, Artificial
  CRISPR gRNA sequence
gacttcacagtgggaaaacg

SEQ ID NO: 359683 - DNA, 20 bp, Artificial
  CRISPR gRNA sequence
aacacaccttaaccacatga

SEQ ID NO: 359684 - DNA, 20 bp, Artificial
  CRISPR gRNA sequence
cacaccttaaccacatgatg

SEQ ID NO: 359685 - DNA, 20 bp, Artificial
  CRISPR gRNA sequence
catgatggagaccaacatct

SEQ ID NO: 359686 - DNA, 20 bp, Artificial
  CRISPR gRNA sequence
aacatctcagtgacgctgcg

SEQ ID NO: 359687 - DNA, 20 bp, Artificial
  CRISPR gRNA sequence
cagtgacgctgcgtggatat

SEQ ID NO: 359688 - DNA, 20 bp, Artificial
  CRISPR gRNA sequence
agtgacgctgcgtggatatg

SEQ ID NO: 359689 - DNA, 20 bp, Artificial
  CRISPR gRNA sequence
accccttgatatgatgtgat

SEQ ID NO: 359690 - DNA, 20 bp, Artificial
  CRISPR gRNA sequence
ccttgatatgatgtgatgag

SEQ ID NO: 359691 - DNA, 20 bp, Artificial
  CRISPR gRNA sequence
cttgatatgatgtgatgaga

SEQ ID NO: 359692 - DNA, 20 bp, Artificial
  CRISPR gRNA sequence
ttgatatgatgtgatgagaa

SEQ ID NO: 359693 - DNA, 20 bp, Artificial
  CRISPR gRNA sequence
tgatatgatgtgatgagaag

SEQ ID NO: 359694 - DNA, 20 bp, Artificial
  CRISPR gRNA sequence
tgagaaggggttcatgactc

SEQ ID NO: 359695 - DNA, 20 bp, Artificial
  CRISPR gRNA sequence
tttccaaaattccatattcc

SEQ ID NO: 359696 - DNA, 20 bp, Artificial
  CRISPR gRNA sequence
catattcccagtctaatcat

SEQ ID NO: 359697 - DNA, 20 bp, Artificial
  CRISPR gRNA sequence
tctaatcatgagtgaaacat

SEQ ID NO: 359698 - DNA, 20 bp, Artificial
  CRISPR gRNA sequence
aacatcagacaaaccctaat

SEQ ID NO: 359699 - DNA, 20 bp, Artificial
  CRISPR gRNA sequence
acatcagacaaaccctaatt

SEQ ID NO: 359700 - DNA, 20 bp, Artificial
  CRISPR gRNA sequence
atcagacaaaccctaattgg

SEQ ID NO: 359701 - DNA, 20 bp, Artificial
  CRISPR gRNA sequence
cctaattgggagatgctctg

SEQ ID NO: 359702 - DNA, 20 bp, Artificial
  CRISPR gRNA sequence
ctaattgggagatgctctgc

SEQ ID NO: 359703 - DNA, 20 bp, Artificial
  CRISPR gRNA sequence
ggagatgctctgcaggacac

SEQ ID NO: 359704 - DNA, 20 bp, Artificial
  CRISPR gRNA sequence
gagatgctctgcaggacact

SEQ ID NO: 359705 - DNA, 20 bp, Artificial
  CRISPR gRNA sequence
tgctctgcaggacactgggc

SEQ ID NO: 359706 - DNA, 20 bp, Artificial
  CRISPR gRNA sequence
gacactgggctagtattcct

SEQ ID NO: 359707 - DNA, 20 bp, Artificial
  CRISPR gRNA sequence
acactgggctagtattcctc

SEQ ID NO: 359708 - DNA, 20 bp, Artificial
  CRISPR gRNA sequence
ctagtattcctcaggcctca

SEQ ID NO: 359709 - DNA, 20 bp, Artificial
  CRISPR gRNA sequence
tagtattcctcaggcctcac

SEQ ID NO: 359710 - DNA, 20 bp, Artificial
  CRISPR gRNA sequence
agtattcctcaggcctcaca

SEQ ID NO: 359711 - DNA, 20 bp, Artificial
  CRISPR gRNA sequence
aggcctcacagggttgtgaa

SEQ ID NO: 359712 - DNA, 20 bp, Artificial
  CRISPR gRNA sequence
ctcacagggttgtgaaaagc

SEQ ID NO: 359713 - DNA, 20 bp, Artificial
  CRISPR gRNA sequence
tcacagggttgtgaaaagca

SEQ ID NO: 359714 - DNA, 20 bp, Artificial
  CRISPR gRNA sequence
acagggttgtgaaaagcaag

SEQ ID NO: 359715 - DNA, 20 bp, Artificial
  CRISPR gRNA sequence
agggttgtgaaaagcaagga

SEQ ID NO: 359716 - DNA, 20 bp, Artificial
  CRISPR gRNA sequence
ttgtgaaaagcaaggagaga

SEQ ID NO: 359717 - DNA, 20 bp, Artificial
  CRISPR gRNA sequence
aggagagatagaaactgtca

SEQ ID NO: 359718 - DNA, 20 bp, Artificial
  CRISPR gRNA sequence
agatagaaactgtcacagat

SEQ ID NO: 359719 - DNA, 20 bp, Artificial
  CRISPR gRNA sequence
atagaaactgtcacagatca

SEQ ID NO: 359720 - DNA, 20 bp, Artificial
  CRISPR gRNA sequence
tagaaactgtcacagatcag

SEQ ID NO: 359721 - DNA, 20 bp, Artificial
  CRISPR gRNA sequence
tgtcacagatcagaggaaac

SEQ ID NO: 359722 - DNA, 20 bp, Artificial
  CRISPR gRNA sequence
gtcacagatcagaggaaact

SEQ ID NO: 359723 - DNA, 20 bp, Artificial
  CRISPR gRNA sequence
tcacagatcagaggaaactg

SEQ ID NO: 359724 - DNA, 20 bp, Artificial
  CRISPR gRNA sequence
acagatcagaggaaactggg

SEQ ID NO: 359725 - DNA, 20 bp, Artificial
  CRISPR gRNA sequence
gatcagaggaaactggggag

SEQ ID NO: 359726 - DNA, 20 bp, Artificial
  CRISPR gRNA sequence
cagaggaaactggggagaag

SEQ ID NO: 359727 - DNA, 20 bp, Artificial
  CRISPR gRNA sequence
agtggcaactcaatgcaatg

SEQ ID NO: 359728 - DNA, 20 bp, Artificial
  CRISPR gRNA sequence
ggcaactcaatgcaatgtgg

SEQ ID NO: 359729 - DNA, 20 bp, Artificial
  CRISPR gRNA sequence
ctcaatgcaatgtggtggcc

SEQ ID NO: 359730 - DNA, 20 bp, Artificial
  CRISPR gRNA sequence
aatgcaatgtggtggcctgg

SEQ ID NO: 359731 - DNA, 20 bp, Artificial
  CRISPR gRNA sequence
tgcaatgtggtggcctggtg

SEQ ID NO: 359732 - DNA, 20 bp, Artificial
  CRISPR gRNA sequence
gcaatgtggtggcctggtgg

SEQ ID NO: 359733 - DNA, 20 bp, Artificial
  CRISPR gRNA sequence
aatgtggtggcctggtggag

SEQ ID NO: 359734 - DNA, 20 bp, Artificial
  CRISPR gRNA sequence
tggcctggtggaggagaccc

SEQ ID NO: 359735 - DNA, 20 bp, Artificial
  CRISPR gRNA sequence
ctggtggaggagaccctgga

SEQ ID NO: 359736 - DNA, 20 bp, Artificial
  CRISPR gRNA sequence
tggtggaggagaccctggaa

SEQ ID NO: 359737 - DNA, 20 bp, Artificial
  CRISPR gRNA sequence
ggaggagaccctggaaagga

SEQ ID NO: 359738 - DNA, 20 bp, Artificial
  CRISPR gRNA sequence
aggagaccctggaaaggaaa

SEQ ID NO: 359739 - DNA, 20 bp, Artificial
  CRISPR gRNA sequence
ggagaccctggaaaggaaag

SEQ ID NO: 359740 - DNA, 20 bp, Artificial
  CRISPR gRNA sequence
aggacaaaacataatcactt

SEQ ID NO: 359741 - DNA, 20 bp, Artificial
  CRISPR gRNA sequence
aatcactttggatccaaata

SEQ ID NO: 359742 - DNA, 20 bp, Artificial
  CRISPR gRNA sequence
ctttggatccaaataaagtc

SEQ ID NO: 359743 - DNA, 20 bp, Artificial
  CRISPR gRNA sequence
ttggatccaaataaagtcta

SEQ ID NO: 359744 - DNA, 20 bp, Artificial
  CRISPR gRNA sequence
tccaaataaagtctagagct

SEQ ID NO: 359745 - DNA, 20 bp, Artificial
  CRISPR gRNA sequence
aaagtctagagctgagttaa

SEQ ID NO: 359746 - DNA, 20 bp, Artificial
  CRISPR gRNA sequence
gtctagagctgagttaacgg

SEQ ID NO: 359747 - DNA, 20 bp, Artificial
  CRISPR gRNA sequence
ctgagttaacggtagtatac

SEQ ID NO: 359748 - DNA, 20 bp, Artificial
  CRISPR gRNA sequence
taacggtagtatactagttt

SEQ ID NO: 359749 - DNA, 20 bp, Artificial
  CRISPR gRNA sequence
tatactagtttcagtttctt

SEQ ID NO: 359750 - DNA, 20 bp, Artificial
  CRISPR gRNA sequence
caaacataccacaataatgt

SEQ ID NO: 359751 - DNA, 20 bp, Artificial
  CRISPR gRNA sequence
ataatgtgagatgttaacaa

SEQ ID NO: 359752 - DNA, 20 bp, Artificial
  CRISPR gRNA sequence
taatgtgagatgttaacaat

SEQ ID NO: 359753 - DNA, 20 bp, Artificial
  CRISPR gRNA sequence
aatgtgagatgttaacaatg

SEQ ID NO: 359754 - DNA, 20 bp, Artificial
  CRISPR gRNA sequence
atgtgagatgttaacaatgg

SEQ ID NO: 359755 - DNA, 20 bp, Artificial
  CRISPR gRNA sequence
gtgagatgttaacaatgggg

SEQ ID NO: 359756 - DNA, 20 bp, Artificial
  CRISPR gRNA sequence
atgttaacaatgggggagac

SEQ ID NO: 359757 - DNA, 20 bp, Artificial
  CRISPR gRNA sequence
aacaatgggggagactggat

SEQ ID NO: 359758 - DNA, 20 bp, Artificial
  CRISPR gRNA sequence
acaatgggggagactggata

SEQ ID NO: 359759 - DNA, 20 bp, Artificial
  CRISPR gRNA sequence
caatgggggagactggataa

SEQ ID NO: 359760 - DNA, 20 bp, Artificial
  CRISPR gRNA sequence
aatgggggagactggataag

SEQ ID NO: 359761 - DNA, 20 bp, Artificial
  CRISPR gRNA sequence
gagactggataaggggtata

SEQ ID NO: 359762 - DNA, 20 bp, Artificial
  CRISPR gRNA sequence
tatatggaaactatctgtac

SEQ ID NO: 359763 - DNA, 20 bp, Artificial
  CRISPR gRNA sequence
taaaaatattctaaaattta

SEQ ID NO: 359764 - DNA, 20 bp, Artificial
  CRISPR gRNA sequence
ttctaaaatttaaagattat

SEQ ID NO: 359765 - DNA, 20 bp, Artificial
  CRISPR gRNA sequence
taaaatttaaagattattag

SEQ ID NO: 359766 - DNA, 20 bp, Artificial
  CRISPR gRNA sequence
aaaatttaaagattattaga

SEQ ID NO: 359767 - DNA, 20 bp, Artificial
  CRISPR gRNA sequence
aaatttaaagattattagaa

SEQ ID NO: 359768 - DNA, 20 bp, Artificial
  CRISPR gRNA sequence
ttaaagattattagaagggt

SEQ ID NO: 359769 - DNA, 20 bp, Artificial
  CRISPR gRNA sequence
aaagattattagaagggtaa

SEQ ID NO: 359770 - DNA, 20 bp, Artificial
  CRISPR gRNA sequence
aagattattagaagggtaag

SEQ ID NO: 359771 - DNA, 20 bp, Artificial
  CRISPR gRNA sequence
agattattagaagggtaaga

SEQ ID NO: 359772 - DNA, 20 bp, Artificial
  CRISPR gRNA sequence
tattagaagggtaagagggc

SEQ ID NO: 359773 - DNA, 20 bp, Artificial
  CRISPR gRNA sequence
aagggtaagagggccagatt

SEQ ID NO: 359774 - DNA, 20 bp, Artificial
  CRISPR gRNA sequence
agggtaagagggccagattt

SEQ ID NO: 359775 - DNA, 20 bp, Artificial
  CRISPR gRNA sequence
ggtaagagggccagatttgg

SEQ ID NO: 359776 - DNA, 20 bp, Artificial
  CRISPR gRNA sequence
ccagatttgggagtctataa

SEQ ID NO: 359777 - DNA, 20 bp, Artificial
  CRISPR gRNA sequence
tttgggagtctataaaagaa

SEQ ID NO: 359778 - DNA, 20 bp, Artificial
  CRISPR gRNA sequence
ctataaaagaaaagaaacac

SEQ ID NO: 359779 - DNA, 20 bp, Artificial
  CRISPR gRNA sequence
aaaagaaaagaaacacaaga

SEQ ID NO: 359780 - DNA, 20 bp, Artificial
  CRISPR gRNA sequence
gaaaagaaacacaagacaga

SEQ ID NO: 359781 - DNA, 20 bp, Artificial
  CRISPR gRNA sequence
aagaaacacaagacagatgg

SEQ ID NO: 359782 - DNA, 20 bp, Artificial
  CRISPR gRNA sequence
gaaacacaagacagatggta

SEQ ID NO: 359783 - DNA, 20 bp, Artificial
  CRISPR gRNA sequence
acacaagacagatggtagag

SEQ ID NO: 359784 - DNA, 20 bp, Artificial
  CRISPR gRNA sequence
caagacagatggtagagcag

SEQ ID NO: 359785 - DNA, 20 bp, Artificial
  CRISPR gRNA sequence
aagacagatggtagagcaga

SEQ ID NO: 359786 - DNA, 20 bp, Artificial
  CRISPR gRNA sequence
tgtttttgcaacaccatctt

SEQ ID NO: 359787 - DNA, 20 bp, Artificial
  CRISPR gRNA sequence
ttttgcaacaccatcttgag

SEQ ID NO: 359788 - DNA, 20 bp, Artificial
  CRISPR gRNA sequence
aacaccatcttgagtggtac

SEQ ID NO: 359789 - DNA, 20 bp, Artificial
  CRISPR gRNA sequence
acaccatcttgagtggtaca

SEQ ID NO: 359790 - DNA, 20 bp, Artificial
  CRISPR gRNA sequence
tcttgagtggtacaaggcaa

SEQ ID NO: 359791 - DNA, 20 bp, Artificial
  CRISPR gRNA sequence
ttgagtggtacaaggcaatg

SEQ ID NO: 359792 - DNA, 20 bp, Artificial
  CRISPR gRNA sequence
ggcaatggagtaaacaccac

SEQ ID NO: 359793 - DNA, 20 bp, Artificial
  CRISPR gRNA sequence
gagtaaacaccacaagacgc

SEQ ID NO: 359794 - DNA, 20 bp, Artificial
  CRISPR gRNA sequence
agtaaacaccacaagacgct

SEQ ID NO: 359795 - DNA, 20 bp, Artificial
  CRISPR gRNA sequence
aagacgctgggactacactg

SEQ ID NO: 359796 - DNA, 20 bp, Artificial
  CRISPR gRNA sequence
cgctgggactacactgcagt

SEQ ID NO: 359797 - DNA, 20 bp, Artificial
  CRISPR gRNA sequence
gggactacactgcagtcggt

SEQ ID NO: 359798 - DNA, 20 bp, Artificial
  CRISPR gRNA sequence
ggactacactgcagtcggtt

SEQ ID NO: 359799 - DNA, 20 bp, Artificial
  CRISPR gRNA sequence
tacactgcagtcggttagga

SEQ ID NO: 359800 - DNA, 20 bp, Artificial
  CRISPR gRNA sequence
cactgcagtcggttaggaaa

SEQ ID NO: 359801 - DNA, 20 bp, Artificial
  CRISPR gRNA sequence
actgcagtcggttaggaaag

SEQ ID NO: 359802 - DNA, 20 bp, Artificial
  CRISPR gRNA sequence
taggaaagaggaataataat

SEQ ID NO: 359803 - DNA, 20 bp, Artificial
  CRISPR gRNA sequence
ggaataataatgagttctca

SEQ ID NO: 359804 - DNA, 20 bp, Artificial
  CRISPR gRNA sequence
gaataataatgagttctcat

SEQ ID NO: 359805 - DNA, 20 bp, Artificial
  CRISPR gRNA sequence
taataatgagttctcatggg

SEQ ID NO: 359806 - DNA, 20 bp, Artificial
  CRISPR gRNA sequence
gagttctcatgggtggaacc

SEQ ID NO: 359807 - DNA, 20 bp, Artificial
  CRISPR gRNA sequence
agttctcatgggtggaaccg

SEQ ID NO: 359808 - DNA, 20 bp, Artificial
  CRISPR gRNA sequence
ggtggaaccgaggccataaa

SEQ ID NO: 359809 - DNA, 20 bp, Artificial
  CRISPR gRNA sequence
cgaggccataaatagcaaac

SEQ ID NO: 359810 - DNA, 20 bp, Artificial
  CRISPR gRNA sequence
gaggccataaatagcaaact

SEQ ID NO: 359811 - DNA, 20 bp, Artificial
  CRISPR gRNA sequence
ataaatagcaaactgggtgt

SEQ ID NO: 359812 - DNA, 20 bp, Artificial
  CRISPR gRNA sequence
tagcaaactgggtgttggcg

SEQ ID NO: 359813 - DNA, 20 bp, Artificial
  CRISPR gRNA sequence
aaactgggtgttggcgaagt

SEQ ID NO: 359814 - DNA, 20 bp, Artificial
  CRISPR gRNA sequence
tgggtgttggcgaagtgagt

SEQ ID NO: 359815 - DNA, 20 bp, Artificial
  CRISPR gRNA sequence
agtgagttagctcaacatac

SEQ ID NO: 359816 - DNA, 20 bp, Artificial
  CRISPR gRNA sequence
agctcaacatactggtgcac

SEQ ID NO: 359817 - DNA, 20 bp, Artificial
  CRISPR gRNA sequence
agaaacaatgttaattgaaa

SEQ ID NO: 359818 - DNA, 20 bp, Artificial
  CRISPR gRNA sequence
gaaatggtccaacattttgc

SEQ ID NO: 359819 - DNA, 20 bp, Artificial
  CRISPR gRNA sequence
ccaacattttgctagctaaa

SEQ ID NO: 359820 - DNA, 20 bp, Artificial
  CRISPR gRNA sequence
taaatttctctgtcttcctt

SEQ ID NO: 359821 - DNA, 20 bp, Artificial
  CRISPR gRNA sequence
tttctctgtcttccttgaga

SEQ ID NO: 359822 - DNA, 20 bp, Artificial
  CRISPR gRNA sequence
ttctctgtcttccttgagat

SEQ ID NO: 359823 - DNA, 20 bp, Artificial
  CRISPR gRNA sequence
tccttgagataggtccatgt

SEQ ID NO: 359824 - DNA, 20 bp, Artificial
  CRISPR gRNA sequence
aggtccatgttggcacatgt

SEQ ID NO: 359825 - DNA, 20 bp, Artificial
  CRISPR gRNA sequence
tgagttaatcttattttttg

SEQ ID NO: 359826 - DNA, 20 bp, Artificial
  CRISPR gRNA sequence
ttaatcttattttttgaagt

SEQ ID NO: 359827 - DNA, 20 bp, Artificial
  CRISPR gRNA sequence
gtgagtactgtcaaaaaact

SEQ ID NO: 359828 - DNA, 20 bp, Artificial
  CRISPR gRNA sequence
gagtactgtcaaaaaactca

SEQ ID NO: 359829 - DNA, 20 bp, Artificial
  CRISPR gRNA sequence
tactgtcaaaaaactcagag

SEQ ID NO: 359830 - DNA, 20 bp, Artificial
  CRISPR gRNA sequence
actgtcaaaaaactcagaga

SEQ ID NO: 359831 - DNA, 20 bp, Artificial
  CRISPR gRNA sequence
aaaaaactcagagaaggctt

SEQ ID NO: 359832 - DNA, 20 bp, Artificial
  CRISPR gRNA sequence
aaactcagagaaggcttcag

SEQ ID NO: 359833 - DNA, 20 bp, Artificial
  CRISPR gRNA sequence
cagagaaggcttcagtggaa

SEQ ID NO: 359834 - DNA, 20 bp, Artificial
  CRISPR gRNA sequence
agagaaggcttcagtggaac

SEQ ID NO: 359835 - DNA, 20 bp, Artificial
  CRISPR gRNA sequence
aggcttcagtggaacaggtt

SEQ ID NO: 359836 - DNA, 20 bp, Artificial
  CRISPR gRNA sequence
ggcttcagtggaacaggttt

SEQ ID NO: 359837 - DNA, 20 bp, Artificial
  CRISPR gRNA sequence
gcttcagtggaacaggtttg

SEQ ID NO: 359838 - DNA, 20 bp, Artificial
  CRISPR gRNA sequence
gtggaacaggtttggggtgc

SEQ ID NO: 359839 - DNA, 20 bp, Artificial
  CRISPR gRNA sequence
ggaacaggtttggggtgctg

SEQ ID NO: 359840 - DNA, 20 bp, Artificial
  CRISPR gRNA sequence
tggggtgctggagattgcca

SEQ ID NO: 359841 - DNA, 20 bp, Artificial
  CRISPR gRNA sequence
gggtgctggagattgccaca

SEQ ID NO: 359842 - DNA, 20 bp, Artificial
  CRISPR gRNA sequence
cagagccccatctttccctt

SEQ ID NO: 359843 - DNA, 20 bp, Artificial
  CRISPR gRNA sequence
agagccccatctttcccttg

SEQ ID NO: 359844 - DNA, 20 bp, Artificial
  CRISPR gRNA sequence
gccccatctttcccttgagg

SEQ ID NO: 359845 - DNA, 20 bp, Artificial
  CRISPR gRNA sequence
ccccatctttcccttgagga

SEQ ID NO: 359846 - DNA, 20 bp, Artificial
  CRISPR gRNA sequence
cccatctttcccttgaggaa

SEQ ID NO: 359847 - DNA, 20 bp, Artificial
  CRISPR gRNA sequence
tttcccttgaggaagggtaa

SEQ ID NO: 359848 - DNA, 20 bp, Artificial
  CRISPR gRNA sequence
tcccttgaggaagggtaata

SEQ ID NO: 359849 - DNA, 20 bp, Artificial
  CRISPR gRNA sequence
cttgaggaagggtaatagag

SEQ ID NO: 359850 - DNA, 20 bp, Artificial
  CRISPR gRNA sequence
ggaagggtaatagagtggat

SEQ ID NO: 359851 - DNA, 20 bp, Artificial
  CRISPR gRNA sequence
ggtaatagagtggattagca

SEQ ID NO: 359852 - DNA, 20 bp, Artificial
  CRISPR gRNA sequence
taatagagtggattagcaaa

SEQ ID NO: 359853 - DNA, 20 bp, Artificial
  CRISPR gRNA sequence
agcaaagagcaactgaacac

SEQ ID NO: 359854 - DNA, 20 bp, Artificial
  CRISPR gRNA sequence
aatgctgacatttatccaac

SEQ ID NO: 359855 - DNA, 20 bp, Artificial
  CRISPR gRNA sequence
atttatccaactagaatatt

SEQ ID NO: 359856 - DNA, 20 bp, Artificial
  CRISPR gRNA sequence
ctagaatattgagctattaa

SEQ ID NO: 359857 - DNA, 20 bp, Artificial
  CRISPR gRNA sequence
ttgagctattaaaagtctat

SEQ ID NO: 359858 - DNA, 20 bp, Artificial
  CRISPR gRNA sequence
ctattaaaagtctattagcc

SEQ ID NO: 359859 - DNA, 20 bp, Artificial
  CRISPR gRNA sequence
taaaagtctattagcctagc

SEQ ID NO: 359860 - DNA, 20 bp, Artificial
  CRISPR gRNA sequence
tctattagcctagcaagccc

SEQ ID NO: 359861 - DNA, 20 bp, Artificial
  CRISPR gRNA sequence
ctattagcctagcaagccct

SEQ ID NO: 359862 - DNA, 20 bp, Artificial
  CRISPR gRNA sequence
ggaactgccttcttcatttt

SEQ ID NO: 359863 - DNA, 20 bp, Artificial
  CRISPR gRNA sequence
actgccttcttcatttttgg

SEQ ID NO: 359864 - DNA, 20 bp, Artificial
  CRISPR gRNA sequence
ccttcttcatttttggaagt

SEQ ID NO: 359865 - DNA, 20 bp, Artificial
  CRISPR gRNA sequence
cttcttcatttttggaagtt

SEQ ID NO: 359866 - DNA, 20 bp, Artificial
  CRISPR gRNA sequence
aattgaaaataaaccctaaa

SEQ ID NO: 359867 - DNA, 20 bp, Artificial
  CRISPR gRNA sequence
attgctacaaaccacatatg

SEQ ID NO: 359868 - DNA, 20 bp, Artificial
  CRISPR gRNA sequence
tgctacaaaccacatatgaa

SEQ ID NO: 359869 - DNA, 20 bp, Artificial
  CRISPR gRNA sequence
acatatgaagagcgacctta

SEQ ID NO: 359870 - DNA, 20 bp, Artificial
  CRISPR gRNA sequence
gaccttaaagtccatgttca

SEQ ID NO: 359871 - DNA, 20 bp, Artificial
  CRISPR gRNA sequence
ccttaaagtccatgttcaca

SEQ ID NO: 359872 - DNA, 20 bp, Artificial
  CRISPR gRNA sequence
taaagtccatgttcacagag

SEQ ID NO: 359873 - DNA, 20 bp, Artificial
  CRISPR gRNA sequence
aaagtccatgttcacagagt

SEQ ID NO: 359874 - DNA, 20 bp, Artificial
  CRISPR gRNA sequence
cagagtgggcacaactgatg

SEQ ID NO: 359875 - DNA, 20 bp, Artificial
  CRISPR gRNA sequence
gtgggcacaactgatgcggc

SEQ ID NO: 359876 - DNA, 20 bp, Artificial
  CRISPR gRNA sequence
tgggcacaactgatgcggcc

SEQ ID NO: 359877 - DNA, 20 bp, Artificial
  CRISPR gRNA sequence
ctccacttcacccatccccg

SEQ ID NO: 359878 - DNA, 20 bp, Artificial
  CRISPR gRNA sequence
tccacttcacccatccccgc

SEQ ID NO: 359879 - DNA, 20 bp, Artificial
  CRISPR gRNA sequence
cttcacccatccccgcaggt

SEQ ID NO: 359880 - DNA, 20 bp, Artificial
  CRISPR gRNA sequence
gtcggcaatactcacacaca

SEQ ID NO: 359881 - DNA, 20 bp, Artificial
  CRISPR gRNA sequence
tcggcaatactcacacacac

SEQ ID NO: 359882 - DNA, 20 bp, Artificial
  CRISPR gRNA sequence
gggaatgctaacactcatat

SEQ ID NO: 359883 - DNA, 20 bp, Artificial
  CRISPR gRNA sequence
tgctaacactcatataagtt

SEQ ID NO: 359884 - DNA, 20 bp, Artificial
  CRISPR gRNA sequence
atacccaattcactcaaaat

SEQ ID NO: 359885 - DNA, 20 bp, Artificial
  CRISPR gRNA sequence
tacccaattcactcaaaatg

SEQ ID NO: 359886 - DNA, 20 bp, Artificial
  CRISPR gRNA sequence
caattcactcaaaatgaggc

SEQ ID NO: 359887 - DNA, 20 bp, Artificial
  CRISPR gRNA sequence
gaattctcaactctaatcca

SEQ ID NO: 359888 - DNA, 20 bp, Artificial
  CRISPR gRNA sequence
ctaatcacttgattaaaata

SEQ ID NO: 359889 - DNA, 20 bp, Artificial
  CRISPR gRNA sequence
aatcacttgattaaaataaa

SEQ ID NO: 359890 - DNA, 20 bp, Artificial
  CRISPR gRNA sequence
atcacttgattaaaataaag

SEQ ID NO: 359891 - DNA, 20 bp, Artificial
  CRISPR gRNA sequence
aaataaagaggtaaatactt

SEQ ID NO: 359892 - DNA, 20 bp, Artificial
  CRISPR gRNA sequence
attcttttctcaaaataaaa

SEQ ID NO: 359893 - DNA, 20 bp, Artificial
  CRISPR gRNA sequence
tgtgtgtgtgtattactaat

SEQ ID NO: 359894 - DNA, 20 bp, Artificial
  CRISPR gRNA sequence
actaataagcatactgaact

SEQ ID NO: 359895 - DNA, 20 bp, Artificial
  CRISPR gRNA sequence
taataagcatactgaactaa

SEQ ID NO: 359896 - DNA, 20 bp, Artificial
  CRISPR gRNA sequence
tatctcttaatcatatttct

SEQ ID NO: 359897 - DNA, 20 bp, Artificial
  CRISPR gRNA sequence
ttaatcatatttcttggctg

SEQ ID NO: 359898 - DNA, 20 bp, Artificial
  CRISPR gRNA sequence
tgtggacttaactttttgtt

SEQ ID NO: 359899 - DNA, 20 bp, Artificial
  CRISPR gRNA sequence
actttttgttcagctgaata

SEQ ID NO: 359900 - DNA, 20 bp, Artificial
  CRISPR gRNA sequence
ttctttttttattatacttt

SEQ ID NO: 359901 - DNA, 20 bp, Artificial
  CRISPR gRNA sequence
ttttattatactttaagttc

SEQ ID NO: 359902 - DNA, 20 bp, Artificial
  CRISPR gRNA sequence
tttattatactttaagttct

SEQ ID NO: 359903 - DNA, 20 bp, Artificial
  CRISPR gRNA sequence
ttattatactttaagttcta

SEQ ID NO: 359904 - DNA, 20 bp, Artificial
  CRISPR gRNA sequence
agggtacatgtgcacacgtg

SEQ ID NO: 359905 - DNA, 20 bp, Artificial
  CRISPR gRNA sequence
gggtacatgtgcacacgtgc

SEQ ID NO: 359906 - DNA, 20 bp, Artificial
  CRISPR gRNA sequence
gcaggtttgttacatatgta

SEQ ID NO: 359907 - DNA, 20 bp, Artificial
  CRISPR gRNA sequence
ttgttacatatgtatggtgc

SEQ ID NO: 359908 - DNA, 20 bp, Artificial
  CRISPR gRNA sequence
tgttacatatgtatggtgct

SEQ ID NO: 359909 - DNA, 20 bp, Artificial
  CRISPR gRNA sequence
atgtatggtgctgggaaaac

SEQ ID NO: 359910 - DNA, 20 bp, Artificial
  CRISPR gRNA sequence
atggtgctgggaaaactggc

SEQ ID NO: 359911 - DNA, 20 bp, Artificial
  CRISPR gRNA sequence
gaaaactggctagccatatg

SEQ ID NO: 359912 - DNA, 20 bp, Artificial
  CRISPR gRNA sequence
actggctagccatatgtaga

SEQ ID NO: 359913 - DNA, 20 bp, Artificial
  CRISPR gRNA sequence
catatgtagaaagctgaaac

SEQ ID NO: 359914 - DNA, 20 bp, Artificial
  CRISPR gRNA sequence
ccttatacaaaaattaattc

SEQ ID NO: 359915 - DNA, 20 bp, Artificial
  CRISPR gRNA sequence
atacaaaaattaattcaaga

SEQ ID NO: 359916 - DNA, 20 bp, Artificial
  CRISPR gRNA sequence
aattaattcaagatggatta

SEQ ID NO: 359917 - DNA, 20 bp, Artificial
  CRISPR gRNA sequence
tggattaaagacttaaatgt

SEQ ID NO: 359918 - DNA, 20 bp, Artificial
  CRISPR gRNA sequence
acctaaaaccataaaaaccc

SEQ ID NO: 359919 - DNA, 20 bp, Artificial
  CRISPR gRNA sequence
taaaaccataaaaaccctag

SEQ ID NO: 359920 - DNA, 20 bp, Artificial
  CRISPR gRNA sequence
aaaaaccctagaagaaaacc

SEQ ID NO: 359921 - DNA, 20 bp, Artificial
  CRISPR gRNA sequence
aaaaccctagaagaaaacct

SEQ ID NO: 359922 - DNA, 20 bp, Artificial
  CRISPR gRNA sequence
aaaacctaggcattaccatt

SEQ ID NO: 359923 - DNA, 20 bp, Artificial
  CRISPR gRNA sequence
aaacctaggcattaccattc

SEQ ID NO: 359924 - DNA, 20 bp, Artificial
  CRISPR gRNA sequence
aggcattaccattcaggaca

SEQ ID NO: 359925 - DNA, 20 bp, Artificial
  CRISPR gRNA sequence
ggcattaccattcaggacat

SEQ ID NO: 359926 - DNA, 20 bp, Artificial
  CRISPR gRNA sequence
taccattcaggacataggca

SEQ ID NO: 359927 - DNA, 20 bp, Artificial
  CRISPR gRNA sequence
accattcaggacataggcat

SEQ ID NO: 359928 - DNA, 20 bp, Artificial
  CRISPR gRNA sequence
ttcaggacataggcatgggc

SEQ ID NO: 359929 - DNA, 20 bp, Artificial
  CRISPR gRNA sequence
tcaggacataggcatgggca

SEQ ID NO: 359930 - DNA, 20 bp, Artificial
  CRISPR gRNA sequence
caggacataggcatgggcaa

SEQ ID NO: 359931 - DNA, 20 bp, Artificial
  CRISPR gRNA sequence
cttcatgcctaaaacaccaa

SEQ ID NO: 359932 - DNA, 20 bp, Artificial
  CRISPR gRNA sequence
gcctaaaacaccaaaagcaa

SEQ ID NO: 359933 - DNA, 20 bp, Artificial
  CRISPR gRNA sequence
accaaaagcaatggcaacaa

SEQ ID NO: 359934 - DNA, 20 bp, Artificial
  CRISPR gRNA sequence
agcaatggcaacaaaagtca

SEQ ID NO: 359935 - DNA, 20 bp, Artificial
  CRISPR gRNA sequence
ttcttcatttaaacataaaa

SEQ ID NO: 359936 - DNA, 20 bp, Artificial
  CRISPR gRNA sequence
catttaaacataaaatggtt

SEQ ID NO: 359937 - DNA, 20 bp, Artificial
  CRISPR gRNA sequence
aaaatggttgagccttctta

SEQ ID NO: 359938 - DNA, 20 bp, Artificial
  CRISPR gRNA sequence
aaatggttgagccttcttac

SEQ ID NO: 359939 - DNA, 20 bp, Artificial
  CRISPR gRNA sequence
tggttgagccttcttacagg

SEQ ID NO: 359940 - DNA, 20 bp, Artificial
  CRISPR gRNA sequence
gccttcttacaggaagaaat

SEQ ID NO: 359941 - DNA, 20 bp, Artificial
  CRISPR gRNA sequence
ggaagaaattagtgaaaacc

SEQ ID NO: 359942 - DNA, 20 bp, Artificial
  CRISPR gRNA sequence
gaagaaattagtgaaaaccc

SEQ ID NO: 359943 - DNA, 20 bp, Artificial
  CRISPR gRNA sequence
agaaattagtgaaaacccag

SEQ ID NO: 359944 - DNA, 20 bp, Artificial
  CRISPR gRNA sequence
aaatctgcaatgttgtcata

SEQ ID NO: 359945 - DNA, 20 bp, Artificial
  CRISPR gRNA sequence
ctgcaatgttgtcataaagt

SEQ ID NO: 359946 - DNA, 20 bp, Artificial
  CRISPR gRNA sequence
caatgttgtcataaagtgag

SEQ ID NO: 359947 - DNA, 20 bp, Artificial
  CRISPR gRNA sequence
ccacatatcttttccttcct

SEQ ID NO: 359948 - DNA, 20 bp, Artificial
  CRISPR gRNA sequence
tcttttccttcctgagttct

SEQ ID NO: 359949 - DNA, 20 bp, Artificial
  CRISPR gRNA sequence
ttccttcctgagttctgaga

SEQ ID NO: 359950 - DNA, 20 bp, Artificial
  CRISPR gRNA sequence
tccttcctgagttctgagaa

SEQ ID NO: 359951 - DNA, 20 bp, Artificial
  CRISPR gRNA sequence
ccttcctgagttctgagaaa

SEQ ID NO: 359952 - DNA, 20 bp, Artificial
  CRISPR gRNA sequence
gttctgagaaagggtataca

SEQ ID NO: 359953 - DNA, 20 bp, Artificial
  CRISPR gRNA sequence
tacaaagctctgtacatttt

SEQ ID NO: 359954 - DNA, 20 bp, Artificial
  CRISPR gRNA sequence
gctctgtacattttgagatt

SEQ ID NO: 359955 - DNA, 20 bp, Artificial
  CRISPR gRNA sequence
cattttgagattgagatgtc

SEQ ID NO: 359956 - DNA, 20 bp, Artificial
  CRISPR gRNA sequence
attttgagattgagatgtct

SEQ ID NO: 359957 - DNA, 20 bp, Artificial
  CRISPR gRNA sequence
tacaaaattctttaaatttt

SEQ ID NO: 359958 - DNA, 20 bp, Artificial
  CRISPR gRNA sequence
acataaaattcctctctact

SEQ ID NO: 359959 - DNA, 20 bp, Artificial
  CRISPR gRNA sequence
cataaaattcctctctactg

SEQ ID NO: 359960 - DNA, 20 bp, Artificial
  CRISPR gRNA sequence
ataaaattcctctctactga

SEQ ID NO: 359961 - DNA, 20 bp, Artificial
  CRISPR gRNA sequence
aattcctctctactgagggc

SEQ ID NO: 359962 - DNA, 20 bp, Artificial
  CRISPR gRNA sequence
aatgtcacctctgatttgct

SEQ ID NO: 359963 - DNA, 20 bp, Artificial
  CRISPR gRNA sequence
atgtcacctctgatttgctc

SEQ ID NO: 359964 - DNA, 20 bp, Artificial
  CRISPR gRNA sequence
tgtcacctctgatttgctca

SEQ ID NO: 359965 - DNA, 20 bp, Artificial
  CRISPR gRNA sequence
ctctgatttgctcagggatt

SEQ ID NO: 359966 - DNA, 20 bp, Artificial
  CRISPR gRNA sequence
tatatttcatgatctttatt

SEQ ID NO: 359967 - DNA, 20 bp, Artificial
  CRISPR gRNA sequence
tttcatgatctttattaaga

SEQ ID NO: 359968 - DNA, 20 bp, Artificial
  CRISPR gRNA sequence
taagaaagatgataataatc

SEQ ID NO: 359969 - DNA, 20 bp, Artificial
  CRISPR gRNA sequence
gatgataataatctagtctt

SEQ ID NO: 359970 - DNA, 20 bp, Artificial
  CRISPR gRNA sequence
atgataataatctagtcttt

SEQ ID NO: 359971 - DNA, 20 bp, Artificial
  CRISPR gRNA sequence
ggtctgattaataataataa

SEQ ID NO: 359972 - DNA, 20 bp, Artificial
  CRISPR gRNA sequence
attaataataataacagcta

SEQ ID NO: 359973 - DNA, 20 bp, Artificial
  CRISPR gRNA sequence
aataataacagctatagttt

SEQ ID NO: 359974 - DNA, 20 bp, Artificial
  CRISPR gRNA sequence
ataataacagctatagtttg

SEQ ID NO: 359975 - DNA, 20 bp, Artificial
  CRISPR gRNA sequence
tattcaatgctttgcatatg

SEQ ID NO: 359976 - DNA, 20 bp, Artificial
  CRISPR gRNA sequence
tcattttcacatttacaatt

SEQ ID NO: 359977 - DNA, 20 bp, Artificial
  CRISPR gRNA sequence
ttcacatttacaattcagtg

SEQ ID NO: 359978 - DNA, 20 bp, Artificial
  CRISPR gRNA sequence
atttacaattcagtgaagta

SEQ ID NO: 359979 - DNA, 20 bp, Artificial
  CRISPR gRNA sequence
tggattattgtatcatttta

SEQ ID NO: 359980 - DNA, 20 bp, Artificial
  CRISPR gRNA sequence
gattattgtatcattttata

SEQ ID NO: 359981 - DNA, 20 bp, Artificial
  CRISPR gRNA sequence
attattgtatcattttatag

SEQ ID NO: 359982 - DNA, 20 bp, Artificial
  CRISPR gRNA sequence
attttatagaggatgaaatt

SEQ ID NO: 359983 - DNA, 20 bp, Artificial
  CRISPR gRNA sequence
ttttatagaggatgaaattc

SEQ ID NO: 359984 - DNA, 20 bp, Artificial
  CRISPR gRNA sequence
tttatagaggatgaaattca

SEQ ID NO: 359985 - DNA, 20 bp, Artificial
  CRISPR gRNA sequence
atagaggatgaaattcaggg

SEQ ID NO: 359986 - DNA, 20 bp, Artificial
  CRISPR gRNA sequence
agaggatgaaattcagggta

SEQ ID NO: 359987 - DNA, 20 bp, Artificial
  CRISPR gRNA sequence
ggatgaaattcagggtagag

SEQ ID NO: 359988 - DNA, 20 bp, Artificial
  CRISPR gRNA sequence
aaattcagggtagagaagta

SEQ ID NO: 359989 - DNA, 20 bp, Artificial
  CRISPR gRNA sequence
attcagggtagagaagtaaa

SEQ ID NO: 359990 - DNA, 20 bp, Artificial
  CRISPR gRNA sequence
cagggtagagaagtaaagag

SEQ ID NO: 359991 - DNA, 20 bp, Artificial
  CRISPR gRNA sequence
agagaagtaaagagaagaat

SEQ ID NO: 359992 - DNA, 20 bp, Artificial
  CRISPR gRNA sequence
taaagagaagaatcagtctt

SEQ ID NO: 359993 - DNA, 20 bp, Artificial
  CRISPR gRNA sequence
atctaatcacttgtaacaaa

SEQ ID NO: 359994 - DNA, 20 bp, Artificial
  CRISPR gRNA sequence
tctaatcacttgtaacaaat

SEQ ID NO: 359995 - DNA, 20 bp, Artificial
  CRISPR gRNA sequence
tctgtttctctctctctcct

SEQ ID NO: 359996 - DNA, 20 bp, Artificial
  CRISPR gRNA sequence
tctctctctctcctcagctt

SEQ ID NO: 359997 - DNA, 20 bp, Artificial
  CRISPR gRNA sequence
ctctctctctcctcagcttt

SEQ ID NO: 359998 - DNA, 20 bp, Artificial
  CRISPR gRNA sequence
ctctctcctcagctttagga

SEQ ID NO: 359999 - DNA, 20 bp, Artificial
  CRISPR gRNA sequence
tctctcctcagctttaggaa

SEQ ID NO: 360000 - DNA, 20 bp, Artificial
  CRISPR gRNA sequence
gctttaggaaaggaaccaca

SEQ ID NO: 360001 - DNA, 20 bp, Artificial
  CRISPR gRNA sequence
aaggaaccacacagcacaac

SEQ ID NO: 360002 - DNA, 20 bp, Artificial
  CRISPR gRNA sequence
aggaaccacacagcacaacc

SEQ ID NO: 360003 - DNA, 20 bp, Artificial
  CRISPR gRNA sequence
gaaccacacagcacaaccag

SEQ ID NO: 360004 - DNA, 20 bp, Artificial
  CRISPR gRNA sequence
cacacagcacaaccaggagc

SEQ ID NO: 360005 - DNA, 20 bp, Artificial
  CRISPR gRNA sequence
acagcacaaccaggagctag

SEQ ID NO: 360006 - DNA, 20 bp, Artificial
  CRISPR gRNA sequence
caaccaggagctagcagata

SEQ ID NO: 360007 - DNA, 20 bp, Artificial
  CRISPR gRNA sequence
accaggagctagcagataaa

SEQ ID NO: 360008 - DNA, 20 bp, Artificial
  CRISPR gRNA sequence
gctagcagataaagagcatt

SEQ ID NO: 360009 - DNA, 20 bp, Artificial
  CRISPR gRNA sequence
ctagcagataaagagcattt

SEQ ID NO: 360010 - DNA, 20 bp, Artificial
  CRISPR gRNA sequence
tagcagataaagagcattta

SEQ ID NO: 360011 - DNA, 20 bp, Artificial
  CRISPR gRNA sequence
taaagagcatttagggaact

SEQ ID NO: 360012 - DNA, 20 bp, Artificial
  CRISPR gRNA sequence
agggaactcagtgcaacaaa

SEQ ID NO: 360013 - DNA, 20 bp, Artificial
  CRISPR gRNA sequence
caacaaacagtttgtctcac

SEQ ID NO: 360014 - DNA, 20 bp, Artificial
  CRISPR gRNA sequence
tctcactggtttcttataac

SEQ ID NO: 360015 - DNA, 20 bp, Artificial
  CRISPR gRNA sequence
tggtttcttataactagaat

SEQ ID NO: 360016 - DNA, 20 bp, Artificial
  CRISPR gRNA sequence
ggtttcttataactagaata

SEQ ID NO: 360017 - DNA, 20 bp, Artificial
  CRISPR gRNA sequence
taactagaataaggtactcc

SEQ ID NO: 360018 - DNA, 20 bp, Artificial
  CRISPR gRNA sequence
gacactctgcttattatgaa

SEQ ID NO: 360019 - DNA, 20 bp, Artificial
  CRISPR gRNA sequence
acactctgcttattatgaat

SEQ ID NO: 360020 - DNA, 20 bp, Artificial
  CRISPR gRNA sequence
cactctgcttattatgaata

SEQ ID NO: 360021 - DNA, 20 bp, Artificial
  CRISPR gRNA sequence
cttattatgaatagggacaa

SEQ ID NO: 360022 - DNA, 20 bp, Artificial
  CRISPR gRNA sequence
tatgaatagggacaatagaa

SEQ ID NO: 360023 - DNA, 20 bp, Artificial
  CRISPR gRNA sequence
atagaaaagatcacttctga

SEQ ID NO: 360024 - DNA, 20 bp, Artificial
  CRISPR gRNA sequence
tagaaaagatcacttctgat

SEQ ID NO: 360025 - DNA, 20 bp, Artificial
  CRISPR gRNA sequence
aaaagatcacttctgatggg

SEQ ID NO: 360026 - DNA, 20 bp, Artificial
  CRISPR gRNA sequence
ttctgatgggcagattcctc

SEQ ID NO: 360027 - DNA, 20 bp, Artificial
  CRISPR gRNA sequence
tgggcagattcctctagcac

SEQ ID NO: 360028 - DNA, 20 bp, Artificial
  CRISPR gRNA sequence
gattcctctagcaccagcac

SEQ ID NO: 360029 - DNA, 20 bp, Artificial
  CRISPR gRNA sequence
cctctagcaccagcaccaga

SEQ ID NO: 360030 - DNA, 20 bp, Artificial
  CRISPR gRNA sequence
ctagcaccagcaccagatgg

SEQ ID NO: 360031 - DNA, 20 bp, Artificial
  CRISPR gRNA sequence
tagcaccagcaccagatggt

SEQ ID NO: 360032 - DNA, 20 bp, Artificial
  CRISPR gRNA sequence
gcaccagatggtgggataaa

SEQ ID NO: 360033 - DNA, 20 bp, Artificial
  CRISPR gRNA sequence
caccagatggtgggataaac

SEQ ID NO: 360034 - DNA, 20 bp, Artificial
  CRISPR gRNA sequence
atggtgggataaacgggctc

SEQ ID NO: 360035 - DNA, 20 bp, Artificial
  CRISPR gRNA sequence
tggtgggataaacgggctct

SEQ ID NO: 360036 - DNA, 20 bp, Artificial
  CRISPR gRNA sequence
ggatgcgccgtcatacctgc

SEQ ID NO: 360037 - DNA, 20 bp, Artificial
  CRISPR gRNA sequence
cgccgtcatacctgccagcc

SEQ ID NO: 360038 - DNA, 20 bp, Artificial
  CRISPR gRNA sequence
acctgccagcccagcaacca

SEQ ID NO: 360039 - DNA, 20 bp, Artificial
  CRISPR gRNA sequence
cacaccctcacctttcccaa

SEQ ID NO: 360040 - DNA, 20 bp, Artificial
  CRISPR gRNA sequence
accctcacctttcccaatag

SEQ ID NO: 360041 - DNA, 20 bp, Artificial
  CRISPR gRNA sequence
ctcacctttcccaatagcag

SEQ ID NO: 360042 - DNA, 20 bp, Artificial
  CRISPR gRNA sequence
cacctttcccaatagcagtg

SEQ ID NO: 360043 - DNA, 20 bp, Artificial
  CRISPR gRNA sequence
ctttcccaatagcagtggag

SEQ ID NO: 360044 - DNA, 20 bp, Artificial
  CRISPR gRNA sequence
ttcccaatagcagtggagaa

SEQ ID NO: 360045 - DNA, 20 bp, Artificial
  CRISPR gRNA sequence
cccaatagcagtggagaaga

SEQ ID NO: 360046 - DNA, 20 bp, Artificial
  CRISPR gRNA sequence
caatagcagtggagaagaga

SEQ ID NO: 360047 - DNA, 20 bp, Artificial
  CRISPR gRNA sequence
atagcagtggagaagagaga

SEQ ID NO: 360048 - DNA, 20 bp, Artificial
  CRISPR gRNA sequence
agaagagagagagacatcac

SEQ ID NO: 360049 - DNA, 20 bp, Artificial
  CRISPR gRNA sequence
agagacatcacaagaatacc

SEQ ID NO: 360050 - DNA, 20 bp, Artificial
  CRISPR gRNA sequence
gagacatcacaagaatacca

SEQ ID NO: 360051 - DNA, 20 bp, Artificial
  CRISPR gRNA sequence
caagaataccaaggatatca

SEQ ID NO: 360052 - DNA, 20 bp, Artificial
  CRISPR gRNA sequence
aataccaaggatatcataga

SEQ ID NO: 360053 - DNA, 20 bp, Artificial
  CRISPR gRNA sequence
catagaaagaaaaatgaacg

SEQ ID NO: 360054 - DNA, 20 bp, Artificial
  CRISPR gRNA sequence
aaatgaacgtggaaacattt

SEQ ID NO: 360055 - DNA, 20 bp, Artificial
  CRISPR gRNA sequence
cgtggaaacattttagaaaa

SEQ ID NO: 360056 - DNA, 20 bp, Artificial
  CRISPR gRNA sequence
cattttagaaaatagatcgc

SEQ ID NO: 360057 - DNA, 20 bp, Artificial
  CRISPR gRNA sequence
ttttagaaaatagatcgcca

SEQ ID NO: 360058 - DNA, 20 bp, Artificial
  CRISPR gRNA sequence
cagagctctgaaaaccaaaa

SEQ ID NO: 360059 - DNA, 20 bp, Artificial
  CRISPR gRNA sequence
aaccaaaaaagtccttattg

SEQ ID NO: 360060 - DNA, 20 bp, Artificial
  CRISPR gRNA sequence
ccaaaaaagtccttattgaa

SEQ ID NO: 360061 - DNA, 20 bp, Artificial
  CRISPR gRNA sequence
aaagtccttattgaagagat

SEQ ID NO: 360062 - DNA, 20 bp, Artificial
  CRISPR gRNA sequence
tgaagagataagtgtgccta

SEQ ID NO: 360063 - DNA, 20 bp, Artificial
  CRISPR gRNA sequence
gaagagataagtgtgcctaa

SEQ ID NO: 360064 - DNA, 20 bp, Artificial
  CRISPR gRNA sequence
taaaggatttgttattgtca

SEQ ID NO: 360065 - DNA, 20 bp, Artificial
  CRISPR gRNA sequence
aaggatttgttattgtcaca

SEQ ID NO: 360066 - DNA, 20 bp, Artificial
  CRISPR gRNA sequence
tttgttattgtcacagagca

SEQ ID NO: 360067 - DNA, 20 bp, Artificial
  CRISPR gRNA sequence
ttgtcacagagcacagatca

SEQ ID NO: 360068 - DNA, 20 bp, Artificial
  CRISPR gRNA sequence
cacagagcacagatcaaaga

SEQ ID NO: 360069 - DNA, 20 bp, Artificial
  CRISPR gRNA sequence
acagagcacagatcaaagat

SEQ ID NO: 360070 - DNA, 20 bp, Artificial
  CRISPR gRNA sequence
gatcaaagatgggattattt

SEQ ID NO: 360071 - DNA, 20 bp, Artificial
  CRISPR gRNA sequence
tatttaagctttttatttct

SEQ ID NO: 360072 - DNA, 20 bp, Artificial
  CRISPR gRNA sequence
tttaagctttttatttctca

SEQ ID NO: 360073 - DNA, 20 bp, Artificial
  CRISPR gRNA sequence
agctttttatttctcagagt

SEQ ID NO: 360074 - DNA, 20 bp, Artificial
  CRISPR gRNA sequence
tttatttctcagagtgagaa

SEQ ID NO: 360075 - DNA, 20 bp, Artificial
  CRISPR gRNA sequence
ttatttctcagagtgagaaa

SEQ ID NO: 360076 - DNA, 20 bp, Artificial
  CRISPR gRNA sequence
ttctcagagtgagaaaagga

SEQ ID NO: 360077 - DNA, 20 bp, Artificial
  CRISPR gRNA sequence
tctcagagtgagaaaaggac

SEQ ID NO: 360078 - DNA, 20 bp, Artificial
  CRISPR gRNA sequence
aggacaggtctgttcataat

SEQ ID NO: 360079 - DNA, 20 bp, Artificial
  CRISPR gRNA sequence
tctaaatgaaaaactgccta

SEQ ID NO: 360080 - DNA, 20 bp, Artificial
  CRISPR gRNA sequence
aaaactgcctaaagcaactc

SEQ ID NO: 360081 - DNA, 20 bp, Artificial
  CRISPR gRNA sequence
tgaacattatttaaaaaaaa

SEQ ID NO: 360082 - DNA, 20 bp, Artificial
  CRISPR gRNA sequence
ttaaaaaaaatagatcatct

SEQ ID NO: 360083 - DNA, 20 bp, Artificial
  CRISPR gRNA sequence
aaaaaaaatagatcatctta

SEQ ID NO: 360084 - DNA, 20 bp, Artificial
  CRISPR gRNA sequence
agatcatcttagagcaaact

SEQ ID NO: 360085 - DNA, 20 bp, Artificial
  CRISPR gRNA sequence
gtaaacgtatgccatactct

SEQ ID NO: 360086 - DNA, 20 bp, Artificial
  CRISPR gRNA sequence
aaacgtatgccatactctta

SEQ ID NO: 360087 - DNA, 20 bp, Artificial
  CRISPR gRNA sequence
taaattactgtttaaattac

SEQ ID NO: 360088 - DNA, 20 bp, Artificial
  CRISPR gRNA sequence
tactgtttaaattacaagcg

SEQ ID NO: 360089 - DNA, 20 bp, Artificial
  CRISPR gRNA sequence
actgtttaaattacaagcgt

SEQ ID NO: 360090 - DNA, 20 bp, Artificial
  CRISPR gRNA sequence
ctgtttaaattacaagcgtg

SEQ ID NO: 360091 - DNA, 20 bp, Artificial
  CRISPR gRNA sequence
ttaaattacaagcgtggggt

SEQ ID NO: 360092 - DNA, 20 bp, Artificial
  CRISPR gRNA sequence
attacaagcgtggggtaagt

SEQ ID NO: 360093 - DNA, 20 bp, Artificial
  CRISPR gRNA sequence
gcgtggggtaagttggtgct

SEQ ID NO: 360094 - DNA, 20 bp, Artificial
  CRISPR gRNA sequence
gtggggtaagttggtgctta

SEQ ID NO: 360095 - DNA, 20 bp, Artificial
  CRISPR gRNA sequence
gggtaagttggtgcttagag

SEQ ID NO: 360096 - DNA, 20 bp, Artificial
  CRISPR gRNA sequence
aagttggtgcttagagtagt

SEQ ID NO: 360097 - DNA, 20 bp, Artificial
  CRISPR gRNA sequence
agttggtgcttagagtagtt

SEQ ID NO: 360098 - DNA, 20 bp, Artificial
  CRISPR gRNA sequence
tggtgcttagagtagttggg

SEQ ID NO: 360099 - DNA, 20 bp, Artificial
  CRISPR gRNA sequence
ggtgcttagagtagttggga

SEQ ID NO: 360100 - DNA, 20 bp, Artificial
  CRISPR gRNA sequence
tgcttagagtagttgggaag

SEQ ID NO: 360101 - DNA, 20 bp, Artificial
  CRISPR gRNA sequence
gcttagagtagttgggaagg

SEQ ID NO: 360102 - DNA, 20 bp, Artificial
  CRISPR gRNA sequence
tagagtagttgggaaggagg

SEQ ID NO: 360103 - DNA, 20 bp, Artificial
  CRISPR gRNA sequence
agagtagttgggaaggaggc

SEQ ID NO: 360104 - DNA, 20 bp, Artificial
  CRISPR gRNA sequence
agtagttgggaaggaggcag

SEQ ID NO: 360105 - DNA, 20 bp, Artificial
  CRISPR gRNA sequence
agttgggaaggaggcaggag

SEQ ID NO: 360106 - DNA, 20 bp, Artificial
  CRISPR gRNA sequence
ggaggcaggagaagtctctg

SEQ ID NO: 360107 - DNA, 20 bp, Artificial
  CRISPR gRNA sequence
gaggcaggagaagtctctgc

SEQ ID NO: 360108 - DNA, 20 bp, Artificial
  CRISPR gRNA sequence
caggagaagtctctgcagga

SEQ ID NO: 360109 - DNA, 20 bp, Artificial
  CRISPR gRNA sequence
ctctgcaggatggacctcac

SEQ ID NO: 360110 - DNA, 20 bp, Artificial
  CRISPR gRNA sequence
tgcaggatggacctcacgag

SEQ ID NO: 360111 - DNA, 20 bp, Artificial
  CRISPR gRNA sequence
gcaggatggacctcacgagc

SEQ ID NO: 360112 - DNA, 20 bp, Artificial
  CRISPR gRNA sequence
ggatggacctcacgagcagg

SEQ ID NO: 360113 - DNA, 20 bp, Artificial
  CRISPR gRNA sequence
gatggacctcacgagcaggc

SEQ ID NO: 360114 - DNA, 20 bp, Artificial
  CRISPR gRNA sequence
tggacctcacgagcaggcag

SEQ ID NO: 360115 - DNA, 20 bp, Artificial
  CRISPR gRNA sequence
ctcacgagcaggcaggagtt

SEQ ID NO: 360116 - DNA, 20 bp, Artificial
  CRISPR gRNA sequence
gagcaggcaggagttcagtg

SEQ ID NO: 360117 - DNA, 20 bp, Artificial
  CRISPR gRNA sequence
agcaggcaggagttcagtgt

SEQ ID NO: 360118 - DNA, 20 bp, Artificial
  CRISPR gRNA sequence
aggcaggagttcagtgtggg

SEQ ID NO: 360119 - DNA, 20 bp, Artificial
  CRISPR gRNA sequence
gcaggagttcagtgtgggca

SEQ ID NO: 360120 - DNA, 20 bp, Artificial
  CRISPR gRNA sequence
tgggcagagaactctttttg

SEQ ID NO: 360121 - DNA, 20 bp, Artificial
  CRISPR gRNA sequence
gggcagagaactctttttgc

SEQ ID NO: 360122 - DNA, 20 bp, Artificial
  CRISPR gRNA sequence
ggcagagaactctttttgca

SEQ ID NO: 360123 - DNA, 20 bp, Artificial
  CRISPR gRNA sequence
gaactctttttgcagggctc

SEQ ID NO: 360124 - DNA, 20 bp, Artificial
  CRISPR gRNA sequence
tttgcagggctcaagtgtcc

SEQ ID NO: 360125 - DNA, 20 bp, Artificial
  CRISPR gRNA sequence
aagtgtcctagtgaaatgct

SEQ ID NO: 360126 - DNA, 20 bp, Artificial
  CRISPR gRNA sequence
aatgctaagcctgcatatta

SEQ ID NO: 360127 - DNA, 20 bp, Artificial
  CRISPR gRNA sequence
tgctaagcctgcatattatg

SEQ ID NO: 360128 - DNA, 20 bp, Artificial
  CRISPR gRNA sequence
aagcctgcatattatggagc

SEQ ID NO: 360129 - DNA, 20 bp, Artificial
  CRISPR gRNA sequence
agcctgcatattatggagca

SEQ ID NO: 360130 - DNA, 20 bp, Artificial
  CRISPR gRNA sequence
gcctgcatattatggagcaa

SEQ ID NO: 360131 - DNA, 20 bp, Artificial
  CRISPR gRNA sequence
catattatggagcaagggac

SEQ ID NO: 360132 - DNA, 20 bp, Artificial
  CRISPR gRNA sequence
gcaagggaccagccctctga

SEQ ID NO: 360133 - DNA, 20 bp, Artificial
  CRISPR gRNA sequence
gggaccagccctctgaaaga

SEQ ID NO: 360134 - DNA, 20 bp, Artificial
  CRISPR gRNA sequence
ggaccagccctctgaaagat

SEQ ID NO: 360135 - DNA, 20 bp, Artificial
  CRISPR gRNA sequence
gccctctgaaagatgggctt

SEQ ID NO: 360136 - DNA, 20 bp, Artificial
  CRISPR gRNA sequence
atgggcttcagatgtgctaa

SEQ ID NO: 360137 - DNA, 20 bp, Artificial
  CRISPR gRNA sequence
ttcagatgtgctaaaagaat

SEQ ID NO: 360138 - DNA, 20 bp, Artificial
  CRISPR gRNA sequence
cagatgtgctaaaagaattg

SEQ ID NO: 360139 - DNA, 20 bp, Artificial
  CRISPR gRNA sequence
ctaaaagaattggagaatta

SEQ ID NO: 360140 - DNA, 20 bp, Artificial
  CRISPR gRNA sequence
agaattatagacaacctcac

SEQ ID NO: 360141 - DNA, 20 bp, Artificial
  CRISPR gRNA sequence
ttatagacaacctcaccgga

SEQ ID NO: 360142 - DNA, 20 bp, Artificial
  CRISPR gRNA sequence
tatagacaacctcaccggaa

SEQ ID NO: 360143 - DNA, 20 bp, Artificial
  CRISPR gRNA sequence
atagacaacctcaccggaaa

SEQ ID NO: 360144 - DNA, 20 bp, Artificial
  CRISPR gRNA sequence
agacaacctcaccggaaagg

SEQ ID NO: 360145 - DNA, 20 bp, Artificial
  CRISPR gRNA sequence
cctcaccggaaagggagaaa

SEQ ID NO: 360146 - DNA, 20 bp, Artificial
  CRISPR gRNA sequence
ctcaccggaaagggagaaaa

SEQ ID NO: 360147 - DNA, 20 bp, Artificial
  CRISPR gRNA sequence
accggaaagggagaaaaagg

SEQ ID NO: 360148 - DNA, 20 bp, Artificial
  CRISPR gRNA sequence
ggaaagggagaaaaaggaag

SEQ ID NO: 360149 - DNA, 20 bp, Artificial
  CRISPR gRNA sequence
gaagaagatgtttcttacta

SEQ ID NO: 360150 - DNA, 20 bp, Artificial
  CRISPR gRNA sequence
atgtttcttactaaagtgtg

SEQ ID NO: 360151 - DNA, 20 bp, Artificial
  CRISPR gRNA sequence
tgtttcttactaaagtgtga

SEQ ID NO: 360152 - DNA, 20 bp, Artificial
  CRISPR gRNA sequence
gtttcttactaaagtgtgaa

SEQ ID NO: 360153 - DNA, 20 bp, Artificial
  CRISPR gRNA sequence
tttcttactaaagtgtgaag

SEQ ID NO: 360154 - DNA, 20 bp, Artificial
  CRISPR gRNA sequence
aaagtgtgaaggggaaaaaa

SEQ ID NO: 360155 - DNA, 20 bp, Artificial
  CRISPR gRNA sequence
atcattctattgatcttaat

SEQ ID NO: 360156 - DNA, 20 bp, Artificial
  CRISPR gRNA sequence
tcattctattgatcttaatg

SEQ ID NO: 360157 - DNA, 20 bp, Artificial
  CRISPR gRNA sequence
attgatcttaatgaggtttc

SEQ ID NO: 360158 - DNA, 20 bp, Artificial
  CRISPR gRNA sequence
gaggtttctggaaacaaaat

SEQ ID NO: 360159 - DNA, 20 bp, Artificial
  CRISPR gRNA sequence
tttctggaaacaaaatgagt

SEQ ID NO: 360160 - DNA, 20 bp, Artificial
  CRISPR gRNA sequence
ttctggaaacaaaatgagtt

SEQ ID NO: 360161 - DNA, 20 bp, Artificial
  CRISPR gRNA sequence
tctggaaacaaaatgagttg

SEQ ID NO: 360162 - DNA, 20 bp, Artificial
  CRISPR gRNA sequence
ctggaaacaaaatgagttgg

SEQ ID NO: 360163 - DNA, 20 bp, Artificial
  CRISPR gRNA sequence
gggaaatgcactacttctat

SEQ ID NO: 360164 - DNA, 20 bp, Artificial
  CRISPR gRNA sequence
gaaatgcactacttctatta

SEQ ID NO: 360165 - DNA, 20 bp, Artificial
  CRISPR gRNA sequence
aatgcactacttctattaga

SEQ ID NO: 360166 - DNA, 20 bp, Artificial
  CRISPR gRNA sequence
ttagagagatttccaaaatt

SEQ ID NO: 360167 - DNA, 20 bp, Artificial
  CRISPR gRNA sequence
agagatttccaaaatttgga

SEQ ID NO: 360168 - DNA, 20 bp, Artificial
  CRISPR gRNA sequence
tcactgtgatcatattttca

SEQ ID NO: 360169 - DNA, 20 bp, Artificial
  CRISPR gRNA sequence
atattttcatagcatgattt

SEQ ID NO: 360170 - DNA, 20 bp, Artificial
  CRISPR gRNA sequence
gaacaataatctaaaatgtc

SEQ ID NO: 360171 - DNA, 20 bp, Artificial
  CRISPR gRNA sequence
tatactaccatctatgaatt

SEQ ID NO: 360172 - DNA, 20 bp, Artificial
  CRISPR gRNA sequence
ttggcttgtatgtattatgt

SEQ ID NO: 360173 - DNA, 20 bp, Artificial
  CRISPR gRNA sequence
gtcagaatgtgaaaaatctc

SEQ ID NO: 360174 - DNA, 20 bp, Artificial
  CRISPR gRNA sequence
tacctttctatataatattt

SEQ ID NO: 360175 - DNA, 20 bp, Artificial
  CRISPR gRNA sequence
acgaccttgacatttttgat

SEQ ID NO: 360176 - DNA, 20 bp, Artificial
  CRISPR gRNA sequence
acatttttgatgagtttgat

SEQ ID NO: 360177 - DNA, 20 bp, Artificial
  CRISPR gRNA sequence
atgagatcttcgactgcttc

SEQ ID NO: 360178 - DNA, 20 bp, Artificial
  CRISPR gRNA sequence
tcaagtcaatcacctcatat

SEQ ID NO: 360179 - DNA, 20 bp, Artificial
  CRISPR gRNA sequence
tcacctcatatcagtgccat

SEQ ID NO: 360180 - DNA, 20 bp, Artificial
  CRISPR gRNA sequence
atcagtgccattggcaattt

SEQ ID NO: 360181 - DNA, 20 bp, Artificial
  CRISPR gRNA sequence
tcagtgccattggcaatttg

SEQ ID NO: 360182 - DNA, 20 bp, Artificial
  CRISPR gRNA sequence
gtgccattggcaatttgagg

SEQ ID NO: 360183 - DNA, 20 bp, Artificial
  CRISPR gRNA sequence
ttggcaatttgaggaagaca

SEQ ID NO: 360184 - DNA, 20 bp, Artificial
  CRISPR gRNA sequence
ggcaatttgaggaagacaaa

SEQ ID NO: 360185 - DNA, 20 bp, Artificial
  CRISPR gRNA sequence
gcaatttgaggaagacaaag

SEQ ID NO: 360186 - DNA, 20 bp, Artificial
  CRISPR gRNA sequence
aatttgaggaagacaaagag

SEQ ID NO: 360187 - DNA, 20 bp, Artificial
  CRISPR gRNA sequence
gaggaagacaaagaggagct

SEQ ID NO: 360188 - DNA, 20 bp, Artificial
  CRISPR gRNA sequence
gacaaagaggagcttggttc

SEQ ID NO: 360189 - DNA, 20 bp, Artificial
  CRISPR gRNA sequence
ggagcttggttcaagttgat

SEQ ID NO: 360190 - DNA, 20 bp, Artificial
  CRISPR gRNA sequence
ttcaagttgattagcactac

SEQ ID NO: 360191 - DNA, 20 bp, Artificial
  CRISPR gRNA sequence
gttgattagcactaccagaa

SEQ ID NO: 360192 - DNA, 20 bp, Artificial
  CRISPR gRNA sequence
actaccagaaaagaaactca

SEQ ID NO: 360193 - DNA, 20 bp, Artificial
  CRISPR gRNA sequence
catatatcaattattccatt

SEQ ID NO: 360194 - DNA, 20 bp, Artificial
  CRISPR gRNA sequence
caattattccattgagttca

SEQ ID NO: 360195 - DNA, 20 bp, Artificial
  CRISPR gRNA sequence
ttccattgagttcatggacc

SEQ ID NO: 360196 - DNA, 20 bp, Artificial
  CRISPR gRNA sequence
ccattgagttcatggaccaa

SEQ ID NO: 360197 - DNA, 20 bp, Artificial
  CRISPR gRNA sequence
cattgagttcatggaccaag

SEQ ID NO: 360198 - DNA, 20 bp, Artificial
  CRISPR gRNA sequence
ttgagttcatggaccaagag

SEQ ID NO: 360199 - DNA, 20 bp, Artificial
  CRISPR gRNA sequence
agaggagaatatttattttc

SEQ ID NO: 360200 - DNA, 20 bp, Artificial
  CRISPR gRNA sequence
atatttattttcaagttttg

SEQ ID NO: 360201 - DNA, 20 bp, Artificial
  CRISPR gRNA sequence
ttattttcaagttttgtggt

SEQ ID NO: 360202 - DNA, 20 bp, Artificial
  CRISPR gRNA sequence
tggttagcaattccttgtga

SEQ ID NO: 360203 - DNA, 20 bp, Artificial
  CRISPR gRNA sequence
attccttgtgatagttctgc

SEQ ID NO: 360204 - DNA, 20 bp, Artificial
  CRISPR gRNA sequence
agtttccaattttctcactg

SEQ ID NO: 360205 - DNA, 20 bp, Artificial
  CRISPR gRNA sequence
gtttccaattttctcactga

SEQ ID NO: 360206 - DNA, 20 bp, Artificial
  CRISPR gRNA sequence
tttccaattttctcactgaa

SEQ ID NO: 360207 - DNA, 20 bp, Artificial
  CRISPR gRNA sequence
attttctcactgaagggcta

SEQ ID NO: 360208 - DNA, 20 bp, Artificial
  CRISPR gRNA sequence
tttctcactgaagggctaca

SEQ ID NO: 360209 - DNA, 20 bp, Artificial
  CRISPR gRNA sequence
cagagttccgtatttgtgcc

SEQ ID NO: 360210 - DNA, 20 bp, Artificial
  CRISPR gRNA sequence
tatatattgctcctttacaa

SEQ ID NO: 360211 - DNA, 20 bp, Artificial
  CRISPR gRNA sequence
ttacaaaagcatttctactg

SEQ ID NO: 360212 - DNA, 20 bp, Artificial
  CRISPR gRNA sequence
gcatttctactgaagtaaat

SEQ ID NO: 360213 - DNA, 20 bp, Artificial
  CRISPR gRNA sequence
ctactgaagtaaattggaaa

SEQ ID NO: 360214 - DNA, 20 bp, Artificial
  CRISPR gRNA sequence
ctgaagtaaattggaaaaag

SEQ ID NO: 360215 - DNA, 20 bp, Artificial
  CRISPR gRNA sequence
gtaaattggaaaaagaagaa

SEQ ID NO: 360216 - DNA, 20 bp, Artificial
  CRISPR gRNA sequence
taaattggaaaaagaagaaa

SEQ ID NO: 360217 - DNA, 20 bp, Artificial
  CRISPR gRNA sequence
ttggaaaaagaagaaaaggc

SEQ ID NO: 360218 - DNA, 20 bp, Artificial
  CRISPR gRNA sequence
aaaaagaagaaaaggcaaga

SEQ ID NO: 360219 - DNA, 20 bp, Artificial
  CRISPR gRNA sequence
gaagaaaaggcaagatagac

SEQ ID NO: 360220 - DNA, 20 bp, Artificial
  CRISPR gRNA sequence
ggcaagatagactagacttt

SEQ ID NO: 360221 - DNA, 20 bp, Artificial
  CRISPR gRNA sequence
ttttggccctccttctaatt

SEQ ID NO: 360222 - DNA, 20 bp, Artificial
  CRISPR gRNA sequence
aatgacaaccacaaccattt

SEQ ID NO: 360223 - DNA, 20 bp, Artificial
  CRISPR gRNA sequence
acaaccatttcagttgcatt

SEQ ID NO: 360224 - DNA, 20 bp, Artificial
  CRISPR gRNA sequence
ttctgttactcccaataaaa

SEQ ID NO: 360225 - DNA, 20 bp, Artificial
  CRISPR gRNA sequence
acagaaatgttcatgctcta

SEQ ID NO: 360226 - DNA, 20 bp, Artificial
  CRISPR gRNA sequence
aacacaaataaccatcaatt

SEQ ID NO: 360227 - DNA, 20 bp, Artificial
  CRISPR gRNA sequence
acacaaataaccatcaattg

SEQ ID NO: 360228 - DNA, 20 bp, Artificial
  CRISPR gRNA sequence
attgaggacctactatattt

SEQ ID NO: 360229 - DNA, 20 bp, Artificial
  CRISPR gRNA sequence
aagacaatgtcccaaattct

SEQ ID NO: 360230 - DNA, 20 bp, Artificial
  CRISPR gRNA sequence
caaattctgagccaaatctc

SEQ ID NO: 360231 - DNA, 20 bp, Artificial
  CRISPR gRNA sequence
aaattctgagccaaatctca

SEQ ID NO: 360232 - DNA, 20 bp, Artificial
  CRISPR gRNA sequence
caaatctcaaggaaattgca

SEQ ID NO: 360233 - DNA, 20 bp, Artificial
  CRISPR gRNA sequence
aaatctcaaggaaattgcaa

SEQ ID NO: 360234 - DNA, 20 bp, Artificial
  CRISPR gRNA sequence
ctcaaggaaattgcaaagga

SEQ ID NO: 360235 - DNA, 20 bp, Artificial
  CRISPR gRNA sequence
gaaattgcaaaggaaagtca

SEQ ID NO: 360236 - DNA, 20 bp, Artificial
  CRISPR gRNA sequence
aaattgcaaaggaaagtcaa

SEQ ID NO: 360237 - DNA, 20 bp, Artificial
  CRISPR gRNA sequence
aattaaaatcaataatgcaa

SEQ ID NO: 360238 - DNA, 20 bp, Artificial
  CRISPR gRNA sequence
attaaaatcaataatgcaat

SEQ ID NO: 360239 - DNA, 20 bp, Artificial
  CRISPR gRNA sequence
ataggtcctgactcgcctga

SEQ ID NO: 360240 - DNA, 20 bp, Artificial
  CRISPR gRNA sequence
tgactcgcctgaaagtaaat

SEQ ID NO: 360241 - DNA, 20 bp, Artificial
  CRISPR gRNA sequence
gcctgaaagtaaattggcac

SEQ ID NO: 360242 - DNA, 20 bp, Artificial
  CRISPR gRNA sequence
aaaatatttttttactatct

SEQ ID NO: 360243 - DNA, 20 bp, Artificial
  CRISPR gRNA sequence
cttagcatactctgattttc

SEQ ID NO: 360244 - DNA, 20 bp, Artificial
  CRISPR gRNA sequence
ctagaaattctactcttgtt

SEQ ID NO: 360245 - DNA, 20 bp, Artificial
  CRISPR gRNA sequence
ttctactcttgttcagttta

SEQ ID NO: 360246 - DNA, 20 bp, Artificial
  CRISPR gRNA sequence
actcttgttcagtttaaagt

SEQ ID NO: 360247 - DNA, 20 bp, Artificial
  CRISPR gRNA sequence
ctcttgttcagtttaaagtg

SEQ ID NO: 360248 - DNA, 20 bp, Artificial
  CRISPR gRNA sequence
tcttgttcagtttaaagtga

SEQ ID NO: 360249 - DNA, 20 bp, Artificial
  CRISPR gRNA sequence
tgttcagtttaaagtgaggg

SEQ ID NO: 360250 - DNA, 20 bp, Artificial
  CRISPR gRNA sequence
tgagggaagattttactttg

SEQ ID NO: 360251 - DNA, 20 bp, Artificial
  CRISPR gRNA sequence
aagattttactttgaagtat

SEQ ID NO: 360252 - DNA, 20 bp, Artificial
  CRISPR gRNA sequence
gattttactttgaagtatta

SEQ ID NO: 360253 - DNA, 20 bp, Artificial
  CRISPR gRNA sequence
ttgaagtattagagctttac

SEQ ID NO: 360254 - DNA, 20 bp, Artificial
  CRISPR gRNA sequence
gaagtattagagctttacca

SEQ ID NO: 360255 - DNA, 20 bp, Artificial
  CRISPR gRNA sequence
tttaccagagttgttcattt

SEQ ID NO: 360256 - DNA, 20 bp, Artificial
  CRISPR gRNA sequence
agagttgttcattttggaaa

SEQ ID NO: 360257 - DNA, 20 bp, Artificial
  CRISPR gRNA sequence
taatgattgacaatgccatt

SEQ ID NO: 360258 - DNA, 20 bp, Artificial
  CRISPR gRNA sequence
aatgattgacaatgccattc

SEQ ID NO: 360259 - DNA, 20 bp, Artificial
  CRISPR gRNA sequence
atgattgacaatgccattca

SEQ ID NO: 360260 - DNA, 20 bp, Artificial
  CRISPR gRNA sequence
ttcagggtaatcacatcttc

SEQ ID NO: 360261 - DNA, 20 bp, Artificial
  CRISPR gRNA sequence
gtaatcacatcttctagtca

SEQ ID NO: 360262 - DNA, 20 bp, Artificial
  CRISPR gRNA sequence
catcttctagtcatagttca

SEQ ID NO: 360263 - DNA, 20 bp, Artificial
  CRISPR gRNA sequence
tagttcacggtgattctaaa

SEQ ID NO: 360264 - DNA, 20 bp, Artificial
  CRISPR gRNA sequence
gttcacggtgattctaaatg

SEQ ID NO: 360265 - DNA, 20 bp, Artificial
  CRISPR gRNA sequence
ttcacggtgattctaaatgg

SEQ ID NO: 360266 - DNA, 20 bp, Artificial
  CRISPR gRNA sequence
attttatccctctcacacaa

SEQ ID NO: 360267 - DNA, 20 bp, Artificial
  CRISPR gRNA sequence
ccctctcacacaatagcacc

SEQ ID NO: 360268 - DNA, 20 bp, Artificial
  CRISPR gRNA sequence
acctggacacgatttcaaaa

SEQ ID NO: 360269 - DNA, 20 bp, Artificial
  CRISPR gRNA sequence
gacacgatttcaaaatggtt

SEQ ID NO: 360270 - DNA, 20 bp, Artificial
  CRISPR gRNA sequence
acacgatttcaaaatggtta

SEQ ID NO: 360271 - DNA, 20 bp, Artificial
  CRISPR gRNA sequence
acgatttcaaaatggttaag

SEQ ID NO: 360272 - DNA, 20 bp, Artificial
  CRISPR gRNA sequence
aatggttaaggagacttata

SEQ ID NO: 360273 - DNA, 20 bp, Artificial
  CRISPR gRNA sequence
gacttataaagtatttatta

SEQ ID NO: 360274 - DNA, 20 bp, Artificial
  CRISPR gRNA sequence
ttataaagtatttattacag

SEQ ID NO: 360275 - DNA, 20 bp, Artificial
  CRISPR gRNA sequence
ataaagtatttattacagaa

SEQ ID NO: 360276 - DNA, 20 bp, Artificial
  CRISPR gRNA sequence
tttattacagaagagaacat

SEQ ID NO: 360277 - DNA, 20 bp, Artificial
  CRISPR gRNA sequence
gaagagaacattggatctga

SEQ ID NO: 360278 - DNA, 20 bp, Artificial
  CRISPR gRNA sequence
aagagaacattggatctgat

SEQ ID NO: 360279 - DNA, 20 bp, Artificial
  CRISPR gRNA sequence
agagaacattggatctgata

SEQ ID NO: 360280 - DNA, 20 bp, Artificial
  CRISPR gRNA sequence
atcattgctatttgctttat

SEQ ID NO: 360281 - DNA, 20 bp, Artificial
  CRISPR gRNA sequence
attgctatttgctttattag

SEQ ID NO: 360282 - DNA, 20 bp, Artificial
  CRISPR gRNA sequence
gctatttgctttattagtag

SEQ ID NO: 360283 - DNA, 20 bp, Artificial
  CRISPR gRNA sequence
tgctttattagtagcagaat

SEQ ID NO: 360284 - DNA, 20 bp, Artificial
  CRISPR gRNA sequence
gcagaatgagtaaaaatatg

SEQ ID NO: 360285 - DNA, 20 bp, Artificial
  CRISPR gRNA sequence
gcagaaatgcatatacactt

SEQ ID NO: 360286 - DNA, 20 bp, Artificial
  CRISPR gRNA sequence
tacactttagcaaatgatca

SEQ ID NO: 360287 - DNA, 20 bp, Artificial
  CRISPR gRNA sequence
cactttagcaaatgatcaaa

SEQ ID NO: 360288 - DNA, 20 bp, Artificial
  CRISPR gRNA sequence
aatgttaatataactaacca

SEQ ID NO: 360289 - DNA, 20 bp, Artificial
  CRISPR gRNA sequence
atgttaatataactaaccaa

SEQ ID NO: 360290 - DNA, 20 bp, Artificial
  CRISPR gRNA sequence
tataactaaccaaaggtcct

SEQ ID NO: 360291 - DNA, 20 bp, Artificial
  CRISPR gRNA sequence
agctactttttatcatgcca

SEQ ID NO: 360292 - DNA, 20 bp, Artificial
  CRISPR gRNA sequence
tgccatggttctccatttgc

SEQ ID NO: 360293 - DNA, 20 bp, Artificial
  CRISPR gRNA sequence
atttgccagaattcatctaa

SEQ ID NO: 360294 - DNA, 20 bp, Artificial
  CRISPR gRNA sequence
cccattaaaattgtaaacac

SEQ ID NO: 360295 - DNA, 20 bp, Artificial
  CRISPR gRNA sequence
attaaaattgtaaacactgg

SEQ ID NO: 360296 - DNA, 20 bp, Artificial
  CRISPR gRNA sequence
aattgtaaacactggaagca

SEQ ID NO: 360297 - DNA, 20 bp, Artificial
  CRISPR gRNA sequence
cactggaagcaaagatgaaa

SEQ ID NO: 360298 - DNA, 20 bp, Artificial
  CRISPR gRNA sequence
ctggaagcaaagatgaaatg

SEQ ID NO: 360299 - DNA, 20 bp, Artificial
  CRISPR gRNA sequence
gaaaacaaacaattcttttc

SEQ ID NO: 360300 - DNA, 20 bp, Artificial
  CRISPR gRNA sequence
aacaattcttttccagatta

SEQ ID NO: 360301 - DNA, 20 bp, Artificial
  CRISPR gRNA sequence
attcttttccagattacagt

SEQ ID NO: 360302 - DNA, 20 bp, Artificial
  CRISPR gRNA sequence
ttagttctcaaatatacctt

SEQ ID NO: 360303 - DNA, 20 bp, Artificial
  CRISPR gRNA sequence
gttctcaaatatacctttgg

SEQ ID NO: 360304 - DNA, 20 bp, Artificial
  CRISPR gRNA sequence
tcaaatatacctttggaagc

SEQ ID NO: 360305 - DNA, 20 bp, Artificial
  CRISPR gRNA sequence
caaatatacctttggaagct

SEQ ID NO: 360306 - DNA, 20 bp, Artificial
  CRISPR gRNA sequence
tatacctttggaagctaggt

SEQ ID NO: 360307 - DNA, 20 bp, Artificial
  CRISPR gRNA sequence
cctttggaagctaggtcaga

SEQ ID NO: 360308 - DNA, 20 bp, Artificial
  CRISPR gRNA sequence
aagctaggtcagaaagaact

SEQ ID NO: 360309 - DNA, 20 bp, Artificial
  CRISPR gRNA sequence
taaatatgcttcctatgaat

SEQ ID NO: 360310 - DNA, 20 bp, Artificial
  CRISPR gRNA sequence
tacgcgccattttttaaatg

SEQ ID NO: 360311 - DNA, 20 bp, Artificial
  CRISPR gRNA sequence
aatgcggaaactaattgaaa

SEQ ID NO: 360312 - DNA, 20 bp, Artificial
  CRISPR gRNA sequence
atagttgctttgaaatattt

SEQ ID NO: 360313 - DNA, 20 bp, Artificial
  CRISPR gRNA sequence
tgctttgaaatatttaagct

SEQ ID NO: 360314 - DNA, 20 bp, Artificial
  CRISPR gRNA sequence
tcagtgtttgccattctcct

SEQ ID NO: 360315 - DNA, 20 bp, Artificial
  CRISPR gRNA sequence
tcactacacactctttttct

SEQ ID NO: 360316 - DNA, 20 bp, Artificial
  CRISPR gRNA sequence
tacacactctttttctaagt

SEQ ID NO: 360317 - DNA, 20 bp, Artificial
  CRISPR gRNA sequence
acacactctttttctaagtt

SEQ ID NO: 360318 - DNA, 20 bp, Artificial
  CRISPR gRNA sequence
cacactctttttctaagtta

SEQ ID NO: 360319 - DNA, 20 bp, Artificial
  CRISPR gRNA sequence
tgacttccatttcccctgca

SEQ ID NO: 360320 - DNA, 20 bp, Artificial
  CRISPR gRNA sequence
gcatagtacgcacttccccg

SEQ ID NO: 360321 - DNA, 20 bp, Artificial
  CRISPR gRNA sequence
ccataattttaaatatttta

SEQ ID NO: 360322 - DNA, 20 bp, Artificial
  CRISPR gRNA sequence
ctctacaattgccttcataa

SEQ ID NO: 360323 - DNA, 20 bp, Artificial
  CRISPR gRNA sequence
gcttcctaactctactgtct

SEQ ID NO: 360324 - DNA, 20 bp, Artificial
  CRISPR gRNA sequence
aattacatttttcacattta

SEQ ID NO: 360325 - DNA, 20 bp, Artificial
  CRISPR gRNA sequence
attacatttttcacatttat

SEQ ID NO: 360326 - DNA, 20 bp, Artificial
  CRISPR gRNA sequence
tttataggtttgtcttttaa

SEQ ID NO: 360327 - DNA, 20 bp, Artificial
  CRISPR gRNA sequence
aaaagcaaaacaaaacaaaa

SEQ ID NO: 360328 - DNA, 20 bp, Artificial
  CRISPR gRNA sequence
aacaaaaaagccataaaatt

SEQ ID NO: 360329 - DNA, 20 bp, Artificial
  CRISPR gRNA sequence
acaaaaaagccataaaattt

SEQ ID NO: 360330 - DNA, 20 bp, Artificial
  CRISPR gRNA sequence
caaaaaagccataaaatttg

SEQ ID NO: 360331 - DNA, 20 bp, Artificial
  CRISPR gRNA sequence
aagccataaaatttggggat

SEQ ID NO: 360332 - DNA, 20 bp, Artificial
  CRISPR gRNA sequence
tggggatcagaatcaaatca

SEQ ID NO: 360333 - DNA, 20 bp, Artificial
  CRISPR gRNA sequence
ggggatcagaatcaaatcac

SEQ ID NO: 360334 - DNA, 20 bp, Artificial
  CRISPR gRNA sequence
aatcaaatcacaggatgtgc

SEQ ID NO: 360335 - DNA, 20 bp, Artificial
  CRISPR gRNA sequence
tcaaatcacaggatgtgcca

SEQ ID NO: 360336 - DNA, 20 bp, Artificial
  CRISPR gRNA sequence
atcacaggatgtgccagagc

SEQ ID NO: 360337 - DNA, 20 bp, Artificial
  CRISPR gRNA sequence
acaggatgtgccagagccag

SEQ ID NO: 360338 - DNA, 20 bp, Artificial
  CRISPR gRNA sequence
agagccagtggtaatgatta

SEQ ID NO: 360339 - DNA, 20 bp, Artificial
  CRISPR gRNA sequence
ttacagatataccctaatgt

SEQ ID NO: 360340 - DNA, 20 bp, Artificial
  CRISPR gRNA sequence
tacagatataccctaatgtg

SEQ ID NO: 360341 - DNA, 20 bp, Artificial
  CRISPR gRNA sequence
ccctaatgtgaggtttattg

SEQ ID NO: 360342 - DNA, 20 bp, Artificial
  CRISPR gRNA sequence
gcagttgtgctatttcattt

SEQ ID NO: 360343 - DNA, 20 bp, Artificial
  CRISPR gRNA sequence
agttgtgctatttcatttca

SEQ ID NO: 360344 - DNA, 20 bp, Artificial
  CRISPR gRNA sequence
gttgtgctatttcatttcag

SEQ ID NO: 360345 - DNA, 20 bp, Artificial
  CRISPR gRNA sequence
atttcagaggtatattactg

SEQ ID NO: 360346 - DNA, 20 bp, Artificial
  CRISPR gRNA sequence
ggtatattactgtagaataa

SEQ ID NO: 360347 - DNA, 20 bp, Artificial
  CRISPR gRNA sequence
attactgtagaataacagtt

SEQ ID NO: 360348 - DNA, 20 bp, Artificial
  CRISPR gRNA sequence
tactgtagaataacagttaa

SEQ ID NO: 360349 - DNA, 20 bp, Artificial
  CRISPR gRNA sequence
gaataacagttaagagaaca

SEQ ID NO: 360350 - DNA, 20 bp, Artificial
  CRISPR gRNA sequence
gcatattttttgcctgtcaa

SEQ ID NO: 360351 - DNA, 20 bp, Artificial
  CRISPR gRNA sequence
atagattcaattgcatttta

SEQ ID NO: 360352 - DNA, 20 bp, Artificial
  CRISPR gRNA sequence
cagcaaaaataatttactcg

SEQ ID NO: 360353 - DNA, 20 bp, Artificial
  CRISPR gRNA sequence
agcaaaaataatttactcgc

SEQ ID NO: 360354 - DNA, 20 bp, Artificial
  CRISPR gRNA sequence
atttactcgcaggtttaaat

SEQ ID NO: 360355 - DNA, 20 bp, Artificial
  CRISPR gRNA sequence
caggtttaaattagacatct

SEQ ID NO: 360356 - DNA, 20 bp, Artificial
  CRISPR gRNA sequence
aaataaatcactgatgattt

SEQ ID NO: 360357 - DNA, 20 bp, Artificial
  CRISPR gRNA sequence
tcactgatgatttcagcaac

SEQ ID NO: 360358 - DNA, 20 bp, Artificial
  CRISPR gRNA sequence
actgatgatttcagcaacca

SEQ ID NO: 360359 - DNA, 20 bp, Artificial
  CRISPR gRNA sequence
agcaaccagagataaccaca

SEQ ID NO: 360360 - DNA, 20 bp, Artificial
  CRISPR gRNA sequence
aaaaacttcaatgtatattt

SEQ ID NO: 360361 - DNA, 20 bp, Artificial
  CRISPR gRNA sequence
aaaacttcaatgtatatttc

SEQ ID NO: 360362 - DNA, 20 bp, Artificial
  CRISPR gRNA sequence
ttcaatgtatatttcaggaa

SEQ ID NO: 360363 - DNA, 20 bp, Artificial
  CRISPR gRNA sequence
atttcaggaaaagattaatt

SEQ ID NO: 360364 - DNA, 20 bp, Artificial
  CRISPR gRNA sequence
gaaaagattaatttggtgtg

SEQ ID NO: 360365 - DNA, 20 bp, Artificial
  CRISPR gRNA sequence
ggttacttataaaatcatgt

SEQ ID NO: 360366 - DNA, 20 bp, Artificial
  CRISPR gRNA sequence
ttacttataaaatcatgtaa

SEQ ID NO: 360367 - DNA, 20 bp, Artificial
  CRISPR gRNA sequence
taaaatcatgtaagagtaac

SEQ ID NO: 360368 - DNA, 20 bp, Artificial
  CRISPR gRNA sequence
acaaaaccaattttaaataa

SEQ ID NO: 360369 - DNA, 20 bp, Artificial
  CRISPR gRNA sequence
aattttaaataatagaattt

SEQ ID NO: 360370 - DNA, 20 bp, Artificial
  CRISPR gRNA sequence
aatagaatttaagaatgctc

SEQ ID NO: 360371 - DNA, 20 bp, Artificial
  CRISPR gRNA sequence
ttaagaatgctctagtccta

SEQ ID NO: 360372 - DNA, 20 bp, Artificial
  CRISPR gRNA sequence
tctagtcctaaagaataatt

SEQ ID NO: 360373 - DNA, 20 bp, Artificial
  CRISPR gRNA sequence
ctatttcctctcccaaaata

SEQ ID NO: 360374 - DNA, 20 bp, Artificial
  CRISPR gRNA sequence
tcctctcccaaaatatagtt

SEQ ID NO: 360375 - DNA, 20 bp, Artificial
  CRISPR gRNA sequence
aaatatagttcggatgctga

SEQ ID NO: 360376 - DNA, 20 bp, Artificial
  CRISPR gRNA sequence
aaatacaccttaaaaaataa

SEQ ID NO: 360377 - DNA, 20 bp, Artificial
  CRISPR gRNA sequence
aatacaccttaaaaaataaa

SEQ ID NO: 360378 - DNA, 20 bp, Artificial
  CRISPR gRNA sequence
aaaaaataaaaggtaaaata

SEQ ID NO: 360379 - DNA, 20 bp, Artificial
  CRISPR gRNA sequence
aaaaataaaaggtaaaatat

SEQ ID NO: 360380 - DNA, 20 bp, Artificial
  CRISPR gRNA sequence
aaaggtaaaatataggctgt

SEQ ID NO: 360381 - DNA, 20 bp, Artificial
  CRISPR gRNA sequence
gtactgaataaaataccctc

SEQ ID NO: 360382 - DNA, 20 bp, Artificial
  CRISPR gRNA sequence
tgaataaaataccctccgga

SEQ ID NO: 360383 - DNA, 20 bp, Artificial
  CRISPR gRNA sequence
aaaacatttatcatctcaac

SEQ ID NO: 360384 - DNA, 20 bp, Artificial
  CRISPR gRNA sequence
aatgatgtgtttgattcata

SEQ ID NO: 360385 - DNA, 20 bp, Artificial
  CRISPR gRNA sequence
gattcataaagtaatacaaa

SEQ ID NO: 360386 - DNA, 20 bp, Artificial
  CRISPR gRNA sequence
atatttgttttcctgatgtt

SEQ ID NO: 360387 - DNA, 20 bp, Artificial
  CRISPR gRNA sequence
tgttttcctgatgtttagac

SEQ ID NO: 360388 - DNA, 20 bp, Artificial
  CRISPR gRNA sequence
accacacaatattttttaat

SEQ ID NO: 360389 - DNA, 20 bp, Artificial
  CRISPR gRNA sequence
aatattttttaatgagtcat

SEQ ID NO: 360390 - DNA, 20 bp, Artificial
  CRISPR gRNA sequence
tttttaatgagtcattggac

SEQ ID NO: 360391 - DNA, 20 bp, Artificial
  CRISPR gRNA sequence
agtcattggactagaaatct

SEQ ID NO: 360392 - DNA, 20 bp, Artificial
  CRISPR gRNA sequence
tatctttcatactaaataca

SEQ ID NO: 360393 - DNA, 20 bp, Artificial
  CRISPR gRNA sequence
taaatacacggttcatccac

SEQ ID NO: 360394 - DNA, 20 bp, Artificial
  CRISPR gRNA sequence
aaatacacggttcatccact

SEQ ID NO: 360395 - DNA, 20 bp, Artificial
  CRISPR gRNA sequence
aatacacggttcatccacta

SEQ ID NO: 360396 - DNA, 20 bp, Artificial
  CRISPR gRNA sequence
ccactagggtatcaacctac

SEQ ID NO: 360397 - DNA, 20 bp, Artificial
  CRISPR gRNA sequence
cactagggtatcaacctact

SEQ ID NO: 360398 - DNA, 20 bp, Artificial
  CRISPR gRNA sequence
actagggtatcaacctacta

SEQ ID NO: 360399 - DNA, 20 bp, Artificial
  CRISPR gRNA sequence
ctagggtatcaacctactag

SEQ ID NO: 360400 - DNA, 20 bp, Artificial
  CRISPR gRNA sequence
tttttatacattttgtacat

SEQ ID NO: 360401 - DNA, 20 bp, Artificial
  CRISPR gRNA sequence
ttttatacattttgtacata

SEQ ID NO: 360402 - DNA, 20 bp, Artificial
  CRISPR gRNA sequence
tttatacattttgtacataa

SEQ ID NO: 360403 - DNA, 20 bp, Artificial
  CRISPR gRNA sequence
acattttgtacataagggaa

SEQ ID NO: 360404 - DNA, 20 bp, Artificial
  CRISPR gRNA sequence
ttgtacataagggaacagac

SEQ ID NO: 360405 - DNA, 20 bp, Artificial
  CRISPR gRNA sequence
gagattcttatactcaatat

SEQ ID NO: 360406 - DNA, 20 bp, Artificial
  CRISPR gRNA sequence
tactcaatatgagcacccaa

SEQ ID NO: 360407 - DNA, 20 bp, Artificial
  CRISPR gRNA sequence
actcaatatgagcacccaat

SEQ ID NO: 360408 - DNA, 20 bp, Artificial
  CRISPR gRNA sequence
gcactcattatatgctcatc

SEQ ID NO: 360409 - DNA, 20 bp, Artificial
  CRISPR gRNA sequence
atgctcatcaagtttgcttt

SEQ ID NO: 360410 - DNA, 20 bp, Artificial
  CRISPR gRNA sequence
tgctcatcaagtttgcttta

SEQ ID NO: 360411 - DNA, 20 bp, Artificial
  CRISPR gRNA sequence
gctcatcaagtttgctttaa

SEQ ID NO: 360412 - DNA, 20 bp, Artificial
  CRISPR gRNA sequence
agtttgctttaagggatgtt

SEQ ID NO: 360413 - DNA, 20 bp, Artificial
  CRISPR gRNA sequence
tttgctttaagggatgttga

SEQ ID NO: 360414 - DNA, 20 bp, Artificial
  CRISPR gRNA sequence
tgctttaagggatgttgaga

SEQ ID NO: 360415 - DNA, 20 bp, Artificial
  CRISPR gRNA sequence
tttaagggatgttgagagag

SEQ ID NO: 360416 - DNA, 20 bp, Artificial
  CRISPR gRNA sequence
aattctgaacctttgtgaca

SEQ ID NO: 360417 - DNA, 20 bp, Artificial
  CRISPR gRNA sequence
ccttctgacaatctctatct

SEQ ID NO: 360418 - DNA, 20 bp, Artificial
  CRISPR gRNA sequence
tccccacatgacctgctatc

SEQ ID NO: 360419 - DNA, 20 bp, Artificial
  CRISPR gRNA sequence
tgacctgctatcaagatttg

SEQ ID NO: 360420 - DNA, 20 bp, Artificial
  CRISPR gRNA sequence
tgctatcaagatttgaagcc

SEQ ID NO: 360421 - DNA, 20 bp, Artificial
  CRISPR gRNA sequence
tgtcacttcctcctccttaa

SEQ ID NO: 360422 - DNA, 20 bp, Artificial
  CRISPR gRNA sequence
tctctgctttcccacttgaa

SEQ ID NO: 360423 - DNA, 20 bp, Artificial
  CRISPR gRNA sequence
ctctgctttcccacttgaac

SEQ ID NO: 360424 - DNA, 20 bp, Artificial
  CRISPR gRNA sequence
ttcttatcatcacctctccc

SEQ ID NO: 360425 - DNA, 20 bp, Artificial
  CRISPR gRNA sequence
tcttatcatcacctctcccc

SEQ ID NO: 360426 - DNA, 20 bp, Artificial
  CRISPR gRNA sequence
tatcatcacctctccccagg

SEQ ID NO: 360427 - DNA, 20 bp, Artificial
  CRISPR gRNA sequence
tctccccaggtggtaatgac

SEQ ID NO: 360428 - DNA, 20 bp, Artificial
  CRISPR gRNA sequence
ctccccaggtggtaatgaca

SEQ ID NO: 360429 - DNA, 20 bp, Artificial
  CRISPR gRNA sequence
tccccaggtggtaatgacaa

SEQ ID NO: 360430 - DNA, 20 bp, Artificial
  CRISPR gRNA sequence
aattctctatatacattaca

SEQ ID NO: 360431 - DNA, 20 bp, Artificial
  CRISPR gRNA sequence
tctatatacattacatagta

SEQ ID NO: 360432 - DNA, 20 bp, Artificial
  CRISPR gRNA sequence
tatacattacatagtacagc

SEQ ID NO: 360433 - DNA, 20 bp, Artificial
  CRISPR gRNA sequence
tacattacatagtacagcca

SEQ ID NO: 360434 - DNA, 20 bp, Artificial
  CRISPR gRNA sequence
ccagagtaatctttgtaaaa

SEQ ID NO: 360435 - DNA, 20 bp, Artificial
  CRISPR gRNA sequence
taatctttgtaaaacagatc

SEQ ID NO: 360436 - DNA, 20 bp, Artificial
  CRISPR gRNA sequence
taaaacagatctggccctat

SEQ ID NO: 360437 - DNA, 20 bp, Artificial
  CRISPR gRNA sequence
gatctggccctattagtccc

SEQ ID NO: 360438 - DNA, 20 bp, Artificial
  CRISPR gRNA sequence
taaaattctatgtatcccca

SEQ ID NO: 360439 - DNA, 20 bp, Artificial
  CRISPR gRNA sequence
ctatgtatccccaaagcctc

SEQ ID NO: 360440 - DNA, 20 bp, Artificial
  CRISPR gRNA sequence
tatgtatccccaaagcctcc

SEQ ID NO: 360441 - DNA, 20 bp, Artificial
  CRISPR gRNA sequence
aggataaaattcaaacttct

SEQ ID NO: 360442 - DNA, 20 bp, Artificial
  CRISPR gRNA sequence
aacttctcagcacatattct

SEQ ID NO: 360443 - DNA, 20 bp, Artificial
  CRISPR gRNA sequence
acttctcagcacatattcta

SEQ ID NO: 360444 - DNA, 20 bp, Artificial
  CRISPR gRNA sequence
gcacatattctaaggcctaa

SEQ ID NO: 360445 - DNA, 20 bp, Artificial
  CRISPR gRNA sequence
catattctaaggcctaatag

SEQ ID NO: 360446 - DNA, 20 bp, Artificial
  CRISPR gRNA sequence
attctaaggcctaatagaag

SEQ ID NO: 360447 - DNA, 20 bp, Artificial
  CRISPR gRNA sequence
aggcctaatagaagtagtca

SEQ ID NO: 360448 - DNA, 20 bp, Artificial
  CRISPR gRNA sequence
gaagtagtcatggtttctcc

SEQ ID NO: 360449 - DNA, 20 bp, Artificial
  CRISPR gRNA sequence
gtcatggtttctccaagtgt

SEQ ID NO: 360450 - DNA, 20 bp, Artificial
  CRISPR gRNA sequence
gtttctccaagtgtcagctc

SEQ ID NO: 360451 - DNA, 20 bp, Artificial
  CRISPR gRNA sequence
tccaccactcaccttgcccc

SEQ ID NO: 360452 - DNA, 20 bp, Artificial
  CRISPR gRNA sequence
ccaccactcaccttgcccct

SEQ ID NO: 360453 - DNA, 20 bp, Artificial
  CRISPR gRNA sequence
cttgcccctgggctcattct

SEQ ID NO: 360454 - DNA, 20 bp, Artificial
  CRISPR gRNA sequence
tccatctcacgtctgaactc

SEQ ID NO: 360455 - DNA, 20 bp, Artificial
  CRISPR gRNA sequence
ctcacgtctgaactctggac

SEQ ID NO: 360456 - DNA, 20 bp, Artificial
  CRISPR gRNA sequence
tcacgtctgaactctggacc

SEQ ID NO: 360457 - DNA, 20 bp, Artificial
  CRISPR gRNA sequence
gaccaggacactccctcccc

SEQ ID NO: 360458 - DNA, 20 bp, Artificial
  CRISPR gRNA sequence
tgctttctgcctcttccatt

SEQ ID NO: 360459 - DNA, 20 bp, Artificial
  CRISPR gRNA sequence
cctcttccattgagctttcc

SEQ ID NO: 360460 - DNA, 20 bp, Artificial
  CRISPR gRNA sequence
ctcttccattgagctttcct

SEQ ID NO: 360461 - DNA, 20 bp, Artificial
  CRISPR gRNA sequence
ctgggttgctcctcctcctc

SEQ ID NO: 360462 - DNA, 20 bp, Artificial
  CRISPR gRNA sequence
gttgctcctcctcctcaagc

SEQ ID NO: 360463 - DNA, 20 bp, Artificial
  CRISPR gRNA sequence
ttgctcctcctcctcaagct

SEQ ID NO: 360464 - DNA, 20 bp, Artificial
  CRISPR gRNA sequence
tgcactttatgctcatattt

SEQ ID NO: 360465 - DNA, 20 bp, Artificial
  CRISPR gRNA sequence
tatatgcacctcttcattta

SEQ ID NO: 360466 - DNA, 20 bp, Artificial
  CRISPR gRNA sequence
tcatttacagtgctgctcct

SEQ ID NO: 360467 - DNA, 20 bp, Artificial
  CRISPR gRNA sequence
cctaagatatgcctcttgtg

SEQ ID NO: 360468 - DNA, 20 bp, Artificial
  CRISPR gRNA sequence
tgttgacttttttaaaaata

SEQ ID NO: 360469 - DNA, 20 bp, Artificial
  CRISPR gRNA sequence
acttttttaaaaataaagca

SEQ ID NO: 360470 - DNA, 20 bp, Artificial
  CRISPR gRNA sequence
cttttttaaaaataaagcac

SEQ ID NO: 360471 - DNA, 20 bp, Artificial
  CRISPR gRNA sequence
tatgttctcctacctgattt

SEQ ID NO: 360472 - DNA, 20 bp, Artificial
  CRISPR gRNA sequence
ttctcctacctgattttagt

SEQ ID NO: 360473 - DNA, 20 bp, Artificial
  CRISPR gRNA sequence
cctacctgattttagtgagt

SEQ ID NO: 360474 - DNA, 20 bp, Artificial
  CRISPR gRNA sequence
ttttagtgagttagcgctgt

SEQ ID NO: 360475 - DNA, 20 bp, Artificial
  CRISPR gRNA sequence
gtgagttagcgctgtcagtt

SEQ ID NO: 360476 - DNA, 20 bp, Artificial
  CRISPR gRNA sequence
ttagcgctgtcagtttagtt

SEQ ID NO: 360477 - DNA, 20 bp, Artificial
  CRISPR gRNA sequence
tgtcagtttagttaagttga

SEQ ID NO: 360478 - DNA, 20 bp, Artificial
  CRISPR gRNA sequence
tttagttaagttgatagttt

SEQ ID NO: 360479 - DNA, 20 bp, Artificial
  CRISPR gRNA sequence
tttgagtttacttttccaaa

SEQ ID NO: 360480 - DNA, 20 bp, Artificial
  CRISPR gRNA sequence
ttgagtttacttttccaaat

SEQ ID NO: 360481 - DNA, 20 bp, Artificial
  CRISPR gRNA sequence
tcgtctatcattgtgaactt

SEQ ID NO: 360482 - DNA, 20 bp, Artificial
  CRISPR gRNA sequence
cgtctatcattgtgaacttc

SEQ ID NO: 360483 - DNA, 20 bp, Artificial
  CRISPR gRNA sequence
atgtgtataaatatatcttt

SEQ ID NO: 360484 - DNA, 20 bp, Artificial
  CRISPR gRNA sequence
tatatctttaagtcttcata

SEQ ID NO: 360485 - DNA, 20 bp, Artificial
  CRISPR gRNA sequence
taagtcttcatacagcttct

SEQ ID NO: 360486 - DNA, 20 bp, Artificial
  CRISPR gRNA sequence
cttcatacagcttcttggac

SEQ ID NO: 360487 - DNA, 20 bp, Artificial
  CRISPR gRNA sequence
ttcatacagcttcttggaca

SEQ ID NO: 360488 - DNA, 20 bp, Artificial
  CRISPR gRNA sequence
tcatacagcttcttggacaa

SEQ ID NO: 360489 - DNA, 20 bp, Artificial
  CRISPR gRNA sequence
catacagcttcttggacaag

SEQ ID NO: 360490 - DNA, 20 bp, Artificial
  CRISPR gRNA sequence
atacagcttcttggacaagg

SEQ ID NO: 360491 - DNA, 20 bp, Artificial
  CRISPR gRNA sequence
tacagcttcttggacaaggg

SEQ ID NO: 360492 - DNA, 20 bp, Artificial
  CRISPR gRNA sequence
cagcttcttggacaaggggg

SEQ ID NO: 360493 - DNA, 20 bp, Artificial
  CRISPR gRNA sequence
acaaggggggagtcattgaa

SEQ ID NO: 360494 - DNA, 20 bp, Artificial
  CRISPR gRNA sequence
caaggggggagtcattgaaa

SEQ ID NO: 360495 - DNA, 20 bp, Artificial
  CRISPR gRNA sequence
ggagtcattgaaaaggatca

SEQ ID NO: 360496 - DNA, 20 bp, Artificial
  CRISPR gRNA sequence
attgaaaaggatcaaagatt

SEQ ID NO: 360497 - DNA, 20 bp, Artificial
  CRISPR gRNA sequence
tccattgttgattatgcttt

SEQ ID NO: 360498 - DNA, 20 bp, Artificial
  CRISPR gRNA sequence
ttgattatgctttgagatca

SEQ ID NO: 360499 - DNA, 20 bp, Artificial
  CRISPR gRNA sequence
gattatgctttgagatcaca

SEQ ID NO: 360500 - DNA, 20 bp, Artificial
  CRISPR gRNA sequence
attatgctttgagatcacag

SEQ ID NO: 360501 - DNA, 20 bp, Artificial
  CRISPR gRNA sequence
ttatgctttgagatcacaga

SEQ ID NO: 360502 - DNA, 20 bp, Artificial
  CRISPR gRNA sequence
tgctttgagatcacagaggg

SEQ ID NO: 360503 - DNA, 20 bp, Artificial
  CRISPR gRNA sequence
gagatcacagagggaagtta

SEQ ID NO: 360504 - DNA, 20 bp, Artificial
  CRISPR gRNA sequence
cacagagggaagttatagtg

SEQ ID NO: 360505 - DNA, 20 bp, Artificial
  CRISPR gRNA sequence
acagagggaagttatagtga

SEQ ID NO: 360506 - DNA, 20 bp, Artificial
  CRISPR gRNA sequence
aagttatagtgaaggaaaat

SEQ ID NO: 360507 - DNA, 20 bp, Artificial
  CRISPR gRNA sequence
ttatagtgaaggaaaatgag

SEQ ID NO: 360508 - DNA, 20 bp, Artificial
  CRISPR gRNA sequence
agtggtttgaattcactcca

SEQ ID NO: 360509 - DNA, 20 bp, Artificial
  CRISPR gRNA sequence
tggtttgaattcactccaaa

SEQ ID NO: 360510 - DNA, 20 bp, Artificial
  CRISPR gRNA sequence
ggtttgaattcactccaaag

SEQ ID NO: 360511 - DNA, 20 bp, Artificial
  CRISPR gRNA sequence
tttgaattcactccaaagag

SEQ ID NO: 360512 - DNA, 20 bp, Artificial
  CRISPR gRNA sequence
ttcactccaaagaggagcaa

SEQ ID NO: 360513 - DNA, 20 bp, Artificial
  CRISPR gRNA sequence
cactccaaagaggagcaaaa

SEQ ID NO: 360514 - DNA, 20 bp, Artificial
  CRISPR gRNA sequence
aaaagagctttataatgacc

SEQ ID NO: 360515 - DNA, 20 bp, Artificial
  CRISPR gRNA sequence
aagagctttataatgaccaa

SEQ ID NO: 360516 - DNA, 20 bp, Artificial
  CRISPR gRNA sequence
ttataatgaccaagagcccc

SEQ ID NO: 360517 - DNA, 20 bp, Artificial
  CRISPR gRNA sequence
ggctctaaaaccttgaaaac

SEQ ID NO: 360518 - DNA, 20 bp, Artificial
  CRISPR gRNA sequence
ctaaaaccttgaaaacaagt

SEQ ID NO: 360519 - DNA, 20 bp, Artificial
  CRISPR gRNA sequence
cccactgaacccacctaccc

SEQ ID NO: 360520 - DNA, 20 bp, Artificial
  CRISPR gRNA sequence
ccactgaacccacctaccca

SEQ ID NO: 360521 - DNA, 20 bp, Artificial
  CRISPR gRNA sequence
ccacctacccaaggccatat

SEQ ID NO: 360522 - DNA, 20 bp, Artificial
  CRISPR gRNA sequence
agattaaatttgtgcctcac

SEQ ID NO: 360523 - DNA, 20 bp, Artificial
  CRISPR gRNA sequence
tgtgcctcaccagccacacc

SEQ ID NO: 360524 - DNA, 20 bp, Artificial
  CRISPR gRNA sequence
cctcaccagccacaccaagc

SEQ ID NO: 360525 - DNA, 20 bp, Artificial
  CRISPR gRNA sequence
ctcaccagccacaccaagca

SEQ ID NO: 360526 - DNA, 20 bp, Artificial
  CRISPR gRNA sequence
caccagccacaccaagcaag

SEQ ID NO: 360527 - DNA, 20 bp, Artificial
  CRISPR gRNA sequence
cagccacaccaagcaaggag

SEQ ID NO: 360528 - DNA, 20 bp, Artificial
  CRISPR gRNA sequence
agccacaccaagcaaggaga

SEQ ID NO: 360529 - DNA, 20 bp, Artificial
  CRISPR gRNA sequence
gccacaccaagcaaggagaa

SEQ ID NO: 360530 - DNA, 20 bp, Artificial
  CRISPR gRNA sequence
accaagcaaggagaagggca

SEQ ID NO: 360531 - DNA, 20 bp, Artificial
  CRISPR gRNA sequence
ggagaagggcacagccaatt

SEQ ID NO: 360532 - DNA, 20 bp, Artificial
  CRISPR gRNA sequence
agccaatttagtcttcaaca

SEQ ID NO: 360533 - DNA, 20 bp, Artificial
  CRISPR gRNA sequence
ccaatttagtcttcaacatg

SEQ ID NO: 360534 - DNA, 20 bp, Artificial
  CRISPR gRNA sequence
caatttagtcttcaacatgg

SEQ ID NO: 360535 - DNA, 20 bp, Artificial
  CRISPR gRNA sequence
ttagtcttcaacatggaggt

SEQ ID NO: 360536 - DNA, 20 bp, Artificial
  CRISPR gRNA sequence
aattaaacaaatctactttt

SEQ ID NO: 360537 - DNA, 20 bp, Artificial
  CRISPR gRNA sequence
attaaacaaatctactttta

SEQ ID NO: 360538 - DNA, 20 bp, Artificial
  CRISPR gRNA sequence
ttaaacaaatctacttttaa

SEQ ID NO: 360539 - DNA, 20 bp, Artificial
  CRISPR gRNA sequence
gtctattgtaaaatatgtgt

SEQ ID NO: 360540 - DNA, 20 bp, Artificial
  CRISPR gRNA sequence
tctattgtaaaatatgtgtg

SEQ ID NO: 360541 - DNA, 20 bp, Artificial
  CRISPR gRNA sequence
tatgtgtgaggcaatgttga

SEQ ID NO: 360542 - DNA, 20 bp, Artificial
  CRISPR gRNA sequence
atgtgtgaggcaatgttgat

SEQ ID NO: 360543 - DNA, 20 bp, Artificial
  CRISPR gRNA sequence
tgaggcaatgttgatgggac

SEQ ID NO: 360544 - DNA, 20 bp, Artificial
  CRISPR gRNA sequence
aagacccatcacgtccctga

SEQ ID NO: 360545 - DNA, 20 bp, Artificial
  CRISPR gRNA sequence
gacccatcacgtccctgaaa

SEQ ID NO: 360546 - DNA, 20 bp, Artificial
  CRISPR gRNA sequence
tccctgaaagagcttacaaa

SEQ ID NO: 360547 - DNA, 20 bp, Artificial
  CRISPR gRNA sequence
cctgaaagagcttacaaaaa

SEQ ID NO: 360548 - DNA, 20 bp, Artificial
  CRISPR gRNA sequence
acctacttcaattacaaatt

SEQ ID NO: 360549 - DNA, 20 bp, Artificial
  CRISPR gRNA sequence
aaattcagttcaaaaatatt

SEQ ID NO: 360550 - DNA, 20 bp, Artificial
  CRISPR gRNA sequence
tcagttcaaaaatatttggt

SEQ ID NO: 360551 - DNA, 20 bp, Artificial
  CRISPR gRNA sequence
cagttcaaaaatatttggta

SEQ ID NO: 360552 - DNA, 20 bp, Artificial
  CRISPR gRNA sequence
agttcaaaaatatttggtaa

SEQ ID NO: 360553 - DNA, 20 bp, Artificial
  CRISPR gRNA sequence
aaaaatatttggtaagggcc

SEQ ID NO: 360554 - DNA, 20 bp, Artificial
  CRISPR gRNA sequence
ttggtaagggcctagtacat

SEQ ID NO: 360555 - DNA, 20 bp, Artificial
  CRISPR gRNA sequence
gtaagggcctagtacatgag

SEQ ID NO: 360556 - DNA, 20 bp, Artificial
  CRISPR gRNA sequence
ctagtacatgagaagtacta

SEQ ID NO: 360557 - DNA, 20 bp, Artificial
  CRISPR gRNA sequence
gtacatgagaagtactaaag

SEQ ID NO: 360558 - DNA, 20 bp, Artificial
  CRISPR gRNA sequence
agaagtactaaagaagctat

SEQ ID NO: 360559 - DNA, 20 bp, Artificial
  CRISPR gRNA sequence
gaagtactaaagaagctatt

SEQ ID NO: 360560 - DNA, 20 bp, Artificial
  CRISPR gRNA sequence
aagtactaaagaagctatta

SEQ ID NO: 360561 - DNA, 20 bp, Artificial
  CRISPR gRNA sequence
actaaagaagctattagggc

SEQ ID NO: 360562 - DNA, 20 bp, Artificial
  CRISPR gRNA sequence
ctaaagaagctattagggcc

SEQ ID NO: 360563 - DNA, 20 bp, Artificial
  CRISPR gRNA sequence
gaagctattagggccaggca

SEQ ID NO: 360564 - DNA, 20 bp, Artificial
  CRISPR gRNA sequence
gctattagggccaggcacgg

SEQ ID NO: 360565 - DNA, 20 bp, Artificial
  CRISPR gRNA sequence
gtggctcacgcctgtaatcc

SEQ ID NO: 360566 - DNA, 20 bp, Artificial
  CRISPR gRNA sequence
cgcctgtaatcccagcactt

SEQ ID NO: 360567 - DNA, 20 bp, Artificial
  CRISPR gRNA sequence
gcctgtaatcccagcacttt

SEQ ID NO: 360568 - DNA, 20 bp, Artificial
  CRISPR gRNA sequence
ctgtaatcccagcactttgg

SEQ ID NO: 360569 - DNA, 20 bp, Artificial
  CRISPR gRNA sequence
tgtaatcccagcactttggg

SEQ ID NO: 360570 - DNA, 20 bp, Artificial
  CRISPR gRNA sequence
tcccagcactttgggaggcc

SEQ ID NO: 360571 - DNA, 20 bp, Artificial
  CRISPR gRNA sequence
cccagcactttgggaggccg

SEQ ID NO: 360572 - DNA, 20 bp, Artificial
  CRISPR gRNA sequence
agcactttgggaggccgagg

SEQ ID NO: 360573 - DNA, 20 bp, Artificial
  CRISPR gRNA sequence
gcactttgggaggccgaggc

SEQ ID NO: 360574 - DNA, 20 bp, Artificial
  CRISPR gRNA sequence
ctttgggaggccgaggcagg

SEQ ID NO: 360575 - DNA, 20 bp, Artificial
  CRISPR gRNA sequence
ccgaggcaggtggatcacct

SEQ ID NO: 360576 - DNA, 20 bp, Artificial
  CRISPR gRNA sequence
cgaggcaggtggatcacctg

SEQ ID NO: 360577 - DNA, 20 bp, Artificial
  CRISPR gRNA sequence
gcaggtggatcacctgaggt

SEQ ID NO: 360578 - DNA, 20 bp, Artificial
  CRISPR gRNA sequence
caggtggatcacctgaggtc

SEQ ID NO: 360579 - DNA, 20 bp, Artificial
  CRISPR gRNA sequence
ggtggatcacctgaggtcag

SEQ ID NO: 360580 - DNA, 20 bp, Artificial
  CRISPR gRNA sequence
tcacctgaggtcaggagttt

SEQ ID NO: 360581 - DNA, 20 bp, Artificial
  CRISPR gRNA sequence
tgaggtcaggagtttgagac

SEQ ID NO: 360582 - DNA, 20 bp, Artificial
  CRISPR gRNA sequence
tcaggagtttgagaccagcc

SEQ ID NO: 360583 - DNA, 20 bp, Artificial
  CRISPR gRNA sequence
taaaaatacaaaaataaaat

SEQ ID NO: 360584 - DNA, 20 bp, Artificial
  CRISPR gRNA sequence
aatacaaaaataaaattagc

SEQ ID NO: 360585 - DNA, 20 bp, Artificial
  CRISPR gRNA sequence
atacaaaaataaaattagcc

SEQ ID NO: 360586 - DNA, 20 bp, Artificial
  CRISPR gRNA sequence
aaaataaaattagccaggtg

SEQ ID NO: 360587 - DNA, 20 bp, Artificial
  CRISPR gRNA sequence
ataaaattagccaggtgtgg

SEQ ID NO: 360588 - DNA, 20 bp, Artificial
  CRISPR gRNA sequence
aaattagccaggtgtggtgg

SEQ ID NO: 360589 - DNA, 20 bp, Artificial
  CRISPR gRNA sequence
aattagccaggtgtggtggc

SEQ ID NO: 360590 - DNA, 20 bp, Artificial
  CRISPR gRNA sequence
gtggcaggcacctgtaatcc

SEQ ID NO: 360591 - DNA, 20 bp, Artificial
  CRISPR gRNA sequence
cacctgtaatcccagctact

SEQ ID NO: 360592 - DNA, 20 bp, Artificial
  CRISPR gRNA sequence
acctgtaatcccagctactt

SEQ ID NO: 360593 - DNA, 20 bp, Artificial
  CRISPR gRNA sequence
ctgtaatcccagctacttgg

SEQ ID NO: 360594 - DNA, 20 bp, Artificial
  CRISPR gRNA sequence
tgtaatcccagctacttggg

SEQ ID NO: 360595 - DNA, 20 bp, Artificial
  CRISPR gRNA sequence
tcccagctacttgggaggct

SEQ ID NO: 360596 - DNA, 20 bp, Artificial
  CRISPR gRNA sequence
cccagctacttgggaggctg

SEQ ID NO: 360597 - DNA, 20 bp, Artificial
  CRISPR gRNA sequence
agctacttgggaggctgagg

SEQ ID NO: 360598 - DNA, 20 bp, Artificial
  CRISPR gRNA sequence
tacttgggaggctgaggcag

SEQ ID NO: 360599 - DNA, 20 bp, Artificial
  CRISPR gRNA sequence
gcagaagaatcacttgaact

SEQ ID NO: 360600 - DNA, 20 bp, Artificial
  CRISPR gRNA sequence
gaagaatcacttgaacttgg

SEQ ID NO: 360601 - DNA, 20 bp, Artificial
  CRISPR gRNA sequence
aagaatcacttgaacttggc

SEQ ID NO: 360602 - DNA, 20 bp, Artificial
  CRISPR gRNA sequence
aatcacttgaacttggcagg

SEQ ID NO: 360603 - DNA, 20 bp, Artificial
  CRISPR gRNA sequence
tcacttgaacttggcaggtg

SEQ ID NO: 360604 - DNA, 20 bp, Artificial
  CRISPR gRNA sequence
cacttgaacttggcaggtgg

SEQ ID NO: 360605 - DNA, 20 bp, Artificial
  CRISPR gRNA sequence
aacttggcaggtggaggttg

SEQ ID NO: 360606 - DNA, 20 bp, Artificial
  CRISPR gRNA sequence
tggcaggtggaggttgcggt

SEQ ID NO: 360607 - DNA, 20 bp, Artificial
  CRISPR gRNA sequence
ggtggaggttgcggtgagcc

SEQ ID NO: 360608 - DNA, 20 bp, Artificial
  CRISPR gRNA sequence
gagattgtgccattgcactc

SEQ ID NO: 360609 - DNA, 20 bp, Artificial
  CRISPR gRNA sequence
gtgccattgcactccagctt

SEQ ID NO: 360610 - DNA, 20 bp, Artificial
  CRISPR gRNA sequence
ttgcactccagctttggtga

SEQ ID NO: 360611 - DNA, 20 bp, Artificial
  CRISPR gRNA sequence
gcactccagctttggtgaca

SEQ ID NO: 360612 - DNA, 20 bp, Artificial
  CRISPR gRNA sequence
ctccagctttggtgacagag

SEQ ID NO: 360613 - DNA, 20 bp, Artificial
  CRISPR gRNA sequence
tccagctttggtgacagagt

SEQ ID NO: 360614 - DNA, 20 bp, Artificial
  CRISPR gRNA sequence
caaaaaataaattaattaaa

SEQ ID NO: 360615 - DNA, 20 bp, Artificial
  CRISPR gRNA sequence
aaaataaattaattaaaaag

SEQ ID NO: 360616 - DNA, 20 bp, Artificial
  CRISPR gRNA sequence
ttaattaaaaagcagctatt

SEQ ID NO: 360617 - DNA, 20 bp, Artificial
  CRISPR gRNA sequence
taattaaaaagcagctatta

SEQ ID NO: 360618 - DNA, 20 bp, Artificial
  CRISPR gRNA sequence
taaaaagcagctattaagga

SEQ ID NO: 360619 - DNA, 20 bp, Artificial
  CRISPR gRNA sequence
aaaagcagctattaaggata

SEQ ID NO: 360620 - DNA, 20 bp, Artificial
  CRISPR gRNA sequence
agcagctattaaggatagag

SEQ ID NO: 360621 - DNA, 20 bp, Artificial
  CRISPR gRNA sequence
ggatagagtggataatacct

SEQ ID NO: 360622 - DNA, 20 bp, Artificial
  CRISPR gRNA sequence
gatagagtggataatacctc

SEQ ID NO: 360623 - DNA, 20 bp, Artificial
  CRISPR gRNA sequence
agtggataatacctcaggca

SEQ ID NO: 360624 - DNA, 20 bp, Artificial
  CRISPR gRNA sequence
taatacctcaggcatggtct

SEQ ID NO: 360625 - DNA, 20 bp, Artificial
  CRISPR gRNA sequence
aggcatggtctcggtcctca

SEQ ID NO: 360626 - DNA, 20 bp, Artificial
  CRISPR gRNA sequence
ggcatggtctcggtcctcac

SEQ ID NO: 360627 - DNA, 20 bp, Artificial
  CRISPR gRNA sequence
gcatggtctcggtcctcaca

SEQ ID NO: 360628 - DNA, 20 bp, Artificial
  CRISPR gRNA sequence
gtctcggtcctcacagggct

SEQ ID NO: 360629 - DNA, 20 bp, Artificial
  CRISPR gRNA sequence
tctcggtcctcacagggctt

SEQ ID NO: 360630 - DNA, 20 bp, Artificial
  CRISPR gRNA sequence
cacagggcttaggaactaat

SEQ ID NO: 360631 - DNA, 20 bp, Artificial
  CRISPR gRNA sequence
acagggcttaggaactaata

SEQ ID NO: 360632 - DNA, 20 bp, Artificial
  CRISPR gRNA sequence
gggcttaggaactaataagg

SEQ ID NO: 360633 - DNA, 20 bp, Artificial
  CRISPR gRNA sequence
aaggaagccataaaactaaa

SEQ ID NO: 360634 - DNA, 20 bp, Artificial
  CRISPR gRNA sequence
tacaatgtaaaatgcactgt

SEQ ID NO: 360635 - DNA, 20 bp, Artificial
  CRISPR gRNA sequence
aatgcactgtgagctctgtg

SEQ ID NO: 360636 - DNA, 20 bp, Artificial
  CRISPR gRNA sequence
atgcactgtgagctctgtgc

SEQ ID NO: 360637 - DNA, 20 bp, Artificial
  CRISPR gRNA sequence
tgcactgtgagctctgtgca

SEQ ID NO: 360638 - DNA, 20 bp, Artificial
  CRISPR gRNA sequence
gtgagctctgtgcagggaca

SEQ ID NO: 360639 - DNA, 20 bp, Artificial
  CRISPR gRNA sequence
agctctgtgcagggacacag

SEQ ID NO: 360640 - DNA, 20 bp, Artificial
  CRISPR gRNA sequence
gctctgtgcagggacacagt

SEQ ID NO: 360641 - DNA, 20 bp, Artificial
  CRISPR gRNA sequence
tgtgcagggacacagtagga

SEQ ID NO: 360642 - DNA, 20 bp, Artificial
  CRISPR gRNA sequence
gtgcagggacacagtaggaa

SEQ ID NO: 360643 - DNA, 20 bp, Artificial
  CRISPR gRNA sequence
gcagggacacagtaggaaag

SEQ ID NO: 360644 - DNA, 20 bp, Artificial
  CRISPR gRNA sequence
ggacacagtaggaaaggagc

SEQ ID NO: 360645 - DNA, 20 bp, Artificial
  CRISPR gRNA sequence
acagtaggaaaggagccaga

SEQ ID NO: 360646 - DNA, 20 bp, Artificial
  CRISPR gRNA sequence
agtaggaaaggagccagata

SEQ ID NO: 360647 - DNA, 20 bp, Artificial
  CRISPR gRNA sequence
taggaaaggagccagataga

SEQ ID NO: 360648 - DNA, 20 bp, Artificial
  CRISPR gRNA sequence
tagagagcaatgtcttgact

SEQ ID NO: 360649 - DNA, 20 bp, Artificial
  CRISPR gRNA sequence
gagagcaatgtcttgacttg

SEQ ID NO: 360650 - DNA, 20 bp, Artificial
  CRISPR gRNA sequence
agcaatgtcttgacttggag

SEQ ID NO: 360651 - DNA, 20 bp, Artificial
  CRISPR gRNA sequence
caatgtcttgacttggagca

SEQ ID NO: 360652 - DNA, 20 bp, Artificial
  CRISPR gRNA sequence
cttgacttggagcagagcca

SEQ ID NO: 360653 - DNA, 20 bp, Artificial
  CRISPR gRNA sequence
tggagcagagccacagccat

SEQ ID NO: 360654 - DNA, 20 bp, Artificial
  CRISPR gRNA sequence
agcagagccacagccatcag

SEQ ID NO: 360655 - DNA, 20 bp, Artificial
  CRISPR gRNA sequence
gcagagccacagccatcagc

SEQ ID NO: 360656 - DNA, 20 bp, Artificial
  CRISPR gRNA sequence
cacagccatcagcaggcatc

SEQ ID NO: 360657 - DNA, 20 bp, Artificial
  CRISPR gRNA sequence
acagccatcagcaggcatcc

SEQ ID NO: 360658 - DNA, 20 bp, Artificial
  CRISPR gRNA sequence
cagccatcagcaggcatcca

SEQ ID NO: 360659 - DNA, 20 bp, Artificial
  CRISPR gRNA sequence
gcaggcatccagggcactta

SEQ ID NO: 360660 - DNA, 20 bp, Artificial
  CRISPR gRNA sequence
tatagacacccctgtgcaaa

SEQ ID NO: 360661 - DNA, 20 bp, Artificial
  CRISPR gRNA sequence
atagacacccctgtgcaaat

SEQ ID NO: 360662 - DNA, 20 bp, Artificial
  CRISPR gRNA sequence
tagacacccctgtgcaaata

SEQ ID NO: 360663 - DNA, 20 bp, Artificial
  CRISPR gRNA sequence
agacacccctgtgcaaatag

SEQ ID NO: 360664 - DNA, 20 bp, Artificial
  CRISPR gRNA sequence
acacccctgtgcaaataggg

SEQ ID NO: 360665 - DNA, 20 bp, Artificial
  CRISPR gRNA sequence
ctgtgcaaataggggagtca

SEQ ID NO: 360666 - DNA, 20 bp, Artificial
  CRISPR gRNA sequence
taggggagtcatggaaaata

SEQ ID NO: 360667 - DNA, 20 bp, Artificial
  CRISPR gRNA sequence
ggagtcatggaaaatacaga

SEQ ID NO: 360668 - DNA, 20 bp, Artificial
  CRISPR gRNA sequence
tcatggaaaatacagatgga

SEQ ID NO: 360669 - DNA, 20 bp, Artificial
  CRISPR gRNA sequence
tggaaaatacagatggaaag

SEQ ID NO: 360670 - DNA, 20 bp, Artificial
  CRISPR gRNA sequence
aaaatacagatggaaagtgg

SEQ ID NO: 360671 - DNA, 20 bp, Artificial
  CRISPR gRNA sequence
aaatacagatggaaagtgga

SEQ ID NO: 360672 - DNA, 20 bp, Artificial
  CRISPR gRNA sequence
cagatggaaagtggaaggcc

SEQ ID NO: 360673 - DNA, 20 bp, Artificial
  CRISPR gRNA sequence
tacgcatctgtataatttcg

SEQ ID NO: 360674 - DNA, 20 bp, Artificial
  CRISPR gRNA sequence
aatttcgtggactgaatgtg

SEQ ID NO: 360675 - DNA, 20 bp, Artificial
  CRISPR gRNA sequence
atttcgtggactgaatgtgt

SEQ ID NO: 360676 - DNA, 20 bp, Artificial
  CRISPR gRNA sequence
tttcgtggactgaatgtgtg

SEQ ID NO: 360677 - DNA, 20 bp, Artificial
  CRISPR gRNA sequence
cgtggactgaatgtgtgggg

SEQ ID NO: 360678 - DNA, 20 bp, Artificial
  CRISPR gRNA sequence
gtggactgaatgtgtggggc

SEQ ID NO: 360679 - DNA, 20 bp, Artificial
  CRISPR gRNA sequence
actgaatgtgtggggcaggc

SEQ ID NO: 360680 - DNA, 20 bp, Artificial
  CRISPR gRNA sequence
ggggcaggctagtgatactt

SEQ ID NO: 360681 - DNA, 20 bp, Artificial
  CRISPR gRNA sequence
gggcaggctagtgatacttc

SEQ ID NO: 360682 - DNA, 20 bp, Artificial
  CRISPR gRNA sequence
caggctagtgatacttcagg

SEQ ID NO: 360683 - DNA, 20 bp, Artificial
  CRISPR gRNA sequence
aggctagtgatacttcagga

SEQ ID NO: 360684 - DNA, 20 bp, Artificial
  CRISPR gRNA sequence
ggctagtgatacttcaggaa

SEQ ID NO: 360685 - DNA, 20 bp, Artificial
  CRISPR gRNA sequence
gtgatacttcaggaagggct

SEQ ID NO: 360686 - DNA, 20 bp, Artificial
  CRISPR gRNA sequence
agattgttgctgcactgata

SEQ ID NO: 360687 - DNA, 20 bp, Artificial
  CRISPR gRNA sequence
ttgctgcactgatacagaca

SEQ ID NO: 360688 - DNA, 20 bp, Artificial
  CRISPR gRNA sequence
tgctgcactgatacagacat

SEQ ID NO: 360689 - DNA, 20 bp, Artificial
  CRISPR gRNA sequence
atacagacatgggatgcaat

SEQ ID NO: 360690 - DNA, 20 bp, Artificial
  CRISPR gRNA sequence
acagacatgggatgcaatca

SEQ ID NO: 360691 - DNA, 20 bp, Artificial
  CRISPR gRNA sequence
cagacatgggatgcaatcag

SEQ ID NO: 360692 - DNA, 20 bp, Artificial
  CRISPR gRNA sequence
gacatgggatgcaatcagag

SEQ ID NO: 360693 - DNA, 20 bp, Artificial
  CRISPR gRNA sequence
acatgggatgcaatcagagg

SEQ ID NO: 360694 - DNA, 20 bp, Artificial
  CRISPR gRNA sequence
tgggatgcaatcagaggagg

SEQ ID NO: 360695 - DNA, 20 bp, Artificial
  CRISPR gRNA sequence
gggatgcaatcagaggaggt

SEQ ID NO: 360696 - DNA, 20 bp, Artificial
  CRISPR gRNA sequence
ggatgcaatcagaggaggtg

SEQ ID NO: 360697 - DNA, 20 bp, Artificial
  CRISPR gRNA sequence
gatgcaatcagaggaggtgg

SEQ ID NO: 360698 - DNA, 20 bp, Artificial
  CRISPR gRNA sequence
atcagaggaggtgggggcca

SEQ ID NO: 360699 - DNA, 20 bp, Artificial
  CRISPR gRNA sequence
tcagaggaggtgggggccat

SEQ ID NO: 360700 - DNA, 20 bp, Artificial
  CRISPR gRNA sequence
tgggggccatgggccctccc

SEQ ID NO: 360701 - DNA, 20 bp, Artificial
  CRISPR gRNA sequence
gggggccatgggccctccca

SEQ ID NO: 360702 - DNA, 20 bp, Artificial
  CRISPR gRNA sequence
ccatgggccctcccaaggcc

SEQ ID NO: 360703 - DNA, 20 bp, Artificial
  CRISPR gRNA sequence
gccctcccaaggcctagaaa

SEQ ID NO: 360704 - DNA, 20 bp, Artificial
  CRISPR gRNA sequence
tcccaaggcctagaaatgga

SEQ ID NO: 360705 - DNA, 20 bp, Artificial
  CRISPR gRNA sequence
ggcctagaaatggaaagatg

SEQ ID NO: 360706 - DNA, 20 bp, Artificial
  CRISPR gRNA sequence
ctagaaatggaaagatgaag

SEQ ID NO: 360707 - DNA, 20 bp, Artificial
  CRISPR gRNA sequence
tggaaagatgaagaagtatt

SEQ ID NO: 360708 - DNA, 20 bp, Artificial
  CRISPR gRNA sequence
ggaaagatgaagaagtattt

SEQ ID NO: 360709 - DNA, 20 bp, Artificial
  CRISPR gRNA sequence
ttaggaaataatgtcactgc

SEQ ID NO: 360710 - DNA, 20 bp, Artificial
  CRISPR gRNA sequence
aggaaataatgtcactgcca

SEQ ID NO: 360711 - DNA, 20 bp, Artificial
  CRISPR gRNA sequence
ggaaataatgtcactgccag

SEQ ID NO: 360712 - DNA, 20 bp, Artificial
  CRISPR gRNA sequence
aatgtcactgccagaggacc

SEQ ID NO: 360713 - DNA, 20 bp, Artificial
  CRISPR gRNA sequence
gtcactgccagaggacctgg

SEQ ID NO: 360714 - DNA, 20 bp, Artificial
  CRISPR gRNA sequence
gaggacctggcagccaaatg

SEQ ID NO: 360715 - DNA, 20 bp, Artificial
  CRISPR gRNA sequence
tggcagccaaatgaagaaaa

SEQ ID NO: 360716 - DNA, 20 bp, Artificial
  CRISPR gRNA sequence
gcagccaaatgaagaaaaaa

SEQ ID NO: 360717 - DNA, 20 bp, Artificial
  CRISPR gRNA sequence
aatgaagaaaaaagagccga

SEQ ID NO: 360718 - DNA, 20 bp, Artificial
  CRISPR gRNA sequence
atgaagaaaaaagagccgaa

SEQ ID NO: 360719 - DNA, 20 bp, Artificial
  CRISPR gRNA sequence
aagagccgaaaggaaataaa

SEQ ID NO: 360720 - DNA, 20 bp, Artificial
  CRISPR gRNA sequence
aaggaaataaatggcaaact

SEQ ID NO: 360721 - DNA, 20 bp, Artificial
  CRISPR gRNA sequence
ataaatggcaaactgagaaa

SEQ ID NO: 360722 - DNA, 20 bp, Artificial
  CRISPR gRNA sequence
taaatggcaaactgagaaaa

SEQ ID NO: 360723 - DNA, 20 bp, Artificial
  CRISPR gRNA sequence
aaaaaggttaacactttaaa

SEQ ID NO: 360724 - DNA, 20 bp, Artificial
  CRISPR gRNA sequence
cactttaaacagaaaatgtt

SEQ ID NO: 360725 - DNA, 20 bp, Artificial
  CRISPR gRNA sequence
ttaaacagaaaatgttcgga

SEQ ID NO: 360726 - DNA, 20 bp, Artificial
  CRISPR gRNA sequence
cagaaaatgttcggacagtt

SEQ ID NO: 360727 - DNA, 20 bp, Artificial
  CRISPR gRNA sequence
agaaaatgttcggacagttg

SEQ ID NO: 360728 - DNA, 20 bp, Artificial
  CRISPR gRNA sequence
gttcggacagttgaggcttc

SEQ ID NO: 360729 - DNA, 20 bp, Artificial
  CRISPR gRNA sequence
cttcaagcactgcgtccaat

SEQ ID NO: 360730 - DNA, 20 bp, Artificial
  CRISPR gRNA sequence
gcactgcgtccaatgagtac

SEQ ID NO: 360731 - DNA, 20 bp, Artificial
  CRISPR gRNA sequence
atgagtactggatattatct

SEQ ID NO: 360732 - DNA, 20 bp, Artificial
  CRISPR gRNA sequence
aatttgccacttcgtttctc

SEQ ID NO: 360733 - DNA, 20 bp, Artificial
  CRISPR gRNA sequence
atttgccacttcgtttctca

SEQ ID NO: 360734 - DNA, 20 bp, Artificial
  CRISPR gRNA sequence
ttcgtttctcaaggataacc

SEQ ID NO: 360735 - DNA, 20 bp, Artificial
  CRISPR gRNA sequence
tctcaaggataaccaagaac

SEQ ID NO: 360736 - DNA, 20 bp, Artificial
  CRISPR gRNA sequence
ggataaccaagaactggttg

SEQ ID NO: 360737 - DNA, 20 bp, Artificial
  CRISPR gRNA sequence
tttccataatgctcaaactg

SEQ ID NO: 360738 - DNA, 20 bp, Artificial
  CRISPR gRNA sequence
ctcaaactgaagaaaaataa

SEQ ID NO: 360739 - DNA, 20 bp, Artificial
  CRISPR gRNA sequence
caaactgaagaaaaataacg

SEQ ID NO: 360740 - DNA, 20 bp, Artificial
  CRISPR gRNA sequence
agaaaaataacggagcaacc

SEQ ID NO: 360741 - DNA, 20 bp, Artificial
  CRISPR gRNA sequence
gaaaaataacggagcaaccc

SEQ ID NO: 360742 - DNA, 20 bp, Artificial
  CRISPR gRNA sequence
cccaggcaatttaaacattc

SEQ ID NO: 360743 - DNA, 20 bp, Artificial
  CRISPR gRNA sequence
aaacattccagaaacgctgt

SEQ ID NO: 360744 - DNA, 20 bp, Artificial
  CRISPR gRNA sequence
aacattccagaaacgctgtc

SEQ ID NO: 360745 - DNA, 20 bp, Artificial
  CRISPR gRNA sequence
acattccagaaacgctgtca

SEQ ID NO: 360746 - DNA, 20 bp, Artificial
  CRISPR gRNA sequence
attccagaaacgctgtcagg

SEQ ID NO: 360747 - DNA, 20 bp, Artificial
  CRISPR gRNA sequence
cagggagcttttttcaaaca

SEQ ID NO: 360748 - DNA, 20 bp, Artificial
  CRISPR gRNA sequence
agggagcttttttcaaacat

SEQ ID NO: 360749 - DNA, 20 bp, Artificial
  CRISPR gRNA sequence
gagcttttttcaaacatagg

SEQ ID NO: 360750 - DNA, 20 bp, Artificial
  CRISPR gRNA sequence
agcttttttcaaacatagga

SEQ ID NO: 360751 - DNA, 20 bp, Artificial
  CRISPR gRNA sequence
gaaaaaactgaccgtttaca

SEQ ID NO: 360752 - DNA, 20 bp, Artificial
  CRISPR gRNA sequence
aatatctaaaatattgtcaa

SEQ ID NO: 360753 - DNA, 20 bp, Artificial
  CRISPR gRNA sequence
atctaaaatattgtcaaaag

SEQ ID NO: 360754 - DNA, 20 bp, Artificial
  CRISPR gRNA sequence
gtcaaaagaagtcttgaacc

SEQ ID NO: 360755 - DNA, 20 bp, Artificial
  CRISPR gRNA sequence
tcaaaagaagtcttgaacca

SEQ ID NO: 360756 - DNA, 20 bp, Artificial
  CRISPR gRNA sequence
accaaggaaatttatcacat

SEQ ID NO: 360757 - DNA, 20 bp, Artificial
  CRISPR gRNA sequence
cattttcaccataatattta

SEQ ID NO: 360758 - DNA, 20 bp, Artificial
  CRISPR gRNA sequence
attttcaccataatatttaa

SEQ ID NO: 360759 - DNA, 20 bp, Artificial
  CRISPR gRNA sequence
ataatatttaaaggatcatc

SEQ ID NO: 360760 - DNA, 20 bp, Artificial
  CRISPR gRNA sequence
taatatttaaaggatcatcc

SEQ ID NO: 360761 - DNA, 20 bp, Artificial
  CRISPR gRNA sequence
tatttaaaggatcatccagg

SEQ ID NO: 360762 - DNA, 20 bp, Artificial
  CRISPR gRNA sequence
ttaaaggatcatccaggaag

SEQ ID NO: 360763 - DNA, 20 bp, Artificial
  CRISPR gRNA sequence
aaaactcttcaaacaatgtc

SEQ ID NO: 360764 - DNA, 20 bp, Artificial
  CRISPR gRNA sequence
caaacaatgtctagtatcaa

SEQ ID NO: 360765 - DNA, 20 bp, Artificial
  CRISPR gRNA sequence
caatgtctagtatcaaaaga

SEQ ID NO: 360766 - DNA, 20 bp, Artificial
  CRISPR gRNA sequence
tgaataattctactttctga

SEQ ID NO: 360767 - DNA, 20 bp, Artificial
  CRISPR gRNA sequence
tctactttctgaaagaactg

SEQ ID NO: 360768 - DNA, 20 bp, Artificial
  CRISPR gRNA sequence
ctactttctgaaagaactga

SEQ ID NO: 360769 - DNA, 20 bp, Artificial
  CRISPR gRNA sequence
tttctgaaagaactgaaggc

SEQ ID NO: 360770 - DNA, 20 bp, Artificial
  CRISPR gRNA sequence
ttctgaaagaactgaaggca

SEQ ID NO: 360771 - DNA, 20 bp, Artificial
  CRISPR gRNA sequence
ctgaaagaactgaaggcaag

SEQ ID NO: 360772 - DNA, 20 bp, Artificial
  CRISPR gRNA sequence
aaggagattacctaaatttt

SEQ ID NO: 360773 - DNA, 20 bp, Artificial
  CRISPR gRNA sequence
ggagattacctaaattttaa

SEQ ID NO: 360774 - DNA, 20 bp, Artificial
  CRISPR gRNA sequence
ttaagagtaaataaatgctg

SEQ ID NO: 360775 - DNA, 20 bp, Artificial
  CRISPR gRNA sequence
aagagtaaataaatgctgaa

SEQ ID NO: 360776 - DNA, 20 bp, Artificial
  CRISPR gRNA sequence
aaacataatatctgtctgtg

SEQ ID NO: 360777 - DNA, 20 bp, Artificial
  CRISPR gRNA sequence
atatctgtctgtgaagtaaa

SEQ ID NO: 360778 - DNA, 20 bp, Artificial
  CRISPR gRNA sequence
gtctgtgaagtaaatggcac

SEQ ID NO: 360779 - DNA, 20 bp, Artificial
  CRISPR gRNA sequence
tctgtgaagtaaatggcacc

SEQ ID NO: 360780 - DNA, 20 bp, Artificial
  CRISPR gRNA sequence
gaagtaaatggcaccaggca

SEQ ID NO: 360781 - DNA, 20 bp, Artificial
  CRISPR gRNA sequence
tcttatttcgctgaacaatg

SEQ ID NO: 360782 - DNA, 20 bp, Artificial
  CRISPR gRNA sequence
cttatttcgctgaacaatgc

SEQ ID NO: 360783 - DNA, 20 bp, Artificial
  CRISPR gRNA sequence
tttcgctgaacaatgcaggc

SEQ ID NO: 360784 - DNA, 20 bp, Artificial
  CRISPR gRNA sequence
ttcgctgaacaatgcaggcc

SEQ ID NO: 360785 - DNA, 20 bp, Artificial
  CRISPR gRNA sequence
tcgctgaacaatgcaggcca

SEQ ID NO: 360786 - DNA, 20 bp, Artificial
  CRISPR gRNA sequence
caatgcaggccagggttatt

SEQ ID NO: 360787 - DNA, 20 bp, Artificial
  CRISPR gRNA sequence
ccagggttattaagtctgac

SEQ ID NO: 360788 - DNA, 20 bp, Artificial
  CRISPR gRNA sequence
cagggttattaagtctgaca

SEQ ID NO: 360789 - DNA, 20 bp, Artificial
  CRISPR gRNA sequence
gcaaattgtttatcatgact

SEQ ID NO: 360790 - DNA, 20 bp, Artificial
  CRISPR gRNA sequence
catgactgagtcataaatac

SEQ ID NO: 360791 - DNA, 20 bp, Artificial
  CRISPR gRNA sequence
gagtcataaatactagtacc

SEQ ID NO: 360792 - DNA, 20 bp, Artificial
  CRISPR gRNA sequence
gtcataaatactagtaccaa

SEQ ID NO: 360793 - DNA, 20 bp, Artificial
  CRISPR gRNA sequence
aagagatgtgatttactgaa

SEQ ID NO: 360794 - DNA, 20 bp, Artificial
  CRISPR gRNA sequence
aacagtaccaaacaccgaat

SEQ ID NO: 360795 - DNA, 20 bp, Artificial
  CRISPR gRNA sequence
acagtaccaaacaccgaatg

SEQ ID NO: 360796 - DNA, 20 bp, Artificial
  CRISPR gRNA sequence
gaatgaggattttttaaatg

SEQ ID NO: 360797 - DNA, 20 bp, Artificial
  CRISPR gRNA sequence
taaatgaagttatttcaaaa

SEQ ID NO: 360798 - DNA, 20 bp, Artificial
  CRISPR gRNA sequence
aatgaagttatttcaaaaaa

SEQ ID NO: 360799 - DNA, 20 bp, Artificial
  CRISPR gRNA sequence
aagttatttcaaaaaagagt

SEQ ID NO: 360800 - DNA, 20 bp, Artificial
  CRISPR gRNA sequence
aaaaaagagtcggttactat

SEQ ID NO: 360801 - DNA, 20 bp, Artificial
  CRISPR gRNA sequence
aaagagtcggttactataag

SEQ ID NO: 360802 - DNA, 20 bp, Artificial
  CRISPR gRNA sequence
tcggttactataagaagcat

SEQ ID NO: 360803 - DNA, 20 bp, Artificial
  CRISPR gRNA sequence
cttttttttttttttttcca

SEQ ID NO: 360804 - DNA, 20 bp, Artificial
  CRISPR gRNA sequence
ttttttttttttccaaagac

SEQ ID NO: 360805 - DNA, 20 bp, Artificial
  CRISPR gRNA sequence
tttttttttttccaaagaca

SEQ ID NO: 360806 - DNA, 20 bp, Artificial
  CRISPR gRNA sequence
ggtctcgctctattgcccat

SEQ ID NO: 360807 - DNA, 20 bp, Artificial
  CRISPR gRNA sequence
ctattgcccatgagcaatca

SEQ ID NO: 360808 - DNA, 20 bp, Artificial
  CRISPR gRNA sequence
tattgcccatgagcaatcac

SEQ ID NO: 360809 - DNA, 20 bp, Artificial
  CRISPR gRNA sequence
tgagcaatcacaggtcactg

SEQ ID NO: 360810 - DNA, 20 bp, Artificial
  CRISPR gRNA sequence
tcactgaagccccgaccttt

SEQ ID NO: 360811 - DNA, 20 bp, Artificial
  CRISPR gRNA sequence
cactgaagccccgacctttc

SEQ ID NO: 360812 - DNA, 20 bp, Artificial
  CRISPR gRNA sequence
atcaaaccatcatcccacct

SEQ ID NO: 360813 - DNA, 20 bp, Artificial
  CRISPR gRNA sequence
tcatcccacctcagcctcct

SEQ ID NO: 360814 - DNA, 20 bp, Artificial
  CRISPR gRNA sequence
tcccacctcagcctcctaag

SEQ ID NO: 360815 - DNA, 20 bp, Artificial
  CRISPR gRNA sequence
acctcagcctcctaagtagc

SEQ ID NO: 360816 - DNA, 20 bp, Artificial
  CRISPR gRNA sequence
cctcagcctcctaagtagct

SEQ ID NO: 360817 - DNA, 20 bp, Artificial
  CRISPR gRNA sequence
ctcctaagtagctgggacaa

SEQ ID NO: 360818 - DNA, 20 bp, Artificial
  CRISPR gRNA sequence
cagacatgtgccaccacact

SEQ ID NO: 360819 - DNA, 20 bp, Artificial
  CRISPR gRNA sequence
ctaatttttatatttttttg

SEQ ID NO: 360820 - DNA, 20 bp, Artificial
  CRISPR gRNA sequence
tttatatttttttgtagcaa

SEQ ID NO: 360821 - DNA, 20 bp, Artificial
  CRISPR gRNA sequence
ttatatttttttgtagcaac

SEQ ID NO: 360822 - DNA, 20 bp, Artificial
  CRISPR gRNA sequence
tatatttttttgtagcaaca

SEQ ID NO: 360823 - DNA, 20 bp, Artificial
  CRISPR gRNA sequence
tgtagcaacagggttttgcc

SEQ ID NO: 360824 - DNA, 20 bp, Artificial
  CRISPR gRNA sequence
cagggttttgccaagttgcc

SEQ ID NO: 360825 - DNA, 20 bp, Artificial
  CRISPR gRNA sequence
agggttttgccaagttgccc

SEQ ID NO: 360826 - DNA, 20 bp, Artificial
  CRISPR gRNA sequence
ttttgccaagttgcccaggc

SEQ ID NO: 360827 - DNA, 20 bp, Artificial
  CRISPR gRNA sequence
cccaggctggtctcgaactc

SEQ ID NO: 360828 - DNA, 20 bp, Artificial
  CRISPR gRNA sequence
ccaggctggtctcgaactct

SEQ ID NO: 360829 - DNA, 20 bp, Artificial
  CRISPR gRNA sequence
tggtctcgaactctaggatc

SEQ ID NO: 360830 - DNA, 20 bp, Artificial
  CRISPR gRNA sequence
ggtctcgaactctaggatca

SEQ ID NO: 360831 - DNA, 20 bp, Artificial
  CRISPR gRNA sequence
gtctcgaactctaggatcaa

SEQ ID NO: 360832 - DNA, 20 bp, Artificial
  CRISPR gRNA sequence
atcaagggatctgcctgcct

SEQ ID NO: 360833 - DNA, 20 bp, Artificial
  CRISPR gRNA sequence
ctgcctgcctcagcctccca

SEQ ID NO: 360834 - DNA, 20 bp, Artificial
  CRISPR gRNA sequence
gcctcagcctcccaaagtgc

SEQ ID NO: 360835 - DNA, 20 bp, Artificial
  CRISPR gRNA sequence
cctcagcctcccaaagtgct

SEQ ID NO: 360836 - DNA, 20 bp, Artificial
  CRISPR gRNA sequence
ctcccaaagtgctgggatta

SEQ ID NO: 360837 - DNA, 20 bp, Artificial
  CRISPR gRNA sequence
tcccaaagtgctgggattac

SEQ ID NO: 360838 - DNA, 20 bp, Artificial
  CRISPR gRNA sequence
agtgctgggattacaggtgt

SEQ ID NO: 360839 - DNA, 20 bp, Artificial
  CRISPR gRNA sequence
caggtgtgagccaccatgcc

SEQ ID NO: 360840 - DNA, 20 bp, Artificial
  CRISPR gRNA sequence
ccttgttgtcactctctaca

SEQ ID NO: 360841 - DNA, 20 bp, Artificial
  CRISPR gRNA sequence
cttgttgtcactctctacac

SEQ ID NO: 360842 - DNA, 20 bp, Artificial
  CRISPR gRNA sequence
cacaggctcaaacccaaaaa

SEQ ID NO: 360843 - DNA, 20 bp, Artificial
  CRISPR gRNA sequence
ctcaaacccaaaaatagaaa

SEQ ID NO: 360844 - DNA, 20 bp, Artificial
  CRISPR gRNA sequence
tcaaacccaaaaatagaaac

SEQ ID NO: 360845 - DNA, 20 bp, Artificial
  CRISPR gRNA sequence
aatagaaacaggaaaaactg

SEQ ID NO: 360846 - DNA, 20 bp, Artificial
  CRISPR gRNA sequence
tttaaactgctttgctttcc

SEQ ID NO: 360847 - DNA, 20 bp, Artificial
  CRISPR gRNA sequence
ttaaactgctttgctttcct

SEQ ID NO: 360848 - DNA, 20 bp, Artificial
  CRISPR gRNA sequence
taaactgctttgctttcctg

SEQ ID NO: 360849 - DNA, 20 bp, Artificial
  CRISPR gRNA sequence
actgctttgctttcctgggg

SEQ ID NO: 360850 - DNA, 20 bp, Artificial
  CRISPR gRNA sequence
cttccatttgctttgataaa

SEQ ID NO: 360851 - DNA, 20 bp, Artificial
  CRISPR gRNA sequence
atttgctttgataaaaagac

SEQ ID NO: 360852 - DNA, 20 bp, Artificial
  CRISPR gRNA sequence
ttgctttgataaaaagacta

SEQ ID NO: 360853 - DNA, 20 bp, Artificial
  CRISPR gRNA sequence
tgctttgataaaaagactag

SEQ ID NO: 360854 - DNA, 20 bp, Artificial
  CRISPR gRNA sequence
ttgttcttcacattatgaaa

SEQ ID NO: 360855 - DNA, 20 bp, Artificial
  CRISPR gRNA sequence
tgttcttcacattatgaaac

SEQ ID NO: 360856 - DNA, 20 bp, Artificial
  CRISPR gRNA sequence
tatgaaacaggaattttcca

SEQ ID NO: 360857 - DNA, 20 bp, Artificial
  CRISPR gRNA sequence
tgaaatgtccatttatatac

SEQ ID NO: 360858 - DNA, 20 bp, Artificial
  CRISPR gRNA sequence
aagataaaaacaatgcttca

SEQ ID NO: 360859 - DNA, 20 bp, Artificial
  CRISPR gRNA sequence
gataaaaacaatgcttcatg

SEQ ID NO: 360860 - DNA, 20 bp, Artificial
  CRISPR gRNA sequence
gcttcatggagtttataata

SEQ ID NO: 360861 - DNA, 20 bp, Artificial
  CRISPR gRNA sequence
tcatttcttcatttttatat

SEQ ID NO: 360862 - DNA, 20 bp, Artificial
  CRISPR gRNA sequence
tctgtatttttctttatacc

SEQ ID NO: 360863 - DNA, 20 bp, Artificial
  CRISPR gRNA sequence
gtatttttctttatacccag

SEQ ID NO: 360864 - DNA, 20 bp, Artificial
  CRISPR gRNA sequence
tacttacaattactcctcaa

SEQ ID NO: 360865 - DNA, 20 bp, Artificial
  CRISPR gRNA sequence
ttcttctatatgttgttatt

SEQ ID NO: 360866 - DNA, 20 bp, Artificial
  CRISPR gRNA sequence
tcttctatatgttgttattt

SEQ ID NO: 360867 - DNA, 20 bp, Artificial
  CRISPR gRNA sequence
taaaaaatttaatatatact

SEQ ID NO: 360868 - DNA, 20 bp, Artificial
  CRISPR gRNA sequence
atatactaagtatttataat

SEQ ID NO: 360869 - DNA, 20 bp, Artificial
  CRISPR gRNA sequence
tatactaagtatttataatg

SEQ ID NO: 360870 - DNA, 20 bp, Artificial
  CRISPR gRNA sequence
gatgtgtgataaacactttg

SEQ ID NO: 360871 - DNA, 20 bp, Artificial
  CRISPR gRNA sequence
gtgtgataaacactttgcag

SEQ ID NO: 360872 - DNA, 20 bp, Artificial
  CRISPR gRNA sequence
ttgaatctcacctttcattt

SEQ ID NO: 360873 - DNA, 20 bp, Artificial
  CRISPR gRNA sequence
tgaatctcacctttcatttg

SEQ ID NO: 360874 - DNA, 20 bp, Artificial
  CRISPR gRNA sequence
ttattatgactctcatttta

SEQ ID NO: 360875 - DNA, 20 bp, Artificial
  CRISPR gRNA sequence
cattttaaagatattgtaac

SEQ ID NO: 360876 - DNA, 20 bp, Artificial
  CRISPR gRNA sequence
attttaaagatattgtaaca

SEQ ID NO: 360877 - DNA, 20 bp, Artificial
  CRISPR gRNA sequence
ttttaaagatattgtaacaa

SEQ ID NO: 360878 - DNA, 20 bp, Artificial
  CRISPR gRNA sequence
attgtaacaagggttatgac

SEQ ID NO: 360879 - DNA, 20 bp, Artificial
  CRISPR gRNA sequence
aacaagggttatgactagcg

SEQ ID NO: 360880 - DNA, 20 bp, Artificial
  CRISPR gRNA sequence
agggttatgactagcgaaga

SEQ ID NO: 360881 - DNA, 20 bp, Artificial
  CRISPR gRNA sequence
ggttatgactagcgaagaca

SEQ ID NO: 360882 - DNA, 20 bp, Artificial
  CRISPR gRNA sequence
atgactagcgaagacagagt

SEQ ID NO: 360883 - DNA, 20 bp, Artificial
  CRISPR gRNA sequence
acagagtcagtatttgaaca

SEQ ID NO: 360884 - DNA, 20 bp, Artificial
  CRISPR gRNA sequence
ttgaacacagaaatttgact

SEQ ID NO: 360885 - DNA, 20 bp, Artificial
  CRISPR gRNA sequence
aatttgactgagttccttaa

SEQ ID NO: 360886 - DNA, 20 bp, Artificial
  CRISPR gRNA sequence
taaaaacttacgtacccaaa

SEQ ID NO: 360887 - DNA, 20 bp, Artificial
  CRISPR gRNA sequence
aaacttacgtacccaaatag

SEQ ID NO: 360888 - DNA, 20 bp, Artificial
  CRISPR gRNA sequence
gtacccaaatagtagatgaa

SEQ ID NO: 360889 - DNA, 20 bp, Artificial
  CRISPR gRNA sequence
aatagtagatgaatagcatc

SEQ ID NO: 360890 - DNA, 20 bp, Artificial
  CRISPR gRNA sequence
taactacaaattattaattc

SEQ ID NO: 360891 - DNA, 20 bp, Artificial
  CRISPR gRNA sequence
ctggaatcctttatacaaaa

SEQ ID NO: 360892 - DNA, 20 bp, Artificial
  CRISPR gRNA sequence
aaaaagtcatctcgcttatg

SEQ ID NO: 360893 - DNA, 20 bp, Artificial
  CRISPR gRNA sequence
ctcgcttatgcagcacaact

SEQ ID NO: 360894 - DNA, 20 bp, Artificial
  CRISPR gRNA sequence
atttgtctttttcccatctg

SEQ ID NO: 360895 - DNA, 20 bp, Artificial
  CRISPR gRNA sequence
tttgtctttttcccatctgc

SEQ ID NO: 360896 - DNA, 20 bp, Artificial
  CRISPR gRNA sequence
tctgcaggtcactgccgtca

SEQ ID NO: 360897 - DNA, 20 bp, Artificial
  CRISPR gRNA sequence
ctgcaggtcactgccgtcac

SEQ ID NO: 360898 - DNA, 20 bp, Artificial
  CRISPR gRNA sequence
cgtcacaggacgcaattgct

SEQ ID NO: 360899 - DNA, 20 bp, Artificial
  CRISPR gRNA sequence
attgctcagttcttcatgcc

SEQ ID NO: 360900 - DNA, 20 bp, Artificial
  CRISPR gRNA sequence
ttgctcagttcttcatgccg

SEQ ID NO: 360901 - DNA, 20 bp, Artificial
  CRISPR gRNA sequence
cttatacccaatgtttcctc

SEQ ID NO: 360902 - DNA, 20 bp, Artificial
  CRISPR gRNA sequence
ttatacccaatgtttcctct

SEQ ID NO: 360903 - DNA, 20 bp, Artificial
  CRISPR gRNA sequence
atacccaatgtttcctctgg

SEQ ID NO: 360904 - DNA, 20 bp, Artificial
  CRISPR gRNA sequence
tacccaatgtttcctctggg

SEQ ID NO: 360905 - DNA, 20 bp, Artificial
  CRISPR gRNA sequence
acccaatgtttcctctggga

SEQ ID NO: 360906 - DNA, 20 bp, Artificial
  CRISPR gRNA sequence
cccaaatgtaaatctgatca

SEQ ID NO: 360907 - DNA, 20 bp, Artificial
  CRISPR gRNA sequence
ggacctctctgcttgcaaac

SEQ ID NO: 360908 - DNA, 20 bp, Artificial
  CRISPR gRNA sequence
tgcaaaccagtttcaatact

SEQ ID NO: 360909 - DNA, 20 bp, Artificial
  CRISPR gRNA sequence
caaaccagtttcaatacttg

SEQ ID NO: 360910 - DNA, 20 bp, Artificial
  CRISPR gRNA sequence
ggagcttcttacactcatgc

SEQ ID NO: 360911 - DNA, 20 bp, Artificial
  CRISPR gRNA sequence
tgcaagtataatctctctct

SEQ ID NO: 360912 - DNA, 20 bp, Artificial
  CRISPR gRNA sequence
accattaatcaccaccactc

SEQ ID NO: 360913 - DNA, 20 bp, Artificial
  CRISPR gRNA sequence
ccattaatcaccaccactcc

SEQ ID NO: 360914 - DNA, 20 bp, Artificial
  CRISPR gRNA sequence
ccacgcctccatgccccgtg

SEQ ID NO: 360915 - DNA, 20 bp, Artificial
  CRISPR gRNA sequence
cacgcctccatgccccgtgc

SEQ ID NO: 360916 - DNA, 20 bp, Artificial
  CRISPR gRNA sequence
tgcaggttgttctgtctgct

SEQ ID NO: 360917 - DNA, 20 bp, Artificial
  CRISPR gRNA sequence
gctgagatcctcaaaccctg

SEQ ID NO: 360918 - DNA, 20 bp, Artificial
  CRISPR gRNA sequence
ctgagatcctcaaaccctga

SEQ ID NO: 360919 - DNA, 20 bp, Artificial
  CRISPR gRNA sequence
accctgaaggcctcctcgca

SEQ ID NO: 360920 - DNA, 20 bp, Artificial
  CRISPR gRNA sequence
ccctgaaggcctcctcgcat

SEQ ID NO: 360921 - DNA, 20 bp, Artificial
  CRISPR gRNA sequence
cctcctcgcatgggatcatc

SEQ ID NO: 360922 - DNA, 20 bp, Artificial
  CRISPR gRNA sequence
ctcctcgcatgggatcatct

SEQ ID NO: 360923 - DNA, 20 bp, Artificial
  CRISPR gRNA sequence
ctcgcatgggatcatctggg

SEQ ID NO: 360924 - DNA, 20 bp, Artificial
  CRISPR gRNA sequence
gatcatctgggaagcttcgc

SEQ ID NO: 360925 - DNA, 20 bp, Artificial
  CRISPR gRNA sequence
ctgggaagcttcgccagctt

SEQ ID NO: 360926 - DNA, 20 bp, Artificial
  CRISPR gRNA sequence
tgggaagcttcgccagcttt

SEQ ID NO: 360927 - DNA, 20 bp, Artificial
  CRISPR gRNA sequence
gggaagcttcgccagctttg

SEQ ID NO: 360928 - DNA, 20 bp, Artificial
  CRISPR gRNA sequence
ggaagcttcgccagctttgg

SEQ ID NO: 360929 - DNA, 20 bp, Artificial
  CRISPR gRNA sequence
cttcgccagctttgggggcg

SEQ ID NO: 360930 - DNA, 20 bp, Artificial
  CRISPR gRNA sequence
atcctatcctatctgcactc

SEQ ID NO: 360931 - DNA, 20 bp, Artificial
  CRISPR gRNA sequence
tgcactctggccatctctgt

SEQ ID NO: 360932 - DNA, 20 bp, Artificial
  CRISPR gRNA sequence
actctggccatctctgtgag

SEQ ID NO: 360933 - DNA, 20 bp, Artificial
  CRISPR gRNA sequence
gagaagctaacacatcttat

SEQ ID NO: 360934 - DNA, 20 bp, Artificial
  CRISPR gRNA sequence
agaagctaacacatcttatt

SEQ ID NO: 360935 - DNA, 20 bp, Artificial
  CRISPR gRNA sequence
aacacatcttattgggccat

SEQ ID NO: 360936 - DNA, 20 bp, Artificial
  CRISPR gRNA sequence
ttattgggccattggattgt

SEQ ID NO: 360937 - DNA, 20 bp, Artificial
  CRISPR gRNA sequence
ttggattgtaagcatctcca

SEQ ID NO: 360938 - DNA, 20 bp, Artificial
  CRISPR gRNA sequence
gattgtaagcatctccacag

SEQ ID NO: 360939 - DNA, 20 bp, Artificial
  CRISPR gRNA sequence
attgtaagcatctccacaga

SEQ ID NO: 360940 - DNA, 20 bp, Artificial
  CRISPR gRNA sequence
ccacagaaggaatgacttct

SEQ ID NO: 360941 - DNA, 20 bp, Artificial
  CRISPR gRNA sequence
gaatgacttcttagtcatat

SEQ ID NO: 360942 - DNA, 20 bp, Artificial
  CRISPR gRNA sequence
atgacttcttagtcatataa

SEQ ID NO: 360943 - DNA, 20 bp, Artificial
  CRISPR gRNA sequence
tgacttcttagtcatataag

SEQ ID NO: 360944 - DNA, 20 bp, Artificial
  CRISPR gRNA sequence
gacttcttagtcatataaga

SEQ ID NO: 360945 - DNA, 20 bp, Artificial
  CRISPR gRNA sequence
tcctacccaatctctttaat

SEQ ID NO: 360946 - DNA, 20 bp, Artificial
  CRISPR gRNA sequence
cctacccaatctctttaata

SEQ ID NO: 360947 - DNA, 20 bp, Artificial
  CRISPR gRNA sequence
acccaatctctttaataagg

SEQ ID NO: 360948 - DNA, 20 bp, Artificial
  CRISPR gRNA sequence
ggtggctgtcctccttcccc

SEQ ID NO: 360949 - DNA, 20 bp, Artificial
  CRISPR gRNA sequence
gtggctgtcctccttccccc

SEQ ID NO: 360950 - DNA, 20 bp, Artificial
  CRISPR gRNA sequence
tgtcctccttcccccaggcc

SEQ ID NO: 360951 - DNA, 20 bp, Artificial
  CRISPR gRNA sequence
cttcccccaggccgagccac

SEQ ID NO: 360952 - DNA, 20 bp, Artificial
  CRISPR gRNA sequence
ttcccccaggccgagccaca

SEQ ID NO: 360953 - DNA, 20 bp, Artificial
  CRISPR gRNA sequence
ccccaggccgagccacaagg

SEQ ID NO: 360954 - DNA, 20 bp, Artificial
  CRISPR gRNA sequence
agaacatcacacctgccctg

SEQ ID NO: 360955 - DNA, 20 bp, Artificial
  CRISPR gRNA sequence
gaacatcacacctgccctgt

SEQ ID NO: 360956 - DNA, 20 bp, Artificial
  CRISPR gRNA sequence
catcacacctgccctgtggg

SEQ ID NO: 360957 - DNA, 20 bp, Artificial
  CRISPR gRNA sequence
tgccctgtgggaagacccat

SEQ ID NO: 360958 - DNA, 20 bp, Artificial
  CRISPR gRNA sequence
gccctgtgggaagacccatg

SEQ ID NO: 360959 - DNA, 20 bp, Artificial
  CRISPR gRNA sequence
aagacccatgaggcccttcg

SEQ ID NO: 360960 - DNA, 20 bp, Artificial
  CRISPR gRNA sequence
ccatgaggcccttcgtggat

SEQ ID NO: 360961 - DNA, 20 bp, Artificial
  CRISPR gRNA sequence
taaatcacttgtctccttgt

SEQ ID NO: 360962 - DNA, 20 bp, Artificial
  CRISPR gRNA sequence
tcacttgtctccttgttagt

SEQ ID NO: 360963 - DNA, 20 bp, Artificial
  CRISPR gRNA sequence
gtctccttgttagtcagttt

SEQ ID NO: 360964 - DNA, 20 bp, Artificial
  CRISPR gRNA sequence
tagtcagtttaagtaactgt

SEQ ID NO: 360965 - DNA, 20 bp, Artificial
  CRISPR gRNA sequence
gtttaagtaactgtaagtca

SEQ ID NO: 360966 - DNA, 20 bp, Artificial
  CRISPR gRNA sequence
tttaagtaactgtaagtcaa

SEQ ID NO: 360967 - DNA, 20 bp, Artificial
  CRISPR gRNA sequence
ttaagtaactgtaagtcaaa

SEQ ID NO: 360968 - DNA, 20 bp, Artificial
  CRISPR gRNA sequence
agtaactgtaagtcaaaggg

SEQ ID NO: 360969 - DNA, 20 bp, Artificial
  CRISPR gRNA sequence
aatgcaaatctacacactcc

SEQ ID NO: 360970 - DNA, 20 bp, Artificial
  CRISPR gRNA sequence
aagttttatccaatgctctt

SEQ ID NO: 360971 - DNA, 20 bp, Artificial
  CRISPR gRNA sequence
tccatgatattctttattct

SEQ ID NO: 360972 - DNA, 20 bp, Artificial
  CRISPR gRNA sequence
ctctactgacttctttcctc

SEQ ID NO: 360973 - DNA, 20 bp, Artificial
  CRISPR gRNA sequence
tctactgacttctttcctcc

SEQ ID NO: 360974 - DNA, 20 bp, Artificial
  CRISPR gRNA sequence
ccgggttttttgttttgatt

SEQ ID NO: 360975 - DNA, 20 bp, Artificial
  CRISPR gRNA sequence
ttttttgttttgatttagtt

SEQ ID NO: 360976 - DNA, 20 bp, Artificial
  CRISPR gRNA sequence
tttttgttttgatttagttt

SEQ ID NO: 360977 - DNA, 20 bp, Artificial
  CRISPR gRNA sequence
ttttgatttagtttgggctt

SEQ ID NO: 360978 - DNA, 20 bp, Artificial
  CRISPR gRNA sequence
tttgatttagtttgggcttt

SEQ ID NO: 360979 - DNA, 20 bp, Artificial
  CRISPR gRNA sequence
ttgatttagtttgggctttg

SEQ ID NO: 360980 - DNA, 20 bp, Artificial
  CRISPR gRNA sequence
tttgggctttggggatttta

SEQ ID NO: 360981 - DNA, 20 bp, Artificial
  CRISPR gRNA sequence
ttgggctttggggattttat

SEQ ID NO: 360982 - DNA, 20 bp, Artificial
  CRISPR gRNA sequence
ttttgtttctttgtttcttt

SEQ ID NO: 360983 - DNA, 20 bp, Artificial
  CRISPR gRNA sequence
tgtttctttgtttcttttgg

SEQ ID NO: 360984 - DNA, 20 bp, Artificial
  CRISPR gRNA sequence
ttttggtagaaattaaaaac

SEQ ID NO: 360985 - DNA, 20 bp, Artificial
  CRISPR gRNA sequence
caagctcccatttttgtctt

SEQ ID NO: 360986 - DNA, 20 bp, Artificial
  CRISPR gRNA sequence
gtctttggaaaactccactt

SEQ ID NO: 360987 - DNA, 20 bp, Artificial
  CRISPR gRNA sequence
tctttggaaaactccacttg

SEQ ID NO: 360988 - DNA, 20 bp, Artificial
  CRISPR gRNA sequence
ttggaaaactccacttgagg

SEQ ID NO: 360989 - DNA, 20 bp, Artificial
  CRISPR gRNA sequence
actccacttgaggaagtacc

SEQ ID NO: 360990 - DNA, 20 bp, Artificial
  CRISPR gRNA sequence
accaagaatcttcactgttt

SEQ ID NO: 360991 - DNA, 20 bp, Artificial
  CRISPR gRNA sequence
ccaagaatcttcactgtttt

SEQ ID NO: 360992 - DNA, 20 bp, Artificial
  CRISPR gRNA sequence
caagaatcttcactgtttta

SEQ ID NO: 360993 - DNA, 20 bp, Artificial
  CRISPR gRNA sequence
tttagggacctcgttattac

SEQ ID NO: 360994 - DNA, 20 bp, Artificial
  CRISPR gRNA sequence
tcgttattaccagtcacatc

SEQ ID NO: 360995 - DNA, 20 bp, Artificial
  CRISPR gRNA sequence
ttaccagtcacatcaagcat

SEQ ID NO: 360996 - DNA, 20 bp, Artificial
  CRISPR gRNA sequence
cataagaaatccccatgata

SEQ ID NO: 360997 - DNA, 20 bp, Artificial
  CRISPR gRNA sequence
ataagaaatccccatgataa

SEQ ID NO: 360998 - DNA, 20 bp, Artificial
  CRISPR gRNA sequence
aaatccccatgataaaggac

SEQ ID NO: 360999 - DNA, 20 bp, Artificial
  CRISPR gRNA sequence
gactagttacacttactaaa

SEQ ID NO: 361000 - DNA, 20 bp, Artificial
  CRISPR gRNA sequence
ctagttacacttactaaacg

SEQ ID NO: 361001 - DNA, 20 bp, Artificial
  CRISPR gRNA sequence
cacttactaaacggagcact

SEQ ID NO: 361002 - DNA, 20 bp, Artificial
  CRISPR gRNA sequence
acttactaaacggagcacta

SEQ ID NO: 361003 - DNA, 20 bp, Artificial
  CRISPR gRNA sequence
cggagcactaaggtgtacaa

SEQ ID NO: 361004 - DNA, 20 bp, Artificial
  CRISPR gRNA sequence
cactaaggtgtacaaaagtc

SEQ ID NO: 361005 - DNA, 20 bp, Artificial
  CRISPR gRNA sequence
agtctggaaaaataaacatg

SEQ ID NO: 361006 - DNA, 20 bp, Artificial
  CRISPR gRNA sequence
gtctggaaaaataaacatgc

SEQ ID NO: 361007 - DNA, 20 bp, Artificial
  CRISPR gRNA sequence
ctggaaaaataaacatgcag

SEQ ID NO: 361008 - DNA, 20 bp, Artificial
  CRISPR gRNA sequence
tggaaaaataaacatgcagg

SEQ ID NO: 361009 - DNA, 20 bp, Artificial
  CRISPR gRNA sequence
catgcaggaggtttttctaa

SEQ ID NO: 361010 - DNA, 20 bp, Artificial
  CRISPR gRNA sequence
ggaggtttttctaacagcat

SEQ ID NO: 361011 - DNA, 20 bp, Artificial
  CRISPR gRNA sequence
ttctaacagcatcagaaatg

SEQ ID NO: 361012 - DNA, 20 bp, Artificial
  CRISPR gRNA sequence
ttttattttttctatctaaa

SEQ ID NO: 361013 - DNA, 20 bp, Artificial
  CRISPR gRNA sequence
atatttaaaaaatattaata

SEQ ID NO: 361014 - DNA, 20 bp, Artificial
  CRISPR gRNA sequence
tatttaaaaaatattaatat

SEQ ID NO: 361015 - DNA, 20 bp, Artificial
  CRISPR gRNA sequence
tattaatataggcctaattc

SEQ ID NO: 361016 - DNA, 20 bp, Artificial
  CRISPR gRNA sequence
attaatataggcctaattca

SEQ ID NO: 361017 - DNA, 20 bp, Artificial
  CRISPR gRNA sequence
tataggcctaattcaaggaa

SEQ ID NO: 361018 - DNA, 20 bp, Artificial
  CRISPR gRNA sequence
tggcaaatgatttcattgtc

SEQ ID NO: 361019 - DNA, 20 bp, Artificial
  CRISPR gRNA sequence
caaatgatttcattgtcaag

SEQ ID NO: 361020 - DNA, 20 bp, Artificial
  CRISPR gRNA sequence
tgatttcattgtcaagaagt

SEQ ID NO: 361021 - DNA, 20 bp, Artificial
  CRISPR gRNA sequence
gatttcattgtcaagaagta

SEQ ID NO: 361022 - DNA, 20 bp, Artificial
  CRISPR gRNA sequence
ttgtcaagaagtaaggcctt

SEQ ID NO: 361023 - DNA, 20 bp, Artificial
  CRISPR gRNA sequence
ttttcgtttgtttatttttt

SEQ ID NO: 361024 - DNA, 20 bp, Artificial
  CRISPR gRNA sequence
cgtttgtttattttttgaga

SEQ ID NO: 361025 - DNA, 20 bp, Artificial
  CRISPR gRNA sequence
gtttgtttattttttgagat

SEQ ID NO: 361026 - DNA, 20 bp, Artificial
  CRISPR gRNA sequence
tttgtttattttttgagata

SEQ ID NO: 361027 - DNA, 20 bp, Artificial
  CRISPR gRNA sequence
tttgagatagggtctcactc

SEQ ID NO: 361028 - DNA, 20 bp, Artificial
  CRISPR gRNA sequence
tagggtctcactctggcacc

SEQ ID NO: 361029 - DNA, 20 bp, Artificial
  CRISPR gRNA sequence
tctcactctggcacccagcc

SEQ ID NO: 361030 - DNA, 20 bp, Artificial
  CRISPR gRNA sequence
tcactctggcacccagcctg

SEQ ID NO: 361031 - DNA, 20 bp, Artificial
  CRISPR gRNA sequence
ctggcacccagcctggagtc

SEQ ID NO: 361032 - DNA, 20 bp, Artificial
  CRISPR gRNA sequence
gcacccagcctggagtccag

SEQ ID NO: 361033 - DNA, 20 bp, Artificial
  CRISPR gRNA sequence
ggagtccagtggtgcgatca

SEQ ID NO: 361034 - DNA, 20 bp, Artificial
  CRISPR gRNA sequence
ggtgcgatcatagctcactg

SEQ ID NO: 361035 - DNA, 20 bp, Artificial
  CRISPR gRNA sequence
tcatagctcactgcagcttc

SEQ ID NO: 361036 - DNA, 20 bp, Artificial
  CRISPR gRNA sequence
tcactgcagcttcaagcacc

SEQ ID NO: 361037 - DNA, 20 bp, Artificial
  CRISPR gRNA sequence
cactgcagcttcaagcacct

SEQ ID NO: 361038 - DNA, 20 bp, Artificial
  CRISPR gRNA sequence
cagcttcaagcacctgggca

SEQ ID NO: 361039 - DNA, 20 bp, Artificial
  CRISPR gRNA sequence
agcttcaagcacctgggcac

SEQ ID NO: 361040 - DNA, 20 bp, Artificial
  CRISPR gRNA sequence
ttcaagcacctgggcacagg

SEQ ID NO: 361041 - DNA, 20 bp, Artificial
  CRISPR gRNA sequence
cacaggcagtcctcctgcct

SEQ ID NO: 361042 - DNA, 20 bp, Artificial
  CRISPR gRNA sequence
tcctcctgcctcagcctccc

SEQ ID NO: 361043 - DNA, 20 bp, Artificial
  CRISPR gRNA sequence
tcctgcctcagcctcccaag

SEQ ID NO: 361044 - DNA, 20 bp, Artificial
  CRISPR gRNA sequence
gcctcagcctcccaagtagc

SEQ ID NO: 361045 - DNA, 20 bp, Artificial
  CRISPR gRNA sequence
cctcagcctcccaagtagct

SEQ ID NO: 361046 - DNA, 20 bp, Artificial
  CRISPR gRNA sequence
ctcccaagtagctgggacca

SEQ ID NO: 361047 - DNA, 20 bp, Artificial
  CRISPR gRNA sequence
cagatgcataccaccacaac

SEQ ID NO: 361048 - DNA, 20 bp, Artificial
  CRISPR gRNA sequence
ataattttttattttcaatc

SEQ ID NO: 361049 - DNA, 20 bp, Artificial
  CRISPR gRNA sequence
ttttattttcaatcgagcca

SEQ ID NO: 361050 - DNA, 20 bp, Artificial
  CRISPR gRNA sequence
cacagtctcactatgttacc

SEQ ID NO: 361051 - DNA, 20 bp, Artificial
  CRISPR gRNA sequence
acagtctcactatgttaccc

SEQ ID NO: 361052 - DNA, 20 bp, Artificial
  CRISPR gRNA sequence
tctcactatgttacccaggc

SEQ ID NO: 361053 - DNA, 20 bp, Artificial
  CRISPR gRNA sequence
ccaggctggtttcaaactcc

SEQ ID NO: 361054 - DNA, 20 bp, Artificial
  CRISPR gRNA sequence
caggctggtttcaaactcct

SEQ ID NO: 361055 - DNA, 20 bp, Artificial
  CRISPR gRNA sequence
ggtttcaaactcctaggctc

SEQ ID NO: 361056 - DNA, 20 bp, Artificial
  CRISPR gRNA sequence
ctcaagcaatcctcctgcct

SEQ ID NO: 361057 - DNA, 20 bp, Artificial
  CRISPR gRNA sequence
ttcccaaaattctgtgatta

SEQ ID NO: 361058 - DNA, 20 bp, Artificial
  CRISPR gRNA sequence
tcccaaaattctgtgattac

SEQ ID NO: 361059 - DNA, 20 bp, Artificial
  CRISPR gRNA sequence
aattctgtgattacaggtgt

SEQ ID NO: 361060 - DNA, 20 bp, Artificial
  CRISPR gRNA sequence
caggtgtgagccactgtgcc

SEQ ID NO: 361061 - DNA, 20 bp, Artificial
  CRISPR gRNA sequence
ataatgttttacactaaaaa

SEQ ID NO: 361062 - DNA, 20 bp, Artificial
  CRISPR gRNA sequence
taaaaacagacttctgtaaa

SEQ ID NO: 361063 - DNA, 20 bp, Artificial
  CRISPR gRNA sequence
ttctgtaaatggaacaatta

SEQ ID NO: 361064 - DNA, 20 bp, Artificial
  CRISPR gRNA sequence
tggaacaattatggaaatgc

SEQ ID NO: 361065 - DNA, 20 bp, Artificial
  CRISPR gRNA sequence
attatggaaatgctggactt

SEQ ID NO: 361066 - DNA, 20 bp, Artificial
  CRISPR gRNA sequence
aaatgctggacttgagaaat

SEQ ID NO: 361067 - DNA, 20 bp, Artificial
  CRISPR gRNA sequence
aatgctggacttgagaaatg

SEQ ID NO: 361068 - DNA, 20 bp, Artificial
  CRISPR gRNA sequence
atctctccacaaatcttatc

SEQ ID NO: 361069 - DNA, 20 bp, Artificial
  CRISPR gRNA sequence
tccacaaatcttatctagtc

SEQ ID NO: 361070 - DNA, 20 bp, Artificial
  CRISPR gRNA sequence
aatcttatctagtcaagaaa

SEQ ID NO: 361071 - DNA, 20 bp, Artificial
  CRISPR gRNA sequence
tatctagtcaagaaacagac

SEQ ID NO: 361072 - DNA, 20 bp, Artificial
  CRISPR gRNA sequence
atctagtcaagaaacagacc

SEQ ID NO: 361073 - DNA, 20 bp, Artificial
  CRISPR gRNA sequence
gaaacagaccaggccattgt

SEQ ID NO: 361074 - DNA, 20 bp, Artificial
  CRISPR gRNA sequence
aaacagaccaggccattgtg

SEQ ID NO: 361075 - DNA, 20 bp, Artificial
  CRISPR gRNA sequence
caggccattgtgaggatgca

SEQ ID NO: 361076 - DNA, 20 bp, Artificial
  CRISPR gRNA sequence
cagtgctgaaaacgaacccc

SEQ ID NO: 361077 - DNA, 20 bp, Artificial
  CRISPR gRNA sequence
agtgctgaaaacgaacccct

SEQ ID NO: 361078 - DNA, 20 bp, Artificial
  CRISPR gRNA sequence
tgaaaacgaacccctgggaa

SEQ ID NO: 361079 - DNA, 20 bp, Artificial
  CRISPR gRNA sequence
gaaaacgaacccctgggaat

SEQ ID NO: 361080 - DNA, 20 bp, Artificial
  CRISPR gRNA sequence
aaaacgaacccctgggaatg

SEQ ID NO: 361081 - DNA, 20 bp, Artificial
  CRISPR gRNA sequence
cctgggaatggggcccttcg

SEQ ID NO: 361082 - DNA, 20 bp, Artificial
  CRISPR gRNA sequence
tacccaattccaccctcata

SEQ ID NO: 361083 - DNA, 20 bp, Artificial
  CRISPR gRNA sequence
tccaccctcatacagctttc

SEQ ID NO: 361084 - DNA, 20 bp, Artificial
  CRISPR gRNA sequence
accctcatacagctttcaag

SEQ ID NO: 361085 - DNA, 20 bp, Artificial
  CRISPR gRNA sequence
tcatacagctttcaagtagt

SEQ ID NO: 361086 - DNA, 20 bp, Artificial
  CRISPR gRNA sequence
atacagctttcaagtagtga

SEQ ID NO: 361087 - DNA, 20 bp, Artificial
  CRISPR gRNA sequence
tagtgagagctgataaacac

SEQ ID NO: 361088 - DNA, 20 bp, Artificial
  CRISPR gRNA sequence
gagctgataaacactggcat

SEQ ID NO: 361089 - DNA, 20 bp, Artificial
  CRISPR gRNA sequence
gctgataaacactggcatga

SEQ ID NO: 361090 - DNA, 20 bp, Artificial
  CRISPR gRNA sequence
gataaacactggcatgagag

SEQ ID NO: 361091 - DNA, 20 bp, Artificial
  CRISPR gRNA sequence
ggcatgagagcagttttgaa

SEQ ID NO: 361092 - DNA, 20 bp, Artificial
  CRISPR gRNA sequence
tgaaaagaaaatctcataac

SEQ ID NO: 361093 - DNA, 20 bp, Artificial
  CRISPR gRNA sequence
aagaaaatctcataactggc

SEQ ID NO: 361094 - DNA, 20 bp, Artificial
  CRISPR gRNA sequence
agaaaatctcataactggcc

SEQ ID NO: 361095 - DNA, 20 bp, Artificial
  CRISPR gRNA sequence
atctcataactggccaggct

SEQ ID NO: 361096 - DNA, 20 bp, Artificial
  CRISPR gRNA sequence
tcataactggccaggcttgg

SEQ ID NO: 361097 - DNA, 20 bp, Artificial
  CRISPR gRNA sequence
tggctcatgccttgtactcc

SEQ ID NO: 361098 - DNA, 20 bp, Artificial
  CRISPR gRNA sequence
gccttgtactcccagcactt

SEQ ID NO: 361099 - DNA, 20 bp, Artificial
  CRISPR gRNA sequence
ccttgtactcccagcacttt

SEQ ID NO: 361100 - DNA, 20 bp, Artificial
  CRISPR gRNA sequence
ttgtactcccagcactttgg

SEQ ID NO: 361101 - DNA, 20 bp, Artificial
  CRISPR gRNA sequence
tgtactcccagcactttggg

SEQ ID NO: 361102 - DNA, 20 bp, Artificial
  CRISPR gRNA sequence
tcccagcactttgggaggcc

SEQ ID NO: 361103 - DNA, 20 bp, Artificial
  CRISPR gRNA sequence
cccagcactttgggaggcca

SEQ ID NO: 361104 - DNA, 20 bp, Artificial
  CRISPR gRNA sequence
agcactttgggaggccaagg

SEQ ID NO: 361105 - DNA, 20 bp, Artificial
  CRISPR gRNA sequence
gcactttgggaggccaaggc

SEQ ID NO: 361106 - DNA, 20 bp, Artificial
  CRISPR gRNA sequence
ctttgggaggccaaggcagg

SEQ ID NO: 361107 - DNA, 20 bp, Artificial
  CRISPR gRNA sequence
ccaaggcaggcagatcgcct

SEQ ID NO: 361108 - DNA, 20 bp, Artificial
  CRISPR gRNA sequence
caaggcaggcagatcgccta

SEQ ID NO: 361109 - DNA, 20 bp, Artificial
  CRISPR gRNA sequence
gcaggcagatcgcctaaggt

SEQ ID NO: 361110 - DNA, 20 bp, Artificial
  CRISPR gRNA sequence
caggcagatcgcctaaggtc

SEQ ID NO: 361111 - DNA, 20 bp, Artificial
  CRISPR gRNA sequence
ggcagatcgcctaaggtcag

SEQ ID NO: 361112 - DNA, 20 bp, Artificial
  CRISPR gRNA sequence
tcgcctaaggtcaggagttc

SEQ ID NO: 361113 - DNA, 20 bp, Artificial
  CRISPR gRNA sequence
taaggtcaggagttcgagac

SEQ ID NO: 361114 - DNA, 20 bp, Artificial
  CRISPR gRNA sequence
tcaggagttcgagaccagcc

SEQ ID NO: 361115 - DNA, 20 bp, Artificial
  CRISPR gRNA sequence
cgagaccagcctggccaaca

SEQ ID NO: 361116 - DNA, 20 bp, Artificial
  CRISPR gRNA sequence
tctactaaaattacaaaaat

SEQ ID NO: 361117 - DNA, 20 bp, Artificial
  CRISPR gRNA sequence
taaaattacaaaaattagcc

SEQ ID NO: 361118 - DNA, 20 bp, Artificial
  CRISPR gRNA sequence
ttacaaaaattagccaagca

SEQ ID NO: 361119 - DNA, 20 bp, Artificial
  CRISPR gRNA sequence
caaaaattagccaagcatgg

SEQ ID NO: 361120 - DNA, 20 bp, Artificial
  CRISPR gRNA sequence
aaattagccaagcatggtgg

SEQ ID NO: 361121 - DNA, 20 bp, Artificial
  CRISPR gRNA sequence
aattagccaagcatggtggc

SEQ ID NO: 361122 - DNA, 20 bp, Artificial
  CRISPR gRNA sequence
gtggcgggcacctgtaatcc

SEQ ID NO: 361123 - DNA, 20 bp, Artificial
  CRISPR gRNA sequence
cacctgtaatcccagctact

SEQ ID NO: 361124 - DNA, 20 bp, Artificial
  CRISPR gRNA sequence
acctgtaatcccagctactc

SEQ ID NO: 361125 - DNA, 20 bp, Artificial
  CRISPR gRNA sequence
ctgtaatcccagctactcag

SEQ ID NO: 361126 - DNA, 20 bp, Artificial
  CRISPR gRNA sequence
tgtaatcccagctactcagg

SEQ ID NO: 361127 - DNA, 20 bp, Artificial
  CRISPR gRNA sequence
tcccagctactcaggaggct

SEQ ID NO: 361128 - DNA, 20 bp, Artificial
  CRISPR gRNA sequence
cccagctactcaggaggctg

SEQ ID NO: 361129 - DNA, 20 bp, Artificial
  CRISPR gRNA sequence
agctactcaggaggctgagg

SEQ ID NO: 361130 - DNA, 20 bp, Artificial
  CRISPR gRNA sequence
gctactcaggaggctgaggc

SEQ ID NO: 361131 - DNA, 20 bp, Artificial
  CRISPR gRNA sequence
tactcaggaggctgaggcag

SEQ ID NO: 361132 - DNA, 20 bp, Artificial
  CRISPR gRNA sequence
aggaggctgaggcaggagaa

SEQ ID NO: 361133 - DNA, 20 bp, Artificial
  CRISPR gRNA sequence
caggagaatggcttgaaccc

SEQ ID NO: 361134 - DNA, 20 bp, Artificial
  CRISPR gRNA sequence
ggagaatggcttgaacccaa

SEQ ID NO: 361135 - DNA, 20 bp, Artificial
  CRISPR gRNA sequence
gagaatggcttgaacccaag

SEQ ID NO: 361136 - DNA, 20 bp, Artificial
  CRISPR gRNA sequence
aatggcttgaacccaagagg

SEQ ID NO: 361137 - DNA, 20 bp, Artificial
  CRISPR gRNA sequence
tggcttgaacccaagaggca

SEQ ID NO: 361138 - DNA, 20 bp, Artificial
  CRISPR gRNA sequence
ggcttgaacccaagaggcag

SEQ ID NO: 361139 - DNA, 20 bp, Artificial
  CRISPR gRNA sequence
aacccaagaggcagaggttg

SEQ ID NO: 361140 - DNA, 20 bp, Artificial
  CRISPR gRNA sequence
ggcagaggttgcagtgatcc

SEQ ID NO: 361141 - DNA, 20 bp, Artificial
  CRISPR gRNA sequence
gagattgcgccactacactc

SEQ ID NO: 361142 - DNA, 20 bp, Artificial
  CRISPR gRNA sequence
tgcgccactacactccagcc

SEQ ID NO: 361143 - DNA, 20 bp, Artificial
  CRISPR gRNA sequence
gcgccactacactccagcct

SEQ ID NO: 361144 - DNA, 20 bp, Artificial
  CRISPR gRNA sequence
ctacactccagcctgggcaa

SEQ ID NO: 361145 - DNA, 20 bp, Artificial
  CRISPR gRNA sequence
actccagcctgggcaacagt

SEQ ID NO: 361146 - DNA, 20 bp, Artificial
  CRISPR gRNA sequence
agtgagactctgtctcaaaa

SEQ ID NO: 361147 - DNA, 20 bp, Artificial
  CRISPR gRNA sequence
actctgtctcaaaaaagtca

SEQ ID NO: 361148 - DNA, 20 bp, Artificial
  CRISPR gRNA sequence
ctgtctcaaaaaagtcaaag

SEQ ID NO: 361149 - DNA, 20 bp, Artificial
  CRISPR gRNA sequence
ctcaaaaaagtcaaagaaga

SEQ ID NO: 361150 - DNA, 20 bp, Artificial
  CRISPR gRNA sequence
aaaaagtcaaagaagaaaga

SEQ ID NO: 361151 - DNA, 20 bp, Artificial
  CRISPR gRNA sequence
agtcaaagaagaaagaaaga

SEQ ID NO: 361152 - DNA, 20 bp, Artificial
  CRISPR gRNA sequence
tcaaagaagaaagaaagaaa

SEQ ID NO: 361153 - DNA, 20 bp, Artificial
  CRISPR gRNA sequence
aaagaagaaagaaagaaaga

SEQ ID NO: 361154 - DNA, 20 bp, Artificial
  CRISPR gRNA sequence
aagaaagaaagaaagagaga

SEQ ID NO: 361155 - DNA, 20 bp, Artificial
  CRISPR gRNA sequence
gaaagaaagaaagagagaaa

SEQ ID NO: 361156 - DNA, 20 bp, Artificial
  CRISPR gRNA sequence
aagaaagagagaaagagaaa

SEQ ID NO: 361157 - DNA, 20 bp, Artificial
  CRISPR gRNA sequence
gaaagagagaaagagaaaaa

SEQ ID NO: 361158 - DNA, 20 bp, Artificial
  CRISPR gRNA sequence
aagagagaaagagaaaaaga

SEQ ID NO: 361159 - DNA, 20 bp, Artificial
  CRISPR gRNA sequence
gagaaagagaaaaagagaga

SEQ ID NO: 361160 - DNA, 20 bp, Artificial
  CRISPR gRNA sequence
aagagaaaaagagagaaaga

SEQ ID NO: 361161 - DNA, 20 bp, Artificial
  CRISPR gRNA sequence
gaaaaagagagaaagaaaga

SEQ ID NO: 361162 - DNA, 20 bp, Artificial
  CRISPR gRNA sequence
aaaaagagagaaagaaagaa

SEQ ID NO: 361163 - DNA, 20 bp, Artificial
  CRISPR gRNA sequence
aagagagaaagaaagaaagg

SEQ ID NO: 361164 - DNA, 20 bp, Artificial
  CRISPR gRNA sequence
agagagaaagaaagaaagga

SEQ ID NO: 361165 - DNA, 20 bp, Artificial
  CRISPR gRNA sequence
gagaaagaaagaaaggaagg

SEQ ID NO: 361166 - DNA, 20 bp, Artificial
  CRISPR gRNA sequence
agaaagaaagaaaggaagga

SEQ ID NO: 361167 - DNA, 20 bp, Artificial
  CRISPR gRNA sequence
aagaaagaaaggaaggaagg

SEQ ID NO: 361168 - DNA, 20 bp, Artificial
  CRISPR gRNA sequence
agaaagaaaggaaggaagga

SEQ ID NO: 361169 - DNA, 20 bp, Artificial
  CRISPR gRNA sequence
aagaaaggaaggaaggaagg

SEQ ID NO: 361170 - DNA, 20 bp, Artificial
  CRISPR gRNA sequence
agaaaggaaggaaggaagga

SEQ ID NO: 361171 - DNA, 20 bp, Artificial
  CRISPR gRNA sequence
aggaaggaaggaaggaagga

SEQ ID NO: 361172 - DNA, 20 bp, Artificial
  CRISPR gRNA sequence
ggaaggaaggaaggaaggaa

SEQ ID NO: 361173 - DNA, 20 bp, Artificial
  CRISPR gRNA sequence
gaaggaaggaaggaaggaaa

SEQ ID NO: 361174 - DNA, 20 bp, Artificial
  CRISPR gRNA sequence
aggaaggaaggaaggaaagg

SEQ ID NO: 361175 - DNA, 20 bp, Artificial
  CRISPR gRNA sequence
aggaaggaaggaaagggaga

SEQ ID NO: 361176 - DNA, 20 bp, Artificial
  CRISPR gRNA sequence
aggaaggaaagggagaaaga

SEQ ID NO: 361177 - DNA, 20 bp, Artificial
  CRISPR gRNA sequence
gaaggaaagggagaaagaaa

SEQ ID NO: 361178 - DNA, 20 bp, Artificial
  CRISPR gRNA sequence
aggaaagggagaaagaaaga

SEQ ID NO: 361179 - DNA, 20 bp, Artificial
  CRISPR gRNA sequence
gaaagggagaaagaaagaga

SEQ ID NO: 361180 - DNA, 20 bp, Artificial
  CRISPR gRNA sequence
aagggagaaagaaagagaga

SEQ ID NO: 361181 - DNA, 20 bp, Artificial
  CRISPR gRNA sequence
gagaaagaaagagagagaga

SEQ ID NO: 361182 - DNA, 20 bp, Artificial
  CRISPR gRNA sequence
aagaaagagagagagaaaga

SEQ ID NO: 361183 - DNA, 20 bp, Artificial
  CRISPR gRNA sequence
gaaagagagagagaaagaaa

SEQ ID NO: 361184 - DNA, 20 bp, Artificial
  CRISPR gRNA sequence
aagagagagagaaagaaaga

SEQ ID NO: 361185 - DNA, 20 bp, Artificial
  CRISPR gRNA sequence
gagagagagaaagaaagaga

SEQ ID NO: 361186 - DNA, 20 bp, Artificial
  CRISPR gRNA sequence
gagagagaaagaaagagaga

SEQ ID NO: 361187 - DNA, 20 bp, Artificial
  CRISPR gRNA sequence
gagagaaagaaagagagaga

SEQ ID NO: 361188 - DNA, 20 bp, Artificial
  CRISPR gRNA sequence
agaaagaaagagagagagag

SEQ ID NO: 361189 - DNA, 20 bp, Artificial
  CRISPR gRNA sequence
gaaagaaagagagagagaga

SEQ ID NO: 361190 - DNA, 20 bp, Artificial
  CRISPR gRNA sequence
agaaagagagagagagaagg

SEQ ID NO: 361191 - DNA, 20 bp, Artificial
  CRISPR gRNA sequence
gaaagagagagagagaagga

SEQ ID NO: 361192 - DNA, 20 bp, Artificial
  CRISPR gRNA sequence
gagagagagagaaggaagga

SEQ ID NO: 361193 - DNA, 20 bp, Artificial
  CRISPR gRNA sequence
aagaaaatctgataacaaaa

SEQ ID NO: 361194 - DNA, 20 bp, Artificial
  CRISPR gRNA sequence
gataacaaaatagcaaaaca

SEQ ID NO: 361195 - DNA, 20 bp, Artificial
  CRISPR gRNA sequence
aaaacatggcatcataatgt

SEQ ID NO: 361196 - DNA, 20 bp, Artificial
  CRISPR gRNA sequence
acatggcatcataatgttgg

SEQ ID NO: 361197 - DNA, 20 bp, Artificial
  CRISPR gRNA sequence
catggcatcataatgttgga

SEQ ID NO: 361198 - DNA, 20 bp, Artificial
  CRISPR gRNA sequence
gcatcataatgttggaaggc

SEQ ID NO: 361199 - DNA, 20 bp, Artificial
  CRISPR gRNA sequence
ggaaggcaagtgtcgtgttg

SEQ ID NO: 361200 - DNA, 20 bp, Artificial
  CRISPR gRNA sequence
gaaggcaagtgtcgtgttgc

SEQ ID NO: 361201 - DNA, 20 bp, Artificial
  CRISPR gRNA sequence
ggcaagtgtcgtgttgcagg

SEQ ID NO: 361202 - DNA, 20 bp, Artificial
  CRISPR gRNA sequence
gtgtcgtgttgcaggaagac

SEQ ID NO: 361203 - DNA, 20 bp, Artificial
  CRISPR gRNA sequence
tgttgcaggaagacaagaat

SEQ ID NO: 361204 - DNA, 20 bp, Artificial
  CRISPR gRNA sequence
gttgcaggaagacaagaatt

SEQ ID NO: 361205 - DNA, 20 bp, Artificial
  CRISPR gRNA sequence
ttgcaggaagacaagaattg

SEQ ID NO: 361206 - DNA, 20 bp, Artificial
  CRISPR gRNA sequence
tgcaggaagacaagaattgg

SEQ ID NO: 361207 - DNA, 20 bp, Artificial
  CRISPR gRNA sequence
ggaagacaagaattgggggc

SEQ ID NO: 361208 - DNA, 20 bp, Artificial
  CRISPR gRNA sequence
gaagacaagaattgggggcc

SEQ ID NO: 361209 - DNA, 20 bp, Artificial
  CRISPR gRNA sequence
agacaagaattgggggccag

SEQ ID NO: 361210 - DNA, 20 bp, Artificial
  CRISPR gRNA sequence
caagaattgggggccaggag

SEQ ID NO: 361211 - DNA, 20 bp, Artificial
  CRISPR gRNA sequence
aagaattgggggccaggagt

SEQ ID NO: 361212 - DNA, 20 bp, Artificial
  CRISPR gRNA sequence
ggccaggagtgggatcaatg

SEQ ID NO: 361213 - DNA, 20 bp, Artificial
  CRISPR gRNA sequence
gccaggagtgggatcaatgc

SEQ ID NO: 361214 - DNA, 20 bp, Artificial
  CRISPR gRNA sequence
ccaggagtgggatcaatgca

SEQ ID NO: 361215 - DNA, 20 bp, Artificial
  CRISPR gRNA sequence
gtgggatcaatgcagggctg

SEQ ID NO: 361216 - DNA, 20 bp, Artificial
  CRISPR gRNA sequence
tgcagggctgaagttctcac

SEQ ID NO: 361217 - DNA, 20 bp, Artificial
  CRISPR gRNA sequence
gggctgaagttctcactggt

SEQ ID NO: 361218 - DNA, 20 bp, Artificial
  CRISPR gRNA sequence
ttatccctgccttaccccat

SEQ ID NO: 361219 - DNA, 20 bp, Artificial
  CRISPR gRNA sequence
ctgccttaccccatcagctc

SEQ ID NO: 361220 - DNA, 20 bp, Artificial
  CRISPR gRNA sequence
taaaaacatttgttgttctc

SEQ ID NO: 361221 - DNA, 20 bp, Artificial
  CRISPR gRNA sequence
acatttgttgttctctagtg

SEQ ID NO: 361222 - DNA, 20 bp, Artificial
  CRISPR gRNA sequence
ctctatcaccttctctatct

SEQ ID NO: 361223 - DNA, 20 bp, Artificial
  CRISPR gRNA sequence
tctatctgagaactgaccaa

SEQ ID NO: 361224 - DNA, 20 bp, Artificial
  CRISPR gRNA sequence
gaaattcataactttatctc

SEQ ID NO: 361225 - DNA, 20 bp, Artificial
  CRISPR gRNA sequence
aactttatctccagaaatcc

SEQ ID NO: 361226 - DNA, 20 bp, Artificial
  CRISPR gRNA sequence
ctttatctccagaaatccca

SEQ ID NO: 361227 - DNA, 20 bp, Artificial
  CRISPR gRNA sequence
tttatctccagaaatcccag

SEQ ID NO: 361228 - DNA, 20 bp, Artificial
  CRISPR gRNA sequence
cccagaggcctaaaaaaatt

SEQ ID NO: 361229 - DNA, 20 bp, Artificial
  CRISPR gRNA sequence
cagaggcctaaaaaaattaa

SEQ ID NO: 361230 - DNA, 20 bp, Artificial
  CRISPR gRNA sequence
agaggcctaaaaaaattaag

SEQ ID NO: 361231 - DNA, 20 bp, Artificial
  CRISPR gRNA sequence
aaaaaaattaagaggattaa

SEQ ID NO: 361232 - DNA, 20 bp, Artificial
  CRISPR gRNA sequence
aaaaaattaagaggattaat

SEQ ID NO: 361233 - DNA, 20 bp, Artificial
  CRISPR gRNA sequence
aggattaatgggaaacttgc

SEQ ID NO: 361234 - DNA, 20 bp, Artificial
  CRISPR gRNA sequence
ttaatgggaaacttgcaaga

SEQ ID NO: 361235 - DNA, 20 bp, Artificial
  CRISPR gRNA sequence
caagaaagtgacaacctcga

SEQ ID NO: 361236 - DNA, 20 bp, Artificial
  CRISPR gRNA sequence
gaaagtgacaacctcgatag

SEQ ID NO: 361237 - DNA, 20 bp, Artificial
  CRISPR gRNA sequence
tagaagtgacacatctgatt

SEQ ID NO: 361238 - DNA, 20 bp, Artificial
  CRISPR gRNA sequence
agaagtgacacatctgattt

SEQ ID NO: 361239 - DNA, 20 bp, Artificial
  CRISPR gRNA sequence
gtgacacatctgatttagga

SEQ ID NO: 361240 - DNA, 20 bp, Artificial
  CRISPR gRNA sequence
catctgatttaggatggaaa

SEQ ID NO: 361241 - DNA, 20 bp, Artificial
  CRISPR gRNA sequence
atctgatttaggatggaaaa

SEQ ID NO: 361242 - DNA, 20 bp, Artificial
  CRISPR gRNA sequence
gatttaggatggaaaaaggt

SEQ ID NO: 361243 - DNA, 20 bp, Artificial
  CRISPR gRNA sequence
aaaggttagtcaataaaaat

SEQ ID NO: 361244 - DNA, 20 bp, Artificial
  CRISPR gRNA sequence
aaggttagtcaataaaaatc

SEQ ID NO: 361245 - DNA, 20 bp, Artificial
  CRISPR gRNA sequence
ttagtcaataaaaatcaggc

SEQ ID NO: 361246 - DNA, 20 bp, Artificial
  CRISPR gRNA sequence
tagtcaataaaaatcaggcc

SEQ ID NO: 361247 - DNA, 20 bp, Artificial
  CRISPR gRNA sequence
aataaaaatcaggccgggcg

SEQ ID NO: 361248 - DNA, 20 bp, Artificial
  CRISPR gRNA sequence
aaaaatcaggccgggcgcgg

SEQ ID NO: 361249 - DNA, 20 bp, Artificial
  CRISPR gRNA sequence
gtggctcacgcctgtaatcc

SEQ ID NO: 361250 - DNA, 20 bp, Artificial
  CRISPR gRNA sequence
cgcctgtaatcccagcactt

SEQ ID NO: 361251 - DNA, 20 bp, Artificial
  CRISPR gRNA sequence
gcctgtaatcccagcacttt

SEQ ID NO: 361252 - DNA, 20 bp, Artificial
  CRISPR gRNA sequence
ctgtaatcccagcactttgg

SEQ ID NO: 361253 - DNA, 20 bp, Artificial
  CRISPR gRNA sequence
tgtaatcccagcactttggg

SEQ ID NO: 361254 - DNA, 20 bp, Artificial
  CRISPR gRNA sequence
tcccagcactttgggaggcc

SEQ ID NO: 361255 - DNA, 20 bp, Artificial
  CRISPR gRNA sequence
cccagcactttgggaggccg

SEQ ID NO: 361256 - DNA, 20 bp, Artificial
  CRISPR gRNA sequence
agcactttgggaggccgagg

SEQ ID NO: 361257 - DNA, 20 bp, Artificial
  CRISPR gRNA sequence
gcactttgggaggccgaggc

SEQ ID NO: 361258 - DNA, 20 bp, Artificial
  CRISPR gRNA sequence
ctttgggaggccgaggcggg

SEQ ID NO: 361259 - DNA, 20 bp, Artificial
  CRISPR gRNA sequence
ggccgaggcgggcggatcac

SEQ ID NO: 361260 - DNA, 20 bp, Artificial
  CRISPR gRNA sequence
gccgaggcgggcggatcacg

SEQ ID NO: 361261 - DNA, 20 bp, Artificial
  CRISPR gRNA sequence
aggcgggcggatcacgaggt

SEQ ID NO: 361262 - DNA, 20 bp, Artificial
  CRISPR gRNA sequence
ggcgggcggatcacgaggtc

SEQ ID NO: 361263 - DNA, 20 bp, Artificial
  CRISPR gRNA sequence
cgggcggatcacgaggtcag

SEQ ID NO: 361264 - DNA, 20 bp, Artificial
  CRISPR gRNA sequence
gatcacgaggtcaggagatc

SEQ ID NO: 361265 - DNA, 20 bp, Artificial
  CRISPR gRNA sequence
tcaggagatcgagaccatcc

SEQ ID NO: 361266 - DNA, 20 bp, Artificial
  CRISPR gRNA sequence
gagaccatcccggctaaaaa

SEQ ID NO: 361267 - DNA, 20 bp, Artificial
  CRISPR gRNA sequence
ctactaaaaatacaaaaaat

SEQ ID NO: 361268 - DNA, 20 bp, Artificial
  CRISPR gRNA sequence
taaaaatacaaaaaattagc

SEQ ID NO: 361269 - DNA, 20 bp, Artificial
  CRISPR gRNA sequence
aaaaatacaaaaaattagcc

SEQ ID NO: 361270 - DNA, 20 bp, Artificial
  CRISPR gRNA sequence
tacaaaaaattagccgggcg

SEQ ID NO: 361271 - DNA, 20 bp, Artificial
  CRISPR gRNA sequence
aaaaaattagccgggcgtag

SEQ ID NO: 361272 - DNA, 20 bp, Artificial
  CRISPR gRNA sequence
aaattagccgggcgtagtgg

SEQ ID NO: 361273 - DNA, 20 bp, Artificial
  CRISPR gRNA sequence
aattagccgggcgtagtggc

SEQ ID NO: 361274 - DNA, 20 bp, Artificial
  CRISPR gRNA sequence
ggcgtagtggcgggcgcctg

SEQ ID NO: 361275 - DNA, 20 bp, Artificial
  CRISPR gRNA sequence
gtggcgggcgcctgtagtcc

SEQ ID NO: 361276 - DNA, 20 bp, Artificial
  CRISPR gRNA sequence
cgcctgtagtcccagctact

SEQ ID NO: 361277 - DNA, 20 bp, Artificial
  CRISPR gRNA sequence
gcctgtagtcccagctactt

SEQ ID NO: 361278 - DNA, 20 bp, Artificial
  CRISPR gRNA sequence
ctgtagtcccagctacttgg

SEQ ID NO: 361279 - DNA, 20 bp, Artificial
  CRISPR gRNA sequence
tgtagtcccagctacttggg

SEQ ID NO: 361280 - DNA, 20 bp, Artificial
  CRISPR gRNA sequence
tcccagctacttgggaggct

SEQ ID NO: 361281 - DNA, 20 bp, Artificial
  CRISPR gRNA sequence
cccagctacttgggaggctg

SEQ ID NO: 361282 - DNA, 20 bp, Artificial
  CRISPR gRNA sequence
agctacttgggaggctgagg

SEQ ID NO: 361283 - DNA, 20 bp, Artificial
  CRISPR gRNA sequence
gctacttgggaggctgaggc

SEQ ID NO: 361284 - DNA, 20 bp, Artificial
  CRISPR gRNA sequence
tacttgggaggctgaggcag

SEQ ID NO: 361285 - DNA, 20 bp, Artificial
  CRISPR gRNA sequence
gggaggctgaggcaggagaa

SEQ ID NO: 361286 - DNA, 20 bp, Artificial
  CRISPR gRNA sequence
gcaggagaatggcatgaacc

SEQ ID NO: 361287 - DNA, 20 bp, Artificial
  CRISPR gRNA sequence
caggagaatggcatgaaccc

SEQ ID NO: 361288 - DNA, 20 bp, Artificial
  CRISPR gRNA sequence
ggagaatggcatgaacccag

SEQ ID NO: 361289 - DNA, 20 bp, Artificial
  CRISPR gRNA sequence
gagaatggcatgaacccagg

SEQ ID NO: 361290 - DNA, 20 bp, Artificial
  CRISPR gRNA sequence
aatggcatgaacccaggagg

SEQ ID NO: 361291 - DNA, 20 bp, Artificial
  CRISPR gRNA sequence
tggcatgaacccaggaggcg

SEQ ID NO: 361292 - DNA, 20 bp, Artificial
  CRISPR gRNA sequence
aacccaggaggcggagcttg

SEQ ID NO: 361293 - DNA, 20 bp, Artificial
  CRISPR gRNA sequence
caggaggcggagcttgcagt

SEQ ID NO: 361294 - DNA, 20 bp, Artificial
  CRISPR gRNA sequence
ggcggagcttgcagtgagcc

SEQ ID NO: 361295 - DNA, 20 bp, Artificial
  CRISPR gRNA sequence
gagatcgcgccactgcactc

SEQ ID NO: 361296 - DNA, 20 bp, Artificial
  CRISPR gRNA sequence
cgcgccactgcactccagcc

SEQ ID NO: 361297 - DNA, 20 bp, Artificial
  CRISPR gRNA sequence
gcgccactgcactccagcct

SEQ ID NO: 361298 - DNA, 20 bp, Artificial
  CRISPR gRNA sequence
ctgcactccagcctgggcga

SEQ ID NO: 361299 - DNA, 20 bp, Artificial
  CRISPR gRNA sequence
gcactccagcctgggcgaca

SEQ ID NO: 361300 - DNA, 20 bp, Artificial
  CRISPR gRNA sequence
tccagcctgggcgacagagc

SEQ ID NO: 361301 - DNA, 20 bp, Artificial
  CRISPR gRNA sequence
aaaaaaaaaaaaaaaatcaa

SEQ ID NO: 361302 - DNA, 20 bp, Artificial
  CRISPR gRNA sequence
aaaaaaaaaaaaaatcaatg

SEQ ID NO: 361303 - DNA, 20 bp, Artificial
  CRISPR gRNA sequence
tcaatggagtattgtgtcct

SEQ ID NO: 361304 - DNA, 20 bp, Artificial
  CRISPR gRNA sequence
ctcagacttcaaaataaaaa

SEQ ID NO: 361305 - DNA, 20 bp, Artificial
  CRISPR gRNA sequence
cttcaaaataaaaacagatg

SEQ ID NO: 361306 - DNA, 20 bp, Artificial
  CRISPR gRNA sequence
cagatgcagcatcatttatc

SEQ ID NO: 361307 - DNA, 20 bp, Artificial
  CRISPR gRNA sequence
agatgcagcatcatttatcg

SEQ ID NO: 361308 - DNA, 20 bp, Artificial
  CRISPR gRNA sequence
gcagcatcatttatcgagga

SEQ ID NO: 361309 - DNA, 20 bp, Artificial
  CRISPR gRNA sequence
ccacaaaactcatatctaaa

SEQ ID NO: 361310 - DNA, 20 bp, Artificial
  CRISPR gRNA sequence
atctaaatagcaactgccaa

SEQ ID NO: 361311 - DNA, 20 bp, Artificial
  CRISPR gRNA sequence
cagaaacctcaacactttac

SEQ ID NO: 361312 - DNA, 20 bp, Artificial
  CRISPR gRNA sequence
agaaacctcaacactttaca

SEQ ID NO: 361313 - DNA, 20 bp, Artificial
  CRISPR gRNA sequence
gaaacctcaacactttacaa

SEQ ID NO: 361314 - DNA, 20 bp, Artificial
  CRISPR gRNA sequence
aacctcaacactttacaagg

SEQ ID NO: 361315 - DNA, 20 bp, Artificial
  CRISPR gRNA sequence
acactttacaagggagaaac

SEQ ID NO: 361316 - DNA, 20 bp, Artificial
  CRISPR gRNA sequence
gagcttcttgaattatacca

SEQ ID NO: 361317 - DNA, 20 bp, Artificial
  CRISPR gRNA sequence
gaattataccatagaccacc

SEQ ID NO: 361318 - DNA, 20 bp, Artificial
  CRISPR gRNA sequence
agaccaccgagccaacgtca

SEQ ID NO: 361319 - DNA, 20 bp, Artificial
  CRISPR gRNA sequence
ccaccgagccaacgtcatag

SEQ ID NO: 361320 - DNA, 20 bp, Artificial
  CRISPR gRNA sequence
aagaaaatattatgcaaaat

SEQ ID NO: 361321 - DNA, 20 bp, Artificial
  CRISPR gRNA sequence
aaatattatgcaaaatgaga

SEQ ID NO: 361322 - DNA, 20 bp, Artificial
  CRISPR gRNA sequence
attatgcaaaatgagacaga

SEQ ID NO: 361323 - DNA, 20 bp, Artificial
  CRISPR gRNA sequence
gacagatggaaaaattaaat

SEQ ID NO: 361324 - DNA, 20 bp, Artificial
  CRISPR gRNA sequence
acagatggaaaaattaaatt

SEQ ID NO: 361325 - DNA, 20 bp, Artificial
  CRISPR gRNA sequence
gatggaaaaattaaattagg

SEQ ID NO: 361326 - DNA, 20 bp, Artificial
  CRISPR gRNA sequence
atggaaaaattaaattagga

SEQ ID NO: 361327 - DNA, 20 bp, Artificial
  CRISPR gRNA sequence
attaaattaggaaggactaa

SEQ ID NO: 361328 - DNA, 20 bp, Artificial
  CRISPR gRNA sequence
cttgaattctacctctgaaa

SEQ ID NO: 361329 - DNA, 20 bp, Artificial
  CRISPR gRNA sequence
ttctacctctgaaaaagcta

SEQ ID NO: 361330 - DNA, 20 bp, Artificial
  CRISPR gRNA sequence
acatttgtactacacataac

SEQ ID NO: 361331 - DNA, 20 bp, Artificial
  CRISPR gRNA sequence
ataactggctcctgaattta

SEQ ID NO: 361332 - DNA, 20 bp, Artificial
  CRISPR gRNA sequence
taactggctcctgaatttat

SEQ ID NO: 361333 - DNA, 20 bp, Artificial
  CRISPR gRNA sequence
tttataggaataaaaatata

SEQ ID NO: 361334 - DNA, 20 bp, Artificial
  CRISPR gRNA sequence
tggaaatttatattgcattg

SEQ ID NO: 361335 - DNA, 20 bp, Artificial
  CRISPR gRNA sequence
tattgcattgcggaatgaaa

SEQ ID NO: 361336 - DNA, 20 bp, Artificial
  CRISPR gRNA sequence
ctgtcatgatcaaatgacaa

SEQ ID NO: 361337 - DNA, 20 bp, Artificial
  CRISPR gRNA sequence
tgtcatgatcaaatgacaaa

SEQ ID NO: 361338 - DNA, 20 bp, Artificial
  CRISPR gRNA sequence
tgacaaaaggtgattctgac

SEQ ID NO: 361339 - DNA, 20 bp, Artificial
  CRISPR gRNA sequence
aaaaggtgattctgactaga

SEQ ID NO: 361340 - DNA, 20 bp, Artificial
  CRISPR gRNA sequence
aaaggtgattctgactagaa

SEQ ID NO: 361341 - DNA, 20 bp, Artificial
  CRISPR gRNA sequence
tgattctgactagaaaggca

SEQ ID NO: 361342 - DNA, 20 bp, Artificial
  CRISPR gRNA sequence
gactagaaaggcaaagtcaa

SEQ ID NO: 361343 - DNA, 20 bp, Artificial
  CRISPR gRNA sequence
aggcaaagtcaaaagttcat

SEQ ID NO: 361344 - DNA, 20 bp, Artificial
  CRISPR gRNA sequence
acaataaaatgcaaatattc

SEQ ID NO: 361345 - DNA, 20 bp, Artificial
  CRISPR gRNA sequence
tgcaaatattctggttaaaa

SEQ ID NO: 361346 - DNA, 20 bp, Artificial
  CRISPR gRNA sequence
tattctggttaaaaaagtaa

SEQ ID NO: 361347 - DNA, 20 bp, Artificial
  CRISPR gRNA sequence
tggttaaaaaagtaaaagta

SEQ ID NO: 361348 - DNA, 20 bp, Artificial
  CRISPR gRNA sequence
aaagtaaaagtatagttgaa

SEQ ID NO: 361349 - DNA, 20 bp, Artificial
  CRISPR gRNA sequence
aagtaaaagtatagttgaaa

SEQ ID NO: 361350 - DNA, 20 bp, Artificial
  CRISPR gRNA sequence
ttgaaaaggtaaaaatccca

SEQ ID NO: 361351 - DNA, 20 bp, Artificial
  CRISPR gRNA sequence
aaaaatcccaaagaaacccc

SEQ ID NO: 361352 - DNA, 20 bp, Artificial
  CRISPR gRNA sequence
aaaccaaaacatgtttttga

SEQ ID NO: 361353 - DNA, 20 bp, Artificial
  CRISPR gRNA sequence
aaaacatgtttttgaaagtc

SEQ ID NO: 361354 - DNA, 20 bp, Artificial
  CRISPR gRNA sequence
aaacatgtttttgaaagtcc

SEQ ID NO: 361355 - DNA, 20 bp, Artificial
  CRISPR gRNA sequence
aacatgtttttgaaagtcca

SEQ ID NO: 361356 - DNA, 20 bp, Artificial
  CRISPR gRNA sequence
ccagggaaaatatatgccaa

SEQ ID NO: 361357 - DNA, 20 bp, Artificial
  CRISPR gRNA sequence
aatatatgccaacagatcta

SEQ ID NO: 361358 - DNA, 20 bp, Artificial
  CRISPR gRNA sequence
atatatgccaacagatctaa

SEQ ID NO: 361359 - DNA, 20 bp, Artificial
  CRISPR gRNA sequence
tatatgccaacagatctaaa

SEQ ID NO: 361360 - DNA, 20 bp, Artificial
  CRISPR gRNA sequence
gccaacagatctaaagggcc

SEQ ID NO: 361361 - DNA, 20 bp, Artificial
  CRISPR gRNA sequence
gcttcaaataaaacccctta

SEQ ID NO: 361362 - DNA, 20 bp, Artificial
  CRISPR gRNA sequence
cccttatggctgaactgaca

SEQ ID NO: 361363 - DNA, 20 bp, Artificial
  CRISPR gRNA sequence
tggctgaactgacaaagtca

SEQ ID NO: 361364 - DNA, 20 bp, Artificial
  CRISPR gRNA sequence
ggctgaactgacaaagtcaa

SEQ ID NO: 361365 - DNA, 20 bp, Artificial
  CRISPR gRNA sequence
gctgaactgacaaagtcaaa

SEQ ID NO: 361366 - DNA, 20 bp, Artificial
  CRISPR gRNA sequence
ctgacaaagtcaaagggcaa

SEQ ID NO: 361367 - DNA, 20 bp, Artificial
  CRISPR gRNA sequence
acaaagtcaaagggcaacag

SEQ ID NO: 361368 - DNA, 20 bp, Artificial
  CRISPR gRNA sequence
caaagtcaaagggcaacagt

SEQ ID NO: 361369 - DNA, 20 bp, Artificial
  CRISPR gRNA sequence
caaagggcaacagtaggatg

SEQ ID NO: 361370 - DNA, 20 bp, Artificial
  CRISPR gRNA sequence
aaagggcaacagtaggatga

SEQ ID NO: 361371 - DNA, 20 bp, Artificial
  CRISPR gRNA sequence
ccaaaaaaaaaaaaaaaaaa

SEQ ID NO: 361372 - DNA, 20 bp, Artificial
  CRISPR gRNA sequence
aaaaaaagaatcattcaaac

SEQ ID NO: 361373 - DNA, 20 bp, Artificial
  CRISPR gRNA sequence
aaaaaagaatcattcaaact

SEQ ID NO: 361374 - DNA, 20 bp, Artificial
  CRISPR gRNA sequence
aaaaagaatcattcaaactg

SEQ ID NO: 361375 - DNA, 20 bp, Artificial
  CRISPR gRNA sequence
aaagaatcattcaaactggg

SEQ ID NO: 361376 - DNA, 20 bp, Artificial
  CRISPR gRNA sequence
tcaaactggggagaactgca

SEQ ID NO: 361377 - DNA, 20 bp, Artificial
  CRISPR gRNA sequence
ctggggagaactgcaaagcc

SEQ ID NO: 361378 - DNA, 20 bp, Artificial
  CRISPR gRNA sequence
ggggagaactgcaaagccca

SEQ ID NO: 361379 - DNA, 20 bp, Artificial
  CRISPR gRNA sequence
gggagaactgcaaagcccag

SEQ ID NO: 361380 - DNA, 20 bp, Artificial
  CRISPR gRNA sequence
caaagcccagaggtacaaat

SEQ ID NO: 361381 - DNA, 20 bp, Artificial
  CRISPR gRNA sequence
agcccagaggtacaaataag

SEQ ID NO: 361382 - DNA, 20 bp, Artificial
  CRISPR gRNA sequence
cagaggtacaaataagcagt

SEQ ID NO: 361383 - DNA, 20 bp, Artificial
  CRISPR gRNA sequence
agaggtacaaataagcagtg

SEQ ID NO: 361384 - DNA, 20 bp, Artificial
  CRISPR gRNA sequence
caaataagcagtgaggccca

SEQ ID NO: 361385 - DNA, 20 bp, Artificial
  CRISPR gRNA sequence
aataagcagtgaggcccaaa

SEQ ID NO: 361386 - DNA, 20 bp, Artificial
  CRISPR gRNA sequence
tgtttgaaaactatctcaca

SEQ ID NO: 361387 - DNA, 20 bp, Artificial
  CRISPR gRNA sequence
ctatctcacatagcactcca

SEQ ID NO: 361388 - DNA, 20 bp, Artificial
  CRISPR gRNA sequence
agcactccaaagtaaatgct

SEQ ID NO: 361389 - DNA, 20 bp, Artificial
  CRISPR gRNA sequence
actccaaagtaaatgctgag

SEQ ID NO: 361390 - DNA, 20 bp, Artificial
  CRISPR gRNA sequence
gtaaatgctgagaagttttt

SEQ ID NO: 361391 - DNA, 20 bp, Artificial
  CRISPR gRNA sequence
aagtttttcagcacatcaaa

SEQ ID NO: 361392 - DNA, 20 bp, Artificial
  CRISPR gRNA sequence
gtttttcagcacatcaaaaa

SEQ ID NO: 361393 - DNA, 20 bp, Artificial
  CRISPR gRNA sequence
ttcagcacatcaaaaagaga

SEQ ID NO: 361394 - DNA, 20 bp, Artificial
  CRISPR gRNA sequence
cagcacatcaaaaagagaaa

SEQ ID NO: 361395 - DNA, 20 bp, Artificial
  CRISPR gRNA sequence
gcacatcaaaaagagaaaga

SEQ ID NO: 361396 - DNA, 20 bp, Artificial
  CRISPR gRNA sequence
cacatcaaaaagagaaagag

SEQ ID NO: 361397 - DNA, 20 bp, Artificial
  CRISPR gRNA sequence
acatcaaaaagagaaagaga

SEQ ID NO: 361398 - DNA, 20 bp, Artificial
  CRISPR gRNA sequence
atcaaaaagagaaagagagg

SEQ ID NO: 361399 - DNA, 20 bp, Artificial
  CRISPR gRNA sequence
caaaaagagaaagagaggga

SEQ ID NO: 361400 - DNA, 20 bp, Artificial
  CRISPR gRNA sequence
agagagggagagaaactgca

SEQ ID NO: 361401 - DNA, 20 bp, Artificial
  CRISPR gRNA sequence
gaaaacaacatacacaacaa

SEQ ID NO: 361402 - DNA, 20 bp, Artificial
  CRISPR gRNA sequence
catacacaacaaaagttttt

SEQ ID NO: 361403 - DNA, 20 bp, Artificial
  CRISPR gRNA sequence
agtttttcagtgaataaaaa

SEQ ID NO: 361404 - DNA, 20 bp, Artificial
  CRISPR gRNA sequence
tttttcagtgaataaaaaca

SEQ ID NO: 361405 - DNA, 20 bp, Artificial
  CRISPR gRNA sequence
gtgaataaaaacagagtaac

SEQ ID NO: 361406 - DNA, 20 bp, Artificial
  CRISPR gRNA sequence
tgaataaaaacagagtaaca

SEQ ID NO: 361407 - DNA, 20 bp, Artificial
  CRISPR gRNA sequence
acagagtaacaaggacacta

SEQ ID NO: 361408 - DNA, 20 bp, Artificial
  CRISPR gRNA sequence
cagagtaacaaggacactaa

SEQ ID NO: 361409 - DNA, 20 bp, Artificial
  CRISPR gRNA sequence
agagtaacaaggacactaaa

SEQ ID NO: 361410 - DNA, 20 bp, Artificial
  CRISPR gRNA sequence
agggattcgtttcatctttt

SEQ ID NO: 361411 - DNA, 20 bp, Artificial
  CRISPR gRNA sequence
tcgtttcatctttttggaaa

SEQ ID NO: 361412 - DNA, 20 bp, Artificial
  CRISPR gRNA sequence
atctttttggaaaaagtgat

SEQ ID NO: 361413 - DNA, 20 bp, Artificial
  CRISPR gRNA sequence
ctttttggaaaaagtgatta

SEQ ID NO: 361414 - DNA, 20 bp, Artificial
  CRISPR gRNA sequence
agaattcctgaattttccat

SEQ ID NO: 361415 - DNA, 20 bp, Artificial
  CRISPR gRNA sequence
tcctgaattttccattagaa

SEQ ID NO: 361416 - DNA, 20 bp, Artificial
  CRISPR gRNA sequence
aattttccattagaacagat

SEQ ID NO: 361417 - DNA, 20 bp, Artificial
  CRISPR gRNA sequence
atatattactttaaataaat

SEQ ID NO: 361418 - DNA, 20 bp, Artificial
  CRISPR gRNA sequence
actgaacaaaacgttctcac

SEQ ID NO: 361419 - DNA, 20 bp, Artificial
  CRISPR gRNA sequence
ctgaacaaaacgttctcacc

SEQ ID NO: 361420 - DNA, 20 bp, Artificial
  CRISPR gRNA sequence
gggaacaaaaatcctccact

SEQ ID NO: 361421 - DNA, 20 bp, Artificial
  CRISPR gRNA sequence
cctccactcagcttgctttg

SEQ ID NO: 361422 - DNA, 20 bp, Artificial
  CRISPR gRNA sequence
ctccactcagcttgctttgc

SEQ ID NO: 361423 - DNA, 20 bp, Artificial
  CRISPR gRNA sequence
gcttgctttgcaggtgctac

SEQ ID NO: 361424 - DNA, 20 bp, Artificial
  CRISPR gRNA sequence
ggtgctacaagacaacctgt

SEQ ID NO: 361425 - DNA, 20 bp, Artificial
  CRISPR gRNA sequence
gcacttccgatatttgcaaa

SEQ ID NO: 361426 - DNA, 20 bp, Artificial
  CRISPR gRNA sequence
tgcaaatggccaccatgctt

SEQ ID NO: 361427 - DNA, 20 bp, Artificial
  CRISPR gRNA sequence
tggccaccatgcttcagaat

SEQ ID NO: 361428 - DNA, 20 bp, Artificial
  CRISPR gRNA sequence
cagaatgagtgtgttttcaa

SEQ ID NO: 361429 - DNA, 20 bp, Artificial
  CRISPR gRNA sequence
agaatgagtgtgttttcaat

SEQ ID NO: 361430 - DNA, 20 bp, Artificial
  CRISPR gRNA sequence
tttcaatgggtgccatccaa

SEQ ID NO: 361431 - DNA, 20 bp, Artificial
  CRISPR gRNA sequence
ttcaatgggtgccatccaaa

SEQ ID NO: 361432 - DNA, 20 bp, Artificial
  CRISPR gRNA sequence
tcaatgggtgccatccaaaa

SEQ ID NO: 361433 - DNA, 20 bp, Artificial
  CRISPR gRNA sequence
caatgggtgccatccaaaag

SEQ ID NO: 361434 - DNA, 20 bp, Artificial
  CRISPR gRNA sequence
gccatccaaaaggggaactc

SEQ ID NO: 361435 - DNA, 20 bp, Artificial
  CRISPR gRNA sequence
ccatccaaaaggggaactct

SEQ ID NO: 361436 - DNA, 20 bp, Artificial
  CRISPR gRNA sequence
tccaaaaggggaactctagg

SEQ ID NO: 361437 - DNA, 20 bp, Artificial
  CRISPR gRNA sequence
ccaaaaggggaactctaggt

SEQ ID NO: 361438 - DNA, 20 bp, Artificial
  CRISPR gRNA sequence
ctaggtaggtcatgaaatta

SEQ ID NO: 361439 - DNA, 20 bp, Artificial
  CRISPR gRNA sequence
gtaggtcatgaaattaaagc

SEQ ID NO: 361440 - DNA, 20 bp, Artificial
  CRISPR gRNA sequence
aggtcatgaaattaaagcca

SEQ ID NO: 361441 - DNA, 20 bp, Artificial
  CRISPR gRNA sequence
gtcatgaaattaaagccaga

SEQ ID NO: 361442 - DNA, 20 bp, Artificial
  CRISPR gRNA sequence
actgctatgtctaaaaaact

SEQ ID NO: 361443 - DNA, 20 bp, Artificial
  CRISPR gRNA sequence
tgctatgtctaaaaaactga

SEQ ID NO: 361444 - DNA, 20 bp, Artificial
  CRISPR gRNA sequence
aaaaaactgagagaatgtgc

SEQ ID NO: 361445 - DNA, 20 bp, Artificial
  CRISPR gRNA sequence
aaaaactgagagaatgtgct

SEQ ID NO: 361446 - DNA, 20 bp, Artificial
  CRISPR gRNA sequence
ctgagagaatgtgctgggac

SEQ ID NO: 361447 - DNA, 20 bp, Artificial
  CRISPR gRNA sequence
gtgcataaccaaatacaaac

SEQ ID NO: 361448 - DNA, 20 bp, Artificial
  CRISPR gRNA sequence
tgcataaccaaatacaaact

SEQ ID NO: 361449 - DNA, 20 bp, Artificial
  CRISPR gRNA sequence
aaccaaatacaaactaggat

SEQ ID NO: 361450 - DNA, 20 bp, Artificial
  CRISPR gRNA sequence
acaaactaggatcagaaatg

SEQ ID NO: 361451 - DNA, 20 bp, Artificial
  CRISPR gRNA sequence
aatgcagaatgatctctgca

SEQ ID NO: 361452 - DNA, 20 bp, Artificial
  CRISPR gRNA sequence
gaatgatctctgcaaagaaa

SEQ ID NO: 361453 - DNA, 20 bp, Artificial
  CRISPR gRNA sequence
aagaatgcaaattcacctgc

SEQ ID NO: 361454 - DNA, 20 bp, Artificial
  CRISPR gRNA sequence
attcacctgctagaatttcc

SEQ ID NO: 361455 - DNA, 20 bp, Artificial
  CRISPR gRNA sequence
ttcacctgctagaatttcct

SEQ ID NO: 361456 - DNA, 20 bp, Artificial
  CRISPR gRNA sequence
acctgctagaatttcctggg

SEQ ID NO: 361457 - DNA, 20 bp, Artificial
  CRISPR gRNA sequence
ggtagataaatcacatgtca

SEQ ID NO: 361458 - DNA, 20 bp, Artificial
  CRISPR gRNA sequence
gtagataaatcacatgtcaa

SEQ ID NO: 361459 - DNA, 20 bp, Artificial
  CRISPR gRNA sequence
agataaatcacatgtcaaag

SEQ ID NO: 361460 - DNA, 20 bp, Artificial
  CRISPR gRNA sequence
acatgtcaaaggagaaacaa

SEQ ID NO: 361461 - DNA, 20 bp, Artificial
  CRISPR gRNA sequence
aacaaaagaaaaaactcgtt

SEQ ID NO: 361462 - DNA, 20 bp, Artificial
  CRISPR gRNA sequence
aaaaactcgtttagattttc

SEQ ID NO: 361463 - DNA, 20 bp, Artificial
  CRISPR gRNA sequence
ttttttccactttctattca

SEQ ID NO: 361464 - DNA, 20 bp, Artificial
  CRISPR gRNA sequence
ccatattcccctctccaaac

SEQ ID NO: 361465 - DNA, 20 bp, Artificial
  CRISPR gRNA sequence
tttttactctccccactgtt

SEQ ID NO: 361466 - DNA, 20 bp, Artificial
  CRISPR gRNA sequence
tctccccactgttcagaaac

SEQ ID NO: 361467 - DNA, 20 bp, Artificial
  CRISPR gRNA sequence
ctccccactgttcagaaact

SEQ ID NO: 361468 - DNA, 20 bp, Artificial
  CRISPR gRNA sequence
ccctttctcactcatccaat

SEQ ID NO: 361469 - DNA, 20 bp, Artificial
  CRISPR gRNA sequence
tcactcatccaatcagttgc

SEQ ID NO: 361470 - DNA, 20 bp, Artificial
  CRISPR gRNA sequence
ttttaaacatctctcaaaca

SEQ ID NO: 361471 - DNA, 20 bp, Artificial
  CRISPR gRNA sequence
tccctactatattactaaaa

SEQ ID NO: 361472 - DNA, 20 bp, Artificial
  CRISPR gRNA sequence
tactaaaatagacttctgcc

SEQ ID NO: 361473 - DNA, 20 bp, Artificial
  CRISPR gRNA sequence
ctgcccagcctccttcactc

SEQ ID NO: 361474 - DNA, 20 bp, Artificial
  CRISPR gRNA sequence
tctcgctcccatatgaacga

SEQ ID NO: 361475 - DNA, 20 bp, Artificial
  CRISPR gRNA sequence
atcaatctgatctctctctc

SEQ ID NO: 361476 - DNA, 20 bp, Artificial
  CRISPR gRNA sequence
aaaacccttcaataaactct

SEQ ID NO: 361477 - DNA, 20 bp, Artificial
  CRISPR gRNA sequence
ataaactctcagtcccctta

SEQ ID NO: 361478 - DNA, 20 bp, Artificial
  CRISPR gRNA sequence
actctcagtccccttatggt

SEQ ID NO: 361479 - DNA, 20 bp, Artificial
  CRISPR gRNA sequence
tgagtatgcacttctcacca

SEQ ID NO: 361480 - DNA, 20 bp, Artificial
  CRISPR gRNA sequence
gcacttctcaccacagcaca

SEQ ID NO: 361481 - DNA, 20 bp, Artificial
  CRISPR gRNA sequence
ccacagcacatagaatcact

SEQ ID NO: 361482 - DNA, 20 bp, Artificial
  CRISPR gRNA sequence
cagcacatagaatcacttag

SEQ ID NO: 361483 - DNA, 20 bp, Artificial
  CRISPR gRNA sequence
agcacatagaatcacttagc

SEQ ID NO: 361484 - DNA, 20 bp, Artificial
  CRISPR gRNA sequence
catagaatcacttagcaggc

SEQ ID NO: 361485 - DNA, 20 bp, Artificial
  CRISPR gRNA sequence
atcacttagcaggctggaaa

SEQ ID NO: 361486 - DNA, 20 bp, Artificial
  CRISPR gRNA sequence
acttagcaggctggaaacag

SEQ ID NO: 361487 - DNA, 20 bp, Artificial
  CRISPR gRNA sequence
gtggatcctgcctgtaatcc

SEQ ID NO: 361488 - DNA, 20 bp, Artificial
  CRISPR gRNA sequence
tgcctgtaatcccagcactt

SEQ ID NO: 361489 - DNA, 20 bp, Artificial
  CRISPR gRNA sequence
gcctgtaatcccagcacttt

SEQ ID NO: 361490 - DNA, 20 bp, Artificial
  CRISPR gRNA sequence
ctgtaatcccagcactttgg

SEQ ID NO: 361491 - DNA, 20 bp, Artificial
  CRISPR gRNA sequence
tgtaatcccagcactttggg

SEQ ID NO: 361492 - DNA, 20 bp, Artificial
  CRISPR gRNA sequence
tcccagcactttgggaggcc

SEQ ID NO: 361493 - DNA, 20 bp, Artificial
  CRISPR gRNA sequence
cccagcactttgggaggccg

SEQ ID NO: 361494 - DNA, 20 bp, Artificial
  CRISPR gRNA sequence
agcactttgggaggccgagg

SEQ ID NO: 361495 - DNA, 20 bp, Artificial
  CRISPR gRNA sequence
gcactttgggaggccgaggc

SEQ ID NO: 361496 - DNA, 20 bp, Artificial
  CRISPR gRNA sequence
ctttgggaggccgaggcggg

SEQ ID NO: 361497 - DNA, 20 bp, Artificial
  CRISPR gRNA sequence
ccgaggcgggcagaccacct

SEQ ID NO: 361498 - DNA, 20 bp, Artificial
  CRISPR gRNA sequence
cgaggcgggcagaccacctg

SEQ ID NO: 361499 - DNA, 20 bp, Artificial
  CRISPR gRNA sequence
gcgggcagaccacctgaggc

SEQ ID NO: 361500 - DNA, 20 bp, Artificial
  CRISPR gRNA sequence
cgggcagaccacctgaggcc

SEQ ID NO: 361501 - DNA, 20 bp, Artificial
  CRISPR gRNA sequence
ggcagaccacctgaggccag

SEQ ID NO: 361502 - DNA, 20 bp, Artificial
  CRISPR gRNA sequence
ccacctgaggccaggagttc

SEQ ID NO: 361503 - DNA, 20 bp, Artificial
  CRISPR gRNA sequence
tgaggccaggagttcgagac

SEQ ID NO: 361504 - DNA, 20 bp, Artificial
  CRISPR gRNA sequence
ccaggagttcgagaccagcc

SEQ ID NO: 361505 - DNA, 20 bp, Artificial
  CRISPR gRNA sequence
cgagaccagcctggccaata

SEQ ID NO: 361506 - DNA, 20 bp, Artificial
  CRISPR gRNA sequence
atctctaccaaatatacaaa

SEQ ID NO: 361507 - DNA, 20 bp, Artificial
  CRISPR gRNA sequence
tctaccaaatatacaaaaag

SEQ ID NO: 361508 - DNA, 20 bp, Artificial
  CRISPR gRNA sequence
ccaaatatacaaaaagtagt

SEQ ID NO: 361509 - DNA, 20 bp, Artificial
  CRISPR gRNA sequence
caaatatacaaaaagtagtc

SEQ ID NO: 361510 - DNA, 20 bp, Artificial
  CRISPR gRNA sequence
tacaaaaagtagtcaggtgt

SEQ ID NO: 361511 - DNA, 20 bp, Artificial
  CRISPR gRNA sequence
acaaaaagtagtcaggtgtg

SEQ ID NO: 361512 - DNA, 20 bp, Artificial
  CRISPR gRNA sequence
caaaaagtagtcaggtgtga

SEQ ID NO: 361513 - DNA, 20 bp, Artificial
  CRISPR gRNA sequence
agggcgcacaactgcaatcc

SEQ ID NO: 361514 - DNA, 20 bp, Artificial
  CRISPR gRNA sequence
caactgcaatccaagctact

SEQ ID NO: 361515 - DNA, 20 bp, Artificial
  CRISPR gRNA sequence
aactgcaatccaagctactc

SEQ ID NO: 361516 - DNA, 20 bp, Artificial
  CRISPR gRNA sequence
ctgcaatccaagctactcgg

SEQ ID NO: 361517 - DNA, 20 bp, Artificial
  CRISPR gRNA sequence
tgcaatccaagctactcggg

SEQ ID NO: 361518 - DNA, 20 bp, Artificial
  CRISPR gRNA sequence
tccaagctactcgggaggct

SEQ ID NO: 361519 - DNA, 20 bp, Artificial
  CRISPR gRNA sequence
ccaagctactcgggaggctg

SEQ ID NO: 361520 - DNA, 20 bp, Artificial
  CRISPR gRNA sequence
agctactcgggaggctgagg

SEQ ID NO: 361521 - DNA, 20 bp, Artificial
  CRISPR gRNA sequence
gctactcgggaggctgagga

SEQ ID NO: 361522 - DNA, 20 bp, Artificial
  CRISPR gRNA sequence
tactcgggaggctgaggaag

SEQ ID NO: 361523 - DNA, 20 bp, Artificial
  CRISPR gRNA sequence
ggctgaggaaggagaatcac

SEQ ID NO: 361524 - DNA, 20 bp, Artificial
  CRISPR gRNA sequence
gaaggagaatcactggaacc

SEQ ID NO: 361525 - DNA, 20 bp, Artificial
  CRISPR gRNA sequence
aaggagaatcactggaaccc

SEQ ID NO: 361526 - DNA, 20 bp, Artificial
  CRISPR gRNA sequence
aatcactggaacccaggatg

SEQ ID NO: 361527 - DNA, 20 bp, Artificial
  CRISPR gRNA sequence
tcactggaacccaggatgtg

SEQ ID NO: 361528 - DNA, 20 bp, Artificial
  CRISPR gRNA sequence
cactggaacccaggatgtgg

SEQ ID NO: 361529 - DNA, 20 bp, Artificial
  CRISPR gRNA sequence
aacccaggatgtggaggtcg

SEQ ID NO: 361530 - DNA, 20 bp, Artificial
  CRISPR gRNA sequence
tgtggaggtcgcagtgtgcc

SEQ ID NO: 361531 - DNA, 20 bp, Artificial
  CRISPR gRNA sequence
aagattgcgccactgcactc

SEQ ID NO: 361532 - DNA, 20 bp, Artificial
  CRISPR gRNA sequence
tgcgccactgcactccagac

SEQ ID NO: 361533 - DNA, 20 bp, Artificial
  CRISPR gRNA sequence
gcgccactgcactccagact

SEQ ID NO: 361534 - DNA, 20 bp, Artificial
  CRISPR gRNA sequence
ctgcactccagactgggcga

SEQ ID NO: 361535 - DNA, 20 bp, Artificial
  CRISPR gRNA sequence
gcactccagactgggcgaca

SEQ ID NO: 361536 - DNA, 20 bp, Artificial
  CRISPR gRNA sequence
tccagactgggcgacagagt

SEQ ID NO: 361537 - DNA, 20 bp, Artificial
  CRISPR gRNA sequence
tcaaaacaacaataacaaca

SEQ ID NO: 361538 - DNA, 20 bp, Artificial
  CRISPR gRNA sequence
aataacaacaaagaaccact

SEQ ID NO: 361539 - DNA, 20 bp, Artificial
  CRISPR gRNA sequence
aacaaagaaccactcagcat

SEQ ID NO: 361540 - DNA, 20 bp, Artificial
  CRISPR gRNA sequence
acaaagaaccactcagcatc

SEQ ID NO: 361541 - DNA, 20 bp, Artificial
  CRISPR gRNA sequence
ccacctcatacattatgttt

SEQ ID NO: 361542 - DNA, 20 bp, Artificial
  CRISPR gRNA sequence
cacctcatacattatgtttc

SEQ ID NO: 361543 - DNA, 20 bp, Artificial
  CRISPR gRNA sequence
tacattatgtttcaggatga

SEQ ID NO: 361544 - DNA, 20 bp, Artificial
  CRISPR gRNA sequence
acattatgtttcaggatgat

SEQ ID NO: 361545 - DNA, 20 bp, Artificial
  CRISPR gRNA sequence
tcccgctttgtatttcttct

SEQ ID NO: 361546 - DNA, 20 bp, Artificial
  CRISPR gRNA sequence
cccgctttgtatttcttctc

SEQ ID NO: 361547 - DNA, 20 bp, Artificial
  CRISPR gRNA sequence
gcacttgctattcctactgc

SEQ ID NO: 361548 - DNA, 20 bp, Artificial
  CRISPR gRNA sequence
cacttgctattcctactgca

SEQ ID NO: 361549 - DNA, 20 bp, Artificial
  CRISPR gRNA sequence
aggacaccctgccctttctt

SEQ ID NO: 361550 - DNA, 20 bp, Artificial
  CRISPR gRNA sequence
ttggctaactcctacttctt

SEQ ID NO: 361551 - DNA, 20 bp, Artificial
  CRISPR gRNA sequence
actcctacttctttagttgt

SEQ ID NO: 361552 - DNA, 20 bp, Artificial
  CRISPR gRNA sequence
ttccatccaacttgaacaat

SEQ ID NO: 361553 - DNA, 20 bp, Artificial
  CRISPR gRNA sequence
tccatccaacttgaacaatg

SEQ ID NO: 361554 - DNA, 20 bp, Artificial
  CRISPR gRNA sequence
tgaacaatgaggaatgacaa

SEQ ID NO: 361555 - DNA, 20 bp, Artificial
  CRISPR gRNA sequence
ggaatgacaacagtcatctt

SEQ ID NO: 361556 - DNA, 20 bp, Artificial
  CRISPR gRNA sequence
gaatgacaacagtcatctta

SEQ ID NO: 361557 - DNA, 20 bp, Artificial
  CRISPR gRNA sequence
acagtcatcttaaggactct

SEQ ID NO: 361558 - DNA, 20 bp, Artificial
  CRISPR gRNA sequence
agtcatcttaaggactctga

SEQ ID NO: 361559 - DNA, 20 bp, Artificial
  CRISPR gRNA sequence
gactctgagagtccccttta

SEQ ID NO: 361560 - DNA, 20 bp, Artificial
  CRISPR gRNA sequence
ctttatggcattatccccat

SEQ ID NO: 361561 - DNA, 20 bp, Artificial
  CRISPR gRNA sequence
ttatggcattatccccatga

SEQ ID NO: 361562 - DNA, 20 bp, Artificial
  CRISPR gRNA sequence
taatgtctacttacatatga

SEQ ID NO: 361563 - DNA, 20 bp, Artificial
  CRISPR gRNA sequence
aatgtctacttacatatgat

SEQ ID NO: 361564 - DNA, 20 bp, Artificial
  CRISPR gRNA sequence
atgtctacttacatatgata

SEQ ID NO: 361565 - DNA, 20 bp, Artificial
  CRISPR gRNA sequence
gtctacttacatatgatagg

SEQ ID NO: 361566 - DNA, 20 bp, Artificial
  CRISPR gRNA sequence
tctacttacatatgataggg

SEQ ID NO: 361567 - DNA, 20 bp, Artificial
  CRISPR gRNA sequence
tacttacatatgatagggag

SEQ ID NO: 361568 - DNA, 20 bp, Artificial
  CRISPR gRNA sequence
acttacatatgatagggagg

SEQ ID NO: 361569 - DNA, 20 bp, Artificial
  CRISPR gRNA sequence
cttacatatgatagggagga

SEQ ID NO: 361570 - DNA, 20 bp, Artificial
  CRISPR gRNA sequence
acatatgatagggaggaggg

SEQ ID NO: 361571 - DNA, 20 bp, Artificial
  CRISPR gRNA sequence
catatgatagggaggagggc

SEQ ID NO: 361572 - DNA, 20 bp, Artificial
  CRISPR gRNA sequence
tatgatagggaggagggcag

SEQ ID NO: 361573 - DNA, 20 bp, Artificial
  CRISPR gRNA sequence
ctcattcatcctaatatttc

SEQ ID NO: 361574 - DNA, 20 bp, Artificial
  CRISPR gRNA sequence
ctaatatttccagttcctga

SEQ ID NO: 361575 - DNA, 20 bp, Artificial
  CRISPR gRNA sequence
ccagttcctgatggaatgcc

SEQ ID NO: 361576 - DNA, 20 bp, Artificial
  CRISPR gRNA sequence
ttcctgatggaatgcctggc

SEQ ID NO: 361577 - DNA, 20 bp, Artificial
  CRISPR gRNA sequence
ctgatggaatgcctggcaag

SEQ ID NO: 361578 - DNA, 20 bp, Artificial
  CRISPR gRNA sequence
gaatgcctggcaagtggtaa

SEQ ID NO: 361579 - DNA, 20 bp, Artificial
  CRISPR gRNA sequence
ggtaacagctaaatatgtgt

SEQ ID NO: 361580 - DNA, 20 bp, Artificial
  CRISPR gRNA sequence
aaatatgtgttagttgaaat

SEQ ID NO: 361581 - DNA, 20 bp, Artificial
  CRISPR gRNA sequence
gtgttagttgaaatgagttg

SEQ ID NO: 361582 - DNA, 20 bp, Artificial
  CRISPR gRNA sequence
gttgaaatgagttgaagttt

SEQ ID NO: 361583 - DNA, 20 bp, Artificial
  CRISPR gRNA sequence
gttgaagtttcagactcaac

SEQ ID NO: 361584 - DNA, 20 bp, Artificial
  CRISPR gRNA sequence
caacaagatatctaattctt

SEQ ID NO: 361585 - DNA, 20 bp, Artificial
  CRISPR gRNA sequence
aacaagatatctaattcttc

SEQ ID NO: 361586 - DNA, 20 bp, Artificial
  CRISPR gRNA sequence
acaagatatctaattcttca

SEQ ID NO: 361587 - DNA, 20 bp, Artificial
  CRISPR gRNA sequence
atctaattcttcagggaaca

SEQ ID NO: 361588 - DNA, 20 bp, Artificial
  CRISPR gRNA sequence
aattcttcagggaacatgga

SEQ ID NO: 361589 - DNA, 20 bp, Artificial
  CRISPR gRNA sequence
attcttcagggaacatggaa

SEQ ID NO: 361590 - DNA, 20 bp, Artificial
  CRISPR gRNA sequence
ttcttcagggaacatggaaa

SEQ ID NO: 361591 - DNA, 20 bp, Artificial
  CRISPR gRNA sequence
aacatggaaagggaattcaa

SEQ ID NO: 361592 - DNA, 20 bp, Artificial
  CRISPR gRNA sequence
tcaatggaaccatcatgtgc

SEQ ID NO: 361593 - DNA, 20 bp, Artificial
  CRISPR gRNA sequence
caatggaaccatcatgtgct

SEQ ID NO: 361594 - DNA, 20 bp, Artificial
  CRISPR gRNA sequence
ctgggcaacttccatgtgcc

SEQ ID NO: 361595 - DNA, 20 bp, Artificial
  CRISPR gRNA sequence
tccatgtgccaagtattata

SEQ ID NO: 361596 - DNA, 20 bp, Artificial
  CRISPR gRNA sequence
ccatgtgccaagtattatat

SEQ ID NO: 361597 - DNA, 20 bp, Artificial
  CRISPR gRNA sequence
atctttgtatattatctcat

SEQ ID NO: 361598 - DNA, 20 bp, Artificial
  CRISPR gRNA sequence
ttagttctcatgcctcccct

SEQ ID NO: 361599 - DNA, 20 bp, Artificial
  CRISPR gRNA sequence
tagttctcatgcctccccta

SEQ ID NO: 361600 - DNA, 20 bp, Artificial
  CRISPR gRNA sequence
ctaaggtacatattatacat

SEQ ID NO: 361601 - DNA, 20 bp, Artificial
  CRISPR gRNA sequence
catgagtactttctatacat

SEQ ID NO: 361602 - DNA, 20 bp, Artificial
  CRISPR gRNA sequence
ttctatacatgagtaaactg

SEQ ID NO: 361603 - DNA, 20 bp, Artificial
  CRISPR gRNA sequence
tacatgagtaaactgaagct

SEQ ID NO: 361604 - DNA, 20 bp, Artificial
  CRISPR gRNA sequence
aactgaagctcagaaaaatg

SEQ ID NO: 361605 - DNA, 20 bp, Artificial
  CRISPR gRNA sequence
agaaaaatgaagaaactttt

SEQ ID NO: 361606 - DNA, 20 bp, Artificial
  CRISPR gRNA sequence
agaaacttttcagacatcac

SEQ ID NO: 361607 - DNA, 20 bp, Artificial
  CRISPR gRNA sequence
cttttcagacatcaccagat

SEQ ID NO: 361608 - DNA, 20 bp, Artificial
  CRISPR gRNA sequence
tcagacatcaccagatgagt

SEQ ID NO: 361609 - DNA, 20 bp, Artificial
  CRISPR gRNA sequence
cagacatcaccagatgagtt

SEQ ID NO: 361610 - DNA, 20 bp, Artificial
  CRISPR gRNA sequence
gacatcaccagatgagttag

SEQ ID NO: 361611 - DNA, 20 bp, Artificial
  CRISPR gRNA sequence
atcaccagatgagttaggag

SEQ ID NO: 361612 - DNA, 20 bp, Artificial
  CRISPR gRNA sequence
tcaccagatgagttaggagc

SEQ ID NO: 361613 - DNA, 20 bp, Artificial
  CRISPR gRNA sequence
cagatgagttaggagcagga

SEQ ID NO: 361614 - DNA, 20 bp, Artificial
  CRISPR gRNA sequence
taggagcaggacagaactca

SEQ ID NO: 361615 - DNA, 20 bp, Artificial
  CRISPR gRNA sequence
ttttttgttttcgtgtaata

SEQ ID NO: 361616 - DNA, 20 bp, Artificial
  CRISPR gRNA sequence
tgttttcgtgtaataaagac

SEQ ID NO: 361617 - DNA, 20 bp, Artificial
  CRISPR gRNA sequence
aaagacaagaaccaaaacaa

SEQ ID NO: 361618 - DNA, 20 bp, Artificial
  CRISPR gRNA sequence
acaagaaccaaaacaataga

SEQ ID NO: 361619 - DNA, 20 bp, Artificial
  CRISPR gRNA sequence
agaaccaaaacaatagatag

SEQ ID NO: 361620 - DNA, 20 bp, Artificial
  CRISPR gRNA sequence
gaaccaaaacaatagatagc

SEQ ID NO: 361621 - DNA, 20 bp, Artificial
  CRISPR gRNA sequence
agcaggaatttctctaaata

SEQ ID NO: 361622 - DNA, 20 bp, Artificial
  CRISPR gRNA sequence
aatttcccttgaaataatcc

SEQ ID NO: 361623 - DNA, 20 bp, Artificial
  CRISPR gRNA sequence
cttgaaataatcctggaact

SEQ ID NO: 361624 - DNA, 20 bp, Artificial
  CRISPR gRNA sequence
ttgaaacctaatccccattg

SEQ ID NO: 361625 - DNA, 20 bp, Artificial
  CRISPR gRNA sequence
aaacctaatccccattgtgg

SEQ ID NO: 361626 - DNA, 20 bp, Artificial
  CRISPR gRNA sequence
atccccattgtggtggtatt

SEQ ID NO: 361627 - DNA, 20 bp, Artificial
  CRISPR gRNA sequence
ccccattgtggtggtattaa

SEQ ID NO: 361628 - DNA, 20 bp, Artificial
  CRISPR gRNA sequence
attgtggtggtattaagaga

SEQ ID NO: 361629 - DNA, 20 bp, Artificial
  CRISPR gRNA sequence
gtattaagagatggtgcttt

SEQ ID NO: 361630 - DNA, 20 bp, Artificial
  CRISPR gRNA sequence
tattaagagatggtgctttt

SEQ ID NO: 361631 - DNA, 20 bp, Artificial
  CRISPR gRNA sequence
attaagagatggtgcttttg

SEQ ID NO: 361632 - DNA, 20 bp, Artificial
  CRISPR gRNA sequence
gtgcttttggggacatcatt

SEQ ID NO: 361633 - DNA, 20 bp, Artificial
  CRISPR gRNA sequence
tggggacatcattaagtctt

SEQ ID NO: 361634 - DNA, 20 bp, Artificial
  CRISPR gRNA sequence
tctgctttcatgaatgtgat

SEQ ID NO: 361635 - DNA, 20 bp, Artificial
  CRISPR gRNA sequence
tgaatgtgattagtgccctt

SEQ ID NO: 361636 - DNA, 20 bp, Artificial
  CRISPR gRNA sequence
tgtgattagtgcccttcaga

SEQ ID NO: 361637 - DNA, 20 bp, Artificial
  CRISPR gRNA sequence
tgcccttcagaaagatgttg

SEQ ID NO: 361638 - DNA, 20 bp, Artificial
  CRISPR gRNA sequence
gcccttcagaaagatgttga

SEQ ID NO: 361639 - DNA, 20 bp, Artificial
  CRISPR gRNA sequence
cccttcagaaagatgttgaa

SEQ ID NO: 361640 - DNA, 20 bp, Artificial
  CRISPR gRNA sequence
cttcagaaagatgttgaagg

SEQ ID NO: 361641 - DNA, 20 bp, Artificial
  CRISPR gRNA sequence
ctttgccccttccaccatat

SEQ ID NO: 361642 - DNA, 20 bp, Artificial
  CRISPR gRNA sequence
tttgccccttccaccatatg

SEQ ID NO: 361643 - DNA, 20 bp, Artificial
  CRISPR gRNA sequence
ccttccaccatatgaggacg

SEQ ID NO: 361644 - DNA, 20 bp, Artificial
  CRISPR gRNA sequence
ccaccatatgaggacgcagc

SEQ ID NO: 361645 - DNA, 20 bp, Artificial
  CRISPR gRNA sequence
ccatatgaggacgcagcaag

SEQ ID NO: 361646 - DNA, 20 bp, Artificial
  CRISPR gRNA sequence
catatgaggacgcagcaaga

SEQ ID NO: 361647 - DNA, 20 bp, Artificial
  CRISPR gRNA sequence
gcagcaagaaggcgccgtct

SEQ ID NO: 361648 - DNA, 20 bp, Artificial
  CRISPR gRNA sequence
gcaagaaggcgccgtcttgg

SEQ ID NO: 361649 - DNA, 20 bp, Artificial
  CRISPR gRNA sequence
aaggcgccgtcttggaagca

SEQ ID NO: 361650 - DNA, 20 bp, Artificial
  CRISPR gRNA sequence
ggcgccgtcttggaagcaaa

SEQ ID NO: 361651 - DNA, 20 bp, Artificial
  CRISPR gRNA sequence
agcaaagagcaacccctcac

SEQ ID NO: 361652 - DNA, 20 bp, Artificial
  CRISPR gRNA sequence
aagagcaacccctcactaga

SEQ ID NO: 361653 - DNA, 20 bp, Artificial
  CRISPR gRNA sequence
cagtaaatttgctcgtgctt

SEQ ID NO: 361654 - DNA, 20 bp, Artificial
  CRISPR gRNA sequence
atttgctcgtgctttggtct

SEQ ID NO: 361655 - DNA, 20 bp, Artificial
  CRISPR gRNA sequence
tgctttggtcttggacttcc

SEQ ID NO: 361656 - DNA, 20 bp, Artificial
  CRISPR gRNA sequence
gtcttggacttcctagcctc

SEQ ID NO: 361657 - DNA, 20 bp, Artificial
  CRISPR gRNA sequence
ggacttcctagcctctagaa

SEQ ID NO: 361658 - DNA, 20 bp, Artificial
  CRISPR gRNA sequence
ttcctagcctctagaacggt

SEQ ID NO: 361659 - DNA, 20 bp, Artificial
  CRISPR gRNA sequence
tatttataaattacccatct

SEQ ID NO: 361660 - DNA, 20 bp, Artificial
  CRISPR gRNA sequence
atttataaattacccatcta

SEQ ID NO: 361661 - DNA, 20 bp, Artificial
  CRISPR gRNA sequence
ccatctaaggtactttgtta

SEQ ID NO: 361662 - DNA, 20 bp, Artificial
  CRISPR gRNA sequence
tctaaggtactttgttatag

SEQ ID NO: 361663 - DNA, 20 bp, Artificial
  CRISPR gRNA sequence
ctttgttatagcagcctgaa

SEQ ID NO: 361664 - DNA, 20 bp, Artificial
  CRISPR gRNA sequence
tatagcagcctgaacagact

SEQ ID NO: 361665 - DNA, 20 bp, Artificial
  CRISPR gRNA sequence
cacacacacatataccatct

SEQ ID NO: 361666 - DNA, 20 bp, Artificial
  CRISPR gRNA sequence
cttagcccttttaaaatgta

SEQ ID NO: 361667 - DNA, 20 bp, Artificial
  CRISPR gRNA sequence
cccttttaaaatgtacagtt

SEQ ID NO: 361668 - DNA, 20 bp, Artificial
  CRISPR gRNA sequence
ttttaaaatgtacagttcag

SEQ ID NO: 361669 - DNA, 20 bp, Artificial
  CRISPR gRNA sequence
atgtacagttcagtagcatt

SEQ ID NO: 361670 - DNA, 20 bp, Artificial
  CRISPR gRNA sequence
attgttgtatacccaatttt

SEQ ID NO: 361671 - DNA, 20 bp, Artificial
  CRISPR gRNA sequence
tcagaactctttttatctca

SEQ ID NO: 361672 - DNA, 20 bp, Artificial
  CRISPR gRNA sequence
ctcctctgtgtacctcatat

SEQ ID NO: 361673 - DNA, 20 bp, Artificial
  CRISPR gRNA sequence
ctctgtgtacctcatataag

SEQ ID NO: 361674 - DNA, 20 bp, Artificial
  CRISPR gRNA sequence
ctcatataagtggaatcaca

SEQ ID NO: 361675 - DNA, 20 bp, Artificial
  CRISPR gRNA sequence
agtatttgttgtcttgtgac

SEQ ID NO: 361676 - DNA, 20 bp, Artificial
  CRISPR gRNA sequence
tgtgactggctttgttcatt

SEQ ID NO: 361677 - DNA, 20 bp, Artificial
  CRISPR gRNA sequence
ttcatttggaataatgtccc

SEQ ID NO: 361678 - DNA, 20 bp, Artificial
  CRISPR gRNA sequence
tcatttggaataatgtcccc

SEQ ID NO: 361679 - DNA, 20 bp, Artificial
  CRISPR gRNA sequence
catttggaataatgtcccca

SEQ ID NO: 361680 - DNA, 20 bp, Artificial
  CRISPR gRNA sequence
cccagggttcacccatgttg

SEQ ID NO: 361681 - DNA, 20 bp, Artificial
  CRISPR gRNA sequence
tgttgcagcatgtgttcaaa

SEQ ID NO: 361682 - DNA, 20 bp, Artificial
  CRISPR gRNA sequence
ttcaaatagtcctcattttt

SEQ ID NO: 361683 - DNA, 20 bp, Artificial
  CRISPR gRNA sequence
agtcctcatttttaagaatg

SEQ ID NO: 361684 - DNA, 20 bp, Artificial
  CRISPR gRNA sequence
ttatatacatatacgcataa

SEQ ID NO: 361685 - DNA, 20 bp, Artificial
  CRISPR gRNA sequence
cgcataatagatatacactg

SEQ ID NO: 361686 - DNA, 20 bp, Artificial
  CRISPR gRNA sequence
tttgtccatttattcctccg

SEQ ID NO: 361687 - DNA, 20 bp, Artificial
  CRISPR gRNA sequence
tttattcctccgtagacact

SEQ ID NO: 361688 - DNA, 20 bp, Artificial
  CRISPR gRNA sequence
ttattcctccgtagacactt

SEQ ID NO: 361689 - DNA, 20 bp, Artificial
  CRISPR gRNA sequence
cttaggttgcttcttctttt

SEQ ID NO: 361690 - DNA, 20 bp, Artificial
  CRISPR gRNA sequence
aataatgctgttatgaacat

SEQ ID NO: 361691 - DNA, 20 bp, Artificial
  CRISPR gRNA sequence
gttatgaacatgagtgtact

SEQ ID NO: 361692 - DNA, 20 bp, Artificial
  CRISPR gRNA sequence
aaatgacactaaaccactct

SEQ ID NO: 361693 - DNA, 20 bp, Artificial
  CRISPR gRNA sequence
tgacactaaaccactctgag

SEQ ID NO: 361694 - DNA, 20 bp, Artificial
  CRISPR gRNA sequence
tgagtggtaaaataacaaac

SEQ ID NO: 361695 - DNA, 20 bp, Artificial
  CRISPR gRNA sequence
gtggtaaaataacaaactag

SEQ ID NO: 361696 - DNA, 20 bp, Artificial
  CRISPR gRNA sequence
tggtaaaataacaaactagt

SEQ ID NO: 361697 - DNA, 20 bp, Artificial
  CRISPR gRNA sequence
aactagtgggtgaaatactg

SEQ ID NO: 361698 - DNA, 20 bp, Artificial
  CRISPR gRNA sequence
aaatactgaagaatctcatt

SEQ ID NO: 361699 - DNA, 20 bp, Artificial
  CRISPR gRNA sequence
tcattaagctatgaaatatg

SEQ ID NO: 361700 - DNA, 20 bp, Artificial
  CRISPR gRNA sequence
aagctatgaaatatgcagaa

SEQ ID NO: 361701 - DNA, 20 bp, Artificial
  CRISPR gRNA sequence
ctatgaaatatgcagaaaag

SEQ ID NO: 361702 - DNA, 20 bp, Artificial
  CRISPR gRNA sequence
tgaaatatgcagaaaagcgg

SEQ ID NO: 361703 - DNA, 20 bp, Artificial
  CRISPR gRNA sequence
tatgcagaaaagcggtagat

SEQ ID NO: 361704 - DNA, 20 bp, Artificial
  CRISPR gRNA sequence
tagataagtttcaaaccatt

SEQ ID NO: 361705 - DNA, 20 bp, Artificial
  CRISPR gRNA sequence
taagtttcaaaccatttaga

SEQ ID NO: 361706 - DNA, 20 bp, Artificial
  CRISPR gRNA sequence
aaccatgtttcacatatgat

SEQ ID NO: 361707 - DNA, 20 bp, Artificial
  CRISPR gRNA sequence
tataaacctttgttcccacc

SEQ ID NO: 361708 - DNA, 20 bp, Artificial
  CRISPR gRNA sequence
ataaacctttgttcccaccc

SEQ ID NO: 361709 - DNA, 20 bp, Artificial
  CRISPR gRNA sequence
taaacctttgttcccaccca

SEQ ID NO: 361710 - DNA, 20 bp, Artificial
  CRISPR gRNA sequence
aaacctttgttcccacccag

SEQ ID NO: 361711 - DNA, 20 bp, Artificial
  CRISPR gRNA sequence
aatacttttcacttactcga

SEQ ID NO: 361712 - DNA, 20 bp, Artificial
  CRISPR gRNA sequence
cacttactcgaaagtactca

SEQ ID NO: 361713 - DNA, 20 bp, Artificial
  CRISPR gRNA sequence
acttactcgaaagtactcat

SEQ ID NO: 361714 - DNA, 20 bp, Artificial
  CRISPR gRNA sequence
tactcgaaagtactcatagg

SEQ ID NO: 361715 - DNA, 20 bp, Artificial
  CRISPR gRNA sequence
ctattctacttaattacata

SEQ ID NO: 361716 - DNA, 20 bp, Artificial
  CRISPR gRNA sequence
attcatacgtttcctatgta

SEQ ID NO: 361717 - DNA, 20 bp, Artificial
  CRISPR gRNA sequence
tacgtttcctatgtacagat

SEQ ID NO: 361718 - DNA, 20 bp, Artificial
  CRISPR gRNA sequence
cctatgtacagatcagcaat

SEQ ID NO: 361719 - DNA, 20 bp, Artificial
  CRISPR gRNA sequence
aactcttttgctgttttatt

SEQ ID NO: 361720 - DNA, 20 bp, Artificial
  CRISPR gRNA sequence
ttttattgagcatgtctcct

SEQ ID NO: 361721 - DNA, 20 bp, Artificial
  CRISPR gRNA sequence
tttattgagcatgtctccta

SEQ ID NO: 361722 - DNA, 20 bp, Artificial
  CRISPR gRNA sequence
ttattgagcatgtctcctaa

SEQ ID NO: 361723 - DNA, 20 bp, Artificial
  CRISPR gRNA sequence
gagcatgtctcctaagggca

SEQ ID NO: 361724 - DNA, 20 bp, Artificial
  CRISPR gRNA sequence
agctctgttcccaacattat

SEQ ID NO: 361725 - DNA, 20 bp, Artificial
  CRISPR gRNA sequence
gctctgttcccaacattatt

SEQ ID NO: 361726 - DNA, 20 bp, Artificial
  CRISPR gRNA sequence
ccaacattattgggatcatg

SEQ ID NO: 361727 - DNA, 20 bp, Artificial
  CRISPR gRNA sequence
aacattattgggatcatgaa

SEQ ID NO: 361728 - DNA, 20 bp, Artificial
  CRISPR gRNA sequence
acattattgggatcatgaag

SEQ ID NO: 361729 - DNA, 20 bp, Artificial
  CRISPR gRNA sequence
cattattgggatcatgaaga

SEQ ID NO: 361730 - DNA, 20 bp, Artificial
  CRISPR gRNA sequence
tgggatcatgaagagggaaa

SEQ ID NO: 361731 - DNA, 20 bp, Artificial
  CRISPR gRNA sequence
gggatcatgaagagggaaat

SEQ ID NO: 361732 - DNA, 20 bp, Artificial
  CRISPR gRNA sequence
atgaagagggaaatgggatg

SEQ ID NO: 361733 - DNA, 20 bp, Artificial
  CRISPR gRNA sequence
ggatgtggcctgccctcatt

SEQ ID NO: 361734 - DNA, 20 bp, Artificial
  CRISPR gRNA sequence
gatgtggcctgccctcattc

SEQ ID NO: 361735 - DNA, 20 bp, Artificial
  CRISPR gRNA sequence
tggcctgccctcattcagga

SEQ ID NO: 361736 - DNA, 20 bp, Artificial
  CRISPR gRNA sequence
ggcctgccctcattcaggac

SEQ ID NO: 361737 - DNA, 20 bp, Artificial
  CRISPR gRNA sequence
cctgccctcattcaggacag

SEQ ID NO: 361738 - DNA, 20 bp, Artificial
  CRISPR gRNA sequence
ctgccctcattcaggacagg

SEQ ID NO: 361739 - DNA, 20 bp, Artificial
  CRISPR gRNA sequence
ccctcattcaggacaggagg

SEQ ID NO: 361740 - DNA, 20 bp, Artificial
  CRISPR gRNA sequence
cattcaggacaggaggcggt

SEQ ID NO: 361741 - DNA, 20 bp, Artificial
  CRISPR gRNA sequence
attcaggacaggaggcggtg

SEQ ID NO: 361742 - DNA, 20 bp, Artificial
  CRISPR gRNA sequence
ttcaggacaggaggcggtga

SEQ ID NO: 361743 - DNA, 20 bp, Artificial
  CRISPR gRNA sequence
caggacaggaggcggtgagg

SEQ ID NO: 361744 - DNA, 20 bp, Artificial
  CRISPR gRNA sequence
acaggaggcggtgagggaga

SEQ ID NO: 361745 - DNA, 20 bp, Artificial
  CRISPR gRNA sequence
ggcggtgagggagatggcaa

SEQ ID NO: 361746 - DNA, 20 bp, Artificial
  CRISPR gRNA sequence
gagatggcaatggtaatcac

SEQ ID NO: 361747 - DNA, 20 bp, Artificial
  CRISPR gRNA sequence
tggcaatggtaatcactaga

SEQ ID NO: 361748 - DNA, 20 bp, Artificial
  CRISPR gRNA sequence
gtaatcactagatggaatgc

SEQ ID NO: 361749 - DNA, 20 bp, Artificial
  CRISPR gRNA sequence
taatcactagatggaatgca

SEQ ID NO: 361750 - DNA, 20 bp, Artificial
  CRISPR gRNA sequence
aataaaatatgttcaatgaa

SEQ ID NO: 361751 - DNA, 20 bp, Artificial
  CRISPR gRNA sequence
ataaaatatgttcaatgaaa

SEQ ID NO: 361752 - DNA, 20 bp, Artificial
  CRISPR gRNA sequence
aaatatgttcaatgaaaagg

SEQ ID NO: 361753 - DNA, 20 bp, Artificial
  CRISPR gRNA sequence
aggtggccacaaacaacatc

SEQ ID NO: 361754 - DNA, 20 bp, Artificial
  CRISPR gRNA sequence
ggtggccacaaacaacatcc

SEQ ID NO: 361755 - DNA, 20 bp, Artificial
  CRISPR gRNA sequence
gtggccacaaacaacatccg

SEQ ID NO: 361756 - DNA, 20 bp, Artificial
  CRISPR gRNA sequence
tggccacaaacaacatccgg

SEQ ID NO: 361757 - DNA, 20 bp, Artificial
  CRISPR gRNA sequence
aaacaacatccgggggaatg

SEQ ID NO: 361758 - DNA, 20 bp, Artificial
  CRISPR gRNA sequence
aacaacatccgggggaatgc

SEQ ID NO: 361759 - DNA, 20 bp, Artificial
  CRISPR gRNA sequence
ccgggggaatgcaggaaaca

SEQ ID NO: 361760 - DNA, 20 bp, Artificial
  CRISPR gRNA sequence
ggaaacatggattcctgttt

SEQ ID NO: 361761 - DNA, 20 bp, Artificial
  CRISPR gRNA sequence
gaaacatggattcctgtttt

SEQ ID NO: 361762 - DNA, 20 bp, Artificial
  CRISPR gRNA sequence
aaacatggattcctgtttta

SEQ ID NO: 361763 - DNA, 20 bp, Artificial
  CRISPR gRNA sequence
aacatggattcctgttttag

SEQ ID NO: 361764 - DNA, 20 bp, Artificial
  CRISPR gRNA sequence
atggattcctgttttagggg

SEQ ID NO: 361765 - DNA, 20 bp, Artificial
  CRISPR gRNA sequence
tggattcctgttttaggggt

SEQ ID NO: 361766 - DNA, 20 bp, Artificial
  CRISPR gRNA sequence
ggggtgggacaatgtttcct

SEQ ID NO: 361767 - DNA, 20 bp, Artificial
  CRISPR gRNA sequence
ggacaatgtttccttagctg

SEQ ID NO: 361768 - DNA, 20 bp, Artificial
  CRISPR gRNA sequence
tgtttccttagctgaagaat

SEQ ID NO: 361769 - DNA, 20 bp, Artificial
  CRISPR gRNA sequence
ccttagctgaagaatgagta

SEQ ID NO: 361770 - DNA, 20 bp, Artificial
  CRISPR gRNA sequence
cttagctgaagaatgagtac

SEQ ID NO: 361771 - DNA, 20 bp, Artificial
  CRISPR gRNA sequence
ctgaagaatgagtacaggtt

SEQ ID NO: 361772 - DNA, 20 bp, Artificial
  CRISPR gRNA sequence
tatcccttatccaaaatact

SEQ ID NO: 361773 - DNA, 20 bp, Artificial
  CRISPR gRNA sequence
atcccttatccaaaatactt

SEQ ID NO: 361774 - DNA, 20 bp, Artificial
  CRISPR gRNA sequence
tccaaaatacttgggaacat

SEQ ID NO: 361775 - DNA, 20 bp, Artificial
  CRISPR gRNA sequence
acttgggaacataagtgttt

SEQ ID NO: 361776 - DNA, 20 bp, Artificial
  CRISPR gRNA sequence
gaacataagtgtttcagatt

SEQ ID NO: 361777 - DNA, 20 bp, Artificial
  CRISPR gRNA sequence
aacataagtgtttcagattt

SEQ ID NO: 361778 - DNA, 20 bp, Artificial
  CRISPR gRNA sequence
tttcagatttgggattcttt

SEQ ID NO: 361779 - DNA, 20 bp, Artificial
  CRISPR gRNA sequence
tttgggattcttttggattt

SEQ ID NO: 361780 - DNA, 20 bp, Artificial
  CRISPR gRNA sequence
ttggaatatttacatcatac

SEQ ID NO: 361781 - DNA, 20 bp, Artificial
  CRISPR gRNA sequence
gaaatctaaaatgctccaat

SEQ ID NO: 361782 - DNA, 20 bp, Artificial
  CRISPR gRNA sequence
ctccaatgagcatttccttt

SEQ ID NO: 361783 - DNA, 20 bp, Artificial
  CRISPR gRNA sequence
atttcctttgagcatcatgt

SEQ ID NO: 361784 - DNA, 20 bp, Artificial
  CRISPR gRNA sequence
gagcatcatgttggcattca

SEQ ID NO: 361785 - DNA, 20 bp, Artificial
  CRISPR gRNA sequence
gcatcatgttggcattcaaa

SEQ ID NO: 361786 - DNA, 20 bp, Artificial
  CRISPR gRNA sequence
tgttggcattcaaagagttt

SEQ ID NO: 361787 - DNA, 20 bp, Artificial
  CRISPR gRNA sequence
attcaaagagttttggattt

SEQ ID NO: 361788 - DNA, 20 bp, Artificial
  CRISPR gRNA sequence
tcaaagagttttggattttg

SEQ ID NO: 361789 - DNA, 20 bp, Artificial
  CRISPR gRNA sequence
ttttggattttggagcattt

SEQ ID NO: 361790 - DNA, 20 bp, Artificial
  CRISPR gRNA sequence
ttttggagcatttcagattt

SEQ ID NO: 361791 - DNA, 20 bp, Artificial
  CRISPR gRNA sequence
agatttcagattttttgatt

SEQ ID NO: 361792 - DNA, 20 bp, Artificial
  CRISPR gRNA sequence
gatttcagattttttgattt

SEQ ID NO: 361793 - DNA, 20 bp, Artificial
  CRISPR gRNA sequence
attttttgatttgggatatt

SEQ ID NO: 361794 - DNA, 20 bp, Artificial
  CRISPR gRNA sequence
gatttgggatattcagtctg

SEQ ID NO: 361795 - DNA, 20 bp, Artificial
  CRISPR gRNA sequence
gatattcagtctgtagtaca

SEQ ID NO: 361796 - DNA, 20 bp, Artificial
  CRISPR gRNA sequence
tattcagtctgtagtacaca

SEQ ID NO: 361797 - DNA, 20 bp, Artificial
  CRISPR gRNA sequence
gtctgtagtacacagagtga

SEQ ID NO: 361798 - DNA, 20 bp, Artificial
  CRISPR gRNA sequence
ctgtagtacacagagtgaaa

SEQ ID NO: 361799 - DNA, 20 bp, Artificial
  CRISPR gRNA sequence
agtacacagagtgaaagagt

SEQ ID NO: 361800 - DNA, 20 bp, Artificial
  CRISPR gRNA sequence
gtacacagagtgaaagagta

SEQ ID NO: 361801 - DNA, 20 bp, Artificial
  CRISPR gRNA sequence
tacacagagtgaaagagtaa

SEQ ID NO: 361802 - DNA, 20 bp, Artificial
  CRISPR gRNA sequence
cagagtgaaagagtaaggga

SEQ ID NO: 361803 - DNA, 20 bp, Artificial
  CRISPR gRNA sequence
tgaaagagtaagggaaagaa

SEQ ID NO: 361804 - DNA, 20 bp, Artificial
  CRISPR gRNA sequence
gaaagagtaagggaaagaaa

SEQ ID NO: 361805 - DNA, 20 bp, Artificial
  CRISPR gRNA sequence
gtaagggaaagaaaaggcac

SEQ ID NO: 361806 - DNA, 20 bp, Artificial
  CRISPR gRNA sequence
aagcaaaaatatctacaatt

SEQ ID NO: 361807 - DNA, 20 bp, Artificial
  CRISPR gRNA sequence
atatctacaattcagaaatg

SEQ ID NO: 361808 - DNA, 20 bp, Artificial
  CRISPR gRNA sequence
atctacaattcagaaatgca

SEQ ID NO: 361809 - DNA, 20 bp, Artificial
  CRISPR gRNA sequence
tctacaattcagaaatgcag

SEQ ID NO: 361810 - DNA, 20 bp, Artificial
  CRISPR gRNA sequence
tcagaaatgcagaggatgcc

SEQ ID NO: 361811 - DNA, 20 bp, Artificial
  CRISPR gRNA sequence
cagaaatgcagaggatgcct

SEQ ID NO: 361812 - DNA, 20 bp, Artificial
  CRISPR gRNA sequence
agaaatgcagaggatgccta

SEQ ID NO: 361813 - DNA, 20 bp, Artificial
  CRISPR gRNA sequence
aatttgcacttaaccatgtt

SEQ ID NO: 361814 - DNA, 20 bp, Artificial
  CRISPR gRNA sequence
aaccatgtttggctgaaaaa

SEQ ID NO: 361815 - DNA, 20 bp, Artificial
  CRISPR gRNA sequence
accatgtttggctgaaaaaa

SEQ ID NO: 361816 - DNA, 20 bp, Artificial
  CRISPR gRNA sequence
ggctgaaaaaaaggaatgca

SEQ ID NO: 361817 - DNA, 20 bp, Artificial
  CRISPR gRNA sequence
aaaggaatgcaaagtgactt

SEQ ID NO: 361818 - DNA, 20 bp, Artificial
  CRISPR gRNA sequence
ggaatgcaaagtgactttgg

SEQ ID NO: 361819 - DNA, 20 bp, Artificial
  CRISPR gRNA sequence
gaatgcaaagtgactttgga

SEQ ID NO: 361820 - DNA, 20 bp, Artificial
  CRISPR gRNA sequence
aagtgactttggaaggtatg

SEQ ID NO: 361821 - DNA, 20 bp, Artificial
  CRISPR gRNA sequence
agtgactttggaaggtatgc

SEQ ID NO: 361822 - DNA, 20 bp, Artificial
  CRISPR gRNA sequence
gtgactttggaaggtatgca

SEQ ID NO: 361823 - DNA, 20 bp, Artificial
  CRISPR gRNA sequence
ttggaaggtatgcagggacc

SEQ ID NO: 361824 - DNA, 20 bp, Artificial
  CRISPR gRNA sequence
ggtatgcagggaccaagcct

SEQ ID NO: 361825 - DNA, 20 bp, Artificial
  CRISPR gRNA sequence
atgcagggaccaagccttag

SEQ ID NO: 361826 - DNA, 20 bp, Artificial
  CRISPR gRNA sequence
aagccttagaagaccttgaa

SEQ ID NO: 361827 - DNA, 20 bp, Artificial
  CRISPR gRNA sequence
agaccttgaacagcacttgt

SEQ ID NO: 361828 - DNA, 20 bp, Artificial
  CRISPR gRNA sequence
gaacagcacttgtaagaatc

SEQ ID NO: 361829 - DNA, 20 bp, Artificial
  CRISPR gRNA sequence
aagaatcaagattaaccacg

SEQ ID NO: 361830 - DNA, 20 bp, Artificial
  CRISPR gRNA sequence
agaatcaagattaaccacgt

SEQ ID NO: 361831 - DNA, 20 bp, Artificial
  CRISPR gRNA sequence
tcaagattaaccacgtaggt

SEQ ID NO: 361832 - DNA, 20 bp, Artificial
  CRISPR gRNA sequence
caagattaaccacgtaggtg

SEQ ID NO: 361833 - DNA, 20 bp, Artificial
  CRISPR gRNA sequence
aagattaaccacgtaggtga

SEQ ID NO: 361834 - DNA, 20 bp, Artificial
  CRISPR gRNA sequence
ccacgtaggtgagggctcca

SEQ ID NO: 361835 - DNA, 20 bp, Artificial
  CRISPR gRNA sequence
gggctccaaagacaaattcc

SEQ ID NO: 361836 - DNA, 20 bp, Artificial
  CRISPR gRNA sequence
gctccaaagacaaattccca

SEQ ID NO: 361837 - DNA, 20 bp, Artificial
  CRISPR gRNA sequence
ctccaaagacaaattcccag

SEQ ID NO: 361838 - DNA, 20 bp, Artificial
  CRISPR gRNA sequence
tccaaagacaaattcccaga

SEQ ID NO: 361839 - DNA, 20 bp, Artificial
  CRISPR gRNA sequence
agacaaattcccagagggtc

SEQ ID NO: 361840 - DNA, 20 bp, Artificial
  CRISPR gRNA sequence
gacaaattcccagagggtcc

SEQ ID NO: 361841 - DNA, 20 bp, Artificial
  CRISPR gRNA sequence
aaattcccagagggtccagg

SEQ ID NO: 361842 - DNA, 20 bp, Artificial
  CRISPR gRNA sequence
cagagggtccaggaagatca

SEQ ID NO: 361843 - DNA, 20 bp, Artificial
  CRISPR gRNA sequence
aggaagatcatggaaatgac

SEQ ID NO: 361844 - DNA, 20 bp, Artificial
  CRISPR gRNA sequence
gaagatcatggaaatgacca

SEQ ID NO: 361845 - DNA, 20 bp, Artificial
  CRISPR gRNA sequence
catggaaatgaccagagcca

SEQ ID NO: 361846 - DNA, 20 bp, Artificial
  CRISPR gRNA sequence
atggaaatgaccagagccaa

SEQ ID NO: 361847 - DNA, 20 bp, Artificial
  CRISPR gRNA sequence
cagagccaaaggtattacaa

SEQ ID NO: 361848 - DNA, 20 bp, Artificial
  CRISPR gRNA sequence
agagccaaaggtattacaat

SEQ ID NO: 361849 - DNA, 20 bp, Artificial
  CRISPR gRNA sequence
gagccaaaggtattacaata

SEQ ID NO: 361850 - DNA, 20 bp, Artificial
  CRISPR gRNA sequence
ccaaaggtattacaataggg

SEQ ID NO: 361851 - DNA, 20 bp, Artificial
  CRISPR gRNA sequence
aaaggtattacaatagggaa

SEQ ID NO: 361852 - DNA, 20 bp, Artificial
  CRISPR gRNA sequence
ggtattacaatagggaagag

SEQ ID NO: 361853 - DNA, 20 bp, Artificial
  CRISPR gRNA sequence
gtattacaatagggaagagt

SEQ ID NO: 361854 - DNA, 20 bp, Artificial
  CRISPR gRNA sequence
tattacaatagggaagagtg

SEQ ID NO: 361855 - DNA, 20 bp, Artificial
  CRISPR gRNA sequence
atagggaagagtggggattg

SEQ ID NO: 361856 - DNA, 20 bp, Artificial
  CRISPR gRNA sequence
tagggaagagtggggattgt

SEQ ID NO: 361857 - DNA, 20 bp, Artificial
  CRISPR gRNA sequence
agtggggattgtgggtgact

SEQ ID NO: 361858 - DNA, 20 bp, Artificial
  CRISPR gRNA sequence
gtggggattgtgggtgactc

SEQ ID NO: 361859 - DNA, 20 bp, Artificial
  CRISPR gRNA sequence
aggaatatattatttacaaa

SEQ ID NO: 361860 - DNA, 20 bp, Artificial
  CRISPR gRNA sequence
ggaatatattatttacaaaa

SEQ ID NO: 361861 - DNA, 20 bp, Artificial
  CRISPR gRNA sequence
acaaaaaggttgctgctacc

SEQ ID NO: 361862 - DNA, 20 bp, Artificial
  CRISPR gRNA sequence
aaggttgctgctacccagcc

SEQ ID NO: 361863 - DNA, 20 bp, Artificial
  CRISPR gRNA sequence
ccagcctagaaaatgctgcc

SEQ ID NO: 361864 - DNA, 20 bp, Artificial
  CRISPR gRNA sequence
gcctagaaaatgctgccaag

SEQ ID NO: 361865 - DNA, 20 bp, Artificial
  CRISPR gRNA sequence
gctgccaagcagaaaactta

SEQ ID NO: 361866 - DNA, 20 bp, Artificial
  CRISPR gRNA sequence
gccaagcagaaaacttatgg

SEQ ID NO: 361867 - DNA, 20 bp, Artificial
  CRISPR gRNA sequence
aaaacttatggcagtattaa

SEQ ID NO: 361868 - DNA, 20 bp, Artificial
  CRISPR gRNA sequence
ggcagtattaatagtccatc

SEQ ID NO: 361869 - DNA, 20 bp, Artificial
  CRISPR gRNA sequence
gtccatccagatgtgcatat

SEQ ID NO: 361870 - DNA, 20 bp, Artificial
  CRISPR gRNA sequence
ctgatcttccaaaaatgtgt

SEQ ID NO: 361871 - DNA, 20 bp, Artificial
  CRISPR gRNA sequence
aatgtgttggtcaaatgaaa

SEQ ID NO: 361872 - DNA, 20 bp, Artificial
  CRISPR gRNA sequence
atgtgttggtcaaatgaaat

SEQ ID NO: 361873 - DNA, 20 bp, Artificial
  CRISPR gRNA sequence
gtcaaatgaaatgggtgtta

SEQ ID NO: 361874 - DNA, 20 bp, Artificial
  CRISPR gRNA sequence
tcaaatgaaatgggtgttac

SEQ ID NO: 361875 - DNA, 20 bp, Artificial
  CRISPR gRNA sequence
ggccacttgtttgcaaactg

SEQ ID NO: 361876 - DNA, 20 bp, Artificial
  CRISPR gRNA sequence
cttgtttgcaaactgtggtg

SEQ ID NO: 361877 - DNA, 20 bp, Artificial
  CRISPR gRNA sequence
caaactgtggtgtggatcgt

SEQ ID NO: 361878 - DNA, 20 bp, Artificial
  CRISPR gRNA sequence
aaactgtggtgtggatcgtg

SEQ ID NO: 361879 - DNA, 20 bp, Artificial
  CRISPR gRNA sequence
tgtggatcgtgaggacaccc

SEQ ID NO: 361880 - DNA, 20 bp, Artificial
  CRISPR gRNA sequence
tcgtgaggacaccctggatc

SEQ ID NO: 361881 - DNA, 20 bp, Artificial
  CRISPR gRNA sequence
acttgtaacatcattttatc

SEQ ID NO: 361882 - DNA, 20 bp, Artificial
  CRISPR gRNA sequence
atcaagtcactctcatgtgc

SEQ ID NO: 361883 - DNA, 20 bp, Artificial
  CRISPR gRNA sequence
tcaagtcactctcatgtgct

SEQ ID NO: 361884 - DNA, 20 bp, Artificial
  CRISPR gRNA sequence
ttttctccctatatgctcca

SEQ ID NO: 361885 - DNA, 20 bp, Artificial
  CRISPR gRNA sequence
taataatactatctccctca

SEQ ID NO: 361886 - DNA, 20 bp, Artificial
  CRISPR gRNA sequence
aataatactatctccctcac

SEQ ID NO: 361887 - DNA, 20 bp, Artificial
  CRISPR gRNA sequence
ataatactatctccctcaca

SEQ ID NO: 361888 - DNA, 20 bp, Artificial
  CRISPR gRNA sequence
ctccctcacagggacaatgt

SEQ ID NO: 361889 - DNA, 20 bp, Artificial
  CRISPR gRNA sequence
tccctcacagggacaatgtg

SEQ ID NO: 361890 - DNA, 20 bp, Artificial
  CRISPR gRNA sequence
ccctcacagggacaatgtga

SEQ ID NO: 361891 - DNA, 20 bp, Artificial
  CRISPR gRNA sequence
taaatgaaataatcaatgta

SEQ ID NO: 361892 - DNA, 20 bp, Artificial
  CRISPR gRNA sequence
aataatcaatgtaaagcctt

SEQ ID NO: 361893 - DNA, 20 bp, Artificial
  CRISPR gRNA sequence
taatcaatgtaaagccttta

SEQ ID NO: 361894 - DNA, 20 bp, Artificial
  CRISPR gRNA sequence
aaagcctttagagccctgcc

SEQ ID NO: 361895 - DNA, 20 bp, Artificial
  CRISPR gRNA sequence
aagcctttagagccctgccc

SEQ ID NO: 361896 - DNA, 20 bp, Artificial
  CRISPR gRNA sequence
agcctttagagccctgccca

SEQ ID NO: 361897 - DNA, 20 bp, Artificial
  CRISPR gRNA sequence
gccacataataaacattcaa

SEQ ID NO: 361898 - DNA, 20 bp, Artificial
  CRISPR gRNA sequence
attcaacggttatgaatgtg

SEQ ID NO: 361899 - DNA, 20 bp, Artificial
  CRISPR gRNA sequence
ttcaacggttatgaatgtga

SEQ ID NO: 361900 - DNA, 20 bp, Artificial
  CRISPR gRNA sequence
aacggttatgaatgtgaagg

SEQ ID NO: 361901 - DNA, 20 bp, Artificial
  CRISPR gRNA sequence
ttatgaatgtgaaggaagac

SEQ ID NO: 361902 - DNA, 20 bp, Artificial
  CRISPR gRNA sequence
atgtgaaggaagactagcca

SEQ ID NO: 361903 - DNA, 20 bp, Artificial
  CRISPR gRNA sequence
cacatttgcatctccaaccc

SEQ ID NO: 361904 - DNA, 20 bp, Artificial
  CRISPR gRNA sequence
ctccaacccaagttctctct

SEQ ID NO: 361905 - DNA, 20 bp, Artificial
  CRISPR gRNA sequence
tccaacccaagttctctctt

SEQ ID NO: 361906 - DNA, 20 bp, Artificial
  CRISPR gRNA sequence
taaaaaatcctcctgcctgc

SEQ ID NO: 361907 - DNA, 20 bp, Artificial
  CRISPR gRNA sequence
aaaaatcctcctgcctgcta

SEQ ID NO: 361908 - DNA, 20 bp, Artificial
  CRISPR gRNA sequence
aaatcctcctgcctgctaga

SEQ ID NO: 361909 - DNA, 20 bp, Artificial
  CRISPR gRNA sequence
gcctgctagagagcttcact

SEQ ID NO: 361910 - DNA, 20 bp, Artificial
  CRISPR gRNA sequence
taaacgattcaaccccactc

SEQ ID NO: 361911 - DNA, 20 bp, Artificial
  CRISPR gRNA sequence
aacgattcaaccccactccg

SEQ ID NO: 361912 - DNA, 20 bp, Artificial
  CRISPR gRNA sequence
tcatctcattctccctgatg

SEQ ID NO: 361913 - DNA, 20 bp, Artificial
  CRISPR gRNA sequence
ctccctgatgcagtcaatga

SEQ ID NO: 361914 - DNA, 20 bp, Artificial
  CRISPR gRNA sequence
caatgacagcaccatctact

SEQ ID NO: 361915 - DNA, 20 bp, Artificial
  CRISPR gRNA sequence
aatgacagcaccatctactc

SEQ ID NO: 361916 - DNA, 20 bp, Artificial
  CRISPR gRNA sequence
caccatctactcaggatccc

SEQ ID NO: 361917 - DNA, 20 bp, Artificial
  CRISPR gRNA sequence
tcaggatcccaagtaaaacc

SEQ ID NO: 361918 - DNA, 20 bp, Artificial
  CRISPR gRNA sequence
tgtctctgtgtgtctctctc

SEQ ID NO: 361919 - DNA, 20 bp, Artificial
  CRISPR gRNA sequence
ctctctctagcctattgtct

SEQ ID NO: 361920 - DNA, 20 bp, Artificial
  CRISPR gRNA sequence
ctattgtctgagctcattcc

SEQ ID NO: 361921 - DNA, 20 bp, Artificial
  CRISPR gRNA sequence
tgagctcattcccagaaata

SEQ ID NO: 361922 - DNA, 20 bp, Artificial
  CRISPR gRNA sequence
ccagaaatatggaaattcca

SEQ ID NO: 361923 - DNA, 20 bp, Artificial
  CRISPR gRNA sequence
cagaaatatggaaattccac

SEQ ID NO: 361924 - DNA, 20 bp, Artificial
  CRISPR gRNA sequence
cacaggctgcatgccatctc

SEQ ID NO: 361925 - DNA, 20 bp, Artificial
  CRISPR gRNA sequence
caggctgcatgccatctctg

SEQ ID NO: 361926 - DNA, 20 bp, Artificial
  CRISPR gRNA sequence
aggctgcatgccatctctgg

SEQ ID NO: 361927 - DNA, 20 bp, Artificial
  CRISPR gRNA sequence
tgccatctctggaggtgatc

SEQ ID NO: 361928 - DNA, 20 bp, Artificial
  CRISPR gRNA sequence
tctggaggtgatcaagaatg

SEQ ID NO: 361929 - DNA, 20 bp, Artificial
  CRISPR gRNA sequence
ctggaggtgatcaagaatga

SEQ ID NO: 361930 - DNA, 20 bp, Artificial
  CRISPR gRNA sequence
ggaggtgatcaagaatgaag

SEQ ID NO: 361931 - DNA, 20 bp, Artificial
  CRISPR gRNA sequence
gaggtgatcaagaatgaagg

SEQ ID NO: 361932 - DNA, 20 bp, Artificial
  CRISPR gRNA sequence
gatcaagaatgaaggaggtc

SEQ ID NO: 361933 - DNA, 20 bp, Artificial
  CRISPR gRNA sequence
gcatctctcctctgcaccat

SEQ ID NO: 361934 - DNA, 20 bp, Artificial
  CRISPR gRNA sequence
tctcctctgcaccatgagca

SEQ ID NO: 361935 - DNA, 20 bp, Artificial
  CRISPR gRNA sequence
ctcctctgcaccatgagcac

SEQ ID NO: 361936 - DNA, 20 bp, Artificial
  CRISPR gRNA sequence
aactacaaacaaaatcctac

SEQ ID NO: 361937 - DNA, 20 bp, Artificial
  CRISPR gRNA sequence
actacaaacaaaatcctact

SEQ ID NO: 361938 - DNA, 20 bp, Artificial
  CRISPR gRNA sequence
aaacaaaatcctactgggac

SEQ ID NO: 361939 - DNA, 20 bp, Artificial
  CRISPR gRNA sequence
acaaaatcctactgggactg

SEQ ID NO: 361940 - DNA, 20 bp, Artificial
  CRISPR gRNA sequence
aaatcctactgggactggag

SEQ ID NO: 361941 - DNA, 20 bp, Artificial
  CRISPR gRNA sequence
atcctactgggactggagaa

SEQ ID NO: 361942 - DNA, 20 bp, Artificial
  CRISPR gRNA sequence
ctggagaagagtccaaaaac

SEQ ID NO: 361943 - DNA, 20 bp, Artificial
  CRISPR gRNA sequence
tggagaagagtccaaaaact

SEQ ID NO: 361944 - DNA, 20 bp, Artificial
  CRISPR gRNA sequence
ggagaagagtccaaaaactg

SEQ ID NO: 361945 - DNA, 20 bp, Artificial
  CRISPR gRNA sequence
ggtatttgatacatcattcc

SEQ ID NO: 361946 - DNA, 20 bp, Artificial
  CRISPR gRNA sequence
gtatttgatacatcattcct

SEQ ID NO: 361947 - DNA, 20 bp, Artificial
  CRISPR gRNA sequence
tttgatacatcattcctggg

SEQ ID NO: 361948 - DNA, 20 bp, Artificial
  CRISPR gRNA sequence
catcattcctgggaagatga

SEQ ID NO: 361949 - DNA, 20 bp, Artificial
  CRISPR gRNA sequence
atcattcctgggaagatgat

SEQ ID NO: 361950 - DNA, 20 bp, Artificial
  CRISPR gRNA sequence
agatgatgggctacattatt

SEQ ID NO: 361951 - DNA, 20 bp, Artificial
  CRISPR gRNA sequence
atgggctacattattcagat

SEQ ID NO: 361952 - DNA, 20 bp, Artificial
  CRISPR gRNA sequence
cattattcagatcagacttt

SEQ ID NO: 361953 - DNA, 20 bp, Artificial
  CRISPR gRNA sequence
attattcagatcagactttc

SEQ ID NO: 361954 - DNA, 20 bp, Artificial
  CRISPR gRNA sequence
cagatcagactttcaggtaa

SEQ ID NO: 361955 - DNA, 20 bp, Artificial
  CRISPR gRNA sequence
gactttcaggtaaaagcatc

SEQ ID NO: 361956 - DNA, 20 bp, Artificial
  CRISPR gRNA sequence
aatattttttaaaaaataca

SEQ ID NO: 361957 - DNA, 20 bp, Artificial
  CRISPR gRNA sequence
tattttttaaaaaatacaaa

SEQ ID NO: 361958 - DNA, 20 bp, Artificial
  CRISPR gRNA sequence
attttttaaaaaatacaaag

SEQ ID NO: 361959 - DNA, 20 bp, Artificial
  CRISPR gRNA sequence
taaaaaatacaaagaggtaa

SEQ ID NO: 361960 - DNA, 20 bp, Artificial
  CRISPR gRNA sequence
aatacaaagaggtaaaagat

SEQ ID NO: 361961 - DNA, 20 bp, Artificial
  CRISPR gRNA sequence
aaagatgagtgttttgaatg

SEQ ID NO: 361962 - DNA, 20 bp, Artificial
  CRISPR gRNA sequence
aagatgagtgttttgaatga

SEQ ID NO: 361963 - DNA, 20 bp, Artificial
  CRISPR gRNA sequence
gaatgaaggctgttgcaata

SEQ ID NO: 361964 - DNA, 20 bp, Artificial
  CRISPR gRNA sequence
aggctgttgcaatatggttt

SEQ ID NO: 361965 - DNA, 20 bp, Artificial
  CRISPR gRNA sequence
gcaatatggtttgagataaa

SEQ ID NO: 361966 - DNA, 20 bp, Artificial
  CRISPR gRNA sequence
ggtttgagataaatggatat

SEQ ID NO: 361967 - DNA, 20 bp, Artificial
  CRISPR gRNA sequence
gtttgagataaatggatatg

SEQ ID NO: 361968 - DNA, 20 bp, Artificial
  CRISPR gRNA sequence
atatgaggtgtctattttgc

SEQ ID NO: 361969 - DNA, 20 bp, Artificial
  CRISPR gRNA sequence
aggtgtctattttgcaagtc

SEQ ID NO: 361970 - DNA, 20 bp, Artificial
  CRISPR gRNA sequence
attttgcaagtctagacact

SEQ ID NO: 361971 - DNA, 20 bp, Artificial
  CRISPR gRNA sequence
gacacttagatgtgaaaaat

SEQ ID NO: 361972 - DNA, 20 bp, Artificial
  CRISPR gRNA sequence
acacttagatgtgaaaaatg

SEQ ID NO: 361973 - DNA, 20 bp, Artificial
  CRISPR gRNA sequence
gtgaaaaatgaggcaaaaca

SEQ ID NO: 361974 - DNA, 20 bp, Artificial
  CRISPR gRNA sequence
tgaggcaaaacaaagcataa

SEQ ID NO: 361975 - DNA, 20 bp, Artificial
  CRISPR gRNA sequence
aagatgacttctatgttttt

SEQ ID NO: 361976 - DNA, 20 bp, Artificial
  CRISPR gRNA sequence
acttctatgtttttaagatg

SEQ ID NO: 361977 - DNA, 20 bp, Artificial
  CRISPR gRNA sequence
cttctatgtttttaagatgt

SEQ ID NO: 361978 - DNA, 20 bp, Artificial
  CRISPR gRNA sequence
gtgggaatattgactcaaat

SEQ ID NO: 361979 - DNA, 20 bp, Artificial
  CRISPR gRNA sequence
gaatattgactcaaatgaga

SEQ ID NO: 361980 - DNA, 20 bp, Artificial
  CRISPR gRNA sequence
ttgactcaaatgagaaagac

SEQ ID NO: 361981 - DNA, 20 bp, Artificial
  CRISPR gRNA sequence
tgactcaaatgagaaagact

SEQ ID NO: 361982 - DNA, 20 bp, Artificial
  CRISPR gRNA sequence
actcaaatgagaaagactgg

SEQ ID NO: 361983 - DNA, 20 bp, Artificial
  CRISPR gRNA sequence
caaatgagaaagactgggag

SEQ ID NO: 361984 - DNA, 20 bp, Artificial
  CRISPR gRNA sequence
aaatgagaaagactgggagc

SEQ ID NO: 361985 - DNA, 20 bp, Artificial
  CRISPR gRNA sequence
gagaaagactgggagcagga

SEQ ID NO: 361986 - DNA, 20 bp, Artificial
  CRISPR gRNA sequence
ggagcaggacagatttgtga

SEQ ID NO: 361987 - DNA, 20 bp, Artificial
  CRISPR gRNA sequence
gagcaggacagatttgtgaa

SEQ ID NO: 361988 - DNA, 20 bp, Artificial
  CRISPR gRNA sequence
gcaggacagatttgtgaaag

SEQ ID NO: 361989 - DNA, 20 bp, Artificial
  CRISPR gRNA sequence
aggagcaaatgtatttgtga

SEQ ID NO: 361990 - DNA, 20 bp, Artificial
  CRISPR gRNA sequence
ggagcaaatgtatttgtgaa

SEQ ID NO: 361991 - DNA, 20 bp, Artificial
  CRISPR gRNA sequence
agcaaatgtatttgtgaaag

SEQ ID NO: 361992 - DNA, 20 bp, Artificial
  CRISPR gRNA sequence
tgtatttgtgaaaggagcaa

SEQ ID NO: 361993 - DNA, 20 bp, Artificial
  CRISPR gRNA sequence
agcaaaagcatcaaatctct

SEQ ID NO: 361994 - DNA, 20 bp, Artificial
  CRISPR gRNA sequence
gcatcaaatctctgagaaca

SEQ ID NO: 361995 - DNA, 20 bp, Artificial
  CRISPR gRNA sequence
catcaaatctctgagaacac

SEQ ID NO: 361996 - DNA, 20 bp, Artificial
  CRISPR gRNA sequence
atcaaatctctgagaacaca

SEQ ID NO: 361997 - DNA, 20 bp, Artificial
  CRISPR gRNA sequence
tctgagaacacagggaccac

SEQ ID NO: 361998 - DNA, 20 bp, Artificial
  CRISPR gRNA sequence
cagggaccaccggaaaaatc

SEQ ID NO: 361999 - DNA, 20 bp, Artificial
  CRISPR gRNA sequence
agggaccaccggaaaaatcc

SEQ ID NO: 362000 - DNA, 20 bp, Artificial
  CRISPR gRNA sequence
gaccaccggaaaaatccagg

SEQ ID NO: 362001 - DNA, 20 bp, Artificial
  CRISPR gRNA sequence
caccggaaaaatccaggtag

SEQ ID NO: 362002 - DNA, 20 bp, Artificial
  CRISPR gRNA sequence
tccaggtagaagtgaaaaac

SEQ ID NO: 362003 - DNA, 20 bp, Artificial
  CRISPR gRNA sequence
caggtagaagtgaaaaacta

SEQ ID NO: 362004 - DNA, 20 bp, Artificial
  CRISPR gRNA sequence
gaagtgaaaaactagagaca

SEQ ID NO: 362005 - DNA, 20 bp, Artificial
  CRISPR gRNA sequence
aagtgaaaaactagagacat

SEQ ID NO: 362006 - DNA, 20 bp, Artificial
  CRISPR gRNA sequence
agtgaaaaactagagacata

SEQ ID NO: 362007 - DNA, 20 bp, Artificial
  CRISPR gRNA sequence
aaactagagacatagggacg

SEQ ID NO: 362008 - DNA, 20 bp, Artificial
  CRISPR gRNA sequence
ctagagacatagggacgtgg

SEQ ID NO: 362009 - DNA, 20 bp, Artificial
  CRISPR gRNA sequence
gtggaagccacttctgccct

SEQ ID NO: 362010 - DNA, 20 bp, Artificial
  CRISPR gRNA sequence
tctgccctgagcacacctgc

SEQ ID NO: 362011 - DNA, 20 bp, Artificial
  CRISPR gRNA sequence
ctgagcacacctgccagtct

SEQ ID NO: 362012 - DNA, 20 bp, Artificial
  CRISPR gRNA sequence
ttgaacctcatacaacacga

SEQ ID NO: 362013 - DNA, 20 bp, Artificial
  CRISPR gRNA sequence
ctcatacaacacgaaagaaa

SEQ ID NO: 362014 - DNA, 20 bp, Artificial
  CRISPR gRNA sequence
tcatacaacacgaaagaaat

SEQ ID NO: 362015 - DNA, 20 bp, Artificial
  CRISPR gRNA sequence
aagaaataggtgtcaaaacc

SEQ ID NO: 362016 - DNA, 20 bp, Artificial
  CRISPR gRNA sequence
agaaataggtgtcaaaaccc

SEQ ID NO: 362017 - DNA, 20 bp, Artificial
  CRISPR gRNA sequence
caaaacccaggacctacctg

SEQ ID NO: 362018 - DNA, 20 bp, Artificial
  CRISPR gRNA sequence
acccaggacctacctgaagt

SEQ ID NO: 362019 - DNA, 20 bp, Artificial
  CRISPR gRNA sequence
tacctgaagtgagaattaaa

SEQ ID NO: 362020 - DNA, 20 bp, Artificial
  CRISPR gRNA sequence
ctgaagtgagaattaaaaag

SEQ ID NO: 362021 - DNA, 20 bp, Artificial
  CRISPR gRNA sequence
gaccttcctcttgtcttgtc

SEQ ID NO: 362022 - DNA, 20 bp, Artificial
  CRISPR gRNA sequence
cttgtcttgtcgagacctct

SEQ ID NO: 362023 - DNA, 20 bp, Artificial
  CRISPR gRNA sequence
ctctaagtgatactccttca

SEQ ID NO: 362024 - DNA, 20 bp, Artificial
  CRISPR gRNA sequence
ccttcatggtaacaatgacc

SEQ ID NO: 362025 - DNA, 20 bp, Artificial
  CRISPR gRNA sequence
ggtaacaatgacctggaaat

SEQ ID NO: 362026 - DNA, 20 bp, Artificial
  CRISPR gRNA sequence
catgtgctcacccgcatccc

SEQ ID NO: 362027 - DNA, 20 bp, Artificial
  CRISPR gRNA sequence
atgtgctcacccgcatcccc

SEQ ID NO: 362028 - DNA, 20 bp, Artificial
  CRISPR gRNA sequence
acccgcatccccaggtgaat

SEQ ID NO: 362029 - DNA, 20 bp, Artificial
  CRISPR gRNA sequence
cccgcatccccaggtgaata

SEQ ID NO: 362030 - DNA, 20 bp, Artificial
  CRISPR gRNA sequence
ccgcatccccaggtgaataa

SEQ ID NO: 362031 - DNA, 20 bp, Artificial
  CRISPR gRNA sequence
atccccaggtgaataaggga

SEQ ID NO: 362032 - DNA, 20 bp, Artificial
  CRISPR gRNA sequence
ccaggtgaataagggaaaga

SEQ ID NO: 362033 - DNA, 20 bp, Artificial
  CRISPR gRNA sequence
gggaaagaaagaaaatcctt

SEQ ID NO: 362034 - DNA, 20 bp, Artificial
  CRISPR gRNA sequence
aaagaaagaaaatccttgag

SEQ ID NO: 362035 - DNA, 20 bp, Artificial
  CRISPR gRNA sequence
gaaaatccttgagtagttct

SEQ ID NO: 362036 - DNA, 20 bp, Artificial
  CRISPR gRNA sequence
gagtagttctaagcacaaat

SEQ ID NO: 362037 - DNA, 20 bp, Artificial
  CRISPR gRNA sequence
agcacaaatcagtcctcatg

SEQ ID NO: 362038 - DNA, 20 bp, Artificial
  CRISPR gRNA sequence
tcagtcctcatgtggattta

SEQ ID NO: 362039 - DNA, 20 bp, Artificial
  CRISPR gRNA sequence
atttatagcctaaattccca

SEQ ID NO: 362040 - DNA, 20 bp, Artificial
  CRISPR gRNA sequence
tagcctaaattcccatagta

SEQ ID NO: 362041 - DNA, 20 bp, Artificial
  CRISPR gRNA sequence
agcctaaattcccatagtac

SEQ ID NO: 362042 - DNA, 20 bp, Artificial
  CRISPR gRNA sequence
catagtacaggtgctccata

SEQ ID NO: 362043 - DNA, 20 bp, Artificial
  CRISPR gRNA sequence
tacaggtgctccataaagct

SEQ ID NO: 362044 - DNA, 20 bp, Artificial
  CRISPR gRNA sequence
acaggtgctccataaagctc

SEQ ID NO: 362045 - DNA, 20 bp, Artificial
  CRISPR gRNA sequence
ctccataaagctcaggctga

SEQ ID NO: 362046 - DNA, 20 bp, Artificial
  CRISPR gRNA sequence
agctcaggctgaaagtaatc

SEQ ID NO: 362047 - DNA, 20 bp, Artificial
  CRISPR gRNA sequence
gctcaggctgaaagtaatcc

SEQ ID NO: 362048 - DNA, 20 bp, Artificial
  CRISPR gRNA sequence
atccaggtttcgactcctct

SEQ ID NO: 362049 - DNA, 20 bp, Artificial
  CRISPR gRNA sequence
tttcgactcctctgagaaca

SEQ ID NO: 362050 - DNA, 20 bp, Artificial
  CRISPR gRNA sequence
ttcgactcctctgagaacaa

SEQ ID NO: 362051 - DNA, 20 bp, Artificial
  CRISPR gRNA sequence
gaacaaaggtcccttcatgt

SEQ ID NO: 362052 - DNA, 20 bp, Artificial
  CRISPR gRNA sequence
ggtcccttcatgttagactt

SEQ ID NO: 362053 - DNA, 20 bp, Artificial
  CRISPR gRNA sequence
tcccttcatgttagacttca

SEQ ID NO: 362054 - DNA, 20 bp, Artificial
  CRISPR gRNA sequence
gttagacttcagagaatccc

SEQ ID NO: 362055 - DNA, 20 bp, Artificial
  CRISPR gRNA sequence
agacttcagagaatccccag

SEQ ID NO: 362056 - DNA, 20 bp, Artificial
  CRISPR gRNA sequence
gacttcagagaatccccaga

SEQ ID NO: 362057 - DNA, 20 bp, Artificial
  CRISPR gRNA sequence
aatccccagaaggctttatc

SEQ ID NO: 362058 - DNA, 20 bp, Artificial
  CRISPR gRNA sequence
atccccagaaggctttatca

SEQ ID NO: 362059 - DNA, 20 bp, Artificial
  CRISPR gRNA sequence
aaggctttatcaaggactat

SEQ ID NO: 362060 - DNA, 20 bp, Artificial
  CRISPR gRNA sequence
gctttatcaaggactatgag

SEQ ID NO: 362061 - DNA, 20 bp, Artificial
  CRISPR gRNA sequence
caaggactatgagcagcaca

SEQ ID NO: 362062 - DNA, 20 bp, Artificial
  CRISPR gRNA sequence
aaaaataaccacaaacactg

SEQ ID NO: 362063 - DNA, 20 bp, Artificial
  CRISPR gRNA sequence
aaacactgcggcactattca

SEQ ID NO: 362064 - DNA, 20 bp, Artificial
  CRISPR gRNA sequence
cactgcggcactattcacag

SEQ ID NO: 362065 - DNA, 20 bp, Artificial
  CRISPR gRNA sequence
cggcactattcacagtagca

SEQ ID NO: 362066 - DNA, 20 bp, Artificial
  CRISPR gRNA sequence
tattcacagtagcaaagact

SEQ ID NO: 362067 - DNA, 20 bp, Artificial
  CRISPR gRNA sequence
acccaaatgtccaacaacga

SEQ ID NO: 362068 - DNA, 20 bp, Artificial
  CRISPR gRNA sequence
aatgtccaacaacgatagac

SEQ ID NO: 362069 - DNA, 20 bp, Artificial
  CRISPR gRNA sequence
caacaacgatagactggatt

SEQ ID NO: 362070 - DNA, 20 bp, Artificial
  CRISPR gRNA sequence
tagactggattaagaaaatg

SEQ ID NO: 362071 - DNA, 20 bp, Artificial
  CRISPR gRNA sequence
aatgtggcacatatacacca

SEQ ID NO: 362072 - DNA, 20 bp, Artificial
  CRISPR gRNA sequence
atacaccatggaatactatg

SEQ ID NO: 362073 - DNA, 20 bp, Artificial
  CRISPR gRNA sequence
atgcagccataaaaaatgat

SEQ ID NO: 362074 - DNA, 20 bp, Artificial
  CRISPR gRNA sequence
tgatgagttcatgtcctttg

SEQ ID NO: 362075 - DNA, 20 bp, Artificial
  CRISPR gRNA sequence
gatgagttcatgtcctttgt

SEQ ID NO: 362076 - DNA, 20 bp, Artificial
  CRISPR gRNA sequence
atgagttcatgtcctttgta

SEQ ID NO: 362077 - DNA, 20 bp, Artificial
  CRISPR gRNA sequence
tcatgtcctttgtagggaca

SEQ ID NO: 362078 - DNA, 20 bp, Artificial
  CRISPR gRNA sequence
tgtagggacatggatgaaac

SEQ ID NO: 362079 - DNA, 20 bp, Artificial
  CRISPR gRNA sequence
aaactggaaaccatcattct

SEQ ID NO: 362080 - DNA, 20 bp, Artificial
  CRISPR gRNA sequence
attctcagcaaactatcaca

SEQ ID NO: 362081 - DNA, 20 bp, Artificial
  CRISPR gRNA sequence
acaccgcatgttctcactca

SEQ ID NO: 362082 - DNA, 20 bp, Artificial
  CRISPR gRNA sequence
caccgcatgttctcactcat

SEQ ID NO: 362083 - DNA, 20 bp, Artificial
  CRISPR gRNA sequence
cgcatgttctcactcatagg

SEQ ID NO: 362084 - DNA, 20 bp, Artificial
  CRISPR gRNA sequence
gcatgttctcactcataggt

SEQ ID NO: 362085 - DNA, 20 bp, Artificial
  CRISPR gRNA sequence
ataggtgggaattgaacaat

SEQ ID NO: 362086 - DNA, 20 bp, Artificial
  CRISPR gRNA sequence
aattgaacaatgagaacaca

SEQ ID NO: 362087 - DNA, 20 bp, Artificial
  CRISPR gRNA sequence
acaatgagaacacatggaca

SEQ ID NO: 362088 - DNA, 20 bp, Artificial
  CRISPR gRNA sequence
caatgagaacacatggacac

SEQ ID NO: 362089 - DNA, 20 bp, Artificial
  CRISPR gRNA sequence
tgagaacacatggacacagg

SEQ ID NO: 362090 - DNA, 20 bp, Artificial
  CRISPR gRNA sequence
gagaacacatggacacagga

SEQ ID NO: 362091 - DNA, 20 bp, Artificial
  CRISPR gRNA sequence
agaacacatggacacaggaa

SEQ ID NO: 362092 - DNA, 20 bp, Artificial
  CRISPR gRNA sequence
gaacacatggacacaggaag

SEQ ID NO: 362093 - DNA, 20 bp, Artificial
  CRISPR gRNA sequence
ggaaggggaacatcacacac

SEQ ID NO: 362094 - DNA, 20 bp, Artificial
  CRISPR gRNA sequence
gaaggggaacatcacacacc

SEQ ID NO: 362095 - DNA, 20 bp, Artificial
  CRISPR gRNA sequence
tcacacaccaggaactgttg

SEQ ID NO: 362096 - DNA, 20 bp, Artificial
  CRISPR gRNA sequence
cacacaccaggaactgttgt

SEQ ID NO: 362097 - DNA, 20 bp, Artificial
  CRISPR gRNA sequence
acacaccaggaactgttgtg

SEQ ID NO: 362098 - DNA, 20 bp, Artificial
  CRISPR gRNA sequence
caccaggaactgttgtgggg

SEQ ID NO: 362099 - DNA, 20 bp, Artificial
  CRISPR gRNA sequence
accaggaactgttgtggggt

SEQ ID NO: 362100 - DNA, 20 bp, Artificial
  CRISPR gRNA sequence
ccaggaactgttgtggggtg

SEQ ID NO: 362101 - DNA, 20 bp, Artificial
  CRISPR gRNA sequence
aggaactgttgtggggtggg

SEQ ID NO: 362102 - DNA, 20 bp, Artificial
  CRISPR gRNA sequence
gaactgttgtggggtgggga

SEQ ID NO: 362103 - DNA, 20 bp, Artificial
  CRISPR gRNA sequence
aactgttgtggggtggggag

SEQ ID NO: 362104 - DNA, 20 bp, Artificial
  CRISPR gRNA sequence
actgttgtggggtggggaga

SEQ ID NO: 362105 - DNA, 20 bp, Artificial
  CRISPR gRNA sequence
ctgttgtggggtggggagag

SEQ ID NO: 362106 - DNA, 20 bp, Artificial
  CRISPR gRNA sequence
tgttgtggggtggggagagg

SEQ ID NO: 362107 - DNA, 20 bp, Artificial
  CRISPR gRNA sequence
gttgtggggtggggagaggg

SEQ ID NO: 362108 - DNA, 20 bp, Artificial
  CRISPR gRNA sequence
tgtggggtggggagaggggg

SEQ ID NO: 362109 - DNA, 20 bp, Artificial
  CRISPR gRNA sequence
gtggggtggggagagggggg

SEQ ID NO: 362110 - DNA, 20 bp, Artificial
  CRISPR gRNA sequence
tggggtggggagagggggga

SEQ ID NO: 362111 - DNA, 20 bp, Artificial
  CRISPR gRNA sequence
gtggggagaggggggaggga

SEQ ID NO: 362112 - DNA, 20 bp, Artificial
  CRISPR gRNA sequence
agaggggggagggatagcat

SEQ ID NO: 362113 - DNA, 20 bp, Artificial
  CRISPR gRNA sequence
gaggggggagggatagcatt

SEQ ID NO: 362114 - DNA, 20 bp, Artificial
  CRISPR gRNA sequence
ggggggagggatagcattag

SEQ ID NO: 362115 - DNA, 20 bp, Artificial
  CRISPR gRNA sequence
tatacctaatgctaaatgac

SEQ ID NO: 362116 - DNA, 20 bp, Artificial
  CRISPR gRNA sequence
aatgctaaatgacaagttaa

SEQ ID NO: 362117 - DNA, 20 bp, Artificial
  CRISPR gRNA sequence
atgctaaatgacaagttaat

SEQ ID NO: 362118 - DNA, 20 bp, Artificial
  CRISPR gRNA sequence
aaatgacaagttaatgggtg

SEQ ID NO: 362119 - DNA, 20 bp, Artificial
  CRISPR gRNA sequence
atgggtgcagcacaccaaca

SEQ ID NO: 362120 - DNA, 20 bp, Artificial
  CRISPR gRNA sequence
cacatgtaccctaaaactta

SEQ ID NO: 362121 - DNA, 20 bp, Artificial
  CRISPR gRNA sequence
taataataaaatttaaaaaa

SEQ ID NO: 362122 - DNA, 20 bp, Artificial
  CRISPR gRNA sequence
ataaaatttaaaaaaaagaa

SEQ ID NO: 362123 - DNA, 20 bp, Artificial
  CRISPR gRNA sequence
aatttaaaaaaaagaaaaga

SEQ ID NO: 362124 - DNA, 20 bp, Artificial
  CRISPR gRNA sequence
aaaagaaaagaaagtaatga

SEQ ID NO: 362125 - DNA, 20 bp, Artificial
  CRISPR gRNA sequence
aaagaaaagaaagtaatgac

SEQ ID NO: 362126 - DNA, 20 bp, Artificial
  CRISPR gRNA sequence
gaaaagaaagtaatgacagg

SEQ ID NO: 362127 - DNA, 20 bp, Artificial
  CRISPR gRNA sequence
tgacaggaagaaaaaaaact

SEQ ID NO: 362128 - DNA, 20 bp, Artificial
  CRISPR gRNA sequence
ggaagaaaaaaaactgagca

SEQ ID NO: 362129 - DNA, 20 bp, Artificial
  CRISPR gRNA sequence
agaaaaaaaactgagcaaag

SEQ ID NO: 362130 - DNA, 20 bp, Artificial
  CRISPR gRNA sequence
ctgagcaaagaagaaaaaaa

SEQ ID NO: 362131 - DNA, 20 bp, Artificial
  CRISPR gRNA sequence
aagaagaaaaaaacagacaa

SEQ ID NO: 362132 - DNA, 20 bp, Artificial
  CRISPR gRNA sequence
gaagaaaaaaacagacaaca

SEQ ID NO: 362133 - DNA, 20 bp, Artificial
  CRISPR gRNA sequence
aaaaaaacagacaacagaga

SEQ ID NO: 362134 - DNA, 20 bp, Artificial
  CRISPR gRNA sequence
atagaactactttaatatta

SEQ ID NO: 362135 - DNA, 20 bp, Artificial
  CRISPR gRNA sequence
ctactttaatattacagcat

SEQ ID NO: 362136 - DNA, 20 bp, Artificial
  CRISPR gRNA sequence
tactttaatattacagcatc

SEQ ID NO: 362137 - DNA, 20 bp, Artificial
  CRISPR gRNA sequence
taatattacagcatcaggca

SEQ ID NO: 362138 - DNA, 20 bp, Artificial
  CRISPR gRNA sequence
gcatagattacaaaataact

SEQ ID NO: 362139 - DNA, 20 bp, Artificial
  CRISPR gRNA sequence
ataactaagtgtactaattc

SEQ ID NO: 362140 - DNA, 20 bp, Artificial
  CRISPR gRNA sequence
taactaagtgtactaattct

SEQ ID NO: 362141 - DNA, 20 bp, Artificial
  CRISPR gRNA sequence
taagtgtactaattctggga

SEQ ID NO: 362142 - DNA, 20 bp, Artificial
  CRISPR gRNA sequence
tgtactaattctgggaaaga

SEQ ID NO: 362143 - DNA, 20 bp, Artificial
  CRISPR gRNA sequence
tactaattctgggaaagatg

SEQ ID NO: 362144 - DNA, 20 bp, Artificial
  CRISPR gRNA sequence
actaattctgggaaagatgg

SEQ ID NO: 362145 - DNA, 20 bp, Artificial
  CRISPR gRNA sequence
tgcactgcaaaacacaaatt

SEQ ID NO: 362146 - DNA, 20 bp, Artificial
  CRISPR gRNA sequence
gcactgcaaaacacaaatta

SEQ ID NO: 362147 - DNA, 20 bp, Artificial
  CRISPR gRNA sequence
ctgcaaaacacaaattaagg

SEQ ID NO: 362148 - DNA, 20 bp, Artificial
  CRISPR gRNA sequence
gcaaaacacaaattaaggta

SEQ ID NO: 362149 - DNA, 20 bp, Artificial
  CRISPR gRNA sequence
aaaacacaaattaaggtaga

SEQ ID NO: 362150 - DNA, 20 bp, Artificial
  CRISPR gRNA sequence
aattaaggtagagagaccga

SEQ ID NO: 362151 - DNA, 20 bp, Artificial
  CRISPR gRNA sequence
agagagaccgacagaaccat

SEQ ID NO: 362152 - DNA, 20 bp, Artificial
  CRISPR gRNA sequence
ccatgagtgaaactttgaca

SEQ ID NO: 362153 - DNA, 20 bp, Artificial
  CRISPR gRNA sequence
gagtgaaactttgacaaagc

SEQ ID NO: 362154 - DNA, 20 bp, Artificial
  CRISPR gRNA sequence
tgaaactttgacaaagcaag

SEQ ID NO: 362155 - DNA, 20 bp, Artificial
  CRISPR gRNA sequence
gaaactttgacaaagcaagt

SEQ ID NO: 362156 - DNA, 20 bp, Artificial
  CRISPR gRNA sequence
actttgacaaagcaagtagg

SEQ ID NO: 362157 - DNA, 20 bp, Artificial
  CRISPR gRNA sequence
ctttgacaaagcaagtaggc

SEQ ID NO: 362158 - DNA, 20 bp, Artificial
  CRISPR gRNA sequence
tttgacaaagcaagtaggca

SEQ ID NO: 362159 - DNA, 20 bp, Artificial
  CRISPR gRNA sequence
tgacaaagcaagtaggcagg

SEQ ID NO: 362160 - DNA, 20 bp, Artificial
  CRISPR gRNA sequence
caaagcaagtaggcagggag

SEQ ID NO: 362161 - DNA, 20 bp, Artificial
  CRISPR gRNA sequence
gtaggcagggagcagtgttc

SEQ ID NO: 362162 - DNA, 20 bp, Artificial
  CRISPR gRNA sequence
gcagtgttccagcaatttct

SEQ ID NO: 362163 - DNA, 20 bp, Artificial
  CRISPR gRNA sequence
ttccagcaatttctgagcca

SEQ ID NO: 362164 - DNA, 20 bp, Artificial
  CRISPR gRNA sequence
caatttctgagccaaagctc

SEQ ID NO: 362165 - DNA, 20 bp, Artificial
  CRISPR gRNA sequence
tttctgagccaaagctctgg

SEQ ID NO: 362166 - DNA, 20 bp, Artificial
  CRISPR gRNA sequence
caaagctctggcagttgtaa

SEQ ID NO: 362167 - DNA, 20 bp, Artificial
  CRISPR gRNA sequence
gtaatagttttttaaaatgt

SEQ ID NO: 362168 - DNA, 20 bp, Artificial
  CRISPR gRNA sequence
aatgtaagacctgaatcttc

SEQ ID NO: 362169 - DNA, 20 bp, Artificial
  CRISPR gRNA sequence
tgtaagacctgaatcttcaa

SEQ ID NO: 362170 - DNA, 20 bp, Artificial
  CRISPR gRNA sequence
gtaagacctgaatcttcaag

SEQ ID NO: 362171 - DNA, 20 bp, Artificial
  CRISPR gRNA sequence
taagacctgaatcttcaaga

SEQ ID NO: 362172 - DNA, 20 bp, Artificial
  CRISPR gRNA sequence
aagacctgaatcttcaagag

SEQ ID NO: 362173 - DNA, 20 bp, Artificial
  CRISPR gRNA sequence
acctgaatcttcaagagggg

SEQ ID NO: 362174 - DNA, 20 bp, Artificial
  CRISPR gRNA sequence
tcttcaagaggggaagaatt

SEQ ID NO: 362175 - DNA, 20 bp, Artificial
  CRISPR gRNA sequence
gggaagaattcagaataatg

SEQ ID NO: 362176 - DNA, 20 bp, Artificial
  CRISPR gRNA sequence
cagaataatgaagaacacac

SEQ ID NO: 362177 - DNA, 20 bp, Artificial
  CRISPR gRNA sequence
agaataatgaagaacacact

SEQ ID NO: 362178 - DNA, 20 bp, Artificial
  CRISPR gRNA sequence
catctgctttatccccactt

SEQ ID NO: 362179 - DNA, 20 bp, Artificial
  CRISPR gRNA sequence
tatccccacttaagctgcct

SEQ ID NO: 362180 - DNA, 20 bp, Artificial
  CRISPR gRNA sequence
tattcccatcacctctgcat

SEQ ID NO: 362181 - DNA, 20 bp, Artificial
  CRISPR gRNA sequence
tcacctctgcattagtttgc

SEQ ID NO: 362182 - DNA, 20 bp, Artificial
  CRISPR gRNA sequence
cacctctgcattagtttgct

SEQ ID NO: 362183 - DNA, 20 bp, Artificial
  CRISPR gRNA sequence
acctctgcattagtttgcta

SEQ ID NO: 362184 - DNA, 20 bp, Artificial
  CRISPR gRNA sequence
ttgctagggctgccataata

SEQ ID NO: 362185 - DNA, 20 bp, Artificial
  CRISPR gRNA sequence
gctgccataataaagtacca

SEQ ID NO: 362186 - DNA, 20 bp, Artificial
  CRISPR gRNA sequence
cataataaagtaccacagac

SEQ ID NO: 362187 - DNA, 20 bp, Artificial
  CRISPR gRNA sequence
ataaagtaccacagactgga

SEQ ID NO: 362188 - DNA, 20 bp, Artificial
  CRISPR gRNA sequence
agactggatggcttaaacaa

SEQ ID NO: 362189 - DNA, 20 bp, Artificial
  CRISPR gRNA sequence
cttattttatcgcaattctg

SEQ ID NO: 362190 - DNA, 20 bp, Artificial
  CRISPR gRNA sequence
ttattttatcgcaattctgc

SEQ ID NO: 362191 - DNA, 20 bp, Artificial
  CRISPR gRNA sequence
tttatcgcaattctgcaggc

SEQ ID NO: 362192 - DNA, 20 bp, Artificial
  CRISPR gRNA sequence
caggctagaaacccaaaatt

SEQ ID NO: 362193 - DNA, 20 bp, Artificial
  CRISPR gRNA sequence
aggctagaaacccaaaattc

SEQ ID NO: 362194 - DNA, 20 bp, Artificial
  CRISPR gRNA sequence
gaaacccaaaattcaggtgc

SEQ ID NO: 362195 - DNA, 20 bp, Artificial
  CRISPR gRNA sequence
acccaaaattcaggtgccag

SEQ ID NO: 362196 - DNA, 20 bp, Artificial
  CRISPR gRNA sequence
cccaaaattcaggtgccagc

SEQ ID NO: 362197 - DNA, 20 bp, Artificial
  CRISPR gRNA sequence
ccaaaattcaggtgccagca

SEQ ID NO: 362198 - DNA, 20 bp, Artificial
  CRISPR gRNA sequence
cagcagggttgattcctttt

SEQ ID NO: 362199 - DNA, 20 bp, Artificial
  CRISPR gRNA sequence
agcagggttgattccttttg

SEQ ID NO: 362200 - DNA, 20 bp, Artificial
  CRISPR gRNA sequence
ccttttgaggcctctctcct

SEQ ID NO: 362201 - DNA, 20 bp, Artificial
  CRISPR gRNA sequence
aggcctctctccttggtttc

SEQ ID NO: 362202 - DNA, 20 bp, Artificial
  CRISPR gRNA sequence
cctaatctcctcttcttatt

SEQ ID NO: 362203 - DNA, 20 bp, Artificial
  CRISPR gRNA sequence
tcctcttcttatttggaaac

SEQ ID NO: 362204 - DNA, 20 bp, Artificial
  CRISPR gRNA sequence
tatttggaaaccagtcatat

SEQ ID NO: 362205 - DNA, 20 bp, Artificial
  CRISPR gRNA sequence
ggaaaccagtcatattggat

SEQ ID NO: 362206 - DNA, 20 bp, Artificial
  CRISPR gRNA sequence
taacttaattacctctttaa

SEQ ID NO: 362207 - DNA, 20 bp, Artificial
  CRISPR gRNA sequence
ttaaaagcctcatttccaaa

SEQ ID NO: 362208 - DNA, 20 bp, Artificial
  CRISPR gRNA sequence
tttccaaatagtcaccttct

SEQ ID NO: 362209 - DNA, 20 bp, Artificial
  CRISPR gRNA sequence
atagtcaccttctgagatat

SEQ ID NO: 362210 - DNA, 20 bp, Artificial
  CRISPR gRNA sequence
tagtcaccttctgagatatc

SEQ ID NO: 362211 - DNA, 20 bp, Artificial
  CRISPR gRNA sequence
gtcaccttctgagatatcag

SEQ ID NO: 362212 - DNA, 20 bp, Artificial
  CRISPR gRNA sequence
gcaacttcaccaaataaact

SEQ ID NO: 362213 - DNA, 20 bp, Artificial
  CRISPR gRNA sequence
caacttcaccaaataaactt

SEQ ID NO: 362214 - DNA, 20 bp, Artificial
  CRISPR gRNA sequence
aacttcaccaaataaacttg

SEQ ID NO: 362215 - DNA, 20 bp, Artificial
  CRISPR gRNA sequence
ctctcttctaaaccctgtct

SEQ ID NO: 362216 - DNA, 20 bp, Artificial
  CRISPR gRNA sequence
ctgagtgctctttctaactg

SEQ ID NO: 362217 - DNA, 20 bp, Artificial
  CRISPR gRNA sequence
aatcccttgcctaaaatcta

SEQ ID NO: 362218 - DNA, 20 bp, Artificial
  CRISPR gRNA sequence
aatctaaagtcaaaatatct

SEQ ID NO: 362219 - DNA, 20 bp, Artificial
  CRISPR gRNA sequence
aaagtcaaaatatcttagaa

SEQ ID NO: 362220 - DNA, 20 bp, Artificial
  CRISPR gRNA sequence
acatgacacgacaatgtaac

SEQ ID NO: 362221 - DNA, 20 bp, Artificial
  CRISPR gRNA sequence
atgacacgacaatgtaacta

SEQ ID NO: 362222 - DNA, 20 bp, Artificial
  CRISPR gRNA sequence
tgacacgacaatgtaactag

SEQ ID NO: 362223 - DNA, 20 bp, Artificial
  CRISPR gRNA sequence
gacacgacaatgtaactaga

SEQ ID NO: 362224 - DNA, 20 bp, Artificial
  CRISPR gRNA sequence
acgacaatgtaactagaggg

SEQ ID NO: 362225 - DNA, 20 bp, Artificial
  CRISPR gRNA sequence
aatgtaactagagggaagta

SEQ ID NO: 362226 - DNA, 20 bp, Artificial
  CRISPR gRNA sequence
ggaagtaaagctcctactcc

SEQ ID NO: 362227 - DNA, 20 bp, Artificial
  CRISPR gRNA sequence
cctactcccagcccactgca

SEQ ID NO: 362228 - DNA, 20 bp, Artificial
  CRISPR gRNA sequence
actgcaaagaaaatgcatct

SEQ ID NO: 362229 - DNA, 20 bp, Artificial
  CRISPR gRNA sequence
caaagaaaatgcatctaagt

SEQ ID NO: 362230 - DNA, 20 bp, Artificial
  CRISPR gRNA sequence
aatgcatctaagtaagcatg

SEQ ID NO: 362231 - DNA, 20 bp, Artificial
  CRISPR gRNA sequence
atgcatctaagtaagcatgt

SEQ ID NO: 362232 - DNA, 20 bp, Artificial
  CRISPR gRNA sequence
gtgggtttgctgtgaacatg

SEQ ID NO: 362233 - DNA, 20 bp, Artificial
  CRISPR gRNA sequence
tgaacatgcagttccaaatc

SEQ ID NO: 362234 - DNA, 20 bp, Artificial
  CRISPR gRNA sequence
ttctgaatgccccctcttct

SEQ ID NO: 362235 - DNA, 20 bp, Artificial
  CRISPR gRNA sequence
ccctcttctaagcaaaaatc

SEQ ID NO: 362236 - DNA, 20 bp, Artificial
  CRISPR gRNA sequence
ctcttctaagcaaaaatctg

SEQ ID NO: 362237 - DNA, 20 bp, Artificial
  CRISPR gRNA sequence
tcaccactatccacccctcc

SEQ ID NO: 362238 - DNA, 20 bp, Artificial
  CRISPR gRNA sequence
acccctccaagttcaccacc

SEQ ID NO: 362239 - DNA, 20 bp, Artificial
  CRISPR gRNA sequence
gcaccactacccacttaaat

SEQ ID NO: 362240 - DNA, 20 bp, Artificial
  CRISPR gRNA sequence
cacttaaattagcttttact

SEQ ID NO: 362241 - DNA, 20 bp, Artificial
  CRISPR gRNA sequence
acttaaattagcttttactc

SEQ ID NO: 362242 - DNA, 20 bp, Artificial
  CRISPR gRNA sequence
tgatccatcctgcaattccc

SEQ ID NO: 362243 - DNA, 20 bp, Artificial
  CRISPR gRNA sequence
cctgcaattcccaagcacac

SEQ ID NO: 362244 - DNA, 20 bp, Artificial
  CRISPR gRNA sequence
tcattttgcttttgcgccat

SEQ ID NO: 362245 - DNA, 20 bp, Artificial
  CRISPR gRNA sequence
ccattagcatgatttccctc

SEQ ID NO: 362246 - DNA, 20 bp, Artificial
  CRISPR gRNA sequence
ttagcatgatttccctccag

SEQ ID NO: 362247 - DNA, 20 bp, Artificial
  CRISPR gRNA sequence
tagcatgatttccctccagc

SEQ ID NO: 362248 - DNA, 20 bp, Artificial
  CRISPR gRNA sequence
cctccagcaggaatgccatc

SEQ ID NO: 362249 - DNA, 20 bp, Artificial
  CRISPR gRNA sequence
caggaatgccatccagctaa

SEQ ID NO: 362250 - DNA, 20 bp, Artificial
  CRISPR gRNA sequence
ctaacagcatgaccacgctt

SEQ ID NO: 362251 - DNA, 20 bp, Artificial
  CRISPR gRNA sequence
ccgttctcatcttccctcat

SEQ ID NO: 362252 - DNA, 20 bp, Artificial
  CRISPR gRNA sequence
tctcatcttccctcatgagt

SEQ ID NO: 362253 - DNA, 20 bp, Artificial
  CRISPR gRNA sequence
ctcgtgtcttctgatctctg

SEQ ID NO: 362254 - DNA, 20 bp, Artificial
  CRISPR gRNA sequence
acactgtcacgacccactcc

SEQ ID NO: 362255 - DNA, 20 bp, Artificial
  CRISPR gRNA sequence
cctctgcacacaaacaatgt

SEQ ID NO: 362256 - DNA, 20 bp, Artificial
  CRISPR gRNA sequence
acacaaacaatgtaagcatc

SEQ ID NO: 362257 - DNA, 20 bp, Artificial
  CRISPR gRNA sequence
aatgtaagcatcaagtcaca

SEQ ID NO: 362258 - DNA, 20 bp, Artificial
  CRISPR gRNA sequence
tgtaagcatcaagtcacaca

SEQ ID NO: 362259 - DNA, 20 bp, Artificial
  CRISPR gRNA sequence
atcaagtcacacagagcctt

SEQ ID NO: 362260 - DNA, 20 bp, Artificial
  CRISPR gRNA sequence
tcacacagagccttgagctt

SEQ ID NO: 362261 - DNA, 20 bp, Artificial
  CRISPR gRNA sequence
cagagccttgagcttgagat

SEQ ID NO: 362262 - DNA, 20 bp, Artificial
  CRISPR gRNA sequence
agagccttgagcttgagatg

SEQ ID NO: 362263 - DNA, 20 bp, Artificial
  CRISPR gRNA sequence
gagccttgagcttgagatga

SEQ ID NO: 362264 - DNA, 20 bp, Artificial
  CRISPR gRNA sequence
ttgagcttgagatgagggac

SEQ ID NO: 362265 - DNA, 20 bp, Artificial
  CRISPR gRNA sequence
tgagcttgagatgagggact

SEQ ID NO: 362266 - DNA, 20 bp, Artificial
  CRISPR gRNA sequence
tgtatgcctccaacctcaca

SEQ ID NO: 362267 - DNA, 20 bp, Artificial
  CRISPR gRNA sequence
gtatgcctccaacctcacac

SEQ ID NO: 362268 - DNA, 20 bp, Artificial
  CRISPR gRNA sequence
cctccaacctcacacaggcc

SEQ ID NO: 362269 - DNA, 20 bp, Artificial
  CRISPR gRNA sequence
cacacaggcccagcatatga

SEQ ID NO: 362270 - DNA, 20 bp, Artificial
  CRISPR gRNA sequence
agacattcaataaacattta

SEQ ID NO: 362271 - DNA, 20 bp, Artificial
  CRISPR gRNA sequence
aataaacatttatagaatta

SEQ ID NO: 362272 - DNA, 20 bp, Artificial
  CRISPR gRNA sequence
taaacatttatagaattaaa

SEQ ID NO: 362273 - DNA, 20 bp, Artificial
  CRISPR gRNA sequence
acatttatagaattaaagag

SEQ ID NO: 362274 - DNA, 20 bp, Artificial
  CRISPR gRNA sequence
catttatagaattaaagagc

SEQ ID NO: 362275 - DNA, 20 bp, Artificial
  CRISPR gRNA sequence
atttatagaattaaagagcg

SEQ ID NO: 362276 - DNA, 20 bp, Artificial
  CRISPR gRNA sequence
agaattaaagagcggggaaa

SEQ ID NO: 362277 - DNA, 20 bp, Artificial
  CRISPR gRNA sequence
gaattaaagagcggggaaat

SEQ ID NO: 362278 - DNA, 20 bp, Artificial
  CRISPR gRNA sequence
ttaaagagcggggaaatggg

SEQ ID NO: 362279 - DNA, 20 bp, Artificial
  CRISPR gRNA sequence
taaagagcggggaaatggga

SEQ ID NO: 362280 - DNA, 20 bp, Artificial
  CRISPR gRNA sequence
aagagcggggaaatgggaag

SEQ ID NO: 362281 - DNA, 20 bp, Artificial
  CRISPR gRNA sequence
aaatgggaaggagaaacttg

SEQ ID NO: 362282 - DNA, 20 bp, Artificial
  CRISPR gRNA sequence
tgggaaggagaaacttgcag

SEQ ID NO: 362283 - DNA, 20 bp, Artificial
  CRISPR gRNA sequence
gggaaggagaaacttgcagc

SEQ ID NO: 362284 - DNA, 20 bp, Artificial
  CRISPR gRNA sequence
ggaaggagaaacttgcagca

SEQ ID NO: 362285 - DNA, 20 bp, Artificial
  CRISPR gRNA sequence
gaaggagaaacttgcagcag

SEQ ID NO: 362286 - DNA, 20 bp, Artificial
  CRISPR gRNA sequence
aggagaaacttgcagcaggg

SEQ ID NO: 362287 - DNA, 20 bp, Artificial
  CRISPR gRNA sequence
ttgcagcaggggagctttcc

SEQ ID NO: 362288 - DNA, 20 bp, Artificial
  CRISPR gRNA sequence
agctttcctggtgtgtaatt

SEQ ID NO: 362289 - DNA, 20 bp, Artificial
  CRISPR gRNA sequence
ttcctggtgtgtaatttgga

SEQ ID NO: 362290 - DNA, 20 bp, Artificial
  CRISPR gRNA sequence
gtaatttggaaagactgctc

SEQ ID NO: 362291 - DNA, 20 bp, Artificial
  CRISPR gRNA sequence
atttggaaagactgctctgg

SEQ ID NO: 362292 - DNA, 20 bp, Artificial
  CRISPR gRNA sequence
tttggaaagactgctctggt

SEQ ID NO: 362293 - DNA, 20 bp, Artificial
  CRISPR gRNA sequence
tgctctggtgggctgcaccg

SEQ ID NO: 362294 - DNA, 20 bp, Artificial
  CRISPR gRNA sequence
gctctggtgggctgcaccgt

SEQ ID NO: 362295 - DNA, 20 bp, Artificial
  CRISPR gRNA sequence
ctctggtgggctgcaccgtg

SEQ ID NO: 362296 - DNA, 20 bp, Artificial
  CRISPR gRNA sequence
tctggtgggctgcaccgtgg

SEQ ID NO: 362297 - DNA, 20 bp, Artificial
  CRISPR gRNA sequence
ggtgggctgcaccgtggggg

SEQ ID NO: 362298 - DNA, 20 bp, Artificial
  CRISPR gRNA sequence
ggcagtgtcctccctcactg

SEQ ID NO: 362299 - DNA, 20 bp, Artificial
  CRISPR gRNA sequence
gcagtgtcctccctcactgc

SEQ ID NO: 362300 - DNA, 20 bp, Artificial
  CRISPR gRNA sequence
cagtgtcctccctcactgca

SEQ ID NO: 362301 - DNA, 20 bp, Artificial
  CRISPR gRNA sequence
cctccctcactgcagggcca

SEQ ID NO: 362302 - DNA, 20 bp, Artificial
  CRISPR gRNA sequence
ctccctcactgcagggccac

SEQ ID NO: 362303 - DNA, 20 bp, Artificial
  CRISPR gRNA sequence
tacatcatcctccgtgctgt

SEQ ID NO: 362304 - DNA, 20 bp, Artificial
  CRISPR gRNA sequence
atcatcctccgtgctgttgg

SEQ ID NO: 362305 - DNA, 20 bp, Artificial
  CRISPR gRNA sequence
tcatcctccgtgctgttggt

SEQ ID NO: 362306 - DNA, 20 bp, Artificial
  CRISPR gRNA sequence
catcctccgtgctgttggta

SEQ ID NO: 362307 - DNA, 20 bp, Artificial
  CRISPR gRNA sequence
ccgtgctgttggtagggtca

SEQ ID NO: 362308 - DNA, 20 bp, Artificial
  CRISPR gRNA sequence
agggtcatggctcccaatca

SEQ ID NO: 362309 - DNA, 20 bp, Artificial
  CRISPR gRNA sequence
ctcccaatcatggccaacat

SEQ ID NO: 362310 - DNA, 20 bp, Artificial
  CRISPR gRNA sequence
actttactaacaaccaaatg

SEQ ID NO: 362311 - DNA, 20 bp, Artificial
  CRISPR gRNA sequence
accaaatgaagtccaaaatc

SEQ ID NO: 362312 - DNA, 20 bp, Artificial
  CRISPR gRNA sequence
ccaccctccgaccttcccct

SEQ ID NO: 362313 - DNA, 20 bp, Artificial
  CRISPR gRNA sequence
ccgaccttcccctaagcctc

SEQ ID NO: 362314 - DNA, 20 bp, Artificial
  CRISPR gRNA sequence
tttcatgtgcctcaaacaca

SEQ ID NO: 362315 - DNA, 20 bp, Artificial
  CRISPR gRNA sequence
tcatgtgcctcaaacacaaa

SEQ ID NO: 362316 - DNA, 20 bp, Artificial
  CRISPR gRNA sequence
aaacacaaagagcatctccc

SEQ ID NO: 362317 - DNA, 20 bp, Artificial
  CRISPR gRNA sequence
aacttcctccctcttcctgc

SEQ ID NO: 362318 - DNA, 20 bp, Artificial
  CRISPR gRNA sequence
ccaaattacacctatatttc

SEQ ID NO: 362319 - DNA, 20 bp, Artificial
  CRISPR gRNA sequence
caaattacacctatatttcc

SEQ ID NO: 362320 - DNA, 20 bp, Artificial
  CRISPR gRNA sequence
acacctatatttccaggcca

SEQ ID NO: 362321 - DNA, 20 bp, Artificial
  CRISPR gRNA sequence
aggccatggtttccccaaac

SEQ ID NO: 362322 - DNA, 20 bp, Artificial
  CRISPR gRNA sequence
ccatggtttccccaaaccag

SEQ ID NO: 362323 - DNA, 20 bp, Artificial
  CRISPR gRNA sequence
aactccccaaaccttgcttt

SEQ ID NO: 362324 - DNA, 20 bp, Artificial
  CRISPR gRNA sequence
ccaaattccaccttgcatta

SEQ ID NO: 362325 - DNA, 20 bp, Artificial
  CRISPR gRNA sequence
caccttgcattacagtcact

SEQ ID NO: 362326 - DNA, 20 bp, Artificial
  CRISPR gRNA sequence
cttggcccaaacgttttaca

SEQ ID NO: 362327 - DNA, 20 bp, Artificial
  CRISPR gRNA sequence
caaacgttttacatggcgta

SEQ ID NO: 362328 - DNA, 20 bp, Artificial
  CRISPR gRNA sequence
aaacgttttacatggcgtat

SEQ ID NO: 362329 - DNA, 20 bp, Artificial
  CRISPR gRNA sequence
tacattctttcttttcctca

SEQ ID NO: 362330 - DNA, 20 bp, Artificial
  CRISPR gRNA sequence
aaacaataatatctattcaa

SEQ ID NO: 362331 - DNA, 20 bp, Artificial
  CRISPR gRNA sequence
taatatctattcaacagatt

SEQ ID NO: 362332 - DNA, 20 bp, Artificial
  CRISPR gRNA sequence
aatatctattcaacagattt

SEQ ID NO: 362333 - DNA, 20 bp, Artificial
  CRISPR gRNA sequence
tctattcaacagatttaggt

SEQ ID NO: 362334 - DNA, 20 bp, Artificial
  CRISPR gRNA sequence
acagatttaggtaagattta

SEQ ID NO: 362335 - DNA, 20 bp, Artificial
  CRISPR gRNA sequence
cagatttaggtaagatttac

SEQ ID NO: 362336 - DNA, 20 bp, Artificial
  CRISPR gRNA sequence
agatttaggtaagatttaca

SEQ ID NO: 362337 - DNA, 20 bp, Artificial
  CRISPR gRNA sequence
ttatcatccttcatccaata

SEQ ID NO: 362338 - DNA, 20 bp, Artificial
  CRISPR gRNA sequence
tcatccttcatccaataaag

SEQ ID NO: 362339 - DNA, 20 bp, Artificial
  CRISPR gRNA sequence
caattacctctgtgtcattt

SEQ ID NO: 362340 - DNA, 20 bp, Artificial
  CRISPR gRNA sequence
tgtgtcatttgagcaacaac

SEQ ID NO: 362341 - DNA, 20 bp, Artificial
  CRISPR gRNA sequence
gtgtcatttgagcaacaaca

SEQ ID NO: 362342 - DNA, 20 bp, Artificial
  CRISPR gRNA sequence
atttgagcaacaacaaggtt

SEQ ID NO: 362343 - DNA, 20 bp, Artificial
  CRISPR gRNA sequence
aggtttagccattttccctt

SEQ ID NO: 362344 - DNA, 20 bp, Artificial
  CRISPR gRNA sequence
tctgctattttcactgaaaa

SEQ ID NO: 362345 - DNA, 20 bp, Artificial
  CRISPR gRNA sequence
ttcactgaaaacagaataat

SEQ ID NO: 362346 - DNA, 20 bp, Artificial
  CRISPR gRNA sequence
cagaataatcagaccatgtt

SEQ ID NO: 362347 - DNA, 20 bp, Artificial
  CRISPR gRNA sequence
tgaaaattcaaacactgtgt

SEQ ID NO: 362348 - DNA, 20 bp, Artificial
  CRISPR gRNA sequence
tcaaacactgtgtcagcaca

SEQ ID NO: 362349 - DNA, 20 bp, Artificial
  CRISPR gRNA sequence
agcacaaagaaacacaatgt

SEQ ID NO: 362350 - DNA, 20 bp, Artificial
  CRISPR gRNA sequence
acaaagaaacacaatgtgag

SEQ ID NO: 362351 - DNA, 20 bp, Artificial
  CRISPR gRNA sequence
tattaaatgtttgctctttc

SEQ ID NO: 362352 - DNA, 20 bp, Artificial
  CRISPR gRNA sequence
gctctttccagaaacattta

SEQ ID NO: 362353 - DNA, 20 bp, Artificial
  CRISPR gRNA sequence
ctctttccagaaacatttat

SEQ ID NO: 362354 - DNA, 20 bp, Artificial
  CRISPR gRNA sequence
agaaacatttataggattta

SEQ ID NO: 362355 - DNA, 20 bp, Artificial
  CRISPR gRNA sequence
aaacatttataggatttaaa

SEQ ID NO: 362356 - DNA, 20 bp, Artificial
  CRISPR gRNA sequence
ataggatttaaagagaataa

SEQ ID NO: 362357 - DNA, 20 bp, Artificial
  CRISPR gRNA sequence
taggatttaaagagaataaa

SEQ ID NO: 362358 - DNA, 20 bp, Artificial
  CRISPR gRNA sequence
gatttaaagagaataaaagg

SEQ ID NO: 362359 - DNA, 20 bp, Artificial
  CRISPR gRNA sequence
ttaaagagaataaaaggaag

SEQ ID NO: 362360 - DNA, 20 bp, Artificial
  CRISPR gRNA sequence
gaataaaaggaagaagttac

SEQ ID NO: 362361 - DNA, 20 bp, Artificial
  CRISPR gRNA sequence
gaagttacaagccctatgtt

SEQ ID NO: 362362 - DNA, 20 bp, Artificial
  CRISPR gRNA sequence
attctttatttcacttaaat

SEQ ID NO: 362363 - DNA, 20 bp, Artificial
  CRISPR gRNA sequence
tgagcaactatgtttcttaa

SEQ ID NO: 362364 - DNA, 20 bp, Artificial
  CRISPR gRNA sequence
atgtttcttaaaagataata

SEQ ID NO: 362365 - DNA, 20 bp, Artificial
  CRISPR gRNA sequence
gtttcttaaaagataataaa

SEQ ID NO: 362366 - DNA, 20 bp, Artificial
  CRISPR gRNA sequence
tttcttaaaagataataaag

SEQ ID NO: 362367 - DNA, 20 bp, Artificial
  CRISPR gRNA sequence
agataataaagaggtatttt

SEQ ID NO: 362368 - DNA, 20 bp, Artificial
  CRISPR gRNA sequence
tattttgagaaatctgatgt

SEQ ID NO: 362369 - DNA, 20 bp, Artificial
  CRISPR gRNA sequence
attttgagaaatctgatgtc

SEQ ID NO: 362370 - DNA, 20 bp, Artificial
  CRISPR gRNA sequence
tttgagaaatctgatgtcag

SEQ ID NO: 362371 - DNA, 20 bp, Artificial
  CRISPR gRNA sequence
aatctgatgtcaggagttaa

SEQ ID NO: 362372 - DNA, 20 bp, Artificial
  CRISPR gRNA sequence
atctgatgtcaggagttaat

SEQ ID NO: 362373 - DNA, 20 bp, Artificial
  CRISPR gRNA sequence
ggagttaatgggactttaca

SEQ ID NO: 362374 - DNA, 20 bp, Artificial
  CRISPR gRNA sequence
gagttaatgggactttacaa

SEQ ID NO: 362375 - DNA, 20 bp, Artificial
  CRISPR gRNA sequence
actttacaaaggatctcttt

SEQ ID NO: 362376 - DNA, 20 bp, Artificial
  CRISPR gRNA sequence
tttacaaaggatctcttttg

SEQ ID NO: 362377 - DNA, 20 bp, Artificial
  CRISPR gRNA sequence
aatacaacaactgaattctt

SEQ ID NO: 362378 - DNA, 20 bp, Artificial
  CRISPR gRNA sequence
tggctgtttctcacatgaaa

SEQ ID NO: 362379 - DNA, 20 bp, Artificial
  CRISPR gRNA sequence
ggctgtttctcacatgaaaa

SEQ ID NO: 362380 - DNA, 20 bp, Artificial
  CRISPR gRNA sequence
gaaaaaggtatacattcaac

SEQ ID NO: 362381 - DNA, 20 bp, Artificial
  CRISPR gRNA sequence
aaaaggtatacattcaacta

SEQ ID NO: 362382 - DNA, 20 bp, Artificial
  CRISPR gRNA sequence
atacattcaactagagcttc

SEQ ID NO: 362383 - DNA, 20 bp, Artificial
  CRISPR gRNA sequence
actagagcttccagtttgca

SEQ ID NO: 362384 - DNA, 20 bp, Artificial
  CRISPR gRNA sequence
tagagcttccagtttgcaaa

SEQ ID NO: 362385 - DNA, 20 bp, Artificial
  CRISPR gRNA sequence
gagaaataaatgtatcctat

SEQ ID NO: 362386 - DNA, 20 bp, Artificial
  CRISPR gRNA sequence
atcctattagtgaaatgaat

SEQ ID NO: 362387 - DNA, 20 bp, Artificial
  CRISPR gRNA sequence
tcctattagtgaaatgaatt

SEQ ID NO: 362388 - DNA, 20 bp, Artificial
  CRISPR gRNA sequence
aaatgacttaaaatttgcta

SEQ ID NO: 362389 - DNA, 20 bp, Artificial
  CRISPR gRNA sequence
cttaaaatttgctatagtct

SEQ ID NO: 362390 - DNA, 20 bp, Artificial
  CRISPR gRNA sequence
ttaaaatttgctatagtctc

SEQ ID NO: 362391 - DNA, 20 bp, Artificial
  CRISPR gRNA sequence
cgggttctttatatatcatg

SEQ ID NO: 362392 - DNA, 20 bp, Artificial
  CRISPR gRNA sequence
gggttctttatatatcatga

SEQ ID NO: 362393 - DNA, 20 bp, Artificial
  CRISPR gRNA sequence
aggaaatgatcctgtccaca

SEQ ID NO: 362394 - DNA, 20 bp, Artificial
  CRISPR gRNA sequence
gaaatgatcctgtccacaca

SEQ ID NO: 362395 - DNA, 20 bp, Artificial
  CRISPR gRNA sequence
aaatgatcctgtccacacag

SEQ ID NO: 362396 - DNA, 20 bp, Artificial
  CRISPR gRNA sequence
cgcacgcacaccccttcact

SEQ ID NO: 362397 - DNA, 20 bp, Artificial
  CRISPR gRNA sequence
accccttcactaagcaattc

SEQ ID NO: 362398 - DNA, 20 bp, Artificial
  CRISPR gRNA sequence
ctaagcaattctggaaatat

SEQ ID NO: 362399 - DNA, 20 bp, Artificial
  CRISPR gRNA sequence
aattctggaaatatcggtgt

SEQ ID NO: 362400 - DNA, 20 bp, Artificial
  CRISPR gRNA sequence
tctggaaatatcggtgttgg

SEQ ID NO: 362401 - DNA, 20 bp, Artificial
  CRISPR gRNA sequence
atatcggtgttggtagcata

SEQ ID NO: 362402 - DNA, 20 bp, Artificial
  CRISPR gRNA sequence
gtagcatatagaattttatg

SEQ ID NO: 362403 - DNA, 20 bp, Artificial
  CRISPR gRNA sequence
catatagaattttatgtagc

SEQ ID NO: 362404 - DNA, 20 bp, Artificial
  CRISPR gRNA sequence
agaattttatgtagctggcc

SEQ ID NO: 362405 - DNA, 20 bp, Artificial
  CRISPR gRNA sequence
ttatgtagctggccaagaat

SEQ ID NO: 362406 - DNA, 20 bp, Artificial
  CRISPR gRNA sequence
agctggccaagaattggaac

SEQ ID NO: 362407 - DNA, 20 bp, Artificial
  CRISPR gRNA sequence
attggaacaagtatgttctt

SEQ ID NO: 362408 - DNA, 20 bp, Artificial
  CRISPR gRNA sequence
tggaacaagtatgttcttaa

SEQ ID NO: 362409 - DNA, 20 bp, Artificial
  CRISPR gRNA sequence
aagagcctgtctgctaaaat

SEQ ID NO: 362410 - DNA, 20 bp, Artificial
  CRISPR gRNA sequence
tctgctaaaatgagaatgtt

SEQ ID NO: 362411 - DNA, 20 bp, Artificial
  CRISPR gRNA sequence
aatgagaatgttaagtttct

SEQ ID NO: 362412 - DNA, 20 bp, Artificial
  CRISPR gRNA sequence
atgagaatgttaagtttctt

SEQ ID NO: 362413 - DNA, 20 bp, Artificial
  CRISPR gRNA sequence
ttaggattctgctcattaaa

SEQ ID NO: 362414 - DNA, 20 bp, Artificial
  CRISPR gRNA sequence
attctgctcattaaatggtg

SEQ ID NO: 362415 - DNA, 20 bp, Artificial
  CRISPR gRNA sequence
atggtgcagctaaatgctcc

SEQ ID NO: 362416 - DNA, 20 bp, Artificial
  CRISPR gRNA sequence
atgctcccagaattaatgcc

SEQ ID NO: 362417 - DNA, 20 bp, Artificial
  CRISPR gRNA sequence
tgcccagattttattctgtt

SEQ ID NO: 362418 - DNA, 20 bp, Artificial
  CRISPR gRNA sequence
gattttattctgtttggcca

SEQ ID NO: 362419 - DNA, 20 bp, Artificial
  CRISPR gRNA sequence
gccacggtcaccactgtgtg

SEQ ID NO: 362420 - DNA, 20 bp, Artificial
  CRISPR gRNA sequence
gtgtgcagatatgatgcaca

SEQ ID NO: 362421 - DNA, 20 bp, Artificial
  CRISPR gRNA sequence
cacatagctatttacaacac

SEQ ID NO: 362422 - DNA, 20 bp, Artificial
  CRISPR gRNA sequence
tagctatttacaacactagt

SEQ ID NO: 362423 - DNA, 20 bp, Artificial
  CRISPR gRNA sequence
gtgttttacacctccatcct

SEQ ID NO: 362424 - DNA, 20 bp, Artificial
  CRISPR gRNA sequence
ttttacacctccatccttgg

SEQ ID NO: 362425 - DNA, 20 bp, Artificial
  CRISPR gRNA sequence
ccttggaagtcttcttatat

SEQ ID NO: 362426 - DNA, 20 bp, Artificial
  CRISPR gRNA sequence
tatcagtattctatgaaaca

SEQ ID NO: 362427 - DNA, 20 bp, Artificial
  CRISPR gRNA sequence
gaaacatggctctttctctc

SEQ ID NO: 362428 - DNA, 20 bp, Artificial
  CRISPR gRNA sequence
aaacatggctctttctctcg

SEQ ID NO: 362429 - DNA, 20 bp, Artificial
  CRISPR gRNA sequence
catggctctttctctcgagg

SEQ ID NO: 362430 - DNA, 20 bp, Artificial
  CRISPR gRNA sequence
ttctctcgaggcagattaca

SEQ ID NO: 362431 - DNA, 20 bp, Artificial
  CRISPR gRNA sequence
tctcgaggcagattacaaag

SEQ ID NO: 362432 - DNA, 20 bp, Artificial
  CRISPR gRNA sequence
ttacaaagaagattttttta

SEQ ID NO: 362433 - DNA, 20 bp, Artificial
  CRISPR gRNA sequence
agaagatttttttaaagtgt

SEQ ID NO: 362434 - DNA, 20 bp, Artificial
  CRISPR gRNA sequence
gatttttttaaagtgtaagt

SEQ ID NO: 362435 - DNA, 20 bp, Artificial
  CRISPR gRNA sequence
taaagtgtaagttggttaaa

SEQ ID NO: 362436 - DNA, 20 bp, Artificial
  CRISPR gRNA sequence
gtaagttggttaaatagctg

SEQ ID NO: 362437 - DNA, 20 bp, Artificial
  CRISPR gRNA sequence
gttggttaaatagctgaagt

SEQ ID NO: 362438 - DNA, 20 bp, Artificial
  CRISPR gRNA sequence
ttggttaaatagctgaagtc

SEQ ID NO: 362439 - DNA, 20 bp, Artificial
  CRISPR gRNA sequence
aggaaaaattttctcacatt

SEQ ID NO: 362440 - DNA, 20 bp, Artificial
  CRISPR gRNA sequence
gaaaaattttctcacattaa

SEQ ID NO: 362441 - DNA, 20 bp, Artificial
  CRISPR gRNA sequence
tttctcacattaagagttat

SEQ ID NO: 362442 - DNA, 20 bp, Artificial
  CRISPR gRNA sequence
tggattgtgaataatctctc

SEQ ID NO: 362443 - DNA, 20 bp, Artificial
  CRISPR gRNA sequence
ggattgtgaataatctctca

SEQ ID NO: 362444 - DNA, 20 bp, Artificial
  CRISPR gRNA sequence
gattgtgaataatctctcaa

SEQ ID NO: 362445 - DNA, 20 bp, Artificial
  CRISPR gRNA sequence
tgtgaataatctctcaaggg

SEQ ID NO: 362446 - DNA, 20 bp, Artificial
  CRISPR gRNA sequence
taatctctcaagggaagtgc

SEQ ID NO: 362447 - DNA, 20 bp, Artificial
  CRISPR gRNA sequence
tctctcaagggaagtgccag

SEQ ID NO: 362448 - DNA, 20 bp, Artificial
  CRISPR gRNA sequence
tgccagaagccccatcaact

SEQ ID NO: 362449 - DNA, 20 bp, Artificial
  CRISPR gRNA sequence
gttatttaattaaaactgct

SEQ ID NO: 362450 - DNA, 20 bp, Artificial
  CRISPR gRNA sequence
ttatttaattaaaactgctc

SEQ ID NO: 362451 - DNA, 20 bp, Artificial
  CRISPR gRNA sequence
atttaattaaaactgctcag

SEQ ID NO: 362452 - DNA, 20 bp, Artificial
  CRISPR gRNA sequence
aattaaaactgctcaggagt

SEQ ID NO: 362453 - DNA, 20 bp, Artificial
  CRISPR gRNA sequence
taaaactgctcaggagtaag

SEQ ID NO: 362454 - DNA, 20 bp, Artificial
  CRISPR gRNA sequence
aactgctcaggagtaagtag

SEQ ID NO: 362455 - DNA, 20 bp, Artificial
  CRISPR gRNA sequence
ctgctcaggagtaagtagaa

SEQ ID NO: 362456 - DNA, 20 bp, Artificial
  CRISPR gRNA sequence
aagtagaagagatgttgcct

SEQ ID NO: 362457 - DNA, 20 bp, Artificial
  CRISPR gRNA sequence
agtagaagagatgttgcctg

SEQ ID NO: 362458 - DNA, 20 bp, Artificial
  CRISPR gRNA sequence
gtagaagagatgttgcctga

SEQ ID NO: 362459 - DNA, 20 bp, Artificial
  CRISPR gRNA sequence
taatttcacactgatccctg

SEQ ID NO: 362460 - DNA, 20 bp, Artificial
  CRISPR gRNA sequence
aatttcacactgatccctga

SEQ ID NO: 362461 - DNA, 20 bp, Artificial
  CRISPR gRNA sequence
tccctgaaggattgacttga

SEQ ID NO: 362462 - DNA, 20 bp, Artificial
  CRISPR gRNA sequence
gatggtcttgaaattcttaa

SEQ ID NO: 362463 - DNA, 20 bp, Artificial
  CRISPR gRNA sequence
ttcaaaatcttaaatgtctt

SEQ ID NO: 362464 - DNA, 20 bp, Artificial
  CRISPR gRNA sequence
atcttaaatgtcttcagaaa

SEQ ID NO: 362465 - DNA, 20 bp, Artificial
  CRISPR gRNA sequence
gtctcctaccattttctcca

SEQ ID NO: 362466 - DNA, 20 bp, Artificial
  CRISPR gRNA sequence
cctaccattttctccacgga

SEQ ID NO: 362467 - DNA, 20 bp, Artificial
  CRISPR gRNA sequence
attttctccacggaaagaaa

SEQ ID NO: 362468 - DNA, 20 bp, Artificial
  CRISPR gRNA sequence
aaccaaacaaaaacaaaaac

SEQ ID NO: 362469 - DNA, 20 bp, Artificial
  CRISPR gRNA sequence
cagcaacaaaaaccataact

SEQ ID NO: 362470 - DNA, 20 bp, Artificial
  CRISPR gRNA sequence
aaaaaccataacttagaaac

SEQ ID NO: 362471 - DNA, 20 bp, Artificial
  CRISPR gRNA sequence
cgacgctacctaaaccatca

SEQ ID NO: 362472 - DNA, 20 bp, Artificial
  CRISPR gRNA sequence
gacgctacctaaaccatcac

SEQ ID NO: 362473 - DNA, 20 bp, Artificial
  CRISPR gRNA sequence
ctacctaaaccatcacagga

SEQ ID NO: 362474 - DNA, 20 bp, Artificial
  CRISPR gRNA sequence
cacaggacagcattaactca

SEQ ID NO: 362475 - DNA, 20 bp, Artificial
  CRISPR gRNA sequence
acagcattaactcaaagata

SEQ ID NO: 362476 - DNA, 20 bp, Artificial
  CRISPR gRNA sequence
ttaactcaaagataaagcca

SEQ ID NO: 362477 - DNA, 20 bp, Artificial
  CRISPR gRNA sequence
aactcaaagataaagccaca

SEQ ID NO: 362478 - DNA, 20 bp, Artificial
  CRISPR gRNA sequence
actcaaagataaagccacag

SEQ ID NO: 362479 - DNA, 20 bp, Artificial
  CRISPR gRNA sequence
tcaaagataaagccacagag

SEQ ID NO: 362480 - DNA, 20 bp, Artificial
  CRISPR gRNA sequence
taaagccacagaggagctcc

SEQ ID NO: 362481 - DNA, 20 bp, Artificial
  CRISPR gRNA sequence
cacagaggagctccaagcat

SEQ ID NO: 362482 - DNA, 20 bp, Artificial
  CRISPR gRNA sequence
tccaagcatcagtaaaaact

SEQ ID NO: 362483 - DNA, 20 bp, Artificial
  CRISPR gRNA sequence
caagcatcagtaaaaactga

SEQ ID NO: 362484 - DNA, 20 bp, Artificial
  CRISPR gRNA sequence
gtaaaaactgagagctttac

SEQ ID NO: 362485 - DNA, 20 bp, Artificial
  CRISPR gRNA sequence
aactgagagctttaccagct

SEQ ID NO: 362486 - DNA, 20 bp, Artificial
  CRISPR gRNA sequence
ctgagagctttaccagctaa

SEQ ID NO: 362487 - DNA, 20 bp, Artificial
  CRISPR gRNA sequence
ctttaccagctaagagcttt

SEQ ID NO: 362488 - DNA, 20 bp, Artificial
  CRISPR gRNA sequence
aagagcttttggactttctt

SEQ ID NO: 362489 - DNA, 20 bp, Artificial
  CRISPR gRNA sequence
gcaatttataatgttacttt

SEQ ID NO: 362490 - DNA, 20 bp, Artificial
  CRISPR gRNA sequence
agttaataatgtgatctgtt

SEQ ID NO: 362491 - DNA, 20 bp, Artificial
  CRISPR gRNA sequence
ttaataatgtgatctgttaa

SEQ ID NO: 362492 - DNA, 20 bp, Artificial
  CRISPR gRNA sequence
taataatgtgatctgttaag

SEQ ID NO: 362493 - DNA, 20 bp, Artificial
  CRISPR gRNA sequence
gttaagaggtaaattcctat

SEQ ID NO: 362494 - DNA, 20 bp, Artificial
  CRISPR gRNA sequence
ttaagaggtaaattcctata

SEQ ID NO: 362495 - DNA, 20 bp, Artificial
  CRISPR gRNA sequence
attcctataaggcctttttg

SEQ ID NO: 362496 - DNA, 20 bp, Artificial
  CRISPR gRNA sequence
ttcctataaggcctttttga

SEQ ID NO: 362497 - DNA, 20 bp, Artificial
  CRISPR gRNA sequence
cacctactcactaatcctat

SEQ ID NO: 362498 - DNA, 20 bp, Artificial
  CRISPR gRNA sequence
acctactcactaatcctata

SEQ ID NO: 362499 - DNA, 20 bp, Artificial
  CRISPR gRNA sequence
tactcactaatcctataagg

SEQ ID NO: 362500 - DNA, 20 bp, Artificial
  CRISPR gRNA sequence
aatcctataaggaagtttcc

SEQ ID NO: 362501 - DNA, 20 bp, Artificial
  CRISPR gRNA sequence
tcctataaggaagtttccca

SEQ ID NO: 362502 - DNA, 20 bp, Artificial
  CRISPR gRNA sequence
ataaggaagtttcccagagc

SEQ ID NO: 362503 - DNA, 20 bp, Artificial
  CRISPR gRNA sequence
aagtttcccagagcaagtgc

SEQ ID NO: 362504 - DNA, 20 bp, Artificial
  CRISPR gRNA sequence
gtttcccagagcaagtgctg

SEQ ID NO: 362505 - DNA, 20 bp, Artificial
  CRISPR gRNA sequence
agaacaatgcccactatctg

SEQ ID NO: 362506 - DNA, 20 bp, Artificial
  CRISPR gRNA sequence
tctgcagctctcaacctttg

SEQ ID NO: 362507 - DNA, 20 bp, Artificial
  CRISPR gRNA sequence
cagctctcaacctttgaagt

SEQ ID NO: 362508 - DNA, 20 bp, Artificial
  CRISPR gRNA sequence
agctctcaacctttgaagtg

SEQ ID NO: 362509 - DNA, 20 bp, Artificial
  CRISPR gRNA sequence
tgaagtgaggaattttttaa

SEQ ID NO: 362510 - DNA, 20 bp, Artificial
  CRISPR gRNA sequence
aggaattttttaaaagatca

SEQ ID NO: 362511 - DNA, 20 bp, Artificial
  CRISPR gRNA sequence
aattttttaaaagatcacag

SEQ ID NO: 362512 - DNA, 20 bp, Artificial
  CRISPR gRNA sequence
tttaaaagatcacagaagcc

SEQ ID NO: 362513 - DNA, 20 bp, Artificial
  CRISPR gRNA sequence
aaagatcacagaagccgaga

SEQ ID NO: 362514 - DNA, 20 bp, Artificial
  CRISPR gRNA sequence
cacagaagccgagatggtct

SEQ ID NO: 362515 - DNA, 20 bp, Artificial
  CRISPR gRNA sequence
acagaagccgagatggtctg

SEQ ID NO: 362516 - DNA, 20 bp, Artificial
  CRISPR gRNA sequence
agaagccgagatggtctgag

SEQ ID NO: 362517 - DNA, 20 bp, Artificial
  CRISPR gRNA sequence
gaagccgagatggtctgagg

SEQ ID NO: 362518 - DNA, 20 bp, Artificial
  CRISPR gRNA sequence
agccgagatggtctgaggag

SEQ ID NO: 362519 - DNA, 20 bp, Artificial
  CRISPR gRNA sequence
aggaggagtctcaacgtgtg

SEQ ID NO: 362520 - DNA, 20 bp, Artificial
  CRISPR gRNA sequence
ggaggagtctcaacgtgtgt

SEQ ID NO: 362521 - DNA, 20 bp, Artificial
  CRISPR gRNA sequence
tgtgggctgaacatgttcca

SEQ ID NO: 362522 - DNA, 20 bp, Artificial
  CRISPR gRNA sequence
catgttccacagttatttga

SEQ ID NO: 362523 - DNA, 20 bp, Artificial
  CRISPR gRNA sequence
atgttccacagttatttgac

SEQ ID NO: 362524 - DNA, 20 bp, Artificial
  CRISPR gRNA sequence
cagttatttgacaggcattg

SEQ ID NO: 362525 - DNA, 20 bp, Artificial
  CRISPR gRNA sequence
agttatttgacaggcattga

SEQ ID NO: 362526 - DNA, 20 bp, Artificial
  CRISPR gRNA sequence
ttgacaggcattgaaggcta

SEQ ID NO: 362527 - DNA, 20 bp, Artificial
  CRISPR gRNA sequence
tgacaggcattgaaggctat

SEQ ID NO: 362528 - DNA, 20 bp, Artificial
  CRISPR gRNA sequence
cattgaaggctataggacac

SEQ ID NO: 362529 - DNA, 20 bp, Artificial
  CRISPR gRNA sequence
accagctcttactcatgtgt

SEQ ID NO: 362530 - DNA, 20 bp, Artificial
  CRISPR gRNA sequence
ccagctcttactcatgtgtg

SEQ ID NO: 362531 - DNA, 20 bp, Artificial
  CRISPR gRNA sequence
cttactcatgtgtgaggcca

SEQ ID NO: 362532 - DNA, 20 bp, Artificial
  CRISPR gRNA sequence
ccacagtccccacgctgcat

SEQ ID NO: 362533 - DNA, 20 bp, Artificial
  CRISPR gRNA sequence
caccaccaacacccattctg

SEQ ID NO: 362534 - DNA, 20 bp, Artificial
  CRISPR gRNA sequence
ccaccaacacccattctgaa

SEQ ID NO: 362535 - DNA, 20 bp, Artificial
  CRISPR gRNA sequence
caccaacacccattctgaag

SEQ ID NO: 362536 - DNA, 20 bp, Artificial
  CRISPR gRNA sequence
gaaatgtattcctcatgttg

SEQ ID NO: 362537 - DNA, 20 bp, Artificial
  CRISPR gRNA sequence
tgtattcctcatgttgtggt

SEQ ID NO: 362538 - DNA, 20 bp, Artificial
  CRISPR gRNA sequence
attcctcatgttgtggttgg

SEQ ID NO: 362539 - DNA, 20 bp, Artificial
  CRISPR gRNA sequence
ttgtggttggcagccgcctt

SEQ ID NO: 362540 - DNA, 20 bp, Artificial
  CRISPR gRNA sequence
ttggcagccgccttcagtgc

SEQ ID NO: 362541 - DNA, 20 bp, Artificial
  CRISPR gRNA sequence
tggcagccgccttcagtgct

SEQ ID NO: 362542 - DNA, 20 bp, Artificial
  CRISPR gRNA sequence
cgccttcagtgctgggtaaa

SEQ ID NO: 362543 - DNA, 20 bp, Artificial
  CRISPR gRNA sequence
tgctgggtaaacagctgttg

SEQ ID NO: 362544 - DNA, 20 bp, Artificial
  CRISPR gRNA sequence
ggtaaacagctgttgtggta

SEQ ID NO: 362545 - DNA, 20 bp, Artificial
  CRISPR gRNA sequence
gtaaacagctgttgtggtaa

SEQ ID NO: 362546 - DNA, 20 bp, Artificial
  CRISPR gRNA sequence
agctgttgtggtaaaggtgt

SEQ ID NO: 362547 - DNA, 20 bp, Artificial
  CRISPR gRNA sequence
tgtgagttgtcttgatcact

SEQ ID NO: 362548 - DNA, 20 bp, Artificial
  CRISPR gRNA sequence
tgagttgtcttgatcactga

SEQ ID NO: 362549 - DNA, 20 bp, Artificial
  CRISPR gRNA sequence
gtcttgatcactgagagttg

SEQ ID NO: 362550 - DNA, 20 bp, Artificial
  CRISPR gRNA sequence
tcttgatcactgagagttga

SEQ ID NO: 362551 - DNA, 20 bp, Artificial
  CRISPR gRNA sequence
ttgatcactgagagttgaag

SEQ ID NO: 362552 - DNA, 20 bp, Artificial
  CRISPR gRNA sequence
tgatcactgagagttgaagg

SEQ ID NO: 362553 - DNA, 20 bp, Artificial
  CRISPR gRNA sequence
gagttgaaggaggaaaaacc

SEQ ID NO: 362554 - DNA, 20 bp, Artificial
  CRISPR gRNA sequence
aggaaaaaccaagaactgtg

SEQ ID NO: 362555 - DNA, 20 bp, Artificial
  CRISPR gRNA sequence
accaagaactgtgtagtttc

SEQ ID NO: 362556 - DNA, 20 bp, Artificial
  CRISPR gRNA sequence
gtagtttccagctatactca

SEQ ID NO: 362557 - DNA, 20 bp, Artificial
  CRISPR gRNA sequence
ctatactcacagaatgttct

SEQ ID NO: 362558 - DNA, 20 bp, Artificial
  CRISPR gRNA sequence
tatactcacagaatgttctg

SEQ ID NO: 362559 - DNA, 20 bp, Artificial
  CRISPR gRNA sequence
cacagaatgttctgaggtca

SEQ ID NO: 362560 - DNA, 20 bp, Artificial
  CRISPR gRNA sequence
acagaatgttctgaggtcac

SEQ ID NO: 362561 - DNA, 20 bp, Artificial
  CRISPR gRNA sequence
agaatgttctgaggtcacag

SEQ ID NO: 362562 - DNA, 20 bp, Artificial
  CRISPR gRNA sequence
ttctgaggtcacaggagaat

SEQ ID NO: 362563 - DNA, 20 bp, Artificial
  CRISPR gRNA sequence
cacaggagaatcagtgtccg

SEQ ID NO: 362564 - DNA, 20 bp, Artificial
  CRISPR gRNA sequence
agaatcagtgtccgaagctt

SEQ ID NO: 362565 - DNA, 20 bp, Artificial
  CRISPR gRNA sequence
agtgtccgaagcttcagctg

SEQ ID NO: 362566 - DNA, 20 bp, Artificial
  CRISPR gRNA sequence
tagcccattctctatcaatt

SEQ ID NO: 362567 - DNA, 20 bp, Artificial
  CRISPR gRNA sequence
cattctctatcaattcagcc

SEQ ID NO: 362568 - DNA, 20 bp, Artificial
  CRISPR gRNA sequence
aaaatataaatacctacaat

SEQ ID NO: 362569 - DNA, 20 bp, Artificial
  CRISPR gRNA sequence
atataaatacctacaataag

SEQ ID NO: 362570 - DNA, 20 bp, Artificial
  CRISPR gRNA sequence
tataaatacctacaataaga

SEQ ID NO: 362571 - DNA, 20 bp, Artificial
  CRISPR gRNA sequence
ataaatacctacaataagaa

SEQ ID NO: 362572 - DNA, 20 bp, Artificial
  CRISPR gRNA sequence
tacctacaataagaagggta

SEQ ID NO: 362573 - DNA, 20 bp, Artificial
  CRISPR gRNA sequence
aataagaagggtacagtttc

SEQ ID NO: 362574 - DNA, 20 bp, Artificial
  CRISPR gRNA sequence
ggtacagtttcaagtttaca

SEQ ID NO: 362575 - DNA, 20 bp, Artificial
  CRISPR gRNA sequence
gtacagtttcaagtttacat

SEQ ID NO: 362576 - DNA, 20 bp, Artificial
  CRISPR gRNA sequence
cagtttcaagtttacatagg

SEQ ID NO: 362577 - DNA, 20 bp, Artificial
  CRISPR gRNA sequence
ggtagtataaataaacaaaa

SEQ ID NO: 362578 - DNA, 20 bp, Artificial
  CRISPR gRNA sequence
aaacaaaatggctgcacaca

SEQ ID NO: 362579 - DNA, 20 bp, Artificial
  CRISPR gRNA sequence
aaaatggctgcacacaaaga

SEQ ID NO: 362580 - DNA, 20 bp, Artificial
  CRISPR gRNA sequence
atggctgcacacaaagatgg

SEQ ID NO: 362581 - DNA, 20 bp, Artificial
  CRISPR gRNA sequence
gccaattccactccctgctc

SEQ ID NO: 362582 - DNA, 20 bp, Artificial
  CRISPR gRNA sequence
gcctgactgcatttgacaac

SEQ ID NO: 362583 - DNA, 20 bp, Artificial
  CRISPR gRNA sequence
tgcatttgacaacaagccca

SEQ ID NO: 362584 - DNA, 20 bp, Artificial
  CRISPR gRNA sequence
tgacaacaagcccaaagtaa

SEQ ID NO: 362585 - DNA, 20 bp, Artificial
  CRISPR gRNA sequence
cccaaagtaaaagtttcctc

SEQ ID NO: 362586 - DNA, 20 bp, Artificial
  CRISPR gRNA sequence
gtttcctctggattttgcta

SEQ ID NO: 362587 - DNA, 20 bp, Artificial
  CRISPR gRNA sequence
ctctggattttgctacagct

SEQ ID NO: 362588 - DNA, 20 bp, Artificial
  CRISPR gRNA sequence
tggattttgctacagctcag

SEQ ID NO: 362589 - DNA, 20 bp, Artificial
  CRISPR gRNA sequence
gctacagctcagaagtgtca

SEQ ID NO: 362590 - DNA, 20 bp, Artificial
  CRISPR gRNA sequence
agctcagaagtgtcaaagac

SEQ ID NO: 362591 - DNA, 20 bp, Artificial
  CRISPR gRNA sequence
gctcagaagtgtcaaagact

SEQ ID NO: 362592 - DNA, 20 bp, Artificial
  CRISPR gRNA sequence
ctcagaagtgtcaaagactg

SEQ ID NO: 362593 - DNA, 20 bp, Artificial
  CRISPR gRNA sequence
tcaaagactggggtgtctca

SEQ ID NO: 362594 - DNA, 20 bp, Artificial
  CRISPR gRNA sequence
caaagactggggtgtctcac

SEQ ID NO: 362595 - DNA, 20 bp, Artificial
  CRISPR gRNA sequence
aaagactggggtgtctcacg

SEQ ID NO: 362596 - DNA, 20 bp, Artificial
  CRISPR gRNA sequence
ggggtgtctcacggggcata

SEQ ID NO: 362597 - DNA, 20 bp, Artificial
  CRISPR gRNA sequence
gggtgtctcacggggcataa

SEQ ID NO: 362598 - DNA, 20 bp, Artificial
  CRISPR gRNA sequence
gtgtctcacggggcataaag

SEQ ID NO: 362599 - DNA, 20 bp, Artificial
  CRISPR gRNA sequence
tgtctcacggggcataaagg

SEQ ID NO: 362600 - DNA, 20 bp, Artificial
  CRISPR gRNA sequence
cacggggcataaaggaggtg

SEQ ID NO: 362601 - DNA, 20 bp, Artificial
  CRISPR gRNA sequence
acggggcataaaggaggtga

SEQ ID NO: 362602 - DNA, 20 bp, Artificial
  CRISPR gRNA sequence
ggggcataaaggaggtgaag

SEQ ID NO: 362603 - DNA, 20 bp, Artificial
  CRISPR gRNA sequence
gggcataaaggaggtgaagg

SEQ ID NO: 362604 - DNA, 20 bp, Artificial
  CRISPR gRNA sequence
cataaaggaggtgaaggagg

SEQ ID NO: 362605 - DNA, 20 bp, Artificial
  CRISPR gRNA sequence
taaaggaggtgaaggaggta

SEQ ID NO: 362606 - DNA, 20 bp, Artificial
  CRISPR gRNA sequence
aaggaggtgaaggaggtaga

SEQ ID NO: 362607 - DNA, 20 bp, Artificial
  CRISPR gRNA sequence
gaaggaggtagagagaaacc

SEQ ID NO: 362608 - DNA, 20 bp, Artificial
  CRISPR gRNA sequence
aaggaggtagagagaaaccc

SEQ ID NO: 362609 - DNA, 20 bp, Artificial
  CRISPR gRNA sequence
tagagagaaacccaggcatc

SEQ ID NO: 362610 - DNA, 20 bp, Artificial
  CRISPR gRNA sequence
gagaaacccaggcatcgaga

SEQ ID NO: 362611 - DNA, 20 bp, Artificial
  CRISPR gRNA sequence
aacccaggcatcgagacaga

SEQ ID NO: 362612 - DNA, 20 bp, Artificial
  CRISPR gRNA sequence
atctcaatccccaaaaatcc

SEQ ID NO: 362613 - DNA, 20 bp, Artificial
  CRISPR gRNA sequence
gtacgtgaattccactgtat

SEQ ID NO: 362614 - DNA, 20 bp, Artificial
  CRISPR gRNA sequence
ttcaattgtgtatataaatt

SEQ ID NO: 362615 - DNA, 20 bp, Artificial
  CRISPR gRNA sequence
tatataaatttagtattatc

SEQ ID NO: 362616 - DNA, 20 bp, Artificial
  CRISPR gRNA sequence
aatttagtattatctggctt

SEQ ID NO: 362617 - DNA, 20 bp, Artificial
  CRISPR gRNA sequence
tttagtattatctggcttta

SEQ ID NO: 362618 - DNA, 20 bp, Artificial
  CRISPR gRNA sequence
tagtattatctggctttaga

SEQ ID NO: 362619 - DNA, 20 bp, Artificial
  CRISPR gRNA sequence
ttttttttgatttttgatta

SEQ ID NO: 362620 - DNA, 20 bp, Artificial
  CRISPR gRNA sequence
ttttttgatttttgattaca

SEQ ID NO: 362621 - DNA, 20 bp, Artificial
  CRISPR gRNA sequence
gattacagagctttgcctga

SEQ ID NO: 362622 - DNA, 20 bp, Artificial
  CRISPR gRNA sequence
agagctttgcctgaaagcct

SEQ ID NO: 362623 - DNA, 20 bp, Artificial
  CRISPR gRNA sequence
gagctttgcctgaaagcctg

SEQ ID NO: 362624 - DNA, 20 bp, Artificial
  CRISPR gRNA sequence
agctttgcctgaaagcctga

SEQ ID NO: 362625 - DNA, 20 bp, Artificial
  CRISPR gRNA sequence
agcctgagggttgattccca

SEQ ID NO: 362626 - DNA, 20 bp, Artificial
  CRISPR gRNA sequence
ttcttgtgcctgttccttcc

SEQ ID NO: 362627 - DNA, 20 bp, Artificial
  CRISPR gRNA sequence
tcttgtgcctgttccttcct

SEQ ID NO: 362628 - DNA, 20 bp, Artificial
  CRISPR gRNA sequence
tgcctgttccttcctgggct

SEQ ID NO: 362629 - DNA, 20 bp, Artificial
  CRISPR gRNA sequence
gttccttcctgggcttagca

SEQ ID NO: 362630 - DNA, 20 bp, Artificial
  CRISPR gRNA sequence
ttccttcctgggcttagcac

SEQ ID NO: 362631 - DNA, 20 bp, Artificial
  CRISPR gRNA sequence
tccttcctgggcttagcaca

SEQ ID NO: 362632 - DNA, 20 bp, Artificial
  CRISPR gRNA sequence
tcctgggcttagcacaggga

SEQ ID NO: 362633 - DNA, 20 bp, Artificial
  CRISPR gRNA sequence
cttagcacagggaaagcacg

SEQ ID NO: 362634 - DNA, 20 bp, Artificial
  CRISPR gRNA sequence
cacgtggataaaaacaacct

SEQ ID NO: 362635 - DNA, 20 bp, Artificial
  CRISPR gRNA sequence
aacaaccttggcacacgttc

SEQ ID NO: 362636 - DNA, 20 bp, Artificial
  CRISPR gRNA sequence
ttctggtaaccatccacttt

SEQ ID NO: 362637 - DNA, 20 bp, Artificial
  CRISPR gRNA sequence
ttcccatttacttcaccctt

SEQ ID NO: 362638 - DNA, 20 bp, Artificial
  CRISPR gRNA sequence
ccatttacttcacccttgag

SEQ ID NO: 362639 - DNA, 20 bp, Artificial
  CRISPR gRNA sequence
tacttcacccttgagaagtg

SEQ ID NO: 362640 - DNA, 20 bp, Artificial
  CRISPR gRNA sequence
accataaccttgctttctgt

SEQ ID NO: 362641 - DNA, 20 bp, Artificial
  CRISPR gRNA sequence
tatactattttatttcatta

SEQ ID NO: 362642 - DNA, 20 bp, Artificial
  CRISPR gRNA sequence
tactattttatttcattacg

SEQ ID NO: 362643 - DNA, 20 bp, Artificial
  CRISPR gRNA sequence
attttatttcattacggagt

SEQ ID NO: 362644 - DNA, 20 bp, Artificial
  CRISPR gRNA sequence
cattacggagtgagattttt

SEQ ID NO: 362645 - DNA, 20 bp, Artificial
  CRISPR gRNA sequence
tgtttctgcttcatcccttg

SEQ ID NO: 362646 - DNA, 20 bp, Artificial
  CRISPR gRNA sequence
catcccttgtggattcctta

SEQ ID NO: 362647 - DNA, 20 bp, Artificial
  CRISPR gRNA sequence
atcccttgtggattccttat

SEQ ID NO: 362648 - DNA, 20 bp, Artificial
  CRISPR gRNA sequence
gattccttataggtaccatt

SEQ ID NO: 362649 - DNA, 20 bp, Artificial
  CRISPR gRNA sequence
tgctaaaatgtaacattttt

SEQ ID NO: 362650 - DNA, 20 bp, Artificial
  CRISPR gRNA sequence
tgcatgcatacacacacaca

SEQ ID NO: 362651 - DNA, 20 bp, Artificial
  CRISPR gRNA sequence
tgacttatttctaatctcac

SEQ ID NO: 362652 - DNA, 20 bp, Artificial
  CRISPR gRNA sequence
tatttctaatctcaccagaa

SEQ ID NO: 362653 - DNA, 20 bp, Artificial
  CRISPR gRNA sequence
atttctaatctcaccagaat

SEQ ID NO: 362654 - DNA, 20 bp, Artificial
  CRISPR gRNA sequence
atctcaccagaatgggcctg

SEQ ID NO: 362655 - DNA, 20 bp, Artificial
  CRISPR gRNA sequence
ctcaccagaatgggcctgaa

SEQ ID NO: 362656 - DNA, 20 bp, Artificial
  CRISPR gRNA sequence
caccagaatgggcctgaaga

SEQ ID NO: 362657 - DNA, 20 bp, Artificial
  CRISPR gRNA sequence
ccagaatgggcctgaagaga

SEQ ID NO: 362658 - DNA, 20 bp, Artificial
  CRISPR gRNA sequence
gggcctgaagagagagctta

SEQ ID NO: 362659 - DNA, 20 bp, Artificial
  CRISPR gRNA sequence
ttatggcttcattctctaat

SEQ ID NO: 362660 - DNA, 20 bp, Artificial
  CRISPR gRNA sequence
cattctctaatcagttgact

SEQ ID NO: 362661 - DNA, 20 bp, Artificial
  CRISPR gRNA sequence
cttatttctccatctgactt

SEQ ID NO: 362662 - DNA, 20 bp, Artificial
  CRISPR gRNA sequence
atctgacttaagaaaattaa

SEQ ID NO: 362663 - DNA, 20 bp, Artificial
  CRISPR gRNA sequence
cttaagaaaattaaaagtga

SEQ ID NO: 362664 - DNA, 20 bp, Artificial
  CRISPR gRNA sequence
taagaaaattaaaagtgata

SEQ ID NO: 362665 - DNA, 20 bp, Artificial
  CRISPR gRNA sequence
agtgatagagatacatatga

SEQ ID NO: 362666 - DNA, 20 bp, Artificial
  CRISPR gRNA sequence
tatgatagacaaaactgaaa

SEQ ID NO: 362667 - DNA, 20 bp, Artificial
  CRISPR gRNA sequence
atgatagacaaaactgaaaa

SEQ ID NO: 362668 - DNA, 20 bp, Artificial
  CRISPR gRNA sequence
aaactgaaaaaggtctacac

SEQ ID NO: 362669 - DNA, 20 bp, Artificial
  CRISPR gRNA sequence
aactgaaaaaggtctacaca

SEQ ID NO: 362670 - DNA, 20 bp, Artificial
  CRISPR gRNA sequence
aaaaggtctacacaaggact

SEQ ID NO: 362671 - DNA, 20 bp, Artificial
  CRISPR gRNA sequence
aaaggtctacacaaggacta

SEQ ID NO: 362672 - DNA, 20 bp, Artificial
  CRISPR gRNA sequence
ggtctacacaaggactaagg

SEQ ID NO: 362673 - DNA, 20 bp, Artificial
  CRISPR gRNA sequence
tacacaaggactaaggaagc

SEQ ID NO: 362674 - DNA, 20 bp, Artificial
  CRISPR gRNA sequence
acaaggactaaggaagctag

SEQ ID NO: 362675 - DNA, 20 bp, Artificial
  CRISPR gRNA sequence
caaggactaaggaagctagc

SEQ ID NO: 362676 - DNA, 20 bp, Artificial
  CRISPR gRNA sequence
ctaaggaagctagcaggaat

SEQ ID NO: 362677 - DNA, 20 bp, Artificial
  CRISPR gRNA sequence
ggaattggtgacccttataa

SEQ ID NO: 362678 - DNA, 20 bp, Artificial
  CRISPR gRNA sequence
gaattggtgacccttataac

SEQ ID NO: 362679 - DNA, 20 bp, Artificial
  CRISPR gRNA sequence
attggtgacccttataacag

SEQ ID NO: 362680 - DNA, 20 bp, Artificial
  CRISPR gRNA sequence
gacccttataacaggagaat

SEQ ID NO: 362681 - DNA, 20 bp, Artificial
  CRISPR gRNA sequence
cttataacaggagaataaga

SEQ ID NO: 362682 - DNA, 20 bp, Artificial
  CRISPR gRNA sequence
taagaaagactctttctctg

SEQ ID NO: 362683 - DNA, 20 bp, Artificial
  CRISPR gRNA sequence
ttgtttgaaatttcctttga

SEQ ID NO: 362684 - DNA, 20 bp, Artificial
  CRISPR gRNA sequence
tgtttgaaatttcctttgac

SEQ ID NO: 362685 - DNA, 20 bp, Artificial
  CRISPR gRNA sequence
aaatttcctttgacaggcaa

SEQ ID NO: 362686 - DNA, 20 bp, Artificial
  CRISPR gRNA sequence
tttgacaggcaatagccttt

SEQ ID NO: 362687 - DNA, 20 bp, Artificial
  CRISPR gRNA sequence
tcactttcacctgtcattaa

SEQ ID NO: 362688 - DNA, 20 bp, Artificial
  CRISPR gRNA sequence
cctgtcattaatagatatga

SEQ ID NO: 362689 - DNA, 20 bp, Artificial
  CRISPR gRNA sequence
ttcttccttccttctgaatt

SEQ ID NO: 362690 - DNA, 20 bp, Artificial
  CRISPR gRNA sequence
tcttccttccttctgaattt

SEQ ID NO: 362691 - DNA, 20 bp, Artificial
  CRISPR gRNA sequence
ccttccttctgaatttggga

SEQ ID NO: 362692 - DNA, 20 bp, Artificial
  CRISPR gRNA sequence
cttccttctgaatttgggat

SEQ ID NO: 362693 - DNA, 20 bp, Artificial
  CRISPR gRNA sequence
atttgggataggcaaaacaa

SEQ ID NO: 362694 - DNA, 20 bp, Artificial
  CRISPR gRNA sequence
caaaacaaaagccgaaatga

SEQ ID NO: 362695 - DNA, 20 bp, Artificial
  CRISPR gRNA sequence
tgaaagtgtgcaaataccgt

SEQ ID NO: 362696 - DNA, 20 bp, Artificial
  CRISPR gRNA sequence
agtgtgcaaataccgtaaga

SEQ ID NO: 362697 - DNA, 20 bp, Artificial
  CRISPR gRNA sequence
gtgtgcaaataccgtaagat

SEQ ID NO: 362698 - DNA, 20 bp, Artificial
  CRISPR gRNA sequence
ggttgtaaaatacaattgca

SEQ ID NO: 362699 - DNA, 20 bp, Artificial
  CRISPR gRNA sequence
atacaattgcatagtgcatc

SEQ ID NO: 362700 - DNA, 20 bp, Artificial
  CRISPR gRNA sequence
ctggcttcccttgccttttg

SEQ ID NO: 362701 - DNA, 20 bp, Artificial
  CRISPR gRNA sequence
gcttcccttgccttttgaag

SEQ ID NO: 362702 - DNA, 20 bp, Artificial
  CRISPR gRNA sequence
agcaattcaacatgtcaacc

SEQ ID NO: 362703 - DNA, 20 bp, Artificial
  CRISPR gRNA sequence
ccaagccatgaattgtaaac

SEQ ID NO: 362704 - DNA, 20 bp, Artificial
  CRISPR gRNA sequence
tgttgatcaattctatgtgt

SEQ ID NO: 362705 - DNA, 20 bp, Artificial
  CRISPR gRNA sequence
tctatgtgttggttcaattt

SEQ ID NO: 362706 - DNA, 20 bp, Artificial
  CRISPR gRNA sequence
tatgtgttggttcaatttta

SEQ ID NO: 362707 - DNA, 20 bp, Artificial
  CRISPR gRNA sequence
atgtgttggttcaattttag

SEQ ID NO: 362708 - DNA, 20 bp, Artificial
  CRISPR gRNA sequence
ggttcaattttagaggtttt

SEQ ID NO: 362709 - DNA, 20 bp, Artificial
  CRISPR gRNA sequence
ggtttttggtgttttgttgt

SEQ ID NO: 362710 - DNA, 20 bp, Artificial
  CRISPR gRNA sequence
gtttttggtgttttgttgtt

SEQ ID NO: 362711 - DNA, 20 bp, Artificial
  CRISPR gRNA sequence
tttttggtgttttgttgttg

SEQ ID NO: 362712 - DNA, 20 bp, Artificial
  CRISPR gRNA sequence
acaatgaaaattatcttcca

SEQ ID NO: 362713 - DNA, 20 bp, Artificial
  CRISPR gRNA sequence
atgaaaattatcttccaaag

SEQ ID NO: 362714 - DNA, 20 bp, Artificial
  CRISPR gRNA sequence
tgaaaattatcttccaaagt

SEQ ID NO: 362715 - DNA, 20 bp, Artificial
  CRISPR gRNA sequence
tcttccaaagtaggttacac

SEQ ID NO: 362716 - DNA, 20 bp, Artificial
  CRISPR gRNA sequence
ttccaaagtaggttacactg

SEQ ID NO: 362717 - DNA, 20 bp, Artificial
  CRISPR gRNA sequence
ttacactggagcctactatc

SEQ ID NO: 362718 - DNA, 20 bp, Artificial
  CRISPR gRNA sequence
ggagcctactatctagaaaa

SEQ ID NO: 362719 - DNA, 20 bp, Artificial
  CRISPR gRNA sequence
gaaaatagctgtctattttc

SEQ ID NO: 362720 - DNA, 20 bp, Artificial
  CRISPR gRNA sequence
attttctagataattttcta

SEQ ID NO: 362721 - DNA, 20 bp, Artificial
  CRISPR gRNA sequence
attttctaaagcaattctcc

SEQ ID NO: 362722 - DNA, 20 bp, Artificial
  CRISPR gRNA sequence
ctaaagcaattctcctggaa

SEQ ID NO: 362723 - DNA, 20 bp, Artificial
  CRISPR gRNA sequence
atctcaacatccaaattttc

SEQ ID NO: 362724 - DNA, 20 bp, Artificial
  CRISPR gRNA sequence
tctcaacatccaaattttct

SEQ ID NO: 362725 - DNA, 20 bp, Artificial
  CRISPR gRNA sequence
aacatccaaattttctgggt

SEQ ID NO: 362726 - DNA, 20 bp, Artificial
  CRISPR gRNA sequence
atccaaattttctgggttgg

SEQ ID NO: 362727 - DNA, 20 bp, Artificial
  CRISPR gRNA sequence
cagttcaaattccacttttt

SEQ ID NO: 362728 - DNA, 20 bp, Artificial
  CRISPR gRNA sequence
agttcaaattccactttttc

SEQ ID NO: 362729 - DNA, 20 bp, Artificial
  CRISPR gRNA sequence
gttcaaattccactttttca

SEQ ID NO: 362730 - DNA, 20 bp, Artificial
  CRISPR gRNA sequence
ggactctgccctgaatttcc

SEQ ID NO: 362731 - DNA, 20 bp, Artificial
  CRISPR gRNA sequence
gactctgccctgaatttcct

SEQ ID NO: 362732 - DNA, 20 bp, Artificial
  CRISPR gRNA sequence
taaaataaaattatatcctc

SEQ ID NO: 362733 - DNA, 20 bp, Artificial
  CRISPR gRNA sequence
ccaatattctacatcctatt

SEQ ID NO: 362734 - DNA, 20 bp, Artificial
  CRISPR gRNA sequence
aatattctacatcctattta

SEQ ID NO: 362735 - DNA, 20 bp, Artificial
  CRISPR gRNA sequence
tctacatcctatttagagct

SEQ ID NO: 362736 - DNA, 20 bp, Artificial
  CRISPR gRNA sequence
gaacattacattgtacattg

SEQ ID NO: 362737 - DNA, 20 bp, Artificial
  CRISPR gRNA sequence
cattgtacattgtagattct

SEQ ID NO: 362738 - DNA, 20 bp, Artificial
  CRISPR gRNA sequence
attgtacattgtagattctc

SEQ ID NO: 362739 - DNA, 20 bp, Artificial
  CRISPR gRNA sequence
tacattgtagattctcagga

SEQ ID NO: 362740 - DNA, 20 bp, Artificial
  CRISPR gRNA sequence
attctcaggaaagacttgat

SEQ ID NO: 362741 - DNA, 20 bp, Artificial
  CRISPR gRNA sequence
agacttgatgagtgaattaa

SEQ ID NO: 362742 - DNA, 20 bp, Artificial
  CRISPR gRNA sequence
tgatgagtgaattaatggat

SEQ ID NO: 362743 - DNA, 20 bp, Artificial
  CRISPR gRNA sequence
tgagtgaattaatggataag

SEQ ID NO: 362744 - DNA, 20 bp, Artificial
  CRISPR gRNA sequence
gagtgaattaatggataagt

SEQ ID NO: 362745 - DNA, 20 bp, Artificial
  CRISPR gRNA sequence
aattaatggataagtgggtt

SEQ ID NO: 362746 - DNA, 20 bp, Artificial
  CRISPR gRNA sequence
tgggttcagctcctgcaaat

SEQ ID NO: 362747 - DNA, 20 bp, Artificial
  CRISPR gRNA sequence
atcagcacacccatttataa

SEQ ID NO: 362748 - DNA, 20 bp, Artificial
  CRISPR gRNA sequence
gcacacccatttataaaagc

SEQ ID NO: 362749 - DNA, 20 bp, Artificial
  CRISPR gRNA sequence
catttataaaagccagattt

SEQ ID NO: 362750 - DNA, 20 bp, Artificial
  CRISPR gRNA sequence
ttgagacacttccctctccc

SEQ ID NO: 362751 - DNA, 20 bp, Artificial
  CRISPR gRNA sequence
ccagctttaaatcaaattta

SEQ ID NO: 362752 - DNA, 20 bp, Artificial
  CRISPR gRNA sequence
cagctttaaatcaaatttaa

SEQ ID NO: 362753 - DNA, 20 bp, Artificial
  CRISPR gRNA sequence
ttaaatcaaatttaaaggct

SEQ ID NO: 362754 - DNA, 20 bp, Artificial
  CRISPR gRNA sequence
taaaggctgagattataccc

SEQ ID NO: 362755 - DNA, 20 bp, Artificial
  CRISPR gRNA sequence
ctgagattataccccagcat

SEQ ID NO: 362756 - DNA, 20 bp, Artificial
  CRISPR gRNA sequence
ccccagcattagaaaaatgt

SEQ ID NO: 362757 - DNA, 20 bp, Artificial
  CRISPR gRNA sequence
tgctgccctcaactaatata

SEQ ID NO: 362758 - DNA, 20 bp, Artificial
  CRISPR gRNA sequence
gctgccctcaactaatatat

SEQ ID NO: 362759 - DNA, 20 bp, Artificial
  CRISPR gRNA sequence
ccctcaactaatatataggc

SEQ ID NO: 362760 - DNA, 20 bp, Artificial
  CRISPR gRNA sequence
atataggccagcatgatctt

SEQ ID NO: 362761 - DNA, 20 bp, Artificial
  CRISPR gRNA sequence
ctttagaatccctttcatca

SEQ ID NO: 362762 - DNA, 20 bp, Artificial
  CRISPR gRNA sequence
tttagaatccctttcatcat

SEQ ID NO: 362763 - DNA, 20 bp, Artificial
  CRISPR gRNA sequence
cctttcatcataggattcct

SEQ ID NO: 362764 - DNA, 20 bp, Artificial
  CRISPR gRNA sequence
ctcagaactgccatcaattc

SEQ ID NO: 362765 - DNA, 20 bp, Artificial
  CRISPR gRNA sequence
cagaactgccatcaattctg

SEQ ID NO: 362766 - DNA, 20 bp, Artificial
  CRISPR gRNA sequence
ttctggagcccttaatatta

SEQ ID NO: 362767 - DNA, 20 bp, Artificial
  CRISPR gRNA sequence
tctggagcccttaatattaa

SEQ ID NO: 362768 - DNA, 20 bp, Artificial
  CRISPR gRNA sequence
taatattaaaggaatctctt

SEQ ID NO: 362769 - DNA, 20 bp, Artificial
  CRISPR gRNA sequence
atctctttagtgccactaac

SEQ ID NO: 362770 - DNA, 20 bp, Artificial
  CRISPR gRNA sequence
tctttagtgccactaaccag

SEQ ID NO: 362771 - DNA, 20 bp, Artificial
  CRISPR gRNA sequence
actaaccagcagatatatac

SEQ ID NO: 362772 - DNA, 20 bp, Artificial
  CRISPR gRNA sequence
gcagatatatacaagaatga

SEQ ID NO: 362773 - DNA, 20 bp, Artificial
  CRISPR gRNA sequence
acaagaatgaaagaaaactt

SEQ ID NO: 362774 - DNA, 20 bp, Artificial
  CRISPR gRNA sequence
gaaaactttggctgctatgt

SEQ ID NO: 362775 - DNA, 20 bp, Artificial
  CRISPR gRNA sequence
ttggctgctatgtcagctgc

SEQ ID NO: 362776 - DNA, 20 bp, Artificial
  CRISPR gRNA sequence
tggctgctatgtcagctgct

SEQ ID NO: 362777 - DNA, 20 bp, Artificial
  CRISPR gRNA sequence
tatgtcagctgctgggaacc

SEQ ID NO: 362778 - DNA, 20 bp, Artificial
  CRISPR gRNA sequence
tcagctgctgggaacctgga

SEQ ID NO: 362779 - DNA, 20 bp, Artificial
  CRISPR gRNA sequence
agctgctgggaacctggaca

SEQ ID NO: 362780 - DNA, 20 bp, Artificial
  CRISPR gRNA sequence
acagagaacacttgtccctg

SEQ ID NO: 362781 - DNA, 20 bp, Artificial
  CRISPR gRNA sequence
cagagaacacttgtccctga

SEQ ID NO: 362782 - DNA, 20 bp, Artificial
  CRISPR gRNA sequence
agagaacacttgtccctgaa

SEQ ID NO: 362783 - DNA, 20 bp, Artificial
  CRISPR gRNA sequence
acacttgtccctgaagggtg

SEQ ID NO: 362784 - DNA, 20 bp, Artificial
  CRISPR gRNA sequence
acttgtccctgaagggtgta

SEQ ID NO: 362785 - DNA, 20 bp, Artificial
  CRISPR gRNA sequence
tccctgaagggtgtagagat

SEQ ID NO: 362786 - DNA, 20 bp, Artificial
  CRISPR gRNA sequence
cctgaagggtgtagagataa

SEQ ID NO: 362787 - DNA, 20 bp, Artificial
  CRISPR gRNA sequence
tgtagagataagagccttct

SEQ ID NO: 362788 - DNA, 20 bp, Artificial
  CRISPR gRNA sequence
gataagagccttctaagaat

SEQ ID NO: 362789 - DNA, 20 bp, Artificial
  CRISPR gRNA sequence
gagccttctaagaatgagca

SEQ ID NO: 362790 - DNA, 20 bp, Artificial
  CRISPR gRNA sequence
cttctaagaatgagcatgga

SEQ ID NO: 362791 - DNA, 20 bp, Artificial
  CRISPR gRNA sequence
aatgagcatggatggcatat

SEQ ID NO: 362792 - DNA, 20 bp, Artificial
  CRISPR gRNA sequence
atgagcatggatggcatata

SEQ ID NO: 362793 - DNA, 20 bp, Artificial
  CRISPR gRNA sequence
gagcatggatggcatataag

SEQ ID NO: 362794 - DNA, 20 bp, Artificial
  CRISPR gRNA sequence
ataaggagcctcatcccacc

SEQ ID NO: 362795 - DNA, 20 bp, Artificial
  CRISPR gRNA sequence
taaggagcctcatcccacct

SEQ ID NO: 362796 - DNA, 20 bp, Artificial
  CRISPR gRNA sequence
aggagcctcatcccacctgg

SEQ ID NO: 362797 - DNA, 20 bp, Artificial
  CRISPR gRNA sequence
gagcctcatcccacctggga

SEQ ID NO: 362798 - DNA, 20 bp, Artificial
  CRISPR gRNA sequence
catcccacctgggagagaat

SEQ ID NO: 362799 - DNA, 20 bp, Artificial
  CRISPR gRNA sequence
gggagagaatgagactctta

SEQ ID NO: 362800 - DNA, 20 bp, Artificial
  CRISPR gRNA sequence
ggagagaatgagactcttaa

SEQ ID NO: 362801 - DNA, 20 bp, Artificial
  CRISPR gRNA sequence
gagagaatgagactcttaaa

SEQ ID NO: 362802 - DNA, 20 bp, Artificial
  CRISPR gRNA sequence
atgagactcttaaagggaaa

SEQ ID NO: 362803 - DNA, 20 bp, Artificial
  CRISPR gRNA sequence
gactcttaaagggaaacagt

SEQ ID NO: 362804 - DNA, 20 bp, Artificial
  CRISPR gRNA sequence
actcttaaagggaaacagtg

SEQ ID NO: 362805 - DNA, 20 bp, Artificial
  CRISPR gRNA sequence
gtgaggaacatctctgtgcc

SEQ ID NO: 362806 - DNA, 20 bp, Artificial
  CRISPR gRNA sequence
aacatctctgtgcccagttt

SEQ ID NO: 362807 - DNA, 20 bp, Artificial
  CRISPR gRNA sequence
tgtgcccagtttgagataaa

SEQ ID NO: 362808 - DNA, 20 bp, Artificial
  CRISPR gRNA sequence
ccagtttgagataaatggac

SEQ ID NO: 362809 - DNA, 20 bp, Artificial
  CRISPR gRNA sequence
gagataaatggactggaata

SEQ ID NO: 362810 - DNA, 20 bp, Artificial
  CRISPR gRNA sequence
agataaatggactggaatat

SEQ ID NO: 362811 - DNA, 20 bp, Artificial
  CRISPR gRNA sequence
ataaatggactggaatatgg

SEQ ID NO: 362812 - DNA, 20 bp, Artificial
  CRISPR gRNA sequence
gactggaatatgggagatca

SEQ ID NO: 362813 - DNA, 20 bp, Artificial
  CRISPR gRNA sequence
ctggaatatgggagatcaca

SEQ ID NO: 362814 - DNA, 20 bp, Artificial
  CRISPR gRNA sequence
aatatgggagatcacagagt

SEQ ID NO: 362815 - DNA, 20 bp, Artificial
  CRISPR gRNA sequence
gagtcagcaaacatacaata

SEQ ID NO: 362816 - DNA, 20 bp, Artificial
  CRISPR gRNA sequence
catacaatacagccaacaca

SEQ ID NO: 362817 - DNA, 20 bp, Artificial
  CRISPR gRNA sequence
acacaaagtacctgcatgtg

SEQ ID NO: 362818 - DNA, 20 bp, Artificial
  CRISPR gRNA sequence
acaaagtacctgcatgtgtg

SEQ ID NO: 362819 - DNA, 20 bp, Artificial
  CRISPR gRNA sequence
agtacctgcatgtgtggagc

SEQ ID NO: 362820 - DNA, 20 bp, Artificial
  CRISPR gRNA sequence
taaccctctactataaatat

SEQ ID NO: 362821 - DNA, 20 bp, Artificial
  CRISPR gRNA sequence
ctacaatgtgaccatcctcc

SEQ ID NO: 362822 - DNA, 20 bp, Artificial
  CRISPR gRNA sequence
gtgaccatcctccaagccac

SEQ ID NO: 362823 - DNA, 20 bp, Artificial
  CRISPR gRNA sequence
caagccacaagctatgacct

SEQ ID NO: 362824 - DNA, 20 bp, Artificial
  CRISPR gRNA sequence
agacttctgcccccatccat

SEQ ID NO: 362825 - DNA, 20 bp, Artificial
  CRISPR gRNA sequence
cccatccattggtactttct

SEQ ID NO: 362826 - DNA, 20 bp, Artificial
  CRISPR gRNA sequence
ccccatccatccacatgtgc

SEQ ID NO: 362827 - DNA, 20 bp, Artificial
  CRISPR gRNA sequence
acatgtgctggatgatcatt

SEQ ID NO: 362828 - DNA, 20 bp, Artificial
  CRISPR gRNA sequence
tcattcagatgacttcaaat

SEQ ID NO: 362829 - DNA, 20 bp, Artificial
  CRISPR gRNA sequence
aaattggatattttcaatcc

SEQ ID NO: 362830 - DNA, 20 bp, Artificial
  CRISPR gRNA sequence
tgttccataatttcaattgt

SEQ ID NO: 362831 - DNA, 20 bp, Artificial
  CRISPR gRNA sequence
ccataatttcaattgtcagc

SEQ ID NO: 362832 - DNA, 20 bp, Artificial
  CRISPR gRNA sequence
tttcaattgtcagctggtca

SEQ ID NO: 362833 - DNA, 20 bp, Artificial
  CRISPR gRNA sequence
ttcaattgtcagctggtcaa

SEQ ID NO: 362834 - DNA, 20 bp, Artificial
  CRISPR gRNA sequence
acaatttaatacacctgaaa

SEQ ID NO: 362835 - DNA, 20 bp, Artificial
  CRISPR gRNA sequence
agacttaattccactcttgc

SEQ ID NO: 362836 - DNA, 20 bp, Artificial
  CRISPR gRNA sequence
taattccactcttgctagcc

SEQ ID NO: 362837 - DNA, 20 bp, Artificial
  CRISPR gRNA sequence
tccactcttgctagccaagt

SEQ ID NO: 362838 - DNA, 20 bp, Artificial
  CRISPR gRNA sequence
tcactaaaatcatcattttt

SEQ ID NO: 362839 - DNA, 20 bp, Artificial
  CRISPR gRNA sequence
aatcatcattttttagtcct

SEQ ID NO: 362840 - DNA, 20 bp, Artificial
  CRISPR gRNA sequence
tgctgaaacttacctctacc

SEQ ID NO: 362841 - DNA, 20 bp, Artificial
  CRISPR gRNA sequence
acttacctctacctggcccc

SEQ ID NO: 362842 - DNA, 20 bp, Artificial
  CRISPR gRNA sequence
cttacctctacctggccccc

SEQ ID NO: 362843 - DNA, 20 bp, Artificial
  CRISPR gRNA sequence
acctggcccccaggccatat

SEQ ID NO: 362844 - DNA, 20 bp, Artificial
  CRISPR gRNA sequence
ccccaggccatatcagaatg

SEQ ID NO: 362845 - DNA, 20 bp, Artificial
  CRISPR gRNA sequence
tgaagatttcatccttacct

SEQ ID NO: 362846 - DNA, 20 bp, Artificial
  CRISPR gRNA sequence
aagatttcatccttacctta

SEQ ID NO: 362847 - DNA, 20 bp, Artificial
  CRISPR gRNA sequence
atcacatctcttttcaccat

SEQ ID NO: 362848 - DNA, 20 bp, Artificial
  CRISPR gRNA sequence
ctcttttcaccattagaaat

SEQ ID NO: 362849 - DNA, 20 bp, Artificial
  CRISPR gRNA sequence
ttttcaccattagaaatcag

SEQ ID NO: 362850 - DNA, 20 bp, Artificial
  CRISPR gRNA sequence
ccattagaaatcagtagatt

SEQ ID NO: 362851 - DNA, 20 bp, Artificial
  CRISPR gRNA sequence
tagaaatcagtagatttggc

SEQ ID NO: 362852 - DNA, 20 bp, Artificial
  CRISPR gRNA sequence
agaaatcagtagatttggcc

SEQ ID NO: 362853 - DNA, 20 bp, Artificial
  CRISPR gRNA sequence
atcagtagatttggccaggc

SEQ ID NO: 362854 - DNA, 20 bp, Artificial
  CRISPR gRNA sequence
tcagtagatttggccaggca

SEQ ID NO: 362855 - DNA, 20 bp, Artificial
  CRISPR gRNA sequence
gtagatttggccaggcaagg

SEQ ID NO: 362856 - DNA, 20 bp, Artificial
  CRISPR gRNA sequence
gtggcctatgcctgtaattc

SEQ ID NO: 362857 - DNA, 20 bp, Artificial
  CRISPR gRNA sequence
tgcctgtaattccagcactt

SEQ ID NO: 362858 - DNA, 20 bp, Artificial
  CRISPR gRNA sequence
gcctgtaattccagcacttt

SEQ ID NO: 362859 - DNA, 20 bp, Artificial
  CRISPR gRNA sequence
ctgtaattccagcactttgg

SEQ ID NO: 362860 - DNA, 20 bp, Artificial
  CRISPR gRNA sequence
tgtaattccagcactttggg

SEQ ID NO: 362861 - DNA, 20 bp, Artificial
  CRISPR gRNA sequence
ttccagcactttgggaggcc

SEQ ID NO: 362862 - DNA, 20 bp, Artificial
  CRISPR gRNA sequence
tccagcactttgggaggcca

SEQ ID NO: 362863 - DNA, 20 bp, Artificial
  CRISPR gRNA sequence
agcactttgggaggccaagg

SEQ ID NO: 362864 - DNA, 20 bp, Artificial
  CRISPR gRNA sequence
gcactttgggaggccaaggt

SEQ ID NO: 362865 - DNA, 20 bp, Artificial
  CRISPR gRNA sequence
cactttgggaggccaaggtg

SEQ ID NO: 362866 - DNA, 20 bp, Artificial
  CRISPR gRNA sequence
tttgggaggccaaggtgggg

SEQ ID NO: 362867 - DNA, 20 bp, Artificial
  CRISPR gRNA sequence
caaggtggggtggatcacct

SEQ ID NO: 362868 - DNA, 20 bp, Artificial
  CRISPR gRNA sequence
aaggtggggtggatcacctg

SEQ ID NO: 362869 - DNA, 20 bp, Artificial
  CRISPR gRNA sequence
tggggtggatcacctgaggt

SEQ ID NO: 362870 - DNA, 20 bp, Artificial
  CRISPR gRNA sequence
ggggtggatcacctgaggtc

SEQ ID NO: 362871 - DNA, 20 bp, Artificial
  CRISPR gRNA sequence
ggtggatcacctgaggtcag

SEQ ID NO: 362872 - DNA, 20 bp, Artificial
  CRISPR gRNA sequence
tcacctgaggtcaggagttt

SEQ ID NO: 362873 - DNA, 20 bp, Artificial
  CRISPR gRNA sequence
tgaggtcaggagtttgagat

SEQ ID NO: 362874 - DNA, 20 bp, Artificial
  CRISPR gRNA sequence
tcaggagtttgagatcagcc

SEQ ID NO: 362875 - DNA, 20 bp, Artificial
  CRISPR gRNA sequence
tgagatcagcctggccaaca

SEQ ID NO: 362876 - DNA, 20 bp, Artificial
  CRISPR gRNA sequence
ctctacaaaaatacaaaaat

SEQ ID NO: 362877 - DNA, 20 bp, Artificial
  CRISPR gRNA sequence
acaaaaatacaaaaattagc

SEQ ID NO: 362878 - DNA, 20 bp, Artificial
  CRISPR gRNA sequence
caaaaatacaaaaattagct

SEQ ID NO: 362879 - DNA, 20 bp, Artificial
  CRISPR gRNA sequence
attagctgggtgtgatgatg

SEQ ID NO: 362880 - DNA, 20 bp, Artificial
  CRISPR gRNA sequence
ttagctgggtgtgatgatgc

SEQ ID NO: 362881 - DNA, 20 bp, Artificial
  CRISPR gRNA sequence
atgatgcaggcctgtaatcc

SEQ ID NO: 362882 - DNA, 20 bp, Artificial
  CRISPR gRNA sequence
ggcctgtaatcccagctact

SEQ ID NO: 362883 - DNA, 20 bp, Artificial
  CRISPR gRNA sequence
gcctgtaatcccagctactc

SEQ ID NO: 362884 - DNA, 20 bp, Artificial
  CRISPR gRNA sequence
ctgtaatcccagctactcag

SEQ ID NO: 362885 - DNA, 20 bp, Artificial
  CRISPR gRNA sequence
tgtaatcccagctactcagg

SEQ ID NO: 362886 - DNA, 20 bp, Artificial
  CRISPR gRNA sequence
tcccagctactcaggaggct

SEQ ID NO: 362887 - DNA, 20 bp, Artificial
  CRISPR gRNA sequence
cccagctactcaggaggctg

SEQ ID NO: 362888 - DNA, 20 bp, Artificial
  CRISPR gRNA sequence
agctactcaggaggctgagg

SEQ ID NO: 362889 - DNA, 20 bp, Artificial
  CRISPR gRNA sequence
gctactcaggaggctgaggc

SEQ ID NO: 362890 - DNA, 20 bp, Artificial
  CRISPR gRNA sequence
tactcaggaggctgaggcag

SEQ ID NO: 362891 - DNA, 20 bp, Artificial
  CRISPR gRNA sequence
gcaggagaaccacttgaacc

SEQ ID NO: 362892 - DNA, 20 bp, Artificial
  CRISPR gRNA sequence
caggagaaccacttgaaccc

SEQ ID NO: 362893 - DNA, 20 bp, Artificial
  CRISPR gRNA sequence
ggagaaccacttgaacccag

SEQ ID NO: 362894 - DNA, 20 bp, Artificial
  CRISPR gRNA sequence
gagaaccacttgaacccagg

SEQ ID NO: 362895 - DNA, 20 bp, Artificial
  CRISPR gRNA sequence
aaccacttgaacccaggagg

SEQ ID NO: 362896 - DNA, 20 bp, Artificial
  CRISPR gRNA sequence
ccacttgaacccaggaggca

SEQ ID NO: 362897 - DNA, 20 bp, Artificial
  CRISPR gRNA sequence
cacttgaacccaggaggcag

SEQ ID NO: 362898 - DNA, 20 bp, Artificial
  CRISPR gRNA sequence
caggaggcagaggttgcaat

SEQ ID NO: 362899 - DNA, 20 bp, Artificial
  CRISPR gRNA sequence
ggcagaggttgcaatgagct

SEQ ID NO: 362900 - DNA, 20 bp, Artificial
  CRISPR gRNA sequence
gagatcatgccactgcactc

SEQ ID NO: 362901 - DNA, 20 bp, Artificial
  CRISPR gRNA sequence
catgccactgcactccagcc

SEQ ID NO: 362902 - DNA, 20 bp, Artificial
  CRISPR gRNA sequence
atgccactgcactccagcct

SEQ ID NO: 362903 - DNA, 20 bp, Artificial
  CRISPR gRNA sequence
ctgcactccagcctgggcaa

SEQ ID NO: 362904 - DNA, 20 bp, Artificial
  CRISPR gRNA sequence
gcactccagcctgggcaaca

SEQ ID NO: 362905 - DNA, 20 bp, Artificial
  CRISPR gRNA sequence
tccagcctgggcaacagagt

SEQ ID NO: 362906 - DNA, 20 bp, Artificial
  CRISPR gRNA sequence
agtgagactctgtctcaaaa

SEQ ID NO: 362907 - DNA, 20 bp, Artificial
  CRISPR gRNA sequence
gtgagactctgtctcaaaaa

SEQ ID NO: 362908 - DNA, 20 bp, Artificial
  CRISPR gRNA sequence
actctgtctcaaaaaaggaa

SEQ ID NO: 362909 - DNA, 20 bp, Artificial
  CRISPR gRNA sequence
tctcaaaaaaggaaaagaaa

SEQ ID NO: 362910 - DNA, 20 bp, Artificial
  CRISPR gRNA sequence
aaaggaaaagaaaaagaaat

SEQ ID NO: 362911 - DNA, 20 bp, Artificial
  CRISPR gRNA sequence
ggaaaagaaaaagaaatcag

SEQ ID NO: 362912 - DNA, 20 bp, Artificial
  CRISPR gRNA sequence
aaagaaatcagtagatttga

SEQ ID NO: 362913 - DNA, 20 bp, Artificial
  CRISPR gRNA sequence
gaaatcttctaaaacatttt

SEQ ID NO: 362914 - DNA, 20 bp, Artificial
  CRISPR gRNA sequence
gcaaaataaaacacctgtat

SEQ ID NO: 362915 - DNA, 20 bp, Artificial
  CRISPR gRNA sequence
caaaataaaacacctgtata

SEQ ID NO: 362916 - DNA, 20 bp, Artificial
  CRISPR gRNA sequence
aaggaaaacaccctgactat

SEQ ID NO: 362917 - DNA, 20 bp, Artificial
  CRISPR gRNA sequence
caccctgactatgagcctta

SEQ ID NO: 362918 - DNA, 20 bp, Artificial
  CRISPR gRNA sequence
atgagccttaaagacccttt

SEQ ID NO: 362919 - DNA, 20 bp, Artificial
  CRISPR gRNA sequence
ctgaactttgcttttcttta

SEQ ID NO: 362920 - DNA, 20 bp, Artificial
  CRISPR gRNA sequence
gcatatttctaaaaccttta

SEQ ID NO: 362921 - DNA, 20 bp, Artificial
  CRISPR gRNA sequence
tttctaaaacctttaaagaa

SEQ ID NO: 362922 - DNA, 20 bp, Artificial
  CRISPR gRNA sequence
ttctaaaacctttaaagaaa

SEQ ID NO: 362923 - DNA, 20 bp, Artificial
  CRISPR gRNA sequence
cctttaaagaaaaggaaccc

SEQ ID NO: 362924 - DNA, 20 bp, Artificial
  CRISPR gRNA sequence
cctagtttacctattttttt

SEQ ID NO: 362925 - DNA, 20 bp, Artificial
  CRISPR gRNA sequence
tgctcttttctttcaacaca

SEQ ID NO: 362926 - DNA, 20 bp, Artificial
  CRISPR gRNA sequence
tctttcaacacaaagttcat

SEQ ID NO: 362927 - DNA, 20 bp, Artificial
  CRISPR gRNA sequence
ttcatgagcttcatccatgt

SEQ ID NO: 362928 - DNA, 20 bp, Artificial
  CRISPR gRNA sequence
tgagcttcatccatgtcggt

SEQ ID NO: 362929 - DNA, 20 bp, Artificial
  CRISPR gRNA sequence
cttcatccatgtcggtgagc

SEQ ID NO: 362930 - DNA, 20 bp, Artificial
  CRISPR gRNA sequence
aagtgataattcactcattt

SEQ ID NO: 362931 - DNA, 20 bp, Artificial
  CRISPR gRNA sequence
attcactcattttagtgatg

SEQ ID NO: 362932 - DNA, 20 bp, Artificial
  CRISPR gRNA sequence
tcactcattttagtgatgta

SEQ ID NO: 362933 - DNA, 20 bp, Artificial
  CRISPR gRNA sequence
agagtatcctaatgtgtgaa

SEQ ID NO: 362934 - DNA, 20 bp, Artificial
  CRISPR gRNA sequence
cctaatgtgtgaatagacct

SEQ ID NO: 362935 - DNA, 20 bp, Artificial
  CRISPR gRNA sequence
atagacctcagtgtgctttt

SEQ ID NO: 362936 - DNA, 20 bp, Artificial
  CRISPR gRNA sequence
cttttcggttctactgttga

SEQ ID NO: 362937 - DNA, 20 bp, Artificial
  CRISPR gRNA sequence
ttttcggttctactgttgat

SEQ ID NO: 362938 - DNA, 20 bp, Artificial
  CRISPR gRNA sequence
ttctactgttgatgggtatt

SEQ ID NO: 362939 - DNA, 20 bp, Artificial
  CRISPR gRNA sequence
tctactgttgatgggtattt

SEQ ID NO: 362940 - DNA, 20 bp, Artificial
  CRISPR gRNA sequence
actgttgctataaatattgt

SEQ ID NO: 362941 - DNA, 20 bp, Artificial
  CRISPR gRNA sequence
ctgttgctataaatattgtc

SEQ ID NO: 362942 - DNA, 20 bp, Artificial
  CRISPR gRNA sequence
tcaggaattttccctataat

SEQ ID NO: 362943 - DNA, 20 bp, Artificial
  CRISPR gRNA sequence
aggaattttccctataatga

SEQ ID NO: 362944 - DNA, 20 bp, Artificial
  CRISPR gRNA sequence
ccctataatgagagaactct

SEQ ID NO: 362945 - DNA, 20 bp, Artificial
  CRISPR gRNA sequence
gagaactcttggataccaaa

SEQ ID NO: 362946 - DNA, 20 bp, Artificial
  CRISPR gRNA sequence
gaactcttggataccaaaca

SEQ ID NO: 362947 - DNA, 20 bp, Artificial
  CRISPR gRNA sequence
ctcttggataccaaacagag

SEQ ID NO: 362948 - DNA, 20 bp, Artificial
  CRISPR gRNA sequence
accaaacagagtagaattat

SEQ ID NO: 362949 - DNA, 20 bp, Artificial
  CRISPR gRNA sequence
agagtagaattattggatca

SEQ ID NO: 362950 - DNA, 20 bp, Artificial
  CRISPR gRNA sequence
gagtagaattattggatcat

SEQ ID NO: 362951 - DNA, 20 bp, Artificial
  CRISPR gRNA sequence
aattattggatcataggatt

SEQ ID NO: 362952 - DNA, 20 bp, Artificial
  CRISPR gRNA sequence
attattggatcataggattt

SEQ ID NO: 362953 - DNA, 20 bp, Artificial
  CRISPR gRNA sequence
ttattggatcataggatttg

SEQ ID NO: 362954 - DNA, 20 bp, Artificial
  CRISPR gRNA sequence
taggatttggggtttttaac

SEQ ID NO: 362955 - DNA, 20 bp, Artificial
  CRISPR gRNA sequence
tgccatatcattttccaaaa

SEQ ID NO: 362956 - DNA, 20 bp, Artificial
  CRISPR gRNA sequence
gccatatcattttccaaaac

SEQ ID NO: 362957 - DNA, 20 bp, Artificial
  CRISPR gRNA sequence
attttccaaaacaggtatga

SEQ ID NO: 362958 - DNA, 20 bp, Artificial
  CRISPR gRNA sequence
taattttacgtgtcaatttg

SEQ ID NO: 362959 - DNA, 20 bp, Artificial
  CRISPR gRNA sequence
aattttacgtgtcaatttga

SEQ ID NO: 362960 - DNA, 20 bp, Artificial
  CRISPR gRNA sequence
attttacgtgtcaatttgaa

SEQ ID NO: 362961 - DNA, 20 bp, Artificial
  CRISPR gRNA sequence
tgtcaatttgaagggtgttt

SEQ ID NO: 362962 - DNA, 20 bp, Artificial
  CRISPR gRNA sequence
gtcaatttgaagggtgtttt

SEQ ID NO: 362963 - DNA, 20 bp, Artificial
  CRISPR gRNA sequence
tttgaagggtgttttgggat

SEQ ID NO: 362964 - DNA, 20 bp, Artificial
  CRISPR gRNA sequence
gatgagattaacatttaaat

SEQ ID NO: 362965 - DNA, 20 bp, Artificial
  CRISPR gRNA sequence
taaattggtgaattttgaat

SEQ ID NO: 362966 - DNA, 20 bp, Artificial
  CRISPR gRNA sequence
attggtgaattttgaataag

SEQ ID NO: 362967 - DNA, 20 bp, Artificial
  CRISPR gRNA sequence
agcagtttgcctccataatg

SEQ ID NO: 362968 - DNA, 20 bp, Artificial
  CRISPR gRNA sequence
gcagtttgcctccataatgt

SEQ ID NO: 362969 - DNA, 20 bp, Artificial
  CRISPR gRNA sequence
tttgcctccataatgtaggt

SEQ ID NO: 362970 - DNA, 20 bp, Artificial
  CRISPR gRNA sequence
ggtgagcctaattcaacaaa

SEQ ID NO: 362971 - DNA, 20 bp, Artificial
  CRISPR gRNA sequence
gcctaattcaacaaaaagac

SEQ ID NO: 362972 - DNA, 20 bp, Artificial
  CRISPR gRNA sequence
acaaaaagaccagcctcccc

SEQ ID NO: 362973 - DNA, 20 bp, Artificial
  CRISPR gRNA sequence
aaagaccagcctccccaagc

SEQ ID NO: 362974 - DNA, 20 bp, Artificial
  CRISPR gRNA sequence
agaccagcctccccaagcaa

SEQ ID NO: 362975 - DNA, 20 bp, Artificial
  CRISPR gRNA sequence
gaccagcctccccaagcaag

SEQ ID NO: 362976 - DNA, 20 bp, Artificial
  CRISPR gRNA sequence
accagcctccccaagcaaga

SEQ ID NO: 362977 - DNA, 20 bp, Artificial
  CRISPR gRNA sequence
cccaagcaagagggattctg

SEQ ID NO: 362978 - DNA, 20 bp, Artificial
  CRISPR gRNA sequence
aagcaagagggattctgcag

SEQ ID NO: 362979 - DNA, 20 bp, Artificial
  CRISPR gRNA sequence
ggattctgcagcagatgacc

SEQ ID NO: 362980 - DNA, 20 bp, Artificial
  CRISPR gRNA sequence
gattctgcagcagatgacct

SEQ ID NO: 362981 - DNA, 20 bp, Artificial
  CRISPR gRNA sequence
ctgggcttcacctgtaccat

SEQ ID NO: 362982 - DNA, 20 bp, Artificial
  CRISPR gRNA sequence
acctgtaccatcggctctcc

SEQ ID NO: 362983 - DNA, 20 bp, Artificial
  CRISPR gRNA sequence
cctgtaccatcggctctcct

SEQ ID NO: 362984 - DNA, 20 bp, Artificial
  CRISPR gRNA sequence
catcggctctcctgggtctg

SEQ ID NO: 362985 - DNA, 20 bp, Artificial
  CRISPR gRNA sequence
ctcctgggtctgcagcctgc

SEQ ID NO: 362986 - DNA, 20 bp, Artificial
  CRISPR gRNA sequence
gcaagcccacactgcaaatt

SEQ ID NO: 362987 - DNA, 20 bp, Artificial
  CRISPR gRNA sequence
caagcccacactgcaaattt

SEQ ID NO: 362988 - DNA, 20 bp, Artificial
  CRISPR gRNA sequence
cactgcaaatttgggcttat

SEQ ID NO: 362989 - DNA, 20 bp, Artificial
  CRISPR gRNA sequence
catgatcatatgatataatt

SEQ ID NO: 362990 - DNA, 20 bp, Artificial
  CRISPR gRNA sequence
gcccacccaaatctcatctt

SEQ ID NO: 362991 - DNA, 20 bp, Artificial
  CRISPR gRNA sequence
ccaaatctcatcttgagttg

SEQ ID NO: 362992 - DNA, 20 bp, Artificial
  CRISPR gRNA sequence
cccataaccctcacgtgtcg

SEQ ID NO: 362993 - DNA, 20 bp, Artificial
  CRISPR gRNA sequence
ccataaccctcacgtgtcgt

SEQ ID NO: 362994 - DNA, 20 bp, Artificial
  CRISPR gRNA sequence
ataaccctcacgtgtcgtgg

SEQ ID NO: 362995 - DNA, 20 bp, Artificial
  CRISPR gRNA sequence
aaccctcacgtgtcgtggga

SEQ ID NO: 362996 - DNA, 20 bp, Artificial
  CRISPR gRNA sequence
tcacgtgtcgtgggagagac

SEQ ID NO: 362997 - DNA, 20 bp, Artificial
  CRISPR gRNA sequence
cacgtgtcgtgggagagacc

SEQ ID NO: 362998 - DNA, 20 bp, Artificial
  CRISPR gRNA sequence
gtgtcgtgggagagaccagg

SEQ ID NO: 362999 - DNA, 20 bp, Artificial
  CRISPR gRNA sequence
gtcgtgggagagaccaggtg

SEQ ID NO: 363000 - DNA, 20 bp, Artificial
  CRISPR gRNA sequence
aggtggagataactgaatca

SEQ ID NO: 363001 - DNA, 20 bp, Artificial
  CRISPR gRNA sequence
ggtggagataactgaatcat

SEQ ID NO: 363002 - DNA, 20 bp, Artificial
  CRISPR gRNA sequence
gtggagataactgaatcatg

SEQ ID NO: 363003 - DNA, 20 bp, Artificial
  CRISPR gRNA sequence
tggagataactgaatcatgg

SEQ ID NO: 363004 - DNA, 20 bp, Artificial
  CRISPR gRNA sequence
agataactgaatcatggggg

SEQ ID NO: 363005 - DNA, 20 bp, Artificial
  CRISPR gRNA sequence
cccccatcctgttctcatga

SEQ ID NO: 363006 - DNA, 20 bp, Artificial
  CRISPR gRNA sequence
catcctgttctcatgatagt

SEQ ID NO: 363007 - DNA, 20 bp, Artificial
  CRISPR gRNA sequence
ctgttctcatgatagtgagt

SEQ ID NO: 363008 - DNA, 20 bp, Artificial
  CRISPR gRNA sequence
gatagtgagttagttctcat

SEQ ID NO: 363009 - DNA, 20 bp, Artificial
  CRISPR gRNA sequence
ttagttctcatgagatctga

SEQ ID NO: 363010 - DNA, 20 bp, Artificial
  CRISPR gRNA sequence
atgagatctgatggttttat

SEQ ID NO: 363011 - DNA, 20 bp, Artificial
  CRISPR gRNA sequence
tgagatctgatggttttata

SEQ ID NO: 363012 - DNA, 20 bp, Artificial
  CRISPR gRNA sequence
gagatctgatggttttataa

SEQ ID NO: 363013 - DNA, 20 bp, Artificial
  CRISPR gRNA sequence
agatctgatggttttataag

SEQ ID NO: 363014 - DNA, 20 bp, Artificial
  CRISPR gRNA sequence
ataaggggcttcccctgctc

SEQ ID NO: 363015 - DNA, 20 bp, Artificial
  CRISPR gRNA sequence
taaggggcttcccctgctct

SEQ ID NO: 363016 - DNA, 20 bp, Artificial
  CRISPR gRNA sequence
cttctccctgctaccatgtg

SEQ ID NO: 363017 - DNA, 20 bp, Artificial
  CRISPR gRNA sequence
ttctccctgctaccatgtga

SEQ ID NO: 363018 - DNA, 20 bp, Artificial
  CRISPR gRNA sequence
tccccttccaccatgattgt

SEQ ID NO: 363019 - DNA, 20 bp, Artificial
  CRISPR gRNA sequence
accatgattgtaagtttcct

SEQ ID NO: 363020 - DNA, 20 bp, Artificial
  CRISPR gRNA sequence
ccatgattgtaagtttcctg

SEQ ID NO: 363021 - DNA, 20 bp, Artificial
  CRISPR gRNA sequence
ctccccacccatactgaact

SEQ ID NO: 363022 - DNA, 20 bp, Artificial
  CRISPR gRNA sequence
ctttataaattaccctgtct

SEQ ID NO: 363023 - DNA, 20 bp, Artificial
  CRISPR gRNA sequence
tttataaattaccctgtctc

SEQ ID NO: 363024 - DNA, 20 bp, Artificial
  CRISPR gRNA sequence
tgtctcaggtatgtctttat

SEQ ID NO: 363025 - DNA, 20 bp, Artificial
  CRISPR gRNA sequence
ctcaggtatgtctttattag

SEQ ID NO: 363026 - DNA, 20 bp, Artificial
  CRISPR gRNA sequence
ttattagcagcatgaaaact

SEQ ID NO: 363027 - DNA, 20 bp, Artificial
  CRISPR gRNA sequence
agcatgaaaactgagtaata

SEQ ID NO: 363028 - DNA, 20 bp, Artificial
  CRISPR gRNA sequence
aactgagtaatacagtaaat

SEQ ID NO: 363029 - DNA, 20 bp, Artificial
  CRISPR gRNA sequence
agtaatacagtaaatgagta

SEQ ID NO: 363030 - DNA, 20 bp, Artificial
  CRISPR gRNA sequence
aatacagtaaatgagtacag

SEQ ID NO: 363031 - DNA, 20 bp, Artificial
  CRISPR gRNA sequence
tacagtaaatgagtacagca

SEQ ID NO: 363032 - DNA, 20 bp, Artificial
  CRISPR gRNA sequence
cagtaaatgagtacagcaga

SEQ ID NO: 363033 - DNA, 20 bp, Artificial
  CRISPR gRNA sequence
taaatgagtacagcagagag

SEQ ID NO: 363034 - DNA, 20 bp, Artificial
  CRISPR gRNA sequence
aatgagtacagcagagagtg

SEQ ID NO: 363035 - DNA, 20 bp, Artificial
  CRISPR gRNA sequence
atgagtacagcagagagtgg

SEQ ID NO: 363036 - DNA, 20 bp, Artificial
  CRISPR gRNA sequence
tgagtacagcagagagtgga

SEQ ID NO: 363037 - DNA, 20 bp, Artificial
  CRISPR gRNA sequence
gagagtggagggttgctgta

SEQ ID NO: 363038 - DNA, 20 bp, Artificial
  CRISPR gRNA sequence
gttgctgtaaagatatccac

SEQ ID NO: 363039 - DNA, 20 bp, Artificial
  CRISPR gRNA sequence
aaagatatccacaagtgtga

SEQ ID NO: 363040 - DNA, 20 bp, Artificial
  CRISPR gRNA sequence
cacaagtgtgaaagcaactt

SEQ ID NO: 363041 - DNA, 20 bp, Artificial
  CRISPR gRNA sequence
tgtgaaagcaactttggaac

SEQ ID NO: 363042 - DNA, 20 bp, Artificial
  CRISPR gRNA sequence
gtgaaagcaactttggaact

SEQ ID NO: 363043 - DNA, 20 bp, Artificial
  CRISPR gRNA sequence
gcaactttggaactgggtaa

SEQ ID NO: 363044 - DNA, 20 bp, Artificial
  CRISPR gRNA sequence
caactttggaactgggtaac

SEQ ID NO: 363045 - DNA, 20 bp, Artificial
  CRISPR gRNA sequence
ctttggaactgggtaacagg

SEQ ID NO: 363046 - DNA, 20 bp, Artificial
  CRISPR gRNA sequence
ttggaactgggtaacaggta

SEQ ID NO: 363047 - DNA, 20 bp, Artificial
  CRISPR gRNA sequence
tggaactgggtaacaggtag

SEQ ID NO: 363048 - DNA, 20 bp, Artificial
  CRISPR gRNA sequence
actgggtaacaggtagaggt

SEQ ID NO: 363049 - DNA, 20 bp, Artificial
  CRISPR gRNA sequence
gtaacaggtagaggttggaa

SEQ ID NO: 363050 - DNA, 20 bp, Artificial
  CRISPR gRNA sequence
gtagaggttggaacagtttt

SEQ ID NO: 363051 - DNA, 20 bp, Artificial
  CRISPR gRNA sequence
tagaggttggaacagttttg

SEQ ID NO: 363052 - DNA, 20 bp, Artificial
  CRISPR gRNA sequence
agaggttggaacagttttga

SEQ ID NO: 363053 - DNA, 20 bp, Artificial
  CRISPR gRNA sequence
ttggaacagttttgagggct

SEQ ID NO: 363054 - DNA, 20 bp, Artificial
  CRISPR gRNA sequence
gaacagttttgagggctcag

SEQ ID NO: 363055 - DNA, 20 bp, Artificial
  CRISPR gRNA sequence
cagttttgagggctcagaag

SEQ ID NO: 363056 - DNA, 20 bp, Artificial
  CRISPR gRNA sequence
tttgagggctcagaagaaga

SEQ ID NO: 363057 - DNA, 20 bp, Artificial
  CRISPR gRNA sequence
ttgagggctcagaagaagac

SEQ ID NO: 363058 - DNA, 20 bp, Artificial
  CRISPR gRNA sequence
cagaagaagacaggaaaatg

SEQ ID NO: 363059 - DNA, 20 bp, Artificial
  CRISPR gRNA sequence
agaagaagacaggaaaatgt

SEQ ID NO: 363060 - DNA, 20 bp, Artificial
  CRISPR gRNA sequence
acaggaaaatgtgggaaatt

SEQ ID NO: 363061 - DNA, 20 bp, Artificial
  CRISPR gRNA sequence
caggaaaatgtgggaaattt

SEQ ID NO: 363062 - DNA, 20 bp, Artificial
  CRISPR gRNA sequence
tgggaaatttgggaacttcc

SEQ ID NO: 363063 - DNA, 20 bp, Artificial
  CRISPR gRNA sequence
gacattgaccaaaatgctga

SEQ ID NO: 363064 - DNA, 20 bp, Artificial
  CRISPR gRNA sequence
tgacagtgatataaacaatg

SEQ ID NO: 363065 - DNA, 20 bp, Artificial
  CRISPR gRNA sequence
gtgatataaacaatgaagtc

SEQ ID NO: 363066 - DNA, 20 bp, Artificial
  CRISPR gRNA sequence
tgatataaacaatgaagtcc

SEQ ID NO: 363067 - DNA, 20 bp, Artificial
  CRISPR gRNA sequence
taaacaatgaagtccaggct

SEQ ID NO: 363068 - DNA, 20 bp, Artificial
  CRISPR gRNA sequence
aaacaatgaagtccaggctg

SEQ ID NO: 363069 - DNA, 20 bp, Artificial
  CRISPR gRNA sequence
caatgaagtccaggctgagg

SEQ ID NO: 363070 - DNA, 20 bp, Artificial
  CRISPR gRNA sequence
agtccaggctgaggtggtct

SEQ ID NO: 363071 - DNA, 20 bp, Artificial
  CRISPR gRNA sequence
caggctgaggtggtctcaga

SEQ ID NO: 363072 - DNA, 20 bp, Artificial
  CRISPR gRNA sequence
ggctgaggtggtctcagatg

SEQ ID NO: 363073 - DNA, 20 bp, Artificial
  CRISPR gRNA sequence
aggtggtctcagatggagat

SEQ ID NO: 363074 - DNA, 20 bp, Artificial
  CRISPR gRNA sequence
ggtggtctcagatggagatg

SEQ ID NO: 363075 - DNA, 20 bp, Artificial
  CRISPR gRNA sequence
gatggagatgaggaactttt

SEQ ID NO: 363076 - DNA, 20 bp, Artificial
  CRISPR gRNA sequence
atggagatgaggaacttttt

SEQ ID NO: 363077 - DNA, 20 bp, Artificial
  CRISPR gRNA sequence
atgaggaactttttgggaaa

SEQ ID NO: 363078 - DNA, 20 bp, Artificial
  CRISPR gRNA sequence
gaggaactttttgggaaatg

SEQ ID NO: 363079 - DNA, 20 bp, Artificial
  CRISPR gRNA sequence
actttttgggaaatggagta

SEQ ID NO: 363080 - DNA, 20 bp, Artificial
  CRISPR gRNA sequence
ctttttgggaaatggagtaa

SEQ ID NO: 363081 - DNA, 20 bp, Artificial
  CRISPR gRNA sequence
aaggtcactcttgctatgca

SEQ ID NO: 363082 - DNA, 20 bp, Artificial
  CRISPR gRNA sequence
ggtcactcttgctatgcaaa

SEQ ID NO: 363083 - DNA, 20 bp, Artificial
  CRISPR gRNA sequence
ctcttgctatgcaaagagtt

SEQ ID NO: 363084 - DNA, 20 bp, Artificial
  CRISPR gRNA sequence
ttgctatgcaaagagtttgg

SEQ ID NO: 363085 - DNA, 20 bp, Artificial
  CRISPR gRNA sequence
gtggcattttgcccctgccc

SEQ ID NO: 363086 - DNA, 20 bp, Artificial
  CRISPR gRNA sequence
ggcattttgcccctgcccca

SEQ ID NO: 363087 - DNA, 20 bp, Artificial
  CRISPR gRNA sequence
gcccctgccccagagatctg

SEQ ID NO: 363088 - DNA, 20 bp, Artificial
  CRISPR gRNA sequence
atctgtggaactttgaactt

SEQ ID NO: 363089 - DNA, 20 bp, Artificial
  CRISPR gRNA sequence
ctgtggaactttgaacttga

SEQ ID NO: 363090 - DNA, 20 bp, Artificial
  CRISPR gRNA sequence
gtggaactttgaacttgaga

SEQ ID NO: 363091 - DNA, 20 bp, Artificial
  CRISPR gRNA sequence
tgaacttgagagagataatt

SEQ ID NO: 363092 - DNA, 20 bp, Artificial
  CRISPR gRNA sequence
gaacttgagagagataattt

SEQ ID NO: 363093 - DNA, 20 bp, Artificial
  CRISPR gRNA sequence
aacttgagagagataattta

SEQ ID NO: 363094 - DNA, 20 bp, Artificial
  CRISPR gRNA sequence
gagagataatttagggtatc

SEQ ID NO: 363095 - DNA, 20 bp, Artificial
  CRISPR gRNA sequence
agataatttagggtatctgg

SEQ ID NO: 363096 - DNA, 20 bp, Artificial
  CRISPR gRNA sequence
taatttagggtatctggcag

SEQ ID NO: 363097 - DNA, 20 bp, Artificial
  CRISPR gRNA sequence
atctggcagaagaaacttct

SEQ ID NO: 363098 - DNA, 20 bp, Artificial
  CRISPR gRNA sequence
tctggcagaagaaacttcta

SEQ ID NO: 363099 - DNA, 20 bp, Artificial
  CRISPR gRNA sequence
ctggcagaagaaacttctaa

SEQ ID NO: 363100 - DNA, 20 bp, Artificial
  CRISPR gRNA sequence
tggcagaagaaacttctaag

SEQ ID NO: 363101 - DNA, 20 bp, Artificial
  CRISPR gRNA sequence
gaagaaacttctaaggggca

SEQ ID NO: 363102 - DNA, 20 bp, Artificial
  CRISPR gRNA sequence
ttctaaggggcaaagcattc

SEQ ID NO: 363103 - DNA, 20 bp, Artificial
  CRISPR gRNA sequence
ctaaggggcaaagcattcaa

SEQ ID NO: 363104 - DNA, 20 bp, Artificial
  CRISPR gRNA sequence
taaggggcaaagcattcaag

SEQ ID NO: 363105 - DNA, 20 bp, Artificial
  CRISPR gRNA sequence
ggggcaaagcattcaagagg

SEQ ID NO: 363106 - DNA, 20 bp, Artificial
  CRISPR gRNA sequence
gcaaagcattcaagaggaag

SEQ ID NO: 363107 - DNA, 20 bp, Artificial
  CRISPR gRNA sequence
aaagcattcaagaggaagca

SEQ ID NO: 363108 - DNA, 20 bp, Artificial
  CRISPR gRNA sequence
gaagcagagcataaaaaatt

SEQ ID NO: 363109 - DNA, 20 bp, Artificial
  CRISPR gRNA sequence
taaaaaatttggaaaatttg

SEQ ID NO: 363110 - DNA, 20 bp, Artificial
  CRISPR gRNA sequence
tttgcagcctgatgatgcga

SEQ ID NO: 363111 - DNA, 20 bp, Artificial
  CRISPR gRNA sequence
agcctgatgatgcgacagaa

SEQ ID NO: 363112 - DNA, 20 bp, Artificial
  CRISPR gRNA sequence
cagaaaagaaaaacattttc

SEQ ID NO: 363113 - DNA, 20 bp, Artificial
  CRISPR gRNA sequence
agaaaagaaaaacattttct

SEQ ID NO: 363114 - DNA, 20 bp, Artificial
  CRISPR gRNA sequence
aaagaaaaacattttctggg

SEQ ID NO: 363115 - DNA, 20 bp, Artificial
  CRISPR gRNA sequence
cattttctgggaagaaattc

SEQ ID NO: 363116 - DNA, 20 bp, Artificial
  CRISPR gRNA sequence
ttctgggaagaaattccagc

SEQ ID NO: 363117 - DNA, 20 bp, Artificial
  CRISPR gRNA sequence
gaagaaattccagccagctg

SEQ ID NO: 363118 - DNA, 20 bp, Artificial
  CRISPR gRNA sequence
ccagctgcagaaatttgcat

SEQ ID NO: 363119 - DNA, 20 bp, Artificial
  CRISPR gRNA sequence
cagaaatttgcataagtaat

SEQ ID NO: 363120 - DNA, 20 bp, Artificial
  CRISPR gRNA sequence
agaaatttgcataagtaatg

SEQ ID NO: 363121 - DNA, 20 bp, Artificial
  CRISPR gRNA sequence
aaatttgcataagtaatgag

SEQ ID NO: 363122 - DNA, 20 bp, Artificial
  CRISPR gRNA sequence
ggagccaaatgtaaatcacc

SEQ ID NO: 363123 - DNA, 20 bp, Artificial
  CRISPR gRNA sequence
aatgtaaatcaccaagacaa

SEQ ID NO: 363124 - DNA, 20 bp, Artificial
  CRISPR gRNA sequence
atgtaaatcaccaagacaat

SEQ ID NO: 363125 - DNA, 20 bp, Artificial
  CRISPR gRNA sequence
tgtaaatcaccaagacaatg

SEQ ID NO: 363126 - DNA, 20 bp, Artificial
  CRISPR gRNA sequence
acaatggggaaaatgtctcc

SEQ ID NO: 363127 - DNA, 20 bp, Artificial
  CRISPR gRNA sequence
caatggggaaaatgtctcca

SEQ ID NO: 363128 - DNA, 20 bp, Artificial
  CRISPR gRNA sequence
aaaatgtctccaaggcatgt

SEQ ID NO: 363129 - DNA, 20 bp, Artificial
  CRISPR gRNA sequence
aatgtctccaaggcatgtca

SEQ ID NO: 363130 - DNA, 20 bp, Artificial
  CRISPR gRNA sequence
aggcatgtcagagaccttca

SEQ ID NO: 363131 - DNA, 20 bp, Artificial
  CRISPR gRNA sequence
catgtcagagaccttcatgg

SEQ ID NO: 363132 - DNA, 20 bp, Artificial
  CRISPR gRNA sequence
atggcagccccttccatcat

SEQ ID NO: 363133 - DNA, 20 bp, Artificial
  CRISPR gRNA sequence
agccccttccatcataagcc

SEQ ID NO: 363134 - DNA, 20 bp, Artificial
  CRISPR gRNA sequence
gccccttccatcataagcct

SEQ ID NO: 363135 - DNA, 20 bp, Artificial
  CRISPR gRNA sequence
cccttccatcataagcctag

SEQ ID NO: 363136 - DNA, 20 bp, Artificial
  CRISPR gRNA sequence
ccttccatcataagcctagg

SEQ ID NO: 363137 - DNA, 20 bp, Artificial
  CRISPR gRNA sequence
cttccatcataagcctagga

SEQ ID NO: 363138 - DNA, 20 bp, Artificial
  CRISPR gRNA sequence
atcataagcctaggagggaa

SEQ ID NO: 363139 - DNA, 20 bp, Artificial
  CRISPR gRNA sequence
aggagggaaaagtgatttcc

SEQ ID NO: 363140 - DNA, 20 bp, Artificial
  CRISPR gRNA sequence
ggagggaaaagtgatttcct

SEQ ID NO: 363141 - DNA, 20 bp, Artificial
  CRISPR gRNA sequence
gaaaagtgatttcctgggcc

SEQ ID NO: 363142 - DNA, 20 bp, Artificial
  CRISPR gRNA sequence
tgatttcctgggccaagcct

SEQ ID NO: 363143 - DNA, 20 bp, Artificial
  CRISPR gRNA sequence
ctaagaccccctgctctatg

SEQ ID NO: 363144 - DNA, 20 bp, Artificial
  CRISPR gRNA sequence
ccccctgctctatgcagcct

SEQ ID NO: 363145 - DNA, 20 bp, Artificial
  CRISPR gRNA sequence
cccctgctctatgcagcctc

SEQ ID NO: 363146 - DNA, 20 bp, Artificial
  CRISPR gRNA sequence
tgcagcctcgggactgcata

SEQ ID NO: 363147 - DNA, 20 bp, Artificial
  CRISPR gRNA sequence
gcatatggtgccctatgtcc

SEQ ID NO: 363148 - DNA, 20 bp, Artificial
  CRISPR gRNA sequence
ggtgccctatgtcccagcca

SEQ ID NO: 363149 - DNA, 20 bp, Artificial
  CRISPR gRNA sequence
tatgtcccagccacggctaa

SEQ ID NO: 363150 - DNA, 20 bp, Artificial
  CRISPR gRNA sequence
atgtcccagccacggctaaa

SEQ ID NO: 363151 - DNA, 20 bp, Artificial
  CRISPR gRNA sequence
tgtcccagccacggctaaaa

SEQ ID NO: 363152 - DNA, 20 bp, Artificial
  CRISPR gRNA sequence
gtcccagccacggctaaaag

SEQ ID NO: 363153 - DNA, 20 bp, Artificial
  CRISPR gRNA sequence
ggctaaaaggggccaacata

SEQ ID NO: 363154 - DNA, 20 bp, Artificial
  CRISPR gRNA sequence
aaaggggccaacatacagct

SEQ ID NO: 363155 - DNA, 20 bp, Artificial
  CRISPR gRNA sequence
aaggggccaacatacagctc

SEQ ID NO: 363156 - DNA, 20 bp, Artificial
  CRISPR gRNA sequence
tacagctcaggctgttgctt

SEQ ID NO: 363157 - DNA, 20 bp, Artificial
  CRISPR gRNA sequence
cagctcaggctgttgcttca

SEQ ID NO: 363158 - DNA, 20 bp, Artificial
  CRISPR gRNA sequence
agctcaggctgttgcttcag

SEQ ID NO: 363159 - DNA, 20 bp, Artificial
  CRISPR gRNA sequence
gctcaggctgttgcttcaga

SEQ ID NO: 363160 - DNA, 20 bp, Artificial
  CRISPR gRNA sequence
gctgttgcttcagagggtgc

SEQ ID NO: 363161 - DNA, 20 bp, Artificial
  CRISPR gRNA sequence
cttcagagggtgcaagcccc

SEQ ID NO: 363162 - DNA, 20 bp, Artificial
  CRISPR gRNA sequence
gtgcaagccccaagccttga

SEQ ID NO: 363163 - DNA, 20 bp, Artificial
  CRISPR gRNA sequence
aagccttgacagcttacacg

SEQ ID NO: 363164 - DNA, 20 bp, Artificial
  CRISPR gRNA sequence
tgacagcttacacgtggtgt

SEQ ID NO: 363165 - DNA, 20 bp, Artificial
  CRISPR gRNA sequence
gacagcttacacgtggtgtt

SEQ ID NO: 363166 - DNA, 20 bp, Artificial
  CRISPR gRNA sequence
tacacgtggtgttgggcctg

SEQ ID NO: 363167 - DNA, 20 bp, Artificial
  CRISPR gRNA sequence
acacgtggtgttgggcctgc

SEQ ID NO: 363168 - DNA, 20 bp, Artificial
  CRISPR gRNA sequence
gtgttgggcctgcgggtgca

SEQ ID NO: 363169 - DNA, 20 bp, Artificial
  CRISPR gRNA sequence
ttgggcctgcgggtgcacag

SEQ ID NO: 363170 - DNA, 20 bp, Artificial
  CRISPR gRNA sequence
cctgcgggtgcacagaagtc

SEQ ID NO: 363171 - DNA, 20 bp, Artificial
  CRISPR gRNA sequence
tgcacagaagtcaagaactg

SEQ ID NO: 363172 - DNA, 20 bp, Artificial
  CRISPR gRNA sequence
gaagtcaagaactgtggttt

SEQ ID NO: 363173 - DNA, 20 bp, Artificial
  CRISPR gRNA sequence
gtggtttgagaacctctgcc

SEQ ID NO: 363174 - DNA, 20 bp, Artificial
  CRISPR gRNA sequence
gagaacctctgcctagactt

SEQ ID NO: 363175 - DNA, 20 bp, Artificial
  CRISPR gRNA sequence
cctagacttcagaaaatgta

SEQ ID NO: 363176 - DNA, 20 bp, Artificial
  CRISPR gRNA sequence
agaaaatgtacagaaacacc

SEQ ID NO: 363177 - DNA, 20 bp, Artificial
  CRISPR gRNA sequence
gaaaatgtacagaaacacct

SEQ ID NO: 363178 - DNA, 20 bp, Artificial
  CRISPR gRNA sequence
gaaacacctgggtgtccatt

SEQ ID NO: 363179 - DNA, 20 bp, Artificial
  CRISPR gRNA sequence
acacctgggtgtccattcag

SEQ ID NO: 363180 - DNA, 20 bp, Artificial
  CRISPR gRNA sequence
gtccattcagaagttgctgc

SEQ ID NO: 363181 - DNA, 20 bp, Artificial
  CRISPR gRNA sequence
tccattcagaagttgctgca

SEQ ID NO: 363182 - DNA, 20 bp, Artificial
  CRISPR gRNA sequence
ccattcagaagttgctgcaa

SEQ ID NO: 363183 - DNA, 20 bp, Artificial
  CRISPR gRNA sequence
ttcagaagttgctgcaaggg

SEQ ID NO: 363184 - DNA, 20 bp, Artificial
  CRISPR gRNA sequence
cagaagttgctgcaagggca

SEQ ID NO: 363185 - DNA, 20 bp, Artificial
  CRISPR gRNA sequence
ctgcaagggcagagccctca

SEQ ID NO: 363186 - DNA, 20 bp, Artificial
  CRISPR gRNA sequence
caagggcagagccctcatgg

SEQ ID NO: 363187 - DNA, 20 bp, Artificial
  CRISPR gRNA sequence
ccctcatggaagacctctgc

SEQ ID NO: 363188 - DNA, 20 bp, Artificial
  CRISPR gRNA sequence
cctcatggaagacctctgct

SEQ ID NO: 363189 - DNA, 20 bp, Artificial
  CRISPR gRNA sequence
ctcatggaagacctctgcta

SEQ ID NO: 363190 - DNA, 20 bp, Artificial
  CRISPR gRNA sequence
agacctctgctagggcactg

SEQ ID NO: 363191 - DNA, 20 bp, Artificial
  CRISPR gRNA sequence
cctctgctagggcactgcag

SEQ ID NO: 363192 - DNA, 20 bp, Artificial
  CRISPR gRNA sequence
ctctgctagggcactgcagc

SEQ ID NO: 363193 - DNA, 20 bp, Artificial
  CRISPR gRNA sequence
tctgctagggcactgcagca

SEQ ID NO: 363194 - DNA, 20 bp, Artificial
  CRISPR gRNA sequence
ggcactgcagcagggaaatg

SEQ ID NO: 363195 - DNA, 20 bp, Artificial
  CRISPR gRNA sequence
gcactgcagcagggaaatgt

SEQ ID NO: 363196 - DNA, 20 bp, Artificial
  CRISPR gRNA sequence
cactgcagcagggaaatgtg

SEQ ID NO: 363197 - DNA, 20 bp, Artificial
  CRISPR gRNA sequence
gcagcagggaaatgtggggt

SEQ ID NO: 363198 - DNA, 20 bp, Artificial
  CRISPR gRNA sequence
agcagggaaatgtggggttg

SEQ ID NO: 363199 - DNA, 20 bp, Artificial
  CRISPR gRNA sequence
gtggggttggagcccccaca

SEQ ID NO: 363200 - DNA, 20 bp, Artificial
  CRISPR gRNA sequence
cccccacacagaatccccac

SEQ ID NO: 363201 - DNA, 20 bp, Artificial
  CRISPR gRNA sequence
ccccacacagaatccccact

SEQ ID NO: 363202 - DNA, 20 bp, Artificial
  CRISPR gRNA sequence
cccacacagaatccccactg

SEQ ID NO: 363203 - DNA, 20 bp, Artificial
  CRISPR gRNA sequence
atccccactggggcactgtc

SEQ ID NO: 363204 - DNA, 20 bp, Artificial
  CRISPR gRNA sequence
cccactggggcactgtctag

SEQ ID NO: 363205 - DNA, 20 bp, Artificial
  CRISPR gRNA sequence
cactggggcactgtctagta

SEQ ID NO: 363206 - DNA, 20 bp, Artificial
  CRISPR gRNA sequence
gcactgtctagtagagctgt

SEQ ID NO: 363207 - DNA, 20 bp, Artificial
  CRISPR gRNA sequence
ctgtctagtagagctgtgag

SEQ ID NO: 363208 - DNA, 20 bp, Artificial
  CRISPR gRNA sequence
gtctagtagagctgtgagaa

SEQ ID NO: 363209 - DNA, 20 bp, Artificial
  CRISPR gRNA sequence
tctagtagagctgtgagaag

SEQ ID NO: 363210 - DNA, 20 bp, Artificial
  CRISPR gRNA sequence
ctagtagagctgtgagaaga

SEQ ID NO: 363211 - DNA, 20 bp, Artificial
  CRISPR gRNA sequence
agaagagggccaccatcctt

SEQ ID NO: 363212 - DNA, 20 bp, Artificial
  CRISPR gRNA sequence
cacaatctgaatctgatcca

SEQ ID NO: 363213 - DNA, 20 bp, Artificial
  CRISPR gRNA sequence
atctgaatctgatccacaga

SEQ ID NO: 363214 - DNA, 20 bp, Artificial
  CRISPR gRNA sequence
gacggcttgcaccatgcaac

SEQ ID NO: 363215 - DNA, 20 bp, Artificial
  CRISPR gRNA sequence
cggcttgcaccatgcaactg

SEQ ID NO: 363216 - DNA, 20 bp, Artificial
  CRISPR gRNA sequence
cttgcaccatgcaactggag

SEQ ID NO: 363217 - DNA, 20 bp, Artificial
  CRISPR gRNA sequence
ccatgcaactggagaagcca

SEQ ID NO: 363218 - DNA, 20 bp, Artificial
  CRISPR gRNA sequence
aagccacagacactcaacac

SEQ ID NO: 363219 - DNA, 20 bp, Artificial
  CRISPR gRNA sequence
cactcaacaccagcctgtga

SEQ ID NO: 363220 - DNA, 20 bp, Artificial
  CRISPR gRNA sequence
tcaacaccagcctgtgaaag

SEQ ID NO: 363221 - DNA, 20 bp, Artificial
  CRISPR gRNA sequence
accagcctgtgaaagcagcc

SEQ ID NO: 363222 - DNA, 20 bp, Artificial
  CRISPR gRNA sequence
cagcctgtgaaagcagccaa

SEQ ID NO: 363223 - DNA, 20 bp, Artificial
  CRISPR gRNA sequence
agcctgtgaaagcagccaag

SEQ ID NO: 363224 - DNA, 20 bp, Artificial
  CRISPR gRNA sequence
gcctgtgaaagcagccaaga

SEQ ID NO: 363225 - DNA, 20 bp, Artificial
  CRISPR gRNA sequence
cctgtgaaagcagccaagag

SEQ ID NO: 363226 - DNA, 20 bp, Artificial
  CRISPR gRNA sequence
tgtgaaagcagccaagaggg

SEQ ID NO: 363227 - DNA, 20 bp, Artificial
  CRISPR gRNA sequence
gtgaaagcagccaagagggg

SEQ ID NO: 363228 - DNA, 20 bp, Artificial
  CRISPR gRNA sequence
aggggaggctgtaccctgca

SEQ ID NO: 363229 - DNA, 20 bp, Artificial
  CRISPR gRNA sequence
gaggctgtaccctgcatagc

SEQ ID NO: 363230 - DNA, 20 bp, Artificial
  CRISPR gRNA sequence
ggctgtaccctgcatagcca

SEQ ID NO: 363231 - DNA, 20 bp, Artificial
  CRISPR gRNA sequence
gctgtaccctgcatagccag

SEQ ID NO: 363232 - DNA, 20 bp, Artificial
  CRISPR gRNA sequence
ctgtaccctgcatagccaga

SEQ ID NO: 363233 - DNA, 20 bp, Artificial
  CRISPR gRNA sequence
tgtaccctgcatagccagag

SEQ ID NO: 363234 - DNA, 20 bp, Artificial
  CRISPR gRNA sequence
accctgcatagccagagggg

SEQ ID NO: 363235 - DNA, 20 bp, Artificial
  CRISPR gRNA sequence
cctgcatagccagaggggtg

SEQ ID NO: 363236 - DNA, 20 bp, Artificial
  CRISPR gRNA sequence
ccagaggggtggagctgccc

SEQ ID NO: 363237 - DNA, 20 bp, Artificial
  CRISPR gRNA sequence
ggtggagctgcccaagacca

SEQ ID NO: 363238 - DNA, 20 bp, Artificial
  CRISPR gRNA sequence
gtggagctgcccaagaccat

SEQ ID NO: 363239 - DNA, 20 bp, Artificial
  CRISPR gRNA sequence
tgggtgcccacctcttgcat

SEQ ID NO: 363240 - DNA, 20 bp, Artificial
  CRISPR gRNA sequence
acctcttgcatcagcatgcc

SEQ ID NO: 363241 - DNA, 20 bp, Artificial
  CRISPR gRNA sequence
cctcttgcatcagcatgccc

SEQ ID NO: 363242 - DNA, 20 bp, Artificial
  CRISPR gRNA sequence
gcatcagcatgcccaggatg

SEQ ID NO: 363243 - DNA, 20 bp, Artificial
  CRISPR gRNA sequence
catcagcatgcccaggatgt

SEQ ID NO: 363244 - DNA, 20 bp, Artificial
  CRISPR gRNA sequence
catgcccaggatgtgggaca

SEQ ID NO: 363245 - DNA, 20 bp, Artificial
  CRISPR gRNA sequence
tgcccaggatgtgggacatg

SEQ ID NO: 363246 - DNA, 20 bp, Artificial
  CRISPR gRNA sequence
ggatgtgggacatggagtca

SEQ ID NO: 363247 - DNA, 20 bp, Artificial
  CRISPR gRNA sequence
gatgtgggacatggagtcaa

SEQ ID NO: 363248 - DNA, 20 bp, Artificial
  CRISPR gRNA sequence
tgtgggacatggagtcaaag

SEQ ID NO: 363249 - DNA, 20 bp, Artificial
  CRISPR gRNA sequence
gagtcaaaggagatcatttt

SEQ ID NO: 363250 - DNA, 20 bp, Artificial
  CRISPR gRNA sequence
gagatcatttttggaacttg

SEQ ID NO: 363251 - DNA, 20 bp, Artificial
  CRISPR gRNA sequence
aagttttaatgactgcccta

SEQ ID NO: 363252 - DNA, 20 bp, Artificial
  CRISPR gRNA sequence
agttttaatgactgccctac

SEQ ID NO: 363253 - DNA, 20 bp, Artificial
  CRISPR gRNA sequence
atgactgccctacaggattt

SEQ ID NO: 363254 - DNA, 20 bp, Artificial
  CRISPR gRNA sequence
tacaggatttcagacttgca

SEQ ID NO: 363255 - DNA, 20 bp, Artificial
  CRISPR gRNA sequence
caggatttcagacttgcatg

SEQ ID NO: 363256 - DNA, 20 bp, Artificial
  CRISPR gRNA sequence
atttcagacttgcatggagc

SEQ ID NO: 363257 - DNA, 20 bp, Artificial
  CRISPR gRNA sequence
tcagacttgcatggagctag

SEQ ID NO: 363258 - DNA, 20 bp, Artificial
  CRISPR gRNA sequence
agctagtagcccctttgttt

SEQ ID NO: 363259 - DNA, 20 bp, Artificial
  CRISPR gRNA sequence
tttggccaatttctctcatt

SEQ ID NO: 363260 - DNA, 20 bp, Artificial
  CRISPR gRNA sequence
caatttctctcatttagaat

SEQ ID NO: 363261 - DNA, 20 bp, Artificial
  CRISPR gRNA sequence
gcctgtacccctcttttatc

SEQ ID NO: 363262 - DNA, 20 bp, Artificial
  CRISPR gRNA sequence
cctgtacccctcttttatct

SEQ ID NO: 363263 - DNA, 20 bp, Artificial
  CRISPR gRNA sequence
gtacccctcttttatctagg

SEQ ID NO: 363264 - DNA, 20 bp, Artificial
  CRISPR gRNA sequence
ctaacttgcttttgatttta

SEQ ID NO: 363265 - DNA, 20 bp, Artificial
  CRISPR gRNA sequence
taacttgcttttgattttac

SEQ ID NO: 363266 - DNA, 20 bp, Artificial
  CRISPR gRNA sequence
cttttgattttacaggctca

SEQ ID NO: 363267 - DNA, 20 bp, Artificial
  CRISPR gRNA sequence
ttttgattttacaggctcat

SEQ ID NO: 363268 - DNA, 20 bp, Artificial
  CRISPR gRNA sequence
tgattttacaggctcatagg

SEQ ID NO: 363269 - DNA, 20 bp, Artificial
  CRISPR gRNA sequence
ttttacaggctcataggcgg

SEQ ID NO: 363270 - DNA, 20 bp, Artificial
  CRISPR gRNA sequence
tttacaggctcataggcgga

SEQ ID NO: 363271 - DNA, 20 bp, Artificial
  CRISPR gRNA sequence
ggaaggtacttgccttgtct

SEQ ID NO: 363272 - DNA, 20 bp, Artificial
  CRISPR gRNA sequence
gtacttgccttgtctcagat

SEQ ID NO: 363273 - DNA, 20 bp, Artificial
  CRISPR gRNA sequence
ccttgtctcagatgagactt

SEQ ID NO: 363274 - DNA, 20 bp, Artificial
  CRISPR gRNA sequence
cttgtctcagatgagacttt

SEQ ID NO: 363275 - DNA, 20 bp, Artificial
  CRISPR gRNA sequence
tcagatgagactttgggctg

SEQ ID NO: 363276 - DNA, 20 bp, Artificial
  CRISPR gRNA sequence
gactttgggctgtggacttt

SEQ ID NO: 363277 - DNA, 20 bp, Artificial
  CRISPR gRNA sequence
tgtggactttcagttaatgc

SEQ ID NO: 363278 - DNA, 20 bp, Artificial
  CRISPR gRNA sequence
gactttcagttaatgctgga

SEQ ID NO: 363279 - DNA, 20 bp, Artificial
  CRISPR gRNA sequence
ctttcagttaatgctggaaa

SEQ ID NO: 363280 - DNA, 20 bp, Artificial
  CRISPR gRNA sequence
agttaatgctggaaagagtt

SEQ ID NO: 363281 - DNA, 20 bp, Artificial
  CRISPR gRNA sequence
gctggaaagagttaagactt

SEQ ID NO: 363282 - DNA, 20 bp, Artificial
  CRISPR gRNA sequence
ctggaaagagttaagacttt

SEQ ID NO: 363283 - DNA, 20 bp, Artificial
  CRISPR gRNA sequence
tggaaagagttaagactttg

SEQ ID NO: 363284 - DNA, 20 bp, Artificial
  CRISPR gRNA sequence
ggaaagagttaagactttgg

SEQ ID NO: 363285 - DNA, 20 bp, Artificial
  CRISPR gRNA sequence
ttaagactttgggggactgt

SEQ ID NO: 363286 - DNA, 20 bp, Artificial
  CRISPR gRNA sequence
taagactttgggggactgtt

SEQ ID NO: 363287 - DNA, 20 bp, Artificial
  CRISPR gRNA sequence
agactttgggggactgttgg

SEQ ID NO: 363288 - DNA, 20 bp, Artificial
  CRISPR gRNA sequence
gactttgggggactgttggg

SEQ ID NO: 363289 - DNA, 20 bp, Artificial
  CRISPR gRNA sequence
actttgggggactgttggga

SEQ ID NO: 363290 - DNA, 20 bp, Artificial
  CRISPR gRNA sequence
gggggactgttgggagggta

SEQ ID NO: 363291 - DNA, 20 bp, Artificial
  CRISPR gRNA sequence
atggttgtattttgaaatgt

SEQ ID NO: 363292 - DNA, 20 bp, Artificial
  CRISPR gRNA sequence
tggttgtattttgaaatgtg

SEQ ID NO: 363293 - DNA, 20 bp, Artificial
  CRISPR gRNA sequence
ggttgtattttgaaatgtga

SEQ ID NO: 363294 - DNA, 20 bp, Artificial
  CRISPR gRNA sequence
attttgaaatgtgagggcat

SEQ ID NO: 363295 - DNA, 20 bp, Artificial
  CRISPR gRNA sequence
aatgtgagggcatgagattt

SEQ ID NO: 363296 - DNA, 20 bp, Artificial
  CRISPR gRNA sequence
tgtgagggcatgagatttca

SEQ ID NO: 363297 - DNA, 20 bp, Artificial
  CRISPR gRNA sequence
gtgagggcatgagatttcag

SEQ ID NO: 363298 - DNA, 20 bp, Artificial
  CRISPR gRNA sequence
tgagggcatgagatttcaga

SEQ ID NO: 363299 - DNA, 20 bp, Artificial
  CRISPR gRNA sequence
gagggcatgagatttcagag

SEQ ID NO: 363300 - DNA, 20 bp, Artificial
  CRISPR gRNA sequence
gcatgagatttcagaggggc

SEQ ID NO: 363301 - DNA, 20 bp, Artificial
  CRISPR gRNA sequence
catgagatttcagaggggcc

SEQ ID NO: 363302 - DNA, 20 bp, Artificial
  CRISPR gRNA sequence
atgagatttcagaggggcca

SEQ ID NO: 363303 - DNA, 20 bp, Artificial
  CRISPR gRNA sequence
tgagatttcagaggggccag

SEQ ID NO: 363304 - DNA, 20 bp, Artificial
  CRISPR gRNA sequence
aggggcaaaatgatataatt

SEQ ID NO: 363305 - DNA, 20 bp, Artificial
  CRISPR gRNA sequence
cccacccaaatctcatcttg

SEQ ID NO: 363306 - DNA, 20 bp, Artificial
  CRISPR gRNA sequence
cccataatccccatgtattg

SEQ ID NO: 363307 - DNA, 20 bp, Artificial
  CRISPR gRNA sequence
ccataatccccatgtattgt

SEQ ID NO: 363308 - DNA, 20 bp, Artificial
  CRISPR gRNA sequence
taatccccatgtattgtggg

SEQ ID NO: 363309 - DNA, 20 bp, Artificial
  CRISPR gRNA sequence
aatccccatgtattgtggga

SEQ ID NO: 363310 - DNA, 20 bp, Artificial
  CRISPR gRNA sequence
catgtattgtgggaaggacc

SEQ ID NO: 363311 - DNA, 20 bp, Artificial
  CRISPR gRNA sequence
gtattgtgggaaggacccgg

SEQ ID NO: 363312 - DNA, 20 bp, Artificial
  CRISPR gRNA sequence
tattgtgggaaggacccggt

SEQ ID NO: 363313 - DNA, 20 bp, Artificial
  CRISPR gRNA sequence
ttgtgggaaggacccggtgg

SEQ ID NO: 363314 - DNA, 20 bp, Artificial
  CRISPR gRNA sequence
tgtgggaaggacccggtggg

SEQ ID NO: 363315 - DNA, 20 bp, Artificial
  CRISPR gRNA sequence
gggaaggacccggtgggagg

SEQ ID NO: 363316 - DNA, 20 bp, Artificial
  CRISPR gRNA sequence
ggtgggaggtagctgaatca

SEQ ID NO: 363317 - DNA, 20 bp, Artificial
  CRISPR gRNA sequence
gtgggaggtagctgaatcat

SEQ ID NO: 363318 - DNA, 20 bp, Artificial
  CRISPR gRNA sequence
tgggaggtagctgaatcatg

SEQ ID NO: 363319 - DNA, 20 bp, Artificial
  CRISPR gRNA sequence
aggtagctgaatcatggggc

SEQ ID NO: 363320 - DNA, 20 bp, Artificial
  CRISPR gRNA sequence
cagtcaccttcatgctgttc

SEQ ID NO: 363321 - DNA, 20 bp, Artificial
  CRISPR gRNA sequence
ccttcatgctgttctggtga

SEQ ID NO: 363322 - DNA, 20 bp, Artificial
  CRISPR gRNA sequence
catgctgttctggtgacagt

SEQ ID NO: 363323 - DNA, 20 bp, Artificial
  CRISPR gRNA sequence
tgaattctcacaaaatctga

SEQ ID NO: 363324 - DNA, 20 bp, Artificial
  CRISPR gRNA sequence
acaaaatctgatggttttat

SEQ ID NO: 363325 - DNA, 20 bp, Artificial
  CRISPR gRNA sequence
caaaatctgatggttttata

SEQ ID NO: 363326 - DNA, 20 bp, Artificial
  CRISPR gRNA sequence
aaaatctgatggttttataa

SEQ ID NO: 363327 - DNA, 20 bp, Artificial
  CRISPR gRNA sequence
aaatctgatggttttataag

SEQ ID NO: 363328 - DNA, 20 bp, Artificial
  CRISPR gRNA sequence
ctccttcctgctgccatgtg

SEQ ID NO: 363329 - DNA, 20 bp, Artificial
  CRISPR gRNA sequence
cttcctgctgccatgtgaag

SEQ ID NO: 363330 - DNA, 20 bp, Artificial
  CRISPR gRNA sequence
ttcctgctgccatgtgaaga

SEQ ID NO: 363331 - DNA, 20 bp, Artificial
  CRISPR gRNA sequence
accatgattgtacgtttcct

SEQ ID NO: 363332 - DNA, 20 bp, Artificial
  CRISPR gRNA sequence
ccatgattgtacgtttcctg

SEQ ID NO: 363333 - DNA, 20 bp, Artificial
  CRISPR gRNA sequence
tacgtttcctgaggcctccc

SEQ ID NO: 363334 - DNA, 20 bp, Artificial
  CRISPR gRNA sequence
ccccagccatactgaactgt

SEQ ID NO: 363335 - DNA, 20 bp, Artificial
  CRISPR gRNA sequence
tctttcccttataaattacc

SEQ ID NO: 363336 - DNA, 20 bp, Artificial
  CRISPR gRNA sequence
cttataaattacccagtctt

SEQ ID NO: 363337 - DNA, 20 bp, Artificial
  CRISPR gRNA sequence
cagtcttaagtatttcttca

SEQ ID NO: 363338 - DNA, 20 bp, Artificial
  CRISPR gRNA sequence
tcttaagtatttcttcacag

SEQ ID NO: 363339 - DNA, 20 bp, Artificial
  CRISPR gRNA sequence
gtatttcttcacagcagtgt

SEQ ID NO: 363340 - DNA, 20 bp, Artificial
  CRISPR gRNA sequence
tcttcacagcagtgtgagaa

SEQ ID NO: 363341 - DNA, 20 bp, Artificial
  CRISPR gRNA sequence
aatagactaatacatcatgt

SEQ ID NO: 363342 - DNA, 20 bp, Artificial
  CRISPR gRNA sequence
atctccatgtatatacacat

SEQ ID NO: 363343 - DNA, 20 bp, Artificial
  CRISPR gRNA sequence
acacattggttctctttctc

SEQ ID NO: 363344 - DNA, 20 bp, Artificial
  CRISPR gRNA sequence
acattggttctctttctctg

SEQ ID NO: 363345 - DNA, 20 bp, Artificial
  CRISPR gRNA sequence
ttggttctctttctctggag

SEQ ID NO: 363346 - DNA, 20 bp, Artificial
  CRISPR gRNA sequence
gagaagcctgactaaaataa

SEQ ID NO: 363347 - DNA, 20 bp, Artificial
  CRISPR gRNA sequence
gaagcctgactaaaataata

SEQ ID NO: 363348 - DNA, 20 bp, Artificial
  CRISPR gRNA sequence
ataccaattaatcctcctgc

SEQ ID NO: 363349 - DNA, 20 bp, Artificial
  CRISPR gRNA sequence
ccaattaatcctcctgctag

SEQ ID NO: 363350 - DNA, 20 bp, Artificial
  CRISPR gRNA sequence
cctcctgctagcagtgtgta

SEQ ID NO: 363351 - DNA, 20 bp, Artificial
  CRISPR gRNA sequence
ctcctgctagcagtgtgtaa

SEQ ID NO: 363352 - DNA, 20 bp, Artificial
  CRISPR gRNA sequence
tgtgtaaaggttccaatcta

SEQ ID NO: 363353 - DNA, 20 bp, Artificial
  CRISPR gRNA sequence
gcaaactcttactctcctaa

SEQ ID NO: 363354 - DNA, 20 bp, Artificial
  CRISPR gRNA sequence
cttactctcctaaaagactg

SEQ ID NO: 363355 - DNA, 20 bp, Artificial
  CRISPR gRNA sequence
ctctcctaaaagactgcagc

SEQ ID NO: 363356 - DNA, 20 bp, Artificial
  CRISPR gRNA sequence
ctgcagctagtgtaatcttt

SEQ ID NO: 363357 - DNA, 20 bp, Artificial
  CRISPR gRNA sequence
tgcagctagtgtaatctttt

SEQ ID NO: 363358 - DNA, 20 bp, Artificial
  CRISPR gRNA sequence
agctagtgtaatcttttagg

SEQ ID NO: 363359 - DNA, 20 bp, Artificial
  CRISPR gRNA sequence
tgtaatcttttaggtggtga

SEQ ID NO: 363360 - DNA, 20 bp, Artificial
  CRISPR gRNA sequence
taggtggtgaaagaaaaatc

SEQ ID NO: 363361 - DNA, 20 bp, Artificial
  CRISPR gRNA sequence
ttgtgtgtctctctaaaaac

SEQ ID NO: 363362 - DNA, 20 bp, Artificial
  CRISPR gRNA sequence
gtgtctctctaaaaactagt

SEQ ID NO: 363363 - DNA, 20 bp, Artificial
  CRISPR gRNA sequence
gtctctctaaaaactagtca

SEQ ID NO: 363364 - DNA, 20 bp, Artificial
  CRISPR gRNA sequence
aactagtcagagatgtcccc

SEQ ID NO: 363365 - DNA, 20 bp, Artificial
  CRISPR gRNA sequence
atgtcccctggtctgcatta

SEQ ID NO: 363366 - DNA, 20 bp, Artificial
  CRISPR gRNA sequence
cccctggtctgcattacaga

SEQ ID NO: 363367 - DNA, 20 bp, Artificial
  CRISPR gRNA sequence
ctggtctgcattacagacag

SEQ ID NO: 363368 - DNA, 20 bp, Artificial
  CRISPR gRNA sequence
gacagaagtcaaaattccat

SEQ ID NO: 363369 - DNA, 20 bp, Artificial
  CRISPR gRNA sequence
acagaagtcaaaattccatt

SEQ ID NO: 363370 - DNA, 20 bp, Artificial
  CRISPR gRNA sequence
taggcacatcaataactttt

SEQ ID NO: 363371 - DNA, 20 bp, Artificial
  CRISPR gRNA sequence
aggcacatcaataacttttc

SEQ ID NO: 363372 - DNA, 20 bp, Artificial
  CRISPR gRNA sequence
tttctgacattctgctgccc

SEQ ID NO: 363373 - DNA, 20 bp, Artificial
  CRISPR gRNA sequence
tgacattctgctgccctagt

SEQ ID NO: 363374 - DNA, 20 bp, Artificial
  CRISPR gRNA sequence
tgagctgcaactcctttttc

SEQ ID NO: 363375 - DNA, 20 bp, Artificial
  CRISPR gRNA sequence
tgcaactcctttttcaagca

SEQ ID NO: 363376 - DNA, 20 bp, Artificial
  CRISPR gRNA sequence
gcacagaatctactgtacta

SEQ ID NO: 363377 - DNA, 20 bp, Artificial
  CRISPR gRNA sequence
aagcttttcctgaaactcta

SEQ ID NO: 363378 - DNA, 20 bp, Artificial
  CRISPR gRNA sequence
ctgaaactctaaagtatcat

SEQ ID NO: 363379 - DNA, 20 bp, Artificial
  CRISPR gRNA sequence
actctaaagtatcataagct

SEQ ID NO: 363380 - DNA, 20 bp, Artificial
  CRISPR gRNA sequence
cataagctgagcccctttgc

SEQ ID NO: 363381 - DNA, 20 bp, Artificial
  CRISPR gRNA sequence
agcccctttgctggtgcatg

SEQ ID NO: 363382 - DNA, 20 bp, Artificial
  CRISPR gRNA sequence
gcccctttgctggtgcatgc

SEQ ID NO: 363383 - DNA, 20 bp, Artificial
  CRISPR gRNA sequence
cccctttgctggtgcatgca

SEQ ID NO: 363384 - DNA, 20 bp, Artificial
  CRISPR gRNA sequence
cctttgctggtgcatgcagg

SEQ ID NO: 363385 - DNA, 20 bp, Artificial
  CRISPR gRNA sequence
tttgctggtgcatgcaggga

SEQ ID NO: 363386 - DNA, 20 bp, Artificial
  CRISPR gRNA sequence
tgctggtgcatgcagggaga

SEQ ID NO: 363387 - DNA, 20 bp, Artificial
  CRISPR gRNA sequence
gggagagagtctcactctca

SEQ ID NO: 363388 - DNA, 20 bp, Artificial
  CRISPR gRNA sequence
ctcacagtgtcttcctttcc

SEQ ID NO: 363389 - DNA, 20 bp, Artificial
  CRISPR gRNA sequence
tcacagtgtcttcctttcct

SEQ ID NO: 363390 - DNA, 20 bp, Artificial
  CRISPR gRNA sequence
acagtgtcttcctttcctgg

SEQ ID NO: 363391 - DNA, 20 bp, Artificial
  CRISPR gRNA sequence
cagtgtcttcctttcctggg

SEQ ID NO: 363392 - DNA, 20 bp, Artificial
  CRISPR gRNA sequence
tttcctgggaggctgcctct

SEQ ID NO: 363393 - DNA, 20 bp, Artificial
  CRISPR gRNA sequence
ttcctgggaggctgcctctc

SEQ ID NO: 363394 - DNA, 20 bp, Artificial
  CRISPR gRNA sequence
tgcctctcaggccacctctg

SEQ ID NO: 363395 - DNA, 20 bp, Artificial
  CRISPR gRNA sequence
gcctctcaggccacctctgt

SEQ ID NO: 363396 - DNA, 20 bp, Artificial
  CRISPR gRNA sequence
tcaggccacctctgtgggtg

SEQ ID NO: 363397 - DNA, 20 bp, Artificial
  CRISPR gRNA sequence
caggccacctctgtgggtgt

SEQ ID NO: 363398 - DNA, 20 bp, Artificial
  CRISPR gRNA sequence
aggccacctctgtgggtgta

SEQ ID NO: 363399 - DNA, 20 bp, Artificial
  CRISPR gRNA sequence
ggccacctctgtgggtgtag

SEQ ID NO: 363400 - DNA, 20 bp, Artificial
  CRISPR gRNA sequence
gccacctctgtgggtgtagg

SEQ ID NO: 363401 - DNA, 20 bp, Artificial
  CRISPR gRNA sequence
tctgtgggtgtagggggcct

SEQ ID NO: 363402 - DNA, 20 bp, Artificial
  CRISPR gRNA sequence
tgtgggtgtagggggcctca

SEQ ID NO: 363403 - DNA, 20 bp, Artificial
  CRISPR gRNA sequence
gtgtagggggcctcagagcc

SEQ ID NO: 363404 - DNA, 20 bp, Artificial
  CRISPR gRNA sequence
tgtagggggcctcagagccc

SEQ ID NO: 363405 - DNA, 20 bp, Artificial
  CRISPR gRNA sequence
gtagggggcctcagagccca

SEQ ID NO: 363406 - DNA, 20 bp, Artificial
  CRISPR gRNA sequence
ggggcctcagagcccagggt

SEQ ID NO: 363407 - DNA, 20 bp, Artificial
  CRISPR gRNA sequence
aaccacatcttatccaaatc

SEQ ID NO: 363408 - DNA, 20 bp, Artificial
  CRISPR gRNA sequence
cttatccaaatccagtgccc

SEQ ID NO: 363409 - DNA, 20 bp, Artificial
  CRISPR gRNA sequence
tccaaatccagtgccctagt

SEQ ID NO: 363410 - DNA, 20 bp, Artificial
  CRISPR gRNA sequence
caaatccagtgccctagtca

SEQ ID NO: 363411 - DNA, 20 bp, Artificial
  CRISPR gRNA sequence
atccagtgccctagtcagag

SEQ ID NO: 363412 - DNA, 20 bp, Artificial
  CRISPR gRNA sequence
tccagtgccctagtcagaga

SEQ ID NO: 363413 - DNA, 20 bp, Artificial
  CRISPR gRNA sequence
gtgccctagtcagagaaggc

SEQ ID NO: 363414 - DNA, 20 bp, Artificial
  CRISPR gRNA sequence
tgccctagtcagagaaggcc

SEQ ID NO: 363415 - DNA, 20 bp, Artificial
  CRISPR gRNA sequence
cctccactgtgcccttcttt

SEQ ID NO: 363416 - DNA, 20 bp, Artificial
  CRISPR gRNA sequence
tgtgcccttctttaagccat

SEQ ID NO: 363417 - DNA, 20 bp, Artificial
  CRISPR gRNA sequence
ctttaagccatcagtacccc

SEQ ID NO: 363418 - DNA, 20 bp, Artificial
  CRISPR gRNA sequence
tttaagccatcagtaccccc

SEQ ID NO: 363419 - DNA, 20 bp, Artificial
  CRISPR gRNA sequence
tctctgtcttctctcttccc

SEQ ID NO: 363420 - DNA, 20 bp, Artificial
  CRISPR gRNA sequence
cttctctcttccccagaccc

SEQ ID NO: 363421 - DNA, 20 bp, Artificial
  CRISPR gRNA sequence
aatattccttccaattcttc

SEQ ID NO: 363422 - DNA, 20 bp, Artificial
  CRISPR gRNA sequence
atattccttccaattcttca

SEQ ID NO: 363423 - DNA, 20 bp, Artificial
  CRISPR gRNA sequence
ccttccaattcttcaaggtc

SEQ ID NO: 363424 - DNA, 20 bp, Artificial
  CRISPR gRNA sequence
agcacgacttttctctacca

SEQ ID NO: 363425 - DNA, 20 bp, Artificial
  CRISPR gRNA sequence
ttctctaccatggccctccc

SEQ ID NO: 363426 - DNA, 20 bp, Artificial
  CRISPR gRNA sequence
ccctccctggttcattccac

SEQ ID NO: 363427 - DNA, 20 bp, Artificial
  CRISPR gRNA sequence
ctccctggttcattccactg

SEQ ID NO: 363428 - DNA, 20 bp, Artificial
  CRISPR gRNA sequence
tggttcattccactggagtt

SEQ ID NO: 363429 - DNA, 20 bp, Artificial
  CRISPR gRNA sequence
tccactggagttaagatctc

SEQ ID NO: 363430 - DNA, 20 bp, Artificial
  CRISPR gRNA sequence
agttaagatctctggctctt

SEQ ID NO: 363431 - DNA, 20 bp, Artificial
  CRISPR gRNA sequence
ggctcttcagaaaaatcaac

SEQ ID NO: 363432 - DNA, 20 bp, Artificial
  CRISPR gRNA sequence
gctcttcagaaaaatcaact

SEQ ID NO: 363433 - DNA, 20 bp, Artificial
  CRISPR gRNA sequence
ctcttcagaaaaatcaactg

SEQ ID NO: 363434 - DNA, 20 bp, Artificial
  CRISPR gRNA sequence
aaaatcaactggggtcattc

SEQ ID NO: 363435 - DNA, 20 bp, Artificial
  CRISPR gRNA sequence
gtcattctggtgctgccact

SEQ ID NO: 363436 - DNA, 20 bp, Artificial
  CRISPR gRNA sequence
attctggtgctgccacttgg

SEQ ID NO: 363437 - DNA, 20 bp, Artificial
  CRISPR gRNA sequence
acttggcagcttgataacct

SEQ ID NO: 363438 - DNA, 20 bp, Artificial
  CRISPR gRNA sequence
gcagcttgataaccttggac

SEQ ID NO: 363439 - DNA, 20 bp, Artificial
  CRISPR gRNA sequence
cttgataaccttggacaagt

SEQ ID NO: 363440 - DNA, 20 bp, Artificial
  CRISPR gRNA sequence
gagtctaccaccctgaacct

SEQ ID NO: 363441 - DNA, 20 bp, Artificial
  CRISPR gRNA sequence
cagtgtcttctgttgtatta

SEQ ID NO: 363442 - DNA, 20 bp, Artificial
  CRISPR gRNA sequence
agtgtcttctgttgtattac

SEQ ID NO: 363443 - DNA, 20 bp, Artificial
  CRISPR gRNA sequence
gggaacatattacctcccca

SEQ ID NO: 363444 - DNA, 20 bp, Artificial
  CRISPR gRNA sequence
acctccccatagtgcttcat

SEQ ID NO: 363445 - DNA, 20 bp, Artificial
  CRISPR gRNA sequence
cctccccatagtgcttcata

SEQ ID NO: 363446 - DNA, 20 bp, Artificial
  CRISPR gRNA sequence
ggattaaatgaaatgacacg

SEQ ID NO: 363447 - DNA, 20 bp, Artificial
  CRISPR gRNA sequence
tgacacgcagttgcatccta

SEQ ID NO: 363448 - DNA, 20 bp, Artificial
  CRISPR gRNA sequence
acacgcagttgcatcctaca

SEQ ID NO: 363449 - DNA, 20 bp, Artificial
  CRISPR gRNA sequence
cgcagttgcatcctacagag

SEQ ID NO: 363450 - DNA, 20 bp, Artificial
  CRISPR gRNA sequence
gcagttgcatcctacagagc

SEQ ID NO: 363451 - DNA, 20 bp, Artificial
  CRISPR gRNA sequence
catcctacagagcaggcacc

SEQ ID NO: 363452 - DNA, 20 bp, Artificial
  CRISPR gRNA sequence
agcaggcacccagtaaacac

SEQ ID NO: 363453 - DNA, 20 bp, Artificial
  CRISPR gRNA sequence
gcaggcacccagtaaacact

SEQ ID NO: 363454 - DNA, 20 bp, Artificial
  CRISPR gRNA sequence
ggcacccagtaaacactagg

SEQ ID NO: 363455 - DNA, 20 bp, Artificial
  CRISPR gRNA sequence
acccagtaaacactaggtgg

SEQ ID NO: 363456 - DNA, 20 bp, Artificial
  CRISPR gRNA sequence
ccagtaaacactaggtggca

SEQ ID NO: 363457 - DNA, 20 bp, Artificial
  CRISPR gRNA sequence
actaggtggcagagcattct

SEQ ID NO: 363458 - DNA, 20 bp, Artificial
  CRISPR gRNA sequence
aggtggcagagcattctgag

SEQ ID NO: 363459 - DNA, 20 bp, Artificial
  CRISPR gRNA sequence
ggtggcagagcattctgagt

SEQ ID NO: 363460 - DNA, 20 bp, Artificial
  CRISPR gRNA sequence
tctgagtgggtcactcattt

SEQ ID NO: 363461 - DNA, 20 bp, Artificial
  CRISPR gRNA sequence
ctgagtgggtcactcatttt

SEQ ID NO: 363462 - DNA, 20 bp, Artificial
  CRISPR gRNA sequence
tgagtgggtcactcattttg

SEQ ID NO: 363463 - DNA, 20 bp, Artificial
  CRISPR gRNA sequence
gagtgggtcactcattttgg

SEQ ID NO: 363464 - DNA, 20 bp, Artificial
  CRISPR gRNA sequence
tttgctttaactgactaata

SEQ ID NO: 363465 - DNA, 20 bp, Artificial
  CRISPR gRNA sequence
ctttaactgactaataaagc

SEQ ID NO: 363466 - DNA, 20 bp, Artificial
  CRISPR gRNA sequence
ttaactgactaataaagcca

SEQ ID NO: 363467 - DNA, 20 bp, Artificial
  CRISPR gRNA sequence
ctaataaagccagagacacg

SEQ ID NO: 363468 - DNA, 20 bp, Artificial
  CRISPR gRNA sequence
taataaagccagagacacgt

SEQ ID NO: 363469 - DNA, 20 bp, Artificial
  CRISPR gRNA sequence
agccagagacacgtaggtga

SEQ ID NO: 363470 - DNA, 20 bp, Artificial
  CRISPR gRNA sequence
cagagacacgtaggtgacag

SEQ ID NO: 363471 - DNA, 20 bp, Artificial
  CRISPR gRNA sequence
catgacctcacaaactctgc

SEQ ID NO: 363472 - DNA, 20 bp, Artificial
  CRISPR gRNA sequence
acctcacaaactctgctaga

SEQ ID NO: 363473 - DNA, 20 bp, Artificial
  CRISPR gRNA sequence
cctcacaaactctgctagaa

SEQ ID NO: 363474 - DNA, 20 bp, Artificial
  CRISPR gRNA sequence
ctcacaaactctgctagaaa

SEQ ID NO: 363475 - DNA, 20 bp, Artificial
  CRISPR gRNA sequence
ctctgctagaaagggctatc

SEQ ID NO: 363476 - DNA, 20 bp, Artificial
  CRISPR gRNA sequence
aaagggctatctggaaaatg

SEQ ID NO: 363477 - DNA, 20 bp, Artificial
  CRISPR gRNA sequence
tctggaaaatgtggtccccc

SEQ ID NO: 363478 - DNA, 20 bp, Artificial
  CRISPR gRNA sequence
ctgcatattttctcacaaac

SEQ ID NO: 363479 - DNA, 20 bp, Artificial
  CRISPR gRNA sequence
tgcatattttctcacaaact

SEQ ID NO: 363480 - DNA, 20 bp, Artificial
  CRISPR gRNA sequence
aatgcatttattcttaccat

SEQ ID NO: 363481 - DNA, 20 bp, Artificial
  CRISPR gRNA sequence
tgcatttattcttaccatca

SEQ ID NO: 363482 - DNA, 20 bp, Artificial
  CRISPR gRNA sequence
ctctaaatcaattgctaatg

SEQ ID NO: 363483 - DNA, 20 bp, Artificial
  CRISPR gRNA sequence
taatgaagaaatgcctgttc

SEQ ID NO: 363484 - DNA, 20 bp, Artificial
  CRISPR gRNA sequence
gaagaaatgcctgttctgga

SEQ ID NO: 363485 - DNA, 20 bp, Artificial
  CRISPR gRNA sequence
attttcaaataactttgtat

SEQ ID NO: 363486 - DNA, 20 bp, Artificial
  CRISPR gRNA sequence
ttcaaataactttgtattag

SEQ ID NO: 363487 - DNA, 20 bp, Artificial
  CRISPR gRNA sequence
tattagtagtaccatttatt

SEQ ID NO: 363488 - DNA, 20 bp, Artificial
  CRISPR gRNA sequence
tagtaccatttattcagaat

SEQ ID NO: 363489 - DNA, 20 bp, Artificial
  CRISPR gRNA sequence
tcctgtttgctcttaaactc

SEQ ID NO: 363490 - DNA, 20 bp, Artificial
  CRISPR gRNA sequence
cctgtttgctcttaaactct

SEQ ID NO: 363491 - DNA, 20 bp, Artificial
  CRISPR gRNA sequence
gctcttaaactctaggctga

SEQ ID NO: 363492 - DNA, 20 bp, Artificial
  CRISPR gRNA sequence
ttaaactctaggctgaaagc

SEQ ID NO: 363493 - DNA, 20 bp, Artificial
  CRISPR gRNA sequence
aaactctaggctgaaagctg

SEQ ID NO: 363494 - DNA, 20 bp, Artificial
  CRISPR gRNA sequence
actctaggctgaaagctgga

SEQ ID NO: 363495 - DNA, 20 bp, Artificial
  CRISPR gRNA sequence
ctctaggctgaaagctggag

SEQ ID NO: 363496 - DNA, 20 bp, Artificial
  CRISPR gRNA sequence
tctaggctgaaagctggaga

SEQ ID NO: 363497 - DNA, 20 bp, Artificial
  CRISPR gRNA sequence
ctaggctgaaagctggagag

SEQ ID NO: 363498 - DNA, 20 bp, Artificial
  CRISPR gRNA sequence
ggctgaaagctggagagggg

SEQ ID NO: 363499 - DNA, 20 bp, Artificial
  CRISPR gRNA sequence
ctggagaggggtagcattga

SEQ ID NO: 363500 - DNA, 20 bp, Artificial
  CRISPR gRNA sequence
tggagaggggtagcattgat

SEQ ID NO: 363501 - DNA, 20 bp, Artificial
  CRISPR gRNA sequence
gagaggggtagcattgatag

SEQ ID NO: 363502 - DNA, 20 bp, Artificial
  CRISPR gRNA sequence
agaggggtagcattgatagg

SEQ ID NO: 363503 - DNA, 20 bp, Artificial
  CRISPR gRNA sequence
tagcattgataggaggtaca

SEQ ID NO: 363504 - DNA, 20 bp, Artificial
  CRISPR gRNA sequence
agcattgataggaggtacaa

SEQ ID NO: 363505 - DNA, 20 bp, Artificial
  CRISPR gRNA sequence
tgataggaggtacaaaggcc

SEQ ID NO: 363506 - DNA, 20 bp, Artificial
  CRISPR gRNA sequence
gataggaggtacaaaggcca

SEQ ID NO: 363507 - DNA, 20 bp, Artificial
  CRISPR gRNA sequence
aggccaaggtctccttcttc

SEQ ID NO: 363508 - DNA, 20 bp, Artificial
  CRISPR gRNA sequence
ggccaaggtctccttcttca

SEQ ID NO: 363509 - DNA, 20 bp, Artificial
  CRISPR gRNA sequence
gccaaggtctccttcttcaa

SEQ ID NO: 363510 - DNA, 20 bp, Artificial
  CRISPR gRNA sequence
gtctccttcttcaagggccc

SEQ ID NO: 363511 - DNA, 20 bp, Artificial
  CRISPR gRNA sequence
tccttcttcaagggccctgg

SEQ ID NO: 363512 - DNA, 20 bp, Artificial
  CRISPR gRNA sequence
ccttcttcaagggccctggt

SEQ ID NO: 363513 - DNA, 20 bp, Artificial
  CRISPR gRNA sequence
tggtgggttcccatgtcccc

SEQ ID NO: 363514 - DNA, 20 bp, Artificial
  CRISPR gRNA sequence
ggtgggttcccatgtccccc

SEQ ID NO: 363515 - DNA, 20 bp, Artificial
  CRISPR gRNA sequence
tcccatgtcccccaggctga

SEQ ID NO: 363516 - DNA, 20 bp, Artificial
  CRISPR gRNA sequence
caatttgcaactttatctgc

SEQ ID NO: 363517 - DNA, 20 bp, Artificial
  CRISPR gRNA sequence
aatttgcaactttatctgct

SEQ ID NO: 363518 - DNA, 20 bp, Artificial
  CRISPR gRNA sequence
gctgggacatacgtgaaact

SEQ ID NO: 363519 - DNA, 20 bp, Artificial
  CRISPR gRNA sequence
ctgggacatacgtgaaactt

SEQ ID NO: 363520 - DNA, 20 bp, Artificial
  CRISPR gRNA sequence
tgggacatacgtgaaactta

SEQ ID NO: 363521 - DNA, 20 bp, Artificial
  CRISPR gRNA sequence
atacgtgaaacttagggcct

SEQ ID NO: 363522 - DNA, 20 bp, Artificial
  CRISPR gRNA sequence
gtgaaacttagggccttgga

SEQ ID NO: 363523 - DNA, 20 bp, Artificial
  CRISPR gRNA sequence
tagggccttggaaagactac

SEQ ID NO: 363524 - DNA, 20 bp, Artificial
  CRISPR gRNA sequence
aatgtcatcatctgtaaaat

SEQ ID NO: 363525 - DNA, 20 bp, Artificial
  CRISPR gRNA sequence
atgtcatcatctgtaaaatc

SEQ ID NO: 363526 - DNA, 20 bp, Artificial
  CRISPR gRNA sequence
atcaggcaatacaaacgttc

SEQ ID NO: 363527 - DNA, 20 bp, Artificial
  CRISPR gRNA sequence
tacaaacgttcaagtgcaca

SEQ ID NO: 363528 - DNA, 20 bp, Artificial
  CRISPR gRNA sequence
acaaacgttcaagtgcacac

SEQ ID NO: 363529 - DNA, 20 bp, Artificial
  CRISPR gRNA sequence
aaacgttcaagtgcacacag

SEQ ID NO: 363530 - DNA, 20 bp, Artificial
  CRISPR gRNA sequence
caagtgcacacaggagattc

SEQ ID NO: 363531 - DNA, 20 bp, Artificial
  CRISPR gRNA sequence
aagtgcacacaggagattca

SEQ ID NO: 363532 - DNA, 20 bp, Artificial
  CRISPR gRNA sequence
gtgcacacaggagattcaag

SEQ ID NO: 363533 - DNA, 20 bp, Artificial
  CRISPR gRNA sequence
tgcacacaggagattcaagg

SEQ ID NO: 363534 - DNA, 20 bp, Artificial
  CRISPR gRNA sequence
acacaggagattcaaggagg

SEQ ID NO: 363535 - DNA, 20 bp, Artificial
  CRISPR gRNA sequence
attcaaggaggaagtctatg

SEQ ID NO: 363536 - DNA, 20 bp, Artificial
  CRISPR gRNA sequence
ggaggaagtctatgaagatc

SEQ ID NO: 363537 - DNA, 20 bp, Artificial
  CRISPR gRNA sequence
tgtaaaattccgcacataat

SEQ ID NO: 363538 - DNA, 20 bp, Artificial
  CRISPR gRNA sequence
cataataagctatcaataaa

SEQ ID NO: 363539 - DNA, 20 bp, Artificial
  CRISPR gRNA sequence
gcaaaaaatcaacatattta

SEQ ID NO: 363540 - DNA, 20 bp, Artificial
  CRISPR gRNA sequence
aaaaaatcaacatatttaca

SEQ ID NO: 363541 - DNA, 20 bp, Artificial
  CRISPR gRNA sequence
atcaacatatttacagagca

SEQ ID NO: 363542 - DNA, 20 bp, Artificial
  CRISPR gRNA sequence
tcaacatatttacagagcat

SEQ ID NO: 363543 - DNA, 20 bp, Artificial
  CRISPR gRNA sequence
caacatatttacagagcata

SEQ ID NO: 363544 - DNA, 20 bp, Artificial
  CRISPR gRNA sequence
ccaactccttcatccttctg

SEQ ID NO: 363545 - DNA, 20 bp, Artificial
  CRISPR gRNA sequence
ttacaatccattatacaaac

SEQ ID NO: 363546 - DNA, 20 bp, Artificial
  CRISPR gRNA sequence
tacaatccattatacaaact

SEQ ID NO: 363547 - DNA, 20 bp, Artificial
  CRISPR gRNA sequence
attatacaaactaggatttc

SEQ ID NO: 363548 - DNA, 20 bp, Artificial
  CRISPR gRNA sequence
aactaggatttctagattcc

SEQ ID NO: 363549 - DNA, 20 bp, Artificial
  CRISPR gRNA sequence
tattttcaactcccccttta

SEQ ID NO: 363550 - DNA, 20 bp, Artificial
  CRISPR gRNA sequence
tccccctttacagtatacaa

SEQ ID NO: 363551 - DNA, 20 bp, Artificial
  CRISPR gRNA sequence
aagtacaatatttgcaatcc

SEQ ID NO: 363552 - DNA, 20 bp, Artificial
  CRISPR gRNA sequence
atcccagtatgttgttactg

SEQ ID NO: 363553 - DNA, 20 bp, Artificial
  CRISPR gRNA sequence
atgttgttactgaagtacat

SEQ ID NO: 363554 - DNA, 20 bp, Artificial
  CRISPR gRNA sequence
gaagtacataagaaaatttc

SEQ ID NO: 363555 - DNA, 20 bp, Artificial
  CRISPR gRNA sequence
agaaaatttcaagcacacct

SEQ ID NO: 363556 - DNA, 20 bp, Artificial
  CRISPR gRNA sequence
gaaaatttcaagcacaccta

SEQ ID NO: 363557 - DNA, 20 bp, Artificial
  CRISPR gRNA sequence
tttaaactcactatcattct

SEQ ID NO: 363558 - DNA, 20 bp, Artificial
  CRISPR gRNA sequence
ctatcattcttagtttaaaa

SEQ ID NO: 363559 - DNA, 20 bp, Artificial
  CRISPR gRNA sequence
attcttagtttaaaaaagtg

SEQ ID NO: 363560 - DNA, 20 bp, Artificial
  CRISPR gRNA sequence
aagctctcaaactctcaaaa

SEQ ID NO: 363561 - DNA, 20 bp, Artificial
  CRISPR gRNA sequence
agctctcaaactctcaaaat

SEQ ID NO: 363562 - DNA, 20 bp, Artificial
  CRISPR gRNA sequence
gctctcaaactctcaaaata

SEQ ID NO: 363563 - DNA, 20 bp, Artificial
  CRISPR gRNA sequence
ctcaaactctcaaaataggg

SEQ ID NO: 363564 - DNA, 20 bp, Artificial
  CRISPR gRNA sequence
atagggtagaatgccctcac

SEQ ID NO: 363565 - DNA, 20 bp, Artificial
  CRISPR gRNA sequence
aaaatacaaataatcaaaac

SEQ ID NO: 363566 - DNA, 20 bp, Artificial
  CRISPR gRNA sequence
aatacaaataatcaaaacaa

SEQ ID NO: 363567 - DNA, 20 bp, Artificial
  CRISPR gRNA sequence
aataatcaaaacaagagcaa

SEQ ID NO: 363568 - DNA, 20 bp, Artificial
  CRISPR gRNA sequence
aaaacaagagcaatggatca

SEQ ID NO: 363569 - DNA, 20 bp, Artificial
  CRISPR gRNA sequence
aagagcaatggatcatggct

SEQ ID NO: 363570 - DNA, 20 bp, Artificial
  CRISPR gRNA sequence
agagcaatggatcatggcta

SEQ ID NO: 363571 - DNA, 20 bp, Artificial
  CRISPR gRNA sequence
tggctaaggataccatcatg

SEQ ID NO: 363572 - DNA, 20 bp, Artificial
  CRISPR gRNA sequence
ccatcatgaagaattcaaac

SEQ ID NO: 363573 - DNA, 20 bp, Artificial
  CRISPR gRNA sequence
catgaagaattcaaactaga

SEQ ID NO: 363574 - DNA, 20 bp, Artificial
  CRISPR gRNA sequence
aagaattcaaactagacgga

SEQ ID NO: 363575 - DNA, 20 bp, Artificial
  CRISPR gRNA sequence
attcaaactagacggacagc

SEQ ID NO: 363576 - DNA, 20 bp, Artificial
  CRISPR gRNA sequence
tctccacattgtattttttt

SEQ ID NO: 363577 - DNA, 20 bp, Artificial
  CRISPR gRNA sequence
gtatttttttaagccccatg

SEQ ID NO: 363578 - DNA, 20 bp, Artificial
  CRISPR gRNA sequence
tatttttttaagccccatga

SEQ ID NO: 363579 - DNA, 20 bp, Artificial
  CRISPR gRNA sequence
tttaagccccatgaaggtga

SEQ ID NO: 363580 - DNA, 20 bp, Artificial
  CRISPR gRNA sequence
cttttcctaacctcaaaaac

SEQ ID NO: 363581 - DNA, 20 bp, Artificial
  CRISPR gRNA sequence
ttcctaacctcaaaaactag

SEQ ID NO: 363582 - DNA, 20 bp, Artificial
  CRISPR gRNA sequence
actagcagtaatgacaaatc

SEQ ID NO: 363583 - DNA, 20 bp, Artificial
  CRISPR gRNA sequence
acaaatctggatgaaaacaa

SEQ ID NO: 363584 - DNA, 20 bp, Artificial
  CRISPR gRNA sequence
caaatctggatgaaaacaac

SEQ ID NO: 363585 - DNA, 20 bp, Artificial
  CRISPR gRNA sequence
aaacaacaggaaatattccg

SEQ ID NO: 363586 - DNA, 20 bp, Artificial
  CRISPR gRNA sequence
tttgcataacaaccatcatt

SEQ ID NO: 363587 - DNA, 20 bp, Artificial
  CRISPR gRNA sequence
aaccatcatttagttctcta

SEQ ID NO: 363588 - DNA, 20 bp, Artificial
  CRISPR gRNA sequence
accatcatttagttctctac

SEQ ID NO: 363589 - DNA, 20 bp, Artificial
  CRISPR gRNA sequence
tcatttagttctctacaggt

SEQ ID NO: 363590 - DNA, 20 bp, Artificial
  CRISPR gRNA sequence
agctccatcctctatcctga

SEQ ID NO: 363591 - DNA, 20 bp, Artificial
  CRISPR gRNA sequence
gctccatcctctatcctgaa

SEQ ID NO: 363592 - DNA, 20 bp, Artificial
  CRISPR gRNA sequence
atcctctatcctgaaaggtt

SEQ ID NO: 363593 - DNA, 20 bp, Artificial
  CRISPR gRNA sequence
aaggttgagctgttttcaat

SEQ ID NO: 363594 - DNA, 20 bp, Artificial
  CRISPR gRNA sequence
ttcaattggttgtcctgtga

SEQ ID NO: 363595 - DNA, 20 bp, Artificial
  CRISPR gRNA sequence
tcctgtgacagaaaccaaaa

SEQ ID NO: 363596 - DNA, 20 bp, Artificial
  CRISPR gRNA sequence
agaaaccaaaacagctaatt

SEQ ID NO: 363597 - DNA, 20 bp, Artificial
  CRISPR gRNA sequence
aatttggaacccaaacttta

SEQ ID NO: 363598 - DNA, 20 bp, Artificial
  CRISPR gRNA sequence
atttggaacccaaactttaa

SEQ ID NO: 363599 - DNA, 20 bp, Artificial
  CRISPR gRNA sequence
actttaaaggcataccacac

SEQ ID NO: 363600 - DNA, 20 bp, Artificial
  CRISPR gRNA sequence
ctttaaaggcataccacaca

SEQ ID NO: 363601 - DNA, 20 bp, Artificial
  CRISPR gRNA sequence
taaaggcataccacacaagg

SEQ ID NO: 363602 - DNA, 20 bp, Artificial
  CRISPR gRNA sequence
aggcataccacacaaggcag

SEQ ID NO: 363603 - DNA, 20 bp, Artificial
  CRISPR gRNA sequence
cataccacacaaggcagcag

SEQ ID NO: 363604 - DNA, 20 bp, Artificial
  CRISPR gRNA sequence
ataccacacaaggcagcagt

SEQ ID NO: 363605 - DNA, 20 bp, Artificial
  CRISPR gRNA sequence
taccacacaaggcagcagtg

SEQ ID NO: 363606 - DNA, 20 bp, Artificial
  CRISPR gRNA sequence
ccacacaaggcagcagtggg

SEQ ID NO: 363607 - DNA, 20 bp, Artificial
  CRISPR gRNA sequence
gtggggagtgcatcctgttc

SEQ ID NO: 363608 - DNA, 20 bp, Artificial
  CRISPR gRNA sequence
agtgcatcctgttctagctt

SEQ ID NO: 363609 - DNA, 20 bp, Artificial
  CRISPR gRNA sequence
gcatcctgttctagctttgg

SEQ ID NO: 363610 - DNA, 20 bp, Artificial
  CRISPR gRNA sequence
ctgttctagctttggtggct

SEQ ID NO: 363611 - DNA, 20 bp, Artificial
  CRISPR gRNA sequence
tgttctagctttggtggctc

SEQ ID NO: 363612 - DNA, 20 bp, Artificial
  CRISPR gRNA sequence
ggctcaggccttgtttccaa

SEQ ID NO: 363613 - DNA, 20 bp, Artificial
  CRISPR gRNA sequence
aggccttgtttccaatggct

SEQ ID NO: 363614 - DNA, 20 bp, Artificial
  CRISPR gRNA sequence
aatggctcagtctatgttaa

SEQ ID NO: 363615 - DNA, 20 bp, Artificial
  CRISPR gRNA sequence
tcgcctgcctgactgattta

SEQ ID NO: 363616 - DNA, 20 bp, Artificial
  CRISPR gRNA sequence
ctgatttatagcaaactaca

SEQ ID NO: 363617 - DNA, 20 bp, Artificial
  CRISPR gRNA sequence
actacacagtaaaaacttcc

SEQ ID NO: 363618 - DNA, 20 bp, Artificial
  CRISPR gRNA sequence
acacagtaaaaacttccaag

SEQ ID NO: 363619 - DNA, 20 bp, Artificial
  CRISPR gRNA sequence
cacagtaaaaacttccaagc

SEQ ID NO: 363620 - DNA, 20 bp, Artificial
  CRISPR gRNA sequence
aacttccaagcaggatttaa

SEQ ID NO: 363621 - DNA, 20 bp, Artificial
  CRISPR gRNA sequence
acttccaagcaggatttaac

SEQ ID NO: 363622 - DNA, 20 bp, Artificial
  CRISPR gRNA sequence
taacaggtgtctacatacaa

SEQ ID NO: 363623 - DNA, 20 bp, Artificial
  CRISPR gRNA sequence
gtctacatacaacagcaaat

SEQ ID NO: 363624 - DNA, 20 bp, Artificial
  CRISPR gRNA sequence
tctacatacaacagcaaatg

SEQ ID NO: 363625 - DNA, 20 bp, Artificial
  CRISPR gRNA sequence
acagcaaatgaggacttgta

SEQ ID NO: 363626 - DNA, 20 bp, Artificial
  CRISPR gRNA sequence
tgaggacttgtatggtgaaa

SEQ ID NO: 363627 - DNA, 20 bp, Artificial
  CRISPR gRNA sequence
aggacttgtatggtgaaaca

SEQ ID NO: 363628 - DNA, 20 bp, Artificial
  CRISPR gRNA sequence
aataaataaacatttaacta

SEQ ID NO: 363629 - DNA, 20 bp, Artificial
  CRISPR gRNA sequence
attgtaaattgacactctat

SEQ ID NO: 363630 - DNA, 20 bp, Artificial
  CRISPR gRNA sequence
aattgacactctataagcct

SEQ ID NO: 363631 - DNA, 20 bp, Artificial
  CRISPR gRNA sequence
ctcagctatatacacaaaat

SEQ ID NO: 363632 - DNA, 20 bp, Artificial
  CRISPR gRNA sequence
cacaaaattagtcttcaccc

SEQ ID NO: 363633 - DNA, 20 bp, Artificial
  CRISPR gRNA sequence
cttcaccctagctacaccta

SEQ ID NO: 363634 - DNA, 20 bp, Artificial
  CRISPR gRNA sequence
tcaccctagctacacctaaa

SEQ ID NO: 363635 - DNA, 20 bp, Artificial
  CRISPR gRNA sequence
cctagctacacctaaagaga

SEQ ID NO: 363636 - DNA, 20 bp, Artificial
  CRISPR gRNA sequence
ctagctacacctaaagagaa

SEQ ID NO: 363637 - DNA, 20 bp, Artificial
  CRISPR gRNA sequence
tagctacacctaaagagaaa

SEQ ID NO: 363638 - DNA, 20 bp, Artificial
  CRISPR gRNA sequence
aagggaaaactaaatatatg

SEQ ID NO: 363639 - DNA, 20 bp, Artificial
  CRISPR gRNA sequence
taattctgtacttgttcttt

SEQ ID NO: 363640 - DNA, 20 bp, Artificial
  CRISPR gRNA sequence
attctgtacttgttctttta

SEQ ID NO: 363641 - DNA, 20 bp, Artificial
  CRISPR gRNA sequence
gtacttgttcttttagagca

SEQ ID NO: 363642 - DNA, 20 bp, Artificial
  CRISPR gRNA sequence
gcacagatcccttaaaaata

SEQ ID NO: 363643 - DNA, 20 bp, Artificial
  CRISPR gRNA sequence
aaaataaagcactattatgt

SEQ ID NO: 363644 - DNA, 20 bp, Artificial
  CRISPR gRNA sequence
ataaaatgttcttctctgta

SEQ ID NO: 363645 - DNA, 20 bp, Artificial
  CRISPR gRNA sequence
gttcttctctgtacagccat

SEQ ID NO: 363646 - DNA, 20 bp, Artificial
  CRISPR gRNA sequence
tacagccatgagtataattt

SEQ ID NO: 363647 - DNA, 20 bp, Artificial
  CRISPR gRNA sequence
cagccatgagtataatttga

SEQ ID NO: 363648 - DNA, 20 bp, Artificial
  CRISPR gRNA sequence
taatttgagagacaccacac

SEQ ID NO: 363649 - DNA, 20 bp, Artificial
  CRISPR gRNA sequence
gacaccacacaagaaacaca

SEQ ID NO: 363650 - DNA, 20 bp, Artificial
  CRISPR gRNA sequence
tccaaaaatattccctgctt

SEQ ID NO: 363651 - DNA, 20 bp, Artificial
  CRISPR gRNA sequence
atatctgaaaatttcattat

SEQ ID NO: 363652 - DNA, 20 bp, Artificial
  CRISPR gRNA sequence
aatttcattattagtccttt

SEQ ID NO: 363653 - DNA, 20 bp, Artificial
  CRISPR gRNA sequence
tattagtccttttggatcac

SEQ ID NO: 363654 - DNA, 20 bp, Artificial
  CRISPR gRNA sequence
gtccttttggatcacaagca

SEQ ID NO: 363655 - DNA, 20 bp, Artificial
  CRISPR gRNA sequence
tccttttggatcacaagcat

SEQ ID NO: 363656 - DNA, 20 bp, Artificial
  CRISPR gRNA sequence
tcacaagcataggaaataat

SEQ ID NO: 363657 - DNA, 20 bp, Artificial
  CRISPR gRNA sequence
gtatcattctctgactacca

SEQ ID NO: 363658 - DNA, 20 bp, Artificial
  CRISPR gRNA sequence
ttctctgactaccatggacc

SEQ ID NO: 363659 - DNA, 20 bp, Artificial
  CRISPR gRNA sequence
tctttaaatatatcgtccct

SEQ ID NO: 363660 - DNA, 20 bp, Artificial
  CRISPR gRNA sequence
tcgtccctcagccattcaac

SEQ ID NO: 363661 - DNA, 20 bp, Artificial
  CRISPR gRNA sequence
tccctcagccattcaacaag

SEQ ID NO: 363662 - DNA, 20 bp, Artificial
  CRISPR gRNA sequence
cagccattcaacaagtagaa

SEQ ID NO: 363663 - DNA, 20 bp, Artificial
  CRISPR gRNA sequence
taccaaccccatttcctctt

SEQ ID NO: 363664 - DNA, 20 bp, Artificial
  CRISPR gRNA sequence
accaaccccatttcctcttc

SEQ ID NO: 363665 - DNA, 20 bp, Artificial
  CRISPR gRNA sequence
catttcctcttcaggaacct

SEQ ID NO: 363666 - DNA, 20 bp, Artificial
  CRISPR gRNA sequence
ctcttcaggaacctgagatt

SEQ ID NO: 363667 - DNA, 20 bp, Artificial
  CRISPR gRNA sequence
cttcaggaacctgagattca

SEQ ID NO: 363668 - DNA, 20 bp, Artificial
  CRISPR gRNA sequence
ttcaggaacctgagattcag

SEQ ID NO: 363669 - DNA, 20 bp, Artificial
  CRISPR gRNA sequence
tcaggaacctgagattcaga

SEQ ID NO: 363670 - DNA, 20 bp, Artificial
  CRISPR gRNA sequence
acctgagattcagagggatc

SEQ ID NO: 363671 - DNA, 20 bp, Artificial
  CRISPR gRNA sequence
agggatcgagcaactaacac

SEQ ID NO: 363672 - DNA, 20 bp, Artificial
  CRISPR gRNA sequence
gggatcgagcaactaacacc

SEQ ID NO: 363673 - DNA, 20 bp, Artificial
  CRISPR gRNA sequence
agcaactaacaccaggttga

SEQ ID NO: 363674 - DNA, 20 bp, Artificial
  CRISPR gRNA sequence
actaacaccaggttgatgga

SEQ ID NO: 363675 - DNA, 20 bp, Artificial
  CRISPR gRNA sequence
aaagtgatgactataaaccc

SEQ ID NO: 363676 - DNA, 20 bp, Artificial
  CRISPR gRNA sequence
tgtttccaatatactacaac

SEQ ID NO: 363677 - DNA, 20 bp, Artificial
  CRISPR gRNA sequence
tatactacaaccagttcatg

SEQ ID NO: 363678 - DNA, 20 bp, Artificial
  CRISPR gRNA sequence
ccagttcatgtagtcatcac

SEQ ID NO: 363679 - DNA, 20 bp, Artificial
  CRISPR gRNA sequence
ttcatgtagtcatcactaga

SEQ ID NO: 363680 - DNA, 20 bp, Artificial
  CRISPR gRNA sequence
aaagacaaaaccacaatctc

SEQ ID NO: 363681 - DNA, 20 bp, Artificial
  CRISPR gRNA sequence
gacaaaaccacaatctctgg

SEQ ID NO: 363682 - DNA, 20 bp, Artificial
  CRISPR gRNA sequence
accacaatctctggtagata

SEQ ID NO: 363683 - DNA, 20 bp, Artificial
  CRISPR gRNA sequence
gataaagcaaaaaacactcc

SEQ ID NO: 363684 - DNA, 20 bp, Artificial
  CRISPR gRNA sequence
ataaagcaaaaaacactcca

SEQ ID NO: 363685 - DNA, 20 bp, Artificial
  CRISPR gRNA sequence
taaagcaaaaaacactccaa

SEQ ID NO: 363686 - DNA, 20 bp, Artificial
  CRISPR gRNA sequence
aaaacactccaagggatcat

SEQ ID NO: 363687 - DNA, 20 bp, Artificial
  CRISPR gRNA sequence
aaacactccaagggatcatt

SEQ ID NO: 363688 - DNA, 20 bp, Artificial
  CRISPR gRNA sequence
ttgggttctttctgacacca

SEQ ID NO: 363689 - DNA, 20 bp, Artificial
  CRISPR gRNA sequence
accacagctcacaatttatg

SEQ ID NO: 363690 - DNA, 20 bp, Artificial
  CRISPR gRNA sequence
cagctcacaatttatgaaga

SEQ ID NO: 363691 - DNA, 20 bp, Artificial
  CRISPR gRNA sequence
tatgaagaaagtgtcctctc

SEQ ID NO: 363692 - DNA, 20 bp, Artificial
  CRISPR gRNA sequence
gtgtcctctctagctaaacc

SEQ ID NO: 363693 - DNA, 20 bp, Artificial
  CRISPR gRNA sequence
ctctctagctaaacctggat

SEQ ID NO: 363694 - DNA, 20 bp, Artificial
  CRISPR gRNA sequence
tctctagctaaacctggatg

SEQ ID NO: 363695 - DNA, 20 bp, Artificial
  CRISPR gRNA sequence
gctaaacctggatgaggtga

SEQ ID NO: 363696 - DNA, 20 bp, Artificial
  CRISPR gRNA sequence
aacctggatgaggtgaaaga

SEQ ID NO: 363697 - DNA, 20 bp, Artificial
  CRISPR gRNA sequence
cctggatgaggtgaaagata

SEQ ID NO: 363698 - DNA, 20 bp, Artificial
  CRISPR gRNA sequence
gatgaggtgaaagatagagc

SEQ ID NO: 363699 - DNA, 20 bp, Artificial
  CRISPR gRNA sequence
atgaggtgaaagatagagcc

SEQ ID NO: 363700 - DNA, 20 bp, Artificial
  CRISPR gRNA sequence
tgaggtgaaagatagagcca

SEQ ID NO: 363701 - DNA, 20 bp, Artificial
  CRISPR gRNA sequence
tgaaagatagagccagggcc

SEQ ID NO: 363702 - DNA, 20 bp, Artificial
  CRISPR gRNA sequence
gatagagccagggccaagct

SEQ ID NO: 363703 - DNA, 20 bp, Artificial
  CRISPR gRNA sequence
agagccagggccaagcttgg

SEQ ID NO: 363704 - DNA, 20 bp, Artificial
  CRISPR gRNA sequence
ccaagcttggtggttcatgc

SEQ ID NO: 363705 - DNA, 20 bp, Artificial
  CRISPR gRNA sequence
gtggttcatgccagtaatcc

SEQ ID NO: 363706 - DNA, 20 bp, Artificial
  CRISPR gRNA sequence
tgccagtaatcctggcactc

SEQ ID NO: 363707 - DNA, 20 bp, Artificial
  CRISPR gRNA sequence
gccagtaatcctggcactct

SEQ ID NO: 363708 - DNA, 20 bp, Artificial
  CRISPR gRNA sequence
cagtaatcctggcactctgg

SEQ ID NO: 363709 - DNA, 20 bp, Artificial
  CRISPR gRNA sequence
agtaatcctggcactctggg

SEQ ID NO: 363710 - DNA, 20 bp, Artificial
  CRISPR gRNA sequence
tcctggcactctgggaggcc

SEQ ID NO: 363711 - DNA, 20 bp, Artificial
  CRISPR gRNA sequence
cctggcactctgggaggccg

SEQ ID NO: 363712 - DNA, 20 bp, Artificial
  CRISPR gRNA sequence
ggcactctgggaggccgagg

SEQ ID NO: 363713 - DNA, 20 bp, Artificial
  CRISPR gRNA sequence
ctctgggaggccgaggcagt

SEQ ID NO: 363714 - DNA, 20 bp, Artificial
  CRISPR gRNA sequence
gcagttggatcacttgaact

SEQ ID NO: 363715 - DNA, 20 bp, Artificial
  CRISPR gRNA sequence
cagttggatcacttgaactc

SEQ ID NO: 363716 - DNA, 20 bp, Artificial
  CRISPR gRNA sequence
gttggatcacttgaactcag

SEQ ID NO: 363717 - DNA, 20 bp, Artificial
  CRISPR gRNA sequence
tcacttgaactcaggagtcc

SEQ ID NO: 363718 - DNA, 20 bp, Artificial
  CRISPR gRNA sequence
tgaactcaggagtccaagac

SEQ ID NO: 363719 - DNA, 20 bp, Artificial
  CRISPR gRNA sequence
tcaggagtccaagaccagcc

SEQ ID NO: 363720 - DNA, 20 bp, Artificial
  CRISPR gRNA sequence
caggagtccaagaccagcct

SEQ ID NO: 363721 - DNA, 20 bp, Artificial
  CRISPR gRNA sequence
tctacaaaaaatacaacaat

SEQ ID NO: 363722 - DNA, 20 bp, Artificial
  CRISPR gRNA sequence
aaaaaatacaacaatcagcc

SEQ ID NO: 363723 - DNA, 20 bp, Artificial
  CRISPR gRNA sequence
atacaacaatcagcctggca

SEQ ID NO: 363724 - DNA, 20 bp, Artificial
  CRISPR gRNA sequence
atcagcctggcatggtgtat

SEQ ID NO: 363725 - DNA, 20 bp, Artificial
  CRISPR gRNA sequence
ccgttttcaccctgctgatg

SEQ ID NO: 363726 - DNA, 20 bp, Artificial
  CRISPR gRNA sequence
ctgctgatgaagatattccc

SEQ ID NO: 363727 - DNA, 20 bp, Artificial
  CRISPR gRNA sequence
gatgaagatattcccaagac

SEQ ID NO: 363728 - DNA, 20 bp, Artificial
  CRISPR gRNA sequence
atgaagatattcccaagact

SEQ ID NO: 363729 - DNA, 20 bp, Artificial
  CRISPR gRNA sequence
caagactgggcaatttacaa

SEQ ID NO: 363730 - DNA, 20 bp, Artificial
  CRISPR gRNA sequence
actgggcaatttacaaaaga

SEQ ID NO: 363731 - DNA, 20 bp, Artificial
  CRISPR gRNA sequence
tgggcaatttacaaaagaaa

SEQ ID NO: 363732 - DNA, 20 bp, Artificial
  CRISPR gRNA sequence
gggcaatttacaaaagaaag

SEQ ID NO: 363733 - DNA, 20 bp, Artificial
  CRISPR gRNA sequence
acaaaagaaagaggtttaat

SEQ ID NO: 363734 - DNA, 20 bp, Artificial
  CRISPR gRNA sequence
aagaggtttaattggactta

SEQ ID NO: 363735 - DNA, 20 bp, Artificial
  CRISPR gRNA sequence
gacttacagcaccacatgtc

SEQ ID NO: 363736 - DNA, 20 bp, Artificial
  CRISPR gRNA sequence
acttacagcaccacatgtct

SEQ ID NO: 363737 - DNA, 20 bp, Artificial
  CRISPR gRNA sequence
cttacagcaccacatgtctg

SEQ ID NO: 363738 - DNA, 20 bp, Artificial
  CRISPR gRNA sequence
acagcaccacatgtctgggg

SEQ ID NO: 363739 - DNA, 20 bp, Artificial
  CRISPR gRNA sequence
tctggggaagcctcacaatc

SEQ ID NO: 363740 - DNA, 20 bp, Artificial
  CRISPR gRNA sequence
ctggggaagcctcacaatca

SEQ ID NO: 363741 - DNA, 20 bp, Artificial
  CRISPR gRNA sequence
gggaagcctcacaatcaagg

SEQ ID NO: 363742 - DNA, 20 bp, Artificial
  CRISPR gRNA sequence
aagcctcacaatcaaggtgg

SEQ ID NO: 363743 - DNA, 20 bp, Artificial
  CRISPR gRNA sequence
agcctcacaatcaaggtgga

SEQ ID NO: 363744 - DNA, 20 bp, Artificial
  CRISPR gRNA sequence
tcacaatcaaggtggaaggc

SEQ ID NO: 363745 - DNA, 20 bp, Artificial
  CRISPR gRNA sequence
cacaatcaaggtggaaggca

SEQ ID NO: 363746 - DNA, 20 bp, Artificial
  CRISPR gRNA sequence
caatcaaggtggaaggcaag

SEQ ID NO: 363747 - DNA, 20 bp, Artificial
  CRISPR gRNA sequence
tcaaggtggaaggcaaggag

SEQ ID NO: 363748 - DNA, 20 bp, Artificial
  CRISPR gRNA sequence
aggagaagtcacgtcttaca

SEQ ID NO: 363749 - DNA, 20 bp, Artificial
  CRISPR gRNA sequence
gaagtcacgtcttacatgga

SEQ ID NO: 363750 - DNA, 20 bp, Artificial
  CRISPR gRNA sequence
gtcacgtcttacatggatgg

SEQ ID NO: 363751 - DNA, 20 bp, Artificial
  CRISPR gRNA sequence
acgtcttacatggatggcag

SEQ ID NO: 363752 - DNA, 20 bp, Artificial
  CRISPR gRNA sequence
cgtcttacatggatggcagc

SEQ ID NO: 363753 - DNA, 20 bp, Artificial
  CRISPR gRNA sequence
catggatggcagcaggcaaa

SEQ ID NO: 363754 - DNA, 20 bp, Artificial
  CRISPR gRNA sequence
tggatggcagcaggcaaaca

SEQ ID NO: 363755 - DNA, 20 bp, Artificial
  CRISPR gRNA sequence
gatggcagcaggcaaacaga

SEQ ID NO: 363756 - DNA, 20 bp, Artificial
  CRISPR gRNA sequence
tggcagcaggcaaacagaga

SEQ ID NO: 363757 - DNA, 20 bp, Artificial
  CRISPR gRNA sequence
agcaggcaaacagagagagc

SEQ ID NO: 363758 - DNA, 20 bp, Artificial
  CRISPR gRNA sequence
gcaaacagagagagctagtg

SEQ ID NO: 363759 - DNA, 20 bp, Artificial
  CRISPR gRNA sequence
caaacagagagagctagtgc

SEQ ID NO: 363760 - DNA, 20 bp, Artificial
  CRISPR gRNA sequence
aaacagagagagctagtgca

SEQ ID NO: 363761 - DNA, 20 bp, Artificial
  CRISPR gRNA sequence
aacagagagagctagtgcag

SEQ ID NO: 363762 - DNA, 20 bp, Artificial
  CRISPR gRNA sequence
actcctcttttttaaaccat

SEQ ID NO: 363763 - DNA, 20 bp, Artificial
  CRISPR gRNA sequence
tttaaaccatcagatctcat

SEQ ID NO: 363764 - DNA, 20 bp, Artificial
  CRISPR gRNA sequence
tgagacttatgcactatcat

SEQ ID NO: 363765 - DNA, 20 bp, Artificial
  CRISPR gRNA sequence
gagacttatgcactatcatg

SEQ ID NO: 363766 - DNA, 20 bp, Artificial
  CRISPR gRNA sequence
cttatgcactatcatgagga

SEQ ID NO: 363767 - DNA, 20 bp, Artificial
  CRISPR gRNA sequence
gcactatcatgaggacagca

SEQ ID NO: 363768 - DNA, 20 bp, Artificial
  CRISPR gRNA sequence
cactatcatgaggacagcat

SEQ ID NO: 363769 - DNA, 20 bp, Artificial
  CRISPR gRNA sequence
atcatgaggacagcatggga

SEQ ID NO: 363770 - DNA, 20 bp, Artificial
  CRISPR gRNA sequence
acgattcaattacctcccac

SEQ ID NO: 363771 - DNA, 20 bp, Artificial
  CRISPR gRNA sequence
cgattcaattacctcccacc

SEQ ID NO: 363772 - DNA, 20 bp, Artificial
  CRISPR gRNA sequence
caggtccctcccacaacaca

SEQ ID NO: 363773 - DNA, 20 bp, Artificial
  CRISPR gRNA sequence
aggtccctcccacaacacat

SEQ ID NO: 363774 - DNA, 20 bp, Artificial
  CRISPR gRNA sequence
ggaattcaaaccatatcacg

SEQ ID NO: 363775 - DNA, 20 bp, Artificial
  CRISPR gRNA sequence
attcaaaccatatcacgtgg

SEQ ID NO: 363776 - DNA, 20 bp, Artificial
  CRISPR gRNA sequence
cacgtggcggtgcacacctg

SEQ ID NO: 363777 - DNA, 20 bp, Artificial
  CRISPR gRNA sequence
gcggtgcacacctgtagtcc

SEQ ID NO: 363778 - DNA, 20 bp, Artificial
  CRISPR gRNA sequence
cctgtagtcccagctacttg

SEQ ID NO: 363779 - DNA, 20 bp, Artificial
  CRISPR gRNA sequence
ctgtagtcccagctacttgc

SEQ ID NO: 363780 - DNA, 20 bp, Artificial
  CRISPR gRNA sequence
tgtagtcccagctacttgcg

SEQ ID NO: 363781 - DNA, 20 bp, Artificial
  CRISPR gRNA sequence
tcccagctacttgcggggct

SEQ ID NO: 363782 - DNA, 20 bp, Artificial
  CRISPR gRNA sequence
cccagctacttgcggggctg

SEQ ID NO: 363783 - DNA, 20 bp, Artificial
  CRISPR gRNA sequence
agctacttgcggggctgagg

SEQ ID NO: 363784 - DNA, 20 bp, Artificial
  CRISPR gRNA sequence
gctacttgcggggctgaggt

SEQ ID NO: 363785 - DNA, 20 bp, Artificial
  CRISPR gRNA sequence
tacttgcggggctgaggtag

SEQ ID NO: 363786 - DNA, 20 bp, Artificial
  CRISPR gRNA sequence
ctgaggtaggagaatcgctt

SEQ ID NO: 363787 - DNA, 20 bp, Artificial
  CRISPR gRNA sequence
gtaggagaatcgcttgagcc

SEQ ID NO: 363788 - DNA, 20 bp, Artificial
  CRISPR gRNA sequence
taggagaatcgcttgagccc

SEQ ID NO: 363789 - DNA, 20 bp, Artificial
  CRISPR gRNA sequence
ggagaatcgcttgagcccag

SEQ ID NO: 363790 - DNA, 20 bp, Artificial
  CRISPR gRNA sequence
aatcgcttgagcccaggagc

SEQ ID NO: 363791 - DNA, 20 bp, Artificial
  CRISPR gRNA sequence
tcgcttgagcccaggagctg

SEQ ID NO: 363792 - DNA, 20 bp, Artificial
  CRISPR gRNA sequence
cgcttgagcccaggagctgg

SEQ ID NO: 363793 - DNA, 20 bp, Artificial
  CRISPR gRNA sequence
agcccaggagctggaggttg

SEQ ID NO: 363794 - DNA, 20 bp, Artificial
  CRISPR gRNA sequence
caggagctggaggttgcagt

SEQ ID NO: 363795 - DNA, 20 bp, Artificial
  CRISPR gRNA sequence
gctggaggttgcagtgagcc

SEQ ID NO: 363796 - DNA, 20 bp, Artificial
  CRISPR gRNA sequence
aagatcatgctactgtactc

SEQ ID NO: 363797 - DNA, 20 bp, Artificial
  CRISPR gRNA sequence
catgctactgtactccagcc

SEQ ID NO: 363798 - DNA, 20 bp, Artificial
  CRISPR gRNA sequence
actgtactccagcctggtga

SEQ ID NO: 363799 - DNA, 20 bp, Artificial
  CRISPR gRNA sequence
tgtactccagcctggtgaca

SEQ ID NO: 363800 - DNA, 20 bp, Artificial
  CRISPR gRNA sequence
ctccagcctggtgacagagc

SEQ ID NO: 363801 - DNA, 20 bp, Artificial
  CRISPR gRNA sequence
aaaaaaaaaaaaaaaaaaaa

SEQ ID NO: 363802 - DNA, 20 bp, Artificial
  CRISPR gRNA sequence
aaaaaaaaaaaaaaaaaaag

SEQ ID NO: 363803 - DNA, 20 bp, Artificial
  CRISPR gRNA sequence
aaaaaaaaaaaaaaaaaaga

SEQ ID NO: 363804 - DNA, 20 bp, Artificial
  CRISPR gRNA sequence
aaaaaaaaaaaaaaagaagg

SEQ ID NO: 363805 - DNA, 20 bp, Artificial
  CRISPR gRNA sequence
aaaaaaaaaaaagaaggaag

SEQ ID NO: 363806 - DNA, 20 bp, Artificial
  CRISPR gRNA sequence
aaaaaaaagaaggaagaaga

SEQ ID NO: 363807 - DNA, 20 bp, Artificial
  CRISPR gRNA sequence
aaaagaaggaagaagaaaga

SEQ ID NO: 363808 - DNA, 20 bp, Artificial
  CRISPR gRNA sequence
gaaggaagaagaaagaaaga

SEQ ID NO: 363809 - DNA, 20 bp, Artificial
  CRISPR gRNA sequence
aaggaagaagaaagaaagac

SEQ ID NO: 363810 - DNA, 20 bp, Artificial
  CRISPR gRNA sequence
aagaagaaagaaagacagga

SEQ ID NO: 363811 - DNA, 20 bp, Artificial
  CRISPR gRNA sequence
agaaagaaagacaggaaaga

SEQ ID NO: 363812 - DNA, 20 bp, Artificial
  CRISPR gRNA sequence
gaaagaaagacaggaaagaa

SEQ ID NO: 363813 - DNA, 20 bp, Artificial
  CRISPR gRNA sequence
gaaagacaggaaagaaagga

SEQ ID NO: 363814 - DNA, 20 bp, Artificial
  CRISPR gRNA sequence
acaggaaagaaaggaaagaa

SEQ ID NO: 363815 - DNA, 20 bp, Artificial
  CRISPR gRNA sequence
gaaagaaaggaaagaaaaga

SEQ ID NO: 363816 - DNA, 20 bp, Artificial
  CRISPR gRNA sequence
gaaaggaaagaaaagaaaga

SEQ ID NO: 363817 - DNA, 20 bp, Artificial
  CRISPR gRNA sequence
aaggaaagaaaagaaagaaa

SEQ ID NO: 363818 - DNA, 20 bp, Artificial
  CRISPR gRNA sequence
ggaaagaaaagaaagaaaga

SEQ ID NO: 363819 - DNA, 20 bp, Artificial
  CRISPR gRNA sequence
aaagaaaagaaagaaagaga

SEQ ID NO: 363820 - DNA, 20 bp, Artificial
  CRISPR gRNA sequence
agaaaagaaagaaagagaga

SEQ ID NO: 363821 - DNA, 20 bp, Artificial
  CRISPR gRNA sequence
aaaagaaagaaagagagaga

SEQ ID NO: 363822 - DNA, 20 bp, Artificial
  CRISPR gRNA sequence
gaaagaaagagagagagaga

SEQ ID NO: 363823 - DNA, 20 bp, Artificial
  CRISPR gRNA sequence
gaaagagagagagagaaaga

SEQ ID NO: 363824 - DNA, 20 bp, Artificial
  CRISPR gRNA sequence
gagagagagagaaagaaaga

SEQ ID NO: 363825 - DNA, 20 bp, Artificial
  CRISPR gRNA sequence
gagagagagaaagaaagaaa

SEQ ID NO: 363826 - DNA, 20 bp, Artificial
  CRISPR gRNA sequence
gagaaagaaagaaagagaaa

SEQ ID NO: 363827 - DNA, 20 bp, Artificial
  CRISPR gRNA sequence
aagaaagaaagagaaaaaga

SEQ ID NO: 363828 - DNA, 20 bp, Artificial
  CRISPR gRNA sequence
aagaaagagaaaaagaaaga

SEQ ID NO: 363829 - DNA, 20 bp, Artificial
  CRISPR gRNA sequence
agaaagaaagaaaacaaact

SEQ ID NO: 363830 - DNA, 20 bp, Artificial
  CRISPR gRNA sequence
aaagaaaacaaacttagatt

SEQ ID NO: 363831 - DNA, 20 bp, Artificial
  CRISPR gRNA sequence
caaacttagatttggtactg

SEQ ID NO: 363832 - DNA, 20 bp, Artificial
  CRISPR gRNA sequence
aaacttagatttggtactgt

SEQ ID NO: 363833 - DNA, 20 bp, Artificial
  CRISPR gRNA sequence
cttagatttggtactgtagg

SEQ ID NO: 363834 - DNA, 20 bp, Artificial
  CRISPR gRNA sequence
taggaagaaccttgaacaca

SEQ ID NO: 363835 - DNA, 20 bp, Artificial
  CRISPR gRNA sequence
aggaagaaccttgaacacac

SEQ ID NO: 363836 - DNA, 20 bp, Artificial
  CRISPR gRNA sequence
ggaagaaccttgaacacaca

SEQ ID NO: 363837 - DNA, 20 bp, Artificial
  CRISPR gRNA sequence
gaagaaccttgaacacacag

SEQ ID NO: 363838 - DNA, 20 bp, Artificial
  CRISPR gRNA sequence
tgaacacacaggggttgatg

SEQ ID NO: 363839 - DNA, 20 bp, Artificial
  CRISPR gRNA sequence
gaacacacaggggttgatgt

SEQ ID NO: 363840 - DNA, 20 bp, Artificial
  CRISPR gRNA sequence
acaggggttgatgtgggtgc

SEQ ID NO: 363841 - DNA, 20 bp, Artificial
  CRISPR gRNA sequence
aggggttgatgtgggtgctg

SEQ ID NO: 363842 - DNA, 20 bp, Artificial
  CRISPR gRNA sequence
gatgtgggtgctggagtgtc

SEQ ID NO: 363843 - DNA, 20 bp, Artificial
  CRISPR gRNA sequence
gtgggtgctggagtgtccag

SEQ ID NO: 363844 - DNA, 20 bp, Artificial
  CRISPR gRNA sequence
ggtgctggagtgtccagcag

SEQ ID NO: 363845 - DNA, 20 bp, Artificial
  CRISPR gRNA sequence
gtgctggagtgtccagcaga

SEQ ID NO: 363846 - DNA, 20 bp, Artificial
  CRISPR gRNA sequence
tgctggagtgtccagcagaa

SEQ ID NO: 363847 - DNA, 20 bp, Artificial
  CRISPR gRNA sequence
gagtgtccagcagaagggaa

SEQ ID NO: 363848 - DNA, 20 bp, Artificial
  CRISPR gRNA sequence
tcactgtgataaaaccctga

SEQ ID NO: 363849 - DNA, 20 bp, Artificial
  CRISPR gRNA sequence
cactgtgataaaaccctgaa

SEQ ID NO: 363850 - DNA, 20 bp, Artificial
  CRISPR gRNA sequence
aacccatgtgttgccaacat

SEQ ID NO: 363851 - DNA, 20 bp, Artificial
  CRISPR gRNA sequence
ttgccaacatcagtttaatc

SEQ ID NO: 363852 - DNA, 20 bp, Artificial
  CRISPR gRNA sequence
tgccaacatcagtttaatca

SEQ ID NO: 363853 - DNA, 20 bp, Artificial
  CRISPR gRNA sequence
acatcagtttaatcaaggct

SEQ ID NO: 363854 - DNA, 20 bp, Artificial
  CRISPR gRNA sequence
catcagtttaatcaaggctc

SEQ ID NO: 363855 - DNA, 20 bp, Artificial
  CRISPR gRNA sequence
tcaaggctcaggttatcatt

SEQ ID NO: 363856 - DNA, 20 bp, Artificial
  CRISPR gRNA sequence
tctactacattcaaatttga

SEQ ID NO: 363857 - DNA, 20 bp, Artificial
  CRISPR gRNA sequence
ctactacattcaaatttgaa

SEQ ID NO: 363858 - DNA, 20 bp, Artificial
  CRISPR gRNA sequence
atttgaaaggcacttctact

SEQ ID NO: 363859 - DNA, 20 bp, Artificial
  CRISPR gRNA sequence
gcacttctactcggacacaa

SEQ ID NO: 363860 - DNA, 20 bp, Artificial
  CRISPR gRNA sequence
tctactcggacacaacagca

SEQ ID NO: 363861 - DNA, 20 bp, Artificial
  CRISPR gRNA sequence
ctcggacacaacagcacagt

SEQ ID NO: 363862 - DNA, 20 bp, Artificial
  CRISPR gRNA sequence
gcacagtcagaaaaatgaaa

SEQ ID NO: 363863 - DNA, 20 bp, Artificial
  CRISPR gRNA sequence
gaaaaatgaaacagactccc

SEQ ID NO: 363864 - DNA, 20 bp, Artificial
  CRISPR gRNA sequence
ctcccaagattgctccttca

SEQ ID NO: 363865 - DNA, 20 bp, Artificial
  CRISPR gRNA sequence
ccaagattgctccttcaaag

SEQ ID NO: 363866 - DNA, 20 bp, Artificial
  CRISPR gRNA sequence
ccttcaaagcagtaacatca

SEQ ID NO: 363867 - DNA, 20 bp, Artificial
  CRISPR gRNA sequence
agcagtaacatcaaagcatc

SEQ ID NO: 363868 - DNA, 20 bp, Artificial
  CRISPR gRNA sequence
aacatcaaagcatctagaaa

SEQ ID NO: 363869 - DNA, 20 bp, Artificial
  CRISPR gRNA sequence
aaagcatctagaaatggaat

SEQ ID NO: 363870 - DNA, 20 bp, Artificial
  CRISPR gRNA sequence
agcatctagaaatggaattg

SEQ ID NO: 363871 - DNA, 20 bp, Artificial
  CRISPR gRNA sequence
aatggaattggagaatgcca

SEQ ID NO: 363872 - DNA, 20 bp, Artificial
  CRISPR gRNA sequence
ggagaatgccacagaaatac

SEQ ID NO: 363873 - DNA, 20 bp, Artificial
  CRISPR gRNA sequence
gaatgccacagaaatacgag

SEQ ID NO: 363874 - DNA, 20 bp, Artificial
  CRISPR gRNA sequence
aaatacgagaagacattcta

SEQ ID NO: 363875 - DNA, 20 bp, Artificial
  CRISPR gRNA sequence
gacattctatagcttctact

SEQ ID NO: 363876 - DNA, 20 bp, Artificial
  CRISPR gRNA sequence
acattctatagcttctactt

SEQ ID NO: 363877 - DNA, 20 bp, Artificial
  CRISPR gRNA sequence
tagcttctacttgggcttta

SEQ ID NO: 363878 - DNA, 20 bp, Artificial
  CRISPR gRNA sequence
tttatagaaataaatgttgt

SEQ ID NO: 363879 - DNA, 20 bp, Artificial
  CRISPR gRNA sequence
atagaaataaatgttgtaag

SEQ ID NO: 363880 - DNA, 20 bp, Artificial
  CRISPR gRNA sequence
aaatgttgtaagtggataaa

SEQ ID NO: 363881 - DNA, 20 bp, Artificial
  CRISPR gRNA sequence
aatgttgtaagtggataaaa

SEQ ID NO: 363882 - DNA, 20 bp, Artificial
  CRISPR gRNA sequence
atgttgtaagtggataaaaa

SEQ ID NO: 363883 - DNA, 20 bp, Artificial
  CRISPR gRNA sequence
cacctgtatcaccttctgcc

SEQ ID NO: 363884 - DNA, 20 bp, Artificial
  CRISPR gRNA sequence
accttctgccaagttccctg

SEQ ID NO: 363885 - DNA, 20 bp, Artificial
  CRISPR gRNA sequence
ccttctgccaagttccctgt

SEQ ID NO: 363886 - DNA, 20 bp, Artificial
  CRISPR gRNA sequence
ctgccaagttccctgtgggt

SEQ ID NO: 363887 - DNA, 20 bp, Artificial
  CRISPR gRNA sequence
gttccctgtgggtaagtgta

SEQ ID NO: 363888 - DNA, 20 bp, Artificial
  CRISPR gRNA sequence
tccctgtgggtaagtgtaaa

SEQ ID NO: 363889 - DNA, 20 bp, Artificial
  CRISPR gRNA sequence
cctgtgggtaagtgtaaaga

SEQ ID NO: 363890 - DNA, 20 bp, Artificial
  CRISPR gRNA sequence
gtgggtaagtgtaaagagag

SEQ ID NO: 363891 - DNA, 20 bp, Artificial
  CRISPR gRNA sequence
tgggtaagtgtaaagagagc

SEQ ID NO: 363892 - DNA, 20 bp, Artificial
  CRISPR gRNA sequence
aagtgtaaagagagcaggaa

SEQ ID NO: 363893 - DNA, 20 bp, Artificial
  CRISPR gRNA sequence
tgtaaagagagcaggaatag

SEQ ID NO: 363894 - DNA, 20 bp, Artificial
  CRISPR gRNA sequence
atagtagccaacatcatctt

SEQ ID NO: 363895 - DNA, 20 bp, Artificial
  CRISPR gRNA sequence
agtagccaacatcatcttca

SEQ ID NO: 363896 - DNA, 20 bp, Artificial
  CRISPR gRNA sequence
gtagccaacatcatcttcag

SEQ ID NO: 363897 - DNA, 20 bp, Artificial
  CRISPR gRNA sequence
catcttcagaggcattccga

SEQ ID NO: 363898 - DNA, 20 bp, Artificial
  CRISPR gRNA sequence
tcagaggcattccgaaagaa

SEQ ID NO: 363899 - DNA, 20 bp, Artificial
  CRISPR gRNA sequence
agaggcattccgaaagaaaa

SEQ ID NO: 363900 - DNA, 20 bp, Artificial
  CRISPR gRNA sequence
aaagaaaagagtcatgttat

SEQ ID NO: 363901 - DNA, 20 bp, Artificial
  CRISPR gRNA sequence
gaaaagagtcatgttattgg

SEQ ID NO: 363902 - DNA, 20 bp, Artificial
  CRISPR gRNA sequence
aagccatcgttgaattcaaa

SEQ ID NO: 363903 - DNA, 20 bp, Artificial
  CRISPR gRNA sequence
attcaaaaagtaaaccctct

SEQ ID NO: 363904 - DNA, 20 bp, Artificial
  CRISPR gRNA sequence
aaaagtaaaccctctcagca

SEQ ID NO: 363905 - DNA, 20 bp, Artificial
  CRISPR gRNA sequence
aaagtaaaccctctcagcat

SEQ ID NO: 363906 - DNA, 20 bp, Artificial
  CRISPR gRNA sequence
aagtaaaccctctcagcata

SEQ ID NO: 363907 - DNA, 20 bp, Artificial
  CRISPR gRNA sequence
cttccttatgaccatgccat

SEQ ID NO: 363908 - DNA, 20 bp, Artificial
  CRISPR gRNA sequence
ccttatgaccatgccatgag

SEQ ID NO: 363909 - DNA, 20 bp, Artificial
  CRISPR gRNA sequence
cttatgaccatgccatgagt

SEQ ID NO: 363910 - DNA, 20 bp, Artificial
  CRISPR gRNA sequence
ttatgaccatgccatgagta

SEQ ID NO: 363911 - DNA, 20 bp, Artificial
  CRISPR gRNA sequence
gccatgagtagggctgaaaa

SEQ ID NO: 363912 - DNA, 20 bp, Artificial
  CRISPR gRNA sequence
agtagggctgaaaatggcta

SEQ ID NO: 363913 - DNA, 20 bp, Artificial
  CRISPR gRNA sequence
aaatggctatggaatcctgc

SEQ ID NO: 363914 - DNA, 20 bp, Artificial
  CRISPR gRNA sequence
aatggctatggaatcctgct

SEQ ID NO: 363915 - DNA, 20 bp, Artificial
  CRISPR gRNA sequence
tgaaccactccacctgtgtt

SEQ ID NO: 363916 - DNA, 20 bp, Artificial
  CRISPR gRNA sequence
tgtgttaagatgcccattga

SEQ ID NO: 363917 - DNA, 20 bp, Artificial
  CRISPR gRNA sequence
attgatggatacacacattc

SEQ ID NO: 363918 - DNA, 20 bp, Artificial
  CRISPR gRNA sequence
tgatggatacacacattcta

SEQ ID NO: 363919 - DNA, 20 bp, Artificial
  CRISPR gRNA sequence
acattctagagacatgttct

SEQ ID NO: 363920 - DNA, 20 bp, Artificial
  CRISPR gRNA sequence
ctagagacatgttctcggca

SEQ ID NO: 363921 - DNA, 20 bp, Artificial
  CRISPR gRNA sequence
tagagacatgttctcggcaa

SEQ ID NO: 363922 - DNA, 20 bp, Artificial
  CRISPR gRNA sequence
agagacatgttctcggcaaa

SEQ ID NO: 363923 - DNA, 20 bp, Artificial
  CRISPR gRNA sequence
aagggaactgatgtatgcca

SEQ ID NO: 363924 - DNA, 20 bp, Artificial
  CRISPR gRNA sequence
tgccaaagcacctcttcaca

SEQ ID NO: 363925 - DNA, 20 bp, Artificial
  CRISPR gRNA sequence
ccaaagcacctcttcacata

SEQ ID NO: 363926 - DNA, 20 bp, Artificial
  CRISPR gRNA sequence
tacaacatcacattaattgt

SEQ ID NO: 363927 - DNA, 20 bp, Artificial
  CRISPR gRNA sequence
ttaattgttagccttgatga

SEQ ID NO: 363928 - DNA, 20 bp, Artificial
  CRISPR gRNA sequence
aaacaccaaatcaatatctt

SEQ ID NO: 363929 - DNA, 20 bp, Artificial
  CRISPR gRNA sequence
atcaatatcttaagcttttg

SEQ ID NO: 363930 - DNA, 20 bp, Artificial
  CRISPR gRNA sequence
atcttaagcttttgaagacc

SEQ ID NO: 363931 - DNA, 20 bp, Artificial
  CRISPR gRNA sequence
ttttgaagacctagtgcatt

SEQ ID NO: 363932 - DNA, 20 bp, Artificial
  CRISPR gRNA sequence
gacctagtgcattgagatca

SEQ ID NO: 363933 - DNA, 20 bp, Artificial
  CRISPR gRNA sequence
agtgcattgagatcacagta

SEQ ID NO: 363934 - DNA, 20 bp, Artificial
  CRISPR gRNA sequence
gtgcattgagatcacagtaa

SEQ ID NO: 363935 - DNA, 20 bp, Artificial
  CRISPR gRNA sequence
gagatcacagtaaaggctga

SEQ ID NO: 363936 - DNA, 20 bp, Artificial
  CRISPR gRNA sequence
agtttctgcctttgtctaaa

SEQ ID NO: 363937 - DNA, 20 bp, Artificial
  CRISPR gRNA sequence
gtttctgcctttgtctaaaa

SEQ ID NO: 363938 - DNA, 20 bp, Artificial
  CRISPR gRNA sequence
aaaggcgtcctgctgataat

SEQ ID NO: 363939 - DNA, 20 bp, Artificial
  CRISPR gRNA sequence
taattggaaaatgtaacttt

SEQ ID NO: 363940 - DNA, 20 bp, Artificial
  CRISPR gRNA sequence
aacttttagtttttctgaac

SEQ ID NO: 363941 - DNA, 20 bp, Artificial
  CRISPR gRNA sequence
tttagtttttctgaacaagt

SEQ ID NO: 363942 - DNA, 20 bp, Artificial
  CRISPR gRNA sequence
gaacaagtgagaaattatcc

SEQ ID NO: 363943 - DNA, 20 bp, Artificial
  CRISPR gRNA sequence
gaaattatcctagccaacta

SEQ ID NO: 363944 - DNA, 20 bp, Artificial
  CRISPR gRNA sequence
aattatcctagccaactaaa

SEQ ID NO: 363945 - DNA, 20 bp, Artificial
  CRISPR gRNA sequence
ccacactgtacaaacaaaaa

SEQ ID NO: 363946 - DNA, 20 bp, Artificial
  CRISPR gRNA sequence
cacactgtacaaacaaaaac

SEQ ID NO: 363947 - DNA, 20 bp, Artificial
  CRISPR gRNA sequence
cactgtacaaacaaaaacag

SEQ ID NO: 363948 - DNA, 20 bp, Artificial
  CRISPR gRNA sequence
aacttttaaatgaaaatata

SEQ ID NO: 363949 - DNA, 20 bp, Artificial
  CRISPR gRNA sequence
tctttacctctgtatacatg

SEQ ID NO: 363950 - DNA, 20 bp, Artificial
  CRISPR gRNA sequence
ttacctctgtatacatgaag

SEQ ID NO: 363951 - DNA, 20 bp, Artificial
  CRISPR gRNA sequence
acctctgtatacatgaagaa

SEQ ID NO: 363952 - DNA, 20 bp, Artificial
  CRISPR gRNA sequence
tatacatgaagaagagccaa

SEQ ID NO: 363953 - DNA, 20 bp, Artificial
  CRISPR gRNA sequence
atgaagaagagccaaaagta

SEQ ID NO: 363954 - DNA, 20 bp, Artificial
  CRISPR gRNA sequence
aagaagagccaaaagtaaag

SEQ ID NO: 363955 - DNA, 20 bp, Artificial
  CRISPR gRNA sequence
agaagagccaaaagtaaagt

SEQ ID NO: 363956 - DNA, 20 bp, Artificial
  CRISPR gRNA sequence
aaagtaggataatccatctc

SEQ ID NO: 363957 - DNA, 20 bp, Artificial
  CRISPR gRNA sequence
catctctggaaactgtttga

SEQ ID NO: 363958 - DNA, 20 bp, Artificial
  CRISPR gRNA sequence
atctctggaaactgtttgaa

SEQ ID NO: 363959 - DNA, 20 bp, Artificial
  CRISPR gRNA sequence
ctggaaactgtttgaaaggc

SEQ ID NO: 363960 - DNA, 20 bp, Artificial
  CRISPR gRNA sequence
gctttttataatgtgacatg

SEQ ID NO: 363961 - DNA, 20 bp, Artificial
  CRISPR gRNA sequence
taatgtgacatgcagatccc

SEQ ID NO: 363962 - DNA, 20 bp, Artificial
  CRISPR gRNA sequence
tgcagatccccagcacaatg

SEQ ID NO: 363963 - DNA, 20 bp, Artificial
  CRISPR gRNA sequence
caatgcagtttccttcctct

SEQ ID NO: 363964 - DNA, 20 bp, Artificial
  CRISPR gRNA sequence
tccttcctctcagatgttat

SEQ ID NO: 363965 - DNA, 20 bp, Artificial
  CRISPR gRNA sequence
agtcgtgtcttctttttctg

SEQ ID NO: 363966 - DNA, 20 bp, Artificial
  CRISPR gRNA sequence
ctttttctgaagtatgaaca

SEQ ID NO: 363967 - DNA, 20 bp, Artificial
  CRISPR gRNA sequence
tttttctgaagtatgaacac

SEQ ID NO: 363968 - DNA, 20 bp, Artificial
  CRISPR gRNA sequence
tgaagtatgaacacaggaaa

SEQ ID NO: 363969 - DNA, 20 bp, Artificial
  CRISPR gRNA sequence
gaagtatgaacacaggaaaa

SEQ ID NO: 363970 - DNA, 20 bp, Artificial
  CRISPR gRNA sequence
tgaacacaggaaaaaggcct

SEQ ID NO: 363971 - DNA, 20 bp, Artificial
  CRISPR gRNA sequence
ggaaaaaggccttagcttaa

SEQ ID NO: 363972 - DNA, 20 bp, Artificial
  CRISPR gRNA sequence
aaaggccttagcttaaaaga

SEQ ID NO: 363973 - DNA, 20 bp, Artificial
  CRISPR gRNA sequence
aaggccttagcttaaaagac

SEQ ID NO: 363974 - DNA, 20 bp, Artificial
  CRISPR gRNA sequence
agacaggtttgctcctttat

SEQ ID NO: 363975 - DNA, 20 bp, Artificial
  CRISPR gRNA sequence
gacaggtttgctcctttatg

SEQ ID NO: 363976 - DNA, 20 bp, Artificial
  CRISPR gRNA sequence
ggtttgctcctttatgagga

SEQ ID NO: 363977 - DNA, 20 bp, Artificial
  CRISPR gRNA sequence
gtttgctcctttatgaggat

SEQ ID NO: 363978 - DNA, 20 bp, Artificial
  CRISPR gRNA sequence
tgctcctttatgaggatggg

SEQ ID NO: 363979 - DNA, 20 bp, Artificial
  CRISPR gRNA sequence
ttatgaggatgggcagattt

SEQ ID NO: 363980 - DNA, 20 bp, Artificial
  CRISPR gRNA sequence
gatttgagtttcttctctct

SEQ ID NO: 363981 - DNA, 20 bp, Artificial
  CRISPR gRNA sequence
atttgagtttcttctctctc

SEQ ID NO: 363982 - DNA, 20 bp, Artificial
  CRISPR gRNA sequence
tttgagtttcttctctctcg

SEQ ID NO: 363983 - DNA, 20 bp, Artificial
  CRISPR gRNA sequence
tttcttctctctcggggaac

SEQ ID NO: 363984 - DNA, 20 bp, Artificial
  CRISPR gRNA sequence
ttctctctcggggaaccagt

SEQ ID NO: 363985 - DNA, 20 bp, Artificial
  CRISPR gRNA sequence
ggaaccagtcggcttatttt

SEQ ID NO: 363986 - DNA, 20 bp, Artificial
  CRISPR gRNA sequence
gaaccagtcggcttattttc

SEQ ID NO: 363987 - DNA, 20 bp, Artificial
  CRISPR gRNA sequence
ttcgggctttcattttctac

SEQ ID NO: 363988 - DNA, 20 bp, Artificial
  CRISPR gRNA sequence
tcgggctttcattttctaca

SEQ ID NO: 363989 - DNA, 20 bp, Artificial
  CRISPR gRNA sequence
gggctttcattttctacaag

SEQ ID NO: 363990 - DNA, 20 bp, Artificial
  CRISPR gRNA sequence
tgcattctctgtgcctaact

SEQ ID NO: 363991 - DNA, 20 bp, Artificial
  CRISPR gRNA sequence
ctctgtgcctaactcagctg

SEQ ID NO: 363992 - DNA, 20 bp, Artificial
  CRISPR gRNA sequence
tctgtgcctaactcagctgt

SEQ ID NO: 363993 - DNA, 20 bp, Artificial
  CRISPR gRNA sequence
ctaactcagctgtaggcaat

SEQ ID NO: 363994 - DNA, 20 bp, Artificial
  CRISPR gRNA sequence
taactcagctgtaggcaatg

SEQ ID NO: 363995 - DNA, 20 bp, Artificial
  CRISPR gRNA sequence
aaaaaaaaatattgccatga

SEQ ID NO: 363996 - DNA, 20 bp, Artificial
  CRISPR gRNA sequence
gatagaacttacattctatg

SEQ ID NO: 363997 - DNA, 20 bp, Artificial
  CRISPR gRNA sequence
tagaacttacattctatgtg

SEQ ID NO: 363998 - DNA, 20 bp, Artificial
  CRISPR gRNA sequence
agaacttacattctatgtgg

SEQ ID NO: 363999 - DNA, 20 bp, Artificial
  CRISPR gRNA sequence
aacttacattctatgtggag

SEQ ID NO: 364000 - DNA, 20 bp, Artificial
  CRISPR gRNA sequence
acttacattctatgtggagg

SEQ ID NO: 364001 - DNA, 20 bp, Artificial
  CRISPR gRNA sequence
tacattctatgtggaggagg

SEQ ID NO: 364002 - DNA, 20 bp, Artificial
  CRISPR gRNA sequence
aggaggcagaaactaaaata

SEQ ID NO: 364003 - DNA, 20 bp, Artificial
  CRISPR gRNA sequence
gatgtaaaaatataaataat

SEQ ID NO: 364004 - DNA, 20 bp, Artificial
  CRISPR gRNA sequence
aaaatataaataataagtga

SEQ ID NO: 364005 - DNA, 20 bp, Artificial
  CRISPR gRNA sequence
aaatataaataataagtgaa

SEQ ID NO: 364006 - DNA, 20 bp, Artificial
  CRISPR gRNA sequence
tataaataataagtgaaagg

SEQ ID NO: 364007 - DNA, 20 bp, Artificial
  CRISPR gRNA sequence
agtgaaaggtggtgcatgca

SEQ ID NO: 364008 - DNA, 20 bp, Artificial
  CRISPR gRNA sequence
tgaaaggtggtgcatgcatg

SEQ ID NO: 364009 - DNA, 20 bp, Artificial
  CRISPR gRNA sequence
aaggtggtgcatgcatggag

SEQ ID NO: 364010 - DNA, 20 bp, Artificial
  CRISPR gRNA sequence
ggtggtgcatgcatggagca

SEQ ID NO: 364011 - DNA, 20 bp, Artificial
  CRISPR gRNA sequence
ggtgcatgcatggagcagag

SEQ ID NO: 364012 - DNA, 20 bp, Artificial
  CRISPR gRNA sequence
ggagcagagaagtcctcact

SEQ ID NO: 364013 - DNA, 20 bp, Artificial
  CRISPR gRNA sequence
agcagagaagtcctcactga

SEQ ID NO: 364014 - DNA, 20 bp, Artificial
  CRISPR gRNA sequence
gaagtcctcactgagagcat

SEQ ID NO: 364015 - DNA, 20 bp, Artificial
  CRISPR gRNA sequence
cctcactgagagcataagat

SEQ ID NO: 364016 - DNA, 20 bp, Artificial
  CRISPR gRNA sequence
ctcactgagagcataagatg

SEQ ID NO: 364017 - DNA, 20 bp, Artificial
  CRISPR gRNA sequence
actgagagcataagatgagg

SEQ ID NO: 364018 - DNA, 20 bp, Artificial
  CRISPR gRNA sequence
tgagagcataagatgaggca

SEQ ID NO: 364019 - DNA, 20 bp, Artificial
  CRISPR gRNA sequence
gagagcataagatgaggcag

SEQ ID NO: 364020 - DNA, 20 bp, Artificial
  CRISPR gRNA sequence
ataagatgaggcagaggctg

SEQ ID NO: 364021 - DNA, 20 bp, Artificial
  CRISPR gRNA sequence
agatgaggcagaggctgaag

SEQ ID NO: 364022 - DNA, 20 bp, Artificial
  CRISPR gRNA sequence
gatgaggcagaggctgaagt

SEQ ID NO: 364023 - DNA, 20 bp, Artificial
  CRISPR gRNA sequence
gaggcagaggctgaagtggg

SEQ ID NO: 364024 - DNA, 20 bp, Artificial
  CRISPR gRNA sequence
ggcagaggctgaagtgggcg

SEQ ID NO: 364025 - DNA, 20 bp, Artificial
  CRISPR gRNA sequence
gcagaggctgaagtgggcgg

SEQ ID NO: 364026 - DNA, 20 bp, Artificial
  CRISPR gRNA sequence
cagaggctgaagtgggcgga

SEQ ID NO: 364027 - DNA, 20 bp, Artificial
  CRISPR gRNA sequence
gaggctgaagtgggcggagg

SEQ ID NO: 364028 - DNA, 20 bp, Artificial
  CRISPR gRNA sequence
gggcggagggagcctacgcc

SEQ ID NO: 364029 - DNA, 20 bp, Artificial
  CRISPR gRNA sequence
gagcctacgcccagcgctga

SEQ ID NO: 364030 - DNA, 20 bp, Artificial
  CRISPR gRNA sequence
agcgctgacagcccatcctg

SEQ ID NO: 364031 - DNA, 20 bp, Artificial
  CRISPR gRNA sequence
ctcttcctccttgctgatct

SEQ ID NO: 364032 - DNA, 20 bp, Artificial
  CRISPR gRNA sequence
tctcagacatttgctttgat

SEQ ID NO: 364033 - DNA, 20 bp, Artificial
  CRISPR gRNA sequence
ctcagacatttgctttgatg

SEQ ID NO: 364034 - DNA, 20 bp, Artificial
  CRISPR gRNA sequence
ctttgatgaggaccaaaaaa

SEQ ID NO: 364035 - DNA, 20 bp, Artificial
  CRISPR gRNA sequence
aggaccaaaaaacagatcaa

SEQ ID NO: 364036 - DNA, 20 bp, Artificial
  CRISPR gRNA sequence
aaaacagatcaaaagcccat

SEQ ID NO: 364037 - DNA, 20 bp, Artificial
  CRISPR gRNA sequence
caaaagcccatcagatacaa

SEQ ID NO: 364038 - DNA, 20 bp, Artificial
  CRISPR gRNA sequence
catcagatacaaaagtatgc

SEQ ID NO: 364039 - DNA, 20 bp, Artificial
  CRISPR gRNA sequence
gatacaaaagtatgctggcc

SEQ ID NO: 364040 - DNA, 20 bp, Artificial
  CRISPR gRNA sequence
atacaaaagtatgctggccc

SEQ ID NO: 364041 - DNA, 20 bp, Artificial
  CRISPR gRNA sequence
tacaaaagtatgctggccca

SEQ ID NO: 364042 - DNA, 20 bp, Artificial
  CRISPR gRNA sequence
atgctggcccagggcatatg

SEQ ID NO: 364043 - DNA, 20 bp, Artificial
  CRISPR gRNA sequence
atatgcagatctaccattat

SEQ ID NO: 364044 - DNA, 20 bp, Artificial
  CRISPR gRNA sequence
atgcagatctaccattatga

SEQ ID NO: 364045 - DNA, 20 bp, Artificial
  CRISPR gRNA sequence
ttctgattttgaaataatta

SEQ ID NO: 364046 - DNA, 20 bp, Artificial
  CRISPR gRNA sequence
ctgattttgaaataattata

SEQ ID NO: 364047 - DNA, 20 bp, Artificial
  CRISPR gRNA sequence
ttgaaataattatagagtca

SEQ ID NO: 364048 - DNA, 20 bp, Artificial
  CRISPR gRNA sequence
aataattatagagtcacagt

SEQ ID NO: 364049 - DNA, 20 bp, Artificial
  CRISPR gRNA sequence
tagagtcacagtaagtcaca

SEQ ID NO: 364050 - DNA, 20 bp, Artificial
  CRISPR gRNA sequence
gagtcacagtaagtcacaaa

SEQ ID NO: 364051 - DNA, 20 bp, Artificial
  CRISPR gRNA sequence
gtcacagtaagtcacaaaga

SEQ ID NO: 364052 - DNA, 20 bp, Artificial
  CRISPR gRNA sequence
agtaagtcacaaagagagta

SEQ ID NO: 364053 - DNA, 20 bp, Artificial
  CRISPR gRNA sequence
agtcacaaagagagtacaga

SEQ ID NO: 364054 - DNA, 20 bp, Artificial
  CRISPR gRNA sequence
gtcacaaagagagtacagac

SEQ ID NO: 364055 - DNA, 20 bp, Artificial
  CRISPR gRNA sequence
tacagacaggtccctgtccc

SEQ ID NO: 364056 - DNA, 20 bp, Artificial
  CRISPR gRNA sequence
acagacaggtccctgtcccc

SEQ ID NO: 364057 - DNA, 20 bp, Artificial
  CRISPR gRNA sequence
tccctgtccccaggttctgt

SEQ ID NO: 364058 - DNA, 20 bp, Artificial
  CRISPR gRNA sequence
ccctgtccccaggttctgtc

SEQ ID NO: 364059 - DNA, 20 bp, Artificial
  CRISPR gRNA sequence
cctgtccccaggttctgtca

SEQ ID NO: 364060 - DNA, 20 bp, Artificial
  CRISPR gRNA sequence
ctgtccccaggttctgtcag

SEQ ID NO: 364061 - DNA, 20 bp, Artificial
  CRISPR gRNA sequence
ggtcatatcttacataatta

SEQ ID NO: 364062 - DNA, 20 bp, Artificial
  CRISPR gRNA sequence
attatagtacaatatcaaaa

SEQ ID NO: 364063 - DNA, 20 bp, Artificial
  CRISPR gRNA sequence
ttatagtacaatatcaaaac

SEQ ID NO: 364064 - DNA, 20 bp, Artificial
  CRISPR gRNA sequence
tcaaaacaggattcattttt

SEQ ID NO: 364065 - DNA, 20 bp, Artificial
  CRISPR gRNA sequence
caaaacaggattcatttttc

SEQ ID NO: 364066 - DNA, 20 bp, Artificial
  CRISPR gRNA sequence
ttctttctcttataaaatac

SEQ ID NO: 364067 - DNA, 20 bp, Artificial
  CRISPR gRNA sequence
aaatacaagttccaattctt

SEQ ID NO: 364068 - DNA, 20 bp, Artificial
  CRISPR gRNA sequence
tccaattcttaagaacttgt

SEQ ID NO: 364069 - DNA, 20 bp, Artificial
  CRISPR gRNA sequence
ccaattcttaagaacttgtt

SEQ ID NO: 364070 - DNA, 20 bp, Artificial
  CRISPR gRNA sequence
cttaagaacttgttaggtac

SEQ ID NO: 364071 - DNA, 20 bp, Artificial
  CRISPR gRNA sequence
aggtacaagttccaattctt

SEQ ID NO: 364072 - DNA, 20 bp, Artificial
  CRISPR gRNA sequence
tccaattcttaagaacttgt

SEQ ID NO: 364073 - DNA, 20 bp, Artificial
  CRISPR gRNA sequence
ccaattcttaagaacttgtt

SEQ ID NO: 364074 - DNA, 20 bp, Artificial
  CRISPR gRNA sequence
agaacttgttaggaacatat

SEQ ID NO: 364075 - DNA, 20 bp, Artificial
  CRISPR gRNA sequence
ttaggaacatatcagcatgt

SEQ ID NO: 364076 - DNA, 20 bp, Artificial
  CRISPR gRNA sequence
tatcagcatgttagtataaa

SEQ ID NO: 364077 - DNA, 20 bp, Artificial
  CRISPR gRNA sequence
aaaaagtatacccctacaaa

SEQ ID NO: 364078 - DNA, 20 bp, Artificial
  CRISPR gRNA sequence
aaagtatacccctacaaaaa

SEQ ID NO: 364079 - DNA, 20 bp, Artificial
  CRISPR gRNA sequence
aagtatacccctacaaaaag

SEQ ID NO: 364080 - DNA, 20 bp, Artificial
  CRISPR gRNA sequence
tgtataaatgcatttgaccc

SEQ ID NO: 364081 - DNA, 20 bp, Artificial
  CRISPR gRNA sequence
taaatgcatttgaccctggt

SEQ ID NO: 364082 - DNA, 20 bp, Artificial
  CRISPR gRNA sequence
ccctggtaagactgtcaaaa

SEQ ID NO: 364083 - DNA, 20 bp, Artificial
  CRISPR gRNA sequence
tggtaagactgtcaaaatag

SEQ ID NO: 364084 - DNA, 20 bp, Artificial
  CRISPR gRNA sequence
agactgtcaaaatagaagat

SEQ ID NO: 364085 - DNA, 20 bp, Artificial
  CRISPR gRNA sequence
aatagaagatgagtaaaaat

SEQ ID NO: 364086 - DNA, 20 bp, Artificial
  CRISPR gRNA sequence
atagaagatgagtaaaaatt

SEQ ID NO: 364087 - DNA, 20 bp, Artificial
  CRISPR gRNA sequence
agatgagtaaaaattgggaa

SEQ ID NO: 364088 - DNA, 20 bp, Artificial
  CRISPR gRNA sequence
tgagtaaaaattgggaaaag

SEQ ID NO: 364089 - DNA, 20 bp, Artificial
  CRISPR gRNA sequence
gagtaaaaattgggaaaagt

SEQ ID NO: 364090 - DNA, 20 bp, Artificial
  CRISPR gRNA sequence
gtaaaaattgggaaaagtag

SEQ ID NO: 364091 - DNA, 20 bp, Artificial
  CRISPR gRNA sequence
aaaattgggaaaagtaggag

SEQ ID NO: 364092 - DNA, 20 bp, Artificial
  CRISPR gRNA sequence
agtaggagcagaaaccactg

SEQ ID NO: 364093 - DNA, 20 bp, Artificial
  CRISPR gRNA sequence
cctgaactttgtttgtgact

SEQ ID NO: 364094 - DNA, 20 bp, Artificial
  CRISPR gRNA sequence
ttgtttgtgactcagtctca

SEQ ID NO: 364095 - DNA, 20 bp, Artificial
  CRISPR gRNA sequence
gactcagtctcaaagtgtat

SEQ ID NO: 364096 - DNA, 20 bp, Artificial
  CRISPR gRNA sequence
cagtctcaaagtgtatcagc

SEQ ID NO: 364097 - DNA, 20 bp, Artificial
  CRISPR gRNA sequence
atcagcaagtgtcgactact

SEQ ID NO: 364098 - DNA, 20 bp, Artificial
  CRISPR gRNA sequence
ctcagcatgaatatctaatg

SEQ ID NO: 364099 - DNA, 20 bp, Artificial
  CRISPR gRNA sequence
tcagcatgaatatctaatgt

SEQ ID NO: 364100 - DNA, 20 bp, Artificial
  CRISPR gRNA sequence
atctaatgtgggaactttct

SEQ ID NO: 364101 - DNA, 20 bp, Artificial
  CRISPR gRNA sequence
tctaatgtgggaactttctc

SEQ ID NO: 364102 - DNA, 20 bp, Artificial
  CRISPR gRNA sequence
ctaatgtgggaactttctca

SEQ ID NO: 364103 - DNA, 20 bp, Artificial
  CRISPR gRNA sequence
atcaacaatgcaatgataat

SEQ ID NO: 364104 - DNA, 20 bp, Artificial
  CRISPR gRNA sequence
tgtaatgtgtacatataatc

SEQ ID NO: 364105 - DNA, 20 bp, Artificial
  CRISPR gRNA sequence
tgtgtacatataatcaagca

SEQ ID NO: 364106 - DNA, 20 bp, Artificial
  CRISPR gRNA sequence
ggtgtcaccttgtgtttata

SEQ ID NO: 364107 - DNA, 20 bp, Artificial
  CRISPR gRNA sequence
tatggcattatattttctaa

SEQ ID NO: 364108 - DNA, 20 bp, Artificial
  CRISPR gRNA sequence
tatgatattatttgtgcctc

SEQ ID NO: 364109 - DNA, 20 bp, Artificial
  CRISPR gRNA sequence
cctctagttgttttgtgatg

SEQ ID NO: 364110 - DNA, 20 bp, Artificial
  CRISPR gRNA sequence
ttgttttgtgatgtagtcaa

SEQ ID NO: 364111 - DNA, 20 bp, Artificial
  CRISPR gRNA sequence
gttttgtgatgtagtcaaaa

SEQ ID NO: 364112 - DNA, 20 bp, Artificial
  CRISPR gRNA sequence
ttttgtgatgtagtcaaaag

SEQ ID NO: 364113 - DNA, 20 bp, Artificial
  CRISPR gRNA sequence
gttatctctgttttgtaaat

SEQ ID NO: 364114 - DNA, 20 bp, Artificial
  CRISPR gRNA sequence
caattcctccaaattgtact

SEQ ID NO: 364115 - DNA, 20 bp, Artificial
  CRISPR gRNA sequence
caaattgtactgagttatgc

SEQ ID NO: 364116 - DNA, 20 bp, Artificial
  CRISPR gRNA sequence
aaattgtactgagttatgct

SEQ ID NO: 364117 - DNA, 20 bp, Artificial
  CRISPR gRNA sequence
gttatgctgggtcctctgct

SEQ ID NO: 364118 - DNA, 20 bp, Artificial
  CRISPR gRNA sequence
gggtcctctgcttagtccct

SEQ ID NO: 364119 - DNA, 20 bp, Artificial
  CRISPR gRNA sequence
cccttggaaatacaatcata

SEQ ID NO: 364120 - DNA, 20 bp, Artificial
  CRISPR gRNA sequence
cttggaaatacaatcataaa

SEQ ID NO: 364121 - DNA, 20 bp, Artificial
  CRISPR gRNA sequence
ttggaaatacaatcataaag

SEQ ID NO: 364122 - DNA, 20 bp, Artificial
  CRISPR gRNA sequence
agaggacacatctctgctct

SEQ ID NO: 364123 - DNA, 20 bp, Artificial
  CRISPR gRNA sequence
gaggacacatctctgctctc

SEQ ID NO: 364124 - DNA, 20 bp, Artificial
  CRISPR gRNA sequence
ctctcaggttatgcataata

SEQ ID NO: 364125 - DNA, 20 bp, Artificial
  CRISPR gRNA sequence
tcaggttatgcataatatag

SEQ ID NO: 364126 - DNA, 20 bp, Artificial
  CRISPR gRNA sequence
caggttatgcataatatagt

SEQ ID NO: 364127 - DNA, 20 bp, Artificial
  CRISPR gRNA sequence
gtgggtcatattaattttaa

SEQ ID NO: 364128 - DNA, 20 bp, Artificial
  CRISPR gRNA sequence
attttaaaagcaatttattg

SEQ ID NO: 364129 - DNA, 20 bp, Artificial
  CRISPR gRNA sequence
aaacatgatcatctctatac

SEQ ID NO: 364130 - DNA, 20 bp, Artificial
  CRISPR gRNA sequence
ctctatacaagtcatttgct

SEQ ID NO: 364131 - DNA, 20 bp, Artificial
  CRISPR gRNA sequence
tcatttgctaagttttatga

SEQ ID NO: 364132 - DNA, 20 bp, Artificial
  CRISPR gRNA sequence
ttgctaagttttatgaaagc

SEQ ID NO: 364133 - DNA, 20 bp, Artificial
  CRISPR gRNA sequence
gctaagttttatgaaagcca

SEQ ID NO: 364134 - DNA, 20 bp, Artificial
  CRISPR gRNA sequence
taagttttatgaaagccaga

SEQ ID NO: 364135 - DNA, 20 bp, Artificial
  CRISPR gRNA sequence
gagagaacaaatcattctaa

SEQ ID NO: 364136 - DNA, 20 bp, Artificial
  CRISPR gRNA sequence
caaatcattctaatagattg

SEQ ID NO: 364137 - DNA, 20 bp, Artificial
  CRISPR gRNA sequence
cattctaatagattgtggaa

SEQ ID NO: 364138 - DNA, 20 bp, Artificial
  CRISPR gRNA sequence
attctaatagattgtggaaa

SEQ ID NO: 364139 - DNA, 20 bp, Artificial
  CRISPR gRNA sequence
agattgtggaaaaggtttta

SEQ ID NO: 364140 - DNA, 20 bp, Artificial
  CRISPR gRNA sequence
tggaaaaggttttatagaaa

SEQ ID NO: 364141 - DNA, 20 bp, Artificial
  CRISPR gRNA sequence
aaaaggttttatagaaaaag

SEQ ID NO: 364142 - DNA, 20 bp, Artificial
  CRISPR gRNA sequence
aaaggttttatagaaaaagt

SEQ ID NO: 364143 - DNA, 20 bp, Artificial
  CRISPR gRNA sequence
aaggttttatagaaaaagtg

SEQ ID NO: 364144 - DNA, 20 bp, Artificial
  CRISPR gRNA sequence
aggttttatagaaaaagtgg

SEQ ID NO: 364145 - DNA, 20 bp, Artificial
  CRISPR gRNA sequence
ggttttatagaaaaagtggg

SEQ ID NO: 364146 - DNA, 20 bp, Artificial
  CRISPR gRNA sequence
tagaaaaagtggggggaaaa

SEQ ID NO: 364147 - DNA, 20 bp, Artificial
  CRISPR gRNA sequence
gaaaaagtggggggaaaaca

SEQ ID NO: 364148 - DNA, 20 bp, Artificial
  CRISPR gRNA sequence
aaaaagtggggggaaaacag

SEQ ID NO: 364149 - DNA, 20 bp, Artificial
  CRISPR gRNA sequence
aaaacagaggcgtgacaatg

SEQ ID NO: 364150 - DNA, 20 bp, Artificial
  CRISPR gRNA sequence
aaacagaggcgtgacaatgc

SEQ ID NO: 364151 - DNA, 20 bp, Artificial
  CRISPR gRNA sequence
gcgtgacaatgcgggtgttt

SEQ ID NO: 364152 - DNA, 20 bp, Artificial
  CRISPR gRNA sequence
cgtgacaatgcgggtgtttc

SEQ ID NO: 364153 - DNA, 20 bp, Artificial
  CRISPR gRNA sequence
aatgcgggtgtttcaggaaa

SEQ ID NO: 364154 - DNA, 20 bp, Artificial
  CRISPR gRNA sequence
ttcaggaaatggtgtgacta

SEQ ID NO: 364155 - DNA, 20 bp, Artificial
  CRISPR gRNA sequence
gaaatggtgtgactacagtc

SEQ ID NO: 364156 - DNA, 20 bp, Artificial
  CRISPR gRNA sequence
atggtgtgactacagtctag

SEQ ID NO: 364157 - DNA, 20 bp, Artificial
  CRISPR gRNA sequence
tggtgtgactacagtctagt

SEQ ID NO: 364158 - DNA, 20 bp, Artificial
  CRISPR gRNA sequence
tgtgactacagtctagtggg

SEQ ID NO: 364159 - DNA, 20 bp, Artificial
  CRISPR gRNA sequence
gtgactacagtctagtgggt

SEQ ID NO: 364160 - DNA, 20 bp, Artificial
  CRISPR gRNA sequence
tgactacagtctagtgggtg

SEQ ID NO: 364161 - DNA, 20 bp, Artificial
  CRISPR gRNA sequence
ctacagtctagtgggtgggg

SEQ ID NO: 364162 - DNA, 20 bp, Artificial
  CRISPR gRNA sequence
gtggggaagtgaccgaaaat

SEQ ID NO: 364163 - DNA, 20 bp, Artificial
  CRISPR gRNA sequence
aagtgaccgaaaatgagact

SEQ ID NO: 364164 - DNA, 20 bp, Artificial
  CRISPR gRNA sequence
accgaaaatgagactgagtc

SEQ ID NO: 364165 - DNA, 20 bp, Artificial
  CRISPR gRNA sequence
gagactgagtctggactgaa

SEQ ID NO: 364166 - DNA, 20 bp, Artificial
  CRISPR gRNA sequence
tctggactgaaaagtgacct

SEQ ID NO: 364167 - DNA, 20 bp, Artificial
  CRISPR gRNA sequence
tgacctgagtgacacacata

SEQ ID NO: 364168 - DNA, 20 bp, Artificial
  CRISPR gRNA sequence
gacctgagtgacacacataa

SEQ ID NO: 364169 - DNA, 20 bp, Artificial
  CRISPR gRNA sequence
cacataaaggaactgaaacg

SEQ ID NO: 364170 - DNA, 20 bp, Artificial
  CRISPR gRNA sequence
aggaactgaaacgtagcaat

SEQ ID NO: 364171 - DNA, 20 bp, Artificial
  CRISPR gRNA sequence
aacgtagcaatcagaaaccg

SEQ ID NO: 364172 - DNA, 20 bp, Artificial
  CRISPR gRNA sequence
catgctaacttctgtaactc

SEQ ID NO: 364173 - DNA, 20 bp, Artificial
  CRISPR gRNA sequence
acttctgtaactccagcacc

SEQ ID NO: 364174 - DNA, 20 bp, Artificial
  CRISPR gRNA sequence
cagcacccagcacaattcct

SEQ ID NO: 364175 - DNA, 20 bp, Artificial
  CRISPR gRNA sequence
agcacccagcacaattcctc

SEQ ID NO: 364176 - DNA, 20 bp, Artificial
  CRISPR gRNA sequence
ccagcacaattcctcaggca

SEQ ID NO: 364177 - DNA, 20 bp, Artificial
  CRISPR gRNA sequence
gcacaattcctcaggcaaag

SEQ ID NO: 364178 - DNA, 20 bp, Artificial
  CRISPR gRNA sequence
cacaattcctcaggcaaagc

SEQ ID NO: 364179 - DNA, 20 bp, Artificial
  CRISPR gRNA sequence
cctcaggcaaagcaggctct

SEQ ID NO: 364180 - DNA, 20 bp, Artificial
  CRISPR gRNA sequence
tgtgacgttaacacattcct

SEQ ID NO: 364181 - DNA, 20 bp, Artificial
  CRISPR gRNA sequence
tgacgttaacacattcctga

SEQ ID NO: 364182 - DNA, 20 bp, Artificial
  CRISPR gRNA sequence
gacgttaacacattcctgag

SEQ ID NO: 364183 - DNA, 20 bp, Artificial
  CRISPR gRNA sequence
acacattcctgagaggaaca

SEQ ID NO: 364184 - DNA, 20 bp, Artificial
  CRISPR gRNA sequence
acattcctgagaggaacatg

SEQ ID NO: 364185 - DNA, 20 bp, Artificial
  CRISPR gRNA sequence
gagaggaacatggagccgcc

SEQ ID NO: 364186 - DNA, 20 bp, Artificial
  CRISPR gRNA sequence
agaggaacatggagccgccg

SEQ ID NO: 364187 - DNA, 20 bp, Artificial
  CRISPR gRNA sequence
aggaacatggagccgccgag

SEQ ID NO: 364188 - DNA, 20 bp, Artificial
  CRISPR gRNA sequence
tggagccgccgaggagctga

SEQ ID NO: 364189 - DNA, 20 bp, Artificial
  CRISPR gRNA sequence
gagccgccgaggagctgatg

SEQ ID NO: 364190 - DNA, 20 bp, Artificial
  CRISPR gRNA sequence
cgccgaggagctgatggaga

SEQ ID NO: 364191 - DNA, 20 bp, Artificial
  CRISPR gRNA sequence
cgaggagctgatggagaaag

SEQ ID NO: 364192 - DNA, 20 bp, Artificial
  CRISPR gRNA sequence
gtgcacacaacttcgcgttt

SEQ ID NO: 364193 - DNA, 20 bp, Artificial
  CRISPR gRNA sequence
acacaacttcgcgttttgga

SEQ ID NO: 364194 - DNA, 20 bp, Artificial
  CRISPR gRNA sequence
gcgttttggaaagataatct

SEQ ID NO: 364195 - DNA, 20 bp, Artificial
  CRISPR gRNA sequence
agataatcttggtcactgta

SEQ ID NO: 364196 - DNA, 20 bp, Artificial
  CRISPR gRNA sequence
ggtcactgtacagaacaaac

SEQ ID NO: 364197 - DNA, 20 bp, Artificial
  CRISPR gRNA sequence
tcactgtacagaacaaactg

SEQ ID NO: 364198 - DNA, 20 bp, Artificial
  CRISPR gRNA sequence
ctgtacagaacaaactggag

SEQ ID NO: 364199 - DNA, 20 bp, Artificial
  CRISPR gRNA sequence
acagaacaaactggagtggc

SEQ ID NO: 364200 - DNA, 20 bp, Artificial
  CRISPR gRNA sequence
cagaacaaactggagtggca

SEQ ID NO: 364201 - DNA, 20 bp, Artificial
  CRISPR gRNA sequence
aaactggagtggcaaggaca

SEQ ID NO: 364202 - DNA, 20 bp, Artificial
  CRISPR gRNA sequence
ctggagtggcaaggacatgg

SEQ ID NO: 364203 - DNA, 20 bp, Artificial
  CRISPR gRNA sequence
aggacatggaagacctccat

SEQ ID NO: 364204 - DNA, 20 bp, Artificial
  CRISPR gRNA sequence
tggaagacctccatcagaat

SEQ ID NO: 364205 - DNA, 20 bp, Artificial
  CRISPR gRNA sequence
tcctattatgtcctaatgac

SEQ ID NO: 364206 - DNA, 20 bp, Artificial
  CRISPR gRNA sequence
atgacaagattttcccctga

SEQ ID NO: 364207 - DNA, 20 bp, Artificial
  CRISPR gRNA sequence
tgacaagattttcccctgac

SEQ ID NO: 364208 - DNA, 20 bp, Artificial
  CRISPR gRNA sequence
gattttcccctgacaggcac

SEQ ID NO: 364209 - DNA, 20 bp, Artificial
  CRISPR gRNA sequence
aaaaatcaaactacaaatgc

SEQ ID NO: 364210 - DNA, 20 bp, Artificial
  CRISPR gRNA sequence
aaaatcaaactacaaatgcc

SEQ ID NO: 364211 - DNA, 20 bp, Artificial
  CRISPR gRNA sequence
tacaaatgccgggctaaacc

SEQ ID NO: 364212 - DNA, 20 bp, Artificial
  CRISPR gRNA sequence
atgccgggctaaaccaagtc

SEQ ID NO: 364213 - DNA, 20 bp, Artificial
  CRISPR gRNA sequence
gccgggctaaaccaagtcca

SEQ ID NO: 364214 - DNA, 20 bp, Artificial
  CRISPR gRNA sequence
accaagtccagagaattcct

SEQ ID NO: 364215 - DNA, 20 bp, Artificial
  CRISPR gRNA sequence
ccaagtccagagaattcctg

SEQ ID NO: 364216 - DNA, 20 bp, Artificial
  CRISPR gRNA sequence
cagagaattcctgaggtcct

SEQ ID NO: 364217 - DNA, 20 bp, Artificial
  CRISPR gRNA sequence
agagaattcctgaggtcctg

SEQ ID NO: 364218 - DNA, 20 bp, Artificial
  CRISPR gRNA sequence
aattcctgaggtcctgagga

SEQ ID NO: 364219 - DNA, 20 bp, Artificial
  CRISPR gRNA sequence
attcctgaggtcctgaggac

SEQ ID NO: 364220 - DNA, 20 bp, Artificial
  CRISPR gRNA sequence
ttcctgaggtcctgaggaca

SEQ ID NO: 364221 - DNA, 20 bp, Artificial
  CRISPR gRNA sequence
cctgaggacagggtccccct

SEQ ID NO: 364222 - DNA, 20 bp, Artificial
  CRISPR gRNA sequence
tgcattcatatcttctgtct

SEQ ID NO: 364223 - DNA, 20 bp, Artificial
  CRISPR gRNA sequence
gcattcatatcttctgtctc

SEQ ID NO: 364224 - DNA, 20 bp, Artificial
  CRISPR gRNA sequence
ttcacacacacacacacaca

SEQ ID NO: 364225 - DNA, 20 bp, Artificial
  CRISPR gRNA sequence
catgcactcacacacacatg

SEQ ID NO: 364226 - DNA, 20 bp, Artificial
  CRISPR gRNA sequence
cacccacacacacatgctca

SEQ ID NO: 364227 - DNA, 20 bp, Artificial
  CRISPR gRNA sequence
cacacacatgctcacagtct

SEQ ID NO: 364228 - DNA, 20 bp, Artificial
  CRISPR gRNA sequence
ctcacacacacaatcacatg

SEQ ID NO: 364229 - DNA, 20 bp, Artificial
  CRISPR gRNA sequence
tcacacacacaatcacatgc

SEQ ID NO: 364230 - DNA, 20 bp, Artificial
  CRISPR gRNA sequence
tctcacacacatactgcatc

SEQ ID NO: 364231 - DNA, 20 bp, Artificial
  CRISPR gRNA sequence
catctggcgtgatctcaaaa

SEQ ID NO: 364232 - DNA, 20 bp, Artificial
  CRISPR gRNA sequence
tctggcgtgatctcaaaaca

SEQ ID NO: 364233 - DNA, 20 bp, Artificial
  CRISPR gRNA sequence
tgatctcaaaacagagtgta

SEQ ID NO: 364234 - DNA, 20 bp, Artificial
  CRISPR gRNA sequence
caaaacagagtgtacggcca

SEQ ID NO: 364235 - DNA, 20 bp, Artificial
  CRISPR gRNA sequence
acataccacctgctctttta

SEQ ID NO: 364236 - DNA, 20 bp, Artificial
  CRISPR gRNA sequence
gaaaaactttttcatgcccc

SEQ ID NO: 364237 - DNA, 20 bp, Artificial
  CRISPR gRNA sequence
actttttcatgcccccagtc

SEQ ID NO: 364238 - DNA, 20 bp, Artificial
  CRISPR gRNA sequence
tttcatgcccccagtctagt

SEQ ID NO: 364239 - DNA, 20 bp, Artificial
  CRISPR gRNA sequence
atgcccccagtctagttgga

SEQ ID NO: 364240 - DNA, 20 bp, Artificial
  CRISPR gRNA sequence
ccccagtctagttggaaaga

SEQ ID NO: 364241 - DNA, 20 bp, Artificial
  CRISPR gRNA sequence
ctagttggaaagacagacat

SEQ ID NO: 364242 - DNA, 20 bp, Artificial
  CRISPR gRNA sequence
cgaacatacaaataaatgca

SEQ ID NO: 364243 - DNA, 20 bp, Artificial
  CRISPR gRNA sequence
caaataaatgcacagttatg

SEQ ID NO: 364244 - DNA, 20 bp, Artificial
  CRISPR gRNA sequence
agtgcatgtcacgttatgaa

SEQ ID NO: 364245 - DNA, 20 bp, Artificial
  CRISPR gRNA sequence
gtgcatgtcacgttatgaaa

SEQ ID NO: 364246 - DNA, 20 bp, Artificial
  CRISPR gRNA sequence
catgtcacgttatgaaaagg

SEQ ID NO: 364247 - DNA, 20 bp, Artificial
  CRISPR gRNA sequence
tgaaaaggaagcaacacaca

SEQ ID NO: 364248 - DNA, 20 bp, Artificial
  CRISPR gRNA sequence
gaaaaggaagcaacacacac

SEQ ID NO: 364249 - DNA, 20 bp, Artificial
  CRISPR gRNA sequence
ggaagcaacacacacaggca

SEQ ID NO: 364250 - DNA, 20 bp, Artificial
  CRISPR gRNA sequence
gaagcaacacacacaggcat

SEQ ID NO: 364251 - DNA, 20 bp, Artificial
  CRISPR gRNA sequence
agcaacacacacaggcatgg

SEQ ID NO: 364252 - DNA, 20 bp, Artificial
  CRISPR gRNA sequence
caacacacacaggcatggga

SEQ ID NO: 364253 - DNA, 20 bp, Artificial
  CRISPR gRNA sequence
cacacaggcatgggagagaa

SEQ ID NO: 364254 - DNA, 20 bp, Artificial
  CRISPR gRNA sequence
caggcatgggagagaatggc

SEQ ID NO: 364255 - DNA, 20 bp, Artificial
  CRISPR gRNA sequence
aggcatgggagagaatggct

SEQ ID NO: 364256 - DNA, 20 bp, Artificial
  CRISPR gRNA sequence
ggcatgggagagaatggctg

SEQ ID NO: 364257 - DNA, 20 bp, Artificial
  CRISPR gRNA sequence
ggagagaatggctggggctg

SEQ ID NO: 364258 - DNA, 20 bp, Artificial
  CRISPR gRNA sequence
gaatggctggggctgcagcc

SEQ ID NO: 364259 - DNA, 20 bp, Artificial
  CRISPR gRNA sequence
tggctggggctgcagccaag

SEQ ID NO: 364260 - DNA, 20 bp, Artificial
  CRISPR gRNA sequence
gctggggctgcagccaagca

SEQ ID NO: 364261 - DNA, 20 bp, Artificial
  CRISPR gRNA sequence
ctggggctgcagccaagcag

SEQ ID NO: 364262 - DNA, 20 bp, Artificial
  CRISPR gRNA sequence
cagccaagcagaggctgtgt

SEQ ID NO: 364263 - DNA, 20 bp, Artificial
  CRISPR gRNA sequence
agccaagcagaggctgtgtc

SEQ ID NO: 364264 - DNA, 20 bp, Artificial
  CRISPR gRNA sequence
aagcagaggctgtgtcaggt

SEQ ID NO: 364265 - DNA, 20 bp, Artificial
  CRISPR gRNA sequence
cagaggctgtgtcaggttgg

SEQ ID NO: 364266 - DNA, 20 bp, Artificial
  CRISPR gRNA sequence
ggctgtgtcaggttggtggt

SEQ ID NO: 364267 - DNA, 20 bp, Artificial
  CRISPR gRNA sequence
gctgtgtcaggttggtggtc

SEQ ID NO: 364268 - DNA, 20 bp, Artificial
  CRISPR gRNA sequence
tgtcaggttggtggtcggga

SEQ ID NO: 364269 - DNA, 20 bp, Artificial
  CRISPR gRNA sequence
gtcaggttggtggtcgggaa

SEQ ID NO: 364270 - DNA, 20 bp, Artificial
  CRISPR gRNA sequence
tggtggtcgggaaaggctct

SEQ ID NO: 364271 - DNA, 20 bp, Artificial
  CRISPR gRNA sequence
ggtggtcgggaaaggctctc

SEQ ID NO: 364272 - DNA, 20 bp, Artificial
  CRISPR gRNA sequence
ggtcgggaaaggctctcggg

SEQ ID NO: 364273 - DNA, 20 bp, Artificial
  CRISPR gRNA sequence
ggaaaggctctcgggcagtg

SEQ ID NO: 364274 - DNA, 20 bp, Artificial
  CRISPR gRNA sequence
tcgggcagtgaagtgtgttc

SEQ ID NO: 364275 - DNA, 20 bp, Artificial
  CRISPR gRNA sequence
gaagtgtgttctggaatctg

SEQ ID NO: 364276 - DNA, 20 bp, Artificial
  CRISPR gRNA sequence
gtgtgttctggaatctgcag

SEQ ID NO: 364277 - DNA, 20 bp, Artificial
  CRISPR gRNA sequence
tgttctggaatctgcagaag

SEQ ID NO: 364278 - DNA, 20 bp, Artificial
  CRISPR gRNA sequence
gttctggaatctgcagaagc

SEQ ID NO: 364279 - DNA, 20 bp, Artificial
  CRISPR gRNA sequence
tctggaatctgcagaagcag

SEQ ID NO: 364280 - DNA, 20 bp, Artificial
  CRISPR gRNA sequence
ctggaatctgcagaagcagg

SEQ ID NO: 364281 - DNA, 20 bp, Artificial
  CRISPR gRNA sequence
tctgcagaagcaggaggctg

SEQ ID NO: 364282 - DNA, 20 bp, Artificial
  CRISPR gRNA sequence
caggaggctgtggccacatg

SEQ ID NO: 364283 - DNA, 20 bp, Artificial
  CRISPR gRNA sequence
aggaggctgtggccacatgc

SEQ ID NO: 364284 - DNA, 20 bp, Artificial
  CRISPR gRNA sequence
ggaggctgtggccacatgca

SEQ ID NO: 364285 - DNA, 20 bp, Artificial
  CRISPR gRNA sequence
ctgtggccacatgcagggtg

SEQ ID NO: 364286 - DNA, 20 bp, Artificial
  CRISPR gRNA sequence
ggccacatgcagggtgtggc

SEQ ID NO: 364287 - DNA, 20 bp, Artificial
  CRISPR gRNA sequence
gccacatgcagggtgtggcc

SEQ ID NO: 364288 - DNA, 20 bp, Artificial
  CRISPR gRNA sequence
gtgtggccaggtgtgtgaac

SEQ ID NO: 364289 - DNA, 20 bp, Artificial
  CRISPR gRNA sequence
tggccaggtgtgtgaacgag

SEQ ID NO: 364290 - DNA, 20 bp, Artificial
  CRISPR gRNA sequence
aggtgtgtgaacgagcagtc

SEQ ID NO: 364291 - DNA, 20 bp, Artificial
  CRISPR gRNA sequence
ggtgtgtgaacgagcagtcc

SEQ ID NO: 364292 - DNA, 20 bp, Artificial
  CRISPR gRNA sequence
gtgtgaacgagcagtccagg

SEQ ID NO: 364293 - DNA, 20 bp, Artificial
  CRISPR gRNA sequence
gaacgagcagtccaggtgga

SEQ ID NO: 364294 - DNA, 20 bp, Artificial
  CRISPR gRNA sequence
aacgagcagtccaggtggat

SEQ ID NO: 364295 - DNA, 20 bp, Artificial
  CRISPR gRNA sequence
cgagcagtccaggtggatag

SEQ ID NO: 364296 - DNA, 20 bp, Artificial
  CRISPR gRNA sequence
agcagtccaggtggatagga

SEQ ID NO: 364297 - DNA, 20 bp, Artificial
  CRISPR gRNA sequence
agtccaggtggataggagag

SEQ ID NO: 364298 - DNA, 20 bp, Artificial
  CRISPR gRNA sequence
gtccaggtggataggagagc

SEQ ID NO: 364299 - DNA, 20 bp, Artificial
  CRISPR gRNA sequence
gataggagagcaggtgcaca

SEQ ID NO: 364300 - DNA, 20 bp, Artificial
  CRISPR gRNA sequence
ggagagcaggtgcacaaagt

SEQ ID NO: 364301 - DNA, 20 bp, Artificial
  CRISPR gRNA sequence
agagcaggtgcacaaagtca

SEQ ID NO: 364302 - DNA, 20 bp, Artificial
  CRISPR gRNA sequence
gcacaaagtcagagactttg

SEQ ID NO: 364303 - DNA, 20 bp, Artificial
  CRISPR gRNA sequence
caaagtcagagactttgtgg

SEQ ID NO: 364304 - DNA, 20 bp, Artificial
  CRISPR gRNA sequence
tggaagtttttcaatcattg

SEQ ID NO: 364305 - DNA, 20 bp, Artificial
  CRISPR gRNA sequence
agtttttcaatcattgtagc

SEQ ID NO: 364306 - DNA, 20 bp, Artificial
  CRISPR gRNA sequence
tcattgtagctggatacatt

SEQ ID NO: 364307 - DNA, 20 bp, Artificial
  CRISPR gRNA sequence
cattgtagctggatacattg

SEQ ID NO: 364308 - DNA, 20 bp, Artificial
  CRISPR gRNA sequence
attgtagctggatacattga

SEQ ID NO: 364309 - DNA, 20 bp, Artificial
  CRISPR gRNA sequence
ttgtagctggatacattgag

SEQ ID NO: 364310 - DNA, 20 bp, Artificial
  CRISPR gRNA sequence
gtagctggatacattgaggg

SEQ ID NO: 364311 - DNA, 20 bp, Artificial
  CRISPR gRNA sequence
ctggatacattgaggggaga

SEQ ID NO: 364312 - DNA, 20 bp, Artificial
  CRISPR gRNA sequence
acattgaggggagatggaaa

SEQ ID NO: 364313 - DNA, 20 bp, Artificial
  CRISPR gRNA sequence
tgaggggagatggaaacaga

SEQ ID NO: 364314 - DNA, 20 bp, Artificial
  CRISPR gRNA sequence
gagatggaaacagaaagatg

SEQ ID NO: 364315 - DNA, 20 bp, Artificial
  CRISPR gRNA sequence
gatggaaacagaaagatgta

SEQ ID NO: 364316 - DNA, 20 bp, Artificial
  CRISPR gRNA sequence
aaacagaaagatgtagagat

SEQ ID NO: 364317 - DNA, 20 bp, Artificial
  CRISPR gRNA sequence
cagaaagatgtagagatgag

SEQ ID NO: 364318 - DNA, 20 bp, Artificial
  CRISPR gRNA sequence
agaaagatgtagagatgagt

SEQ ID NO: 364319 - DNA, 20 bp, Artificial
  CRISPR gRNA sequence
gaaagatgtagagatgagtg

SEQ ID NO: 364320 - DNA, 20 bp, Artificial
  CRISPR gRNA sequence
agatgtagagatgagtgggg

SEQ ID NO: 364321 - DNA, 20 bp, Artificial
  CRISPR gRNA sequence
gatgtagagatgagtggggt

SEQ ID NO: 364322 - DNA, 20 bp, Artificial
  CRISPR gRNA sequence
tgtagagatgagtggggtgg

SEQ ID NO: 364323 - DNA, 20 bp, Artificial
  CRISPR gRNA sequence
catttgccttatatacttcc

SEQ ID NO: 364324 - DNA, 20 bp, Artificial
  CRISPR gRNA sequence
atacttcctggtacaattct

SEQ ID NO: 364325 - DNA, 20 bp, Artificial
  CRISPR gRNA sequence
acttcctggtacaattctaa

SEQ ID NO: 364326 - DNA, 20 bp, Artificial
  CRISPR gRNA sequence
ggtacaattctaagagcgat

SEQ ID NO: 364327 - DNA, 20 bp, Artificial
  CRISPR gRNA sequence
tacaattctaagagcgattg

SEQ ID NO: 364328 - DNA, 20 bp, Artificial
  CRISPR gRNA sequence
aagagcgattggagattgtt

SEQ ID NO: 364329 - DNA, 20 bp, Artificial
  CRISPR gRNA sequence
gattggagattgttaagcac

SEQ ID NO: 364330 - DNA, 20 bp, Artificial
  CRISPR gRNA sequence
aagcaccagaatgatataat

SEQ ID NO: 364331 - DNA, 20 bp, Artificial
  CRISPR gRNA sequence
tataatcagatttcaattat

SEQ ID NO: 364332 - DNA, 20 bp, Artificial
  CRISPR gRNA sequence
atcagatttcaattattaga

SEQ ID NO: 364333 - DNA, 20 bp, Artificial
  CRISPR gRNA sequence
catttcactttcctcactcc

SEQ ID NO: 364334 - DNA, 20 bp, Artificial
  CRISPR gRNA sequence
ttcactttcctcactcctag

SEQ ID NO: 364335 - DNA, 20 bp, Artificial
  CRISPR gRNA sequence
ctcctagcagtactgtacct

SEQ ID NO: 364336 - DNA, 20 bp, Artificial
  CRISPR gRNA sequence
gcagtactgtacctgagttt

SEQ ID NO: 364337 - DNA, 20 bp, Artificial
  CRISPR gRNA sequence
ccacccctttccacacgcca

SEQ ID NO: 364338 - DNA, 20 bp, Artificial
  CRISPR gRNA sequence
acccctttccacacgccaca

SEQ ID NO: 364339 - DNA, 20 bp, Artificial
  CRISPR gRNA sequence
cacagagatattatgacaaa

SEQ ID NO: 364340 - DNA, 20 bp, Artificial
  CRISPR gRNA sequence
agagatattatgacaaatag

SEQ ID NO: 364341 - DNA, 20 bp, Artificial
  CRISPR gRNA sequence
tgtgtgtgtgtgtgtgtgtg

SEQ ID NO: 364342 - DNA, 20 bp, Artificial
  CRISPR gRNA sequence
tgtgtgtgtgtgtgtgtgta

SEQ ID NO: 364343 - DNA, 20 bp, Artificial
  CRISPR gRNA sequence
gtgtgtgtgtgtgtgtgtag

SEQ ID NO: 364344 - DNA, 20 bp, Artificial
  CRISPR gRNA sequence
tgtgtgtgtgtgtgtagagg

SEQ ID NO: 364345 - DNA, 20 bp, Artificial
  CRISPR gRNA sequence
gtgtgtgtgtgtgtagaggt

SEQ ID NO: 364346 - DNA, 20 bp, Artificial
  CRISPR gRNA sequence
tgtgtgtgtgtgtagaggtg

SEQ ID NO: 364347 - DNA, 20 bp, Artificial
  CRISPR gRNA sequence
tggggacgtgctatgttgtc

SEQ ID NO: 364348 - DNA, 20 bp, Artificial
  CRISPR gRNA sequence
ggggacgtgctatgttgtcc

SEQ ID NO: 364349 - DNA, 20 bp, Artificial
  CRISPR gRNA sequence
ccaggctgatctcaaactcc

SEQ ID NO: 364350 - DNA, 20 bp, Artificial
  CRISPR gRNA sequence
gatctcaaactcctggtctc

SEQ ID NO: 364351 - DNA, 20 bp, Artificial
  CRISPR gRNA sequence
ctcaagtgaccctcccactt

SEQ ID NO: 364352 - DNA, 20 bp, Artificial
  CRISPR gRNA sequence
accctcccacttcagcctcc

SEQ ID NO: 364353 - DNA, 20 bp, Artificial
  CRISPR gRNA sequence
ccctcccacttcagcctcct

SEQ ID NO: 364354 - DNA, 20 bp, Artificial
  CRISPR gRNA sequence
tcccacttcagcctcctggg

SEQ ID NO: 364355 - DNA, 20 bp, Artificial
  CRISPR gRNA sequence
acttcagcctcctgggtagc

SEQ ID NO: 364356 - DNA, 20 bp, Artificial
  CRISPR gRNA sequence
cttcagcctcctgggtagct

SEQ ID NO: 364357 - DNA, 20 bp, Artificial
  CRISPR gRNA sequence
cctcctgggtagctgggacc

SEQ ID NO: 364358 - DNA, 20 bp, Artificial
  CRISPR gRNA sequence
tgggtagctgggacccagct

SEQ ID NO: 364359 - DNA, 20 bp, Artificial
  CRISPR gRNA sequence
cccagctgagccaccacact

SEQ ID NO: 364360 - DNA, 20 bp, Artificial
  CRISPR gRNA sequence
ttttaaaattattttttttt

SEQ ID NO: 364361 - DNA, 20 bp, Artificial
  CRISPR gRNA sequence
ttaaaattattttttttttg

SEQ ID NO: 364362 - DNA, 20 bp, Artificial
  CRISPR gRNA sequence
aattattttttttttggaga

SEQ ID NO: 364363 - DNA, 20 bp, Artificial
  CRISPR gRNA sequence
attattttttttttggagac

SEQ ID NO: 364364 - DNA, 20 bp, Artificial
  CRISPR gRNA sequence
ttattttttttttggagaca

SEQ ID NO: 364365 - DNA, 20 bp, Artificial
  CRISPR gRNA sequence
cagggtcttgctacattgcc

SEQ ID NO: 364366 - DNA, 20 bp, Artificial
  CRISPR gRNA sequence
agggtcttgctacattgcca

SEQ ID NO: 364367 - DNA, 20 bp, Artificial
  CRISPR gRNA sequence
ctacattgccaaggcttgct

SEQ ID NO: 364368 - DNA, 20 bp, Artificial
  CRISPR gRNA sequence
acattgccaaggcttgcttg

SEQ ID NO: 364369 - DNA, 20 bp, Artificial
  CRISPR gRNA sequence
caaggcttgcttggagcttc

SEQ ID NO: 364370 - DNA, 20 bp, Artificial
  CRISPR gRNA sequence
aattttgcacttgtacatgt

SEQ ID NO: 364371 - DNA, 20 bp, Artificial
  CRISPR gRNA sequence
ttgtacatgttggcctccta

SEQ ID NO: 364372 - DNA, 20 bp, Artificial
  CRISPR gRNA sequence
atgttggcctcctaaagtgt

SEQ ID NO: 364373 - DNA, 20 bp, Artificial
  CRISPR gRNA sequence
tgttggcctcctaaagtgtt

SEQ ID NO: 364374 - DNA, 20 bp, Artificial
  CRISPR gRNA sequence
ttggcctcctaaagtgttgg

SEQ ID NO: 364375 - DNA, 20 bp, Artificial
  CRISPR gRNA sequence
ctcctaaagtgttgggagta

SEQ ID NO: 364376 - DNA, 20 bp, Artificial
  CRISPR gRNA sequence
tcctaaagtgttgggagtac

SEQ ID NO: 364377 - DNA, 20 bp, Artificial
  CRISPR gRNA sequence
cgggcatgatccaccatgcc

SEQ ID NO: 364378 - DNA, 20 bp, Artificial
  CRISPR gRNA sequence
ctgaaaactatgattgattt

SEQ ID NO: 364379 - DNA, 20 bp, Artificial
  CRISPR gRNA sequence
tgaaaactatgattgatttg

SEQ ID NO: 364380 - DNA, 20 bp, Artificial
  CRISPR gRNA sequence
gaaaactatgattgatttga

SEQ ID NO: 364381 - DNA, 20 bp, Artificial
  CRISPR gRNA sequence
aaaactatgattgatttgag

SEQ ID NO: 364382 - DNA, 20 bp, Artificial
  CRISPR gRNA sequence
ctatgattgatttgaggggt

SEQ ID NO: 364383 - DNA, 20 bp, Artificial
  CRISPR gRNA sequence
atgattgatttgaggggtca

SEQ ID NO: 364384 - DNA, 20 bp, Artificial
  CRISPR gRNA sequence
attgatttgaggggtcagag

SEQ ID NO: 364385 - DNA, 20 bp, Artificial
  CRISPR gRNA sequence
ggggtcagagaagccaacta

SEQ ID NO: 364386 - DNA, 20 bp, Artificial
  CRISPR gRNA sequence
agagaagccaactatggcct

SEQ ID NO: 364387 - DNA, 20 bp, Artificial
  CRISPR gRNA sequence
aagccaactatggcctgagt

SEQ ID NO: 364388 - DNA, 20 bp, Artificial
  CRISPR gRNA sequence
tatggcctgagttggcccat

SEQ ID NO: 364389 - DNA, 20 bp, Artificial
  CRISPR gRNA sequence
tggcctgagttggcccatca

SEQ ID NO: 364390 - DNA, 20 bp, Artificial
  CRISPR gRNA sequence
tgagttggcccatcagagtg

SEQ ID NO: 364391 - DNA, 20 bp, Artificial
  CRISPR gRNA sequence
gagttggcccatcagagtga

SEQ ID NO: 364392 - DNA, 20 bp, Artificial
  CRISPR gRNA sequence
ttggcccatcagagtgaagg

SEQ ID NO: 364393 - DNA, 20 bp, Artificial
  CRISPR gRNA sequence
aagttattcacattccatgc

SEQ ID NO: 364394 - DNA, 20 bp, Artificial
  CRISPR gRNA sequence
cacattccatgccagaaaaa

SEQ ID NO: 364395 - DNA, 20 bp, Artificial
  CRISPR gRNA sequence
tccatgccagaaaaacagca

SEQ ID NO: 364396 - DNA, 20 bp, Artificial
  CRISPR gRNA sequence
tcctctcattatgcatgaac

SEQ ID NO: 364397 - DNA, 20 bp, Artificial
  CRISPR gRNA sequence
catgaacaagaatgctgtcc

SEQ ID NO: 364398 - DNA, 20 bp, Artificial
  CRISPR gRNA sequence
gaatgctgtcctggttacca

SEQ ID NO: 364399 - DNA, 20 bp, Artificial
  CRISPR gRNA sequence
aatgctgtcctggttaccac

SEQ ID NO: 364400 - DNA, 20 bp, Artificial
  CRISPR gRNA sequence
gctgtcctggttaccacagg

SEQ ID NO: 364401 - DNA, 20 bp, Artificial
  CRISPR gRNA sequence
taccacaggcagccatattg

SEQ ID NO: 364402 - DNA, 20 bp, Artificial
  CRISPR gRNA sequence
accacaggcagccatattga

SEQ ID NO: 364403 - DNA, 20 bp, Artificial
  CRISPR gRNA sequence
gcagccatattgaaggaaat

SEQ ID NO: 364404 - DNA, 20 bp, Artificial
  CRISPR gRNA sequence
atattgaaggaaatcagcct

SEQ ID NO: 364405 - DNA, 20 bp, Artificial
  CRISPR gRNA sequence
tattgaaggaaatcagcctg

SEQ ID NO: 364406 - DNA, 20 bp, Artificial
  CRISPR gRNA sequence
gaaatcagcctgaggacaaa

SEQ ID NO: 364407 - DNA, 20 bp, Artificial
  CRISPR gRNA sequence
aaatcagcctgaggacaaac

SEQ ID NO: 364408 - DNA, 20 bp, Artificial
  CRISPR gRNA sequence
aatcagcctgaggacaaaca

SEQ ID NO: 364409 - DNA, 20 bp, Artificial
  CRISPR gRNA sequence
cagcctgaggacaaacaggg

SEQ ID NO: 364410 - DNA, 20 bp, Artificial
  CRISPR gRNA sequence
cctgaggacaaacagggtgg

SEQ ID NO: 364411 - DNA, 20 bp, Artificial
  CRISPR gRNA sequence
tgaggacaaacagggtggta

SEQ ID NO: 364412 - DNA, 20 bp, Artificial
  CRISPR gRNA sequence
aggacaaacagggtggtaga

SEQ ID NO: 364413 - DNA, 20 bp, Artificial
  CRISPR gRNA sequence
gacaaacagggtggtagaga

SEQ ID NO: 364414 - DNA, 20 bp, Artificial
  CRISPR gRNA sequence
aacagggtggtagagagaga

SEQ ID NO: 364415 - DNA, 20 bp, Artificial
  CRISPR gRNA sequence
agagagagacagaatgaatg

SEQ ID NO: 364416 - DNA, 20 bp, Artificial
  CRISPR gRNA sequence
gagagagacagaatgaatgt

SEQ ID NO: 364417 - DNA, 20 bp, Artificial
  CRISPR gRNA sequence
agagagacagaatgaatgtg

SEQ ID NO: 364418 - DNA, 20 bp, Artificial
  CRISPR gRNA sequence
gacagaatgaatgtggggct

SEQ ID NO: 364419 - DNA, 20 bp, Artificial
  CRISPR gRNA sequence
gaatgaatgtggggctcaga

SEQ ID NO: 364420 - DNA, 20 bp, Artificial
  CRISPR gRNA sequence
ggggctcagatggcattact

SEQ ID NO: 364421 - DNA, 20 bp, Artificial
  CRISPR gRNA sequence
tactgaatccaccaactctg

SEQ ID NO: 364422 - DNA, 20 bp, Artificial
  CRISPR gRNA sequence
tgaagtctgaacatattaca

SEQ ID NO: 364423 - DNA, 20 bp, Artificial
  CRISPR gRNA sequence
aacatattacatagaattgc

SEQ ID NO: 364424 - DNA, 20 bp, Artificial
  CRISPR gRNA sequence
acatattacatagaattgca

SEQ ID NO: 364425 - DNA, 20 bp, Artificial
  CRISPR gRNA sequence
catattacatagaattgcaa

SEQ ID NO: 364426 - DNA, 20 bp, Artificial
  CRISPR gRNA sequence
atattacatagaattgcaag

SEQ ID NO: 364427 - DNA, 20 bp, Artificial
  CRISPR gRNA sequence
gaattgcaaggggtcctgaa

SEQ ID NO: 364428 - DNA, 20 bp, Artificial
  CRISPR gRNA sequence
ggggtcctgaatagccaaaa

SEQ ID NO: 364429 - DNA, 20 bp, Artificial
  CRISPR gRNA sequence
tagccaaaatggtattaaaa

SEQ ID NO: 364430 - DNA, 20 bp, Artificial
  CRISPR gRNA sequence
ccaaaatggtattaaaaaag

SEQ ID NO: 364431 - DNA, 20 bp, Artificial
  CRISPR gRNA sequence
tggtattaaaaaagaagaaa

SEQ ID NO: 364432 - DNA, 20 bp, Artificial
  CRISPR gRNA sequence
aaaaaagaagaaaaagctga

SEQ ID NO: 364433 - DNA, 20 bp, Artificial
  CRISPR gRNA sequence
catttcccatttcaaaactg

SEQ ID NO: 364434 - DNA, 20 bp, Artificial
  CRISPR gRNA sequence
catttcaaaactgtagtaca

SEQ ID NO: 364435 - DNA, 20 bp, Artificial
  CRISPR gRNA sequence
aaaactgtagtacacagcta

SEQ ID NO: 364436 - DNA, 20 bp, Artificial
  CRISPR gRNA sequence
cacagctacagtaatcaaaa

SEQ ID NO: 364437 - DNA, 20 bp, Artificial
  CRISPR gRNA sequence
ctacagtaatcaaaacagtg

SEQ ID NO: 364438 - DNA, 20 bp, Artificial
  CRISPR gRNA sequence
tacagtaatcaaaacagtgt

SEQ ID NO: 364439 - DNA, 20 bp, Artificial
  CRISPR gRNA sequence
aatcaaaacagtgtgggtat

SEQ ID NO: 364440 - DNA, 20 bp, Artificial
  CRISPR gRNA sequence
tgtgggtattggcatataca

SEQ ID NO: 364441 - DNA, 20 bp, Artificial
  CRISPR gRNA sequence
ttggcatatacatagacaaa

SEQ ID NO: 364442 - DNA, 20 bp, Artificial
  CRISPR gRNA sequence
tatacatagacaaatagacc

SEQ ID NO: 364443 - DNA, 20 bp, Artificial
  CRISPR gRNA sequence
atacatagacaaatagacca

SEQ ID NO: 364444 - DNA, 20 bp, Artificial
  CRISPR gRNA sequence
aattgaaatgatgatcaaaa

SEQ ID NO: 364445 - DNA, 20 bp, Artificial
  CRISPR gRNA sequence
atgatgatcaaaacagatgt

SEQ ID NO: 364446 - DNA, 20 bp, Artificial
  CRISPR gRNA sequence
tgatgatcaaaacagatgtt

SEQ ID NO: 364447 - DNA, 20 bp, Artificial
  CRISPR gRNA sequence
tgatcaaaacagatgttagg

SEQ ID NO: 364448 - DNA, 20 bp, Artificial
  CRISPR gRNA sequence
gatcaaaacagatgttaggt

SEQ ID NO: 364449 - DNA, 20 bp, Artificial
  CRISPR gRNA sequence
aacagatgttaggtaggatg

SEQ ID NO: 364450 - DNA, 20 bp, Artificial
  CRISPR gRNA sequence
cagatgttaggtaggatgtg

SEQ ID NO: 364451 - DNA, 20 bp, Artificial
  CRISPR gRNA sequence
agatgttaggtaggatgtgg

SEQ ID NO: 364452 - DNA, 20 bp, Artificial
  CRISPR gRNA sequence
gttaggtaggatgtggagga

SEQ ID NO: 364453 - DNA, 20 bp, Artificial
  CRISPR gRNA sequence
taggtaggatgtggaggaaa

SEQ ID NO: 364454 - DNA, 20 bp, Artificial
  CRISPR gRNA sequence
gaacatttatacactgttca

SEQ ID NO: 364455 - DNA, 20 bp, Artificial
  CRISPR gRNA sequence
aacatttatacactgttcat

SEQ ID NO: 364456 - DNA, 20 bp, Artificial
  CRISPR gRNA sequence
ctgttcatgggaatgtaaat

SEQ ID NO: 364457 - DNA, 20 bp, Artificial
  CRISPR gRNA sequence
gtaaattagtacaacgtcta

SEQ ID NO: 364458 - DNA, 20 bp, Artificial
  CRISPR gRNA sequence
agtacaacgtctatggaaaa

SEQ ID NO: 364459 - DNA, 20 bp, Artificial
  CRISPR gRNA sequence
aacgtctatggaaaatagta

SEQ ID NO: 364460 - DNA, 20 bp, Artificial
  CRISPR gRNA sequence
gtctatggaaaatagtatgg

SEQ ID NO: 364461 - DNA, 20 bp, Artificial
  CRISPR gRNA sequence
aatagtatggcagttcctca

SEQ ID NO: 364462 - DNA, 20 bp, Artificial
  CRISPR gRNA sequence
gttcctcaaagaactaaaaa

SEQ ID NO: 364463 - DNA, 20 bp, Artificial
  CRISPR gRNA sequence
actaaaaatagaattaccat

SEQ ID NO: 364464 - DNA, 20 bp, Artificial
  CRISPR gRNA sequence
aatagaattaccattagatc

SEQ ID NO: 364465 - DNA, 20 bp, Artificial
  CRISPR gRNA sequence
agaattaccattagatccgg

SEQ ID NO: 364466 - DNA, 20 bp, Artificial
  CRISPR gRNA sequence
tagatccggcagtctcacta

SEQ ID NO: 364467 - DNA, 20 bp, Artificial
  CRISPR gRNA sequence
agatccggcagtctcactac

SEQ ID NO: 364468 - DNA, 20 bp, Artificial
  CRISPR gRNA sequence
gatccggcagtctcactaca

SEQ ID NO: 364469 - DNA, 20 bp, Artificial
  CRISPR gRNA sequence
cactacagggtatctaccca

SEQ ID NO: 364470 - DNA, 20 bp, Artificial
  CRISPR gRNA sequence
actacagggtatctacccaa

SEQ ID NO: 364471 - DNA, 20 bp, Artificial
  CRISPR gRNA sequence
agggtatctacccaaaggaa

SEQ ID NO: 364472 - DNA, 20 bp, Artificial
  CRISPR gRNA sequence
ctgcccttatatgtttattg

SEQ ID NO: 364473 - DNA, 20 bp, Artificial
  CRISPR gRNA sequence
cagcactattcacaataacc

SEQ ID NO: 364474 - DNA, 20 bp, Artificial
  CRISPR gRNA sequence
tattcacaataaccaagata

SEQ ID NO: 364475 - DNA, 20 bp, Artificial
  CRISPR gRNA sequence
ccaagatatggaatcaacct

SEQ ID NO: 364476 - DNA, 20 bp, Artificial
  CRISPR gRNA sequence
aacctaagtgcccatcaatg

SEQ ID NO: 364477 - DNA, 20 bp, Artificial
  CRISPR gRNA sequence
acctaagtgcccatcaatga

SEQ ID NO: 364478 - DNA, 20 bp, Artificial
  CRISPR gRNA sequence
cctaagtgcccatcaatgaa

SEQ ID NO: 364479 - DNA, 20 bp, Artificial
  CRISPR gRNA sequence
agtgcccatcaatgaagggt

SEQ ID NO: 364480 - DNA, 20 bp, Artificial
  CRISPR gRNA sequence
catcaatgaagggttagata

SEQ ID NO: 364481 - DNA, 20 bp, Artificial
  CRISPR gRNA sequence
agggttagataaagaaactg

SEQ ID NO: 364482 - DNA, 20 bp, Artificial
  CRISPR gRNA sequence
actgtggtatatatccacaa

SEQ ID NO: 364483 - DNA, 20 bp, Artificial
  CRISPR gRNA sequence
atccacaatggaatactaca

SEQ ID NO: 364484 - DNA, 20 bp, Artificial
  CRISPR gRNA sequence
gaatactacacagccctaaa

SEQ ID NO: 364485 - DNA, 20 bp, Artificial
  CRISPR gRNA sequence
gaatgaaatcatgtcttttg

SEQ ID NO: 364486 - DNA, 20 bp, Artificial
  CRISPR gRNA sequence
tcatgtcttttgcagcaaca

SEQ ID NO: 364487 - DNA, 20 bp, Artificial
  CRISPR gRNA sequence
gtcttttgcagcaacataga

SEQ ID NO: 364488 - DNA, 20 bp, Artificial
  CRISPR gRNA sequence
ttgcagcaacatagatagac

SEQ ID NO: 364489 - DNA, 20 bp, Artificial
  CRISPR gRNA sequence
tgcagcaacatagatagacc

SEQ ID NO: 364490 - DNA, 20 bp, Artificial
  CRISPR gRNA sequence
agcaacatagatagaccggg

SEQ ID NO: 364491 - DNA, 20 bp, Artificial
  CRISPR gRNA sequence
ttatattaaatgaaacaact

SEQ ID NO: 364492 - DNA, 20 bp, Artificial
  CRISPR gRNA sequence
taaatgaaacaactcagaca

SEQ ID NO: 364493 - DNA, 20 bp, Artificial
  CRISPR gRNA sequence
cacatgttctcacttataaa

SEQ ID NO: 364494 - DNA, 20 bp, Artificial
  CRISPR gRNA sequence
acatgttctcacttataaat

SEQ ID NO: 364495 - DNA, 20 bp, Artificial
  CRISPR gRNA sequence
atgttctcacttataaatgg

SEQ ID NO: 364496 - DNA, 20 bp, Artificial
  CRISPR gRNA sequence
agcaaaataatgtgtaccca

SEQ ID NO: 364497 - DNA, 20 bp, Artificial
  CRISPR gRNA sequence
aatgtgtacccatggacata

SEQ ID NO: 364498 - DNA, 20 bp, Artificial
  CRISPR gRNA sequence
ggacatacagtatgcaataa

SEQ ID NO: 364499 - DNA, 20 bp, Artificial
  CRISPR gRNA sequence
cagtatgcaataatggacac

SEQ ID NO: 364500 - DNA, 20 bp, Artificial
  CRISPR gRNA sequence
gtatgcaataatggacactg

SEQ ID NO: 364501 - DNA, 20 bp, Artificial
  CRISPR gRNA sequence
aataatggacactggagact

SEQ ID NO: 364502 - DNA, 20 bp, Artificial
  CRISPR gRNA sequence
aatggacactggagacttgg

SEQ ID NO: 364503 - DNA, 20 bp, Artificial
  CRISPR gRNA sequence
acactggagacttggaagaa

SEQ ID NO: 364504 - DNA, 20 bp, Artificial
  CRISPR gRNA sequence
cactggagacttggaagaat

SEQ ID NO: 364505 - DNA, 20 bp, Artificial
  CRISPR gRNA sequence
ctggagacttggaagaatgg

SEQ ID NO: 364506 - DNA, 20 bp, Artificial
  CRISPR gRNA sequence
ggagacttggaagaatggga

SEQ ID NO: 364507 - DNA, 20 bp, Artificial
  CRISPR gRNA sequence
gacttggaagaatgggagag

SEQ ID NO: 364508 - DNA, 20 bp, Artificial
  CRISPR gRNA sequence
tggaagaatgggagagtaga

SEQ ID NO: 364509 - DNA, 20 bp, Artificial
  CRISPR gRNA sequence
ggaagaatgggagagtagaa

SEQ ID NO: 364510 - DNA, 20 bp, Artificial
  CRISPR gRNA sequence
gaagaatgggagagtagaaa

SEQ ID NO: 364511 - DNA, 20 bp, Artificial
  CRISPR gRNA sequence
aagaatgggagagtagaaag

SEQ ID NO: 364512 - DNA, 20 bp, Artificial
  CRISPR gRNA sequence
atgggagagtagaaaggggt

SEQ ID NO: 364513 - DNA, 20 bp, Artificial
  CRISPR gRNA sequence
tgggagagtagaaaggggtg

SEQ ID NO: 364514 - DNA, 20 bp, Artificial
  CRISPR gRNA sequence
gggagagtagaaaggggtga

SEQ ID NO: 364515 - DNA, 20 bp, Artificial
  CRISPR gRNA sequence
gagtagaaaggggtgaggga

SEQ ID NO: 364516 - DNA, 20 bp, Artificial
  CRISPR gRNA sequence
tgtgtacaacatatattatt

SEQ ID NO: 364517 - DNA, 20 bp, Artificial
  CRISPR gRNA sequence
gtgtacaacatatattattc

SEQ ID NO: 364518 - DNA, 20 bp, Artificial
  CRISPR gRNA sequence
aacatatattattcaggtga

SEQ ID NO: 364519 - DNA, 20 bp, Artificial
  CRISPR gRNA sequence
tcaggtgatggttatattaa

SEQ ID NO: 364520 - DNA, 20 bp, Artificial
  CRISPR gRNA sequence
tgatggttatattaaaagtc

SEQ ID NO: 364521 - DNA, 20 bp, Artificial
  CRISPR gRNA sequence
atacaaataaaaataataat

SEQ ID NO: 364522 - DNA, 20 bp, Artificial
  CRISPR gRNA sequence
atgaacaattgatattcaac

SEQ ID NO: 364523 - DNA, 20 bp, Artificial
  CRISPR gRNA sequence
tgaacaattgatattcaaca

SEQ ID NO: 364524 - DNA, 20 bp, Artificial
  CRISPR gRNA sequence
aacaaggtgccaaccccact

SEQ ID NO: 364525 - DNA, 20 bp, Artificial
  CRISPR gRNA sequence
aaggtgccaaccccactgag

SEQ ID NO: 364526 - DNA, 20 bp, Artificial
  CRISPR gRNA sequence
aggtgccaaccccactgagt

SEQ ID NO: 364527 - DNA, 20 bp, Artificial
  CRISPR gRNA sequence
ggtgccaaccccactgagtg

SEQ ID NO: 364528 - DNA, 20 bp, Artificial
  CRISPR gRNA sequence
ccaaccccactgagtgggga

SEQ ID NO: 364529 - DNA, 20 bp, Artificial
  CRISPR gRNA sequence
cccactgagtggggaaagaa

SEQ ID NO: 364530 - DNA, 20 bp, Artificial
  CRISPR gRNA sequence
agaatagcttcttcaataaa

SEQ ID NO: 364531 - DNA, 20 bp, Artificial
  CRISPR gRNA sequence
gcttcttcaataaatggtcc

SEQ ID NO: 364532 - DNA, 20 bp, Artificial
  CRISPR gRNA sequence
cttcttcaataaatggtcct

SEQ ID NO: 364533 - DNA, 20 bp, Artificial
  CRISPR gRNA sequence
ataaatggtcctgggacaac

SEQ ID NO: 364534 - DNA, 20 bp, Artificial
  CRISPR gRNA sequence
atggtcctgggacaactgga

SEQ ID NO: 364535 - DNA, 20 bp, Artificial
  CRISPR gRNA sequence
aactggatagccacatgcaa

SEQ ID NO: 364536 - DNA, 20 bp, Artificial
  CRISPR gRNA sequence
cacatgcaaaagcatgaaat

SEQ ID NO: 364537 - DNA, 20 bp, Artificial
  CRISPR gRNA sequence
acacaaaaattaactcaaaa

SEQ ID NO: 364538 - DNA, 20 bp, Artificial
  CRISPR gRNA sequence
cacaaaaattaactcaaaat

SEQ ID NO: 364539 - DNA, 20 bp, Artificial
  CRISPR gRNA sequence
aaatgggttgacctaaatat

SEQ ID NO: 364540 - DNA, 20 bp, Artificial
  CRISPR gRNA sequence
ttgacctaaatataagacct

SEQ ID NO: 364541 - DNA, 20 bp, Artificial
  CRISPR gRNA sequence
aaatataagacctcagactg

SEQ ID NO: 364542 - DNA, 20 bp, Artificial
  CRISPR gRNA sequence
acctcagactgtagaaatct

SEQ ID NO: 364543 - DNA, 20 bp, Artificial
  CRISPR gRNA sequence
gactgtagaaatcttagaat

SEQ ID NO: 364544 - DNA, 20 bp, Artificial
  CRISPR gRNA sequence
tagaaatcttagaataagca

SEQ ID NO: 364545 - DNA, 20 bp, Artificial
  CRISPR gRNA sequence
agaaatcttagaataagcac

SEQ ID NO: 364546 - DNA, 20 bp, Artificial
  CRISPR gRNA sequence
gaaatcttagaataagcaca

SEQ ID NO: 364547 - DNA, 20 bp, Artificial
  CRISPR gRNA sequence
aaatcttagaataagcacag

SEQ ID NO: 364548 - DNA, 20 bp, Artificial
  CRISPR gRNA sequence
aagcacaggggtaaattttt

SEQ ID NO: 364549 - DNA, 20 bp, Artificial
  CRISPR gRNA sequence
aggggtaaatttttaagacc

SEQ ID NO: 364550 - DNA, 20 bp, Artificial
  CRISPR gRNA sequence
ggtaaatttttaagacctgg

SEQ ID NO: 364551 - DNA, 20 bp, Artificial
  CRISPR gRNA sequence
taagacctggaagttgtcaa

SEQ ID NO: 364552 - DNA, 20 bp, Artificial
  CRISPR gRNA sequence
ggaagttgtcaacggattct

SEQ ID NO: 364553 - DNA, 20 bp, Artificial
  CRISPR gRNA sequence
caacggattcttagacatga

SEQ ID NO: 364554 - DNA, 20 bp, Artificial
  CRISPR gRNA sequence
tagacatgacagcaaaccta

SEQ ID NO: 364555 - DNA, 20 bp, Artificial
  CRISPR gRNA sequence
agacatgacagcaaacctat

SEQ ID NO: 364556 - DNA, 20 bp, Artificial
  CRISPR gRNA sequence
agcaaacctatgggcaacaa

SEQ ID NO: 364557 - DNA, 20 bp, Artificial
  CRISPR gRNA sequence
aacaaaagaaaaaaataaat

SEQ ID NO: 364558 - DNA, 20 bp, Artificial
  CRISPR gRNA sequence
ttaaaaacttttgtgcatca

SEQ ID NO: 364559 - DNA, 20 bp, Artificial
  CRISPR gRNA sequence
taaaaacttttgtgcatcaa

SEQ ID NO: 364560 - DNA, 20 bp, Artificial
  CRISPR gRNA sequence
gtgcatcaaaggacattttc

SEQ ID NO: 364561 - DNA, 20 bp, Artificial
  CRISPR gRNA sequence
atcaaaggacattttcaaga

SEQ ID NO: 364562 - DNA, 20 bp, Artificial
  CRISPR gRNA sequence
gacattttcaagaaagtgaa

SEQ ID NO: 364563 - DNA, 20 bp, Artificial
  CRISPR gRNA sequence
gaaagtgaaaagtcacccta

SEQ ID NO: 364564 - DNA, 20 bp, Artificial
  CRISPR gRNA sequence
aaagtcaccctacagaatgc

SEQ ID NO: 364565 - DNA, 20 bp, Artificial
  CRISPR gRNA sequence
gcaaataatctatctgatta

SEQ ID NO: 364566 - DNA, 20 bp, Artificial
  CRISPR gRNA sequence
gtctaatatccataatatat

SEQ ID NO: 364567 - DNA, 20 bp, Artificial
  CRISPR gRNA sequence
tctaatatccataatatata

SEQ ID NO: 364568 - DNA, 20 bp, Artificial
  CRISPR gRNA sequence
actctcacactttaacataa

SEQ ID NO: 364569 - DNA, 20 bp, Artificial
  CRISPR gRNA sequence
gaaacaacccaattttcaaa

SEQ ID NO: 364570 - DNA, 20 bp, Artificial
  CRISPR gRNA sequence
aaacaacccaattttcaaat

SEQ ID NO: 364571 - DNA, 20 bp, Artificial
  CRISPR gRNA sequence
acccaattttcaaatgggca

SEQ ID NO: 364572 - DNA, 20 bp, Artificial
  CRISPR gRNA sequence
aaatgggcaaagtacttgaa

SEQ ID NO: 364573 - DNA, 20 bp, Artificial
  CRISPR gRNA sequence
gaatagacatttttctccaa

SEQ ID NO: 364574 - DNA, 20 bp, Artificial
  CRISPR gRNA sequence
caaaagatgctcaacattat

SEQ ID NO: 364575 - DNA, 20 bp, Artificial
  CRISPR gRNA sequence
gctcaacattatcagtcaat

SEQ ID NO: 364576 - DNA, 20 bp, Artificial
  CRISPR gRNA sequence
ctcaacattatcagtcaata

SEQ ID NO: 364577 - DNA, 20 bp, Artificial
  CRISPR gRNA sequence
gtcaataaggaaacacaaat

SEQ ID NO: 364578 - DNA, 20 bp, Artificial
  CRISPR gRNA sequence
acacaaataagaaccacaat

SEQ ID NO: 364579 - DNA, 20 bp, Artificial
  CRISPR gRNA sequence
agaactcactttatatctac

SEQ ID NO: 364580 - DNA, 20 bp, Artificial
  CRISPR gRNA sequence
gaactcactttatatctact

SEQ ID NO: 364581 - DNA, 20 bp, Artificial
  CRISPR gRNA sequence
tcactttatatctactagga

SEQ ID NO: 364582 - DNA, 20 bp, Artificial
  CRISPR gRNA sequence
ctaggatggacataatcaaa

SEQ ID NO: 364583 - DNA, 20 bp, Artificial
  CRISPR gRNA sequence
aggatggacataatcaaaaa

SEQ ID NO: 364584 - DNA, 20 bp, Artificial
  CRISPR gRNA sequence
aaagagaaaaattaatatgt

SEQ ID NO: 364585 - DNA, 20 bp, Artificial
  CRISPR gRNA sequence
aagagaaaaattaatatgtt

SEQ ID NO: 364586 - DNA, 20 bp, Artificial
  CRISPR gRNA sequence
agagaaaaattaatatgtta

SEQ ID NO: 364587 - DNA, 20 bp, Artificial
  CRISPR gRNA sequence
ttaatatgttagggaaaatg

SEQ ID NO: 364588 - DNA, 20 bp, Artificial
  CRISPR gRNA sequence
aatatgttagggaaaatgtg

SEQ ID NO: 364589 - DNA, 20 bp, Artificial
  CRISPR gRNA sequence
acccttgtgtactgttgcac

SEQ ID NO: 364590 - DNA, 20 bp, Artificial
  CRISPR gRNA sequence
actgttgcacaagcgttgta

SEQ ID NO: 364591 - DNA, 20 bp, Artificial
  CRISPR gRNA sequence
taaagaaatgtaaaatgatg

SEQ ID NO: 364592 - DNA, 20 bp, Artificial
  CRISPR gRNA sequence
aaaatgatgcagctgctgtg

SEQ ID NO: 364593 - DNA, 20 bp, Artificial
  CRISPR gRNA sequence
gatgcagctgctgtgaagaa

SEQ ID NO: 364594 - DNA, 20 bp, Artificial
  CRISPR gRNA sequence
agctgctgtgaagaacagtt

SEQ ID NO: 364595 - DNA, 20 bp, Artificial
  CRISPR gRNA sequence
ctgctgtgaagaacagttta

SEQ ID NO: 364596 - DNA, 20 bp, Artificial
  CRISPR gRNA sequence
agattcttcaaaacgttcaa

SEQ ID NO: 364597 - DNA, 20 bp, Artificial
  CRISPR gRNA sequence
gattcttcaaaacgttcaac

SEQ ID NO: 364598 - DNA, 20 bp, Artificial
  CRISPR gRNA sequence
aacaggattactgtatgacc

SEQ ID NO: 364599 - DNA, 20 bp, Artificial
  CRISPR gRNA sequence
aggattactgtatgacccag

SEQ ID NO: 364600 - DNA, 20 bp, Artificial
  CRISPR gRNA sequence
tgacccagaagttttattcc

SEQ ID NO: 364601 - DNA, 20 bp, Artificial
  CRISPR gRNA sequence
gacccagaagttttattcct

SEQ ID NO: 364602 - DNA, 20 bp, Artificial
  CRISPR gRNA sequence
attcctaggtatatactcaa

SEQ ID NO: 364603 - DNA, 20 bp, Artificial
  CRISPR gRNA sequence
tatactcaaaccaatatttg

SEQ ID NO: 364604 - DNA, 20 bp, Artificial
  CRISPR gRNA sequence
tatttgtagaccaatgttta

SEQ ID NO: 364605 - DNA, 20 bp, Artificial
  CRISPR gRNA sequence
ttgtagaccaatgtttacag

SEQ ID NO: 364606 - DNA, 20 bp, Artificial
  CRISPR gRNA sequence
tacagcagcattattcacaa

SEQ ID NO: 364607 - DNA, 20 bp, Artificial
  CRISPR gRNA sequence
gcagcattattcacaaaagc

SEQ ID NO: 364608 - DNA, 20 bp, Artificial
  CRISPR gRNA sequence
gcattattcacaaaagccag

SEQ ID NO: 364609 - DNA, 20 bp, Artificial
  CRISPR gRNA sequence
cattattcacaaaagccaga

SEQ ID NO: 364610 - DNA, 20 bp, Artificial
  CRISPR gRNA sequence
tattcacaaaagccagaagg

SEQ ID NO: 364611 - DNA, 20 bp, Artificial
  CRISPR gRNA sequence
ccagaaggtggtaacgatcc

SEQ ID NO: 364612 - DNA, 20 bp, Artificial
  CRISPR gRNA sequence
acgatccaagcgtctgccaa

SEQ ID NO: 364613 - DNA, 20 bp, Artificial
  CRISPR gRNA sequence
cgatccaagcgtctgccaac

SEQ ID NO: 364614 - DNA, 20 bp, Artificial
  CRISPR gRNA sequence
ttgtgatcaaatccatacaa

SEQ ID NO: 364615 - DNA, 20 bp, Artificial
  CRISPR gRNA sequence
ccatacaatggaatattact

SEQ ID NO: 364616 - DNA, 20 bp, Artificial
  CRISPR gRNA sequence
gaatattactcagccataaa

SEQ ID NO: 364617 - DNA, 20 bp, Artificial
  CRISPR gRNA sequence
aatattactcagccataaaa

SEQ ID NO: 364618 - DNA, 20 bp, Artificial
  CRISPR gRNA sequence
ctcagccataaaaaggaatg

SEQ ID NO: 364619 - DNA, 20 bp, Artificial
  CRISPR gRNA sequence
tcagccataaaaaggaatga

SEQ ID NO: 364620 - DNA, 20 bp, Artificial
  CRISPR gRNA sequence
cagccataaaaaggaatgaa

SEQ ID NO: 364621 - DNA, 20 bp, Artificial
  CRISPR gRNA sequence
atgcatgctacaacatgaat

SEQ ID NO: 364622 - DNA, 20 bp, Artificial
  CRISPR gRNA sequence
agccttgataacattatgct

SEQ ID NO: 364623 - DNA, 20 bp, Artificial
  CRISPR gRNA sequence
gataacattatgctaagtca

SEQ ID NO: 364624 - DNA, 20 bp, Artificial
  CRISPR gRNA sequence
ttatgctaagtcaaagaatg

SEQ ID NO: 364625 - DNA, 20 bp, Artificial
  CRISPR gRNA sequence
gtcaaagaatgcagaaacaa

SEQ ID NO: 364626 - DNA, 20 bp, Artificial
  CRISPR gRNA sequence
tcaaagaatgcagaaacaaa

SEQ ID NO: 364627 - DNA, 20 bp, Artificial
  CRISPR gRNA sequence
aacaaaaggccacattttgt

SEQ ID NO: 364628 - DNA, 20 bp, Artificial
  CRISPR gRNA sequence
atccatttatatgaaatatc

SEQ ID NO: 364629 - DNA, 20 bp, Artificial
  CRISPR gRNA sequence
atttatatgaaatatccaga

SEQ ID NO: 364630 - DNA, 20 bp, Artificial
  CRISPR gRNA sequence
tatccagatagttaaatcca

SEQ ID NO: 364631 - DNA, 20 bp, Artificial
  CRISPR gRNA sequence
tccagatagttaaatccatg

SEQ ID NO: 364632 - DNA, 20 bp, Artificial
  CRISPR gRNA sequence
gatagttaaatccatggaga

SEQ ID NO: 364633 - DNA, 20 bp, Artificial
  CRISPR gRNA sequence
gttaaatccatggagatgga

SEQ ID NO: 364634 - DNA, 20 bp, Artificial
  CRISPR gRNA sequence
aaatccatggagatggaaag

SEQ ID NO: 364635 - DNA, 20 bp, Artificial
  CRISPR gRNA sequence
catggagatggaaagcagat

SEQ ID NO: 364636 - DNA, 20 bp, Artificial
  CRISPR gRNA sequence
tttgccaattgattgactgt

SEQ ID NO: 364637 - DNA, 20 bp, Artificial
  CRISPR gRNA sequence
gccaattgattgactgttgg

SEQ ID NO: 364638 - DNA, 20 bp, Artificial
  CRISPR gRNA sequence
ccaattgattgactgttgga

SEQ ID NO: 364639 - DNA, 20 bp, Artificial
  CRISPR gRNA sequence
aattgattgactgttggaag

SEQ ID NO: 364640 - DNA, 20 bp, Artificial
  CRISPR gRNA sequence
attgattgactgttggaagg

SEQ ID NO: 364641 - DNA, 20 bp, Artificial
  CRISPR gRNA sequence
ttgattgactgttggaagga

SEQ ID NO: 364642 - DNA, 20 bp, Artificial
  CRISPR gRNA sequence
tgactgttggaaggagggaa

SEQ ID NO: 364643 - DNA, 20 bp, Artificial
  CRISPR gRNA sequence
gactgttggaaggagggaat

SEQ ID NO: 364644 - DNA, 20 bp, Artificial
  CRISPR gRNA sequence
actgttggaaggagggaata

SEQ ID NO: 364645 - DNA, 20 bp, Artificial
  CRISPR gRNA sequence
tgttggaaggagggaatagg

SEQ ID NO: 364646 - DNA, 20 bp, Artificial
  CRISPR gRNA sequence
ggaatagggagtgactgttt

SEQ ID NO: 364647 - DNA, 20 bp, Artificial
  CRISPR gRNA sequence
gaatagggagtgactgttta

SEQ ID NO: 364648 - DNA, 20 bp, Artificial
  CRISPR gRNA sequence
gggagtgactgtttaaggta

SEQ ID NO: 364649 - DNA, 20 bp, Artificial
  CRISPR gRNA sequence
ggagtgactgtttaaggtat

SEQ ID NO: 364650 - DNA, 20 bp, Artificial
  CRISPR gRNA sequence
gagtgactgtttaaggtatg

SEQ ID NO: 364651 - DNA, 20 bp, Artificial
  CRISPR gRNA sequence
ttaaaatgatgaaaatgttt

SEQ ID NO: 364652 - DNA, 20 bp, Artificial
  CRISPR gRNA sequence
aatgttttggaatctgataa

SEQ ID NO: 364653 - DNA, 20 bp, Artificial
  CRISPR gRNA sequence
gttttggaatctgataaaag

SEQ ID NO: 364654 - DNA, 20 bp, Artificial
  CRISPR gRNA sequence
tctgataaaagcggtcatca

SEQ ID NO: 364655 - DNA, 20 bp, Artificial
  CRISPR gRNA sequence
gcggtcatcacagaacactg

SEQ ID NO: 364656 - DNA, 20 bp, Artificial
  CRISPR gRNA sequence
taaaatatttaatcttgacc

SEQ ID NO: 364657 - DNA, 20 bp, Artificial
  CRISPR gRNA sequence
tatttaatcttgacctggtg

SEQ ID NO: 364658 - DNA, 20 bp, Artificial
  CRISPR gRNA sequence
ttaatcttgacctggtgtgg

SEQ ID NO: 364659 - DNA, 20 bp, Artificial
  CRISPR gRNA sequence
gtggctcacacctgtaatcc

SEQ ID NO: 364660 - DNA, 20 bp, Artificial
  CRISPR gRNA sequence
cacctgtaatcccagtactt

SEQ ID NO: 364661 - DNA, 20 bp, Artificial
  CRISPR gRNA sequence
acctgtaatcccagtacttt

SEQ ID NO: 364662 - DNA, 20 bp, Artificial
  CRISPR gRNA sequence
ctgtaatcccagtactttgg

SEQ ID NO: 364663 - DNA, 20 bp, Artificial
  CRISPR gRNA sequence
tgtaatcccagtactttggg

SEQ ID NO: 364664 - DNA, 20 bp, Artificial
  CRISPR gRNA sequence
tcccagtactttgggaggcc

SEQ ID NO: 364665 - DNA, 20 bp, Artificial
  CRISPR gRNA sequence
cccagtactttgggaggcca

SEQ ID NO: 364666 - DNA, 20 bp, Artificial
  CRISPR gRNA sequence
agtactttgggaggccaagg

SEQ ID NO: 364667 - DNA, 20 bp, Artificial
  CRISPR gRNA sequence
gtactttgggaggccaaggc

SEQ ID NO: 364668 - DNA, 20 bp, Artificial
  CRISPR gRNA sequence
ctttgggaggccaaggcagg

SEQ ID NO: 364669 - DNA, 20 bp, Artificial
  CRISPR gRNA sequence
ccaaggcaggtggattgctt

SEQ ID NO: 364670 - DNA, 20 bp, Artificial
  CRISPR gRNA sequence
caaggcaggtggattgcttg

SEQ ID NO: 364671 - DNA, 20 bp, Artificial
  CRISPR gRNA sequence
gcaggtggattgcttgaggt

SEQ ID NO: 364672 - DNA, 20 bp, Artificial
  CRISPR gRNA sequence
caggtggattgcttgaggtc

SEQ ID NO: 364673 - DNA, 20 bp, Artificial
  CRISPR gRNA sequence
tgaggtcaggaattcaaaac

SEQ ID NO: 364674 - DNA, 20 bp, Artificial
  CRISPR gRNA sequence
tcaggaattcaaaaccagcc

SEQ ID NO: 364675 - DNA, 20 bp, Artificial
  CRISPR gRNA sequence
caaaaccagcctggccaaca

SEQ ID NO: 364676 - DNA, 20 bp, Artificial
  CRISPR gRNA sequence
tctactaaaaatacaaaaat

SEQ ID NO: 364677 - DNA, 20 bp, Artificial
  CRISPR gRNA sequence
atacaaaaattagctgtgcg

SEQ ID NO: 364678 - DNA, 20 bp, Artificial
  CRISPR gRNA sequence
caaaaattagctgtgcgtgg

SEQ ID NO: 364679 - DNA, 20 bp, Artificial
  CRISPR gRNA sequence
gtggtgcgcaactgtaatcc

SEQ ID NO: 364680 - DNA, 20 bp, Artificial
  CRISPR gRNA sequence
caactgtaatcccagctact

SEQ ID NO: 364681 - DNA, 20 bp, Artificial
  CRISPR gRNA sequence
aactgtaatcccagctactt

SEQ ID NO: 364682 - DNA, 20 bp, Artificial
  CRISPR gRNA sequence
ctgtaatcccagctacttgg

SEQ ID NO: 364683 - DNA, 20 bp, Artificial
  CRISPR gRNA sequence
tgtaatcccagctacttggg

SEQ ID NO: 364684 - DNA, 20 bp, Artificial
  CRISPR gRNA sequence
tcccagctacttgggaggct

SEQ ID NO: 364685 - DNA, 20 bp, Artificial
  CRISPR gRNA sequence
agctacttgggaggctgaga

SEQ ID NO: 364686 - DNA, 20 bp, Artificial
  CRISPR gRNA sequence
gctacttgggaggctgagac

SEQ ID NO: 364687 - DNA, 20 bp, Artificial
  CRISPR gRNA sequence
tacttgggaggctgagacag

SEQ ID NO: 364688 - DNA, 20 bp, Artificial
  CRISPR gRNA sequence
acaggagaatcgcttgaacc

SEQ ID NO: 364689 - DNA, 20 bp, Artificial
  CRISPR gRNA sequence
caggagaatcgcttgaaccc

SEQ ID NO: 364690 - DNA, 20 bp, Artificial
  CRISPR gRNA sequence
ggagaatcgcttgaacccag

SEQ ID NO: 364691 - DNA, 20 bp, Artificial
  CRISPR gRNA sequence
gagaatcgcttgaacccagg

SEQ ID NO: 364692 - DNA, 20 bp, Artificial
  CRISPR gRNA sequence
aatcgcttgaacccaggagg

SEQ ID NO: 364693 - DNA, 20 bp, Artificial
  CRISPR gRNA sequence
tcgcttgaacccaggaggtg

SEQ ID NO: 364694 - DNA, 20 bp, Artificial
  CRISPR gRNA sequence
cgcttgaacccaggaggtgg

SEQ ID NO: 364695 - DNA, 20 bp, Artificial
  CRISPR gRNA sequence
aacccaggaggtggaggttg

SEQ ID NO: 364696 - DNA, 20 bp, Artificial
  CRISPR gRNA sequence
caggaggtggaggttgcagt

SEQ ID NO: 364697 - DNA, 20 bp, Artificial
  CRISPR gRNA sequence
ggtggaggttgcagtgagct

SEQ ID NO: 364698 - DNA, 20 bp, Artificial
  CRISPR gRNA sequence
gagattgtgccactgcactc

SEQ ID NO: 364699 - DNA, 20 bp, Artificial
  CRISPR gRNA sequence
ttgtgccactgcactccagc

SEQ ID NO: 364700 - DNA, 20 bp, Artificial
  CRISPR gRNA sequence
tgtgccactgcactccagcc

SEQ ID NO: 364701 - DNA, 20 bp, Artificial
  CRISPR gRNA sequence
ctgcactccagccaggtcaa

SEQ ID NO: 364702 - DNA, 20 bp, Artificial
  CRISPR gRNA sequence
gcactccagccaggtcaaca

SEQ ID NO: 364703 - DNA, 20 bp, Artificial
  CRISPR gRNA sequence
tccagccaggtcaacagagc

SEQ ID NO: 364704 - DNA, 20 bp, Artificial
  CRISPR gRNA sequence
gtttcaaaaaaaaaaaaaaa

SEQ ID NO: 364705 - DNA, 20 bp, Artificial
  CRISPR gRNA sequence
atcttatgttgactaaatct

SEQ ID NO: 364706 - DNA, 20 bp, Artificial
  CRISPR gRNA sequence
tcttatgttgactaaatctt

SEQ ID NO: 364707 - DNA, 20 bp, Artificial
  CRISPR gRNA sequence
caatttttaaaaattgttac

SEQ ID NO: 364708 - DNA, 20 bp, Artificial
  CRISPR gRNA sequence
taaaaattgttactagtgaa

SEQ ID NO: 364709 - DNA, 20 bp, Artificial
  CRISPR gRNA sequence
ttgttactagtgaatagtat

SEQ ID NO: 364710 - DNA, 20 bp, Artificial
  CRISPR gRNA sequence
gtatgagtccacattcaccc

SEQ ID NO: 364711 - DNA, 20 bp, Artificial
  CRISPR gRNA sequence
tatgagtccacattcacccc

SEQ ID NO: 364712 - DNA, 20 bp, Artificial
  CRISPR gRNA sequence
cccaggtcttaccaatgaat

SEQ ID NO: 364713 - DNA, 20 bp, Artificial
  CRISPR gRNA sequence
ccaggtcttaccaatgaatg

SEQ ID NO: 364714 - DNA, 20 bp, Artificial
  CRISPR gRNA sequence
aggccaccccatcttgctgt

SEQ ID NO: 364715 - DNA, 20 bp, Artificial
  CRISPR gRNA sequence
atttgatcccccaaccaccc

SEQ ID NO: 364716 - DNA, 20 bp, Artificial
  CRISPR gRNA sequence
cccccaaccaccccggtcca

SEQ ID NO: 364717 - DNA, 20 bp, Artificial
  CRISPR gRNA sequence
caccccggtccaaagatgcc

SEQ ID NO: 364718 - DNA, 20 bp, Artificial
  CRISPR gRNA sequence
aaagatgccaagtacattct

SEQ ID NO: 364719 - DNA, 20 bp, Artificial
  CRISPR gRNA sequence
ccaagtacattctaagaata

SEQ ID NO: 364720 - DNA, 20 bp, Artificial
  CRISPR gRNA sequence
attctaagaatacagtacat

SEQ ID NO: 364721 - DNA, 20 bp, Artificial
  CRISPR gRNA sequence
aagaatacagtacattagca

SEQ ID NO: 364722 - DNA, 20 bp, Artificial
  CRISPR gRNA sequence
tacagtacattagcatagta

SEQ ID NO: 364723 - DNA, 20 bp, Artificial
  CRISPR gRNA sequence
acattagcatagtacagtct

SEQ ID NO: 364724 - DNA, 20 bp, Artificial
  CRISPR gRNA sequence
agcatagtacagtctaagca

SEQ ID NO: 364725 - DNA, 20 bp, Artificial
  CRISPR gRNA sequence
catagtacagtctaagcata

SEQ ID NO: 364726 - DNA, 20 bp, Artificial
  CRISPR gRNA sequence
cagtctaagcatagagtcca

SEQ ID NO: 364727 - DNA, 20 bp, Artificial
  CRISPR gRNA sequence
ctgtcacaactttgtgataa

SEQ ID NO: 364728 - DNA, 20 bp, Artificial
  CRISPR gRNA sequence
cacaactttgtgataacagc

SEQ ID NO: 364729 - DNA, 20 bp, Artificial
  CRISPR gRNA sequence
gctggaaatcaataatgcaa

SEQ ID NO: 364730 - DNA, 20 bp, Artificial
  CRISPR gRNA sequence
aataatgcaaaagatcatga

SEQ ID NO: 364731 - DNA, 20 bp, Artificial
  CRISPR gRNA sequence
tgcaaaagatcatgatagtc

SEQ ID NO: 364732 - DNA, 20 bp, Artificial
  CRISPR gRNA sequence
gcaaaagatcatgatagtcg

SEQ ID NO: 364733 - DNA, 20 bp, Artificial
  CRISPR gRNA sequence
atcatgatagtcgaggttgt

SEQ ID NO: 364734 - DNA, 20 bp, Artificial
  CRISPR gRNA sequence
ggttgtcagataaatgattt

SEQ ID NO: 364735 - DNA, 20 bp, Artificial
  CRISPR gRNA sequence
ccaaaacatatctattttct

SEQ ID NO: 364736 - DNA, 20 bp, Artificial
  CRISPR gRNA sequence
caaaacatatctattttctg

SEQ ID NO: 364737 - DNA, 20 bp, Artificial
  CRISPR gRNA sequence
aaaacatatctattttctga

SEQ ID NO: 364738 - DNA, 20 bp, Artificial
  CRISPR gRNA sequence
aacatatctattttctgagg

SEQ ID NO: 364739 - DNA, 20 bp, Artificial
  CRISPR gRNA sequence
acatatctattttctgaggg

SEQ ID NO: 364740 - DNA, 20 bp, Artificial
  CRISPR gRNA sequence
catatctattttctgaggga

SEQ ID NO: 364741 - DNA, 20 bp, Artificial
  CRISPR gRNA sequence
atatctattttctgagggag

SEQ ID NO: 364742 - DNA, 20 bp, Artificial
  CRISPR gRNA sequence
ctattttctgagggaggggt

SEQ ID NO: 364743 - DNA, 20 bp, Artificial
  CRISPR gRNA sequence
tattttctgagggaggggtc

SEQ ID NO: 364744 - DNA, 20 bp, Artificial
  CRISPR gRNA sequence
attttctgagggaggggtca

SEQ ID NO: 364745 - DNA, 20 bp, Artificial
  CRISPR gRNA sequence
tctgagggaggggtcagggt

SEQ ID NO: 364746 - DNA, 20 bp, Artificial
  CRISPR gRNA sequence
ctgagggaggggtcagggtt

SEQ ID NO: 364747 - DNA, 20 bp, Artificial
  CRISPR gRNA sequence
ggaggggtcagggttgggta

SEQ ID NO: 364748 - DNA, 20 bp, Artificial
  CRISPR gRNA sequence
ggggtcagggttgggtaaag

SEQ ID NO: 364749 - DNA, 20 bp, Artificial
  CRISPR gRNA sequence
gggtcagggttgggtaaagt

SEQ ID NO: 364750 - DNA, 20 bp, Artificial
  CRISPR gRNA sequence
ggtcagggttgggtaaagtg

SEQ ID NO: 364751 - DNA, 20 bp, Artificial
  CRISPR gRNA sequence
cagggttgggtaaagtgggg

SEQ ID NO: 364752 - DNA, 20 bp, Artificial
  CRISPR gRNA sequence
gggttgggtaaagtggggta

SEQ ID NO: 364753 - DNA, 20 bp, Artificial
  CRISPR gRNA sequence
ggttgggtaaagtggggtag

SEQ ID NO: 364754 - DNA, 20 bp, Artificial
  CRISPR gRNA sequence
ggtaaagtggggtagaggtg

SEQ ID NO: 364755 - DNA, 20 bp, Artificial
  CRISPR gRNA sequence
gtaaagtggggtagaggtgc

SEQ ID NO: 364756 - DNA, 20 bp, Artificial
  CRISPR gRNA sequence
aagtggggtagaggtgcagg

SEQ ID NO: 364757 - DNA, 20 bp, Artificial
  CRISPR gRNA sequence
gtggggtagaggtgcaggta

SEQ ID NO: 364758 - DNA, 20 bp, Artificial
  CRISPR gRNA sequence
ggggtagaggtgcaggtaga

SEQ ID NO: 364759 - DNA, 20 bp, Artificial
  CRISPR gRNA sequence
gggtagaggtgcaggtagag

SEQ ID NO: 364760 - DNA, 20 bp, Artificial
  CRISPR gRNA sequence
tagaggtgcaggtagagagg

SEQ ID NO: 364761 - DNA, 20 bp, Artificial
  CRISPR gRNA sequence
aggtgcaggtagagaggtag

SEQ ID NO: 364762 - DNA, 20 bp, Artificial
  CRISPR gRNA sequence
ggtgcaggtagagaggtaga

SEQ ID NO: 364763 - DNA, 20 bp, Artificial
  CRISPR gRNA sequence
gtgcaggtagagaggtagaa

SEQ ID NO: 364764 - DNA, 20 bp, Artificial
  CRISPR gRNA sequence
ggtagagaggtagaagggct

SEQ ID NO: 364765 - DNA, 20 bp, Artificial
  CRISPR gRNA sequence
gtagagaggtagaagggctg

SEQ ID NO: 364766 - DNA, 20 bp, Artificial
  CRISPR gRNA sequence
tagagaggtagaagggctga

SEQ ID NO: 364767 - DNA, 20 bp, Artificial
  CRISPR gRNA sequence
aggtagaagggctgagggcc

SEQ ID NO: 364768 - DNA, 20 bp, Artificial
  CRISPR gRNA sequence
tagaagggctgagggccaag

SEQ ID NO: 364769 - DNA, 20 bp, Artificial
  CRISPR gRNA sequence
agaagggctgagggccaagc

SEQ ID NO: 364770 - DNA, 20 bp, Artificial
  CRISPR gRNA sequence
ccgtgctgcctcaaatccta

SEQ ID NO: 364771 - DNA, 20 bp, Artificial
  CRISPR gRNA sequence
cgtgctgcctcaaatcctaa

SEQ ID NO: 364772 - DNA, 20 bp, Artificial
  CRISPR gRNA sequence
cctcaaatcctaaaggaaat

SEQ ID NO: 364773 - DNA, 20 bp, Artificial
  CRISPR gRNA sequence
aaaggaaatgagatgaaacc

SEQ ID NO: 364774 - DNA, 20 bp, Artificial
  CRISPR gRNA sequence
aacctagcatcatccactct

SEQ ID NO: 364775 - DNA, 20 bp, Artificial
  CRISPR gRNA sequence
ctagcatcatccactctcgg

SEQ ID NO: 364776 - DNA, 20 bp, Artificial
  CRISPR gRNA sequence
ctctcggtggtttctatgat

SEQ ID NO: 364777 - DNA, 20 bp, Artificial
  CRISPR gRNA sequence
tctcggtggtttctatgatc

SEQ ID NO: 364778 - DNA, 20 bp, Artificial
  CRISPR gRNA sequence
ggtttctatgatcaggccca

SEQ ID NO: 364779 - DNA, 20 bp, Artificial
  CRISPR gRNA sequence
ccaaagtgaacttcctcacc

SEQ ID NO: 364780 - DNA, 20 bp, Artificial
  CRISPR gRNA sequence
caaagtgaacttcctcaccc

SEQ ID NO: 364781 - DNA, 20 bp, Artificial
  CRISPR gRNA sequence
gaacttcctcacccaggata

SEQ ID NO: 364782 - DNA, 20 bp, Artificial
  CRISPR gRNA sequence
ctcacccaggataaagaaat

SEQ ID NO: 364783 - DNA, 20 bp, Artificial
  CRISPR gRNA sequence
tcacccaggataaagaaatg

SEQ ID NO: 364784 - DNA, 20 bp, Artificial
  CRISPR gRNA sequence
ggataaagaaatgaggttca

SEQ ID NO: 364785 - DNA, 20 bp, Artificial
  CRISPR gRNA sequence
gataaagaaatgaggttcat

SEQ ID NO: 364786 - DNA, 20 bp, Artificial
  CRISPR gRNA sequence
taaagaaatgaggttcatgg

SEQ ID NO: 364787 - DNA, 20 bp, Artificial
  CRISPR gRNA sequence
aaagaaatgaggttcatggg

SEQ ID NO: 364788 - DNA, 20 bp, Artificial
  CRISPR gRNA sequence
agaaatgaggttcatgggag

SEQ ID NO: 364789 - DNA, 20 bp, Artificial
  CRISPR gRNA sequence
gaaatgaggttcatgggagg

SEQ ID NO: 364790 - DNA, 20 bp, Artificial
  CRISPR gRNA sequence
gaggttcatgggaggaggac

SEQ ID NO: 364791 - DNA, 20 bp, Artificial
  CRISPR gRNA sequence
tcatgggaggaggactggaa

SEQ ID NO: 364792 - DNA, 20 bp, Artificial
  CRISPR gRNA sequence
catgggaggaggactggaaa

SEQ ID NO: 364793 - DNA, 20 bp, Artificial
  CRISPR gRNA sequence
atgggaggaggactggaaaa

SEQ ID NO: 364794 - DNA, 20 bp, Artificial
  CRISPR gRNA sequence
tgggaggaggactggaaaag

SEQ ID NO: 364795 - DNA, 20 bp, Artificial
  CRISPR gRNA sequence
actggaaaaggggtactaac

SEQ ID NO: 364796 - DNA, 20 bp, Artificial
  CRISPR gRNA sequence
tactaactggtaataacttg

SEQ ID NO: 364797 - DNA, 20 bp, Artificial
  CRISPR gRNA sequence
actaactggtaataacttgt

SEQ ID NO: 364798 - DNA, 20 bp, Artificial
  CRISPR gRNA sequence
tgtaggaactccttattccc

SEQ ID NO: 364799 - DNA, 20 bp, Artificial
  CRISPR gRNA sequence
gtaggaactccttattccca

SEQ ID NO: 364800 - DNA, 20 bp, Artificial
  CRISPR gRNA sequence
ctccttattcccaaggcatc

SEQ ID NO: 364801 - DNA, 20 bp, Artificial
  CRISPR gRNA sequence
ccttattcccaaggcatcca

SEQ ID NO: 364802 - DNA, 20 bp, Artificial
  CRISPR gRNA sequence
ccaaggcatccagagccaac

SEQ ID NO: 364803 - DNA, 20 bp, Artificial
  CRISPR gRNA sequence
gcatccagagccaactagtc

SEQ ID NO: 364804 - DNA, 20 bp, Artificial
  CRISPR gRNA sequence
atccagagccaactagtcaa

SEQ ID NO: 364805 - DNA, 20 bp, Artificial
  CRISPR gRNA sequence
agccaactagtcaagagatg

SEQ ID NO: 364806 - DNA, 20 bp, Artificial
  CRISPR gRNA sequence
ccaactagtcaagagatgaa

SEQ ID NO: 364807 - DNA, 20 bp, Artificial
  CRISPR gRNA sequence
gaacttgtgtatttgcaccc

SEQ ID NO: 364808 - DNA, 20 bp, Artificial
  CRISPR gRNA sequence
tgtatttgcaccctggaatt

SEQ ID NO: 364809 - DNA, 20 bp, Artificial
  CRISPR gRNA sequence
gtatttgcaccctggaattg

SEQ ID NO: 364810 - DNA, 20 bp, Artificial
  CRISPR gRNA sequence
tatttgcaccctggaattga

SEQ ID NO: 364811 - DNA, 20 bp, Artificial
  CRISPR gRNA sequence
caccctggaattgagggtcc

SEQ ID NO: 364812 - DNA, 20 bp, Artificial
  CRISPR gRNA sequence
ccctggaattgagggtccta

SEQ ID NO: 364813 - DNA, 20 bp, Artificial
  CRISPR gRNA sequence
cctggaattgagggtcctag

SEQ ID NO: 364814 - DNA, 20 bp, Artificial
  CRISPR gRNA sequence
attgagggtcctagaggtca

SEQ ID NO: 364815 - DNA, 20 bp, Artificial
  CRISPR gRNA sequence
gaggtcacagattcgaatga

SEQ ID NO: 364816 - DNA, 20 bp, Artificial
  CRISPR gRNA sequence
aggtcacagattcgaatgaa

SEQ ID NO: 364817 - DNA, 20 bp, Artificial
  CRISPR gRNA sequence
ggtcacagattcgaatgaaa

SEQ ID NO: 364818 - DNA, 20 bp, Artificial
  CRISPR gRNA sequence
gtcacagattcgaatgaaag

SEQ ID NO: 364819 - DNA, 20 bp, Artificial
  CRISPR gRNA sequence
acagattcgaatgaaagggg

SEQ ID NO: 364820 - DNA, 20 bp, Artificial
  CRISPR gRNA sequence
attcgaatgaaaggggcaga

SEQ ID NO: 364821 - DNA, 20 bp, Artificial
  CRISPR gRNA sequence
gaaaggggcagaaagacttg

SEQ ID NO: 364822 - DNA, 20 bp, Artificial
  CRISPR gRNA sequence
ggcagaaagacttgcagctg

SEQ ID NO: 364823 - DNA, 20 bp, Artificial
  CRISPR gRNA sequence
aagacttgcagctgaagaca

SEQ ID NO: 364824 - DNA, 20 bp, Artificial
  CRISPR gRNA sequence
ttgcagctgaagacaaagtc

SEQ ID NO: 364825 - DNA, 20 bp, Artificial
  CRISPR gRNA sequence
tccagctgttacgactttgc

SEQ ID NO: 364826 - DNA, 20 bp, Artificial
  CRISPR gRNA sequence
cagctgttacgactttgcta

SEQ ID NO: 364827 - DNA, 20 bp, Artificial
  CRISPR gRNA sequence
gttacgactttgctagagat

SEQ ID NO: 364828 - DNA, 20 bp, Artificial
  CRISPR gRNA sequence
tatttatcaacatctaacca

SEQ ID NO: 364829 - DNA, 20 bp, Artificial
  CRISPR gRNA sequence
aacatctaaccaaagacaaa

SEQ ID NO: 364830 - DNA, 20 bp, Artificial
  CRISPR gRNA sequence
catctaaccaaagacaaata

SEQ ID NO: 364831 - DNA, 20 bp, Artificial
  CRISPR gRNA sequence
taaccaaagacaaatagaga

SEQ ID NO: 364832 - DNA, 20 bp, Artificial
  CRISPR gRNA sequence
gacaaatagagacagcgctt

SEQ ID NO: 364833 - DNA, 20 bp, Artificial
  CRISPR gRNA sequence
ttgagctatttttgttgtgt

SEQ ID NO: 364834 - DNA, 20 bp, Artificial
  CRISPR gRNA sequence
agctatttttgttgtgtcag

SEQ ID NO: 364835 - DNA, 20 bp, Artificial
  CRISPR gRNA sequence
cattttttgcatgatttatg

SEQ ID NO: 364836 - DNA, 20 bp, Artificial
  CRISPR gRNA sequence
attttttgcatgatttatga

SEQ ID NO: 364837 - DNA, 20 bp, Artificial
  CRISPR gRNA sequence
ttttttgcatgatttatgaa

SEQ ID NO: 364838 - DNA, 20 bp, Artificial
  CRISPR gRNA sequence
catgatttatgaagggattt

SEQ ID NO: 364839 - DNA, 20 bp, Artificial
  CRISPR gRNA sequence
ttatgaagggattttggctt

SEQ ID NO: 364840 - DNA, 20 bp, Artificial
  CRISPR gRNA sequence
tatgaagggattttggcttg

SEQ ID NO: 364841 - DNA, 20 bp, Artificial
  CRISPR gRNA sequence
gcttgaggttttttttctaa

SEQ ID NO: 364842 - DNA, 20 bp, Artificial
  CRISPR gRNA sequence
ttgaggttttttttctaata

SEQ ID NO: 364843 - DNA, 20 bp, Artificial
  CRISPR gRNA sequence
taatagagctgtctgtataa

SEQ ID NO: 364844 - DNA, 20 bp, Artificial
  CRISPR gRNA sequence
atagagctgtctgtataaaa

SEQ ID NO: 364845 - DNA, 20 bp, Artificial
  CRISPR gRNA sequence
tataaaagagctttgtcctc

SEQ ID NO: 364846 - DNA, 20 bp, Artificial
  CRISPR gRNA sequence
ataaaagagctttgtcctca

SEQ ID NO: 364847 - DNA, 20 bp, Artificial
  CRISPR gRNA sequence
aaagagctttgtcctcaagg

SEQ ID NO: 364848 - DNA, 20 bp, Artificial
  CRISPR gRNA sequence
gtcattaatcaaaatattac

SEQ ID NO: 364849 - DNA, 20 bp, Artificial
  CRISPR gRNA sequence
ctctactattaaaaatgtct

SEQ ID NO: 364850 - DNA, 20 bp, Artificial
  CRISPR gRNA sequence
aatgtctcagctaaccacat

SEQ ID NO: 364851 - DNA, 20 bp, Artificial
  CRISPR gRNA sequence
tgagcatgaattcatctcac

SEQ ID NO: 364852 - DNA, 20 bp, Artificial
  CRISPR gRNA sequence
cacaagcttgcctctgaatg

SEQ ID NO: 364853 - DNA, 20 bp, Artificial
  CRISPR gRNA sequence
tgcctctgaatgcagactcc

SEQ ID NO: 364854 - DNA, 20 bp, Artificial
  CRISPR gRNA sequence
gcctctgaatgcagactcct

SEQ ID NO: 364855 - DNA, 20 bp, Artificial
  CRISPR gRNA sequence
tctgaatgcagactcctagg

SEQ ID NO: 364856 - DNA, 20 bp, Artificial
  CRISPR gRNA sequence
atgcagactcctaggtggcc

SEQ ID NO: 364857 - DNA, 20 bp, Artificial
  CRISPR gRNA sequence
tgcagactcctaggtggcct

SEQ ID NO: 364858 - DNA, 20 bp, Artificial
  CRISPR gRNA sequence
agactcctaggtggcctggg

SEQ ID NO: 364859 - DNA, 20 bp, Artificial
  CRISPR gRNA sequence
gactcctaggtggcctgggt

SEQ ID NO: 364860 - DNA, 20 bp, Artificial
  CRISPR gRNA sequence
tcctaggtggcctgggtggg

SEQ ID NO: 364861 - DNA, 20 bp, Artificial
  CRISPR gRNA sequence
cctaggtggcctgggtgggt

SEQ ID NO: 364862 - DNA, 20 bp, Artificial
  CRISPR gRNA sequence
ctaggtggcctgggtgggtg

SEQ ID NO: 364863 - DNA, 20 bp, Artificial
  CRISPR gRNA sequence
gtggcctgggtgggtgggga

SEQ ID NO: 364864 - DNA, 20 bp, Artificial
  CRISPR gRNA sequence
tggcctgggtgggtggggac

SEQ ID NO: 364865 - DNA, 20 bp, Artificial
  CRISPR gRNA sequence
ggcctgggtgggtggggacg

SEQ ID NO: 364866 - DNA, 20 bp, Artificial
  CRISPR gRNA sequence
tggggacggggaacactctt

SEQ ID NO: 364867 - DNA, 20 bp, Artificial
  CRISPR gRNA sequence
ccacactgttcttcttcctg

SEQ ID NO: 364868 - DNA, 20 bp, Artificial
  CRISPR gRNA sequence
cacactgttcttcttcctgt

SEQ ID NO: 364869 - DNA, 20 bp, Artificial
  CRISPR gRNA sequence
cttcctgtaggctgtccacc

SEQ ID NO: 364870 - DNA, 20 bp, Artificial
  CRISPR gRNA sequence
ttcctgtaggctgtccaccc

SEQ ID NO: 364871 - DNA, 20 bp, Artificial
  CRISPR gRNA sequence
ctgtaggctgtccacccagg

SEQ ID NO: 364872 - DNA, 20 bp, Artificial
  CRISPR gRNA sequence
tagaaccttccctgtcacct

SEQ ID NO: 364873 - DNA, 20 bp, Artificial
  CRISPR gRNA sequence
tacaatatgtcctgcttccc

SEQ ID NO: 364874 - DNA, 20 bp, Artificial
  CRISPR gRNA sequence
tgcttccccagatgtctcta

SEQ ID NO: 364875 - DNA, 20 bp, Artificial
  CRISPR gRNA sequence
cagatgtctctatggtttct

SEQ ID NO: 364876 - DNA, 20 bp, Artificial
  CRISPR gRNA sequence
tctctatggtttctgagcat

SEQ ID NO: 364877 - DNA, 20 bp, Artificial
  CRISPR gRNA sequence
ctctatggtttctgagcatt

SEQ ID NO: 364878 - DNA, 20 bp, Artificial
  CRISPR gRNA sequence
ctatggtttctgagcattgg

SEQ ID NO: 364879 - DNA, 20 bp, Artificial
  CRISPR gRNA sequence
tatggtttctgagcattggg

SEQ ID NO: 364880 - DNA, 20 bp, Artificial
  CRISPR gRNA sequence
tggtttctgagcattgggag

SEQ ID NO: 364881 - DNA, 20 bp, Artificial
  CRISPR gRNA sequence
gagcattgggaggagtctcc

SEQ ID NO: 364882 - DNA, 20 bp, Artificial
  CRISPR gRNA sequence
ctcaatgaccccaccttccc

SEQ ID NO: 364883 - DNA, 20 bp, Artificial
  CRISPR gRNA sequence
aaaacacctgatgtgtgtga

SEQ ID NO: 364884 - DNA, 20 bp, Artificial
  CRISPR gRNA sequence
aacacctgatgtgtgtgatg

SEQ ID NO: 364885 - DNA, 20 bp, Artificial
  CRISPR gRNA sequence
gatacctttcgacacttgct

SEQ ID NO: 364886 - DNA, 20 bp, Artificial
  CRISPR gRNA sequence
ttggaaaactattcacatgc

SEQ ID NO: 364887 - DNA, 20 bp, Artificial
  CRISPR gRNA sequence
aaaactattcacatgctgga

SEQ ID NO: 364888 - DNA, 20 bp, Artificial
  CRISPR gRNA sequence
actattcacatgctggaaag

SEQ ID NO: 364889 - DNA, 20 bp, Artificial
  CRISPR gRNA sequence
tattcacatgctggaaagca

SEQ ID NO: 364890 - DNA, 20 bp, Artificial
  CRISPR gRNA sequence
attcacatgctggaaagcag

SEQ ID NO: 364891 - DNA, 20 bp, Artificial
  CRISPR gRNA sequence
ggaaagcagaggactgtgaa

SEQ ID NO: 364892 - DNA, 20 bp, Artificial
  CRISPR gRNA sequence
aggactgtgaacagaaaatc

SEQ ID NO: 364893 - DNA, 20 bp, Artificial
  CRISPR gRNA sequence
acagaaaatctagctaaact

SEQ ID NO: 364894 - DNA, 20 bp, Artificial
  CRISPR gRNA sequence
aatctagctaaactcagaac

SEQ ID NO: 364895 - DNA, 20 bp, Artificial
  CRISPR gRNA sequence
ctaaactcagaacaagtgac

SEQ ID NO: 364896 - DNA, 20 bp, Artificial
  CRISPR gRNA sequence
taaactcagaacaagtgact

SEQ ID NO: 364897 - DNA, 20 bp, Artificial
  CRISPR gRNA sequence
aaactcagaacaagtgactg

SEQ ID NO: 364898 - DNA, 20 bp, Artificial
  CRISPR gRNA sequence
tcagaacaagtgactggggc

SEQ ID NO: 364899 - DNA, 20 bp, Artificial
  CRISPR gRNA sequence
cagaacaagtgactggggct

SEQ ID NO: 364900 - DNA, 20 bp, Artificial
  CRISPR gRNA sequence
aacaagtgactggggctggg

SEQ ID NO: 364901 - DNA, 20 bp, Artificial
  CRISPR gRNA sequence
gactggggctgggaagatta

SEQ ID NO: 364902 - DNA, 20 bp, Artificial
  CRISPR gRNA sequence
ggctgggaagattatagtgt

SEQ ID NO: 364903 - DNA, 20 bp, Artificial
  CRISPR gRNA sequence
ctgggaagattatagtgtga

SEQ ID NO: 364904 - DNA, 20 bp, Artificial
  CRISPR gRNA sequence
tgggaagattatagtgtgag

SEQ ID NO: 364905 - DNA, 20 bp, Artificial
  CRISPR gRNA sequence
ttgctccctccactccttct

SEQ ID NO: 364906 - DNA, 20 bp, Artificial
  CRISPR gRNA sequence
ctccactccttctcagatgc

SEQ ID NO: 364907 - DNA, 20 bp, Artificial
  CRISPR gRNA sequence
tccactccttctcagatgcg

SEQ ID NO: 364908 - DNA, 20 bp, Artificial
  CRISPR gRNA sequence
ccactccttctcagatgcga

SEQ ID NO: 364909 - DNA, 20 bp, Artificial
  CRISPR gRNA sequence
agggtttgcctgccttctgc

SEQ ID NO: 364910 - DNA, 20 bp, Artificial
  CRISPR gRNA sequence
gggtttgcctgccttctgct

SEQ ID NO: 364911 - DNA, 20 bp, Artificial
  CRISPR gRNA sequence
tgccttctgctgggatgccc

SEQ ID NO: 364912 - DNA, 20 bp, Artificial
  CRISPR gRNA sequence
gctgggatgccccagctgtt

SEQ ID NO: 364913 - DNA, 20 bp, Artificial
  CRISPR gRNA sequence
tgggatgccccagctgttaa

SEQ ID NO: 364914 - DNA, 20 bp, Artificial
  CRISPR gRNA sequence
gggatgccccagctgttaag

SEQ ID NO: 364915 - DNA, 20 bp, Artificial
  CRISPR gRNA sequence
tgttaagaggctcatacttc

SEQ ID NO: 364916 - DNA, 20 bp, Artificial
  CRISPR gRNA sequence
aagaggctcatacttccagt

SEQ ID NO: 364917 - DNA, 20 bp, Artificial
  CRISPR gRNA sequence
tacttccagtaagatttcca

SEQ ID NO: 364918 - DNA, 20 bp, Artificial
  CRISPR gRNA sequence
acttccagtaagatttccac

SEQ ID NO: 364919 - DNA, 20 bp, Artificial
  CRISPR gRNA sequence
ttccagtaagatttccacag

SEQ ID NO: 364920 - DNA, 20 bp, Artificial
  CRISPR gRNA sequence
tccagtaagatttccacagg

SEQ ID NO: 364921 - DNA, 20 bp, Artificial
  CRISPR gRNA sequence
gtaagatttccacaggaggc

SEQ ID NO: 364922 - DNA, 20 bp, Artificial
  CRISPR gRNA sequence
taagatttccacaggaggcc

SEQ ID NO: 364923 - DNA, 20 bp, Artificial
  CRISPR gRNA sequence
tttccacaggaggccgggtg

SEQ ID NO: 364924 - DNA, 20 bp, Artificial
  CRISPR gRNA sequence
ccacaggaggccgggtgcgg

SEQ ID NO: 364925 - DNA, 20 bp, Artificial
  CRISPR gRNA sequence
ggctcacgcctgtaatccca

SEQ ID NO: 364926 - DNA, 20 bp, Artificial
  CRISPR gRNA sequence
acgcctgtaatcccaaagtg

SEQ ID NO: 364927 - DNA, 20 bp, Artificial
  CRISPR gRNA sequence
cgcctgtaatcccaaagtga

SEQ ID NO: 364928 - DNA, 20 bp, Artificial
  CRISPR gRNA sequence
gtaatcccaaagtgaaggcc

SEQ ID NO: 364929 - DNA, 20 bp, Artificial
  CRISPR gRNA sequence
taatcccaaagtgaaggccg

SEQ ID NO: 364930 - DNA, 20 bp, Artificial
  CRISPR gRNA sequence
tcccaaagtgaaggccgagg

SEQ ID NO: 364931 - DNA, 20 bp, Artificial
  CRISPR gRNA sequence
cccaaagtgaaggccgaggc

SEQ ID NO: 364932 - DNA, 20 bp, Artificial
  CRISPR gRNA sequence
aaagtgaaggccgaggcggg

SEQ ID NO: 364933 - DNA, 20 bp, Artificial
  CRISPR gRNA sequence
ggccgaggcgggcggatcat

SEQ ID NO: 364934 - DNA, 20 bp, Artificial
  CRISPR gRNA sequence
gccgaggcgggcggatcatg

SEQ ID NO: 364935 - DNA, 20 bp, Artificial
  CRISPR gRNA sequence
aggcgggcggatcatgaggt

SEQ ID NO: 364936 - DNA, 20 bp, Artificial
  CRISPR gRNA sequence
ggcgggcggatcatgaggtc

SEQ ID NO: 364937 - DNA, 20 bp, Artificial
  CRISPR gRNA sequence
cgggcggatcatgaggtcag

SEQ ID NO: 364938 - DNA, 20 bp, Artificial
  CRISPR gRNA sequence
gatcatgaggtcaggagatc

SEQ ID NO: 364939 - DNA, 20 bp, Artificial
  CRISPR gRNA sequence
tcaggagatcgagaccatcg

SEQ ID NO: 364940 - DNA, 20 bp, Artificial
  CRISPR gRNA sequence
cgagaccatcgtggctaaca

SEQ ID NO: 364941 - DNA, 20 bp, Artificial
  CRISPR gRNA sequence
ctgctaaaaatacaaaaaat

SEQ ID NO: 364942 - DNA, 20 bp, Artificial
  CRISPR gRNA sequence
taaaaatacaaaaaattagc

SEQ ID NO: 364943 - DNA, 20 bp, Artificial
  CRISPR gRNA sequence
aaaaatacaaaaaattagcc

SEQ ID NO: 364944 - DNA, 20 bp, Artificial
  CRISPR gRNA sequence
tacaaaaaattagccgggtg

SEQ ID NO: 364945 - DNA, 20 bp, Artificial
  CRISPR gRNA sequence
aaaaaattagccgggtgtgg

SEQ ID NO: 364946 - DNA, 20 bp, Artificial
  CRISPR gRNA sequence
aaattagccgggtgtggtag

SEQ ID NO: 364947 - DNA, 20 bp, Artificial
  CRISPR gRNA sequence
aattagccgggtgtggtagc

SEQ ID NO: 364948 - DNA, 20 bp, Artificial
  CRISPR gRNA sequence
ggtgtggtagcgggcacctg

SEQ ID NO: 364949 - DNA, 20 bp, Artificial
  CRISPR gRNA sequence
gtagcgggcacctgtagtcc

SEQ ID NO: 364950 - DNA, 20 bp, Artificial
  CRISPR gRNA sequence
cacctgtagtcccagctact

SEQ ID NO: 364951 - DNA, 20 bp, Artificial
  CRISPR gRNA sequence
acctgtagtcccagctactc

SEQ ID NO: 364952 - DNA, 20 bp, Artificial
  CRISPR gRNA sequence
ctgtagtcccagctactcag

SEQ ID NO: 364953 - DNA, 20 bp, Artificial
  CRISPR gRNA sequence
tgtagtcccagctactcagg

SEQ ID NO: 364954 - DNA, 20 bp, Artificial
  CRISPR gRNA sequence
tcccagctactcaggaggct

SEQ ID NO: 364955 - DNA, 20 bp, Artificial
  CRISPR gRNA sequence
cccagctactcaggaggctg

SEQ ID NO: 364956 - DNA, 20 bp, Artificial
  CRISPR gRNA sequence
agctactcaggaggctgagg

SEQ ID NO: 364957 - DNA, 20 bp, Artificial
  CRISPR gRNA sequence
gctactcaggaggctgaggc

SEQ ID NO: 364958 - DNA, 20 bp, Artificial
  CRISPR gRNA sequence
tactcaggaggctgaggcag

SEQ ID NO: 364959 - DNA, 20 bp, Artificial
  CRISPR gRNA sequence
aggaggctgaggcaggagaa

SEQ ID NO: 364960 - DNA, 20 bp, Artificial
  CRISPR gRNA sequence
gcaggagaatggcgtgaacc

SEQ ID NO: 364961 - DNA, 20 bp, Artificial
  CRISPR gRNA sequence
caggagaatggcgtgaaccc

SEQ ID NO: 364962 - DNA, 20 bp, Artificial
  CRISPR gRNA sequence
ggagaatggcgtgaacccag

SEQ ID NO: 364963 - DNA, 20 bp, Artificial
  CRISPR gRNA sequence
gagaatggcgtgaacccagg

SEQ ID NO: 364964 - DNA, 20 bp, Artificial
  CRISPR gRNA sequence
aatggcgtgaacccaggagg

SEQ ID NO: 364965 - DNA, 20 bp, Artificial
  CRISPR gRNA sequence
tggcgtgaacccaggaggca

SEQ ID NO: 364966 - DNA, 20 bp, Artificial
  CRISPR gRNA sequence
aacccaggaggcagagcttg

SEQ ID NO: 364967 - DNA, 20 bp, Artificial
  CRISPR gRNA sequence
caggaggcagagcttgcagt

SEQ ID NO: 364968 - DNA, 20 bp, Artificial
  CRISPR gRNA sequence
gacatcgcaccactgcactc

SEQ ID NO: 364969 - DNA, 20 bp, Artificial
  CRISPR gRNA sequence
cgcaccactgcactccagcc

SEQ ID NO: 364970 - DNA, 20 bp, Artificial
  CRISPR gRNA sequence
gcaccactgcactccagcct

SEQ ID NO: 364971 - DNA, 20 bp, Artificial
  CRISPR gRNA sequence
actgcactccagcctgggca

SEQ ID NO: 364972 - DNA, 20 bp, Artificial
  CRISPR gRNA sequence
ctgcactccagcctgggcaa

SEQ ID NO: 364973 - DNA, 20 bp, Artificial
  CRISPR gRNA sequence
gcactccagcctgggcaaag

SEQ ID NO: 364974 - DNA, 20 bp, Artificial
  CRISPR gRNA sequence
tccagcctgggcaaaggagc

SEQ ID NO: 364975 - DNA, 20 bp, Artificial
  CRISPR gRNA sequence
aaaaaaaaaaaaaatttcct

SEQ ID NO: 364976 - DNA, 20 bp, Artificial
  CRISPR gRNA sequence
aaaaaaaaaaaaatttcctc

SEQ ID NO: 364977 - DNA, 20 bp, Artificial
  CRISPR gRNA sequence
aaatttcctcaggaacacaa

SEQ ID NO: 364978 - DNA, 20 bp, Artificial
  CRISPR gRNA sequence
tcctcaggaacacaatagtc

SEQ ID NO: 364979 - DNA, 20 bp, Artificial
  CRISPR gRNA sequence
cctcaggaacacaatagtct

SEQ ID NO: 364980 - DNA, 20 bp, Artificial
  CRISPR gRNA sequence
cttcctcaaataatctcatt

SEQ ID NO: 364981 - DNA, 20 bp, Artificial
  CRISPR gRNA sequence
tcctcaaataatctcattaa

SEQ ID NO: 364982 - DNA, 20 bp, Artificial
  CRISPR gRNA sequence
ttaagagaacctttccaatg

SEQ ID NO: 364983 - DNA, 20 bp, Artificial
  CRISPR gRNA sequence
taagagaacctttccaatgt

SEQ ID NO: 364984 - DNA, 20 bp, Artificial
  CRISPR gRNA sequence
cctttccaatgtgggccaca

SEQ ID NO: 364985 - DNA, 20 bp, Artificial
  CRISPR gRNA sequence
gtgggccacatggtctcctc

SEQ ID NO: 364986 - DNA, 20 bp, Artificial
  CRISPR gRNA sequence
cctctagaccacgataccct

SEQ ID NO: 364987 - DNA, 20 bp, Artificial
  CRISPR gRNA sequence
ccacgatacccttagaacct

SEQ ID NO: 364988 - DNA, 20 bp, Artificial
  CRISPR gRNA sequence
gatacccttagaaccttggc

SEQ ID NO: 364989 - DNA, 20 bp, Artificial
  CRISPR gRNA sequence
gcaagtcatacacatgtccc

SEQ ID NO: 364990 - DNA, 20 bp, Artificial
  CRISPR gRNA sequence
caagtcatacacatgtcccc

SEQ ID NO: 364991 - DNA, 20 bp, Artificial
  CRISPR gRNA sequence
agtcatacacatgtccccag

SEQ ID NO: 364992 - DNA, 20 bp, Artificial
  CRISPR gRNA sequence
atacacatgtccccaggagt

SEQ ID NO: 364993 - DNA, 20 bp, Artificial
  CRISPR gRNA sequence
tacacatgtccccaggagtg

SEQ ID NO: 364994 - DNA, 20 bp, Artificial
  CRISPR gRNA sequence
ccaggagtgaggctactgct

SEQ ID NO: 364995 - DNA, 20 bp, Artificial
  CRISPR gRNA sequence
tgaggctactgctgagtgac

SEQ ID NO: 364996 - DNA, 20 bp, Artificial
  CRISPR gRNA sequence
ggctactgctgagtgaccag

SEQ ID NO: 364997 - DNA, 20 bp, Artificial
  CRISPR gRNA sequence
gaccagtagaaccccacttc

SEQ ID NO: 364998 - DNA, 20 bp, Artificial
  CRISPR gRNA sequence
ccccacttccagtcaacgca

SEQ ID NO: 364999 - DNA, 20 bp, Artificial
  CRISPR gRNA sequence
tccagtcaacgcaaagactc

SEQ ID NO: 365000 - DNA, 20 bp, Artificial
  CRISPR gRNA sequence
gtcaacgcaaagactccagt

SEQ ID NO: 365001 - DNA, 20 bp, Artificial
  CRISPR gRNA sequence
tcaacgcaaagactccagtt

SEQ ID NO: 365002 - DNA, 20 bp, Artificial
  CRISPR gRNA sequence
caacgcaaagactccagttg

SEQ ID NO: 365003 - DNA, 20 bp, Artificial
  CRISPR gRNA sequence
caaagactccagttggggtt

SEQ ID NO: 365004 - DNA, 20 bp, Artificial
  CRISPR gRNA sequence
agactccagttggggttcag

SEQ ID NO: 365005 - DNA, 20 bp, Artificial
  CRISPR gRNA sequence
gactccagttggggttcagc

SEQ ID NO: 365006 - DNA, 20 bp, Artificial
  CRISPR gRNA sequence
actccagttggggttcagca

SEQ ID NO: 365007 - DNA, 20 bp, Artificial
  CRISPR gRNA sequence
gggttcagcagggatcctct

SEQ ID NO: 365008 - DNA, 20 bp, Artificial
  CRISPR gRNA sequence
tcagcagggatcctctaaga

SEQ ID NO: 365009 - DNA, 20 bp, Artificial
  CRISPR gRNA sequence
cagcagggatcctctaagac

SEQ ID NO: 365010 - DNA, 20 bp, Artificial
  CRISPR gRNA sequence
agcagggatcctctaagaca

SEQ ID NO: 365011 - DNA, 20 bp, Artificial
  CRISPR gRNA sequence
aagacagggttctgaaacta

SEQ ID NO: 365012 - DNA, 20 bp, Artificial
  CRISPR gRNA sequence
gggttctgaaactatggcct

SEQ ID NO: 365013 - DNA, 20 bp, Artificial
  CRISPR gRNA sequence
ggttctgaaactatggcctg

SEQ ID NO: 365014 - DNA, 20 bp, Artificial
  CRISPR gRNA sequence
gttctgaaactatggcctga

SEQ ID NO: 365015 - DNA, 20 bp, Artificial
  CRISPR gRNA sequence
tgaaactatggcctgagggc

SEQ ID NO: 365016 - DNA, 20 bp, Artificial
  CRISPR gRNA sequence
gaaactatggcctgagggct

SEQ ID NO: 365017 - DNA, 20 bp, Artificial
  CRISPR gRNA sequence
tatggcctgagggctgggcg

SEQ ID NO: 365018 - DNA, 20 bp, Artificial
  CRISPR gRNA sequence
agcccactgatttccataaa

SEQ ID NO: 365019 - DNA, 20 bp, Artificial
  CRISPR gRNA sequence
actgatttccataaacagtt

SEQ ID NO: 365020 - DNA, 20 bp, Artificial
  CRISPR gRNA sequence
atttccataaacagtttggt

SEQ ID NO: 365021 - DNA, 20 bp, Artificial
  CRISPR gRNA sequence
ttccataaacagtttggttg

SEQ ID NO: 365022 - DNA, 20 bp, Artificial
  CRISPR gRNA sequence
ataaacagtttggttggaga

SEQ ID NO: 365023 - DNA, 20 bp, Artificial
  CRISPR gRNA sequence
tggagacagccatgctcact

SEQ ID NO: 365024 - DNA, 20 bp, Artificial
  CRISPR gRNA sequence
ctgtttttgtgctgcaatgc

SEQ ID NO: 365025 - DNA, 20 bp, Artificial
  CRISPR gRNA sequence
tgtgctgcaatgctggaacc

SEQ ID NO: 365026 - DNA, 20 bp, Artificial
  CRISPR gRNA sequence
tgctgcaatgctggaaccaa

SEQ ID NO: 365027 - DNA, 20 bp, Artificial
  CRISPR gRNA sequence
gctgcaatgctggaaccaag

SEQ ID NO: 365028 - DNA, 20 bp, Artificial
  CRISPR gRNA sequence
atgctggaaccaagaggtgt

SEQ ID NO: 365029 - DNA, 20 bp, Artificial
  CRISPR gRNA sequence
tgctggaaccaagaggtgtt

SEQ ID NO: 365030 - DNA, 20 bp, Artificial
  CRISPR gRNA sequence
aggtgttaggtcacaactga

SEQ ID NO: 365031 - DNA, 20 bp, Artificial
  CRISPR gRNA sequence
cacaactgacagacaccaca

SEQ ID NO: 365032 - DNA, 20 bp, Artificial
  CRISPR gRNA sequence
cagacaccacacggcccaca

SEQ ID NO: 365033 - DNA, 20 bp, Artificial
  CRISPR gRNA sequence
agctgtaaatattaactatc

SEQ ID NO: 365034 - DNA, 20 bp, Artificial
  CRISPR gRNA sequence
attaactatctggcccttta

SEQ ID NO: 365035 - DNA, 20 bp, Artificial
  CRISPR gRNA sequence
tatctggccctttacagaaa

SEQ ID NO: 365036 - DNA, 20 bp, Artificial
  CRISPR gRNA sequence
gaaaaagtttcccaaccctt

SEQ ID NO: 365037 - DNA, 20 bp, Artificial
  CRISPR gRNA sequence
aaagtttcccaacccttgag

SEQ ID NO: 365038 - DNA, 20 bp, Artificial
  CRISPR gRNA sequence
aagtttcccaacccttgagt

SEQ ID NO: 365039 - DNA, 20 bp, Artificial
  CRISPR gRNA sequence
tgagtaggataataaatctt

SEQ ID NO: 365040 - DNA, 20 bp, Artificial
  CRISPR gRNA sequence
gataataaatctttggatca

SEQ ID NO: 365041 - DNA, 20 bp, Artificial
  CRISPR gRNA sequence
atcatggacatttattattt

SEQ ID NO: 365042 - DNA, 20 bp, Artificial
  CRISPR gRNA sequence
tatttaagttcatccttgtt

SEQ ID NO: 365043 - DNA, 20 bp, Artificial
  CRISPR gRNA sequence
tcatccttgttcagtcttgc

SEQ ID NO: 365044 - DNA, 20 bp, Artificial
  CRISPR gRNA sequence
atccttgttcagtcttgctg

SEQ ID NO: 365045 - DNA, 20 bp, Artificial
  CRISPR gRNA sequence
ccttgttcagtcttgctgga

SEQ ID NO: 365046 - DNA, 20 bp, Artificial
  CRISPR gRNA sequence
tgttcagtcttgctggagag

SEQ ID NO: 365047 - DNA, 20 bp, Artificial
  CRISPR gRNA sequence
gttcagtcttgctggagaga

SEQ ID NO: 365048 - DNA, 20 bp, Artificial
  CRISPR gRNA sequence
cagtcttgctggagagaagg

SEQ ID NO: 365049 - DNA, 20 bp, Artificial
  CRISPR gRNA sequence
gctggagagaaggaagattt

SEQ ID NO: 365050 - DNA, 20 bp, Artificial
  CRISPR gRNA sequence
gaaggaagatttaagcttga

SEQ ID NO: 365051 - DNA, 20 bp, Artificial
  CRISPR gRNA sequence
aagatttaagcttgacagac

SEQ ID NO: 365052 - DNA, 20 bp, Artificial
  CRISPR gRNA sequence
aagcttgacagaccagatgc

SEQ ID NO: 365053 - DNA, 20 bp, Artificial
  CRISPR gRNA sequence
agaccagatgccggtaaaat

SEQ ID NO: 365054 - DNA, 20 bp, Artificial
  CRISPR gRNA sequence
agatgccggtaaaattagct

SEQ ID NO: 365055 - DNA, 20 bp, Artificial
  CRISPR gRNA sequence
agctcagttttcttattctc

SEQ ID NO: 365056 - DNA, 20 bp, Artificial
  CRISPR gRNA sequence
attctcaagaactttacgat

SEQ ID NO: 365057 - DNA, 20 bp, Artificial
  CRISPR gRNA sequence
atctattataaatacaattc

SEQ ID NO: 365058 - DNA, 20 bp, Artificial
  CRISPR gRNA sequence
ctattataaatacaattcta

SEQ ID NO: 365059 - DNA, 20 bp, Artificial
  CRISPR gRNA sequence
tataaatacaattctagaga

SEQ ID NO: 365060 - DNA, 20 bp, Artificial
  CRISPR gRNA sequence
tacaattctagagacagact

SEQ ID NO: 365061 - DNA, 20 bp, Artificial
  CRISPR gRNA sequence
tctagagacagactgagaaa

SEQ ID NO: 365062 - DNA, 20 bp, Artificial
  CRISPR gRNA sequence
actgagaaaaagtacttaac

SEQ ID NO: 365063 - DNA, 20 bp, Artificial
  CRISPR gRNA sequence
tgcacccctcattaaactaa

SEQ ID NO: 365064 - DNA, 20 bp, Artificial
  CRISPR gRNA sequence
ctcattaaactaacagttca

SEQ ID NO: 365065 - DNA, 20 bp, Artificial
  CRISPR gRNA sequence
ctaacagttcacagaacacc

SEQ ID NO: 365066 - DNA, 20 bp, Artificial
  CRISPR gRNA sequence
accgagcacttaacttactc

SEQ ID NO: 365067 - DNA, 20 bp, Artificial
  CRISPR gRNA sequence
taacttactccagctttttc

SEQ ID NO: 365068 - DNA, 20 bp, Artificial
  CRISPR gRNA sequence
cctgctgcatcaacttgcca

SEQ ID NO: 365069 - DNA, 20 bp, Artificial
  CRISPR gRNA sequence
tcaacttgccatggtttcac

SEQ ID NO: 365070 - DNA, 20 bp, Artificial
  CRISPR gRNA sequence
acttgccatggtttcactgg

SEQ ID NO: 365071 - DNA, 20 bp, Artificial
  CRISPR gRNA sequence
tcgcacacgattcatttaaa

SEQ ID NO: 365072 - DNA, 20 bp, Artificial
  CRISPR gRNA sequence
cacgattcatttaaaaagtt

SEQ ID NO: 365073 - DNA, 20 bp, Artificial
  CRISPR gRNA sequence
ttcatttaaaaagttgagct

SEQ ID NO: 365074 - DNA, 20 bp, Artificial
  CRISPR gRNA sequence
aagttgagctcagacacatc

SEQ ID NO: 365075 - DNA, 20 bp, Artificial
  CRISPR gRNA sequence
acacatccagtcttttttct

SEQ ID NO: 365076 - DNA, 20 bp, Artificial
  CRISPR gRNA sequence
catccagtcttttttctgag

SEQ ID NO: 365077 - DNA, 20 bp, Artificial
  CRISPR gRNA sequence
atccagtcttttttctgaga

SEQ ID NO: 365078 - DNA, 20 bp, Artificial
  CRISPR gRNA sequence
ctgagaaggttactaacctt

SEQ ID NO: 365079 - DNA, 20 bp, Artificial
  CRISPR gRNA sequence
ggttactaaccttgagatgt

SEQ ID NO: 365080 - DNA, 20 bp, Artificial
  CRISPR gRNA sequence
gcttcttcccatctgcgtct

SEQ ID NO: 365081 - DNA, 20 bp, Artificial
  CRISPR gRNA sequence
ttcccatctgcgtcttggtt

SEQ ID NO: 365082 - DNA, 20 bp, Artificial
  CRISPR gRNA sequence
tcccatctgcgtcttggtta

SEQ ID NO: 365083 - DNA, 20 bp, Artificial
  CRISPR gRNA sequence
ttatcgtatcctgtttatcg

SEQ ID NO: 365084 - DNA, 20 bp, Artificial
  CRISPR gRNA sequence
tcctgtttatcgtggcctcc

SEQ ID NO: 365085 - DNA, 20 bp, Artificial
  CRISPR gRNA sequence
tcctagcctcaacaccctct

SEQ ID NO: 365086 - DNA, 20 bp, Artificial
  CRISPR gRNA sequence
aacaccctcttggtcactgc

SEQ ID NO: 365087 - DNA, 20 bp, Artificial
  CRISPR gRNA sequence
ccgctgctccctcccttaat

SEQ ID NO: 365088 - DNA, 20 bp, Artificial
  CRISPR gRNA sequence
ccctcccttaattagcactg

SEQ ID NO: 365089 - DNA, 20 bp, Artificial
  CRISPR gRNA sequence
cctcccttaattagcactgc

SEQ ID NO: 365090 - DNA, 20 bp, Artificial
  CRISPR gRNA sequence
tcccttaattagcactgcag

SEQ ID NO: 365091 - DNA, 20 bp, Artificial
  CRISPR gRNA sequence
taattagcactgcaggagct

SEQ ID NO: 365092 - DNA, 20 bp, Artificial
  CRISPR gRNA sequence
aattagcactgcaggagctg

SEQ ID NO: 365093 - DNA, 20 bp, Artificial
  CRISPR gRNA sequence
attagcactgcaggagctga

SEQ ID NO: 365094 - DNA, 20 bp, Artificial
  CRISPR gRNA sequence
ttagcactgcaggagctgag

SEQ ID NO: 365095 - DNA, 20 bp, Artificial
  CRISPR gRNA sequence
agcactgcaggagctgaggg

SEQ ID NO: 365096 - DNA, 20 bp, Artificial
  CRISPR gRNA sequence
caggagctgaggggagcgtt

SEQ ID NO: 365097 - DNA, 20 bp, Artificial
  CRISPR gRNA sequence
aggggagcgttcagcccact

SEQ ID NO: 365098 - DNA, 20 bp, Artificial
  CRISPR gRNA sequence
ggggagcgttcagcccactc

SEQ ID NO: 365099 - DNA, 20 bp, Artificial
  CRISPR gRNA sequence
ggagcgttcagcccactcag

SEQ ID NO: 365100 - DNA, 20 bp, Artificial
  CRISPR gRNA sequence
ctgactctgcccatgctctt

SEQ ID NO: 365101 - DNA, 20 bp, Artificial
  CRISPR gRNA sequence
tcttgagctcttctctctac

SEQ ID NO: 365102 - DNA, 20 bp, Artificial
  CRISPR gRNA sequence
tctctctaccagaacttcct

SEQ ID NO: 365103 - DNA, 20 bp, Artificial
  CRISPR gRNA sequence
tctaccagaacttcctcaga

SEQ ID NO: 365104 - DNA, 20 bp, Artificial
  CRISPR gRNA sequence
acttcctcagatagcaactg

SEQ ID NO: 365105 - DNA, 20 bp, Artificial
  CRISPR gRNA sequence
tgaatcactaatatttcatg

SEQ ID NO: 365106 - DNA, 20 bp, Artificial
  CRISPR gRNA sequence
atcactaatatttcatgaag

SEQ ID NO: 365107 - DNA, 20 bp, Artificial
  CRISPR gRNA sequence
tcactaatatttcatgaagc

SEQ ID NO: 365108 - DNA, 20 bp, Artificial
  CRISPR gRNA sequence
cactaatatttcatgaagcg

SEQ ID NO: 365109 - DNA, 20 bp, Artificial
  CRISPR gRNA sequence
tcatgaagcggggttttttg

SEQ ID NO: 365110 - DNA, 20 bp, Artificial
  CRISPR gRNA sequence
aagcggggttttttgaagtc

SEQ ID NO: 365111 - DNA, 20 bp, Artificial
  CRISPR gRNA sequence
aagtcaagtttacctgcttc

SEQ ID NO: 365112 - DNA, 20 bp, Artificial
  CRISPR gRNA sequence
tcaagtttacctgcttctgg

SEQ ID NO: 365113 - DNA, 20 bp, Artificial
  CRISPR gRNA sequence
tggaagcaactttactattg

SEQ ID NO: 365114 - DNA, 20 bp, Artificial
  CRISPR gRNA sequence
actttactattgcagctact

SEQ ID NO: 365115 - DNA, 20 bp, Artificial
  CRISPR gRNA sequence
actcagactcattccaaact

SEQ ID NO: 365116 - DNA, 20 bp, Artificial
  CRISPR gRNA sequence
actcattccaaactcagata

SEQ ID NO: 365117 - DNA, 20 bp, Artificial
  CRISPR gRNA sequence
tctgtccctcttttccccca

SEQ ID NO: 365118 - DNA, 20 bp, Artificial
  CRISPR gRNA sequence
ccaaagaatctataatttga

SEQ ID NO: 365119 - DNA, 20 bp, Artificial
  CRISPR gRNA sequence
caaagaatctataatttgaa

SEQ ID NO: 365120 - DNA, 20 bp, Artificial
  CRISPR gRNA sequence
gacgcacttctcctttgttc

SEQ ID NO: 365121 - DNA, 20 bp, Artificial
  CRISPR gRNA sequence
tcctttgttctagctctaaa

SEQ ID NO: 365122 - DNA, 20 bp, Artificial
  CRISPR gRNA sequence
actacactccccgccgaaat

SEQ ID NO: 365123 - DNA, 20 bp, Artificial
  CRISPR gRNA sequence
gtgttttttcctgccaatca

SEQ ID NO: 365124 - DNA, 20 bp, Artificial
  CRISPR gRNA sequence
tcctgccaatcaaagcacat

SEQ ID NO: 365125 - DNA, 20 bp, Artificial
  CRISPR gRNA sequence
caatcaaagcacattagatt

SEQ ID NO: 365126 - DNA, 20 bp, Artificial
  CRISPR gRNA sequence
tgaatctaatgtgctttgat

SEQ ID NO: 365127 - DNA, 20 bp, Artificial
  CRISPR gRNA sequence
atctaatgtgctttgattgg

SEQ ID NO: 365128 - DNA, 20 bp, Artificial
  CRISPR gRNA sequence
tctaatgtgctttgattggc

SEQ ID NO: 365129 - DNA, 20 bp, Artificial
  CRISPR gRNA sequence
tgattggcaggaaaaaacac

SEQ ID NO: 365130 - DNA, 20 bp, Artificial
  CRISPR gRNA sequence
gattggcaggaaaaaacacg

SEQ ID NO: 365131 - DNA, 20 bp, Artificial
  CRISPR gRNA sequence
tggcaggaaaaaacacgagg

SEQ ID NO: 365132 - DNA, 20 bp, Artificial
  CRISPR gRNA sequence
ggaaaaaacacgaggaagaa

SEQ ID NO: 365133 - DNA, 20 bp, Artificial
  CRISPR gRNA sequence
gaaaaaacacgaggaagaaa

SEQ ID NO: 365134 - DNA, 20 bp, Artificial
  CRISPR gRNA sequence
aacacgaggaagaaaaggca

SEQ ID NO: 365135 - DNA, 20 bp, Artificial
  CRISPR gRNA sequence
gcaaagaaacaaactgattt

SEQ ID NO: 365136 - DNA, 20 bp, Artificial
  CRISPR gRNA sequence
aagaaacaaactgatttcgg

SEQ ID NO: 365137 - DNA, 20 bp, Artificial
  CRISPR gRNA sequence
agaaacaaactgatttcggc

SEQ ID NO: 365138 - DNA, 20 bp, Artificial
  CRISPR gRNA sequence
gaaacaaactgatttcggcg

SEQ ID NO: 365139 - DNA, 20 bp, Artificial
  CRISPR gRNA sequence
aacaaactgatttcggcggg

SEQ ID NO: 365140 - DNA, 20 bp, Artificial
  CRISPR gRNA sequence
actgatttcggcggggagtg

SEQ ID NO: 365141 - DNA, 20 bp, Artificial
  CRISPR gRNA sequence
cggggagtgtagtttctatt

SEQ ID NO: 365142 - DNA, 20 bp, Artificial
  CRISPR gRNA sequence
gggagtgtagtttctattta

SEQ ID NO: 365143 - DNA, 20 bp, Artificial
  CRISPR gRNA sequence
gtgtagtttctatttagagc

SEQ ID NO: 365144 - DNA, 20 bp, Artificial
  CRISPR gRNA sequence
ttctatttagagctagaaca

SEQ ID NO: 365145 - DNA, 20 bp, Artificial
  CRISPR gRNA sequence
tctatttagagctagaacaa

SEQ ID NO: 365146 - DNA, 20 bp, Artificial
  CRISPR gRNA sequence
tatttagagctagaacaaag

SEQ ID NO: 365147 - DNA, 20 bp, Artificial
  CRISPR gRNA sequence
ttagagctagaacaaaggag

SEQ ID NO: 365148 - DNA, 20 bp, Artificial
  CRISPR gRNA sequence
aagtgcgtcctttcaaatta

SEQ ID NO: 365149 - DNA, 20 bp, Artificial
  CRISPR gRNA sequence
ctttcaaattatagattctt

SEQ ID NO: 365150 - DNA, 20 bp, Artificial
  CRISPR gRNA sequence
tttcaaattatagattcttt

SEQ ID NO: 365151 - DNA, 20 bp, Artificial
  CRISPR gRNA sequence
ttcaaattatagattctttg

SEQ ID NO: 365152 - DNA, 20 bp, Artificial
  CRISPR gRNA sequence
tcaaattatagattctttgg

SEQ ID NO: 365153 - DNA, 20 bp, Artificial
  CRISPR gRNA sequence
ttatagattctttgggggaa

SEQ ID NO: 365154 - DNA, 20 bp, Artificial
  CRISPR gRNA sequence
atagattctttgggggaaaa

SEQ ID NO: 365155 - DNA, 20 bp, Artificial
  CRISPR gRNA sequence
tagattctttgggggaaaag

SEQ ID NO: 365156 - DNA, 20 bp, Artificial
  CRISPR gRNA sequence
agattctttgggggaaaaga

SEQ ID NO: 365157 - DNA, 20 bp, Artificial
  CRISPR gRNA sequence
tctttgggggaaaagaggga

SEQ ID NO: 365158 - DNA, 20 bp, Artificial
  CRISPR gRNA sequence
agagggacagaactttatct

SEQ ID NO: 365159 - DNA, 20 bp, Artificial
  CRISPR gRNA sequence
gacagaactttatctgagtt

SEQ ID NO: 365160 - DNA, 20 bp, Artificial
  CRISPR gRNA sequence
actttatctgagtttggaat

SEQ ID NO: 365161 - DNA, 20 bp, Artificial
  CRISPR gRNA sequence
tctgagtttggaatgagtct

SEQ ID NO: 365162 - DNA, 20 bp, Artificial
  CRISPR gRNA sequence
gagtttggaatgagtctgag

SEQ ID NO: 365163 - DNA, 20 bp, Artificial
  CRISPR gRNA sequence
atgagtctgagtagctgcaa

SEQ ID NO: 365164 - DNA, 20 bp, Artificial
  CRISPR gRNA sequence
tctgagtagctgcaatagta

SEQ ID NO: 365165 - DNA, 20 bp, Artificial
  CRISPR gRNA sequence
tgcaatagtaaagttgcttc

SEQ ID NO: 365166 - DNA, 20 bp, Artificial
  CRISPR gRNA sequence
aatagtaaagttgcttccag

SEQ ID NO: 365167 - DNA, 20 bp, Artificial
  CRISPR gRNA sequence
agtaaagttgcttccagaag

SEQ ID NO: 365168 - DNA, 20 bp, Artificial
  CRISPR gRNA sequence
gtaaagttgcttccagaagc

SEQ ID NO: 365169 - DNA, 20 bp, Artificial
  CRISPR gRNA sequence
aaccccgcttcatgaaatat

SEQ ID NO: 365170 - DNA, 20 bp, Artificial
  CRISPR gRNA sequence
gaaatattagtgattcactt

SEQ ID NO: 365171 - DNA, 20 bp, Artificial
  CRISPR gRNA sequence
attcacttcagttgctatct

SEQ ID NO: 365172 - DNA, 20 bp, Artificial
  CRISPR gRNA sequence
ttcacttcagttgctatctg

SEQ ID NO: 365173 - DNA, 20 bp, Artificial
  CRISPR gRNA sequence
acttcagttgctatctgagg

SEQ ID NO: 365174 - DNA, 20 bp, Artificial
  CRISPR gRNA sequence
gttgctatctgaggaagttc

SEQ ID NO: 365175 - DNA, 20 bp, Artificial
  CRISPR gRNA sequence
gctatctgaggaagttctgg

SEQ ID NO: 365176 - DNA, 20 bp, Artificial
  CRISPR gRNA sequence
tatctgaggaagttctggta

SEQ ID NO: 365177 - DNA, 20 bp, Artificial
  CRISPR gRNA sequence
tctgaggaagttctggtaga

SEQ ID NO: 365178 - DNA, 20 bp, Artificial
  CRISPR gRNA sequence
gaggaagttctggtagagag

SEQ ID NO: 365179 - DNA, 20 bp, Artificial
  CRISPR gRNA sequence
ggaagttctggtagagagaa

SEQ ID NO: 365180 - DNA, 20 bp, Artificial
  CRISPR gRNA sequence
tctggtagagagaagagctc

SEQ ID NO: 365181 - DNA, 20 bp, Artificial
  CRISPR gRNA sequence
tggtagagagaagagctcaa

SEQ ID NO: 365182 - DNA, 20 bp, Artificial
  CRISPR gRNA sequence
gagagaagagctcaagagca

SEQ ID NO: 365183 - DNA, 20 bp, Artificial
  CRISPR gRNA sequence
agagaagagctcaagagcat

SEQ ID NO: 365184 - DNA, 20 bp, Artificial
  CRISPR gRNA sequence
gaagagctcaagagcatggg

SEQ ID NO: 365185 - DNA, 20 bp, Artificial
  CRISPR gRNA sequence
agagctcaagagcatgggca

SEQ ID NO: 365186 - DNA, 20 bp, Artificial
  CRISPR gRNA sequence
ctcaagagcatgggcagagt

SEQ ID NO: 365187 - DNA, 20 bp, Artificial
  CRISPR gRNA sequence
catgggcagagtcagctcct

SEQ ID NO: 365188 - DNA, 20 bp, Artificial
  CRISPR gRNA sequence
gggcagagtcagctcctgag

SEQ ID NO: 365189 - DNA, 20 bp, Artificial
  CRISPR gRNA sequence
ggcagagtcagctcctgagt

SEQ ID NO: 365190 - DNA, 20 bp, Artificial
  CRISPR gRNA sequence
agtgggctgaacgctcccct

SEQ ID NO: 365191 - DNA, 20 bp, Artificial
  CRISPR gRNA sequence
aacgctcccctcagctcctg

SEQ ID NO: 365192 - DNA, 20 bp, Artificial
  CRISPR gRNA sequence
cagctcctgcagtgctaatt

SEQ ID NO: 365193 - DNA, 20 bp, Artificial
  CRISPR gRNA sequence
agctcctgcagtgctaatta

SEQ ID NO: 365194 - DNA, 20 bp, Artificial
  CRISPR gRNA sequence
gctcctgcagtgctaattaa

SEQ ID NO: 365195 - DNA, 20 bp, Artificial
  CRISPR gRNA sequence
tcctgcagtgctaattaagg

SEQ ID NO: 365196 - DNA, 20 bp, Artificial
  CRISPR gRNA sequence
cctgcagtgctaattaaggg

SEQ ID NO: 365197 - DNA, 20 bp, Artificial
  CRISPR gRNA sequence
ctgcagtgctaattaaggga

SEQ ID NO: 365198 - DNA, 20 bp, Artificial
  CRISPR gRNA sequence
gcagtgctaattaagggagg

SEQ ID NO: 365199 - DNA, 20 bp, Artificial
  CRISPR gRNA sequence
gtgctaattaagggagggag

SEQ ID NO: 365200 - DNA, 20 bp, Artificial
  CRISPR gRNA sequence
ctaattaagggagggagcag

SEQ ID NO: 365201 - DNA, 20 bp, Artificial
  CRISPR gRNA sequence
taattaagggagggagcagc

SEQ ID NO: 365202 - DNA, 20 bp, Artificial
  CRISPR gRNA sequence
aattaagggagggagcagcg

SEQ ID NO: 365203 - DNA, 20 bp, Artificial
  CRISPR gRNA sequence
ttaagggagggagcagcggg

SEQ ID NO: 365204 - DNA, 20 bp, Artificial
  CRISPR gRNA sequence
agggagcagcggggagcttg

SEQ ID NO: 365205 - DNA, 20 bp, Artificial
  CRISPR gRNA sequence
gcggggagcttgcagtgacc

SEQ ID NO: 365206 - DNA, 20 bp, Artificial
  CRISPR gRNA sequence
ggggagcttgcagtgaccaa

SEQ ID NO: 365207 - DNA, 20 bp, Artificial
  CRISPR gRNA sequence
gggagcttgcagtgaccaag

SEQ ID NO: 365208 - DNA, 20 bp, Artificial
  CRISPR gRNA sequence
ggagcttgcagtgaccaaga

SEQ ID NO: 365209 - DNA, 20 bp, Artificial
  CRISPR gRNA sequence
gcagtgaccaagagggtgtt

SEQ ID NO: 365210 - DNA, 20 bp, Artificial
  CRISPR gRNA sequence
cagtgaccaagagggtgttg

SEQ ID NO: 365211 - DNA, 20 bp, Artificial
  CRISPR gRNA sequence
gaccaagagggtgttgaggc

SEQ ID NO: 365212 - DNA, 20 bp, Artificial
  CRISPR gRNA sequence
accaagagggtgttgaggct

SEQ ID NO: 365213 - DNA, 20 bp, Artificial
  CRISPR gRNA sequence
caagagggtgttgaggctag

SEQ ID NO: 365214 - DNA, 20 bp, Artificial
  CRISPR gRNA sequence
aagagggtgttgaggctagg

SEQ ID NO: 365215 - DNA, 20 bp, Artificial
  CRISPR gRNA sequence
ggctaggaggccacgataaa

SEQ ID NO: 365216 - DNA, 20 bp, Artificial
  CRISPR gRNA sequence
gctaggaggccacgataaac

SEQ ID NO: 365217 - DNA, 20 bp, Artificial
  CRISPR gRNA sequence
cgataaacaggatacgataa

SEQ ID NO: 365218 - DNA, 20 bp, Artificial
  CRISPR gRNA sequence
tacgataaaagtccttaacc

SEQ ID NO: 365219 - DNA, 20 bp, Artificial
  CRISPR gRNA sequence
aaaagtccttaaccaagacg

SEQ ID NO: 365220 - DNA, 20 bp, Artificial
  CRISPR gRNA sequence
gtccttaaccaagacgcaga

SEQ ID NO: 365221 - DNA, 20 bp, Artificial
  CRISPR gRNA sequence
tccttaaccaagacgcagat

SEQ ID NO: 365222 - DNA, 20 bp, Artificial
  CRISPR gRNA sequence
ttaaccaagacgcagatggg

SEQ ID NO: 365223 - DNA, 20 bp, Artificial
  CRISPR gRNA sequence
accaagacgcagatgggaag

SEQ ID NO: 365224 - DNA, 20 bp, Artificial
  CRISPR gRNA sequence
acgcagatgggaagaagcgt

SEQ ID NO: 365225 - DNA, 20 bp, Artificial
  CRISPR gRNA sequence
gcagatgggaagaagcgtta

SEQ ID NO: 365226 - DNA, 20 bp, Artificial
  CRISPR gRNA sequence
atgggaagaagcgttagagc

SEQ ID NO: 365227 - DNA, 20 bp, Artificial
  CRISPR gRNA sequence
ggaagaagcgttagagcgag

SEQ ID NO: 365228 - DNA, 20 bp, Artificial
  CRISPR gRNA sequence
gcgagcagcactcacatctc

SEQ ID NO: 365229 - DNA, 20 bp, Artificial
  CRISPR gRNA sequence
cgagcagcactcacatctca

SEQ ID NO: 365230 - DNA, 20 bp, Artificial
  CRISPR gRNA sequence
cagcactcacatctcaaggt

SEQ ID NO: 365231 - DNA, 20 bp, Artificial
  CRISPR gRNA sequence
ctcaaggttagtaaccttct

SEQ ID NO: 365232 - DNA, 20 bp, Artificial
  CRISPR gRNA sequence
ttagtaaccttctcagaaaa

SEQ ID NO: 365233 - DNA, 20 bp, Artificial
  CRISPR gRNA sequence
aaccttctcagaaaaaagac

SEQ ID NO: 365234 - DNA, 20 bp, Artificial
  CRISPR gRNA sequence
aaaaaagactggatgtgtct

SEQ ID NO: 365235 - DNA, 20 bp, Artificial
  CRISPR gRNA sequence
tttaaatgaatcgtgtgcga

SEQ ID NO: 365236 - DNA, 20 bp, Artificial
  CRISPR gRNA sequence
ttaaatgaatcgtgtgcgaa

SEQ ID NO: 365237 - DNA, 20 bp, Artificial
  CRISPR gRNA sequence
taaatgaatcgtgtgcgaaa

SEQ ID NO: 365238 - DNA, 20 bp, Artificial
  CRISPR gRNA sequence
atgaatcgtgtgcgaaaggg

SEQ ID NO: 365239 - DNA, 20 bp, Artificial
  CRISPR gRNA sequence
tgaatcgtgtgcgaaagggt

SEQ ID NO: 365240 - DNA, 20 bp, Artificial
  CRISPR gRNA sequence
gaatcgtgtgcgaaagggtg

SEQ ID NO: 365241 - DNA, 20 bp, Artificial
  CRISPR gRNA sequence
aatcgtgtgcgaaagggtgg

SEQ ID NO: 365242 - DNA, 20 bp, Artificial
  CRISPR gRNA sequence
tgcgaaagggtgggggctgc

SEQ ID NO: 365243 - DNA, 20 bp, Artificial
  CRISPR gRNA sequence
gggggctgccagtgaaacca

SEQ ID NO: 365244 - DNA, 20 bp, Artificial
  CRISPR gRNA sequence
gctgccagtgaaaccatggc

SEQ ID NO: 365245 - DNA, 20 bp, Artificial
  CRISPR gRNA sequence
gaaaccatggcaagttgatg

SEQ ID NO: 365246 - DNA, 20 bp, Artificial
  CRISPR gRNA sequence
accatggcaagttgatgcag

SEQ ID NO: 365247 - DNA, 20 bp, Artificial
  CRISPR gRNA sequence
ccatggcaagttgatgcagc

SEQ ID NO: 365248 - DNA, 20 bp, Artificial
  CRISPR gRNA sequence
gcaagttgatgcagcaggac

SEQ ID NO: 365249 - DNA, 20 bp, Artificial
  CRISPR gRNA sequence
aagttgatgcagcaggacaa

SEQ ID NO: 365250 - DNA, 20 bp, Artificial
  CRISPR gRNA sequence
gttgatgcagcaggacaaga

SEQ ID NO: 365251 - DNA, 20 bp, Artificial
  CRISPR gRNA sequence
cagcaggacaagagagttgc

SEQ ID NO: 365252 - DNA, 20 bp, Artificial
  CRISPR gRNA sequence
gacaagagagttgccggaaa

SEQ ID NO: 365253 - DNA, 20 bp, Artificial
  CRISPR gRNA sequence
agagagttgccggaaaaagc

SEQ ID NO: 365254 - DNA, 20 bp, Artificial
  CRISPR gRNA sequence
agagttgccggaaaaagctg

SEQ ID NO: 365255 - DNA, 20 bp, Artificial
  CRISPR gRNA sequence
ttgccggaaaaagctggagt

SEQ ID NO: 365256 - DNA, 20 bp, Artificial
  CRISPR gRNA sequence
ggaaaaagctggagtaagtt

SEQ ID NO: 365257 - DNA, 20 bp, Artificial
  CRISPR gRNA sequence
gctggagtaagttaagtgct

SEQ ID NO: 365258 - DNA, 20 bp, Artificial
  CRISPR gRNA sequence
ctcggtgttctgtgaactgt

SEQ ID NO: 365259 - DNA, 20 bp, Artificial
  CRISPR gRNA sequence
ctgtgaactgttagtttaat

SEQ ID NO: 365260 - DNA, 20 bp, Artificial
  CRISPR gRNA sequence
tgtgaactgttagtttaatg

SEQ ID NO: 365261 - DNA, 20 bp, Artificial
  CRISPR gRNA sequence
gtgaactgttagtttaatga

SEQ ID NO: 365262 - DNA, 20 bp, Artificial
  CRISPR gRNA sequence
tgaactgttagtttaatgag

SEQ ID NO: 365263 - DNA, 20 bp, Artificial
  CRISPR gRNA sequence
tgttagtttaatgaggggtg

SEQ ID NO: 365264 - DNA, 20 bp, Artificial
  CRISPR gRNA sequence
ttaatgaggggtgcagtttg

SEQ ID NO: 365265 - DNA, 20 bp, Artificial
  CRISPR gRNA sequence
aggggtgcagtttgtagtaa

SEQ ID NO: 365266 - DNA, 20 bp, Artificial
  CRISPR gRNA sequence
ggggtgcagtttgtagtaaa

SEQ ID NO: 365267 - DNA, 20 bp, Artificial
  CRISPR gRNA sequence
gggtgcagtttgtagtaaaa

SEQ ID NO: 365268 - DNA, 20 bp, Artificial
  CRISPR gRNA sequence
agtttgtagtaaaagggtgc

SEQ ID NO: 365269 - DNA, 20 bp, Artificial
  CRISPR gRNA sequence
gtagtaaaagggtgccagtt

SEQ ID NO: 365270 - DNA, 20 bp, Artificial
  CRISPR gRNA sequence
gccagttaagtactttttct

SEQ ID NO: 365271 - DNA, 20 bp, Artificial
  CRISPR gRNA sequence
actttttctcagtctgtctc

SEQ ID NO: 365272 - DNA, 20 bp, Artificial
  CRISPR gRNA sequence
ctctagaattgtatttataa

SEQ ID NO: 365273 - DNA, 20 bp, Artificial
  CRISPR gRNA sequence
ttataatagatctgatcgta

SEQ ID NO: 365274 - DNA, 20 bp, Artificial
  CRISPR gRNA sequence
gatctgatcgtaaagttctt

SEQ ID NO: 365275 - DNA, 20 bp, Artificial
  CRISPR gRNA sequence
atcgtaaagttcttgagaat

SEQ ID NO: 365276 - DNA, 20 bp, Artificial
  CRISPR gRNA sequence
ttcttgagaataagaaaact

SEQ ID NO: 365277 - DNA, 20 bp, Artificial
  CRISPR gRNA sequence
gaaaactgagctaattttac

SEQ ID NO: 365278 - DNA, 20 bp, Artificial
  CRISPR gRNA sequence
gagctaattttaccggcatc

SEQ ID NO: 365279 - DNA, 20 bp, Artificial
  CRISPR gRNA sequence
ttaccggcatctggtctgtc

SEQ ID NO: 365280 - DNA, 20 bp, Artificial
  CRISPR gRNA sequence
gcttaaatcttccttctctc

SEQ ID NO: 365281 - DNA, 20 bp, Artificial
  CRISPR gRNA sequence
aaatcttccttctctccagc

SEQ ID NO: 365282 - DNA, 20 bp, Artificial
  CRISPR gRNA sequence
tctctccagcaagactgaac

SEQ ID NO: 365283 - DNA, 20 bp, Artificial
  CRISPR gRNA sequence
ctctccagcaagactgaaca

SEQ ID NO: 365284 - DNA, 20 bp, Artificial
  CRISPR gRNA sequence
taataaatgtccatgatcca

SEQ ID NO: 365285 - DNA, 20 bp, Artificial
  CRISPR gRNA sequence
aaagatttattatcctactc

SEQ ID NO: 365286 - DNA, 20 bp, Artificial
  CRISPR gRNA sequence
aagatttattatcctactca

SEQ ID NO: 365287 - DNA, 20 bp, Artificial
  CRISPR gRNA sequence
agatttattatcctactcaa

SEQ ID NO: 365288 - DNA, 20 bp, Artificial
  CRISPR gRNA sequence
ttattatcctactcaagggt

SEQ ID NO: 365289 - DNA, 20 bp, Artificial
  CRISPR gRNA sequence
tattatcctactcaagggtt

SEQ ID NO: 365290 - DNA, 20 bp, Artificial
  CRISPR gRNA sequence
gttgggaaactttttctgta

SEQ ID NO: 365291 - DNA, 20 bp, Artificial
  CRISPR gRNA sequence
ttgggaaactttttctgtaa

SEQ ID NO: 365292 - DNA, 20 bp, Artificial
  CRISPR gRNA sequence
tgggaaactttttctgtaaa

SEQ ID NO: 365293 - DNA, 20 bp, Artificial
  CRISPR gRNA sequence
aaactttttctgtaaagggc

SEQ ID NO: 365294 - DNA, 20 bp, Artificial
  CRISPR gRNA sequence
tttttctgtaaagggccaga

SEQ ID NO: 365295 - DNA, 20 bp, Artificial
  CRISPR gRNA sequence
ggccagatagttaatattta

SEQ ID NO: 365296 - DNA, 20 bp, Artificial
  CRISPR gRNA sequence
agttaatatttacagctttg

SEQ ID NO: 365297 - DNA, 20 bp, Artificial
  CRISPR gRNA sequence
gttaatatttacagctttgt

SEQ ID NO: 365298 - DNA, 20 bp, Artificial
  CRISPR gRNA sequence
ttacagctttgtgggccgtg

SEQ ID NO: 365299 - DNA, 20 bp, Artificial
  CRISPR gRNA sequence
gtgggccgtgtggtgtctgt

SEQ ID NO: 365300 - DNA, 20 bp, Artificial
  CRISPR gRNA sequence
agttgtgacctaacacctct

SEQ ID NO: 365301 - DNA, 20 bp, Artificial
  CRISPR gRNA sequence
gacctaacacctcttggttc

SEQ ID NO: 365302 - DNA, 20 bp, Artificial
  CRISPR gRNA sequence
acctcttggttccagcattg

SEQ ID NO: 365303 - DNA, 20 bp, Artificial
  CRISPR gRNA sequence
ccagcattgcagcacaaaaa

SEQ ID NO: 365304 - DNA, 20 bp, Artificial
  CRISPR gRNA sequence
gcattgcagcacaaaaacag

SEQ ID NO: 365305 - DNA, 20 bp, Artificial
  CRISPR gRNA sequence
ttgcagcacaaaaacagcgg

SEQ ID NO: 365306 - DNA, 20 bp, Artificial
  CRISPR gRNA sequence
agcacaaaaacagcggtgga

SEQ ID NO: 365307 - DNA, 20 bp, Artificial
  CRISPR gRNA sequence
gcggtggatggtatgtaacc

SEQ ID NO: 365308 - DNA, 20 bp, Artificial
  CRISPR gRNA sequence
tggatggtatgtaaccaagt

SEQ ID NO: 365309 - DNA, 20 bp, Artificial
  CRISPR gRNA sequence
ggtatgtaaccaagtgagca

SEQ ID NO: 365310 - DNA, 20 bp, Artificial
  CRISPR gRNA sequence
gtctccaaccaaactgttta

SEQ ID NO: 365311 - DNA, 20 bp, Artificial
  CRISPR gRNA sequence
accaaactgtttatggaaat

SEQ ID NO: 365312 - DNA, 20 bp, Artificial
  CRISPR gRNA sequence
aaactgtttatggaaatcag

SEQ ID NO: 365313 - DNA, 20 bp, Artificial
  CRISPR gRNA sequence
aactgtttatggaaatcagt

SEQ ID NO: 365314 - DNA, 20 bp, Artificial
  CRISPR gRNA sequence
ggaaatcagtgggctgcgcc

SEQ ID NO: 365315 - DNA, 20 bp, Artificial
  CRISPR gRNA sequence
agtgggctgcgcccagccct

SEQ ID NO: 365316 - DNA, 20 bp, Artificial
  CRISPR gRNA sequence
gtgggctgcgcccagccctc

SEQ ID NO: 365317 - DNA, 20 bp, Artificial
  CRISPR gRNA sequence
tgcgcccagccctcaggcca

SEQ ID NO: 365318 - DNA, 20 bp, Artificial
  CRISPR gRNA sequence
cagccctcaggccatagttt

SEQ ID NO: 365319 - DNA, 20 bp, Artificial
  CRISPR gRNA sequence
atagtttcagaaccctgtct

SEQ ID NO: 365320 - DNA, 20 bp, Artificial
  CRISPR gRNA sequence
agtttcagaaccctgtctta

SEQ ID NO: 365321 - DNA, 20 bp, Artificial
  CRISPR gRNA sequence
gtttcagaaccctgtcttag

SEQ ID NO: 365322 - DNA, 20 bp, Artificial
  CRISPR gRNA sequence
gatccctgctgaaccccaac

SEQ ID NO: 365323 - DNA, 20 bp, Artificial
  CRISPR gRNA sequence
tccctgctgaaccccaactg

SEQ ID NO: 365324 - DNA, 20 bp, Artificial
  CRISPR gRNA sequence
actggagtctttgcgttgac

SEQ ID NO: 365325 - DNA, 20 bp, Artificial
  CRISPR gRNA sequence
ggagtctttgcgttgactgg

SEQ ID NO: 365326 - DNA, 20 bp, Artificial
  CRISPR gRNA sequence
gtctttgcgttgactggaag

SEQ ID NO: 365327 - DNA, 20 bp, Artificial
  CRISPR gRNA sequence
tctttgcgttgactggaagt

SEQ ID NO: 365328 - DNA, 20 bp, Artificial
  CRISPR gRNA sequence
ctttgcgttgactggaagtg

SEQ ID NO: 365329 - DNA, 20 bp, Artificial
  CRISPR gRNA sequence
gactggaagtggggttctac

SEQ ID NO: 365330 - DNA, 20 bp, Artificial
  CRISPR gRNA sequence
gtggggttctactggtcact

SEQ ID NO: 365331 - DNA, 20 bp, Artificial
  CRISPR gRNA sequence
gggttctactggtcactcag

SEQ ID NO: 365332 - DNA, 20 bp, Artificial
  CRISPR gRNA sequence
ttctactggtcactcagcag

SEQ ID NO: 365333 - DNA, 20 bp, Artificial
  CRISPR gRNA sequence
ctcagcagtagcctcactcc

SEQ ID NO: 365334 - DNA, 20 bp, Artificial
  CRISPR gRNA sequence
tcagcagtagcctcactcct

SEQ ID NO: 365335 - DNA, 20 bp, Artificial
  CRISPR gRNA sequence
cagcagtagcctcactcctg

SEQ ID NO: 365336 - DNA, 20 bp, Artificial
  CRISPR gRNA sequence
ggacatgtgtatgacttgcc

SEQ ID NO: 365337 - DNA, 20 bp, Artificial
  CRISPR gRNA sequence
gacatgtgtatgacttgcca

SEQ ID NO: 365338 - DNA, 20 bp, Artificial
  CRISPR gRNA sequence
gtatgacttgccaaggttct

SEQ ID NO: 365339 - DNA, 20 bp, Artificial
  CRISPR gRNA sequence
tatgacttgccaaggttcta

SEQ ID NO: 365340 - DNA, 20 bp, Artificial
  CRISPR gRNA sequence
atgacttgccaaggttctaa

SEQ ID NO: 365341 - DNA, 20 bp, Artificial
  CRISPR gRNA sequence
ccaaggttctaagggtatcg

SEQ ID NO: 365342 - DNA, 20 bp, Artificial
  CRISPR gRNA sequence
gttctaagggtatcgtggtc

SEQ ID NO: 365343 - DNA, 20 bp, Artificial
  CRISPR gRNA sequence
tctaagggtatcgtggtcta

SEQ ID NO: 365344 - DNA, 20 bp, Artificial
  CRISPR gRNA sequence
ctaagggtatcgtggtctag

SEQ ID NO: 365345 - DNA, 20 bp, Artificial
  CRISPR gRNA sequence
aagggtatcgtggtctagag

SEQ ID NO: 365346 - DNA, 20 bp, Artificial
  CRISPR gRNA sequence
gtggtctagaggagaccatg

SEQ ID NO: 365347 - DNA, 20 bp, Artificial
  CRISPR gRNA sequence
ggagaccatgtggcccacat

SEQ ID NO: 365348 - DNA, 20 bp, Artificial
  CRISPR gRNA sequence
accatgtggcccacattgga

SEQ ID NO: 365349 - DNA, 20 bp, Artificial
  CRISPR gRNA sequence
ccatgtggcccacattggaa

SEQ ID NO: 365350 - DNA, 20 bp, Artificial
  CRISPR gRNA sequence
attggaaaggttctcttaat

SEQ ID NO: 365351 - DNA, 20 bp, Artificial
  CRISPR gRNA sequence
ttctcttaatgagattattt

SEQ ID NO: 365352 - DNA, 20 bp, Artificial
  CRISPR gRNA sequence
tctcttaatgagattatttg

SEQ ID NO: 365353 - DNA, 20 bp, Artificial
  CRISPR gRNA sequence
cttaatgagattatttgagg

SEQ ID NO: 365354 - DNA, 20 bp, Artificial
  CRISPR gRNA sequence
ttaatgagattatttgagga

SEQ ID NO: 365355 - DNA, 20 bp, Artificial
  CRISPR gRNA sequence
taatgagattatttgaggaa

SEQ ID NO: 365356 - DNA, 20 bp, Artificial
  CRISPR gRNA sequence
atgagattatttgaggaagg

SEQ ID NO: 365357 - DNA, 20 bp, Artificial
  CRISPR gRNA sequence
agattatttgaggaagggag

SEQ ID NO: 365358 - DNA, 20 bp, Artificial
  CRISPR gRNA sequence
tgaggaagggagcagaaacc

SEQ ID NO: 365359 - DNA, 20 bp, Artificial
  CRISPR gRNA sequence
acccagactattgtgttcct

SEQ ID NO: 365360 - DNA, 20 bp, Artificial
  CRISPR gRNA sequence
cccagactattgtgttcctg

SEQ ID NO: 365361 - DNA, 20 bp, Artificial
  CRISPR gRNA sequence
tttttttttttttttttttt

SEQ ID NO: 365362 - DNA, 20 bp, Artificial
  CRISPR gRNA sequence
ttttttttttttttttgaga

SEQ ID NO: 365363 - DNA, 20 bp, Artificial
  CRISPR gRNA sequence
ttttttttttttttgagatg

SEQ ID NO: 365364 - DNA, 20 bp, Artificial
  CRISPR gRNA sequence
tggagtctcgctcctttgcc

SEQ ID NO: 365365 - DNA, 20 bp, Artificial
  CRISPR gRNA sequence
ggagtctcgctcctttgccc

SEQ ID NO: 365366 - DNA, 20 bp, Artificial
  CRISPR gRNA sequence
tctcgctcctttgcccaggc

SEQ ID NO: 365367 - DNA, 20 bp, Artificial
  CRISPR gRNA sequence
tcgctcctttgcccaggctg

SEQ ID NO: 365368 - DNA, 20 bp, Artificial
  CRISPR gRNA sequence
cctttgcccaggctggagtg

SEQ ID NO: 365369 - DNA, 20 bp, Artificial
  CRISPR gRNA sequence
ttgcccaggctggagtgcag

SEQ ID NO: 365370 - DNA, 20 bp, Artificial
  CRISPR gRNA sequence
ggagtgcagtggtgcgatgt

SEQ ID NO: 365371 - DNA, 20 bp, Artificial
  CRISPR gRNA sequence
gtgcgatgtcggctcactgc

SEQ ID NO: 365372 - DNA, 20 bp, Artificial
  CRISPR gRNA sequence
tcactgcaagctctgcctcc

SEQ ID NO: 365373 - DNA, 20 bp, Artificial
  CRISPR gRNA sequence
cactgcaagctctgcctcct

SEQ ID NO: 365374 - DNA, 20 bp, Artificial
  CRISPR gRNA sequence
ttcacgccattctcctgcct

SEQ ID NO: 365375 - DNA, 20 bp, Artificial
  CRISPR gRNA sequence
ttctcctgcctcagcctcct

SEQ ID NO: 365376 - DNA, 20 bp, Artificial
  CRISPR gRNA sequence
tcctgcctcagcctcctgag

SEQ ID NO: 365377 - DNA, 20 bp, Artificial
  CRISPR gRNA sequence
gcctcagcctcctgagtagc

SEQ ID NO: 365378 - DNA, 20 bp, Artificial
  CRISPR gRNA sequence
cctcagcctcctgagtagct

SEQ ID NO: 365379 - DNA, 20 bp, Artificial
  CRISPR gRNA sequence
ctcctgagtagctgggacta

SEQ ID NO: 365380 - DNA, 20 bp, Artificial
  CRISPR gRNA sequence
tcctgagtagctgggactac

SEQ ID NO: 365381 - DNA, 20 bp, Artificial
  CRISPR gRNA sequence
caggtgcccgctaccacacc

SEQ ID NO: 365382 - DNA, 20 bp, Artificial
  CRISPR gRNA sequence
cggctaattttttgtatttt

SEQ ID NO: 365383 - DNA, 20 bp, Artificial
  CRISPR gRNA sequence
ctaattttttgtatttttag

SEQ ID NO: 365384 - DNA, 20 bp, Artificial
  CRISPR gRNA sequence
aattttttgtatttttagca

SEQ ID NO: 365385 - DNA, 20 bp, Artificial
  CRISPR gRNA sequence
ttgtatttttagcagagacg

SEQ ID NO: 365386 - DNA, 20 bp, Artificial
  CRISPR gRNA sequence
gagacgtggtttcaccgtgt

SEQ ID NO: 365387 - DNA, 20 bp, Artificial
  CRISPR gRNA sequence
tttcaccgtgttagccacga

SEQ ID NO: 365388 - DNA, 20 bp, Artificial
  CRISPR gRNA sequence
acctcatgatccgcccgcct

SEQ ID NO: 365389 - DNA, 20 bp, Artificial
  CRISPR gRNA sequence
gcccgcctcggccttcactt

SEQ ID NO: 365390 - DNA, 20 bp, Artificial
  CRISPR gRNA sequence
cccgcctcggccttcacttt

SEQ ID NO: 365391 - DNA, 20 bp, Artificial
  CRISPR gRNA sequence
cggccttcactttgggatta

SEQ ID NO: 365392 - DNA, 20 bp, Artificial
  CRISPR gRNA sequence
ggccttcactttgggattac

SEQ ID NO: 365393 - DNA, 20 bp, Artificial
  CRISPR gRNA sequence
cactttgggattacaggcgt

SEQ ID NO: 365394 - DNA, 20 bp, Artificial
  CRISPR gRNA sequence
caggcgtgagccaccgcacc

SEQ ID NO: 365395 - DNA, 20 bp, Artificial
  CRISPR gRNA sequence
ccaccgcacccggcctcctg

SEQ ID NO: 365396 - DNA, 20 bp, Artificial
  CRISPR gRNA sequence
gcctcctgtggaaatcttac

SEQ ID NO: 365397 - DNA, 20 bp, Artificial
  CRISPR gRNA sequence
tcctgtggaaatcttactgg

SEQ ID NO: 365398 - DNA, 20 bp, Artificial
  CRISPR gRNA sequence
ggaaatcttactggaagtat

SEQ ID NO: 365399 - DNA, 20 bp, Artificial
  CRISPR gRNA sequence
tggaagtatgagcctcttaa

SEQ ID NO: 365400 - DNA, 20 bp, Artificial
  CRISPR gRNA sequence
agtatgagcctcttaacagc

SEQ ID NO: 365401 - DNA, 20 bp, Artificial
  CRISPR gRNA sequence
gtatgagcctcttaacagct

SEQ ID NO: 365402 - DNA, 20 bp, Artificial
  CRISPR gRNA sequence
tatgagcctcttaacagctg

SEQ ID NO: 365403 - DNA, 20 bp, Artificial
  CRISPR gRNA sequence
tcttaacagctggggcatcc

SEQ ID NO: 365404 - DNA, 20 bp, Artificial
  CRISPR gRNA sequence
taacagctggggcatcccag

SEQ ID NO: 365405 - DNA, 20 bp, Artificial
  CRISPR gRNA sequence
cagctggggcatcccagcag

SEQ ID NO: 365406 - DNA, 20 bp, Artificial
  CRISPR gRNA sequence
agctggggcatcccagcaga

SEQ ID NO: 365407 - DNA, 20 bp, Artificial
  CRISPR gRNA sequence
tggggcatcccagcagaagg

SEQ ID NO: 365408 - DNA, 20 bp, Artificial
  CRISPR gRNA sequence
ggggcatcccagcagaaggc

SEQ ID NO: 365409 - DNA, 20 bp, Artificial
  CRISPR gRNA sequence
gcaggcaaaccctcgcatct

SEQ ID NO: 365410 - DNA, 20 bp, Artificial
  CRISPR gRNA sequence
ggcaaaccctcgcatctgag

SEQ ID NO: 365411 - DNA, 20 bp, Artificial
  CRISPR gRNA sequence
gcaaaccctcgcatctgaga

SEQ ID NO: 365412 - DNA, 20 bp, Artificial
  CRISPR gRNA sequence
aaaccctcgcatctgagaag

SEQ ID NO: 365413 - DNA, 20 bp, Artificial
  CRISPR gRNA sequence
ccctcgcatctgagaaggag

SEQ ID NO: 365414 - DNA, 20 bp, Artificial
  CRISPR gRNA sequence
ctcgcatctgagaaggagtg

SEQ ID NO: 365415 - DNA, 20 bp, Artificial
  CRISPR gRNA sequence
tcgcatctgagaaggagtgg

SEQ ID NO: 365416 - DNA, 20 bp, Artificial
  CRISPR gRNA sequence
cgcatctgagaaggagtgga

SEQ ID NO: 365417 - DNA, 20 bp, Artificial
  CRISPR gRNA sequence
catctgagaaggagtggagg

SEQ ID NO: 365418 - DNA, 20 bp, Artificial
  CRISPR gRNA sequence
ctctcacactataatcttcc

SEQ ID NO: 365419 - DNA, 20 bp, Artificial
  CRISPR gRNA sequence
cactataatcttcccagccc

SEQ ID NO: 365420 - DNA, 20 bp, Artificial
  CRISPR gRNA sequence
cagccccagtcacttgttct

SEQ ID NO: 365421 - DNA, 20 bp, Artificial
  CRISPR gRNA sequence
ccagtcacttgttctgagtt

SEQ ID NO: 365422 - DNA, 20 bp, Artificial
  CRISPR gRNA sequence
tcacttgttctgagtttagc

SEQ ID NO: 365423 - DNA, 20 bp, Artificial
  CRISPR gRNA sequence
ttagctagattttctgttca

SEQ ID NO: 365424 - DNA, 20 bp, Artificial
  CRISPR gRNA sequence
gttcacagtcctctgctttc

SEQ ID NO: 365425 - DNA, 20 bp, Artificial
  CRISPR gRNA sequence
tctgctttccagcatgtgaa

SEQ ID NO: 365426 - DNA, 20 bp, Artificial
  CRISPR gRNA sequence
cagcatgtgaatagttttcc

SEQ ID NO: 365427 - DNA, 20 bp, Artificial
  CRISPR gRNA sequence
atgtgaatagttttccaagc

SEQ ID NO: 365428 - DNA, 20 bp, Artificial
  CRISPR gRNA sequence
gttttccaagcaagtgtcga

SEQ ID NO: 365429 - DNA, 20 bp, Artificial
  CRISPR gRNA sequence
ttttccaagcaagtgtcgaa

SEQ ID NO: 365430 - DNA, 20 bp, Artificial
  CRISPR gRNA sequence
aagcaagtgtcgaaaggtat

SEQ ID NO: 365431 - DNA, 20 bp, Artificial
  CRISPR gRNA sequence
gcaagtgtcgaaaggtatca

SEQ ID NO: 365432 - DNA, 20 bp, Artificial
  CRISPR gRNA sequence
agtgtcgaaaggtatcagag

SEQ ID NO: 365433 - DNA, 20 bp, Artificial
  CRISPR gRNA sequence
agattctccatcacacacat

SEQ ID NO: 365434 - DNA, 20 bp, Artificial
  CRISPR gRNA sequence
gattctccatcacacacatc

SEQ ID NO: 365435 - DNA, 20 bp, Artificial
  CRISPR gRNA sequence
tcaggtgtttttgcataaac

SEQ ID NO: 365436 - DNA, 20 bp, Artificial
  CRISPR gRNA sequence
caggtgtttttgcataaact

SEQ ID NO: 365437 - DNA, 20 bp, Artificial
  CRISPR gRNA sequence
aggtgtttttgcataaactg

SEQ ID NO: 365438 - DNA, 20 bp, Artificial
  CRISPR gRNA sequence
tgtttttgcataaactgggg

SEQ ID NO: 365439 - DNA, 20 bp, Artificial
  CRISPR gRNA sequence
gtttttgcataaactgggga

SEQ ID NO: 365440 - DNA, 20 bp, Artificial
  CRISPR gRNA sequence
tttgcataaactggggaagg

SEQ ID NO: 365441 - DNA, 20 bp, Artificial
  CRISPR gRNA sequence
ttgcataaactggggaaggt

SEQ ID NO: 365442 - DNA, 20 bp, Artificial
  CRISPR gRNA sequence
tgcataaactggggaaggtg

SEQ ID NO: 365443 - DNA, 20 bp, Artificial
  CRISPR gRNA sequence
ctggggaaggtggggtcatt

SEQ ID NO: 365444 - DNA, 20 bp, Artificial
  CRISPR gRNA sequence
gggaaggtggggtcattgag

SEQ ID NO: 365445 - DNA, 20 bp, Artificial
  CRISPR gRNA sequence
tggggtcattgagtagacac

SEQ ID NO: 365446 - DNA, 20 bp, Artificial
  CRISPR gRNA sequence
ggggtcattgagtagacact

SEQ ID NO: 365447 - DNA, 20 bp, Artificial
  CRISPR gRNA sequence
ggtcattgagtagacactag

SEQ ID NO: 365448 - DNA, 20 bp, Artificial
  CRISPR gRNA sequence
aggagactcctcccaatgct

SEQ ID NO: 365449 - DNA, 20 bp, Artificial
  CRISPR gRNA sequence
ctcccaatgctcagaaacca

SEQ ID NO: 365450 - DNA, 20 bp, Artificial
  CRISPR gRNA sequence
cccaatgctcagaaaccata

SEQ ID NO: 365451 - DNA, 20 bp, Artificial
  CRISPR gRNA sequence
tcagaaaccatagagacatc

SEQ ID NO: 365452 - DNA, 20 bp, Artificial
  CRISPR gRNA sequence
cagaaaccatagagacatct

SEQ ID NO: 365453 - DNA, 20 bp, Artificial
  CRISPR gRNA sequence
agaaaccatagagacatctg

SEQ ID NO: 365454 - DNA, 20 bp, Artificial
  CRISPR gRNA sequence
aaccatagagacatctgggg

SEQ ID NO: 365455 - DNA, 20 bp, Artificial
  CRISPR gRNA sequence
catagagacatctggggaag

SEQ ID NO: 365456 - DNA, 20 bp, Artificial
  CRISPR gRNA sequence
atagagacatctggggaagc

SEQ ID NO: 365457 - DNA, 20 bp, Artificial
  CRISPR gRNA sequence
tggggaagcaggacatattg

SEQ ID NO: 365458 - DNA, 20 bp, Artificial
  CRISPR gRNA sequence
ggggaagcaggacatattgt

SEQ ID NO: 365459 - DNA, 20 bp, Artificial
  CRISPR gRNA sequence
gaagcaggacatattgtagg

SEQ ID NO: 365460 - DNA, 20 bp, Artificial
  CRISPR gRNA sequence
gcaggacatattgtaggtag

SEQ ID NO: 365461 - DNA, 20 bp, Artificial
  CRISPR gRNA sequence
gtagcagaaacaatgaaact

SEQ ID NO: 365462 - DNA, 20 bp, Artificial
  CRISPR gRNA sequence
tagcagaaacaatgaaactg

SEQ ID NO: 365463 - DNA, 20 bp, Artificial
  CRISPR gRNA sequence
aaacaatgaaactgaggtga

SEQ ID NO: 365464 - DNA, 20 bp, Artificial
  CRISPR gRNA sequence
aacaatgaaactgaggtgac

SEQ ID NO: 365465 - DNA, 20 bp, Artificial
  CRISPR gRNA sequence
acaatgaaactgaggtgaca

SEQ ID NO: 365466 - DNA, 20 bp, Artificial
  CRISPR gRNA sequence
atgaaactgaggtgacaggg

SEQ ID NO: 365467 - DNA, 20 bp, Artificial
  CRISPR gRNA sequence
tgaaactgaggtgacaggga

SEQ ID NO: 365468 - DNA, 20 bp, Artificial
  CRISPR gRNA sequence
gtgacagggaaggttctacc

SEQ ID NO: 365469 - DNA, 20 bp, Artificial
  CRISPR gRNA sequence
tgacagggaaggttctacct

SEQ ID NO: 365470 - DNA, 20 bp, Artificial
  CRISPR gRNA sequence
cagggaaggttctacctggg

SEQ ID NO: 365471 - DNA, 20 bp, Artificial
  CRISPR gRNA sequence
gaaggttctacctgggtgga

SEQ ID NO: 365472 - DNA, 20 bp, Artificial
  CRISPR gRNA sequence
ctacctgggtggacagccta

SEQ ID NO: 365473 - DNA, 20 bp, Artificial
  CRISPR gRNA sequence
tacctgggtggacagcctac

SEQ ID NO: 365474 - DNA, 20 bp, Artificial
  CRISPR gRNA sequence
ctgggtggacagcctacagg

SEQ ID NO: 365475 - DNA, 20 bp, Artificial
  CRISPR gRNA sequence
ggtggacagcctacaggaag

SEQ ID NO: 365476 - DNA, 20 bp, Artificial
  CRISPR gRNA sequence
acagcctacaggaagaagaa

SEQ ID NO: 365477 - DNA, 20 bp, Artificial
  CRISPR gRNA sequence
ctacaggaagaagaacagtg

SEQ ID NO: 365478 - DNA, 20 bp, Artificial
  CRISPR gRNA sequence
gaagaagaacagtgtggctg

SEQ ID NO: 365479 - DNA, 20 bp, Artificial
  CRISPR gRNA sequence
agaagaacagtgtggctgaa

SEQ ID NO: 365480 - DNA, 20 bp, Artificial
  CRISPR gRNA sequence
gttccccgtccccacccacc

SEQ ID NO: 365481 - DNA, 20 bp, Artificial
  CRISPR gRNA sequence
ttccccgtccccacccaccc

SEQ ID NO: 365482 - DNA, 20 bp, Artificial
  CRISPR gRNA sequence
ccccacccacccaggccacc

SEQ ID NO: 365483 - DNA, 20 bp, Artificial
  CRISPR gRNA sequence
cccacccacccaggccacct

SEQ ID NO: 365484 - DNA, 20 bp, Artificial
  CRISPR gRNA sequence
cacccacccaggccacctag

SEQ ID NO: 365485 - DNA, 20 bp, Artificial
  CRISPR gRNA sequence
gccacctaggagtctgcatt

SEQ ID NO: 365486 - DNA, 20 bp, Artificial
  CRISPR gRNA sequence
cacctaggagtctgcattca

SEQ ID NO: 365487 - DNA, 20 bp, Artificial
  CRISPR gRNA sequence
acctaggagtctgcattcag

SEQ ID NO: 365488 - DNA, 20 bp, Artificial
  CRISPR gRNA sequence
aggagtctgcattcagaggc

SEQ ID NO: 365489 - DNA, 20 bp, Artificial
  CRISPR gRNA sequence
gcattcagaggcaagcttgt

SEQ ID NO: 365490 - DNA, 20 bp, Artificial
  CRISPR gRNA sequence
gagatgaattcatgctcatg

SEQ ID NO: 365491 - DNA, 20 bp, Artificial
  CRISPR gRNA sequence
tgaattcatgctcatgtggt

SEQ ID NO: 365492 - DNA, 20 bp, Artificial
  CRISPR gRNA sequence
tcatgctcatgtggttagct

SEQ ID NO: 365493 - DNA, 20 bp, Artificial
  CRISPR gRNA sequence
gttagctgagacatttttaa

SEQ ID NO: 365494 - DNA, 20 bp, Artificial
  CRISPR gRNA sequence
agctgagacatttttaatag

SEQ ID NO: 365495 - DNA, 20 bp, Artificial
  CRISPR gRNA sequence
ctgagacatttttaatagta

SEQ ID NO: 365496 - DNA, 20 bp, Artificial
  CRISPR gRNA sequence
tttttaatagtagagaaatc

SEQ ID NO: 365497 - DNA, 20 bp, Artificial
  CRISPR gRNA sequence
ttttgattaatgacttcctt

SEQ ID NO: 365498 - DNA, 20 bp, Artificial
  CRISPR gRNA sequence
tttgattaatgacttccttg

SEQ ID NO: 365499 - DNA, 20 bp, Artificial
  CRISPR gRNA sequence
taatgacttccttgaggaca

SEQ ID NO: 365500 - DNA, 20 bp, Artificial
  CRISPR gRNA sequence
gaggacaaagctcttttata

SEQ ID NO: 365501 - DNA, 20 bp, Artificial
  CRISPR gRNA sequence
acaaagctcttttatacaga

SEQ ID NO: 365502 - DNA, 20 bp, Artificial
  CRISPR gRNA sequence
ttttatacagacagctctat

SEQ ID NO: 365503 - DNA, 20 bp, Artificial
  CRISPR gRNA sequence
tctattagaaaaaaaacctc

SEQ ID NO: 365504 - DNA, 20 bp, Artificial
  CRISPR gRNA sequence
ttcataaatcatgcaaaaaa

SEQ ID NO: 365505 - DNA, 20 bp, Artificial
  CRISPR gRNA sequence
ggctgctgacacaacaaaaa

SEQ ID NO: 365506 - DNA, 20 bp, Artificial
  CRISPR gRNA sequence
tgacacaacaaaaatagctc

SEQ ID NO: 365507 - DNA, 20 bp, Artificial
  CRISPR gRNA sequence
gcgctgtctctatttgtctt

SEQ ID NO: 365508 - DNA, 20 bp, Artificial
  CRISPR gRNA sequence
tgtctctatttgtctttggt

SEQ ID NO: 365509 - DNA, 20 bp, Artificial
  CRISPR gRNA sequence
tttggttagatgttgataaa

SEQ ID NO: 365510 - DNA, 20 bp, Artificial
  CRISPR gRNA sequence
ttggttagatgttgataaat

SEQ ID NO: 365511 - DNA, 20 bp, Artificial
  CRISPR gRNA sequence
tggttagatgttgataaata

SEQ ID NO: 365512 - DNA, 20 bp, Artificial
  CRISPR gRNA sequence
tgataaatagggctcatctc

SEQ ID NO: 365513 - DNA, 20 bp, Artificial
  CRISPR gRNA sequence
aatagggctcatctctagca

SEQ ID NO: 365514 - DNA, 20 bp, Artificial
  CRISPR gRNA sequence
catctctagcaaagtcgtaa

SEQ ID NO: 365515 - DNA, 20 bp, Artificial
  CRISPR gRNA sequence
tctagcaaagtcgtaacagc

SEQ ID NO: 365516 - DNA, 20 bp, Artificial
  CRISPR gRNA sequence
taacagctggactttgtctt

SEQ ID NO: 365517 - DNA, 20 bp, Artificial
  CRISPR gRNA sequence
tggactttgtcttcagctgc

SEQ ID NO: 365518 - DNA, 20 bp, Artificial
  CRISPR gRNA sequence
tcattcgaatctgtgacctc

SEQ ID NO: 365519 - DNA, 20 bp, Artificial
  CRISPR gRNA sequence
cattcgaatctgtgacctct

SEQ ID NO: 365520 - DNA, 20 bp, Artificial
  CRISPR gRNA sequence
acctctaggaccctcaattc

SEQ ID NO: 365521 - DNA, 20 bp, Artificial
  CRISPR gRNA sequence
cctctaggaccctcaattcc

SEQ ID NO: 365522 - DNA, 20 bp, Artificial
  CRISPR gRNA sequence
ctctaggaccctcaattcca

SEQ ID NO: 365523 - DNA, 20 bp, Artificial
  CRISPR gRNA sequence
attccagggtgcaaatacac

SEQ ID NO: 365524 - DNA, 20 bp, Artificial
  CRISPR gRNA sequence
agttctcttcatctcttgac

SEQ ID NO: 365525 - DNA, 20 bp, Artificial
  CRISPR gRNA sequence
ctcttcatctcttgactagt

SEQ ID NO: 365526 - DNA, 20 bp, Artificial
  CRISPR gRNA sequence
atctcttgactagttggctc

SEQ ID NO: 365527 - DNA, 20 bp, Artificial
  CRISPR gRNA sequence
ctagttggctctggatgcct

SEQ ID NO: 365528 - DNA, 20 bp, Artificial
  CRISPR gRNA sequence
tagttggctctggatgcctt

SEQ ID NO: 365529 - DNA, 20 bp, Artificial
  CRISPR gRNA sequence
gctctggatgccttgggaat

SEQ ID NO: 365530 - DNA, 20 bp, Artificial
  CRISPR gRNA sequence
ctctggatgccttgggaata

SEQ ID NO: 365531 - DNA, 20 bp, Artificial
  CRISPR gRNA sequence
ctggatgccttgggaataag

SEQ ID NO: 365532 - DNA, 20 bp, Artificial
  CRISPR gRNA sequence
tgggaataaggagttcctac

SEQ ID NO: 365533 - DNA, 20 bp, Artificial
  CRISPR gRNA sequence
gagttcctacaagttattac

SEQ ID NO: 365534 - DNA, 20 bp, Artificial
  CRISPR gRNA sequence
tcctacaagttattaccagt

SEQ ID NO: 365535 - DNA, 20 bp, Artificial
  CRISPR gRNA sequence
accagttagtaccccttttc

SEQ ID NO: 365536 - DNA, 20 bp, Artificial
  CRISPR gRNA sequence
tgaacctcatttctttatcc

SEQ ID NO: 365537 - DNA, 20 bp, Artificial
  CRISPR gRNA sequence
gaacctcatttctttatcct

SEQ ID NO: 365538 - DNA, 20 bp, Artificial
  CRISPR gRNA sequence
ctcatttctttatcctgggt

SEQ ID NO: 365539 - DNA, 20 bp, Artificial
  CRISPR gRNA sequence
tcatttctttatcctgggtg

SEQ ID NO: 365540 - DNA, 20 bp, Artificial
  CRISPR gRNA sequence
tttctttatcctgggtgagg

SEQ ID NO: 365541 - DNA, 20 bp, Artificial
  CRISPR gRNA sequence
ctgggtgaggaagttcactt

SEQ ID NO: 365542 - DNA, 20 bp, Artificial
  CRISPR gRNA sequence
tgggtgaggaagttcacttt

SEQ ID NO: 365543 - DNA, 20 bp, Artificial
  CRISPR gRNA sequence
gttcactttgggcctgatca

SEQ ID NO: 365544 - DNA, 20 bp, Artificial
  CRISPR gRNA sequence
gcctgatcatagaaaccacc

SEQ ID NO: 365545 - DNA, 20 bp, Artificial
  CRISPR gRNA sequence
ctgatcatagaaaccaccga

SEQ ID NO: 365546 - DNA, 20 bp, Artificial
  CRISPR gRNA sequence
atcatagaaaccaccgagag

SEQ ID NO: 365547 - DNA, 20 bp, Artificial
  CRISPR gRNA sequence
ccaccgagagtggatgatgc

SEQ ID NO: 365548 - DNA, 20 bp, Artificial
  CRISPR gRNA sequence
caccgagagtggatgatgct

SEQ ID NO: 365549 - DNA, 20 bp, Artificial
  CRISPR gRNA sequence
aggtttcatctcatttcctt

SEQ ID NO: 365550 - DNA, 20 bp, Artificial
  CRISPR gRNA sequence
ggtttcatctcatttccttt

SEQ ID NO: 365551 - DNA, 20 bp, Artificial
  CRISPR gRNA sequence
tctcatttcctttaggattt

SEQ ID NO: 365552 - DNA, 20 bp, Artificial
  CRISPR gRNA sequence
ctcatttcctttaggatttg

SEQ ID NO: 365553 - DNA, 20 bp, Artificial
  CRISPR gRNA sequence
atttcctttaggatttgagg

SEQ ID NO: 365554 - DNA, 20 bp, Artificial
  CRISPR gRNA sequence
ctttaggatttgaggcagca

SEQ ID NO: 365555 - DNA, 20 bp, Artificial
  CRISPR gRNA sequence
tttgaggcagcacggtgttg

SEQ ID NO: 365556 - DNA, 20 bp, Artificial
  CRISPR gRNA sequence
cggtgttgcagatgcctgct

SEQ ID NO: 365557 - DNA, 20 bp, Artificial
  CRISPR gRNA sequence
gcagatgcctgcttggccct

SEQ ID NO: 365558 - DNA, 20 bp, Artificial
  CRISPR gRNA sequence
cccaaccctgacccctccct

SEQ ID NO: 365559 - DNA, 20 bp, Artificial
  CRISPR gRNA sequence
ctgacccctccctcagaaaa

SEQ ID NO: 365560 - DNA, 20 bp, Artificial
  CRISPR gRNA sequence
ctcagaaaatagatatgttt

SEQ ID NO: 365561 - DNA, 20 bp, Artificial
  CRISPR gRNA sequence
tgttttggcatttgtttaat

SEQ ID NO: 365562 - DNA, 20 bp, Artificial
  CRISPR gRNA sequence
tcttttgcattattgatttc

SEQ ID NO: 365563 - DNA, 20 bp, Artificial
  CRISPR gRNA sequence
gatttccagctgttatcaca

SEQ ID NO: 365564 - DNA, 20 bp, Artificial
  CRISPR gRNA sequence
ctgttatcacaaagttgtga

SEQ ID NO: 365565 - DNA, 20 bp, Artificial
  CRISPR gRNA sequence
gttatcacaaagttgtgaca

SEQ ID NO: 365566 - DNA, 20 bp, Artificial
  CRISPR gRNA sequence
gttgtgacagagtgtgtctg

SEQ ID NO: 365567 - DNA, 20 bp, Artificial
  CRISPR gRNA sequence
gtgtctgtggactctatgct

SEQ ID NO: 365568 - DNA, 20 bp, Artificial
  CRISPR gRNA sequence
atgctaatgtactgtattct

SEQ ID NO: 365569 - DNA, 20 bp, Artificial
  CRISPR gRNA sequence
ctgtattcttagaatgtact

SEQ ID NO: 365570 - DNA, 20 bp, Artificial
  CRISPR gRNA sequence
tagaatgtacttggcatctt

SEQ ID NO: 365571 - DNA, 20 bp, Artificial
  CRISPR gRNA sequence
tgtacttggcatctttggac

SEQ ID NO: 365572 - DNA, 20 bp, Artificial
  CRISPR gRNA sequence
gtacttggcatctttggacc

SEQ ID NO: 365573 - DNA, 20 bp, Artificial
  CRISPR gRNA sequence
tacttggcatctttggaccg

SEQ ID NO: 365574 - DNA, 20 bp, Artificial
  CRISPR gRNA sequence
ttggcatctttggaccgggg

SEQ ID NO: 365575 - DNA, 20 bp, Artificial
  CRISPR gRNA sequence
catctttggaccggggtggt

SEQ ID NO: 365576 - DNA, 20 bp, Artificial
  CRISPR gRNA sequence
atctttggaccggggtggtt

SEQ ID NO: 365577 - DNA, 20 bp, Artificial
  CRISPR gRNA sequence
tctttggaccggggtggttg

SEQ ID NO: 365578 - DNA, 20 bp, Artificial
  CRISPR gRNA sequence
ctttggaccggggtggttgg

SEQ ID NO: 365579 - DNA, 20 bp, Artificial
  CRISPR gRNA sequence
aaatgaaatcaattaatacg

SEQ ID NO: 365580 - DNA, 20 bp, Artificial
  CRISPR gRNA sequence
atcaattaatacgtggccaa

SEQ ID NO: 365581 - DNA, 20 bp, Artificial
  CRISPR gRNA sequence
attaatacgtggccaacagc

SEQ ID NO: 365582 - DNA, 20 bp, Artificial
  CRISPR gRNA sequence
atacgtggccaacagcaaga

SEQ ID NO: 365583 - DNA, 20 bp, Artificial
  CRISPR gRNA sequence
tacgtggccaacagcaagat

SEQ ID NO: 365584 - DNA, 20 bp, Artificial
  CRISPR gRNA sequence
acgtggccaacagcaagatg

SEQ ID NO: 365585 - DNA, 20 bp, Artificial
  CRISPR gRNA sequence
tggccaacagcaagatgggg

SEQ ID NO: 365586 - DNA, 20 bp, Artificial
  CRISPR gRNA sequence
gatggggtggcctcattcat

SEQ ID NO: 365587 - DNA, 20 bp, Artificial
  CRISPR gRNA sequence
gggtggcctcattcattggt

SEQ ID NO: 365588 - DNA, 20 bp, Artificial
  CRISPR gRNA sequence
cctcattcattggtaagacc

SEQ ID NO: 365589 - DNA, 20 bp, Artificial
  CRISPR gRNA sequence
ctcattcattggtaagacct

SEQ ID NO: 365590 - DNA, 20 bp, Artificial
  CRISPR gRNA sequence
tcattcattggtaagacctg

SEQ ID NO: 365591 - DNA, 20 bp, Artificial
  CRISPR gRNA sequence
ggtaagacctggggtgaatg

SEQ ID NO: 365592 - DNA, 20 bp, Artificial
  CRISPR gRNA sequence
tgtggactcatactattcac

SEQ ID NO: 365593 - DNA, 20 bp, Artificial
  CRISPR gRNA sequence
agtaacaatttttaaaaatt

SEQ ID NO: 365594 - DNA, 20 bp, Artificial
  CRISPR gRNA sequence
gtaacaatttttaaaaattg

SEQ ID NO: 365595 - DNA, 20 bp, Artificial
  CRISPR gRNA sequence
tcacataacattgttcacct

SEQ ID NO: 365596 - DNA, 20 bp, Artificial
  CRISPR gRNA sequence
aacattgttcacctaagatt

SEQ ID NO: 365597 - DNA, 20 bp, Artificial
  CRISPR gRNA sequence
acctaagatttagtcaacat

SEQ ID NO: 365598 - DNA, 20 bp, Artificial
  CRISPR gRNA sequence
ttttttttttttttttgaaa

SEQ ID NO: 365599 - DNA, 20 bp, Artificial
  CRISPR gRNA sequence
ttttttttttttttgaaacg

SEQ ID NO: 365600 - DNA, 20 bp, Artificial
  CRISPR gRNA sequence
ggagtcttgctctgttgacc

SEQ ID NO: 365601 - DNA, 20 bp, Artificial
  CRISPR gRNA sequence
tcttgctctgttgacctggc

SEQ ID NO: 365602 - DNA, 20 bp, Artificial
  CRISPR gRNA sequence
ttgctctgttgacctggctg

SEQ ID NO: 365603 - DNA, 20 bp, Artificial
  CRISPR gRNA sequence
ctgttgacctggctggagtg

SEQ ID NO: 365604 - DNA, 20 bp, Artificial
  CRISPR gRNA sequence
ttgacctggctggagtgcag

SEQ ID NO: 365605 - DNA, 20 bp, Artificial
  CRISPR gRNA sequence
ggagtgcagtggcacaatct

SEQ ID NO: 365606 - DNA, 20 bp, Artificial
  CRISPR gRNA sequence
tcactgcaacctccacctcc

SEQ ID NO: 365607 - DNA, 20 bp, Artificial
  CRISPR gRNA sequence
cactgcaacctccacctcct

SEQ ID NO: 365608 - DNA, 20 bp, Artificial
  CRISPR gRNA sequence
aacctccacctcctgggttc

SEQ ID NO: 365609 - DNA, 20 bp, Artificial
  CRISPR gRNA sequence
ttcaagcgattctcctgtct

SEQ ID NO: 365610 - DNA, 20 bp, Artificial
  CRISPR gRNA sequence
ttctcctgtctcagcctccc

SEQ ID NO: 365611 - DNA, 20 bp, Artificial
  CRISPR gRNA sequence
tcctgtctcagcctcccaag

SEQ ID NO: 365612 - DNA, 20 bp, Artificial
  CRISPR gRNA sequence
gtctcagcctcccaagtagc

SEQ ID NO: 365613 - DNA, 20 bp, Artificial
  CRISPR gRNA sequence
tctcagcctcccaagtagct

SEQ ID NO: 365614 - DNA, 20 bp, Artificial
  CRISPR gRNA sequence
ctcccaagtagctgggatta

SEQ ID NO: 365615 - DNA, 20 bp, Artificial
  CRISPR gRNA sequence
cagttgcgcaccaccacgca

SEQ ID NO: 365616 - DNA, 20 bp, Artificial
  CRISPR gRNA sequence
acagctaatttttgtatttt

SEQ ID NO: 365617 - DNA, 20 bp, Artificial
  CRISPR gRNA sequence
gctaatttttgtatttttag

SEQ ID NO: 365618 - DNA, 20 bp, Artificial
  CRISPR gRNA sequence
taatttttgtatttttagta

SEQ ID NO: 365619 - DNA, 20 bp, Artificial
  CRISPR gRNA sequence
ttttgtatttttagtagagt

SEQ ID NO: 365620 - DNA, 20 bp, Artificial
  CRISPR gRNA sequence
tttgtatttttagtagagtc

SEQ ID NO: 365621 - DNA, 20 bp, Artificial
  CRISPR gRNA sequence
ttgtatttttagtagagtcg

SEQ ID NO: 365622 - DNA, 20 bp, Artificial
  CRISPR gRNA sequence
gagtcggggtttcaccatgt

SEQ ID NO: 365623 - DNA, 20 bp, Artificial
  CRISPR gRNA sequence
cggggtttcaccatgttggc

SEQ ID NO: 365624 - DNA, 20 bp, Artificial
  CRISPR gRNA sequence
ggggtttcaccatgttggcc

SEQ ID NO: 365625 - DNA, 20 bp, Artificial
  CRISPR gRNA sequence
tttcaccatgttggccaggc

SEQ ID NO: 365626 - DNA, 20 bp, Artificial
  CRISPR gRNA sequence
ggttttgaattcctgacctc

SEQ ID NO: 365627 - DNA, 20 bp, Artificial
  CRISPR gRNA sequence
ctcaagcaatccacctgcct

SEQ ID NO: 365628 - DNA, 20 bp, Artificial
  CRISPR gRNA sequence
ccacctgccttggcctccca

SEQ ID NO: 365629 - DNA, 20 bp, Artificial
  CRISPR gRNA sequence
gccttggcctcccaaagtac

SEQ ID NO: 365630 - DNA, 20 bp, Artificial
  CRISPR gRNA sequence
ccttggcctcccaaagtact

SEQ ID NO: 365631 - DNA, 20 bp, Artificial
  CRISPR gRNA sequence
ctcccaaagtactgggatta

SEQ ID NO: 365632 - DNA, 20 bp, Artificial
  CRISPR gRNA sequence
tcccaaagtactgggattac

SEQ ID NO: 365633 - DNA, 20 bp, Artificial
  CRISPR gRNA sequence
agtactgggattacaggtgt

SEQ ID NO: 365634 - DNA, 20 bp, Artificial
  CRISPR gRNA sequence
acaggtgtgagccaccacac

SEQ ID NO: 365635 - DNA, 20 bp, Artificial
  CRISPR gRNA sequence
caggtgtgagccaccacacc

SEQ ID NO: 365636 - DNA, 20 bp, Artificial
  CRISPR gRNA sequence
gtgagccaccacaccaggtc

SEQ ID NO: 365637 - DNA, 20 bp, Artificial
  CRISPR gRNA sequence
attaaatattttaaaatata

SEQ ID NO: 365638 - DNA, 20 bp, Artificial
  CRISPR gRNA sequence
atattttaaaatatacagtt

SEQ ID NO: 365639 - DNA, 20 bp, Artificial
  CRISPR gRNA sequence
ttttaaaatatacagttcag

SEQ ID NO: 365640 - DNA, 20 bp, Artificial
  CRISPR gRNA sequence
atatacagttcagtggtatt

SEQ ID NO: 365641 - DNA, 20 bp, Artificial
  CRISPR gRNA sequence
agtggtatttagtacatcca

SEQ ID NO: 365642 - DNA, 20 bp, Artificial
  CRISPR gRNA sequence
tctgtgatgaccgcttttat

SEQ ID NO: 365643 - DNA, 20 bp, Artificial
  CRISPR gRNA sequence
aaaacattttcatcatttta

SEQ ID NO: 365644 - DNA, 20 bp, Artificial
  CRISPR gRNA sequence
agaaaaccccataccttaaa

SEQ ID NO: 365645 - DNA, 20 bp, Artificial
  CRISPR gRNA sequence
tccctattccctccttccaa

SEQ ID NO: 365646 - DNA, 20 bp, Artificial
  CRISPR gRNA sequence
ccttccaacagtcaatcaat

SEQ ID NO: 365647 - DNA, 20 bp, Artificial
  CRISPR gRNA sequence
caatctgctttccatctcca

SEQ ID NO: 365648 - DNA, 20 bp, Artificial
  CRISPR gRNA sequence
tctccatggatttaactatc

SEQ ID NO: 365649 - DNA, 20 bp, Artificial
  CRISPR gRNA sequence
atctggatatttcatataaa

SEQ ID NO: 365650 - DNA, 20 bp, Artificial
  CRISPR gRNA sequence
aaatggattcttacaaaatg

SEQ ID NO: 365651 - DNA, 20 bp, Artificial
  CRISPR gRNA sequence
tgtttctgcattctttgact

SEQ ID NO: 365652 - DNA, 20 bp, Artificial
  CRISPR gRNA sequence
tgacttagcataatgttatc

SEQ ID NO: 365653 - DNA, 20 bp, Artificial
  CRISPR gRNA sequence
gacttagcataatgttatca

SEQ ID NO: 365654 - DNA, 20 bp, Artificial
  CRISPR gRNA sequence
atcaaggcttattcatgttg

SEQ ID NO: 365655 - DNA, 20 bp, Artificial
  CRISPR gRNA sequence
attcatgttgtagcatgcat

SEQ ID NO: 365656 - DNA, 20 bp, Artificial
  CRISPR gRNA sequence
tagcccttcattccttttta

SEQ ID NO: 365657 - DNA, 20 bp, Artificial
  CRISPR gRNA sequence
cttcattcctttttatggct

SEQ ID NO: 365658 - DNA, 20 bp, Artificial
  CRISPR gRNA sequence
ctgagtaatattccattgta

SEQ ID NO: 365659 - DNA, 20 bp, Artificial
  CRISPR gRNA sequence
tcattcattcattcacctgt

SEQ ID NO: 365660 - DNA, 20 bp, Artificial
  CRISPR gRNA sequence
ttcattcattcacctgttgg

SEQ ID NO: 365661 - DNA, 20 bp, Artificial
  CRISPR gRNA sequence
ttcacctgttggcagacgct

SEQ ID NO: 365662 - DNA, 20 bp, Artificial
  CRISPR gRNA sequence
cttggatcgttaccaccttc

SEQ ID NO: 365663 - DNA, 20 bp, Artificial
  CRISPR gRNA sequence
aataatgctgctgtaaacat

SEQ ID NO: 365664 - DNA, 20 bp, Artificial
  CRISPR gRNA sequence
aaacattggtctacaaatat

SEQ ID NO: 365665 - DNA, 20 bp, Artificial
  CRISPR gRNA sequence
tggtctacaaatattggttt

SEQ ID NO: 365666 - DNA, 20 bp, Artificial
  CRISPR gRNA sequence
tggtttgagtatattctttt

SEQ ID NO: 365667 - DNA, 20 bp, Artificial
  CRISPR gRNA sequence
tattcttttgagtatatacc

SEQ ID NO: 365668 - DNA, 20 bp, Artificial
  CRISPR gRNA sequence
attcttttgagtatatacct

SEQ ID NO: 365669 - DNA, 20 bp, Artificial
  CRISPR gRNA sequence
atacctaggaataaaacttc

SEQ ID NO: 365670 - DNA, 20 bp, Artificial
  CRISPR gRNA sequence
tacctaggaataaaacttct

SEQ ID NO: 365671 - DNA, 20 bp, Artificial
  CRISPR gRNA sequence
aataaaacttctgggtcata

SEQ ID NO: 365672 - DNA, 20 bp, Artificial
  CRISPR gRNA sequence
taatcctgttgaacgttttg

SEQ ID NO: 365673 - DNA, 20 bp, Artificial
  CRISPR gRNA sequence
aatctctaaactgttcttca

SEQ ID NO: 365674 - DNA, 20 bp, Artificial
  CRISPR gRNA sequence
ctctaaactgttcttcacag

SEQ ID NO: 365675 - DNA, 20 bp, Artificial
  CRISPR gRNA sequence
tctttacaacgcttgtgcaa

SEQ ID NO: 365676 - DNA, 20 bp, Artificial
  CRISPR gRNA sequence
acgcttgtgcaacagtacac

SEQ ID NO: 365677 - DNA, 20 bp, Artificial
  CRISPR gRNA sequence
cgcttgtgcaacagtacaca

SEQ ID NO: 365678 - DNA, 20 bp, Artificial
  CRISPR gRNA sequence
gcttgtgcaacagtacacaa

SEQ ID NO: 365679 - DNA, 20 bp, Artificial
  CRISPR gRNA sequence
ctttttgattatgtccatcc

SEQ ID NO: 365680 - DNA, 20 bp, Artificial
  CRISPR gRNA sequence
tttgattatgtccatcctag

SEQ ID NO: 365681 - DNA, 20 bp, Artificial
  CRISPR gRNA sequence
tgtccatcctagtagatata

SEQ ID NO: 365682 - DNA, 20 bp, Artificial
  CRISPR gRNA sequence
catcctagtagatataaagt

SEQ ID NO: 365683 - DNA, 20 bp, Artificial
  CRISPR gRNA sequence
tataaagtgagttctcattg

SEQ ID NO: 365684 - DNA, 20 bp, Artificial
  CRISPR gRNA sequence
ccttattgactgataatgtt

SEQ ID NO: 365685 - DNA, 20 bp, Artificial
  CRISPR gRNA sequence
tgataatgttgagcatcttt

SEQ ID NO: 365686 - DNA, 20 bp, Artificial
  CRISPR gRNA sequence
ataatgttgagcatcttttg

SEQ ID NO: 365687 - DNA, 20 bp, Artificial
  CRISPR gRNA sequence
ttggagaaaaatgtctattc

SEQ ID NO: 365688 - DNA, 20 bp, Artificial
  CRISPR gRNA sequence
tactttgcccatttgaaaat

SEQ ID NO: 365689 - DNA, 20 bp, Artificial
  CRISPR gRNA sequence
actttgcccatttgaaaatt

SEQ ID NO: 365690 - DNA, 20 bp, Artificial
  CRISPR gRNA sequence
gggttgtttcttttatgtta

SEQ ID NO: 365691 - DNA, 20 bp, Artificial
  CRISPR gRNA sequence
tttcttttatgttaaagtgt

SEQ ID NO: 365692 - DNA, 20 bp, Artificial
  CRISPR gRNA sequence
tcttttatgttaaagtgtga

SEQ ID NO: 365693 - DNA, 20 bp, Artificial
  CRISPR gRNA sequence
tgagagttccttatatatta

SEQ ID NO: 365694 - DNA, 20 bp, Artificial
  CRISPR gRNA sequence
tccttatatattatggatat

SEQ ID NO: 365695 - DNA, 20 bp, Artificial
  CRISPR gRNA sequence
tatggatattagaccataat

SEQ ID NO: 365696 - DNA, 20 bp, Artificial
  CRISPR gRNA sequence
gatattagaccataatcaga

SEQ ID NO: 365697 - DNA, 20 bp, Artificial
  CRISPR gRNA sequence
aaatatttgcttgcattctg

SEQ ID NO: 365698 - DNA, 20 bp, Artificial
  CRISPR gRNA sequence
aatatttgcttgcattctgt

SEQ ID NO: 365699 - DNA, 20 bp, Artificial
  CRISPR gRNA sequence
atatttgcttgcattctgta

SEQ ID NO: 365700 - DNA, 20 bp, Artificial
  CRISPR gRNA sequence
aaatgtcctttgatgcacaa

SEQ ID NO: 365701 - DNA, 20 bp, Artificial
  CRISPR gRNA sequence
tgcacaaaagtttttaattt

SEQ ID NO: 365702 - DNA, 20 bp, Artificial
  CRISPR gRNA sequence
caaaagtttttaattttagt

SEQ ID NO: 365703 - DNA, 20 bp, Artificial
  CRISPR gRNA sequence
tttttttcttttgttgccca

SEQ ID NO: 365704 - DNA, 20 bp, Artificial
  CRISPR gRNA sequence
ttttttcttttgttgcccat

SEQ ID NO: 365705 - DNA, 20 bp, Artificial
  CRISPR gRNA sequence
ataggtttgctgtcatgtct

SEQ ID NO: 365706 - DNA, 20 bp, Artificial
  CRISPR gRNA sequence
aagaatccgttgacaacttc

SEQ ID NO: 365707 - DNA, 20 bp, Artificial
  CRISPR gRNA sequence
agaatccgttgacaacttcc

SEQ ID NO: 365708 - DNA, 20 bp, Artificial
  CRISPR gRNA sequence
tttacccctgtgcttattct

SEQ ID NO: 365709 - DNA, 20 bp, Artificial
  CRISPR gRNA sequence
tgcttattctaagatttcta

SEQ ID NO: 365710 - DNA, 20 bp, Artificial
  CRISPR gRNA sequence
ttctaagatttctacagtct

SEQ ID NO: 365711 - DNA, 20 bp, Artificial
  CRISPR gRNA sequence
tctaagatttctacagtctg

SEQ ID NO: 365712 - DNA, 20 bp, Artificial
  CRISPR gRNA sequence
acagtctgaggtcttatatt

SEQ ID NO: 365713 - DNA, 20 bp, Artificial
  CRISPR gRNA sequence
cagtctgaggtcttatattt

SEQ ID NO: 365714 - DNA, 20 bp, Artificial
  CRISPR gRNA sequence
tatttaggtcaacccatttt

SEQ ID NO: 365715 - DNA, 20 bp, Artificial
  CRISPR gRNA sequence
gagttaatttttgtgtttca

SEQ ID NO: 365716 - DNA, 20 bp, Artificial
  CRISPR gRNA sequence
gttaatttttgtgtttcacg

SEQ ID NO: 365717 - DNA, 20 bp, Artificial
  CRISPR gRNA sequence
ttaatttttgtgtttcacgg

SEQ ID NO: 365718 - DNA, 20 bp, Artificial
  CRISPR gRNA sequence
atttttgtgtttcacggagg

SEQ ID NO: 365719 - DNA, 20 bp, Artificial
  CRISPR gRNA sequence
tttttgtgtttcacggaggt

SEQ ID NO: 365720 - DNA, 20 bp, Artificial
  CRISPR gRNA sequence
ttttgtgtttcacggaggta

SEQ ID NO: 365721 - DNA, 20 bp, Artificial
  CRISPR gRNA sequence
caatttcatgcttttgcatg

SEQ ID NO: 365722 - DNA, 20 bp, Artificial
  CRISPR gRNA sequence
tgcttttgcatgtggctatc

SEQ ID NO: 365723 - DNA, 20 bp, Artificial
  CRISPR gRNA sequence
atgtggctatccagttgtcc

SEQ ID NO: 365724 - DNA, 20 bp, Artificial
  CRISPR gRNA sequence
tgtggctatccagttgtccc

SEQ ID NO: 365725 - DNA, 20 bp, Artificial
  CRISPR gRNA sequence
tgtcccaggaccatttattg

SEQ ID NO: 365726 - DNA, 20 bp, Artificial
  CRISPR gRNA sequence
cccaggaccatttattgaag

SEQ ID NO: 365727 - DNA, 20 bp, Artificial
  CRISPR gRNA sequence
gaagctattctttccccact

SEQ ID NO: 365728 - DNA, 20 bp, Artificial
  CRISPR gRNA sequence
gctattctttccccactcag

SEQ ID NO: 365729 - DNA, 20 bp, Artificial
  CRISPR gRNA sequence
ctattctttccccactcagt

SEQ ID NO: 365730 - DNA, 20 bp, Artificial
  CRISPR gRNA sequence
tattctttccccactcagtg

SEQ ID NO: 365731 - DNA, 20 bp, Artificial
  CRISPR gRNA sequence
ctttccccactcagtggggt

SEQ ID NO: 365732 - DNA, 20 bp, Artificial
  CRISPR gRNA sequence
tgttgaatatcaattgttca

SEQ ID NO: 365733 - DNA, 20 bp, Artificial
  CRISPR gRNA sequence
atcaattgttcatagatgta

SEQ ID NO: 365734 - DNA, 20 bp, Artificial
  CRISPR gRNA sequence
tcaattgttcatagatgtat

SEQ ID NO: 365735 - DNA, 20 bp, Artificial
  CRISPR gRNA sequence
atttttatttgtataaattc

SEQ ID NO: 365736 - DNA, 20 bp, Artificial
  CRISPR gRNA sequence
tttttatttgtataaattca

SEQ ID NO: 365737 - DNA, 20 bp, Artificial
  CRISPR gRNA sequence
ttttatttgtataaattcaa

SEQ ID NO: 365738 - DNA, 20 bp, Artificial
  CRISPR gRNA sequence
tttatttgtataaattcaag

SEQ ID NO: 365739 - DNA, 20 bp, Artificial
  CRISPR gRNA sequence
tgtataaattcaaggggtac

SEQ ID NO: 365740 - DNA, 20 bp, Artificial
  CRISPR gRNA sequence
gtataaattcaaggggtaca

SEQ ID NO: 365741 - DNA, 20 bp, Artificial
  CRISPR gRNA sequence
tataaattcaaggggtacaa

SEQ ID NO: 365742 - DNA, 20 bp, Artificial
  CRISPR gRNA sequence
aaattcaaggggtacaaggg

SEQ ID NO: 365743 - DNA, 20 bp, Artificial
  CRISPR gRNA sequence
gtacaagggcagttttgtac

SEQ ID NO: 365744 - DNA, 20 bp, Artificial
  CRISPR gRNA sequence
tacaagggcagttttgtaca

SEQ ID NO: 365745 - DNA, 20 bp, Artificial
  CRISPR gRNA sequence
acaagggcagttttgtacaa

SEQ ID NO: 365746 - DNA, 20 bp, Artificial
  CRISPR gRNA sequence
agggcagttttgtacaaggg

SEQ ID NO: 365747 - DNA, 20 bp, Artificial
  CRISPR gRNA sequence
acaagggcagttttattatg

SEQ ID NO: 365748 - DNA, 20 bp, Artificial
  CRISPR gRNA sequence
agggcagttttattatgtag

SEQ ID NO: 365749 - DNA, 20 bp, Artificial
  CRISPR gRNA sequence
agttttattatgtagtggtg

SEQ ID NO: 365750 - DNA, 20 bp, Artificial
  CRISPR gRNA sequence
tattatgtagtggtgaagtc

SEQ ID NO: 365751 - DNA, 20 bp, Artificial
  CRISPR gRNA sequence
taatatatgttgtacacatt

SEQ ID NO: 365752 - DNA, 20 bp, Artificial
  CRISPR gRNA sequence
ttctactctcccattcttcc

SEQ ID NO: 365753 - DNA, 20 bp, Artificial
  CRISPR gRNA sequence
ctcccattcttccaagtctc

SEQ ID NO: 365754 - DNA, 20 bp, Artificial
  CRISPR gRNA sequence
tattgcatactgtatgtcca

SEQ ID NO: 365755 - DNA, 20 bp, Artificial
  CRISPR gRNA sequence
attgcatactgtatgtccat

SEQ ID NO: 365756 - DNA, 20 bp, Artificial
  CRISPR gRNA sequence
attattttgctcccatttat

SEQ ID NO: 365757 - DNA, 20 bp, Artificial
  CRISPR gRNA sequence
ttttgctcccatttataagt

SEQ ID NO: 365758 - DNA, 20 bp, Artificial
  CRISPR gRNA sequence
catttataagtgagaacatg

SEQ ID NO: 365759 - DNA, 20 bp, Artificial
  CRISPR gRNA sequence
agtgagaacatgtggttttt

SEQ ID NO: 365760 - DNA, 20 bp, Artificial
  CRISPR gRNA sequence
gtttttgagtttctgtgtct

SEQ ID NO: 365761 - DNA, 20 bp, Artificial
  CRISPR gRNA sequence
agttgtttcatttaatataa

SEQ ID NO: 365762 - DNA, 20 bp, Artificial
  CRISPR gRNA sequence
catttaatataatggcttcc

SEQ ID NO: 365763 - DNA, 20 bp, Artificial
  CRISPR gRNA sequence
gtctatctatgttgctgcaa

SEQ ID NO: 365764 - DNA, 20 bp, Artificial
  CRISPR gRNA sequence
agacatgatttcattctttt

SEQ ID NO: 365765 - DNA, 20 bp, Artificial
  CRISPR gRNA sequence
gacatgatttcattcttttt

SEQ ID NO: 365766 - DNA, 20 bp, Artificial
  CRISPR gRNA sequence
acatgatttcattcttttta

SEQ ID NO: 365767 - DNA, 20 bp, Artificial
  CRISPR gRNA sequence
tcattctttttagggctgtg

SEQ ID NO: 365768 - DNA, 20 bp, Artificial
  CRISPR gRNA sequence
ggctgtgtagtattccattg

SEQ ID NO: 365769 - DNA, 20 bp, Artificial
  CRISPR gRNA sequence
tccattgtggatatatacca

SEQ ID NO: 365770 - DNA, 20 bp, Artificial
  CRISPR gRNA sequence
tttatctaacccttcattga

SEQ ID NO: 365771 - DNA, 20 bp, Artificial
  CRISPR gRNA sequence
ttatctaacccttcattgat

SEQ ID NO: 365772 - DNA, 20 bp, Artificial
  CRISPR gRNA sequence
acccttcattgatgggcact

SEQ ID NO: 365773 - DNA, 20 bp, Artificial
  CRISPR gRNA sequence
cccttcattgatgggcactt

SEQ ID NO: 365774 - DNA, 20 bp, Artificial
  CRISPR gRNA sequence
cttaggttgattccatatct

SEQ ID NO: 365775 - DNA, 20 bp, Artificial
  CRISPR gRNA sequence
catatcttggttattgtgaa

SEQ ID NO: 365776 - DNA, 20 bp, Artificial
  CRISPR gRNA sequence
tagtgctgcaataaacatat

SEQ ID NO: 365777 - DNA, 20 bp, Artificial
  CRISPR gRNA sequence
agtgctgcaataaacatata

SEQ ID NO: 365778 - DNA, 20 bp, Artificial
  CRISPR gRNA sequence
gtgctgcaataaacatataa

SEQ ID NO: 365779 - DNA, 20 bp, Artificial
  CRISPR gRNA sequence
ctgcaataaacatataaggg

SEQ ID NO: 365780 - DNA, 20 bp, Artificial
  CRISPR gRNA sequence
tgcaataaacatataagggc

SEQ ID NO: 365781 - DNA, 20 bp, Artificial
  CRISPR gRNA sequence
tataatgatttcttttcctt

SEQ ID NO: 365782 - DNA, 20 bp, Artificial
  CRISPR gRNA sequence
ataatgatttcttttccttt

SEQ ID NO: 365783 - DNA, 20 bp, Artificial
  CRISPR gRNA sequence
atgatttcttttcctttggg

SEQ ID NO: 365784 - DNA, 20 bp, Artificial
  CRISPR gRNA sequence
tcctttgggtagataccctg

SEQ ID NO: 365785 - DNA, 20 bp, Artificial
  CRISPR gRNA sequence
ttgggtagataccctgtagt

SEQ ID NO: 365786 - DNA, 20 bp, Artificial
  CRISPR gRNA sequence
ataccctgtagtgagactgc

SEQ ID NO: 365787 - DNA, 20 bp, Artificial
  CRISPR gRNA sequence
agtgagactgccggatctaa

SEQ ID NO: 365788 - DNA, 20 bp, Artificial
  CRISPR gRNA sequence
tctaatggtaattctatttt

SEQ ID NO: 365789 - DNA, 20 bp, Artificial
  CRISPR gRNA sequence
aattctatttttagttcttt

SEQ ID NO: 365790 - DNA, 20 bp, Artificial
  CRISPR gRNA sequence
attctatttttagttctttg

SEQ ID NO: 365791 - DNA, 20 bp, Artificial
  CRISPR gRNA sequence
aactgccatactattttcca

SEQ ID NO: 365792 - DNA, 20 bp, Artificial
  CRISPR gRNA sequence
ctaatttacattcccatgaa

SEQ ID NO: 365793 - DNA, 20 bp, Artificial
  CRISPR gRNA sequence
gatcatcatttcaatttcct

SEQ ID NO: 365794 - DNA, 20 bp, Artificial
  CRISPR gRNA sequence
ccacactgttttgattactg

SEQ ID NO: 365795 - DNA, 20 bp, Artificial
  CRISPR gRNA sequence
attactgtagctgtgtacta

SEQ ID NO: 365796 - DNA, 20 bp, Artificial
  CRISPR gRNA sequence
tgtgtactacagttttgaaa

SEQ ID NO: 365797 - DNA, 20 bp, Artificial
  CRISPR gRNA sequence
gtgtactacagttttgaaat

SEQ ID NO: 365798 - DNA, 20 bp, Artificial
  CRISPR gRNA sequence
agttttgaaatgggaaatgt

SEQ ID NO: 365799 - DNA, 20 bp, Artificial
  CRISPR gRNA sequence
aatgggaaatgttagtcttt

SEQ ID NO: 365800 - DNA, 20 bp, Artificial
  CRISPR gRNA sequence
cttcttttttaataccattt

SEQ ID NO: 365801 - DNA, 20 bp, Artificial
  CRISPR gRNA sequence
ttaataccattttggctatt

SEQ ID NO: 365802 - DNA, 20 bp, Artificial
  CRISPR gRNA sequence
taataccattttggctattc

SEQ ID NO: 365803 - DNA, 20 bp, Artificial
  CRISPR gRNA sequence
gcaattctatgtaatatgtt

SEQ ID NO: 365804 - DNA, 20 bp, Artificial
  CRISPR gRNA sequence
tatgtaatatgttcagactt

SEQ ID NO: 365805 - DNA, 20 bp, Artificial
  CRISPR gRNA sequence
tgtaatatgttcagacttca

SEQ ID NO: 365806 - DNA, 20 bp, Artificial
  CRISPR gRNA sequence
atatgttcagacttcagagt

SEQ ID NO: 365807 - DNA, 20 bp, Artificial
  CRISPR gRNA sequence
tgttcagacttcagagttgg

SEQ ID NO: 365808 - DNA, 20 bp, Artificial
  CRISPR gRNA sequence
gacttcagagttggtggatt

SEQ ID NO: 365809 - DNA, 20 bp, Artificial
  CRISPR gRNA sequence
ttcagagttggtggattcag

SEQ ID NO: 365810 - DNA, 20 bp, Artificial
  CRISPR gRNA sequence
agttggtggattcagtagct

SEQ ID NO: 365811 - DNA, 20 bp, Artificial
  CRISPR gRNA sequence
gtagctcagtaatgccatct

SEQ ID NO: 365812 - DNA, 20 bp, Artificial
  CRISPR gRNA sequence
tctaccaccctgtttgtcct

SEQ ID NO: 365813 - DNA, 20 bp, Artificial
  CRISPR gRNA sequence
ctaccaccctgtttgtcctc

SEQ ID NO: 365814 - DNA, 20 bp, Artificial
  CRISPR gRNA sequence
caggctgatttccttcaata

SEQ ID NO: 365815 - DNA, 20 bp, Artificial
  CRISPR gRNA sequence
tccttcaatatggctgcctg

SEQ ID NO: 365816 - DNA, 20 bp, Artificial
  CRISPR gRNA sequence
atatggctgcctgtggtaac

SEQ ID NO: 365817 - DNA, 20 bp, Artificial
  CRISPR gRNA sequence
tatggctgcctgtggtaacc

SEQ ID NO: 365818 - DNA, 20 bp, Artificial
  CRISPR gRNA sequence
gctgcctgtggtaaccagga

SEQ ID NO: 365819 - DNA, 20 bp, Artificial
  CRISPR gRNA sequence
cattcttgttcatgcataat

SEQ ID NO: 365820 - DNA, 20 bp, Artificial
  CRISPR gRNA sequence
ttcttgttcatgcataatga

SEQ ID NO: 365821 - DNA, 20 bp, Artificial
  CRISPR gRNA sequence
tcttgttcatgcataatgag

SEQ ID NO: 365822 - DNA, 20 bp, Artificial
  CRISPR gRNA sequence
ttgttcatgcataatgagag

SEQ ID NO: 365823 - DNA, 20 bp, Artificial
  CRISPR gRNA sequence
atgcataatgagaggagata

SEQ ID NO: 365824 - DNA, 20 bp, Artificial
  CRISPR gRNA sequence
ataatgagaggagataaaga

SEQ ID NO: 365825 - DNA, 20 bp, Artificial
  CRISPR gRNA sequence
gaggagataaagatagaaac

SEQ ID NO: 365826 - DNA, 20 bp, Artificial
  CRISPR gRNA sequence
aggagataaagatagaaaca

SEQ ID NO: 365827 - DNA, 20 bp, Artificial
  CRISPR gRNA sequence
gataaagatagaaacaagga

SEQ ID NO: 365828 - DNA, 20 bp, Artificial
  CRISPR gRNA sequence
taaagatagaaacaaggatg

SEQ ID NO: 365829 - DNA, 20 bp, Artificial
  CRISPR gRNA sequence
aagatagaaacaaggatgga

SEQ ID NO: 365830 - DNA, 20 bp, Artificial
  CRISPR gRNA sequence
atagaaacaaggatggagag

SEQ ID NO: 365831 - DNA, 20 bp, Artificial
  CRISPR gRNA sequence
agaaacaaggatggagagaa

SEQ ID NO: 365832 - DNA, 20 bp, Artificial
  CRISPR gRNA sequence
cacattccatgctgtttttc

SEQ ID NO: 365833 - DNA, 20 bp, Artificial
  CRISPR gRNA sequence
tccatgctgtttttctggca

SEQ ID NO: 365834 - DNA, 20 bp, Artificial
  CRISPR gRNA sequence
aataacttccttcactctga

SEQ ID NO: 365835 - DNA, 20 bp, Artificial
  CRISPR gRNA sequence
ataacttccttcactctgat

SEQ ID NO: 365836 - DNA, 20 bp, Artificial
  CRISPR gRNA sequence
ttcactctgatgggccaact

SEQ ID NO: 365837 - DNA, 20 bp, Artificial
  CRISPR gRNA sequence
tcactctgatgggccaactc

SEQ ID NO: 365838 - DNA, 20 bp, Artificial
  CRISPR gRNA sequence
tgatgggccaactcaggcca

SEQ ID NO: 365839 - DNA, 20 bp, Artificial
  CRISPR gRNA sequence
gggccaactcaggccatagt

SEQ ID NO: 365840 - DNA, 20 bp, Artificial
  CRISPR gRNA sequence
ctgacccctcaaatcaatca

SEQ ID NO: 365841 - DNA, 20 bp, Artificial
  CRISPR gRNA sequence
ctcaaatcaatcatagtttt

SEQ ID NO: 365842 - DNA, 20 bp, Artificial
  CRISPR gRNA sequence
tcaaatcaatcatagttttc

SEQ ID NO: 365843 - DNA, 20 bp, Artificial
  CRISPR gRNA sequence
atcaatcatagttttcaggc

SEQ ID NO: 365844 - DNA, 20 bp, Artificial
  CRISPR gRNA sequence
tcaatcatagttttcaggct

SEQ ID NO: 365845 - DNA, 20 bp, Artificial
  CRISPR gRNA sequence
catagttttcaggctgggca

SEQ ID NO: 365846 - DNA, 20 bp, Artificial
  CRISPR gRNA sequence
agttttcaggctgggcatgg

SEQ ID NO: 365847 - DNA, 20 bp, Artificial
  CRISPR gRNA sequence
tgcccgtactcccaacactt

SEQ ID NO: 365848 - DNA, 20 bp, Artificial
  CRISPR gRNA sequence
gcccgtactcccaacacttt

SEQ ID NO: 365849 - DNA, 20 bp, Artificial
  CRISPR gRNA sequence
ccgtactcccaacactttag

SEQ ID NO: 365850 - DNA, 20 bp, Artificial
  CRISPR gRNA sequence
cgtactcccaacactttagg

SEQ ID NO: 365851 - DNA, 20 bp, Artificial
  CRISPR gRNA sequence
tttaggaggccaacatgtac

SEQ ID NO: 365852 - DNA, 20 bp, Artificial
  CRISPR gRNA sequence
gtacaagtgcaaaattacat

SEQ ID NO: 365853 - DNA, 20 bp, Artificial
  CRISPR gRNA sequence
agtgcaaaattacatgagtc

SEQ ID NO: 365854 - DNA, 20 bp, Artificial
  CRISPR gRNA sequence
gcaaaattacatgagtccag

SEQ ID NO: 365855 - DNA, 20 bp, Artificial
  CRISPR gRNA sequence
tacatgagtccagaagctcc

SEQ ID NO: 365856 - DNA, 20 bp, Artificial
  CRISPR gRNA sequence
tgagtccagaagctccaagc

SEQ ID NO: 365857 - DNA, 20 bp, Artificial
  CRISPR gRNA sequence
cagaagctccaagcaagcct

SEQ ID NO: 365858 - DNA, 20 bp, Artificial
  CRISPR gRNA sequence
ccaagcaagccttggcaatg

SEQ ID NO: 365859 - DNA, 20 bp, Artificial
  CRISPR gRNA sequence
gcaagccttggcaatgtagc

SEQ ID NO: 365860 - DNA, 20 bp, Artificial
  CRISPR gRNA sequence
aaaaaataattttaaaaaat

SEQ ID NO: 365861 - DNA, 20 bp, Artificial
  CRISPR gRNA sequence
ataattttaaaaaattagct

SEQ ID NO: 365862 - DNA, 20 bp, Artificial
  CRISPR gRNA sequence
tttaaaaaattagctgagtg

SEQ ID NO: 365863 - DNA, 20 bp, Artificial
  CRISPR gRNA sequence
aaaaaattagctgagtgtgg

SEQ ID NO: 365864 - DNA, 20 bp, Artificial
  CRISPR gRNA sequence
attagctgagtgtggtggct

SEQ ID NO: 365865 - DNA, 20 bp, Artificial
  CRISPR gRNA sequence
gctgagtgtggtggctcagc

SEQ ID NO: 365866 - DNA, 20 bp, Artificial
  CRISPR gRNA sequence
ctgagtgtggtggctcagct

SEQ ID NO: 365867 - DNA, 20 bp, Artificial
  CRISPR gRNA sequence
gtggtggctcagctgggtcc

SEQ ID NO: 365868 - DNA, 20 bp, Artificial
  CRISPR gRNA sequence
tcagctgggtcccagctacc

SEQ ID NO: 365869 - DNA, 20 bp, Artificial
  CRISPR gRNA sequence
cagctgggtcccagctaccc

SEQ ID NO: 365870 - DNA, 20 bp, Artificial
  CRISPR gRNA sequence
gctgggtcccagctacccag

SEQ ID NO: 365871 - DNA, 20 bp, Artificial
  CRISPR gRNA sequence
ctgggtcccagctacccagg

SEQ ID NO: 365872 - DNA, 20 bp, Artificial
  CRISPR gRNA sequence
cccagctacccaggaggctg

SEQ ID NO: 365873 - DNA, 20 bp, Artificial
  CRISPR gRNA sequence
agctacccaggaggctgaag

SEQ ID NO: 365874 - DNA, 20 bp, Artificial
  CRISPR gRNA sequence
gctacccaggaggctgaagt

SEQ ID NO: 365875 - DNA, 20 bp, Artificial
  CRISPR gRNA sequence
tacccaggaggctgaagtgg

SEQ ID NO: 365876 - DNA, 20 bp, Artificial
  CRISPR gRNA sequence
acccaggaggctgaagtggg

SEQ ID NO: 365877 - DNA, 20 bp, Artificial
  CRISPR gRNA sequence
cccaggaggctgaagtggga

SEQ ID NO: 365878 - DNA, 20 bp, Artificial
  CRISPR gRNA sequence
ctgaagtgggagggtcactt

SEQ ID NO: 365879 - DNA, 20 bp, Artificial
  CRISPR gRNA sequence
gtgggagggtcacttgagac

SEQ ID NO: 365880 - DNA, 20 bp, Artificial
  CRISPR gRNA sequence
tgggagggtcacttgagacc

SEQ ID NO: 365881 - DNA, 20 bp, Artificial
  CRISPR gRNA sequence
ggagggtcacttgagaccag

SEQ ID NO: 365882 - DNA, 20 bp, Artificial
  CRISPR gRNA sequence
tcacttgagaccaggagttt

SEQ ID NO: 365883 - DNA, 20 bp, Artificial
  CRISPR gRNA sequence
tgagaccaggagtttgagat

SEQ ID NO: 365884 - DNA, 20 bp, Artificial
  CRISPR gRNA sequence
ccaggagtttgagatcagcc

SEQ ID NO: 365885 - DNA, 20 bp, Artificial
  CRISPR gRNA sequence
tgagatcagcctggacaaca

SEQ ID NO: 365886 - DNA, 20 bp, Artificial
  CRISPR gRNA sequence
cacacacacacacaaaatca

SEQ ID NO: 365887 - DNA, 20 bp, Artificial
  CRISPR gRNA sequence
acacacaaaatcatagtttt

SEQ ID NO: 365888 - DNA, 20 bp, Artificial
  CRISPR gRNA sequence
aatcatagttttcagtacaa

SEQ ID NO: 365889 - DNA, 20 bp, Artificial
  CRISPR gRNA sequence
tatttgtcataatatctctg

SEQ ID NO: 365890 - DNA, 20 bp, Artificial
  CRISPR gRNA sequence
cataatatctctgtggcgtg

SEQ ID NO: 365891 - DNA, 20 bp, Artificial
  CRISPR gRNA sequence
atatctctgtggcgtgtgga

SEQ ID NO: 365892 - DNA, 20 bp, Artificial
  CRISPR gRNA sequence
tatctctgtggcgtgtggaa

SEQ ID NO: 365893 - DNA, 20 bp, Artificial
  CRISPR gRNA sequence
atctctgtggcgtgtggaaa

SEQ ID NO: 365894 - DNA, 20 bp, Artificial
  CRISPR gRNA sequence
tctctgtggcgtgtggaaag

SEQ ID NO: 365895 - DNA, 20 bp, Artificial
  CRISPR gRNA sequence
ctgtggcgtgtggaaagggg

SEQ ID NO: 365896 - DNA, 20 bp, Artificial
  CRISPR gRNA sequence
aaggggtggatactcaaact

SEQ ID NO: 365897 - DNA, 20 bp, Artificial
  CRISPR gRNA sequence
aggggtggatactcaaactc

SEQ ID NO: 365898 - DNA, 20 bp, Artificial
  CRISPR gRNA sequence
tggatactcaaactcaggta

SEQ ID NO: 365899 - DNA, 20 bp, Artificial
  CRISPR gRNA sequence
aaactcaggtacagtactgc

SEQ ID NO: 365900 - DNA, 20 bp, Artificial
  CRISPR gRNA sequence
aactcaggtacagtactgct

SEQ ID NO: 365901 - DNA, 20 bp, Artificial
  CRISPR gRNA sequence
ctcaggtacagtactgctag

SEQ ID NO: 365902 - DNA, 20 bp, Artificial
  CRISPR gRNA sequence
ggtacagtactgctaggagt

SEQ ID NO: 365903 - DNA, 20 bp, Artificial
  CRISPR gRNA sequence
gtacagtactgctaggagtg

SEQ ID NO: 365904 - DNA, 20 bp, Artificial
  CRISPR gRNA sequence
agtactgctaggagtgagga

SEQ ID NO: 365905 - DNA, 20 bp, Artificial
  CRISPR gRNA sequence
taggagtgaggaaagtgaaa

SEQ ID NO: 365906 - DNA, 20 bp, Artificial
  CRISPR gRNA sequence
aggagtgaggaaagtgaaat

SEQ ID NO: 365907 - DNA, 20 bp, Artificial
  CRISPR gRNA sequence
gaggaaagtgaaatgggtga

SEQ ID NO: 365908 - DNA, 20 bp, Artificial
  CRISPR gRNA sequence
aaagtgaaatgggtgatggt

SEQ ID NO: 365909 - DNA, 20 bp, Artificial
  CRISPR gRNA sequence
gaaatctgattatatcattc

SEQ ID NO: 365910 - DNA, 20 bp, Artificial
  CRISPR gRNA sequence
taacaatctccaatcgctct

SEQ ID NO: 365911 - DNA, 20 bp, Artificial
  CRISPR gRNA sequence
aatcgctcttagaattgtac

SEQ ID NO: 365912 - DNA, 20 bp, Artificial
  CRISPR gRNA sequence
atcgctcttagaattgtacc

SEQ ID NO: 365913 - DNA, 20 bp, Artificial
  CRISPR gRNA sequence
gctcttagaattgtaccagg

SEQ ID NO: 365914 - DNA, 20 bp, Artificial
  CRISPR gRNA sequence
aattgtaccaggaagtatat

SEQ ID NO: 365915 - DNA, 20 bp, Artificial
  CRISPR gRNA sequence
attgtaccaggaagtatata

SEQ ID NO: 365916 - DNA, 20 bp, Artificial
  CRISPR gRNA sequence
ccatctcccctcaatgtatc

SEQ ID NO: 365917 - DNA, 20 bp, Artificial
  CRISPR gRNA sequence
atgattgaaaaacttccaca

SEQ ID NO: 365918 - DNA, 20 bp, Artificial
  CRISPR gRNA sequence
cacctgctctcctatccacc

SEQ ID NO: 365919 - DNA, 20 bp, Artificial
  CRISPR gRNA sequence
ggactgctcgttcacacacc

SEQ ID NO: 365920 - DNA, 20 bp, Artificial
  CRISPR gRNA sequence
acctggccacaccctgcatg

SEQ ID NO: 365921 - DNA, 20 bp, Artificial
  CRISPR gRNA sequence
ccacaccctgcatgtggcca

SEQ ID NO: 365922 - DNA, 20 bp, Artificial
  CRISPR gRNA sequence
gccacagcctcctgcttctg

SEQ ID NO: 365923 - DNA, 20 bp, Artificial
  CRISPR gRNA sequence
cctcctgcttctgcagattc

SEQ ID NO: 365924 - DNA, 20 bp, Artificial
  CRISPR gRNA sequence
cagaacacacttcactgccc

SEQ ID NO: 365925 - DNA, 20 bp, Artificial
  CRISPR gRNA sequence
gaacacacttcactgcccga

SEQ ID NO: 365926 - DNA, 20 bp, Artificial
  CRISPR gRNA sequence
tcccgaccaccaacctgaca

SEQ ID NO: 365927 - DNA, 20 bp, Artificial
  CRISPR gRNA sequence
aacctgacacagcctctgct

SEQ ID NO: 365928 - DNA, 20 bp, Artificial
  CRISPR gRNA sequence
acacagcctctgcttggctg

SEQ ID NO: 365929 - DNA, 20 bp, Artificial
  CRISPR gRNA sequence
cctctgcttggctgcagccc

SEQ ID NO: 365930 - DNA, 20 bp, Artificial
  CRISPR gRNA sequence
ctgatgtctgtctttccaac

SEQ ID NO: 365931 - DNA, 20 bp, Artificial
  CRISPR gRNA sequence
gtctgtctttccaactagac

SEQ ID NO: 365932 - DNA, 20 bp, Artificial
  CRISPR gRNA sequence
tctgtctttccaactagact

SEQ ID NO: 365933 - DNA, 20 bp, Artificial
  CRISPR gRNA sequence
ctgtctttccaactagactg

SEQ ID NO: 365934 - DNA, 20 bp, Artificial
  CRISPR gRNA sequence
tgtctttccaactagactgg

SEQ ID NO: 365935 - DNA, 20 bp, Artificial
  CRISPR gRNA sequence
actagactgggggcatgaaa

SEQ ID NO: 365936 - DNA, 20 bp, Artificial
  CRISPR gRNA sequence
atgaaaaagtttttctgtaa

SEQ ID NO: 365937 - DNA, 20 bp, Artificial
  CRISPR gRNA sequence
gaaaaagtttttctgtaaaa

SEQ ID NO: 365938 - DNA, 20 bp, Artificial
  CRISPR gRNA sequence
aaagtttttctgtaaaagag

SEQ ID NO: 365939 - DNA, 20 bp, Artificial
  CRISPR gRNA sequence
aagtttttctgtaaaagagc

SEQ ID NO: 365940 - DNA, 20 bp, Artificial
  CRISPR gRNA sequence
tttttctgtaaaagagcagg

SEQ ID NO: 365941 - DNA, 20 bp, Artificial
  CRISPR gRNA sequence
taaaagagcaggtggtatgt

SEQ ID NO: 365942 - DNA, 20 bp, Artificial
  CRISPR gRNA sequence
gcaggtggtatgttagactt

SEQ ID NO: 365943 - DNA, 20 bp, Artificial
  CRISPR gRNA sequence
ttggccgtacactctgtttt

SEQ ID NO: 365944 - DNA, 20 bp, Artificial
  CRISPR gRNA sequence
actctgttttgagatcacgc

SEQ ID NO: 365945 - DNA, 20 bp, Artificial
  CRISPR gRNA sequence
ttttgagatcacgccagatg

SEQ ID NO: 365946 - DNA, 20 bp, Artificial
  CRISPR gRNA sequence
gccagatgcagtatgtgtgt

SEQ ID NO: 365947 - DNA, 20 bp, Artificial
  CRISPR gRNA sequence
cagatgcagtatgtgtgtga

SEQ ID NO: 365948 - DNA, 20 bp, Artificial
  CRISPR gRNA sequence
gatgcagtatgtgtgtgaga

SEQ ID NO: 365949 - DNA, 20 bp, Artificial
  CRISPR gRNA sequence
tgcagtatgtgtgtgagaga

SEQ ID NO: 365950 - DNA, 20 bp, Artificial
  CRISPR gRNA sequence
cagtatgtgtgtgagagaga

SEQ ID NO: 365951 - DNA, 20 bp, Artificial
  CRISPR gRNA sequence
gtatgtgtgtgagagagaga

SEQ ID NO: 365952 - DNA, 20 bp, Artificial
  CRISPR gRNA sequence
atgtgtgtgagagagagaga

SEQ ID NO: 365953 - DNA, 20 bp, Artificial
  CRISPR gRNA sequence
gtgtgagagagagagagaga

SEQ ID NO: 365954 - DNA, 20 bp, Artificial
  CRISPR gRNA sequence
gtgagagagagagagagaca

SEQ ID NO: 365955 - DNA, 20 bp, Artificial
  CRISPR gRNA sequence
gagagagagacagagtgtgt

SEQ ID NO: 365956 - DNA, 20 bp, Artificial
  CRISPR gRNA sequence
gagagagacagagtgtgtga

SEQ ID NO: 365957 - DNA, 20 bp, Artificial
  CRISPR gRNA sequence
gagtgtgtgcaaatgtgtgt

SEQ ID NO: 365958 - DNA, 20 bp, Artificial
  CRISPR gRNA sequence
atgcatgtgtgcgtgcatgt

SEQ ID NO: 365959 - DNA, 20 bp, Artificial
  CRISPR gRNA sequence
atgtgagtgtatgcatgtac

SEQ ID NO: 365960 - DNA, 20 bp, Artificial
  CRISPR gRNA sequence
atgcatgtacgagtgtgttt

SEQ ID NO: 365961 - DNA, 20 bp, Artificial
  CRISPR gRNA sequence
gcatgtacgagtgtgtttga

SEQ ID NO: 365962 - DNA, 20 bp, Artificial
  CRISPR gRNA sequence
agtgtgtttgagagtacgtg

SEQ ID NO: 365963 - DNA, 20 bp, Artificial
  CRISPR gRNA sequence
gcagatgcatgtgattgtgt

SEQ ID NO: 365964 - DNA, 20 bp, Artificial
  CRISPR gRNA sequence
gagattgtgtgtgcatatgt

SEQ ID NO: 365965 - DNA, 20 bp, Artificial
  CRISPR gRNA sequence
gtgcatatgtgagcatgtgt

SEQ ID NO: 365966 - DNA, 20 bp, Artificial
  CRISPR gRNA sequence
gcatgtgtgagaacatgtat

SEQ ID NO: 365967 - DNA, 20 bp, Artificial
  CRISPR gRNA sequence
atgcgtgtgtgcatgtgtgt

SEQ ID NO: 365968 - DNA, 20 bp, Artificial
  CRISPR gRNA sequence
gagtgcatgtatacgtgttt

SEQ ID NO: 365969 - DNA, 20 bp, Artificial
  CRISPR gRNA sequence
gtgcatgtatacgtgtttga

SEQ ID NO: 365970 - DNA, 20 bp, Artificial
  CRISPR gRNA sequence
ctgcatgtgattgtgtgtgt

SEQ ID NO: 365971 - DNA, 20 bp, Artificial
  CRISPR gRNA sequence
gcatgtgattgtgtgtgtga

SEQ ID NO: 365972 - DNA, 20 bp, Artificial
  CRISPR gRNA sequence
atgtgattgtgtgtgtgaga

SEQ ID NO: 365973 - DNA, 20 bp, Artificial
  CRISPR gRNA sequence
ttgtgtgtgtgagagagtgt

SEQ ID NO: 365974 - DNA, 20 bp, Artificial
  CRISPR gRNA sequence
gtgagagagtgtgagaaaca

SEQ ID NO: 365975 - DNA, 20 bp, Artificial
  CRISPR gRNA sequence
gtgtgaatgtgtgcatatgt

SEQ ID NO: 365976 - DNA, 20 bp, Artificial
  CRISPR gRNA sequence
atgtgtgcatatgtgagtgt

SEQ ID NO: 365977 - DNA, 20 bp, Artificial
  CRISPR gRNA sequence
gtgtgcatatgtgagtgtga

SEQ ID NO: 365978 - DNA, 20 bp, Artificial
  CRISPR gRNA sequence
gtgagtgtgagagcatgtgt

SEQ ID NO: 365979 - DNA, 20 bp, Artificial
  CRISPR gRNA sequence
tgtaagtgcatgcgtgtgtg

SEQ ID NO: 365980 - DNA, 20 bp, Artificial
  CRISPR gRNA sequence
gtgtgtgtggatgtgtgttt

SEQ ID NO: 365981 - DNA, 20 bp, Artificial
  CRISPR gRNA sequence
gtgtgtggatgtgtgtttga

SEQ ID NO: 365982 - DNA, 20 bp, Artificial
  CRISPR gRNA sequence
atgtgcacatgcatgtgatt

SEQ ID NO: 365983 - DNA, 20 bp, Artificial
  CRISPR gRNA sequence
gcacatgcatgtgattgaga

SEQ ID NO: 365984 - DNA, 20 bp, Artificial
  CRISPR gRNA sequence
acatgcatgtgattgagata

SEQ ID NO: 365985 - DNA, 20 bp, Artificial
  CRISPR gRNA sequence
gcatgtgattgagatagagt

SEQ ID NO: 365986 - DNA, 20 bp, Artificial
  CRISPR gRNA sequence
gtgattgagatagagtgaga

SEQ ID NO: 365987 - DNA, 20 bp, Artificial
  CRISPR gRNA sequence
gtgagacagtgtgcatatgt

SEQ ID NO: 365988 - DNA, 20 bp, Artificial
  CRISPR gRNA sequence
atatgtgagtgataacgtgt

SEQ ID NO: 365989 - DNA, 20 bp, Artificial
  CRISPR gRNA sequence
gtgataacgtgtaagtgcat

SEQ ID NO: 365990 - DNA, 20 bp, Artificial
  CRISPR gRNA sequence
acgtgtaagtgcatgagtgt

SEQ ID NO: 365991 - DNA, 20 bp, Artificial
  CRISPR gRNA sequence
tgcatgagtgtgagtgtgcg

SEQ ID NO: 365992 - DNA, 20 bp, Artificial
  CRISPR gRNA sequence
gtgtgagtgtgcgtggatgt

SEQ ID NO: 365993 - DNA, 20 bp, Artificial
  CRISPR gRNA sequence
gtgagtgtgcgtggatgtga

SEQ ID NO: 365994 - DNA, 20 bp, Artificial
  CRISPR gRNA sequence
atgcatgtgattgtgtgtct

SEQ ID NO: 365995 - DNA, 20 bp, Artificial
  CRISPR gRNA sequence
gattgtgtgtctgagactgt

SEQ ID NO: 365996 - DNA, 20 bp, Artificial
  CRISPR gRNA sequence
agactgtgagcatgtgtgtg

SEQ ID NO: 365997 - DNA, 20 bp, Artificial
  CRISPR gRNA sequence
gactgtgagcatgtgtgtgt

SEQ ID NO: 365998 - DNA, 20 bp, Artificial
  CRISPR gRNA sequence
tgtgtgggtgcatgtgtatg

SEQ ID NO: 365999 - DNA, 20 bp, Artificial
  CRISPR gRNA sequence
gtgtgggtgcatgtgtatgt

SEQ ID NO: 366000 - DNA, 20 bp, Artificial
  CRISPR gRNA sequence
ttgtgtgtgtgaatgtgtgt

SEQ ID NO: 366001 - DNA, 20 bp, Artificial
  CRISPR gRNA sequence
gtgtgtgtgaatgtgtgtta

SEQ ID NO: 366002 - DNA, 20 bp, Artificial
  CRISPR gRNA sequence
aatgtgtgttagagcatgtg

SEQ ID NO: 366003 - DNA, 20 bp, Artificial
  CRISPR gRNA sequence
atgtgtgttagagcatgtgt

SEQ ID NO: 366004 - DNA, 20 bp, Artificial
  CRISPR gRNA sequence
gcatgtgtgggtgcatatgt

SEQ ID NO: 366005 - DNA, 20 bp, Artificial
  CRISPR gRNA sequence
gtgagactgcatgtgtgtgt

SEQ ID NO: 366006 - DNA, 20 bp, Artificial
  CRISPR gRNA sequence
tgtgtgagtgcatgcatgtt

SEQ ID NO: 366007 - DNA, 20 bp, Artificial
  CRISPR gRNA sequence
gtgtgagtgcatgcatgttt

SEQ ID NO: 366008 - DNA, 20 bp, Artificial
  CRISPR gRNA sequence
gtgagtgcatgcatgtttgg

SEQ ID NO: 366009 - DNA, 20 bp, Artificial
  CRISPR gRNA sequence
gtgcatgcatgtttgggaga

SEQ ID NO: 366010 - DNA, 20 bp, Artificial
  CRISPR gRNA sequence
tgtttgggagacagcatgtg

SEQ ID NO: 366011 - DNA, 20 bp, Artificial
  CRISPR gRNA sequence
gtttgggagacagcatgtgt

SEQ ID NO: 366012 - DNA, 20 bp, Artificial
  CRISPR gRNA sequence
atgtgtgggttcatgcattt

SEQ ID NO: 366013 - DNA, 20 bp, Artificial
  CRISPR gRNA sequence
gttcatgcatttgagcacgt

SEQ ID NO: 366014 - DNA, 20 bp, Artificial
  CRISPR gRNA sequence
atttgagcacgtgagtgtgt

SEQ ID NO: 366015 - DNA, 20 bp, Artificial
  CRISPR gRNA sequence
cgtgtgtgtgtgtgtgtgtg

SEQ ID NO: 366016 - DNA, 20 bp, Artificial
  CRISPR gRNA sequence
gtgtgtgtgtgtgtgtgtga

SEQ ID NO: 366017 - DNA, 20 bp, Artificial
  CRISPR gRNA sequence
tgtgtgtgtgtgtgtgtgaa

SEQ ID NO: 366018 - DNA, 20 bp, Artificial
  CRISPR gRNA sequence
tgtgtgtgtgtgaagggaca

SEQ ID NO: 366019 - DNA, 20 bp, Artificial
  CRISPR gRNA sequence
gtgtgtgtgtgaagggacac

SEQ ID NO: 366020 - DNA, 20 bp, Artificial
  CRISPR gRNA sequence
gtgtgaagggacacaggcct

SEQ ID NO: 366021 - DNA, 20 bp, Artificial
  CRISPR gRNA sequence
gaagggacacaggcctgaga

SEQ ID NO: 366022 - DNA, 20 bp, Artificial
  CRISPR gRNA sequence
gggacacaggcctgagacag

SEQ ID NO: 366023 - DNA, 20 bp, Artificial
  CRISPR gRNA sequence
tgagacagaagatatgaatg

SEQ ID NO: 366024 - DNA, 20 bp, Artificial
  CRISPR gRNA sequence
gagacagaagatatgaatgc

SEQ ID NO: 366025 - DNA, 20 bp, Artificial
  CRISPR gRNA sequence
gacagaagatatgaatgcag

SEQ ID NO: 366026 - DNA, 20 bp, Artificial
  CRISPR gRNA sequence
acagaagatatgaatgcagg

SEQ ID NO: 366027 - DNA, 20 bp, Artificial
  CRISPR gRNA sequence
agaagatatgaatgcaggag

SEQ ID NO: 366028 - DNA, 20 bp, Artificial
  CRISPR gRNA sequence
atgaatgcaggaggagtact

SEQ ID NO: 366029 - DNA, 20 bp, Artificial
  CRISPR gRNA sequence
tgaatgcaggaggagtactt

SEQ ID NO: 366030 - DNA, 20 bp, Artificial
  CRISPR gRNA sequence
gaatgcaggaggagtactta

SEQ ID NO: 366031 - DNA, 20 bp, Artificial
  CRISPR gRNA sequence
aatgcaggaggagtacttag

SEQ ID NO: 366032 - DNA, 20 bp, Artificial
  CRISPR gRNA sequence
atgcaggaggagtacttagg

SEQ ID NO: 366033 - DNA, 20 bp, Artificial
  CRISPR gRNA sequence
acttagggggaccctgtcct

SEQ ID NO: 366034 - DNA, 20 bp, Artificial
  CRISPR gRNA sequence
cttagggggaccctgtcctc

SEQ ID NO: 366035 - DNA, 20 bp, Artificial
  CRISPR gRNA sequence
ggaccctgtcctcaggacct

SEQ ID NO: 366036 - DNA, 20 bp, Artificial
  CRISPR gRNA sequence
gaccctgtcctcaggacctc

SEQ ID NO: 366037 - DNA, 20 bp, Artificial
  CRISPR gRNA sequence
tcaggacctcaggaattctc

SEQ ID NO: 366038 - DNA, 20 bp, Artificial
  CRISPR gRNA sequence
cctcaggaattctctggact

SEQ ID NO: 366039 - DNA, 20 bp, Artificial
  CRISPR gRNA sequence
ggaattctctggacttggtt

SEQ ID NO: 366040 - DNA, 20 bp, Artificial
  CRISPR gRNA sequence
tctctggacttggtttagcc

SEQ ID NO: 366041 - DNA, 20 bp, Artificial
  CRISPR gRNA sequence
ttggtttagcccggcatttg

SEQ ID NO: 366042 - DNA, 20 bp, Artificial
  CRISPR gRNA sequence
atttgtagtttgatttttgc

SEQ ID NO: 366043 - DNA, 20 bp, Artificial
  CRISPR gRNA sequence
tgatttttgctggtgcctgt

SEQ ID NO: 366044 - DNA, 20 bp, Artificial
  CRISPR gRNA sequence
gatttttgctggtgcctgtc

SEQ ID NO: 366045 - DNA, 20 bp, Artificial
  CRISPR gRNA sequence
atttttgctggtgcctgtca

SEQ ID NO: 366046 - DNA, 20 bp, Artificial
  CRISPR gRNA sequence
tttttgctggtgcctgtcag

SEQ ID NO: 366047 - DNA, 20 bp, Artificial
  CRISPR gRNA sequence
tcaggggaaaatcttgtcat

SEQ ID NO: 366048 - DNA, 20 bp, Artificial
  CRISPR gRNA sequence
caggggaaaatcttgtcatt

SEQ ID NO: 366049 - DNA, 20 bp, Artificial
  CRISPR gRNA sequence
atcttgtcattaggacataa

SEQ ID NO: 366050 - DNA, 20 bp, Artificial
  CRISPR gRNA sequence
tcttgtcattaggacataat

SEQ ID NO: 366051 - DNA, 20 bp, Artificial
  CRISPR gRNA sequence
taggacataataggacataa

SEQ ID NO: 366052 - DNA, 20 bp, Artificial
  CRISPR gRNA sequence
attaatttttccaattctga

SEQ ID NO: 366053 - DNA, 20 bp, Artificial
  CRISPR gRNA sequence
taatttttccaattctgatg

SEQ ID NO: 366054 - DNA, 20 bp, Artificial
  CRISPR gRNA sequence
aatttttccaattctgatgg

SEQ ID NO: 366055 - DNA, 20 bp, Artificial
  CRISPR gRNA sequence
cttccatgtccttgccactc

SEQ ID NO: 366056 - DNA, 20 bp, Artificial
  CRISPR gRNA sequence
ccactccagtttgttctgta

SEQ ID NO: 366057 - DNA, 20 bp, Artificial
  CRISPR gRNA sequence
gtttgttctgtacagtgacc

SEQ ID NO: 366058 - DNA, 20 bp, Artificial
  CRISPR gRNA sequence
gattatctttccaaaacgcg

SEQ ID NO: 366059 - DNA, 20 bp, Artificial
  CRISPR gRNA sequence
gtgtgcaccgctttctccat

SEQ ID NO: 366060 - DNA, 20 bp, Artificial
  CRISPR gRNA sequence
cgctttctccatcagctcct

SEQ ID NO: 366061 - DNA, 20 bp, Artificial
  CRISPR gRNA sequence
tttctccatcagctcctcgg

SEQ ID NO: 366062 - DNA, 20 bp, Artificial
  CRISPR gRNA sequence
cggcggctccatgttcctct

SEQ ID NO: 366063 - DNA, 20 bp, Artificial
  CRISPR gRNA sequence
ggcggctccatgttcctctc

SEQ ID NO: 366064 - DNA, 20 bp, Artificial
  CRISPR gRNA sequence
tcaggaatgtgttaacgtca

SEQ ID NO: 366065 - DNA, 20 bp, Artificial
  CRISPR gRNA sequence
caggaatgtgttaacgtcac

SEQ ID NO: 366066 - DNA, 20 bp, Artificial
  CRISPR gRNA sequence
ttaacgtcacaggcgttact

SEQ ID NO: 366067 - DNA, 20 bp, Artificial
  CRISPR gRNA sequence
aacgtcacaggcgttactga

SEQ ID NO: 366068 - DNA, 20 bp, Artificial
  CRISPR gRNA sequence
actgagagcctgctttgcct

SEQ ID NO: 366069 - DNA, 20 bp, Artificial
  CRISPR gRNA sequence
ctgagagcctgctttgcctg

SEQ ID NO: 366070 - DNA, 20 bp, Artificial
  CRISPR gRNA sequence
ctttgcctgaggaattgtgc

SEQ ID NO: 366071 - DNA, 20 bp, Artificial
  CRISPR gRNA sequence
tttgcctgaggaattgtgct

SEQ ID NO: 366072 - DNA, 20 bp, Artificial
  CRISPR gRNA sequence
tgaggaattgtgctgggtgc

SEQ ID NO: 366073 - DNA, 20 bp, Artificial
  CRISPR gRNA sequence
aggaattgtgctgggtgctg

SEQ ID NO: 366074 - DNA, 20 bp, Artificial
  CRISPR gRNA sequence
tgtgctgggtgctggagtta

SEQ ID NO: 366075 - DNA, 20 bp, Artificial
  CRISPR gRNA sequence
gctgggtgctggagttacag

SEQ ID NO: 366076 - DNA, 20 bp, Artificial
  CRISPR gRNA sequence
ggtgctggagttacagaagt

SEQ ID NO: 366077 - DNA, 20 bp, Artificial
  CRISPR gRNA sequence
cagaagttagcatgacgccg

SEQ ID NO: 366078 - DNA, 20 bp, Artificial
  CRISPR gRNA sequence
ggtttctgattgctacgttt

SEQ ID NO: 366079 - DNA, 20 bp, Artificial
  CRISPR gRNA sequence
gttcctttatgtgtgtcact

SEQ ID NO: 366080 - DNA, 20 bp, Artificial
  CRISPR gRNA sequence
ttcctttatgtgtgtcactc

SEQ ID NO: 366081 - DNA, 20 bp, Artificial
  CRISPR gRNA sequence
gtgtcactcaggtcactttt

SEQ ID NO: 366082 - DNA, 20 bp, Artificial
  CRISPR gRNA sequence
actcaggtcacttttcagtc

SEQ ID NO: 366083 - DNA, 20 bp, Artificial
  CRISPR gRNA sequence
gtcacttttcagtccagact

SEQ ID NO: 366084 - DNA, 20 bp, Artificial
  CRISPR gRNA sequence
tccagactcagtctcatttt

SEQ ID NO: 366085 - DNA, 20 bp, Artificial
  CRISPR gRNA sequence
tcggtcacttccccacccac

SEQ ID NO: 366086 - DNA, 20 bp, Artificial
  CRISPR gRNA sequence
cttccccacccactagactg

SEQ ID NO: 366087 - DNA, 20 bp, Artificial
  CRISPR gRNA sequence
aaaccttttccacaatctat

SEQ ID NO: 366088 - DNA, 20 bp, Artificial
  CRISPR gRNA sequence
ttagaatgatttgttctctc

SEQ ID NO: 366089 - DNA, 20 bp, Artificial
  CRISPR gRNA sequence
tctctggctttcataaaact

SEQ ID NO: 366090 - DNA, 20 bp, Artificial
  CRISPR gRNA sequence
aacttagcaaatgacttgta

SEQ ID NO: 366091 - DNA, 20 bp, Artificial
  CRISPR gRNA sequence
cttagcaaatgacttgtata

SEQ ID NO: 366092 - DNA, 20 bp, Artificial
  CRISPR gRNA sequence
cactatattatgcataacct

SEQ ID NO: 366093 - DNA, 20 bp, Artificial
  CRISPR gRNA sequence
ctatattatgcataacctga

SEQ ID NO: 366094 - DNA, 20 bp, Artificial
  CRISPR gRNA sequence
tattatgcataacctgagag

SEQ ID NO: 366095 - DNA, 20 bp, Artificial
  CRISPR gRNA sequence
ttatgcataacctgagagca

SEQ ID NO: 366096 - DNA, 20 bp, Artificial
  CRISPR gRNA sequence
ctctttatgattgtatttcc

SEQ ID NO: 366097 - DNA, 20 bp, Artificial
  CRISPR gRNA sequence
tctttatgattgtatttcca

SEQ ID NO: 366098 - DNA, 20 bp, Artificial
  CRISPR gRNA sequence
ctttatgattgtatttccaa

SEQ ID NO: 366099 - DNA, 20 bp, Artificial
  CRISPR gRNA sequence
gattgtatttccaagggact

SEQ ID NO: 366100 - DNA, 20 bp, Artificial
  CRISPR gRNA sequence
tgtatttccaagggactaag

SEQ ID NO: 366101 - DNA, 20 bp, Artificial
  CRISPR gRNA sequence
tatttccaagggactaagca

SEQ ID NO: 366102 - DNA, 20 bp, Artificial
  CRISPR gRNA sequence
atttccaagggactaagcag

SEQ ID NO: 366103 - DNA, 20 bp, Artificial
  CRISPR gRNA sequence
aagggactaagcagaggacc

SEQ ID NO: 366104 - DNA, 20 bp, Artificial
  CRISPR gRNA sequence
gcagaggacccagcataact

SEQ ID NO: 366105 - DNA, 20 bp, Artificial
  CRISPR gRNA sequence
cagcataactcagtacaatt

SEQ ID NO: 366106 - DNA, 20 bp, Artificial
  CRISPR gRNA sequence
gcataactcagtacaatttg

SEQ ID NO: 366107 - DNA, 20 bp, Artificial
  CRISPR gRNA sequence
cataactcagtacaatttgg

SEQ ID NO: 366108 - DNA, 20 bp, Artificial
  CRISPR gRNA sequence
gtacaatttggaggaattgt

SEQ ID NO: 366109 - DNA, 20 bp, Artificial
  CRISPR gRNA sequence
tacaatttggaggaattgtt

SEQ ID NO: 366110 - DNA, 20 bp, Artificial
  CRISPR gRNA sequence
gggttgacttatttacaaaa

SEQ ID NO: 366111 - DNA, 20 bp, Artificial
  CRISPR gRNA sequence
gttgacttatttacaaaaca

SEQ ID NO: 366112 - DNA, 20 bp, Artificial
  CRISPR gRNA sequence
tatttacaaaacagagataa

SEQ ID NO: 366113 - DNA, 20 bp, Artificial
  CRISPR gRNA sequence
tgactacatcacaaaacaac

SEQ ID NO: 366114 - DNA, 20 bp, Artificial
  CRISPR gRNA sequence
actacatcacaaaacaacta

SEQ ID NO: 366115 - DNA, 20 bp, Artificial
  CRISPR gRNA sequence
ctacatcacaaaacaactag

SEQ ID NO: 366116 - DNA, 20 bp, Artificial
  CRISPR gRNA sequence
tagaggcacaaataatatca

SEQ ID NO: 366117 - DNA, 20 bp, Artificial
  CRISPR gRNA sequence
atcatagatgtgaaaacttt

SEQ ID NO: 366118 - DNA, 20 bp, Artificial
  CRISPR gRNA sequence
atataatgccatataaacac

SEQ ID NO: 366119 - DNA, 20 bp, Artificial
  CRISPR gRNA sequence
tataatgccatataaacaca

SEQ ID NO: 366120 - DNA, 20 bp, Artificial
  CRISPR gRNA sequence
ttgttgattttatgttccct

SEQ ID NO: 366121 - DNA, 20 bp, Artificial
  CRISPR gRNA sequence
tgattttatgttccctgaga

SEQ ID NO: 366122 - DNA, 20 bp, Artificial
  CRISPR gRNA sequence
ccctgagaaagttcccacat

SEQ ID NO: 366123 - DNA, 20 bp, Artificial
  CRISPR gRNA sequence
ccacattagatattcatgct

SEQ ID NO: 366124 - DNA, 20 bp, Artificial
  CRISPR gRNA sequence
cattagatattcatgctgag

SEQ ID NO: 366125 - DNA, 20 bp, Artificial
  CRISPR gRNA sequence
gacacttgctgatacacttt

SEQ ID NO: 366126 - DNA, 20 bp, Artificial
  CRISPR gRNA sequence
tgctgatacactttgagact

SEQ ID NO: 366127 - DNA, 20 bp, Artificial
  CRISPR gRNA sequence
ttgagactgagtcacaaaca

SEQ ID NO: 366128 - DNA, 20 bp, Artificial
  CRISPR gRNA sequence
actgagtcacaaacaaagtt

SEQ ID NO: 366129 - DNA, 20 bp, Artificial
  CRISPR gRNA sequence
ctgagtcacaaacaaagttc

SEQ ID NO: 366130 - DNA, 20 bp, Artificial
  CRISPR gRNA sequence
tgagtcacaaacaaagttca

SEQ ID NO: 366131 - DNA, 20 bp, Artificial
  CRISPR gRNA sequence
tcacaaacaaagttcagggt

SEQ ID NO: 366132 - DNA, 20 bp, Artificial
  CRISPR gRNA sequence
acaaagttcagggtcggcat

SEQ ID NO: 366133 - DNA, 20 bp, Artificial
  CRISPR gRNA sequence
gcattagataaaattgtctt

SEQ ID NO: 366134 - DNA, 20 bp, Artificial
  CRISPR gRNA sequence
ttagataaaattgtcttcag

SEQ ID NO: 366135 - DNA, 20 bp, Artificial
  CRISPR gRNA sequence
ttactcatcttctattttga

SEQ ID NO: 366136 - DNA, 20 bp, Artificial
  CRISPR gRNA sequence
ttctattttgacagtcttac

SEQ ID NO: 366137 - DNA, 20 bp, Artificial
  CRISPR gRNA sequence
tctattttgacagtcttacc

SEQ ID NO: 366138 - DNA, 20 bp, Artificial
  CRISPR gRNA sequence
ctattttgacagtcttacca

SEQ ID NO: 366139 - DNA, 20 bp, Artificial
  CRISPR gRNA sequence
ttatacaattcctctttttg

SEQ ID NO: 366140 - DNA, 20 bp, Artificial
  CRISPR gRNA sequence
tatacaattcctctttttgt

SEQ ID NO: 366141 - DNA, 20 bp, Artificial
  CRISPR gRNA sequence
atacaattcctctttttgta

SEQ ID NO: 366142 - DNA, 20 bp, Artificial
  CRISPR gRNA sequence
tacaattcctctttttgtag

SEQ ID NO: 366143 - DNA, 20 bp, Artificial
  CRISPR gRNA sequence
catgctgatatgttcctaac

SEQ ID NO: 366144 - DNA, 20 bp, Artificial
  CRISPR gRNA sequence
tatgttcctaacaagttctt

SEQ ID NO: 366145 - DNA, 20 bp, Artificial
  CRISPR gRNA sequence
cctaacaagttcttaagaat

SEQ ID NO: 366146 - DNA, 20 bp, Artificial
  CRISPR gRNA sequence
aattggaacttgtacctaac

SEQ ID NO: 366147 - DNA, 20 bp, Artificial
  CRISPR gRNA sequence
cttgtacctaacaagttctt

SEQ ID NO: 366148 - DNA, 20 bp, Artificial
  CRISPR gRNA sequence
cctaacaagttcttaagaat

SEQ ID NO: 366149 - DNA, 20 bp, Artificial
  CRISPR gRNA sequence
aattggaacttgtattttat

SEQ ID NO: 366150 - DNA, 20 bp, Artificial
  CRISPR gRNA sequence
ttggaacttgtattttataa

SEQ ID NO: 366151 - DNA, 20 bp, Artificial
  CRISPR gRNA sequence
aacttgtattttataagaga

SEQ ID NO: 366152 - DNA, 20 bp, Artificial
  CRISPR gRNA sequence
ttgtattttataagagaaag

SEQ ID NO: 366153 - DNA, 20 bp, Artificial
  CRISPR gRNA sequence
gtattttataagagaaagaa

SEQ ID NO: 366154 - DNA, 20 bp, Artificial
  CRISPR gRNA sequence
attttataagagaaagaaga

SEQ ID NO: 366155 - DNA, 20 bp, Artificial
  CRISPR gRNA sequence
atattgtactataattatgt

SEQ ID NO: 366156 - DNA, 20 bp, Artificial
  CRISPR gRNA sequence
atgtaagatatgacccctga

SEQ ID NO: 366157 - DNA, 20 bp, Artificial
  CRISPR gRNA sequence
atatgacccctgacagaacc

SEQ ID NO: 366158 - DNA, 20 bp, Artificial
  CRISPR gRNA sequence
tatgacccctgacagaacct

SEQ ID NO: 366159 - DNA, 20 bp, Artificial
  CRISPR gRNA sequence
atgacccctgacagaacctg

SEQ ID NO: 366160 - DNA, 20 bp, Artificial
  CRISPR gRNA sequence
cccctgacagaacctgggga

SEQ ID NO: 366161 - DNA, 20 bp, Artificial
  CRISPR gRNA sequence
ccctgacagaacctggggac

SEQ ID NO: 366162 - DNA, 20 bp, Artificial
  CRISPR gRNA sequence
cctgacagaacctggggaca

SEQ ID NO: 366163 - DNA, 20 bp, Artificial
  CRISPR gRNA sequence
ctctataattatttcaaaat

SEQ ID NO: 366164 - DNA, 20 bp, Artificial
  CRISPR gRNA sequence
tataattatttcaaaatcag

SEQ ID NO: 366165 - DNA, 20 bp, Artificial
  CRISPR gRNA sequence
agaagttaaatctctcataa

SEQ ID NO: 366166 - DNA, 20 bp, Artificial
  CRISPR gRNA sequence
agttaaatctctcataatgg

SEQ ID NO: 366167 - DNA, 20 bp, Artificial
  CRISPR gRNA sequence
tggtagatctgcatatgccc

SEQ ID NO: 366168 - DNA, 20 bp, Artificial
  CRISPR gRNA sequence
ggtagatctgcatatgccct

SEQ ID NO: 366169 - DNA, 20 bp, Artificial
  CRISPR gRNA sequence
gatctgcatatgccctgggc

SEQ ID NO: 366170 - DNA, 20 bp, Artificial
  CRISPR gRNA sequence
cagcatacttttgtatctga

SEQ ID NO: 366171 - DNA, 20 bp, Artificial
  CRISPR gRNA sequence
agcatacttttgtatctgat

SEQ ID NO: 366172 - DNA, 20 bp, Artificial
  CRISPR gRNA sequence
tgggcttttgatctgttttt

SEQ ID NO: 366173 - DNA, 20 bp, Artificial
  CRISPR gRNA sequence
ctgttttttggtcctcatca

SEQ ID NO: 366174 - DNA, 20 bp, Artificial
  CRISPR gRNA sequence
cctcatcaaagcaaatgtct

SEQ ID NO: 366175 - DNA, 20 bp, Artificial
  CRISPR gRNA sequence
tcaaagcaaatgtctgagat

SEQ ID NO: 366176 - DNA, 20 bp, Artificial
  CRISPR gRNA sequence
agcaaatgtctgagatcagc

SEQ ID NO: 366177 - DNA, 20 bp, Artificial
  CRISPR gRNA sequence
gcaaatgtctgagatcagca

SEQ ID NO: 366178 - DNA, 20 bp, Artificial
  CRISPR gRNA sequence
aaatgtctgagatcagcaag

SEQ ID NO: 366179 - DNA, 20 bp, Artificial
  CRISPR gRNA sequence
aatgtctgagatcagcaagg

SEQ ID NO: 366180 - DNA, 20 bp, Artificial
  CRISPR gRNA sequence
gtctgagatcagcaaggagg

SEQ ID NO: 366181 - DNA, 20 bp, Artificial
  CRISPR gRNA sequence
ctgagatcagcaaggaggaa

SEQ ID NO: 366182 - DNA, 20 bp, Artificial
  CRISPR gRNA sequence
tgagatcagcaaggaggaag

SEQ ID NO: 366183 - DNA, 20 bp, Artificial
  CRISPR gRNA sequence
cagcaaggaggaagaggtga

SEQ ID NO: 366184 - DNA, 20 bp, Artificial
  CRISPR gRNA sequence
agcaaggaggaagaggtgaa

SEQ ID NO: 366185 - DNA, 20 bp, Artificial
  CRISPR gRNA sequence
aaggaggaagaggtgaaagg

SEQ ID NO: 366186 - DNA, 20 bp, Artificial
  CRISPR gRNA sequence
aggaggaagaggtgaaagga

SEQ ID NO: 366187 - DNA, 20 bp, Artificial
  CRISPR gRNA sequence
aagaggtgaaaggaaggcca

SEQ ID NO: 366188 - DNA, 20 bp, Artificial
  CRISPR gRNA sequence
agaggtgaaaggaaggccac

SEQ ID NO: 366189 - DNA, 20 bp, Artificial
  CRISPR gRNA sequence
gtgaaaggaaggccacagga

SEQ ID NO: 366190 - DNA, 20 bp, Artificial
  CRISPR gRNA sequence
tgaaaggaaggccacaggat

SEQ ID NO: 366191 - DNA, 20 bp, Artificial
  CRISPR gRNA sequence
aaggccacaggatgggctgt

SEQ ID NO: 366192 - DNA, 20 bp, Artificial
  CRISPR gRNA sequence
acaggatgggctgtcagcgc

SEQ ID NO: 366193 - DNA, 20 bp, Artificial
  CRISPR gRNA sequence
caggatgggctgtcagcgct

SEQ ID NO: 366194 - DNA, 20 bp, Artificial
  CRISPR gRNA sequence
tgggctgtcagcgctgggcg

SEQ ID NO: 366195 - DNA, 20 bp, Artificial
  CRISPR gRNA sequence
gggctgtcagcgctgggcgt

SEQ ID NO: 366196 - DNA, 20 bp, Artificial
  CRISPR gRNA sequence
taggctccctccgcccactt

SEQ ID NO: 366197 - DNA, 20 bp, Artificial
  CRISPR gRNA sequence
tctgcctcatcttatgctct

SEQ ID NO: 366198 - DNA, 20 bp, Artificial
  CRISPR gRNA sequence
cctcatcttatgctctcagt

SEQ ID NO: 366199 - DNA, 20 bp, Artificial
  CRISPR gRNA sequence
ctcatcttatgctctcagtg

SEQ ID NO: 366200 - DNA, 20 bp, Artificial
  CRISPR gRNA sequence
atatttttacatctttattt

SEQ ID NO: 366201 - DNA, 20 bp, Artificial
  CRISPR gRNA sequence
tagtttctgcctcctccaca

SEQ ID NO: 366202 - DNA, 20 bp, Artificial
  CRISPR gRNA sequence
gcctcctccacatagaatgt

SEQ ID NO: 366203 - DNA, 20 bp, Artificial
  CRISPR gRNA sequence
atagaatgtaagttctatca

SEQ ID NO: 366204 - DNA, 20 bp, Artificial
  CRISPR gRNA sequence
tattgtatcctcattgccta

SEQ ID NO: 366205 - DNA, 20 bp, Artificial
  CRISPR gRNA sequence
tatcctcattgcctacagct

SEQ ID NO: 366206 - DNA, 20 bp, Artificial
  CRISPR gRNA sequence
ctcattgcctacagctgagt

SEQ ID NO: 366207 - DNA, 20 bp, Artificial
  CRISPR gRNA sequence
tcattgcctacagctgagtt

SEQ ID NO: 366208 - DNA, 20 bp, Artificial
  CRISPR gRNA sequence
gcctacagctgagttaggca

SEQ ID NO: 366209 - DNA, 20 bp, Artificial
  CRISPR gRNA sequence
ctacagctgagttaggcaca

SEQ ID NO: 366210 - DNA, 20 bp, Artificial
  CRISPR gRNA sequence
ttaggcacagagaatgcatg

SEQ ID NO: 366211 - DNA, 20 bp, Artificial
  CRISPR gRNA sequence
gttgaatgaatgactccttg

SEQ ID NO: 366212 - DNA, 20 bp, Artificial
  CRISPR gRNA sequence
tgactccttgtagaaaatga

SEQ ID NO: 366213 - DNA, 20 bp, Artificial
  CRISPR gRNA sequence
gaaaatgaaagcccgaaaat

SEQ ID NO: 366214 - DNA, 20 bp, Artificial
  CRISPR gRNA sequence
aagcccgaaaataagccgac

SEQ ID NO: 366215 - DNA, 20 bp, Artificial
  CRISPR gRNA sequence
aataagccgactggttcccc

SEQ ID NO: 366216 - DNA, 20 bp, Artificial
  CRISPR gRNA sequence
taagccgactggttccccga

SEQ ID NO: 366217 - DNA, 20 bp, Artificial
  CRISPR gRNA sequence
agccgactggttccccgaga

SEQ ID NO: 366218 - DNA, 20 bp, Artificial
  CRISPR gRNA sequence
cgactggttccccgagagag

SEQ ID NO: 366219 - DNA, 20 bp, Artificial
  CRISPR gRNA sequence
caaatctgcccatcctcata

SEQ ID NO: 366220 - DNA, 20 bp, Artificial
  CRISPR gRNA sequence
aaatctgcccatcctcataa

SEQ ID NO: 366221 - DNA, 20 bp, Artificial
  CRISPR gRNA sequence
atctgcccatcctcataaag

SEQ ID NO: 366222 - DNA, 20 bp, Artificial
  CRISPR gRNA sequence
aaggagcaaacctgtctttt

SEQ ID NO: 366223 - DNA, 20 bp, Artificial
  CRISPR gRNA sequence
gcaaacctgtcttttaagct

SEQ ID NO: 366224 - DNA, 20 bp, Artificial
  CRISPR gRNA sequence
caaacctgtcttttaagcta

SEQ ID NO: 366225 - DNA, 20 bp, Artificial
  CRISPR gRNA sequence
tttttcctgtgttcatactt

SEQ ID NO: 366226 - DNA, 20 bp, Artificial
  CRISPR gRNA sequence
ctgtgttcatacttcagaaa

SEQ ID NO: 366227 - DNA, 20 bp, Artificial
  CRISPR gRNA sequence
tgttcatacttcagaaaaag

SEQ ID NO: 366228 - DNA, 20 bp, Artificial
  CRISPR gRNA sequence
agacacgactgataacatct

SEQ ID NO: 366229 - DNA, 20 bp, Artificial
  CRISPR gRNA sequence
acacgactgataacatctga

SEQ ID NO: 366230 - DNA, 20 bp, Artificial
  CRISPR gRNA sequence
cacgactgataacatctgag

SEQ ID NO: 366231 - DNA, 20 bp, Artificial
  CRISPR gRNA sequence
gactgataacatctgagagg

SEQ ID NO: 366232 - DNA, 20 bp, Artificial
  CRISPR gRNA sequence
actgataacatctgagagga

SEQ ID NO: 366233 - DNA, 20 bp, Artificial
  CRISPR gRNA sequence
ggaaggaaactgcattgtgc

SEQ ID NO: 366234 - DNA, 20 bp, Artificial
  CRISPR gRNA sequence
gaaggaaactgcattgtgct

SEQ ID NO: 366235 - DNA, 20 bp, Artificial
  CRISPR gRNA sequence
aaggaaactgcattgtgctg

SEQ ID NO: 366236 - DNA, 20 bp, Artificial
  CRISPR gRNA sequence
tctgcatgtcacattataaa

SEQ ID NO: 366237 - DNA, 20 bp, Artificial
  CRISPR gRNA sequence
aaagcaatttttttttttaa

SEQ ID NO: 366238 - DNA, 20 bp, Artificial
  CRISPR gRNA sequence
atttttttttttaatagaac

SEQ ID NO: 366239 - DNA, 20 bp, Artificial
  CRISPR gRNA sequence
aatagaaccagcctttcaaa

SEQ ID NO: 366240 - DNA, 20 bp, Artificial
  CRISPR gRNA sequence
ccagcctttcaaacagtttc

SEQ ID NO: 366241 - DNA, 20 bp, Artificial
  CRISPR gRNA sequence
agcctttcaaacagtttcca

SEQ ID NO: 366242 - DNA, 20 bp, Artificial
  CRISPR gRNA sequence
tttcaaacagtttccagaga

SEQ ID NO: 366243 - DNA, 20 bp, Artificial
  CRISPR gRNA sequence
ggattatcctactttacttt

SEQ ID NO: 366244 - DNA, 20 bp, Artificial
  CRISPR gRNA sequence
ttggctcttcttcatgtata

SEQ ID NO: 366245 - DNA, 20 bp, Artificial
  CRISPR gRNA sequence
ggctcttcttcatgtataca

SEQ ID NO: 366246 - DNA, 20 bp, Artificial
  CRISPR gRNA sequence
gctcttcttcatgtatacag

SEQ ID NO: 366247 - DNA, 20 bp, Artificial
  CRISPR gRNA sequence
tcttcatgtatacagaggta

SEQ ID NO: 366248 - DNA, 20 bp, Artificial
  CRISPR gRNA sequence
atctttatattttcatttaa

SEQ ID NO: 366249 - DNA, 20 bp, Artificial
  CRISPR gRNA sequence
tgctcctgtttttgtttgta

SEQ ID NO: 366250 - DNA, 20 bp, Artificial
  CRISPR gRNA sequence
ctgtttttgtttgtacagtg

SEQ ID NO: 366251 - DNA, 20 bp, Artificial
  CRISPR gRNA sequence
tttgtacagtgtggcatatt

SEQ ID NO: 366252 - DNA, 20 bp, Artificial
  CRISPR gRNA sequence
tgtggcatattcagaattta

SEQ ID NO: 366253 - DNA, 20 bp, Artificial
  CRISPR gRNA sequence
tcagaatttacagtgctctt

SEQ ID NO: 366254 - DNA, 20 bp, Artificial
  CRISPR gRNA sequence
aatttacagtgctctttagt

SEQ ID NO: 366255 - DNA, 20 bp, Artificial
  CRISPR gRNA sequence
tacagtgctctttagttggc

SEQ ID NO: 366256 - DNA, 20 bp, Artificial
  CRISPR gRNA sequence
acagtgctctttagttggct

SEQ ID NO: 366257 - DNA, 20 bp, Artificial
  CRISPR gRNA sequence
aggataatttctcacttgtt

SEQ ID NO: 366258 - DNA, 20 bp, Artificial
  CRISPR gRNA sequence
cacttgttcagaaaaactaa

SEQ ID NO: 366259 - DNA, 20 bp, Artificial
  CRISPR gRNA sequence
aagttacattttccaattat

SEQ ID NO: 366260 - DNA, 20 bp, Artificial
  CRISPR gRNA sequence
ttacattttccaattatcag

SEQ ID NO: 366261 - DNA, 20 bp, Artificial
  CRISPR gRNA sequence
tacattttccaattatcagc

SEQ ID NO: 366262 - DNA, 20 bp, Artificial
  CRISPR gRNA sequence
ttatcagcaggacgcctttt

SEQ ID NO: 366263 - DNA, 20 bp, Artificial
  CRISPR gRNA sequence
gcaggacgcctttttagaca

SEQ ID NO: 366264 - DNA, 20 bp, Artificial
  CRISPR gRNA sequence
caggacgcctttttagacaa

SEQ ID NO: 366265 - DNA, 20 bp, Artificial
  CRISPR gRNA sequence
gacgcctttttagacaaagg

SEQ ID NO: 366266 - DNA, 20 bp, Artificial
  CRISPR gRNA sequence
tagacaaaggcagaaactgt

SEQ ID NO: 366267 - DNA, 20 bp, Artificial
  CRISPR gRNA sequence
ttactgtgatctcaatgcac

SEQ ID NO: 366268 - DNA, 20 bp, Artificial
  CRISPR gRNA sequence
tactgtgatctcaatgcact

SEQ ID NO: 366269 - DNA, 20 bp, Artificial
  CRISPR gRNA sequence
tcaatgcactaggtcttcaa

SEQ ID NO: 366270 - DNA, 20 bp, Artificial
  CRISPR gRNA sequence
cactaggtcttcaaaagctt

SEQ ID NO: 366271 - DNA, 20 bp, Artificial
  CRISPR gRNA sequence
aaaagcttaagatattgatt

SEQ ID NO: 366272 - DNA, 20 bp, Artificial
  CRISPR gRNA sequence
gatttggtgtttccatcatc

SEQ ID NO: 366273 - DNA, 20 bp, Artificial
  CRISPR gRNA sequence
atttggtgtttccatcatca

SEQ ID NO: 366274 - DNA, 20 bp, Artificial
  CRISPR gRNA sequence
taatgtgatgttgtatattt

SEQ ID NO: 366275 - DNA, 20 bp, Artificial
  CRISPR gRNA sequence
gtatatttcagctctatgtg

SEQ ID NO: 366276 - DNA, 20 bp, Artificial
  CRISPR gRNA sequence
atatttcagctctatgtgaa

SEQ ID NO: 366277 - DNA, 20 bp, Artificial
  CRISPR gRNA sequence
tatttcagctctatgtgaag

SEQ ID NO: 366278 - DNA, 20 bp, Artificial
  CRISPR gRNA sequence
ctctatgtgaagaggtgctt

SEQ ID NO: 366279 - DNA, 20 bp, Artificial
  CRISPR gRNA sequence
agaggtgctttggcatacat

SEQ ID NO: 366280 - DNA, 20 bp, Artificial
  CRISPR gRNA sequence
atacatcagttccctttgcc

SEQ ID NO: 366281 - DNA, 20 bp, Artificial
  CRISPR gRNA sequence
ctttgccgagaacatgtctc

SEQ ID NO: 366282 - DNA, 20 bp, Artificial
  CRISPR gRNA sequence
agaatgtgtgtatccatcaa

SEQ ID NO: 366283 - DNA, 20 bp, Artificial
  CRISPR gRNA sequence
gaatgtgtgtatccatcaat

SEQ ID NO: 366284 - DNA, 20 bp, Artificial
  CRISPR gRNA sequence
catcaatgggcatcttaaca

SEQ ID NO: 366285 - DNA, 20 bp, Artificial
  CRISPR gRNA sequence
atcaatgggcatcttaacac

SEQ ID NO: 366286 - DNA, 20 bp, Artificial
  CRISPR gRNA sequence
aatgggcatcttaacacagg

SEQ ID NO: 366287 - DNA, 20 bp, Artificial
  CRISPR gRNA sequence
tgggcatcttaacacaggtg

SEQ ID NO: 366288 - DNA, 20 bp, Artificial
  CRISPR gRNA sequence
gcatcttaacacaggtggag

SEQ ID NO: 366289 - DNA, 20 bp, Artificial
  CRISPR gRNA sequence
taacacaggtggagtggttc

SEQ ID NO: 366290 - DNA, 20 bp, Artificial
  CRISPR gRNA sequence
caggtggagtggttcaagat

SEQ ID NO: 366291 - DNA, 20 bp, Artificial
  CRISPR gRNA sequence
aggtggagtggttcaagatc

SEQ ID NO: 366292 - DNA, 20 bp, Artificial
  CRISPR gRNA sequence
agtggttcaagatcgggacc

SEQ ID NO: 366293 - DNA, 20 bp, Artificial
  CRISPR gRNA sequence
ggttcaagatcgggacccag

SEQ ID NO: 366294 - DNA, 20 bp, Artificial
  CRISPR gRNA sequence
gttcaagatcgggacccagc

SEQ ID NO: 366295 - DNA, 20 bp, Artificial
  CRISPR gRNA sequence
cgggacccagcaggattcca

SEQ ID NO: 366296 - DNA, 20 bp, Artificial
  CRISPR gRNA sequence
caggattccatagccatttt

SEQ ID NO: 366297 - DNA, 20 bp, Artificial
  CRISPR gRNA sequence
gccattttcagccctactca

SEQ ID NO: 366298 - DNA, 20 bp, Artificial
  CRISPR gRNA sequence
tttcagccctactcatggca

SEQ ID NO: 366299 - DNA, 20 bp, Artificial
  CRISPR gRNA sequence
cctactcatggcatggtcat

SEQ ID NO: 366300 - DNA, 20 bp, Artificial
  CRISPR gRNA sequence
ctactcatggcatggtcata

SEQ ID NO: 366301 - DNA, 20 bp, Artificial
  CRISPR gRNA sequence
ctcatggcatggtcataagg

SEQ ID NO: 366302 - DNA, 20 bp, Artificial
  CRISPR gRNA sequence
tcataaggaagccctatgct

SEQ ID NO: 366303 - DNA, 20 bp, Artificial
  CRISPR gRNA sequence
ataaggaagccctatgctga

SEQ ID NO: 366304 - DNA, 20 bp, Artificial
  CRISPR gRNA sequence
taaggaagccctatgctgag

SEQ ID NO: 366305 - DNA, 20 bp, Artificial
  CRISPR gRNA sequence
aaggaagccctatgctgaga

SEQ ID NO: 366306 - DNA, 20 bp, Artificial
  CRISPR gRNA sequence
ttactttttgaattcaacga

SEQ ID NO: 366307 - DNA, 20 bp, Artificial
  CRISPR gRNA sequence
ataacatgactcttttcttt

SEQ ID NO: 366308 - DNA, 20 bp, Artificial
  CRISPR gRNA sequence
tttctttcggaatgcctctg

SEQ ID NO: 366309 - DNA, 20 bp, Artificial
  CRISPR gRNA sequence
aatgcctctgaagatgatgt

SEQ ID NO: 366310 - DNA, 20 bp, Artificial
  CRISPR gRNA sequence
gctctctttacacttaccca

SEQ ID NO: 366311 - DNA, 20 bp, Artificial
  CRISPR gRNA sequence
ctctctttacacttacccac

SEQ ID NO: 366312 - DNA, 20 bp, Artificial
  CRISPR gRNA sequence
tctctttacacttacccaca

SEQ ID NO: 366313 - DNA, 20 bp, Artificial
  CRISPR gRNA sequence
acacttacccacagggaact

SEQ ID NO: 366314 - DNA, 20 bp, Artificial
  CRISPR gRNA sequence
cttacccacagggaacttgg

SEQ ID NO: 366315 - DNA, 20 bp, Artificial
  CRISPR gRNA sequence
acccacagggaacttggcag

SEQ ID NO: 366316 - DNA, 20 bp, Artificial
  CRISPR gRNA sequence
cccacagggaacttggcaga

SEQ ID NO: 366317 - DNA, 20 bp, Artificial
  CRISPR gRNA sequence
gaacttggcagaaggtgata

SEQ ID NO: 366318 - DNA, 20 bp, Artificial
  CRISPR gRNA sequence
aacttggcagaaggtgatac

SEQ ID NO: 366319 - DNA, 20 bp, Artificial
  CRISPR gRNA sequence
ttggcagaaggtgatacagg

SEQ ID NO: 366320 - DNA, 20 bp, Artificial
  CRISPR gRNA sequence
agaaggtgatacaggtggtt

SEQ ID NO: 366321 - DNA, 20 bp, Artificial
  CRISPR gRNA sequence
ggtgatacaggtggttcagt

SEQ ID NO: 366322 - DNA, 20 bp, Artificial
  CRISPR gRNA sequence
gtgatacaggtggttcagtc

SEQ ID NO: 366323 - DNA, 20 bp, Artificial
  CRISPR gRNA sequence
tacaggtggttcagtcaggt

SEQ ID NO: 366324 - DNA, 20 bp, Artificial
  CRISPR gRNA sequence
acaggtggttcagtcaggta

SEQ ID NO: 366325 - DNA, 20 bp, Artificial
  CRISPR gRNA sequence
caggtggttcagtcaggtaa

SEQ ID NO: 366326 - DNA, 20 bp, Artificial
  CRISPR gRNA sequence
tggttcagtcaggtaagggc

SEQ ID NO: 366327 - DNA, 20 bp, Artificial
  CRISPR gRNA sequence
ttacaacatttatttctata

SEQ ID NO: 366328 - DNA, 20 bp, Artificial
  CRISPR gRNA sequence
catttatttctataaagccc

SEQ ID NO: 366329 - DNA, 20 bp, Artificial
  CRISPR gRNA sequence
ttatttctataaagcccaag

SEQ ID NO: 366330 - DNA, 20 bp, Artificial
  CRISPR gRNA sequence
tttctataaagcccaagtag

SEQ ID NO: 366331 - DNA, 20 bp, Artificial
  CRISPR gRNA sequence
taaagcccaagtagaagcta

SEQ ID NO: 366332 - DNA, 20 bp, Artificial
  CRISPR gRNA sequence
aatgtcttctcgtatttctg

SEQ ID NO: 366333 - DNA, 20 bp, Artificial
  CRISPR gRNA sequence
gcattctccaattccatttc

SEQ ID NO: 366334 - DNA, 20 bp, Artificial
  CRISPR gRNA sequence
gctttgatgttactgctttg

SEQ ID NO: 366335 - DNA, 20 bp, Artificial
  CRISPR gRNA sequence
ctttgatgttactgctttga

SEQ ID NO: 366336 - DNA, 20 bp, Artificial
  CRISPR gRNA sequence
ttgatgttactgctttgaag

SEQ ID NO: 366337 - DNA, 20 bp, Artificial
  CRISPR gRNA sequence
ctgctttgaaggagcaatct

SEQ ID NO: 366338 - DNA, 20 bp, Artificial
  CRISPR gRNA sequence
tgctttgaaggagcaatctt

SEQ ID NO: 366339 - DNA, 20 bp, Artificial
  CRISPR gRNA sequence
ctttgaaggagcaatcttgg

SEQ ID NO: 366340 - DNA, 20 bp, Artificial
  CRISPR gRNA sequence
ctgactgtgctgttgtgtcc

SEQ ID NO: 366341 - DNA, 20 bp, Artificial
  CRISPR gRNA sequence
actgtgctgttgtgtccgag

SEQ ID NO: 366342 - DNA, 20 bp, Artificial
  CRISPR gRNA sequence
gtgctgttgtgtccgagtag

SEQ ID NO: 366343 - DNA, 20 bp, Artificial
  CRISPR gRNA sequence
gtgcctttcaaatttgaatg

SEQ ID NO: 366344 - DNA, 20 bp, Artificial
  CRISPR gRNA sequence
cctttcaaatttgaatgtag

SEQ ID NO: 366345 - DNA, 20 bp, Artificial
  CRISPR gRNA sequence
ttcaaatttgaatgtagtag

SEQ ID NO: 366346 - DNA, 20 bp, Artificial
  CRISPR gRNA sequence
aatttgaatgtagtagaaga

SEQ ID NO: 366347 - DNA, 20 bp, Artificial
  CRISPR gRNA sequence
gaatgtagtagaagaaagca

SEQ ID NO: 366348 - DNA, 20 bp, Artificial
  CRISPR gRNA sequence
aatgtagtagaagaaagcac

SEQ ID NO: 366349 - DNA, 20 bp, Artificial
  CRISPR gRNA sequence
tgttgtcttaatgataacct

SEQ ID NO: 366350 - DNA, 20 bp, Artificial
  CRISPR gRNA sequence
agccttgattaaactgatgt

SEQ ID NO: 366351 - DNA, 20 bp, Artificial
  CRISPR gRNA sequence
aaactgatgttggcaacaca

SEQ ID NO: 366352 - DNA, 20 bp, Artificial
  CRISPR gRNA sequence
aactgatgttggcaacacat

SEQ ID NO: 366353 - DNA, 20 bp, Artificial
  CRISPR gRNA sequence
atgttggcaacacatgggtt

SEQ ID NO: 366354 - DNA, 20 bp, Artificial
  CRISPR gRNA sequence
tgttggcaacacatgggttc

SEQ ID NO: 366355 - DNA, 20 bp, Artificial
  CRISPR gRNA sequence
acatgggttcaggatccttt

SEQ ID NO: 366356 - DNA, 20 bp, Artificial
  CRISPR gRNA sequence
catgggttcaggatcctttc

SEQ ID NO: 366357 - DNA, 20 bp, Artificial
  CRISPR gRNA sequence
atgggttcaggatcctttca

SEQ ID NO: 366358 - DNA, 20 bp, Artificial
  CRISPR gRNA sequence
atcctttcagggttttatca

SEQ ID NO: 366359 - DNA, 20 bp, Artificial
  CRISPR gRNA sequence
agggttttatcacagtgaca

SEQ ID NO: 366360 - DNA, 20 bp, Artificial
  CRISPR gRNA sequence
atagcaccattcccttctgc

SEQ ID NO: 366361 - DNA, 20 bp, Artificial
  CRISPR gRNA sequence
ttcccttctgctggacactc

SEQ ID NO: 366362 - DNA, 20 bp, Artificial
  CRISPR gRNA sequence
acatcaacccctgtgtgttc

SEQ ID NO: 366363 - DNA, 20 bp, Artificial
  CRISPR gRNA sequence
catcaacccctgtgtgttca

SEQ ID NO: 366364 - DNA, 20 bp, Artificial
  CRISPR gRNA sequence
tgtgttcaaggttcttccta

SEQ ID NO: 366365 - DNA, 20 bp, Artificial
  CRISPR gRNA sequence
cttcctacagtaccaaatct

SEQ ID NO: 366366 - DNA, 20 bp, Artificial
  CRISPR gRNA sequence
ttttttttttttttttttga

SEQ ID NO: 366367 - DNA, 20 bp, Artificial
  CRISPR gRNA sequence
ttttttttttttttttgatg

SEQ ID NO: 366368 - DNA, 20 bp, Artificial
  CRISPR gRNA sequence
atggagtcttgctctgtcac

SEQ ID NO: 366369 - DNA, 20 bp, Artificial
  CRISPR gRNA sequence
tggagtcttgctctgtcacc

SEQ ID NO: 366370 - DNA, 20 bp, Artificial
  CRISPR gRNA sequence
gtcttgctctgtcaccaggc

SEQ ID NO: 366371 - DNA, 20 bp, Artificial
  CRISPR gRNA sequence
cttgctctgtcaccaggctg

SEQ ID NO: 366372 - DNA, 20 bp, Artificial
  CRISPR gRNA sequence
tctgtcaccaggctggagta

SEQ ID NO: 366373 - DNA, 20 bp, Artificial
  CRISPR gRNA sequence
gtcaccaggctggagtacag

SEQ ID NO: 366374 - DNA, 20 bp, Artificial
  CRISPR gRNA sequence
ggagtacagtagcatgatct

SEQ ID NO: 366375 - DNA, 20 bp, Artificial
  CRISPR gRNA sequence
tcttggctcactgcaacctc

SEQ ID NO: 366376 - DNA, 20 bp, Artificial
  CRISPR gRNA sequence
tcactgcaacctccagctcc

SEQ ID NO: 366377 - DNA, 20 bp, Artificial
  CRISPR gRNA sequence
cactgcaacctccagctcct

SEQ ID NO: 366378 - DNA, 20 bp, Artificial
  CRISPR gRNA sequence
aacctccagctcctgggctc

SEQ ID NO: 366379 - DNA, 20 bp, Artificial
  CRISPR gRNA sequence
ctcaagcgattctcctacct

SEQ ID NO: 366380 - DNA, 20 bp, Artificial
  CRISPR gRNA sequence
ttctcctacctcagccccgc

SEQ ID NO: 366381 - DNA, 20 bp, Artificial
  CRISPR gRNA sequence
tcctacctcagccccgcaag

SEQ ID NO: 366382 - DNA, 20 bp, Artificial
  CRISPR gRNA sequence
acctcagccccgcaagtagc

SEQ ID NO: 366383 - DNA, 20 bp, Artificial
  CRISPR gRNA sequence
cctcagccccgcaagtagct

SEQ ID NO: 366384 - DNA, 20 bp, Artificial
  CRISPR gRNA sequence
cccgcaagtagctgggacta

SEQ ID NO: 366385 - DNA, 20 bp, Artificial
  CRISPR gRNA sequence
ccgcaagtagctgggactac

SEQ ID NO: 366386 - DNA, 20 bp, Artificial
  CRISPR gRNA sequence
gtgtgcaccgccacgtgata

SEQ ID NO: 366387 - DNA, 20 bp, Artificial
  CRISPR gRNA sequence
gtttgaattcccatgtgttg

SEQ ID NO: 366388 - DNA, 20 bp, Artificial
  CRISPR gRNA sequence
tttgaattcccatgtgttgt

SEQ ID NO: 366389 - DNA, 20 bp, Artificial
  CRISPR gRNA sequence
tgaattcccatgtgttgtgg

SEQ ID NO: 366390 - DNA, 20 bp, Artificial
  CRISPR gRNA sequence
gaattcccatgtgttgtggg

SEQ ID NO: 366391 - DNA, 20 bp, Artificial
  CRISPR gRNA sequence
aattcccatgtgttgtggga

SEQ ID NO: 366392 - DNA, 20 bp, Artificial
  CRISPR gRNA sequence
catgtgttgtgggagggacc

SEQ ID NO: 366393 - DNA, 20 bp, Artificial
  CRISPR gRNA sequence
gtgttgtgggagggacctgg

SEQ ID NO: 366394 - DNA, 20 bp, Artificial
  CRISPR gRNA sequence
tgttgtgggagggacctggt

SEQ ID NO: 366395 - DNA, 20 bp, Artificial
  CRISPR gRNA sequence
ttgtgggagggacctggtgg

SEQ ID NO: 366396 - DNA, 20 bp, Artificial
  CRISPR gRNA sequence
tgtgggagggacctggtggg

SEQ ID NO: 366397 - DNA, 20 bp, Artificial
  CRISPR gRNA sequence
tgggaggtaattgaatcgtg

SEQ ID NO: 366398 - DNA, 20 bp, Artificial
  CRISPR gRNA sequence
gggaggtaattgaatcgtgc

SEQ ID NO: 366399 - DNA, 20 bp, Artificial
  CRISPR gRNA sequence
ggtaattgaatcgtgcgggc

SEQ ID NO: 366400 - DNA, 20 bp, Artificial
  CRISPR gRNA sequence
ttcccatgctgtcctcatga

SEQ ID NO: 366401 - DNA, 20 bp, Artificial
  CRISPR gRNA sequence
ctgtcctcatgatagtgcat

SEQ ID NO: 366402 - DNA, 20 bp, Artificial
  CRISPR gRNA sequence
tgatagtgcataagtctcat

SEQ ID NO: 366403 - DNA, 20 bp, Artificial
  CRISPR gRNA sequence
ataagtctcatgagatctga

SEQ ID NO: 366404 - DNA, 20 bp, Artificial
  CRISPR gRNA sequence
tgagatctgatggtttaaaa

SEQ ID NO: 366405 - DNA, 20 bp, Artificial
  CRISPR gRNA sequence
agatctgatggtttaaaaaa

SEQ ID NO: 366406 - DNA, 20 bp, Artificial
  CRISPR gRNA sequence
gatctgatggtttaaaaaag

SEQ ID NO: 366407 - DNA, 20 bp, Artificial
  CRISPR gRNA sequence
tctgatggtttaaaaaagag

SEQ ID NO: 366408 - DNA, 20 bp, Artificial
  CRISPR gRNA sequence
aaagaggagttcccctgcac

SEQ ID NO: 366409 - DNA, 20 bp, Artificial
  CRISPR gRNA sequence
ttgcctgctgccatccatgt

SEQ ID NO: 366410 - DNA, 20 bp, Artificial
  CRISPR gRNA sequence
ttgccttccaccttgattgt

SEQ ID NO: 366411 - DNA, 20 bp, Artificial
  CRISPR gRNA sequence
tgccttccaccttgattgtg

SEQ ID NO: 366412 - DNA, 20 bp, Artificial
  CRISPR gRNA sequence
ccttgattgtgaggcttccc

SEQ ID NO: 366413 - DNA, 20 bp, Artificial
  CRISPR gRNA sequence
gtgaggcttccccagacatg

SEQ ID NO: 366414 - DNA, 20 bp, Artificial
  CRISPR gRNA sequence
ccccagacatgtggtgctgt

SEQ ID NO: 366415 - DNA, 20 bp, Artificial
  CRISPR gRNA sequence
tctttcttttgtaaattgcc

SEQ ID NO: 366416 - DNA, 20 bp, Artificial
  CRISPR gRNA sequence
ttttgtaaattgcccagtct

SEQ ID NO: 366417 - DNA, 20 bp, Artificial
  CRISPR gRNA sequence
tttgtaaattgcccagtctt

SEQ ID NO: 366418 - DNA, 20 bp, Artificial
  CRISPR gRNA sequence
agtcttgggaatatcttcat

SEQ ID NO: 366419 - DNA, 20 bp, Artificial
  CRISPR gRNA sequence
cttgggaatatcttcatcag

SEQ ID NO: 366420 - DNA, 20 bp, Artificial
  CRISPR gRNA sequence
ttgggaatatcttcatcagc

SEQ ID NO: 366421 - DNA, 20 bp, Artificial
  CRISPR gRNA sequence
tgggaatatcttcatcagca

SEQ ID NO: 366422 - DNA, 20 bp, Artificial
  CRISPR gRNA sequence
cttcatcagcagggtgaaaa

SEQ ID NO: 366423 - DNA, 20 bp, Artificial
  CRISPR gRNA sequence
aacggactaatacaccatgc

SEQ ID NO: 366424 - DNA, 20 bp, Artificial
  CRISPR gRNA sequence
acggactaatacaccatgcc

SEQ ID NO: 366425 - DNA, 20 bp, Artificial
  CRISPR gRNA sequence
gctgattgttgtattttttg

SEQ ID NO: 366426 - DNA, 20 bp, Artificial
  CRISPR gRNA sequence
tgattgttgtattttttgta

SEQ ID NO: 366427 - DNA, 20 bp, Artificial
  CRISPR gRNA sequence
gttgtattttttgtagagat

SEQ ID NO: 366428 - DNA, 20 bp, Artificial
  CRISPR gRNA sequence
ttgtattttttgtagagatg

SEQ ID NO: 366429 - DNA, 20 bp, Artificial
  CRISPR gRNA sequence
tgaggtttcaacatgttgcc

SEQ ID NO: 366430 - DNA, 20 bp, Artificial
  CRISPR gRNA sequence
gaggtttcaacatgttgccc

SEQ ID NO: 366431 - DNA, 20 bp, Artificial
  CRISPR gRNA sequence
tttcaacatgttgcccaggc

SEQ ID NO: 366432 - DNA, 20 bp, Artificial
  CRISPR gRNA sequence
catgttgcccaggctggtct

SEQ ID NO: 366433 - DNA, 20 bp, Artificial
  CRISPR gRNA sequence
caggctggtcttggactcct

SEQ ID NO: 366434 - DNA, 20 bp, Artificial
  CRISPR gRNA sequence
ggtcttggactcctgagttc

SEQ ID NO: 366435 - DNA, 20 bp, Artificial
  CRISPR gRNA sequence
ttcaagtgatccaactgcct

SEQ ID NO: 366436 - DNA, 20 bp, Artificial
  CRISPR gRNA sequence
atccaactgcctcggcctcc

SEQ ID NO: 366437 - DNA, 20 bp, Artificial
  CRISPR gRNA sequence
ccaactgcctcggcctccca

SEQ ID NO: 366438 - DNA, 20 bp, Artificial
  CRISPR gRNA sequence
gcctcggcctcccagagtgc

SEQ ID NO: 366439 - DNA, 20 bp, Artificial
  CRISPR gRNA sequence
cctcggcctcccagagtgcc

SEQ ID NO: 366440 - DNA, 20 bp, Artificial
  CRISPR gRNA sequence
tcccagagtgccaggattac

SEQ ID NO: 366441 - DNA, 20 bp, Artificial
  CRISPR gRNA sequence
gattactggcatgaaccacc

SEQ ID NO: 366442 - DNA, 20 bp, Artificial
  CRISPR gRNA sequence
ctggcatgaaccaccaagct

SEQ ID NO: 366443 - DNA, 20 bp, Artificial
  CRISPR gRNA sequence
tgaaccaccaagcttggccc

SEQ ID NO: 366444 - DNA, 20 bp, Artificial
  CRISPR gRNA sequence
gctctatctttcacctcatc

SEQ ID NO: 366445 - DNA, 20 bp, Artificial
  CRISPR gRNA sequence
ctctatctttcacctcatcc

SEQ ID NO: 366446 - DNA, 20 bp, Artificial
  CRISPR gRNA sequence
tctttcacctcatccaggtt

SEQ ID NO: 366447 - DNA, 20 bp, Artificial
  CRISPR gRNA sequence
tcacctcatccaggtttagc

SEQ ID NO: 366448 - DNA, 20 bp, Artificial
  CRISPR gRNA sequence
acctcatccaggtttagcta

SEQ ID NO: 366449 - DNA, 20 bp, Artificial
  CRISPR gRNA sequence
ctcatccaggtttagctaga

SEQ ID NO: 366450 - DNA, 20 bp, Artificial
  CRISPR gRNA sequence
tcatccaggtttagctagag

SEQ ID NO: 366451 - DNA, 20 bp, Artificial
  CRISPR gRNA sequence
acactttcttcataaattgt

SEQ ID NO: 366452 - DNA, 20 bp, Artificial
  CRISPR gRNA sequence
tcttcataaattgtgagctg

SEQ ID NO: 366453 - DNA, 20 bp, Artificial
  CRISPR gRNA sequence
taaattgtgagctgtggtgt

SEQ ID NO: 366454 - DNA, 20 bp, Artificial
  CRISPR gRNA sequence
ttgtgagctgtggtgtcaga

SEQ ID NO: 366455 - DNA, 20 bp, Artificial
  CRISPR gRNA sequence
gaaagaacccaatgatccct

SEQ ID NO: 366456 - DNA, 20 bp, Artificial
  CRISPR gRNA sequence
aagaacccaatgatcccttg

SEQ ID NO: 366457 - DNA, 20 bp, Artificial
  CRISPR gRNA sequence
gtgttttttgctttatctac

SEQ ID NO: 366458 - DNA, 20 bp, Artificial
  CRISPR gRNA sequence
gttttttgctttatctacca

SEQ ID NO: 366459 - DNA, 20 bp, Artificial
  CRISPR gRNA sequence
gctttatctaccagagattg

SEQ ID NO: 366460 - DNA, 20 bp, Artificial
  CRISPR gRNA sequence
agattgtggttttgtctttc

SEQ ID NO: 366461 - DNA, 20 bp, Artificial
  CRISPR gRNA sequence
ctagtgatgactacatgaac

SEQ ID NO: 366462 - DNA, 20 bp, Artificial
  CRISPR gRNA sequence
atgactacatgaactggttg

SEQ ID NO: 366463 - DNA, 20 bp, Artificial
  CRISPR gRNA sequence
atgaactggttgtagtatat

SEQ ID NO: 366464 - DNA, 20 bp, Artificial
  CRISPR gRNA sequence
tgtagtatattggaaacact

SEQ ID NO: 366465 - DNA, 20 bp, Artificial
  CRISPR gRNA sequence
gtagtatattggaaacactt

SEQ ID NO: 366466 - DNA, 20 bp, Artificial
  CRISPR gRNA sequence
attggaaacacttgggttta

SEQ ID NO: 366467 - DNA, 20 bp, Artificial
  CRISPR gRNA sequence
gtcatcactttccatcaacc

SEQ ID NO: 366468 - DNA, 20 bp, Artificial
  CRISPR gRNA sequence
actttccatcaacctggtgt

SEQ ID NO: 366469 - DNA, 20 bp, Artificial
  CRISPR gRNA sequence
tgctcgatccctctgaatct

SEQ ID NO: 366470 - DNA, 20 bp, Artificial
  CRISPR gRNA sequence
gctcgatccctctgaatctc

SEQ ID NO: 366471 - DNA, 20 bp, Artificial
  CRISPR gRNA sequence
ctctgaatctcaggttcctg

SEQ ID NO: 366472 - DNA, 20 bp, Artificial
  CRISPR gRNA sequence
ctgaatctcaggttcctgaa

SEQ ID NO: 366473 - DNA, 20 bp, Artificial
  CRISPR gRNA sequence
tgaatctcaggttcctgaag

SEQ ID NO: 366474 - DNA, 20 bp, Artificial
  CRISPR gRNA sequence
tcaggttcctgaagaggaaa

SEQ ID NO: 366475 - DNA, 20 bp, Artificial
  CRISPR gRNA sequence
caggttcctgaagaggaaat

SEQ ID NO: 366476 - DNA, 20 bp, Artificial
  CRISPR gRNA sequence
aggttcctgaagaggaaatg

SEQ ID NO: 366477 - DNA, 20 bp, Artificial
  CRISPR gRNA sequence
tcctgaagaggaaatggggt

SEQ ID NO: 366478 - DNA, 20 bp, Artificial
  CRISPR gRNA sequence
tgaagaggaaatggggttgg

SEQ ID NO: 366479 - DNA, 20 bp, Artificial
  CRISPR gRNA sequence
gtgccattctacttgttgaa

SEQ ID NO: 366480 - DNA, 20 bp, Artificial
  CRISPR gRNA sequence
attctacttgttgaatggct

SEQ ID NO: 366481 - DNA, 20 bp, Artificial
  CRISPR gRNA sequence
ttctacttgttgaatggctg

SEQ ID NO: 366482 - DNA, 20 bp, Artificial
  CRISPR gRNA sequence
tctacttgttgaatggctga

SEQ ID NO: 366483 - DNA, 20 bp, Artificial
  CRISPR gRNA sequence
gctgagggacgatatattta

SEQ ID NO: 366484 - DNA, 20 bp, Artificial
  CRISPR gRNA sequence
gacgatatatttaaagaact

SEQ ID NO: 366485 - DNA, 20 bp, Artificial
  CRISPR gRNA sequence
tatttaaagaacttggtcca

SEQ ID NO: 366486 - DNA, 20 bp, Artificial
  CRISPR gRNA sequence
ttaaagaacttggtccatgg

SEQ ID NO: 366487 - DNA, 20 bp, Artificial
  CRISPR gRNA sequence
agaacttggtccatggtagt

SEQ ID NO: 366488 - DNA, 20 bp, Artificial
  CRISPR gRNA sequence
aacttggtccatggtagtca

SEQ ID NO: 366489 - DNA, 20 bp, Artificial
  CRISPR gRNA sequence
ttcctatgcttgtgatccaa

SEQ ID NO: 366490 - DNA, 20 bp, Artificial
  CRISPR gRNA sequence
tcctatgcttgtgatccaaa

SEQ ID NO: 366491 - DNA, 20 bp, Artificial
  CRISPR gRNA sequence
aggactaataatgaaatttt

SEQ ID NO: 366492 - DNA, 20 bp, Artificial
  CRISPR gRNA sequence
ataatgaaattttcagatat

SEQ ID NO: 366493 - DNA, 20 bp, Artificial
  CRISPR gRNA sequence
cagatattagtgacaatcta

SEQ ID NO: 366494 - DNA, 20 bp, Artificial
  CRISPR gRNA sequence
atattagtgacaatctaaag

SEQ ID NO: 366495 - DNA, 20 bp, Artificial
  CRISPR gRNA sequence
tattagtgacaatctaaagc

SEQ ID NO: 366496 - DNA, 20 bp, Artificial
  CRISPR gRNA sequence
attagtgacaatctaaagca

SEQ ID NO: 366497 - DNA, 20 bp, Artificial
  CRISPR gRNA sequence
tctaaagcagggaatatttt

SEQ ID NO: 366498 - DNA, 20 bp, Artificial
  CRISPR gRNA sequence
ggaactgtgtgtttcttgtg

SEQ ID NO: 366499 - DNA, 20 bp, Artificial
  CRISPR gRNA sequence
tgtctctcaaattatactca

SEQ ID NO: 366500 - DNA, 20 bp, Artificial
  CRISPR gRNA sequence
aaattatactcatggctgta

SEQ ID NO: 366501 - DNA, 20 bp, Artificial
  CRISPR gRNA sequence
attatactcatggctgtaca

SEQ ID NO: 366502 - DNA, 20 bp, Artificial
  CRISPR gRNA sequence
atactcatggctgtacagag

SEQ ID NO: 366503 - DNA, 20 bp, Artificial
  CRISPR gRNA sequence
ttttatgacatctgacataa

SEQ ID NO: 366504 - DNA, 20 bp, Artificial
  CRISPR gRNA sequence
cataatagtgctttattttt

SEQ ID NO: 366505 - DNA, 20 bp, Artificial
  CRISPR gRNA sequence
ataatagtgctttattttta

SEQ ID NO: 366506 - DNA, 20 bp, Artificial
  CRISPR gRNA sequence
taatagtgctttatttttaa

SEQ ID NO: 366507 - DNA, 20 bp, Artificial
  CRISPR gRNA sequence
ttaagggatctgtgctctaa

SEQ ID NO: 366508 - DNA, 20 bp, Artificial
  CRISPR gRNA sequence
gatctgtgctctaaaagaac

SEQ ID NO: 366509 - DNA, 20 bp, Artificial
  CRISPR gRNA sequence
gtgctctaaaagaacaagta

SEQ ID NO: 366510 - DNA, 20 bp, Artificial
  CRISPR gRNA sequence
gaacaagtacagaattatat

SEQ ID NO: 366511 - DNA, 20 bp, Artificial
  CRISPR gRNA sequence
aacaagtacagaattatatg

SEQ ID NO: 366512 - DNA, 20 bp, Artificial
  CRISPR gRNA sequence
attatatgaggaatatcaaa

SEQ ID NO: 366513 - DNA, 20 bp, Artificial
  CRISPR gRNA sequence
tatgaggaatatcaaatggt

SEQ ID NO: 366514 - DNA, 20 bp, Artificial
  CRISPR gRNA sequence
atgaggaatatcaaatggtc

SEQ ID NO: 366515 - DNA, 20 bp, Artificial
  CRISPR gRNA sequence
gaggaatatcaaatggtcag

SEQ ID NO: 366516 - DNA, 20 bp, Artificial
  CRISPR gRNA sequence
atatcaaatggtcaggagat

SEQ ID NO: 366517 - DNA, 20 bp, Artificial
  CRISPR gRNA sequence
aagaaacatcttcatatatt

SEQ ID NO: 366518 - DNA, 20 bp, Artificial
  CRISPR gRNA sequence
tttagttttccctttctctt

SEQ ID NO: 366519 - DNA, 20 bp, Artificial
  CRISPR gRNA sequence
ttagttttccctttctcttt

SEQ ID NO: 366520 - DNA, 20 bp, Artificial
  CRISPR gRNA sequence
tttccctttctctttaggtg

SEQ ID NO: 366521 - DNA, 20 bp, Artificial
  CRISPR gRNA sequence
cctttctctttaggtgtagc

SEQ ID NO: 366522 - DNA, 20 bp, Artificial
  CRISPR gRNA sequence
ctttctctttaggtgtagct

SEQ ID NO: 366523 - DNA, 20 bp, Artificial
  CRISPR gRNA sequence
tttctctttaggtgtagcta

SEQ ID NO: 366524 - DNA, 20 bp, Artificial
  CRISPR gRNA sequence
ctttaggtgtagctagggtg

SEQ ID NO: 366525 - DNA, 20 bp, Artificial
  CRISPR gRNA sequence
gaagactaattttgtgtata

SEQ ID NO: 366526 - DNA, 20 bp, Artificial
  CRISPR gRNA sequence
ctaattttgtgtatatagct

SEQ ID NO: 366527 - DNA, 20 bp, Artificial
  CRISPR gRNA sequence
taattttgtgtatatagctg

SEQ ID NO: 366528 - DNA, 20 bp, Artificial
  CRISPR gRNA sequence
gtgtatatagctgaggctta

SEQ ID NO: 366529 - DNA, 20 bp, Artificial
  CRISPR gRNA sequence
gtatatagctgaggcttata

SEQ ID NO: 366530 - DNA, 20 bp, Artificial
  CRISPR gRNA sequence
gtcaatttacaatgtttctt

SEQ ID NO: 366531 - DNA, 20 bp, Artificial
  CRISPR gRNA sequence
agttaaatgtttatttatta

SEQ ID NO: 366532 - DNA, 20 bp, Artificial
  CRISPR gRNA sequence
aagactctgtttcaccatac

SEQ ID NO: 366533 - DNA, 20 bp, Artificial
  CRISPR gRNA sequence
tcctcatttgctgttgtatg

SEQ ID NO: 366534 - DNA, 20 bp, Artificial
  CRISPR gRNA sequence
gacacctgttaaatcctgct

SEQ ID NO: 366535 - DNA, 20 bp, Artificial
  CRISPR gRNA sequence
acctgttaaatcctgcttgg

SEQ ID NO: 366536 - DNA, 20 bp, Artificial
  CRISPR gRNA sequence
gcttggaagtttttactgtg

SEQ ID NO: 366537 - DNA, 20 bp, Artificial
  CRISPR gRNA sequence
ctgtgtagtttgctataaat

SEQ ID NO: 366538 - DNA, 20 bp, Artificial
  CRISPR gRNA sequence
gtagtttgctataaatcagt

SEQ ID NO: 366539 - DNA, 20 bp, Artificial
  CRISPR gRNA sequence
tagtttgctataaatcagtc

SEQ ID NO: 366540 - DNA, 20 bp, Artificial
  CRISPR gRNA sequence
tttgctataaatcagtcagg

SEQ ID NO: 366541 - DNA, 20 bp, Artificial
  CRISPR gRNA sequence
ttgctataaatcagtcaggc

SEQ ID NO: 366542 - DNA, 20 bp, Artificial
  CRISPR gRNA sequence
ataaatcagtcaggcaggcg

SEQ ID NO: 366543 - DNA, 20 bp, Artificial
  CRISPR gRNA sequence
aatcagtcaggcaggcgaag

SEQ ID NO: 366544 - DNA, 20 bp, Artificial
  CRISPR gRNA sequence
cagtcaggcaggcgaagtag

SEQ ID NO: 366545 - DNA, 20 bp, Artificial
  CRISPR gRNA sequence
aggcaggcgaagtagaagat

SEQ ID NO: 366546 - DNA, 20 bp, Artificial
  CRISPR gRNA sequence
ggcgaagtagaagattggca

SEQ ID NO: 366547 - DNA, 20 bp, Artificial
  CRISPR gRNA sequence
gattggcaaagcttttaaca

SEQ ID NO: 366548 - DNA, 20 bp, Artificial
  CRISPR gRNA sequence
caaagcttttaacatagact

SEQ ID NO: 366549 - DNA, 20 bp, Artificial
  CRISPR gRNA sequence
tttaacatagactgagccat

SEQ ID NO: 366550 - DNA, 20 bp, Artificial
  CRISPR gRNA sequence
tagactgagccattggaaac

SEQ ID NO: 366551 - DNA, 20 bp, Artificial
  CRISPR gRNA sequence
agactgagccattggaaaca

SEQ ID NO: 366552 - DNA, 20 bp, Artificial
  CRISPR gRNA sequence
agccattggaaacaaggcct

SEQ ID NO: 366553 - DNA, 20 bp, Artificial
  CRISPR gRNA sequence
aaacaaggcctgagccacca

SEQ ID NO: 366554 - DNA, 20 bp, Artificial
  CRISPR gRNA sequence
aaggcctgagccaccaaagc

SEQ ID NO: 366555 - DNA, 20 bp, Artificial
  CRISPR gRNA sequence
ctgagccaccaaagctagaa

SEQ ID NO: 366556 - DNA, 20 bp, Artificial
  CRISPR gRNA sequence
tgagccaccaaagctagaac

SEQ ID NO: 366557 - DNA, 20 bp, Artificial
  CRISPR gRNA sequence
ctccccactgctgccttgtg

SEQ ID NO: 366558 - DNA, 20 bp, Artificial
  CRISPR gRNA sequence
ccttgtgtggtatgccttta

SEQ ID NO: 366559 - DNA, 20 bp, Artificial
  CRISPR gRNA sequence
tgtggtatgcctttaaagtt

SEQ ID NO: 366560 - DNA, 20 bp, Artificial
  CRISPR gRNA sequence
gtggtatgcctttaaagttt

SEQ ID NO: 366561 - DNA, 20 bp, Artificial
  CRISPR gRNA sequence
ttaaagtttgggttccaaat

SEQ ID NO: 366562 - DNA, 20 bp, Artificial
  CRISPR gRNA sequence
gggttccaaattagctgttt

SEQ ID NO: 366563 - DNA, 20 bp, Artificial
  CRISPR gRNA sequence
agctgttttggtttctgtca

SEQ ID NO: 366564 - DNA, 20 bp, Artificial
  CRISPR gRNA sequence
gctgttttggtttctgtcac

SEQ ID NO: 366565 - DNA, 20 bp, Artificial
  CRISPR gRNA sequence
acaggacaaccaattgaaaa

SEQ ID NO: 366566 - DNA, 20 bp, Artificial
  CRISPR gRNA sequence
ttgaaaacagctcaaccttt

SEQ ID NO: 366567 - DNA, 20 bp, Artificial
  CRISPR gRNA sequence
tgaaaacagctcaacctttc

SEQ ID NO: 366568 - DNA, 20 bp, Artificial
  CRISPR gRNA sequence
aacagctcaacctttcagga

SEQ ID NO: 366569 - DNA, 20 bp, Artificial
  CRISPR gRNA sequence
cagctcaacctttcaggata

SEQ ID NO: 366570 - DNA, 20 bp, Artificial
  CRISPR gRNA sequence
agctcaacctttcaggatag

SEQ ID NO: 366571 - DNA, 20 bp, Artificial
  CRISPR gRNA sequence
caacctttcaggatagagga

SEQ ID NO: 366572 - DNA, 20 bp, Artificial
  CRISPR gRNA sequence
acctttcaggatagaggatg

SEQ ID NO: 366573 - DNA, 20 bp, Artificial
  CRISPR gRNA sequence
tagaggatggagctaacctg

SEQ ID NO: 366574 - DNA, 20 bp, Artificial
  CRISPR gRNA sequence
gaggatggagctaacctgta

SEQ ID NO: 366575 - DNA, 20 bp, Artificial
  CRISPR gRNA sequence
acctgtagagaactaaatga

SEQ ID NO: 366576 - DNA, 20 bp, Artificial
  CRISPR gRNA sequence
taaatgatggttgttatgca

SEQ ID NO: 366577 - DNA, 20 bp, Artificial
  CRISPR gRNA sequence
aaatgatggttgttatgcaa

SEQ ID NO: 366578 - DNA, 20 bp, Artificial
  CRISPR gRNA sequence
tgatggttgttatgcaaagg

SEQ ID NO: 366579 - DNA, 20 bp, Artificial
  CRISPR gRNA sequence
gatggttgttatgcaaaggt

SEQ ID NO: 366580 - DNA, 20 bp, Artificial
  CRISPR gRNA sequence
tttttaacatcacatatgaa

SEQ ID NO: 366581 - DNA, 20 bp, Artificial
  CRISPR gRNA sequence
catcacatatgaatagtctt

SEQ ID NO: 366582 - DNA, 20 bp, Artificial
  CRISPR gRNA sequence
tatttcctgttgttttcatc

SEQ ID NO: 366583 - DNA, 20 bp, Artificial
  CRISPR gRNA sequence
tccagatttgtcattactgc

SEQ ID NO: 366584 - DNA, 20 bp, Artificial
  CRISPR gRNA sequence
tgtcattactgctagttttt

SEQ ID NO: 366585 - DNA, 20 bp, Artificial
  CRISPR gRNA sequence
gtcattactgctagtttttg

SEQ ID NO: 366586 - DNA, 20 bp, Artificial
  CRISPR gRNA sequence
ttactgctagtttttgaggt

SEQ ID NO: 366587 - DNA, 20 bp, Artificial
  CRISPR gRNA sequence
tactgctagtttttgaggtt

SEQ ID NO: 366588 - DNA, 20 bp, Artificial
  CRISPR gRNA sequence
ctagtttttgaggttaggaa

SEQ ID NO: 366589 - DNA, 20 bp, Artificial
  CRISPR gRNA sequence
agtttttgaggttaggaaaa

SEQ ID NO: 366590 - DNA, 20 bp, Artificial
  CRISPR gRNA sequence
tttttgaggttaggaaaaga

SEQ ID NO: 366591 - DNA, 20 bp, Artificial
  CRISPR gRNA sequence
aaagagagctgtcaccttca

SEQ ID NO: 366592 - DNA, 20 bp, Artificial
  CRISPR gRNA sequence
aagagagctgtcaccttcat

SEQ ID NO: 366593 - DNA, 20 bp, Artificial
  CRISPR gRNA sequence
agagagctgtcaccttcatg

SEQ ID NO: 366594 - DNA, 20 bp, Artificial
  CRISPR gRNA sequence
gggcttaaaaaaatacaatg

SEQ ID NO: 366595 - DNA, 20 bp, Artificial
  CRISPR gRNA sequence
gcttaaaaaaatacaatgtg

SEQ ID NO: 366596 - DNA, 20 bp, Artificial
  CRISPR gRNA sequence
aaatacaatgtggagatttt

SEQ ID NO: 366597 - DNA, 20 bp, Artificial
  CRISPR gRNA sequence
acaatgtggagattttcagt

SEQ ID NO: 366598 - DNA, 20 bp, Artificial
  CRISPR gRNA sequence
ggagattttcagtcagtttt

SEQ ID NO: 366599 - DNA, 20 bp, Artificial
  CRISPR gRNA sequence
attttcagtcagttttcagt

SEQ ID NO: 366600 - DNA, 20 bp, Artificial
  CRISPR gRNA sequence
tttcagtcagttttcagtca

SEQ ID NO: 366601 - DNA, 20 bp, Artificial
  CRISPR gRNA sequence
ttcagtcagttttcagtcag

SEQ ID NO: 366602 - DNA, 20 bp, Artificial
  CRISPR gRNA sequence
agtcagttttcagtcagagg

SEQ ID NO: 366603 - DNA, 20 bp, Artificial
  CRISPR gRNA sequence
gtcagttttcagtcagagga

SEQ ID NO: 366604 - DNA, 20 bp, Artificial
  CRISPR gRNA sequence
tcagtcagaggaaggaatac

SEQ ID NO: 366605 - DNA, 20 bp, Artificial
  CRISPR gRNA sequence
aggaataccggctgtccgtc

SEQ ID NO: 366606 - DNA, 20 bp, Artificial
  CRISPR gRNA sequence
ctagtttgaattcttcatga

SEQ ID NO: 366607 - DNA, 20 bp, Artificial
  CRISPR gRNA sequence
attcttcatgatggtatcct

SEQ ID NO: 366608 - DNA, 20 bp, Artificial
  CRISPR gRNA sequence
ttttgattatttgtatttta

SEQ ID NO: 366609 - DNA, 20 bp, Artificial
  CRISPR gRNA sequence
ttgattatttgtattttaaa

SEQ ID NO: 366610 - DNA, 20 bp, Artificial
  CRISPR gRNA sequence
attatttgtattttaaagag

SEQ ID NO: 366611 - DNA, 20 bp, Artificial
  CRISPR gRNA sequence
taaagagcagattgatgcaa

SEQ ID NO: 366612 - DNA, 20 bp, Artificial
  CRISPR gRNA sequence
aaagagcagattgatgcaat

SEQ ID NO: 366613 - DNA, 20 bp, Artificial
  CRISPR gRNA sequence
agcagattgatgcaatgggc

SEQ ID NO: 366614 - DNA, 20 bp, Artificial
  CRISPR gRNA sequence
gattgatgcaatgggctagt

SEQ ID NO: 366615 - DNA, 20 bp, Artificial
  CRISPR gRNA sequence
attgatgcaatgggctagtg

SEQ ID NO: 366616 - DNA, 20 bp, Artificial
  CRISPR gRNA sequence
ttgatgcaatgggctagtga

SEQ ID NO: 366617 - DNA, 20 bp, Artificial
  CRISPR gRNA sequence
agggcattctaccctatttt

SEQ ID NO: 366618 - DNA, 20 bp, Artificial
  CRISPR gRNA sequence
ggcattctaccctattttga

SEQ ID NO: 366619 - DNA, 20 bp, Artificial
  CRISPR gRNA sequence
ctaccctattttgagagttt

SEQ ID NO: 366620 - DNA, 20 bp, Artificial
  CRISPR gRNA sequence
accctattttgagagtttga

SEQ ID NO: 366621 - DNA, 20 bp, Artificial
  CRISPR gRNA sequence
gagcttcacttttttaaact

SEQ ID NO: 366622 - DNA, 20 bp, Artificial
  CRISPR gRNA sequence
cttttttaaactaagaatga

SEQ ID NO: 366623 - DNA, 20 bp, Artificial
  CRISPR gRNA sequence
tttaaactaagaatgatagt

SEQ ID NO: 366624 - DNA, 20 bp, Artificial
  CRISPR gRNA sequence
atagtgagtttaaaaaatat

SEQ ID NO: 366625 - DNA, 20 bp, Artificial
  CRISPR gRNA sequence
ttgtatttcaaaattaacct

SEQ ID NO: 366626 - DNA, 20 bp, Artificial
  CRISPR gRNA sequence
tgtatttcaaaattaacctt

SEQ ID NO: 366627 - DNA, 20 bp, Artificial
  CRISPR gRNA sequence
tgaaattttcttatgtactt

SEQ ID NO: 366628 - DNA, 20 bp, Artificial
  CRISPR gRNA sequence
gtacttcagtaacaacatac

SEQ ID NO: 366629 - DNA, 20 bp, Artificial
  CRISPR gRNA sequence
tacttcagtaacaacatact

SEQ ID NO: 366630 - DNA, 20 bp, Artificial
  CRISPR gRNA sequence
ttgtacttttgtatactgta

SEQ ID NO: 366631 - DNA, 20 bp, Artificial
  CRISPR gRNA sequence
tgtacttttgtatactgtaa

SEQ ID NO: 366632 - DNA, 20 bp, Artificial
  CRISPR gRNA sequence
gtacttttgtatactgtaaa

SEQ ID NO: 366633 - DNA, 20 bp, Artificial
  CRISPR gRNA sequence
tacttttgtatactgtaaag

SEQ ID NO: 366634 - DNA, 20 bp, Artificial
  CRISPR gRNA sequence
acttttgtatactgtaaagg

SEQ ID NO: 366635 - DNA, 20 bp, Artificial
  CRISPR gRNA sequence
ttttgtatactgtaaagggg

SEQ ID NO: 366636 - DNA, 20 bp, Artificial
  CRISPR gRNA sequence
ggagttgaaaatacattaaa

SEQ ID NO: 366637 - DNA, 20 bp, Artificial
  CRISPR gRNA sequence
atagtaaaaaaaaaaaaaaa

SEQ ID NO: 366638 - DNA, 20 bp, Artificial
  CRISPR gRNA sequence
aaaaaaaaaaaaaaaagact

SEQ ID NO: 366639 - DNA, 20 bp, Artificial
  CRISPR gRNA sequence
aaaaaaaaagacttggaatc

SEQ ID NO: 366640 - DNA, 20 bp, Artificial
  CRISPR gRNA sequence
gacttggaatctagaaatcc

SEQ ID NO: 366641 - DNA, 20 bp, Artificial
  CRISPR gRNA sequence
agaaatcctagtttgtataa

SEQ ID NO: 366642 - DNA, 20 bp, Artificial
  CRISPR gRNA sequence
tagtttgtataatggattgt

SEQ ID NO: 366643 - DNA, 20 bp, Artificial
  CRISPR gRNA sequence
ataatggattgtaagaactt

SEQ ID NO: 366644 - DNA, 20 bp, Artificial
  CRISPR gRNA sequence
atggattgtaagaacttcag

SEQ ID NO: 366645 - DNA, 20 bp, Artificial
  CRISPR gRNA sequence
tggattgtaagaacttcaga

SEQ ID NO: 366646 - DNA, 20 bp, Artificial
  CRISPR gRNA sequence
gtaagaacttcagaaggatg

SEQ ID NO: 366647 - DNA, 20 bp, Artificial
  CRISPR gRNA sequence
taagaacttcagaaggatga

SEQ ID NO: 366648 - DNA, 20 bp, Artificial
  CRISPR gRNA sequence
agaacttcagaaggatgaag

SEQ ID NO: 366649 - DNA, 20 bp, Artificial
  CRISPR gRNA sequence
cttcagaaggatgaaggagt

SEQ ID NO: 366650 - DNA, 20 bp, Artificial
  CRISPR gRNA sequence
ttcagaaggatgaaggagtt

SEQ ID NO: 366651 - DNA, 20 bp, Artificial
  CRISPR gRNA sequence
gattttttgctatttattga

SEQ ID NO: 366652 - DNA, 20 bp, Artificial
  CRISPR gRNA sequence
tattgatagcttattatgtg

SEQ ID NO: 366653 - DNA, 20 bp, Artificial
  CRISPR gRNA sequence
attatgtgcggaattttaca

SEQ ID NO: 366654 - DNA, 20 bp, Artificial
  CRISPR gRNA sequence
gtgcggaattttacatagtc

SEQ ID NO: 366655 - DNA, 20 bp, Artificial
  CRISPR gRNA sequence
ttacatagtctggatcttca

SEQ ID NO: 366656 - DNA, 20 bp, Artificial
  CRISPR gRNA sequence
gtttgtattgcctgatttta

SEQ ID NO: 366657 - DNA, 20 bp, Artificial
  CRISPR gRNA sequence
ttttacagatgatgacattg

SEQ ID NO: 366658 - DNA, 20 bp, Artificial
  CRISPR gRNA sequence
cagatgatgacattgaagtg

SEQ ID NO: 366659 - DNA, 20 bp, Artificial
  CRISPR gRNA sequence
tgatgacattgaagtgcagt

SEQ ID NO: 366660 - DNA, 20 bp, Artificial
  CRISPR gRNA sequence
gatgacattgaagtgcagtg

SEQ ID NO: 366661 - DNA, 20 bp, Artificial
  CRISPR gRNA sequence
cattgaagtgcagtgaggtc

SEQ ID NO: 366662 - DNA, 20 bp, Artificial
  CRISPR gRNA sequence
tgaagtgcagtgaggtctag

SEQ ID NO: 366663 - DNA, 20 bp, Artificial
  CRISPR gRNA sequence
tgaggtctagtagtctttcc

SEQ ID NO: 366664 - DNA, 20 bp, Artificial
  CRISPR gRNA sequence
gaggtctagtagtctttcca

SEQ ID NO: 366665 - DNA, 20 bp, Artificial
  CRISPR gRNA sequence
agtagtctttccaaggccct

SEQ ID NO: 366666 - DNA, 20 bp, Artificial
  CRISPR gRNA sequence
cctaagtttcacgtatgtcc

SEQ ID NO: 366667 - DNA, 20 bp, Artificial
  CRISPR gRNA sequence
aagtttcacgtatgtcccag

SEQ ID NO: 366668 - DNA, 20 bp, Artificial
  CRISPR gRNA sequence
cacgtatgtcccagcagata

SEQ ID NO: 366669 - DNA, 20 bp, Artificial
  CRISPR gRNA sequence
ttgcaaattgatgtaactgt

SEQ ID NO: 366670 - DNA, 20 bp, Artificial
  CRISPR gRNA sequence
aattgatgtaactgtcagcc

SEQ ID NO: 366671 - DNA, 20 bp, Artificial
  CRISPR gRNA sequence
attgatgtaactgtcagcct

SEQ ID NO: 366672 - DNA, 20 bp, Artificial
  CRISPR gRNA sequence
ttgatgtaactgtcagcctg

SEQ ID NO: 366673 - DNA, 20 bp, Artificial
  CRISPR gRNA sequence
tgatgtaactgtcagcctgg

SEQ ID NO: 366674 - DNA, 20 bp, Artificial
  CRISPR gRNA sequence
aactgtcagcctgggggaca

SEQ ID NO: 366675 - DNA, 20 bp, Artificial
  CRISPR gRNA sequence
actgtcagcctgggggacat

SEQ ID NO: 366676 - DNA, 20 bp, Artificial
  CRISPR gRNA sequence
tgggggacatgggaacccac

SEQ ID NO: 366677 - DNA, 20 bp, Artificial
  CRISPR gRNA sequence
gggggacatgggaacccacc

SEQ ID NO: 366678 - DNA, 20 bp, Artificial
  CRISPR gRNA sequence
ggggacatgggaacccacca

SEQ ID NO: 366679 - DNA, 20 bp, Artificial
  CRISPR gRNA sequence
ggaacccaccagggcccttg

SEQ ID NO: 366680 - DNA, 20 bp, Artificial
  CRISPR gRNA sequence
acccaccagggcccttgaag

SEQ ID NO: 366681 - DNA, 20 bp, Artificial
  CRISPR gRNA sequence
cccaccagggcccttgaaga

SEQ ID NO: 366682 - DNA, 20 bp, Artificial
  CRISPR gRNA sequence
caccagggcccttgaagaag

SEQ ID NO: 366683 - DNA, 20 bp, Artificial
  CRISPR gRNA sequence
gcccttgaagaaggagacct

SEQ ID NO: 366684 - DNA, 20 bp, Artificial
  CRISPR gRNA sequence
ctatcaatgctacccctctc

SEQ ID NO: 366685 - DNA, 20 bp, Artificial
  CRISPR gRNA sequence
tgctacccctctccagcttt

SEQ ID NO: 366686 - DNA, 20 bp, Artificial
  CRISPR gRNA sequence
cccctctccagctttcagcc

SEQ ID NO: 366687 - DNA, 20 bp, Artificial
  CRISPR gRNA sequence
cctctccagctttcagccta

SEQ ID NO: 366688 - DNA, 20 bp, Artificial
  CRISPR gRNA sequence
cagctttcagcctagagttt

SEQ ID NO: 366689 - DNA, 20 bp, Artificial
  CRISPR gRNA sequence
gctttcagcctagagtttaa

SEQ ID NO: 366690 - DNA, 20 bp, Artificial
  CRISPR gRNA sequence
gcctagagtttaagagcaaa

SEQ ID NO: 366691 - DNA, 20 bp, Artificial
  CRISPR gRNA sequence
cctagagtttaagagcaaac

SEQ ID NO: 366692 - DNA, 20 bp, Artificial
  CRISPR gRNA sequence
gacatcttattctgaataaa

SEQ ID NO: 366693 - DNA, 20 bp, Artificial
  CRISPR gRNA sequence
taaatggtactactaataca

SEQ ID NO: 366694 - DNA, 20 bp, Artificial
  CRISPR gRNA sequence
ttgaaaatatgtgttctttc

SEQ ID NO: 366695 - DNA, 20 bp, Artificial
  CRISPR gRNA sequence
aatatgtgttctttccagaa

SEQ ID NO: 366696 - DNA, 20 bp, Artificial
  CRISPR gRNA sequence
atatgtgttctttccagaac

SEQ ID NO: 366697 - DNA, 20 bp, Artificial
  CRISPR gRNA sequence
cagaacaggcatttcttcat

SEQ ID NO: 366698 - DNA, 20 bp, Artificial
  CRISPR gRNA sequence
ttcttcattagcaattgatt

SEQ ID NO: 366699 - DNA, 20 bp, Artificial
  CRISPR gRNA sequence
cttcattagcaattgattta

SEQ ID NO: 366700 - DNA, 20 bp, Artificial
  CRISPR gRNA sequence
aattgatttagagactctga

SEQ ID NO: 366701 - DNA, 20 bp, Artificial
  CRISPR gRNA sequence
gatttagagactctgatggt

SEQ ID NO: 366702 - DNA, 20 bp, Artificial
  CRISPR gRNA sequence
taaatgcatttgtttttacc

SEQ ID NO: 366703 - DNA, 20 bp, Artificial
  CRISPR gRNA sequence
tttgtttttacctagtttgt

SEQ ID NO: 366704 - DNA, 20 bp, Artificial
  CRISPR gRNA sequence
ctagtttgtgagaaaatatg

SEQ ID NO: 366705 - DNA, 20 bp, Artificial
  CRISPR gRNA sequence
agtttgtgagaaaatatgca

SEQ ID NO: 366706 - DNA, 20 bp, Artificial
  CRISPR gRNA sequence
gaaaatatgcagagatgact

SEQ ID NO: 366707 - DNA, 20 bp, Artificial
  CRISPR gRNA sequence
aaaatatgcagagatgactt

SEQ ID NO: 366708 - DNA, 20 bp, Artificial
  CRISPR gRNA sequence
aaatatgcagagatgacttg

SEQ ID NO: 366709 - DNA, 20 bp, Artificial
  CRISPR gRNA sequence
aatatgcagagatgacttgg

SEQ ID NO: 366710 - DNA, 20 bp, Artificial
  CRISPR gRNA sequence
acttgggggaccacattttc

SEQ ID NO: 366711 - DNA, 20 bp, Artificial
  CRISPR gRNA sequence
gggggaccacattttccaga

SEQ ID NO: 366712 - DNA, 20 bp, Artificial
  CRISPR gRNA sequence
attttccagatagccctttc

SEQ ID NO: 366713 - DNA, 20 bp, Artificial
  CRISPR gRNA sequence
ttccagatagccctttctag

SEQ ID NO: 366714 - DNA, 20 bp, Artificial
  CRISPR gRNA sequence
ccagatagccctttctagca

SEQ ID NO: 366715 - DNA, 20 bp, Artificial
  CRISPR gRNA sequence
ccctttctagcagagtttgt

SEQ ID NO: 366716 - DNA, 20 bp, Artificial
  CRISPR gRNA sequence
cctttctagcagagtttgtg

SEQ ID NO: 366717 - DNA, 20 bp, Artificial
  CRISPR gRNA sequence
tagcagagtttgtgaggtca

SEQ ID NO: 366718 - DNA, 20 bp, Artificial
  CRISPR gRNA sequence
gcagagtttgtgaggtcatg

SEQ ID NO: 366719 - DNA, 20 bp, Artificial
  CRISPR gRNA sequence
tactgtcacctacgtgtctc

SEQ ID NO: 366720 - DNA, 20 bp, Artificial
  CRISPR gRNA sequence
ctacgtgtctctggctttat

SEQ ID NO: 366721 - DNA, 20 bp, Artificial
  CRISPR gRNA sequence
gtgtctctggctttattagt

SEQ ID NO: 366722 - DNA, 20 bp, Artificial
  CRISPR gRNA sequence
ctggctttattagtcagtta

SEQ ID NO: 366723 - DNA, 20 bp, Artificial
  CRISPR gRNA sequence
ttagtcagttaaagcaaata

SEQ ID NO: 366724 - DNA, 20 bp, Artificial
  CRISPR gRNA sequence
agcaaatatagttgcattta

SEQ ID NO: 366725 - DNA, 20 bp, Artificial
  CRISPR gRNA sequence
tacagaaatacccccaaaat

SEQ ID NO: 366726 - DNA, 20 bp, Artificial
  CRISPR gRNA sequence
cccaaaatgagtgacccact

SEQ ID NO: 366727 - DNA, 20 bp, Artificial
  CRISPR gRNA sequence
actcagaatgctctgccacc

SEQ ID NO: 366728 - DNA, 20 bp, Artificial
  CRISPR gRNA sequence
ctctgccacctagtgtttac

SEQ ID NO: 366729 - DNA, 20 bp, Artificial
  CRISPR gRNA sequence
tctgccacctagtgtttact

SEQ ID NO: 366730 - DNA, 20 bp, Artificial
  CRISPR gRNA sequence
tttactgggtgcctgctctg

SEQ ID NO: 366731 - DNA, 20 bp, Artificial
  CRISPR gRNA sequence
ttactgggtgcctgctctgt

SEQ ID NO: 366732 - DNA, 20 bp, Artificial
  CRISPR gRNA sequence
catttcatttaatccttatg

SEQ ID NO: 366733 - DNA, 20 bp, Artificial
  CRISPR gRNA sequence
ttaatccttatgaagcacta

SEQ ID NO: 366734 - DNA, 20 bp, Artificial
  CRISPR gRNA sequence
taatccttatgaagcactat

SEQ ID NO: 366735 - DNA, 20 bp, Artificial
  CRISPR gRNA sequence
aatccttatgaagcactatg

SEQ ID NO: 366736 - DNA, 20 bp, Artificial
  CRISPR gRNA sequence
tccttatgaagcactatggg

SEQ ID NO: 366737 - DNA, 20 bp, Artificial
  CRISPR gRNA sequence
ccttatgaagcactatgggg

SEQ ID NO: 366738 - DNA, 20 bp, Artificial
  CRISPR gRNA sequence
aatatgttcccgtaatacaa

SEQ ID NO: 366739 - DNA, 20 bp, Artificial
  CRISPR gRNA sequence
atgttcccgtaatacaacag

SEQ ID NO: 366740 - DNA, 20 bp, Artificial
  CRISPR gRNA sequence
gtaatacaacagaagacact

SEQ ID NO: 366741 - DNA, 20 bp, Artificial
  CRISPR gRNA sequence
taatacaacagaagacactg

SEQ ID NO: 366742 - DNA, 20 bp, Artificial
  CRISPR gRNA sequence
caacagaagacactgaggtt

SEQ ID NO: 366743 - DNA, 20 bp, Artificial
  CRISPR gRNA sequence
aacagaagacactgaggttc

SEQ ID NO: 366744 - DNA, 20 bp, Artificial
  CRISPR gRNA sequence
acagaagacactgaggttca

SEQ ID NO: 366745 - DNA, 20 bp, Artificial
  CRISPR gRNA sequence
gaagacactgaggttcaggg

SEQ ID NO: 366746 - DNA, 20 bp, Artificial
  CRISPR gRNA sequence
gacactgaggttcagggtgg

SEQ ID NO: 366747 - DNA, 20 bp, Artificial
  CRISPR gRNA sequence
ggtggtagactcacttgtcc

SEQ ID NO: 366748 - DNA, 20 bp, Artificial
  CRISPR gRNA sequence
gtggtagactcacttgtcca

SEQ ID NO: 366749 - DNA, 20 bp, Artificial
  CRISPR gRNA sequence
ctcacttgtccaaggttatc

SEQ ID NO: 366750 - DNA, 20 bp, Artificial
  CRISPR gRNA sequence
tccaaggttatcaagctgcc

SEQ ID NO: 366751 - DNA, 20 bp, Artificial
  CRISPR gRNA sequence
aaggttatcaagctgccaag

SEQ ID NO: 366752 - DNA, 20 bp, Artificial
  CRISPR gRNA sequence
gttatcaagctgccaagtgg

SEQ ID NO: 366753 - DNA, 20 bp, Artificial
  CRISPR gRNA sequence
aagctgccaagtggcagcac

SEQ ID NO: 366754 - DNA, 20 bp, Artificial
  CRISPR gRNA sequence
tggcagcaccagaatgaccc

SEQ ID NO: 366755 - DNA, 20 bp, Artificial
  CRISPR gRNA sequence
gaccccagttgatttttctg

SEQ ID NO: 366756 - DNA, 20 bp, Artificial
  CRISPR gRNA sequence
ccccagttgatttttctgaa

SEQ ID NO: 366757 - DNA, 20 bp, Artificial
  CRISPR gRNA sequence
agttgatttttctgaagagc

SEQ ID NO: 366758 - DNA, 20 bp, Artificial
  CRISPR gRNA sequence
ttgatttttctgaagagcca

SEQ ID NO: 366759 - DNA, 20 bp, Artificial
  CRISPR gRNA sequence
agagccagagatcttaactc

SEQ ID NO: 366760 - DNA, 20 bp, Artificial
  CRISPR gRNA sequence
gccagagatcttaactccag

SEQ ID NO: 366761 - DNA, 20 bp, Artificial
  CRISPR gRNA sequence
ttaactccagtggaatgaac

SEQ ID NO: 366762 - DNA, 20 bp, Artificial
  CRISPR gRNA sequence
taactccagtggaatgaacc

SEQ ID NO: 366763 - DNA, 20 bp, Artificial
  CRISPR gRNA sequence
aactccagtggaatgaacca

SEQ ID NO: 366764 - DNA, 20 bp, Artificial
  CRISPR gRNA sequence
ctccagtggaatgaaccagg

SEQ ID NO: 366765 - DNA, 20 bp, Artificial
  CRISPR gRNA sequence
tccagtggaatgaaccaggg

SEQ ID NO: 366766 - DNA, 20 bp, Artificial
  CRISPR gRNA sequence
ccagtggaatgaaccaggga

SEQ ID NO: 366767 - DNA, 20 bp, Artificial
  CRISPR gRNA sequence
gaatgaaccagggagggcca

SEQ ID NO: 366768 - DNA, 20 bp, Artificial
  CRISPR gRNA sequence
tgaaccagggagggccatgg

SEQ ID NO: 366769 - DNA, 20 bp, Artificial
  CRISPR gRNA sequence
aaccagggagggccatggta

SEQ ID NO: 366770 - DNA, 20 bp, Artificial
  CRISPR gRNA sequence
gggagggccatggtagagaa

SEQ ID NO: 366771 - DNA, 20 bp, Artificial
  CRISPR gRNA sequence
atggtagagaaaagtcgtgc

SEQ ID NO: 366772 - DNA, 20 bp, Artificial
  CRISPR gRNA sequence
aaaagtcgtgctggaccttg

SEQ ID NO: 366773 - DNA, 20 bp, Artificial
  CRISPR gRNA sequence
cgtgctggaccttgaagaat

SEQ ID NO: 366774 - DNA, 20 bp, Artificial
  CRISPR gRNA sequence
gctggaccttgaagaattgg

SEQ ID NO: 366775 - DNA, 20 bp, Artificial
  CRISPR gRNA sequence
ctggaccttgaagaattgga

SEQ ID NO: 366776 - DNA, 20 bp, Artificial
  CRISPR gRNA sequence
attggaaggaatattttaat

SEQ ID NO: 366777 - DNA, 20 bp, Artificial
  CRISPR gRNA sequence
tggaaggaatattttaatta

SEQ ID NO: 366778 - DNA, 20 bp, Artificial
  CRISPR gRNA sequence
gaaggaatattttaattaga

SEQ ID NO: 366779 - DNA, 20 bp, Artificial
  CRISPR gRNA sequence
aaggaatattttaattagag

SEQ ID NO: 366780 - DNA, 20 bp, Artificial
  CRISPR gRNA sequence
aatattttaattagagaggc

SEQ ID NO: 366781 - DNA, 20 bp, Artificial
  CRISPR gRNA sequence
atattttaattagagaggcc

SEQ ID NO: 366782 - DNA, 20 bp, Artificial
  CRISPR gRNA sequence
tattttaattagagaggccg

SEQ ID NO: 366783 - DNA, 20 bp, Artificial
  CRISPR gRNA sequence
taattagagaggccggggtc

SEQ ID NO: 366784 - DNA, 20 bp, Artificial
  CRISPR gRNA sequence
aattagagaggccggggtct

SEQ ID NO: 366785 - DNA, 20 bp, Artificial
  CRISPR gRNA sequence
attagagaggccggggtctg

SEQ ID NO: 366786 - DNA, 20 bp, Artificial
  CRISPR gRNA sequence
agagaggccggggtctgggg

SEQ ID NO: 366787 - DNA, 20 bp, Artificial
  CRISPR gRNA sequence
agaggccggggtctggggaa

SEQ ID NO: 366788 - DNA, 20 bp, Artificial
  CRISPR gRNA sequence
aggccggggtctggggaaga

SEQ ID NO: 366789 - DNA, 20 bp, Artificial
  CRISPR gRNA sequence
ccggggtctggggaagagag

SEQ ID NO: 366790 - DNA, 20 bp, Artificial
  CRISPR gRNA sequence
ggtctggggaagagagaaga

SEQ ID NO: 366791 - DNA, 20 bp, Artificial
  CRISPR gRNA sequence
tctggggaagagagaagaca

SEQ ID NO: 366792 - DNA, 20 bp, Artificial
  CRISPR gRNA sequence
tggggaagagagaagacaga

SEQ ID NO: 366793 - DNA, 20 bp, Artificial
  CRISPR gRNA sequence
ggggaagagagaagacagag

SEQ ID NO: 366794 - DNA, 20 bp, Artificial
  CRISPR gRNA sequence
gggaagagagaagacagaga

SEQ ID NO: 366795 - DNA, 20 bp, Artificial
  CRISPR gRNA sequence
aagagagaagacagagaggg

SEQ ID NO: 366796 - DNA, 20 bp, Artificial
  CRISPR gRNA sequence
agagagaagacagagaggga

SEQ ID NO: 366797 - DNA, 20 bp, Artificial
  CRISPR gRNA sequence
gagagaagacagagagggaa

SEQ ID NO: 366798 - DNA, 20 bp, Artificial
  CRISPR gRNA sequence
acagagagggaagggtgtcc

SEQ ID NO: 366799 - DNA, 20 bp, Artificial
  CRISPR gRNA sequence
cagagagggaagggtgtcct

SEQ ID NO: 366800 - DNA, 20 bp, Artificial
  CRISPR gRNA sequence
agagagggaagggtgtcctg

SEQ ID NO: 366801 - DNA, 20 bp, Artificial
  CRISPR gRNA sequence
gagagggaagggtgtcctgg

SEQ ID NO: 366802 - DNA, 20 bp, Artificial
  CRISPR gRNA sequence
gggtgtcctgggggtactga

SEQ ID NO: 366803 - DNA, 20 bp, Artificial
  CRISPR gRNA sequence
ctgggggtactgatggctta

SEQ ID NO: 366804 - DNA, 20 bp, Artificial
  CRISPR gRNA sequence
ggggtactgatggcttaaag

SEQ ID NO: 366805 - DNA, 20 bp, Artificial
  CRISPR gRNA sequence
gggtactgatggcttaaaga

SEQ ID NO: 366806 - DNA, 20 bp, Artificial
  CRISPR gRNA sequence
ggtactgatggcttaaagaa

SEQ ID NO: 366807 - DNA, 20 bp, Artificial
  CRISPR gRNA sequence
tgatggcttaaagaagggca

SEQ ID NO: 366808 - DNA, 20 bp, Artificial
  CRISPR gRNA sequence
tggcttaaagaagggcacag

SEQ ID NO: 366809 - DNA, 20 bp, Artificial
  CRISPR gRNA sequence
gcttaaagaagggcacagtg

SEQ ID NO: 366810 - DNA, 20 bp, Artificial
  CRISPR gRNA sequence
cttaaagaagggcacagtgg

SEQ ID NO: 366811 - DNA, 20 bp, Artificial
  CRISPR gRNA sequence
aagggcacagtggaggtgta

SEQ ID NO: 366812 - DNA, 20 bp, Artificial
  CRISPR gRNA sequence
tggaggtgtaaagttcatgt

SEQ ID NO: 366813 - DNA, 20 bp, Artificial
  CRISPR gRNA sequence
gaggtgtaaagttcatgtaa

SEQ ID NO: 366814 - DNA, 20 bp, Artificial
  CRISPR gRNA sequence
aggtgtaaagttcatgtaag

SEQ ID NO: 366815 - DNA, 20 bp, Artificial
  CRISPR gRNA sequence
tgtaaagttcatgtaagagg

SEQ ID NO: 366816 - DNA, 20 bp, Artificial
  CRISPR gRNA sequence
taaagttcatgtaagaggca

SEQ ID NO: 366817 - DNA, 20 bp, Artificial
  CRISPR gRNA sequence
ttcatgtaagaggcagagcc

SEQ ID NO: 366818 - DNA, 20 bp, Artificial
  CRISPR gRNA sequence
agagcctggccttctctgac

SEQ ID NO: 366819 - DNA, 20 bp, Artificial
  CRISPR gRNA sequence
gagcctggccttctctgact

SEQ ID NO: 366820 - DNA, 20 bp, Artificial
  CRISPR gRNA sequence
agcctggccttctctgacta

SEQ ID NO: 366821 - DNA, 20 bp, Artificial
  CRISPR gRNA sequence
gccttctctgactagggcac

SEQ ID NO: 366822 - DNA, 20 bp, Artificial
  CRISPR gRNA sequence
tctgactagggcactggatt

SEQ ID NO: 366823 - DNA, 20 bp, Artificial
  CRISPR gRNA sequence
ctagggcactggatttggat

SEQ ID NO: 366824 - DNA, 20 bp, Artificial
  CRISPR gRNA sequence
cactggatttggataagatg

SEQ ID NO: 366825 - DNA, 20 bp, Artificial
  CRISPR gRNA sequence
ataagatgtggttctcaccc

SEQ ID NO: 366826 - DNA, 20 bp, Artificial
  CRISPR gRNA sequence
taagatgtggttctcaccct

SEQ ID NO: 366827 - DNA, 20 bp, Artificial
  CRISPR gRNA sequence
tggttctcaccctgggctct

SEQ ID NO: 366828 - DNA, 20 bp, Artificial
  CRISPR gRNA sequence
ggttctcaccctgggctctg

SEQ ID NO: 366829 - DNA, 20 bp, Artificial
  CRISPR gRNA sequence
tctgaggccccctacaccca

SEQ ID NO: 366830 - DNA, 20 bp, Artificial
  CRISPR gRNA sequence
tgaggccccctacacccaca

SEQ ID NO: 366831 - DNA, 20 bp, Artificial
  CRISPR gRNA sequence
gaggccccctacacccacag

SEQ ID NO: 366832 - DNA, 20 bp, Artificial
  CRISPR gRNA sequence
gccccctacacccacagagg

SEQ ID NO: 366833 - DNA, 20 bp, Artificial
  CRISPR gRNA sequence
tacacccacagaggtggcct

SEQ ID NO: 366834 - DNA, 20 bp, Artificial
  CRISPR gRNA sequence
cacccacagaggtggcctga

SEQ ID NO: 366835 - DNA, 20 bp, Artificial
  CRISPR gRNA sequence
acccacagaggtggcctgag

SEQ ID NO: 366836 - DNA, 20 bp, Artificial
  CRISPR gRNA sequence
cacagaggtggcctgagagg

SEQ ID NO: 366837 - DNA, 20 bp, Artificial
  CRISPR gRNA sequence
tggcctgagaggcagcctcc

SEQ ID NO: 366838 - DNA, 20 bp, Artificial
  CRISPR gRNA sequence
ggcctgagaggcagcctccc

SEQ ID NO: 366839 - DNA, 20 bp, Artificial
  CRISPR gRNA sequence
tgagaggcagcctcccagga

SEQ ID NO: 366840 - DNA, 20 bp, Artificial
  CRISPR gRNA sequence
gagaggcagcctcccaggaa

SEQ ID NO: 366841 - DNA, 20 bp, Artificial
  CRISPR gRNA sequence
aggcagcctcccaggaaagg

SEQ ID NO: 366842 - DNA, 20 bp, Artificial
  CRISPR gRNA sequence
ccaggaaaggaagacactgt

SEQ ID NO: 366843 - DNA, 20 bp, Artificial
  CRISPR gRNA sequence
aggaaaggaagacactgtga

SEQ ID NO: 366844 - DNA, 20 bp, Artificial
  CRISPR gRNA sequence
aaggaagacactgtgagagt

SEQ ID NO: 366845 - DNA, 20 bp, Artificial
  CRISPR gRNA sequence
gactctctccctgcatgcac

SEQ ID NO: 366846 - DNA, 20 bp, Artificial
  CRISPR gRNA sequence
tctccctgcatgcaccagca

SEQ ID NO: 366847 - DNA, 20 bp, Artificial
  CRISPR gRNA sequence
ctccctgcatgcaccagcaa

SEQ ID NO: 366848 - DNA, 20 bp, Artificial
  CRISPR gRNA sequence
tccctgcatgcaccagcaaa

SEQ ID NO: 366849 - DNA, 20 bp, Artificial
  CRISPR gRNA sequence
ccctgcatgcaccagcaaag

SEQ ID NO: 366850 - DNA, 20 bp, Artificial
  CRISPR gRNA sequence
catgcaccagcaaaggggct

SEQ ID NO: 366851 - DNA, 20 bp, Artificial
  CRISPR gRNA sequence
gggctcagcttatgatactt

SEQ ID NO: 366852 - DNA, 20 bp, Artificial
  CRISPR gRNA sequence
gctcagcttatgatacttta

SEQ ID NO: 366853 - DNA, 20 bp, Artificial
  CRISPR gRNA sequence
cttatgatactttagagttt

SEQ ID NO: 366854 - DNA, 20 bp, Artificial
  CRISPR gRNA sequence
ttatgatactttagagtttc

SEQ ID NO: 366855 - DNA, 20 bp, Artificial
  CRISPR gRNA sequence
atactttagagtttcaggaa

SEQ ID NO: 366856 - DNA, 20 bp, Artificial
  CRISPR gRNA sequence
tagagtttcaggaaaagctt

SEQ ID NO: 366857 - DNA, 20 bp, Artificial
  CRISPR gRNA sequence
tttcaggaaaagctttagta

SEQ ID NO: 366858 - DNA, 20 bp, Artificial
  CRISPR gRNA sequence
caggaaaagctttagtacag

SEQ ID NO: 366859 - DNA, 20 bp, Artificial
  CRISPR gRNA sequence
agtagattctgtgcttgaaa

SEQ ID NO: 366860 - DNA, 20 bp, Artificial
  CRISPR gRNA sequence
gtagattctgtgcttgaaaa

SEQ ID NO: 366861 - DNA, 20 bp, Artificial
  CRISPR gRNA sequence
agattctgtgcttgaaaaag

SEQ ID NO: 366862 - DNA, 20 bp, Artificial
  CRISPR gRNA sequence
tgtgcttgaaaaaggagttg

SEQ ID NO: 366863 - DNA, 20 bp, Artificial
  CRISPR gRNA sequence
aaaaaggagttgcagctcac

SEQ ID NO: 366864 - DNA, 20 bp, Artificial
  CRISPR gRNA sequence
aaaaggagttgcagctcact

SEQ ID NO: 366865 - DNA, 20 bp, Artificial
  CRISPR gRNA sequence
aaaggagttgcagctcacta

SEQ ID NO: 366866 - DNA, 20 bp, Artificial
  CRISPR gRNA sequence
ggagttgcagctcactaggg

SEQ ID NO: 366867 - DNA, 20 bp, Artificial
  CRISPR gRNA sequence
gttgcagctcactagggcag

SEQ ID NO: 366868 - DNA, 20 bp, Artificial
  CRISPR gRNA sequence
tcactagggcagcagaatgt

SEQ ID NO: 366869 - DNA, 20 bp, Artificial
  CRISPR gRNA sequence
atgtcagaaataaacccgaa

SEQ ID NO: 366870 - DNA, 20 bp, Artificial
  CRISPR gRNA sequence
aaagttattgatgtgcctaa

SEQ ID NO: 366871 - DNA, 20 bp, Artificial
  CRISPR gRNA sequence
tttgacttctgtctgtaatg

SEQ ID NO: 366872 - DNA, 20 bp, Artificial
  CRISPR gRNA sequence
cttctgtctgtaatgcagac

SEQ ID NO: 366873 - DNA, 20 bp, Artificial
  CRISPR gRNA sequence
ttctgtctgtaatgcagacc

SEQ ID NO: 366874 - DNA, 20 bp, Artificial
  CRISPR gRNA sequence
tctgtctgtaatgcagacca

SEQ ID NO: 366875 - DNA, 20 bp, Artificial
  CRISPR gRNA sequence
ctgtctgtaatgcagaccag

SEQ ID NO: 366876 - DNA, 20 bp, Artificial
  CRISPR gRNA sequence
gaccaggggacatctctgac

SEQ ID NO: 366877 - DNA, 20 bp, Artificial
  CRISPR gRNA sequence
ggacatctctgactagtttt

SEQ ID NO: 366878 - DNA, 20 bp, Artificial
  CRISPR gRNA sequence
acatctctgactagttttta

SEQ ID NO: 366879 - DNA, 20 bp, Artificial
  CRISPR gRNA sequence
atctctgactagtttttaga

SEQ ID NO: 366880 - DNA, 20 bp, Artificial
  CRISPR gRNA sequence
agagacacacaaaataaaac

SEQ ID NO: 366881 - DNA, 20 bp, Artificial
  CRISPR gRNA sequence
atttttctttcaccacctaa

SEQ ID NO: 366882 - DNA, 20 bp, Artificial
  CRISPR gRNA sequence
caccacctaaaagattacac

SEQ ID NO: 366883 - DNA, 20 bp, Artificial
  CRISPR gRNA sequence
ctaaaagattacactagctg

SEQ ID NO: 366884 - DNA, 20 bp, Artificial
  CRISPR gRNA sequence
ttacactagctgcagtcttt

SEQ ID NO: 366885 - DNA, 20 bp, Artificial
  CRISPR gRNA sequence
tacactagctgcagtctttt

SEQ ID NO: 366886 - DNA, 20 bp, Artificial
  CRISPR gRNA sequence
cactagctgcagtcttttag

SEQ ID NO: 366887 - DNA, 20 bp, Artificial
  CRISPR gRNA sequence
ctagctgcagtcttttagga

SEQ ID NO: 366888 - DNA, 20 bp, Artificial
  CRISPR gRNA sequence
ctgcagtcttttaggagagt

SEQ ID NO: 366889 - DNA, 20 bp, Artificial
  CRISPR gRNA sequence
gcagtcttttaggagagtaa

SEQ ID NO: 366890 - DNA, 20 bp, Artificial
  CRISPR gRNA sequence
tttaggagagtaagagtttg

SEQ ID NO: 366891 - DNA, 20 bp, Artificial
  CRISPR gRNA sequence
ttaggagagtaagagtttgc

SEQ ID NO: 366892 - DNA, 20 bp, Artificial
  CRISPR gRNA sequence
gagagtaagagtttgcaggc

SEQ ID NO: 366893 - DNA, 20 bp, Artificial
  CRISPR gRNA sequence
agagtaagagtttgcaggca

SEQ ID NO: 366894 - DNA, 20 bp, Artificial
  CRISPR gRNA sequence
taagagtttgcaggcaaggt

SEQ ID NO: 366895 - DNA, 20 bp, Artificial
  CRISPR gRNA sequence
ttgcaggcaaggtaagcaaa

SEQ ID NO: 366896 - DNA, 20 bp, Artificial
  CRISPR gRNA sequence
tgcaggcaaggtaagcaaat

SEQ ID NO: 366897 - DNA, 20 bp, Artificial
  CRISPR gRNA sequence
ggtaagcaaataggcatctg

SEQ ID NO: 366898 - DNA, 20 bp, Artificial
  CRISPR gRNA sequence
gcaaataggcatctgtagat

SEQ ID NO: 366899 - DNA, 20 bp, Artificial
  CRISPR gRNA sequence
ttggaacctttacacactgc

SEQ ID NO: 366900 - DNA, 20 bp, Artificial
  CRISPR gRNA sequence
gaacctttacacactgctag

SEQ ID NO: 366901 - DNA, 20 bp, Artificial
  CRISPR gRNA sequence
aacctttacacactgctagc

SEQ ID NO: 366902 - DNA, 20 bp, Artificial
  CRISPR gRNA sequence
cctttacacactgctagcag

SEQ ID NO: 366903 - DNA, 20 bp, Artificial
  CRISPR gRNA sequence
ctttacacactgctagcagg

SEQ ID NO: 366904 - DNA, 20 bp, Artificial
  CRISPR gRNA sequence
ctgctagcaggaggattaat

SEQ ID NO: 366905 - DNA, 20 bp, Artificial
  CRISPR gRNA sequence
aattggtatctctattattt

SEQ ID NO: 366906 - DNA, 20 bp, Artificial
  CRISPR gRNA sequence
ggtatctctattattttagt

SEQ ID NO: 366907 - DNA, 20 bp, Artificial
  CRISPR gRNA sequence
gtatctctattattttagtc

SEQ ID NO: 366908 - DNA, 20 bp, Artificial
  CRISPR gRNA sequence
ttattttagtcaggcttctc

SEQ ID NO: 366909 - DNA, 20 bp, Artificial
  CRISPR gRNA sequence
attttagtcaggcttctcca

SEQ ID NO: 366910 - DNA, 20 bp, Artificial
  CRISPR gRNA sequence
tagtcaggcttctccagaga

SEQ ID NO: 366911 - DNA, 20 bp, Artificial
  CRISPR gRNA sequence
gtcaggcttctccagagaaa

SEQ ID NO: 366912 - DNA, 20 bp, Artificial
  CRISPR gRNA sequence
agaaccaatgtgtatataca

SEQ ID NO: 366913 - DNA, 20 bp, Artificial
  CRISPR gRNA sequence
aaccaatgtgtatatacatg

SEQ ID NO: 366914 - DNA, 20 bp, Artificial
  CRISPR gRNA sequence
tatacatggagatttattat

SEQ ID NO: 366915 - DNA, 20 bp, Artificial
  CRISPR gRNA sequence
ggagatttattataagaaat

SEQ ID NO: 366916 - DNA, 20 bp, Artificial
  CRISPR gRNA sequence
aattggctcacatgatgtat

SEQ ID NO: 366917 - DNA, 20 bp, Artificial
  CRISPR gRNA sequence
tctattctcacactgctgtg

SEQ ID NO: 366918 - DNA, 20 bp, Artificial
  CRISPR gRNA sequence
actgctgtgaagaaatactt

SEQ ID NO: 366919 - DNA, 20 bp, Artificial
  CRISPR gRNA sequence
tgtgaagaaatacttaagac

SEQ ID NO: 366920 - DNA, 20 bp, Artificial
  CRISPR gRNA sequence
gtgaagaaatacttaagact

SEQ ID NO: 366921 - DNA, 20 bp, Artificial
  CRISPR gRNA sequence
cttaagactgggtaatttat

SEQ ID NO: 366922 - DNA, 20 bp, Artificial
  CRISPR gRNA sequence
ttaagactgggtaatttata

SEQ ID NO: 366923 - DNA, 20 bp, Artificial
  CRISPR gRNA sequence
taagactgggtaatttataa

SEQ ID NO: 366924 - DNA, 20 bp, Artificial
  CRISPR gRNA sequence
actgggtaatttataaggga

SEQ ID NO: 366925 - DNA, 20 bp, Artificial
  CRISPR gRNA sequence
tgggtaatttataagggaaa

SEQ ID NO: 366926 - DNA, 20 bp, Artificial
  CRISPR gRNA sequence
gggtaatttataagggaaag

SEQ ID NO: 366927 - DNA, 20 bp, Artificial
  CRISPR gRNA sequence
aaagaggtttaattgactca

SEQ ID NO: 366928 - DNA, 20 bp, Artificial
  CRISPR gRNA sequence
ggtttaattgactcacagtt

SEQ ID NO: 366929 - DNA, 20 bp, Artificial
  CRISPR gRNA sequence
aattgactcacagttcagta

SEQ ID NO: 366930 - DNA, 20 bp, Artificial
  CRISPR gRNA sequence
gactcacagttcagtatggc

SEQ ID NO: 366931 - DNA, 20 bp, Artificial
  CRISPR gRNA sequence
actcacagttcagtatggct

SEQ ID NO: 366932 - DNA, 20 bp, Artificial
  CRISPR gRNA sequence
ctcacagttcagtatggctg

SEQ ID NO: 366933 - DNA, 20 bp, Artificial
  CRISPR gRNA sequence
cacagttcagtatggctggg

SEQ ID NO: 366934 - DNA, 20 bp, Artificial
  CRISPR gRNA sequence
acagttcagtatggctgggg

SEQ ID NO: 366935 - DNA, 20 bp, Artificial
  CRISPR gRNA sequence
cagtatggctggggaggcct

SEQ ID NO: 366936 - DNA, 20 bp, Artificial
  CRISPR gRNA sequence
agtatggctggggaggcctc

SEQ ID NO: 366937 - DNA, 20 bp, Artificial
  CRISPR gRNA sequence
cctcaggaaacgtacaatca

SEQ ID NO: 366938 - DNA, 20 bp, Artificial
  CRISPR gRNA sequence
aaacgtacaatcatggtgaa

SEQ ID NO: 366939 - DNA, 20 bp, Artificial
  CRISPR gRNA sequence
aacgtacaatcatggtgaaa

SEQ ID NO: 366940 - DNA, 20 bp, Artificial
  CRISPR gRNA sequence
acgtacaatcatggtgaaaa

SEQ ID NO: 366941 - DNA, 20 bp, Artificial
  CRISPR gRNA sequence
cgtacaatcatggtgaaaag

SEQ ID NO: 366942 - DNA, 20 bp, Artificial
  CRISPR gRNA sequence
tacaatcatggtgaaaaggg

SEQ ID NO: 366943 - DNA, 20 bp, Artificial
  CRISPR gRNA sequence
caaacatgtccttcttcaca

SEQ ID NO: 366944 - DNA, 20 bp, Artificial
  CRISPR gRNA sequence
acatgtccttcttcacatgg

SEQ ID NO: 366945 - DNA, 20 bp, Artificial
  CRISPR gRNA sequence
tgtccttcttcacatggcag

SEQ ID NO: 366946 - DNA, 20 bp, Artificial
  CRISPR gRNA sequence
gtccttcttcacatggcagc

SEQ ID NO: 366947 - DNA, 20 bp, Artificial
  CRISPR gRNA sequence
cttcttcacatggcagcagg

SEQ ID NO: 366948 - DNA, 20 bp, Artificial
  CRISPR gRNA sequence
ttcttcacatggcagcagga

SEQ ID NO: 366949 - DNA, 20 bp, Artificial
  CRISPR gRNA sequence
cttcacatggcagcaggaag

SEQ ID NO: 366950 - DNA, 20 bp, Artificial
  CRISPR gRNA sequence
cacatggcagcaggaaggag

SEQ ID NO: 366951 - DNA, 20 bp, Artificial
  CRISPR gRNA sequence
ggcagcaggaaggagaagtg

SEQ ID NO: 366952 - DNA, 20 bp, Artificial
  CRISPR gRNA sequence
cagcaggaaggagaagtgca

SEQ ID NO: 366953 - DNA, 20 bp, Artificial
  CRISPR gRNA sequence
aggaaggagaagtgcagagt

SEQ ID NO: 366954 - DNA, 20 bp, Artificial
  CRISPR gRNA sequence
ggaaggagaagtgcagagtg

SEQ ID NO: 366955 - DNA, 20 bp, Artificial
  CRISPR gRNA sequence
aggagaagtgcagagtgagg

SEQ ID NO: 366956 - DNA, 20 bp, Artificial
  CRISPR gRNA sequence
ggagaagtgcagagtgaggt

SEQ ID NO: 366957 - DNA, 20 bp, Artificial
  CRISPR gRNA sequence
gagaagtgcagagtgaggtg

SEQ ID NO: 366958 - DNA, 20 bp, Artificial
  CRISPR gRNA sequence
agaagtgcagagtgaggtgg

SEQ ID NO: 366959 - DNA, 20 bp, Artificial
  CRISPR gRNA sequence
tgcagagtgaggtgggggaa

SEQ ID NO: 366960 - DNA, 20 bp, Artificial
  CRISPR gRNA sequence
aaagccccttataaaaccat

SEQ ID NO: 366961 - DNA, 20 bp, Artificial
  CRISPR gRNA sequence
ataaaaccatcagattttgt

SEQ ID NO: 366962 - DNA, 20 bp, Artificial
  CRISPR gRNA sequence
gagaattcactcactgtcac

SEQ ID NO: 366963 - DNA, 20 bp, Artificial
  CRISPR gRNA sequence
ttcactcactgtcaccagaa

SEQ ID NO: 366964 - DNA, 20 bp, Artificial
  CRISPR gRNA sequence
actgtcaccagaacagcatg

SEQ ID NO: 366965 - DNA, 20 bp, Artificial
  CRISPR gRNA sequence
ctgtcaccagaacagcatga

SEQ ID NO: 366966 - DNA, 20 bp, Artificial
  CRISPR gRNA sequence
cagaacagcatgaaggtgac

SEQ ID NO: 366967 - DNA, 20 bp, Artificial
  CRISPR gRNA sequence
aggtgactggccccatgatt

SEQ ID NO: 366968 - DNA, 20 bp, Artificial
  CRISPR gRNA sequence
atgattcagctacctcccac

SEQ ID NO: 366969 - DNA, 20 bp, Artificial
  CRISPR gRNA sequence
tgattcagctacctcccacc

SEQ ID NO: 366970 - DNA, 20 bp, Artificial
  CRISPR gRNA sequence
cgggtccttcccacaataca

SEQ ID NO: 366971 - DNA, 20 bp, Artificial
  CRISPR gRNA sequence
gggtccttcccacaatacat

SEQ ID NO: 366972 - DNA, 20 bp, Artificial
  CRISPR gRNA sequence
ggtccttcccacaatacatg

SEQ ID NO: 366973 - DNA, 20 bp, Artificial
  CRISPR gRNA sequence
cccacaatacatggggatta

SEQ ID NO: 366974 - DNA, 20 bp, Artificial
  CRISPR gRNA sequence
ccacaatacatggggattat

SEQ ID NO: 366975 - DNA, 20 bp, Artificial
  CRISPR gRNA sequence
atggggattatgggaactac

SEQ ID NO: 366976 - DNA, 20 bp, Artificial
  CRISPR gRNA sequence
gattatgggaactacaagat

SEQ ID NO: 366977 - DNA, 20 bp, Artificial
  CRISPR gRNA sequence
gggaactacaagatgagatt

SEQ ID NO: 366978 - DNA, 20 bp, Artificial
  CRISPR gRNA sequence
ggaactacaagatgagattt

SEQ ID NO: 366979 - DNA, 20 bp, Artificial
  CRISPR gRNA sequence
actacaagatgagatttggg

SEQ ID NO: 366980 - DNA, 20 bp, Artificial
  CRISPR gRNA sequence
ctacaagatgagatttgggt

SEQ ID NO: 366981 - DNA, 20 bp, Artificial
  CRISPR gRNA sequence
tacaagatgagatttgggtg

SEQ ID NO: 366982 - DNA, 20 bp, Artificial
  CRISPR gRNA sequence
atgagatttgggtggggaaa

SEQ ID NO: 366983 - DNA, 20 bp, Artificial
  CRISPR gRNA sequence
aaattatatcattttgcccc

SEQ ID NO: 366984 - DNA, 20 bp, Artificial
  CRISPR gRNA sequence
atacaaccataccctcccaa

SEQ ID NO: 366985 - DNA, 20 bp, Artificial
  CRISPR gRNA sequence
accctcccaacagtccccca

SEQ ID NO: 366986 - DNA, 20 bp, Artificial
  CRISPR gRNA sequence
cccaaagtcttaactctttc

SEQ ID NO: 366987 - DNA, 20 bp, Artificial
  CRISPR gRNA sequence
ctctttccagcattaactga

SEQ ID NO: 366988 - DNA, 20 bp, Artificial
  CRISPR gRNA sequence
cagcattaactgaaagtcca

SEQ ID NO: 366989 - DNA, 20 bp, Artificial
  CRISPR gRNA sequence
aactgaaagtccacagccca

SEQ ID NO: 366990 - DNA, 20 bp, Artificial
  CRISPR gRNA sequence
cacagcccaaagtctcatct

SEQ ID NO: 366991 - DNA, 20 bp, Artificial
  CRISPR gRNA sequence
cccaaagtctcatctgagac

SEQ ID NO: 366992 - DNA, 20 bp, Artificial
  CRISPR gRNA sequence
ccaaagtctcatctgagaca

SEQ ID NO: 366993 - DNA, 20 bp, Artificial
  CRISPR gRNA sequence
agtctcatctgagacaaggc

SEQ ID NO: 366994 - DNA, 20 bp, Artificial
  CRISPR gRNA sequence
ggcaagtaccttccgcctat

SEQ ID NO: 366995 - DNA, 20 bp, Artificial
  CRISPR gRNA sequence
ctatgagcctgtaaaatcaa

SEQ ID NO: 366996 - DNA, 20 bp, Artificial
  CRISPR gRNA sequence
gagcctgtaaaatcaaaagc

SEQ ID NO: 366997 - DNA, 20 bp, Artificial
  CRISPR gRNA sequence
ctgtaaaatcaaaagcaagt

SEQ ID NO: 366998 - DNA, 20 bp, Artificial
  CRISPR gRNA sequence
aaagcaagttagttacttcc

SEQ ID NO: 366999 - DNA, 20 bp, Artificial
  CRISPR gRNA sequence
gttagttacttcctagataa

SEQ ID NO: 367000 - DNA, 20 bp, Artificial
  CRISPR gRNA sequence
tagttacttcctagataaaa

SEQ ID NO: 367001 - DNA, 20 bp, Artificial
  CRISPR gRNA sequence
agttacttcctagataaaag

SEQ ID NO: 367002 - DNA, 20 bp, Artificial
  CRISPR gRNA sequence
gttacttcctagataaaaga

SEQ ID NO: 367003 - DNA, 20 bp, Artificial
  CRISPR gRNA sequence
ttacttcctagataaaagag

SEQ ID NO: 367004 - DNA, 20 bp, Artificial
  CRISPR gRNA sequence
tcctagataaaagaggggta

SEQ ID NO: 367005 - DNA, 20 bp, Artificial
  CRISPR gRNA sequence
cctagataaaagaggggtac

SEQ ID NO: 367006 - DNA, 20 bp, Artificial
  CRISPR gRNA sequence
taaaagaggggtacaggcat

SEQ ID NO: 367007 - DNA, 20 bp, Artificial
  CRISPR gRNA sequence
taaatacaccaattctaaat

SEQ ID NO: 367008 - DNA, 20 bp, Artificial
  CRISPR gRNA sequence
aatacaccaattctaaatga

SEQ ID NO: 367009 - DNA, 20 bp, Artificial
  CRISPR gRNA sequence
caattctaaatgagagaaat

SEQ ID NO: 367010 - DNA, 20 bp, Artificial
  CRISPR gRNA sequence
gagagaaattggccaaaaca

SEQ ID NO: 367011 - DNA, 20 bp, Artificial
  CRISPR gRNA sequence
agagaaattggccaaaacaa

SEQ ID NO: 367012 - DNA, 20 bp, Artificial
  CRISPR gRNA sequence
gagaaattggccaaaacaaa

SEQ ID NO: 367013 - DNA, 20 bp, Artificial
  CRISPR gRNA sequence
agaaattggccaaaacaaag

SEQ ID NO: 367014 - DNA, 20 bp, Artificial
  CRISPR gRNA sequence
ggccaaaacaaaggggctac

SEQ ID NO: 367015 - DNA, 20 bp, Artificial
  CRISPR gRNA sequence
aggggctactagctccatgc

SEQ ID NO: 367016 - DNA, 20 bp, Artificial
  CRISPR gRNA sequence
catgcaagtctgaaatcctg

SEQ ID NO: 367017 - DNA, 20 bp, Artificial
  CRISPR gRNA sequence
atgcaagtctgaaatcctgt

SEQ ID NO: 367018 - DNA, 20 bp, Artificial
  CRISPR gRNA sequence
tgcaagtctgaaatcctgta

SEQ ID NO: 367019 - DNA, 20 bp, Artificial
  CRISPR gRNA sequence
aagtctgaaatcctgtaggg

SEQ ID NO: 367020 - DNA, 20 bp, Artificial
  CRISPR gRNA sequence
agggcagtcattaaaacttc

SEQ ID NO: 367021 - DNA, 20 bp, Artificial
  CRISPR gRNA sequence
tgactccatgtcccacatcc

SEQ ID NO: 367022 - DNA, 20 bp, Artificial
  CRISPR gRNA sequence
gactccatgtcccacatcct

SEQ ID NO: 367023 - DNA, 20 bp, Artificial
  CRISPR gRNA sequence
catcctgggcatgctgatgc

SEQ ID NO: 367024 - DNA, 20 bp, Artificial
  CRISPR gRNA sequence
tcctgggcatgctgatgcaa

SEQ ID NO: 367025 - DNA, 20 bp, Artificial
  CRISPR gRNA sequence
cctgggcatgctgatgcaag

SEQ ID NO: 367026 - DNA, 20 bp, Artificial
  CRISPR gRNA sequence
gggcatgctgatgcaagagg

SEQ ID NO: 367027 - DNA, 20 bp, Artificial
  CRISPR gRNA sequence
ggcatgctgatgcaagaggt

SEQ ID NO: 367028 - DNA, 20 bp, Artificial
  CRISPR gRNA sequence
atgcaagaggtgggcaccca

SEQ ID NO: 367029 - DNA, 20 bp, Artificial
  CRISPR gRNA sequence
gaggtgggcacccatggtct

SEQ ID NO: 367030 - DNA, 20 bp, Artificial
  CRISPR gRNA sequence
aggtgggcacccatggtctt

SEQ ID NO: 367031 - DNA, 20 bp, Artificial
  CRISPR gRNA sequence
tgggcacccatggtcttggg

SEQ ID NO: 367032 - DNA, 20 bp, Artificial
  CRISPR gRNA sequence
cttgggcagctccacccctc

SEQ ID NO: 367033 - DNA, 20 bp, Artificial
  CRISPR gRNA sequence
gctccacccctctggctatg

SEQ ID NO: 367034 - DNA, 20 bp, Artificial
  CRISPR gRNA sequence
ctccacccctctggctatgc

SEQ ID NO: 367035 - DNA, 20 bp, Artificial
  CRISPR gRNA sequence
tccacccctctggctatgca

SEQ ID NO: 367036 - DNA, 20 bp, Artificial
  CRISPR gRNA sequence
ccctctggctatgcagggta

SEQ ID NO: 367037 - DNA, 20 bp, Artificial
  CRISPR gRNA sequence
cagggtacagcctcccctct

SEQ ID NO: 367038 - DNA, 20 bp, Artificial
  CRISPR gRNA sequence
tcccctcttggctgctttca

SEQ ID NO: 367039 - DNA, 20 bp, Artificial
  CRISPR gRNA sequence
cccctcttggctgctttcac

SEQ ID NO: 367040 - DNA, 20 bp, Artificial
  CRISPR gRNA sequence
tcttggctgctttcacaggc

SEQ ID NO: 367041 - DNA, 20 bp, Artificial
  CRISPR gRNA sequence
tgctttcacaggctggtgtt

SEQ ID NO: 367042 - DNA, 20 bp, Artificial
  CRISPR gRNA sequence
aggctggtgttgagtgtctg

SEQ ID NO: 367043 - DNA, 20 bp, Artificial
  CRISPR gRNA sequence
ttgagtgtctgtggcttctc

SEQ ID NO: 367044 - DNA, 20 bp, Artificial
  CRISPR gRNA sequence
ctgtggcttctccagttgca

SEQ ID NO: 367045 - DNA, 20 bp, Artificial
  CRISPR gRNA sequence
cttctccagttgcatggtgc

SEQ ID NO: 367046 - DNA, 20 bp, Artificial
  CRISPR gRNA sequence
tgcatggtgcaagccgtctg

SEQ ID NO: 367047 - DNA, 20 bp, Artificial
  CRISPR gRNA sequence
ggtgcaagccgtctgtggat

SEQ ID NO: 367048 - DNA, 20 bp, Artificial
  CRISPR gRNA sequence
agccgtctgtggatcagatt

SEQ ID NO: 367049 - DNA, 20 bp, Artificial
  CRISPR gRNA sequence
tgtggatcagattcagattg

SEQ ID NO: 367050 - DNA, 20 bp, Artificial
  CRISPR gRNA sequence
gtggatcagattcagattgt

SEQ ID NO: 367051 - DNA, 20 bp, Artificial
  CRISPR gRNA sequence
tggatcagattcagattgtg

SEQ ID NO: 367052 - DNA, 20 bp, Artificial
  CRISPR gRNA sequence
gattcagattgtggggtctg

SEQ ID NO: 367053 - DNA, 20 bp, Artificial
  CRISPR gRNA sequence
attcagattgtggggtctga

SEQ ID NO: 367054 - DNA, 20 bp, Artificial
  CRISPR gRNA sequence
agattgtggggtctgaagga

SEQ ID NO: 367055 - DNA, 20 bp, Artificial
  CRISPR gRNA sequence
ttgtggggtctgaaggatgg

SEQ ID NO: 367056 - DNA, 20 bp, Artificial
  CRISPR gRNA sequence
ggatggtggccctcttctca

SEQ ID NO: 367057 - DNA, 20 bp, Artificial
  CRISPR gRNA sequence
ccctcttctcacagctctac

SEQ ID NO: 367058 - DNA, 20 bp, Artificial
  CRISPR gRNA sequence
cttctcacagctctactaga

SEQ ID NO: 367059 - DNA, 20 bp, Artificial
  CRISPR gRNA sequence
agctctactagacagtgccc

SEQ ID NO: 367060 - DNA, 20 bp, Artificial
  CRISPR gRNA sequence
tctactagacagtgccccag

SEQ ID NO: 367061 - DNA, 20 bp, Artificial
  CRISPR gRNA sequence
ctactagacagtgccccagt

SEQ ID NO: 367062 - DNA, 20 bp, Artificial
  CRISPR gRNA sequence
tactagacagtgccccagtg

SEQ ID NO: 367063 - DNA, 20 bp, Artificial
  CRISPR gRNA sequence
gccccagtggggattctgtg

SEQ ID NO: 367064 - DNA, 20 bp, Artificial
  CRISPR gRNA sequence
ccccagtggggattctgtgt

SEQ ID NO: 367065 - DNA, 20 bp, Artificial
  CRISPR gRNA sequence
cccagtggggattctgtgtg

SEQ ID NO: 367066 - DNA, 20 bp, Artificial
  CRISPR gRNA sequence
ccagtggggattctgtgtgg

SEQ ID NO: 367067 - DNA, 20 bp, Artificial
  CRISPR gRNA sequence
aaccccacatttccctgctg

SEQ ID NO: 367068 - DNA, 20 bp, Artificial
  CRISPR gRNA sequence
atttccctgctgcagtgccc

SEQ ID NO: 367069 - DNA, 20 bp, Artificial
  CRISPR gRNA sequence
tccctgctgcagtgccctag

SEQ ID NO: 367070 - DNA, 20 bp, Artificial
  CRISPR gRNA sequence
cctgctgcagtgccctagca

SEQ ID NO: 367071 - DNA, 20 bp, Artificial
  CRISPR gRNA sequence
ctgctgcagtgccctagcag

SEQ ID NO: 367072 - DNA, 20 bp, Artificial
  CRISPR gRNA sequence
ccctagcagaggtcttccat

SEQ ID NO: 367073 - DNA, 20 bp, Artificial
  CRISPR gRNA sequence
cctagcagaggtcttccatg

SEQ ID NO: 367074 - DNA, 20 bp, Artificial
  CRISPR gRNA sequence
ctagcagaggtcttccatga

SEQ ID NO: 367075 - DNA, 20 bp, Artificial
  CRISPR gRNA sequence
ccatgagggctctgcccttg

SEQ ID NO: 367076 - DNA, 20 bp, Artificial
  CRISPR gRNA sequence
cccttgcagcaacttctgaa

SEQ ID NO: 367077 - DNA, 20 bp, Artificial
  CRISPR gRNA sequence
gcaacttctgaatggacacc

SEQ ID NO: 367078 - DNA, 20 bp, Artificial
  CRISPR gRNA sequence
caacttctgaatggacaccc

SEQ ID NO: 367079 - DNA, 20 bp, Artificial
  CRISPR gRNA sequence
gtgtttctgtacattttctg

SEQ ID NO: 367080 - DNA, 20 bp, Artificial
  CRISPR gRNA sequence
tctgtacattttctgaagtc

SEQ ID NO: 367081 - DNA, 20 bp, Artificial
  CRISPR gRNA sequence
ctgtacattttctgaagtct

SEQ ID NO: 367082 - DNA, 20 bp, Artificial
  CRISPR gRNA sequence
tacattttctgaagtctagg

SEQ ID NO: 367083 - DNA, 20 bp, Artificial
  CRISPR gRNA sequence
cattttctgaagtctaggca

SEQ ID NO: 367084 - DNA, 20 bp, Artificial
  CRISPR gRNA sequence
attttctgaagtctaggcag

SEQ ID NO: 367085 - DNA, 20 bp, Artificial
  CRISPR gRNA sequence
aggcagaggttctcaaacca

SEQ ID NO: 367086 - DNA, 20 bp, Artificial
  CRISPR gRNA sequence
tcttgacttctgtgcacccg

SEQ ID NO: 367087 - DNA, 20 bp, Artificial
  CRISPR gRNA sequence
cttgacttctgtgcacccgc

SEQ ID NO: 367088 - DNA, 20 bp, Artificial
  CRISPR gRNA sequence
gcaggcccaacaccacgtgt

SEQ ID NO: 367089 - DNA, 20 bp, Artificial
  CRISPR gRNA sequence
aacaccacgtgtaagctgtc

SEQ ID NO: 367090 - DNA, 20 bp, Artificial
  CRISPR gRNA sequence
acaccacgtgtaagctgtca

SEQ ID NO: 367091 - DNA, 20 bp, Artificial
  CRISPR gRNA sequence
acgtgtaagctgtcaaggct

SEQ ID NO: 367092 - DNA, 20 bp, Artificial
  CRISPR gRNA sequence
cgtgtaagctgtcaaggctt

SEQ ID NO: 367093 - DNA, 20 bp, Artificial
  CRISPR gRNA sequence
gtgtaagctgtcaaggcttg

SEQ ID NO: 367094 - DNA, 20 bp, Artificial
  CRISPR gRNA sequence
cttggggcttgcaccctctg

SEQ ID NO: 367095 - DNA, 20 bp, Artificial
  CRISPR gRNA sequence
gcttgcaccctctgaagcaa

SEQ ID NO: 367096 - DNA, 20 bp, Artificial
  CRISPR gRNA sequence
accctctgaagcaacagcct

SEQ ID NO: 367097 - DNA, 20 bp, Artificial
  CRISPR gRNA sequence
caacagcctgagctgtatgt

SEQ ID NO: 367098 - DNA, 20 bp, Artificial
  CRISPR gRNA sequence
agctgtatgttggccccttt

SEQ ID NO: 367099 - DNA, 20 bp, Artificial
  CRISPR gRNA sequence
atgttggccccttttagccg

SEQ ID NO: 367100 - DNA, 20 bp, Artificial
  CRISPR gRNA sequence
tggccccttttagccgtggc

SEQ ID NO: 367101 - DNA, 20 bp, Artificial
  CRISPR gRNA sequence
ggccccttttagccgtggct

SEQ ID NO: 367102 - DNA, 20 bp, Artificial
  CRISPR gRNA sequence
ttttagccgtggctgggaca

SEQ ID NO: 367103 - DNA, 20 bp, Artificial
  CRISPR gRNA sequence
tttagccgtggctgggacat

SEQ ID NO: 367104 - DNA, 20 bp, Artificial
  CRISPR gRNA sequence
ttagccgtggctgggacata

SEQ ID NO: 367105 - DNA, 20 bp, Artificial
  CRISPR gRNA sequence
gggacatagggcaccatatg

SEQ ID NO: 367106 - DNA, 20 bp, Artificial
  CRISPR gRNA sequence
agggcaccatatgcagtccc

SEQ ID NO: 367107 - DNA, 20 bp, Artificial
  CRISPR gRNA sequence
gggcaccatatgcagtcccg

SEQ ID NO: 367108 - DNA, 20 bp, Artificial
  CRISPR gRNA sequence
tatgcagtcccgaggctgca

SEQ ID NO: 367109 - DNA, 20 bp, Artificial
  CRISPR gRNA sequence
tgcagtcccgaggctgcata

SEQ ID NO: 367110 - DNA, 20 bp, Artificial
  CRISPR gRNA sequence
agtcccgaggctgcatagag

SEQ ID NO: 367111 - DNA, 20 bp, Artificial
  CRISPR gRNA sequence
gtcccgaggctgcatagagc

SEQ ID NO: 367112 - DNA, 20 bp, Artificial
  CRISPR gRNA sequence
tcccgaggctgcatagagca

SEQ ID NO: 367113 - DNA, 20 bp, Artificial
  CRISPR gRNA sequence
cccgaggctgcatagagcag

SEQ ID NO: 367114 - DNA, 20 bp, Artificial
  CRISPR gRNA sequence
ccgaggctgcatagagcagg

SEQ ID NO: 367115 - DNA, 20 bp, Artificial
  CRISPR gRNA sequence
ctgcatagagcagggggtct

SEQ ID NO: 367116 - DNA, 20 bp, Artificial
  CRISPR gRNA sequence
tgcatagagcagggggtctt

SEQ ID NO: 367117 - DNA, 20 bp, Artificial
  CRISPR gRNA sequence
agagcagggggtcttaggct

SEQ ID NO: 367118 - DNA, 20 bp, Artificial
  CRISPR gRNA sequence
agggggtcttaggcttggcc

SEQ ID NO: 367119 - DNA, 20 bp, Artificial
  CRISPR gRNA sequence
gggggtcttaggcttggccc

SEQ ID NO: 367120 - DNA, 20 bp, Artificial
  CRISPR gRNA sequence
aggaaatcacttttccctcc

SEQ ID NO: 367121 - DNA, 20 bp, Artificial
  CRISPR gRNA sequence
ggaaatcacttttccctcct

SEQ ID NO: 367122 - DNA, 20 bp, Artificial
  CRISPR gRNA sequence
tttccctcctaggcttatga

SEQ ID NO: 367123 - DNA, 20 bp, Artificial
  CRISPR gRNA sequence
ccctcctaggcttatgatgg

SEQ ID NO: 367124 - DNA, 20 bp, Artificial
  CRISPR gRNA sequence
cctcctaggcttatgatgga

SEQ ID NO: 367125 - DNA, 20 bp, Artificial
  CRISPR gRNA sequence
ctcctaggcttatgatggaa

SEQ ID NO: 367126 - DNA, 20 bp, Artificial
  CRISPR gRNA sequence
tcctaggcttatgatggaag

SEQ ID NO: 367127 - DNA, 20 bp, Artificial
  CRISPR gRNA sequence
tgatggaaggggctgccatg

SEQ ID NO: 367128 - DNA, 20 bp, Artificial
  CRISPR gRNA sequence
gatggaaggggctgccatga

SEQ ID NO: 367129 - DNA, 20 bp, Artificial
  CRISPR gRNA sequence
tgaaggtctctgacatgcct

SEQ ID NO: 367130 - DNA, 20 bp, Artificial
  CRISPR gRNA sequence
aaggtctctgacatgccttg

SEQ ID NO: 367131 - DNA, 20 bp, Artificial
  CRISPR gRNA sequence
agacattttccccattgtct

SEQ ID NO: 367132 - DNA, 20 bp, Artificial
  CRISPR gRNA sequence
ttgtcttggtgatttacatt

SEQ ID NO: 367133 - DNA, 20 bp, Artificial
  CRISPR gRNA sequence
attacttatgcaaatttctg

SEQ ID NO: 367134 - DNA, 20 bp, Artificial
  CRISPR gRNA sequence
cttatgcaaatttctgcagc

SEQ ID NO: 367135 - DNA, 20 bp, Artificial
  CRISPR gRNA sequence
tgcaaatttctgcagctggc

SEQ ID NO: 367136 - DNA, 20 bp, Artificial
  CRISPR gRNA sequence
agctggctggaatttcttcc

SEQ ID NO: 367137 - DNA, 20 bp, Artificial
  CRISPR gRNA sequence
tttcttttctgtcgcatcat

SEQ ID NO: 367138 - DNA, 20 bp, Artificial
  CRISPR gRNA sequence
ttcttttctgtcgcatcatc

SEQ ID NO: 367139 - DNA, 20 bp, Artificial
  CRISPR gRNA sequence
ctcttgaatgctttgcccct

SEQ ID NO: 367140 - DNA, 20 bp, Artificial
  CRISPR gRNA sequence
ttgaatgctttgccccttag

SEQ ID NO: 367141 - DNA, 20 bp, Artificial
  CRISPR gRNA sequence
cccttagaagtttcttctgc

SEQ ID NO: 367142 - DNA, 20 bp, Artificial
  CRISPR gRNA sequence
taccctaaattatctctctc

SEQ ID NO: 367143 - DNA, 20 bp, Artificial
  CRISPR gRNA sequence
aattatctctctcaagttca

SEQ ID NO: 367144 - DNA, 20 bp, Artificial
  CRISPR gRNA sequence
ctctcaagttcaaagttcca

SEQ ID NO: 367145 - DNA, 20 bp, Artificial
  CRISPR gRNA sequence
ttcaaagttccacagatctc

SEQ ID NO: 367146 - DNA, 20 bp, Artificial
  CRISPR gRNA sequence
tcaaagttccacagatctct

SEQ ID NO: 367147 - DNA, 20 bp, Artificial
  CRISPR gRNA sequence
caaagttccacagatctctg

SEQ ID NO: 367148 - DNA, 20 bp, Artificial
  CRISPR gRNA sequence
agttccacagatctctgggg

SEQ ID NO: 367149 - DNA, 20 bp, Artificial
  CRISPR gRNA sequence
gttccacagatctctggggc

SEQ ID NO: 367150 - DNA, 20 bp, Artificial
  CRISPR gRNA sequence
ttccacagatctctggggca

SEQ ID NO: 367151 - DNA, 20 bp, Artificial
  CRISPR gRNA sequence
tccacagatctctggggcag

SEQ ID NO: 367152 - DNA, 20 bp, Artificial
  CRISPR gRNA sequence
atgccaccaaactctttgca

SEQ ID NO: 367153 - DNA, 20 bp, Artificial
  CRISPR gRNA sequence
caccaaactctttgcatagc

SEQ ID NO: 367154 - DNA, 20 bp, Artificial
  CRISPR gRNA sequence
ccaaactctttgcatagcaa

SEQ ID NO: 367155 - DNA, 20 bp, Artificial
  CRISPR gRNA sequence
cctttactccatttcccaaa

SEQ ID NO: 367156 - DNA, 20 bp, Artificial
  CRISPR gRNA sequence
aaagttcctcatctccatct

SEQ ID NO: 367157 - DNA, 20 bp, Artificial
  CRISPR gRNA sequence
atctccatctgagaccacct

SEQ ID NO: 367158 - DNA, 20 bp, Artificial
  CRISPR gRNA sequence
catctgagaccacctcagcc

SEQ ID NO: 367159 - DNA, 20 bp, Artificial
  CRISPR gRNA sequence
ttcattgtttatatcactgt

SEQ ID NO: 367160 - DNA, 20 bp, Artificial
  CRISPR gRNA sequence
ttatatcactgtcagcattt

SEQ ID NO: 367161 - DNA, 20 bp, Artificial
  CRISPR gRNA sequence
aatgtcattcaacaaatttc

SEQ ID NO: 367162 - DNA, 20 bp, Artificial
  CRISPR gRNA sequence
atgtcattcaacaaatttct

SEQ ID NO: 367163 - DNA, 20 bp, Artificial
  CRISPR gRNA sequence
tcattcaacaaatttctagg

SEQ ID NO: 367164 - DNA, 20 bp, Artificial
  CRISPR gRNA sequence
acattttcctgtcttcttct

SEQ ID NO: 367165 - DNA, 20 bp, Artificial
  CRISPR gRNA sequence
tccaacctctacctgttacc

SEQ ID NO: 367166 - DNA, 20 bp, Artificial
  CRISPR gRNA sequence
ctacctgttacccagttcca

SEQ ID NO: 367167 - DNA, 20 bp, Artificial
  CRISPR gRNA sequence
caaagttgctttcacacttg

SEQ ID NO: 367168 - DNA, 20 bp, Artificial
  CRISPR gRNA sequence
cacacttgtggatatcttta

SEQ ID NO: 367169 - DNA, 20 bp, Artificial
  CRISPR gRNA sequence
tactcatttactgtattact

SEQ ID NO: 367170 - DNA, 20 bp, Artificial
  CRISPR gRNA sequence
cagttttcatgctgctaata

SEQ ID NO: 367171 - DNA, 20 bp, Artificial
  CRISPR gRNA sequence
ctgctaataaagacatacct

SEQ ID NO: 367172 - DNA, 20 bp, Artificial
  CRISPR gRNA sequence
taataaagacatacctgaga

SEQ ID NO: 367173 - DNA, 20 bp, Artificial
  CRISPR gRNA sequence
aataaagacatacctgagac

SEQ ID NO: 367174 - DNA, 20 bp, Artificial
  CRISPR gRNA sequence
ataaagacatacctgagaca

SEQ ID NO: 367175 - DNA, 20 bp, Artificial
  CRISPR gRNA sequence
ctgagacagggtaatttata

SEQ ID NO: 367176 - DNA, 20 bp, Artificial
  CRISPR gRNA sequence
tgagacagggtaatttataa

SEQ ID NO: 367177 - DNA, 20 bp, Artificial
  CRISPR gRNA sequence
acagggtaatttataaagga

SEQ ID NO: 367178 - DNA, 20 bp, Artificial
  CRISPR gRNA sequence
agggtaatttataaaggaaa

SEQ ID NO: 367179 - DNA, 20 bp, Artificial
  CRISPR gRNA sequence
gggtaatttataaaggaaag

SEQ ID NO: 367180 - DNA, 20 bp, Artificial
  CRISPR gRNA sequence
aaagaggtttaattgattct

SEQ ID NO: 367181 - DNA, 20 bp, Artificial
  CRISPR gRNA sequence
ggtttaattgattctcagtt

SEQ ID NO: 367182 - DNA, 20 bp, Artificial
  CRISPR gRNA sequence
aattgattctcagttcagta

SEQ ID NO: 367183 - DNA, 20 bp, Artificial
  CRISPR gRNA sequence
attgattctcagttcagtat

SEQ ID NO: 367184 - DNA, 20 bp, Artificial
  CRISPR gRNA sequence
gattctcagttcagtatggg

SEQ ID NO: 367185 - DNA, 20 bp, Artificial
  CRISPR gRNA sequence
attctcagttcagtatgggt

SEQ ID NO: 367186 - DNA, 20 bp, Artificial
  CRISPR gRNA sequence
ttctcagttcagtatgggtg

SEQ ID NO: 367187 - DNA, 20 bp, Artificial
  CRISPR gRNA sequence
ctcagttcagtatgggtggg

SEQ ID NO: 367188 - DNA, 20 bp, Artificial
  CRISPR gRNA sequence
tcagttcagtatgggtgggg

SEQ ID NO: 367189 - DNA, 20 bp, Artificial
  CRISPR gRNA sequence
cagtatgggtggggaggcct

SEQ ID NO: 367190 - DNA, 20 bp, Artificial
  CRISPR gRNA sequence
agtatgggtggggaggcctc

SEQ ID NO: 367191 - DNA, 20 bp, Artificial
  CRISPR gRNA sequence
cctcaggaaacttacaatca

SEQ ID NO: 367192 - DNA, 20 bp, Artificial
  CRISPR gRNA sequence
caggaaacttacaatcatgg

SEQ ID NO: 367193 - DNA, 20 bp, Artificial
  CRISPR gRNA sequence
gaaacttacaatcatggtgg

SEQ ID NO: 367194 - DNA, 20 bp, Artificial
  CRISPR gRNA sequence
aaacttacaatcatggtgga

SEQ ID NO: 367195 - DNA, 20 bp, Artificial
  CRISPR gRNA sequence
aacttacaatcatggtggaa

SEQ ID NO: 367196 - DNA, 20 bp, Artificial
  CRISPR gRNA sequence
acttacaatcatggtggaag

SEQ ID NO: 367197 - DNA, 20 bp, Artificial
  CRISPR gRNA sequence
tacaatcatggtggaagggg

SEQ ID NO: 367198 - DNA, 20 bp, Artificial
  CRISPR gRNA sequence
aagcaaatatgtccttcaca

SEQ ID NO: 367199 - DNA, 20 bp, Artificial
  CRISPR gRNA sequence
caaatatgtccttcacatgg

SEQ ID NO: 367200 - DNA, 20 bp, Artificial
  CRISPR gRNA sequence
atatgtccttcacatggtag

SEQ ID NO: 367201 - DNA, 20 bp, Artificial
  CRISPR gRNA sequence
tatgtccttcacatggtagc

SEQ ID NO: 367202 - DNA, 20 bp, Artificial
  CRISPR gRNA sequence
atgtccttcacatggtagca

SEQ ID NO: 367203 - DNA, 20 bp, Artificial
  CRISPR gRNA sequence
gtccttcacatggtagcagg

SEQ ID NO: 367204 - DNA, 20 bp, Artificial
  CRISPR gRNA sequence
cttcacatggtagcagggag

SEQ ID NO: 367205 - DNA, 20 bp, Artificial
  CRISPR gRNA sequence
cacatggtagcagggagaag

SEQ ID NO: 367206 - DNA, 20 bp, Artificial
  CRISPR gRNA sequence
catggtagcagggagaagaa

SEQ ID NO: 367207 - DNA, 20 bp, Artificial
  CRISPR gRNA sequence
gtagcagggagaagaagagt

SEQ ID NO: 367208 - DNA, 20 bp, Artificial
  CRISPR gRNA sequence
ggagaagaagagtgagtgcc

SEQ ID NO: 367209 - DNA, 20 bp, Artificial
  CRISPR gRNA sequence
agaagaagagtgagtgccca

SEQ ID NO: 367210 - DNA, 20 bp, Artificial
  CRISPR gRNA sequence
agaagagtgagtgcccagag

SEQ ID NO: 367211 - DNA, 20 bp, Artificial
  CRISPR gRNA sequence
gaagagtgagtgcccagagc

SEQ ID NO: 367212 - DNA, 20 bp, Artificial
  CRISPR gRNA sequence
aagagtgagtgcccagagca

SEQ ID NO: 367213 - DNA, 20 bp, Artificial
  CRISPR gRNA sequence
agagtgagtgcccagagcag

SEQ ID NO: 367214 - DNA, 20 bp, Artificial
  CRISPR gRNA sequence
gtgagtgcccagagcagggg

SEQ ID NO: 367215 - DNA, 20 bp, Artificial
  CRISPR gRNA sequence
gaagccccttataaaaccat

SEQ ID NO: 367216 - DNA, 20 bp, Artificial
  CRISPR gRNA sequence
ataaaaccatcagatctcat

SEQ ID NO: 367217 - DNA, 20 bp, Artificial
  CRISPR gRNA sequence
gagaactaactcactatcat

SEQ ID NO: 367218 - DNA, 20 bp, Artificial
  CRISPR gRNA sequence
ctaactcactatcatgagaa

SEQ ID NO: 367219 - DNA, 20 bp, Artificial
  CRISPR gRNA sequence
taactcactatcatgagaac

SEQ ID NO: 367220 - DNA, 20 bp, Artificial
  CRISPR gRNA sequence
tcactatcatgagaacagga

SEQ ID NO: 367221 - DNA, 20 bp, Artificial
  CRISPR gRNA sequence
cactatcatgagaacaggat

SEQ ID NO: 367222 - DNA, 20 bp, Artificial
  CRISPR gRNA sequence
actatcatgagaacaggatg

SEQ ID NO: 367223 - DNA, 20 bp, Artificial
  CRISPR gRNA sequence
ctatcatgagaacaggatgg

SEQ ID NO: 367224 - DNA, 20 bp, Artificial
  CRISPR gRNA sequence
gggaaaccacccccatgatt

SEQ ID NO: 367225 - DNA, 20 bp, Artificial
  CRISPR gRNA sequence
atgattcagttatctccacc

SEQ ID NO: 367226 - DNA, 20 bp, Artificial
  CRISPR gRNA sequence
tggtctctcccacgacacgt

SEQ ID NO: 367227 - DNA, 20 bp, Artificial
  CRISPR gRNA sequence
ggtctctcccacgacacgtg

SEQ ID NO: 367228 - DNA, 20 bp, Artificial
  CRISPR gRNA sequence
gtctctcccacgacacgtga

SEQ ID NO: 367229 - DNA, 20 bp, Artificial
  CRISPR gRNA sequence
cccacgacacgtgagggtta

SEQ ID NO: 367230 - DNA, 20 bp, Artificial
  CRISPR gRNA sequence
ccacgacacgtgagggttat

SEQ ID NO: 367231 - DNA, 20 bp, Artificial
  CRISPR gRNA sequence
ggttatgggaactacaactc

SEQ ID NO: 367232 - DNA, 20 bp, Artificial
  CRISPR gRNA sequence
tgggaactacaactcaagat

SEQ ID NO: 367233 - DNA, 20 bp, Artificial
  CRISPR gRNA sequence
ctacaactcaagatgagatt

SEQ ID NO: 367234 - DNA, 20 bp, Artificial
  CRISPR gRNA sequence
tacaactcaagatgagattt

SEQ ID NO: 367235 - DNA, 20 bp, Artificial
  CRISPR gRNA sequence
aactcaagatgagatttggg

SEQ ID NO: 367236 - DNA, 20 bp, Artificial
  CRISPR gRNA sequence
actcaagatgagatttgggt

SEQ ID NO: 367237 - DNA, 20 bp, Artificial
  CRISPR gRNA sequence
atgagatttgggtgggcaca

SEQ ID NO: 367238 - DNA, 20 bp, Artificial
  CRISPR gRNA sequence
caaattatatcatatgatca

SEQ ID NO: 367239 - DNA, 20 bp, Artificial
  CRISPR gRNA sequence
aattatatcatatgatcatg

SEQ ID NO: 367240 - DNA, 20 bp, Artificial
  CRISPR gRNA sequence
atatgatcatggagactgat

SEQ ID NO: 367241 - DNA, 20 bp, Artificial
  CRISPR gRNA sequence
gactgataagcccaaatttg

SEQ ID NO: 367242 - DNA, 20 bp, Artificial
  CRISPR gRNA sequence
ataagcccaaatttgcagtg

SEQ ID NO: 367243 - DNA, 20 bp, Artificial
  CRISPR gRNA sequence
taagcccaaatttgcagtgt

SEQ ID NO: 367244 - DNA, 20 bp, Artificial
  CRISPR gRNA sequence
aaatttgcagtgtgggcttg

SEQ ID NO: 367245 - DNA, 20 bp, Artificial
  CRISPR gRNA sequence
aatttgcagtgtgggcttgc

SEQ ID NO: 367246 - DNA, 20 bp, Artificial
  CRISPR gRNA sequence
cagtgtgggcttgcaggctg

SEQ ID NO: 367247 - DNA, 20 bp, Artificial
  CRISPR gRNA sequence
gggcttgcaggctgcagacc

SEQ ID NO: 367248 - DNA, 20 bp, Artificial
  CRISPR gRNA sequence
ggcttgcaggctgcagaccc

SEQ ID NO: 367249 - DNA, 20 bp, Artificial
  CRISPR gRNA sequence
cttgcaggctgcagacccag

SEQ ID NO: 367250 - DNA, 20 bp, Artificial
  CRISPR gRNA sequence
tgcaggctgcagacccagga

SEQ ID NO: 367251 - DNA, 20 bp, Artificial
  CRISPR gRNA sequence
tgcagacccaggagagccga

SEQ ID NO: 367252 - DNA, 20 bp, Artificial
  CRISPR gRNA sequence
acccaggagagccgatggta

SEQ ID NO: 367253 - DNA, 20 bp, Artificial
  CRISPR gRNA sequence
cccaggagagccgatggtac

SEQ ID NO: 367254 - DNA, 20 bp, Artificial
  CRISPR gRNA sequence
gagagccgatggtacaggtg

SEQ ID NO: 367255 - DNA, 20 bp, Artificial
  CRISPR gRNA sequence
ccgatggtacaggtgaagcc

SEQ ID NO: 367256 - DNA, 20 bp, Artificial
  CRISPR gRNA sequence
cgatggtacaggtgaagccc

SEQ ID NO: 367257 - DNA, 20 bp, Artificial
  CRISPR gRNA sequence
gaagcccaggtcatctgctg

SEQ ID NO: 367258 - DNA, 20 bp, Artificial
  CRISPR gRNA sequence
gctgcagaatccctcttgct

SEQ ID NO: 367259 - DNA, 20 bp, Artificial
  CRISPR gRNA sequence
ctgcagaatccctcttgctt

SEQ ID NO: 367260 - DNA, 20 bp, Artificial
  CRISPR gRNA sequence
tgcagaatccctcttgcttg

SEQ ID NO: 367261 - DNA, 20 bp, Artificial
  CRISPR gRNA sequence
cagaatccctcttgcttggg

SEQ ID NO: 367262 - DNA, 20 bp, Artificial
  CRISPR gRNA sequence
agaatccctcttgcttgggg

SEQ ID NO: 367263 - DNA, 20 bp, Artificial
  CRISPR gRNA sequence
tccctcttgcttggggaggc

SEQ ID NO: 367264 - DNA, 20 bp, Artificial
  CRISPR gRNA sequence
ggctggtctttttgttgaat

SEQ ID NO: 367265 - DNA, 20 bp, Artificial
  CRISPR gRNA sequence
gctggtctttttgttgaatt

SEQ ID NO: 367266 - DNA, 20 bp, Artificial
  CRISPR gRNA sequence
aattaggctcacctacatta

SEQ ID NO: 367267 - DNA, 20 bp, Artificial
  CRISPR gRNA sequence
ttaggctcacctacattatg

SEQ ID NO: 367268 - DNA, 20 bp, Artificial
  CRISPR gRNA sequence
taggctcacctacattatgg

SEQ ID NO: 367269 - DNA, 20 bp, Artificial
  CRISPR gRNA sequence
attaaccatcatacctgttt

SEQ ID NO: 367270 - DNA, 20 bp, Artificial
  CRISPR gRNA sequence
acctgttttggaaaatgata

SEQ ID NO: 367271 - DNA, 20 bp, Artificial
  CRISPR gRNA sequence
tttggaaaatgatatggcat

SEQ ID NO: 367272 - DNA, 20 bp, Artificial
  CRISPR gRNA sequence
gaaaatgatatggcattagc

SEQ ID NO: 367273 - DNA, 20 bp, Artificial
  CRISPR gRNA sequence
tccaataattctactctgtt

SEQ ID NO: 367274 - DNA, 20 bp, Artificial
  CRISPR gRNA sequence
ttctactctgtttggtatcc

SEQ ID NO: 367275 - DNA, 20 bp, Artificial
  CRISPR gRNA sequence
ctactctgtttggtatccaa

SEQ ID NO: 367276 - DNA, 20 bp, Artificial
  CRISPR gRNA sequence
atccaagagttctctcatta

SEQ ID NO: 367277 - DNA, 20 bp, Artificial
  CRISPR gRNA sequence
tccaagagttctctcattat

SEQ ID NO: 367278 - DNA, 20 bp, Artificial
  CRISPR gRNA sequence
ccaagagttctctcattata

SEQ ID NO: 367279 - DNA, 20 bp, Artificial
  CRISPR gRNA sequence
aaaattcctgacaatattta

SEQ ID NO: 367280 - DNA, 20 bp, Artificial
  CRISPR gRNA sequence
cctgacaatatttatagcaa

SEQ ID NO: 367281 - DNA, 20 bp, Artificial
  CRISPR gRNA sequence
tatagcaacagtgattgcaa

SEQ ID NO: 367282 - DNA, 20 bp, Artificial
  CRISPR gRNA sequence
tgattgcaatagcaaaaaat

SEQ ID NO: 367283 - DNA, 20 bp, Artificial
  CRISPR gRNA sequence
acaacccaaatacccatcaa

SEQ ID NO: 367284 - DNA, 20 bp, Artificial
  CRISPR gRNA sequence
acccaaatacccatcaacag

SEQ ID NO: 367285 - DNA, 20 bp, Artificial
  CRISPR gRNA sequence
ccatcaacagtagaaccgaa

SEQ ID NO: 367286 - DNA, 20 bp, Artificial
  CRISPR gRNA sequence
gtagaaccgaaaagcacact

SEQ ID NO: 367287 - DNA, 20 bp, Artificial
  CRISPR gRNA sequence
tagaaccgaaaagcacactg

SEQ ID NO: 367288 - DNA, 20 bp, Artificial
  CRISPR gRNA sequence
actgaggtctattcacacat

SEQ ID NO: 367289 - DNA, 20 bp, Artificial
  CRISPR gRNA sequence
ctgaggtctattcacacatt

SEQ ID NO: 367290 - DNA, 20 bp, Artificial
  CRISPR gRNA sequence
atactctacatcactaaaat

SEQ ID NO: 367291 - DNA, 20 bp, Artificial
  CRISPR gRNA sequence
ttatcacttgctcaccgaca

SEQ ID NO: 367292 - DNA, 20 bp, Artificial
  CRISPR gRNA sequence
cttgctcaccgacatggatg

SEQ ID NO: 367293 - DNA, 20 bp, Artificial
  CRISPR gRNA sequence
gctcatgaactttgtgttga

SEQ ID NO: 367294 - DNA, 20 bp, Artificial
  CRISPR gRNA sequence
tgaactttgtgttgaaagaa

SEQ ID NO: 367295 - DNA, 20 bp, Artificial
  CRISPR gRNA sequence
aactttgtgttgaaagaaaa

SEQ ID NO: 367296 - DNA, 20 bp, Artificial
  CRISPR gRNA sequence
ttgtgttgaaagaaaagagc

SEQ ID NO: 367297 - DNA, 20 bp, Artificial
  CRISPR gRNA sequence
gagcaagttaccaaaaaaaa

SEQ ID NO: 367298 - DNA, 20 bp, Artificial
  CRISPR gRNA sequence
agcaagttaccaaaaaaaat

SEQ ID NO: 367299 - DNA, 20 bp, Artificial
  CRISPR gRNA sequence
accaaaaaaaataggtaaac

SEQ ID NO: 367300 - DNA, 20 bp, Artificial
  CRISPR gRNA sequence
ccaaaaaaaataggtaaact

SEQ ID NO: 367301 - DNA, 20 bp, Artificial
  CRISPR gRNA sequence
caaaaaaaataggtaaacta

SEQ ID NO: 367302 - DNA, 20 bp, Artificial
  CRISPR gRNA sequence
actagggttccttttcttta

SEQ ID NO: 367303 - DNA, 20 bp, Artificial
  CRISPR gRNA sequence
ctagggttccttttctttaa

SEQ ID NO: 367304 - DNA, 20 bp, Artificial
  CRISPR gRNA sequence
ttccttttctttaaaggttt

SEQ ID NO: 367305 - DNA, 20 bp, Artificial
  CRISPR gRNA sequence
attaaacaatacgttattta

SEQ ID NO: 367306 - DNA, 20 bp, Artificial
  CRISPR gRNA sequence
gttatttatagatacaaacg

SEQ ID NO: 367307 - DNA, 20 bp, Artificial
  CRISPR gRNA sequence
acaaacgtggtaaaactata

SEQ ID NO: 367308 - DNA, 20 bp, Artificial
  CRISPR gRNA sequence
cgtggtaaaactataaagaa

SEQ ID NO: 367309 - DNA, 20 bp, Artificial
  CRISPR gRNA sequence
taaaactataaagaaaagca

SEQ ID NO: 367310 - DNA, 20 bp, Artificial
  CRISPR gRNA sequence
ctataaagaaaagcaaagtt

SEQ ID NO: 367311 - DNA, 20 bp, Artificial
  CRISPR gRNA sequence
aaaagcaaagttcagaaaca

SEQ ID NO: 367312 - DNA, 20 bp, Artificial
  CRISPR gRNA sequence
agcaaagttcagaaacatgg

SEQ ID NO: 367313 - DNA, 20 bp, Artificial
  CRISPR gRNA sequence
gcaaagttcagaaacatggt

SEQ ID NO: 367314 - DNA, 20 bp, Artificial
  CRISPR gRNA sequence
aagttcagaaacatggtagg

SEQ ID NO: 367315 - DNA, 20 bp, Artificial
  CRISPR gRNA sequence
agttcagaaacatggtaggt

SEQ ID NO: 367316 - DNA, 20 bp, Artificial
  CRISPR gRNA sequence
gttcagaaacatggtaggtg

SEQ ID NO: 367317 - DNA, 20 bp, Artificial
  CRISPR gRNA sequence
ttcagaaacatggtaggtgg

SEQ ID NO: 367318 - DNA, 20 bp, Artificial
  CRISPR gRNA sequence
gaaacatggtaggtggggga

SEQ ID NO: 367319 - DNA, 20 bp, Artificial
  CRISPR gRNA sequence
atggtaggtgggggatagaa

SEQ ID NO: 367320 - DNA, 20 bp, Artificial
  CRISPR gRNA sequence
ggtgggggatagaatagaat

SEQ ID NO: 367321 - DNA, 20 bp, Artificial
  CRISPR gRNA sequence
gtgggggatagaatagaatc

SEQ ID NO: 367322 - DNA, 20 bp, Artificial
  CRISPR gRNA sequence
ggggatagaatagaatcagg

SEQ ID NO: 367323 - DNA, 20 bp, Artificial
  CRISPR gRNA sequence
gggatagaatagaatcagga

SEQ ID NO: 367324 - DNA, 20 bp, Artificial
  CRISPR gRNA sequence
ggatagaatagaatcaggaa

SEQ ID NO: 367325 - DNA, 20 bp, Artificial
  CRISPR gRNA sequence
atagaatcaggaagggctga

SEQ ID NO: 367326 - DNA, 20 bp, Artificial
  CRISPR gRNA sequence
tagaatcaggaagggctgaa

SEQ ID NO: 367327 - DNA, 20 bp, Artificial
  CRISPR gRNA sequence
agaatcaggaagggctgaaa

SEQ ID NO: 367328 - DNA, 20 bp, Artificial
  CRISPR gRNA sequence
gaagggctgaaagggtcttt

SEQ ID NO: 367329 - DNA, 20 bp, Artificial
  CRISPR gRNA sequence
aagggctgaaagggtcttta

SEQ ID NO: 367330 - DNA, 20 bp, Artificial
  CRISPR gRNA sequence
gaaagggtctttaaggctca

SEQ ID NO: 367331 - DNA, 20 bp, Artificial
  CRISPR gRNA sequence
gggtctttaaggctcatagt

SEQ ID NO: 367332 - DNA, 20 bp, Artificial
  CRISPR gRNA sequence
ggtctttaaggctcatagtc

SEQ ID NO: 367333 - DNA, 20 bp, Artificial
  CRISPR gRNA sequence
gtctttaaggctcatagtca

SEQ ID NO: 367334 - DNA, 20 bp, Artificial
  CRISPR gRNA sequence
gtcagggtgttttccttata

SEQ ID NO: 367335 - DNA, 20 bp, Artificial
  CRISPR gRNA sequence
tcagggtgttttccttatac

SEQ ID NO: 367336 - DNA, 20 bp, Artificial
  CRISPR gRNA sequence
gcatttgtctcaaaatgttt

SEQ ID NO: 367337 - DNA, 20 bp, Artificial
  CRISPR gRNA sequence
tttgtctcaaaatgttttag

SEQ ID NO: 367338 - DNA, 20 bp, Artificial
  CRISPR gRNA sequence
tctttttcttttcctttttt

SEQ ID NO: 367339 - DNA, 20 bp, Artificial
  CRISPR gRNA sequence
tttcttttccttttttgaga

SEQ ID NO: 367340 - DNA, 20 bp, Artificial
  CRISPR gRNA sequence
tcttttccttttttgagaca

SEQ ID NO: 367341 - DNA, 20 bp, Artificial
  CRISPR gRNA sequence
cagagtctcactctgttgcc

SEQ ID NO: 367342 - DNA, 20 bp, Artificial
  CRISPR gRNA sequence
agagtctcactctgttgccc

SEQ ID NO: 367343 - DNA, 20 bp, Artificial
  CRISPR gRNA sequence
tctcactctgttgcccaggc

SEQ ID NO: 367344 - DNA, 20 bp, Artificial
  CRISPR gRNA sequence
tcactctgttgcccaggctg

SEQ ID NO: 367345 - DNA, 20 bp, Artificial
  CRISPR gRNA sequence
ctgttgcccaggctggagtg

SEQ ID NO: 367346 - DNA, 20 bp, Artificial
  CRISPR gRNA sequence
ttgcccaggctggagtgcag

SEQ ID NO: 367347 - DNA, 20 bp, Artificial
  CRISPR gRNA sequence
ggagtgcagtggcatgatct

SEQ ID NO: 367348 - DNA, 20 bp, Artificial
  CRISPR gRNA sequence
tcattgcaacctctgcctcc

SEQ ID NO: 367349 - DNA, 20 bp, Artificial
  CRISPR gRNA sequence
cattgcaacctctgcctcct

SEQ ID NO: 367350 - DNA, 20 bp, Artificial
  CRISPR gRNA sequence
aacctctgcctcctgggttc

SEQ ID NO: 367351 - DNA, 20 bp, Artificial
  CRISPR gRNA sequence
ctctgcctcctgggttcaag

SEQ ID NO: 367352 - DNA, 20 bp, Artificial
  CRISPR gRNA sequence
ttcaagtggttctcctgcct

SEQ ID NO: 367353 - DNA, 20 bp, Artificial
  CRISPR gRNA sequence
ttctcctgcctcagcctcct

SEQ ID NO: 367354 - DNA, 20 bp, Artificial
  CRISPR gRNA sequence
tcctgcctcagcctcctgag

SEQ ID NO: 367355 - DNA, 20 bp, Artificial
  CRISPR gRNA sequence
gcctcagcctcctgagtagc

SEQ ID NO: 367356 - DNA, 20 bp, Artificial
  CRISPR gRNA sequence
cctcagcctcctgagtagct

SEQ ID NO: 367357 - DNA, 20 bp, Artificial
  CRISPR gRNA sequence
ctcctgagtagctgggatta

SEQ ID NO: 367358 - DNA, 20 bp, Artificial
  CRISPR gRNA sequence
tcctgagtagctgggattac

SEQ ID NO: 367359 - DNA, 20 bp, Artificial
  CRISPR gRNA sequence
caggcctgcatcatcacacc

SEQ ID NO: 367360 - DNA, 20 bp, Artificial
  CRISPR gRNA sequence
agctaatttttgtatttttg

SEQ ID NO: 367361 - DNA, 20 bp, Artificial
  CRISPR gRNA sequence
ctaatttttgtatttttgta

SEQ ID NO: 367362 - DNA, 20 bp, Artificial
  CRISPR gRNA sequence
tttttgtatttttgtagaga

SEQ ID NO: 367363 - DNA, 20 bp, Artificial
  CRISPR gRNA sequence
ttttgtatttttgtagagat

SEQ ID NO: 367364 - DNA, 20 bp, Artificial
  CRISPR gRNA sequence
tttgtatttttgtagagatg

SEQ ID NO: 367365 - DNA, 20 bp, Artificial
  CRISPR gRNA sequence
ttgtatttttgtagagatgg

SEQ ID NO: 367366 - DNA, 20 bp, Artificial
  CRISPR gRNA sequence
agatgggggttttgccatgt

SEQ ID NO: 367367 - DNA, 20 bp, Artificial
  CRISPR gRNA sequence
gggggttttgccatgttggc

SEQ ID NO: 367368 - DNA, 20 bp, Artificial
  CRISPR gRNA sequence
ggggttttgccatgttggcc

SEQ ID NO: 367369 - DNA, 20 bp, Artificial
  CRISPR gRNA sequence
tgatctcaaactcctgacct

SEQ ID NO: 367370 - DNA, 20 bp, Artificial
  CRISPR gRNA sequence
gatctcaaactcctgacctc

SEQ ID NO: 367371 - DNA, 20 bp, Artificial
  CRISPR gRNA sequence
tcaggtgatccaccccacct

SEQ ID NO: 367372 - DNA, 20 bp, Artificial
  CRISPR gRNA sequence
caccccaccttggcctccca

SEQ ID NO: 367373 - DNA, 20 bp, Artificial
  CRISPR gRNA sequence
accttggcctcccaaagtgc

SEQ ID NO: 367374 - DNA, 20 bp, Artificial
  CRISPR gRNA sequence
ctcccaaagtgctggaatta

SEQ ID NO: 367375 - DNA, 20 bp, Artificial
  CRISPR gRNA sequence
tcccaaagtgctggaattac

SEQ ID NO: 367376 - DNA, 20 bp, Artificial
  CRISPR gRNA sequence
aagtgctggaattacaggca

SEQ ID NO: 367377 - DNA, 20 bp, Artificial
  CRISPR gRNA sequence
agtgctggaattacaggcat

SEQ ID NO: 367378 - DNA, 20 bp, Artificial
  CRISPR gRNA sequence
caggcataggccaccttgcc

SEQ ID NO: 367379 - DNA, 20 bp, Artificial
  CRISPR gRNA sequence
ccaaatctactgatttctaa

SEQ ID NO: 367380 - DNA, 20 bp, Artificial
  CRISPR gRNA sequence
tactgatttctaatggtgaa

SEQ ID NO: 367381 - DNA, 20 bp, Artificial
  CRISPR gRNA sequence
ctgatttctaatggtgaaaa

SEQ ID NO: 367382 - DNA, 20 bp, Artificial
  CRISPR gRNA sequence
gagatgtgattgcaattttt

SEQ ID NO: 367383 - DNA, 20 bp, Artificial
  CRISPR gRNA sequence
atgtgattgcaatttttgag

SEQ ID NO: 367384 - DNA, 20 bp, Artificial
  CRISPR gRNA sequence
tgcaatttttgagcagttga

SEQ ID NO: 367385 - DNA, 20 bp, Artificial
  CRISPR gRNA sequence
tttgagcagttgaaagctct

SEQ ID NO: 367386 - DNA, 20 bp, Artificial
  CRISPR gRNA sequence
ttgagcagttgaaagctcta

SEQ ID NO: 367387 - DNA, 20 bp, Artificial
  CRISPR gRNA sequence
gcagttgaaagctctaaggt

SEQ ID NO: 367388 - DNA, 20 bp, Artificial
  CRISPR gRNA sequence
cagttgaaagctctaaggta

SEQ ID NO: 367389 - DNA, 20 bp, Artificial
  CRISPR gRNA sequence
atgaaatcttcattctgata

SEQ ID NO: 367390 - DNA, 20 bp, Artificial
  CRISPR gRNA sequence
atcttcattctgatatggcc

SEQ ID NO: 367391 - DNA, 20 bp, Artificial
  CRISPR gRNA sequence
tcttcattctgatatggcct

SEQ ID NO: 367392 - DNA, 20 bp, Artificial
  CRISPR gRNA sequence
cttcattctgatatggcctg

SEQ ID NO: 367393 - DNA, 20 bp, Artificial
  CRISPR gRNA sequence
ttcattctgatatggcctgg

SEQ ID NO: 367394 - DNA, 20 bp, Artificial
  CRISPR gRNA sequence
ttctgatatggcctgggggc

SEQ ID NO: 367395 - DNA, 20 bp, Artificial
  CRISPR gRNA sequence
tctgatatggcctgggggcc

SEQ ID NO: 367396 - DNA, 20 bp, Artificial
  CRISPR gRNA sequence
gatatggcctgggggccagg

SEQ ID NO: 367397 - DNA, 20 bp, Artificial
  CRISPR gRNA sequence
tatggcctgggggccaggta

SEQ ID NO: 367398 - DNA, 20 bp, Artificial
  CRISPR gRNA sequence
atggcctgggggccaggtag

SEQ ID NO: 367399 - DNA, 20 bp, Artificial
  CRISPR gRNA sequence
cctgggggccaggtagaggt

SEQ ID NO: 367400 - DNA, 20 bp, Artificial
  CRISPR gRNA sequence
ggccaggtagaggtaagttt

SEQ ID NO: 367401 - DNA, 20 bp, Artificial
  CRISPR gRNA sequence
gtagaggtaagtttcagcaa

SEQ ID NO: 367402 - DNA, 20 bp, Artificial
  CRISPR gRNA sequence
gtttcaaatttttatgatcc

SEQ ID NO: 367403 - DNA, 20 bp, Artificial
  CRISPR gRNA sequence
tttcaaatttttatgatcca

SEQ ID NO: 367404 - DNA, 20 bp, Artificial
  CRISPR gRNA sequence
ggactaaaaaatgatgattt

SEQ ID NO: 367405 - DNA, 20 bp, Artificial
  CRISPR gRNA sequence
aaatgatgattttagtgaaa

SEQ ID NO: 367406 - DNA, 20 bp, Artificial
  CRISPR gRNA sequence
agtgaaaaagatgtgaaatt

SEQ ID NO: 367407 - DNA, 20 bp, Artificial
  CRISPR gRNA sequence
tgaaaaagatgtgaaattaa

SEQ ID NO: 367408 - DNA, 20 bp, Artificial
  CRISPR gRNA sequence
gtgaaattaagagaccaact

SEQ ID NO: 367409 - DNA, 20 bp, Artificial
  CRISPR gRNA sequence
aattaagagaccaacttggc

SEQ ID NO: 367410 - DNA, 20 bp, Artificial
  CRISPR gRNA sequence
aagagaccaacttggctagc

SEQ ID NO: 367411 - DNA, 20 bp, Artificial
  CRISPR gRNA sequence
gagaccaacttggctagcaa

SEQ ID NO: 367412 - DNA, 20 bp, Artificial
  CRISPR gRNA sequence
accaacttggctagcaagag

SEQ ID NO: 367413 - DNA, 20 bp, Artificial
  CRISPR gRNA sequence
tggctagcaagagtggaatt

SEQ ID NO: 367414 - DNA, 20 bp, Artificial
  CRISPR gRNA sequence
gagtggaattaagtctgttt

SEQ ID NO: 367415 - DNA, 20 bp, Artificial
  CRISPR gRNA sequence
agtggaattaagtctgtttc

SEQ ID NO: 367416 - DNA, 20 bp, Artificial
  CRISPR gRNA sequence
ttcaggtgtattaaattgta

SEQ ID NO: 367417 - DNA, 20 bp, Artificial
  CRISPR gRNA sequence
aggtgtattaaattgtaaag

SEQ ID NO: 367418 - DNA, 20 bp, Artificial
  CRISPR gRNA sequence
attgtaaagtagcctttgac

SEQ ID NO: 367419 - DNA, 20 bp, Artificial
  CRISPR gRNA sequence
ccagctgacaattgaaatta

SEQ ID NO: 367420 - DNA, 20 bp, Artificial
  CRISPR gRNA sequence
gaaattatggaacaacaaac

SEQ ID NO: 367421 - DNA, 20 bp, Artificial
  CRISPR gRNA sequence
aaattatggaacaacaaacc

SEQ ID NO: 367422 - DNA, 20 bp, Artificial
  CRISPR gRNA sequence
gattgaaaatatccaatttg

SEQ ID NO: 367423 - DNA, 20 bp, Artificial
  CRISPR gRNA sequence
aagtcatctgaatgatcatc

SEQ ID NO: 367424 - DNA, 20 bp, Artificial
  CRISPR gRNA sequence
gaatgatcatccagcacatg

SEQ ID NO: 367425 - DNA, 20 bp, Artificial
  CRISPR gRNA sequence
gatcatccagcacatgtgga

SEQ ID NO: 367426 - DNA, 20 bp, Artificial
  CRISPR gRNA sequence
atccagcacatgtggatgga

SEQ ID NO: 367427 - DNA, 20 bp, Artificial
  CRISPR gRNA sequence
tccagcacatgtggatggat

SEQ ID NO: 367428 - DNA, 20 bp, Artificial
  CRISPR gRNA sequence
ccagcacatgtggatggatg

SEQ ID NO: 367429 - DNA, 20 bp, Artificial
  CRISPR gRNA sequence
gtggatggatggggttaact

SEQ ID NO: 367430 - DNA, 20 bp, Artificial
  CRISPR gRNA sequence
atggatggggttaactaaga

SEQ ID NO: 367431 - DNA, 20 bp, Artificial
  CRISPR gRNA sequence
gttaactaagaaagtaccaa

SEQ ID NO: 367432 - DNA, 20 bp, Artificial
  CRISPR gRNA sequence
actaagaaagtaccaatgga

SEQ ID NO: 367433 - DNA, 20 bp, Artificial
  CRISPR gRNA sequence
ctaagaaagtaccaatggat

SEQ ID NO: 367434 - DNA, 20 bp, Artificial
  CRISPR gRNA sequence
taagaaagtaccaatggatg

SEQ ID NO: 367435 - DNA, 20 bp, Artificial
  CRISPR gRNA sequence
aagaaagtaccaatggatgg

SEQ ID NO: 367436 - DNA, 20 bp, Artificial
  CRISPR gRNA sequence
aaagtaccaatggatggggg

SEQ ID NO: 367437 - DNA, 20 bp, Artificial
  CRISPR gRNA sequence
gtaccaatggatgggggcag

SEQ ID NO: 367438 - DNA, 20 bp, Artificial
  CRISPR gRNA sequence
atggatgggggcagaagtct

SEQ ID NO: 367439 - DNA, 20 bp, Artificial
  CRISPR gRNA sequence
tggatgggggcagaagtcta

SEQ ID NO: 367440 - DNA, 20 bp, Artificial
  CRISPR gRNA sequence
ggggcagaagtctaaggtca

SEQ ID NO: 367441 - DNA, 20 bp, Artificial
  CRISPR gRNA sequence
aagtctaaggtcatagcttg

SEQ ID NO: 367442 - DNA, 20 bp, Artificial
  CRISPR gRNA sequence
taaggtcatagcttgtggct

SEQ ID NO: 367443 - DNA, 20 bp, Artificial
  CRISPR gRNA sequence
aggtcatagcttgtggcttg

SEQ ID NO: 367444 - DNA, 20 bp, Artificial
  CRISPR gRNA sequence
ggtcatagcttgtggcttgg

SEQ ID NO: 367445 - DNA, 20 bp, Artificial
  CRISPR gRNA sequence
atagcttgtggcttggagga

SEQ ID NO: 367446 - DNA, 20 bp, Artificial
  CRISPR gRNA sequence
cttggaggatggtcacattg

SEQ ID NO: 367447 - DNA, 20 bp, Artificial
  CRISPR gRNA sequence
ggtcacattgtagtgtgtta

SEQ ID NO: 367448 - DNA, 20 bp, Artificial
  CRISPR gRNA sequence
cacattgtagtgtgttaaag

SEQ ID NO: 367449 - DNA, 20 bp, Artificial
  CRISPR gRNA sequence
acattgtagtgtgttaaaga

SEQ ID NO: 367450 - DNA, 20 bp, Artificial
  CRISPR gRNA sequence
taaagaaggtgttcatgtta

SEQ ID NO: 367451 - DNA, 20 bp, Artificial
  CRISPR gRNA sequence
ggtgttcatgttaaagaatg

SEQ ID NO: 367452 - DNA, 20 bp, Artificial
  CRISPR gRNA sequence
tgttcatgttaaagaatgta

SEQ ID NO: 367453 - DNA, 20 bp, Artificial
  CRISPR gRNA sequence
gttcatgttaaagaatgtag

SEQ ID NO: 367454 - DNA, 20 bp, Artificial
  CRISPR gRNA sequence
ttcatgttaaagaatgtaga

SEQ ID NO: 367455 - DNA, 20 bp, Artificial
  CRISPR gRNA sequence
gttaaagaatgtagagggca

SEQ ID NO: 367456 - DNA, 20 bp, Artificial
  CRISPR gRNA sequence
taaagaatgtagagggcata

SEQ ID NO: 367457 - DNA, 20 bp, Artificial
  CRISPR gRNA sequence
aatgtagagggcatagagaa

SEQ ID NO: 367458 - DNA, 20 bp, Artificial
  CRISPR gRNA sequence
tgtagagggcatagagaaaa

SEQ ID NO: 367459 - DNA, 20 bp, Artificial
  CRISPR gRNA sequence
gtagagggcatagagaaaag

SEQ ID NO: 367460 - DNA, 20 bp, Artificial
  CRISPR gRNA sequence
tagagggcatagagaaaaga

SEQ ID NO: 367461 - DNA, 20 bp, Artificial
  CRISPR gRNA sequence
agagggcatagagaaaagag

SEQ ID NO: 367462 - DNA, 20 bp, Artificial
  CRISPR gRNA sequence
gagggcatagagaaaagagg

SEQ ID NO: 367463 - DNA, 20 bp, Artificial
  CRISPR gRNA sequence
gggcatagagaaaagagggg

SEQ ID NO: 367464 - DNA, 20 bp, Artificial
  CRISPR gRNA sequence
gcatagagaaaagaggggga

SEQ ID NO: 367465 - DNA, 20 bp, Artificial
  CRISPR gRNA sequence
agagaaaagagggggagagt

SEQ ID NO: 367466 - DNA, 20 bp, Artificial
  CRISPR gRNA sequence
gagaaaagagggggagagtt

SEQ ID NO: 367467 - DNA, 20 bp, Artificial
  CRISPR gRNA sequence
gaaaagagggggagagttgg

SEQ ID NO: 367468 - DNA, 20 bp, Artificial
  CRISPR gRNA sequence
aaaagagggggagagttggg

SEQ ID NO: 367469 - DNA, 20 bp, Artificial
  CRISPR gRNA sequence
aaagagggggagagttggga

SEQ ID NO: 367470 - DNA, 20 bp, Artificial
  CRISPR gRNA sequence
agagggggagagttgggagg

SEQ ID NO: 367471 - DNA, 20 bp, Artificial
  CRISPR gRNA sequence
agggggagagttgggaggga

SEQ ID NO: 367472 - DNA, 20 bp, Artificial
  CRISPR gRNA sequence
gggggagagttgggagggag

SEQ ID NO: 367473 - DNA, 20 bp, Artificial
  CRISPR gRNA sequence
gagagttgggagggagagga

SEQ ID NO: 367474 - DNA, 20 bp, Artificial
  CRISPR gRNA sequence
gggagggagaggaaagtgaa

SEQ ID NO: 367475 - DNA, 20 bp, Artificial
  CRISPR gRNA sequence
ggagggagaggaaagtgaac

SEQ ID NO: 367476 - DNA, 20 bp, Artificial
  CRISPR gRNA sequence
aacaggtgaattattgatgt

SEQ ID NO: 367477 - DNA, 20 bp, Artificial
  CRISPR gRNA sequence
caggtgaattattgatgtga

SEQ ID NO: 367478 - DNA, 20 bp, Artificial
  CRISPR gRNA sequence
gtgaattattgatgtgagag

SEQ ID NO: 367479 - DNA, 20 bp, Artificial
  CRISPR gRNA sequence
aattattgatgtgagagcag

SEQ ID NO: 367480 - DNA, 20 bp, Artificial
  CRISPR gRNA sequence
atgtgagagcagaagacaca

SEQ ID NO: 367481 - DNA, 20 bp, Artificial
  CRISPR gRNA sequence
acacatagaactcatattta

SEQ ID NO: 367482 - DNA, 20 bp, Artificial
  CRISPR gRNA sequence
catagaactcatatttatag

SEQ ID NO: 367483 - DNA, 20 bp, Artificial
  CRISPR gRNA sequence
tagaactcatatttatagta

SEQ ID NO: 367484 - DNA, 20 bp, Artificial
  CRISPR gRNA sequence
agaactcatatttatagtag

SEQ ID NO: 367485 - DNA, 20 bp, Artificial
  CRISPR gRNA sequence
gaactcatatttatagtaga

SEQ ID NO: 367486 - DNA, 20 bp, Artificial
  CRISPR gRNA sequence
tcatatttatagtagagggt

SEQ ID NO: 367487 - DNA, 20 bp, Artificial
  CRISPR gRNA sequence
attttcttgctccacacatg

SEQ ID NO: 367488 - DNA, 20 bp, Artificial
  CRISPR gRNA sequence
ttttcttgctccacacatgc

SEQ ID NO: 367489 - DNA, 20 bp, Artificial
  CRISPR gRNA sequence
cacatgcaggtactttgtgt

SEQ ID NO: 367490 - DNA, 20 bp, Artificial
  CRISPR gRNA sequence
ctctgtgatctcccatattc

SEQ ID NO: 367491 - DNA, 20 bp, Artificial
  CRISPR gRNA sequence
ccagtccatttatctcaaac

SEQ ID NO: 367492 - DNA, 20 bp, Artificial
  CRISPR gRNA sequence
cagtccatttatctcaaact

SEQ ID NO: 367493 - DNA, 20 bp, Artificial
  CRISPR gRNA sequence
catttatctcaaactgggca

SEQ ID NO: 367494 - DNA, 20 bp, Artificial
  CRISPR gRNA sequence
tttatctcaaactgggcaca

SEQ ID NO: 367495 - DNA, 20 bp, Artificial
  CRISPR gRNA sequence
gttcctcactgtttcccttt

SEQ ID NO: 367496 - DNA, 20 bp, Artificial
  CRISPR gRNA sequence
tcctcactgtttccctttaa

SEQ ID NO: 367497 - DNA, 20 bp, Artificial
  CRISPR gRNA sequence
ttaagagtctcattctctcc

SEQ ID NO: 367498 - DNA, 20 bp, Artificial
  CRISPR gRNA sequence
taagagtctcattctctccc

SEQ ID NO: 367499 - DNA, 20 bp, Artificial
  CRISPR gRNA sequence
gagtctcattctctcccagg

SEQ ID NO: 367500 - DNA, 20 bp, Artificial
  CRISPR gRNA sequence
agtctcattctctcccaggt

SEQ ID NO: 367501 - DNA, 20 bp, Artificial
  CRISPR gRNA sequence
cattctctcccaggtgggat

SEQ ID NO: 367502 - DNA, 20 bp, Artificial
  CRISPR gRNA sequence
attctctcccaggtgggatg

SEQ ID NO: 367503 - DNA, 20 bp, Artificial
  CRISPR gRNA sequence
atgccatccatgctcattct

SEQ ID NO: 367504 - DNA, 20 bp, Artificial
  CRISPR gRNA sequence
ccatccatgctcattcttag

SEQ ID NO: 367505 - DNA, 20 bp, Artificial
  CRISPR gRNA sequence
catccatgctcattcttaga

SEQ ID NO: 367506 - DNA, 20 bp, Artificial
  CRISPR gRNA sequence
gctcttatctctacaccctt

SEQ ID NO: 367507 - DNA, 20 bp, Artificial
  CRISPR gRNA sequence
ctcttatctctacacccttc

SEQ ID NO: 367508 - DNA, 20 bp, Artificial
  CRISPR gRNA sequence
tcttatctctacacccttca

SEQ ID NO: 367509 - DNA, 20 bp, Artificial
  CRISPR gRNA sequence
tctctacacccttcagggac

SEQ ID NO: 367510 - DNA, 20 bp, Artificial
  CRISPR gRNA sequence
agggacaagtgttctctgtc

SEQ ID NO: 367511 - DNA, 20 bp, Artificial
  CRISPR gRNA sequence
gggacaagtgttctctgtcc

SEQ ID NO: 367512 - DNA, 20 bp, Artificial
  CRISPR gRNA sequence
gtgttctctgtccaggttcc

SEQ ID NO: 367513 - DNA, 20 bp, Artificial
  CRISPR gRNA sequence
ttctctgtccaggttcccag

SEQ ID NO: 367514 - DNA, 20 bp, Artificial
  CRISPR gRNA sequence
caggttcccagcagctgaca

SEQ ID NO: 367515 - DNA, 20 bp, Artificial
  CRISPR gRNA sequence
gttcccagcagctgacatag

SEQ ID NO: 367516 - DNA, 20 bp, Artificial
  CRISPR gRNA sequence
agcagctgacatagcagcca

SEQ ID NO: 367517 - DNA, 20 bp, Artificial
  CRISPR gRNA sequence
tcattcttgtatatatctgc

SEQ ID NO: 367518 - DNA, 20 bp, Artificial
  CRISPR gRNA sequence
tcttgtatatatctgctggt

SEQ ID NO: 367519 - DNA, 20 bp, Artificial
  CRISPR gRNA sequence
tgtatatatctgctggttag

SEQ ID NO: 367520 - DNA, 20 bp, Artificial
  CRISPR gRNA sequence
tctgctggttagtggcacta

SEQ ID NO: 367521 - DNA, 20 bp, Artificial
  CRISPR gRNA sequence
tgctggttagtggcactaaa

SEQ ID NO: 367522 - DNA, 20 bp, Artificial
  CRISPR gRNA sequence
aaagagattcctttaatatt

SEQ ID NO: 367523 - DNA, 20 bp, Artificial
  CRISPR gRNA sequence
aagagattcctttaatatta

SEQ ID NO: 367524 - DNA, 20 bp, Artificial
  CRISPR gRNA sequence
agagattcctttaatattaa

SEQ ID NO: 367525 - DNA, 20 bp, Artificial
  CRISPR gRNA sequence
tcctttaatattaagggctc

SEQ ID NO: 367526 - DNA, 20 bp, Artificial
  CRISPR gRNA sequence
attaagggctccagaattga

SEQ ID NO: 367527 - DNA, 20 bp, Artificial
  CRISPR gRNA sequence
aagggctccagaattgatgg

SEQ ID NO: 367528 - DNA, 20 bp, Artificial
  CRISPR gRNA sequence
ccagaattgatggcagttct

SEQ ID NO: 367529 - DNA, 20 bp, Artificial
  CRISPR gRNA sequence
cagaattgatggcagttctg

SEQ ID NO: 367530 - DNA, 20 bp, Artificial
  CRISPR gRNA sequence
tctgaggaatcctatgatga

SEQ ID NO: 367531 - DNA, 20 bp, Artificial
  CRISPR gRNA sequence
ctgaggaatcctatgatgaa

SEQ ID NO: 367532 - DNA, 20 bp, Artificial
  CRISPR gRNA sequence
tgaggaatcctatgatgaaa

SEQ ID NO: 367533 - DNA, 20 bp, Artificial
  CRISPR gRNA sequence
ctatgatgaaagggattcta

SEQ ID NO: 367534 - DNA, 20 bp, Artificial
  CRISPR gRNA sequence
agggattctaaagatcatgc

SEQ ID NO: 367535 - DNA, 20 bp, Artificial
  CRISPR gRNA sequence
gatcatgctggcctatatat

SEQ ID NO: 367536 - DNA, 20 bp, Artificial
  CRISPR gRNA sequence
tgctggcctatatattagtt

SEQ ID NO: 367537 - DNA, 20 bp, Artificial
  CRISPR gRNA sequence
gctggcctatatattagttg

SEQ ID NO: 367538 - DNA, 20 bp, Artificial
  CRISPR gRNA sequence
ctggcctatatattagttga

SEQ ID NO: 367539 - DNA, 20 bp, Artificial
  CRISPR gRNA sequence
gcctatatattagttgaggg

SEQ ID NO: 367540 - DNA, 20 bp, Artificial
  CRISPR gRNA sequence
tatattagttgagggcagca

SEQ ID NO: 367541 - DNA, 20 bp, Artificial
  CRISPR gRNA sequence
ggccaacatttttctaatgc

SEQ ID NO: 367542 - DNA, 20 bp, Artificial
  CRISPR gRNA sequence
gccaacatttttctaatgct

SEQ ID NO: 367543 - DNA, 20 bp, Artificial
  CRISPR gRNA sequence
ccaacatttttctaatgctg

SEQ ID NO: 367544 - DNA, 20 bp, Artificial
  CRISPR gRNA sequence
ctaatgctggggtataatct

SEQ ID NO: 367545 - DNA, 20 bp, Artificial
  CRISPR gRNA sequence
cagcctttaaatttgattta

SEQ ID NO: 367546 - DNA, 20 bp, Artificial
  CRISPR gRNA sequence
ctttaaatttgatttaaagc

SEQ ID NO: 367547 - DNA, 20 bp, Artificial
  CRISPR gRNA sequence
tttaaatttgatttaaagct

SEQ ID NO: 367548 - DNA, 20 bp, Artificial
  CRISPR gRNA sequence
ttaaatttgatttaaagctg

SEQ ID NO: 367549 - DNA, 20 bp, Artificial
  CRISPR gRNA sequence
aaatttgatttaaagctggg

SEQ ID NO: 367550 - DNA, 20 bp, Artificial
  CRISPR gRNA sequence
atttgatttaaagctgggga

SEQ ID NO: 367551 - DNA, 20 bp, Artificial
  CRISPR gRNA sequence
tttgatttaaagctggggag

SEQ ID NO: 367552 - DNA, 20 bp, Artificial
  CRISPR gRNA sequence
ttgatttaaagctggggaga

SEQ ID NO: 367553 - DNA, 20 bp, Artificial
  CRISPR gRNA sequence
atttaaagctggggagaggg

SEQ ID NO: 367554 - DNA, 20 bp, Artificial
  CRISPR gRNA sequence
agagggaagtgtctcaaatc

SEQ ID NO: 367555 - DNA, 20 bp, Artificial
  CRISPR gRNA sequence
tcaaatctggcttttataaa

SEQ ID NO: 367556 - DNA, 20 bp, Artificial
  CRISPR gRNA sequence
caaatctggcttttataaat

SEQ ID NO: 367557 - DNA, 20 bp, Artificial
  CRISPR gRNA sequence
taaatgggtgtgctgatttg

SEQ ID NO: 367558 - DNA, 20 bp, Artificial
  CRISPR gRNA sequence
aaatgggtgtgctgatttgc

SEQ ID NO: 367559 - DNA, 20 bp, Artificial
  CRISPR gRNA sequence
atgggtgtgctgatttgcag

SEQ ID NO: 367560 - DNA, 20 bp, Artificial
  CRISPR gRNA sequence
tatccattaattcactcatc

SEQ ID NO: 367561 - DNA, 20 bp, Artificial
  CRISPR gRNA sequence
tcactcatcaagtctttcct

SEQ ID NO: 367562 - DNA, 20 bp, Artificial
  CRISPR gRNA sequence
acaatgtacaatgtaatgtt

SEQ ID NO: 367563 - DNA, 20 bp, Artificial
  CRISPR gRNA sequence
atgtacaatgtaatgttcag

SEQ ID NO: 367564 - DNA, 20 bp, Artificial
  CRISPR gRNA sequence
caatgtaatgttcagtggtt

SEQ ID NO: 367565 - DNA, 20 bp, Artificial
  CRISPR gRNA sequence
tgtaatgttcagtggtttgg

SEQ ID NO: 367566 - DNA, 20 bp, Artificial
  CRISPR gRNA sequence
atgttcagtggtttggaaga

SEQ ID NO: 367567 - DNA, 20 bp, Artificial
  CRISPR gRNA sequence
tcagtggtttggaagataga

SEQ ID NO: 367568 - DNA, 20 bp, Artificial
  CRISPR gRNA sequence
gtttggaagatagaaagaca

SEQ ID NO: 367569 - DNA, 20 bp, Artificial
  CRISPR gRNA sequence
agatagaaagacatagatct

SEQ ID NO: 367570 - DNA, 20 bp, Artificial
  CRISPR gRNA sequence
acatagatcttagctctaaa
